United States Patent 7,888,497 (BIOINFORMATICALLY DETECTABLE GROUP OF NOVEL REGULATORY OLIGONUCLEOTIDES AND USES THEREOF) - sequence listing, part 69

SEQ ID NO: 2906089 - DNA, 13 bp, Homo sapiens
ttttgtgagatgt

SEQ ID NO: 2906090 - DNA, 17 bp, Homo sapiens
ttttgtgagcctctttg

SEQ ID NO: 2906091 - DNA, 16 bp, Homo sapiens
ttttgtgctctttcct

SEQ ID NO: 2906092 - DNA, 16 bp, Homo sapiens
ttttgtggaggcagtg

SEQ ID NO: 2906093 - DNA, 16 bp, Homo sapiens
ttttgtgtctcattta

SEQ ID NO: 2906094 - DNA, 18 bp, Homo sapiens
ttttgttatcagtcaata

SEQ ID NO: 2906095 - DNA, 20 bp, Homo sapiens
ttttgttccaatgtcaatgt

SEQ ID NO: 2906096 - DNA, 14 bp, Homo sapiens
ttttgttcttcaga

SEQ ID NO: 2906097 - DNA, 19 bp, Homo sapiens
ttttgttcttcagagatca

SEQ ID NO: 2906098 - DNA, 16 bp, Homo sapiens
ttttgttggtgctttg

SEQ ID NO: 2906099 - DNA, 15 bp, Homo sapiens
tgccagagataaact

SEQ ID NO: 2906100 - DNA, 12 bp, Homo sapiens
tgccagatgctg

SEQ ID NO: 2906101 - DNA, 21 bp, Homo sapiens
tgccagatgctgatgttcagt

SEQ ID NO: 2906102 - DNA, 22 bp, Homo sapiens
tgccagatgctgatgttcagtg

SEQ ID NO: 2906103 - DNA, 16 bp, Homo sapiens
tgccagcagcctcgca

SEQ ID NO: 2906104 - DNA, 13 bp, Homo sapiens
tgccagcccggct

SEQ ID NO: 2906105 - DNA, 21 bp, Homo sapiens
tgccagcccggctcggcccag

SEQ ID NO: 2906106 - DNA, 22 bp, Homo sapiens
tgccagcccggctcggcccagc

SEQ ID NO: 2906107 - DNA, 23 bp, Homo sapiens
tgccagcccggctcggcccagca

SEQ ID NO: 2906108 - DNA, 20 bp, Homo sapiens
tgccaggaaacaagggaagg

SEQ ID NO: 2906109 - DNA, 21 bp, Homo sapiens
tgccaggaaacaagggaaggg

SEQ ID NO: 2906110 - DNA, 15 bp, Homo sapiens
tgccaggaatgtttc

SEQ ID NO: 2906111 - DNA, 17 bp, Homo sapiens
tgccaggaatgtttcag

SEQ ID NO: 2906112 - DNA, 16 bp, Homo sapiens
tgccaggaggcggcag

SEQ ID NO: 2906113 - DNA, 22 bp, Homo sapiens
tgccaggaggcggcagctcttc

SEQ ID NO: 2906114 - DNA, 11 bp, Homo sapiens
tgccaggcccc

SEQ ID NO: 2906115 - DNA, 15 bp, Homo sapiens
tgccaggctgcggtg

SEQ ID NO: 2906116 - DNA, 13 bp, Homo sapiens
tgccaggcttgcc

SEQ ID NO: 2906117 - DNA, 18 bp, Homo sapiens
tgccagggatgggcagcc

SEQ ID NO: 2906118 - DNA, 16 bp, Homo sapiens
tgccagggcagggccc

SEQ ID NO: 2906119 - DNA, 16 bp, Homo sapiens
tgccagggccgaccag

SEQ ID NO: 2906120 - DNA, 11 bp, Homo sapiens
tgccagggctc

SEQ ID NO: 2906121 - DNA, 20 bp, Homo sapiens
tgccagggctctgggggcag

SEQ ID NO: 2906122 - DNA, 22 bp, Homo sapiens
tgccagggctctgggggcagat

SEQ ID NO: 2906123 - DNA, 18 bp, Homo sapiens
tgccagggcttcctcttc

SEQ ID NO: 2906124 - DNA, 19 bp, Homo sapiens
tgccaggttctatttggaa

SEQ ID NO: 2906125 - DNA, 20 bp, Homo sapiens
tgccaggttctatttggaat

SEQ ID NO: 2906126 - DNA, 18 bp, Homo sapiens
tgccagtcgggagagcca

SEQ ID NO: 2906127 - DNA, 23 bp, Homo sapiens
tgccagtcgggagagccaggctt

SEQ ID NO: 2906128 - DNA, 19 bp, Homo sapiens
tgccagtgtgctgatgggc

SEQ ID NO: 2906129 - DNA, 21 bp, Homo sapiens
tgccagtgtgttactcatctt

SEQ ID NO: 2906130 - DNA, 22 bp, Homo sapiens
tgccagtgtgttactcatcttt

SEQ ID NO: 2906131 - DNA, 13 bp, Homo sapiens
tgccatacatgtt

SEQ ID NO: 2906132 - DNA, 16 bp, Homo sapiens
tgccatacatgttatt

SEQ ID NO: 2906133 - DNA, 23 bp, Homo sapiens
tgccatacatgttattgttttca

SEQ ID NO: 2906134 - DNA, 15 bp, Homo sapiens
tgccatactttgtct

SEQ ID NO: 2906135 - DNA, 22 bp, Homo sapiens
tgccatactttgtctgaaaaat

SEQ ID NO: 2906136 - DNA, 17 bp, Homo sapiens
tgccatagtcacatggc

SEQ ID NO: 2906137 - DNA, 18 bp, Homo sapiens
tgccatagtcacatggcc

SEQ ID NO: 2906138 - DNA, 15 bp, Homo sapiens
tgccatcaaactgta

SEQ ID NO: 2906139 - DNA, 13 bp, Homo sapiens
tgccatcatctcc

SEQ ID NO: 2906140 - DNA, 15 bp, Homo sapiens
tgccatcatgcctga

SEQ ID NO: 2906141 - DNA, 16 bp, Homo sapiens
tgccatcattgctgtc

SEQ ID NO: 2906142 - DNA, 18 bp, Homo sapiens
tgccatcattgctgtctg

SEQ ID NO: 2906143 - DNA, 21 bp, Homo sapiens
tgccatcattgctgtctgcag

SEQ ID NO: 2906144 - DNA, 20 bp, Homo sapiens
tgccatccccctctcacgcc

SEQ ID NO: 2906145 - DNA, 21 bp, Homo sapiens
tgccatccccctctcacgcca

SEQ ID NO: 2906146 - DNA, 18 bp, Homo sapiens
tgccatcgggtgccaaat

SEQ ID NO: 2906147 - DNA, 22 bp, Homo sapiens
tgccatctgcgtgacaataaaa

SEQ ID NO: 2906148 - DNA, 21 bp, Homo sapiens
tgccatcttctccccgaggct

SEQ ID NO: 2906149 - DNA, 20 bp, Homo sapiens
tgccatgatgcctctgtctt

SEQ ID NO: 2906150 - DNA, 17 bp, Homo sapiens
tgccatgcatacatgct

SEQ ID NO: 2906151 - DNA, 17 bp, Homo sapiens
tgccatgtctttactag

SEQ ID NO: 2906152 - DNA, 21 bp, Homo sapiens
tgccatgtgactctggcttgg

SEQ ID NO: 2906153 - DNA, 14 bp, Homo sapiens
tgccatgtgctggg

SEQ ID NO: 2906154 - DNA, 18 bp, Homo sapiens
tgccattggaacctgtta

SEQ ID NO: 2906155 - DNA, 17 bp, Homo sapiens
tgccattgtactccagc

SEQ ID NO: 2906156 - DNA, 16 bp, Homo sapiens
tgccattttaaggaaa

SEQ ID NO: 2906157 - DNA, 20 bp, Homo sapiens
tgccattttaaggaaaacta

SEQ ID NO: 2906158 - DNA, 14 bp, Homo sapiens
tgccattttaaggt

SEQ ID NO: 2906159 - DNA, 19 bp, Homo sapiens
tgcccaacccttccctcac

SEQ ID NO: 2906160 - DNA, 22 bp, Homo sapiens
tgcccaactactatctcagaga

SEQ ID NO: 2906161 - DNA, 9 bp, Homo sapiens
tgcccaagt

SEQ ID NO: 2906162 - DNA, 16 bp, Homo sapiens
tgcccaagtgaccagg

SEQ ID NO: 2906163 - DNA, 19 bp, Homo sapiens
tgcccacacacactccttc

SEQ ID NO: 2906164 - DNA, 21 bp, Homo sapiens
tgcccacaggccgccctgcgg

SEQ ID NO: 2906165 - DNA, 18 bp, Homo sapiens
tgcccacatttagtctct

SEQ ID NO: 2906166 - DNA, 17 bp, Homo sapiens
tgcccaccaacatccca

SEQ ID NO: 2906167 - DNA, 12 bp, Homo sapiens
tgcccacccccg

SEQ ID NO: 2906168 - DNA, 22 bp, Homo sapiens
tgcccacctcagcctcccaaag

SEQ ID NO: 2906169 - DNA, 11 bp, Homo sapiens
tgcccacctgc

SEQ ID NO: 2906170 - DNA, 13 bp, Homo sapiens
tgcccacctgcct

SEQ ID NO: 2906171 - DNA, 16 bp, Homo sapiens
tgcccacctgcctggc

SEQ ID NO: 2906172 - DNA, 22 bp, Homo sapiens
tgcccacctgcctggccggcca

SEQ ID NO: 2906173 - DNA, 19 bp, Homo sapiens
tgcccagaataagttattg

SEQ ID NO: 2906174 - DNA, 21 bp, Homo sapiens
tgcccagaataagttattgca

SEQ ID NO: 2906175 - DNA, 17 bp, Homo sapiens
tgcccagagatgcctcc

SEQ ID NO: 2906176 - DNA, 19 bp, Homo sapiens
tgcccagagatgcctccac

SEQ ID NO: 2906177 - DNA, 21 bp, Homo sapiens
tgcccagagatgcctccaccg

SEQ ID NO: 2906178 - DNA, 17 bp, Homo sapiens
tgcccagccacccctca

SEQ ID NO: 2906179 - DNA, 19 bp, Homo sapiens
tgcccagccacccctcaga

SEQ ID NO: 2906180 - DNA, 20 bp, Homo sapiens
tgcccagctatacctgtgcc

SEQ ID NO: 2906181 - DNA, 21 bp, Homo sapiens
tgcccagctatacctgtgcct

SEQ ID NO: 2906182 - DNA, 17 bp, Homo sapiens
tgcccaggagagccagc

SEQ ID NO: 2906183 - DNA, 18 bp, Homo sapiens
tgcccaggagagccagcc

SEQ ID NO: 2906184 - DNA, 19 bp, Homo sapiens
tgcccaggagagccagccc

SEQ ID NO: 2906185 - DNA, 20 bp, Homo sapiens
tgcccaggagagccagccct

SEQ ID NO: 2906186 - DNA, 14 bp, Homo sapiens
tgcccaggatttga

SEQ ID NO: 2906187 - DNA, 20 bp, Homo sapiens
tgcccaggcctctcggtgct

SEQ ID NO: 2906188 - DNA, 21 bp, Homo sapiens
tgcccagggtcagtgtatcta

SEQ ID NO: 2906189 - DNA, 19 bp, Homo sapiens
tgcccagggtgcagtgtga

SEQ ID NO: 2906190 - DNA, 22 bp, Homo sapiens
tgcccaggtggggtttcctgca

SEQ ID NO: 2906191 - DNA, 17 bp, Homo sapiens
tgcccagtctttcatgt

SEQ ID NO: 2906192 - DNA, 11 bp, Homo sapiens
tgcccatcctc

SEQ ID NO: 2906193 - DNA, 12 bp, Homo sapiens
tgcccatcctcc

SEQ ID NO: 2906194 - DNA, 14 bp, Homo sapiens
tgcccatgagcaag

SEQ ID NO: 2906195 - DNA, 18 bp, Homo sapiens
tgcccatggcatgtcttt

SEQ ID NO: 2906196 - DNA, 19 bp, Homo sapiens
tgcccattcttttcacttc

SEQ ID NO: 2906197 - DNA, 12 bp, Homo sapiens
tgcccatttcat

SEQ ID NO: 2906198 - DNA, 12 bp, Homo sapiens
tgccccagactg

SEQ ID NO: 2906199 - DNA, 17 bp, Homo sapiens
tgccccagactgagctc

SEQ ID NO: 2906200 - DNA, 19 bp, Homo sapiens
tgccccagactgagctctc

SEQ ID NO: 2906201 - DNA, 14 bp, Homo sapiens
tgccccaggaccag

SEQ ID NO: 2906202 - DNA, 23 bp, Homo sapiens
tgccccatgaagccacagcccag

SEQ ID NO: 2906203 - DNA, 20 bp, Homo sapiens
tgcccccaaagcccatgccc

SEQ ID NO: 2906204 - DNA, 17 bp, Homo sapiens
tgcccccactgaccaga

SEQ ID NO: 2906205 - DNA, 18 bp, Homo sapiens
tgcccccagacagctgct

SEQ ID NO: 2906206 - DNA, 16 bp, Homo sapiens
tgcccccagctggccc

SEQ ID NO: 2906207 - DNA, 22 bp, Homo sapiens
tgccccctcgggggcctgtggt

SEQ ID NO: 2906208 - DNA, 21 bp, Homo sapiens
tgccccgcaggcctgccttct

SEQ ID NO: 2906209 - DNA, 20 bp, Homo sapiens
tgcccctaaagatgggagga

SEQ ID NO: 2906210 - DNA, 17 bp, Homo sapiens
tgcccctccccctaccg

SEQ ID NO: 2906211 - DNA, 22 bp, Homo sapiens
tgcccctccctagatccaggct

SEQ ID NO: 2906212 - DNA, 14 bp, Homo sapiens
tgcccctccctgcc

SEQ ID NO: 2906213 - DNA, 13 bp, Homo sapiens
tgcccctcctgga

SEQ ID NO: 2906214 - DNA, 18 bp, Homo sapiens
tgcccctcctggagcaga

SEQ ID NO: 2906215 - DNA, 16 bp, Homo sapiens
tgcccctggcacctgt

SEQ ID NO: 2906216 - DNA, 13 bp, Homo sapiens
tgcccctggctgg

SEQ ID NO: 2906217 - DNA, 13 bp, Homo sapiens
tgcccctgttcat

SEQ ID NO: 2906218 - DNA, 19 bp, Homo sapiens
tgccccttctctttaatct

SEQ ID NO: 2906219 - DNA, 21 bp, Homo sapiens
tgccccttgacaactggcagg

SEQ ID NO: 2906220 - DNA, 14 bp, Homo sapiens
tgcccgcctgccca

SEQ ID NO: 2906221 - DNA, 17 bp, Homo sapiens
tgcccgcctgcccacct

SEQ ID NO: 2906222 - DNA, 15 bp, Homo sapiens
tgcccgctcagccca

SEQ ID NO: 2906223 - DNA, 16 bp, Homo sapiens
tgcccggcgcctgccc

SEQ ID NO: 2906224 - DNA, 19 bp, Homo sapiens
tgcccggcgcctgccctgc

SEQ ID NO: 2906225 - DNA, 24 bp, Homo sapiens
tgcccggcgcctgccctgcccaag

SEQ ID NO: 2906226 - DNA, 18 bp, Homo sapiens
tgcccggggaaaggcaag

SEQ ID NO: 2906227 - DNA, 21 bp, Homo sapiens
tgcccggggaaaggcaaggtc

SEQ ID NO: 2906228 - DNA, 23 bp, Homo sapiens
tgcccgtaaacacgcctgcaaac

SEQ ID NO: 2906229 - DNA, 16 bp, Homo sapiens
tgcccgtaatcccagc

SEQ ID NO: 2906230 - DNA, 18 bp, Homo sapiens
tgcccgtaatcccagcta

SEQ ID NO: 2906231 - DNA, 17 bp, Homo sapiens
tgccctaacctgacaga

SEQ ID NO: 2906232 - DNA, 23 bp, Homo sapiens
tgccctaagtgatttccacaggt

SEQ ID NO: 2906233 - DNA, 19 bp, Homo sapiens
tgccctaattcatctttta

SEQ ID NO: 2906234 - DNA, 15 bp, Homo sapiens
tgcgcatcttgcctc

SEQ ID NO: 2906235 - DNA, 14 bp, Homo sapiens
tgcgccaccatgcc

SEQ ID NO: 2906236 - DNA, 18 bp, Homo sapiens
tgcgccaccatgccctat

SEQ ID NO: 2906237 - DNA, 17 bp, Homo sapiens
tgcgccaccgcccagag

SEQ ID NO: 2906238 - DNA, 12 bp, Homo sapiens
tgcgccaggcag

SEQ ID NO: 2906239 - DNA, 18 bp, Homo sapiens
tgcgcccagtccttccac

SEQ ID NO: 2906240 - DNA, 17 bp, Homo sapiens
tgcgcctcaggctgctg

SEQ ID NO: 2906241 - DNA, 19 bp, Homo sapiens
tgcgcctccatccatctgt

SEQ ID NO: 2906242 - DNA, 20 bp, Homo sapiens
tgcgcctccatccatctgtc

SEQ ID NO: 2906243 - DNA, 17 bp, Homo sapiens
tgcgcgcgctctctctc

SEQ ID NO: 2906244 - DNA, 17 bp, Homo sapiens
tgcgcgtggcgtggccc

SEQ ID NO: 2906245 - DNA, 11 bp, Homo sapiens
tgcgctgcctg

SEQ ID NO: 2906246 - DNA, 15 bp, Homo sapiens
tgcggaaaggtattt

SEQ ID NO: 2906247 - DNA, 14 bp, Homo sapiens
tgcggaatcagctt

SEQ ID NO: 2906248 - DNA, 15 bp, Homo sapiens
tgcggaatcagcttc

SEQ ID NO: 2906249 - DNA, 15 bp, Homo sapiens
tgcggagcagccttt

SEQ ID NO: 2906250 - DNA, 17 bp, Homo sapiens
tgcggcacaggaaacag

SEQ ID NO: 2906251 - DNA, 22 bp, Homo sapiens
tgcggcgtggagactggcaggc

SEQ ID NO: 2906252 - DNA, 23 bp, Homo sapiens
tgcgggcattttgaatgtgatca

SEQ ID NO: 2906253 - DNA, 17 bp, Homo sapiens
tgcgggctcgcccatac

SEQ ID NO: 2906254 - DNA, 13 bp, Homo sapiens
tgcggggacaggc

SEQ ID NO: 2906255 - DNA, 23 bp, Homo sapiens
tgcggggacaggctggaatgagg

SEQ ID NO: 2906256 - DNA, 21 bp, Homo sapiens
tgcggggcctgaggcaagcca

SEQ ID NO: 2906257 - DNA, 17 bp, Homo sapiens
tgcggggcctgtctcag

SEQ ID NO: 2906258 - DNA, 19 bp, Homo sapiens
tgcgggtcctcagctgctc

SEQ ID NO: 2906259 - DNA, 21 bp, Homo sapiens
tgcggtacaggagtcagccat

SEQ ID NO: 2906260 - DNA, 17 bp, Homo sapiens
tgcggtagccagcacac

SEQ ID NO: 2906261 - DNA, 16 bp, Homo sapiens
tgcggtgggcagccat

SEQ ID NO: 2906262 - DNA, 20 bp, Homo sapiens
tgcgtattctgtggccgcca

SEQ ID NO: 2906263 - DNA, 15 bp, Homo sapiens
tgcgtccaccaggcc

SEQ ID NO: 2906264 - DNA, 21 bp, Homo sapiens
tgcgtccaccaggcctcactg

SEQ ID NO: 2906265 - DNA, 19 bp, Homo sapiens
tgcgtccacgagctgttta

SEQ ID NO: 2906266 - DNA, 15 bp, Homo sapiens
tgcgtgacaataaaa

SEQ ID NO: 2906267 - DNA, 15 bp, Homo sapiens
tgcgtgacactctcc

SEQ ID NO: 2906268 - DNA, 15 bp, Homo sapiens
tgcgtggaaaaagac

SEQ ID NO: 2906269 - DNA, 19 bp, Homo sapiens
tgcgtggaagtgttcctgt

SEQ ID NO: 2906270 - DNA, 20 bp, Homo sapiens
tgcgtggaagtgttcctgtc

SEQ ID NO: 2906271 - DNA, 17 bp, Homo sapiens
tgcgtggactctgcaca

SEQ ID NO: 2906272 - DNA, 15 bp, Homo sapiens
tgcgtggcgtggccc

SEQ ID NO: 2906273 - DNA, 18 bp, Homo sapiens
tgcgtgtccgtctgtctg

SEQ ID NO: 2906274 - DNA, 14 bp, Homo sapiens
tgcgtgtttgcacg

SEQ ID NO: 2906275 - DNA, 16 bp, Homo sapiens
tgcgtgtttgcacgtt

SEQ ID NO: 2906276 - DNA, 19 bp, Homo sapiens
tgcgttcccttcagtactg

SEQ ID NO: 2906277 - DNA, 17 bp, Homo sapiens
tgcgttggtctctgcat

SEQ ID NO: 2906278 - DNA, 13 bp, Homo sapiens
tgcgtttttacag

SEQ ID NO: 2906279 - DNA, 15 bp, Homo sapiens
tgctaaaaatgggac

SEQ ID NO: 2906280 - DNA, 11 bp, Homo sapiens
tgctaaaattc

SEQ ID NO: 2906281 - DNA, 17 bp, Homo sapiens
tgctaaaattctataga

SEQ ID NO: 2906282 - DNA, 21 bp, Homo sapiens
tgctaaaattctatagagata

SEQ ID NO: 2906283 - DNA, 22 bp, Homo sapiens
tgctaaacatttgctggagaaa

SEQ ID NO: 2906284 - DNA, 17 bp, Homo sapiens
tgctaaataaaatttgt

SEQ ID NO: 2906285 - DNA, 21 bp, Homo sapiens
tgctaaataaaatttgttgca

SEQ ID NO: 2906286 - DNA, 23 bp, Homo sapiens
tgctaaataaaatttgttgcata

SEQ ID NO: 2906287 - DNA, 13 bp, Homo sapiens
tgctaaataacta

SEQ ID NO: 2906288 - DNA, 15 bp, Homo sapiens
tgctaaataactata

SEQ ID NO: 2906289 - DNA, 14 bp, Homo sapiens
tgctaaatgtaaca

SEQ ID NO: 2906290 - DNA, 18 bp, Homo sapiens
tgctaaatgtaacagtct

SEQ ID NO: 2906291 - DNA, 15 bp, Homo sapiens
tgctaaatgtgtaat

SEQ ID NO: 2906292 - DNA, 12 bp, Homo sapiens
tgctaactgaac

SEQ ID NO: 2906293 - DNA, 17 bp, Homo sapiens
tgctaaggagaagctaa

SEQ ID NO: 2906294 - DNA, 15 bp, Homo sapiens
tgctaaggttctaag

SEQ ID NO: 2906295 - DNA, 17 bp, Homo sapiens
tgctaaggttctaaggc

SEQ ID NO: 2906296 - DNA, 21 bp, Homo sapiens
tgctaatattttatttgaaaa

SEQ ID NO: 2906297 - DNA, 16 bp, Homo sapiens
tgctaattgctgttga

SEQ ID NO: 2906298 - DNA, 17 bp, Homo sapiens
tgctaattgctgttgaa

SEQ ID NO: 2906299 - DNA, 16 bp, Homo sapiens
tgctacaaagaagaca

SEQ ID NO: 2906300 - DNA, 11 bp, Homo sapiens
tgctacacttc

SEQ ID NO: 2906301 - DNA, 12 bp, Homo sapiens
tgctacacttct

SEQ ID NO: 2906302 - DNA, 15 bp, Homo sapiens
tgctaccttctttgg

SEQ ID NO: 2906303 - DNA, 13 bp, Homo sapiens
tgctacgtgtgat

SEQ ID NO: 2906304 - DNA, 18 bp, Homo sapiens
tgctactagctctttgag

SEQ ID NO: 2906305 - DNA, 13 bp, Homo sapiens
tgctactgaaact

SEQ ID NO: 2906306 - DNA, 16 bp, Homo sapiens
tgctactgcccctctc

SEQ ID NO: 2906307 - DNA, 22 bp, Homo sapiens
tgctactgtctcactgaaacat

SEQ ID NO: 2906308 - DNA, 15 bp, Homo sapiens
tgctacttgctctgc

SEQ ID NO: 2906309 - DNA, 17 bp, Homo sapiens
tgctacttttacttgtt

SEQ ID NO: 2906310 - DNA, 19 bp, Homo sapiens
tgctacttttacttgttca

SEQ ID NO: 2906311 - DNA, 20 bp, Homo sapiens
tgctacttttacttgttcat

SEQ ID NO: 2906312 - DNA, 22 bp, Homo sapiens
tgctacttttacttgttcattt

SEQ ID NO: 2906313 - DNA, 15 bp, Homo sapiens
tgctagaaattttca

SEQ ID NO: 2906314 - DNA, 15 bp, Homo sapiens
tgctagaagaaaaca

SEQ ID NO: 2906315 - DNA, 15 bp, Homo sapiens
tgctagagcagacag

SEQ ID NO: 2906316 - DNA, 16 bp, Homo sapiens
tgctagagcagacagg

SEQ ID NO: 2906317 - DNA, 16 bp, Homo sapiens
tgctagctagccagcc

SEQ ID NO: 2906318 - DNA, 17 bp, Homo sapiens
tgctagctagccagcca

SEQ ID NO: 2906319 - DNA, 18 bp, Homo sapiens
tgctagctagccagccaa

SEQ ID NO: 2906320 - DNA, 12 bp, Homo sapiens
tgctagctttcc

SEQ ID NO: 2906321 - DNA, 18 bp, Homo sapiens
tgctaggggaaggactgg

SEQ ID NO: 2906322 - DNA, 23 bp, Homo sapiens
tgctaggggaaggactggccgtg

SEQ ID NO: 2906323 - DNA, 19 bp, Homo sapiens
tgctgccaccaaatctgtc

SEQ ID NO: 2906324 - DNA, 22 bp, Homo sapiens
tgctgccaccaaatctgtctag

SEQ ID NO: 2906325 - DNA, 17 bp, Homo sapiens
tgctgccactctgctgc

SEQ ID NO: 2906326 - DNA, 12 bp, Homo sapiens
tgctgcccctcc

SEQ ID NO: 2906327 - DNA, 16 bp, Homo sapiens
tgctgcccctccctgc

SEQ ID NO: 2906328 - DNA, 17 bp, Homo sapiens
tgctgcccttggtttct

SEQ ID NO: 2906329 - DNA, 15 bp, Homo sapiens
tgctgcctcagctca

SEQ ID NO: 2906330 - DNA, 20 bp, Homo sapiens
tgctgcgcatgttttcttca

SEQ ID NO: 2906331 - DNA, 15 bp, Homo sapiens
tgctgctactgcccc

SEQ ID NO: 2906332 - DNA, 19 bp, Homo sapiens
tgctgctcatactggtctc

SEQ ID NO: 2906333 - DNA, 15 bp, Homo sapiens
tgctgctccatgttt

SEQ ID NO: 2906334 - DNA, 12 bp, Homo sapiens
tgctgctcctct

SEQ ID NO: 2906335 - DNA, 13 bp, Homo sapiens
tgctgctcctctt

SEQ ID NO: 2906336 - DNA, 21 bp, Homo sapiens
tgctgctgaatttataaaaat

SEQ ID NO: 2906337 - DNA, 13 bp, Homo sapiens
tgctgctgtcacc

SEQ ID NO: 2906338 - DNA, 18 bp, Homo sapiens
tgctgctgtgcgtggaaa

SEQ ID NO: 2906339 - DNA, 13 bp, Homo sapiens
tgctgctgtgctt

SEQ ID NO: 2906340 - DNA, 22 bp, Homo sapiens
tgctgctgtgcttttgatctct

SEQ ID NO: 2906341 - DNA, 18 bp, Homo sapiens
tgctgcttgtgcctccct

SEQ ID NO: 2906342 - DNA, 21 bp, Homo sapiens
tgctgctttgttgttctgcct

SEQ ID NO: 2906343 - DNA, 21 bp, Homo sapiens
tgctggaaaatctgtaaaaaa

SEQ ID NO: 2906344 - DNA, 19 bp, Homo sapiens
tgctggaacctgcaaaaaa

SEQ ID NO: 2906345 - DNA, 14 bp, Homo sapiens
tgctggaagaggtg

SEQ ID NO: 2906346 - DNA, 23 bp, Homo sapiens
tgctggagcccgcactgtcccag

SEQ ID NO: 2906347 - DNA, 17 bp, Homo sapiens
tgctggagtcatgtgcc

SEQ ID NO: 2906348 - DNA, 22 bp, Homo sapiens
tgctggatgtctgccaattttt

SEQ ID NO: 2906349 - DNA, 13 bp, Homo sapiens
tgctggcatgtct

SEQ ID NO: 2906350 - DNA, 13 bp, Homo sapiens
tgctggcccagca

SEQ ID NO: 2906351 - DNA, 14 bp, Homo sapiens
tgctggcccagcat

SEQ ID NO: 2906352 - DNA, 14 bp, Homo sapiens
tgctggcccagggc

SEQ ID NO: 2906353 - DNA, 18 bp, Homo sapiens
tgctggcccagggcccag

SEQ ID NO: 2906354 - DNA, 15 bp, Homo sapiens
tgcttgtttcttggt

SEQ ID NO: 2906355 - DNA, 15 bp, Homo sapiens
tgctttaagaatgaa

SEQ ID NO: 2906356 - DNA, 13 bp, Homo sapiens
tgctttacaggat

SEQ ID NO: 2906357 - DNA, 22 bp, Homo sapiens
tgctttacaggatcatgtaaat

SEQ ID NO: 2906358 - DNA, 18 bp, Homo sapiens
tgctttaccaaacagcaa

SEQ ID NO: 2906359 - DNA, 19 bp, Homo sapiens
tgctttaccaaacagcaaa

SEQ ID NO: 2906360 - DNA, 17 bp, Homo sapiens
tgctttattccagaatg

SEQ ID NO: 2906361 - DNA, 12 bp, Homo sapiens
tgctttcactct

SEQ ID NO: 2906362 - DNA, 14 bp, Homo sapiens
tgctttcattatgt

SEQ ID NO: 2906363 - DNA, 20 bp, Homo sapiens
tgctttccagaataatatga

SEQ ID NO: 2906364 - DNA, 17 bp, Homo sapiens
tgctttccgtggcactg

SEQ ID NO: 2906365 - DNA, 21 bp, Homo sapiens
tgctttccgtggcactgcata

SEQ ID NO: 2906366 - DNA, 18 bp, Homo sapiens
tgctttcctcttactttc

SEQ ID NO: 2906367 - DNA, 22 bp, Homo sapiens
tgctttcctcttactttcagtt

SEQ ID NO: 2906368 - DNA, 18 bp, Homo sapiens
tgctttcgaactgctagt

SEQ ID NO: 2906369 - DNA, 15 bp, Homo sapiens
tgctttctctttcag

SEQ ID NO: 2906370 - DNA, 18 bp, Homo sapiens
tgctttctctttcagtat

SEQ ID NO: 2906371 - DNA, 13 bp, Homo sapiens
tgctttctgaaat

SEQ ID NO: 2906372 - DNA, 19 bp, Homo sapiens
tgctttctgatgttgcctt

SEQ ID NO: 2906373 - DNA, 14 bp, Homo sapiens
tgctttctgctcag

SEQ ID NO: 2906374 - DNA, 20 bp, Homo sapiens
tgctttctgctcagcttctc

SEQ ID NO: 2906375 - DNA, 12 bp, Homo sapiens
tgctttctgtgg

SEQ ID NO: 2906376 - DNA, 13 bp, Homo sapiens
tgctttctgtgga

SEQ ID NO: 2906377 - DNA, 14 bp, Homo sapiens
tgctttctgttcat

SEQ ID NO: 2906378 - DNA, 18 bp, Homo sapiens
tgctttgacgggccaggc

SEQ ID NO: 2906379 - DNA, 17 bp, Homo sapiens
tgctttgcctcgaaagt

SEQ ID NO: 2906380 - DNA, 18 bp, Homo sapiens
tgctttgcctcgaaagtg

SEQ ID NO: 2906381 - DNA, 19 bp, Homo sapiens
tgctttgctttctgctcag

SEQ ID NO: 2906382 - DNA, 16 bp, Homo sapiens
tgcttttaaatctgca

SEQ ID NO: 2906383 - DNA, 15 bp, Homo sapiens
tgcttttatatctgt

SEQ ID NO: 2906384 - DNA, 15 bp, Homo sapiens
tgcttttatccactg

SEQ ID NO: 2906385 - DNA, 17 bp, Homo sapiens
tgcttttatgtttgtac

SEQ ID NO: 2906386 - DNA, 16 bp, Homo sapiens
tgcttttcttcctagt

SEQ ID NO: 2906387 - DNA, 13 bp, Homo sapiens
tgcttttggcctg

SEQ ID NO: 2906388 - DNA, 16 bp, Homo sapiens
tggaaaaaaaaaaaag

SEQ ID NO: 2906389 - DNA, 17 bp, Homo sapiens
tggaaaaaaaaaaaaga

SEQ ID NO: 2906390 - DNA, 17 bp, Homo sapiens
tggaaaaaaaaaagaca

SEQ ID NO: 2906391 - DNA, 12 bp, Homo sapiens
tggaaaaaaaca

SEQ ID NO: 2906392 - DNA, 20 bp, Homo sapiens
tggaaaaaccacccccaaat

SEQ ID NO: 2906393 - DNA, 18 bp, Homo sapiens
tggaaaaagaaagaaaca

SEQ ID NO: 2906394 - DNA, 21 bp, Homo sapiens
tggaaaaagaaagaaacactc

SEQ ID NO: 2906395 - DNA, 11 bp, Homo sapiens
tggaaaaatga

SEQ ID NO: 2906396 - DNA, 17 bp, Homo sapiens
tggaaaacaaggaagtc

SEQ ID NO: 2906397 - DNA, 21 bp, Homo sapiens
tggaaaactaagaaaattgct

SEQ ID NO: 2906398 - DNA, 14 bp, Homo sapiens
tggaaaagaaatca

SEQ ID NO: 2906399 - DNA, 19 bp, Homo sapiens
tggaaaagggtcttgggaa

SEQ ID NO: 2906400 - DNA, 22 bp, Homo sapiens
tggaaaagggtcttgggaaata

SEQ ID NO: 2906401 - DNA, 15 bp, Homo sapiens
tggaaacagaggtaa

SEQ ID NO: 2906402 - DNA, 22 bp, Homo sapiens
tggaaaccaagtcaggccaggt

SEQ ID NO: 2906403 - DNA, 17 bp, Homo sapiens
tggaaacccataggccc

SEQ ID NO: 2906404 - DNA, 21 bp, Homo sapiens
tggaaacccataggcccacac

SEQ ID NO: 2906405 - DNA, 14 bp, Homo sapiens
tggaaacttctgta

SEQ ID NO: 2906406 - DNA, 13 bp, Homo sapiens
tggaaagactggg

SEQ ID NO: 2906407 - DNA, 21 bp, Homo sapiens
tggaaagatagagattgtttt

SEQ ID NO: 2906408 - DNA, 20 bp, Homo sapiens
tggaaaggaagaatgcagag

SEQ ID NO: 2906409 - DNA, 15 bp, Homo sapiens
tggaaaggatcacag

SEQ ID NO: 2906410 - DNA, 20 bp, Homo sapiens
tggaaaggattctaaacaga

SEQ ID NO: 2906411 - DNA, 21 bp, Homo sapiens
tggaaaggattctaaacagat

SEQ ID NO: 2906412 - DNA, 16 bp, Homo sapiens
tggaaaggtttcaaga

SEQ ID NO: 2906413 - DNA, 15 bp, Homo sapiens
tggaaagtttttgta

SEQ ID NO: 2906414 - DNA, 21 bp, Homo sapiens
tggaacaagacagccttcact

SEQ ID NO: 2906415 - DNA, 23 bp, Homo sapiens
tggaacacaaatgaaaatgaata

SEQ ID NO: 2906416 - DNA, 15 bp, Homo sapiens
tggaacacggccaca

SEQ ID NO: 2906417 - DNA, 21 bp, Homo sapiens
tggaacactagacaagccaga

SEQ ID NO: 2906418 - DNA, 22 bp, Homo sapiens
tggaacactagacaagccagaa

SEQ ID NO: 2906419 - DNA, 22 bp, Homo sapiens
tggaacagtgaaagtcaattca

SEQ ID NO: 2906420 - DNA, 14 bp, Homo sapiens
tggaacatccttgg

SEQ ID NO: 2906421 - DNA, 17 bp, Homo sapiens
tggaacatgcttttact

SEQ ID NO: 2906422 - DNA, 20 bp, Homo sapiens
tggaaccagcaagtcccaga

SEQ ID NO: 2906423 - DNA, 16 bp, Homo sapiens
tggaacccagactcag

SEQ ID NO: 2906424 - DNA, 16 bp, Homo sapiens
tggaacctgcaaaaaa

SEQ ID NO: 2906425 - DNA, 22 bp, Homo sapiens
tggaactaaggactccaatgtc

SEQ ID NO: 2906426 - DNA, 16 bp, Homo sapiens
tggaactgtcccagct

SEQ ID NO: 2906427 - DNA, 13 bp, Homo sapiens
tggaacttgaact

SEQ ID NO: 2906428 - DNA, 15 bp, Homo sapiens
tggaacttgaactga

SEQ ID NO: 2906429 - DNA, 16 bp, Homo sapiens
tggaacttgaactgat

SEQ ID NO: 2906430 - DNA, 17 bp, Homo sapiens
tggaagaaaatggaatt

SEQ ID NO: 2906431 - DNA, 23 bp, Homo sapiens
tggaagaaaatggaattactcca

SEQ ID NO: 2906432 - DNA, 14 bp, Homo sapiens
tggaagatcctgtg

SEQ ID NO: 2906433 - DNA, 17 bp, Homo sapiens
tggaagatcctgtgagg

SEQ ID NO: 2906434 - DNA, 12 bp, Homo sapiens
tggaagcagagc

SEQ ID NO: 2906435 - DNA, 17 bp, Homo sapiens
tggaagcatgtaggaga

SEQ ID NO: 2906436 - DNA, 22 bp, Homo sapiens
tggaagcatgtaggagaatcca

SEQ ID NO: 2906437 - DNA, 16 bp, Homo sapiens
tggaagctaatttgca

SEQ ID NO: 2906438 - DNA, 18 bp, Homo sapiens
tggaagctaatttgcatt

SEQ ID NO: 2906439 - DNA, 16 bp, Homo sapiens
tggaagctgtgtcctt

SEQ ID NO: 2906440 - DNA, 18 bp, Homo sapiens
tggaagcttgttttccag

SEQ ID NO: 2906441 - DNA, 17 bp, Homo sapiens
tggaaggagacacagat

SEQ ID NO: 2906442 - DNA, 19 bp, Homo sapiens
tggaaggagacacagatgt

SEQ ID NO: 2906443 - DNA, 12 bp, Homo sapiens
tggaaggagcac

SEQ ID NO: 2906444 - DNA, 23 bp, Homo sapiens
tggaaggtgaggcgttctcctgc

SEQ ID NO: 2906445 - DNA, 14 bp, Homo sapiens
tggaaggtgccaga

SEQ ID NO: 2906446 - DNA, 20 bp, Homo sapiens
tggaagtaaccatttgcact

SEQ ID NO: 2906447 - DNA, 16 bp, Homo sapiens
tggaagtattttcctc

SEQ ID NO: 2906448 - DNA, 22 bp, Homo sapiens
tggaagtattttcctccaaagt

SEQ ID NO: 2906449 - DNA, 21 bp, Homo sapiens
tggaagtcaaataaatgtttc

SEQ ID NO: 2906450 - DNA, 15 bp, Homo sapiens
tggaagtccctcaga

SEQ ID NO: 2906451 - DNA, 18 bp, Homo sapiens
tggaagtgtgtgtggcag

SEQ ID NO: 2906452 - DNA, 18 bp, Homo sapiens
tggaagtgttcctgtctc

SEQ ID NO: 2906453 - DNA, 19 bp, Homo sapiens
tggaagtgttcctgtctca

SEQ ID NO: 2906454 - DNA, 22 bp, Homo sapiens
tggaataatcctaaacatatga

SEQ ID NO: 2906455 - DNA, 20 bp, Homo sapiens
tggaatactaaaaatcatga

SEQ ID NO: 2906456 - DNA, 18 bp, Homo sapiens
tggaatataaggaaagca

SEQ ID NO: 2906457 - DNA, 20 bp, Homo sapiens
tggaatattgtccattgtcc

SEQ ID NO: 2906458 - DNA, 12 bp, Homo sapiens
tggaatcaacac

SEQ ID NO: 2906459 - DNA, 18 bp, Homo sapiens
tggaatctggagaccagg

SEQ ID NO: 2906460 - DNA, 13 bp, Homo sapiens
tggaatgagggag

SEQ ID NO: 2906461 - DNA, 15 bp, Homo sapiens
tggaatgcacacagc

SEQ ID NO: 2906462 - DNA, 20 bp, Homo sapiens
tggaatgcacacagcggctg

SEQ ID NO: 2906463 - DNA, 13 bp, Homo sapiens
tggaatgcttctt

SEQ ID NO: 2906464 - DNA, 17 bp, Homo sapiens
tggaattactccaaaaa

SEQ ID NO: 2906465 - DNA, 13 bp, Homo sapiens
tggaattagatgt

SEQ ID NO: 2906466 - DNA, 15 bp, Homo sapiens
tggaattagatgttt

SEQ ID NO: 2906467 - DNA, 20 bp, Homo sapiens
tggaattagcttggggccag

SEQ ID NO: 2906468 - DNA, 17 bp, Homo sapiens
ggcgtggcccgtggcct

SEQ ID NO: 2906469 - DNA, 20 bp, Homo sapiens
ggcgtggggaatgggcaggt

SEQ ID NO: 2906470 - DNA, 22 bp, Homo sapiens
ggcgtgtgcatagcgtcctgcc

SEQ ID NO: 2906471 - DNA, 14 bp, Homo sapiens
ggcgttctcctgct

SEQ ID NO: 2906472 - DNA, 16 bp, Homo sapiens
ggcgttggatttaaaa

SEQ ID NO: 2906473 - DNA, 11 bp, Homo sapiens
ggctaaatgaa

SEQ ID NO: 2906474 - DNA, 12 bp, Homo sapiens
ggctaaatgaag

SEQ ID NO: 2906475 - DNA, 21 bp, Homo sapiens
ggctaagatactgctgatgct

SEQ ID NO: 2906476 - DNA, 23 bp, Homo sapiens
ggctaagggggaccatggggagg

SEQ ID NO: 2906477 - DNA, 13 bp, Homo sapiens
ggctaatttttgt

SEQ ID NO: 2906478 - DNA, 16 bp, Homo sapiens
ggctacaaaggaggac

SEQ ID NO: 2906479 - DNA, 16 bp, Homo sapiens
ggctactcagcagccc

SEQ ID NO: 2906480 - DNA, 18 bp, Homo sapiens
ggctactcagcagccctc

SEQ ID NO: 2906481 - DNA, 17 bp, Homo sapiens
ggctagagggcccaaag

SEQ ID NO: 2906482 - DNA, 19 bp, Homo sapiens
ggctagattctaacatatt

SEQ ID NO: 2906483 - DNA, 15 bp, Homo sapiens
ggctagctggagcct

SEQ ID NO: 2906484 - DNA, 17 bp, Homo sapiens
ggctagctggagcctgg

SEQ ID NO: 2906485 - DNA, 20 bp, Homo sapiens
ggctaggacgttggcctcag

SEQ ID NO: 2906486 - DNA, 15 bp, Homo sapiens
ggctagggaggacca

SEQ ID NO: 2906487 - DNA, 16 bp, Homo sapiens
ggctagggtggggaga

SEQ ID NO: 2906488 - DNA, 23 bp, Homo sapiens
ggctaggtatcattcaactctcc

SEQ ID NO: 2906489 - DNA, 23 bp, Homo sapiens
ggctagtggggtgaacagctggt

SEQ ID NO: 2906490 - DNA, 13 bp, Homo sapiens
ggctattcacaac

SEQ ID NO: 2906491 - DNA, 13 bp, Homo sapiens
ggctcacacctgt

SEQ ID NO: 2906492 - DNA, 22 bp, Homo sapiens
ggctcacgccccgctgtgtcct

SEQ ID NO: 2906493 - DNA, 22 bp, Homo sapiens
ggctcacgcctgtaatcccagc

SEQ ID NO: 2906494 - DNA, 19 bp, Homo sapiens
ggctcagaagagcagcttc

SEQ ID NO: 2906495 - DNA, 23 bp, Homo sapiens
ggctcagagagtacactgtgtct

SEQ ID NO: 2906496 - DNA, 15 bp, Homo sapiens
ggctcagccagcact

SEQ ID NO: 2906497 - DNA, 20 bp, Homo sapiens
ggctcagctcggggagcctt

SEQ ID NO: 2906498 - DNA, 14 bp, Homo sapiens
ggctcaggcccagc

SEQ ID NO: 2906499 - DNA, 12 bp, Homo sapiens
ggctcagggtgg

SEQ ID NO: 2906500 - DNA, 17 bp, Homo sapiens
ggctccagaatgtgctg

SEQ ID NO: 2906501 - DNA, 18 bp, Homo sapiens
ggctccagaatgtgctgc

SEQ ID NO: 2906502 - DNA, 11 bp, Homo sapiens
ggctccccagg

SEQ ID NO: 2906503 - DNA, 19 bp, Homo sapiens
ggctccccaggaagcccac

SEQ ID NO: 2906504 - DNA, 15 bp, Homo sapiens
ggctcccggaattcc

SEQ ID NO: 2906505 - DNA, 14 bp, Homo sapiens
ggctccctctctcc

SEQ ID NO: 2906506 - DNA, 16 bp, Homo sapiens
ggctccctctctcctg

SEQ ID NO: 2906507 - DNA, 20 bp, Homo sapiens
ggctccctctctcctggact

SEQ ID NO: 2906508 - DNA, 16 bp, Homo sapiens
ggctccctcttctttc

SEQ ID NO: 2906509 - DNA, 21 bp, Homo sapiens
ggctccctgtaacctcttcag

SEQ ID NO: 2906510 - DNA, 15 bp, Homo sapiens
ggctccggcctctgc

SEQ ID NO: 2906511 - DNA, 12 bp, Homo sapiens
ggctcctccctc

SEQ ID NO: 2906512 - DNA, 16 bp, Homo sapiens
ggctcctccctccctc

SEQ ID NO: 2906513 - DNA, 12 bp, Homo sapiens
ggctcctctcag

SEQ ID NO: 2906514 - DNA, 21 bp, Homo sapiens
ggctcctgttagctcctcact

SEQ ID NO: 2906515 - DNA, 18 bp, Homo sapiens
ggctcgttgactggctgt

SEQ ID NO: 2906516 - DNA, 17 bp, Homo sapiens
tgcaccgcctgccctcc

SEQ ID NO: 2906517 - DNA, 18 bp, Homo sapiens
tgcaccgcctgccctccc

SEQ ID NO: 2906518 - DNA, 13 bp, Homo sapiens
tgcaccggacagt

SEQ ID NO: 2906519 - DNA, 12 bp, Homo sapiens
tgcaccggggcc

SEQ ID NO: 2906520 - DNA, 16 bp, Homo sapiens
tgcaccggggcctggg

SEQ ID NO: 2906521 - DNA, 14 bp, Homo sapiens
tgcacctcccccca

SEQ ID NO: 2906522 - DNA, 19 bp, Homo sapiens
tgcacctccccccactgca

SEQ ID NO: 2906523 - DNA, 11 bp, Homo sapiens
tgcacctgcat

SEQ ID NO: 2906524 - DNA, 12 bp, Homo sapiens
tgcacctgcctc

SEQ ID NO: 2906525 - DNA, 16 bp, Homo sapiens
tgcacctgcctcagct

SEQ ID NO: 2906526 - DNA, 16 bp, Homo sapiens
tgcacgctcccctcca

SEQ ID NO: 2906527 - DNA, 22 bp, Homo sapiens
tgcacgctcccctccatcccca

SEQ ID NO: 2906528 - DNA, 20 bp, Homo sapiens
tgcacggttcaatggtagat

SEQ ID NO: 2906529 - DNA, 22 bp, Homo sapiens
tgcacggtttcgaagtcattaa

SEQ ID NO: 2906530 - DNA, 19 bp, Homo sapiens
tgcacggtttctgttctgc

SEQ ID NO: 2906531 - DNA, 21 bp, Homo sapiens
tgcacgttaacagcgtgtcaa

SEQ ID NO: 2906532 - DNA, 20 bp, Homo sapiens
tgcacgttatggtgtttctc

SEQ ID NO: 2906533 - DNA, 15 bp, Homo sapiens
tgcacgttgcttcag

SEQ ID NO: 2906534 - DNA, 16 bp, Homo sapiens
tgcactcaagttgttt

SEQ ID NO: 2906535 - DNA, 12 bp, Homo sapiens
tgcactccagcc

SEQ ID NO: 2906536 - DNA, 14 bp, Homo sapiens
tgcactccagcctg

SEQ ID NO: 2906537 - DNA, 15 bp, Homo sapiens
tgcactccagcctgg

SEQ ID NO: 2906538 - DNA, 13 bp, Homo sapiens
tgcactccctggc

SEQ ID NO: 2906539 - DNA, 16 bp, Homo sapiens
tgcactcctcagggca

SEQ ID NO: 2906540 - DNA, 17 bp, Homo sapiens
tgcactgatgctgcccc

SEQ ID NO: 2906541 - DNA, 21 bp, Homo sapiens
tgcactgatgctgcccctcat

SEQ ID NO: 2906542 - DNA, 22 bp, Homo sapiens
tgcactgatgctgcccctcatc

SEQ ID NO: 2906543 - DNA, 13 bp, Homo sapiens
tgcactgctgtaa

SEQ ID NO: 2906544 - DNA, 17 bp, Homo sapiens
tgcactggagccacagg

SEQ ID NO: 2906545 - DNA, 18 bp, Homo sapiens
tgcactggagccacaggc

SEQ ID NO: 2906546 - DNA, 22 bp, Homo sapiens
tgcactggagccacaggcaggg

SEQ ID NO: 2906547 - DNA, 15 bp, Homo sapiens
tgcactggggtggga

SEQ ID NO: 2906548 - DNA, 11 bp, Homo sapiens
tgcactgtctg

SEQ ID NO: 2906549 - DNA, 15 bp, Homo sapiens
tgcactgtgaaggac

SEQ ID NO: 2906550 - DNA, 19 bp, Homo sapiens
tgcactgtgaatcctggca

SEQ ID NO: 2906551 - DNA, 13 bp, Homo sapiens
tgcactgttcccc

SEQ ID NO: 2906552 - DNA, 14 bp, Homo sapiens
tgcactgttccccc

SEQ ID NO: 2906553 - DNA, 21 bp, Homo sapiens
tgcacttaaggcactctgtta

SEQ ID NO: 2906554 - DNA, 12 bp, Homo sapiens
tgcactttgtaa

SEQ ID NO: 2906555 - DNA, 13 bp, Homo sapiens
tgcactttgtaaa

SEQ ID NO: 2906556 - DNA, 13 bp, Homo sapiens
tgcagaaaaagaa

SEQ ID NO: 2906557 - DNA, 14 bp, Homo sapiens
tgcagaaaaagaaa

SEQ ID NO: 2906558 - DNA, 16 bp, Homo sapiens
tgcagaaaaagaaaaa

SEQ ID NO: 2906559 - DNA, 17 bp, Homo sapiens
tgcagaaaagcacctgc

SEQ ID NO: 2906560 - DNA, 18 bp, Homo sapiens
tgcagaaaagcacctgcc

SEQ ID NO: 2906561 - DNA, 20 bp, Homo sapiens
tgcagaaaagcacctgccga

SEQ ID NO: 2906562 - DNA, 21 bp, Homo sapiens
tgcagaaaagcacctgccgac

SEQ ID NO: 2906563 - DNA, 23 bp, Homo sapiens
tgcagaagtattcttttcaatta

SEQ ID NO: 2906564 - DNA, 24 bp, Homo sapiens
tgcagaatctctgcctagaatctt

SEQ ID NO: 2906565 - DNA, 11 bp, Homo sapiens
tgcagaatgta

SEQ ID NO: 2906566 - DNA, 20 bp, Homo sapiens
tgcagaatgtaagtgggccc

SEQ ID NO: 2906567 - DNA, 13 bp, Homo sapiens
tgcagacaggaat

SEQ ID NO: 2906568 - DNA, 15 bp, Homo sapiens
tgcagacaggaatct

SEQ ID NO: 2906569 - DNA, 18 bp, Homo sapiens
tgcagacaggaatcttaa

SEQ ID NO: 2906570 - DNA, 14 bp, Homo sapiens
tgcagaccttactc

SEQ ID NO: 2906571 - DNA, 12 bp, Homo sapiens
tgcagagatcct

SEQ ID NO: 2906572 - DNA, 21 bp, Homo sapiens
tgcagaggaagtacaaactaa

SEQ ID NO: 2906573 - DNA, 16 bp, Homo sapiens
tgcagaggagcccagt

SEQ ID NO: 2906574 - DNA, 17 bp, Homo sapiens
tgcagaggagcccagtg

SEQ ID NO: 2906575 - DNA, 18 bp, Homo sapiens
tgcagaggagcccagtgg

SEQ ID NO: 2906576 - DNA, 14 bp, Homo sapiens
tgcagaggcctggg

SEQ ID NO: 2906577 - DNA, 17 bp, Homo sapiens
tgcagaggtaccctggg

SEQ ID NO: 2906578 - DNA, 11 bp, Homo sapiens
tgcagagtaag

SEQ ID NO: 2906579 - DNA, 20 bp, Homo sapiens
tgcagagtccatttcccaca

SEQ ID NO: 2906580 - DNA, 17 bp, Homo sapiens
tgcagattgcagttctg

SEQ ID NO: 2906581 - DNA, 20 bp, Homo sapiens
tgcagatttctgccttgaaa

SEQ ID NO: 2906582 - DNA, 14 bp, Homo sapiens
tgcagcaatattct

SEQ ID NO: 2906583 - DNA, 18 bp, Homo sapiens
tgcagcaattaaaaattg

SEQ ID NO: 2906584 - DNA, 18 bp, Homo sapiens
tgcagcacatgcgggctc

SEQ ID NO: 2906585 - DNA, 23 bp, Homo sapiens
tgcagcacatgcgggctcgccca

SEQ ID NO: 2906586 - DNA, 21 bp, Homo sapiens
tgcagcaccgaggggcctttg

SEQ ID NO: 2906587 - DNA, 18 bp, Homo sapiens
tgcagcactgctgcctca

SEQ ID NO: 2906588 - DNA, 22 bp, Homo sapiens
tgcagcagattggaaggagaca

SEQ ID NO: 2906589 - DNA, 18 bp, Homo sapiens
tgcagcagggatgccctg

SEQ ID NO: 2906590 - DNA, 19 bp, Homo sapiens
tgcagccagcccagcccag

SEQ ID NO: 2906591 - DNA, 23 bp, Homo sapiens
tgcagccagcccagcccagctgg

SEQ ID NO: 2906592 - DNA, 12 bp, Homo sapiens
tgcagccaggcc

SEQ ID NO: 2906593 - DNA, 13 bp, Homo sapiens
tgcagccaggcct

SEQ ID NO: 2906594 - DNA, 19 bp, Homo sapiens
tgcagcccaccaggagcac

SEQ ID NO: 2906595 - DNA, 15 bp, Homo sapiens
tgcagcccatttctc

SEQ ID NO: 2906596 - DNA, 22 bp, Homo sapiens
tgcagccctgagaaagccctgt

SEQ ID NO: 2906597 - DNA, 21 bp, Homo sapiens
tgcagccttgaactctgggct

SEQ ID NO: 2906598 - DNA, 19 bp, Homo sapiens
tgcagctagtcctagtgaa

SEQ ID NO: 2906599 - DNA, 13 bp, Homo sapiens
tgcagctatctgg

SEQ ID NO: 2906600 - DNA, 14 bp, Homo sapiens
tgcagctcctcagc

SEQ ID NO: 2906601 - DNA, 13 bp, Homo sapiens
tgcagctctgcag

SEQ ID NO: 2906602 - DNA, 20 bp, Homo sapiens
tgcagctctgcagcaatatt

SEQ ID NO: 2906603 - DNA, 15 bp, Homo sapiens
tgcagctggcccact

SEQ ID NO: 2906604 - DNA, 21 bp, Homo sapiens
tgcagctggcccactgctggc

SEQ ID NO: 2906605 - DNA, 23 bp, Homo sapiens
tgcagctggcccactgctggctg

SEQ ID NO: 2906606 - DNA, 17 bp, Homo sapiens
tgcaggaaatggctgtg

SEQ ID NO: 2906607 - DNA, 16 bp, Homo sapiens
tgcaggaaggaaaact

SEQ ID NO: 2906608 - DNA, 15 bp, Homo sapiens
tgcaggacagctctt

SEQ ID NO: 2906609 - DNA, 16 bp, Homo sapiens
tgcaggacctgcctgt

SEQ ID NO: 2906610 - DNA, 13 bp, Homo sapiens
tgcaggacttgag

SEQ ID NO: 2906611 - DNA, 17 bp, Homo sapiens
tgcaggagacattttca

SEQ ID NO: 2906612 - DNA, 17 bp, Homo sapiens
tgcaggagcagggcggc

SEQ ID NO: 2906613 - DNA, 14 bp, Homo sapiens
tgcaggagctagtt

SEQ ID NO: 2906614 - DNA, 13 bp, Homo sapiens
tgcaggagggcac

SEQ ID NO: 2906615 - DNA, 20 bp, Homo sapiens
tgcaggatttttagagcatt

SEQ ID NO: 2906616 - DNA, 22 bp, Homo sapiens
tgcaggatttttagagcattaa

SEQ ID NO: 2906617 - DNA, 12 bp, Homo sapiens
tgcaggcagtgt

SEQ ID NO: 2906618 - DNA, 19 bp, Homo sapiens
tgcaggccccgcttgtcca

SEQ ID NO: 2906619 - DNA, 17 bp, Homo sapiens
tgcaggcctaggtgcag

SEQ ID NO: 2906620 - DNA, 14 bp, Homo sapiens
tgcaggcggccctc

SEQ ID NO: 2906621 - DNA, 17 bp, Homo sapiens
tgcaggcggccctcagt

SEQ ID NO: 2906622 - DNA, 18 bp, Homo sapiens
tgcaggcggccctcagtg

SEQ ID NO: 2906623 - DNA, 19 bp, Homo sapiens
tgcaggctgcaggagggca

SEQ ID NO: 2906624 - DNA, 19 bp, Homo sapiens
tgcaggctggccagccgct

SEQ ID NO: 2906625 - DNA, 19 bp, Homo sapiens
tgcagggccatggctcagg

SEQ ID NO: 2906626 - DNA, 12 bp, Homo sapiens
tgcagggctggt

SEQ ID NO: 2906627 - DNA, 15 bp, Homo sapiens
tgcaggggactgggc

SEQ ID NO: 2906628 - DNA, 17 bp, Homo sapiens
tgcaggggactgggcca

SEQ ID NO: 2906629 - DNA, 20 bp, Homo sapiens
tgcaggggactgggccatgg

SEQ ID NO: 2906630 - DNA, 15 bp, Homo sapiens
tgcagggtcctcttc

SEQ ID NO: 2906631 - DNA, 16 bp, Homo sapiens
tgcaggtgaaacccag

SEQ ID NO: 2906632 - DNA, 23 bp, Homo sapiens
tgcaggtgtggagagagaggctt

SEQ ID NO: 2906633 - DNA, 20 bp, Homo sapiens
tgcaggtttgaccaggaaag

SEQ ID NO: 2906634 - DNA, 18 bp, Homo sapiens
tgcagtaaatcttttaca

SEQ ID NO: 2906635 - DNA, 20 bp, Homo sapiens
tgcagtagattttctttaaa

SEQ ID NO: 2906636 - DNA, 16 bp, Homo sapiens
tgcagtaggggaggag

SEQ ID NO: 2906637 - DNA, 13 bp, Homo sapiens
tgcagtatatttc

SEQ ID NO: 2906638 - DNA, 17 bp, Homo sapiens
tgcagtatggtacattt

SEQ ID NO: 2906639 - DNA, 18 bp, Homo sapiens
tgcagtcatcaacaatga

SEQ ID NO: 2906640 - DNA, 17 bp, Homo sapiens
tgcagtccatttcctaa

SEQ ID NO: 2906641 - DNA, 22 bp, Homo sapiens
tgcagtcgcttgccaaagcaga

SEQ ID NO: 2906642 - DNA, 15 bp, Homo sapiens
tgcagtcggcatgcc

SEQ ID NO: 2906643 - DNA, 21 bp, Homo sapiens
tgcagtcggcatgccaggacc

SEQ ID NO: 2906644 - DNA, 14 bp, Homo sapiens
tgcagtctccgcct

SEQ ID NO: 2906645 - DNA, 18 bp, Homo sapiens
tgcagtctccgcctcctg

SEQ ID NO: 2906646 - DNA, 16 bp, Homo sapiens
tgcagtctttccccca

SEQ ID NO: 2906647 - DNA, 16 bp, Homo sapiens
tgcagtggcctggccg

SEQ ID NO: 2906648 - DNA, 18 bp, Homo sapiens
tgcagtggcgcattctag

SEQ ID NO: 2906649 - DNA, 13 bp, Homo sapiens
tgcagtggggttt

SEQ ID NO: 2906650 - DNA, 23 bp, Homo sapiens
tgcagtggggtttcgcagcctga

SEQ ID NO: 2906651 - DNA, 13 bp, Homo sapiens
tgcagttcttgag

SEQ ID NO: 2906652 - DNA, 16 bp, Homo sapiens
tgcagtttaagatgac

SEQ ID NO: 2906653 - DNA, 19 bp, Homo sapiens
tgcagtttaagatgacact

SEQ ID NO: 2906654 - DNA, 21 bp, Homo sapiens
tgcagtttatatatatgctac

SEQ ID NO: 2906655 - DNA, 16 bp, Homo sapiens
tgcagtttatcattca

SEQ ID NO: 2906656 - DNA, 17 bp, Homo sapiens
tgcagtttatcattcaa

SEQ ID NO: 2906657 - DNA, 19 bp, Homo sapiens
tgcagtttatcattcaagt

SEQ ID NO: 2906658 - DNA, 14 bp, Homo sapiens
tgcagtttgaaatt

SEQ ID NO: 2906659 - DNA, 21 bp, Homo sapiens
tgcagttttggtttgatgtaa

SEQ ID NO: 2906660 - DNA, 13 bp, Homo sapiens
tgcagttttgtaa

SEQ ID NO: 2906661 - DNA, 22 bp, Homo sapiens
tgcataaaagggtcaaacctgt

SEQ ID NO: 2906662 - DNA, 19 bp, Homo sapiens
tgcataaacaatccaaatg

SEQ ID NO: 2906663 - DNA, 18 bp, Homo sapiens
tgcataagtgaaaatctt

SEQ ID NO: 2906664 - DNA, 22 bp, Homo sapiens
tgcataagtgaaaatcttacaa

SEQ ID NO: 2906665 - DNA, 12 bp, Homo sapiens
tgcatacacaca

SEQ ID NO: 2906666 - DNA, 13 bp, Homo sapiens
tgcatacacacac

SEQ ID NO: 2906667 - DNA, 16 bp, Homo sapiens
tgcatacgtacattcc

SEQ ID NO: 2906668 - DNA, 15 bp, Homo sapiens
tgcatacttcaaaag

SEQ ID NO: 2906669 - DNA, 18 bp, Homo sapiens
tgcatacttcaaaagtat

SEQ ID NO: 2906670 - DNA, 19 bp, Homo sapiens
tgcatacttcaaaagtatt

SEQ ID NO: 2906671 - DNA, 21 bp, Homo sapiens
tgcatacttcaaaagtatttt

SEQ ID NO: 2906672 - DNA, 22 bp, Homo sapiens
tgcatagcagatggtttccaca

SEQ ID NO: 2906673 - DNA, 16 bp, Homo sapiens
tgcatagcagctgcta

SEQ ID NO: 2906674 - DNA, 18 bp, Homo sapiens
tgcatagcgtcctgccct

SEQ ID NO: 2906675 - DNA, 14 bp, Homo sapiens
tgcatatagaaaac

SEQ ID NO: 2906676 - DNA, 18 bp, Homo sapiens
tgcatatctctagtccct

SEQ ID NO: 2906677 - DNA, 13 bp, Homo sapiens
tgcatatgttgaa

SEQ ID NO: 2906678 - DNA, 15 bp, Homo sapiens
tgcatatgttgaata

SEQ ID NO: 2906679 - DNA, 15 bp, Homo sapiens
tgcatattcaacaca

SEQ ID NO: 2906680 - DNA, 18 bp, Homo sapiens
tgcatattcaacacactg

SEQ ID NO: 2906681 - DNA, 13 bp, Homo sapiens
tgcatattgtaca

SEQ ID NO: 2906682 - DNA, 16 bp, Homo sapiens
tgcatattgtacactt

SEQ ID NO: 2906683 - DNA, 17 bp, Homo sapiens
tgcatattgtacacttt

SEQ ID NO: 2906684 - DNA, 19 bp, Homo sapiens
tgcatattgtacacttttt

SEQ ID NO: 2906685 - DNA, 14 bp, Homo sapiens
tgcatccagaggca

SEQ ID NO: 2906686 - DNA, 14 bp, Homo sapiens
tgcatccattcctc

SEQ ID NO: 2906687 - DNA, 15 bp, Homo sapiens
tgcatctaagcccat

SEQ ID NO: 2906688 - DNA, 16 bp, Homo sapiens
tgcatctaagcccatg

SEQ ID NO: 2906689 - DNA, 17 bp, Homo sapiens
tgcatctaagcccatgg

SEQ ID NO: 2906690 - DNA, 15 bp, Homo sapiens
tgcatctgaccagca

SEQ ID NO: 2906691 - DNA, 17 bp, Homo sapiens
tgcatctgaccagcagc

SEQ ID NO: 2906692 - DNA, 21 bp, Homo sapiens
tgcatctgaccagcagcgcct

SEQ ID NO: 2906693 - DNA, 16 bp, Homo sapiens
tgcatctgataaagtt

SEQ ID NO: 2906694 - DNA, 14 bp, Homo sapiens
tgcatcttactgaa

SEQ ID NO: 2906695 - DNA, 17 bp, Homo sapiens
tgcatcttactgaaggt

SEQ ID NO: 2906696 - DNA, 18 bp, Homo sapiens
tgcatctttttttcattt

SEQ ID NO: 2906697 - DNA, 18 bp, Homo sapiens
tgcatgacacttccaaag

SEQ ID NO: 2906698 - DNA, 17 bp, Homo sapiens
tgcatgacgtttaaggc

SEQ ID NO: 2906699 - DNA, 15 bp, Homo sapiens
tgcatgcaggtctcc

SEQ ID NO: 2906700 - DNA, 23 bp, Homo sapiens
tgcatgctaaattattatttagc

SEQ ID NO: 2906701 - DNA, 14 bp, Homo sapiens
tgcatggagtgttt

SEQ ID NO: 2906702 - DNA, 16 bp, Homo sapiens
tgcatggagtgtttga

SEQ ID NO: 2906703 - DNA, 17 bp, Homo sapiens
tgcatggagtgtttgac

SEQ ID NO: 2906704 - DNA, 22 bp, Homo sapiens
tgcatggcattaattgttcctt

SEQ ID NO: 2906705 - DNA, 16 bp, Homo sapiens
tgcatgggccagcccc

SEQ ID NO: 2906706 - DNA, 18 bp, Homo sapiens
tgcatggtgccccaggac

SEQ ID NO: 2906707 - DNA, 13 bp, Homo sapiens
tgcatggtggcca

SEQ ID NO: 2906708 - DNA, 22 bp, Homo sapiens
tgcatgtaaaatcttcagctgg

SEQ ID NO: 2906709 - DNA, 20 bp, Homo sapiens
tgcatgtaaacacgcctgca

SEQ ID NO: 2906710 - DNA, 13 bp, Homo sapiens
tgcatgtatgtct

SEQ ID NO: 2906711 - DNA, 20 bp, Homo sapiens
tgcatgtcaaacatgagatg

SEQ ID NO: 2906712 - DNA, 16 bp, Homo sapiens
tgcatgtgaagaaagg

SEQ ID NO: 2906713 - DNA, 13 bp, Homo sapiens
tgcatgtgactct

SEQ ID NO: 2906714 - DNA, 14 bp, Homo sapiens
tgcatgtgactctg

SEQ ID NO: 2906715 - DNA, 17 bp, Homo sapiens
tgcatgtgactctgaag

SEQ ID NO: 2906716 - DNA, 19 bp, Homo sapiens
tgcatgtgcgtggaagtgt

SEQ ID NO: 2906717 - DNA, 22 bp, Homo sapiens
tgcatgtgcgtggaagtgttcc

SEQ ID NO: 2906718 - DNA, 23 bp, Homo sapiens
tgcatgtgcgtggaagtgttcct

SEQ ID NO: 2906719 - DNA, 12 bp, Homo sapiens
tgcatgtgtata

SEQ ID NO: 2906720 - DNA, 17 bp, Homo sapiens
tgcatgtgtatatatgt

SEQ ID NO: 2906721 - DNA, 22 bp, Homo sapiens
tgcatgtgtgcgtgtctccatg

SEQ ID NO: 2906722 - DNA, 14 bp, Homo sapiens
tgcatgtttgctgt

SEQ ID NO: 2906723 - DNA, 14 bp, Homo sapiens
tgcattaaattcac

SEQ ID NO: 2906724 - DNA, 15 bp, Homo sapiens
tgcattaaattcaca

SEQ ID NO: 2906725 - DNA, 20 bp, Homo sapiens
tgcattaaattcacaaactt

SEQ ID NO: 2906726 - DNA, 23 bp, Homo sapiens
tgcattcctgtaacttttaatcc

SEQ ID NO: 2906727 - DNA, 13 bp, Homo sapiens
tgcattctatcgt

SEQ ID NO: 2906728 - DNA, 13 bp, Homo sapiens
tgcattgaacaca

SEQ ID NO: 2906729 - DNA, 22 bp, Homo sapiens
tgcattgaacacaaactgtaaa

SEQ ID NO: 2906730 - DNA, 17 bp, Homo sapiens
tgcattgatattgtgaa

SEQ ID NO: 2906731 - DNA, 18 bp, Homo sapiens
tgcattgggattttagaa

SEQ ID NO: 2906732 - DNA, 22 bp, Homo sapiens
tgcatttaaatacagtcttcca

SEQ ID NO: 2906733 - DNA, 24 bp, Homo sapiens
tgcatttaaatacagtcttccatt

SEQ ID NO: 2906734 - DNA, 19 bp, Homo sapiens
tgcatttattgcagtttat

SEQ ID NO: 2906735 - DNA, 20 bp, Homo sapiens
tgcatttcacatgccttgca

SEQ ID NO: 2906736 - DNA, 19 bp, Homo sapiens
tgcatttctatgccatttt

SEQ ID NO: 2906737 - DNA, 18 bp, Homo sapiens
tgcatttgatttgtttag

SEQ ID NO: 2906738 - DNA, 17 bp, Homo sapiens
tgcatttgtaccttatt

SEQ ID NO: 2906739 - DNA, 18 bp, Homo sapiens
tgcatttgtgctagaaat

SEQ ID NO: 2906740 - DNA, 23 bp, Homo sapiens
tgcattttggagagtttcctgaa

SEQ ID NO: 2906741 - DNA, 16 bp, Homo sapiens
tgcattttgtgtacag

SEQ ID NO: 2906742 - DNA, 13 bp, Homo sapiens
tgcattttgtttg

SEQ ID NO: 2906743 - DNA, 14 bp, Homo sapiens
tgcatttttctgca

SEQ ID NO: 2906744 - DNA, 21 bp, Homo sapiens
tgcatttttttcattactgtt

SEQ ID NO: 2906745 - DNA, 20 bp, Homo sapiens
tgccaaaaaaagacagggct

SEQ ID NO: 2906746 - DNA, 19 bp, Homo sapiens
tgccaaaaaggatacataa

SEQ ID NO: 2906747 - DNA, 19 bp, Homo sapiens
tgccaaaacatttatgaca

SEQ ID NO: 2906748 - DNA, 17 bp, Homo sapiens
tgccaaatataaataaa

SEQ ID NO: 2906749 - DNA, 18 bp, Homo sapiens
tgccaaatataaataaaa

SEQ ID NO: 2906750 - DNA, 18 bp, Homo sapiens
tgccaaattgattgtcat

SEQ ID NO: 2906751 - DNA, 18 bp, Homo sapiens
tgccaacaagaatgcatt

SEQ ID NO: 2906752 - DNA, 19 bp, Homo sapiens
tgccaaccccacccagctc

SEQ ID NO: 2906753 - DNA, 21 bp, Homo sapiens
tgccaaccccacccagctcca

SEQ ID NO: 2906754 - DNA, 14 bp, Homo sapiens
tgccaactgtggct

SEQ ID NO: 2906755 - DNA, 17 bp, Homo sapiens
tgccaactgtggctggt

SEQ ID NO: 2906756 - DNA, 16 bp, Homo sapiens
tgccaagaaaatgaag

SEQ ID NO: 2906757 - DNA, 19 bp, Homo sapiens
tgccaagaaatcgccttat

SEQ ID NO: 2906758 - DNA, 23 bp, Homo sapiens
tgccaagcaaggaaaacttattt

SEQ ID NO: 2906759 - DNA, 15 bp, Homo sapiens
tgccaagcagtgcac

SEQ ID NO: 2906760 - DNA, 21 bp, Homo sapiens
tgccaagggctttgttttgca

SEQ ID NO: 2906761 - DNA, 18 bp, Homo sapiens
tgccaagtcctgcctttg

SEQ ID NO: 2906762 - DNA, 19 bp, Homo sapiens
tgccaatattaaatctgct

SEQ ID NO: 2906763 - DNA, 21 bp, Homo sapiens
tgccaatattaaatctgctgg

SEQ ID NO: 2906764 - DNA, 16 bp, Homo sapiens
tgccaatctgtacaaa

SEQ ID NO: 2906765 - DNA, 22 bp, Homo sapiens
tgccaatgttgtgtgttgcact

SEQ ID NO: 2906766 - DNA, 17 bp, Homo sapiens
tgccaatttttgccttc

SEQ ID NO: 2906767 - DNA, 18 bp, Homo sapiens
tgccacaacgcctggcta

SEQ ID NO: 2906768 - DNA, 18 bp, Homo sapiens
tgccacacattgtgcttg

SEQ ID NO: 2906769 - DNA, 18 bp, Homo sapiens
tgccacagagtgtagcca

SEQ ID NO: 2906770 - DNA, 16 bp, Homo sapiens
tgccacatcttaaact

SEQ ID NO: 2906771 - DNA, 15 bp, Homo sapiens
tgccacattagaact

SEQ ID NO: 2906772 - DNA, 18 bp, Homo sapiens
tgccaccactataaaatg

SEQ ID NO: 2906773 - DNA, 16 bp, Homo sapiens
tgccacccacctccct

SEQ ID NO: 2906774 - DNA, 20 bp, Homo sapiens
tgccacccacctccctgcct

SEQ ID NO: 2906775 - DNA, 21 bp, Homo sapiens
tgccacccacctccctgcctc

SEQ ID NO: 2906776 - DNA, 22 bp, Homo sapiens
tgccacccacctccctgcctcc

SEQ ID NO: 2906777 - DNA, 22 bp, Homo sapiens
tgccacccccagccctggcccc

SEQ ID NO: 2906778 - DNA, 15 bp, Homo sapiens
tgccaccgactgccc

SEQ ID NO: 2906779 - DNA, 21 bp, Homo sapiens
tgccacctcccctatccaccc

SEQ ID NO: 2906780 - DNA, 22 bp, Homo sapiens
tgccacctcccctatccaccca

SEQ ID NO: 2906781 - DNA, 23 bp, Homo sapiens
tgccactaagagattgcacagtc

SEQ ID NO: 2906782 - DNA, 17 bp, Homo sapiens
tgccactcctccctccg

SEQ ID NO: 2906783 - DNA, 12 bp, Homo sapiens
tgccactctgct

SEQ ID NO: 2906784 - DNA, 20 bp, Homo sapiens
tgccactctgctgcctgtac

SEQ ID NO: 2906785 - DNA, 16 bp, Homo sapiens
tgccactgcactccag

SEQ ID NO: 2906786 - DNA, 20 bp, Homo sapiens
tgccactggcaaatgtaact

SEQ ID NO: 2906787 - DNA, 19 bp, Homo sapiens
tgccactggggaaaactcc

SEQ ID NO: 2906788 - DNA, 13 bp, Homo sapiens
tgccactttttca

SEQ ID NO: 2906789 - DNA, 13 bp, Homo sapiens
tgccagaaggaag

SEQ ID NO: 2906790 - DNA, 18 bp, Homo sapiens
tggagttttttgtaccaa

SEQ ID NO: 2906791 - DNA, 15 bp, Homo sapiens
tggataaaaaagaaa

SEQ ID NO: 2906792 - DNA, 16 bp, Homo sapiens
tggataaaaaagaaaa

SEQ ID NO: 2906793 - DNA, 17 bp, Homo sapiens
tggataaaaaagaaaac

SEQ ID NO: 2906794 - DNA, 14 bp, Homo sapiens
tggataaactgagc

SEQ ID NO: 2906795 - DNA, 15 bp, Homo sapiens
tggataaactgagcc

SEQ ID NO: 2906796 - DNA, 16 bp, Homo sapiens
tggataaactgagcct

SEQ ID NO: 2906797 - DNA, 15 bp, Homo sapiens
tggataaatttgaac

SEQ ID NO: 2906798 - DNA, 14 bp, Homo sapiens
tggataaccaggct

SEQ ID NO: 2906799 - DNA, 21 bp, Homo sapiens
tggataaccaggctgggctca

SEQ ID NO: 2906800 - DNA, 16 bp, Homo sapiens
tggataataaaaattg

SEQ ID NO: 2906801 - DNA, 19 bp, Homo sapiens
tggataatcttaaattttg

SEQ ID NO: 2906802 - DNA, 18 bp, Homo sapiens
tggataatgctgttgcct

SEQ ID NO: 2906803 - DNA, 18 bp, Homo sapiens
tggatacagcagtagaca

SEQ ID NO: 2906804 - DNA, 18 bp, Homo sapiens
tggatacatacaccagca

SEQ ID NO: 2906805 - DNA, 17 bp, Homo sapiens
tggataccagctcaggg

SEQ ID NO: 2906806 - DNA, 18 bp, Homo sapiens
tggataccagctcagggg

SEQ ID NO: 2906807 - DNA, 12 bp, Homo sapiens
tggatagccttg

SEQ ID NO: 2906808 - DNA, 18 bp, Homo sapiens
tggatagccttgaaaaca

SEQ ID NO: 2906809 - DNA, 19 bp, Homo sapiens
tggatataaattaattgtg

SEQ ID NO: 2906810 - DNA, 22 bp, Homo sapiens
tggatcccgttcagaaaaccac

SEQ ID NO: 2906811 - DNA, 18 bp, Homo sapiens
tggatcctcagttctcaa

SEQ ID NO: 2906812 - DNA, 19 bp, Homo sapiens
tggatcctgggctgggtgg

SEQ ID NO: 2906813 - DNA, 11 bp, Homo sapiens
tggatctattt

SEQ ID NO: 2906814 - DNA, 15 bp, Homo sapiens
tggatctggggactg

SEQ ID NO: 2906815 - DNA, 19 bp, Homo sapiens
tggatcttttctaaatgtt

SEQ ID NO: 2906816 - DNA, 17 bp, Homo sapiens
tggatgagccctcagaa

SEQ ID NO: 2906817 - DNA, 16 bp, Homo sapiens
tggatgatacagtgtt

SEQ ID NO: 2906818 - DNA, 20 bp, Homo sapiens
tggatgatggtcttcagcct

SEQ ID NO: 2906819 - DNA, 17 bp, Homo sapiens
tggatgatgtttcgtga

SEQ ID NO: 2906820 - DNA, 21 bp, Homo sapiens
tggatgccaatattaaatctg

SEQ ID NO: 2906821 - DNA, 18 bp, Homo sapiens
tggatgcggccattcaag

SEQ ID NO: 2906822 - DNA, 16 bp, Homo sapiens
tggatgctctttcaat

SEQ ID NO: 2906823 - DNA, 16 bp, Homo sapiens
tggatgcttagaggga

SEQ ID NO: 2906824 - DNA, 21 bp, Homo sapiens
tggatgcttagagggatttct

SEQ ID NO: 2906825 - DNA, 15 bp, Homo sapiens
tggatgggaatttgt

SEQ ID NO: 2906826 - DNA, 17 bp, Homo sapiens
tggatgggaatttgtca

SEQ ID NO: 2906827 - DNA, 14 bp, Homo sapiens
tggatggtgacttt

SEQ ID NO: 2906828 - DNA, 18 bp, Homo sapiens
tggatggtgacttttgaa

SEQ ID NO: 2906829 - DNA, 16 bp, Homo sapiens
tggatgtctgaacttt

SEQ ID NO: 2906830 - DNA, 13 bp, Homo sapiens
tggatgtgagcag

SEQ ID NO: 2906831 - DNA, 16 bp, Homo sapiens
tggatgtgttgcccct

SEQ ID NO: 2906832 - DNA, 15 bp, Homo sapiens
tggattaaacttatg

SEQ ID NO: 2906833 - DNA, 17 bp, Homo sapiens
tggattaaacttatgaa

SEQ ID NO: 2906834 - DNA, 17 bp, Homo sapiens
tggattagcctttgaca

SEQ ID NO: 2906835 - DNA, 22 bp, Homo sapiens
tggattagtgaactaagttatt

SEQ ID NO: 2906836 - DNA, 14 bp, Homo sapiens
tggattccaaacca

SEQ ID NO: 2906837 - DNA, 19 bp, Homo sapiens
tggattccccatctcaggc

SEQ ID NO: 2906838 - DNA, 19 bp, Homo sapiens
tggattctccctgggcctc

SEQ ID NO: 2906839 - DNA, 22 bp, Homo sapiens
tggattctcttagctactgtat

SEQ ID NO: 2906840 - DNA, 15 bp, Homo sapiens
tggatttccactgct

SEQ ID NO: 2906841 - DNA, 20 bp, Homo sapiens
tggatttccttctaacatgt

SEQ ID NO: 2906842 - DNA, 14 bp, Homo sapiens
tggatttcttttgt

SEQ ID NO: 2906843 - DNA, 14 bp, Homo sapiens
tggatttgtccaaa

SEQ ID NO: 2906844 - DNA, 21 bp, Homo sapiens
tggatttgtccaaacaggtgc

SEQ ID NO: 2906845 - DNA, 16 bp, Homo sapiens
tggatttttaattaaa

SEQ ID NO: 2906846 - DNA, 19 bp, Homo sapiens
tggatttttaattaaaaac

SEQ ID NO: 2906847 - DNA, 22 bp, Homo sapiens
tggatttttttgtcattaaaat

SEQ ID NO: 2906848 - DNA, 21 bp, Homo sapiens
tggcaaaaggatctttgtggc

SEQ ID NO: 2906849 - DNA, 14 bp, Homo sapiens
tggcaaacatgtgc

SEQ ID NO: 2906850 - DNA, 16 bp, Homo sapiens
tggcaaacgggcttga

SEQ ID NO: 2906851 - DNA, 19 bp, Homo sapiens
tggcaacactgaaggaaca

SEQ ID NO: 2906852 - DNA, 20 bp, Homo sapiens
tggcaacagaaaacaattgt

SEQ ID NO: 2906853 - DNA, 18 bp, Homo sapiens
tggcaacagatctggaac

SEQ ID NO: 2906854 - DNA, 22 bp, Homo sapiens
tggcaacagatctggaacctca

SEQ ID NO: 2906855 - DNA, 16 bp, Homo sapiens
tggcaacattcattgc

SEQ ID NO: 2906856 - DNA, 16 bp, Homo sapiens
tggcaacattccaaga

SEQ ID NO: 2906857 - DNA, 16 bp, Homo sapiens
tggcaagactgtctta

SEQ ID NO: 2906858 - DNA, 11 bp, Homo sapiens
tggcaaggaaa

SEQ ID NO: 2906859 - DNA, 16 bp, Homo sapiens
tggcaaggaaaaacag

SEQ ID NO: 2906860 - DNA, 19 bp, Homo sapiens
tggcaatgccatcatctcc

SEQ ID NO: 2906861 - DNA, 20 bp, Homo sapiens
tggcacatagtgggccttca

SEQ ID NO: 2906862 - DNA, 19 bp, Homo sapiens
tggcacatcctatgcaata

SEQ ID NO: 2906863 - DNA, 14 bp, Homo sapiens
tggcaccagacacc

SEQ ID NO: 2906864 - DNA, 16 bp, Homo sapiens
tggcaccagacaccca

SEQ ID NO: 2906865 - DNA, 20 bp, Homo sapiens
tggcaccagacacccaggac

SEQ ID NO: 2906866 - DNA, 21 bp, Homo sapiens
tggcaccagacacccaggact

SEQ ID NO: 2906867 - DNA, 23 bp, Homo sapiens
tggcaccagacacccaggactta

SEQ ID NO: 2906868 - DNA, 23 bp, Homo sapiens
tggcaccgcctccccacctccag

SEQ ID NO: 2906869 - DNA, 16 bp, Homo sapiens
tggcacgatctcagct

SEQ ID NO: 2906870 - DNA, 18 bp, Homo sapiens
tggcacgatctcagctca

SEQ ID NO: 2906871 - DNA, 22 bp, Homo sapiens
tggcacgcacctgtagtcccag

SEQ ID NO: 2906872 - DNA, 23 bp, Homo sapiens
tggcacgcacctgtagtcccagc

SEQ ID NO: 2906873 - DNA, 12 bp, Homo sapiens
tggcactaggga

SEQ ID NO: 2906874 - DNA, 15 bp, Homo sapiens
tggcactatttttat

SEQ ID NO: 2906875 - DNA, 15 bp, Homo sapiens
tggcactccctccag

SEQ ID NO: 2906876 - DNA, 20 bp, Homo sapiens
tggcactccctccagcacaa

SEQ ID NO: 2906877 - DNA, 14 bp, Homo sapiens
tggcactttagtga

SEQ ID NO: 2906878 - DNA, 19 bp, Homo sapiens
tggcagaactgctggggct

SEQ ID NO: 2906879 - DNA, 15 bp, Homo sapiens
tggcagactgtgtaa

SEQ ID NO: 2906880 - DNA, 13 bp, Homo sapiens
tggcagagcttct

SEQ ID NO: 2906881 - DNA, 17 bp, Homo sapiens
tggcagagtttgtgtgt

SEQ ID NO: 2906882 - DNA, 20 bp, Homo sapiens
tggcagcagagtgtggcctt

SEQ ID NO: 2906883 - DNA, 15 bp, Homo sapiens
tggcagccacacgca

SEQ ID NO: 2906884 - DNA, 15 bp, Homo sapiens
tggcagccccagcac

SEQ ID NO: 2906885 - DNA, 15 bp, Homo sapiens
tggcagcctgcacct

SEQ ID NO: 2906886 - DNA, 22 bp, Homo sapiens
tggcagctctggacagccccac

SEQ ID NO: 2906887 - DNA, 23 bp, Homo sapiens
tggcagctgcccctcctggagca

SEQ ID NO: 2906888 - DNA, 20 bp, Homo sapiens
tggcagctgcccctggcacc

SEQ ID NO: 2906889 - DNA, 13 bp, Homo sapiens
tggcagctgggcc

SEQ ID NO: 2906890 - DNA, 12 bp, Homo sapiens
tggcaggaaggc

SEQ ID NO: 2906891 - DNA, 15 bp, Homo sapiens
tggcaggaaggcttg

SEQ ID NO: 2906892 - DNA, 12 bp, Homo sapiens
tggcaggatcca

SEQ ID NO: 2906893 - DNA, 20 bp, Homo sapiens
tggcaggcaggctcccaggg

SEQ ID NO: 2906894 - DNA, 18 bp, Homo sapiens
tggcaggcggggggggcg

SEQ ID NO: 2906895 - DNA, 14 bp, Homo sapiens
tggcagggcctagc

SEQ ID NO: 2906896 - DNA, 21 bp, Homo sapiens
tggcagggggtgaaggcagga

SEQ ID NO: 2906897 - DNA, 15 bp, Homo sapiens
tggcaggtcactgtc

SEQ ID NO: 2906898 - DNA, 22 bp, Homo sapiens
tggcaggtcactgtcactgccg

SEQ ID NO: 2906899 - DNA, 14 bp, Homo sapiens
tggcagtgatgaat

SEQ ID NO: 2906900 - DNA, 11 bp, Homo sapiens
tggcagtgttt

SEQ ID NO: 2906901 - DNA, 18 bp, Homo sapiens
tggcagtgttttgagaac

SEQ ID NO: 2906902 - DNA, 20 bp, Homo sapiens
tggcagttggaggacacagt

SEQ ID NO: 2906903 - DNA, 21 bp, Homo sapiens
tggcagttttgacatcagcca

SEQ ID NO: 2906904 - DNA, 16 bp, Homo sapiens
tggcatatagtgccct

SEQ ID NO: 2906905 - DNA, 21 bp, Homo sapiens
tggcatccagagtccctgcct

SEQ ID NO: 2906906 - DNA, 20 bp, Homo sapiens
tggcatccagggctgccagg

SEQ ID NO: 2906907 - DNA, 22 bp, Homo sapiens
tggcatccagggctgccaggag

SEQ ID NO: 2906908 - DNA, 13 bp, Homo sapiens
tggcatcctgtga

SEQ ID NO: 2906909 - DNA, 14 bp, Homo sapiens
tggcatctgtgtgc

SEQ ID NO: 2906910 - DNA, 23 bp, Homo sapiens
tggcatcttcgtcttcactctta

SEQ ID NO: 2906911 - DNA, 18 bp, Homo sapiens
tggcatggaaggggcttc

SEQ ID NO: 2906912 - DNA, 23 bp, Homo sapiens
tggcatgtgggttgtgatattga

SEQ ID NO: 2906913 - DNA, 12 bp, Homo sapiens
tggcatgtttaa

SEQ ID NO: 2906914 - DNA, 17 bp, Homo sapiens
tggcatgtttaattgtg

SEQ ID NO: 2906915 - DNA, 16 bp, Homo sapiens
tggcattctacacctg

SEQ ID NO: 2906916 - DNA, 14 bp, Homo sapiens
tggcattgatctta

SEQ ID NO: 2906917 - DNA, 21 bp, Homo sapiens
tggcatttcaattcctggccc

SEQ ID NO: 2906918 - DNA, 14 bp, Homo sapiens
tggcatttgaacta

SEQ ID NO: 2906919 - DNA, 18 bp, Homo sapiens
tggcatttgctggcctgg

SEQ ID NO: 2906920 - DNA, 17 bp, Homo sapiens
tggcatttttagctcct

SEQ ID NO: 2906921 - DNA, 14 bp, Homo sapiens
tggccaaagagcct

SEQ ID NO: 2906922 - DNA, 11 bp, Homo sapiens
tggggctgaac

SEQ ID NO: 2906923 - DNA, 14 bp, Homo sapiens
tggggctgctcctc

SEQ ID NO: 2906924 - DNA, 13 bp, Homo sapiens
tggggctggtgga

SEQ ID NO: 2906925 - DNA, 17 bp, Homo sapiens
tggggcttgaatttgca

SEQ ID NO: 2906926 - DNA, 18 bp, Homo sapiens
tggggcttgaatttgcat

SEQ ID NO: 2906927 - DNA, 22 bp, Homo sapiens
tggggcttgaatttgcatgtct

SEQ ID NO: 2906928 - DNA, 23 bp, Homo sapiens
tggggctttcgtccacagcttcc

SEQ ID NO: 2906929 - DNA, 12 bp, Homo sapiens
tgggggaaaaag

SEQ ID NO: 2906930 - DNA, 21 bp, Homo sapiens
tgggggacatgctaaataact

SEQ ID NO: 2906931 - DNA, 23 bp, Homo sapiens
tgggggacatgctaaataactat

SEQ ID NO: 2906932 - DNA, 17 bp, Homo sapiens
tgggggacgtttctcat

SEQ ID NO: 2906933 - DNA, 18 bp, Homo sapiens
tgggggagattgaacttt

SEQ ID NO: 2906934 - DNA, 12 bp, Homo sapiens
tgggggagccag

SEQ ID NO: 2906935 - DNA, 21 bp, Homo sapiens
tgggggagggactgctgaccc

SEQ ID NO: 2906936 - DNA, 14 bp, Homo sapiens
tgggggccaggcct

SEQ ID NO: 2906937 - DNA, 20 bp, Homo sapiens
tgggggctagaaaaaacata

SEQ ID NO: 2906938 - DNA, 16 bp, Homo sapiens
tgggggctggaggtgc

SEQ ID NO: 2906939 - DNA, 21 bp, Homo sapiens
tgggggctgtctttgcagggc

SEQ ID NO: 2906940 - DNA, 20 bp, Homo sapiens
tggggggaaataccttgagc

SEQ ID NO: 2906941 - DNA, 19 bp, Homo sapiens
tgggggggagaaggcctcc

SEQ ID NO: 2906942 - DNA, 17 bp, Homo sapiens
tgggggggctgcctttg

SEQ ID NO: 2906943 - DNA, 19 bp, Homo sapiens
tgggggggtgttaatttat

SEQ ID NO: 2906944 - DNA, 20 bp, Homo sapiens
tgggggtaaaaaatatagcc

SEQ ID NO: 2906945 - DNA, 14 bp, Homo sapiens
tgggggtgccagga

SEQ ID NO: 2906946 - DNA, 16 bp, Homo sapiens
tgggggttcaggcccg

SEQ ID NO: 2906947 - DNA, 21 bp, Homo sapiens
tggggtaagcggaataaacta

SEQ ID NO: 2906948 - DNA, 22 bp, Homo sapiens
tggggtaccagccactggaggg

SEQ ID NO: 2906949 - DNA, 22 bp, Homo sapiens
tggggtcaagctgagctggctt

SEQ ID NO: 2906950 - DNA, 18 bp, Homo sapiens
tggggtcatgccctcctc

SEQ ID NO: 2906951 - DNA, 17 bp, Homo sapiens
tggggtcccactgctcg

SEQ ID NO: 2906952 - DNA, 21 bp, Homo sapiens
tggggtcctagcccagtgctt

SEQ ID NO: 2906953 - DNA, 16 bp, Homo sapiens
tggggtcctggccatc

SEQ ID NO: 2906954 - DNA, 19 bp, Homo sapiens
tggggtctccctctcctgc

SEQ ID NO: 2906955 - DNA, 21 bp, Homo sapiens
tggggtctccctctcctgcct

SEQ ID NO: 2906956 - DNA, 20 bp, Homo sapiens
tggggtgaacagctggtgcc

SEQ ID NO: 2906957 - DNA, 20 bp, Homo sapiens
tggggtggcgcgcctgcctt

SEQ ID NO: 2906958 - DNA, 15 bp, Homo sapiens
tggggtgggggccag

SEQ ID NO: 2906959 - DNA, 16 bp, Homo sapiens
tggggtgggggtgggc

SEQ ID NO: 2906960 - DNA, 14 bp, Homo sapiens
tggggttcagcccc

SEQ ID NO: 2906961 - DNA, 17 bp, Homo sapiens
tggggttcagcccctcc

SEQ ID NO: 2906962 - DNA, 19 bp, Homo sapiens
tggggttcataggggcagg

SEQ ID NO: 2906963 - DNA, 14 bp, Homo sapiens
tggggttgtgttgt

SEQ ID NO: 2906964 - DNA, 14 bp, Homo sapiens
tgggtaaaattaga

SEQ ID NO: 2906965 - DNA, 15 bp, Homo sapiens
tgggtaaaattagat

SEQ ID NO: 2906966 - DNA, 19 bp, Homo sapiens
tgggtacttcttgaaggtg

SEQ ID NO: 2906967 - DNA, 22 bp, Homo sapiens
tgggtagaagccacccttccct

SEQ ID NO: 2906968 - DNA, 23 bp, Homo sapiens
tgggtagaagccacccttccctg

SEQ ID NO: 2906969 - DNA, 16 bp, Homo sapiens
tgggtaggccccacaa

SEQ ID NO: 2906970 - DNA, 20 bp, Homo sapiens
tgggtatcaagacatagcat

SEQ ID NO: 2906971 - DNA, 19 bp, Homo sapiens
tgggtcacacacggaggca

SEQ ID NO: 2906972 - DNA, 14 bp, Homo sapiens
tgggtcacaggaag

SEQ ID NO: 2906973 - DNA, 15 bp, Homo sapiens
tgggtcacaggaagg

SEQ ID NO: 2906974 - DNA, 23 bp, Homo sapiens
tgggtcagatttatttgtttgat

SEQ ID NO: 2906975 - DNA, 13 bp, Homo sapiens
tgggtcattttta

SEQ ID NO: 2906976 - DNA, 15 bp, Homo sapiens
tgggtcctgcctgca

SEQ ID NO: 2906977 - DNA, 15 bp, Homo sapiens
tgggtcctgggcagg

SEQ ID NO: 2906978 - DNA, 19 bp, Homo sapiens
tgggtcgggagaggggacg

SEQ ID NO: 2906979 - DNA, 18 bp, Homo sapiens
tgggtctattccagctca

SEQ ID NO: 2906980 - DNA, 14 bp, Homo sapiens
tgggtctctggaag

SEQ ID NO: 2906981 - DNA, 20 bp, Homo sapiens
tgggtcttgccatgtgctgg

SEQ ID NO: 2906982 - DNA, 17 bp, Homo sapiens
tgggtctttttctcttc

SEQ ID NO: 2906983 - DNA, 14 bp, Homo sapiens
tgggtgaaggctgg

SEQ ID NO: 2906984 - DNA, 15 bp, Homo sapiens
tgggtgaaggctggc

SEQ ID NO: 2906985 - DNA, 13 bp, Homo sapiens
tgggtgccctgaa

SEQ ID NO: 2906986 - DNA, 14 bp, Homo sapiens
tgggtggagaagcc

SEQ ID NO: 2906987 - DNA, 17 bp, Homo sapiens
tgggtggagaagccatt

SEQ ID NO: 2906988 - DNA, 21 bp, Homo sapiens
tgggtggggctgctcctccag

SEQ ID NO: 2906989 - DNA, 21 bp, Homo sapiens
tgggtggggggcttcatacac

SEQ ID NO: 2906990 - DNA, 22 bp, Homo sapiens
tgggtggtgtcctgaagctgct

SEQ ID NO: 2906991 - DNA, 21 bp, Homo sapiens
tgggtggtttgtgagccttgc

SEQ ID NO: 2906992 - DNA, 19 bp, Homo sapiens
tgggtggtttttattttta

SEQ ID NO: 2906993 - DNA, 15 bp, Homo sapiens
tgggtgtttcagttt

SEQ ID NO: 2906994 - DNA, 23 bp, Homo sapiens
tgggttacagtatgcttgctcta

SEQ ID NO: 2906995 - DNA, 22 bp, Homo sapiens
tgggttctgcctgccagctgca

SEQ ID NO: 2906996 - DNA, 15 bp, Homo sapiens
tgggttgctaactga

SEQ ID NO: 2906997 - DNA, 17 bp, Homo sapiens
tgggttgctaactgaac

SEQ ID NO: 2906998 - DNA, 20 bp, Homo sapiens
tgggtttacaacaaacactg

SEQ ID NO: 2906999 - DNA, 14 bp, Homo sapiens
tgggtttggcccct

SEQ ID NO: 2907000 - DNA, 14 bp, Homo sapiens
tgggtttttaactc

SEQ ID NO: 2907001 - DNA, 22 bp, Homo sapiens
tggtaaaatagtggatctcagt

SEQ ID NO: 2907002 - DNA, 23 bp, Homo sapiens
tggtaaaatagtggatctcagtt

SEQ ID NO: 2907003 - DNA, 21 bp, Homo sapiens
tggtaaagaaaagcctcagct

SEQ ID NO: 2907004 - DNA, 17 bp, Homo sapiens
tggtaaagactggcttt

SEQ ID NO: 2907005 - DNA, 20 bp, Homo sapiens
tggtaaatttccccaacagt

SEQ ID NO: 2907006 - DNA, 23 bp, Homo sapiens
tggtaaatttccccaacagtgtg

SEQ ID NO: 2907007 - DNA, 13 bp, Homo sapiens
tggtaacagctat

SEQ ID NO: 2907008 - DNA, 13 bp, Homo sapiens
tggtaagcagagg

SEQ ID NO: 2907009 - DNA, 16 bp, Homo sapiens
tggtaagcagaggctt

SEQ ID NO: 2907010 - DNA, 14 bp, Homo sapiens
tggtaatatatata

SEQ ID NO: 2907011 - DNA, 15 bp, Homo sapiens
tggtacaacggaggc

SEQ ID NO: 2907012 - DNA, 15 bp, Homo sapiens
tggtacaggtatatt

SEQ ID NO: 2907013 - DNA, 15 bp, Homo sapiens
tggtaccagataaaa

SEQ ID NO: 2907014 - DNA, 20 bp, Homo sapiens
tggtacgtgaccctctgctg

SEQ ID NO: 2907015 - DNA, 17 bp, Homo sapiens
tggtactccctctcagg

SEQ ID NO: 2907016 - DNA, 16 bp, Homo sapiens
tggtagaaaatgcacc

SEQ ID NO: 2907017 - DNA, 14 bp, Homo sapiens
tggtagagtttatt

SEQ ID NO: 2907018 - DNA, 21 bp, Homo sapiens
tggtagatttcctcctcccag

SEQ ID NO: 2907019 - DNA, 20 bp, Homo sapiens
tggtagccatcaagcacttc

SEQ ID NO: 2907020 - DNA, 14 bp, Homo sapiens
tggtagctccagcg

SEQ ID NO: 2907021 - DNA, 18 bp, Homo sapiens
tggtagctccagcgatgg

SEQ ID NO: 2907022 - DNA, 22 bp, Homo sapiens
tggtagctgaaaaaactatatt

SEQ ID NO: 2907023 - DNA, 21 bp, Homo sapiens
tggtagctgaggggacgggca

SEQ ID NO: 2907024 - DNA, 16 bp, Homo sapiens
tggtaggcatttccta

SEQ ID NO: 2907025 - DNA, 15 bp, Homo sapiens
tggtaggtaaatcta

SEQ ID NO: 2907026 - DNA, 22 bp, Homo sapiens
tggtaggtactttttgtgaaga

SEQ ID NO: 2907027 - DNA, 14 bp, Homo sapiens
tggtagtaaaacac

SEQ ID NO: 2907028 - DNA, 19 bp, Homo sapiens
tggtagtaaaacacagagg

SEQ ID NO: 2907029 - DNA, 15 bp, Homo sapiens
tggtataagtaactt

SEQ ID NO: 2907030 - DNA, 13 bp, Homo sapiens
tggtatatataca

SEQ ID NO: 2907031 - DNA, 14 bp, Homo sapiens
tggtatatatacat

SEQ ID NO: 2907032 - DNA, 22 bp, Homo sapiens
tggtatctagacccatcttctt

SEQ ID NO: 2907033 - DNA, 14 bp, Homo sapiens
tggtatgtgccagg

SEQ ID NO: 2907034 - DNA, 17 bp, Homo sapiens
tggtattgtgagatgat

SEQ ID NO: 2907035 - DNA, 22 bp, Homo sapiens
tggtatttgtttgtagctttcc

SEQ ID NO: 2907036 - DNA, 16 bp, Homo sapiens
tggtcaacctcctgga

SEQ ID NO: 2907037 - DNA, 12 bp, Homo sapiens
tggtcacatgga

SEQ ID NO: 2907038 - DNA, 13 bp, Homo sapiens
tggtcacatggag

SEQ ID NO: 2907039 - DNA, 16 bp, Homo sapiens
tggtcactctgccctc

SEQ ID NO: 2907040 - DNA, 15 bp, Homo sapiens
tggtcagccctaggg

SEQ ID NO: 2907041 - DNA, 19 bp, Homo sapiens
tggtcagccctagggtgga

SEQ ID NO: 2907042 - DNA, 20 bp, Homo sapiens
tggtcatgaattcatactct

SEQ ID NO: 2907043 - DNA, 16 bp, Homo sapiens
tggtccaaaaaaagga

SEQ ID NO: 2907044 - DNA, 18 bp, Homo sapiens
tggtccaaaaaaaggaaa

SEQ ID NO: 2907045 - DNA, 19 bp, Homo sapiens
tggtccaaaaaaaggaaaa

SEQ ID NO: 2907046 - DNA, 20 bp, Homo sapiens
tggtccaaaaaaaggaaaaa

SEQ ID NO: 2907047 - DNA, 21 bp, Homo sapiens
tggtccaaaaaaaggaaaaat

SEQ ID NO: 2907048 - DNA, 14 bp, Homo sapiens
tggtccacagggca

SEQ ID NO: 2907049 - DNA, 21 bp, Homo sapiens
tggtccacagggcacctgcca

SEQ ID NO: 2907050 - DNA, 12 bp, Homo sapiens
tggtccaccctt

SEQ ID NO: 2907051 - DNA, 16 bp, Homo sapiens
tggtccaggagaaggc

SEQ ID NO: 2907052 - DNA, 16 bp, Homo sapiens
tggtccaggccctgtg

SEQ ID NO: 2907053 - DNA, 20 bp, Homo sapiens
tggtcccacccaggaaggga

SEQ ID NO: 2907054 - DNA, 22 bp, Homo sapiens
tggtccctccagaaccaccccg

SEQ ID NO: 2907055 - DNA, 14 bp, Homo sapiens
tggtccctgggagg

SEQ ID NO: 2907056 - DNA, 18 bp, Homo sapiens
tggtccctggtccttcac

SEQ ID NO: 2907057 - DNA, 20 bp, Homo sapiens
tggtcctatttttgtgaaga

SEQ ID NO: 2907058 - DNA, 16 bp, Homo sapiens
tggtgtttctccctct

SEQ ID NO: 2907059 - DNA, 20 bp, Homo sapiens
tggtgttttggggatgagag

SEQ ID NO: 2907060 - DNA, 15 bp, Homo sapiens
tggtgtttttacaga

SEQ ID NO: 2907061 - DNA, 16 bp, Homo sapiens
tggtgtttttcttgta

SEQ ID NO: 2907062 - DNA, 18 bp, Homo sapiens
tggtgtttttcttgtaaa

SEQ ID NO: 2907063 - DNA, 13 bp, Homo sapiens
tggttaagagtcc

SEQ ID NO: 2907064 - DNA, 15 bp, Homo sapiens
tggttataaaagtga

SEQ ID NO: 2907065 - DNA, 20 bp, Homo sapiens
tggttataaaagtgattgtt

SEQ ID NO: 2907066 - DNA, 14 bp, Homo sapiens
tggttatcttgtta

SEQ ID NO: 2907067 - DNA, 12 bp, Homo sapiens
tggttatgaact

SEQ ID NO: 2907068 - DNA, 22 bp, Homo sapiens
tggttatttagggaactgcttg

SEQ ID NO: 2907069 - DNA, 17 bp, Homo sapiens
tggttcactcttggagc

SEQ ID NO: 2907070 - DNA, 22 bp, Homo sapiens
tggttcactcttggagcctgca

SEQ ID NO: 2907071 - DNA, 14 bp, Homo sapiens
tggttcagtctaga

SEQ ID NO: 2907072 - DNA, 14 bp, Homo sapiens
tggttcattccaca

SEQ ID NO: 2907073 - DNA, 19 bp, Homo sapiens
tggttccagatacttcagc

SEQ ID NO: 2907074 - DNA, 22 bp, Homo sapiens
tggttctaaggacctgaaattc

SEQ ID NO: 2907075 - DNA, 14 bp, Homo sapiens
tggttctcaatgaa

SEQ ID NO: 2907076 - DNA, 15 bp, Homo sapiens
tggttctcaatgaaa

SEQ ID NO: 2907077 - DNA, 12 bp, Homo sapiens
tggttgaagaag

SEQ ID NO: 2907078 - DNA, 15 bp, Homo sapiens
tggttgatgtttaaa

SEQ ID NO: 2907079 - DNA, 20 bp, Homo sapiens
tggttgcacttatgatttca

SEQ ID NO: 2907080 - DNA, 22 bp, Homo sapiens
tggttgcagtctttcccccagg

SEQ ID NO: 2907081 - DNA, 22 bp, Homo sapiens
tggttgccagtagtaccttgtt

SEQ ID NO: 2907082 - DNA, 23 bp, Homo sapiens
tggttgccagtagtaccttgttt

SEQ ID NO: 2907083 - DNA, 13 bp, Homo sapiens
tggttgtatataa

SEQ ID NO: 2907084 - DNA, 17 bp, Homo sapiens
tggttgtatataaagtt

SEQ ID NO: 2907085 - DNA, 12 bp, Homo sapiens
tggttgtgtagg

SEQ ID NO: 2907086 - DNA, 15 bp, Homo sapiens
tggttgtttctctga

SEQ ID NO: 2907087 - DNA, 23 bp, Homo sapiens
tggtttaatgcaatagaagtgct

SEQ ID NO: 2907088 - DNA, 24 bp, Homo sapiens
tggtttataatttgatagatgttt

SEQ ID NO: 2907089 - DNA, 16 bp, Homo sapiens
tggtttatttgttgtt

SEQ ID NO: 2907090 - DNA, 21 bp, Homo sapiens
tggtttcctgcccagcctggg

SEQ ID NO: 2907091 - DNA, 11 bp, Homo sapiens
tggtttcttat

SEQ ID NO: 2907092 - DNA, 16 bp, Homo sapiens
tggtttcttattcaaa

SEQ ID NO: 2907093 - DNA, 16 bp, Homo sapiens
tggtttgggaaagatg

SEQ ID NO: 2907094 - DNA, 22 bp, Homo sapiens
tggtttgtgagccttgctgcca

SEQ ID NO: 2907095 - DNA, 11 bp, Homo sapiens
tggtttgtgtg

SEQ ID NO: 2907096 - DNA, 11 bp, Homo sapiens
tggttttacta

SEQ ID NO: 2907097 - DNA, 20 bp, Homo sapiens
tggttttcgtcatcttccct

SEQ ID NO: 2907098 - DNA, 22 bp, Homo sapiens
tggttttcgtcatcttccctgc

SEQ ID NO: 2907099 - DNA, 14 bp, Homo sapiens
tggttttcttaagg

SEQ ID NO: 2907100 - DNA, 11 bp, Homo sapiens
tggttttggaa

SEQ ID NO: 2907101 - DNA, 20 bp, Homo sapiens
tggtttttaaattttgtaat

SEQ ID NO: 2907102 - DNA, 14 bp, Homo sapiens
tggtttttgctctc

SEQ ID NO: 2907103 - DNA, 13 bp, Homo sapiens
tgtatacttaata

SEQ ID NO: 2907104 - DNA, 23 bp, Homo sapiens
tgtatacttaatactgaatttct

SEQ ID NO: 2907105 - DNA, 14 bp, Homo sapiens
tgtatagttcacgt

SEQ ID NO: 2907106 - DNA, 17 bp, Homo sapiens
tgtatagttttccctat

SEQ ID NO: 2907107 - DNA, 16 bp, Homo sapiens
tgtatataaagttttt

SEQ ID NO: 2907108 - DNA, 12 bp, Homo sapiens
tgtatataaata

SEQ ID NO: 2907109 - DNA, 19 bp, Homo sapiens
tgtatataaatgggaacat

SEQ ID NO: 2907110 - DNA, 20 bp, Homo sapiens
tgtatataaatgggaacatt

SEQ ID NO: 2907111 - DNA, 15 bp, Homo sapiens
tgtatatatatatat

SEQ ID NO: 2907112 - DNA, 21 bp, Homo sapiens
tgtatatatatgtgaggatgt

SEQ ID NO: 2907113 - DNA, 15 bp, Homo sapiens
tgtatatatgtattt

SEQ ID NO: 2907114 - DNA, 17 bp, Homo sapiens
tgtatatatgtatttct

SEQ ID NO: 2907115 - DNA, 15 bp, Homo sapiens
tgtatatatgtcaaa

SEQ ID NO: 2907116 - DNA, 19 bp, Homo sapiens
tgtatatatgtcaaattgt

SEQ ID NO: 2907117 - DNA, 14 bp, Homo sapiens
tgtatatatttaaa

SEQ ID NO: 2907118 - DNA, 15 bp, Homo sapiens
tgtatatgactgcat

SEQ ID NO: 2907119 - DNA, 17 bp, Homo sapiens
tgtatatgactgcattt

SEQ ID NO: 2907120 - DNA, 17 bp, Homo sapiens
tgtatatgattctctgt

SEQ ID NO: 2907121 - DNA, 18 bp, Homo sapiens
tgtatatgattctctgtg

SEQ ID NO: 2907122 - DNA, 20 bp, Homo sapiens
tgtatatggtatatatacat

SEQ ID NO: 2907123 - DNA, 22 bp, Homo sapiens
tgtatatggtattgtgagatga

SEQ ID NO: 2907124 - DNA, 14 bp, Homo sapiens
tgtatatgtgcttg

SEQ ID NO: 2907125 - DNA, 19 bp, Homo sapiens
tgtatatgtgcttgtgctc

SEQ ID NO: 2907126 - DNA, 16 bp, Homo sapiens
tgtatattaaggtgtg

SEQ ID NO: 2907127 - DNA, 20 bp, Homo sapiens
tgtatattacccaatggaaa

SEQ ID NO: 2907128 - DNA, 13 bp, Homo sapiens
tgtatatttaagg

SEQ ID NO: 2907129 - DNA, 15 bp, Homo sapiens
tgtatatttaaggta

SEQ ID NO: 2907130 - DNA, 14 bp, Homo sapiens
tgtatatttatgac

SEQ ID NO: 2907131 - DNA, 19 bp, Homo sapiens
tgtatcagaagagagggga

SEQ ID NO: 2907132 - DNA, 16 bp, Homo sapiens
tgtatcataattacca

SEQ ID NO: 2907133 - DNA, 19 bp, Homo sapiens
tgtatcataattaccaagt

SEQ ID NO: 2907134 - DNA, 22 bp, Homo sapiens
tgtatcatgtgctagattggag

SEQ ID NO: 2907135 - DNA, 17 bp, Homo sapiens
tgtatccattatcatgt

SEQ ID NO: 2907136 - DNA, 20 bp, Homo sapiens
tgtatccattatcatgtgta

SEQ ID NO: 2907137 - DNA, 14 bp, Homo sapiens
tgtatccatttaaa

SEQ ID NO: 2907138 - DNA, 18 bp, Homo sapiens
tgtatcccgggaaggacc

SEQ ID NO: 2907139 - DNA, 19 bp, Homo sapiens
tgtatcctccctggcagac

SEQ ID NO: 2907140 - DNA, 21 bp, Homo sapiens
tgtatcctttatttctgataa

SEQ ID NO: 2907141 - DNA, 20 bp, Homo sapiens
tgtatcgggaagatttctaa

SEQ ID NO: 2907142 - DNA, 15 bp, Homo sapiens
tgtatcgtatagctg

SEQ ID NO: 2907143 - DNA, 22 bp, Homo sapiens
tgtatcgtatagctgtattgaa

SEQ ID NO: 2907144 - DNA, 20 bp, Homo sapiens
tgtatctacatcttttttca

SEQ ID NO: 2907145 - DNA, 13 bp, Homo sapiens
tgtatctcttaaa

SEQ ID NO: 2907146 - DNA, 12 bp, Homo sapiens
tgtatctgtcta

SEQ ID NO: 2907147 - DNA, 14 bp, Homo sapiens
tgtatgaagtactt

SEQ ID NO: 2907148 - DNA, 21 bp, Homo sapiens
tgtatgaagtacttttaacgt

SEQ ID NO: 2907149 - DNA, 17 bp, Homo sapiens
tgtatgagaagtacttt

SEQ ID NO: 2907150 - DNA, 11 bp, Homo sapiens
tgtatgagaca

SEQ ID NO: 2907151 - DNA, 15 bp, Homo sapiens
tgtatgatttataaa

SEQ ID NO: 2907152 - DNA, 12 bp, Homo sapiens
tgtatgcagcta

SEQ ID NO: 2907153 - DNA, 18 bp, Homo sapiens
tgtatgcagctatctggt

SEQ ID NO: 2907154 - DNA, 16 bp, Homo sapiens
tgtatgccaagtgaga

SEQ ID NO: 2907155 - DNA, 14 bp, Homo sapiens
tgtatgctgatcat

SEQ ID NO: 2907156 - DNA, 19 bp, Homo sapiens
tgtatgcttcatacaggga

SEQ ID NO: 2907157 - DNA, 19 bp, Homo sapiens
tgtatggaatcccactgta

SEQ ID NO: 2907158 - DNA, 17 bp, Homo sapiens
tgtatggggaatctaag

SEQ ID NO: 2907159 - DNA, 23 bp, Homo sapiens
tgtatgggggagattgaactttc

SEQ ID NO: 2907160 - DNA, 23 bp, Homo sapiens
tgtatgtaaagttcctgctgtaa

SEQ ID NO: 2907161 - DNA, 14 bp, Homo sapiens
tgtatgtagaagca

SEQ ID NO: 2907162 - DNA, 11 bp, Homo sapiens
tgtatgtctgt

SEQ ID NO: 2907163 - DNA, 13 bp, Homo sapiens
tgtatgtctgtca

SEQ ID NO: 2907164 - DNA, 19 bp, Homo sapiens
tgtatgtcttggacactgt

SEQ ID NO: 2907165 - DNA, 17 bp, Homo sapiens
tgtcacatcaagcatca

SEQ ID NO: 2907166 - DNA, 21 bp, Homo sapiens
tgtcacatcacgaaggaaaac

SEQ ID NO: 2907167 - DNA, 21 bp, Homo sapiens
tgtcacatctatccacactgt

SEQ ID NO: 2907168 - DNA, 15 bp, Homo sapiens
tgtcaccaaggaaac

SEQ ID NO: 2907169 - DNA, 23 bp, Homo sapiens
tgtcaccaaggaaacgctacctc

SEQ ID NO: 2907170 - DNA, 23 bp, Homo sapiens
tgtcaccaccttcccagctctcc

SEQ ID NO: 2907171 - DNA, 23 bp, Homo sapiens
tgtcacccaaaccggcaggtgcg

SEQ ID NO: 2907172 - DNA, 13 bp, Homo sapiens
tgtcacccaaagc

SEQ ID NO: 2907173 - DNA, 18 bp, Homo sapiens
tgtcacccaaagcctgtc

SEQ ID NO: 2907174 - DNA, 22 bp, Homo sapiens
tgtcacccaaagcctgtcccag

SEQ ID NO: 2907175 - DNA, 21 bp, Homo sapiens
tgtcaccccagagccacacat

SEQ ID NO: 2907176 - DNA, 21 bp, Homo sapiens
tgtcaccctggccaccaccca

SEQ ID NO: 2907177 - DNA, 22 bp, Homo sapiens
tgtcacctttcttcttgtgtct

SEQ ID NO: 2907178 - DNA, 13 bp, Homo sapiens
tgtcaccttttct

SEQ ID NO: 2907179 - DNA, 16 bp, Homo sapiens
tgtcaccttttcttgc

SEQ ID NO: 2907180 - DNA, 20 bp, Homo sapiens
tgtcaccttttcttgcctga

SEQ ID NO: 2907181 - DNA, 14 bp, Homo sapiens
tgtcacgaatatgg

SEQ ID NO: 2907182 - DNA, 18 bp, Homo sapiens
tgtcacgaatatggacat

SEQ ID NO: 2907183 - DNA, 19 bp, Homo sapiens
tgtcacgaatatggacata

SEQ ID NO: 2907184 - DNA, 20 bp, Homo sapiens
tgtcactcaaggcggtgctt

SEQ ID NO: 2907185 - DNA, 12 bp, Homo sapiens
tgtcactcaggc

SEQ ID NO: 2907186 - DNA, 16 bp, Homo sapiens
tgtcactcattgctga

SEQ ID NO: 2907187 - DNA, 21 bp, Homo sapiens
tgtcactcattgctgagcctc

SEQ ID NO: 2907188 - DNA, 19 bp, Homo sapiens
tgtcactgccgacatccct

SEQ ID NO: 2907189 - DNA, 13 bp, Homo sapiens
tgtcactgctttt

SEQ ID NO: 2907190 - DNA, 18 bp, Homo sapiens
tgtcactgtacagttttg

SEQ ID NO: 2907191 - DNA, 13 bp, Homo sapiens
tgtcacttgcatg

SEQ ID NO: 2907192 - DNA, 22 bp, Homo sapiens
tgtcagagaagaaaaacgtgag

SEQ ID NO: 2907193 - DNA, 16 bp, Homo sapiens
tgtcagagcccagccc

SEQ ID NO: 2907194 - DNA, 20 bp, Homo sapiens
tgtcagagcccagcccagga

SEQ ID NO: 2907195 - DNA, 15 bp, Homo sapiens
tgtcagagcccaggg

SEQ ID NO: 2907196 - DNA, 15 bp, Homo sapiens
tgtcagatacaatgt

SEQ ID NO: 2907197 - DNA, 12 bp, Homo sapiens
tgtcagcatctg

SEQ ID NO: 2907198 - DNA, 13 bp, Homo sapiens
tgtcagcatctga

SEQ ID NO: 2907199 - DNA, 20 bp, Homo sapiens
tgtcagccaacattgccttg

SEQ ID NO: 2907200 - DNA, 13 bp, Homo sapiens
tgtcagccacctc

SEQ ID NO: 2907201 - DNA, 15 bp, Homo sapiens
tgtcagccacctccc

SEQ ID NO: 2907202 - DNA, 21 bp, Homo sapiens
tgtcagcgcctggcctaccca

SEQ ID NO: 2907203 - DNA, 20 bp, Homo sapiens
tgtcagcgttctaccaggca

SEQ ID NO: 2907204 - DNA, 17 bp, Homo sapiens
tgtcagctctcatctga

SEQ ID NO: 2907205 - DNA, 16 bp, Homo sapiens
tgtcagctgctgttga

SEQ ID NO: 2907206 - DNA, 22 bp, Homo sapiens
tgtcagctgctgttgaactttt

SEQ ID NO: 2907207 - DNA, 15 bp, Homo sapiens
tgtcaggccctctgc

SEQ ID NO: 2907208 - DNA, 16 bp, Homo sapiens
tgtcaggccctctgcc

SEQ ID NO: 2907209 - DNA, 17 bp, Homo sapiens
tgtcaggccctctgcct

SEQ ID NO: 2907210 - DNA, 18 bp, Homo sapiens
tgtcaggccctctgcctg

SEQ ID NO: 2907211 - DNA, 19 bp, Homo sapiens
tgtcaggccctctgcctgc

SEQ ID NO: 2907212 - DNA, 19 bp, Homo sapiens
tgtcagggagggccaggga

SEQ ID NO: 2907213 - DNA, 22 bp, Homo sapiens
tgtcaggggcggggagggtgac

SEQ ID NO: 2907214 - DNA, 16 bp, Homo sapiens
tgtcaggtcccagcga

SEQ ID NO: 2907215 - DNA, 20 bp, Homo sapiens
tgtcaggtcccagcgagcca

SEQ ID NO: 2907216 - DNA, 20 bp, Homo sapiens
tgtcagtactaaggtgactt

SEQ ID NO: 2907217 - DNA, 16 bp, Homo sapiens
tgtcagtcacagccac

SEQ ID NO: 2907218 - DNA, 20 bp, Homo sapiens
tgtcagtggggctctctgag

SEQ ID NO: 2907219 - DNA, 11 bp, Homo sapiens
tgtcagtgttg

SEQ ID NO: 2907220 - DNA, 23 bp, Homo sapiens
tgtcagtgttgcctcttgcaatg

SEQ ID NO: 2907221 - DNA, 19 bp, Homo sapiens
tgtcagtttcagatcctga

SEQ ID NO: 2907222 - DNA, 13 bp, Homo sapiens
tgtcataagcatt

SEQ ID NO: 2907223 - DNA, 23 bp, Homo sapiens
tgtcatagttctgagctgccagt

SEQ ID NO: 2907224 - DNA, 17 bp, Homo sapiens
tgtcatcaacattcttg

SEQ ID NO: 2907225 - DNA, 15 bp, Homo sapiens
tgtcatcagccacca

SEQ ID NO: 2907226 - DNA, 16 bp, Homo sapiens
tgtcatcagtaagtat

SEQ ID NO: 2907227 - DNA, 18 bp, Homo sapiens
tgtcatcgttccccaccc

SEQ ID NO: 2907228 - DNA, 18 bp, Homo sapiens
tgtcatctgcatgtctac

SEQ ID NO: 2907229 - DNA, 12 bp, Homo sapiens
tgtcatgtgtat

SEQ ID NO: 2907230 - DNA, 12 bp, Homo sapiens
tgtcattattcc

SEQ ID NO: 2907231 - DNA, 23 bp, Homo sapiens
tgtcattcccctcttttgtcttc

SEQ ID NO: 2907232 - DNA, 21 bp, Homo sapiens
tgtcatttactcaaaatctgt

SEQ ID NO: 2907233 - DNA, 13 bp, Homo sapiens
tgtcatttctcat

SEQ ID NO: 2907234 - DNA, 15 bp, Homo sapiens
tgtcatttttgaatg

SEQ ID NO: 2907235 - DNA, 23 bp, Homo sapiens
tgtctccatgaggtactggtccc

SEQ ID NO: 2907236 - DNA, 19 bp, Homo sapiens
tgtctcccctaccaggctg

SEQ ID NO: 2907237 - DNA, 20 bp, Homo sapiens
tgtctcccctttccccgcgt

SEQ ID NO: 2907238 - DNA, 23 bp, Homo sapiens
tgtctcgccagaagactcctagg

SEQ ID NO: 2907239 - DNA, 15 bp, Homo sapiens
tgtctctaaaaagaa

SEQ ID NO: 2907240 - DNA, 22 bp, Homo sapiens
tgtctctccttgttgcccccaa

SEQ ID NO: 2907241 - DNA, 14 bp, Homo sapiens
tgtctctgacaaag

SEQ ID NO: 2907242 - DNA, 15 bp, Homo sapiens
tgtctctgagatttt

SEQ ID NO: 2907243 - DNA, 17 bp, Homo sapiens
tgtctctgcctggagca

SEQ ID NO: 2907244 - DNA, 19 bp, Homo sapiens
tgtctctgtatatagctct

SEQ ID NO: 2907245 - DNA, 13 bp, Homo sapiens
tgtctctttcatg

SEQ ID NO: 2907246 - DNA, 22 bp, Homo sapiens
tgtctgaaaaattcctttgtgt

SEQ ID NO: 2907247 - DNA, 14 bp, Homo sapiens
tgtctgagagacca

SEQ ID NO: 2907248 - DNA, 21 bp, Homo sapiens
tgtctgatcgttcaaagcatg

SEQ ID NO: 2907249 - DNA, 14 bp, Homo sapiens
tgtctgcaacatgg

SEQ ID NO: 2907250 - DNA, 12 bp, Homo sapiens
tgtctgcagccc

SEQ ID NO: 2907251 - DNA, 18 bp, Homo sapiens
tgtctgcagccctgagaa

SEQ ID NO: 2907252 - DNA, 21 bp, Homo sapiens
tgtctgcatttcggtggctag

SEQ ID NO: 2907253 - DNA, 16 bp, Homo sapiens
tgtctgccaatttttg

SEQ ID NO: 2907254 - DNA, 23 bp, Homo sapiens
tgtctgcgaagtcctatggaaac

SEQ ID NO: 2907255 - DNA, 14 bp, Homo sapiens
tgtctgctcaatgc

SEQ ID NO: 2907256 - DNA, 18 bp, Homo sapiens
tgtctggaagaagcagcg

SEQ ID NO: 2907257 - DNA, 15 bp, Homo sapiens
tgtctggaggttcct

SEQ ID NO: 2907258 - DNA, 18 bp, Homo sapiens
tgtctggcaaaagaaaaa

SEQ ID NO: 2907259 - DNA, 17 bp, Homo sapiens
tgtctggcacagcctgg

SEQ ID NO: 2907260 - DNA, 15 bp, Homo sapiens
tgtctggccaggcct

SEQ ID NO: 2907261 - DNA, 18 bp, Homo sapiens
tgtctggcctgaggtcaa

SEQ ID NO: 2907262 - DNA, 19 bp, Homo sapiens
tgtctgggtttggcccaag

SEQ ID NO: 2907263 - DNA, 22 bp, Homo sapiens
tgtctgggtttggcccaagact

SEQ ID NO: 2907264 - DNA, 14 bp, Homo sapiens
tgtctgtaaaaaat

SEQ ID NO: 2907265 - DNA, 17 bp, Homo sapiens
tgtctgtaaatatgttt

SEQ ID NO: 2907266 - DNA, 15 bp, Homo sapiens
tgtctgtacacgtgt

SEQ ID NO: 2907267 - DNA, 13 bp, Homo sapiens
tgtctgtcattgt

SEQ ID NO: 2907268 - DNA, 11 bp, Homo sapiens
tgtctgtcttc

SEQ ID NO: 2907269 - DNA, 14 bp, Homo sapiens
tgtctgtcttctcc

SEQ ID NO: 2907270 - DNA, 15 bp, Homo sapiens
tgtctgtcttctcct

SEQ ID NO: 2907271 - DNA, 23 bp, Homo sapiens
tgtctgtggttgcagtctttccc

SEQ ID NO: 2907272 - DNA, 17 bp, Homo sapiens
tgtctgtgtgattttca

SEQ ID NO: 2907273 - DNA, 12 bp, Homo sapiens
tgtctgttacac

SEQ ID NO: 2907274 - DNA, 17 bp, Homo sapiens
tgtctgttacactggag

SEQ ID NO: 2907275 - DNA, 14 bp, Homo sapiens
tgtcttaaatcagt

SEQ ID NO: 2907276 - DNA, 17 bp, Homo sapiens
tgtcttaaatcagttta

SEQ ID NO: 2907277 - DNA, 19 bp, Homo sapiens
tgtcttaaatcagtttatt

SEQ ID NO: 2907278 - DNA, 17 bp, Homo sapiens
tgtcttaaggagactgg

SEQ ID NO: 2907279 - DNA, 17 bp, Homo sapiens
tgtcttaatactgtcct

SEQ ID NO: 2907280 - DNA, 17 bp, Homo sapiens
tgtcttatggattcatt

SEQ ID NO: 2907281 - DNA, 13 bp, Homo sapiens
tgtcttcaaggct

SEQ ID NO: 2907282 - DNA, 19 bp, Homo sapiens
tgtcttcggccgagctggt

SEQ ID NO: 2907283 - DNA, 17 bp, Homo sapiens
tgtggccaaggagctgc

SEQ ID NO: 2907284 - DNA, 18 bp, Homo sapiens
tgtggccaaggagctgct

SEQ ID NO: 2907285 - DNA, 20 bp, Homo sapiens
tgtggccaaggagctgctat

SEQ ID NO: 2907286 - DNA, 17 bp, Homo sapiens
tgtggcccccgccccct

SEQ ID NO: 2907287 - DNA, 17 bp, Homo sapiens
tgtggccctggcctgct

SEQ ID NO: 2907288 - DNA, 16 bp, Homo sapiens
tgtggccctgtcctgc

SEQ ID NO: 2907289 - DNA, 17 bp, Homo sapiens
tgtggcctgcacagtga

SEQ ID NO: 2907290 - DNA, 13 bp, Homo sapiens
tgtggcctgccca

SEQ ID NO: 2907291 - DNA, 15 bp, Homo sapiens
tgtggcctgcccagc

SEQ ID NO: 2907292 - DNA, 17 bp, Homo sapiens
tgtggcctgcccagcct

SEQ ID NO: 2907293 - DNA, 13 bp, Homo sapiens
tgtggctccctct

SEQ ID NO: 2907294 - DNA, 14 bp, Homo sapiens
tgtggctccctctc

SEQ ID NO: 2907295 - DNA, 22 bp, Homo sapiens
tgtggctccctctctcctggac

SEQ ID NO: 2907296 - DNA, 13 bp, Homo sapiens
tgtggctgtgccc

SEQ ID NO: 2907297 - DNA, 22 bp, Homo sapiens
tgtggcttctctgtctctgtgg

SEQ ID NO: 2907298 - DNA, 16 bp, Homo sapiens
tgtgggaaaaaagaaa

SEQ ID NO: 2907299 - DNA, 17 bp, Homo sapiens
tgtgggaaaaaagaaaa

SEQ ID NO: 2907300 - DNA, 17 bp, Homo sapiens
tgtgggaatctcccaga

SEQ ID NO: 2907301 - DNA, 15 bp, Homo sapiens
tgtgggaatttaaga

SEQ ID NO: 2907302 - DNA, 18 bp, Homo sapiens
tgtgggaccccaggccca

SEQ ID NO: 2907303 - DNA, 15 bp, Homo sapiens
tgtggggaggctgca

SEQ ID NO: 2907304 - DNA, 15 bp, Homo sapiens
tgtgggttgtgatat

SEQ ID NO: 2907305 - DNA, 18 bp, Homo sapiens
tgtggtcagcggtatgtg

SEQ ID NO: 2907306 - DNA, 23 bp, Homo sapiens
tgtggtctgccaatctgtacaaa

SEQ ID NO: 2907307 - DNA, 17 bp, Homo sapiens
tgtggtctttttcctga

SEQ ID NO: 2907308 - DNA, 18 bp, Homo sapiens
tgtggtgggcgctgggga

SEQ ID NO: 2907309 - DNA, 15 bp, Homo sapiens
tgtggtgtctgcctg

SEQ ID NO: 2907310 - DNA, 13 bp, Homo sapiens
tgtggtgtgccat

SEQ ID NO: 2907311 - DNA, 17 bp, Homo sapiens
tgtggtgttagggtgca

SEQ ID NO: 2907312 - DNA, 16 bp, Homo sapiens
tgtgtaaaaaatggaa

SEQ ID NO: 2907313 - DNA, 17 bp, Homo sapiens
tgtgtaaaaaatggaaa

SEQ ID NO: 2907314 - DNA, 20 bp, Homo sapiens
tgtgtaaaaaatggaaaaaa

SEQ ID NO: 2907315 - DNA, 23 bp, Homo sapiens
tgttattaaacgtatgcatgtga

SEQ ID NO: 2907316 - DNA, 14 bp, Homo sapiens
tgttattagatgtt

SEQ ID NO: 2907317 - DNA, 16 bp, Homo sapiens
tgttattcttttccag

SEQ ID NO: 2907318 - DNA, 13 bp, Homo sapiens
tgttatttctcag

SEQ ID NO: 2907319 - DNA, 18 bp, Homo sapiens
tgttattttctgttgaag

SEQ ID NO: 2907320 - DNA, 17 bp, Homo sapiens
tgttatttttgtatttt

SEQ ID NO: 2907321 - DNA, 22 bp, Homo sapiens
tgttcaaacacaacctactctg

SEQ ID NO: 2907322 - DNA, 17 bp, Homo sapiens
tgttcaacatcactgaa

SEQ ID NO: 2907323 - DNA, 14 bp, Homo sapiens
tgttcacaacctgg

SEQ ID NO: 2907324 - DNA, 14 bp, Homo sapiens
tgttcacactccta

SEQ ID NO: 2907325 - DNA, 17 bp, Homo sapiens
tgttcacagaaaaagca

SEQ ID NO: 2907326 - DNA, 17 bp, Homo sapiens
tgttcacttttgacaaa

SEQ ID NO: 2907327 - DNA, 15 bp, Homo sapiens
tgttcagtgtaaata

SEQ ID NO: 2907328 - DNA, 15 bp, Homo sapiens
tgttcagtgtaattt

SEQ ID NO: 2907329 - DNA, 17 bp, Homo sapiens
tgttcagttacagaaag

SEQ ID NO: 2907330 - DNA, 16 bp, Homo sapiens
tgttcatctctttgtc

SEQ ID NO: 2907331 - DNA, 18 bp, Homo sapiens
tgttcatctctttgtcct

SEQ ID NO: 2907332 - DNA, 18 bp, Homo sapiens
tgttcatgaaggtcctag

SEQ ID NO: 2907333 - DNA, 22 bp, Homo sapiens
tgttcatttagattgaaaactt

SEQ ID NO: 2907334 - DNA, 15 bp, Homo sapiens
tgttccaatgaaaaa

SEQ ID NO: 2907335 - DNA, 18 bp, Homo sapiens
tgttccaatgtcaatgtg

SEQ ID NO: 2907336 - DNA, 14 bp, Homo sapiens
tgttccagtgttta

SEQ ID NO: 2907337 - DNA, 16 bp, Homo sapiens
tgttcccattggatgc

SEQ ID NO: 2907338 - DNA, 20 bp, Homo sapiens
tgttcccattggatgcattt

SEQ ID NO: 2907339 - DNA, 16 bp, Homo sapiens
tgttccccctgtgcag

SEQ ID NO: 2907340 - DNA, 22 bp, Homo sapiens
tgttcccttgaccattggctgc

SEQ ID NO: 2907341 - DNA, 18 bp, Homo sapiens
tgttcctccctcccacac

SEQ ID NO: 2907342 - DNA, 12 bp, Homo sapiens
tgttcctgtctc

SEQ ID NO: 2907343 - DNA, 13 bp, Homo sapiens
tgttcctgtctca

SEQ ID NO: 2907344 - DNA, 18 bp, Homo sapiens
tgttcctgtttattttta

SEQ ID NO: 2907345 - DNA, 22 bp, Homo sapiens
tgttccttagtggtagaggtgt

SEQ ID NO: 2907346 - DNA, 14 bp, Homo sapiens
tgttccttctgtga

SEQ ID NO: 2907347 - DNA, 18 bp, Homo sapiens
tgttccttctgtgaagaa

SEQ ID NO: 2907348 - DNA, 12 bp, Homo sapiens
tgttccttttga

SEQ ID NO: 2907349 - DNA, 21 bp, Homo sapiens
tgttcctttttaaatgtgaat

SEQ ID NO: 2907350 - DNA, 16 bp, Homo sapiens
tgttcgaagttcattt

SEQ ID NO: 2907351 - DNA, 22 bp, Homo sapiens
tgttcgcatggtcacacactga

SEQ ID NO: 2907352 - DNA, 13 bp, Homo sapiens
tgttcggagctct

SEQ ID NO: 2907353 - DNA, 18 bp, Homo sapiens
tgttcggttttgttgttc

SEQ ID NO: 2907354 - DNA, 14 bp, Homo sapiens
tgttctaagatgtg

SEQ ID NO: 2907355 - DNA, 22 bp, Homo sapiens
tgttctaagatgtgatattcta

SEQ ID NO: 2907356 - DNA, 12 bp, Homo sapiens
tgttctaaggct

SEQ ID NO: 2907357 - DNA, 18 bp, Homo sapiens
tgttctaaggctctgaga

SEQ ID NO: 2907358 - DNA, 19 bp, Homo sapiens
tgttctaaggctctgagag

SEQ ID NO: 2907359 - DNA, 17 bp, Homo sapiens
tgttctaagtctttcca

SEQ ID NO: 2907360 - DNA, 12 bp, Homo sapiens
tgttctaagttt

SEQ ID NO: 2907361 - DNA, 16 bp, Homo sapiens
tgttctaagtttctaa

SEQ ID NO: 2907362 - DNA, 19 bp, Homo sapiens
tgttctaagtttctaagat

SEQ ID NO: 2907363 - DNA, 13 bp, Homo sapiens
tgttctacttgat

SEQ ID NO: 2907364 - DNA, 20 bp, Homo sapiens
tgttctacttgatatttcct

SEQ ID NO: 2907365 - DNA, 17 bp, Homo sapiens
tgttctcggagtgtgta

SEQ ID NO: 2907366 - DNA, 16 bp, Homo sapiens
tgttctcgttgcccta

SEQ ID NO: 2907367 - DNA, 17 bp, Homo sapiens
tgttctcgttgccctaa

SEQ ID NO: 2907368 - DNA, 11 bp, Homo sapiens
tgttctgcctg

SEQ ID NO: 2907369 - DNA, 15 bp, Homo sapiens
tgttctgctgagact

SEQ ID NO: 2907370 - DNA, 21 bp, Homo sapiens
tgttctggggggacccagtgc

SEQ ID NO: 2907371 - DNA, 23 bp, Homo sapiens
tgttctggggggacccagtgcag

SEQ ID NO: 2907372 - DNA, 21 bp, Homo sapiens
tgttctgggtgatttctagaa

SEQ ID NO: 2907373 - DNA, 22 bp, Homo sapiens
tgttctgtggaaagtgtaaagc

SEQ ID NO: 2907374 - DNA, 16 bp, Homo sapiens
tgttcttatagaataa

SEQ ID NO: 2907375 - DNA, 13 bp, Homo sapiens
tgttcttcagaga

SEQ ID NO: 2907376 - DNA, 14 bp, Homo sapiens
tgttcttcgtatat

SEQ ID NO: 2907377 - DNA, 13 bp, Homo sapiens
tgttcttgaagca

SEQ ID NO: 2907378 - DNA, 17 bp, Homo sapiens
tgttcttgaggtctctt

SEQ ID NO: 2907379 - DNA, 11 bp, Homo sapiens
tgttctttata

SEQ ID NO: 2907380 - DNA, 20 bp, Homo sapiens
tgttctttggaaatacacag

SEQ ID NO: 2907381 - DNA, 22 bp, Homo sapiens
tgttcttttaaagactacctgg

SEQ ID NO: 2907382 - DNA, 14 bp, Homo sapiens
tgttctttttattg

SEQ ID NO: 2907383 - DNA, 21 bp, Homo sapiens
tgttgaaaaatatctttgcat

SEQ ID NO: 2907384 - DNA, 19 bp, Homo sapiens
tgttgaaaataatccattt

SEQ ID NO: 2907385 - DNA, 21 bp, Homo sapiens
tgttgaaaatgtatttcctga

SEQ ID NO: 2907386 - DNA, 23 bp, Homo sapiens
tgttgaaagcaaaaatgctaata

SEQ ID NO: 2907387 - DNA, 20 bp, Homo sapiens
tgttgaactttttaaagaag

SEQ ID NO: 2907388 - DNA, 13 bp, Homo sapiens
tgttgaatacttt

SEQ ID NO: 2907389 - DNA, 14 bp, Homo sapiens
tgttgaataggaaa

SEQ ID NO: 2907390 - DNA, 16 bp, Homo sapiens
tgttgacacaggtctt

SEQ ID NO: 2907391 - DNA, 16 bp, Homo sapiens
tgttgacagttctgaa

SEQ ID NO: 2907392 - DNA, 18 bp, Homo sapiens
tgttgacataccttttat

SEQ ID NO: 2907393 - DNA, 18 bp, Homo sapiens
tgttgacatatttaatgt

SEQ ID NO: 2907394 - DNA, 21 bp, Homo sapiens
tgttgacatatttaatgtttt

SEQ ID NO: 2907395 - DNA, 18 bp, Homo sapiens
tgttgaccatgtctatga

SEQ ID NO: 2907396 - DNA, 22 bp, Homo sapiens
tgttgagaatcccaaatttgat

SEQ ID NO: 2907397 - DNA, 23 bp, Homo sapiens
tgttgagcaagcagtagcatttg

SEQ ID NO: 2907398 - DNA, 16 bp, Homo sapiens
tgttgagcatcacaga

SEQ ID NO: 2907399 - DNA, 20 bp, Homo sapiens
tgttgagcatcacagaatgt

SEQ ID NO: 2907400 - DNA, 13 bp, Homo sapiens
tgttgagctgtca

SEQ ID NO: 2907401 - DNA, 19 bp, Homo sapiens
tgttgatcatgtacttttt

SEQ ID NO: 2907402 - DNA, 22 bp, Homo sapiens
tgttgatcatgtactttttagt

SEQ ID NO: 2907403 - DNA, 20 bp, Homo sapiens
tgttgatccatccagcttgc

SEQ ID NO: 2907404 - DNA, 19 bp, Homo sapiens
tgttgattgctaaatgtaa

SEQ ID NO: 2907405 - DNA, 22 bp, Homo sapiens
tgttgatttttactgtgtttta

SEQ ID NO: 2907406 - DNA, 19 bp, Homo sapiens
tgttgcaagtactgctgta

SEQ ID NO: 2907407 - DNA, 17 bp, Homo sapiens
tgttgcaagtgcaataa

SEQ ID NO: 2907408 - DNA, 22 bp, Homo sapiens
tgttgcacacccactcagctcc

SEQ ID NO: 2907409 - DNA, 22 bp, Homo sapiens
tgttgcacttttgaatgtccaa

SEQ ID NO: 2907410 - DNA, 24 bp, Homo sapiens
tgttgcacttttgaatgtccaaaa

SEQ ID NO: 2907411 - DNA, 19 bp, Homo sapiens
tgttgcagtggcctggccg

SEQ ID NO: 2907412 - DNA, 20 bp, Homo sapiens
tgttgcattacgataaacat

SEQ ID NO: 2907413 - DNA, 14 bp, Homo sapiens
tgttgcccaggctg

SEQ ID NO: 2907414 - DNA, 21 bp, Homo sapiens
tgttgcccaggctggagtgca

SEQ ID NO: 2907415 - DNA, 21 bp, Homo sapiens
tgttgccctgtttcctgctgc

SEQ ID NO: 2907416 - DNA, 13 bp, Homo sapiens
tgttgcctcctct

SEQ ID NO: 2907417 - DNA, 15 bp, Homo sapiens
tgttgcctcctctct

SEQ ID NO: 2907418 - DNA, 19 bp, Homo sapiens
tgttgcctcctctctccct

SEQ ID NO: 2907419 - DNA, 20 bp, Homo sapiens
tgttgcctcctctctccctg

SEQ ID NO: 2907420 - DNA, 15 bp, Homo sapiens
tgttgcctcttgcaa

SEQ ID NO: 2907421 - DNA, 18 bp, Homo sapiens
tgttgcctcttgcaatgc

SEQ ID NO: 2907422 - DNA, 21 bp, Homo sapiens
tgttgcgtgacactctccttg

SEQ ID NO: 2907423 - DNA, 17 bp, Homo sapiens
tgttgctctaggaagac

SEQ ID NO: 2907424 - DNA, 21 bp, Homo sapiens
tgttgctctctgtgtctgaga

SEQ ID NO: 2907425 - DNA, 12 bp, Homo sapiens
tgttgctgctgc

SEQ ID NO: 2907426 - DNA, 13 bp, Homo sapiens
tgttgctgctgct

SEQ ID NO: 2907427 - DNA, 14 bp, Homo sapiens
tgttgcttaattgt

SEQ ID NO: 2907428 - DNA, 13 bp, Homo sapiens
tgttgcttacaat

SEQ ID NO: 2907429 - DNA, 12 bp, Homo sapiens
tgaaaatacaac

SEQ ID NO: 2907430 - DNA, 22 bp, Homo sapiens
tgaaaatatgttggaaaaaaga

SEQ ID NO: 2907431 - DNA, 15 bp, Homo sapiens
tgaaaatcactggcc

SEQ ID NO: 2907432 - DNA, 20 bp, Homo sapiens
tgaaaatgaagaaggaagct

SEQ ID NO: 2907433 - DNA, 18 bp, Homo sapiens
tgaaaatgtatttcctga

SEQ ID NO: 2907434 - DNA, 21 bp, Homo sapiens
tgaaaatgtatttcctgaaat

SEQ ID NO: 2907435 - DNA, 13 bp, Homo sapiens
tgaaaatgtcttg

SEQ ID NO: 2907436 - DNA, 15 bp, Homo sapiens
tgaaaatgtcttgtg

SEQ ID NO: 2907437 - DNA, 17 bp, Homo sapiens
tgaaaattgtataaatt

SEQ ID NO: 2907438 - DNA, 22 bp, Homo sapiens
tgaaacaccaagatgtctgtct

SEQ ID NO: 2907439 - DNA, 13 bp, Homo sapiens
tgaaacacttttt

SEQ ID NO: 2907440 - DNA, 12 bp, Homo sapiens
tgaaacagaaaa

SEQ ID NO: 2907441 - DNA, 22 bp, Homo sapiens
tgaaacagaaaaataagtcaaa

SEQ ID NO: 2907442 - DNA, 17 bp, Homo sapiens
tgaaacagctgccttag

SEQ ID NO: 2907443 - DNA, 22 bp, Homo sapiens
tgaaacagctgccttagcttca

SEQ ID NO: 2907444 - DNA, 17 bp, Homo sapiens
tgatttgaagaacatgt

SEQ ID NO: 2907445 - DNA, 23 bp, Homo sapiens
tgatttgcaatgggatgtatgaa

SEQ ID NO: 2907446 - DNA, 14 bp, Homo sapiens
tgatttgcaggatt

SEQ ID NO: 2907447 - DNA, 12 bp, Homo sapiens
tgatttgcattg

SEQ ID NO: 2907448 - DNA, 20 bp, Homo sapiens
tgatttggtgaccaactgtc

SEQ ID NO: 2907449 - DNA, 20 bp, Homo sapiens
tgatttgttgggaccttctg

SEQ ID NO: 2907450 - DNA, 23 bp, Homo sapiens
tgatttgtttagttttgattgtt

SEQ ID NO: 2907451 - DNA, 15 bp, Homo sapiens
tgattttaaaaggtt

SEQ ID NO: 2907452 - DNA, 12 bp, Homo sapiens
tgattttaagag

SEQ ID NO: 2907453 - DNA, 22 bp, Homo sapiens
tgattttacaaattaatatttg

SEQ ID NO: 2907454 - DNA, 23 bp, Homo sapiens
tgattttacaaattaatatttgt

SEQ ID NO: 2907455 - DNA, 20 bp, Homo sapiens
tgattttaggagctaaggct

SEQ ID NO: 2907456 - DNA, 17 bp, Homo sapiens
tgattttatttttgcaa

SEQ ID NO: 2907457 - DNA, 19 bp, Homo sapiens
tgattttatttttgcaaaa

SEQ ID NO: 2907458 - DNA, 10 bp, Homo sapiens
tgattttcat

SEQ ID NO: 2907459 - DNA, 14 bp, Homo sapiens
tgatttttgtgtat

SEQ ID NO: 2907460 - DNA, 20 bp, Homo sapiens
tgatttttgtgtatccagta

SEQ ID NO: 2907461 - DNA, 13 bp, Homo sapiens
tgatttttttcca

SEQ ID NO: 2907462 - DNA, 18 bp, Homo sapiens
tgcaaaaaaattaaaatg

SEQ ID NO: 2907463 - DNA, 19 bp, Homo sapiens
tgcaaaaactacaaccaat

SEQ ID NO: 2907464 - DNA, 23 bp, Homo sapiens
tgcaaaaaggactggaaaaatga

SEQ ID NO: 2907465 - DNA, 13 bp, Homo sapiens
tgcaaaacatttc

SEQ ID NO: 2907466 - DNA, 23 bp, Homo sapiens
tgcaaaagtggggctaaatgaag

SEQ ID NO: 2907467 - DNA, 14 bp, Homo sapiens
tgcaaaatgtctgt

SEQ ID NO: 2907468 - DNA, 21 bp, Homo sapiens
tgcaaaatgtcttgtgtattt

SEQ ID NO: 2907469 - DNA, 22 bp, Homo sapiens
tgcaaacactgtgattactctt

SEQ ID NO: 2907470 - DNA, 12 bp, Homo sapiens
tgcaaacagtgt

SEQ ID NO: 2907471 - DNA, 19 bp, Homo sapiens
tgcaaacgctgcctgccca

SEQ ID NO: 2907472 - DNA, 19 bp, Homo sapiens
tgcaaacttgtatctgaag

SEQ ID NO: 2907473 - DNA, 19 bp, Homo sapiens
tgcaaagaggcaagaggct

SEQ ID NO: 2907474 - DNA, 12 bp, Homo sapiens
tgcaaagtattg

SEQ ID NO: 2907475 - DNA, 16 bp, Homo sapiens
tgcaaagtattgtaaa

SEQ ID NO: 2907476 - DNA, 22 bp, Homo sapiens
tgcaaagtctccagaagaaaat

SEQ ID NO: 2907477 - DNA, 19 bp, Homo sapiens
tgcaaagtggaattaaagg

SEQ ID NO: 2907478 - DNA, 19 bp, Homo sapiens
tgcaaagtttgtgtcaata

SEQ ID NO: 2907479 - DNA, 21 bp, Homo sapiens
tgcaaataagactcttaccta

SEQ ID NO: 2907480 - DNA, 19 bp, Homo sapiens
tgcaaatattagcaaagaa

SEQ ID NO: 2907481 - DNA, 23 bp, Homo sapiens
tgcaaatattagcaaagaagctt

SEQ ID NO: 2907482 - DNA, 17 bp, Homo sapiens
tgcaaatcctatgtgat

SEQ ID NO: 2907483 - DNA, 18 bp, Homo sapiens
tgcaaatcctatgtgatt

SEQ ID NO: 2907484 - DNA, 19 bp, Homo sapiens
tgcaacaacctttccagct

SEQ ID NO: 2907485 - DNA, 13 bp, Homo sapiens
tgcaacacaacat

SEQ ID NO: 2907486 - DNA, 13 bp, Homo sapiens
tgcaacctccgcc

SEQ ID NO: 2907487 - DNA, 21 bp, Homo sapiens
tgcaacctccgccttccgggt

SEQ ID NO: 2907488 - DNA, 14 bp, Homo sapiens
tgcaacctcgctgg

SEQ ID NO: 2907489 - DNA, 20 bp, Homo sapiens
tgcaacctcgctggactctc

SEQ ID NO: 2907490 - DNA, 14 bp, Homo sapiens
tgcaacctctgcct

SEQ ID NO: 2907491 - DNA, 21 bp, Homo sapiens
tgcaacctctgcctcccaggt

SEQ ID NO: 2907492 - DNA, 21 bp, Homo sapiens
tgcaacctctgcctcctgggt

SEQ ID NO: 2907493 - DNA, 14 bp, Homo sapiens
tgcaacctgttgat

SEQ ID NO: 2907494 - DNA, 14 bp, Homo sapiens
tgcaaccttcacct

SEQ ID NO: 2907495 - DNA, 21 bp, Homo sapiens
tgcaacggtctcctgactggt

SEQ ID NO: 2907496 - DNA, 20 bp, Homo sapiens
tgcaactgctcagctctggt

SEQ ID NO: 2907497 - DNA, 14 bp, Homo sapiens
tgcaacttctgcct

SEQ ID NO: 2907498 - DNA, 21 bp, Homo sapiens
tgcaagaactcatcactgtgg

SEQ ID NO: 2907499 - DNA, 23 bp, Homo sapiens
tgcaagaactcatcactgtggct

SEQ ID NO: 2907500 - DNA, 21 bp, Homo sapiens
tgcaagccccaactttcttat

SEQ ID NO: 2907501 - DNA, 23 bp, Homo sapiens
tgcaaggccgctgttcacccaca

SEQ ID NO: 2907502 - DNA, 17 bp, Homo sapiens
tgcaagggcccagagtg

SEQ ID NO: 2907503 - DNA, 15 bp, Homo sapiens
tgcaaggtggctcca

SEQ ID NO: 2907504 - DNA, 14 bp, Homo sapiens
tgcaaggttccaca

SEQ ID NO: 2907505 - DNA, 17 bp, Homo sapiens
tgcaaggttccacagag

SEQ ID NO: 2907506 - DNA, 15 bp, Homo sapiens
tgcaagtactgctgt

SEQ ID NO: 2907507 - DNA, 16 bp, Homo sapiens
tgcaagtgacatctct

SEQ ID NO: 2907508 - DNA, 17 bp, Homo sapiens
tgcaagtgggagatgaa

SEQ ID NO: 2907509 - DNA, 15 bp, Homo sapiens
tgcaagtgtctggag

SEQ ID NO: 2907510 - DNA, 19 bp, Homo sapiens
tgcaagtgtctggagcggc

SEQ ID NO: 2907511 - DNA, 20 bp, Homo sapiens
tgcaagtgtctggagcggct

SEQ ID NO: 2907512 - DNA, 22 bp, Homo sapiens
tgcaagtgtctggagcggctgc

SEQ ID NO: 2907513 - DNA, 17 bp, Homo sapiens
tgcaataacttctatat

SEQ ID NO: 2907514 - DNA, 22 bp, Homo sapiens
tgcaataacttctatattttaa

SEQ ID NO: 2907515 - DNA, 15 bp, Homo sapiens
tgcaataatgcagta

SEQ ID NO: 2907516 - DNA, 18 bp, Homo sapiens
tgcaataatgcagtatgg

SEQ ID NO: 2907517 - DNA, 20 bp, Homo sapiens
tgcaataatgcagtatggta

SEQ ID NO: 2907518 - DNA, 23 bp, Homo sapiens
tgcaatacgggagtgacccagct

SEQ ID NO: 2907519 - DNA, 17 bp, Homo sapiens
tgcaatagtcagagtgt

SEQ ID NO: 2907520 - DNA, 20 bp, Homo sapiens
tgcaatatatctaaattgaa

SEQ ID NO: 2907521 - DNA, 21 bp, Homo sapiens
tgcaatatatctaaattgaat

SEQ ID NO: 2907522 - DNA, 22 bp, Homo sapiens
tgcaatatatctaaattgaata

SEQ ID NO: 2907523 - DNA, 13 bp, Homo sapiens
tgcaatcactgtg

SEQ ID NO: 2907524 - DNA, 14 bp, Homo sapiens
tgcaatcactgtgc

SEQ ID NO: 2907525 - DNA, 16 bp, Homo sapiens
tgcaatcactgtgcta

SEQ ID NO: 2907526 - DNA, 17 bp, Homo sapiens
tgcaatgggatgtatga

SEQ ID NO: 2907527 - DNA, 18 bp, Homo sapiens
tgcaatgggatgtatgaa

SEQ ID NO: 2907528 - DNA, 22 bp, Homo sapiens
tgcaatgggatgtatgaataca

SEQ ID NO: 2907529 - DNA, 19 bp, Homo sapiens
tgcaatggtgactgatttc

SEQ ID NO: 2907530 - DNA, 14 bp, Homo sapiens
tgcaattcaaaagt

SEQ ID NO: 2907531 - DNA, 16 bp, Homo sapiens
tgcaattcaaaagttc

SEQ ID NO: 2907532 - DNA, 15 bp, Homo sapiens
tgcaattcagtgttc

SEQ ID NO: 2907533 - DNA, 14 bp, Homo sapiens
tgcaattctttttg

SEQ ID NO: 2907534 - DNA, 21 bp, Homo sapiens
tgcaattctttttggaaaaga

SEQ ID NO: 2907535 - DNA, 17 bp, Homo sapiens
tgcaatttcaaggttct

SEQ ID NO: 2907536 - DNA, 20 bp, Homo sapiens
tgcaatttcaaggttctaac

SEQ ID NO: 2907537 - DNA, 14 bp, Homo sapiens
tgcaatttctacta

SEQ ID NO: 2907538 - DNA, 18 bp, Homo sapiens
tgcacaaaacccagacct

SEQ ID NO: 2907539 - DNA, 18 bp, Homo sapiens
tgcacaaacttgtgagca

SEQ ID NO: 2907540 - DNA, 19 bp, Homo sapiens
tgcacacagcggctgcctc

SEQ ID NO: 2907541 - DNA, 20 bp, Homo sapiens
tgcacacatcaccaggtgca

SEQ ID NO: 2907542 - DNA, 14 bp, Homo sapiens
tgcacacccactca

SEQ ID NO: 2907543 - DNA, 17 bp, Homo sapiens
tgcacacccactcagct

SEQ ID NO: 2907544 - DNA, 18 bp, Homo sapiens
tgcacacccactcagctc

SEQ ID NO: 2907545 - DNA, 18 bp, Homo sapiens
tgcacacggctggtcact

SEQ ID NO: 2907546 - DNA, 21 bp, Homo sapiens
tgcacacggctggtcactctg

SEQ ID NO: 2907547 - DNA, 23 bp, Homo sapiens
tgcacacggctggtcactctgcc

SEQ ID NO: 2907548 - DNA, 14 bp, Homo sapiens
tgcacagaagtcct

SEQ ID NO: 2907549 - DNA, 22 bp, Homo sapiens
tgcacagaagtcctgtatgtct

SEQ ID NO: 2907550 - DNA, 10 bp, Homo sapiens
tgcacagagg

SEQ ID NO: 2907551 - DNA, 12 bp, Homo sapiens
tgcacagagggc

SEQ ID NO: 2907552 - DNA, 18 bp, Homo sapiens
tgcacagagggcgctcct

SEQ ID NO: 2907553 - DNA, 19 bp, Homo sapiens
tgcacagagggcgctcctg

SEQ ID NO: 2907554 - DNA, 16 bp, Homo sapiens
tgcacagattcccagg

SEQ ID NO: 2907555 - DNA, 17 bp, Homo sapiens
tgcacagattcccaggc

SEQ ID NO: 2907556 - DNA, 19 bp, Homo sapiens
tgcacagattcccaggcca

SEQ ID NO: 2907557 - DNA, 20 bp, Homo sapiens
tgcacagattcccaggccag

SEQ ID NO: 2907558 - DNA, 16 bp, Homo sapiens
tgcacagggcaattga

SEQ ID NO: 2907559 - DNA, 15 bp, Homo sapiens
tgcacaggtctctgt

SEQ ID NO: 2907560 - DNA, 19 bp, Homo sapiens
tgcacaggtggctgtttct

SEQ ID NO: 2907561 - DNA, 18 bp, Homo sapiens
tgcacagtcagaaggacg

SEQ ID NO: 2907562 - DNA, 19 bp, Homo sapiens
tgcacatagcagactagaa

SEQ ID NO: 2907563 - DNA, 15 bp, Homo sapiens
tgcacatatggactc

SEQ ID NO: 2907564 - DNA, 16 bp, Homo sapiens
tgcacatgaagaaata

SEQ ID NO: 2907565 - DNA, 19 bp, Homo sapiens
tgcacatgtcttgtacatg

SEQ ID NO: 2907566 - DNA, 12 bp, Homo sapiens
tgcacattgttc

SEQ ID NO: 2907567 - DNA, 13 bp, Homo sapiens
tgcaccaaatagg

SEQ ID NO: 2907568 - DNA, 14 bp, Homo sapiens
tgcaccaagcagga

SEQ ID NO: 2907569 - DNA, 14 bp, Homo sapiens
tgcaccaccatgcc

SEQ ID NO: 2907570 - DNA, 16 bp, Homo sapiens
tgcaccaccatgccca

SEQ ID NO: 2907571 - DNA, 23 bp, Homo sapiens
tgcaccagggttgaccccagagg

SEQ ID NO: 2907572 - DNA, 15 bp, Homo sapiens
tgcaccattgctgct

SEQ ID NO: 2907573 - DNA, 15 bp, Homo sapiens
tgcacccacctactt

SEQ ID NO: 2907574 - DNA, 15 bp, Homo sapiens
tgcacccactgaaag

SEQ ID NO: 2907575 - DNA, 14 bp, Homo sapiens
tgcacccagcccag

SEQ ID NO: 2907576 - DNA, 14 bp, Homo sapiens
tgcacccccctggg

SEQ ID NO: 2907577 - DNA, 20 bp, Homo sapiens
tgcaccctcttctcctctgg

SEQ ID NO: 2907578 - DNA, 21 bp, Homo sapiens
tgcaccgacccgaggcccaga

SEQ ID NO: 2907579 - DNA, 14 bp, Homo sapiens
tgcaccgcctgccc

SEQ ID NO: 2907580 - DNA, 15 bp, Homo sapiens
tgaccaatacatttg

SEQ ID NO: 2907581 - DNA, 17 bp, Homo sapiens
tgaccaatacatttgta

SEQ ID NO: 2907582 - DNA, 18 bp, Homo sapiens
tgaccaatacatttgtat

SEQ ID NO: 2907583 - DNA, 14 bp, Homo sapiens
tgaccaatgtcttg

SEQ ID NO: 2907584 - DNA, 15 bp, Homo sapiens
tgaccacgcacctcc

SEQ ID NO: 2907585 - DNA, 20 bp, Homo sapiens
tgaccacgcacctccacgcc

SEQ ID NO: 2907586 - DNA, 15 bp, Homo sapiens
tgaccagagcaaaaa

SEQ ID NO: 2907587 - DNA, 12 bp, Homo sapiens
tgaccagggaag

SEQ ID NO: 2907588 - DNA, 13 bp, Homo sapiens
tgaccagggaagt

SEQ ID NO: 2907589 - DNA, 15 bp, Homo sapiens
tgaccagtttctttt

SEQ ID NO: 2907590 - DNA, 14 bp, Homo sapiens
tgaccatactcaga

SEQ ID NO: 2907591 - DNA, 13 bp, Homo sapiens
tgaccatgtgaat

SEQ ID NO: 2907592 - DNA, 12 bp, Homo sapiens
tgaccatgtgat

SEQ ID NO: 2907593 - DNA, 19 bp, Homo sapiens
tgacccacagcctccaagt

SEQ ID NO: 2907594 - DNA, 22 bp, Homo sapiens
tgacccacttctcatcacacac

SEQ ID NO: 2907595 - DNA, 14 bp, Homo sapiens
tgacccagtccctg

SEQ ID NO: 2907596 - DNA, 18 bp, Homo sapiens
tgacccagtgcccccact

SEQ ID NO: 2907597 - DNA, 14 bp, Homo sapiens
tgacccccagctcc

SEQ ID NO: 2907598 - DNA, 14 bp, Homo sapiens
tgacccctaccccc

SEQ ID NO: 2907599 - DNA, 13 bp, Homo sapiens
tgacccctcctgg

SEQ ID NO: 2907600 - DNA, 20 bp, Homo sapiens
tgacccggattggccctgcc

SEQ ID NO: 2907601 - DNA, 22 bp, Homo sapiens
tgacccggattggccctgcccc

SEQ ID NO: 2907602 - DNA, 12 bp, Homo sapiens
tgaccctctcac

SEQ ID NO: 2907603 - DNA, 20 bp, Homo sapiens
tgaccctctgtccccaggcc

SEQ ID NO: 2907604 - DNA, 21 bp, Homo sapiens
tgaccctctgtccccaggcct

SEQ ID NO: 2907605 - DNA, 15 bp, Homo sapiens
tgaccctggggctgg

SEQ ID NO: 2907606 - DNA, 17 bp, Homo sapiens
tgaccctggggctggct

SEQ ID NO: 2907607 - DNA, 17 bp, Homo sapiens
tgaccctgtatatagcc

SEQ ID NO: 2907608 - DNA, 22 bp, Homo sapiens
tgacccttacagcctctgactt

SEQ ID NO: 2907609 - DNA, 19 bp, Homo sapiens
tgaccgaaacagcgctggg

SEQ ID NO: 2907610 - DNA, 18 bp, Homo sapiens
tgaccgcccagctctccc

SEQ ID NO: 2907611 - DNA, 19 bp, Homo sapiens
tgaccgcctcctgctctgc

SEQ ID NO: 2907612 - DNA, 18 bp, Homo sapiens
tgaccgctgcccaggtgg

SEQ ID NO: 2907613 - DNA, 17 bp, Homo sapiens
tgacctcacctggtcct

SEQ ID NO: 2907614 - DNA, 19 bp, Homo sapiens
tgacctcacctggtcctcc

SEQ ID NO: 2907615 - DNA, 14 bp, Homo sapiens
tgacctccacagct

SEQ ID NO: 2907616 - DNA, 16 bp, Homo sapiens
tgacctccagtcctgc

SEQ ID NO: 2907617 - DNA, 19 bp, Homo sapiens
tgacctccagtcctgctgg

SEQ ID NO: 2907618 - DNA, 15 bp, Homo sapiens
tgacctcccaactct

SEQ ID NO: 2907619 - DNA, 14 bp, Homo sapiens
tgacctgaactctg

SEQ ID NO: 2907620 - DNA, 13 bp, Homo sapiens
tgacctgaagttc

SEQ ID NO: 2907621 - DNA, 17 bp, Homo sapiens
tgacctgcaaaaatgct

SEQ ID NO: 2907622 - DNA, 20 bp, Homo sapiens
tgacctgcgggtcctcagct

SEQ ID NO: 2907623 - DNA, 20 bp, Homo sapiens
tgacctggtccacagggcac

SEQ ID NO: 2907624 - DNA, 20 bp, Homo sapiens
tgacctggttaaacaaacca

SEQ ID NO: 2907625 - DNA, 20 bp, Homo sapiens
tgacctgtgagcccagctgg

SEQ ID NO: 2907626 - DNA, 22 bp, Homo sapiens
tgaccttagtgtttctgtgcat

SEQ ID NO: 2907627 - DNA, 19 bp, Homo sapiens
tgaccttatccttcctctc

SEQ ID NO: 2907628 - DNA, 22 bp, Homo sapiens
tgaccttatgagaaactgcatg

SEQ ID NO: 2907629 - DNA, 19 bp, Homo sapiens
tgaccttcagctcacgctt

SEQ ID NO: 2907630 - DNA, 14 bp, Homo sapiens
tgacctttgtacag

SEQ ID NO: 2907631 - DNA, 12 bp, Homo sapiens
tgacgaactggc

SEQ ID NO: 2907632 - DNA, 13 bp, Homo sapiens
tgacgaactggct

SEQ ID NO: 2907633 - DNA, 19 bp, Homo sapiens
tgacgaacttccatggccc

SEQ ID NO: 2907634 - DNA, 15 bp, Homo sapiens
tgacgaatcctgctc

SEQ ID NO: 2907635 - DNA, 14 bp, Homo sapiens
tgacgcagccggag

SEQ ID NO: 2907636 - DNA, 17 bp, Homo sapiens
tgacgctgaataaatgt

SEQ ID NO: 2907637 - DNA, 21 bp, Homo sapiens
tgacgtcaagtgatctgcctg

SEQ ID NO: 2907638 - DNA, 16 bp, Homo sapiens
tgacgtgactcagagc

SEQ ID NO: 2907639 - DNA, 14 bp, Homo sapiens
tgacgtgcactgtg

SEQ ID NO: 2907640 - DNA, 23 bp, Homo sapiens
tgactaaagtaccagattataat

SEQ ID NO: 2907641 - DNA, 23 bp, Homo sapiens
tgactaactagacaccaaagttc

SEQ ID NO: 2907642 - DNA, 20 bp, Homo sapiens
tgactaagccaagctgtgtt

SEQ ID NO: 2907643 - DNA, 21 bp, Homo sapiens
tgactaagccaagctgtgttc

SEQ ID NO: 2907644 - DNA, 23 bp, Homo sapiens
tgactaatagggataatccaggt

SEQ ID NO: 2907645 - DNA, 17 bp, Homo sapiens
tgactaattgtataaca

SEQ ID NO: 2907646 - DNA, 21 bp, Homo sapiens
tgactaattgtataacaggtt

SEQ ID NO: 2907647 - DNA, 22 bp, Homo sapiens
tgactaattttacatgtttata

SEQ ID NO: 2907648 - DNA, 22 bp, Homo sapiens
tgactacctactggtgtaatct

SEQ ID NO: 2907649 - DNA, 15 bp, Homo sapiens
tgactagaaattctt

SEQ ID NO: 2907650 - DNA, 16 bp, Homo sapiens
tgactagaaattctta

SEQ ID NO: 2907651 - DNA, 18 bp, Homo sapiens
tgactagggagccatgtt

SEQ ID NO: 2907652 - DNA, 20 bp, Homo sapiens
tgactagggagccatgtttc

SEQ ID NO: 2907653 - DNA, 14 bp, Homo sapiens
tgactataaagctg

SEQ ID NO: 2907654 - DNA, 21 bp, Homo sapiens
tgactatcacacactttctct

SEQ ID NO: 2907655 - DNA, 21 bp, Homo sapiens
tgactatcccaacagtcatgt

SEQ ID NO: 2907656 - DNA, 23 bp, Homo sapiens
tgactatcccaacagtcatgttt

SEQ ID NO: 2907657 - DNA, 24 bp, Homo sapiens
tgactatgcagaggcctgggggac

SEQ ID NO: 2907658 - DNA, 22 bp, Homo sapiens
tgactattacagttgcattttt

SEQ ID NO: 2907659 - DNA, 22 bp, Homo sapiens
tgactattatgttgttagagaa

SEQ ID NO: 2907660 - DNA, 17 bp, Homo sapiens
tgactcagcagaggcag

SEQ ID NO: 2907661 - DNA, 21 bp, Homo sapiens
tgactcaggcgggcaccaagg

SEQ ID NO: 2907662 - DNA, 18 bp, Homo sapiens
tgactcagggctcctggg

SEQ ID NO: 2907663 - DNA, 15 bp, Homo sapiens
tgactcatcatttgt

SEQ ID NO: 2907664 - DNA, 18 bp, Homo sapiens
tgactcatgcctctgagc

SEQ ID NO: 2907665 - DNA, 21 bp, Homo sapiens
tgactccctccccacccaaga

SEQ ID NO: 2907666 - DNA, 22 bp, Homo sapiens
tgactcgggccttagaactttg

SEQ ID NO: 2907667 - DNA, 14 bp, Homo sapiens
tgactctcctgcct

SEQ ID NO: 2907668 - DNA, 17 bp, Homo sapiens
tgagccgcatcttctcc

SEQ ID NO: 2907669 - DNA, 16 bp, Homo sapiens
tgagccgccgcgcctg

SEQ ID NO: 2907670 - DNA, 21 bp, Homo sapiens
tgagccggagggcaccaggga

SEQ ID NO: 2907671 - DNA, 12 bp, Homo sapiens
tgagcctctgct

SEQ ID NO: 2907672 - DNA, 16 bp, Homo sapiens
tgagcctggccagcct

SEQ ID NO: 2907673 - DNA, 16 bp, Homo sapiens
tgagcctgggaaataa

SEQ ID NO: 2907674 - DNA, 18 bp, Homo sapiens
tgagcctgtttattgcca

SEQ ID NO: 2907675 - DNA, 15 bp, Homo sapiens
tgagccttgctgcca

SEQ ID NO: 2907676 - DNA, 16 bp, Homo sapiens
tgagcgacaaagatga

SEQ ID NO: 2907677 - DNA, 19 bp, Homo sapiens
tgagcgaggaaaaacaaca

SEQ ID NO: 2907678 - DNA, 20 bp, Homo sapiens
tgagcgaggaaaaacaacaa

SEQ ID NO: 2907679 - DNA, 15 bp, Homo sapiens
tgagcgagtggatgc

SEQ ID NO: 2907680 - DNA, 21 bp, Homo sapiens
tgagcgagtggatgctgtgct

SEQ ID NO: 2907681 - DNA, 17 bp, Homo sapiens
tgagcgcaagccacagc

SEQ ID NO: 2907682 - DNA, 21 bp, Homo sapiens
tgagcgcaagccacagcctgt

SEQ ID NO: 2907683 - DNA, 12 bp, Homo sapiens
tgagcgccagga

SEQ ID NO: 2907684 - DNA, 14 bp, Homo sapiens
tgagctaaataagt

SEQ ID NO: 2907685 - DNA, 16 bp, Homo sapiens
tgagctaggaagagtc

SEQ ID NO: 2907686 - DNA, 23 bp, Homo sapiens
tgagctatgataagattgaaatt

SEQ ID NO: 2907687 - DNA, 19 bp, Homo sapiens
tgagctcagacccccactc

SEQ ID NO: 2907688 - DNA, 20 bp, Homo sapiens
tgagctcagacccccactct

SEQ ID NO: 2907689 - DNA, 22 bp, Homo sapiens
tgagctcaggagtttgagacca

SEQ ID NO: 2907690 - DNA, 23 bp, Homo sapiens
tgagctcccaggtgcagccagag

SEQ ID NO: 2907691 - DNA, 14 bp, Homo sapiens
tgagctctccaggc

SEQ ID NO: 2907692 - DNA, 21 bp, Homo sapiens
tgagctgcccggcgcctgccc

SEQ ID NO: 2907693 - DNA, 14 bp, Homo sapiens
tgagctgggccgga

SEQ ID NO: 2907694 - DNA, 18 bp, Homo sapiens
tgagctgggccggagggt

SEQ ID NO: 2907695 - DNA, 16 bp, Homo sapiens
tgagctggggaggtgg

SEQ ID NO: 2907696 - DNA, 16 bp, Homo sapiens
tgagctggtgcctgct

SEQ ID NO: 2907697 - DNA, 14 bp, Homo sapiens
tgagctgtcccaag

SEQ ID NO: 2907698 - DNA, 21 bp, Homo sapiens
tgagctgtgacattgctggtc

SEQ ID NO: 2907699 - DNA, 20 bp, Homo sapiens
tgagcttctaaactgaagct

SEQ ID NO: 2907700 - DNA, 14 bp, Homo sapiens
tgagcttgagagtt

SEQ ID NO: 2907701 - DNA, 23 bp, Homo sapiens
tgaggaaaaaaatcgtccaggga

SEQ ID NO: 2907702 - DNA, 21 bp, Homo sapiens
tgaggaactgtagatgatgta

SEQ ID NO: 2907703 - DNA, 12 bp, Homo sapiens
tgaggaccaggg

SEQ ID NO: 2907704 - DNA, 20 bp, Homo sapiens
tgaggaccagggtggagctg

SEQ ID NO: 2907705 - DNA, 22 bp, Homo sapiens
tgaggaccagggtggagctgag

SEQ ID NO: 2907706 - DNA, 24 bp, Homo sapiens
tgaggactctgcaagtgtctggag

SEQ ID NO: 2907707 - DNA, 15 bp, Homo sapiens
tgaggagaagtgggg

SEQ ID NO: 2907708 - DNA, 21 bp, Homo sapiens
tgaggagcggactcacttgat

SEQ ID NO: 2907709 - DNA, 22 bp, Homo sapiens
tgaggagtggttgggctgtgcc

SEQ ID NO: 2907710 - DNA, 20 bp, Homo sapiens
tgaggataaaaaggaaggag

SEQ ID NO: 2907711 - DNA, 21 bp, Homo sapiens
tgaggataaaaaggaaggaga

SEQ ID NO: 2907712 - DNA, 18 bp, Homo sapiens
tgaggataaggggtgggg

SEQ ID NO: 2907713 - DNA, 17 bp, Homo sapiens
tgaggatcccctgtccc

SEQ ID NO: 2907714 - DNA, 17 bp, Homo sapiens
tgaggcaagccatggag

SEQ ID NO: 2907715 - DNA, 13 bp, Homo sapiens
tgaggcagaagaa

SEQ ID NO: 2907716 - DNA, 22 bp, Homo sapiens
tgaggcagatggccactgctct

SEQ ID NO: 2907717 - DNA, 13 bp, Homo sapiens
tgaggcaggagaa

SEQ ID NO: 2907718 - DNA, 17 bp, Homo sapiens
tgaggcatgagttactg

SEQ ID NO: 2907719 - DNA, 12 bp, Homo sapiens
tgaggccacact

SEQ ID NO: 2907720 - DNA, 13 bp, Homo sapiens
tgaggccagggca

SEQ ID NO: 2907721 - DNA, 15 bp, Homo sapiens
tgaggccagggcaga

SEQ ID NO: 2907722 - DNA, 16 bp, Homo sapiens
tgaggccagggcagag

SEQ ID NO: 2907723 - DNA, 14 bp, Homo sapiens
tgaggccggccctg

SEQ ID NO: 2907724 - DNA, 16 bp, Homo sapiens
tgatcccagctcactg

SEQ ID NO: 2907725 - DNA, 21 bp, Homo sapiens
tgatcccctttggttttacta

SEQ ID NO: 2907726 - DNA, 22 bp, Homo sapiens
tgatcccctttggttttactac

SEQ ID NO: 2907727 - DNA, 17 bp, Homo sapiens
tgatcccgttttcccca

SEQ ID NO: 2907728 - DNA, 12 bp, Homo sapiens
tgatcctcagtg

SEQ ID NO: 2907729 - DNA, 15 bp, Homo sapiens
tgatcctgccaatct

SEQ ID NO: 2907730 - DNA, 16 bp, Homo sapiens
tgatcctggaggccca

SEQ ID NO: 2907731 - DNA, 21 bp, Homo sapiens
tgatcctgtattcagacagat

SEQ ID NO: 2907732 - DNA, 19 bp, Homo sapiens
tgatcgtgacgctgaataa

SEQ ID NO: 2907733 - DNA, 23 bp, Homo sapiens
tgatcgtgacgctgaataaatgt

SEQ ID NO: 2907734 - DNA, 19 bp, Homo sapiens
tgatctacccgtgcctggg

SEQ ID NO: 2907735 - DNA, 13 bp, Homo sapiens
tgatctccctgcc

SEQ ID NO: 2907736 - DNA, 14 bp, Homo sapiens
tgatctccctgccg

SEQ ID NO: 2907737 - DNA, 11 bp, Homo sapiens
tgatctcctga

SEQ ID NO: 2907738 - DNA, 18 bp, Homo sapiens
tgatctcgaactcctaac

SEQ ID NO: 2907739 - DNA, 16 bp, Homo sapiens
tgatctgaacatctgg

SEQ ID NO: 2907740 - DNA, 15 bp, Homo sapiens
tgatctggaacccag

SEQ ID NO: 2907741 - DNA, 17 bp, Homo sapiens
tgatctggaacccagac

SEQ ID NO: 2907742 - DNA, 18 bp, Homo sapiens
tgatctggaacccagact

SEQ ID NO: 2907743 - DNA, 14 bp, Homo sapiens
tgatctgtccacct

SEQ ID NO: 2907744 - DNA, 17 bp, Homo sapiens
tgatcttatttttctaa

SEQ ID NO: 2907745 - DNA, 20 bp, Homo sapiens
tgatcttatttttctaaacg

SEQ ID NO: 2907746 - DNA, 14 bp, Homo sapiens
tgatgaaaatattt

SEQ ID NO: 2907747 - DNA, 17 bp, Homo sapiens
tgatgaatctacatttg

SEQ ID NO: 2907748 - DNA, 20 bp, Homo sapiens
tgatgaatgaggaacaatca

SEQ ID NO: 2907749 - DNA, 20 bp, Homo sapiens
tgatgacaaaaaatgtttta

SEQ ID NO: 2907750 - DNA, 17 bp, Homo sapiens
tgatgactggcatttta

SEQ ID NO: 2907751 - DNA, 18 bp, Homo sapiens
tgatgactggcattttat

SEQ ID NO: 2907752 - DNA, 20 bp, Homo sapiens
tgatgagatattaaattctc

SEQ ID NO: 2907753 - DNA, 21 bp, Homo sapiens
tgatgaggccgcggcctcccc

SEQ ID NO: 2907754 - DNA, 22 bp, Homo sapiens
tgatgaggccgcggcctccccg

SEQ ID NO: 2907755 - DNA, 19 bp, Homo sapiens
tgatgaggtattttttcct

SEQ ID NO: 2907756 - DNA, 16 bp, Homo sapiens
tgatgatgataataat

SEQ ID NO: 2907757 - DNA, 16 bp, Homo sapiens
tgatgatgatgataat

SEQ ID NO: 2907758 - DNA, 14 bp, Homo sapiens
tgatgatgcatgga

SEQ ID NO: 2907759 - DNA, 16 bp, Homo sapiens
tgatgcaaggattaca

SEQ ID NO: 2907760 - DNA, 20 bp, Homo sapiens
tgatgcaaggattacagaaa

SEQ ID NO: 2907761 - DNA, 22 bp, Homo sapiens
tgatgcaaggattacagaaact

SEQ ID NO: 2907762 - DNA, 23 bp, Homo sapiens
tgatgcaaggattacagaaactg

SEQ ID NO: 2907763 - DNA, 17 bp, Homo sapiens
tgatgcatgcactgttc

SEQ ID NO: 2907764 - DNA, 20 bp, Homo sapiens
tgatgcatggagtgtttgac

SEQ ID NO: 2907765 - DNA, 16 bp, Homo sapiens
tgatgcatgtctttta

SEQ ID NO: 2907766 - DNA, 16 bp, Homo sapiens
tgatgccaaggggctg

SEQ ID NO: 2907767 - DNA, 14 bp, Homo sapiens
tgatgcctctgtct

SEQ ID NO: 2907768 - DNA, 12 bp, Homo sapiens
tgatgctcagtt

SEQ ID NO: 2907769 - DNA, 13 bp, Homo sapiens
tgatgctgaaata

SEQ ID NO: 2907770 - DNA, 20 bp, Homo sapiens
tgatgctgtgctatgaattt

SEQ ID NO: 2907771 - DNA, 22 bp, Homo sapiens
tgatgctttggaagatgcagaa

SEQ ID NO: 2907772 - DNA, 19 bp, Homo sapiens
tgatggaacagtgaaagtc

SEQ ID NO: 2907773 - DNA, 11 bp, Homo sapiens
tgatggaggag

SEQ ID NO: 2907774 - DNA, 15 bp, Homo sapiens
tgatggcaacactga

SEQ ID NO: 2907775 - DNA, 18 bp, Homo sapiens
tgatggcaacagatctgg

SEQ ID NO: 2907776 - DNA, 22 bp, Homo sapiens
tgatggctaagatactgctgat

SEQ ID NO: 2907777 - DNA, 16 bp, Homo sapiens
tgatggctagattcta

SEQ ID NO: 2907778 - DNA, 13 bp, Homo sapiens
tgatgggaaaact

SEQ ID NO: 2907779 - DNA, 15 bp, Homo sapiens
tgatgggaaaatatt

SEQ ID NO: 2907780 - DNA, 24 bp, Homo sapiens
tgatgggattctggacaggatgtg

SEQ ID NO: 2907781 - DNA, 23 bp, Homo sapiens
tgatgggcttttgttctgagggg

SEQ ID NO: 2907782 - DNA, 14 bp, Homo sapiens
tgatggggaaggag

SEQ ID NO: 2907783 - DNA, 22 bp, Homo sapiens
tgatgtaatcttgaattgtaac

SEQ ID NO: 2907784 - DNA, 13 bp, Homo sapiens
tgatgtcatttga

SEQ ID NO: 2907785 - DNA, 14 bp, Homo sapiens
tgatgtgaagccaa

SEQ ID NO: 2907786 - DNA, 15 bp, Homo sapiens
tgatgtgttcggttt

SEQ ID NO: 2907787 - DNA, 16 bp, Homo sapiens
tgatgtgtttttgtat

SEQ ID NO: 2907788 - DNA, 15 bp, Homo sapiens
tgatgttaaagcatt

SEQ ID NO: 2907789 - DNA, 15 bp, Homo sapiens
tgatgttaacacatt

SEQ ID NO: 2907790 - DNA, 16 bp, Homo sapiens
tgatgttaacacattt

SEQ ID NO: 2907791 - DNA, 17 bp, Homo sapiens
tgatgttaacacatttt

SEQ ID NO: 2907792 - DNA, 13 bp, Homo sapiens
tgatgttcagtgt

SEQ ID NO: 2907793 - DNA, 14 bp, Homo sapiens
tgatgttcagtgta

SEQ ID NO: 2907794 - DNA, 12 bp, Homo sapiens
tgatgttctaag

SEQ ID NO: 2907795 - DNA, 14 bp, Homo sapiens
tgatgttctaaggc

SEQ ID NO: 2907796 - DNA, 15 bp, Homo sapiens
tgatgttctaaggct

SEQ ID NO: 2907797 - DNA, 21 bp, Homo sapiens
tgatgttctaaggctctgaga

SEQ ID NO: 2907798 - DNA, 14 bp, Homo sapiens
tgatgtttcctgga

SEQ ID NO: 2907799 - DNA, 11 bp, Homo sapiens
tgattaaaatc

SEQ ID NO: 2907800 - DNA, 15 bp, Homo sapiens
tgattaaaatctctt

SEQ ID NO: 2907801 - DNA, 15 bp, Homo sapiens
tgattaaaatggtga

SEQ ID NO: 2907802 - DNA, 13 bp, Homo sapiens
tgattaaagaaaa

SEQ ID NO: 2907803 - DNA, 19 bp, Homo sapiens
tgattaaataagattctaa

SEQ ID NO: 2907804 - DNA, 20 bp, Homo sapiens
tgattaaataagattctaac

SEQ ID NO: 2907805 - DNA, 14 bp, Homo sapiens
tgattaacaatgta

SEQ ID NO: 2907806 - DNA, 15 bp, Homo sapiens
tgattaacaatgtat

SEQ ID NO: 2907807 - DNA, 16 bp, Homo sapiens
tgattaacaatgtatt

SEQ ID NO: 2907808 - DNA, 23 bp, Homo sapiens
tgattaacaatgtattttaataa

SEQ ID NO: 2907809 - DNA, 14 bp, Homo sapiens
tgattacagtgcag

SEQ ID NO: 2907810 - DNA, 15 bp, Homo sapiens
tgattactctttgct

SEQ ID NO: 2907811 - DNA, 19 bp, Homo sapiens
tgattagaaaggaaatgaa

SEQ ID NO: 2907812 - DNA, 18 bp, Homo sapiens
tgattagcaagttacagt

SEQ ID NO: 2907813 - DNA, 13 bp, Homo sapiens
tgattataaatgt

SEQ ID NO: 2907814 - DNA, 21 bp, Homo sapiens
tgattatagcaatgtgatttt

SEQ ID NO: 2907815 - DNA, 14 bp, Homo sapiens
tgattattcagtgt

SEQ ID NO: 2907816 - DNA, 16 bp, Homo sapiens
tgattattcagtgtca

SEQ ID NO: 2907817 - DNA, 16 bp, Homo sapiens
tgattatttattattt

SEQ ID NO: 2907818 - DNA, 16 bp, Homo sapiens
tgattcaaggctcaga

SEQ ID NO: 2907819 - DNA, 21 bp, Homo sapiens
tgattcaaggctcagaaggaa

SEQ ID NO: 2907820 - DNA, 23 bp, Homo sapiens
tgattcaaggctcagaaggaatg

SEQ ID NO: 2907821 - DNA, 12 bp, Homo sapiens
tgattcactgca

SEQ ID NO: 2907822 - DNA, 17 bp, Homo sapiens
tgattcactgcatggct

SEQ ID NO: 2907823 - DNA, 14 bp, Homo sapiens
tgattcaggtgcag

SEQ ID NO: 2907824 - DNA, 13 bp, Homo sapiens
tgattcataaaga

SEQ ID NO: 2907825 - DNA, 18 bp, Homo sapiens
tgattcatagtaacttct

SEQ ID NO: 2907826 - DNA, 16 bp, Homo sapiens
tgattcatttgaataa

SEQ ID NO: 2907827 - DNA, 20 bp, Homo sapiens
tgattcatttgaataaaaag

SEQ ID NO: 2907828 - DNA, 17 bp, Homo sapiens
tgattcgtctgcgattt

SEQ ID NO: 2907829 - DNA, 20 bp, Homo sapiens
tgattctagtacataattga

SEQ ID NO: 2907830 - DNA, 21 bp, Homo sapiens
tgattctatttatatgtacat

SEQ ID NO: 2907831 - DNA, 17 bp, Homo sapiens
tgattctcgactgcttt

SEQ ID NO: 2907832 - DNA, 14 bp, Homo sapiens
tgattctctgtggt

SEQ ID NO: 2907833 - DNA, 19 bp, Homo sapiens
tgattctctgtggtttttt

SEQ ID NO: 2907834 - DNA, 22 bp, Homo sapiens
tgattctcttagacacttttat

SEQ ID NO: 2907835 - DNA, 18 bp, Homo sapiens
tgattctgaagcttatgt

SEQ ID NO: 2907836 - DNA, 19 bp, Homo sapiens
tgattgacagctttgctgc

SEQ ID NO: 2907837 - DNA, 21 bp, Homo sapiens
tgattgacagctttgctgctg

SEQ ID NO: 2907838 - DNA, 14 bp, Homo sapiens
tgattgatttgaag

SEQ ID NO: 2907839 - DNA, 19 bp, Homo sapiens
tgattgctaaatgtaacag

SEQ ID NO: 2907840 - DNA, 16 bp, Homo sapiens
tgattgggaataaata

SEQ ID NO: 2907841 - DNA, 18 bp, Homo sapiens
tgattgggaataaatatg

SEQ ID NO: 2907842 - DNA, 13 bp, Homo sapiens
tgattgtcagcca

SEQ ID NO: 2907843 - DNA, 22 bp, Homo sapiens
tgattgtcagccacctccctct

SEQ ID NO: 2907844 - DNA, 14 bp, Homo sapiens
tgattgtggaatgg

SEQ ID NO: 2907845 - DNA, 20 bp, Homo sapiens
tgattgttcttttgtttcat

SEQ ID NO: 2907846 - DNA, 22 bp, Homo sapiens
tgattgttcttttgtttcatta

SEQ ID NO: 2907847 - DNA, 17 bp, Homo sapiens
tgattgtttgcacagag

SEQ ID NO: 2907848 - DNA, 14 bp, Homo sapiens
tgattgttttaaca

SEQ ID NO: 2907849 - DNA, 14 bp, Homo sapiens
tgatttaaaacatg

SEQ ID NO: 2907850 - DNA, 16 bp, Homo sapiens
tgatttaaaacatgta

SEQ ID NO: 2907851 - DNA, 18 bp, Homo sapiens
tgatttaatagtgttaat

SEQ ID NO: 2907852 - DNA, 22 bp, Homo sapiens
tgatttaatagtgttaatcaat

SEQ ID NO: 2907853 - DNA, 20 bp, Homo sapiens
tgatttatcctcacataaaa

SEQ ID NO: 2907854 - DNA, 14 bp, Homo sapiens
tgatttccaaagag

SEQ ID NO: 2907855 - DNA, 15 bp, Homo sapiens
tgatttcccactgca

SEQ ID NO: 2907856 - DNA, 14 bp, Homo sapiens
tgatttccttgaat

SEQ ID NO: 2907857 - DNA, 15 bp, Homo sapiens
tgatttccttgaatg

SEQ ID NO: 2907858 - DNA, 13 bp, Homo sapiens
tgatttctagaat

SEQ ID NO: 2907859 - DNA, 18 bp, Homo sapiens
tgatttctagaatggttt

SEQ ID NO: 2907860 - DNA, 11 bp, Homo sapiens
tgatttctagg

SEQ ID NO: 2907861 - DNA, 21 bp, Homo sapiens
tgatttcttttcttcctggct

SEQ ID NO: 2907862 - DNA, 13 bp, Homo sapiens
tctgcctcctccc

SEQ ID NO: 2907863 - DNA, 18 bp, Homo sapiens
tctgcctctaactccctc

SEQ ID NO: 2907864 - DNA, 18 bp, Homo sapiens
tctgcctcttctgggagg

SEQ ID NO: 2907865 - DNA, 18 bp, Homo sapiens
tctgcctgcactccctgg

SEQ ID NO: 2907866 - DNA, 23 bp, Homo sapiens
tctgcctgcactccctggccttg

SEQ ID NO: 2907867 - DNA, 17 bp, Homo sapiens
tctgcctgccagctgca

SEQ ID NO: 2907868 - DNA, 18 bp, Homo sapiens
tctgcctgccagctgcac

SEQ ID NO: 2907869 - DNA, 22 bp, Homo sapiens
tctgcctgccagctgcactgat

SEQ ID NO: 2907870 - DNA, 17 bp, Homo sapiens
tctgcctgctgggctct

SEQ ID NO: 2907871 - DNA, 12 bp, Homo sapiens
tctgcctggagt

SEQ ID NO: 2907872 - DNA, 13 bp, Homo sapiens
tctgccttagcct

SEQ ID NO: 2907873 - DNA, 11 bp, Homo sapiens
tctgccttcca

SEQ ID NO: 2907874 - DNA, 19 bp, Homo sapiens
tctgcctttagctttgaca

SEQ ID NO: 2907875 - DNA, 14 bp, Homo sapiens
tctgcgccaggcag

SEQ ID NO: 2907876 - DNA, 13 bp, Homo sapiens
tctgcgcctcagg

SEQ ID NO: 2907877 - DNA, 17 bp, Homo sapiens
tctgcgtccaccaggcc

SEQ ID NO: 2907878 - DNA, 18 bp, Homo sapiens
tctgcgtccaccaggcct

SEQ ID NO: 2907879 - DNA, 20 bp, Homo sapiens
tctgcgtccaccaggcctca

SEQ ID NO: 2907880 - DNA, 22 bp, Homo sapiens
tctgcgtccaccaggcctcact

SEQ ID NO: 2907881 - DNA, 20 bp, Homo sapiens
tctgcgtgtcacctgtgctt

SEQ ID NO: 2907882 - DNA, 17 bp, Homo sapiens
tctgctagagcagacag

SEQ ID NO: 2907883 - DNA, 18 bp, Homo sapiens
tctgctcagatagaatga

SEQ ID NO: 2907884 - DNA, 14 bp, Homo sapiens
tctgctcagctctg

SEQ ID NO: 2907885 - DNA, 14 bp, Homo sapiens
tctgctcagcttct

SEQ ID NO: 2907886 - DNA, 18 bp, Homo sapiens
tctgctcaggtaaatctt

SEQ ID NO: 2907887 - DNA, 18 bp, Homo sapiens
tctgctctattatataaa

SEQ ID NO: 2907888 - DNA, 21 bp, Homo sapiens
tctgctctgcgtgtcacctgt

SEQ ID NO: 2907889 - DNA, 16 bp, Homo sapiens
tctgctgatataatat

SEQ ID NO: 2907890 - DNA, 18 bp, Homo sapiens
tctgctggtctctggctc

SEQ ID NO: 2907891 - DNA, 19 bp, Homo sapiens
tctgctggtctctggctct

SEQ ID NO: 2907892 - DNA, 20 bp, Homo sapiens
tctgcttaccgttcaagagg

SEQ ID NO: 2907893 - DNA, 22 bp, Homo sapiens
tctgcttccatggcttcctgag

SEQ ID NO: 2907894 - DNA, 12 bp, Homo sapiens
tctgcttcccag

SEQ ID NO: 2907895 - DNA, 23 bp, Homo sapiens
tctgcttctcggggtccagtgca

SEQ ID NO: 2907896 - DNA, 21 bp, Homo sapiens
tctgctttaaattaaaatttt

SEQ ID NO: 2907897 - DNA, 14 bp, Homo sapiens
tctgctttctgttc

SEQ ID NO: 2907898 - DNA, 16 bp, Homo sapiens
tctgctttctgttcat

SEQ ID NO: 2907899 - DNA, 18 bp, Homo sapiens
tctgctttctgttcatct

SEQ ID NO: 2907900 - DNA, 21 bp, Homo sapiens
tctgctttctgttcatctctt

SEQ ID NO: 2907901 - DNA, 20 bp, Homo sapiens
tctgctttgctcttcaagaa

SEQ ID NO: 2907902 - DNA, 13 bp, Homo sapiens
tctggaacccaga

SEQ ID NO: 2907903 - DNA, 19 bp, Homo sapiens
tctggaagtattttcctcc

SEQ ID NO: 2907904 - DNA, 13 bp, Homo sapiens
tctggaagtccaa

SEQ ID NO: 2907905 - DNA, 18 bp, Homo sapiens
tctggacagatggacgca

SEQ ID NO: 2907906 - DNA, 17 bp, Homo sapiens
tctggacagtcagctct

SEQ ID NO: 2907907 - DNA, 13 bp, Homo sapiens
tctggacctcagg

SEQ ID NO: 2907908 - DNA, 16 bp, Homo sapiens
tctggacctctcttgt

SEQ ID NO: 2907909 - DNA, 19 bp, Homo sapiens
tctggactaaccctgtggt

SEQ ID NO: 2907910 - DNA, 16 bp, Homo sapiens
tctggagaagcagtga

SEQ ID NO: 2907911 - DNA, 12 bp, Homo sapiens
tctggagagctg

SEQ ID NO: 2907912 - DNA, 21 bp, Homo sapiens
tctggagcaatctgacccttc

SEQ ID NO: 2907913 - DNA, 18 bp, Homo sapiens
tctggagcccctcctccc

SEQ ID NO: 2907914 - DNA, 14 bp, Homo sapiens
tctggagcggctgc

SEQ ID NO: 2907915 - DNA, 15 bp, Homo sapiens
tctggagcggctgct

SEQ ID NO: 2907916 - DNA, 17 bp, Homo sapiens
tctggagcggctgctcg

SEQ ID NO: 2907917 - DNA, 20 bp, Homo sapiens
tctggagtgcccccagccca

SEQ ID NO: 2907918 - DNA, 14 bp, Homo sapiens
tctggagtggccac

SEQ ID NO: 2907919 - DNA, 16 bp, Homo sapiens
tctggagttgatctgg

SEQ ID NO: 2907920 - DNA, 21 bp, Homo sapiens
tctggagttgatctggaaccc

SEQ ID NO: 2907921 - DNA, 17 bp, Homo sapiens
tctggattaggtctctg

SEQ ID NO: 2907922 - DNA, 17 bp, Homo sapiens
tctggcaaacatgtgca

SEQ ID NO: 2907923 - DNA, 18 bp, Homo sapiens
tctggcaaacatgtgcaa

SEQ ID NO: 2907924 - DNA, 20 bp, Homo sapiens
tctggcagggtgggatggag

SEQ ID NO: 2907925 - DNA, 16 bp, Homo sapiens
tctggcatctcccaca

SEQ ID NO: 2907926 - DNA, 20 bp, Homo sapiens
tctggcattctacacctgga

SEQ ID NO: 2907927 - DNA, 17 bp, Homo sapiens
tctggccaggaagcttt

SEQ ID NO: 2907928 - DNA, 11 bp, Homo sapiens
tctggccaggc

SEQ ID NO: 2907929 - DNA, 20 bp, Homo sapiens
tctggccctggcgggtggct

SEQ ID NO: 2907930 - DNA, 23 bp, Homo sapiens
tctggccctggcgggtggctgca

SEQ ID NO: 2907931 - DNA, 13 bp, Homo sapiens
tctggcctcccac

SEQ ID NO: 2907932 - DNA, 12 bp, Homo sapiens
tctggcctgagg

SEQ ID NO: 2907933 - DNA, 14 bp, Homo sapiens
tctggcgagccctt

SEQ ID NO: 2907934 - DNA, 15 bp, Homo sapiens
tctggcgagccctta

SEQ ID NO: 2907935 - DNA, 14 bp, Homo sapiens
tctggctcagctgt

SEQ ID NO: 2907936 - DNA, 21 bp, Homo sapiens
tctggctcagctgtggtccca

SEQ ID NO: 2907937 - DNA, 15 bp, Homo sapiens
tctggctctccccaa

SEQ ID NO: 2907938 - DNA, 15 bp, Homo sapiens
tctggcttctggcca

SEQ ID NO: 2907939 - DNA, 13 bp, Homo sapiens
tctggcttggcct

SEQ ID NO: 2907940 - DNA, 15 bp, Homo sapiens
tctggctttgttctt

SEQ ID NO: 2907941 - DNA, 19 bp, Homo sapiens
tctggctttgttcttgtca

SEQ ID NO: 2907942 - DNA, 23 bp, Homo sapiens
tctgggaactgaatcaggaaact

SEQ ID NO: 2907943 - DNA, 20 bp, Homo sapiens
tctgggaagggagagggcct

SEQ ID NO: 2907944 - DNA, 15 bp, Homo sapiens
tctgggaccctttcc

SEQ ID NO: 2907945 - DNA, 19 bp, Homo sapiens
tctgggagggcagcagggc

SEQ ID NO: 2907946 - DNA, 18 bp, Homo sapiens
tctgggagtcacacagtg

SEQ ID NO: 2907947 - DNA, 19 bp, Homo sapiens
tctgggccaccaggatcag

SEQ ID NO: 2907948 - DNA, 21 bp, Homo sapiens
tctgggccattctccacagca

SEQ ID NO: 2907949 - DNA, 20 bp, Homo sapiens
tctggggaaagacactgcct

SEQ ID NO: 2907950 - DNA, 23 bp, Homo sapiens
tctggggaaagacactgcctggg

SEQ ID NO: 2907951 - DNA, 15 bp, Homo sapiens
tctgggggaaaaagc

SEQ ID NO: 2907952 - DNA, 13 bp, Homo sapiens
tctgggggctggt

SEQ ID NO: 2907953 - DNA, 15 bp, Homo sapiens
tctgggggctggttg

SEQ ID NO: 2907954 - DNA, 21 bp, Homo sapiens
tctggggggacccagtgcaga

SEQ ID NO: 2907955 - DNA, 15 bp, Homo sapiens
tctggggtccccagg

SEQ ID NO: 2907956 - DNA, 21 bp, Homo sapiens
tctgggtacctgcaagcagaa

SEQ ID NO: 2907957 - DNA, 20 bp, Homo sapiens
tctgggtagaagccaccctt

SEQ ID NO: 2907958 - DNA, 21 bp, Homo sapiens
tctgggtagaagccacccttc

SEQ ID NO: 2907959 - DNA, 23 bp, Homo sapiens
tctgggtagaagccacccttccc

SEQ ID NO: 2907960 - DNA, 15 bp, Homo sapiens
tctgggtcagtggtc

SEQ ID NO: 2907961 - DNA, 13 bp, Homo sapiens
tctgggtcccggg

SEQ ID NO: 2907962 - DNA, 23 bp, Homo sapiens
tctgggtgaaagggatactttta

SEQ ID NO: 2907963 - DNA, 14 bp, Homo sapiens
tctgggtgccctga

SEQ ID NO: 2907964 - DNA, 20 bp, Homo sapiens
tctgggtggatgtgagcaga

SEQ ID NO: 2907965 - DNA, 21 bp, Homo sapiens
tctgggtggatgtgagcagaa

SEQ ID NO: 2907966 - DNA, 22 bp, Homo sapiens
tctgggtggatgtgagcagaag

SEQ ID NO: 2907967 - DNA, 23 bp, Homo sapiens
tctgggtttacaacaaacactgt

SEQ ID NO: 2907968 - DNA, 13 bp, Homo sapiens
tctgggtttggat

SEQ ID NO: 2907969 - DNA, 22 bp, Homo sapiens
tctggtatggtgctaatatttt

SEQ ID NO: 2907970 - DNA, 13 bp, Homo sapiens
tctggtcctaccc

SEQ ID NO: 2907971 - DNA, 12 bp, Homo sapiens
tctggtcctcgg

SEQ ID NO: 2907972 - DNA, 16 bp, Homo sapiens
tctggtcctcggagct

SEQ ID NO: 2907973 - DNA, 21 bp, Homo sapiens
tctggtcctgttttctaaaaa

SEQ ID NO: 2907974 - DNA, 16 bp, Homo sapiens
tctggtgataaggaca

SEQ ID NO: 2907975 - DNA, 13 bp, Homo sapiens
tctggtgcctcca

SEQ ID NO: 2907976 - DNA, 22 bp, Homo sapiens
tctggtggaggagctgagggag

SEQ ID NO: 2907977 - DNA, 15 bp, Homo sapiens
tctggtggtctcctc

SEQ ID NO: 2907978 - DNA, 13 bp, Homo sapiens
tctggttctaaca

SEQ ID NO: 2907979 - DNA, 14 bp, Homo sapiens
tctgtaaaactaag

SEQ ID NO: 2907980 - DNA, 21 bp, Homo sapiens
tctgtaaaactaagaaactta

SEQ ID NO: 2907981 - DNA, 17 bp, Homo sapiens
tctgtaaacagaataaa

SEQ ID NO: 2907982 - DNA, 16 bp, Homo sapiens
tctgtaaatatgtttt

SEQ ID NO: 2907983 - DNA, 21 bp, Homo sapiens
tctgtaaccacctctctgtct

SEQ ID NO: 2907984 - DNA, 22 bp, Homo sapiens
tctgtaaccacctctctgtctt

SEQ ID NO: 2907985 - DNA, 18 bp, Homo sapiens
tctgtaaggaactggaac

SEQ ID NO: 2907986 - DNA, 15 bp, Homo sapiens
tctgtaatctcgttt

SEQ ID NO: 2907987 - DNA, 17 bp, Homo sapiens
tctgtaattgtgtgtga

SEQ ID NO: 2907988 - DNA, 14 bp, Homo sapiens
tctgtacactgccc

SEQ ID NO: 2907989 - DNA, 22 bp, Homo sapiens
tctgtacattttttctttatca

SEQ ID NO: 2907990 - DNA, 12 bp, Homo sapiens
tctgtacttggt

SEQ ID NO: 2907991 - DNA, 20 bp, Homo sapiens
tctgtacttttcattctctt

SEQ ID NO: 2907992 - DNA, 15 bp, Homo sapiens
tctgtagagccaatt

SEQ ID NO: 2907993 - DNA, 15 bp, Homo sapiens
tctgtaggtacgttt

SEQ ID NO: 2907994 - DNA, 21 bp, Homo sapiens
tcttaaaaagttgttcaacta

SEQ ID NO: 2907995 - DNA, 13 bp, Homo sapiens
tcttaaatcagaa

SEQ ID NO: 2907996 - DNA, 15 bp, Homo sapiens
tcttaaatcagaata

SEQ ID NO: 2907997 - DNA, 14 bp, Homo sapiens
tcttaaatttttca

SEQ ID NO: 2907998 - DNA, 12 bp, Homo sapiens
tcttaacactga

SEQ ID NO: 2907999 - DNA, 16 bp, Homo sapiens
tcttaacctttgctat

SEQ ID NO: 2908000 - DNA, 19 bp, Homo sapiens
tcttaactgaagaaagaga

SEQ ID NO: 2908001 - DNA, 14 bp, Homo sapiens
tcttaactgttgct

SEQ ID NO: 2908002 - DNA, 16 bp, Homo sapiens
tcttaagatgtccagg

SEQ ID NO: 2908003 - DNA, 19 bp, Homo sapiens
tcttaagcagagataaata

SEQ ID NO: 2908004 - DNA, 23 bp, Homo sapiens
tcttaagccatcttggtaaattt

SEQ ID NO: 2908005 - DNA, 19 bp, Homo sapiens
tcttaaggacaaagtgcca

SEQ ID NO: 2908006 - DNA, 15 bp, Homo sapiens
tcttaaggagactgg

SEQ ID NO: 2908007 - DNA, 23 bp, Homo sapiens
tcttaaggtgaggcctgtctgtg

SEQ ID NO: 2908008 - DNA, 23 bp, Homo sapiens
tcttaagttttgtttagcaatgt

SEQ ID NO: 2908009 - DNA, 20 bp, Homo sapiens
tcttaatgatgttatcttaa

SEQ ID NO: 2908010 - DNA, 15 bp, Homo sapiens
tcttaatttggataa

SEQ ID NO: 2908011 - DNA, 18 bp, Homo sapiens
tcttaatttggataataa

SEQ ID NO: 2908012 - DNA, 20 bp, Homo sapiens
tcttaattttggttgtattc

SEQ ID NO: 2908013 - DNA, 19 bp, Homo sapiens
tcttacaaataaagtttgt

SEQ ID NO: 2908014 - DNA, 16 bp, Homo sapiens
tcttacacaagagctg

SEQ ID NO: 2908015 - DNA, 19 bp, Homo sapiens
tcttacacaagagctggag

SEQ ID NO: 2908016 - DNA, 14 bp, Homo sapiens
tcttaccagtctcc

SEQ ID NO: 2908017 - DNA, 18 bp, Homo sapiens
tcttaccctagttctctt

SEQ ID NO: 2908018 - DNA, 19 bp, Homo sapiens
tcttaccctagttctctta

SEQ ID NO: 2908019 - DNA, 16 bp, Homo sapiens
tcttactgataatttt

SEQ ID NO: 2908020 - DNA, 18 bp, Homo sapiens
tcttactgtacctgttcc

SEQ ID NO: 2908021 - DNA, 19 bp, Homo sapiens
tcttactttgtgcaaaagc

SEQ ID NO: 2908022 - DNA, 23 bp, Homo sapiens
tcttactttgtgcaaaagcaggc

SEQ ID NO: 2908023 - DNA, 19 bp, Homo sapiens
tcttagaagtggaccagga

SEQ ID NO: 2908024 - DNA, 21 bp, Homo sapiens
tcttagatctggtgtccagca

SEQ ID NO: 2908025 - DNA, 12 bp, Homo sapiens
tcttagattctc

SEQ ID NO: 2908026 - DNA, 18 bp, Homo sapiens
tcttagctactgtatgca

SEQ ID NO: 2908027 - DNA, 21 bp, Homo sapiens
tcttagctatcattgcttcct

SEQ ID NO: 2908028 - DNA, 20 bp, Homo sapiens
tcttagctgaggctgagaaa

SEQ ID NO: 2908029 - DNA, 11 bp, Homo sapiens
tcttaggtctt

SEQ ID NO: 2908030 - DNA, 14 bp, Homo sapiens
tcttaggtcttcct

SEQ ID NO: 2908031 - DNA, 18 bp, Homo sapiens
tcttaggtcttcctgtgg

SEQ ID NO: 2908032 - DNA, 20 bp, Homo sapiens
tcttaggtcttcctgtggct

SEQ ID NO: 2908033 - DNA, 21 bp, Homo sapiens
tcttaggtcttcctgtggctc

SEQ ID NO: 2908034 - DNA, 21 bp, Homo sapiens
tcttagtttggattcttatgt

SEQ ID NO: 2908035 - DNA, 20 bp, Homo sapiens
tcttataaaccttgtcaata

SEQ ID NO: 2908036 - DNA, 13 bp, Homo sapiens
tcttataaatatg

SEQ ID NO: 2908037 - DNA, 21 bp, Homo sapiens
tcttataaatatgaagctcac

SEQ ID NO: 2908038 - DNA, 20 bp, Homo sapiens
tcttatacgcttttctttgt

SEQ ID NO: 2908039 - DNA, 17 bp, Homo sapiens
tcttatagaataaaagc

SEQ ID NO: 2908040 - DNA, 20 bp, Homo sapiens
tcttatagattttttaaaaa

SEQ ID NO: 2908041 - DNA, 24 bp, Homo sapiens
tcttatccaactttttcatagtaa

SEQ ID NO: 2908042 - DNA, 17 bp, Homo sapiens
tcttatcttgctttgga

SEQ ID NO: 2908043 - DNA, 13 bp, Homo sapiens
tcttatctttgat

SEQ ID NO: 2908044 - DNA, 22 bp, Homo sapiens
tcttatgagtataatgaacact

SEQ ID NO: 2908045 - DNA, 17 bp, Homo sapiens
tcttatgcaaaactttt

SEQ ID NO: 2908046 - DNA, 15 bp, Homo sapiens
tcttatggaattgat

SEQ ID NO: 2908047 - DNA, 22 bp, Homo sapiens
tcttatggaattgatttgcatt

SEQ ID NO: 2908048 - DNA, 17 bp, Homo sapiens
tcttattcaaagatgat

SEQ ID NO: 2908049 - DNA, 18 bp, Homo sapiens
tcttattcctttaaagtg

SEQ ID NO: 2908050 - DNA, 15 bp, Homo sapiens
tcttattctcactcc

SEQ ID NO: 2908051 - DNA, 15 bp, Homo sapiens
tcttattgaaatgca

SEQ ID NO: 2908052 - DNA, 19 bp, Homo sapiens
tcttatttggaattgacat

SEQ ID NO: 2908053 - DNA, 20 bp, Homo sapiens
tcttcaaaagtaatgcctct

SEQ ID NO: 2908054 - DNA, 21 bp, Homo sapiens
tcttcaaatctcccacaagta

SEQ ID NO: 2908055 - DNA, 22 bp, Homo sapiens
tcttcaaatctcccacaagtat

SEQ ID NO: 2908056 - DNA, 20 bp, Homo sapiens
tcttcaacatgtcacactgg

SEQ ID NO: 2908057 - DNA, 16 bp, Homo sapiens
tcttcaaggcttcagt

SEQ ID NO: 2908058 - DNA, 21 bp, Homo sapiens
tcttcacctgattcaactaaa

SEQ ID NO: 2908059 - DNA, 23 bp, Homo sapiens
tcttcacctgggcgccaactgct

SEQ ID NO: 2908060 - DNA, 13 bp, Homo sapiens
tcttcaccttggt

SEQ ID NO: 2908061 - DNA, 20 bp, Homo sapiens
tcttcactgcaattttgtgt

SEQ ID NO: 2908062 - DNA, 12 bp, Homo sapiens
tcttcacttcct

SEQ ID NO: 2908063 - DNA, 13 bp, Homo sapiens
tcttcacttcctc

SEQ ID NO: 2908064 - DNA, 18 bp, Homo sapiens
tcttcagagatcatggaa

SEQ ID NO: 2908065 - DNA, 16 bp, Homo sapiens
tcttcagccacctctc

SEQ ID NO: 2908066 - DNA, 19 bp, Homo sapiens
tcttcagccacctctcttt

SEQ ID NO: 2908067 - DNA, 13 bp, Homo sapiens
tcttcagcttctt

SEQ ID NO: 2908068 - DNA, 23 bp, Homo sapiens
tcttcaggatgcacggtttctgt

SEQ ID NO: 2908069 - DNA, 17 bp, Homo sapiens
tcttcaggctctgccca

SEQ ID NO: 2908070 - DNA, 18 bp, Homo sapiens
tcttcaggctctgcccag

SEQ ID NO: 2908071 - DNA, 13 bp, Homo sapiens
tcttcagggcctg

SEQ ID NO: 2908072 - DNA, 22 bp, Homo sapiens
tcttcagggcctggttgaagaa

SEQ ID NO: 2908073 - DNA, 16 bp, Homo sapiens
tcttcaggtggaaaaa

SEQ ID NO: 2908074 - DNA, 20 bp, Homo sapiens
tcttcagtgtaatgtgactt

SEQ ID NO: 2908075 - DNA, 22 bp, Homo sapiens
tcttcagtgtaatgtgacttca

SEQ ID NO: 2908076 - DNA, 16 bp, Homo sapiens
tcttcagttaattctt

SEQ ID NO: 2908077 - DNA, 12 bp, Homo sapiens
tcttcatataaa

SEQ ID NO: 2908078 - DNA, 16 bp, Homo sapiens
tcttcatctccctgcc

SEQ ID NO: 2908079 - DNA, 18 bp, Homo sapiens
tcttcatcttcaccagag

SEQ ID NO: 2908080 - DNA, 20 bp, Homo sapiens
tcttccacaaaaaatacttt

SEQ ID NO: 2908081 - DNA, 11 bp, Homo sapiens
tcttccagaag

SEQ ID NO: 2908082 - DNA, 16 bp, Homo sapiens
tcttccagaagtgtga

SEQ ID NO: 2908083 - DNA, 18 bp, Homo sapiens
tcttcccgaaccccaagg

SEQ ID NO: 2908084 - DNA, 15 bp, Homo sapiens
tcttcccgcctcagc

SEQ ID NO: 2908085 - DNA, 14 bp, Homo sapiens
tcttccctgcccct

SEQ ID NO: 2908086 - DNA, 21 bp, Homo sapiens
tcttcccttttacatactgct

SEQ ID NO: 2908087 - DNA, 15 bp, Homo sapiens
tcttccgggcagaaa

SEQ ID NO: 2908088 - DNA, 14 bp, Homo sapiens
tcttcctcaagtct

SEQ ID NO: 2908089 - DNA, 14 bp, Homo sapiens
tcttcctcatcctg

SEQ ID NO: 2908090 - DNA, 20 bp, Homo sapiens
tcttcctccagtctgttctc

SEQ ID NO: 2908091 - DNA, 18 bp, Homo sapiens
tcttcctcttagcctctg

SEQ ID NO: 2908092 - DNA, 13 bp, Homo sapiens
tcttcctgtggct

SEQ ID NO: 2908093 - DNA, 19 bp, Homo sapiens
tcttcctgtggctccctct

SEQ ID NO: 2908094 - DNA, 17 bp, Homo sapiens
tcttcgggaccaggatt

SEQ ID NO: 2908095 - DNA, 22 bp, Homo sapiens
tcttcgtaacttcatattaata

SEQ ID NO: 2908096 - DNA, 15 bp, Homo sapiens
tcttctaattgctgt

SEQ ID NO: 2908097 - DNA, 20 bp, Homo sapiens
tcttctagaagataacattt

SEQ ID NO: 2908098 - DNA, 21 bp, Homo sapiens
tcttctagatggaccccagca

SEQ ID NO: 2908099 - DNA, 11 bp, Homo sapiens
tcttctcaagt

SEQ ID NO: 2908100 - DNA, 14 bp, Homo sapiens
tcttctcaagttct

SEQ ID NO: 2908101 - DNA, 15 bp, Homo sapiens
tcttctcaagttcta

SEQ ID NO: 2908102 - DNA, 17 bp, Homo sapiens
tcttctcaagttctaag

SEQ ID NO: 2908103 - DNA, 13 bp, Homo sapiens
tcttctcctctgg

SEQ ID NO: 2908104 - DNA, 15 bp, Homo sapiens
tcttctccttggagg

SEQ ID NO: 2908105 - DNA, 15 bp, Homo sapiens
tcttctcgcctagga

SEQ ID NO: 2908106 - DNA, 13 bp, Homo sapiens
tcttctctccact

SEQ ID NO: 2908107 - DNA, 16 bp, Homo sapiens
tcttctcttctttggg

SEQ ID NO: 2908108 - DNA, 17 bp, Homo sapiens
tcttctgcgcctcaggc

SEQ ID NO: 2908109 - DNA, 12 bp, Homo sapiens
tcttctggctca

SEQ ID NO: 2908110 - DNA, 13 bp, Homo sapiens
tcttctggctcaa

SEQ ID NO: 2908111 - DNA, 18 bp, Homo sapiens
tcttctggctcaaaaaga

SEQ ID NO: 2908112 - DNA, 17 bp, Homo sapiens
tcttctgggagggcagc

SEQ ID NO: 2908113 - DNA, 22 bp, Homo sapiens
tcttctgggagggcagcagggc

SEQ ID NO: 2908114 - DNA, 19 bp, Homo sapiens
tcttctgggcagagcctgt

SEQ ID NO: 2908115 - DNA, 15 bp, Homo sapiens
tcttcttcaccattt

SEQ ID NO: 2908116 - DNA, 13 bp, Homo sapiens
tcttcttgaaaaa

SEQ ID NO: 2908117 - DNA, 20 bp, Homo sapiens
tcttcttggggcccagtgca

SEQ ID NO: 2908118 - DNA, 23 bp, Homo sapiens
tcttctttgggatgctatttcag

SEQ ID NO: 2908119 - DNA, 15 bp, Homo sapiens
tcttcttttcctgca

SEQ ID NO: 2908120 - DNA, 16 bp, Homo sapiens
tcttcttttggcttcc

SEQ ID NO: 2908121 - DNA, 18 bp, Homo sapiens
tcttcttttggcttccat

SEQ ID NO: 2908122 - DNA, 21 bp, Homo sapiens
tcttctttttgaaatcagcat

SEQ ID NO: 2908123 - DNA, 19 bp, Homo sapiens
tcttctttttgcttcaaaa

SEQ ID NO: 2908124 - DNA, 13 bp, Homo sapiens
tctctaacatatg

SEQ ID NO: 2908125 - DNA, 21 bp, Homo sapiens
tctctaactcagaaacatcag

SEQ ID NO: 2908126 - DNA, 15 bp, Homo sapiens
tctctaataagaaaa

SEQ ID NO: 2908127 - DNA, 15 bp, Homo sapiens
tctctacccctttct

SEQ ID NO: 2908128 - DNA, 16 bp, Homo sapiens
tctctactccatggtt

SEQ ID NO: 2908129 - DNA, 21 bp, Homo sapiens
tctctactccatggttctcaa

SEQ ID NO: 2908130 - DNA, 22 bp, Homo sapiens
tctctacttttccctgtacttt

SEQ ID NO: 2908131 - DNA, 15 bp, Homo sapiens
tctctagtagttaaa

SEQ ID NO: 2908132 - DNA, 20 bp, Homo sapiens
tctctagtccctgtgttctg

SEQ ID NO: 2908133 - DNA, 14 bp, Homo sapiens
tctctatcattaaa

SEQ ID NO: 2908134 - DNA, 20 bp, Homo sapiens
tctctatgcaaaatgtctgt

SEQ ID NO: 2908135 - DNA, 14 bp, Homo sapiens
tctctcagccccat

SEQ ID NO: 2908136 - DNA, 12 bp, Homo sapiens
tctctcagctcc

SEQ ID NO: 2908137 - DNA, 16 bp, Homo sapiens
tctctcatagtgtcat

SEQ ID NO: 2908138 - DNA, 16 bp, Homo sapiens
tctctcattgtctgtg

SEQ ID NO: 2908139 - DNA, 12 bp, Homo sapiens
tctctccagcct

SEQ ID NO: 2908140 - DNA, 18 bp, Homo sapiens
tctctccagcctcacaga

SEQ ID NO: 2908141 - DNA, 17 bp, Homo sapiens
tctctcccaacgctgaa

SEQ ID NO: 2908142 - DNA, 19 bp, Homo sapiens
tctctcccaccccctcccc

SEQ ID NO: 2908143 - DNA, 19 bp, Homo sapiens
tctctcccaccctaagggc

SEQ ID NO: 2908144 - DNA, 22 bp, Homo sapiens
tctctcccaccctaagggcagc

SEQ ID NO: 2908145 - DNA, 19 bp, Homo sapiens
tctctccctctttctagcc

SEQ ID NO: 2908146 - DNA, 12 bp, Homo sapiens
tctctccctgcc

SEQ ID NO: 2908147 - DNA, 22 bp, Homo sapiens
tctctcccttactattcccact

SEQ ID NO: 2908148 - DNA, 13 bp, Homo sapiens
tctctcccttctt

SEQ ID NO: 2908149 - DNA, 15 bp, Homo sapiens
tctctcccttcttta

SEQ ID NO: 2908150 - DNA, 11 bp, Homo sapiens
tctctcctcct

SEQ ID NO: 2908151 - DNA, 12 bp, Homo sapiens
tctctcctggac

SEQ ID NO: 2908152 - DNA, 13 bp, Homo sapiens
tctctcctgtcca

SEQ ID NO: 2908153 - DNA, 14 bp, Homo sapiens
tctctcctgtccaa

SEQ ID NO: 2908154 - DNA, 17 bp, Homo sapiens
tctctctaacataacaa

SEQ ID NO: 2908155 - DNA, 19 bp, Homo sapiens
tctctctccctctttctag

SEQ ID NO: 2908156 - DNA, 13 bp, Homo sapiens
tctctctccctta

SEQ ID NO: 2908157 - DNA, 15 bp, Homo sapiens
tctctctcccttact

SEQ ID NO: 2908158 - DNA, 11 bp, Homo sapiens
tctctctcctg

SEQ ID NO: 2908159 - DNA, 10 bp, Homo sapiens
tctctctctt

SEQ ID NO: 2908160 - DNA, 14 bp, Homo sapiens
tctctctgcccaac

SEQ ID NO: 2908161 - DNA, 14 bp, Homo sapiens
tctctctgcctgct

SEQ ID NO: 2908162 - DNA, 15 bp, Homo sapiens
tctctctgcctgctg

SEQ ID NO: 2908163 - DNA, 17 bp, Homo sapiens
tctctctggagcccctc

SEQ ID NO: 2908164 - DNA, 20 bp, Homo sapiens
tctctctgtggtggttcatt

SEQ ID NO: 2908165 - DNA, 14 bp, Homo sapiens
tctctcttggaatt

SEQ ID NO: 2908166 - DNA, 14 bp, Homo sapiens
tctctgagcagtga

SEQ ID NO: 2908167 - DNA, 18 bp, Homo sapiens
tctctgagtcagctgacc

SEQ ID NO: 2908168 - DNA, 18 bp, Homo sapiens
tctctgatatacaaaggg

SEQ ID NO: 2908169 - DNA, 23 bp, Homo sapiens
tctctgatcaaaattacttttct

SEQ ID NO: 2908170 - DNA, 15 bp, Homo sapiens
tctctgcagccagcc

SEQ ID NO: 2908171 - DNA, 14 bp, Homo sapiens
tctctgcccagccg

SEQ ID NO: 2908172 - DNA, 16 bp, Homo sapiens
tctctgccgctacctc

SEQ ID NO: 2908173 - DNA, 18 bp, Homo sapiens
tctctgcctagaatcttt

SEQ ID NO: 2908174 - DNA, 15 bp, Homo sapiens
tctctgcctggagca

SEQ ID NO: 2908175 - DNA, 18 bp, Homo sapiens
tctctgcctggagcaggg

SEQ ID NO: 2908176 - DNA, 15 bp, Homo sapiens
tctctgccttgcctt

SEQ ID NO: 2908177 - DNA, 13 bp, Homo sapiens
tctctgcctttga

SEQ ID NO: 2908178 - DNA, 13 bp, Homo sapiens
tctctgcttaccg

SEQ ID NO: 2908179 - DNA, 12 bp, Homo sapiens
tctctgcttcca

SEQ ID NO: 2908180 - DNA, 22 bp, Homo sapiens
tctctgcttccatggcttcctg

SEQ ID NO: 2908181 - DNA, 11 bp, Homo sapiens
tctctggagcc

SEQ ID NO: 2908182 - DNA, 20 bp, Homo sapiens
tctctggagcccctcctccc

SEQ ID NO: 2908183 - DNA, 14 bp, Homo sapiens
tctctggcatttgt

SEQ ID NO: 2908184 - DNA, 16 bp, Homo sapiens
tctctggcgacagttt

SEQ ID NO: 2908185 - DNA, 17 bp, Homo sapiens
tctctggctcagctgtg

SEQ ID NO: 2908186 - DNA, 19 bp, Homo sapiens
tctctggctcagctgtggt

SEQ ID NO: 2908187 - DNA, 19 bp, Homo sapiens
tctctggctgtaaggctct

SEQ ID NO: 2908188 - DNA, 20 bp, Homo sapiens
tctctggctgtaaggctcta

SEQ ID NO: 2908189 - DNA, 22 bp, Homo sapiens
tctctggctgtaaggctctaga

SEQ ID NO: 2908190 - DNA, 23 bp, Homo sapiens
tctctggctgtaaggctctagat

SEQ ID NO: 2908191 - DNA, 21 bp, Homo sapiens
tctctgggtttacaacaaaca

SEQ ID NO: 2908192 - DNA, 16 bp, Homo sapiens
tctctgtacttttcat

SEQ ID NO: 2908193 - DNA, 21 bp, Homo sapiens
tctctgtacttttcattctct

SEQ ID NO: 2908194 - DNA, 16 bp, Homo sapiens
tctctgtatatttatg

SEQ ID NO: 2908195 - DNA, 22 bp, Homo sapiens
tctctgtcagtgtgaaaattca

SEQ ID NO: 2908196 - DNA, 14 bp, Homo sapiens
tctctgtcccttgc

SEQ ID NO: 2908197 - DNA, 17 bp, Homo sapiens
tctctgtcccttgctgt

SEQ ID NO: 2908198 - DNA, 11 bp, Homo sapiens
tctctgtcctc

SEQ ID NO: 2908199 - DNA, 15 bp, Homo sapiens
tctctgtctctgtgg

SEQ ID NO: 2908200 - DNA, 14 bp, Homo sapiens
tctctgtcttctct

SEQ ID NO: 2908201 - DNA, 22 bp, Homo sapiens
tctctgtctttttccttcctga

SEQ ID NO: 2908202 - DNA, 13 bp, Homo sapiens
tctctgtgaatcc

SEQ ID NO: 2908203 - DNA, 17 bp, Homo sapiens
tctctgtgaatccatgg

SEQ ID NO: 2908204 - DNA, 19 bp, Homo sapiens
tctctgtgaatccatgggt

SEQ ID NO: 2908205 - DNA, 18 bp, Homo sapiens
tctctgttgactggctgt

SEQ ID NO: 2908206 - DNA, 14 bp, Homo sapiens
tctcttaaactctc

SEQ ID NO: 2908207 - DNA, 20 bp, Homo sapiens
tctcttagctactgtatgca

SEQ ID NO: 2908208 - DNA, 20 bp, Homo sapiens
tctcttcaagcatcctcaga

SEQ ID NO: 2908209 - DNA, 16 bp, Homo sapiens
tctcttcactgctaca

SEQ ID NO: 2908210 - DNA, 22 bp, Homo sapiens
tctcttcccttttttttctggg

SEQ ID NO: 2908211 - DNA, 20 bp, Homo sapiens
tctcttctgtccatcagtgc

SEQ ID NO: 2908212 - DNA, 22 bp, Homo sapiens
tctcttcttccctgtcagcctg

SEQ ID NO: 2908213 - DNA, 15 bp, Homo sapiens
tctcttcttgtttct

SEQ ID NO: 2908214 - DNA, 15 bp, Homo sapiens
tctcttgcccttcct

SEQ ID NO: 2908215 - DNA, 22 bp, Homo sapiens
tctcttggaattagatgtttat

SEQ ID NO: 2908216 - DNA, 14 bp, Homo sapiens
tctcttgtcacatg

SEQ ID NO: 2908217 - DNA, 19 bp, Homo sapiens
tctcttgtgacgtgcactg

SEQ ID NO: 2908218 - DNA, 20 bp, Homo sapiens
tctcttgtgacgtgcactgt

SEQ ID NO: 2908219 - DNA, 15 bp, Homo sapiens
tctcttgtgactcag

SEQ ID NO: 2908220 - DNA, 22 bp, Homo sapiens
tctcttgtttaaaaaaagaaaa

SEQ ID NO: 2908221 - DNA, 16 bp, Homo sapiens
tctctttccactttgt

SEQ ID NO: 2908222 - DNA, 12 bp, Homo sapiens
tctctttctctc

SEQ ID NO: 2908223 - DNA, 17 bp, Homo sapiens
tctctttgttctaaaga

SEQ ID NO: 2908224 - DNA, 12 bp, Homo sapiens
tctcttttccac

SEQ ID NO: 2908225 - DNA, 21 bp, Homo sapiens
tctttcagacttgccatgtga

SEQ ID NO: 2908226 - DNA, 23 bp, Homo sapiens
tctttcagtattaaactctcctt

SEQ ID NO: 2908227 - DNA, 12 bp, Homo sapiens
tctttcatgagt

SEQ ID NO: 2908228 - DNA, 19 bp, Homo sapiens
tctttccaaccggctttgt

SEQ ID NO: 2908229 - DNA, 19 bp, Homo sapiens
tctttccacggagccactc

SEQ ID NO: 2908230 - DNA, 14 bp, Homo sapiens
tctttccactttgt

SEQ ID NO: 2908231 - DNA, 17 bp, Homo sapiens
tccgacctctctcggcc

SEQ ID NO: 2908232 - DNA, 20 bp, Homo sapiens
tccgagagcagtgggcaggt

SEQ ID NO: 2908233 - DNA, 13 bp, Homo sapiens
tccgagaggctgg

SEQ ID NO: 2908234 - DNA, 20 bp, Homo sapiens
tccgcagactgcttggccag

SEQ ID NO: 2908235 - DNA, 22 bp, Homo sapiens
tccgcagactgcttggccagat

SEQ ID NO: 2908236 - DNA, 19 bp, Homo sapiens
tccgcagtgtggccaggct

SEQ ID NO: 2908237 - DNA, 13 bp, Homo sapiens
tccgcataagaaa

SEQ ID NO: 2908238 - DNA, 19 bp, Homo sapiens
tccgcataagaaaaagaat

SEQ ID NO: 2908239 - DNA, 16 bp, Homo sapiens
tccgcatccctgcttc

SEQ ID NO: 2908240 - DNA, 15 bp, Homo sapiens
tccgccaggcgctgc

SEQ ID NO: 2908241 - DNA, 16 bp, Homo sapiens
tccgcctactgtccct

SEQ ID NO: 2908242 - DNA, 15 bp, Homo sapiens
tccgcctccacactg

SEQ ID NO: 2908243 - DNA, 16 bp, Homo sapiens
tccgcctcccatcccg

SEQ ID NO: 2908244 - DNA, 14 bp, Homo sapiens
tccgcctgcgcctc

SEQ ID NO: 2908245 - DNA, 11 bp, Homo sapiens
tccgccttcac

SEQ ID NO: 2908246 - DNA, 17 bp, Homo sapiens
tccgccttcacattccc

SEQ ID NO: 2908247 - DNA, 20 bp, Homo sapiens
tccgcgcggagacctcctga

SEQ ID NO: 2908248 - DNA, 14 bp, Homo sapiens
tccgctgccgtgcc

SEQ ID NO: 2908249 - DNA, 15 bp, Homo sapiens
tccgcttatcctgct

SEQ ID NO: 2908250 - DNA, 16 bp, Homo sapiens
tccgcttatcctgcta

SEQ ID NO: 2908251 - DNA, 16 bp, Homo sapiens
tccggaatgccaccca

SEQ ID NO: 2908252 - DNA, 17 bp, Homo sapiens
tccggaatgccacccac

SEQ ID NO: 2908253 - DNA, 18 bp, Homo sapiens
tccggaatgccacccaca

SEQ ID NO: 2908254 - DNA, 16 bp, Homo sapiens
tccggatcctaagcat

SEQ ID NO: 2908255 - DNA, 21 bp, Homo sapiens
tccggcctgggtgacagagtg

SEQ ID NO: 2908256 - DNA, 14 bp, Homo sapiens
tccggcgcagacag

SEQ ID NO: 2908257 - DNA, 21 bp, Homo sapiens
tccggcttgacctgtttctct

SEQ ID NO: 2908258 - DNA, 12 bp, Homo sapiens
tccgggcagaaa

SEQ ID NO: 2908259 - DNA, 19 bp, Homo sapiens
tccgggcaggggagccagg

SEQ ID NO: 2908260 - DNA, 23 bp, Homo sapiens
tcctccccctgccagtgccttac

SEQ ID NO: 2908261 - DNA, 24 bp, Homo sapiens
tcctccccctgccagtgccttacc

SEQ ID NO: 2908262 - DNA, 18 bp, Homo sapiens
tcctcccctgccgcctcc

SEQ ID NO: 2908263 - DNA, 13 bp, Homo sapiens
tcctccctccctc

SEQ ID NO: 2908264 - DNA, 14 bp, Homo sapiens
tcctccctgcatct

SEQ ID NO: 2908265 - DNA, 14 bp, Homo sapiens
tcctccctggctgc

SEQ ID NO: 2908266 - DNA, 15 bp, Homo sapiens
tcctccctggctgca

SEQ ID NO: 2908267 - DNA, 19 bp, Homo sapiens
tcctccctggctgcagcct

SEQ ID NO: 2908268 - DNA, 12 bp, Homo sapiens
tcctccctgtta

SEQ ID NO: 2908269 - DNA, 16 bp, Homo sapiens
tcctcccttctgctac

SEQ ID NO: 2908270 - DNA, 14 bp, Homo sapiens
tcctccgaggccag

SEQ ID NO: 2908271 - DNA, 15 bp, Homo sapiens
tcctccgcatgccaa

SEQ ID NO: 2908272 - DNA, 19 bp, Homo sapiens
tcctccgcctactgtccct

SEQ ID NO: 2908273 - DNA, 19 bp, Homo sapiens
tcctccggttcttcctcgg

SEQ ID NO: 2908274 - DNA, 13 bp, Homo sapiens
tcctccgtggcac

SEQ ID NO: 2908275 - DNA, 14 bp, Homo sapiens
tcctccgtggcaca

SEQ ID NO: 2908276 - DNA, 15 bp, Homo sapiens
tcctccgtggcacat

SEQ ID NO: 2908277 - DNA, 23 bp, Homo sapiens
tcctcctacctcagcctcctggg

SEQ ID NO: 2908278 - DNA, 15 bp, Homo sapiens
tcctcctccaccacc

SEQ ID NO: 2908279 - DNA, 18 bp, Homo sapiens
tcctcctccaccaccgcc

SEQ ID NO: 2908280 - DNA, 19 bp, Homo sapiens
tcctcctccctcctcactc

SEQ ID NO: 2908281 - DNA, 20 bp, Homo sapiens
tctacccgtgcctgggcccc

SEQ ID NO: 2908282 - DNA, 20 bp, Homo sapiens
tctacctgagcattcaggca

SEQ ID NO: 2908283 - DNA, 18 bp, Homo sapiens
tctacctgcaacacaaca

SEQ ID NO: 2908284 - DNA, 13 bp, Homo sapiens
tctacctgttctg

SEQ ID NO: 2908285 - DNA, 14 bp, Homo sapiens
tctacctgttctgt

SEQ ID NO: 2908286 - DNA, 15 bp, Homo sapiens
tctacctgttctgta

SEQ ID NO: 2908287 - DNA, 19 bp, Homo sapiens
tctacgcaattgacaaacc

SEQ ID NO: 2908288 - DNA, 18 bp, Homo sapiens
tctactaaaaataccaaa

SEQ ID NO: 2908289 - DNA, 15 bp, Homo sapiens
tctactaagttattt

SEQ ID NO: 2908290 - DNA, 20 bp, Homo sapiens
tctactaagttattttatga

SEQ ID NO: 2908291 - DNA, 20 bp, Homo sapiens
tctactaagtttccttttaa

SEQ ID NO: 2908292 - DNA, 18 bp, Homo sapiens
tctactaattccacacct

SEQ ID NO: 2908293 - DNA, 18 bp, Homo sapiens
tctactcagcatttgatt

SEQ ID NO: 2908294 - DNA, 16 bp, Homo sapiens
tctactgggagcctac

SEQ ID NO: 2908295 - DNA, 19 bp, Homo sapiens
tctacttctgcccttgcca

SEQ ID NO: 2908296 - DNA, 15 bp, Homo sapiens
tctacttctgtgtct

SEQ ID NO: 2908297 - DNA, 20 bp, Homo sapiens
tctacttctgtgtctgtcac

SEQ ID NO: 2908298 - DNA, 20 bp, Homo sapiens
tctacttgtccagttcaaat

SEQ ID NO: 2908299 - DNA, 17 bp, Homo sapiens
tctacttgttcatttgg

SEQ ID NO: 2908300 - DNA, 22 bp, Homo sapiens
tctactttagaatgagagtgtg

SEQ ID NO: 2908301 - DNA, 12 bp, Homo sapiens
tctactttctct

SEQ ID NO: 2908302 - DNA, 17 bp, Homo sapiens
tctactttctcttgttt

SEQ ID NO: 2908303 - DNA, 16 bp, Homo sapiens
tctagaaaagcttcct

SEQ ID NO: 2908304 - DNA, 20 bp, Homo sapiens
tctagaaaagcttcctagct

SEQ ID NO: 2908305 - DNA, 17 bp, Homo sapiens
tctagaagaattaagct

SEQ ID NO: 2908306 - DNA, 13 bp, Homo sapiens
tctagaagataac

SEQ ID NO: 2908307 - DNA, 17 bp, Homo sapiens
tctagaagataacattt

SEQ ID NO: 2908308 - DNA, 18 bp, Homo sapiens
tctagaagataacatttt

SEQ ID NO: 2908309 - DNA, 16 bp, Homo sapiens
tctagaagttgtttgt

SEQ ID NO: 2908310 - DNA, 17 bp, Homo sapiens
tctagaatcctgcttta

SEQ ID NO: 2908311 - DNA, 22 bp, Homo sapiens
tctagaatctgcaattcaaaag

SEQ ID NO: 2908312 - DNA, 23 bp, Homo sapiens
tctagagagggaggcaagccctg

SEQ ID NO: 2908313 - DNA, 13 bp, Homo sapiens
tctagagtccaag

SEQ ID NO: 2908314 - DNA, 22 bp, Homo sapiens
tctagagtttatacagtgtaca

SEQ ID NO: 2908315 - DNA, 15 bp, Homo sapiens
tctagatacctaaaa

SEQ ID NO: 2908316 - DNA, 18 bp, Homo sapiens
tctagatacctaaaacat

SEQ ID NO: 2908317 - DNA, 18 bp, Homo sapiens
tctagatcagatgctcca

SEQ ID NO: 2908318 - DNA, 22 bp, Homo sapiens
tctagatcagatgctccaagat

SEQ ID NO: 2908319 - DNA, 14 bp, Homo sapiens
tctagatctcagcc

SEQ ID NO: 2908320 - DNA, 22 bp, Homo sapiens
tctagatgaagttttacattgt

SEQ ID NO: 2908321 - DNA, 23 bp, Homo sapiens
tctagatgaagttttacattgtt

SEQ ID NO: 2908322 - DNA, 14 bp, Homo sapiens
tctagatgacataa

SEQ ID NO: 2908323 - DNA, 16 bp, Homo sapiens
tctagatgagctgggc

SEQ ID NO: 2908324 - DNA, 19 bp, Homo sapiens
tctagatggctcctctcag

SEQ ID NO: 2908325 - DNA, 23 bp, Homo sapiens
tctagatgtttattcttctagag

SEQ ID NO: 2908326 - DNA, 17 bp, Homo sapiens
tctagattcaaaggttc

SEQ ID NO: 2908327 - DNA, 19 bp, Homo sapiens
tctagattcaaaggttcta

SEQ ID NO: 2908328 - DNA, 23 bp, Homo sapiens
tctagattcaaaggttctaggtt

SEQ ID NO: 2908329 - DNA, 21 bp, Homo sapiens
tctagattccattggtccaag

SEQ ID NO: 2908330 - DNA, 23 bp, Homo sapiens
tctagattccattggtccaagat

SEQ ID NO: 2908331 - DNA, 11 bp, Homo sapiens
tctagattctc

SEQ ID NO: 2908332 - DNA, 15 bp, Homo sapiens
tctagcaaatgttat

SEQ ID NO: 2908333 - DNA, 22 bp, Homo sapiens
tctagcatgccaacaagaatgc

SEQ ID NO: 2908334 - DNA, 18 bp, Homo sapiens
tctagccgctgccctggg

SEQ ID NO: 2908335 - DNA, 20 bp, Homo sapiens
tctagccgctgccctgggtc

SEQ ID NO: 2908336 - DNA, 13 bp, Homo sapiens
tctagctgtatga

SEQ ID NO: 2908337 - DNA, 19 bp, Homo sapiens
tctagctgtatgatttgtt

SEQ ID NO: 2908338 - DNA, 17 bp, Homo sapiens
tctagcttttttcctcc

SEQ ID NO: 2908339 - DNA, 23 bp, Homo sapiens
tctagcttttttcctcctttctc

SEQ ID NO: 2908340 - DNA, 22 bp, Homo sapiens
tctaggaagaattttaaaaatg

SEQ ID NO: 2908341 - DNA, 17 bp, Homo sapiens
tctaggagctgggagga

SEQ ID NO: 2908342 - DNA, 15 bp, Homo sapiens
tctaggcaaaagaaa

SEQ ID NO: 2908343 - DNA, 17 bp, Homo sapiens
tctaggctctgccttcg

SEQ ID NO: 2908344 - DNA, 14 bp, Homo sapiens
tctagggcagggtg

SEQ ID NO: 2908345 - DNA, 13 bp, Homo sapiens
tctagggctggga

SEQ ID NO: 2908346 - DNA, 18 bp, Homo sapiens
tctagggttattgcattt

SEQ ID NO: 2908347 - DNA, 21 bp, Homo sapiens
tctaggtcttggttagagaag

SEQ ID NO: 2908348 - DNA, 15 bp, Homo sapiens
tctaggtttcaaaga

SEQ ID NO: 2908349 - DNA, 15 bp, Homo sapiens
tctagtagttaaaaa

SEQ ID NO: 2908350 - DNA, 15 bp, Homo sapiens
tctagtctgagcttc

SEQ ID NO: 2908351 - DNA, 18 bp, Homo sapiens
tctagtgccttctaaagg

SEQ ID NO: 2908352 - DNA, 18 bp, Homo sapiens
tctagttgcttgtaaaat

SEQ ID NO: 2908353 - DNA, 15 bp, Homo sapiens
tctagtttgcaactt

SEQ ID NO: 2908354 - DNA, 13 bp, Homo sapiens
tctagtttgcatt

SEQ ID NO: 2908355 - DNA, 18 bp, Homo sapiens
tctagtttgcattcctga

SEQ ID NO: 2908356 - DNA, 12 bp, Homo sapiens
tctagtttgttt

SEQ ID NO: 2908357 - DNA, 16 bp, Homo sapiens
tctataaattgtccgt

SEQ ID NO: 2908358 - DNA, 16 bp, Homo sapiens
tctataaggccataaa

SEQ ID NO: 2908359 - DNA, 15 bp, Homo sapiens
tctatacctgtgtcc

SEQ ID NO: 2908360 - DNA, 17 bp, Homo sapiens
tctatagaactgaatga

SEQ ID NO: 2908361 - DNA, 21 bp, Homo sapiens
tctataggaacatatgaaaat

SEQ ID NO: 2908362 - DNA, 14 bp, Homo sapiens
tctatagttctaga

SEQ ID NO: 2908363 - DNA, 15 bp, Homo sapiens
tctatagttctagac

SEQ ID NO: 2908364 - DNA, 14 bp, Homo sapiens
tctatatagacttg

SEQ ID NO: 2908365 - DNA, 13 bp, Homo sapiens
tctatatgtactt

SEQ ID NO: 2908366 - DNA, 18 bp, Homo sapiens
tctatattttaatagaaa

SEQ ID NO: 2908367 - DNA, 22 bp, Homo sapiens
tctatcaaccccagacactggt

SEQ ID NO: 2908368 - DNA, 14 bp, Homo sapiens
tctatcattaaagt

SEQ ID NO: 2908369 - DNA, 15 bp, Homo sapiens
tctatcctctctctc

SEQ ID NO: 2908370 - DNA, 18 bp, Homo sapiens
tctatcgttattataaat

SEQ ID NO: 2908371 - DNA, 14 bp, Homo sapiens
tctatcttgttcca

SEQ ID NO: 2908372 - DNA, 22 bp, Homo sapiens
tctatgatgtttcttttgcaat

SEQ ID NO: 2908373 - DNA, 22 bp, Homo sapiens
tctatgattccaggtggcatca

SEQ ID NO: 2908374 - DNA, 22 bp, Homo sapiens
tctatgcaaaatgtctgtttta

SEQ ID NO: 2908375 - DNA, 21 bp, Homo sapiens
tctatgccatttttagtttaa

SEQ ID NO: 2908376 - DNA, 15 bp, Homo sapiens
tctatgtaggaaaaa

SEQ ID NO: 2908377 - DNA, 19 bp, Homo sapiens
tctatgtaggaaaaaaata

SEQ ID NO: 2908378 - DNA, 20 bp, Homo sapiens
tctatgtcgtgttttcaagg

SEQ ID NO: 2908379 - DNA, 18 bp, Homo sapiens
tctatgtgaatatttgta

SEQ ID NO: 2908380 - DNA, 12 bp, Homo sapiens
tctatgttgcta

SEQ ID NO: 2908381 - DNA, 17 bp, Homo sapiens
tctatgttttaaaataa

SEQ ID NO: 2908382 - DNA, 15 bp, Homo sapiens
tctattaagggatta

SEQ ID NO: 2908383 - DNA, 16 bp, Homo sapiens
tctattacccctcatt

SEQ ID NO: 2908384 - DNA, 23 bp, Homo sapiens
tctattattatgaagaattgcca

SEQ ID NO: 2908385 - DNA, 13 bp, Homo sapiens
tctattccagctc

SEQ ID NO: 2908386 - DNA, 15 bp, Homo sapiens
tctattccagctcat

SEQ ID NO: 2908387 - DNA, 13 bp, Homo sapiens
tctattctctcca

SEQ ID NO: 2908388 - DNA, 19 bp, Homo sapiens
tctattctgagaaaacaag

SEQ ID NO: 2908389 - DNA, 22 bp, Homo sapiens
tctattgacttcaatgatagta

SEQ ID NO: 2908390 - DNA, 22 bp, Homo sapiens
tctattgtaattttgttcctgt

SEQ ID NO: 2908391 - DNA, 23 bp, Homo sapiens
tctattgtcatggggatcaattt

SEQ ID NO: 2908392 - DNA, 12 bp, Homo sapiens
tctatttagtta

SEQ ID NO: 2908393 - DNA, 13 bp, Homo sapiens
tctatttatgttt

SEQ ID NO: 2908394 - DNA, 15 bp, Homo sapiens
tctatttcctggaat

SEQ ID NO: 2908395 - DNA, 15 bp, Homo sapiens
tctatttctcctcca

SEQ ID NO: 2908396 - DNA, 16 bp, Homo sapiens
tctatttctctgtgta

SEQ ID NO: 2908397 - DNA, 12 bp, Homo sapiens
tctattttaaga

SEQ ID NO: 2908398 - DNA, 15 bp, Homo sapiens
tctattttggattgt

SEQ ID NO: 2908399 - DNA, 13 bp, Homo sapiens
tctcaaagctggg

SEQ ID NO: 2908400 - DNA, 12 bp, Homo sapiens
tctcaaagtttt

SEQ ID NO: 2908401 - DNA, 14 bp, Homo sapiens
tctcaaagttttat

SEQ ID NO: 2908402 - DNA, 23 bp, Homo sapiens
tctcaaatccctctccaactgcc

SEQ ID NO: 2908403 - DNA, 12 bp, Homo sapiens
tctcaaatgtgt

SEQ ID NO: 2908404 - DNA, 22 bp, Homo sapiens
tctcaaatgtgtgtggcagcca

SEQ ID NO: 2908405 - DNA, 12 bp, Homo sapiens
tctcaagactga

SEQ ID NO: 2908406 - DNA, 20 bp, Homo sapiens
tctcaagggtggcaggtcac

SEQ ID NO: 2908407 - DNA, 13 bp, Homo sapiens
tctcaagttctaa

SEQ ID NO: 2908408 - DNA, 20 bp, Homo sapiens
tctcaatagctccaagctgt

SEQ ID NO: 2908409 - DNA, 21 bp, Homo sapiens
tctcaatagctccaagctgtt

SEQ ID NO: 2908410 - DNA, 16 bp, Homo sapiens
tctcctcatgttctgc

SEQ ID NO: 2908411 - DNA, 16 bp, Homo sapiens
tctcctccatgggaga

SEQ ID NO: 2908412 - DNA, 13 bp, Homo sapiens
tctcctccgtggc

SEQ ID NO: 2908413 - DNA, 14 bp, Homo sapiens
tctcctcctcctcc

SEQ ID NO: 2908414 - DNA, 16 bp, Homo sapiens
tctcctcctgcccacc

SEQ ID NO: 2908415 - DNA, 18 bp, Homo sapiens
tctcctccttgggcaggg

SEQ ID NO: 2908416 - DNA, 21 bp, Homo sapiens
tctcctccttgggcagggtct

SEQ ID NO: 2908417 - DNA, 22 bp, Homo sapiens
tctcctcgttggttcatgtgtt

SEQ ID NO: 2908418 - DNA, 12 bp, Homo sapiens
tctcctctcagc

SEQ ID NO: 2908419 - DNA, 13 bp, Homo sapiens
tctcctctcagct

SEQ ID NO: 2908420 - DNA, 16 bp, Homo sapiens
tctcctctcttggcat

SEQ ID NO: 2908421 - DNA, 15 bp, Homo sapiens
tctcctctggcttcc

SEQ ID NO: 2908422 - DNA, 15 bp, Homo sapiens
tctcctcttgtaaat

SEQ ID NO: 2908423 - DNA, 20 bp, Homo sapiens
tctcctctttgaacatggtc

SEQ ID NO: 2908424 - DNA, 17 bp, Homo sapiens
tctcctgaagatactta

SEQ ID NO: 2908425 - DNA, 15 bp, Homo sapiens
tctcctgactggtgc

SEQ ID NO: 2908426 - DNA, 14 bp, Homo sapiens
tctcctgagctagg

SEQ ID NO: 2908427 - DNA, 14 bp, Homo sapiens
tctcctgcatggca

SEQ ID NO: 2908428 - DNA, 12 bp, Homo sapiens
tctcctgcctac

SEQ ID NO: 2908429 - DNA, 12 bp, Homo sapiens
tctcctgcctca

SEQ ID NO: 2908430 - DNA, 14 bp, Homo sapiens
tctcctgcctcagc

SEQ ID NO: 2908431 - DNA, 16 bp, Homo sapiens
tctcctgcctcagcct

SEQ ID NO: 2908432 - DNA, 20 bp, Homo sapiens
tctcctgcctcagcctccca

SEQ ID NO: 2908433 - DNA, 20 bp, Homo sapiens
tctcctgccttcctcctggg

SEQ ID NO: 2908434 - DNA, 16 bp, Homo sapiens
tctcctgcttgtacta

SEQ ID NO: 2908435 - DNA, 22 bp, Homo sapiens
tctcctgcttgtactaagccag

SEQ ID NO: 2908436 - DNA, 19 bp, Homo sapiens
tcagctcttggctccactg

SEQ ID NO: 2908437 - DNA, 15 bp, Homo sapiens
tcagctgaccccctc

SEQ ID NO: 2908438 - DNA, 16 bp, Homo sapiens
tcagctgaccccctcc

SEQ ID NO: 2908439 - DNA, 21 bp, Homo sapiens
tcagctgcatttcacatgcct

SEQ ID NO: 2908440 - DNA, 23 bp, Homo sapiens
tcagctgcatttcacatgccttg

SEQ ID NO: 2908441 - DNA, 13 bp, Homo sapiens
tcagctgctccca

SEQ ID NO: 2908442 - DNA, 17 bp, Homo sapiens
tcagctgctcccacact

SEQ ID NO: 2908443 - DNA, 19 bp, Homo sapiens
tcagctgctgttgaacttt

SEQ ID NO: 2908444 - DNA, 22 bp, Homo sapiens
tcagctgctgttgaacttttta

SEQ ID NO: 2908445 - DNA, 20 bp, Homo sapiens
tcagctgggcagtgccagcc

SEQ ID NO: 2908446 - DNA, 11 bp, Homo sapiens
tcagctggtgg

SEQ ID NO: 2908447 - DNA, 15 bp, Homo sapiens
tcagctgtctgtcat

SEQ ID NO: 2908448 - DNA, 18 bp, Homo sapiens
tcagctgttgcaggcagt

SEQ ID NO: 2908449 - DNA, 19 bp, Homo sapiens
tcagctgttgcaggcagtg

SEQ ID NO: 2908450 - DNA, 22 bp, Homo sapiens
tcagctgttgcaggcagtgtct

SEQ ID NO: 2908451 - DNA, 13 bp, Homo sapiens
tcagcttatctct

SEQ ID NO: 2908452 - DNA, 15 bp, Homo sapiens
tcagcttcgtgcctg

SEQ ID NO: 2908453 - DNA, 14 bp, Homo sapiens
tcagcttcttcatc

SEQ ID NO: 2908454 - DNA, 20 bp, Homo sapiens
tcagctttatttttctttaa

SEQ ID NO: 2908455 - DNA, 19 bp, Homo sapiens
tcagctttgcttcatgttc

SEQ ID NO: 2908456 - DNA, 16 bp, Homo sapiens
tcagcttttcagtgaa

SEQ ID NO: 2908457 - DNA, 18 bp, Homo sapiens
tcagcttttgttgtttat

SEQ ID NO: 2908458 - DNA, 22 bp, Homo sapiens
tcaggaaaactgacagaggagg

SEQ ID NO: 2908459 - DNA, 17 bp, Homo sapiens
tcaggaaacatatttaa

SEQ ID NO: 2908460 - DNA, 20 bp, Homo sapiens
tcaggaaacatatttaagaa

SEQ ID NO: 2908461 - DNA, 22 bp, Homo sapiens
tcaggaaaccacaaccttgcag

SEQ ID NO: 2908462 - DNA, 15 bp, Homo sapiens
tcaggaaaggaatca

SEQ ID NO: 2908463 - DNA, 21 bp, Homo sapiens
tcaggaacctcgagtactgtg

SEQ ID NO: 2908464 - DNA, 13 bp, Homo sapiens
tcaggaagaacac

SEQ ID NO: 2908465 - DNA, 18 bp, Homo sapiens
tcaggaatcagaaatcat

SEQ ID NO: 2908466 - DNA, 20 bp, Homo sapiens
tcaggaatttaaaattaagt

SEQ ID NO: 2908467 - DNA, 20 bp, Homo sapiens
tcaggacctccaagccactg

SEQ ID NO: 2908468 - DNA, 14 bp, Homo sapiens
tcaggacctggctt

SEQ ID NO: 2908469 - DNA, 18 bp, Homo sapiens
tcaggagaattagatttc

SEQ ID NO: 2908470 - DNA, 18 bp, Homo sapiens
tcaggaggaggctgccct

SEQ ID NO: 2908471 - DNA, 18 bp, Homo sapiens
tcaggaggctgagacagg

SEQ ID NO: 2908472 - DNA, 18 bp, Homo sapiens
tcaggaggctgaggcaga

SEQ ID NO: 2908473 - DNA, 17 bp, Homo sapiens
tcaggagttcaagacta

SEQ ID NO: 2908474 - DNA, 22 bp, Homo sapiens
tcaggagtttgagaccaggctg

SEQ ID NO: 2908475 - DNA, 22 bp, Homo sapiens
tcaggatccaagctaagcactg

SEQ ID NO: 2908476 - DNA, 19 bp, Homo sapiens
tcaggcaattctcctgcct

SEQ ID NO: 2908477 - DNA, 19 bp, Homo sapiens
tcaggcaattgattgtgaa

SEQ ID NO: 2908478 - DNA, 13 bp, Homo sapiens
tcaggcacaggtc

SEQ ID NO: 2908479 - DNA, 15 bp, Homo sapiens
tcaggcacaggtcag

SEQ ID NO: 2908480 - DNA, 19 bp, Homo sapiens
tcaggcaccagtccctgtc

SEQ ID NO: 2908481 - DNA, 14 bp, Homo sapiens
tcaggccagagcca

SEQ ID NO: 2908482 - DNA, 11 bp, Homo sapiens
tcaggccaggt

SEQ ID NO: 2908483 - DNA, 22 bp, Homo sapiens
tcaggccaggtagcagcaaata

SEQ ID NO: 2908484 - DNA, 20 bp, Homo sapiens
tcaggcccgtcggagctgcc

SEQ ID NO: 2908485 - DNA, 17 bp, Homo sapiens
tcaggccctcagctgtc

SEQ ID NO: 2908486 - DNA, 13 bp, Homo sapiens
tcaggccctctgc

SEQ ID NO: 2908487 - DNA, 14 bp, Homo sapiens
tcaggccctctgcc

SEQ ID NO: 2908488 - DNA, 15 bp, Homo sapiens
tcaggccctctgcct

SEQ ID NO: 2908489 - DNA, 24 bp, Homo sapiens
tcaggctgctggggcctcagacga

SEQ ID NO: 2908490 - DNA, 14 bp, Homo sapiens
tcaggctggtctcg

SEQ ID NO: 2908491 - DNA, 18 bp, Homo sapiens
tcaggcttataacaaata

SEQ ID NO: 2908492 - DNA, 20 bp, Homo sapiens
tcaggcttcctggtgagaac

SEQ ID NO: 2908493 - DNA, 16 bp, Homo sapiens
tcagggaaaagcagct

SEQ ID NO: 2908494 - DNA, 17 bp, Homo sapiens
tcagggaacatatttaa

SEQ ID NO: 2908495 - DNA, 17 bp, Homo sapiens
tcagggaactgcttgcc

SEQ ID NO: 2908496 - DNA, 19 bp, Homo sapiens
tcagggaactgcttgccca

SEQ ID NO: 2908497 - DNA, 14 bp, Homo sapiens
tcagggagggccag

SEQ ID NO: 2908498 - DNA, 22 bp, Homo sapiens
tcagggaggggccggctggcct

SEQ ID NO: 2908499 - DNA, 24 bp, Homo sapiens
tcagggcagcccctgcagacgtct

SEQ ID NO: 2908500 - DNA, 15 bp, Homo sapiens
tcagggcagcgccag

SEQ ID NO: 2908501 - DNA, 12 bp, Homo sapiens
tcagggcagctg

SEQ ID NO: 2908502 - DNA, 20 bp, Homo sapiens
tcagggcagctgcctggcca

SEQ ID NO: 2908503 - DNA, 14 bp, Homo sapiens
tcagggcaggtggg

SEQ ID NO: 2908504 - DNA, 13 bp, Homo sapiens
tcagggccaggaa

SEQ ID NO: 2908505 - DNA, 14 bp, Homo sapiens
tcagggctcctggg

SEQ ID NO: 2908506 - DNA, 17 bp, Homo sapiens
tcaggggctgacacttc

SEQ ID NO: 2908507 - DNA, 19 bp, Homo sapiens
tcaggggtcaggtgtcagg

SEQ ID NO: 2908508 - DNA, 21 bp, Homo sapiens
tcaggggtcaggtgtcaggcc

SEQ ID NO: 2908509 - DNA, 15 bp, Homo sapiens
tcaggggtgacacag

SEQ ID NO: 2908510 - DNA, 14 bp, Homo sapiens
tcaggggtgcacag

SEQ ID NO: 2908511 - DNA, 14 bp, Homo sapiens
tcagggtattgctt

SEQ ID NO: 2908512 - DNA, 15 bp, Homo sapiens
tcagggtcatagcat

SEQ ID NO: 2908513 - DNA, 16 bp, Homo sapiens
tcaggtagtactaaga

SEQ ID NO: 2908514 - DNA, 15 bp, Homo sapiens
tcaggtatgttgcct

SEQ ID NO: 2908515 - DNA, 18 bp, Homo sapiens
tcaggtcacataaaactt

SEQ ID NO: 2908516 - DNA, 22 bp, Homo sapiens
tcaggtcccagcgagccacagg

SEQ ID NO: 2908517 - DNA, 13 bp, Homo sapiens
tcaggtggaccct

SEQ ID NO: 2908518 - DNA, 20 bp, Homo sapiens
tcaggtggaccctgtaaata

SEQ ID NO: 2908519 - DNA, 11 bp, Homo sapiens
tcaggtggcca

SEQ ID NO: 2908520 - DNA, 23 bp, Homo sapiens
tcaggtgtagtagttctgtgttg

SEQ ID NO: 2908521 - DNA, 16 bp, Homo sapiens
tcagtaagctgtgtgg

SEQ ID NO: 2908522 - DNA, 19 bp, Homo sapiens
tcagtaatgctaaatgtgt

SEQ ID NO: 2908523 - DNA, 16 bp, Homo sapiens
tcagtacttcagcaag

SEQ ID NO: 2908524 - DNA, 23 bp, Homo sapiens
tcagtaggtgcccagaataagtt

SEQ ID NO: 2908525 - DNA, 16 bp, Homo sapiens
tcagtataatttttta

SEQ ID NO: 2908526 - DNA, 18 bp, Homo sapiens
tcagtatgttttacactg

SEQ ID NO: 2908527 - DNA, 19 bp, Homo sapiens
tcagtatgttttacactgt

SEQ ID NO: 2908528 - DNA, 16 bp, Homo sapiens
tcagtattaaactctc

SEQ ID NO: 2908529 - DNA, 17 bp, Homo sapiens
tcagtattaaactctcc

SEQ ID NO: 2908530 - DNA, 22 bp, Homo sapiens
tcagtattaaactctcctttga

SEQ ID NO: 2908531 - DNA, 23 bp, Homo sapiens
tcagtattaaactctcctttgat

SEQ ID NO: 2908532 - DNA, 17 bp, Homo sapiens
tcagtattatgtagttg

SEQ ID NO: 2908533 - DNA, 16 bp, Homo sapiens
tcagtcaatattttta

SEQ ID NO: 2908534 - DNA, 13 bp, Homo sapiens
tcagtcacagcca

SEQ ID NO: 2908535 - DNA, 14 bp, Homo sapiens
tcagtcacagccac

SEQ ID NO: 2908536 - DNA, 20 bp, Homo sapiens
tcagtccagcagtttccagt

SEQ ID NO: 2908537 - DNA, 16 bp, Homo sapiens
tcagtccctatgtatt

SEQ ID NO: 2908538 - DNA, 13 bp, Homo sapiens
tcagtctctgagc

SEQ ID NO: 2908539 - DNA, 20 bp, Homo sapiens
tcagtctctgagcagtgaat

SEQ ID NO: 2908540 - DNA, 15 bp, Homo sapiens
tcagtctgctttctc

SEQ ID NO: 2908541 - DNA, 14 bp, Homo sapiens
tcagtctgttcact

SEQ ID NO: 2908542 - DNA, 21 bp, Homo sapiens
tcagtgaaaaacattagtata

SEQ ID NO: 2908543 - DNA, 12 bp, Homo sapiens
tcagtgactgaa

SEQ ID NO: 2908544 - DNA, 20 bp, Homo sapiens
tcagtgatggcaacactgaa

SEQ ID NO: 2908545 - DNA, 14 bp, Homo sapiens
tcagtgcaaaatgt

SEQ ID NO: 2908546 - DNA, 17 bp, Homo sapiens
tcagtgcaacctctgct

SEQ ID NO: 2908547 - DNA, 18 bp, Homo sapiens
tcagtgcacctgcctcag

SEQ ID NO: 2908548 - DNA, 15 bp, Homo sapiens
tcagtgccagcccct

SEQ ID NO: 2908549 - DNA, 16 bp, Homo sapiens
tccatcttcagcttct

SEQ ID NO: 2908550 - DNA, 18 bp, Homo sapiens
tccatgaatcgcttctct

SEQ ID NO: 2908551 - DNA, 19 bp, Homo sapiens
tccatgaatcgcttctctt

SEQ ID NO: 2908552 - DNA, 19 bp, Homo sapiens
tccatgacatttttcctct

SEQ ID NO: 2908553 - DNA, 18 bp, Homo sapiens
tccatgaggtactggtcc

SEQ ID NO: 2908554 - DNA, 14 bp, Homo sapiens
tccatgcaagtgct

SEQ ID NO: 2908555 - DNA, 16 bp, Homo sapiens
tccatgcaagtgctgt

SEQ ID NO: 2908556 - DNA, 17 bp, Homo sapiens
tccatgcggagtccatt

SEQ ID NO: 2908557 - DNA, 13 bp, Homo sapiens
tccatgctcccaa

SEQ ID NO: 2908558 - DNA, 14 bp, Homo sapiens
tccatggcttcctg

SEQ ID NO: 2908559 - DNA, 18 bp, Homo sapiens
tccatgggagaaaataga

SEQ ID NO: 2908560 - DNA, 18 bp, Homo sapiens
tccatgggattttatctg

SEQ ID NO: 2908561 - DNA, 18 bp, Homo sapiens
tccatgggcagagcccaa

SEQ ID NO: 2908562 - DNA, 16 bp, Homo sapiens
tccatgggtctggcct

SEQ ID NO: 2908563 - DNA, 17 bp, Homo sapiens
tccatgggtctggctag

SEQ ID NO: 2908564 - DNA, 14 bp, Homo sapiens
tccatggttctcaa

SEQ ID NO: 2908565 - DNA, 16 bp, Homo sapiens
tccatgtaatgatctt

SEQ ID NO: 2908566 - DNA, 15 bp, Homo sapiens
tccatgtagcaggac

SEQ ID NO: 2908567 - DNA, 17 bp, Homo sapiens
tccatgtagcaggactg

SEQ ID NO: 2908568 - DNA, 18 bp, Homo sapiens
tccatgtgttttgctttt

SEQ ID NO: 2908569 - DNA, 18 bp, Homo sapiens
tccatgtttccaccaaat

SEQ ID NO: 2908570 - DNA, 17 bp, Homo sapiens
tccatgttttaaaatta

SEQ ID NO: 2908571 - DNA, 13 bp, Homo sapiens
tccattatcatgt

SEQ ID NO: 2908572 - DNA, 14 bp, Homo sapiens
tccattatcatgtg

SEQ ID NO: 2908573 - DNA, 15 bp, Homo sapiens
tccattatcatgtgt

SEQ ID NO: 2908574 - DNA, 12 bp, Homo sapiens
tccattctgttt

SEQ ID NO: 2908575 - DNA, 17 bp, Homo sapiens
tccattcttggcatcta

SEQ ID NO: 2908576 - DNA, 18 bp, Homo sapiens
tccattctttcttcctcc

SEQ ID NO: 2908577 - DNA, 15 bp, Homo sapiens
tccattgaaagtgct

SEQ ID NO: 2908578 - DNA, 22 bp, Homo sapiens
tccattggtttacctgtgaaat

SEQ ID NO: 2908579 - DNA, 22 bp, Homo sapiens
tccattgtagtggcctgtgctt

SEQ ID NO: 2908580 - DNA, 14 bp, Homo sapiens
tccattgtttgaaa

SEQ ID NO: 2908581 - DNA, 23 bp, Homo sapiens
tccattgtttgaaacaaagaagg

SEQ ID NO: 2908582 - DNA, 22 bp, Homo sapiens
tccatttacaaactacttgatt

SEQ ID NO: 2908583 - DNA, 18 bp, Homo sapiens
tccatttatgttttttct

SEQ ID NO: 2908584 - DNA, 19 bp, Homo sapiens
tccatttatgttttttctg

SEQ ID NO: 2908585 - DNA, 15 bp, Homo sapiens
tccatttctttcttc

SEQ ID NO: 2908586 - DNA, 12 bp, Homo sapiens
tccatttgagga

SEQ ID NO: 2908587 - DNA, 12 bp, Homo sapiens
tccatttgcaag

SEQ ID NO: 2908588 - DNA, 21 bp, Homo sapiens
tccatttggcagaactgctgg

SEQ ID NO: 2908589 - DNA, 14 bp, Homo sapiens
tccattttcttgtc

SEQ ID NO: 2908590 - DNA, 15 bp, Homo sapiens
tccattttgtgaagc

SEQ ID NO: 2908591 - DNA, 19 bp, Homo sapiens
tccattttgtgaagccctg

SEQ ID NO: 2908592 - DNA, 21 bp, Homo sapiens
tcccaaacgcctcccctgccc

SEQ ID NO: 2908593 - DNA, 13 bp, Homo sapiens
tcccaaagcaagg

SEQ ID NO: 2908594 - DNA, 14 bp, Homo sapiens
tcccaaagggcaca

SEQ ID NO: 2908595 - DNA, 19 bp, Homo sapiens
tcccaaatccgccagtgtt

SEQ ID NO: 2908596 - DNA, 22 bp, Homo sapiens
tcccaaatccgccagtgtttct

SEQ ID NO: 2908597 - DNA, 16 bp, Homo sapiens
tcccaaatccttccca

SEQ ID NO: 2908598 - DNA, 22 bp, Homo sapiens
tcccaaatttgattgatttgaa

SEQ ID NO: 2908599 - DNA, 18 bp, Homo sapiens
tcccaacaggaggacaat

SEQ ID NO: 2908600 - DNA, 22 bp, Homo sapiens
tcccaacaggaggacaattcat

SEQ ID NO: 2908601 - DNA, 16 bp, Homo sapiens
tcccaacagtcatgtt

SEQ ID NO: 2908602 - DNA, 18 bp, Homo sapiens
tcccaacttccctgttct

SEQ ID NO: 2908603 - DNA, 13 bp, Homo sapiens
tcccaagctggct

SEQ ID NO: 2908604 - DNA, 15 bp, Homo sapiens
tcccaagctggctgg

SEQ ID NO: 2908605 - DNA, 16 bp, Homo sapiens
tcccaagtagaatctc

SEQ ID NO: 2908606 - DNA, 17 bp, Homo sapiens
tcccaagtagaatctca

SEQ ID NO: 2908607 - DNA, 19 bp, Homo sapiens
tcccaagtagaatctcagt

SEQ ID NO: 2908608 - DNA, 20 bp, Homo sapiens
tcccaagtagctgggattac

SEQ ID NO: 2908609 - DNA, 21 bp, Homo sapiens
tcccaagtagctgggattaca

SEQ ID NO: 2908610 - DNA, 23 bp, Homo sapiens
tcccaagtagctgggattacagg

SEQ ID NO: 2908611 - DNA, 15 bp, Homo sapiens
tcccaagtcctccgg

SEQ ID NO: 2908612 - DNA, 21 bp, Homo sapiens
tcccaatacaggcatgaacca

SEQ ID NO: 2908613 - DNA, 13 bp, Homo sapiens
tcccaatggtgtt

SEQ ID NO: 2908614 - DNA, 18 bp, Homo sapiens
tcccaatttcagactccc

SEQ ID NO: 2908615 - DNA, 18 bp, Homo sapiens
tcccacaagcctgcctcg

SEQ ID NO: 2908616 - DNA, 14 bp, Homo sapiens
tcccacaagtggtg

SEQ ID NO: 2908617 - DNA, 23 bp, Homo sapiens
tcccacacaagacccaagtagct

SEQ ID NO: 2908618 - DNA, 12 bp, Homo sapiens
tcccacacccaa

SEQ ID NO: 2908619 - DNA, 18 bp, Homo sapiens
tcccacacttgtgccagc

SEQ ID NO: 2908620 - DNA, 13 bp, Homo sapiens
tcccaccacccca

SEQ ID NO: 2908621 - DNA, 19 bp, Homo sapiens
tcccacccaattcaaaaca

SEQ ID NO: 2908622 - DNA, 13 bp, Homo sapiens
tcccacccaggaa

SEQ ID NO: 2908623 - DNA, 14 bp, Homo sapiens
tcccacccaggaag

SEQ ID NO: 2908624 - DNA, 16 bp, Homo sapiens
tcccaccccaccccct

SEQ ID NO: 2908625 - DNA, 14 bp, Homo sapiens
tcccaccccctccc

SEQ ID NO: 2908626 - DNA, 19 bp, Homo sapiens
tcccaccctaagggcagcc

SEQ ID NO: 2908627 - DNA, 20 bp, Homo sapiens
tcccaccctaagggcagccc

SEQ ID NO: 2908628 - DNA, 16 bp, Homo sapiens
tcccacctagcagcac

SEQ ID NO: 2908629 - DNA, 15 bp, Homo sapiens
tcccacctagtgccc

SEQ ID NO: 2908630 - DNA, 17 bp, Homo sapiens
tcccacctagtgcccca

SEQ ID NO: 2908631 - DNA, 18 bp, Homo sapiens
tcccacctagtgccccag

SEQ ID NO: 2908632 - DNA, 20 bp, Homo sapiens
tcccacctagtgccccagac

SEQ ID NO: 2908633 - DNA, 15 bp, Homo sapiens
tcccacctccatccc

SEQ ID NO: 2908634 - DNA, 17 bp, Homo sapiens
tcccaccttggagcatt

SEQ ID NO: 2908635 - DNA, 18 bp, Homo sapiens
tcccacgggacctggggc

SEQ ID NO: 2908636 - DNA, 21 bp, Homo sapiens
tcccacggggaccactgggcc

SEQ ID NO: 2908637 - DNA, 18 bp, Homo sapiens
tcccactcaagccaagca

SEQ ID NO: 2908638 - DNA, 17 bp, Homo sapiens
tcccactgcactccagc

SEQ ID NO: 2908639 - DNA, 19 bp, Homo sapiens
tcccactgcactccagcct

SEQ ID NO: 2908640 - DNA, 18 bp, Homo sapiens
tcccactgccaggatttt

SEQ ID NO: 2908641 - DNA, 14 bp, Homo sapiens
tcccactgccctgg

SEQ ID NO: 2908642 - DNA, 16 bp, Homo sapiens
tcccacttcccaccct

SEQ ID NO: 2908643 - DNA, 13 bp, Homo sapiens
tcccactttcatt

SEQ ID NO: 2908644 - DNA, 20 bp, Homo sapiens
tcccagaacacactccatca

SEQ ID NO: 2908645 - DNA, 23 bp, Homo sapiens
tcccagaactttgggaggccaag

SEQ ID NO: 2908646 - DNA, 15 bp, Homo sapiens
tcccagacttgtttc

SEQ ID NO: 2908647 - DNA, 18 bp, Homo sapiens
tcccagacttgtttcctg

SEQ ID NO: 2908648 - DNA, 20 bp, Homo sapiens
tcccagagacaggaaaatcc

SEQ ID NO: 2908649 - DNA, 19 bp, Homo sapiens
tcccagagctggtggaccc

SEQ ID NO: 2908650 - DNA, 21 bp, Homo sapiens
tcccagagctggtggacccag

SEQ ID NO: 2908651 - DNA, 16 bp, Homo sapiens
tcccagataatgtgaa

SEQ ID NO: 2908652 - DNA, 20 bp, Homo sapiens
tcccagatcgctcccttggc

SEQ ID NO: 2908653 - DNA, 18 bp, Homo sapiens
tcccagccttgagatgct

SEQ ID NO: 2908654 - DNA, 18 bp, Homo sapiens
tcccagcgagccacagga

SEQ ID NO: 2908655 - DNA, 20 bp, Homo sapiens
tcccagctaccaagtcagac

SEQ ID NO: 2908656 - DNA, 16 bp, Homo sapiens
tcccagctactcagga

SEQ ID NO: 2908657 - DNA, 23 bp, Homo sapiens
tcccagctactcaggaggctgag

SEQ ID NO: 2908658 - DNA, 23 bp, Homo sapiens
tcccagctacttgggagcctgag

SEQ ID NO: 2908659 - DNA, 21 bp, Homo sapiens
tcccagctctccctctggccc

SEQ ID NO: 2908660 - DNA, 22 bp, Homo sapiens
tcccagctctccctctggccct

SEQ ID NO: 2908661 - DNA, 23 bp, Homo sapiens
tcccagctctccctctggccctg

SEQ ID NO: 2908662 - DNA, 17 bp, Homo sapiens
tcccaggaagcagggag

SEQ ID NO: 2908663 - DNA, 11 bp, Homo sapiens
tcccaggaccc

SEQ ID NO: 2908664 - DNA, 13 bp, Homo sapiens
tcccaggaccctg

SEQ ID NO: 2908665 - DNA, 18 bp, Homo sapiens
tcccaggatctgctccaa

SEQ ID NO: 2908666 - DNA, 20 bp, Homo sapiens
tcccaggccaacagtagcca

SEQ ID NO: 2908667 - DNA, 18 bp, Homo sapiens
tcccaggccagggctggg

SEQ ID NO: 2908668 - DNA, 21 bp, Homo sapiens
tcccaggccagggctgggtca

SEQ ID NO: 2908669 - DNA, 16 bp, Homo sapiens
tcccaggggcagccac

SEQ ID NO: 2908670 - DNA, 17 bp, Homo sapiens
tcccaggggcagccaca

SEQ ID NO: 2908671 - DNA, 14 bp, Homo sapiens
tcccagtgccttct

SEQ ID NO: 2908672 - DNA, 15 bp, Homo sapiens
tcccagtttctgctg

SEQ ID NO: 2908673 - DNA, 13 bp, Homo sapiens
tcccatccagggc

SEQ ID NO: 2908674 - DNA, 14 bp, Homo sapiens
tcccatccagggcc

SEQ ID NO: 2908675 - DNA, 14 bp, Homo sapiens
tcccatcggaagtt

SEQ ID NO: 2908676 - DNA, 16 bp, Homo sapiens
tcccatctccactgtt

SEQ ID NO: 2908677 - DNA, 16 bp, Homo sapiens
tcccatgcctgcaacc

SEQ ID NO: 2908678 - DNA, 22 bp, Homo sapiens
tcccatgtagccccctggcctc

SEQ ID NO: 2908679 - DNA, 18 bp, Homo sapiens
tcccattcacttctgcat

SEQ ID NO: 2908680 - DNA, 19 bp, Homo sapiens
tcccattcacttctgcatt

SEQ ID NO: 2908681 - DNA, 23 bp, Homo sapiens
tcccattcacttctgcattcctg

SEQ ID NO: 2908682 - DNA, 13 bp, Homo sapiens
tcccattcctgaa

SEQ ID NO: 2908683 - DNA, 14 bp, Homo sapiens
tcccattcctgaag

SEQ ID NO: 2908684 - DNA, 15 bp, Homo sapiens
tcccattgccctggt

SEQ ID NO: 2908685 - DNA, 16 bp, Homo sapiens
tcccattggatgcatt

SEQ ID NO: 2908686 - DNA, 18 bp, Homo sapiens
tccccttacccttagaat

SEQ ID NO: 2908687 - DNA, 13 bp, Homo sapiens
tccccttcatcct

SEQ ID NO: 2908688 - DNA, 13 bp, Homo sapiens
tccccttccactg

SEQ ID NO: 2908689 - DNA, 18 bp, Homo sapiens
tccccttccactgagggc

SEQ ID NO: 2908690 - DNA, 17 bp, Homo sapiens
tccccttcccaggggcg

SEQ ID NO: 2908691 - DNA, 16 bp, Homo sapiens
tccccttcctcactgc

SEQ ID NO: 2908692 - DNA, 19 bp, Homo sapiens
tccccttgaacctcattaa

SEQ ID NO: 2908693 - DNA, 15 bp, Homo sapiens
tccccttgcagcctg

SEQ ID NO: 2908694 - DNA, 16 bp, Homo sapiens
tccccttgcagcctgg

SEQ ID NO: 2908695 - DNA, 17 bp, Homo sapiens
tccccttgtccctgggg

SEQ ID NO: 2908696 - DNA, 19 bp, Homo sapiens
tccccttgtccctggggca

SEQ ID NO: 2908697 - DNA, 18 bp, Homo sapiens
tcccctttggttttacta

SEQ ID NO: 2908698 - DNA, 17 bp, Homo sapiens
tccccttttattgctgc

SEQ ID NO: 2908699 - DNA, 17 bp, Homo sapiens
tcccgacaccagaagct

SEQ ID NO: 2908700 - DNA, 22 bp, Homo sapiens
tcccgagcacctccacatcctc

SEQ ID NO: 2908701 - DNA, 22 bp, Homo sapiens
tcccgaggaactcgcctcagcc

SEQ ID NO: 2908702 - DNA, 15 bp, Homo sapiens
tcccgagtagctggg

SEQ ID NO: 2908703 - DNA, 17 bp, Homo sapiens
tcccgcaccttcctcct

SEQ ID NO: 2908704 - DNA, 20 bp, Homo sapiens
tcccgcaccttcctcctccc

SEQ ID NO: 2908705 - DNA, 20 bp, Homo sapiens
tcccgccccgggctggccct

SEQ ID NO: 2908706 - DNA, 23 bp, Homo sapiens
tcccgccccgggctggccctgtg

SEQ ID NO: 2908707 - DNA, 13 bp, Homo sapiens
tcccgcctcagcc

SEQ ID NO: 2908708 - DNA, 17 bp, Homo sapiens
tcccgcctcagcctctc

SEQ ID NO: 2908709 - DNA, 22 bp, Homo sapiens
tcccggagggaaactgtgaatg

SEQ ID NO: 2908710 - DNA, 19 bp, Homo sapiens
tcccggctgaccctgtgcc

SEQ ID NO: 2908711 - DNA, 22 bp, Homo sapiens
tcccgggaagcatcctccccac

SEQ ID NO: 2908712 - DNA, 22 bp, Homo sapiens
tcccgggactcactggcagccc

SEQ ID NO: 2908713 - DNA, 19 bp, Homo sapiens
tcccgttttccccatgaca

SEQ ID NO: 2908714 - DNA, 14 bp, Homo sapiens
tccctaattcttca

SEQ ID NO: 2908715 - DNA, 14 bp, Homo sapiens
tccctacactgatg

SEQ ID NO: 2908716 - DNA, 20 bp, Homo sapiens
tccctacaggaggaacagtg

SEQ ID NO: 2908717 - DNA, 14 bp, Homo sapiens
tccctaccttgcct

SEQ ID NO: 2908718 - DNA, 15 bp, Homo sapiens
tccctaccttgcctc

SEQ ID NO: 2908719 - DNA, 17 bp, Homo sapiens
tccctaccttgcctcct

SEQ ID NO: 2908720 - DNA, 20 bp, Homo sapiens
tccctaccttgcctcctttt

SEQ ID NO: 2908721 - DNA, 18 bp, Homo sapiens
tccctagaaacttccaaa

SEQ ID NO: 2908722 - DNA, 22 bp, Homo sapiens
tccctagactttaggctttcag

SEQ ID NO: 2908723 - DNA, 17 bp, Homo sapiens
tccctagatccaggctt

SEQ ID NO: 2908724 - DNA, 21 bp, Homo sapiens
tccctagatccaggcttctcc

SEQ ID NO: 2908725 - DNA, 16 bp, Homo sapiens
tccctagcaaaatgct

SEQ ID NO: 2908726 - DNA, 17 bp, Homo sapiens
tccctagcagcccaccc

SEQ ID NO: 2908727 - DNA, 22 bp, Homo sapiens
tccctagccagcacttgtatat

SEQ ID NO: 2908728 - DNA, 21 bp, Homo sapiens
tccctagttagcatccaggct

SEQ ID NO: 2908729 - DNA, 16 bp, Homo sapiens
tccctatcttgtgaag

SEQ ID NO: 2908730 - DNA, 16 bp, Homo sapiens
tccctcaaccccacca

SEQ ID NO: 2908731 - DNA, 17 bp, Homo sapiens
tccctcactcttcctca

SEQ ID NO: 2908732 - DNA, 20 bp, Homo sapiens
tccctcagccgtcagccatc

SEQ ID NO: 2908733 - DNA, 13 bp, Homo sapiens
tccctccactcct

SEQ ID NO: 2908734 - DNA, 16 bp, Homo sapiens
tccctccactcctctc

SEQ ID NO: 2908735 - DNA, 17 bp, Homo sapiens
tccctccagcacaaaca

SEQ ID NO: 2908736 - DNA, 14 bp, Homo sapiens
tccctcccaggact

SEQ ID NO: 2908737 - DNA, 22 bp, Homo sapiens
tccctcccatcctccagccctg

SEQ ID NO: 2908738 - DNA, 13 bp, Homo sapiens
tccctccccaccc

SEQ ID NO: 2908739 - DNA, 14 bp, Homo sapiens
tccctccccaccca

SEQ ID NO: 2908740 - DNA, 14 bp, Homo sapiens
tccctcccccagca

SEQ ID NO: 2908741 - DNA, 12 bp, Homo sapiens
tccctccccccc

SEQ ID NO: 2908742 - DNA, 21 bp, Homo sapiens
tccctcccccccatgcactgt

SEQ ID NO: 2908743 - DNA, 16 bp, Homo sapiens
tccctccctctgccgg

SEQ ID NO: 2908744 - DNA, 12 bp, Homo sapiens
tccctccctgcc

SEQ ID NO: 2908745 - DNA, 16 bp, Homo sapiens
tccctccgcctcccat

SEQ ID NO: 2908746 - DNA, 15 bp, Homo sapiens
tccctccgggacctg

SEQ ID NO: 2908747 - DNA, 15 bp, Homo sapiens
tccctccgggcaggg

SEQ ID NO: 2908748 - DNA, 22 bp, Homo sapiens
tccctccgggcaggggagccag

SEQ ID NO: 2908749 - DNA, 12 bp, Homo sapiens
tccctcctcaca

SEQ ID NO: 2908750 - DNA, 15 bp, Homo sapiens
tccctcctcacactc

SEQ ID NO: 2908751 - DNA, 18 bp, Homo sapiens
tccctcctcacactccag

SEQ ID NO: 2908752 - DNA, 16 bp, Homo sapiens
tccctcctctgcccgg

SEQ ID NO: 2908753 - DNA, 14 bp, Homo sapiens
tccctcctgctact

SEQ ID NO: 2908754 - DNA, 14 bp, Homo sapiens
tccctcctggagct

SEQ ID NO: 2908755 - DNA, 19 bp, Homo sapiens
tccctcctggagctctgtg

SEQ ID NO: 2908756 - DNA, 21 bp, Homo sapiens
tccctcctggagctctgtggg

SEQ ID NO: 2908757 - DNA, 20 bp, Homo sapiens
tccctcctggtgtcacccca

SEQ ID NO: 2908758 - DNA, 21 bp, Homo sapiens
tccctcctggtgtcaccccag

SEQ ID NO: 2908759 - DNA, 21 bp, Homo sapiens
tccctcgtcttcagctgcatt

SEQ ID NO: 2908760 - DNA, 17 bp, Homo sapiens
tccctctaacccagtgg

SEQ ID NO: 2908761 - DNA, 19 bp, Homo sapiens
tccctctaacccagtggct

SEQ ID NO: 2908762 - DNA, 22 bp, Homo sapiens
tccctctacagagcttccctga

SEQ ID NO: 2908763 - DNA, 17 bp, Homo sapiens
tccctctactgggagcc

SEQ ID NO: 2908764 - DNA, 23 bp, Homo sapiens
tccctctactgggagcctaccca

SEQ ID NO: 2908765 - DNA, 21 bp, Homo sapiens
tccctctcagtgccttctctc

SEQ ID NO: 2908766 - DNA, 13 bp, Homo sapiens
tccctctcctgcc

SEQ ID NO: 2908767 - DNA, 16 bp, Homo sapiens
tccctctcctgcctac

SEQ ID NO: 2908768 - DNA, 17 bp, Homo sapiens
tccctctctcccatttc

SEQ ID NO: 2908769 - DNA, 19 bp, Homo sapiens
tccctctcttccgggagct

SEQ ID NO: 2908770 - DNA, 12 bp, Homo sapiens
tccctctgccag

SEQ ID NO: 2908771 - DNA, 11 bp, Homo sapiens
tccctctgcct

SEQ ID NO: 2908772 - DNA, 12 bp, Homo sapiens
tccctctgcctc

SEQ ID NO: 2908773 - DNA, 13 bp, Homo sapiens
tccctctgcctca

SEQ ID NO: 2908774 - DNA, 18 bp, Homo sapiens
tccctctgcctcatcctc

SEQ ID NO: 2908775 - DNA, 20 bp, Homo sapiens
tccctctggggggtggggac

SEQ ID NO: 2908776 - DNA, 20 bp, Homo sapiens
tccctctgtcatcctcagga

SEQ ID NO: 2908777 - DNA, 16 bp, Homo sapiens
tccctcttctttcaga

SEQ ID NO: 2908778 - DNA, 18 bp, Homo sapiens
tccctcttgtgctcagtc

SEQ ID NO: 2908779 - DNA, 12 bp, Homo sapiens
tccctctttcta

SEQ ID NO: 2908780 - DNA, 18 bp, Homo sapiens
tccctctttctagcctgg

SEQ ID NO: 2908781 - DNA, 17 bp, Homo sapiens
tccctgaaaacccagag

SEQ ID NO: 2908782 - DNA, 20 bp, Homo sapiens
tccctgaaacactgcttctc

SEQ ID NO: 2908783 - DNA, 17 bp, Homo sapiens
tccctgaccctgtatat

SEQ ID NO: 2908784 - DNA, 22 bp, Homo sapiens
tccctgaccctgtatatagccc

SEQ ID NO: 2908785 - DNA, 19 bp, Homo sapiens
tccctgactcattctgaag

SEQ ID NO: 2908786 - DNA, 18 bp, Homo sapiens
tccctgagcagtctactt

SEQ ID NO: 2908787 - DNA, 22 bp, Homo sapiens
tccctgagcagtctacttctgt

SEQ ID NO: 2908788 - DNA, 21 bp, Homo sapiens
tccctgagttgcaccattctt

SEQ ID NO: 2908789 - DNA, 15 bp, Homo sapiens
tccctgatcccagac

SEQ ID NO: 2908790 - DNA, 20 bp, Homo sapiens
tccctgatcccagtttctgc

SEQ ID NO: 2908791 - DNA, 22 bp, Homo sapiens
tccctgcatctgaccagcagcg

SEQ ID NO: 2908792 - DNA, 14 bp, Homo sapiens
tccctgcccctgtg

SEQ ID NO: 2908793 - DNA, 15 bp, Homo sapiens
tccctgcctaaggaa

SEQ ID NO: 2908794 - DNA, 17 bp, Homo sapiens
tccctgcctccacccac

SEQ ID NO: 2908795 - DNA, 13 bp, Homo sapiens
tccctgcctccag

SEQ ID NO: 2908796 - DNA, 17 bp, Homo sapiens
tccctgcctccagctgt

SEQ ID NO: 2908797 - DNA, 19 bp, Homo sapiens
tccctgcctccagctgtca

SEQ ID NO: 2908798 - DNA, 22 bp, Homo sapiens
tccctgcctcggttgattgtgc

SEQ ID NO: 2908799 - DNA, 13 bp, Homo sapiens
tccctgcctggac

SEQ ID NO: 2908800 - DNA, 11 bp, Homo sapiens
tccctgccttc

SEQ ID NO: 2908801 - DNA, 22 bp, Homo sapiens
tccctgccttcactgtgctcca

SEQ ID NO: 2908802 - DNA, 15 bp, Homo sapiens
tccctgcgcttcctg

SEQ ID NO: 2908803 - DNA, 16 bp, Homo sapiens
tccctgcttcatatct

SEQ ID NO: 2908804 - DNA, 20 bp, Homo sapiens
tccctgcttcatatctctcc

SEQ ID NO: 2908805 - DNA, 22 bp, Homo sapiens
tccctgcttcatatctctccct

SEQ ID NO: 2908806 - DNA, 14 bp, Homo sapiens
tccctgctttctgg

SEQ ID NO: 2908807 - DNA, 18 bp, Homo sapiens
tccctggaaggacatcca

SEQ ID NO: 2908808 - DNA, 14 bp, Homo sapiens
tccctggccttgcc

SEQ ID NO: 2908809 - DNA, 19 bp, Homo sapiens
tccctggctgcagcctccg

SEQ ID NO: 2908810 - DNA, 21 bp, Homo sapiens
tccctggctgcagcctccggg

SEQ ID NO: 2908811 - DNA, 21 bp, Homo sapiens
tccctggcttgtaactccacc

SEQ ID NO: 2908812 - DNA, 17 bp, Homo sapiens
tccctgggcattgcttt

SEQ ID NO: 2908813 - DNA, 18 bp, Homo sapiens
tccctgggcattgctttc

SEQ ID NO: 2908814 - DNA, 17 bp, Homo sapiens
tccctggggcactcccc

SEQ ID NO: 2908815 - DNA, 20 bp, Homo sapiens
tccctggggctagggggagc

SEQ ID NO: 2908816 - DNA, 20 bp, Homo sapiens
tccctgggggaagccctgga

SEQ ID NO: 2908817 - DNA, 14 bp, Homo sapiens
tccctggtccttca

SEQ ID NO: 2908818 - DNA, 16 bp, Homo sapiens
tcacccttggtagagt

SEQ ID NO: 2908819 - DNA, 20 bp, Homo sapiens
tcaccgagagtagccgagag

SEQ ID NO: 2908820 - DNA, 21 bp, Homo sapiens
tcaccgtggattcgcttgagt

SEQ ID NO: 2908821 - DNA, 16 bp, Homo sapiens
tcaccgtgggctccct

SEQ ID NO: 2908822 - DNA, 15 bp, Homo sapiens
tcacctaaccctctg

SEQ ID NO: 2908823 - DNA, 22 bp, Homo sapiens
tcacctaagagattctgatttg

SEQ ID NO: 2908824 - DNA, 12 bp, Homo sapiens
tcacctcagcct

SEQ ID NO: 2908825 - DNA, 14 bp, Homo sapiens
tcacctcattctga

SEQ ID NO: 2908826 - DNA, 14 bp, Homo sapiens
tcacctccttcaat

SEQ ID NO: 2908827 - DNA, 24 bp, Homo sapiens
tcacctcgagaagtaattatcagt

SEQ ID NO: 2908828 - DNA, 13 bp, Homo sapiens
tcacctctcccac

SEQ ID NO: 2908829 - DNA, 16 bp, Homo sapiens
tcacctctctcactga

SEQ ID NO: 2908830 - DNA, 14 bp, Homo sapiens
tcacctctgcctca

SEQ ID NO: 2908831 - DNA, 17 bp, Homo sapiens
tcacctgaaccccagag

SEQ ID NO: 2908832 - DNA, 19 bp, Homo sapiens
tcacctgaaccccagaggc

SEQ ID NO: 2908833 - DNA, 23 bp, Homo sapiens
tcacctgaaccccagaggcagag

SEQ ID NO: 2908834 - DNA, 22 bp, Homo sapiens
tcacctgagcaggacctctgaa

SEQ ID NO: 2908835 - DNA, 12 bp, Homo sapiens
tcacctgaggtc

SEQ ID NO: 2908836 - DNA, 17 bp, Homo sapiens
tcacctgaggtcgggag

SEQ ID NO: 2908837 - DNA, 21 bp, Homo sapiens
tcacctgcaaagctctgtggc

SEQ ID NO: 2908838 - DNA, 16 bp, Homo sapiens
tcacctgccccaactc

SEQ ID NO: 2908839 - DNA, 19 bp, Homo sapiens
tcacctggaagcatttgtt

SEQ ID NO: 2908840 - DNA, 14 bp, Homo sapiens
tcacctgtgcttcg

SEQ ID NO: 2908841 - DNA, 21 bp, Homo sapiens
tcacctgtgcttcgggccctt

SEQ ID NO: 2908842 - DNA, 16 bp, Homo sapiens
tcaccttcagtaaccc

SEQ ID NO: 2908843 - DNA, 23 bp, Homo sapiens
tcaccttggcaccagacacccag

SEQ ID NO: 2908844 - DNA, 18 bp, Homo sapiens
tcaccttgtttctcaact

SEQ ID NO: 2908845 - DNA, 19 bp, Homo sapiens
tcacctttcccactttctt

SEQ ID NO: 2908846 - DNA, 19 bp, Homo sapiens
tcacctttctccactgggt

SEQ ID NO: 2908847 - DNA, 21 bp, Homo sapiens
tcacgaattccatcttgtaaa

SEQ ID NO: 2908848 - DNA, 15 bp, Homo sapiens
tcacgagtgttcctg

SEQ ID NO: 2908849 - DNA, 20 bp, Homo sapiens
tcacgattatgactaaagta

SEQ ID NO: 2908850 - DNA, 15 bp, Homo sapiens
tcacgcacctcccat

SEQ ID NO: 2908851 - DNA, 14 bp, Homo sapiens
tcacgcacctgggt

SEQ ID NO: 2908852 - DNA, 12 bp, Homo sapiens
tcacgccacccc

SEQ ID NO: 2908853 - DNA, 13 bp, Homo sapiens
tcacgccaccccc

SEQ ID NO: 2908854 - DNA, 17 bp, Homo sapiens
tcacgccattctcctgc

SEQ ID NO: 2908855 - DNA, 21 bp, Homo sapiens
tcacgccgggagaagccacct

SEQ ID NO: 2908856 - DNA, 21 bp, Homo sapiens
tcacgcctgtaatcccagcac

SEQ ID NO: 2908857 - DNA, 23 bp, Homo sapiens
tcacgcctgtaatcccagcactt

SEQ ID NO: 2908858 - DNA, 18 bp, Homo sapiens
tcacgggcagtagctgtg

SEQ ID NO: 2908859 - DNA, 18 bp, Homo sapiens
tcacgggcggtcctgcac

SEQ ID NO: 2908860 - DNA, 21 bp, Homo sapiens
tcacgggcggtcctgcacaga

SEQ ID NO: 2908861 - DNA, 18 bp, Homo sapiens
tcacgtatttcacagagc

SEQ ID NO: 2908862 - DNA, 19 bp, Homo sapiens
tcacgtgcaggacagctct

SEQ ID NO: 2908863 - DNA, 16 bp, Homo sapiens
tcacgtgcgctgggca

SEQ ID NO: 2908864 - DNA, 12 bp, Homo sapiens
tcactaaggact

SEQ ID NO: 2908865 - DNA, 15 bp, Homo sapiens
tcactaatacacagt

SEQ ID NO: 2908866 - DNA, 16 bp, Homo sapiens
tcactaatttttgtat

SEQ ID NO: 2908867 - DNA, 13 bp, Homo sapiens
tcactacaactga

SEQ ID NO: 2908868 - DNA, 16 bp, Homo sapiens
tcactactcgagccca

SEQ ID NO: 2908869 - DNA, 15 bp, Homo sapiens
tcactagttgtcagc

SEQ ID NO: 2908870 - DNA, 14 bp, Homo sapiens
tcactatgtttctc

SEQ ID NO: 2908871 - DNA, 15 bp, Homo sapiens
tcactatgtttctca

SEQ ID NO: 2908872 - DNA, 23 bp, Homo sapiens
tcactcaacaacatctttgtgtt

SEQ ID NO: 2908873 - DNA, 12 bp, Homo sapiens
tcactcaaggcg

SEQ ID NO: 2908874 - DNA, 22 bp, Homo sapiens
tcactcagcccctacccctgcc

SEQ ID NO: 2908875 - DNA, 13 bp, Homo sapiens
tcactcattgctg

SEQ ID NO: 2908876 - DNA, 18 bp, Homo sapiens
tcactcattgctgagcct

SEQ ID NO: 2908877 - DNA, 22 bp, Homo sapiens
tcactcattgctgagcctctgc

SEQ ID NO: 2908878 - DNA, 21 bp, Homo sapiens
tcactcccatacctttaatgg

SEQ ID NO: 2908879 - DNA, 14 bp, Homo sapiens
tcactcgcaggacc

SEQ ID NO: 2908880 - DNA, 23 bp, Homo sapiens
tcactctctattgtcatggggat

SEQ ID NO: 2908881 - DNA, 16 bp, Homo sapiens
tcactctgccctctgc

SEQ ID NO: 2908882 - DNA, 17 bp, Homo sapiens
tcactctgccctctgct

SEQ ID NO: 2908883 - DNA, 20 bp, Homo sapiens
tcactctgccctctgctgct

SEQ ID NO: 2908884 - DNA, 12 bp, Homo sapiens
tcactcttaggc

SEQ ID NO: 2908885 - DNA, 20 bp, Homo sapiens
tcactcttcctcatcctgct

SEQ ID NO: 2908886 - DNA, 23 bp, Homo sapiens
tcactcttcctcatcctgcttct

SEQ ID NO: 2908887 - DNA, 17 bp, Homo sapiens
tcactcttgaagtccag

SEQ ID NO: 2908888 - DNA, 21 bp, Homo sapiens
tcactcttgaagtccaggact

SEQ ID NO: 2908889 - DNA, 17 bp, Homo sapiens
tcactgaaaacatctgg

SEQ ID NO: 2908890 - DNA, 12 bp, Homo sapiens
tcactgaagacg

SEQ ID NO: 2908891 - DNA, 14 bp, Homo sapiens
tcactgaagacgcc

SEQ ID NO: 2908892 - DNA, 19 bp, Homo sapiens
tcactgaagcccagacctc

SEQ ID NO: 2908893 - DNA, 17 bp, Homo sapiens
tcactgacacatcagca

SEQ ID NO: 2908894 - DNA, 16 bp, Homo sapiens
tcactgaggcctgaga

SEQ ID NO: 2908895 - DNA, 17 bp, Homo sapiens
tcactgagttttccatg

SEQ ID NO: 2908896 - DNA, 21 bp, Homo sapiens
tcactgcaagctccaactccc

SEQ ID NO: 2908897 - DNA, 18 bp, Homo sapiens
tcactgcaattttgtgta

SEQ ID NO: 2908898 - DNA, 22 bp, Homo sapiens
tcactgcagcctcaacctcctg

SEQ ID NO: 2908899 - DNA, 20 bp, Homo sapiens
tcactgccagagataaacta

SEQ ID NO: 2908900 - DNA, 20 bp, Homo sapiens
tcactgccgacatccctccc

SEQ ID NO: 2908901 - DNA, 14 bp, Homo sapiens
tcactgctacatgt

SEQ ID NO: 2908902 - DNA, 14 bp, Homo sapiens
tcactgctgctcct

SEQ ID NO: 2908903 - DNA, 16 bp, Homo sapiens
tcactggaaaggaaag

SEQ ID NO: 2908904 - DNA, 21 bp, Homo sapiens
tcactggaaaggaaagatgat

SEQ ID NO: 2908905 - DNA, 17 bp, Homo sapiens
tcactggagcaccaggc

SEQ ID NO: 2908906 - DNA, 19 bp, Homo sapiens
tcactggattggtcattta

SEQ ID NO: 2908907 - DNA, 14 bp, Homo sapiens
tcactggcagcctg

SEQ ID NO: 2908908 - DNA, 20 bp, Homo sapiens
tcactggcgacacgtagcag

SEQ ID NO: 2908909 - DNA, 22 bp, Homo sapiens
tcactggcgacacgtagcagct

SEQ ID NO: 2908910 - DNA, 13 bp, Homo sapiens
tcactggcgcctt

SEQ ID NO: 2908911 - DNA, 19 bp, Homo sapiens
tcactggcgccttctcgga

SEQ ID NO: 2908912 - DNA, 20 bp, Homo sapiens
tcactgtacagttttgtgga

SEQ ID NO: 2908913 - DNA, 21 bp, Homo sapiens
tcactgtataccgatcaggaa

SEQ ID NO: 2908914 - DNA, 14 bp, Homo sapiens
tcactgtcactgcc

SEQ ID NO: 2908915 - DNA, 16 bp, Homo sapiens
tcactgtccctcctgg

SEQ ID NO: 2908916 - DNA, 16 bp, Homo sapiens
tcactgtcctccaagc

SEQ ID NO: 2908917 - DNA, 19 bp, Homo sapiens
tcactgtcctccaagccag

SEQ ID NO: 2908918 - DNA, 15 bp, Homo sapiens
tcactgtctgagagt

SEQ ID NO: 2908919 - DNA, 14 bp, Homo sapiens
tcactgtcttttaa

SEQ ID NO: 2908920 - DNA, 17 bp, Homo sapiens
tcactgtcttttaaaaa

SEQ ID NO: 2908921 - DNA, 23 bp, Homo sapiens
tcactgtgaaccaacccccatct

SEQ ID NO: 2908922 - DNA, 18 bp, Homo sapiens
tcactgtgggaaggccag

SEQ ID NO: 2908923 - DNA, 20 bp, Homo sapiens
tcactgtggtaaatgccaca

SEQ ID NO: 2908924 - DNA, 22 bp, Homo sapiens
tcactgtttgtttttaaaaagc

SEQ ID NO: 2908925 - DNA, 17 bp, Homo sapiens
tcactgtttttagacac

SEQ ID NO: 2908926 - DNA, 18 bp, Homo sapiens
tcacttaaaacttttaaa

SEQ ID NO: 2908927 - DNA, 19 bp, Homo sapiens
tcacttagaacctttctgt

SEQ ID NO: 2908928 - DNA, 21 bp, Homo sapiens
tcacttagaacctttctgtgt

SEQ ID NO: 2908929 - DNA, 14 bp, Homo sapiens
tcacttcctccaga

SEQ ID NO: 2908930 - DNA, 19 bp, Homo sapiens
tcacttcctctccacagga

SEQ ID NO: 2908931 - DNA, 14 bp, Homo sapiens
tcacttccttgccc

SEQ ID NO: 2908932 - DNA, 22 bp, Homo sapiens
tcacttctgcattcctgtaact

SEQ ID NO: 2908933 - DNA, 22 bp, Homo sapiens
tcacttgaacccgggaggcaga

SEQ ID NO: 2908934 - DNA, 21 bp, Homo sapiens
tcacttgaatccattgaaagt

SEQ ID NO: 2908935 - DNA, 21 bp, Homo sapiens
tcacttgatgtttcctggaag

SEQ ID NO: 2908936 - DNA, 22 bp, Homo sapiens
tcacttgatgtttcctggaagc

SEQ ID NO: 2908937 - DNA, 18 bp, Homo sapiens
tcacttgtcttgctctta

SEQ ID NO: 2908938 - DNA, 18 bp, Homo sapiens
tcacttttgacaaaggca

SEQ ID NO: 2908939 - DNA, 13 bp, Homo sapiens
tcactttttaata

SEQ ID NO: 2908940 - DNA, 16 bp, Homo sapiens
tcagaaaaaaattcat

SEQ ID NO: 2908941 - DNA, 18 bp, Homo sapiens
tcagaaacatcagttact

SEQ ID NO: 2908942 - DNA, 16 bp, Homo sapiens
tcagaaacttgtgaag

SEQ ID NO: 2908943 - DNA, 21 bp, Homo sapiens
tcagaaatttaattcatgttt

SEQ ID NO: 2908944 - DNA, 15 bp, Homo sapiens
tcagaacagaggcat

SEQ ID NO: 2908945 - DNA, 20 bp, Homo sapiens
tcagaacagatgctgagcca

SEQ ID NO: 2908946 - DNA, 23 bp, Homo sapiens
tcagaacagcagactcagctctg

SEQ ID NO: 2908947 - DNA, 22 bp, Homo sapiens
tcagaaccatccatagtagtat

SEQ ID NO: 2908948 - DNA, 16 bp, Homo sapiens
tcagaacccttggctt

SEQ ID NO: 2908949 - DNA, 21 bp, Homo sapiens
tcagaactcaaatggggccag

SEQ ID NO: 2908950 - DNA, 20 bp, Homo sapiens
tcagaactgtcggaggaaag

SEQ ID NO: 2908951 - DNA, 17 bp, Homo sapiens
tcagaacttcaggtgtg

SEQ ID NO: 2908952 - DNA, 13 bp, Homo sapiens
tcagaagagcagc

SEQ ID NO: 2908953 - DNA, 16 bp, Homo sapiens
tcagagcccagcccag

SEQ ID NO: 2908954 - DNA, 12 bp, Homo sapiens
tcagagcccagg

SEQ ID NO: 2908955 - DNA, 13 bp, Homo sapiens
tcagagcccaggg

SEQ ID NO: 2908956 - DNA, 17 bp, Homo sapiens
tcagagcccaggggaga

SEQ ID NO: 2908957 - DNA, 18 bp, Homo sapiens
tcagagcccaggggagaa

SEQ ID NO: 2908958 - DNA, 12 bp, Homo sapiens
tcagagcccatg

SEQ ID NO: 2908959 - DNA, 13 bp, Homo sapiens
tcagagctgcggg

SEQ ID NO: 2908960 - DNA, 14 bp, Homo sapiens
tcagagctgcgggc

SEQ ID NO: 2908961 - DNA, 15 bp, Homo sapiens
tcagagctgcgggct

SEQ ID NO: 2908962 - DNA, 16 bp, Homo sapiens
tcagagctgcgggctg

SEQ ID NO: 2908963 - DNA, 17 bp, Homo sapiens
tcagagctgcgggctga

SEQ ID NO: 2908964 - DNA, 23 bp, Homo sapiens
tcagagctgcgggctgagggcat

SEQ ID NO: 2908965 - DNA, 22 bp, Homo sapiens
tcagagcttttcgaactgtgct

SEQ ID NO: 2908966 - DNA, 21 bp, Homo sapiens
tcagaggaacagtcctgttca

SEQ ID NO: 2908967 - DNA, 21 bp, Homo sapiens
tcagaggagagatagcctgtg

SEQ ID NO: 2908968 - DNA, 22 bp, Homo sapiens
tcagaggagagatagcctgtgg

SEQ ID NO: 2908969 - DNA, 23 bp, Homo sapiens
tcagaggagagatagcctgtggc

SEQ ID NO: 2908970 - DNA, 18 bp, Homo sapiens
tcagaggccctcgctgcc

SEQ ID NO: 2908971 - DNA, 22 bp, Homo sapiens
tcagaggccctcgctgccagct

SEQ ID NO: 2908972 - DNA, 22 bp, Homo sapiens
tcagaggccttatgagggtcct

SEQ ID NO: 2908973 - DNA, 19 bp, Homo sapiens
tcagagggtgtcctgcacc

SEQ ID NO: 2908974 - DNA, 16 bp, Homo sapiens
tcagagtctataacag

SEQ ID NO: 2908975 - DNA, 19 bp, Homo sapiens
tcagagtctataacagaaa

SEQ ID NO: 2908976 - DNA, 23 bp, Homo sapiens
tcagagtgacacccaagagggct

SEQ ID NO: 2908977 - DNA, 20 bp, Homo sapiens
tcagagtggcgtgagctgcc

SEQ ID NO: 2908978 - DNA, 23 bp, Homo sapiens
tcagagtggcgtgagctgcccgg

SEQ ID NO: 2908979 - DNA, 22 bp, Homo sapiens
tcagataaggtaaaatgccatg

SEQ ID NO: 2908980 - DNA, 23 bp, Homo sapiens
tcagataaggtaaaatgccatga

SEQ ID NO: 2908981 - DNA, 17 bp, Homo sapiens
tcagatagaatgacagt

SEQ ID NO: 2908982 - DNA, 18 bp, Homo sapiens
tcagatattctgctctat

SEQ ID NO: 2908983 - DNA, 21 bp, Homo sapiens
tcagatcatttcaaaactcat

SEQ ID NO: 2908984 - DNA, 14 bp, Homo sapiens
tcagatccagggac

SEQ ID NO: 2908985 - DNA, 16 bp, Homo sapiens
tcagatccttgtttca

SEQ ID NO: 2908986 - DNA, 17 bp, Homo sapiens
tcagatccttgtttcaa

SEQ ID NO: 2908987 - DNA, 23 bp, Homo sapiens
tcagatgactatgcagaggcctg

SEQ ID NO: 2908988 - DNA, 23 bp, Homo sapiens
tcagatgcaattgctcccatcag

SEQ ID NO: 2908989 - DNA, 14 bp, Homo sapiens
tcagatgctccaag

SEQ ID NO: 2908990 - DNA, 15 bp, Homo sapiens
tcagatgctccaaga

SEQ ID NO: 2908991 - DNA, 22 bp, Homo sapiens
tcagatgctccaagattctaga

SEQ ID NO: 2908992 - DNA, 14 bp, Homo sapiens
tcagatgctcttgg

SEQ ID NO: 2908993 - DNA, 13 bp, Homo sapiens
tcagatgcttctg

SEQ ID NO: 2908994 - DNA, 23 bp, Homo sapiens
tcagatggaaccgcaggaagctg

SEQ ID NO: 2908995 - DNA, 22 bp, Homo sapiens
tcagatggattgataattgcat

SEQ ID NO: 2908996 - DNA, 13 bp, Homo sapiens
tcagatgtaatgt

SEQ ID NO: 2908997 - DNA, 15 bp, Homo sapiens
tcagatgtaatgttt

SEQ ID NO: 2908998 - DNA, 17 bp, Homo sapiens
tcagatgtggagccagg

SEQ ID NO: 2908999 - DNA, 20 bp, Homo sapiens
tcagatgtggagccaggcgt

SEQ ID NO: 2909000 - DNA, 11 bp, Homo sapiens
tcagatgtttt

SEQ ID NO: 2909001 - DNA, 13 bp, Homo sapiens
tcagattattaaa

SEQ ID NO: 2909002 - DNA, 15 bp, Homo sapiens
tcagattgcatgtga

SEQ ID NO: 2909003 - DNA, 17 bp, Homo sapiens
tcagattgcatgtgact

SEQ ID NO: 2909004 - DNA, 21 bp, Homo sapiens
tcagattgcatgtgactctga

SEQ ID NO: 2909005 - DNA, 18 bp, Homo sapiens
tcagatttatttgtttga

SEQ ID NO: 2909006 - DNA, 23 bp, Homo sapiens
tcagatttctagttttttttcta

SEQ ID NO: 2909007 - DNA, 21 bp, Homo sapiens
tcagattttatattttctatt

SEQ ID NO: 2909008 - DNA, 14 bp, Homo sapiens
tcagcaaacacaat

SEQ ID NO: 2909009 - DNA, 15 bp, Homo sapiens
tcagcaaattccaga

SEQ ID NO: 2909010 - DNA, 14 bp, Homo sapiens
tcagcaatgaagaa

SEQ ID NO: 2909011 - DNA, 13 bp, Homo sapiens
tcagcacaaggcc

SEQ ID NO: 2909012 - DNA, 19 bp, Homo sapiens
tcagcaccttggcccagga

SEQ ID NO: 2909013 - DNA, 20 bp, Homo sapiens
tcagcaccttggcccaggag

SEQ ID NO: 2909014 - DNA, 22 bp, Homo sapiens
tcagcaccttggcccaggagct

SEQ ID NO: 2909015 - DNA, 23 bp, Homo sapiens
tcagcaccttggcccaggagctc

SEQ ID NO: 2909016 - DNA, 13 bp, Homo sapiens
tcagcagaacctg

SEQ ID NO: 2909017 - DNA, 14 bp, Homo sapiens
tcagcagcagctca

SEQ ID NO: 2909018 - DNA, 18 bp, Homo sapiens
tcagcagcagctcacacc

SEQ ID NO: 2909019 - DNA, 12 bp, Homo sapiens
tcagcagccctc

SEQ ID NO: 2909020 - DNA, 16 bp, Homo sapiens
tcagcagccctcctca

SEQ ID NO: 2909021 - DNA, 17 bp, Homo sapiens
tcagcagccctcctcac

SEQ ID NO: 2909022 - DNA, 18 bp, Homo sapiens
tcagcagccctcctcacc

SEQ ID NO: 2909023 - DNA, 22 bp, Homo sapiens
tcagcagcctgcgctcggcagg

SEQ ID NO: 2909024 - DNA, 22 bp, Homo sapiens
tcagcaggttggcttttttccc

SEQ ID NO: 2909025 - DNA, 16 bp, Homo sapiens
tcagcatcaaacatga

SEQ ID NO: 2909026 - DNA, 18 bp, Homo sapiens
tcagcatcaaacatgaaa

SEQ ID NO: 2909027 - DNA, 16 bp, Homo sapiens
tcagcatcaagcccca

SEQ ID NO: 2909028 - DNA, 14 bp, Homo sapiens
tcagcatctgacca

SEQ ID NO: 2909029 - DNA, 17 bp, Homo sapiens
tcagcatctgaccatct

SEQ ID NO: 2909030 - DNA, 18 bp, Homo sapiens
tcagcatctgaccatctg

SEQ ID NO: 2909031 - DNA, 14 bp, Homo sapiens
tcagcatgttttct

SEQ ID NO: 2909032 - DNA, 15 bp, Homo sapiens
tcagcatgttttctg

SEQ ID NO: 2909033 - DNA, 17 bp, Homo sapiens
tcagcatgttttctgct

SEQ ID NO: 2909034 - DNA, 14 bp, Homo sapiens
tcagcattgtaatt

SEQ ID NO: 2909035 - DNA, 23 bp, Homo sapiens
tcagccaacattgccttgcattt

SEQ ID NO: 2909036 - DNA, 15 bp, Homo sapiens
tcagccaagcacagt

SEQ ID NO: 2909037 - DNA, 20 bp, Homo sapiens
tcagccaagcacagtggtgg

SEQ ID NO: 2909038 - DNA, 21 bp, Homo sapiens
tcagccaatctggacacttct

SEQ ID NO: 2909039 - DNA, 21 bp, Homo sapiens
tcagccacatgccccaggctc

SEQ ID NO: 2909040 - DNA, 21 bp, Homo sapiens
tcagccatgaggagttgctgt

SEQ ID NO: 2909041 - DNA, 14 bp, Homo sapiens
tcagccatgtacag

SEQ ID NO: 2909042 - DNA, 16 bp, Homo sapiens
tcagccatgtctgtgc

SEQ ID NO: 2909043 - DNA, 21 bp, Homo sapiens
tcagccatgtctgtgctgtgt

SEQ ID NO: 2909044 - DNA, 13 bp, Homo sapiens
tcagccccatcgc

SEQ ID NO: 2909045 - DNA, 13 bp, Homo sapiens
tcagcccctcctc

SEQ ID NO: 2909046 - DNA, 18 bp, Homo sapiens
tcagcccctcctctgcca

SEQ ID NO: 2909047 - DNA, 21 bp, Homo sapiens
tcagcccctcctctgccacct

SEQ ID NO: 2909048 - DNA, 16 bp, Homo sapiens
tcagccctgaccctgt

SEQ ID NO: 2909049 - DNA, 17 bp, Homo sapiens
tcagccgaattgtggtg

SEQ ID NO: 2909050 - DNA, 20 bp, Homo sapiens
tcagcctcccgagtagctgg

SEQ ID NO: 2909051 - DNA, 13 bp, Homo sapiens
tcagcctcctgag

SEQ ID NO: 2909052 - DNA, 21 bp, Homo sapiens
tcagcctcctgagtagctgga

SEQ ID NO: 2909053 - DNA, 13 bp, Homo sapiens
tcagcctcctggg

SEQ ID NO: 2909054 - DNA, 15 bp, Homo sapiens
tcagcctcctgtctc

SEQ ID NO: 2909055 - DNA, 21 bp, Homo sapiens
tcagcctctcaaatagctggg

SEQ ID NO: 2909056 - DNA, 20 bp, Homo sapiens
tcagcctgcagttaattagc

SEQ ID NO: 2909057 - DNA, 21 bp, Homo sapiens
tatttgcataacaattcctct

SEQ ID NO: 2909058 - DNA, 16 bp, Homo sapiens
tatttgctaaatattt

SEQ ID NO: 2909059 - DNA, 20 bp, Homo sapiens
tatttggaagcaacgtgtta

SEQ ID NO: 2909060 - DNA, 16 bp, Homo sapiens
tatttgggaaacttgt

SEQ ID NO: 2909061 - DNA, 23 bp, Homo sapiens
tatttgtactgtttaatgttctg

SEQ ID NO: 2909062 - DNA, 12 bp, Homo sapiens
tatttgtgaata

SEQ ID NO: 2909063 - DNA, 21 bp, Homo sapiens
tatttgtgctatagtatttga

SEQ ID NO: 2909064 - DNA, 15 bp, Homo sapiens
tatttgtgctttgaa

SEQ ID NO: 2909065 - DNA, 17 bp, Homo sapiens
tatttgtgtatttaaca

SEQ ID NO: 2909066 - DNA, 13 bp, Homo sapiens
tatttgtgttcag

SEQ ID NO: 2909067 - DNA, 16 bp, Homo sapiens
tatttgtgttcagttc

SEQ ID NO: 2909068 - DNA, 22 bp, Homo sapiens
tatttgttgttttctgggggaa

SEQ ID NO: 2909069 - DNA, 21 bp, Homo sapiens
tattttaaaagataaatatta

SEQ ID NO: 2909070 - DNA, 15 bp, Homo sapiens
tattttaaaatattt

SEQ ID NO: 2909071 - DNA, 22 bp, Homo sapiens
tattttaaaatatttaaacctt

SEQ ID NO: 2909072 - DNA, 22 bp, Homo sapiens
tattttaaaggggtctgaaatt

SEQ ID NO: 2909073 - DNA, 22 bp, Homo sapiens
tattttaaattactatatatgt

SEQ ID NO: 2909074 - DNA, 11 bp, Homo sapiens
tattttacaca

SEQ ID NO: 2909075 - DNA, 14 bp, Homo sapiens
tattttacacagaa

SEQ ID NO: 2909076 - DNA, 17 bp, Homo sapiens
tattttacacagaaaca

SEQ ID NO: 2909077 - DNA, 11 bp, Homo sapiens
tattttacatc

SEQ ID NO: 2909078 - DNA, 14 bp, Homo sapiens
tattttacttgaat

SEQ ID NO: 2909079 - DNA, 21 bp, Homo sapiens
tattttagtgaacttgaaata

SEQ ID NO: 2909080 - DNA, 14 bp, Homo sapiens
tattttagtttctg

SEQ ID NO: 2909081 - DNA, 20 bp, Homo sapiens
tattttagtttctgttctgt

SEQ ID NO: 2909082 - DNA, 22 bp, Homo sapiens
tattttatatctgagcaaggag

SEQ ID NO: 2909083 - DNA, 16 bp, Homo sapiens
tattttatgagaaatg

SEQ ID NO: 2909084 - DNA, 17 bp, Homo sapiens
tattttatgagaaatgt

SEQ ID NO: 2909085 - DNA, 20 bp, Homo sapiens
tattttattcagtagtttga

SEQ ID NO: 2909086 - DNA, 13 bp, Homo sapiens
tattttatttgaa

SEQ ID NO: 2909087 - DNA, 11 bp, Homo sapiens
tattttcaaga

SEQ ID NO: 2909088 - DNA, 14 bp, Homo sapiens
tattttccaagtgt

SEQ ID NO: 2909089 - DNA, 16 bp, Homo sapiens
tattttccctacctaa

SEQ ID NO: 2909090 - DNA, 17 bp, Homo sapiens
tattttccctacctaag

SEQ ID NO: 2909091 - DNA, 14 bp, Homo sapiens
tattttctgttttt

SEQ ID NO: 2909092 - DNA, 12 bp, Homo sapiens
tattttctttct

SEQ ID NO: 2909093 - DNA, 14 bp, Homo sapiens
tattttctttctag

SEQ ID NO: 2909094 - DNA, 13 bp, Homo sapiens
tattttgaaaaca

SEQ ID NO: 2909095 - DNA, 14 bp, Homo sapiens
tattttgaaatgaa

SEQ ID NO: 2909096 - DNA, 18 bp, Homo sapiens
tattttgagaactccagc

SEQ ID NO: 2909097 - DNA, 22 bp, Homo sapiens
tattttgatgagatattaaatt

SEQ ID NO: 2909098 - DNA, 15 bp, Homo sapiens
tattttgatgagctt

SEQ ID NO: 2909099 - DNA, 12 bp, Homo sapiens
tattttgcaaac

SEQ ID NO: 2909100 - DNA, 22 bp, Homo sapiens
tattttgcaaacactgtgatta

SEQ ID NO: 2909101 - DNA, 15 bp, Homo sapiens
tattttgctcttgtt

SEQ ID NO: 2909102 - DNA, 16 bp, Homo sapiens
tattttgctcttgttt

SEQ ID NO: 2909103 - DNA, 16 bp, Homo sapiens
tattttgctgatttaa

SEQ ID NO: 2909104 - DNA, 14 bp, Homo sapiens
tattttggaaagtt

SEQ ID NO: 2909105 - DNA, 21 bp, Homo sapiens
tattttggaagacatatatta

SEQ ID NO: 2909106 - DNA, 20 bp, Homo sapiens
tattttggattgtatattgt

SEQ ID NO: 2909107 - DNA, 23 bp, Homo sapiens
tattttggattgtatattgtgtt

SEQ ID NO: 2909108 - DNA, 17 bp, Homo sapiens
tattttgtacattttgg

SEQ ID NO: 2909109 - DNA, 21 bp, Homo sapiens
tattttgtggaggcagtgtca

SEQ ID NO: 2909110 - DNA, 21 bp, Homo sapiens
tattttgttttgtgcagagat

SEQ ID NO: 2909111 - DNA, 17 bp, Homo sapiens
tatttttaaaagatctt

SEQ ID NO: 2909112 - DNA, 13 bp, Homo sapiens
tatttttaaattt

SEQ ID NO: 2909113 - DNA, 11 bp, Homo sapiens
tatttttaatt

SEQ ID NO: 2909114 - DNA, 15 bp, Homo sapiens
tatttttaatttaaa

SEQ ID NO: 2909115 - DNA, 18 bp, Homo sapiens
tatttttatataatatct

SEQ ID NO: 2909116 - DNA, 19 bp, Homo sapiens
tatttttatataatatcta

SEQ ID NO: 2909117 - DNA, 23 bp, Homo sapiens
tatttttatataatatctaaagt

SEQ ID NO: 2909118 - DNA, 23 bp, Homo sapiens
tatttttattcaaactacctata

SEQ ID NO: 2909119 - DNA, 23 bp, Homo sapiens
tatttttcagatataaatactga

SEQ ID NO: 2909120 - DNA, 13 bp, Homo sapiens
tatttttctgtga

SEQ ID NO: 2909121 - DNA, 18 bp, Homo sapiens
tatttttctgtgaccatc

SEQ ID NO: 2909122 - DNA, 13 bp, Homo sapiens
tatttttctttaa

SEQ ID NO: 2909123 - DNA, 19 bp, Homo sapiens
tatttttgcaaaataagtt

SEQ ID NO: 2909124 - DNA, 18 bp, Homo sapiens
tattttttcttgcattga

SEQ ID NO: 2909125 - DNA, 14 bp, Homo sapiens
tattttttcttttg

SEQ ID NO: 2909126 - DNA, 21 bp, Homo sapiens
tattttttcttttgtaattgt

SEQ ID NO: 2909127 - DNA, 15 bp, Homo sapiens
tatttttttaactgt

SEQ ID NO: 2909128 - DNA, 16 bp, Homo sapiens
tatttttttaactgtg

SEQ ID NO: 2909129 - DNA, 17 bp, Homo sapiens
tatttttttaactgtga

SEQ ID NO: 2909130 - DNA, 19 bp, Homo sapiens
tatttttttaactgtgata

SEQ ID NO: 2909131 - DNA, 16 bp, Homo sapiens
tcaaaaaaaaaaaaga

SEQ ID NO: 2909132 - DNA, 15 bp, Homo sapiens
tcaaaaaacttgtaa

SEQ ID NO: 2909133 - DNA, 23 bp, Homo sapiens
tcaaaaacacagtgtttttgtaa

SEQ ID NO: 2909134 - DNA, 13 bp, Homo sapiens
tcaaaaataatat

SEQ ID NO: 2909135 - DNA, 18 bp, Homo sapiens
tcaaaaattacactacaa

SEQ ID NO: 2909136 - DNA, 19 bp, Homo sapiens
tcaaaacagattgtttgca

SEQ ID NO: 2909137 - DNA, 23 bp, Homo sapiens
tcaaaacagttacttaagattca

SEQ ID NO: 2909138 - DNA, 23 bp, Homo sapiens
tcaaaaccagcctcatgctctga

SEQ ID NO: 2909139 - DNA, 18 bp, Homo sapiens
tcaaaactcatttcctat

SEQ ID NO: 2909140 - DNA, 15 bp, Homo sapiens
tcaaaagcattgtct

SEQ ID NO: 2909141 - DNA, 11 bp, Homo sapiens
tcaaaaggaac

SEQ ID NO: 2909142 - DNA, 17 bp, Homo sapiens
tcaaaagtaatgcctct

SEQ ID NO: 2909143 - DNA, 14 bp, Homo sapiens
tcaaaagtattttc

SEQ ID NO: 2909144 - DNA, 15 bp, Homo sapiens
tcaaaagtattttcc

SEQ ID NO: 2909145 - DNA, 16 bp, Homo sapiens
tcaaaagttgaaatta

SEQ ID NO: 2909146 - DNA, 19 bp, Homo sapiens
tcaaaatagaaaagttatt

SEQ ID NO: 2909147 - DNA, 19 bp, Homo sapiens
tcaaaataggatttcttaa

SEQ ID NO: 2909148 - DNA, 22 bp, Homo sapiens
tcaaaatatttaaaaatgtctt

SEQ ID NO: 2909149 - DNA, 23 bp, Homo sapiens
tcaaaatatttaaaaatgtcttg

SEQ ID NO: 2909150 - DNA, 18 bp, Homo sapiens
tcaaaatatttttaaaag

SEQ ID NO: 2909151 - DNA, 14 bp, Homo sapiens
tcaaaatctgtcat

SEQ ID NO: 2909152 - DNA, 15 bp, Homo sapiens
tcaaaatctgtcata

SEQ ID NO: 2909153 - DNA, 14 bp, Homo sapiens
tcaaacaaagccag

SEQ ID NO: 2909154 - DNA, 12 bp, Homo sapiens
tcaaataagaaa

SEQ ID NO: 2909155 - DNA, 15 bp, Homo sapiens
tcaaatacaaaaatg

SEQ ID NO: 2909156 - DNA, 16 bp, Homo sapiens
tcaaatattagatgtg

SEQ ID NO: 2909157 - DNA, 19 bp, Homo sapiens
tcaaatattagatgtgatt

SEQ ID NO: 2909158 - DNA, 20 bp, Homo sapiens
tcaaatcaatctgtaaaact

SEQ ID NO: 2909159 - DNA, 15 bp, Homo sapiens
tcaaatcagtcagtg

SEQ ID NO: 2909160 - DNA, 18 bp, Homo sapiens
tcaaatctcccacaagta

SEQ ID NO: 2909161 - DNA, 19 bp, Homo sapiens
tcaaatctgtaatcagcaa

SEQ ID NO: 2909162 - DNA, 17 bp, Homo sapiens
tcaaatcttacaaaatc

SEQ ID NO: 2909163 - DNA, 16 bp, Homo sapiens
tcaaatgaaggtggtt

SEQ ID NO: 2909164 - DNA, 16 bp, Homo sapiens
tcaaatgcagtatatt

SEQ ID NO: 2909165 - DNA, 19 bp, Homo sapiens
tcaaatgcagtatatttct

SEQ ID NO: 2909166 - DNA, 20 bp, Homo sapiens
tcaaatgcagtatatttctt

SEQ ID NO: 2909167 - DNA, 19 bp, Homo sapiens
tcaaatggggccagatcca

SEQ ID NO: 2909168 - DNA, 19 bp, Homo sapiens
tcaaatgttctaagtttct

SEQ ID NO: 2909169 - DNA, 13 bp, Homo sapiens
tcaaatgttttct

SEQ ID NO: 2909170 - DNA, 16 bp, Homo sapiens
tcaaatgttttctgca

SEQ ID NO: 2909171 - DNA, 18 bp, Homo sapiens
tcaaattaaagtgctgtt

SEQ ID NO: 2909172 - DNA, 15 bp, Homo sapiens
tcaaattaagattct

SEQ ID NO: 2909173 - DNA, 22 bp, Homo sapiens
tcaaattaagattctctgccca

SEQ ID NO: 2909174 - DNA, 19 bp, Homo sapiens
tcaaattaggcaaatcttt

SEQ ID NO: 2909175 - DNA, 19 bp, Homo sapiens
tcaaatttactgtcttaaa

SEQ ID NO: 2909176 - DNA, 23 bp, Homo sapiens
tcaaatttactgtcttaaatcag

SEQ ID NO: 2909177 - DNA, 15 bp, Homo sapiens
tcaacaaacagtgta

SEQ ID NO: 2909178 - DNA, 17 bp, Homo sapiens
tcaacaataaaattttt

SEQ ID NO: 2909179 - DNA, 22 bp, Homo sapiens
tcaacaatttgggcttcctgtt

SEQ ID NO: 2909180 - DNA, 23 bp, Homo sapiens
tcaacactaccagcgtatatata

SEQ ID NO: 2909181 - DNA, 12 bp, Homo sapiens
tcaacagaatga

SEQ ID NO: 2909182 - DNA, 19 bp, Homo sapiens
tcaacagagaggaccaaca

SEQ ID NO: 2909183 - DNA, 17 bp, Homo sapiens
tcaacagtgaagacaga

SEQ ID NO: 2909184 - DNA, 22 bp, Homo sapiens
tcaacagtgaagacagaagttt

SEQ ID NO: 2909185 - DNA, 17 bp, Homo sapiens
tcaacagttttcctatg

SEQ ID NO: 2909186 - DNA, 20 bp, Homo sapiens
tcaacagttttcctatgctt

SEQ ID NO: 2909187 - DNA, 23 bp, Homo sapiens
tcaacagttttcctatgctttga

SEQ ID NO: 2909188 - DNA, 13 bp, Homo sapiens
tcaacatcactga

SEQ ID NO: 2909189 - DNA, 17 bp, Homo sapiens
tcaacatcactgaaacc

SEQ ID NO: 2909190 - DNA, 14 bp, Homo sapiens
tcaacatttacatg

SEQ ID NO: 2909191 - DNA, 16 bp, Homo sapiens
tcaacatttacatgta

SEQ ID NO: 2909192 - DNA, 17 bp, Homo sapiens
tcaacatttacatgtat

SEQ ID NO: 2909193 - DNA, 17 bp, Homo sapiens
tcaaccaatgccaaaaa

SEQ ID NO: 2909194 - DNA, 15 bp, Homo sapiens
tcaaccaatgtagaa

SEQ ID NO: 2909195 - DNA, 13 bp, Homo sapiens
tcaaccccaccct

SEQ ID NO: 2909196 - DNA, 17 bp, Homo sapiens
tcaaccccagacactgg

SEQ ID NO: 2909197 - DNA, 17 bp, Homo sapiens
tcaacctcttctggctc

SEQ ID NO: 2909198 - DNA, 18 bp, Homo sapiens
tcaacctcttctggctca

SEQ ID NO: 2909199 - DNA, 17 bp, Homo sapiens
tcaacctgggcaaagcc

SEQ ID NO: 2909200 - DNA, 18 bp, Homo sapiens
tcaacctgggcaaagcct

SEQ ID NO: 2909201 - DNA, 21 bp, Homo sapiens
tcaactccaaggcacactgtt

SEQ ID NO: 2909202 - DNA, 19 bp, Homo sapiens
tcaactcctcgacatcact

SEQ ID NO: 2909203 - DNA, 20 bp, Homo sapiens
tcaactctccaatgttctat

SEQ ID NO: 2909204 - DNA, 19 bp, Homo sapiens
tcaactgccaaaatgctct

SEQ ID NO: 2909205 - DNA, 22 bp, Homo sapiens
tcaactggggggaccaaatagc

SEQ ID NO: 2909206 - DNA, 17 bp, Homo sapiens
tcaactgggttttcagc

SEQ ID NO: 2909207 - DNA, 15 bp, Homo sapiens
tcaacttaaaagtca

SEQ ID NO: 2909208 - DNA, 15 bp, Homo sapiens
tcaacttaaagtgaa

SEQ ID NO: 2909209 - DNA, 21 bp, Homo sapiens
tcaacttggaaaaagaaagaa

SEQ ID NO: 2909210 - DNA, 16 bp, Homo sapiens
tcaactttcatttgaa

SEQ ID NO: 2909211 - DNA, 18 bp, Homo sapiens
tcaactttgaataaagaa

SEQ ID NO: 2909212 - DNA, 16 bp, Homo sapiens
tcaagaaaactggaaa

SEQ ID NO: 2909213 - DNA, 21 bp, Homo sapiens
tcaagaaataaaaggaagcca

SEQ ID NO: 2909214 - DNA, 18 bp, Homo sapiens
tcaagaagaaagtgttca

SEQ ID NO: 2909215 - DNA, 19 bp, Homo sapiens
tcaagaagtcagagaaaac

SEQ ID NO: 2909216 - DNA, 23 bp, Homo sapiens
tcaagaagtcagagaaaacactt

SEQ ID NO: 2909217 - DNA, 14 bp, Homo sapiens
tcaagacatagcat

SEQ ID NO: 2909218 - DNA, 12 bp, Homo sapiens
tcaagactgaaa

SEQ ID NO: 2909219 - DNA, 16 bp, Homo sapiens
tcaagagactcctgaa

SEQ ID NO: 2909220 - DNA, 22 bp, Homo sapiens
tcaagaggaatgaaaaaagctt

SEQ ID NO: 2909221 - DNA, 18 bp, Homo sapiens
tcaagaggctgagacagg

SEQ ID NO: 2909222 - DNA, 22 bp, Homo sapiens
tcaagatcaatgaaatgatgtc

SEQ ID NO: 2909223 - DNA, 13 bp, Homo sapiens
tcaagatccaaat

SEQ ID NO: 2909224 - DNA, 14 bp, Homo sapiens
tcaagcacttccca

SEQ ID NO: 2909225 - DNA, 17 bp, Homo sapiens
tcaagcacttcccagga

SEQ ID NO: 2909226 - DNA, 21 bp, Homo sapiens
tcaagcacttcccaggatctg

SEQ ID NO: 2909227 - DNA, 22 bp, Homo sapiens
tcaagcaggtttcttgcttctg

SEQ ID NO: 2909228 - DNA, 17 bp, Homo sapiens
tcaagcatattggaaag

SEQ ID NO: 2909229 - DNA, 18 bp, Homo sapiens
tcaagcatattggaaagt

SEQ ID NO: 2909230 - DNA, 15 bp, Homo sapiens
tcaagccaagcagcc

SEQ ID NO: 2909231 - DNA, 16 bp, Homo sapiens
tcaagccaagcagcca

SEQ ID NO: 2909232 - DNA, 16 bp, Homo sapiens
tcaagccatcttcccg

SEQ ID NO: 2909233 - DNA, 16 bp, Homo sapiens
tcaagcccgcggggac

SEQ ID NO: 2909234 - DNA, 13 bp, Homo sapiens
tcaagctcctcct

SEQ ID NO: 2909235 - DNA, 20 bp, Homo sapiens
tcaagctcctcctccctgca

SEQ ID NO: 2909236 - DNA, 17 bp, Homo sapiens
tcaaggaacttgaaaaa

SEQ ID NO: 2909237 - DNA, 18 bp, Homo sapiens
tcaaggaacttgaaaaat

SEQ ID NO: 2909238 - DNA, 20 bp, Homo sapiens
tcaaggaacttgaaaaatac

SEQ ID NO: 2909239 - DNA, 15 bp, Homo sapiens
tcaaggaagaaaacg

SEQ ID NO: 2909240 - DNA, 20 bp, Homo sapiens
tcaaggactttctgaagcct

SEQ ID NO: 2909241 - DNA, 15 bp, Homo sapiens
tcaaggcactctaga

SEQ ID NO: 2909242 - DNA, 17 bp, Homo sapiens
ggctggtgcctgaagac

SEQ ID NO: 2909243 - DNA, 14 bp, Homo sapiens
ggctggtggcccag

SEQ ID NO: 2909244 - DNA, 16 bp, Homo sapiens
ggctggtggcccagga

SEQ ID NO: 2909245 - DNA, 23 bp, Homo sapiens
ggctgtagttacattaatgccca

SEQ ID NO: 2909246 - DNA, 17 bp, Homo sapiens
ggctgtcatctgtgcac

SEQ ID NO: 2909247 - DNA, 13 bp, Homo sapiens
ggctgtctggatc

SEQ ID NO: 2909248 - DNA, 17 bp, Homo sapiens
ggctgtctttgcagggc

SEQ ID NO: 2909249 - DNA, 21 bp, Homo sapiens
ggctgtgactctgggcaggga

SEQ ID NO: 2909250 - DNA, 22 bp, Homo sapiens
ggctgtgactctgggcagggac

SEQ ID NO: 2909251 - DNA, 15 bp, Homo sapiens
ggctgtgagcattta

SEQ ID NO: 2909252 - DNA, 15 bp, Homo sapiens
ggctgtgctcagaga

SEQ ID NO: 2909253 - DNA, 14 bp, Homo sapiens
ggctgtgggaccag

SEQ ID NO: 2909254 - DNA, 18 bp, Homo sapiens
ggctgtgtaaccttgggt

SEQ ID NO: 2909255 - DNA, 18 bp, Homo sapiens
ggctgtgtttccatctca

SEQ ID NO: 2909256 - DNA, 20 bp, Homo sapiens
ggctgtttcttgtctgttat

SEQ ID NO: 2909257 - DNA, 19 bp, Homo sapiens
ggctgttttagtgccaggc

SEQ ID NO: 2909258 - DNA, 14 bp, Homo sapiens
ggcttagctgccat

SEQ ID NO: 2909259 - DNA, 21 bp, Homo sapiens
ggcttagctgccatcttgctt

SEQ ID NO: 2909260 - DNA, 22 bp, Homo sapiens
ggcttatattttcagcaaagaa

SEQ ID NO: 2909261 - DNA, 13 bp, Homo sapiens
ggcttcagcctag

SEQ ID NO: 2909262 - DNA, 13 bp, Homo sapiens
ggcttcaggtcca

SEQ ID NO: 2909263 - DNA, 11 bp, Homo sapiens
ggcttcataca

SEQ ID NO: 2909264 - DNA, 14 bp, Homo sapiens
ggcttccctctctg

SEQ ID NO: 2909265 - DNA, 23 bp, Homo sapiens
ggcttcctgagaaagcccacctg

SEQ ID NO: 2909266 - DNA, 20 bp, Homo sapiens
ggcttcctggtgagaactga

SEQ ID NO: 2909267 - DNA, 13 bp, Homo sapiens
ggcttctcccgga

SEQ ID NO: 2909268 - DNA, 14 bp, Homo sapiens
ggcttctctctgtg

SEQ ID NO: 2909269 - DNA, 19 bp, Homo sapiens
ggcttctgcgtccaccagg

SEQ ID NO: 2909270 - DNA, 20 bp, Homo sapiens
ggcttcttcagatcagtgct

SEQ ID NO: 2909271 - DNA, 16 bp, Homo sapiens
ggcttgaatttgcatg

SEQ ID NO: 2909272 - DNA, 17 bp, Homo sapiens
ggcttgacacctttgaa

SEQ ID NO: 2909273 - DNA, 20 bp, Homo sapiens
ggcttgagcccccgcgccca

SEQ ID NO: 2909274 - DNA, 22 bp, Homo sapiens
ggcttgagtttaaattgtaata

SEQ ID NO: 2909275 - DNA, 16 bp, Homo sapiens
ggcttgcctgggctgg

SEQ ID NO: 2909276 - DNA, 19 bp, Homo sapiens
ggcttgcctgggctgggca

SEQ ID NO: 2909277 - DNA, 15 bp, Homo sapiens
ggcttggatcctggg

SEQ ID NO: 2909278 - DNA, 17 bp, Homo sapiens
ggcttggatcctgggct

SEQ ID NO: 2909279 - DNA, 17 bp, Homo sapiens
ggcttggcctatctcct

SEQ ID NO: 2909280 - DNA, 18 bp, Homo sapiens
ggcttgtaactccaccaa

SEQ ID NO: 2909281 - DNA, 15 bp, Homo sapiens
ggcttgtacattttt

SEQ ID NO: 2909282 - DNA, 16 bp, Homo sapiens
ggcttgttttattttg

SEQ ID NO: 2909283 - DNA, 18 bp, Homo sapiens
ggctttaagctccagctt

SEQ ID NO: 2909284 - DNA, 20 bp, Homo sapiens
ggctttatgataatagattc

SEQ ID NO: 2909285 - DNA, 22 bp, Homo sapiens
tacttaagtttgtaagacagtg

SEQ ID NO: 2909286 - DNA, 14 bp, Homo sapiens
tacttaataaaaca

SEQ ID NO: 2909287 - DNA, 19 bp, Homo sapiens
tacttaatactgaatttct

SEQ ID NO: 2909288 - DNA, 22 bp, Homo sapiens
tacttacattctctaataagaa

SEQ ID NO: 2909289 - DNA, 13 bp, Homo sapiens
tacttagatattt

SEQ ID NO: 2909290 - DNA, 16 bp, Homo sapiens
tacttagatatttcat

SEQ ID NO: 2909291 - DNA, 21 bp, Homo sapiens
tacttagatatttcatgtgct

SEQ ID NO: 2909292 - DNA, 15 bp, Homo sapiens
tacttagctggccaa

SEQ ID NO: 2909293 - DNA, 23 bp, Homo sapiens
tacttaggactacattttgctct

SEQ ID NO: 2909294 - DNA, 16 bp, Homo sapiens
tacttatatggaaatt

SEQ ID NO: 2909295 - DNA, 15 bp, Homo sapiens
tacttatccctgccc

SEQ ID NO: 2909296 - DNA, 17 bp, Homo sapiens
tacttatccctgcccat

SEQ ID NO: 2909297 - DNA, 18 bp, Homo sapiens
tacttatccctgcccatt

SEQ ID NO: 2909298 - DNA, 14 bp, Homo sapiens
tacttatctctaaa

SEQ ID NO: 2909299 - DNA, 19 bp, Homo sapiens
tacttcaaaagtattttcc

SEQ ID NO: 2909300 - DNA, 20 bp, Homo sapiens
tacttcactatacaaacaaa

SEQ ID NO: 2909301 - DNA, 13 bp, Homo sapiens
tacttcagcaaga

SEQ ID NO: 2909302 - DNA, 21 bp, Homo sapiens
tacttcagcaagagagaacct

SEQ ID NO: 2909303 - DNA, 16 bp, Homo sapiens
tacttcagctttgtgt

SEQ ID NO: 2909304 - DNA, 22 bp, Homo sapiens
tacttcaggggcacttcattga

SEQ ID NO: 2909305 - DNA, 18 bp, Homo sapiens
tacttcattttcagagtg

SEQ ID NO: 2909306 - DNA, 19 bp, Homo sapiens
tacttcattttcagagtga

SEQ ID NO: 2909307 - DNA, 18 bp, Homo sapiens
tacttcccccaccctggg

SEQ ID NO: 2909308 - DNA, 18 bp, Homo sapiens
tacttctgtgtctgtcac

SEQ ID NO: 2909309 - DNA, 15 bp, Homo sapiens
tacttcttattcact

SEQ ID NO: 2909310 - DNA, 11 bp, Homo sapiens
tacttgaaggg

SEQ ID NO: 2909311 - DNA, 14 bp, Homo sapiens
tacttgaagggcca

SEQ ID NO: 2909312 - DNA, 16 bp, Homo sapiens
tacttgaagggccaga

SEQ ID NO: 2909313 - DNA, 22 bp, Homo sapiens
tacttgaagggccagagccagg

SEQ ID NO: 2909314 - DNA, 22 bp, Homo sapiens
tacttgaagtaactataacaaa

SEQ ID NO: 2909315 - DNA, 17 bp, Homo sapiens
tacttgctcaggtactt

SEQ ID NO: 2909316 - DNA, 14 bp, Homo sapiens
tacttgggagcctg

SEQ ID NO: 2909317 - DNA, 16 bp, Homo sapiens
tacttgggagcctgag

SEQ ID NO: 2909318 - DNA, 18 bp, Homo sapiens
tacttgtcaaagaaggtt

SEQ ID NO: 2909319 - DNA, 21 bp, Homo sapiens
tacttgtgttacttgccaagc

SEQ ID NO: 2909320 - DNA, 14 bp, Homo sapiens
tacttgttcatttc

SEQ ID NO: 2909321 - DNA, 15 bp, Homo sapiens
tacttgttcatttct

SEQ ID NO: 2909322 - DNA, 17 bp, Homo sapiens
tacttgttcatttctgt

SEQ ID NO: 2909323 - DNA, 17 bp, Homo sapiens
tactttaaaaatcagtt

SEQ ID NO: 2909324 - DNA, 14 bp, Homo sapiens
tactttatttctga

SEQ ID NO: 2909325 - DNA, 10 bp, Homo sapiens
tactttcaaa

SEQ ID NO: 2909326 - DNA, 23 bp, Homo sapiens
tactttcaaaagagtagaaagct

SEQ ID NO: 2909327 - DNA, 16 bp, Homo sapiens
tactttcggagaaatt

SEQ ID NO: 2909328 - DNA, 20 bp, Homo sapiens
tactttcggagaaattctct

SEQ ID NO: 2909329 - DNA, 20 bp, Homo sapiens
tactttcgtaatagctcaga

SEQ ID NO: 2909330 - DNA, 18 bp, Homo sapiens
tactttctcttgtttaaa

SEQ ID NO: 2909331 - DNA, 14 bp, Homo sapiens
tactttgaagtcat

SEQ ID NO: 2909332 - DNA, 18 bp, Homo sapiens
tactttgaagtcatacca

SEQ ID NO: 2909333 - DNA, 18 bp, Homo sapiens
tactttgaatagtcctaa

SEQ ID NO: 2909334 - DNA, 18 bp, Homo sapiens
tactttgattccatttta

SEQ ID NO: 2909335 - DNA, 21 bp, Homo sapiens
tactttgattccattttaagt

SEQ ID NO: 2909336 - DNA, 15 bp, Homo sapiens
tactttgtttttcca

SEQ ID NO: 2909337 - DNA, 13 bp, Homo sapiens
tacttttaaataa

SEQ ID NO: 2909338 - DNA, 19 bp, Homo sapiens
tacttttaaataaattatg

SEQ ID NO: 2909339 - DNA, 18 bp, Homo sapiens
tacttttaccagtttctt

SEQ ID NO: 2909340 - DNA, 21 bp, Homo sapiens
tacttttacttgttcatttct

SEQ ID NO: 2909341 - DNA, 23 bp, Homo sapiens
tacttttattttacacagaaaca

SEQ ID NO: 2909342 - DNA, 19 bp, Homo sapiens
tacttttcccatttgtaat

SEQ ID NO: 2909343 - DNA, 14 bp, Homo sapiens
tacttttgataata

SEQ ID NO: 2909344 - DNA, 18 bp, Homo sapiens
tacttttgataatagata

SEQ ID NO: 2909345 - DNA, 19 bp, Homo sapiens
tacttttggtgtcattatt

SEQ ID NO: 2909346 - DNA, 13 bp, Homo sapiens
tactttttaaaca

SEQ ID NO: 2909347 - DNA, 13 bp, Homo sapiens
tactttttctaat

SEQ ID NO: 2909348 - DNA, 14 bp, Homo sapiens
tactttttctaatg

SEQ ID NO: 2909349 - DNA, 16 bp, Homo sapiens
tactttttctaatgag

SEQ ID NO: 2909350 - DNA, 13 bp, Homo sapiens
tactttttgtgaa

SEQ ID NO: 2909351 - DNA, 13 bp, Homo sapiens
tactttttgttat

SEQ ID NO: 2909352 - DNA, 19 bp, Homo sapiens
tactttttgttccagagct

SEQ ID NO: 2909353 - DNA, 22 bp, Homo sapiens
tacttttttaaatattttctat

SEQ ID NO: 2909354 - DNA, 21 bp, Homo sapiens
tacttttttttttttttggta

SEQ ID NO: 2909355 - DNA, 18 bp, Homo sapiens
tagaaaaatagcaacttg

SEQ ID NO: 2909356 - DNA, 17 bp, Homo sapiens
tagaaacactttctcac

SEQ ID NO: 2909357 - DNA, 16 bp, Homo sapiens
tagaaacagtgtttgc

SEQ ID NO: 2909358 - DNA, 18 bp, Homo sapiens
tagaaacctctctatttt

SEQ ID NO: 2909359 - DNA, 15 bp, Homo sapiens
tagaaacttccaaat

SEQ ID NO: 2909360 - DNA, 15 bp, Homo sapiens
tagaaagcattacat

SEQ ID NO: 2909361 - DNA, 19 bp, Homo sapiens
tagaaagcttgaaaagatt

SEQ ID NO: 2909362 - DNA, 21 bp, Homo sapiens
tagaaagcttgaaaagattct

SEQ ID NO: 2909363 - DNA, 20 bp, Homo sapiens
tagaaaggagagaacgggcg

SEQ ID NO: 2909364 - DNA, 19 bp, Homo sapiens
tagaaataaaggatgtgat

SEQ ID NO: 2909365 - DNA, 15 bp, Homo sapiens
tagaaatctgtcctg

SEQ ID NO: 2909366 - DNA, 16 bp, Homo sapiens
tagaaatctgtcctgt

SEQ ID NO: 2909367 - DNA, 21 bp, Homo sapiens
tagaaatggaaattttgctat

SEQ ID NO: 2909368 - DNA, 21 bp, Homo sapiens
tagaaatggtttcctctggat

SEQ ID NO: 2909369 - DNA, 13 bp, Homo sapiens
tagaaattttcaa

SEQ ID NO: 2909370 - DNA, 22 bp, Homo sapiens
tagaaatttttcagatgcttct

SEQ ID NO: 2909371 - DNA, 16 bp, Homo sapiens
tagaacaaaggacaga

SEQ ID NO: 2909372 - DNA, 19 bp, Homo sapiens
tagaacagaaatatataaa

SEQ ID NO: 2909373 - DNA, 22 bp, Homo sapiens
tagaacagtcattaattttcaa

SEQ ID NO: 2909374 - DNA, 14 bp, Homo sapiens
tagaacatccctgc

SEQ ID NO: 2909375 - DNA, 18 bp, Homo sapiens
tagaacatccctgccagc

SEQ ID NO: 2909376 - DNA, 19 bp, Homo sapiens
tagaaccagcagaagccag

SEQ ID NO: 2909377 - DNA, 22 bp, Homo sapiens
tagaacttggatgtacctgccc

SEQ ID NO: 2909378 - DNA, 22 bp, Homo sapiens
tagaagagaagagccatcttgg

SEQ ID NO: 2909379 - DNA, 17 bp, Homo sapiens
tagaagataacattttc

SEQ ID NO: 2909380 - DNA, 19 bp, Homo sapiens
tagaagataacattttcaa

SEQ ID NO: 2909381 - DNA, 22 bp, Homo sapiens
tagaagccacccttccctgcct

SEQ ID NO: 2909382 - DNA, 18 bp, Homo sapiens
tagaagcctgacaactca

SEQ ID NO: 2909383 - DNA, 24 bp, Homo sapiens
tagaagcgatttaagttacaatgt

SEQ ID NO: 2909384 - DNA, 19 bp, Homo sapiens
tagattttctttaaaagaa

SEQ ID NO: 2909385 - DNA, 12 bp, Homo sapiens
tagattttttca

SEQ ID NO: 2909386 - DNA, 22 bp, Homo sapiens
tagcaaaactaaatacttgctc

SEQ ID NO: 2909387 - DNA, 16 bp, Homo sapiens
tagcaaaacttttaaa

SEQ ID NO: 2909388 - DNA, 18 bp, Homo sapiens
tagcaaaacttttaaact

SEQ ID NO: 2909389 - DNA, 14 bp, Homo sapiens
tagcaatgctgtga

SEQ ID NO: 2909390 - DNA, 17 bp, Homo sapiens
tagcaatgctgtgaata

SEQ ID NO: 2909391 - DNA, 13 bp, Homo sapiens
tagcacaagttat

SEQ ID NO: 2909392 - DNA, 16 bp, Homo sapiens
tagcacatgcttcaat

SEQ ID NO: 2909393 - DNA, 17 bp, Homo sapiens
tagcaccaaataaatta

SEQ ID NO: 2909394 - DNA, 13 bp, Homo sapiens
tagcaccatggca

SEQ ID NO: 2909395 - DNA, 23 bp, Homo sapiens
tagcagaaggttgcacctccccc

SEQ ID NO: 2909396 - DNA, 12 bp, Homo sapiens
tagcagatggtt

SEQ ID NO: 2909397 - DNA, 15 bp, Homo sapiens
tagcagcccaccctg

SEQ ID NO: 2909398 - DNA, 21 bp, Homo sapiens
tagcagcccaccctgctgctg

SEQ ID NO: 2909399 - DNA, 21 bp, Homo sapiens
tagcagctgctactagctctt

SEQ ID NO: 2909400 - DNA, 15 bp, Homo sapiens
tagcaggtttcacta

SEQ ID NO: 2909401 - DNA, 12 bp, Homo sapiens
tagcataaattt

SEQ ID NO: 2909402 - DNA, 16 bp, Homo sapiens
tagcataaatttaatg

SEQ ID NO: 2909403 - DNA, 19 bp, Homo sapiens
tagcataaatttaatgtag

SEQ ID NO: 2909404 - DNA, 19 bp, Homo sapiens
tagcatgaggccactgctg

SEQ ID NO: 2909405 - DNA, 22 bp, Homo sapiens
taggccctggttcctgctgtcc

SEQ ID NO: 2909406 - DNA, 19 bp, Homo sapiens
taggccggtgtgcctgact

SEQ ID NO: 2909407 - DNA, 15 bp, Homo sapiens
taggctagggtgggg

SEQ ID NO: 2909408 - DNA, 15 bp, Homo sapiens
taggctctgccttcg

SEQ ID NO: 2909409 - DNA, 15 bp, Homo sapiens
tagggacctttaaaa

SEQ ID NO: 2909410 - DNA, 17 bp, Homo sapiens
tagggacctttaaaaag

SEQ ID NO: 2909411 - DNA, 22 bp, Homo sapiens
tagggagccccaaaacctacca

SEQ ID NO: 2909412 - DNA, 13 bp, Homo sapiens
tagggaggaccac

SEQ ID NO: 2909413 - DNA, 23 bp, Homo sapiens
tagggaggaccagggcagggcca

SEQ ID NO: 2909414 - DNA, 21 bp, Homo sapiens
tagggaggcctttagcttaag

SEQ ID NO: 2909415 - DNA, 17 bp, Homo sapiens
tagggatccctcatctg

SEQ ID NO: 2909416 - DNA, 15 bp, Homo sapiens
tagggatgcctcctt

SEQ ID NO: 2909417 - DNA, 16 bp, Homo sapiens
tagggcctcggaggct

SEQ ID NO: 2909418 - DNA, 23 bp, Homo sapiens
tagggcctcggaggctcctccct

SEQ ID NO: 2909419 - DNA, 21 bp, Homo sapiens
tagggcctggtccctgggagg

SEQ ID NO: 2909420 - DNA, 20 bp, Homo sapiens
tagggcttttattttttctt

SEQ ID NO: 2909421 - DNA, 13 bp, Homo sapiens
tagggtccttgaa

SEQ ID NO: 2909422 - DNA, 15 bp, Homo sapiens
tagggtcggaaccca

SEQ ID NO: 2909423 - DNA, 17 bp, Homo sapiens
tagggtggcacatctgt

SEQ ID NO: 2909424 - DNA, 19 bp, Homo sapiens
tagggttctgcttttaagt

SEQ ID NO: 2909425 - DNA, 16 bp, Homo sapiens
tagggttttggcctgc

SEQ ID NO: 2909426 - DNA, 11 bp, Homo sapiens
taggtaaatct

SEQ ID NO: 2909427 - DNA, 14 bp, Homo sapiens
taggtaggaaatgt

SEQ ID NO: 2909428 - DNA, 20 bp, Homo sapiens
taggtcattgcacctatctc

SEQ ID NO: 2909429 - DNA, 18 bp, Homo sapiens
taggtcttcctgtggctc

SEQ ID NO: 2909430 - DNA, 22 bp, Homo sapiens
taggtgcaatttcaaggttcta

SEQ ID NO: 2909431 - DNA, 17 bp, Homo sapiens
taggtgcagctcctcag

SEQ ID NO: 2909432 - DNA, 13 bp, Homo sapiens
taggttaaaaaaa

SEQ ID NO: 2909433 - DNA, 15 bp, Homo sapiens
taggttatttaaaat

SEQ ID NO: 2909434 - DNA, 17 bp, Homo sapiens
taggttccccaatccat

SEQ ID NO: 2909435 - DNA, 22 bp, Homo sapiens
taggttctaaagttctaagatt

SEQ ID NO: 2909436 - DNA, 15 bp, Homo sapiens
taggttggactggaa

SEQ ID NO: 2909437 - DNA, 21 bp, Homo sapiens
tagtaaaaaatcaattaacca

SEQ ID NO: 2909438 - DNA, 16 bp, Homo sapiens
tagtaaaacacagagg

SEQ ID NO: 2909439 - DNA, 22 bp, Homo sapiens
tagtaacctttaaaaatgtata

SEQ ID NO: 2909440 - DNA, 14 bp, Homo sapiens
tagtaactgctgtc

SEQ ID NO: 2909441 - DNA, 19 bp, Homo sapiens
tagtaacttcttatggaat

SEQ ID NO: 2909442 - DNA, 21 bp, Homo sapiens
tagtaagaaatttgcagtttt

SEQ ID NO: 2909443 - DNA, 16 bp, Homo sapiens
tagtaagcatctactt

SEQ ID NO: 2909444 - DNA, 20 bp, Homo sapiens
tagtaagtttttcttcatga

SEQ ID NO: 2909445 - DNA, 15 bp, Homo sapiens
tagtaatgagtttaa

SEQ ID NO: 2909446 - DNA, 22 bp, Homo sapiens
tagtaatgctacgtgtgatttt

SEQ ID NO: 2909447 - DNA, 13 bp, Homo sapiens
tagtaatggtgct

SEQ ID NO: 2909448 - DNA, 14 bp, Homo sapiens
tagtaatttctttt

SEQ ID NO: 2909449 - DNA, 18 bp, Homo sapiens
tagtacataattgattaa

SEQ ID NO: 2909450 - DNA, 15 bp, Homo sapiens
tagtacctgaaaagt

SEQ ID NO: 2909451 - DNA, 18 bp, Homo sapiens
tagtacctgaaaagtaac

SEQ ID NO: 2909452 - DNA, 15 bp, Homo sapiens
tagtactaagcattt

SEQ ID NO: 2909453 - DNA, 15 bp, Homo sapiens
tagtactagaaactg

SEQ ID NO: 2909454 - DNA, 13 bp, Homo sapiens
tagtactgctctt

SEQ ID NO: 2909455 - DNA, 23 bp, Homo sapiens
tagtagagcaacccattaatctt

SEQ ID NO: 2909456 - DNA, 23 bp, Homo sapiens
tagtagccaaagttaaatgtatc

SEQ ID NO: 2909457 - DNA, 22 bp, Homo sapiens
tagtagcccttcagtcttaata

SEQ ID NO: 2909458 - DNA, 16 bp, Homo sapiens
tagtaggcatttttac

SEQ ID NO: 2909459 - DNA, 14 bp, Homo sapiens
tagtagttctcttg

SEQ ID NO: 2909460 - DNA, 14 bp, Homo sapiens
tagtatcaaatatt

SEQ ID NO: 2909461 - DNA, 20 bp, Homo sapiens
tagtatcaaatattagatgt

SEQ ID NO: 2909462 - DNA, 16 bp, Homo sapiens
tagtatcaagtgttct

SEQ ID NO: 2909463 - DNA, 18 bp, Homo sapiens
tagtatcatcagatagca

SEQ ID NO: 2909464 - DNA, 16 bp, Homo sapiens
tagtatttatttatgt

SEQ ID NO: 2909465 - DNA, 23 bp, Homo sapiens
tagtatttgattcaaaatattta

SEQ ID NO: 2909466 - DNA, 19 bp, Homo sapiens
tagtcaaatatttattgga

SEQ ID NO: 2909467 - DNA, 23 bp, Homo sapiens
tagtcaaggtgctcaataaatat

SEQ ID NO: 2909468 - DNA, 18 bp, Homo sapiens
tagtcaatcaagtctgtt

SEQ ID NO: 2909469 - DNA, 21 bp, Homo sapiens
tagtcacatggcctatgcaca

SEQ ID NO: 2909470 - DNA, 15 bp, Homo sapiens
tagtcacctctgggc

SEQ ID NO: 2909471 - DNA, 19 bp, Homo sapiens
tagtcactggcagcctgca

SEQ ID NO: 2909472 - DNA, 17 bp, Homo sapiens
tagtcagagtgtccctt

SEQ ID NO: 2909473 - DNA, 22 bp, Homo sapiens
tagtcattaaaaacatagaaaa

SEQ ID NO: 2909474 - DNA, 14 bp, Homo sapiens
tagtcccccaaagg

SEQ ID NO: 2909475 - DNA, 14 bp, Homo sapiens
tagtccctgtgttc

SEQ ID NO: 2909476 - DNA, 23 bp, Homo sapiens
tagtccgtgctgacagctgctcc

SEQ ID NO: 2909477 - DNA, 22 bp, Homo sapiens
tagtcctttataagttgctttc

SEQ ID NO: 2909478 - DNA, 20 bp, Homo sapiens
tagtctactcttaagccatc

SEQ ID NO: 2909479 - DNA, 21 bp, Homo sapiens
tagtctactcttaagccatct

SEQ ID NO: 2909480 - DNA, 18 bp, Homo sapiens
tagtctagatggctcctc

SEQ ID NO: 2909481 - DNA, 16 bp, Homo sapiens
tagtctagtgtagtat

SEQ ID NO: 2909482 - DNA, 20 bp, Homo sapiens
tagtctctatcattaaagtt

SEQ ID NO: 2909483 - DNA, 13 bp, Homo sapiens
tagtctctttatt

SEQ ID NO: 2909484 - DNA, 12 bp, Homo sapiens
tagtctgggtca

SEQ ID NO: 2909485 - DNA, 22 bp, Homo sapiens
tagtctgggtcagacccatctc

SEQ ID NO: 2909486 - DNA, 22 bp, Homo sapiens
tagtcttccacaaaaaatactt

SEQ ID NO: 2909487 - DNA, 18 bp, Homo sapiens
tagtgaacacagcagacc

SEQ ID NO: 2909488 - DNA, 20 bp, Homo sapiens
tagtgaactaagttattgtt

SEQ ID NO: 2909489 - DNA, 12 bp, Homo sapiens
tagtgagccaag

SEQ ID NO: 2909490 - DNA, 21 bp, Homo sapiens
tagtgagcgagtggatgctgt

SEQ ID NO: 2909491 - DNA, 21 bp, Homo sapiens
tagtgatttttatgccacctg

SEQ ID NO: 2909492 - DNA, 23 bp, Homo sapiens
tagtgcatagaattctagctttt

SEQ ID NO: 2909493 - DNA, 11 bp, Homo sapiens
tagtgccaggc

SEQ ID NO: 2909494 - DNA, 22 bp, Homo sapiens
tagtgcttcttgtaatatttct

SEQ ID NO: 2909495 - DNA, 19 bp, Homo sapiens
tagtggatctcagttttta

SEQ ID NO: 2909496 - DNA, 23 bp, Homo sapiens
tagtggggtctccctctcctgcc

SEQ ID NO: 2909497 - DNA, 20 bp, Homo sapiens
tagtggtttatcagcaaaaa

SEQ ID NO: 2909498 - DNA, 20 bp, Homo sapiens
tagtgtacctattaaaagtt

SEQ ID NO: 2909499 - DNA, 21 bp, Homo sapiens
tagtgtacctcctctcagtgt

SEQ ID NO: 2909500 - DNA, 23 bp, Homo sapiens
tagtgtacctcctctcagtgttt

SEQ ID NO: 2909501 - DNA, 23 bp, Homo sapiens
tagtgtccattttgtgaagccct

SEQ ID NO: 2909502 - DNA, 21 bp, Homo sapiens
tagtgtctgggtttggcccaa

SEQ ID NO: 2909503 - DNA, 16 bp, Homo sapiens
tagtgttaatcaattt

SEQ ID NO: 2909504 - DNA, 23 bp, Homo sapiens
tagtgttaatcaatttaaaccca

SEQ ID NO: 2909505 - DNA, 14 bp, Homo sapiens
tagtgttgtccagg

SEQ ID NO: 2909506 - DNA, 16 bp, Homo sapiens
tagtgttgtccaggaa

SEQ ID NO: 2909507 - DNA, 17 bp, Homo sapiens
tagtgtttctgtgcatg

SEQ ID NO: 2909508 - DNA, 19 bp, Homo sapiens
tagtgtttggaattttctg

SEQ ID NO: 2909509 - DNA, 13 bp, Homo sapiens
tagttactcaagc

SEQ ID NO: 2909510 - DNA, 17 bp, Homo sapiens
tagttactgttgtgacc

SEQ ID NO: 2909511 - DNA, 15 bp, Homo sapiens
tagttatataattgt

SEQ ID NO: 2909512 - DNA, 20 bp, Homo sapiens
tagttatttaagaagaatga

SEQ ID NO: 2909513 - DNA, 23 bp, Homo sapiens
tagttccctgaaaacccagagag

SEQ ID NO: 2909514 - DNA, 17 bp, Homo sapiens
tagttcttactgcttaa

SEQ ID NO: 2909515 - DNA, 13 bp, Homo sapiens
tagttctttgttc

SEQ ID NO: 2909516 - DNA, 21 bp, Homo sapiens
tagttctttgttcctgctttc

SEQ ID NO: 2909517 - DNA, 18 bp, Homo sapiens
tagttgaactgatagtta

SEQ ID NO: 2909518 - DNA, 20 bp, Homo sapiens
tagttgaactgatagttact

SEQ ID NO: 2909519 - DNA, 14 bp, Homo sapiens
tagttgaattccaa

SEQ ID NO: 2909520 - DNA, 18 bp, Homo sapiens
tagttgaattccaagtgt

SEQ ID NO: 2909521 - DNA, 14 bp, Homo sapiens
tagttgcaattgaa

SEQ ID NO: 2909522 - DNA, 22 bp, Homo sapiens
tagttgcttgctaatatttcca

SEQ ID NO: 2909523 - DNA, 22 bp, Homo sapiens
tagttggaatgactgaaagaag

SEQ ID NO: 2909524 - DNA, 21 bp, Homo sapiens
tagttgtctttctttgctgct

SEQ ID NO: 2909525 - DNA, 18 bp, Homo sapiens
tagttgtgaccttagtgt

SEQ ID NO: 2909526 - DNA, 22 bp, Homo sapiens
tagtttaaccatatgcccacat

SEQ ID NO: 2909527 - DNA, 21 bp, Homo sapiens
tagaaggaaagcatgtctctg

SEQ ID NO: 2909528 - DNA, 21 bp, Homo sapiens
tagaaggatgtacatttccaa

SEQ ID NO: 2909529 - DNA, 17 bp, Homo sapiens
tagaagtagaattgaca

SEQ ID NO: 2909530 - DNA, 19 bp, Homo sapiens
tagaagtggaccaggacag

SEQ ID NO: 2909531 - DNA, 15 bp, Homo sapiens
tagaataaaagctgt

SEQ ID NO: 2909532 - DNA, 16 bp, Homo sapiens
tagaataaaagctgtg

SEQ ID NO: 2909533 - DNA, 14 bp, Homo sapiens
tagaataaatgaag

SEQ ID NO: 2909534 - DNA, 15 bp, Homo sapiens
tagaatcctgcttta

SEQ ID NO: 2909535 - DNA, 17 bp, Homo sapiens
tagaatcgttggactca

SEQ ID NO: 2909536 - DNA, 12 bp, Homo sapiens
tagaatgacagt

SEQ ID NO: 2909537 - DNA, 13 bp, Homo sapiens
tagaatgataaat

SEQ ID NO: 2909538 - DNA, 20 bp, Homo sapiens
tagaatgctacaagtaactc

SEQ ID NO: 2909539 - DNA, 18 bp, Homo sapiens
tagaatggttgagttaca

SEQ ID NO: 2909540 - DNA, 22 bp, Homo sapiens
tagaatgtattgtaccttttaa

SEQ ID NO: 2909541 - DNA, 14 bp, Homo sapiens
tagaattagctttt

SEQ ID NO: 2909542 - DNA, 20 bp, Homo sapiens
tagaattatttcacaaataa

SEQ ID NO: 2909543 - DNA, 17 bp, Homo sapiens
tagaattctagcttttt

SEQ ID NO: 2909544 - DNA, 22 bp, Homo sapiens
tagaattctagcttttttcctc

SEQ ID NO: 2909545 - DNA, 14 bp, Homo sapiens
tagaattgcattga

SEQ ID NO: 2909546 - DNA, 13 bp, Homo sapiens
tagaattgttaga

SEQ ID NO: 2909547 - DNA, 16 bp, Homo sapiens
tagaattgttagatgg

SEQ ID NO: 2909548 - DNA, 13 bp, Homo sapiens
tagacaaaatcaa

SEQ ID NO: 2909549 - DNA, 16 bp, Homo sapiens
tagacaaatactcatg

SEQ ID NO: 2909550 - DNA, 19 bp, Homo sapiens
tagacaaatatttggaggg

SEQ ID NO: 2909551 - DNA, 17 bp, Homo sapiens
tagacaccaaagttcta

SEQ ID NO: 2909552 - DNA, 18 bp, Homo sapiens
tagacaccaaagttctaa

SEQ ID NO: 2909553 - DNA, 20 bp, Homo sapiens
tagacaccaaagttctaata

SEQ ID NO: 2909554 - DNA, 16 bp, Homo sapiens
tagacaccaaggaggc

SEQ ID NO: 2909555 - DNA, 20 bp, Homo sapiens
tagacatggaggttctaagg

SEQ ID NO: 2909556 - DNA, 14 bp, Homo sapiens
tatctcactgctgt

SEQ ID NO: 2909557 - DNA, 15 bp, Homo sapiens
tatctccatactttg

SEQ ID NO: 2909558 - DNA, 20 bp, Homo sapiens
tatctccctgcttcatatct

SEQ ID NO: 2909559 - DNA, 14 bp, Homo sapiens
tatctctcccttct

SEQ ID NO: 2909560 - DNA, 19 bp, Homo sapiens
tatctgaatgatcctgtct

SEQ ID NO: 2909561 - DNA, 12 bp, Homo sapiens
tatctgaatgtt

SEQ ID NO: 2909562 - DNA, 21 bp, Homo sapiens
tatctgcaatgtttttgtgta

SEQ ID NO: 2909563 - DNA, 11 bp, Homo sapiens
tatgtatttcc

SEQ ID NO: 2909564 - DNA, 15 bp, Homo sapiens
tatgtattttaaaat

SEQ ID NO: 2909565 - DNA, 18 bp, Homo sapiens
tatgtattttttgaatct

SEQ ID NO: 2909566 - DNA, 21 bp, Homo sapiens
tatgtcaaattgtcagcatga

SEQ ID NO: 2909567 - DNA, 17 bp, Homo sapiens
tatgtccactgtgtata

SEQ ID NO: 2909568 - DNA, 22 bp, Homo sapiens
tatgtcgtgttttcaaggaaga

SEQ ID NO: 2909569 - DNA, 23 bp, Homo sapiens
tatgtcttttgatgaatagaagt

SEQ ID NO: 2909570 - DNA, 22 bp, Homo sapiens
tatgtgaatatttgtaaaaata

SEQ ID NO: 2909571 - DNA, 17 bp, Homo sapiens
tatgtgccaaaactagt

SEQ ID NO: 2909572 - DNA, 13 bp, Homo sapiens
tatgtgccaggct

SEQ ID NO: 2909573 - DNA, 18 bp, Homo sapiens
tatgtgccaggcttgcct

SEQ ID NO: 2909574 - DNA, 15 bp, Homo sapiens
tatgtgctgtaattt

SEQ ID NO: 2909575 - DNA, 13 bp, Homo sapiens
tatgtggctttta

SEQ ID NO: 2909576 - DNA, 20 bp, Homo sapiens
tatgtggcttttatttcagt

SEQ ID NO: 2909577 - DNA, 16 bp, Homo sapiens
tatgtggttttagatt

SEQ ID NO: 2909578 - DNA, 18 bp, Homo sapiens
tatgtggttttagatttt

SEQ ID NO: 2909579 - DNA, 13 bp, Homo sapiens
tatgtgtaggcag

SEQ ID NO: 2909580 - DNA, 12 bp, Homo sapiens
tatgtgtatgta

SEQ ID NO: 2909581 - DNA, 19 bp, Homo sapiens
tatgtgtcagttcatttgt

SEQ ID NO: 2909582 - DNA, 15 bp, Homo sapiens
tatgtgtctggaaga

SEQ ID NO: 2909583 - DNA, 14 bp, Homo sapiens
tatgtgtgtagaca

SEQ ID NO: 2909584 - DNA, 13 bp, Homo sapiens
tatgttaaagttt

SEQ ID NO: 2909585 - DNA, 22 bp, Homo sapiens
tatgttaagcagctaaattttc

SEQ ID NO: 2909586 - DNA, 19 bp, Homo sapiens
tatgttacttaaacatcat

SEQ ID NO: 2909587 - DNA, 18 bp, Homo sapiens
tatgttatcatcctccct

SEQ ID NO: 2909588 - DNA, 19 bp, Homo sapiens
tatgttcttatagaataaa

SEQ ID NO: 2909589 - DNA, 18 bp, Homo sapiens
tatgttgaatacttttta

SEQ ID NO: 2909590 - DNA, 18 bp, Homo sapiens
tatgttgcctttatggtt

SEQ ID NO: 2909591 - DNA, 17 bp, Homo sapiens
tatgttgttagagaaaa

SEQ ID NO: 2909592 - DNA, 19 bp, Homo sapiens
tatgttgttagagaaaaat

SEQ ID NO: 2909593 - DNA, 18 bp, Homo sapiens
tatgtttaaaaaaacatt

SEQ ID NO: 2909594 - DNA, 17 bp, Homo sapiens
tatgtttgtctcacttt

SEQ ID NO: 2909595 - DNA, 18 bp, Homo sapiens
tatgtttgtctcactttt

SEQ ID NO: 2909596 - DNA, 14 bp, Homo sapiens
tattaaaaaaatgc

SEQ ID NO: 2909597 - DNA, 21 bp, Homo sapiens
tattaaaaaacaattaactgc

SEQ ID NO: 2909598 - DNA, 16 bp, Homo sapiens
tattaaaaatatacaa

SEQ ID NO: 2909599 - DNA, 17 bp, Homo sapiens
tattaaaaatatacaag

SEQ ID NO: 2909600 - DNA, 14 bp, Homo sapiens
tattaaaagtcaca

SEQ ID NO: 2909601 - DNA, 22 bp, Homo sapiens
tattaaaagtcacaatgttctt

SEQ ID NO: 2909602 - DNA, 15 bp, Homo sapiens
tattaaaatatgaag

SEQ ID NO: 2909603 - DNA, 17 bp, Homo sapiens
tattaaactctcctttg

SEQ ID NO: 2909604 - DNA, 13 bp, Homo sapiens
tattaaacttgaa

SEQ ID NO: 2909605 - DNA, 23 bp, Homo sapiens
tattaaaggtgaaaattgtataa

SEQ ID NO: 2909606 - DNA, 22 bp, Homo sapiens
tattaaagtgctaaggttctaa

SEQ ID NO: 2909607 - DNA, 24 bp, Homo sapiens
tattaaagtgctaaggttctaagg

SEQ ID NO: 2909608 - DNA, 22 bp, Homo sapiens
tattaaatcgtttaatgtttat

SEQ ID NO: 2909609 - DNA, 16 bp, Homo sapiens
tattaaatctgaattt

SEQ ID NO: 2909610 - DNA, 20 bp, Homo sapiens
tattaaattaattgaatcta

SEQ ID NO: 2909611 - DNA, 19 bp, Homo sapiens
tattaaattctcaaagttt

SEQ ID NO: 2909612 - DNA, 17 bp, Homo sapiens
tattaaatttatttgaa

SEQ ID NO: 2909613 - DNA, 20 bp, Homo sapiens
tattaactactgtagaactg

SEQ ID NO: 2909614 - DNA, 20 bp, Homo sapiens
tattaactctgtaaaagtgt

SEQ ID NO: 2909615 - DNA, 21 bp, Homo sapiens
tattaactctgtaaaagtgtc

SEQ ID NO: 2909616 - DNA, 21 bp, Homo sapiens
tattaagaatagtctctgggt

SEQ ID NO: 2909617 - DNA, 15 bp, Homo sapiens
tattaatactggtat

SEQ ID NO: 2909618 - DNA, 13 bp, Homo sapiens
tattaattgcttt

SEQ ID NO: 2909619 - DNA, 20 bp, Homo sapiens
tattacataactgatctatt

SEQ ID NO: 2909620 - DNA, 12 bp, Homo sapiens
tattacatcttt

SEQ ID NO: 2909621 - DNA, 20 bp, Homo sapiens
tattacatttaaatccttgt

SEQ ID NO: 2909622 - DNA, 14 bp, Homo sapiens
tattacccctcatt

SEQ ID NO: 2909623 - DNA, 17 bp, Homo sapiens
tattaccttaagatttt

SEQ ID NO: 2909624 - DNA, 19 bp, Homo sapiens
tattaccttaagatttttc

SEQ ID NO: 2909625 - DNA, 23 bp, Homo sapiens
tattaccttaagatttttctttt

SEQ ID NO: 2909626 - DNA, 22 bp, Homo sapiens
tattactaaggagtaatctgtg

SEQ ID NO: 2909627 - DNA, 22 bp, Homo sapiens
tattactggcgtggattaaact

SEQ ID NO: 2909628 - DNA, 14 bp, Homo sapiens
tattactgtctttt

SEQ ID NO: 2909629 - DNA, 14 bp, Homo sapiens
tattacttttcatc

SEQ ID NO: 2909630 - DNA, 18 bp, Homo sapiens
tattagagtgtctttcca

SEQ ID NO: 2909631 - DNA, 21 bp, Homo sapiens
tattagatcccatatttactt

SEQ ID NO: 2909632 - DNA, 13 bp, Homo sapiens
tattagatgtgat

SEQ ID NO: 2909633 - DNA, 16 bp, Homo sapiens
tattagatgtgattta

SEQ ID NO: 2909634 - DNA, 15 bp, Homo sapiens
tattagccacaaaat

SEQ ID NO: 2909635 - DNA, 17 bp, Homo sapiens
tattagtattgtgaata

SEQ ID NO: 2909636 - DNA, 17 bp, Homo sapiens
tattagtcagagtttca

SEQ ID NO: 2909637 - DNA, 14 bp, Homo sapiens
tattagtgatattt

SEQ ID NO: 2909638 - DNA, 21 bp, Homo sapiens
tattagtgatatttctctagt

SEQ ID NO: 2909639 - DNA, 13 bp, Homo sapiens
tattataaatgtt

SEQ ID NO: 2909640 - DNA, 14 bp, Homo sapiens
tattataaatgtta

SEQ ID NO: 2909641 - DNA, 22 bp, Homo sapiens
tattataagggagagctgagcc

SEQ ID NO: 2909642 - DNA, 22 bp, Homo sapiens
tattatcctcctgttctgaaac

SEQ ID NO: 2909643 - DNA, 19 bp, Homo sapiens
tattatctttgttctccta

SEQ ID NO: 2909644 - DNA, 14 bp, Homo sapiens
tattatgagatgct

SEQ ID NO: 2909645 - DNA, 20 bp, Homo sapiens
tattatgccccagttcagaa

SEQ ID NO: 2909646 - DNA, 19 bp, Homo sapiens
tattatgctttattggaaa

SEQ ID NO: 2909647 - DNA, 14 bp, Homo sapiens
tattatttaactct

SEQ ID NO: 2909648 - DNA, 15 bp, Homo sapiens
tattcaaactaccta

SEQ ID NO: 2909649 - DNA, 23 bp, Homo sapiens
tattcaaactacctatattcctt

SEQ ID NO: 2909650 - DNA, 13 bp, Homo sapiens
tattcaaactttt

SEQ ID NO: 2909651 - DNA, 19 bp, Homo sapiens
tattcaaatgaaggtggtt

SEQ ID NO: 2909652 - DNA, 13 bp, Homo sapiens
tattcaaattcct

SEQ ID NO: 2909653 - DNA, 19 bp, Homo sapiens
tattcaacacactgcctta

SEQ ID NO: 2909654 - DNA, 19 bp, Homo sapiens
tattcaactcataagactt

SEQ ID NO: 2909655 - DNA, 16 bp, Homo sapiens
tattcaatatcctttg

SEQ ID NO: 2909656 - DNA, 19 bp, Homo sapiens
tattcagaatcaaaccttt

SEQ ID NO: 2909657 - DNA, 18 bp, Homo sapiens
tattcagaatctttgtta

SEQ ID NO: 2909658 - DNA, 15 bp, Homo sapiens
tattcagtagtttga

SEQ ID NO: 2909659 - DNA, 16 bp, Homo sapiens
tattcagtctgtgcct

SEQ ID NO: 2909660 - DNA, 18 bp, Homo sapiens
tattcatcaaataaacct

SEQ ID NO: 2909661 - DNA, 23 bp, Homo sapiens
tattcatcaaataaaccttgttt

SEQ ID NO: 2909662 - DNA, 20 bp, Homo sapiens
tattcatgaagcggtcacag

SEQ ID NO: 2909663 - DNA, 14 bp, Homo sapiens
tattcatgttcatg

SEQ ID NO: 2909664 - DNA, 15 bp, Homo sapiens
tattcatgttcatgt

SEQ ID NO: 2909665 - DNA, 19 bp, Homo sapiens
tattccacagatatctttt

SEQ ID NO: 2909666 - DNA, 23 bp, Homo sapiens
tattccagaatgctgtacatcta

SEQ ID NO: 2909667 - DNA, 12 bp, Homo sapiens
tattccatcagg

SEQ ID NO: 2909668 - DNA, 16 bp, Homo sapiens
tattccatcaggcaga

SEQ ID NO: 2909669 - DNA, 14 bp, Homo sapiens
tattccatgtttta

SEQ ID NO: 2909670 - DNA, 18 bp, Homo sapiens
tattccatgttttaaaat

SEQ ID NO: 2909671 - DNA, 21 bp, Homo sapiens
tattcccactttcattcaatc

SEQ ID NO: 2909672 - DNA, 23 bp, Homo sapiens
tattccccagcagggtcttttca

SEQ ID NO: 2909673 - DNA, 23 bp, Homo sapiens
tattcctagttggtgagaaacct

SEQ ID NO: 2909674 - DNA, 24 bp, Homo sapiens
tattcctagttggtgagaaacctg

SEQ ID NO: 2909675 - DNA, 17 bp, Homo sapiens
tattcctatctgtggat

SEQ ID NO: 2909676 - DNA, 21 bp, Homo sapiens
tatttcagtgatttttagtaa

SEQ ID NO: 2909677 - DNA, 14 bp, Homo sapiens
tatttccaatgtga

SEQ ID NO: 2909678 - DNA, 20 bp, Homo sapiens
tatttccagaaggatttctt

SEQ ID NO: 2909679 - DNA, 22 bp, Homo sapiens
tatttccagaaggatttcttgt

SEQ ID NO: 2909680 - DNA, 18 bp, Homo sapiens
tatttccctctcattttg

SEQ ID NO: 2909681 - DNA, 15 bp, Homo sapiens
tatttcctgaaataa

SEQ ID NO: 2909682 - DNA, 11 bp, Homo sapiens
tatttcctgac

SEQ ID NO: 2909683 - DNA, 13 bp, Homo sapiens
tatttcctgactt

SEQ ID NO: 2909684 - DNA, 21 bp, Homo sapiens
tatttcctgacttgagtgttc

SEQ ID NO: 2909685 - DNA, 22 bp, Homo sapiens
tatttctacaaggtgttcattt

SEQ ID NO: 2909686 - DNA, 16 bp, Homo sapiens
tatttctaggaagaat

SEQ ID NO: 2909687 - DNA, 14 bp, Homo sapiens
tatttctattatta

SEQ ID NO: 2909688 - DNA, 22 bp, Homo sapiens
tatttctcagactttggaaaat

SEQ ID NO: 2909689 - DNA, 21 bp, Homo sapiens
tatttctcataatgtgaaata

SEQ ID NO: 2909690 - DNA, 15 bp, Homo sapiens
tatttctctagtagt

SEQ ID NO: 2909691 - DNA, 17 bp, Homo sapiens
tatttctctgtgaatcc

SEQ ID NO: 2909692 - DNA, 14 bp, Homo sapiens
tatttctctgtgta

SEQ ID NO: 2909693 - DNA, 16 bp, Homo sapiens
tatttcttaaacactt

SEQ ID NO: 2909694 - DNA, 18 bp, Homo sapiens
tatttcttatacgctttt

SEQ ID NO: 2909695 - DNA, 21 bp, Homo sapiens
tatttgaaaaaagttactgca

SEQ ID NO: 2909696 - DNA, 14 bp, Homo sapiens
tatttgaaaaaatt

SEQ ID NO: 2909697 - DNA, 19 bp, Homo sapiens
tatttgaatgaacactatg

SEQ ID NO: 2909698 - DNA, 21 bp, Homo sapiens
tatttgaatgtatgcttcata

SEQ ID NO: 2909699 - DNA, 23 bp, Homo sapiens
tatttgaatgtatgcttcataca

SEQ ID NO: 2909700 - DNA, 13 bp, Homo sapiens
tatttgacagaca

SEQ ID NO: 2909701 - DNA, 14 bp, Homo sapiens
tatttgagttgtga

SEQ ID NO: 2909702 - DNA, 18 bp, Homo sapiens
tatttgagttgtgattga

SEQ ID NO: 2909703 - DNA, 13 bp, Homo sapiens
tatttgataacat

SEQ ID NO: 2909704 - DNA, 21 bp, Homo sapiens
tatttgattcaaaatatttaa

SEQ ID NO: 2909705 - DNA, 16 bp, Homo sapiens
tatttgcactgtagcc

SEQ ID NO: 2909706 - DNA, 18 bp, Homo sapiens
tatttgcagttcacctgc

SEQ ID NO: 2909707 - DNA, 19 bp, Homo sapiens
ccctagcagcccaccctgc

SEQ ID NO: 2909708 - DNA, 20 bp, Homo sapiens
ccctagcagcccaccctgct

SEQ ID NO: 2909709 - DNA, 17 bp, Homo sapiens
ccctagccagcacttgt

SEQ ID NO: 2909710 - DNA, 16 bp, Homo sapiens
ccctaggctttctcct

SEQ ID NO: 2909711 - DNA, 14 bp, Homo sapiens
ccctagtatgaaag

SEQ ID NO: 2909712 - DNA, 22 bp, Homo sapiens
ccctagtatgaaagctgggggt

SEQ ID NO: 2909713 - DNA, 20 bp, Homo sapiens
ccctagttagcatccaggct

SEQ ID NO: 2909714 - DNA, 19 bp, Homo sapiens
ccctatccacccagcccat

SEQ ID NO: 2909715 - DNA, 20 bp, Homo sapiens
ccctatgaaagattccacag

SEQ ID NO: 2909716 - DNA, 22 bp, Homo sapiens
ccctatgaagtaaagaactgca

SEQ ID NO: 2909717 - DNA, 18 bp, Homo sapiens
ccctcacagactcttcca

SEQ ID NO: 2909718 - DNA, 22 bp, Homo sapiens
ccctcaccccacaatttcttta

SEQ ID NO: 2909719 - DNA, 14 bp, Homo sapiens
ccctcaccccagct

SEQ ID NO: 2909720 - DNA, 17 bp, Homo sapiens
ccctcaccctctgtccc

SEQ ID NO: 2909721 - DNA, 22 bp, Homo sapiens
ccctcactatatattattctcg

SEQ ID NO: 2909722 - DNA, 21 bp, Homo sapiens
ccctcagaacccttggcttgc

SEQ ID NO: 2909723 - DNA, 19 bp, Homo sapiens
ccctcagacagccccctgc

SEQ ID NO: 2909724 - DNA, 23 bp, Homo sapiens
ccctcagatgcgttcgcctctgg

SEQ ID NO: 2909725 - DNA, 17 bp, Homo sapiens
ccctcagattttatatt

SEQ ID NO: 2909726 - DNA, 22 bp, Homo sapiens
ccctcagcgggggccttgaaga

SEQ ID NO: 2909727 - DNA, 13 bp, Homo sapiens
ccctcagctctgt

SEQ ID NO: 2909728 - DNA, 17 bp, Homo sapiens
ccctcaggcctatgcaa

SEQ ID NO: 2909729 - DNA, 16 bp, Homo sapiens
ccctcaggggaagctg

SEQ ID NO: 2909730 - DNA, 17 bp, Homo sapiens
ccctcagttgtgcagct

SEQ ID NO: 2909731 - DNA, 18 bp, Homo sapiens
ccctcatcaggagttcca

SEQ ID NO: 2909732 - DNA, 15 bp, Homo sapiens
ccctcattcaggaaa

SEQ ID NO: 2909733 - DNA, 19 bp, Homo sapiens
ccctcattggctcttgaac

SEQ ID NO: 2909734 - DNA, 18 bp, Homo sapiens
ccctccagaaccaccccg

SEQ ID NO: 2909735 - DNA, 14 bp, Homo sapiens
ccctccagagaaag

SEQ ID NO: 2909736 - DNA, 16 bp, Homo sapiens
ccctccataagtttaa

SEQ ID NO: 2909737 - DNA, 18 bp, Homo sapiens
ccctccatggtcctgtct

SEQ ID NO: 2909738 - DNA, 12 bp, Homo sapiens
ccctcccacagc

SEQ ID NO: 2909739 - DNA, 10 bp, Homo sapiens
ccctcccact

SEQ ID NO: 2909740 - DNA, 13 bp, Homo sapiens
ccctcccagctct

SEQ ID NO: 2909741 - DNA, 15 bp, Homo sapiens
ccctcccagctctga

SEQ ID NO: 2909742 - DNA, 20 bp, Homo sapiens
ccctcccaggactctgaccc

SEQ ID NO: 2909743 - DNA, 16 bp, Homo sapiens
ccctcccatcctccag

SEQ ID NO: 2909744 - DNA, 20 bp, Homo sapiens
ccctccccaaagccactgga

SEQ ID NO: 2909745 - DNA, 22 bp, Homo sapiens
ccctccccaaagccactggaag

SEQ ID NO: 2909746 - DNA, 23 bp, Homo sapiens
ccctccccaaagccactggaagg

SEQ ID NO: 2909747 - DNA, 14 bp, Homo sapiens
ccctccccacccaa

SEQ ID NO: 2909748 - DNA, 16 bp, Homo sapiens
ccctccccacccaaga

SEQ ID NO: 2909749 - DNA, 17 bp, Homo sapiens
ccctccccacccaagag

SEQ ID NO: 2909750 - DNA, 13 bp, Homo sapiens
ccctccccaggaa

SEQ ID NO: 2909751 - DNA, 23 bp, Homo sapiens
ccctccccatctcggggctgctg

SEQ ID NO: 2909752 - DNA, 14 bp, Homo sapiens
ccctccccatggag

SEQ ID NO: 2909753 - DNA, 17 bp, Homo sapiens
ccctcccctcagagccc

SEQ ID NO: 2909754 - DNA, 14 bp, Homo sapiens
ccctccccttctct

SEQ ID NO: 2909755 - DNA, 18 bp, Homo sapiens
ccctcccgcaccttcctc

SEQ ID NO: 2909756 - DNA, 15 bp, Homo sapiens
ccctccctagatcca

SEQ ID NO: 2909757 - DNA, 21 bp, Homo sapiens
ccctccctatatgcacccctg

SEQ ID NO: 2909758 - DNA, 19 bp, Homo sapiens
ccctccctgttccccagag

SEQ ID NO: 2909759 - DNA, 20 bp, Homo sapiens
ccctcccttcctgtctattt

SEQ ID NO: 2909760 - DNA, 14 bp, Homo sapiens
ccctcccttccttg

SEQ ID NO: 2909761 - DNA, 14 bp, Homo sapiens
ccctccgccttcac

SEQ ID NO: 2909762 - DNA, 14 bp, Homo sapiens
ccctccgggcaggg

SEQ ID NO: 2909763 - DNA, 21 bp, Homo sapiens
ccctccgggcaggggagccag

SEQ ID NO: 2909764 - DNA, 18 bp, Homo sapiens
ccctcctaccctgcgccc

SEQ ID NO: 2909765 - DNA, 12 bp, Homo sapiens
ccctcctcacac

SEQ ID NO: 2909766 - DNA, 16 bp, Homo sapiens
ccctcctcacactcca

SEQ ID NO: 2909767 - DNA, 17 bp, Homo sapiens
ccctcctcactccctag

SEQ ID NO: 2909768 - DNA, 19 bp, Homo sapiens
ccctcctcactccctaggc

SEQ ID NO: 2909769 - DNA, 23 bp, Homo sapiens
ccctcctcactccctaggcccaa

SEQ ID NO: 2909770 - DNA, 22 bp, Homo sapiens
ccctcctcccccggctgggcct

SEQ ID NO: 2909771 - DNA, 23 bp, Homo sapiens
ccctcctcccccggctgggcctc

SEQ ID NO: 2909772 - DNA, 14 bp, Homo sapiens
ccctcctctcccat

SEQ ID NO: 2909773 - DNA, 22 bp, Homo sapiens
ccctcctctcccgtctcgcctg

SEQ ID NO: 2909774 - DNA, 14 bp, Homo sapiens
ccctcctctgaaac

SEQ ID NO: 2909775 - DNA, 15 bp, Homo sapiens
ccctcctctgaaaca

SEQ ID NO: 2909776 - DNA, 16 bp, Homo sapiens
ccctcctctgccacct

SEQ ID NO: 2909777 - DNA, 21 bp, Homo sapiens
ccctcctggagctctgtgggt

SEQ ID NO: 2909778 - DNA, 16 bp, Homo sapiens
ccctcctggcctcaga

SEQ ID NO: 2909779 - DNA, 19 bp, Homo sapiens
ccctcctggcctcagactg

SEQ ID NO: 2909780 - DNA, 19 bp, Homo sapiens
ccctcctggggccaggccg

SEQ ID NO: 2909781 - DNA, 11 bp, Homo sapiens
ccctccttcca

SEQ ID NO: 2909782 - DNA, 22 bp, Homo sapiens
ccctcgaggcggatctttggac

SEQ ID NO: 2909783 - DNA, 15 bp, Homo sapiens
ccctcgcccatcagt

SEQ ID NO: 2909784 - DNA, 23 bp, Homo sapiens
ccctcgcttggacggctgggcac

SEQ ID NO: 2909785 - DNA, 15 bp, Homo sapiens
ccctcgtttgatagt

SEQ ID NO: 2909786 - DNA, 13 bp, Homo sapiens
ccctctaacccag

SEQ ID NO: 2909787 - DNA, 18 bp, Homo sapiens
ccctctacagagcttccc

SEQ ID NO: 2909788 - DNA, 20 bp, Homo sapiens
ccctctactgggagcctacc

SEQ ID NO: 2909789 - DNA, 10 bp, Homo sapiens
ccctctaggg

SEQ ID NO: 2909790 - DNA, 16 bp, Homo sapiens
ccctctagggcagggt

SEQ ID NO: 2909791 - DNA, 23 bp, Homo sapiens
ccctctagggcagggtgggagcc

SEQ ID NO: 2909792 - DNA, 15 bp, Homo sapiens
ccctctcacgccacc

SEQ ID NO: 2909793 - DNA, 16 bp, Homo sapiens
ccctctcacgccaccc

SEQ ID NO: 2909794 - DNA, 14 bp, Homo sapiens
ccctctcaggctgt

SEQ ID NO: 2909795 - DNA, 20 bp, Homo sapiens
ccctctcatctcaggtagaa

SEQ ID NO: 2909796 - DNA, 16 bp, Homo sapiens
ccctctccctctaggc

SEQ ID NO: 2909797 - DNA, 19 bp, Homo sapiens
ccctctccgcacacctctg

SEQ ID NO: 2909798 - DNA, 19 bp, Homo sapiens
ccctctcctccgtggcaca

SEQ ID NO: 2909799 - DNA, 20 bp, Homo sapiens
ccctctcctccgtggcacat

SEQ ID NO: 2909800 - DNA, 11 bp, Homo sapiens
ccctctcctgc

SEQ ID NO: 2909801 - DNA, 14 bp, Homo sapiens
ccctctcctggagg

SEQ ID NO: 2909802 - DNA, 24 bp, Homo sapiens
ccctctctatcggggtcacttgca

SEQ ID NO: 2909803 - DNA, 10 bp, Homo sapiens
ccctctctca

SEQ ID NO: 2909804 - DNA, 21 bp, Homo sapiens
ccctctctcatatcactgaag

SEQ ID NO: 2909805 - DNA, 12 bp, Homo sapiens
ccctctctcctg

SEQ ID NO: 2909806 - DNA, 15 bp, Homo sapiens
ccctctctcctggac

SEQ ID NO: 2909807 - DNA, 14 bp, Homo sapiens
ccctctctgcaccg

SEQ ID NO: 2909808 - DNA, 20 bp, Homo sapiens
ccctctctgcagacttccca

SEQ ID NO: 2909809 - DNA, 15 bp, Homo sapiens
ccctctctgctctgc

SEQ ID NO: 2909810 - DNA, 13 bp, Homo sapiens
ccctctctgggcc

SEQ ID NO: 2909811 - DNA, 14 bp, Homo sapiens
ccctctctgggcct

SEQ ID NO: 2909812 - DNA, 17 bp, Homo sapiens
ccctctcttccgggagc

SEQ ID NO: 2909813 - DNA, 13 bp, Homo sapiens
ccctctgccccat

SEQ ID NO: 2909814 - DNA, 14 bp, Homo sapiens
ccctctgccggctc

SEQ ID NO: 2909815 - DNA, 12 bp, Homo sapiens
ccctctgcctca

SEQ ID NO: 2909816 - DNA, 20 bp, Homo sapiens
ccctctgcctcctccccagg

SEQ ID NO: 2909817 - DNA, 12 bp, Homo sapiens
ccctctgcctgc

SEQ ID NO: 2909818 - DNA, 18 bp, Homo sapiens
ccctctgcctgcactccc

SEQ ID NO: 2909819 - DNA, 19 bp, Homo sapiens
ccctctgcctgcactccct

SEQ ID NO: 2909820 - DNA, 21 bp, Homo sapiens
ccctctgcctgcactccctgg

SEQ ID NO: 2909821 - DNA, 23 bp, Homo sapiens
ccctctgcctgcactccctggcc

SEQ ID NO: 2909822 - DNA, 15 bp, Homo sapiens
ccctctgctgaagac

SEQ ID NO: 2909823 - DNA, 22 bp, Homo sapiens
ccctctggagtggccactaagc

SEQ ID NO: 2909824 - DNA, 24 bp, Homo sapiens
ccctctgtccaggcactgagatac

SEQ ID NO: 2909825 - DNA, 19 bp, Homo sapiens
ccctctgtcttctctatcc

SEQ ID NO: 2909826 - DNA, 16 bp, Homo sapiens
ccctcttctcctctgg

SEQ ID NO: 2909827 - DNA, 14 bp, Homo sapiens
ccctcttctgagca

SEQ ID NO: 2909828 - DNA, 15 bp, Homo sapiens
ccctcttctgagcac

SEQ ID NO: 2909829 - DNA, 22 bp, Homo sapiens
ccctcttgtcctttaatatttg

SEQ ID NO: 2909830 - DNA, 17 bp, Homo sapiens
ccctctttaatgctgtc

SEQ ID NO: 2909831 - DNA, 18 bp, Homo sapiens
ccctctttctagcctggg

SEQ ID NO: 2909832 - DNA, 12 bp, Homo sapiens
ccctctttttct

SEQ ID NO: 2909833 - DNA, 17 bp, Homo sapiens
ccctctttttctctgta

SEQ ID NO: 2909834 - DNA, 20 bp, Homo sapiens
ccctctttttctctgtatat

SEQ ID NO: 2909835 - DNA, 14 bp, Homo sapiens
ccctgaaggaacca

SEQ ID NO: 2909836 - DNA, 17 bp, Homo sapiens
ccctgaaggggccatga

SEQ ID NO: 2909837 - DNA, 21 bp, Homo sapiens
ccctgaccgtgtacatagccc

SEQ ID NO: 2909838 - DNA, 18 bp, Homo sapiens
ccctgacctcccaactct

SEQ ID NO: 2909839 - DNA, 20 bp, Homo sapiens
ccgcccccaccgggctgcag

SEQ ID NO: 2909840 - DNA, 15 bp, Homo sapiens
ccgccccgggctggc

SEQ ID NO: 2909841 - DNA, 11 bp, Homo sapiens
ccgcccctgag

SEQ ID NO: 2909842 - DNA, 19 bp, Homo sapiens
ccgcccgaggtggctgcct

SEQ ID NO: 2909843 - DNA, 17 bp, Homo sapiens
ccgccctgcgggccaca

SEQ ID NO: 2909844 - DNA, 19 bp, Homo sapiens
ccgccctgcgggccacagg

SEQ ID NO: 2909845 - DNA, 12 bp, Homo sapiens
ccgccgcccgct

SEQ ID NO: 2909846 - DNA, 15 bp, Homo sapiens
ccgccggggtcctgg

SEQ ID NO: 2909847 - DNA, 14 bp, Homo sapiens
ccgcctcagcctct

SEQ ID NO: 2909848 - DNA, 17 bp, Homo sapiens
ccgcctcctacagccca

SEQ ID NO: 2909849 - DNA, 14 bp, Homo sapiens
ccgcctgcccacct

SEQ ID NO: 2909850 - DNA, 20 bp, Homo sapiens
ccgcctgcccacctgcctgg

SEQ ID NO: 2909851 - DNA, 22 bp, Homo sapiens
ccgcctgcccacctgcctggcc

SEQ ID NO: 2909852 - DNA, 12 bp, Homo sapiens
ccgcctgccctc

SEQ ID NO: 2909853 - DNA, 14 bp, Homo sapiens
ccgcctgccttagc

SEQ ID NO: 2909854 - DNA, 14 bp, Homo sapiens
ccgccttccctcac

SEQ ID NO: 2909855 - DNA, 15 bp, Homo sapiens
ccgccttccctcact

SEQ ID NO: 2909856 - DNA, 23 bp, Homo sapiens
ccgccttccctcactcttcctca

SEQ ID NO: 2909857 - DNA, 16 bp, Homo sapiens
ccgccttggccttgca

SEQ ID NO: 2909858 - DNA, 13 bp, Homo sapiens
ccgcgccctccga

SEQ ID NO: 2909859 - DNA, 21 bp, Homo sapiens
ccgcgccctccgacctctctc

SEQ ID NO: 2909860 - DNA, 19 bp, Homo sapiens
ccgcggcccagacccagcc

SEQ ID NO: 2909861 - DNA, 16 bp, Homo sapiens
ccgcggcctccccgag

SEQ ID NO: 2909862 - DNA, 19 bp, Homo sapiens
ccgcgtcgccctcccaggc

SEQ ID NO: 2909863 - DNA, 12 bp, Homo sapiens
ccgcgtgccggg

SEQ ID NO: 2909864 - DNA, 20 bp, Homo sapiens
ccgctccaggtaccttgacc

SEQ ID NO: 2909865 - DNA, 17 bp, Homo sapiens
ccgctcccacctagtgc

SEQ ID NO: 2909866 - DNA, 21 bp, Homo sapiens
ccgctccgtctctgtcctcga

SEQ ID NO: 2909867 - DNA, 17 bp, Homo sapiens
ccgctctcctgccacat

SEQ ID NO: 2909868 - DNA, 17 bp, Homo sapiens
ccgctgaccctgggcct

SEQ ID NO: 2909869 - DNA, 20 bp, Homo sapiens
ccgctgaccctgggcctgga

SEQ ID NO: 2909870 - DNA, 19 bp, Homo sapiens
ccgctgcctaagtggctgc

SEQ ID NO: 2909871 - DNA, 20 bp, Homo sapiens
ccgctgcctaagtggctgct

SEQ ID NO: 2909872 - DNA, 20 bp, Homo sapiens
ccgctggggaccggttccca

SEQ ID NO: 2909873 - DNA, 22 bp, Homo sapiens
ccgctggggaccggttcccaca

SEQ ID NO: 2909874 - DNA, 19 bp, Homo sapiens
ccgctgtgtcctccctccc

SEQ ID NO: 2909875 - DNA, 16 bp, Homo sapiens
ccgctgttcacccaca

SEQ ID NO: 2909876 - DNA, 18 bp, Homo sapiens
ccgctgttcacccacagg

SEQ ID NO: 2909877 - DNA, 16 bp, Homo sapiens
ccgcttagcgctctgg

SEQ ID NO: 2909878 - DNA, 17 bp, Homo sapiens
ccgcttggagcagaggg

SEQ ID NO: 2909879 - DNA, 14 bp, Homo sapiens
ccgctttggcctga

SEQ ID NO: 2909880 - DNA, 23 bp, Homo sapiens
ccggaagggtgatcatcgacccc

SEQ ID NO: 2909881 - DNA, 20 bp, Homo sapiens
ccggacacttctcaggaaat

SEQ ID NO: 2909882 - DNA, 19 bp, Homo sapiens
ccggacctggactagggcc

SEQ ID NO: 2909883 - DNA, 12 bp, Homo sapiens
ccggagaggaag

SEQ ID NO: 2909884 - DNA, 18 bp, Homo sapiens
ccggagcaaactctgctg

SEQ ID NO: 2909885 - DNA, 19 bp, Homo sapiens
ccggagcaaactctgctgt

SEQ ID NO: 2909886 - DNA, 13 bp, Homo sapiens
ccggagcccagat

SEQ ID NO: 2909887 - DNA, 22 bp, Homo sapiens
ccggagctgcccctctctgggc

SEQ ID NO: 2909888 - DNA, 23 bp, Homo sapiens
ccggagctgcccctctctgggcc

SEQ ID NO: 2909889 - DNA, 16 bp, Homo sapiens
ccggattggccctgcc

SEQ ID NO: 2909890 - DNA, 20 bp, Homo sapiens
ccggattggccctgcccctc

SEQ ID NO: 2909891 - DNA, 21 bp, Homo sapiens
ccggcagggcgggcagagggc

SEQ ID NO: 2909892 - DNA, 15 bp, Homo sapiens
ccggcatccttgcct

SEQ ID NO: 2909893 - DNA, 20 bp, Homo sapiens
ccggcatgagactcagtgca

SEQ ID NO: 2909894 - DNA, 22 bp, Homo sapiens
ccggcatgagactcagtgcaga

SEQ ID NO: 2909895 - DNA, 14 bp, Homo sapiens
ccggccagccagcc

SEQ ID NO: 2909896 - DNA, 17 bp, Homo sapiens
ccggccagccagccact

SEQ ID NO: 2909897 - DNA, 18 bp, Homo sapiens
ccggccagccagccactc

SEQ ID NO: 2909898 - DNA, 11 bp, Homo sapiens
ccggccagccc

SEQ ID NO: 2909899 - DNA, 13 bp, Homo sapiens
ccggccctgcccc

SEQ ID NO: 2909900 - DNA, 14 bp, Homo sapiens
ccggccctgcccct

SEQ ID NO: 2909901 - DNA, 13 bp, Homo sapiens
ccggccctggggc

SEQ ID NO: 2909902 - DNA, 13 bp, Homo sapiens
ccggccctgtgtg

SEQ ID NO: 2909903 - DNA, 17 bp, Homo sapiens
ccggccgctccaccagc

SEQ ID NO: 2909904 - DNA, 13 bp, Homo sapiens
ccggcgcctgccc

SEQ ID NO: 2909905 - DNA, 15 bp, Homo sapiens
ccggcgcctgccctg

SEQ ID NO: 2909906 - DNA, 22 bp, Homo sapiens
ccggcgcctgccctgcccaagt

SEQ ID NO: 2909907 - DNA, 20 bp, Homo sapiens
ccggcgcctggcctccaggc

SEQ ID NO: 2909908 - DNA, 16 bp, Homo sapiens
ccggcggccctgctga

SEQ ID NO: 2909909 - DNA, 21 bp, Homo sapiens
ccggctaatttttttgtattt

SEQ ID NO: 2909910 - DNA, 14 bp, Homo sapiens
ccggctacatcagc

SEQ ID NO: 2909911 - DNA, 14 bp, Homo sapiens
ccggctcggcccag

SEQ ID NO: 2909912 - DNA, 17 bp, Homo sapiens
ccggctctacgggggcc

SEQ ID NO: 2909913 - DNA, 14 bp, Homo sapiens
ccggctgaccctgt

SEQ ID NO: 2909914 - DNA, 15 bp, Homo sapiens
ccggctgaccctgtg

SEQ ID NO: 2909915 - DNA, 21 bp, Homo sapiens
ccggctggcctggaggctcag

SEQ ID NO: 2909916 - DNA, 15 bp, Homo sapiens
ccggctgggcctcct

SEQ ID NO: 2909917 - DNA, 16 bp, Homo sapiens
ccggctgggcctcctt

SEQ ID NO: 2909918 - DNA, 17 bp, Homo sapiens
ccggctgtgctcagaga

SEQ ID NO: 2909919 - DNA, 19 bp, Homo sapiens
ccggctttgtggcactggg

SEQ ID NO: 2909920 - DNA, 14 bp, Homo sapiens
ccgggaaggaaggc

SEQ ID NO: 2909921 - DNA, 18 bp, Homo sapiens
ccgggaaggaaggctctc

SEQ ID NO: 2909922 - DNA, 15 bp, Homo sapiens
ccgggacaccgtggg

SEQ ID NO: 2909923 - DNA, 17 bp, Homo sapiens
ccgggaccccgagcctg

SEQ ID NO: 2909924 - DNA, 22 bp, Homo sapiens
ccgggactcactggcagcccca

SEQ ID NO: 2909925 - DNA, 23 bp, Homo sapiens
ccgggactcactggcagccccag

SEQ ID NO: 2909926 - DNA, 17 bp, Homo sapiens
ccgggagaagccacctt

SEQ ID NO: 2909927 - DNA, 11 bp, Homo sapiens
ccgggagctgg

SEQ ID NO: 2909928 - DNA, 15 bp, Homo sapiens
ccgggatcctgcccc

SEQ ID NO: 2909929 - DNA, 16 bp, Homo sapiens
ccgggatcctgccccc

SEQ ID NO: 2909930 - DNA, 18 bp, Homo sapiens
ccgggatcctgcccccaa

SEQ ID NO: 2909931 - DNA, 21 bp, Homo sapiens
ccgggatggtcttgatctcct

SEQ ID NO: 2909932 - DNA, 16 bp, Homo sapiens
ccgggcactcccggga

SEQ ID NO: 2909933 - DNA, 11 bp, Homo sapiens
ccgggcagggg

SEQ ID NO: 2909934 - DNA, 22 bp, Homo sapiens
ccgggcaggggagccagggtag

SEQ ID NO: 2909935 - DNA, 17 bp, Homo sapiens
ccgggcatgtctgcctg

SEQ ID NO: 2909936 - DNA, 16 bp, Homo sapiens
ccgggcccccaccgcc

SEQ ID NO: 2909937 - DNA, 23 bp, Homo sapiens
ccgggcccccaccgccggggtcc

SEQ ID NO: 2909938 - DNA, 23 bp, Homo sapiens
ccgggcccttcagtccctgagca

SEQ ID NO: 2909939 - DNA, 22 bp, Homo sapiens
ccgggccggacctgagcccgca

SEQ ID NO: 2909940 - DNA, 18 bp, Homo sapiens
ccgggccggacgcaggtg

SEQ ID NO: 2909941 - DNA, 14 bp, Homo sapiens
ccgggcctggggct

SEQ ID NO: 2909942 - DNA, 14 bp, Homo sapiens
ccgggctgcaggtg

SEQ ID NO: 2909943 - DNA, 12 bp, Homo sapiens
ccgggctggccc

SEQ ID NO: 2909944 - DNA, 14 bp, Homo sapiens
ccgggctggccctg

SEQ ID NO: 2909945 - DNA, 15 bp, Homo sapiens
ccgggctggccctgt

SEQ ID NO: 2909946 - DNA, 18 bp, Homo sapiens
ccgggctggccctgtgca

SEQ ID NO: 2909947 - DNA, 15 bp, Homo sapiens
ccggggaaaggcaag

SEQ ID NO: 2909948 - DNA, 21 bp, Homo sapiens
ccggggaagagatccaaagac

SEQ ID NO: 2909949 - DNA, 15 bp, Homo sapiens
ccggggatggatctt

SEQ ID NO: 2909950 - DNA, 17 bp, Homo sapiens
ccggggcaagagggaag

SEQ ID NO: 2909951 - DNA, 15 bp, Homo sapiens
ccggggccagcactt

SEQ ID NO: 2909952 - DNA, 11 bp, Homo sapiens
ccggggctgag

SEQ ID NO: 2909953 - DNA, 19 bp, Homo sapiens
ccggggctggcggctactc

SEQ ID NO: 2909954 - DNA, 14 bp, Homo sapiens
ccgggggacagagg

SEQ ID NO: 2909955 - DNA, 12 bp, Homo sapiens
ccggggtcctgg

SEQ ID NO: 2909956 - DNA, 13 bp, Homo sapiens
ccggggtcctggg

SEQ ID NO: 2909957 - DNA, 15 bp, Homo sapiens
ccggggtcctgggag

SEQ ID NO: 2909958 - DNA, 17 bp, Homo sapiens
ccggggtctcctggacc

SEQ ID NO: 2909959 - DNA, 18 bp, Homo sapiens
ccggggtctcctggacct

SEQ ID NO: 2909960 - DNA, 20 bp, Homo sapiens
ccggggtgcccacaggccgc

SEQ ID NO: 2909961 - DNA, 22 bp, Homo sapiens
ccggggtggggtgcactcgcca

SEQ ID NO: 2909962 - DNA, 23 bp, Homo sapiens
ccggggtggggtgcactcgccat

SEQ ID NO: 2909963 - DNA, 17 bp, Homo sapiens
ccgggtcaccctgtgac

SEQ ID NO: 2909964 - DNA, 14 bp, Homo sapiens
ccgggtctgcctct

SEQ ID NO: 2909965 - DNA, 21 bp, Homo sapiens
ccgggtgtggcacgcacctgt

SEQ ID NO: 2909966 - DNA, 14 bp, Homo sapiens
ccggtccccacaga

SEQ ID NO: 2909967 - DNA, 23 bp, Homo sapiens
ccggtctatgtcgagagctggcc

SEQ ID NO: 2909968 - DNA, 11 bp, Homo sapiens
ccggtgcagct

SEQ ID NO: 2909969 - DNA, 21 bp, Homo sapiens
ccggtggcggcagggccaggc

SEQ ID NO: 2909970 - DNA, 22 bp, Homo sapiens
ccggtgggacccccgtggggca

SEQ ID NO: 2909971 - DNA, 21 bp, Homo sapiens
ccggtgtgcctgactgcccag

SEQ ID NO: 2909972 - DNA, 13 bp, Homo sapiens
cctcatcaggagt

SEQ ID NO: 2909973 - DNA, 23 bp, Homo sapiens
cctcatcaggagttccagtgctg

SEQ ID NO: 2909974 - DNA, 14 bp, Homo sapiens
cctcatcccgagca

SEQ ID NO: 2909975 - DNA, 14 bp, Homo sapiens
cctcatcctcctcc

SEQ ID NO: 2909976 - DNA, 15 bp, Homo sapiens
cctcatcctcctcct

SEQ ID NO: 2909977 - DNA, 18 bp, Homo sapiens
cctcatcctcctcctcat

SEQ ID NO: 2909978 - DNA, 13 bp, Homo sapiens
cctcatcctgctt

SEQ ID NO: 2909979 - DNA, 15 bp, Homo sapiens
cctcatctgtgcctg

SEQ ID NO: 2909980 - DNA, 17 bp, Homo sapiens
cctcatctgtgcctgtc

SEQ ID NO: 2909981 - DNA, 15 bp, Homo sapiens
cctcatcttcttcac

SEQ ID NO: 2909982 - DNA, 17 bp, Homo sapiens
cctcatcttcttcacca

SEQ ID NO: 2909983 - DNA, 18 bp, Homo sapiens
cctcatcttcttcaccat

SEQ ID NO: 2909984 - DNA, 21 bp, Homo sapiens
cctcattaaatggtgatttct

SEQ ID NO: 2909985 - DNA, 12 bp, Homo sapiens
cctcattaaatt

SEQ ID NO: 2909986 - DNA, 20 bp, Homo sapiens
cctcattaaccgatgcttta

SEQ ID NO: 2909987 - DNA, 15 bp, Homo sapiens
cctcattaatgacac

SEQ ID NO: 2909988 - DNA, 20 bp, Homo sapiens
cctcattcaaagggacggtc

SEQ ID NO: 2909989 - DNA, 18 bp, Homo sapiens
cctcattcagaccaatct

SEQ ID NO: 2909990 - DNA, 13 bp, Homo sapiens
cctcattcaggaa

SEQ ID NO: 2909991 - DNA, 17 bp, Homo sapiens
cctcattcaggaaaact

SEQ ID NO: 2909992 - DNA, 16 bp, Homo sapiens
cctcatttatccctca

SEQ ID NO: 2909993 - DNA, 19 bp, Homo sapiens
cctcatttatccctcaacc

SEQ ID NO: 2909994 - DNA, 11 bp, Homo sapiens
cctcatttctc

SEQ ID NO: 2909995 - DNA, 14 bp, Homo sapiens
cctccaatcctccc

SEQ ID NO: 2909996 - DNA, 20 bp, Homo sapiens
cctccaatcctccccgctct

SEQ ID NO: 2909997 - DNA, 21 bp, Homo sapiens
cctccaatcctccccgctctg

SEQ ID NO: 2909998 - DNA, 16 bp, Homo sapiens
cctccacatcctccac

SEQ ID NO: 2909999 - DNA, 21 bp, Homo sapiens
cctccacccacagtggagagg

SEQ ID NO: 2910000 - DNA, 17 bp, Homo sapiens
cctccacgccactgcct

SEQ ID NO: 2910001 - DNA, 18 bp, Homo sapiens
cctccacgccactgcctc

SEQ ID NO: 2910002 - DNA, 22 bp, Homo sapiens
cctccagaactcactggggcct

SEQ ID NO: 2910003 - DNA, 19 bp, Homo sapiens
cctccagaagcactgggat

SEQ ID NO: 2910004 - DNA, 20 bp, Homo sapiens
cctccagcacaaacacaagg

SEQ ID NO: 2910005 - DNA, 15 bp, Homo sapiens
cctccagctgtcagc

SEQ ID NO: 2910006 - DNA, 19 bp, Homo sapiens
cctccagcttttcctcagg

SEQ ID NO: 2910007 - DNA, 14 bp, Homo sapiens
cctccagggccacg

SEQ ID NO: 2910008 - DNA, 16 bp, Homo sapiens
cctccagtaccttgct

SEQ ID NO: 2910009 - DNA, 17 bp, Homo sapiens
cctccagtaccttgctt

SEQ ID NO: 2910010 - DNA, 19 bp, Homo sapiens
cctccagtcctgctggcct

SEQ ID NO: 2910011 - DNA, 20 bp, Homo sapiens
cctccagtcctgctggcctg

SEQ ID NO: 2910012 - DNA, 15 bp, Homo sapiens
cctccataagtttaa

SEQ ID NO: 2910013 - DNA, 16 bp, Homo sapiens
cctccataagtttaac

SEQ ID NO: 2910014 - DNA, 22 bp, Homo sapiens
cctccatccatctgtccgtcca

SEQ ID NO: 2910015 - DNA, 23 bp, Homo sapiens
cctccatcctaccccctgtgcct

SEQ ID NO: 2910016 - DNA, 11 bp, Homo sapiens
cctccatggga

SEQ ID NO: 2910017 - DNA, 16 bp, Homo sapiens
cctccatggtcctgtc

SEQ ID NO: 2910018 - DNA, 18 bp, Homo sapiens
cctccatggtcctgtctg

SEQ ID NO: 2910019 - DNA, 23 bp, Homo sapiens
cctcccaaagtgctgggattaca

SEQ ID NO: 2910020 - DNA, 12 bp, Homo sapiens
cctcccaactct

SEQ ID NO: 2910021 - DNA, 19 bp, Homo sapiens
cctcccacacccaaagctg

SEQ ID NO: 2910022 - DNA, 15 bp, Homo sapiens
cctcccaccacccca

SEQ ID NO: 2910023 - DNA, 17 bp, Homo sapiens
cctcccagaacacactc

SEQ ID NO: 2910024 - DNA, 12 bp, Homo sapiens
cctcccagctct

SEQ ID NO: 2910025 - DNA, 17 bp, Homo sapiens
cctcccaggactctgac

SEQ ID NO: 2910026 - DNA, 19 bp, Homo sapiens
cctcccagtgccttctggg

SEQ ID NO: 2910027 - DNA, 15 bp, Homo sapiens
cctcccatccagggc

SEQ ID NO: 2910028 - DNA, 15 bp, Homo sapiens
cctcccatcctccag

SEQ ID NO: 2910029 - DNA, 21 bp, Homo sapiens
cctccccaaagccactggaag

SEQ ID NO: 2910030 - DNA, 22 bp, Homo sapiens
cctccccaaagccactggaagg

SEQ ID NO: 2910031 - DNA, 13 bp, Homo sapiens
cctccccaactcc

SEQ ID NO: 2910032 - DNA, 14 bp, Homo sapiens
cctccccaactccc

SEQ ID NO: 2910033 - DNA, 15 bp, Homo sapiens
cctccccaccagagc

SEQ ID NO: 2910034 - DNA, 16 bp, Homo sapiens
cctccccaccagagct

SEQ ID NO: 2910035 - DNA, 18 bp, Homo sapiens
cctccccaccagagctgc

SEQ ID NO: 2910036 - DNA, 18 bp, Homo sapiens
cctccccaccctcctggc

SEQ ID NO: 2910037 - DNA, 23 bp, Homo sapiens
cctcccccacgtctctctgcctg

SEQ ID NO: 2910038 - DNA, 14 bp, Homo sapiens
cctcccccactcct

SEQ ID NO: 2910039 - DNA, 15 bp, Homo sapiens
cctcccccactcctc

SEQ ID NO: 2910040 - DNA, 14 bp, Homo sapiens
cctcccccagcaga

SEQ ID NO: 2910041 - DNA, 19 bp, Homo sapiens
cctccccccaatccctcaa

SEQ ID NO: 2910042 - DNA, 17 bp, Homo sapiens
cctccccccactgcagg

SEQ ID NO: 2910043 - DNA, 19 bp, Homo sapiens
cctcccccccatgcactgt

SEQ ID NO: 2910044 - DNA, 19 bp, Homo sapiens
cctcccccggctgggcctc

SEQ ID NO: 2910045 - DNA, 21 bp, Homo sapiens
cctccccctaccgcatggcag

SEQ ID NO: 2910046 - DNA, 12 bp, Homo sapiens
cctccccctgag

SEQ ID NO: 2910047 - DNA, 13 bp, Homo sapiens
cctccccctgcca

SEQ ID NO: 2910048 - DNA, 17 bp, Homo sapiens
cctccccctgccagtgc

SEQ ID NO: 2910049 - DNA, 13 bp, Homo sapiens
cctcccctatcca

SEQ ID NO: 2910050 - DNA, 13 bp, Homo sapiens
cctcccctcagag

SEQ ID NO: 2910051 - DNA, 14 bp, Homo sapiens
cctcccctcagagc

SEQ ID NO: 2910052 - DNA, 15 bp, Homo sapiens
cctcccctcagagcc

SEQ ID NO: 2910053 - DNA, 17 bp, Homo sapiens
cctcccctcagagccca

SEQ ID NO: 2910054 - DNA, 14 bp, Homo sapiens
cctcccctcgccca

SEQ ID NO: 2910055 - DNA, 13 bp, Homo sapiens
cctcccctgagga

SEQ ID NO: 2910056 - DNA, 18 bp, Homo sapiens
cctcccctgccagggcag

SEQ ID NO: 2910057 - DNA, 16 bp, Homo sapiens
cctcccctgccgcctc

SEQ ID NO: 2910058 - DNA, 21 bp, Homo sapiens
cctcccctgccgcctcccggg

SEQ ID NO: 2910059 - DNA, 13 bp, Homo sapiens
cctccccttgaat

SEQ ID NO: 2910060 - DNA, 19 bp, Homo sapiens
cctcccgggaagcatcctc

SEQ ID NO: 2910061 - DNA, 21 bp, Homo sapiens
cctcccgggaagcatcctccc

SEQ ID NO: 2910062 - DNA, 14 bp, Homo sapiens
cctccctagatcca

SEQ ID NO: 2910063 - DNA, 19 bp, Homo sapiens
cctccctatatgcacccct

SEQ ID NO: 2910064 - DNA, 12 bp, Homo sapiens
cctccctccctc

SEQ ID NO: 2910065 - DNA, 15 bp, Homo sapiens
cctccctccgagtga

SEQ ID NO: 2910066 - DNA, 11 bp, Homo sapiens
cctccctctct

SEQ ID NO: 2910067 - DNA, 13 bp, Homo sapiens
cctccctctgcct

SEQ ID NO: 2910068 - DNA, 18 bp, Homo sapiens
cctccctctgcctcatcc

SEQ ID NO: 2910069 - DNA, 19 bp, Homo sapiens
cctccctctgcctcatcct

SEQ ID NO: 2910070 - DNA, 22 bp, Homo sapiens
cctccctctgcctcatcctcct

SEQ ID NO: 2910071 - DNA, 19 bp, Homo sapiens
cctccctgaagcctttgca

SEQ ID NO: 2910072 - DNA, 14 bp, Homo sapiens
cctccctgcatctg

SEQ ID NO: 2910073 - DNA, 20 bp, Homo sapiens
cctccctgcatctgaccagc

SEQ ID NO: 2910074 - DNA, 21 bp, Homo sapiens
cctccctgcatctgaccagca

SEQ ID NO: 2910075 - DNA, 18 bp, Homo sapiens
cctccctgcctccaccca

SEQ ID NO: 2910076 - DNA, 20 bp, Homo sapiens
cctccctgcgcttcctgagc

SEQ ID NO: 2910077 - DNA, 15 bp, Homo sapiens
cctccctggctgcag

SEQ ID NO: 2910078 - DNA, 16 bp, Homo sapiens
cctccctggctgcagc

SEQ ID NO: 2910079 - DNA, 11 bp, Homo sapiens
cctccctgtcc

SEQ ID NO: 2910080 - DNA, 15 bp, Homo sapiens
cctccctgtcctcct

SEQ ID NO: 2910081 - DNA, 16 bp, Homo sapiens
cctccctgtcctcctc

SEQ ID NO: 2910082 - DNA, 19 bp, Homo sapiens
cctccctgttcaaggcccc

SEQ ID NO: 2910083 - DNA, 10 bp, Homo sapiens
cctcccttcc

SEQ ID NO: 2910084 - DNA, 12 bp, Homo sapiens
cctcccttcctt

SEQ ID NO: 2910085 - DNA, 13 bp, Homo sapiens
cctcccttctgct

SEQ ID NO: 2910086 - DNA, 20 bp, Homo sapiens
cctcccttgagtaggccctg

SEQ ID NO: 2910087 - DNA, 23 bp, Homo sapiens
cctcccttgagtaggccctgctt

SEQ ID NO: 2910088 - DNA, 14 bp, Homo sapiens
cctccgacctctct

SEQ ID NO: 2910089 - DNA, 16 bp, Homo sapiens
cctccgactccagata

SEQ ID NO: 2910090 - DNA, 19 bp, Homo sapiens
cctccgccctttttgtcct

SEQ ID NO: 2910091 - DNA, 16 bp, Homo sapiens
cctccgcctcccatcc

SEQ ID NO: 2910092 - DNA, 13 bp, Homo sapiens
cctccgggcaggg

SEQ ID NO: 2910093 - DNA, 14 bp, Homo sapiens
cctccgtggcacat

SEQ ID NO: 2910094 - DNA, 22 bp, Homo sapiens
cctcctaaagctgaatcccggc

SEQ ID NO: 2910095 - DNA, 16 bp, Homo sapiens
cctcctaccctgcgcc

SEQ ID NO: 2910096 - DNA, 22 bp, Homo sapiens
cctcctacctcagcctcctggg

SEQ ID NO: 2910097 - DNA, 21 bp, Homo sapiens
cctcctagccccttcttccaa

SEQ ID NO: 2910098 - DNA, 15 bp, Homo sapiens
cctcctcacactcca

SEQ ID NO: 2910099 - DNA, 15 bp, Homo sapiens
cctcctcaccccgtc

SEQ ID NO: 2910100 - DNA, 14 bp, Homo sapiens
cctcctcactccct

SEQ ID NO: 2910101 - DNA, 15 bp, Homo sapiens
cctcctcactcccta

SEQ ID NO: 2910102 - DNA, 20 bp, Homo sapiens
cctcctcactccctaggccc

SEQ ID NO: 2910103 - DNA, 19 bp, Homo sapiens
cctcctcaggcacacagct

SEQ ID NO: 2910104 - DNA, 18 bp, Homo sapiens
cctcctcattcagaccaa

SEQ ID NO: 2910105 - DNA, 18 bp, Homo sapiens
cctcctccaccaccgccc

SEQ ID NO: 2910106 - DNA, 13 bp, Homo sapiens
taatgatttttgt

SEQ ID NO: 2910107 - DNA, 18 bp, Homo sapiens
taatgcaatagaagtgct

SEQ ID NO: 2910108 - DNA, 12 bp, Homo sapiens
taatgcactttc

SEQ ID NO: 2910109 - DNA, 21 bp, Homo sapiens
taatgcagcggtgtggaccga

SEQ ID NO: 2910110 - DNA, 22 bp, Homo sapiens
taatgcagttgtggtgtgccat

SEQ ID NO: 2910111 - DNA, 20 bp, Homo sapiens
taatgccacacattgtgctt

SEQ ID NO: 2910112 - DNA, 19 bp, Homo sapiens
taatgccattttaaggaaa

SEQ ID NO: 2910113 - DNA, 18 bp, Homo sapiens
taatgcccagccagccac

SEQ ID NO: 2910114 - DNA, 22 bp, Homo sapiens
taatgcccagccagccacccct

SEQ ID NO: 2910115 - DNA, 23 bp, Homo sapiens
taatgcccagccagccacccctg

SEQ ID NO: 2910116 - DNA, 17 bp, Homo sapiens
taatgcgattttattac

SEQ ID NO: 2910117 - DNA, 18 bp, Homo sapiens
taatgctacgtgtgattt

SEQ ID NO: 2910118 - DNA, 13 bp, Homo sapiens
taatgctactgtc

SEQ ID NO: 2910119 - DNA, 15 bp, Homo sapiens
taatgctactgtctc

SEQ ID NO: 2910120 - DNA, 13 bp, Homo sapiens
taatgctctgaaa

SEQ ID NO: 2910121 - DNA, 16 bp, Homo sapiens
taatgctgtctttgtg

SEQ ID NO: 2910122 - DNA, 14 bp, Homo sapiens
taatgctgttgcct

SEQ ID NO: 2910123 - DNA, 20 bp, Homo sapiens
taatgcttaagggagtttaa

SEQ ID NO: 2910124 - DNA, 13 bp, Homo sapiens
taatggacacttt

SEQ ID NO: 2910125 - DNA, 17 bp, Homo sapiens
taatggacagattaata

SEQ ID NO: 2910126 - DNA, 17 bp, Homo sapiens
taatggcatgagaaata

SEQ ID NO: 2910127 - DNA, 17 bp, Homo sapiens
taatggccggctggaaa

SEQ ID NO: 2910128 - DNA, 15 bp, Homo sapiens
taatggggtcctggc

SEQ ID NO: 2910129 - DNA, 18 bp, Homo sapiens
taatggggtcctggccat

SEQ ID NO: 2910130 - DNA, 14 bp, Homo sapiens
taatggtaccagat

SEQ ID NO: 2910131 - DNA, 18 bp, Homo sapiens
taatggtaccagataaaa

SEQ ID NO: 2910132 - DNA, 16 bp, Homo sapiens
taatgtaacatgattt

SEQ ID NO: 2910133 - DNA, 22 bp, Homo sapiens
taatgtgaaatatgatgagatt

SEQ ID NO: 2910134 - DNA, 21 bp, Homo sapiens
taatgtgaactctcccctccc

SEQ ID NO: 2910135 - DNA, 15 bp, Homo sapiens
taatgtgaagacatt

SEQ ID NO: 2910136 - DNA, 16 bp, Homo sapiens
taatgtgacctagcaa

SEQ ID NO: 2910137 - DNA, 14 bp, Homo sapiens
taatgtgctgtgta

SEQ ID NO: 2910138 - DNA, 18 bp, Homo sapiens
taatgttctgtgatacag

SEQ ID NO: 2910139 - DNA, 20 bp, Homo sapiens
taatgttgattttaatcctg

SEQ ID NO: 2910140 - DNA, 21 bp, Homo sapiens
taatgttgggtagaaagagat

SEQ ID NO: 2910141 - DNA, 21 bp, Homo sapiens
taatgttgtttacaatataga

SEQ ID NO: 2910142 - DNA, 15 bp, Homo sapiens
taatgtttatacaga

SEQ ID NO: 2910143 - DNA, 18 bp, Homo sapiens
taatgttttctttgcaaa

SEQ ID NO: 2910144 - DNA, 19 bp, Homo sapiens
taatgttttctttgcaaag

SEQ ID NO: 2910145 - DNA, 20 bp, Homo sapiens
taatgttttctttgcaaagt

SEQ ID NO: 2910146 - DNA, 16 bp, Homo sapiens
taatgtttttaatatt

SEQ ID NO: 2910147 - DNA, 19 bp, Homo sapiens
taattaaaaactagtagtt

SEQ ID NO: 2910148 - DNA, 22 bp, Homo sapiens
taattaaaaactagtagttctc

SEQ ID NO: 2910149 - DNA, 19 bp, Homo sapiens
taattaaatatttcttaag

SEQ ID NO: 2910150 - DNA, 18 bp, Homo sapiens
taattaaccttactaatt

SEQ ID NO: 2910151 - DNA, 15 bp, Homo sapiens
taattaataaacgaa

SEQ ID NO: 2910152 - DNA, 15 bp, Homo sapiens
taattaatcagctcg

SEQ ID NO: 2910153 - DNA, 20 bp, Homo sapiens
taattacgataaggaagaaa

SEQ ID NO: 2910154 - DNA, 13 bp, Homo sapiens
taattagcattct

SEQ ID NO: 2910155 - DNA, 11 bp, Homo sapiens
taattataaga

SEQ ID NO: 2910156 - DNA, 21 bp, Homo sapiens
taattataagaatttctaaca

SEQ ID NO: 2910157 - DNA, 19 bp, Homo sapiens
taattataggaagttcttt

SEQ ID NO: 2910158 - DNA, 20 bp, Homo sapiens
taattatcagttggtttgga

SEQ ID NO: 2910159 - DNA, 13 bp, Homo sapiens
taattattattat

SEQ ID NO: 2910160 - DNA, 15 bp, Homo sapiens
taattattattatta

SEQ ID NO: 2910161 - DNA, 15 bp, Homo sapiens
taattatttaaatgt

SEQ ID NO: 2910162 - DNA, 13 bp, Homo sapiens
taattattttaaa

SEQ ID NO: 2910163 - DNA, 22 bp, Homo sapiens
taattcaggggctgacacttca

SEQ ID NO: 2910164 - DNA, 21 bp, Homo sapiens
taattcagtatgttttacact

SEQ ID NO: 2910165 - DNA, 19 bp, Homo sapiens
taattcatatttttcctta

SEQ ID NO: 2910166 - DNA, 12 bp, Homo sapiens
taattcatcttt

SEQ ID NO: 2910167 - DNA, 14 bp, Homo sapiens
taattcatgtttct

SEQ ID NO: 2910168 - DNA, 10 bp, Homo sapiens
taattccatg

SEQ ID NO: 2910169 - DNA, 15 bp, Homo sapiens
taattcctcttttta

SEQ ID NO: 2910170 - DNA, 13 bp, Homo sapiens
taattctcttgaa

SEQ ID NO: 2910171 - DNA, 14 bp, Homo sapiens
taattctgcatctg

SEQ ID NO: 2910172 - DNA, 14 bp, Homo sapiens
taattcttcctgtt

SEQ ID NO: 2910173 - DNA, 21 bp, Homo sapiens
taattgcaaaaacatagaaat

SEQ ID NO: 2910174 - DNA, 23 bp, Homo sapiens
taattgcagataactttgacttt

SEQ ID NO: 2910175 - DNA, 16 bp, Homo sapiens
tacaaagaagacatgt

SEQ ID NO: 2910176 - DNA, 22 bp, Homo sapiens
tacaaagaagacatgttttaga

SEQ ID NO: 2910177 - DNA, 17 bp, Homo sapiens
tacaaaggaggacaaga

SEQ ID NO: 2910178 - DNA, 16 bp, Homo sapiens
tacaaatataaatctt

SEQ ID NO: 2910179 - DNA, 17 bp, Homo sapiens
tacaaatataaatctta

SEQ ID NO: 2910180 - DNA, 13 bp, Homo sapiens
tacaaatctgtat

SEQ ID NO: 2910181 - DNA, 16 bp, Homo sapiens
tacaaatgacactgca

SEQ ID NO: 2910182 - DNA, 21 bp, Homo sapiens
tacaaatggacataggactca

SEQ ID NO: 2910183 - DNA, 15 bp, Homo sapiens
tacaaattaatattt

SEQ ID NO: 2910184 - DNA, 17 bp, Homo sapiens
tacaaattaatatttgt

SEQ ID NO: 2910185 - DNA, 20 bp, Homo sapiens
tacaaattttcttttgaaag

SEQ ID NO: 2910186 - DNA, 12 bp, Homo sapiens
tacaacaaacac

SEQ ID NO: 2910187 - DNA, 16 bp, Homo sapiens
tacaacaaacactgtg

SEQ ID NO: 2910188 - DNA, 13 bp, Homo sapiens
tacaacagatttg

SEQ ID NO: 2910189 - DNA, 19 bp, Homo sapiens
tacaacagatttgtgaact

SEQ ID NO: 2910190 - DNA, 21 bp, Homo sapiens
tacaacagatttgtgaactca

SEQ ID NO: 2910191 - DNA, 13 bp, Homo sapiens
tacaacagtgcta

SEQ ID NO: 2910192 - DNA, 19 bp, Homo sapiens
tacaacatttatatattgt

SEQ ID NO: 2910193 - DNA, 21 bp, Homo sapiens
tacaacatttatatattgtct

SEQ ID NO: 2910194 - DNA, 22 bp, Homo sapiens
tacaacatttatatattgtctg

SEQ ID NO: 2910195 - DNA, 14 bp, Homo sapiens
tacaaccaggtctt

SEQ ID NO: 2910196 - DNA, 14 bp, Homo sapiens
tacaacttcaagtg

SEQ ID NO: 2910197 - DNA, 24 bp, Homo sapiens
tacaagatgaaggagaggcaacat

SEQ ID NO: 2910198 - DNA, 21 bp, Homo sapiens
tacaagattagaagctgaaaa

SEQ ID NO: 2910199 - DNA, 16 bp, Homo sapiens
tacaagctacagttgt

SEQ ID NO: 2910200 - DNA, 18 bp, Homo sapiens
tacaagctcttgtttctg

SEQ ID NO: 2910201 - DNA, 17 bp, Homo sapiens
tacaaggacagacagca

SEQ ID NO: 2910202 - DNA, 17 bp, Homo sapiens
tacaagggagaagacaa

SEQ ID NO: 2910203 - DNA, 19 bp, Homo sapiens
tacaaggggccatttggca

SEQ ID NO: 2910204 - DNA, 13 bp, Homo sapiens
tacaagttgcttt

SEQ ID NO: 2910205 - DNA, 16 bp, Homo sapiens
tacaagtttatatata

SEQ ID NO: 2910206 - DNA, 23 bp, Homo sapiens
tacaataaaactaaatgtgtaca

SEQ ID NO: 2910207 - DNA, 14 bp, Homo sapiens
tacaataaactggt

SEQ ID NO: 2910208 - DNA, 15 bp, Homo sapiens
tacaatatgaaaagg

SEQ ID NO: 2910209 - DNA, 21 bp, Homo sapiens
tacaatgaacccccatgatgt

SEQ ID NO: 2910210 - DNA, 14 bp, Homo sapiens
tacaatgtatttat

SEQ ID NO: 2910211 - DNA, 19 bp, Homo sapiens
tacaatgtatttatttaaa

SEQ ID NO: 2910212 - DNA, 22 bp, Homo sapiens
tacaatgtatttatttaaaaga

SEQ ID NO: 2910213 - DNA, 12 bp, Homo sapiens
tacaatgtttta

SEQ ID NO: 2910214 - DNA, 22 bp, Homo sapiens
tacaattaaaaaaaaagatctg

SEQ ID NO: 2910215 - DNA, 19 bp, Homo sapiens
tacaattatatcagtcctc

SEQ ID NO: 2910216 - DNA, 19 bp, Homo sapiens
tacaattattgtatattga

SEQ ID NO: 2910217 - DNA, 12 bp, Homo sapiens
tacaattcattg

SEQ ID NO: 2910218 - DNA, 13 bp, Homo sapiens
tacaattcattgt

SEQ ID NO: 2910219 - DNA, 21 bp, Homo sapiens
tacaattcattgttttgcaaa

SEQ ID NO: 2910220 - DNA, 12 bp, Homo sapiens
tacaattttatc

SEQ ID NO: 2910221 - DNA, 21 bp, Homo sapiens
tacaatttttttaattttgta

SEQ ID NO: 2910222 - DNA, 17 bp, Homo sapiens
tacacaacatgtatgtg

SEQ ID NO: 2910223 - DNA, 17 bp, Homo sapiens
tacacaatggtttttaa

SEQ ID NO: 2910224 - DNA, 20 bp, Homo sapiens
tacacaatggtttttaaatt

SEQ ID NO: 2910225 - DNA, 9 bp, Homo sapiens
tacacacac

SEQ ID NO: 2910226 - DNA, 13 bp, Homo sapiens
tacacacacacac

SEQ ID NO: 2910227 - DNA, 17 bp, Homo sapiens
tacacacacacacacag

SEQ ID NO: 2910228 - DNA, 18 bp, Homo sapiens
tacacacacacacacagc

SEQ ID NO: 2910229 - DNA, 22 bp, Homo sapiens
tacacacctaagggacatgttt

SEQ ID NO: 2910230 - DNA, 20 bp, Homo sapiens
tacacactgtcatgcttcat

SEQ ID NO: 2910231 - DNA, 17 bp, Homo sapiens
tacacagcaccagaatg

SEQ ID NO: 2910232 - DNA, 15 bp, Homo sapiens
tacacataacttctt

SEQ ID NO: 2910233 - DNA, 20 bp, Homo sapiens
tacacatctctgtcagtgtg

SEQ ID NO: 2910234 - DNA, 21 bp, Homo sapiens
tacacatctctgtcagtgtga

SEQ ID NO: 2910235 - DNA, 13 bp, Homo sapiens
tacaccacacaca

SEQ ID NO: 2910236 - DNA, 18 bp, Homo sapiens
tacaccacacacaacagc

SEQ ID NO: 2910237 - DNA, 17 bp, Homo sapiens
aaggggccagaggctcg

SEQ ID NO: 2910238 - DNA, 15 bp, Homo sapiens
aaggggcccgtggga

SEQ ID NO: 2910239 - DNA, 16 bp, Homo sapiens
aaggggctcttctgag

SEQ ID NO: 2910240 - DNA, 22 bp, Homo sapiens
aaggggcttcaggtccaggctg

SEQ ID NO: 2910241 - DNA, 14 bp, Homo sapiens
aagggggaccatgg

SEQ ID NO: 2910242 - DNA, 16 bp, Homo sapiens
aaggggtcacttacag

SEQ ID NO: 2910243 - DNA, 20 bp, Homo sapiens
aaggggtcggctaagtggga

SEQ ID NO: 2910244 - DNA, 16 bp, Homo sapiens
aaggggttggattgca

SEQ ID NO: 2910245 - DNA, 18 bp, Homo sapiens
aagggtcgaaagctctag

SEQ ID NO: 2910246 - DNA, 19 bp, Homo sapiens
aagggtcgaaagctctaga

SEQ ID NO: 2910247 - DNA, 17 bp, Homo sapiens
aagggtctagggagaga

SEQ ID NO: 2910248 - DNA, 22 bp, Homo sapiens
aagggtctagggagagaccctt

SEQ ID NO: 2910249 - DNA, 19 bp, Homo sapiens
aagggtcttgggaaatatg

SEQ ID NO: 2910250 - DNA, 13 bp, Homo sapiens
aagggtgatcatc

SEQ ID NO: 2910251 - DNA, 12 bp, Homo sapiens
aagggttgtgag

SEQ ID NO: 2910252 - DNA, 12 bp, Homo sapiens
aaggtaaaattg

SEQ ID NO: 2910253 - DNA, 14 bp, Homo sapiens
aaggtaaatacaag

SEQ ID NO: 2910254 - DNA, 19 bp, Homo sapiens
aaggtaacatttatagaag

SEQ ID NO: 2910255 - DNA, 12 bp, Homo sapiens
aaggtataaata

SEQ ID NO: 2910256 - DNA, 12 bp, Homo sapiens
aaggtataataa

SEQ ID NO: 2910257 - DNA, 13 bp, Homo sapiens
aaggtatctggta

SEQ ID NO: 2910258 - DNA, 17 bp, Homo sapiens
aaggtatttgggaaact

SEQ ID NO: 2910259 - DNA, 21 bp, Homo sapiens
aaggtatttgggaaacttgtc

SEQ ID NO: 2910260 - DNA, 20 bp, Homo sapiens
aaggtcctctgtcagtcaca

SEQ ID NO: 2910261 - DNA, 19 bp, Homo sapiens
aaggtctcacactcctcct

SEQ ID NO: 2910262 - DNA, 21 bp, Homo sapiens
aaggtctcacactcctcctgc

SEQ ID NO: 2910263 - DNA, 13 bp, Homo sapiens
aaggtctgatttg

SEQ ID NO: 2910264 - DNA, 18 bp, Homo sapiens
aaggtctgatttgcagga

SEQ ID NO: 2910265 - DNA, 18 bp, Homo sapiens
aaggtctttcagtacttt

SEQ ID NO: 2910266 - DNA, 13 bp, Homo sapiens
aaggtctttgtaa

SEQ ID NO: 2910267 - DNA, 14 bp, Homo sapiens
aaggtctttgtaaa

SEQ ID NO: 2910268 - DNA, 20 bp, Homo sapiens
aaggtctttgtaaaatcttg

SEQ ID NO: 2910269 - DNA, 14 bp, Homo sapiens
aaggtgaaaattgt

SEQ ID NO: 2910270 - DNA, 20 bp, Homo sapiens
aaggtgaaaattgtataaat

SEQ ID NO: 2910271 - DNA, 13 bp, Homo sapiens
aaggtgaactttg

SEQ ID NO: 2910272 - DNA, 14 bp, Homo sapiens
aaggtgaactttgt

SEQ ID NO: 2910273 - DNA, 17 bp, Homo sapiens
aaggtgaccgcccagct

SEQ ID NO: 2910274 - DNA, 13 bp, Homo sapiens
aaggtgaggcctg

SEQ ID NO: 2910275 - DNA, 18 bp, Homo sapiens
aaggtgcatatagaaaac

SEQ ID NO: 2910276 - DNA, 15 bp, Homo sapiens
aaggtgccagaagga

SEQ ID NO: 2910277 - DNA, 17 bp, Homo sapiens
aaggtgccagaaggaag

SEQ ID NO: 2910278 - DNA, 19 bp, Homo sapiens
aaggtgccagaaggaaggt

SEQ ID NO: 2910279 - DNA, 20 bp, Homo sapiens
aaggtgcctgtgaggcaggg

SEQ ID NO: 2910280 - DNA, 15 bp, Homo sapiens
aaggtggacctggca

SEQ ID NO: 2910281 - DNA, 16 bp, Homo sapiens
aaggtggacctggcag

SEQ ID NO: 2910282 - DNA, 22 bp, Homo sapiens
aaggtggattttgtttaaaaaa

SEQ ID NO: 2910283 - DNA, 19 bp, Homo sapiens
aaggtgttttctgtgtaac

SEQ ID NO: 2910284 - DNA, 18 bp, Homo sapiens
aaggttaaaggaaaagca

SEQ ID NO: 2910285 - DNA, 11 bp, Homo sapiens
aaggttctaag

SEQ ID NO: 2910286 - DNA, 13 bp, Homo sapiens
aaggttctaaggc

SEQ ID NO: 2910287 - DNA, 14 bp, Homo sapiens
aaggttctaaggcc

SEQ ID NO: 2910288 - DNA, 13 bp, Homo sapiens
aaggttctaggtt

SEQ ID NO: 2910289 - DNA, 21 bp, Homo sapiens
aaggttcttcccttttacata

SEQ ID NO: 2910290 - DNA, 17 bp, Homo sapiens
aaggttgactcaagttt

SEQ ID NO: 2910291 - DNA, 22 bp, Homo sapiens
aaggttggagctttgcaattct

SEQ ID NO: 2910292 - DNA, 20 bp, Homo sapiens
aaggtttaaagagtctagat

SEQ ID NO: 2910293 - DNA, 21 bp, Homo sapiens
aaggtttaaagagtctagatt

SEQ ID NO: 2910294 - DNA, 19 bp, Homo sapiens
aaggtttaggctggtggcc

SEQ ID NO: 2910295 - DNA, 14 bp, Homo sapiens
aaggtttcaagact

SEQ ID NO: 2910296 - DNA, 15 bp, Homo sapiens
aaggttttaggttct

SEQ ID NO: 2910297 - DNA, 14 bp, Homo sapiens
aagtaactataaca

SEQ ID NO: 2910298 - DNA, 18 bp, Homo sapiens
aagtaactataacaaaaa

SEQ ID NO: 2910299 - DNA, 14 bp, Homo sapiens
aagtaactcccact

SEQ ID NO: 2910300 - DNA, 15 bp, Homo sapiens
aagtaacttattttg

SEQ ID NO: 2910301 - DNA, 19 bp, Homo sapiens
aagtaactttattcttgaa

SEQ ID NO: 2910302 - DNA, 18 bp, Homo sapiens
aagtaagaagaggagcct

SEQ ID NO: 2910303 - DNA, 16 bp, Homo sapiens
aagtaagcatttccag

SEQ ID NO: 2910304 - DNA, 21 bp, Homo sapiens
aagtaatgcatttgagcatgg

SEQ ID NO: 2910305 - DNA, 14 bp, Homo sapiens
aagtaatgcctctg

SEQ ID NO: 2910306 - DNA, 19 bp, Homo sapiens
aagtaatgtagcatgattt

SEQ ID NO: 2910307 - DNA, 16 bp, Homo sapiens
aagtaattgtgaaaaa

SEQ ID NO: 2910308 - DNA, 16 bp, Homo sapiens
aagtacaattcattgt

SEQ ID NO: 2910309 - DNA, 12 bp, Homo sapiens
aagtacaggcag

SEQ ID NO: 2910310 - DNA, 14 bp, Homo sapiens
aagtaccagattat

SEQ ID NO: 2910311 - DNA, 23 bp, Homo sapiens
aagtacgtcccagcggcctcagg

SEQ ID NO: 2910312 - DNA, 15 bp, Homo sapiens
aagtactgagcagta

SEQ ID NO: 2910313 - DNA, 17 bp, Homo sapiens
aagtactgtaagaataa

SEQ ID NO: 2910314 - DNA, 22 bp, Homo sapiens
aagtactgtaagaataatttat

SEQ ID NO: 2910315 - DNA, 23 bp, Homo sapiens
aagtactgtaagaataatttata

SEQ ID NO: 2910316 - DNA, 11 bp, Homo sapiens
aagtagaaatg

SEQ ID NO: 2910317 - DNA, 16 bp, Homo sapiens
aagtagaagcatgttt

SEQ ID NO: 2910318 - DNA, 19 bp, Homo sapiens
aagtagacagttttgagaa

SEQ ID NO: 2910319 - DNA, 21 bp, Homo sapiens
aagtagacagttttgagaacg

SEQ ID NO: 2910320 - DNA, 18 bp, Homo sapiens
aagtagatctgctttctg

SEQ ID NO: 2910321 - DNA, 17 bp, Homo sapiens
aagtagcaccaaataaa

SEQ ID NO: 2910322 - DNA, 18 bp, Homo sapiens
aagtagctgctaccttct

SEQ ID NO: 2910323 - DNA, 15 bp, Homo sapiens
aagtagctgggattt

SEQ ID NO: 2910324 - DNA, 22 bp, Homo sapiens
aagtaggactttcctaaatgtt

SEQ ID NO: 2910325 - DNA, 13 bp, Homo sapiens
aagtagtaaaaat

SEQ ID NO: 2910326 - DNA, 13 bp, Homo sapiens
aagtataaagtca

SEQ ID NO: 2910327 - DNA, 22 bp, Homo sapiens
aagtatagcctatggcagaaaa

SEQ ID NO: 2910328 - DNA, 11 bp, Homo sapiens
aagtatatact

SEQ ID NO: 2910329 - DNA, 22 bp, Homo sapiens
aagtatatacttttaaattatg

SEQ ID NO: 2910330 - DNA, 18 bp, Homo sapiens
aagtatatgtcatttact

SEQ ID NO: 2910331 - DNA, 18 bp, Homo sapiens
aagtatcctgcttctgat

SEQ ID NO: 2910332 - DNA, 19 bp, Homo sapiens
aagtatcttctatttttat

SEQ ID NO: 2910333 - DNA, 20 bp, Homo sapiens
aagtatcttctatttttatc

SEQ ID NO: 2910334 - DNA, 15 bp, Homo sapiens
aagtatggaattttc

SEQ ID NO: 2910335 - DNA, 22 bp, Homo sapiens
aagtattatgccccagttcaga

SEQ ID NO: 2910336 - DNA, 20 bp, Homo sapiens
aagtattcacatcatttggg

SEQ ID NO: 2910337 - DNA, 12 bp, Homo sapiens
aagtattgtaaa

SEQ ID NO: 2910338 - DNA, 17 bp, Homo sapiens
aagtattgtaaattata

SEQ ID NO: 2910339 - DNA, 16 bp, Homo sapiens
aagtattgtttacatt

SEQ ID NO: 2910340 - DNA, 22 bp, Homo sapiens
aagtattgtttacattaaactc

SEQ ID NO: 2910341 - DNA, 16 bp, Homo sapiens
aagtatttaagtgatc

SEQ ID NO: 2910342 - DNA, 21 bp, Homo sapiens
aagtatttcaaattggagctt

SEQ ID NO: 2910343 - DNA, 18 bp, Homo sapiens
aagtattttcctgtaaaa

SEQ ID NO: 2910344 - DNA, 23 bp, Homo sapiens
aagtatttttgattaacaatgta

SEQ ID NO: 2910345 - DNA, 24 bp, Homo sapiens
aagtatttttgattaacaatgtat

SEQ ID NO: 2910346 - DNA, 14 bp, Homo sapiens
aagccatcttggta

SEQ ID NO: 2910347 - DNA, 21 bp, Homo sapiens
aagccatggagtgagacccag

SEQ ID NO: 2910348 - DNA, 12 bp, Homo sapiens
aagccattgtct

SEQ ID NO: 2910349 - DNA, 14 bp, Homo sapiens
aagccattgtcttc

SEQ ID NO: 2910350 - DNA, 22 bp, Homo sapiens
aagcccaaatttaatttgcaac

SEQ ID NO: 2910351 - DNA, 22 bp, Homo sapiens
aagcccacctgaaagcctgtct

SEQ ID NO: 2910352 - DNA, 13 bp, Homo sapiens
aagcccacctggg

SEQ ID NO: 2910353 - DNA, 16 bp, Homo sapiens
aagcccacctgggctg

SEQ ID NO: 2910354 - DNA, 17 bp, Homo sapiens
aagcccacctgggctgg

SEQ ID NO: 2910355 - DNA, 20 bp, Homo sapiens
aagcccagcactgcttgagg

SEQ ID NO: 2910356 - DNA, 18 bp, Homo sapiens
aagcccagttcagcttgg

SEQ ID NO: 2910357 - DNA, 19 bp, Homo sapiens
aagcccatgagtccttgaa

SEQ ID NO: 2910358 - DNA, 20 bp, Homo sapiens
aagcccatgagtccttgaaa

SEQ ID NO: 2910359 - DNA, 22 bp, Homo sapiens
aagcccatgagtccttgaaaat

SEQ ID NO: 2910360 - DNA, 14 bp, Homo sapiens
aagccccaactttc

SEQ ID NO: 2910361 - DNA, 16 bp, Homo sapiens
aagccccaagcgaatt

SEQ ID NO: 2910362 - DNA, 12 bp, Homo sapiens
aagccccatcct

SEQ ID NO: 2910363 - DNA, 13 bp, Homo sapiens
aagccccctggca

SEQ ID NO: 2910364 - DNA, 20 bp, Homo sapiens
aagccccctggcagctgccc

SEQ ID NO: 2910365 - DNA, 12 bp, Homo sapiens
aagccctccttc

SEQ ID NO: 2910366 - DNA, 14 bp, Homo sapiens
aagccctccttcca

SEQ ID NO: 2910367 - DNA, 15 bp, Homo sapiens
aagccctccttccac

SEQ ID NO: 2910368 - DNA, 19 bp, Homo sapiens
aagccctgaatttcttctt

SEQ ID NO: 2910369 - DNA, 17 bp, Homo sapiens
aagccctgcctctgtgt

SEQ ID NO: 2910370 - DNA, 19 bp, Homo sapiens
aagccctgggatcactgtg

SEQ ID NO: 2910371 - DNA, 21 bp, Homo sapiens
aagccctgttctcgttgccct

SEQ ID NO: 2910372 - DNA, 22 bp, Homo sapiens
aagccctgttctcgttgcccta

SEQ ID NO: 2910373 - DNA, 15 bp, Homo sapiens
aagccctttgcctgt

SEQ ID NO: 2910374 - DNA, 22 bp, Homo sapiens
aagccgttgtttacttaaagat

SEQ ID NO: 2910375 - DNA, 17 bp, Homo sapiens
aagcctaattgtcacat

SEQ ID NO: 2910376 - DNA, 22 bp, Homo sapiens
aagcctagtgaaggcttctctc

SEQ ID NO: 2910377 - DNA, 23 bp, Homo sapiens
aagcctcaaggttttaggttcta

SEQ ID NO: 2910378 - DNA, 14 bp, Homo sapiens
aagcctcagctcat

SEQ ID NO: 2910379 - DNA, 17 bp, Homo sapiens
aagcctcagtgaaacag

SEQ ID NO: 2910380 - DNA, 20 bp, Homo sapiens
aagcctccttacattaaaaa

SEQ ID NO: 2910381 - DNA, 18 bp, Homo sapiens
aagcctcgaggtgccttc

SEQ ID NO: 2910382 - DNA, 12 bp, Homo sapiens
aagcctctggaa

SEQ ID NO: 2910383 - DNA, 12 bp, Homo sapiens
aagcctctgtcc

SEQ ID NO: 2910384 - DNA, 18 bp, Homo sapiens
aagcctgaactgaggcct

SEQ ID NO: 2910385 - DNA, 19 bp, Homo sapiens
aagcctgaactgaggcctt

SEQ ID NO: 2910386 - DNA, 23 bp, Homo sapiens
aagcctgaatttctcagtgttgg

SEQ ID NO: 2910387 - DNA, 15 bp, Homo sapiens
aagcctgatgctgac

SEQ ID NO: 2910388 - DNA, 19 bp, Homo sapiens
aagcctgcctcgccttgtg

SEQ ID NO: 2910389 - DNA, 19 bp, Homo sapiens
aagcctgctttttaagtgt

SEQ ID NO: 2910390 - DNA, 21 bp, Homo sapiens
aagcctggcctacatggttga

SEQ ID NO: 2910391 - DNA, 17 bp, Homo sapiens
aagcctgggattgacag

SEQ ID NO: 2910392 - DNA, 16 bp, Homo sapiens
aagcctgtcccaggac

SEQ ID NO: 2910393 - DNA, 18 bp, Homo sapiens
aagcctgtgcaaaaaaat

SEQ ID NO: 2910394 - DNA, 13 bp, Homo sapiens
aagcctgtggctg

SEQ ID NO: 2910395 - DNA, 22 bp, Homo sapiens
aagccttacagttatcctgcaa

SEQ ID NO: 2910396 - DNA, 22 bp, Homo sapiens
aagccttcgggcgtctgtgtgc

SEQ ID NO: 2910397 - DNA, 16 bp, Homo sapiens
aagcgaacatcttcat

SEQ ID NO: 2910398 - DNA, 19 bp, Homo sapiens
aagcgaacatcttcatata

SEQ ID NO: 2910399 - DNA, 15 bp, Homo sapiens
aagcgaattatactc

SEQ ID NO: 2910400 - DNA, 14 bp, Homo sapiens
aagcgattctcctg

SEQ ID NO: 2910401 - DNA, 18 bp, Homo sapiens
aagcgcccacccaggtcc

SEQ ID NO: 2910402 - DNA, 13 bp, Homo sapiens
aagcgctgtttcc

SEQ ID NO: 2910403 - DNA, 14 bp, Homo sapiens
aagcgctgtttcct

SEQ ID NO: 2910404 - DNA, 20 bp, Homo sapiens
aagcggtcagactggaggtc

SEQ ID NO: 2910405 - DNA, 14 bp, Homo sapiens
aagcgtatttaatg

SEQ ID NO: 2910406 - DNA, 16 bp, Homo sapiens
aagcgtctttaagaga

SEQ ID NO: 2910407 - DNA, 23 bp, Homo sapiens
aagcgtctttaagagactcactg

SEQ ID NO: 2910408 - DNA, 14 bp, Homo sapiens
aagctaatttgcat

SEQ ID NO: 2910409 - DNA, 21 bp, Homo sapiens
aagctagtgtacctcctctca

SEQ ID NO: 2910410 - DNA, 18 bp, Homo sapiens
aagctatggtgagatgca

SEQ ID NO: 2910411 - DNA, 22 bp, Homo sapiens
aagctatggtgagatgcagctg

SEQ ID NO: 2910412 - DNA, 13 bp, Homo sapiens
aagctatttcctt

SEQ ID NO: 2910413 - DNA, 19 bp, Homo sapiens
aagctcaagtgttcacaac

SEQ ID NO: 2910414 - DNA, 16 bp, Homo sapiens
aagctcacctgttgct

SEQ ID NO: 2910415 - DNA, 22 bp, Homo sapiens
aagctcagaggcgcactgtgac

SEQ ID NO: 2910416 - DNA, 23 bp, Homo sapiens
aagctcagaggcgcactgtgacc

SEQ ID NO: 2910417 - DNA, 13 bp, Homo sapiens
aagctccagcttt

SEQ ID NO: 2910418 - DNA, 17 bp, Homo sapiens
aagctcctatctgtttt

SEQ ID NO: 2910419 - DNA, 15 bp, Homo sapiens
aagctcctcctccct

SEQ ID NO: 2910420 - DNA, 16 bp, Homo sapiens
aagctcctcctccctg

SEQ ID NO: 2910421 - DNA, 17 bp, Homo sapiens
aagctcctcctccctgc

SEQ ID NO: 2910422 - DNA, 18 bp, Homo sapiens
aagctcctctccccagcc

SEQ ID NO: 2910423 - DNA, 15 bp, Homo sapiens
aagctcttgtttctg

SEQ ID NO: 2910424 - DNA, 19 bp, Homo sapiens
aagctcttgtttctgttta

SEQ ID NO: 2910425 - DNA, 13 bp, Homo sapiens
aagctgaatacat

SEQ ID NO: 2910426 - DNA, 19 bp, Homo sapiens
aagctgacgaacttccatg

SEQ ID NO: 2910427 - DNA, 11 bp, Homo sapiens
aagctgagcct

SEQ ID NO: 2910428 - DNA, 23 bp, Homo sapiens
aagctgcctcccctctccttcct

SEQ ID NO: 2910429 - DNA, 13 bp, Homo sapiens
aagctgcctctga

SEQ ID NO: 2910430 - DNA, 19 bp, Homo sapiens
aagctgcctctgacagcag

SEQ ID NO: 2910431 - DNA, 17 bp, Homo sapiens
aagctgctgcagccctg

SEQ ID NO: 2910432 - DNA, 21 bp, Homo sapiens
aagctgctggagcccgcactg

SEQ ID NO: 2910433 - DNA, 22 bp, Homo sapiens
aagctgctgtgactgtgtcccc

SEQ ID NO: 2910434 - DNA, 18 bp, Homo sapiens
aagctggagtgctgcttg

SEQ ID NO: 2910435 - DNA, 15 bp, Homo sapiens
aagctggctggggtg

SEQ ID NO: 2910436 - DNA, 23 bp, Homo sapiens
aagctggctggggtggcctgtgt

SEQ ID NO: 2910437 - DNA, 17 bp, Homo sapiens
aagctgggggtggggag

SEQ ID NO: 2910438 - DNA, 14 bp, Homo sapiens
aagctgtactttta

SEQ ID NO: 2910439 - DNA, 14 bp, Homo sapiens
aagctgtggaatga

SEQ ID NO: 2910440 - DNA, 20 bp, Homo sapiens
aagctgtggaatgaagcttt

SEQ ID NO: 2910441 - DNA, 22 bp, Homo sapiens
aagctgtgtccttgcacctgca

SEQ ID NO: 2910442 - DNA, 12 bp, Homo sapiens
aaaagcacaaaa

SEQ ID NO: 2910443 - DNA, 14 bp, Homo sapiens
aaaagcagaatttt

SEQ ID NO: 2910444 - DNA, 22 bp, Homo sapiens
aaaagcagaattttaatgtgaa

SEQ ID NO: 2910445 - DNA, 19 bp, Homo sapiens
aaaagcatgatgggaaaat

SEQ ID NO: 2910446 - DNA, 21 bp, Homo sapiens
aaaagccaaggtgtcatttat

SEQ ID NO: 2910447 - DNA, 22 bp, Homo sapiens
aaaagccgaaagggttaatcat

SEQ ID NO: 2910448 - DNA, 18 bp, Homo sapiens
aaaagcgtctttaagaga

SEQ ID NO: 2910449 - DNA, 15 bp, Homo sapiens
aaaagctcctggggc

SEQ ID NO: 2910450 - DNA, 18 bp, Homo sapiens
aaaagctgtggaatgaag

SEQ ID NO: 2910451 - DNA, 18 bp, Homo sapiens
aaaaggaaaaataatcaa

SEQ ID NO: 2910452 - DNA, 14 bp, Homo sapiens
aaaaggaactgcag

SEQ ID NO: 2910453 - DNA, 20 bp, Homo sapiens
aaaaggacgtaaaatttaca

SEQ ID NO: 2910454 - DNA, 15 bp, Homo sapiens
aaaaggactggaaaa

SEQ ID NO: 2910455 - DNA, 16 bp, Homo sapiens
aaaaggagagattatt

SEQ ID NO: 2910456 - DNA, 23 bp, Homo sapiens
aaaaggagagattattaaatcgt

SEQ ID NO: 2910457 - DNA, 17 bp, Homo sapiens
aaaaggagcgggcaggg

SEQ ID NO: 2910458 - DNA, 19 bp, Homo sapiens
aaaaggatctttgtggcca

SEQ ID NO: 2910459 - DNA, 19 bp, Homo sapiens
aaaaggccaaacctctgtt

SEQ ID NO: 2910460 - DNA, 19 bp, Homo sapiens
aaaaggttaatttttcctt

SEQ ID NO: 2910461 - DNA, 20 bp, Homo sapiens
aaaaggttgcctgaaaaatg

SEQ ID NO: 2910462 - DNA, 13 bp, Homo sapiens
aaaaggtttgaga

SEQ ID NO: 2910463 - DNA, 13 bp, Homo sapiens
aaaagtaaagatg

SEQ ID NO: 2910464 - DNA, 22 bp, Homo sapiens
aaaagtagtgttgtccaggaag

SEQ ID NO: 2910465 - DNA, 22 bp, Homo sapiens
aaaagtattattttccaaaagt

SEQ ID NO: 2910466 - DNA, 15 bp, Homo sapiens
aaaagtcaaaaggtg

SEQ ID NO: 2910467 - DNA, 17 bp, Homo sapiens
aaaagtgattgttggca

SEQ ID NO: 2910468 - DNA, 23 bp, Homo sapiens
aaaagtggagttgttttaacaga

SEQ ID NO: 2910469 - DNA, 16 bp, Homo sapiens
aaaagtggcctctttg

SEQ ID NO: 2910470 - DNA, 17 bp, Homo sapiens
aaaagtgggcttgattc

SEQ ID NO: 2910471 - DNA, 20 bp, Homo sapiens
aaaagtggggctaaatgaag

SEQ ID NO: 2910472 - DNA, 13 bp, Homo sapiens
aaaagtgtacaag

SEQ ID NO: 2910473 - DNA, 12 bp, Homo sapiens
aaaagtgtattt

SEQ ID NO: 2910474 - DNA, 14 bp, Homo sapiens
aaaagttaaaaagt

SEQ ID NO: 2910475 - DNA, 19 bp, Homo sapiens
aaaagttacatgtttgcac

SEQ ID NO: 2910476 - DNA, 21 bp, Homo sapiens
aaaagttatttatgctataaa

SEQ ID NO: 2910477 - DNA, 15 bp, Homo sapiens
aaaagttccaagagt

SEQ ID NO: 2910478 - DNA, 23 bp, Homo sapiens
aaaagttccaagagtctaaagat

SEQ ID NO: 2910479 - DNA, 21 bp, Homo sapiens
aaaagttcctctcccttccct

SEQ ID NO: 2910480 - DNA, 12 bp, Homo sapiens
aaaagttgttca

SEQ ID NO: 2910481 - DNA, 17 bp, Homo sapiens
aaaagtttctatttagt

SEQ ID NO: 2910482 - DNA, 12 bp, Homo sapiens
aaaagtttgcat

SEQ ID NO: 2910483 - DNA, 17 bp, Homo sapiens
aaaataaaaaacatata

SEQ ID NO: 2910484 - DNA, 15 bp, Homo sapiens
aaaataaaaagttaa

SEQ ID NO: 2910485 - DNA, 16 bp, Homo sapiens
aaaataaaaagttaaa

SEQ ID NO: 2910486 - DNA, 18 bp, Homo sapiens
aaaataaaaatcaaacaa

SEQ ID NO: 2910487 - DNA, 13 bp, Homo sapiens
aaaataaaacaaa

SEQ ID NO: 2910488 - DNA, 15 bp, Homo sapiens
aaaataaaacacatt

SEQ ID NO: 2910489 - DNA, 22 bp, Homo sapiens
aaaataaaccaaatatgttaaa

SEQ ID NO: 2910490 - DNA, 19 bp, Homo sapiens
aaaataaataccaattatg

SEQ ID NO: 2910491 - DNA, 14 bp, Homo sapiens
aaaataaatttata

SEQ ID NO: 2910492 - DNA, 12 bp, Homo sapiens
aaaataactatc

SEQ ID NO: 2910493 - DNA, 13 bp, Homo sapiens
aaaataactgaac

SEQ ID NO: 2910494 - DNA, 21 bp, Homo sapiens
aaaataactgaaccaaattgc

SEQ ID NO: 2910495 - DNA, 22 bp, Homo sapiens
aaaataactgaaccaaattgca

SEQ ID NO: 2910496 - DNA, 16 bp, Homo sapiens
aaaataagttaaaggc

SEQ ID NO: 2910497 - DNA, 12 bp, Homo sapiens
aaaataagtttt

SEQ ID NO: 2910498 - DNA, 23 bp, Homo sapiens
aaaataatactgctgagatacat

SEQ ID NO: 2910499 - DNA, 16 bp, Homo sapiens
aaaataatcaagattt

SEQ ID NO: 2910500 - DNA, 23 bp, Homo sapiens
aaaataatctggtgttcttgcta

SEQ ID NO: 2910501 - DNA, 12 bp, Homo sapiens
aaaataatgtaa

SEQ ID NO: 2910502 - DNA, 16 bp, Homo sapiens
aaaatacaaaaatttg

SEQ ID NO: 2910503 - DNA, 16 bp, Homo sapiens
aaaatacaaacacatg

SEQ ID NO: 2910504 - DNA, 13 bp, Homo sapiens
aaaatactaccta

SEQ ID NO: 2910505 - DNA, 14 bp, Homo sapiens
aaaatactgccaga

SEQ ID NO: 2910506 - DNA, 19 bp, Homo sapiens
aaaatactgccagatgctg

SEQ ID NO: 2910507 - DNA, 15 bp, Homo sapiens
aaaatacttttcctt

SEQ ID NO: 2910508 - DNA, 16 bp, Homo sapiens
aaaatacttttcctta

SEQ ID NO: 2910509 - DNA, 12 bp, Homo sapiens
aaaatagaaaag

SEQ ID NO: 2910510 - DNA, 11 bp, Homo sapiens
aaaatagaaac

SEQ ID NO: 2910511 - DNA, 13 bp, Homo sapiens
aaaatagaaacat

SEQ ID NO: 2910512 - DNA, 15 bp, Homo sapiens
aaaatagaaacatat

SEQ ID NO: 2910513 - DNA, 13 bp, Homo sapiens
aaaatagagcaag

SEQ ID NO: 2910514 - DNA, 24 bp, Homo sapiens
aaaatagaggctttgagcaactaa

SEQ ID NO: 2910515 - DNA, 22 bp, Homo sapiens
aaaatagataagagtagaaact

SEQ ID NO: 2910516 - DNA, 13 bp, Homo sapiens
aaaatagatgttt

SEQ ID NO: 2910517 - DNA, 20 bp, Homo sapiens
aaaatagatgttttaactta

SEQ ID NO: 2910518 - DNA, 17 bp, Homo sapiens
aaaatagcaatcctaaa

SEQ ID NO: 2910519 - DNA, 23 bp, Homo sapiens
aaaatagttaagacatgatttcc

SEQ ID NO: 2910520 - DNA, 13 bp, Homo sapiens
aaaatataaaata

SEQ ID NO: 2910521 - DNA, 11 bp, Homo sapiens
aaaatatactg

SEQ ID NO: 2910522 - DNA, 17 bp, Homo sapiens
aaaatatactgtaaaga

SEQ ID NO: 2910523 - DNA, 12 bp, Homo sapiens
aaaatatcttgg

SEQ ID NO: 2910524 - DNA, 12 bp, Homo sapiens
aaaatatttaaa

SEQ ID NO: 2910525 - DNA, 11 bp, Homo sapiens
aaaatatttca

SEQ ID NO: 2910526 - DNA, 21 bp, Homo sapiens
aaaatatttcctgacttgagt

SEQ ID NO: 2910527 - DNA, 22 bp, Homo sapiens
aaaatatttcctgacttgagtg

SEQ ID NO: 2910528 - DNA, 13 bp, Homo sapiens
aaaatattttgaa

SEQ ID NO: 2910529 - DNA, 16 bp, Homo sapiens
aaaatcaaaaactttt

SEQ ID NO: 2910530 - DNA, 17 bp, Homo sapiens
aaaatcaacctatcaaa

SEQ ID NO: 2910531 - DNA, 12 bp, Homo sapiens
aaaatcaacttt

SEQ ID NO: 2910532 - DNA, 20 bp, Homo sapiens
aaaatcaactttttattgcc

SEQ ID NO: 2910533 - DNA, 22 bp, Homo sapiens
aaaatcaactttttattgcctt

SEQ ID NO: 2910534 - DNA, 14 bp, Homo sapiens
aaaatcacttgatt

SEQ ID NO: 2910535 - DNA, 16 bp, Homo sapiens
aaaatcagtttcttac

SEQ ID NO: 2910536 - DNA, 12 bp, Homo sapiens
aaaatcatgaga

SEQ ID NO: 2910537 - DNA, 13 bp, Homo sapiens
aaaatcatggaat

SEQ ID NO: 2910538 - DNA, 14 bp, Homo sapiens
aaaatccaaaaaga

SEQ ID NO: 2910539 - DNA, 16 bp, Homo sapiens
aaaatccaaactgctg

SEQ ID NO: 2910540 - DNA, 18 bp, Homo sapiens
aaaatccccatgcctgtg

SEQ ID NO: 2910541 - DNA, 18 bp, Homo sapiens
aaaatcgccataggccaa

SEQ ID NO: 2910542 - DNA, 16 bp, Homo sapiens
aaaatctcttgattat

SEQ ID NO: 2910543 - DNA, 21 bp, Homo sapiens
aaaatctcttgattataaatg

SEQ ID NO: 2910544 - DNA, 16 bp, Homo sapiens
aaaatctgagaaactc

SEQ ID NO: 2910545 - DNA, 16 bp, Homo sapiens
aaaatcttcagctggt

SEQ ID NO: 2910546 - DNA, 13 bp, Homo sapiens
aaaatctttcttt

SEQ ID NO: 2910547 - DNA, 12 bp, Homo sapiens
aaaatgaaagaa

SEQ ID NO: 2910548 - DNA, 15 bp, Homo sapiens
aaaatgaaagatgat

SEQ ID NO: 2910549 - DNA, 16 bp, Homo sapiens
aaaatgaactgtatta

SEQ ID NO: 2910550 - DNA, 19 bp, Homo sapiens
aaaatgaactgtattattg

SEQ ID NO: 2910551 - DNA, 21 bp, Homo sapiens
aaaatgaagaaggaagctgtg

SEQ ID NO: 2910552 - DNA, 14 bp, Homo sapiens
aaaatgaatagctt

SEQ ID NO: 2910553 - DNA, 14 bp, Homo sapiens
aaaatgagaaagga

SEQ ID NO: 2910554 - DNA, 23 bp, Homo sapiens
aaaatgagctcgcatttgtcaat

SEQ ID NO: 2910555 - DNA, 22 bp, Homo sapiens
aaaatgagtcaggcaattgatt

SEQ ID NO: 2910556 - DNA, 17 bp, Homo sapiens
aaaatgatcctcagtgc

SEQ ID NO: 2910557 - DNA, 16 bp, Homo sapiens
aaaatgatgcaaccaa

SEQ ID NO: 2910558 - DNA, 18 bp, Homo sapiens
aaaatgcagcagggatgc

SEQ ID NO: 2910559 - DNA, 18 bp, Homo sapiens
aaaatgctttttatttct

SEQ ID NO: 2910560 - DNA, 22 bp, Homo sapiens
aaaatgctttttatttctgcat

SEQ ID NO: 2910561 - DNA, 20 bp, Homo sapiens
aaaatggaaaaaaacataaa

SEQ ID NO: 2910562 - DNA, 18 bp, Homo sapiens
aaaatggaaaagagagat

SEQ ID NO: 2910563 - DNA, 16 bp, Homo sapiens
aaaatggaaccaggct

SEQ ID NO: 2910564 - DNA, 20 bp, Homo sapiens
aaaatggaagccaacacatc

SEQ ID NO: 2910565 - DNA, 16 bp, Homo sapiens
aaaatggaggtggaaa

SEQ ID NO: 2910566 - DNA, 22 bp, Homo sapiens
aaaatggattttagtcaaatat

SEQ ID NO: 2910567 - DNA, 14 bp, Homo sapiens
aaaatggcagtgat

SEQ ID NO: 2910568 - DNA, 17 bp, Homo sapiens
aaaatggcgaacatgtg

SEQ ID NO: 2910569 - DNA, 19 bp, Homo sapiens
aaaatggcgaacatgtgtt

SEQ ID NO: 2910570 - DNA, 21 bp, Homo sapiens
aaaatgggacttcttttcaca

SEQ ID NO: 2910571 - DNA, 15 bp, Homo sapiens
aaaatggtataagta

SEQ ID NO: 2910572 - DNA, 18 bp, Homo sapiens
aaaatggtataagtaact

SEQ ID NO: 2910573 - DNA, 15 bp, Homo sapiens
aaaatggtggcttca

SEQ ID NO: 2910574 - DNA, 13 bp, Homo sapiens
aaaatgtaaaaaa

SEQ ID NO: 2910575 - DNA, 16 bp, Homo sapiens
aaaggagcgggcaggg

SEQ ID NO: 2910576 - DNA, 19 bp, Homo sapiens
aaaggagtttaaaaacatt

SEQ ID NO: 2910577 - DNA, 17 bp, Homo sapiens
aaaggatatgaaactct

SEQ ID NO: 2910578 - DNA, 20 bp, Homo sapiens
aaaggatgtaaacagtgcct

SEQ ID NO: 2910579 - DNA, 21 bp, Homo sapiens
aaaggatgtaaacagtgcctg

SEQ ID NO: 2910580 - DNA, 16 bp, Homo sapiens
aaaggatgttggtgtt

SEQ ID NO: 2910581 - DNA, 20 bp, Homo sapiens
aaaggatttgatgcttttct

SEQ ID NO: 2910582 - DNA, 17 bp, Homo sapiens
aaaggcaaatgtgtaca

SEQ ID NO: 2910583 - DNA, 15 bp, Homo sapiens
aaaggcaagccagca

SEQ ID NO: 2910584 - DNA, 12 bp, Homo sapiens
aaaggcacagtg

SEQ ID NO: 2910585 - DNA, 18 bp, Homo sapiens
aaaggcattctctgaaga

SEQ ID NO: 2910586 - DNA, 15 bp, Homo sapiens
aaaggccgtgtgttt

SEQ ID NO: 2910587 - DNA, 19 bp, Homo sapiens
aaaggctttggcaacagaa

SEQ ID NO: 2910588 - DNA, 12 bp, Homo sapiens
aaagggaaaaaa

SEQ ID NO: 2910589 - DNA, 13 bp, Homo sapiens
aaagggacttttg

SEQ ID NO: 2910590 - DNA, 16 bp, Homo sapiens
aaagggcagaggaaga

SEQ ID NO: 2910591 - DNA, 14 bp, Homo sapiens
aaagggcagccctc

SEQ ID NO: 2910592 - DNA, 20 bp, Homo sapiens
aaagggcgcaaagggcatgg

SEQ ID NO: 2910593 - DNA, 15 bp, Homo sapiens
aaagggtcaaacctg

SEQ ID NO: 2910594 - DNA, 17 bp, Homo sapiens
aaagggtcttgggaaat

SEQ ID NO: 2910595 - DNA, 14 bp, Homo sapiens
aaagggttaatcat

SEQ ID NO: 2910596 - DNA, 14 bp, Homo sapiens
aaaggtatgaaaat

SEQ ID NO: 2910597 - DNA, 12 bp, Homo sapiens
aaaggtatttgg

SEQ ID NO: 2910598 - DNA, 20 bp, Homo sapiens
aaaggtccacaggtctagac

SEQ ID NO: 2910599 - DNA, 21 bp, Homo sapiens
aaaggtccacaggtctagact

SEQ ID NO: 2910600 - DNA, 18 bp, Homo sapiens
aaaggtggtgaggcaata

SEQ ID NO: 2910601 - DNA, 18 bp, Homo sapiens
aaaggtgttgtcccttct

SEQ ID NO: 2910602 - DNA, 20 bp, Homo sapiens
aaaggttctaggtttcaaag

SEQ ID NO: 2910603 - DNA, 16 bp, Homo sapiens
aaaggtttacagaatt

SEQ ID NO: 2910604 - DNA, 23 bp, Homo sapiens
aaaggtttttaaagtaaatctct

SEQ ID NO: 2910605 - DNA, 11 bp, Homo sapiens
aaagtactgta

SEQ ID NO: 2910606 - DNA, 12 bp, Homo sapiens
aaagtactgtaa

SEQ ID NO: 2910607 - DNA, 20 bp, Homo sapiens
aaagtaggaactcttaagca

SEQ ID NO: 2910608 - DNA, 14 bp, Homo sapiens
aaagtagtaaaaat

SEQ ID NO: 2910609 - DNA, 16 bp, Homo sapiens
aaagtatgttgtatat

SEQ ID NO: 2910610 - DNA, 22 bp, Homo sapiens
aaagtattcttctcttcctttt

SEQ ID NO: 2910611 - DNA, 15 bp, Homo sapiens
aaagtattgtaaatt

SEQ ID NO: 2910612 - DNA, 20 bp, Homo sapiens
aaagtattgtaaattatatt

SEQ ID NO: 2910613 - DNA, 21 bp, Homo sapiens
aaagtattgtaaattatattt

SEQ ID NO: 2910614 - DNA, 14 bp, Homo sapiens
aaagtattttcctg

SEQ ID NO: 2910615 - DNA, 21 bp, Homo sapiens
aaagtattttcctgtaaaaaa

SEQ ID NO: 2910616 - DNA, 20 bp, Homo sapiens
aaagtcaaaaggtgcctgtg

SEQ ID NO: 2910617 - DNA, 18 bp, Homo sapiens
aaagtccttttcttgctt

SEQ ID NO: 2910618 - DNA, 18 bp, Homo sapiens
aaagtcctttttttccat

SEQ ID NO: 2910619 - DNA, 18 bp, Homo sapiens
aaagtctctaattctatt

SEQ ID NO: 2910620 - DNA, 19 bp, Homo sapiens
aaagtgaaagacatttcaa

SEQ ID NO: 2910621 - DNA, 13 bp, Homo sapiens
aaagtgaagcaaa

SEQ ID NO: 2910622 - DNA, 23 bp, Homo sapiens
aaagtgacagatgttatttttgt

SEQ ID NO: 2910623 - DNA, 14 bp, Homo sapiens
aaagtgagtactgt

SEQ ID NO: 2910624 - DNA, 18 bp, Homo sapiens
aaagtgcatatttatcca

SEQ ID NO: 2910625 - DNA, 13 bp, Homo sapiens
aaagtgccaaaga

SEQ ID NO: 2910626 - DNA, 13 bp, Homo sapiens
aaagtgctaaggt

SEQ ID NO: 2910627 - DNA, 17 bp, Homo sapiens
aaagtgctaaggttcta

SEQ ID NO: 2910628 - DNA, 18 bp, Homo sapiens
aaagtgctaaggttctaa

SEQ ID NO: 2910629 - DNA, 12 bp, Homo sapiens
aaagtgctggga

SEQ ID NO: 2910630 - DNA, 15 bp, Homo sapiens
aaagtgctgtttaga

SEQ ID NO: 2910631 - DNA, 21 bp, Homo sapiens
aaagtgcttcaagggtaatct

SEQ ID NO: 2910632 - DNA, 20 bp, Homo sapiens
aaagtggaaaacaaggaagt

SEQ ID NO: 2910633 - DNA, 16 bp, Homo sapiens
aaagtggcctctttgt

SEQ ID NO: 2910634 - DNA, 19 bp, Homo sapiens
aaagtggtgctcagttgta

SEQ ID NO: 2910635 - DNA, 12 bp, Homo sapiens
aaagtgtaaagc

SEQ ID NO: 2910636 - DNA, 13 bp, Homo sapiens
aaagtgtaaagca

SEQ ID NO: 2910637 - DNA, 17 bp, Homo sapiens
aaagtgtaaagcattcc

SEQ ID NO: 2910638 - DNA, 18 bp, Homo sapiens
aaagtgtcaccttttctt

SEQ ID NO: 2910639 - DNA, 11 bp, Homo sapiens
aaagtgtcatc

SEQ ID NO: 2910640 - DNA, 18 bp, Homo sapiens
aaagtgtgagcaaactaa

SEQ ID NO: 2910641 - DNA, 13 bp, Homo sapiens
aaagttaaatgta

SEQ ID NO: 2910642 - DNA, 22 bp, Homo sapiens
aaagttactgattcactgcatg

SEQ ID NO: 2910643 - DNA, 24 bp, Homo sapiens
aaagttatatttcagatgtaatgt

SEQ ID NO: 2910644 - DNA, 18 bp, Homo sapiens
aaagttattagtggttta

SEQ ID NO: 2910645 - DNA, 14 bp, Homo sapiens
aaagttatttatgc

SEQ ID NO: 2910646 - DNA, 15 bp, Homo sapiens
aaagttatttatgct

SEQ ID NO: 2910647 - DNA, 15 bp, Homo sapiens
aaagttcagagtttt

SEQ ID NO: 2910648 - DNA, 16 bp, Homo sapiens
aaagttccaagagtct

SEQ ID NO: 2910649 - DNA, 20 bp, Homo sapiens
aaagttccaagagtctaaag

SEQ ID NO: 2910650 - DNA, 17 bp, Homo sapiens
aaagttctaagattctg

SEQ ID NO: 2910651 - DNA, 18 bp, Homo sapiens
aaagttctaataatttct

SEQ ID NO: 2910652 - DNA, 20 bp, Homo sapiens
aaagttctaataatttctaa

SEQ ID NO: 2910653 - DNA, 17 bp, Homo sapiens
aaagttctgtaaaatat

SEQ ID NO: 2910654 - DNA, 21 bp, Homo sapiens
aaagttctgtactcaaatgta

SEQ ID NO: 2910655 - DNA, 24 bp, Homo sapiens
aaagttgagagacagtaacacaat

SEQ ID NO: 2910656 - DNA, 18 bp, Homo sapiens
aaagttgtgccaaactat

SEQ ID NO: 2910657 - DNA, 16 bp, Homo sapiens
aaagttgttcaactat

SEQ ID NO: 2910658 - DNA, 23 bp, Homo sapiens
aaagtttcacaggtcaataaact

SEQ ID NO: 2910659 - DNA, 15 bp, Homo sapiens
aaagtttgcttagaa

SEQ ID NO: 2910660 - DNA, 17 bp, Homo sapiens
aaagtttggttttgaca

SEQ ID NO: 2910661 - DNA, 21 bp, Homo sapiens
aaagtttgttactttgaatag

SEQ ID NO: 2910662 - DNA, 16 bp, Homo sapiens
aaagttttattataaa

SEQ ID NO: 2910663 - DNA, 13 bp, Homo sapiens
aaataaaaagtta

SEQ ID NO: 2910664 - DNA, 14 bp, Homo sapiens
aaataaaaagttaa

SEQ ID NO: 2910665 - DNA, 12 bp, Homo sapiens
aaataaaataaa

SEQ ID NO: 2910666 - DNA, 17 bp, Homo sapiens
aaataaaatttgttgca

SEQ ID NO: 2910667 - DNA, 13 bp, Homo sapiens
aaataaaccaaat

SEQ ID NO: 2910668 - DNA, 15 bp, Homo sapiens
aaataaaccaaatat

SEQ ID NO: 2910669 - DNA, 16 bp, Homo sapiens
aaataaagtctatttt

SEQ ID NO: 2910670 - DNA, 21 bp, Homo sapiens
aaataaataccaattatggaa

SEQ ID NO: 2910671 - DNA, 13 bp, Homo sapiens
aaataaatgtttc

SEQ ID NO: 2910672 - DNA, 15 bp, Homo sapiens
aaataaattctctcc

SEQ ID NO: 2910673 - DNA, 16 bp, Homo sapiens
aaataaatttatatga

SEQ ID NO: 2910674 - DNA, 21 bp, Homo sapiens
aaataacaagtcgatgaacta

SEQ ID NO: 2910675 - DNA, 21 bp, Homo sapiens
aaataacatgtttctctataa

SEQ ID NO: 2910676 - DNA, 20 bp, Homo sapiens
aaataactatataagacatt

SEQ ID NO: 2910677 - DNA, 21 bp, Homo sapiens
aaataactatataagacatta

SEQ ID NO: 2910678 - DNA, 17 bp, Homo sapiens
aaataactatcaggcag

SEQ ID NO: 2910679 - DNA, 17 bp, Homo sapiens
aaataactgaaccaaat

SEQ ID NO: 2910680 - DNA, 18 bp, Homo sapiens
aaataagtatttctgatt

SEQ ID NO: 2910681 - DNA, 17 bp, Homo sapiens
aaataagtcaaaaggaa

SEQ ID NO: 2910682 - DNA, 16 bp, Homo sapiens
aaataagtcaccattg

SEQ ID NO: 2910683 - DNA, 12 bp, Homo sapiens
aaataagttaaa

SEQ ID NO: 2910684 - DNA, 17 bp, Homo sapiens
aaataagttaaaggcag

SEQ ID NO: 2910685 - DNA, 15 bp, Homo sapiens
aaataatatgtaaat

SEQ ID NO: 2910686 - DNA, 18 bp, Homo sapiens
aaataatcaagattttag

SEQ ID NO: 2910687 - DNA, 14 bp, Homo sapiens
aaataatctggtgt

SEQ ID NO: 2910688 - DNA, 15 bp, Homo sapiens
aaataatttaagttg

SEQ ID NO: 2910689 - DNA, 17 bp, Homo sapiens
aaataatttattttgct

SEQ ID NO: 2910690 - DNA, 18 bp, Homo sapiens
aaataatttattttgctc

SEQ ID NO: 2910691 - DNA, 20 bp, Homo sapiens
aaataattttaaaaatggtg

SEQ ID NO: 2910692 - DNA, 12 bp, Homo sapiens
aaatacaaatct

SEQ ID NO: 2910693 - DNA, 13 bp, Homo sapiens
aaatacaaatctg

SEQ ID NO: 2910694 - DNA, 18 bp, Homo sapiens
aaatacaaatctgtataa

SEQ ID NO: 2910695 - DNA, 19 bp, Homo sapiens
aaatacaaatctgtataaa

SEQ ID NO: 2910696 - DNA, 19 bp, Homo sapiens
aaatacaacttaaataata

SEQ ID NO: 2910697 - DNA, 21 bp, Homo sapiens
aaatacaagttaaggtatctg

SEQ ID NO: 2910698 - DNA, 19 bp, Homo sapiens
aaatacaattattgtatat

SEQ ID NO: 2910699 - DNA, 22 bp, Homo sapiens
aaatacagtcttccatttgcaa

SEQ ID NO: 2910700 - DNA, 20 bp, Homo sapiens
aaatacatcctttttctgct

SEQ ID NO: 2910701 - DNA, 16 bp, Homo sapiens
aaataccttgagcaga

SEQ ID NO: 2910702 - DNA, 18 bp, Homo sapiens
aaatactaactgctgatt

SEQ ID NO: 2910703 - DNA, 20 bp, Homo sapiens
aaatactaactgctgatttt

SEQ ID NO: 2910704 - DNA, 13 bp, Homo sapiens
aaatactacctat

SEQ ID NO: 2910705 - DNA, 15 bp, Homo sapiens
aaatactgacaatgt

SEQ ID NO: 2910706 - DNA, 16 bp, Homo sapiens
aaatactgacaatgta

SEQ ID NO: 2910707 - DNA, 17 bp, Homo sapiens
aaatactgacaatgtat

SEQ ID NO: 2910708 - DNA, 18 bp, Homo sapiens
aaccagtccccccaccct

SEQ ID NO: 2910709 - DNA, 22 bp, Homo sapiens
aaccagtccccccaccctcatt

SEQ ID NO: 2910710 - DNA, 12 bp, Homo sapiens
aaccagttgtgg

SEQ ID NO: 2910711 - DNA, 20 bp, Homo sapiens
aaccagttgtggtgtgagta

SEQ ID NO: 2910712 - DNA, 21 bp, Homo sapiens
aaccagttgtggtgtgagtat

SEQ ID NO: 2910713 - DNA, 17 bp, Homo sapiens
aaccagttttgctgcta

SEQ ID NO: 2910714 - DNA, 16 bp, Homo sapiens
aaccatcagaattcag

SEQ ID NO: 2910715 - DNA, 23 bp, Homo sapiens
aaccattgatgagcactcctgat

SEQ ID NO: 2910716 - DNA, 17 bp, Homo sapiens
aaccattttataaagtg

SEQ ID NO: 2910717 - DNA, 21 bp, Homo sapiens
aaccatttttagaaggaaaaa

SEQ ID NO: 2910718 - DNA, 15 bp, Homo sapiens
aaccatttttgaacc

SEQ ID NO: 2910719 - DNA, 17 bp, Homo sapiens
aaccatttttgaacctt

SEQ ID NO: 2910720 - DNA, 14 bp, Homo sapiens
aacccaaactctcc

SEQ ID NO: 2910721 - DNA, 14 bp, Homo sapiens
aacccaatccaaat

SEQ ID NO: 2910722 - DNA, 18 bp, Homo sapiens
aacccacaagctgcctct

SEQ ID NO: 2910723 - DNA, 22 bp, Homo sapiens
aacccacaagctgcctctgaca

SEQ ID NO: 2910724 - DNA, 23 bp, Homo sapiens
aacccagacctgttagcagacag

SEQ ID NO: 2910725 - DNA, 18 bp, Homo sapiens
aacccagactcagacatt

SEQ ID NO: 2910726 - DNA, 16 bp, Homo sapiens
aacccaggacctctgg

SEQ ID NO: 2910727 - DNA, 21 bp, Homo sapiens
aacccaggccacaaatgtgtc

SEQ ID NO: 2910728 - DNA, 19 bp, Homo sapiens
aacccataggcccacacac

SEQ ID NO: 2910729 - DNA, 21 bp, Homo sapiens
aacccataggcccacacacag

SEQ ID NO: 2910730 - DNA, 15 bp, Homo sapiens
aacccatcagaagga

SEQ ID NO: 2910731 - DNA, 17 bp, Homo sapiens
aacccatcagaaggaga

SEQ ID NO: 2910732 - DNA, 17 bp, Homo sapiens
aacccattaatcttttg

SEQ ID NO: 2910733 - DNA, 12 bp, Homo sapiens
aaccccacccag

SEQ ID NO: 2910734 - DNA, 16 bp, Homo sapiens
aaccccacccagctcc

SEQ ID NO: 2910735 - DNA, 13 bp, Homo sapiens
aacccctccccca

SEQ ID NO: 2910736 - DNA, 15 bp, Homo sapiens
aaccccttctctgtg

SEQ ID NO: 2910737 - DNA, 20 bp, Homo sapiens
aaccccttctctgtgaccca

SEQ ID NO: 2910738 - DNA, 16 bp, Homo sapiens
aacccgggggacagag

SEQ ID NO: 2910739 - DNA, 21 bp, Homo sapiens
aaccctatactgtagtattct

SEQ ID NO: 2910740 - DNA, 19 bp, Homo sapiens
aacccttcaacgtttcttc

SEQ ID NO: 2910741 - DNA, 20 bp, Homo sapiens
aacccttctcctcttgtaaa

SEQ ID NO: 2910742 - DNA, 21 bp, Homo sapiens
aacccttttcatcctggctgg

SEQ ID NO: 2910743 - DNA, 17 bp, Homo sapiens
aaccgatgctttaccaa

SEQ ID NO: 2910744 - DNA, 14 bp, Homo sapiens
aaccgcaggaagct

SEQ ID NO: 2910745 - DNA, 15 bp, Homo sapiens
aacctaacccctttc

SEQ ID NO: 2910746 - DNA, 11 bp, Homo sapiens
aacctaacctg

SEQ ID NO: 2910747 - DNA, 14 bp, Homo sapiens
aacctaacctgtgt

SEQ ID NO: 2910748 - DNA, 18 bp, Homo sapiens
aacctaacctgtgtctgc

SEQ ID NO: 2910749 - DNA, 15 bp, Homo sapiens
aacctaactgtatct

SEQ ID NO: 2910750 - DNA, 14 bp, Homo sapiens
aacctactgtctaa

SEQ ID NO: 2910751 - DNA, 19 bp, Homo sapiens
aacctaggagtgccccatt

SEQ ID NO: 2910752 - DNA, 20 bp, Homo sapiens
aacctagtttgttactttaa

SEQ ID NO: 2910753 - DNA, 21 bp, Homo sapiens
aacctatttttttctcccttt

SEQ ID NO: 2910754 - DNA, 23 bp, Homo sapiens
aacctcaccccgaggccctgcat

SEQ ID NO: 2910755 - DNA, 18 bp, Homo sapiens
aacctcagagtatcttta

SEQ ID NO: 2910756 - DNA, 19 bp, Homo sapiens
aacctcagagtatctttac

SEQ ID NO: 2910757 - DNA, 14 bp, Homo sapiens
aacctcagcctggc

SEQ ID NO: 2910758 - DNA, 16 bp, Homo sapiens
aacctcagcctggcca

SEQ ID NO: 2910759 - DNA, 20 bp, Homo sapiens
aacctcagcctggccagaca

SEQ ID NO: 2910760 - DNA, 13 bp, Homo sapiens
aacctcctctgtg

SEQ ID NO: 2910761 - DNA, 14 bp, Homo sapiens
aacctcctctgtga

SEQ ID NO: 2910762 - DNA, 15 bp, Homo sapiens
aacctcctctgtgaa

SEQ ID NO: 2910763 - DNA, 13 bp, Homo sapiens
aacctcctgggtt

SEQ ID NO: 2910764 - DNA, 15 bp, Homo sapiens
aacctcgagtactgt

SEQ ID NO: 2910765 - DNA, 14 bp, Homo sapiens
aacctcggggtggg

SEQ ID NO: 2910766 - DNA, 18 bp, Homo sapiens
aacctctgcttcccaggt

SEQ ID NO: 2910767 - DNA, 15 bp, Homo sapiens
aacctctgttcagtg

SEQ ID NO: 2910768 - DNA, 16 bp, Homo sapiens
aacctctgttcagtgt

SEQ ID NO: 2910769 - DNA, 18 bp, Homo sapiens
aacctcttcagaggccct

SEQ ID NO: 2910770 - DNA, 17 bp, Homo sapiens
aacctcttctggctcaa

SEQ ID NO: 2910771 - DNA, 15 bp, Homo sapiens
aacctgaacctagga

SEQ ID NO: 2910772 - DNA, 20 bp, Homo sapiens
aacctgaaggtcccctggca

SEQ ID NO: 2910773 - DNA, 16 bp, Homo sapiens
aacctgcaaaatctgt

SEQ ID NO: 2910774 - DNA, 11 bp, Homo sapiens
aacctgcattt

SEQ ID NO: 2910775 - DNA, 23 bp, Homo sapiens
aacctgcatttttaaaggacaaa

SEQ ID NO: 2910776 - DNA, 13 bp, Homo sapiens
aacctgctccctt

SEQ ID NO: 2910777 - DNA, 22 bp, Homo sapiens
aacctgctcccttcgctctgct

SEQ ID NO: 2910778 - DNA, 14 bp, Homo sapiens
aacctgtagatgca

SEQ ID NO: 2910779 - DNA, 22 bp, Homo sapiens
aacctgtagatgcagaaaaaga

SEQ ID NO: 2910780 - DNA, 19 bp, Homo sapiens
aacctgtaggatcttattt

SEQ ID NO: 2910781 - DNA, 22 bp, Homo sapiens
aacctgtaggatcttatttgga

SEQ ID NO: 2910782 - DNA, 21 bp, Homo sapiens
aacctgtccttactcagagct

SEQ ID NO: 2910783 - DNA, 14 bp, Homo sapiens
aacctgtgcctccc

SEQ ID NO: 2910784 - DNA, 12 bp, Homo sapiens
aacctgtgtctg

SEQ ID NO: 2910785 - DNA, 21 bp, Homo sapiens
aacctgtgtctgcgaagtcct

SEQ ID NO: 2910786 - DNA, 22 bp, Homo sapiens
aacctgtgtctgcgaagtccta

SEQ ID NO: 2910787 - DNA, 18 bp, Homo sapiens
aacctgtttttttttcat

SEQ ID NO: 2910788 - DNA, 22 bp, Homo sapiens
aaccttcctttttttaaatttt

SEQ ID NO: 2910789 - DNA, 14 bp, Homo sapiens
aaccttgggccctg

SEQ ID NO: 2910790 - DNA, 15 bp, Homo sapiens
aaccttgtttgtttt

SEQ ID NO: 2910791 - DNA, 15 bp, Homo sapiens
aacctttaaaaatgt

SEQ ID NO: 2910792 - DNA, 17 bp, Homo sapiens
aacctttaaaaatgtat

SEQ ID NO: 2910793 - DNA, 13 bp, Homo sapiens
aacctttccattt

SEQ ID NO: 2910794 - DNA, 12 bp, Homo sapiens
aacctttctgac

SEQ ID NO: 2910795 - DNA, 22 bp, Homo sapiens
aaccttttatcaataaagcact

SEQ ID NO: 2910796 - DNA, 17 bp, Homo sapiens
aacgaaaacctgactag

SEQ ID NO: 2910797 - DNA, 15 bp, Homo sapiens
aacgaagataaatca

SEQ ID NO: 2910798 - DNA, 18 bp, Homo sapiens
aacgagcctggaagcact

SEQ ID NO: 2910799 - DNA, 16 bp, Homo sapiens
aacgcagaagaggggg

SEQ ID NO: 2910800 - DNA, 14 bp, Homo sapiens
aacgcgaaaccaat

SEQ ID NO: 2910801 - DNA, 13 bp, Homo sapiens
aacgctgcctgcc

SEQ ID NO: 2910802 - DNA, 19 bp, Homo sapiens
aacggagagcgcctgcccc

SEQ ID NO: 2910803 - DNA, 21 bp, Homo sapiens
aacggatgctccgaggactgg

SEQ ID NO: 2910804 - DNA, 20 bp, Homo sapiens
aacggccctgcaggagcagg

SEQ ID NO: 2910805 - DNA, 19 bp, Homo sapiens
aacgggggggttctccccc

SEQ ID NO: 2910806 - DNA, 16 bp, Homo sapiens
aacgtatgtatttcat

SEQ ID NO: 2910807 - DNA, 16 bp, Homo sapiens
aacgtcacccaaaagc

SEQ ID NO: 2910808 - DNA, 17 bp, Homo sapiens
aacgtcacccaaaagca

SEQ ID NO: 2910809 - DNA, 18 bp, Homo sapiens
aacgtcacccaaaagcac

SEQ ID NO: 2910810 - DNA, 20 bp, Homo sapiens
aacgtccatctctctccctt

SEQ ID NO: 2910811 - DNA, 16 bp, Homo sapiens
aacgtgccagcagccc

SEQ ID NO: 2910812 - DNA, 15 bp, Homo sapiens
aacgtggctctgctg

SEQ ID NO: 2910813 - DNA, 16 bp, Homo sapiens
aacgtggctctgctgg

SEQ ID NO: 2910814 - DNA, 17 bp, Homo sapiens
aacgtggctctgctggc

SEQ ID NO: 2910815 - DNA, 18 bp, Homo sapiens
aacgtgggattcagagaa

SEQ ID NO: 2910816 - DNA, 17 bp, Homo sapiens
aacgtgggttcaatttg

SEQ ID NO: 2910817 - DNA, 18 bp, Homo sapiens
aacgttgatgtaatgaaa

SEQ ID NO: 2910818 - DNA, 17 bp, Homo sapiens
aactaaactcatttata

SEQ ID NO: 2910819 - DNA, 18 bp, Homo sapiens
aactaaactcatttataa

SEQ ID NO: 2910820 - DNA, 16 bp, Homo sapiens
aactaaagttgtacct

SEQ ID NO: 2910821 - DNA, 21 bp, Homo sapiens
aactaaatgagacctaataat

SEQ ID NO: 2910822 - DNA, 14 bp, Homo sapiens
aactaaatgtgtac

SEQ ID NO: 2910823 - DNA, 20 bp, Homo sapiens
aactaacacgtgatgtgata

SEQ ID NO: 2910824 - DNA, 15 bp, Homo sapiens
aactaaggtgctaaa

SEQ ID NO: 2910825 - DNA, 18 bp, Homo sapiens
aactaaggtgctaaatct

SEQ ID NO: 2910826 - DNA, 17 bp, Homo sapiens
aactacctatattcctt

SEQ ID NO: 2910827 - DNA, 20 bp, Homo sapiens
aactacctcgcatcattgca

SEQ ID NO: 2910828 - DNA, 21 bp, Homo sapiens
aactacctgtatttaaaaata

SEQ ID NO: 2910829 - DNA, 20 bp, Homo sapiens
aactactgtagaactgattt

SEQ ID NO: 2910830 - DNA, 17 bp, Homo sapiens
aactagacaccaaagtt

SEQ ID NO: 2910831 - DNA, 12 bp, Homo sapiens
aactagagaagg

SEQ ID NO: 2910832 - DNA, 13 bp, Homo sapiens
aactagagaaggg

SEQ ID NO: 2910833 - DNA, 17 bp, Homo sapiens
aactagatgacctcatt

SEQ ID NO: 2910834 - DNA, 20 bp, Homo sapiens
aactagctctatgtttacaa

SEQ ID NO: 2910835 - DNA, 15 bp, Homo sapiens
aactagttttgttta

SEQ ID NO: 2910836 - DNA, 15 bp, Homo sapiens
aactataaagtttta

SEQ ID NO: 2910837 - DNA, 22 bp, Homo sapiens
aactataaagttttatttgaat

SEQ ID NO: 2910838 - DNA, 12 bp, Homo sapiens
aactataaatac

SEQ ID NO: 2910839 - DNA, 14 bp, Homo sapiens
aactataacaaaaa

SEQ ID NO: 2910840 - DNA, 21 bp, Homo sapiens
aactataacaaaaaaagaaaa

SEQ ID NO: 2910841 - DNA, 14 bp, Homo sapiens
aagatggagtttct

SEQ ID NO: 2910842 - DNA, 15 bp, Homo sapiens
aagatggagtttcta

SEQ ID NO: 2910843 - DNA, 18 bp, Homo sapiens
aagatggagtttctaagg

SEQ ID NO: 2910844 - DNA, 13 bp, Homo sapiens
aagatgggaggag

SEQ ID NO: 2910845 - DNA, 23 bp, Homo sapiens
aagatggtgctgggtaataaaat

SEQ ID NO: 2910846 - DNA, 14 bp, Homo sapiens
aagatgtatatagg

SEQ ID NO: 2910847 - DNA, 11 bp, Homo sapiens
aagatgtctgt

SEQ ID NO: 2910848 - DNA, 20 bp, Homo sapiens
aagatgtctgtttgctgatg

SEQ ID NO: 2910849 - DNA, 14 bp, Homo sapiens
aagatgtgaaaact

SEQ ID NO: 2910850 - DNA, 14 bp, Homo sapiens
aagatgtgatattc

SEQ ID NO: 2910851 - DNA, 17 bp, Homo sapiens
aagatgtgatattctaa

SEQ ID NO: 2910852 - DNA, 22 bp, Homo sapiens
aagatgttgatttttactgtgt

SEQ ID NO: 2910853 - DNA, 21 bp, Homo sapiens
aagatgtttgtttacataaga

SEQ ID NO: 2910854 - DNA, 17 bp, Homo sapiens
aagattactttttcttt

SEQ ID NO: 2910855 - DNA, 11 bp, Homo sapiens
aagattagaag

SEQ ID NO: 2910856 - DNA, 14 bp, Homo sapiens
aagattatagattc

SEQ ID NO: 2910857 - DNA, 16 bp, Homo sapiens
aagattatagattcta

SEQ ID NO: 2910858 - DNA, 20 bp, Homo sapiens
aagattatagattctaaaga

SEQ ID NO: 2910859 - DNA, 18 bp, Homo sapiens
aagattcaaatctcttgc

SEQ ID NO: 2910860 - DNA, 20 bp, Homo sapiens
aagattcatttttaatcatg

SEQ ID NO: 2910861 - DNA, 21 bp, Homo sapiens
aagattcatttttaatcatga

SEQ ID NO: 2910862 - DNA, 13 bp, Homo sapiens
aagattcccagag

SEQ ID NO: 2910863 - DNA, 19 bp, Homo sapiens
aagattcccagagacagga

SEQ ID NO: 2910864 - DNA, 20 bp, Homo sapiens
aagattcccagagacaggaa

SEQ ID NO: 2910865 - DNA, 17 bp, Homo sapiens
aagattcctgtccttca

SEQ ID NO: 2910866 - DNA, 11 bp, Homo sapiens
aagattctaaa

SEQ ID NO: 2910867 - DNA, 14 bp, Homo sapiens
aagattctaatgat

SEQ ID NO: 2910868 - DNA, 13 bp, Homo sapiens
aagattctagatc

SEQ ID NO: 2910869 - DNA, 20 bp, Homo sapiens
aagattctagatcagatgct

SEQ ID NO: 2910870 - DNA, 13 bp, Homo sapiens
aagattctttccc

SEQ ID NO: 2910871 - DNA, 16 bp, Homo sapiens
aagattctttcccaat

SEQ ID NO: 2910872 - DNA, 20 bp, Homo sapiens
aagattgaaaaaaataaatt

SEQ ID NO: 2910873 - DNA, 18 bp, Homo sapiens
aagattgaaatttgaact

SEQ ID NO: 2910874 - DNA, 23 bp, Homo sapiens
aagattgtattactttaatgatt

SEQ ID NO: 2910875 - DNA, 17 bp, Homo sapiens
aagatttatcaaatcag

SEQ ID NO: 2910876 - DNA, 17 bp, Homo sapiens
aagatttctaaataaaa

SEQ ID NO: 2910877 - DNA, 20 bp, Homo sapiens
aagattttattgtataaaaa

SEQ ID NO: 2910878 - DNA, 23 bp, Homo sapiens
aagattttattgtataaaaagtt

SEQ ID NO: 2910879 - DNA, 17 bp, Homo sapiens
aagattttggtaatgat

SEQ ID NO: 2910880 - DNA, 12 bp, Homo sapiens
aagatttttaaa

SEQ ID NO: 2910881 - DNA, 13 bp, Homo sapiens
aagatttttcttt

SEQ ID NO: 2910882 - DNA, 13 bp, Homo sapiens
aagcaaaaatgct

SEQ ID NO: 2910883 - DNA, 16 bp, Homo sapiens
aagcaaaaatgctaat

SEQ ID NO: 2910884 - DNA, 13 bp, Homo sapiens
aagcaaaatcctg

SEQ ID NO: 2910885 - DNA, 16 bp, Homo sapiens
aagcaaacccagacgg

SEQ ID NO: 2910886 - DNA, 15 bp, Homo sapiens
aagcaaatatagaaa

SEQ ID NO: 2910887 - DNA, 21 bp, Homo sapiens
aagcaaatctttctgtaaaca

SEQ ID NO: 2910888 - DNA, 13 bp, Homo sapiens
aagcaaattattt

SEQ ID NO: 2910889 - DNA, 18 bp, Homo sapiens
aagcaacgtgttaattat

SEQ ID NO: 2910890 - DNA, 11 bp, Homo sapiens
aagcaagctgt

SEQ ID NO: 2910891 - DNA, 12 bp, Homo sapiens
aagcaagctgtg

SEQ ID NO: 2910892 - DNA, 23 bp, Homo sapiens
aagcaagctgtgttacttgaagt

SEQ ID NO: 2910893 - DNA, 14 bp, Homo sapiens
aagcaaggcggtgg

SEQ ID NO: 2910894 - DNA, 16 bp, Homo sapiens
aagcaagggtctcctt

SEQ ID NO: 2910895 - DNA, 19 bp, Homo sapiens
aagcaataaaatttttttg

SEQ ID NO: 2910896 - DNA, 17 bp, Homo sapiens
aagcaataaagaagagt

SEQ ID NO: 2910897 - DNA, 14 bp, Homo sapiens
aagcaatagaaaca

SEQ ID NO: 2910898 - DNA, 18 bp, Homo sapiens
aagcaattatttaaagaa

SEQ ID NO: 2910899 - DNA, 21 bp, Homo sapiens
aagcaattatttaaagaaagt

SEQ ID NO: 2910900 - DNA, 23 bp, Homo sapiens
aagcaattatttaaagaaagtga

SEQ ID NO: 2910901 - DNA, 12 bp, Homo sapiens
aagcacagtggt

SEQ ID NO: 2910902 - DNA, 15 bp, Homo sapiens
aagcacagtttgaac

SEQ ID NO: 2910903 - DNA, 16 bp, Homo sapiens
aagcacagtttgaaca

SEQ ID NO: 2910904 - DNA, 16 bp, Homo sapiens
aagcacatgccaggga

SEQ ID NO: 2910905 - DNA, 15 bp, Homo sapiens
aagcaccatggcctt

SEQ ID NO: 2910906 - DNA, 17 bp, Homo sapiens
aagcacctgccgacctc

SEQ ID NO: 2910907 - DNA, 21 bp, Homo sapiens
aagcactattgtttagatatt

SEQ ID NO: 2910908 - DNA, 13 bp, Homo sapiens
aagcactgttttt

SEQ ID NO: 2910909 - DNA, 14 bp, Homo sapiens
aagcacttgaagaa

SEQ ID NO: 2910910 - DNA, 19 bp, Homo sapiens
aagcagaaaataaaggaag

SEQ ID NO: 2910911 - DNA, 17 bp, Homo sapiens
aagcagaagggcagatg

SEQ ID NO: 2910912 - DNA, 20 bp, Homo sapiens
aagcagaattttaatgtgaa

SEQ ID NO: 2910913 - DNA, 21 bp, Homo sapiens
aagcagaattttaatgtgaag

SEQ ID NO: 2910914 - DNA, 15 bp, Homo sapiens
aagcagacagctcca

SEQ ID NO: 2910915 - DNA, 14 bp, Homo sapiens
aagcagagaagctc

SEQ ID NO: 2910916 - DNA, 16 bp, Homo sapiens
aagcagagaagctctc

SEQ ID NO: 2910917 - DNA, 13 bp, Homo sapiens
aagcagaggacca

SEQ ID NO: 2910918 - DNA, 15 bp, Homo sapiens
aagcagaggaccagg

SEQ ID NO: 2910919 - DNA, 12 bp, Homo sapiens
aagcagaggagg

SEQ ID NO: 2910920 - DNA, 14 bp, Homo sapiens
aagcagaggctttg

SEQ ID NO: 2910921 - DNA, 16 bp, Homo sapiens
aagcagatgcaaagag

SEQ ID NO: 2910922 - DNA, 19 bp, Homo sapiens
aagcagatgcaaagaggca

SEQ ID NO: 2910923 - DNA, 21 bp, Homo sapiens
aagcagatgcaaagaggcaag

SEQ ID NO: 2910924 - DNA, 18 bp, Homo sapiens
aagcagatggacttgaaa

SEQ ID NO: 2910925 - DNA, 19 bp, Homo sapiens
aagcagatggacttgaaaa

SEQ ID NO: 2910926 - DNA, 15 bp, Homo sapiens
aagcagattttccta

SEQ ID NO: 2910927 - DNA, 22 bp, Homo sapiens
aagcagattttcctaaggccac

SEQ ID NO: 2910928 - DNA, 14 bp, Homo sapiens
aagcagcaacagcc

SEQ ID NO: 2910929 - DNA, 16 bp, Homo sapiens
aagcagccaagctcct

SEQ ID NO: 2910930 - DNA, 19 bp, Homo sapiens
aagcagccaggagggacct

SEQ ID NO: 2910931 - DNA, 14 bp, Homo sapiens
aagcagccctctgc

SEQ ID NO: 2910932 - DNA, 18 bp, Homo sapiens
aagcagctcaaaggcaca

SEQ ID NO: 2910933 - DNA, 17 bp, Homo sapiens
aagcagctctcccctca

SEQ ID NO: 2910934 - DNA, 14 bp, Homo sapiens
aagcaggacagaca

SEQ ID NO: 2910935 - DNA, 15 bp, Homo sapiens
aagcaggttagagaa

SEQ ID NO: 2910936 - DNA, 15 bp, Homo sapiens
aagcagttttgtaaa

SEQ ID NO: 2910937 - DNA, 16 bp, Homo sapiens
aagcagttttgtaaat

SEQ ID NO: 2910938 - DNA, 19 bp, Homo sapiens
aagcagttttgtaaatgta

SEQ ID NO: 2910939 - DNA, 16 bp, Homo sapiens
aagcataatttgttta

SEQ ID NO: 2910940 - DNA, 22 bp, Homo sapiens
aagcataatttgtttaaaattc

SEQ ID NO: 2910941 - DNA, 23 bp, Homo sapiens
aagcataatttgtttaaaattct

SEQ ID NO: 2910942 - DNA, 17 bp, Homo sapiens
aagcatactttgtaaat

SEQ ID NO: 2910943 - DNA, 19 bp, Homo sapiens
aagcatatgggttagatgt

SEQ ID NO: 2910944 - DNA, 13 bp, Homo sapiens
aagcatattggaa

SEQ ID NO: 2910945 - DNA, 14 bp, Homo sapiens
aagcatcattgtcc

SEQ ID NO: 2910946 - DNA, 20 bp, Homo sapiens
aagcatccattaattaatga

SEQ ID NO: 2910947 - DNA, 14 bp, Homo sapiens
aagcatcctcagaa

SEQ ID NO: 2910948 - DNA, 18 bp, Homo sapiens
aagcatcctcagaagcct

SEQ ID NO: 2910949 - DNA, 19 bp, Homo sapiens
aagcatcggtcatgtgtgt

SEQ ID NO: 2910950 - DNA, 13 bp, Homo sapiens
aagcatctacttc

SEQ ID NO: 2910951 - DNA, 21 bp, Homo sapiens
aagcatcttccagaagtgtga

SEQ ID NO: 2910952 - DNA, 12 bp, Homo sapiens
aagcatgaaatg

SEQ ID NO: 2910953 - DNA, 15 bp, Homo sapiens
aagcatgagtggcct

SEQ ID NO: 2910954 - DNA, 18 bp, Homo sapiens
aagcatgatgggaaaata

SEQ ID NO: 2910955 - DNA, 21 bp, Homo sapiens
aagcatgatgggaaaatattt

SEQ ID NO: 2910956 - DNA, 23 bp, Homo sapiens
aagcatgatgggaaaatatttcc

SEQ ID NO: 2910957 - DNA, 13 bp, Homo sapiens
aagcatgcattct

SEQ ID NO: 2910958 - DNA, 21 bp, Homo sapiens
aagcatgcttgtgaaaatgtg

SEQ ID NO: 2910959 - DNA, 14 bp, Homo sapiens
aagcatggccctgc

SEQ ID NO: 2910960 - DNA, 14 bp, Homo sapiens
aagcattactttat

SEQ ID NO: 2910961 - DNA, 17 bp, Homo sapiens
aagcattccaacaaagg

SEQ ID NO: 2910962 - DNA, 20 bp, Homo sapiens
aagcatttcaaagccctgcc

SEQ ID NO: 2910963 - DNA, 12 bp, Homo sapiens
aagcatttccag

SEQ ID NO: 2910964 - DNA, 13 bp, Homo sapiens
aagcatttgtact

SEQ ID NO: 2910965 - DNA, 17 bp, Homo sapiens
aagcattttcagcatca

SEQ ID NO: 2910966 - DNA, 15 bp, Homo sapiens
aagcattttctctca

SEQ ID NO: 2910967 - DNA, 12 bp, Homo sapiens
aagccaaagagt

SEQ ID NO: 2910968 - DNA, 16 bp, Homo sapiens
aagccaaccagccttt

SEQ ID NO: 2910969 - DNA, 14 bp, Homo sapiens
aagccaagaaagat

SEQ ID NO: 2910970 - DNA, 13 bp, Homo sapiens
aagccaagaattg

SEQ ID NO: 2910971 - DNA, 17 bp, Homo sapiens
aagccaattcagacagg

SEQ ID NO: 2910972 - DNA, 14 bp, Homo sapiens
aagccaccgcagct

SEQ ID NO: 2910973 - DNA, 15 bp, Homo sapiens
aagccactggaagga

SEQ ID NO: 2910974 - DNA, 16 bp, Homo sapiens
aagccactggaaggag

SEQ ID NO: 2910975 - DNA, 22 bp, Homo sapiens
aagtctgaggcacctgcatatc

SEQ ID NO: 2910976 - DNA, 22 bp, Homo sapiens
aagtctgcctatcctggccagg

SEQ ID NO: 2910977 - DNA, 13 bp, Homo sapiens
aagtctgtttact

SEQ ID NO: 2910978 - DNA, 16 bp, Homo sapiens
aagtctgtttactgca

SEQ ID NO: 2910979 - DNA, 12 bp, Homo sapiens
aagtcttgcatt

SEQ ID NO: 2910980 - DNA, 17 bp, Homo sapiens
aagtctttaatatttta

SEQ ID NO: 2910981 - DNA, 23 bp, Homo sapiens
aagtctttaggtctttgtaagaa

SEQ ID NO: 2910982 - DNA, 16 bp, Homo sapiens
aagtctttcaagaatg

SEQ ID NO: 2910983 - DNA, 15 bp, Homo sapiens
aagtgaaagacattt

SEQ ID NO: 2910984 - DNA, 15 bp, Homo sapiens
aagtgaatttgcctg

SEQ ID NO: 2910985 - DNA, 17 bp, Homo sapiens
aagtgaatttgcctgta

SEQ ID NO: 2910986 - DNA, 20 bp, Homo sapiens
aagtgaatttgcctgtaaca

SEQ ID NO: 2910987 - DNA, 21 bp, Homo sapiens
aagtgacaatgcttatggaaa

SEQ ID NO: 2910988 - DNA, 18 bp, Homo sapiens
aagtgagaataggcagcc

SEQ ID NO: 2910989 - DNA, 13 bp, Homo sapiens
aagtgagagggga

SEQ ID NO: 2910990 - DNA, 17 bp, Homo sapiens
aagtgagaggggaggga

SEQ ID NO: 2910991 - DNA, 21 bp, Homo sapiens
aagtgagtactgttaagaata

SEQ ID NO: 2910992 - DNA, 15 bp, Homo sapiens
aagtgagtggcatgt

SEQ ID NO: 2910993 - DNA, 17 bp, Homo sapiens
aagtgagtgtgctgctg

SEQ ID NO: 2910994 - DNA, 15 bp, Homo sapiens
aagtgatcagcaatg

SEQ ID NO: 2910995 - DNA, 15 bp, Homo sapiens
aagtgattgttggca

SEQ ID NO: 2910996 - DNA, 22 bp, Homo sapiens
aagtgcaataaatctgacccag

SEQ ID NO: 2910997 - DNA, 19 bp, Homo sapiens
aagtgcaatatgggcgggc

SEQ ID NO: 2910998 - DNA, 17 bp, Homo sapiens
aagtgcatgaaaaacca

SEQ ID NO: 2910999 - DNA, 16 bp, Homo sapiens
aagtgccaaagaaagt

SEQ ID NO: 2911000 - DNA, 21 bp, Homo sapiens
aagtgcctcaagaggaatgaa

SEQ ID NO: 2911001 - DNA, 18 bp, Homo sapiens
aagtgcctttatctcagc

SEQ ID NO: 2911002 - DNA, 19 bp, Homo sapiens
aagtgctcaagcagcaaaa

SEQ ID NO: 2911003 - DNA, 13 bp, Homo sapiens
aagtgctgagatt

SEQ ID NO: 2911004 - DNA, 14 bp, Homo sapiens
aagtgctgagatta

SEQ ID NO: 2911005 - DNA, 20 bp, Homo sapiens
aagtgctgtttgggcaggag

SEQ ID NO: 2911006 - DNA, 21 bp, Homo sapiens
aagtgctgtttgggcaggagt

SEQ ID NO: 2911007 - DNA, 22 bp, Homo sapiens
aagtgcttgggggtttttgaag

SEQ ID NO: 2911008 - DNA, 15 bp, Homo sapiens
aagtgcttgtgtaat

SEQ ID NO: 2911009 - DNA, 13 bp, Homo sapiens
aagtggaaatgtt

SEQ ID NO: 2911010 - DNA, 20 bp, Homo sapiens
aagtggaccaggacaggacc

SEQ ID NO: 2911011 - DNA, 18 bp, Homo sapiens
aagtggaggttgagtgag

SEQ ID NO: 2911012 - DNA, 21 bp, Homo sapiens
aagtggatgggaatttgtcag

SEQ ID NO: 2911013 - DNA, 13 bp, Homo sapiens
aagtggcctcttt

SEQ ID NO: 2911014 - DNA, 22 bp, Homo sapiens
aagtggcctctttgtctaaaac

SEQ ID NO: 2911015 - DNA, 12 bp, Homo sapiens
aagtggctgctg

SEQ ID NO: 2911016 - DNA, 16 bp, Homo sapiens
aagtgggccaggacag

SEQ ID NO: 2911017 - DNA, 19 bp, Homo sapiens
aagtgggcccacccggtgg

SEQ ID NO: 2911018 - DNA, 23 bp, Homo sapiens
aagtgggctggtattctctctat

SEQ ID NO: 2911019 - DNA, 16 bp, Homo sapiens
aagtgggcttgattct

SEQ ID NO: 2911020 - DNA, 22 bp, Homo sapiens
aagtgggtagtgtcatttttcc

SEQ ID NO: 2911021 - DNA, 18 bp, Homo sapiens
aagtggttcagtctagaa

SEQ ID NO: 2911022 - DNA, 19 bp, Homo sapiens
aagtggttcagtctagaag

SEQ ID NO: 2911023 - DNA, 21 bp, Homo sapiens
aagtggttcagtctagaagaa

SEQ ID NO: 2911024 - DNA, 17 bp, Homo sapiens
aagtgtaaacaccatag

SEQ ID NO: 2911025 - DNA, 17 bp, Homo sapiens
aagtgtaaagcattcca

SEQ ID NO: 2911026 - DNA, 22 bp, Homo sapiens
aagtgtaaagcattccaacaaa

SEQ ID NO: 2911027 - DNA, 12 bp, Homo sapiens
aagtgtaactgg

SEQ ID NO: 2911028 - DNA, 19 bp, Homo sapiens
aagtgtaagaaacacactg

SEQ ID NO: 2911029 - DNA, 19 bp, Homo sapiens
aagtgtatggtaggggctt

SEQ ID NO: 2911030 - DNA, 23 bp, Homo sapiens
aagtgtcatcaatttgtaatttt

SEQ ID NO: 2911031 - DNA, 12 bp, Homo sapiens
aagtgtcatgtt

SEQ ID NO: 2911032 - DNA, 21 bp, Homo sapiens
aagtgtgattgggaataaata

SEQ ID NO: 2911033 - DNA, 20 bp, Homo sapiens
aagtgtgtcaaatcaataaa

SEQ ID NO: 2911034 - DNA, 17 bp, Homo sapiens
aagtgtgtgtggcagca

SEQ ID NO: 2911035 - DNA, 16 bp, Homo sapiens
aagtgttaatactagt

SEQ ID NO: 2911036 - DNA, 16 bp, Homo sapiens
aagtgttctaaaatga

SEQ ID NO: 2911037 - DNA, 19 bp, Homo sapiens
aagtgttctaaaatgaaat

SEQ ID NO: 2911038 - DNA, 16 bp, Homo sapiens
aagtgttcttcagtgt

SEQ ID NO: 2911039 - DNA, 19 bp, Homo sapiens
aagtgttcttcagtgtaat

SEQ ID NO: 2911040 - DNA, 14 bp, Homo sapiens
aagttaaaggcagt

SEQ ID NO: 2911041 - DNA, 12 bp, Homo sapiens
aagttaaatgta

SEQ ID NO: 2911042 - DNA, 13 bp, Homo sapiens
aagttaaatgtat

SEQ ID NO: 2911043 - DNA, 14 bp, Homo sapiens
aagttaaatgtatc

SEQ ID NO: 2911044 - DNA, 18 bp, Homo sapiens
aagttaattgtatttatg

SEQ ID NO: 2911045 - DNA, 15 bp, Homo sapiens
aagttaatttaaagt

SEQ ID NO: 2911046 - DNA, 19 bp, Homo sapiens
aagttacatgtttgcacct

SEQ ID NO: 2911047 - DNA, 12 bp, Homo sapiens
aagttactttgt

SEQ ID NO: 2911048 - DNA, 21 bp, Homo sapiens
aagttagaattccttcagggt

SEQ ID NO: 2911049 - DNA, 22 bp, Homo sapiens
aagttaggtcattactaaccat

SEQ ID NO: 2911050 - DNA, 16 bp, Homo sapiens
aagttaggttataaga

SEQ ID NO: 2911051 - DNA, 17 bp, Homo sapiens
aagttaggttataagaa

SEQ ID NO: 2911052 - DNA, 12 bp, Homo sapiens
aagttatatttc

SEQ ID NO: 2911053 - DNA, 13 bp, Homo sapiens
aagttatatttca

SEQ ID NO: 2911054 - DNA, 14 bp, Homo sapiens
aagttatttatgct

SEQ ID NO: 2911055 - DNA, 14 bp, Homo sapiens
aagttattttatga

SEQ ID NO: 2911056 - DNA, 15 bp, Homo sapiens
aagttattttatgac

SEQ ID NO: 2911057 - DNA, 21 bp, Homo sapiens
aagttattttatgacatgaaa

SEQ ID NO: 2911058 - DNA, 12 bp, Homo sapiens
aagttctaagat

SEQ ID NO: 2911059 - DNA, 18 bp, Homo sapiens
aagttctaagattctaat

SEQ ID NO: 2911060 - DNA, 21 bp, Homo sapiens
aagttctaagattctaatgat

SEQ ID NO: 2911061 - DNA, 20 bp, Homo sapiens
aagttctccttttgaacttg

SEQ ID NO: 2911062 - DNA, 19 bp, Homo sapiens
aagttctgtactcaaatgt

SEQ ID NO: 2911063 - DNA, 16 bp, Homo sapiens
aagttcttttttgtac

SEQ ID NO: 2911064 - DNA, 20 bp, Homo sapiens
aagttgaaagagtcctattt

SEQ ID NO: 2911065 - DNA, 17 bp, Homo sapiens
aagttgaaattaaccat

SEQ ID NO: 2911066 - DNA, 22 bp, Homo sapiens
aagttgaaggttaaaggaaaag

SEQ ID NO: 2911067 - DNA, 15 bp, Homo sapiens
aagttgagagacagt

SEQ ID NO: 2911068 - DNA, 15 bp, Homo sapiens
aagttggtcttactt

SEQ ID NO: 2911069 - DNA, 15 bp, Homo sapiens
aagttgtacatgaaa

SEQ ID NO: 2911070 - DNA, 14 bp, Homo sapiens
aagttgtacctttt

SEQ ID NO: 2911071 - DNA, 16 bp, Homo sapiens
aagttgtggatttcag

SEQ ID NO: 2911072 - DNA, 18 bp, Homo sapiens
aagttgtggatttcagtt

SEQ ID NO: 2911073 - DNA, 19 bp, Homo sapiens
aagttgtggatttcagttt

SEQ ID NO: 2911074 - DNA, 20 bp, Homo sapiens
aagttgttccttaagtcaga

SEQ ID NO: 2911075 - DNA, 20 bp, Homo sapiens
aagttgtttaactgtgcatg

SEQ ID NO: 2911076 - DNA, 13 bp, Homo sapiens
aagttgttttttt

SEQ ID NO: 2911077 - DNA, 17 bp, Homo sapiens
aagtttaagtgtgcagc

SEQ ID NO: 2911078 - DNA, 16 bp, Homo sapiens
aagtttcagttgattt

SEQ ID NO: 2911079 - DNA, 17 bp, Homo sapiens
aagtttctaagattcta

SEQ ID NO: 2911080 - DNA, 21 bp, Homo sapiens
aagtttctaagattctaaagg

SEQ ID NO: 2911081 - DNA, 13 bp, Homo sapiens
aagtttctattta

SEQ ID NO: 2911082 - DNA, 15 bp, Homo sapiens
aagtttgaccagtgc

SEQ ID NO: 2911083 - DNA, 15 bp, Homo sapiens
aagtttgcttagaaa

SEQ ID NO: 2911084 - DNA, 19 bp, Homo sapiens
aagtttgcttgtttcttgg

SEQ ID NO: 2911085 - DNA, 17 bp, Homo sapiens
aagtttgtaaaaatata

SEQ ID NO: 2911086 - DNA, 12 bp, Homo sapiens
aagtttgtgtca

SEQ ID NO: 2911087 - DNA, 17 bp, Homo sapiens
aagtttgttactttgaa

SEQ ID NO: 2911088 - DNA, 20 bp, Homo sapiens
aagttttcttcccagagaga

SEQ ID NO: 2911089 - DNA, 20 bp, Homo sapiens
aagtttttctttaatatgat

SEQ ID NO: 2911090 - DNA, 18 bp, Homo sapiens
aagtttttgaaatacctt

SEQ ID NO: 2911091 - DNA, 15 bp, Homo sapiens
aataaaaaccaaatt

SEQ ID NO: 2911092 - DNA, 14 bp, Homo sapiens
aataaaaaccaaga

SEQ ID NO: 2911093 - DNA, 15 bp, Homo sapiens
aataaaaagttaaaa

SEQ ID NO: 2911094 - DNA, 16 bp, Homo sapiens
aataaaaataaatcta

SEQ ID NO: 2911095 - DNA, 13 bp, Homo sapiens
aataaaacaaagg

SEQ ID NO: 2911096 - DNA, 11 bp, Homo sapiens
aataaaagcct

SEQ ID NO: 2911097 - DNA, 20 bp, Homo sapiens
aataaaagttcctctccctt

SEQ ID NO: 2911098 - DNA, 13 bp, Homo sapiens
aataaaataaaaa

SEQ ID NO: 2911099 - DNA, 14 bp, Homo sapiens
aataaaatcatcac

SEQ ID NO: 2911100 - DNA, 14 bp, Homo sapiens
aataaaatttgttg

SEQ ID NO: 2911101 - DNA, 12 bp, Homo sapiens
aataaacaaaat

SEQ ID NO: 2911102 - DNA, 15 bp, Homo sapiens
aataaaccaaatatg

SEQ ID NO: 2911103 - DNA, 14 bp, Homo sapiens
aataaaccaagaca

SEQ ID NO: 2911104 - DNA, 15 bp, Homo sapiens
aataaaccattggac

SEQ ID NO: 2911105 - DNA, 17 bp, Homo sapiens
aataaaccttgtttctt

SEQ ID NO: 2911106 - DNA, 22 bp, Homo sapiens
aataaaccttgtttctttctga

SEQ ID NO: 2911107 - DNA, 13 bp, Homo sapiens
aataaacgaagat

SEQ ID NO: 2911108 - DNA, 15 bp, Homo sapiens
aatccatcagcaatg

SEQ ID NO: 2911109 - DNA, 20 bp, Homo sapiens
aatccatcagcaatgcttct

SEQ ID NO: 2911110 - DNA, 23 bp, Homo sapiens
aatccatcgtattaaaaaacaat

SEQ ID NO: 2911111 - DNA, 15 bp, Homo sapiens
aatccatttggcaga

SEQ ID NO: 2911112 - DNA, 17 bp, Homo sapiens
aatccattttcactaaa

SEQ ID NO: 2911113 - DNA, 18 bp, Homo sapiens
aatcccaaatttgattga

SEQ ID NO: 2911114 - DNA, 21 bp, Homo sapiens
aatcccaaatttgattgattt

SEQ ID NO: 2911115 - DNA, 13 bp, Homo sapiens
aatcccagcactt

SEQ ID NO: 2911116 - DNA, 11 bp, Homo sapiens
aatcccagcta

SEQ ID NO: 2911117 - DNA, 15 bp, Homo sapiens
aatccctatgtttgt

SEQ ID NO: 2911118 - DNA, 17 bp, Homo sapiens
aatccctgggcattgct

SEQ ID NO: 2911119 - DNA, 23 bp, Homo sapiens
aatccctttattaccccctcctt

SEQ ID NO: 2911120 - DNA, 20 bp, Homo sapiens
aatccgaacctcctctgtga

SEQ ID NO: 2911121 - DNA, 15 bp, Homo sapiens
aatccgccagtgttt

SEQ ID NO: 2911122 - DNA, 14 bp, Homo sapiens
aatcctatgtgatt

SEQ ID NO: 2911123 - DNA, 20 bp, Homo sapiens
aatcctatgtgattttaact

SEQ ID NO: 2911124 - DNA, 20 bp, Homo sapiens
aatcctcagtttttgtgaaa

SEQ ID NO: 2911125 - DNA, 9 bp, Homo sapiens
aatcctcct

SEQ ID NO: 2911126 - DNA, 20 bp, Homo sapiens
aatcctctcacctcagcctc

SEQ ID NO: 2911127 - DNA, 17 bp, Homo sapiens
aatcctgctctaaaata

SEQ ID NO: 2911128 - DNA, 13 bp, Homo sapiens
aatcctgggcccc

SEQ ID NO: 2911129 - DNA, 23 bp, Homo sapiens
aatccttactaagtaggtgatga

SEQ ID NO: 2911130 - DNA, 19 bp, Homo sapiens
aatccttactatcctatta

SEQ ID NO: 2911131 - DNA, 13 bp, Homo sapiens
aatccttacttcc

SEQ ID NO: 2911132 - DNA, 18 bp, Homo sapiens
aatccttggagtcccagg

SEQ ID NO: 2911133 - DNA, 14 bp, Homo sapiens
aatcctttaatgat

SEQ ID NO: 2911134 - DNA, 20 bp, Homo sapiens
aatccttttgttttgaagct

SEQ ID NO: 2911135 - DNA, 12 bp, Homo sapiens
aatcgcttctct

SEQ ID NO: 2911136 - DNA, 21 bp, Homo sapiens
aatcgcttgaacctgggaagt

SEQ ID NO: 2911137 - DNA, 16 bp, Homo sapiens
aatcgggaaggatggg

SEQ ID NO: 2911138 - DNA, 17 bp, Homo sapiens
aatcgggaaggatggga

SEQ ID NO: 2911139 - DNA, 14 bp, Homo sapiens
aatctaaagccagt

SEQ ID NO: 2911140 - DNA, 14 bp, Homo sapiens
aatctaaggataat

SEQ ID NO: 2911141 - DNA, 23 bp, Homo sapiens
aatctaatgtgagtgtgaagctt

SEQ ID NO: 2911142 - DNA, 16 bp, Homo sapiens
aatctacatgtgtttg

SEQ ID NO: 2911143 - DNA, 17 bp, Homo sapiens
aatctactaattccaca

SEQ ID NO: 2911144 - DNA, 13 bp, Homo sapiens
aatctagagttta

SEQ ID NO: 2911145 - DNA, 17 bp, Homo sapiens
aatctataaacaatgaa

SEQ ID NO: 2911146 - DNA, 20 bp, Homo sapiens
aatctatgaacctgaaaagg

SEQ ID NO: 2911147 - DNA, 14 bp, Homo sapiens
aatctcaatgcaag

SEQ ID NO: 2911148 - DNA, 23 bp, Homo sapiens
aatctcccacaagtatatacttt

SEQ ID NO: 2911149 - DNA, 21 bp, Homo sapiens
aatctcccagacttgtttcct

SEQ ID NO: 2911150 - DNA, 17 bp, Homo sapiens
aatctcgtttagtgcca

SEQ ID NO: 2911151 - DNA, 16 bp, Homo sapiens
aatctcgtttcaaaaa

SEQ ID NO: 2911152 - DNA, 22 bp, Homo sapiens
aatctctcaaacggcaacattc

SEQ ID NO: 2911153 - DNA, 20 bp, Homo sapiens
aatctctttttgctttcgaa

SEQ ID NO: 2911154 - DNA, 21 bp, Homo sapiens
aatctgaagtggttcagtcta

SEQ ID NO: 2911155 - DNA, 24 bp, Homo sapiens
aatctgaagtggttcagtctagaa

SEQ ID NO: 2911156 - DNA, 14 bp, Homo sapiens
aatctgaattttaa

SEQ ID NO: 2911157 - DNA, 13 bp, Homo sapiens
aatctgacccagt

SEQ ID NO: 2911158 - DNA, 22 bp, Homo sapiens
aatctgatcacccccctgctta

SEQ ID NO: 2911159 - DNA, 23 bp, Homo sapiens
aatctgatgaaaatattctgatt

SEQ ID NO: 2911160 - DNA, 17 bp, Homo sapiens
aatctgcagcacattga

SEQ ID NO: 2911161 - DNA, 19 bp, Homo sapiens
aatctggacacttctttat

SEQ ID NO: 2911162 - DNA, 14 bp, Homo sapiens
aatctggagaccag

SEQ ID NO: 2911163 - DNA, 16 bp, Homo sapiens
aatctggatttcacgg

SEQ ID NO: 2911164 - DNA, 17 bp, Homo sapiens
aatctggtgttcttgct

SEQ ID NO: 2911165 - DNA, 19 bp, Homo sapiens
aatctggtgttcttgctaa

SEQ ID NO: 2911166 - DNA, 18 bp, Homo sapiens
aatctgtaaaaaagaaaa

SEQ ID NO: 2911167 - DNA, 15 bp, Homo sapiens
aatctgtaattacca

SEQ ID NO: 2911168 - DNA, 17 bp, Homo sapiens
aatctgtacaaaatggt

SEQ ID NO: 2911169 - DNA, 13 bp, Homo sapiens
aatctgtataaat

SEQ ID NO: 2911170 - DNA, 19 bp, Homo sapiens
aatctgtcaagagtagtta

SEQ ID NO: 2911171 - DNA, 22 bp, Homo sapiens
aatctgtcacgtagaacttgga

SEQ ID NO: 2911172 - DNA, 22 bp, Homo sapiens
aatctgtcactacaatttaaac

SEQ ID NO: 2911173 - DNA, 22 bp, Homo sapiens
aatctgtcataagcattacttt

SEQ ID NO: 2911174 - DNA, 23 bp, Homo sapiens
aatctgtcataagcattacttta

SEQ ID NO: 2911175 - DNA, 15 bp, Homo sapiens
aatctgtcctctgta

SEQ ID NO: 2911176 - DNA, 22 bp, Homo sapiens
aatctgtctagaatcctgcttt

SEQ ID NO: 2911177 - DNA, 13 bp, Homo sapiens
aatctgtgtacaa

SEQ ID NO: 2911178 - DNA, 17 bp, Homo sapiens
aatctgtgtacaaagaa

SEQ ID NO: 2911179 - DNA, 18 bp, Homo sapiens
aatctgtgtacaaagaaa

SEQ ID NO: 2911180 - DNA, 19 bp, Homo sapiens
aatctgtgtacaaagaaat

SEQ ID NO: 2911181 - DNA, 23 bp, Homo sapiens
aatctgtttttgtttatttcatt

SEQ ID NO: 2911182 - DNA, 15 bp, Homo sapiens
aatcttaaaaagttg

SEQ ID NO: 2911183 - DNA, 15 bp, Homo sapiens
aatcttaaatcagaa

SEQ ID NO: 2911184 - DNA, 19 bp, Homo sapiens
aatcttaaatcagaataaa

SEQ ID NO: 2911185 - DNA, 19 bp, Homo sapiens
aatcttaaggtgtagccac

SEQ ID NO: 2911186 - DNA, 17 bp, Homo sapiens
aatcttacaaaatcctg

SEQ ID NO: 2911187 - DNA, 24 bp, Homo sapiens
aatcttacaaaatcctggaagatt

SEQ ID NO: 2911188 - DNA, 14 bp, Homo sapiens
aatcttataattta

SEQ ID NO: 2911189 - DNA, 15 bp, Homo sapiens
aatcttatagttcta

SEQ ID NO: 2911190 - DNA, 18 bp, Homo sapiens
aatcttgctccaataaag

SEQ ID NO: 2911191 - DNA, 13 bp, Homo sapiens
aatcttgctctgc

SEQ ID NO: 2911192 - DNA, 18 bp, Homo sapiens
aatcttgttttaagcaaa

SEQ ID NO: 2911193 - DNA, 20 bp, Homo sapiens
aatcttgttttaagcaaatg

SEQ ID NO: 2911194 - DNA, 22 bp, Homo sapiens
aatcttgttttaagcaaatgca

SEQ ID NO: 2911195 - DNA, 21 bp, Homo sapiens
aatctttaaaagatgctttta

SEQ ID NO: 2911196 - DNA, 16 bp, Homo sapiens
aatctttatagtaaaa

SEQ ID NO: 2911197 - DNA, 20 bp, Homo sapiens
aatctttattatgcattctt

SEQ ID NO: 2911198 - DNA, 18 bp, Homo sapiens
aatctttcctactttcta

SEQ ID NO: 2911199 - DNA, 21 bp, Homo sapiens
aatctttctttggggaaaaat

SEQ ID NO: 2911200 - DNA, 15 bp, Homo sapiens
aatctttttctccac

SEQ ID NO: 2911201 - DNA, 14 bp, Homo sapiens
aatgaaaaaagctt

SEQ ID NO: 2911202 - DNA, 12 bp, Homo sapiens
aatgaaaaatga

SEQ ID NO: 2911203 - DNA, 16 bp, Homo sapiens
aatgaaaaatgaaaga

SEQ ID NO: 2911204 - DNA, 18 bp, Homo sapiens
aatgaaaaatgaaagatg

SEQ ID NO: 2911205 - DNA, 13 bp, Homo sapiens
aatgaaaataact

SEQ ID NO: 2911206 - DNA, 16 bp, Homo sapiens
aatgaaaataactgaa

SEQ ID NO: 2911207 - DNA, 17 bp, Homo sapiens
aatgaaaataactgaac

SEQ ID NO: 2911208 - DNA, 13 bp, Homo sapiens
aatgaaacatggg

SEQ ID NO: 2911209 - DNA, 19 bp, Homo sapiens
aatgaaacccccacacaca

SEQ ID NO: 2911210 - DNA, 23 bp, Homo sapiens
aatgaaaggagtttaaaaacatt

SEQ ID NO: 2911211 - DNA, 12 bp, Homo sapiens
aatgaaataatc

SEQ ID NO: 2911212 - DNA, 20 bp, Homo sapiens
aatgaaatatgtgaagccca

SEQ ID NO: 2911213 - DNA, 18 bp, Homo sapiens
aatgaaatattgctgtat

SEQ ID NO: 2911214 - DNA, 17 bp, Homo sapiens
aatgaaatgctctcctt

SEQ ID NO: 2911215 - DNA, 15 bp, Homo sapiens
aatgaaatgtatgtg

SEQ ID NO: 2911216 - DNA, 15 bp, Homo sapiens
aatgaacactctttt

SEQ ID NO: 2911217 - DNA, 21 bp, Homo sapiens
aatgaacccccatgatgtaag

SEQ ID NO: 2911218 - DNA, 22 bp, Homo sapiens
aatgaacccccatgatgtaagt

SEQ ID NO: 2911219 - DNA, 18 bp, Homo sapiens
aatgaacctgcaagcctt

SEQ ID NO: 2911220 - DNA, 13 bp, Homo sapiens
aatgaactgattt

SEQ ID NO: 2911221 - DNA, 18 bp, Homo sapiens
aatgaactgtccgtgaat

SEQ ID NO: 2911222 - DNA, 14 bp, Homo sapiens
aatgaagaaggaag

SEQ ID NO: 2911223 - DNA, 16 bp, Homo sapiens
aatgaagcttgtgtat

SEQ ID NO: 2911224 - DNA, 22 bp, Homo sapiens
aatgaagcttgtgtatccatta

SEQ ID NO: 2911225 - DNA, 16 bp, Homo sapiens
aatgaagggtcatttc

SEQ ID NO: 2911226 - DNA, 20 bp, Homo sapiens
aatgaatactttataaagga

SEQ ID NO: 2911227 - DNA, 13 bp, Homo sapiens
aatgaatagcttg

SEQ ID NO: 2911228 - DNA, 18 bp, Homo sapiens
aatgaatcctacacacct

SEQ ID NO: 2911229 - DNA, 21 bp, Homo sapiens
aatgaatgggatattttgaaa

SEQ ID NO: 2911230 - DNA, 23 bp, Homo sapiens
aatgaatgggatattttgaaatg

SEQ ID NO: 2911231 - DNA, 16 bp, Homo sapiens
aatgaattcctagaat

SEQ ID NO: 2911232 - DNA, 18 bp, Homo sapiens
aatgaattcctatatacc

SEQ ID NO: 2911233 - DNA, 20 bp, Homo sapiens
aatgaattcgatgcgtattc

SEQ ID NO: 2911234 - DNA, 23 bp, Homo sapiens
aatgaattcgatgcgtattctgt

SEQ ID NO: 2911235 - DNA, 22 bp, Homo sapiens
aatgaattgaaattttatttat

SEQ ID NO: 2911236 - DNA, 13 bp, Homo sapiens
aatgacacagtct

SEQ ID NO: 2911237 - DNA, 17 bp, Homo sapiens
aatgacacttgtcccca

SEQ ID NO: 2911238 - DNA, 18 bp, Homo sapiens
aatgacatttatatcaca

SEQ ID NO: 2911239 - DNA, 22 bp, Homo sapiens
aatgaccttcattctgagacca

SEQ ID NO: 2911240 - DNA, 15 bp, Homo sapiens
acaaagggttttaat

SEQ ID NO: 2911241 - DNA, 16 bp, Homo sapiens
acaaagtccaagtctg

SEQ ID NO: 2911242 - DNA, 15 bp, Homo sapiens
acaaagtgccaaaga

SEQ ID NO: 2911243 - DNA, 16 bp, Homo sapiens
acaaagtgccaaagaa

SEQ ID NO: 2911244 - DNA, 17 bp, Homo sapiens
acaaagtgccaaagaaa

SEQ ID NO: 2911245 - DNA, 15 bp, Homo sapiens
acaaagttgtatgtg

SEQ ID NO: 2911246 - DNA, 13 bp, Homo sapiens
acaaatactcatg

SEQ ID NO: 2911247 - DNA, 14 bp, Homo sapiens
acaaatactcatgt

SEQ ID NO: 2911248 - DNA, 15 bp, Homo sapiens
acaaatataaatctt

SEQ ID NO: 2911249 - DNA, 14 bp, Homo sapiens
acaaatcaaacaca

SEQ ID NO: 2911250 - DNA, 14 bp, Homo sapiens
acaaatggccttta

SEQ ID NO: 2911251 - DNA, 23 bp, Homo sapiens
acaaatgtgaagatgcattgtag

SEQ ID NO: 2911252 - DNA, 14 bp, Homo sapiens
acaaattaatattt

SEQ ID NO: 2911253 - DNA, 17 bp, Homo sapiens
acaaattaatatttgtg

SEQ ID NO: 2911254 - DNA, 14 bp, Homo sapiens
acaaattatttttg

SEQ ID NO: 2911255 - DNA, 15 bp, Homo sapiens
acaaattctgtttct

SEQ ID NO: 2911256 - DNA, 16 bp, Homo sapiens
acaaattctgtttctt

SEQ ID NO: 2911257 - DNA, 15 bp, Homo sapiens
acaaattgagacagt

SEQ ID NO: 2911258 - DNA, 21 bp, Homo sapiens
acaaattttcactgctgctcc

SEQ ID NO: 2911259 - DNA, 10 bp, Homo sapiens
acaacaaaaa

SEQ ID NO: 2911260 - DNA, 13 bp, Homo sapiens
acaacaaaaaaag

SEQ ID NO: 2911261 - DNA, 15 bp, Homo sapiens
acaacaaaaggaaga

SEQ ID NO: 2911262 - DNA, 19 bp, Homo sapiens
acaacaaataatttaagtt

SEQ ID NO: 2911263 - DNA, 15 bp, Homo sapiens
acaacaacaataata

SEQ ID NO: 2911264 - DNA, 14 bp, Homo sapiens
acaacaataataaa

SEQ ID NO: 2911265 - DNA, 15 bp, Homo sapiens
acaacacaaccaacg

SEQ ID NO: 2911266 - DNA, 16 bp, Homo sapiens
acaacacaagaaaact

SEQ ID NO: 2911267 - DNA, 19 bp, Homo sapiens
acaacacctaaaaccagtt

SEQ ID NO: 2911268 - DNA, 17 bp, Homo sapiens
acaacagatttgtgaac

SEQ ID NO: 2911269 - DNA, 17 bp, Homo sapiens
acaacagtgctaaaaat

SEQ ID NO: 2911270 - DNA, 14 bp, Homo sapiens
acaacataaaactc

SEQ ID NO: 2911271 - DNA, 17 bp, Homo sapiens
acaacatggcttctcct

SEQ ID NO: 2911272 - DNA, 16 bp, Homo sapiens
acaacattaaaacaat

SEQ ID NO: 2911273 - DNA, 18 bp, Homo sapiens
acaacatttatatattgt

SEQ ID NO: 2911274 - DNA, 18 bp, Homo sapiens
acaacattttgagaacaa

SEQ ID NO: 2911275 - DNA, 17 bp, Homo sapiens
acaaccactcattcaaa

SEQ ID NO: 2911276 - DNA, 23 bp, Homo sapiens
acaaccctgaagcagaggccttt

SEQ ID NO: 2911277 - DNA, 13 bp, Homo sapiens
acaacctgaacct

SEQ ID NO: 2911278 - DNA, 14 bp, Homo sapiens
acaacctgaaccta

SEQ ID NO: 2911279 - DNA, 18 bp, Homo sapiens
acaacctgaacctaggag

SEQ ID NO: 2911280 - DNA, 23 bp, Homo sapiens
acaacctgcttgggtggagaagc

SEQ ID NO: 2911281 - DNA, 17 bp, Homo sapiens
acaaccttcagctttat

SEQ ID NO: 2911282 - DNA, 20 bp, Homo sapiens
acaaccttcagctttatttt

SEQ ID NO: 2911283 - DNA, 14 bp, Homo sapiens
acaacgaggaagcc

SEQ ID NO: 2911284 - DNA, 13 bp, Homo sapiens
acaacggaggcct

SEQ ID NO: 2911285 - DNA, 14 bp, Homo sapiens
acaacgtctcttca

SEQ ID NO: 2911286 - DNA, 22 bp, Homo sapiens
acaacgtgcaactgacactccc

SEQ ID NO: 2911287 - DNA, 22 bp, Homo sapiens
acaactagcctcatctccagta

SEQ ID NO: 2911288 - DNA, 16 bp, Homo sapiens
acaactattttcagat

SEQ ID NO: 2911289 - DNA, 19 bp, Homo sapiens
acaactccttccatccttg

SEQ ID NO: 2911290 - DNA, 16 bp, Homo sapiens
acaactggcaggcagg

SEQ ID NO: 2911291 - DNA, 17 bp, Homo sapiens
acaactgtaaagcaaat

SEQ ID NO: 2911292 - DNA, 14 bp, Homo sapiens
acaacttaaataat

SEQ ID NO: 2911293 - DNA, 15 bp, Homo sapiens
acaacttaaataata

SEQ ID NO: 2911294 - DNA, 15 bp, Homo sapiens
acaacttaatggaaa

SEQ ID NO: 2911295 - DNA, 22 bp, Homo sapiens
acaacttatttaaaaatatttc

SEQ ID NO: 2911296 - DNA, 15 bp, Homo sapiens
acaacttttaaccaa

SEQ ID NO: 2911297 - DNA, 20 bp, Homo sapiens
acaacttttaaccaaacaat

SEQ ID NO: 2911298 - DNA, 16 bp, Homo sapiens
acaagaaaaagataag

SEQ ID NO: 2911299 - DNA, 13 bp, Homo sapiens
acaagaaaactca

SEQ ID NO: 2911300 - DNA, 20 bp, Homo sapiens
acaagaaaccaagtgggctg

SEQ ID NO: 2911301 - DNA, 13 bp, Homo sapiens
acaagaaactttg

SEQ ID NO: 2911302 - DNA, 12 bp, Homo sapiens
acaagaagatga

SEQ ID NO: 2911303 - DNA, 17 bp, Homo sapiens
acaagaatcacttgaac

SEQ ID NO: 2911304 - DNA, 19 bp, Homo sapiens
acaagaccaccacttcgaa

SEQ ID NO: 2911305 - DNA, 13 bp, Homo sapiens
acaagactgcctc

SEQ ID NO: 2911306 - DNA, 15 bp, Homo sapiens
acaagactgcctccc

SEQ ID NO: 2911307 - DNA, 12 bp, Homo sapiens
acaagagcaaaa

SEQ ID NO: 2911308 - DNA, 21 bp, Homo sapiens
acaagagcactacattcattt

SEQ ID NO: 2911309 - DNA, 17 bp, Homo sapiens
acaagagcgaaactccg

SEQ ID NO: 2911310 - DNA, 18 bp, Homo sapiens
acaagatagagagctatt

SEQ ID NO: 2911311 - DNA, 14 bp, Homo sapiens
acaagatgggacag

SEQ ID NO: 2911312 - DNA, 15 bp, Homo sapiens
acaagatgggacagc

SEQ ID NO: 2911313 - DNA, 16 bp, Homo sapiens
acaagatgggacagca

SEQ ID NO: 2911314 - DNA, 20 bp, Homo sapiens
acaagatgggacagcaacaa

SEQ ID NO: 2911315 - DNA, 20 bp, Homo sapiens
acaagatgtagcaccttttc

SEQ ID NO: 2911316 - DNA, 16 bp, Homo sapiens
acaagattcccagaga

SEQ ID NO: 2911317 - DNA, 15 bp, Homo sapiens
acaagcaaacccaga

SEQ ID NO: 2911318 - DNA, 19 bp, Homo sapiens
acaagcaaacccagacggc

SEQ ID NO: 2911319 - DNA, 19 bp, Homo sapiens
acaagcaagggtctccttc

SEQ ID NO: 2911320 - DNA, 14 bp, Homo sapiens
acaagccagaactt

SEQ ID NO: 2911321 - DNA, 13 bp, Homo sapiens
acaagccagctgg

SEQ ID NO: 2911322 - DNA, 19 bp, Homo sapiens
acaagcccaaatttaattt

SEQ ID NO: 2911323 - DNA, 18 bp, Homo sapiens
acaagcccccccttccac

SEQ ID NO: 2911324 - DNA, 23 bp, Homo sapiens
acaagctattccctcaaatctga

SEQ ID NO: 2911325 - DNA, 16 bp, Homo sapiens
acaagctcttgtttct

SEQ ID NO: 2911326 - DNA, 13 bp, Homo sapiens
acaagctgcctct

SEQ ID NO: 2911327 - DNA, 14 bp, Homo sapiens
acaagctgcctctg

SEQ ID NO: 2911328 - DNA, 13 bp, Homo sapiens
acaagctgtatca

SEQ ID NO: 2911329 - DNA, 21 bp, Homo sapiens
acaagcttcaaagccatatgg

SEQ ID NO: 2911330 - DNA, 13 bp, Homo sapiens
acaaggaataaat

SEQ ID NO: 2911331 - DNA, 16 bp, Homo sapiens
acaaggacaactttat

SEQ ID NO: 2911332 - DNA, 21 bp, Homo sapiens
acaaggagctttcttgtttct

SEQ ID NO: 2911333 - DNA, 17 bp, Homo sapiens
acaaggatagatgctgg

SEQ ID NO: 2911334 - DNA, 18 bp, Homo sapiens
acaaggcaggaggagctg

SEQ ID NO: 2911335 - DNA, 16 bp, Homo sapiens
acaaggcaggcctttc

SEQ ID NO: 2911336 - DNA, 17 bp, Homo sapiens
acaaggcaggcctttcc

SEQ ID NO: 2911337 - DNA, 13 bp, Homo sapiens
acaaggcctggtc

SEQ ID NO: 2911338 - DNA, 15 bp, Homo sapiens
acaaggctgttgcat

SEQ ID NO: 2911339 - DNA, 12 bp, Homo sapiens
acaagggaaggg

SEQ ID NO: 2911340 - DNA, 19 bp, Homo sapiens
acaagggagaagacaacag

SEQ ID NO: 2911341 - DNA, 19 bp, Homo sapiens
acaagggtctagggagaga

SEQ ID NO: 2911342 - DNA, 20 bp, Homo sapiens
acaaggtcaggagttcgaga

SEQ ID NO: 2911343 - DNA, 16 bp, Homo sapiens
acaaggtctttaaagt

SEQ ID NO: 2911344 - DNA, 13 bp, Homo sapiens
acaaggtgttcat

SEQ ID NO: 2911345 - DNA, 13 bp, Homo sapiens
acaaggttcttcc

SEQ ID NO: 2911346 - DNA, 15 bp, Homo sapiens
acaagtaagagactc

SEQ ID NO: 2911347 - DNA, 18 bp, Homo sapiens
acaagtaatcactaaccc

SEQ ID NO: 2911348 - DNA, 14 bp, Homo sapiens
acaagtataattac

SEQ ID NO: 2911349 - DNA, 17 bp, Homo sapiens
acaagtcatggacattc

SEQ ID NO: 2911350 - DNA, 19 bp, Homo sapiens
acaagtcatggacattcat

SEQ ID NO: 2911351 - DNA, 18 bp, Homo sapiens
acaagtgccgcaaattgt

SEQ ID NO: 2911352 - DNA, 15 bp, Homo sapiens
acaagtggactcagg

SEQ ID NO: 2911353 - DNA, 19 bp, Homo sapiens
acaagtgggaaaacatggt

SEQ ID NO: 2911354 - DNA, 13 bp, Homo sapiens
acaagtggtggta

SEQ ID NO: 2911355 - DNA, 18 bp, Homo sapiens
acaagttaaggtatctgg

SEQ ID NO: 2911356 - DNA, 11 bp, Homo sapiens
acaagttatta

SEQ ID NO: 2911357 - DNA, 17 bp, Homo sapiens
acaagttatttaaatct

SEQ ID NO: 2911358 - DNA, 17 bp, Homo sapiens
acaagttgctttgttac

SEQ ID NO: 2911359 - DNA, 18 bp, Homo sapiens
acaagttgctttgttaca

SEQ ID NO: 2911360 - DNA, 15 bp, Homo sapiens
acaagttgtgtttga

SEQ ID NO: 2911361 - DNA, 12 bp, Homo sapiens
acaataaaacat

SEQ ID NO: 2911362 - DNA, 20 bp, Homo sapiens
acaataaaaccaagcctctg

SEQ ID NO: 2911363 - DNA, 21 bp, Homo sapiens
acaataaaactaaatgtgtac

SEQ ID NO: 2911364 - DNA, 23 bp, Homo sapiens
acaataaaactaaatgtgtacac

SEQ ID NO: 2911365 - DNA, 22 bp, Homo sapiens
acaataaaattttttttcatgt

SEQ ID NO: 2911366 - DNA, 23 bp, Homo sapiens
acaataaaattttttttcatgtt

SEQ ID NO: 2911367 - DNA, 14 bp, Homo sapiens
acaataaagactga

SEQ ID NO: 2911368 - DNA, 17 bp, Homo sapiens
acaataagtaaatccac

SEQ ID NO: 2911369 - DNA, 13 bp, Homo sapiens
acaataataaaga

SEQ ID NO: 2911370 - DNA, 13 bp, Homo sapiens
acaatacatctga

SEQ ID NO: 2911371 - DNA, 19 bp, Homo sapiens
acaatacctacaataaact

SEQ ID NO: 2911372 - DNA, 14 bp, Homo sapiens
acaatattgaactt

SEQ ID NO: 2911373 - DNA, 15 bp, Homo sapiens
acaatattgactttg

SEQ ID NO: 2911374 - DNA, 22 bp, Homo sapiens
acagaaccttgttatttctcag

SEQ ID NO: 2911375 - DNA, 18 bp, Homo sapiens
acagaaggtgttcaaaca

SEQ ID NO: 2911376 - DNA, 22 bp, Homo sapiens
acagaagtcctgtatgtctgtc

SEQ ID NO: 2911377 - DNA, 15 bp, Homo sapiens
acagaagtttgcact

SEQ ID NO: 2911378 - DNA, 14 bp, Homo sapiens
acagaatgaaaaat

SEQ ID NO: 2911379 - DNA, 16 bp, Homo sapiens
acagaatgaaaaatga

SEQ ID NO: 2911380 - DNA, 21 bp, Homo sapiens
acagaatgaaaaatgaaagat

SEQ ID NO: 2911381 - DNA, 18 bp, Homo sapiens
acagaatgtgataaggaa

SEQ ID NO: 2911382 - DNA, 17 bp, Homo sapiens
acagaattaatggtcat

SEQ ID NO: 2911383 - DNA, 22 bp, Homo sapiens
acagaattactgtaactgatta

SEQ ID NO: 2911384 - DNA, 15 bp, Homo sapiens
acagaattttttttg

SEQ ID NO: 2911385 - DNA, 20 bp, Homo sapiens
acagacacgagccacctcac

SEQ ID NO: 2911386 - DNA, 11 bp, Homo sapiens
acagacaggag

SEQ ID NO: 2911387 - DNA, 14 bp, Homo sapiens
acagacaggagaaa

SEQ ID NO: 2911388 - DNA, 21 bp, Homo sapiens
acagacaggagaaatgcatcc

SEQ ID NO: 2911389 - DNA, 12 bp, Homo sapiens
acagacatacat

SEQ ID NO: 2911390 - DNA, 15 bp, Homo sapiens
acagacatacataga

SEQ ID NO: 2911391 - DNA, 17 bp, Homo sapiens
acagacattctgccagg

SEQ ID NO: 2911392 - DNA, 17 bp, Homo sapiens
acagaccaaaaatcaac

SEQ ID NO: 2911393 - DNA, 16 bp, Homo sapiens
acagacctggtgctct

SEQ ID NO: 2911394 - DNA, 19 bp, Homo sapiens
acagacgtctcaagactga

SEQ ID NO: 2911395 - DNA, 21 bp, Homo sapiens
acagacgtctcaagactgaaa

SEQ ID NO: 2911396 - DNA, 22 bp, Homo sapiens
acagactcattaaatattctgt

SEQ ID NO: 2911397 - DNA, 22 bp, Homo sapiens
acagactcgattcatattgaat

SEQ ID NO: 2911398 - DNA, 20 bp, Homo sapiens
acagactggccgggcaggcg

SEQ ID NO: 2911399 - DNA, 14 bp, Homo sapiens
acagagaaggcagg

SEQ ID NO: 2911400 - DNA, 15 bp, Homo sapiens
acagagaaggcagga

SEQ ID NO: 2911401 - DNA, 17 bp, Homo sapiens
acagagacacctgcacc

SEQ ID NO: 2911402 - DNA, 21 bp, Homo sapiens
acagagacacctgcacctccc

SEQ ID NO: 2911403 - DNA, 16 bp, Homo sapiens
acagagcacgcctgcc

SEQ ID NO: 2911404 - DNA, 22 bp, Homo sapiens
acagagccagcggctccaactc

SEQ ID NO: 2911405 - DNA, 21 bp, Homo sapiens
acagagcctcgggacatcaaa

SEQ ID NO: 2911406 - DNA, 17 bp, Homo sapiens
acagagcgagactccat

SEQ ID NO: 2911407 - DNA, 14 bp, Homo sapiens
acagagcttccctg

SEQ ID NO: 2911408 - DNA, 15 bp, Homo sapiens
acagagcttccctga

SEQ ID NO: 2911409 - DNA, 20 bp, Homo sapiens
acagaggagggcgtgactca

SEQ ID NO: 2911410 - DNA, 13 bp, Homo sapiens
acagaggcagccc

SEQ ID NO: 2911411 - DNA, 23 bp, Homo sapiens
acagagggaggaatgtgtgcctt

SEQ ID NO: 2911412 - DNA, 13 bp, Homo sapiens
acagagggcacat

SEQ ID NO: 2911413 - DNA, 15 bp, Homo sapiens
acagagggcgctcct

SEQ ID NO: 2911414 - DNA, 17 bp, Homo sapiens
acagagggcgctcctgt

SEQ ID NO: 2911415 - DNA, 20 bp, Homo sapiens
acagaggtaaaaaaaagaag

SEQ ID NO: 2911416 - DNA, 21 bp, Homo sapiens
acagaggtaaaaaaaagaagt

SEQ ID NO: 2911417 - DNA, 24 bp, Homo sapiens
acagaggtcgtcgaaaggtgcagc

SEQ ID NO: 2911418 - DNA, 14 bp, Homo sapiens
acagagtaagacat

SEQ ID NO: 2911419 - DNA, 16 bp, Homo sapiens
acagagtgagaccctg

SEQ ID NO: 2911420 - DNA, 17 bp, Homo sapiens
acagagtgagactccat

SEQ ID NO: 2911421 - DNA, 13 bp, Homo sapiens
acagagtgtagcc

SEQ ID NO: 2911422 - DNA, 18 bp, Homo sapiens
acagataagtgttcttca

SEQ ID NO: 2911423 - DNA, 22 bp, Homo sapiens
acagataagtgttcttcagtgt

SEQ ID NO: 2911424 - DNA, 22 bp, Homo sapiens
acagatactgtgagcttacatt

SEQ ID NO: 2911425 - DNA, 23 bp, Homo sapiens
acagatactgtgagcttacattg

SEQ ID NO: 2911426 - DNA, 15 bp, Homo sapiens
acagatatctttttc

SEQ ID NO: 2911427 - DNA, 18 bp, Homo sapiens
acagatatttttctccag

SEQ ID NO: 2911428 - DNA, 14 bp, Homo sapiens
acagatcaagctgt

SEQ ID NO: 2911429 - DNA, 18 bp, Homo sapiens
acagatcaagctgtgaga

SEQ ID NO: 2911430 - DNA, 16 bp, Homo sapiens
acagatcactcctgga

SEQ ID NO: 2911431 - DNA, 17 bp, Homo sapiens
acagatcactcctggag

SEQ ID NO: 2911432 - DNA, 22 bp, Homo sapiens
acagatctggaacctcagcctg

SEQ ID NO: 2911433 - DNA, 16 bp, Homo sapiens
acagatgaccaaagtc

SEQ ID NO: 2911434 - DNA, 18 bp, Homo sapiens
acagatgaccaaagtccc

SEQ ID NO: 2911435 - DNA, 17 bp, Homo sapiens
acagatgcaatgtgcta

SEQ ID NO: 2911436 - DNA, 16 bp, Homo sapiens
acagatgctgagccat

SEQ ID NO: 2911437 - DNA, 20 bp, Homo sapiens
acagatgctggcctcttggc

SEQ ID NO: 2911438 - DNA, 20 bp, Homo sapiens
acagatggacgcaggccctg

SEQ ID NO: 2911439 - DNA, 22 bp, Homo sapiens
acagatggacgtcgaggaccgg

SEQ ID NO: 2911440 - DNA, 21 bp, Homo sapiens
acagatgtaaatcgggaagga

SEQ ID NO: 2911441 - DNA, 16 bp, Homo sapiens
acagatgttatttttg

SEQ ID NO: 2911442 - DNA, 19 bp, Homo sapiens
acagatgttatttttgtat

SEQ ID NO: 2911443 - DNA, 22 bp, Homo sapiens
acagatgttatttttgtatttt

SEQ ID NO: 2911444 - DNA, 16 bp, Homo sapiens
acagattcccaggcca

SEQ ID NO: 2911445 - DNA, 17 bp, Homo sapiens
acagattcccaggccag

SEQ ID NO: 2911446 - DNA, 15 bp, Homo sapiens
acagattgtttgcaa

SEQ ID NO: 2911447 - DNA, 18 bp, Homo sapiens
acagatttcagtaatgtc

SEQ ID NO: 2911448 - DNA, 20 bp, Homo sapiens
acagatttcagtaatgtctt

SEQ ID NO: 2911449 - DNA, 14 bp, Homo sapiens
acagcaaaccaaga

SEQ ID NO: 2911450 - DNA, 14 bp, Homo sapiens
acagcaaccccagg

SEQ ID NO: 2911451 - DNA, 12 bp, Homo sapiens
acagcaagtcag

SEQ ID NO: 2911452 - DNA, 14 bp, Homo sapiens
acagcacagagaag

SEQ ID NO: 2911453 - DNA, 22 bp, Homo sapiens
acagcacagagaagacaaaatt

SEQ ID NO: 2911454 - DNA, 12 bp, Homo sapiens
acagcacagcca

SEQ ID NO: 2911455 - DNA, 17 bp, Homo sapiens
acagcactcctcggcag

SEQ ID NO: 2911456 - DNA, 13 bp, Homo sapiens
acagcagactcag

SEQ ID NO: 2911457 - DNA, 18 bp, Homo sapiens
acagcagactcagctctg

SEQ ID NO: 2911458 - DNA, 23 bp, Homo sapiens
acagcagactcagctctgacatt

SEQ ID NO: 2911459 - DNA, 16 bp, Homo sapiens
acagcagcaagaaaaa

SEQ ID NO: 2911460 - DNA, 23 bp, Homo sapiens
acagcagcaagaaaaaaaaatgc

SEQ ID NO: 2911461 - DNA, 15 bp, Homo sapiens
acagcagcctgtgag

SEQ ID NO: 2911462 - DNA, 13 bp, Homo sapiens
acagcagtagaca

SEQ ID NO: 2911463 - DNA, 16 bp, Homo sapiens
acagcagtagacattt

SEQ ID NO: 2911464 - DNA, 24 bp, Homo sapiens
acagcagtagacattttaacaaga

SEQ ID NO: 2911465 - DNA, 17 bp, Homo sapiens
acagcagttgactcaga

SEQ ID NO: 2911466 - DNA, 19 bp, Homo sapiens
acagcagttgactcagagt

SEQ ID NO: 2911467 - DNA, 14 bp, Homo sapiens
acagcatctgtagt

SEQ ID NO: 2911468 - DNA, 21 bp, Homo sapiens
acagccaacagctacaacagc

SEQ ID NO: 2911469 - DNA, 17 bp, Homo sapiens
acagccaactagcccct

SEQ ID NO: 2911470 - DNA, 10 bp, Homo sapiens
acagccacac

SEQ ID NO: 2911471 - DNA, 11 bp, Homo sapiens
acagccacaca

SEQ ID NO: 2911472 - DNA, 19 bp, Homo sapiens
acagccacacacacagaaa

SEQ ID NO: 2911473 - DNA, 21 bp, Homo sapiens
acagccacacacacagaaaat

SEQ ID NO: 2911474 - DNA, 14 bp, Homo sapiens
acagccagggggat

SEQ ID NO: 2911475 - DNA, 21 bp, Homo sapiens
acagccagtgggagatgttag

SEQ ID NO: 2911476 - DNA, 20 bp, Homo sapiens
acagcccaggcctccagctc

SEQ ID NO: 2911477 - DNA, 21 bp, Homo sapiens
acagcccaggcctccagctca

SEQ ID NO: 2911478 - DNA, 14 bp, Homo sapiens
acagcccccacccc

SEQ ID NO: 2911479 - DNA, 17 bp, Homo sapiens
acagcccccaccccagc

SEQ ID NO: 2911480 - DNA, 18 bp, Homo sapiens
acagcccccaccccagca

SEQ ID NO: 2911481 - DNA, 16 bp, Homo sapiens
acagcccccgggacac

SEQ ID NO: 2911482 - DNA, 14 bp, Homo sapiens
acagccccctgccc

SEQ ID NO: 2911483 - DNA, 15 bp, Homo sapiens
acagccccctgcccc

SEQ ID NO: 2911484 - DNA, 17 bp, Homo sapiens
acagcctcacagaagaa

SEQ ID NO: 2911485 - DNA, 14 bp, Homo sapiens
acagcctcacttgg

SEQ ID NO: 2911486 - DNA, 15 bp, Homo sapiens
acagcctgggcccca

SEQ ID NO: 2911487 - DNA, 20 bp, Homo sapiens
acagcctgtggcggtgcctg

SEQ ID NO: 2911488 - DNA, 21 bp, Homo sapiens
acagcctgtggcggtgcctgg

SEQ ID NO: 2911489 - DNA, 22 bp, Homo sapiens
acagcctgtggcggtgcctggg

SEQ ID NO: 2911490 - DNA, 23 bp, Homo sapiens
acagccttattttgttggtgctt

SEQ ID NO: 2911491 - DNA, 11 bp, Homo sapiens
acagccttcag

SEQ ID NO: 2911492 - DNA, 12 bp, Homo sapiens
acagccttgggc

SEQ ID NO: 2911493 - DNA, 21 bp, Homo sapiens
acagcggctgcctcctgatgt

SEQ ID NO: 2911494 - DNA, 17 bp, Homo sapiens
acagctaatagcatggt

SEQ ID NO: 2911495 - DNA, 18 bp, Homo sapiens
acagctacaacagcctca

SEQ ID NO: 2911496 - DNA, 22 bp, Homo sapiens
acagctactctccccacgaggg

SEQ ID NO: 2911497 - DNA, 21 bp, Homo sapiens
acagctcagctttttgtcttt

SEQ ID NO: 2911498 - DNA, 17 bp, Homo sapiens
acagctccaccctggcc

SEQ ID NO: 2911499 - DNA, 16 bp, Homo sapiens
acagctcccaccccac

SEQ ID NO: 2911500 - DNA, 14 bp, Homo sapiens
acagctcctcccct

SEQ ID NO: 2911501 - DNA, 16 bp, Homo sapiens
acagctcctcccctgc

SEQ ID NO: 2911502 - DNA, 17 bp, Homo sapiens
acagctcctcccctgcc

SEQ ID NO: 2911503 - DNA, 19 bp, Homo sapiens
acagctcctcccctgccgc

SEQ ID NO: 2911504 - DNA, 20 bp, Homo sapiens
acagctcctcccctgccgcc

SEQ ID NO: 2911505 - DNA, 17 bp, Homo sapiens
acagctctgactttaca

SEQ ID NO: 2911506 - DNA, 23 bp, Homo sapiens
accaaagttctaataatttctaa

SEQ ID NO: 2911507 - DNA, 15 bp, Homo sapiens
accaaatacacattt

SEQ ID NO: 2911508 - DNA, 16 bp, Homo sapiens
accaaatacacatttc

SEQ ID NO: 2911509 - DNA, 16 bp, Homo sapiens
accaaatatgttaaag

SEQ ID NO: 2911510 - DNA, 19 bp, Homo sapiens
accaaattgcactgaagtt

SEQ ID NO: 2911511 - DNA, 15 bp, Homo sapiens
accaaattgcttcta

SEQ ID NO: 2911512 - DNA, 21 bp, Homo sapiens
accaaattttgaggtctttta

SEQ ID NO: 2911513 - DNA, 22 bp, Homo sapiens
accaaattttgaggtcttttac

SEQ ID NO: 2911514 - DNA, 21 bp, Homo sapiens
accaacaactcagaatggggg

SEQ ID NO: 2911515 - DNA, 16 bp, Homo sapiens
accaacagttccttca

SEQ ID NO: 2911516 - DNA, 14 bp, Homo sapiens
accaacatctttgc

SEQ ID NO: 2911517 - DNA, 14 bp, Homo sapiens
accaacccatgtat

SEQ ID NO: 2911518 - DNA, 17 bp, Homo sapiens
accaaccccgcggccca

SEQ ID NO: 2911519 - DNA, 16 bp, Homo sapiens
accaacctttctgaca

SEQ ID NO: 2911520 - DNA, 21 bp, Homo sapiens
accaacgcgaaaccaattcct

SEQ ID NO: 2911521 - DNA, 23 bp, Homo sapiens
accaactgtcactcattgctgag

SEQ ID NO: 2911522 - DNA, 22 bp, Homo sapiens
accaactttttccaagtccttt

SEQ ID NO: 2911523 - DNA, 11 bp, Homo sapiens
accaagaagat

SEQ ID NO: 2911524 - DNA, 13 bp, Homo sapiens
accaagagaaggg

SEQ ID NO: 2911525 - DNA, 17 bp, Homo sapiens
accaagagattgctaat

SEQ ID NO: 2911526 - DNA, 13 bp, Homo sapiens
accaagcaggaaa

SEQ ID NO: 2911527 - DNA, 14 bp, Homo sapiens
accaagcaggaagc

SEQ ID NO: 2911528 - DNA, 15 bp, Homo sapiens
accaagcaggaagct

SEQ ID NO: 2911529 - DNA, 17 bp, Homo sapiens
accaagcaggaagctca

SEQ ID NO: 2911530 - DNA, 19 bp, Homo sapiens
accaagccaccgcagctgc

SEQ ID NO: 2911531 - DNA, 20 bp, Homo sapiens
accaagccaccgcagctgct

SEQ ID NO: 2911532 - DNA, 15 bp, Homo sapiens
accaagcctctggaa

SEQ ID NO: 2911533 - DNA, 17 bp, Homo sapiens
accaagctcacagttcc

SEQ ID NO: 2911534 - DNA, 18 bp, Homo sapiens
accaagctcacagttcct

SEQ ID NO: 2911535 - DNA, 11 bp, Homo sapiens
accaaggaaac

SEQ ID NO: 2911536 - DNA, 16 bp, Homo sapiens
accaaggaaggagccc

SEQ ID NO: 2911537 - DNA, 19 bp, Homo sapiens
accaaggtctcacactcct

SEQ ID NO: 2911538 - DNA, 21 bp, Homo sapiens
accaaggtctcacactcctcc

SEQ ID NO: 2911539 - DNA, 22 bp, Homo sapiens
accaaggtttatgccaccaggt

SEQ ID NO: 2911540 - DNA, 16 bp, Homo sapiens
accaagtcaggccagg

SEQ ID NO: 2911541 - DNA, 21 bp, Homo sapiens
accaagtgcaatatgggcggg

SEQ ID NO: 2911542 - DNA, 16 bp, Homo sapiens
accaagtgctggccca

SEQ ID NO: 2911543 - DNA, 15 bp, Homo sapiens
accaagttgtttatt

SEQ ID NO: 2911544 - DNA, 18 bp, Homo sapiens
accaagttgtttattcca

SEQ ID NO: 2911545 - DNA, 17 bp, Homo sapiens
accaataaaataatttt

SEQ ID NO: 2911546 - DNA, 13 bp, Homo sapiens
accaatacatttg

SEQ ID NO: 2911547 - DNA, 14 bp, Homo sapiens
accaatgcactgag

SEQ ID NO: 2911548 - DNA, 21 bp, Homo sapiens
accaatgccaaaaaaagacag

SEQ ID NO: 2911549 - DNA, 20 bp, Homo sapiens
accaattagtcactgctgct

SEQ ID NO: 2911550 - DNA, 23 bp, Homo sapiens
accaattttttgttcttcagaga

SEQ ID NO: 2911551 - DNA, 18 bp, Homo sapiens
accacaaacggagcccct

SEQ ID NO: 2911552 - DNA, 15 bp, Homo sapiens
accacaaccttgcag

SEQ ID NO: 2911553 - DNA, 21 bp, Homo sapiens
accacaattctccctatcttg

SEQ ID NO: 2911554 - DNA, 15 bp, Homo sapiens
accacacatcccagc

SEQ ID NO: 2911555 - DNA, 16 bp, Homo sapiens
accacaccagcctcct

SEQ ID NO: 2911556 - DNA, 18 bp, Homo sapiens
accacaccagcctcctgg

SEQ ID NO: 2911557 - DNA, 15 bp, Homo sapiens
accacaccctgcctg

SEQ ID NO: 2911558 - DNA, 14 bp, Homo sapiens
accacacctggcta

SEQ ID NO: 2911559 - DNA, 22 bp, Homo sapiens
accacacgtaatgaaacttgga

SEQ ID NO: 2911560 - DNA, 13 bp, Homo sapiens
accacactggact

SEQ ID NO: 2911561 - DNA, 14 bp, Homo sapiens
accacactttcaaa

SEQ ID NO: 2911562 - DNA, 14 bp, Homo sapiens
accacagagttttt

SEQ ID NO: 2911563 - DNA, 20 bp, Homo sapiens
accacagagttttttaaaca

SEQ ID NO: 2911564 - DNA, 18 bp, Homo sapiens
accacatggccttgcctc

SEQ ID NO: 2911565 - DNA, 22 bp, Homo sapiens
accacatttcctctgttctttt

SEQ ID NO: 2911566 - DNA, 17 bp, Homo sapiens
accaccaccttatacat

SEQ ID NO: 2911567 - DNA, 18 bp, Homo sapiens
accaccaccttatacatc

SEQ ID NO: 2911568 - DNA, 18 bp, Homo sapiens
accaccccggccccctgc

SEQ ID NO: 2911569 - DNA, 18 bp, Homo sapiens
accaccgcccgtctgtgt

SEQ ID NO: 2911570 - DNA, 16 bp, Homo sapiens
accacctaggccactc

SEQ ID NO: 2911571 - DNA, 17 bp, Homo sapiens
accacctaggccactcc

SEQ ID NO: 2911572 - DNA, 20 bp, Homo sapiens
accacctaggccactcctcc

SEQ ID NO: 2911573 - DNA, 21 bp, Homo sapiens
accacctaggccactcctcca

SEQ ID NO: 2911574 - DNA, 19 bp, Homo sapiens
accacctggagcggctcat

SEQ ID NO: 2911575 - DNA, 16 bp, Homo sapiens
accaccttatacatca

SEQ ID NO: 2911576 - DNA, 23 bp, Homo sapiens
accaccttatacatcacttcctg

SEQ ID NO: 2911577 - DNA, 15 bp, Homo sapiens
accaccttcccagct

SEQ ID NO: 2911578 - DNA, 19 bp, Homo sapiens
accacgactggccagggcc

SEQ ID NO: 2911579 - DNA, 19 bp, Homo sapiens
accacgatgtggccctggc

SEQ ID NO: 2911580 - DNA, 15 bp, Homo sapiens
accacgcacctccac

SEQ ID NO: 2911581 - DNA, 14 bp, Homo sapiens
accacgcaggaagc

SEQ ID NO: 2911582 - DNA, 13 bp, Homo sapiens
accacggccagaa

SEQ ID NO: 2911583 - DNA, 20 bp, Homo sapiens
accacggccggctaattttt

SEQ ID NO: 2911584 - DNA, 17 bp, Homo sapiens
accacgtaccaagccac

SEQ ID NO: 2911585 - DNA, 15 bp, Homo sapiens
accactataaaatgt

SEQ ID NO: 2911586 - DNA, 15 bp, Homo sapiens
accactatgaagcta

SEQ ID NO: 2911587 - DNA, 18 bp, Homo sapiens
accactatgcaaagaact

SEQ ID NO: 2911588 - DNA, 22 bp, Homo sapiens
accactcctgaatgagacttaa

SEQ ID NO: 2911589 - DNA, 21 bp, Homo sapiens
accactcctgccagcccggct

SEQ ID NO: 2911590 - DNA, 23 bp, Homo sapiens
accactcttctctccaaggaaat

SEQ ID NO: 2911591 - DNA, 13 bp, Homo sapiens
accactgagctct

SEQ ID NO: 2911592 - DNA, 17 bp, Homo sapiens
accactgcactccagcc

SEQ ID NO: 2911593 - DNA, 19 bp, Homo sapiens
accactgcactccagcctg

SEQ ID NO: 2911594 - DNA, 20 bp, Homo sapiens
accactgccattacccagtg

SEQ ID NO: 2911595 - DNA, 15 bp, Homo sapiens
accactgggcccctc

SEQ ID NO: 2911596 - DNA, 16 bp, Homo sapiens
accactgggcccctca

SEQ ID NO: 2911597 - DNA, 19 bp, Homo sapiens
accactgggcccctcaggg

SEQ ID NO: 2911598 - DNA, 19 bp, Homo sapiens
accactgtggaagtccctc

SEQ ID NO: 2911599 - DNA, 23 bp, Homo sapiens
accactgtggaagtccctcagag

SEQ ID NO: 2911600 - DNA, 21 bp, Homo sapiens
accactttattgcaatgcaga

SEQ ID NO: 2911601 - DNA, 20 bp, Homo sapiens
accactttcttattctgtat

SEQ ID NO: 2911602 - DNA, 18 bp, Homo sapiens
accacttttcattgcaaa

SEQ ID NO: 2911603 - DNA, 19 bp, Homo sapiens
accacttttcattgcaaag

SEQ ID NO: 2911604 - DNA, 22 bp, Homo sapiens
accacttttctgctgttgcctc

SEQ ID NO: 2911605 - DNA, 19 bp, Homo sapiens
accagaaacctgggagaga

SEQ ID NO: 2911606 - DNA, 15 bp, Homo sapiens
accagacacccagga

SEQ ID NO: 2911607 - DNA, 13 bp, Homo sapiens
accagacagaggg

SEQ ID NO: 2911608 - DNA, 12 bp, Homo sapiens
accagactttga

SEQ ID NO: 2911609 - DNA, 13 bp, Homo sapiens
accagacttttct

SEQ ID NO: 2911610 - DNA, 23 bp, Homo sapiens
accagacttttctctagaagctg

SEQ ID NO: 2911611 - DNA, 23 bp, Homo sapiens
accagagcaaaaatgtaaaaaac

SEQ ID NO: 2911612 - DNA, 19 bp, Homo sapiens
accagagcaggggctgctg

SEQ ID NO: 2911613 - DNA, 20 bp, Homo sapiens
accagagcaggggctgctgg

SEQ ID NO: 2911614 - DNA, 11 bp, Homo sapiens
accagagctgc

SEQ ID NO: 2911615 - DNA, 14 bp, Homo sapiens
accagagctgcctc

SEQ ID NO: 2911616 - DNA, 17 bp, Homo sapiens
accagagctgcctcccc

SEQ ID NO: 2911617 - DNA, 15 bp, Homo sapiens
accagaggagccttt

SEQ ID NO: 2911618 - DNA, 17 bp, Homo sapiens
accagaggagccttttt

SEQ ID NO: 2911619 - DNA, 17 bp, Homo sapiens
accagagtctgtatttt

SEQ ID NO: 2911620 - DNA, 22 bp, Homo sapiens
accagagtctgtatttttctaa

SEQ ID NO: 2911621 - DNA, 22 bp, Homo sapiens
accagatagctcaatactctct

SEQ ID NO: 2911622 - DNA, 14 bp, Homo sapiens
accagatgcagctc

SEQ ID NO: 2911623 - DNA, 22 bp, Homo sapiens
accagcaaagagaatgtatttc

SEQ ID NO: 2911624 - DNA, 16 bp, Homo sapiens
accagcaacttgaact

SEQ ID NO: 2911625 - DNA, 17 bp, Homo sapiens
accagcaagtcccagac

SEQ ID NO: 2911626 - DNA, 15 bp, Homo sapiens
accagcagcactgga

SEQ ID NO: 2911627 - DNA, 16 bp, Homo sapiens
accagcatcacctgcc

SEQ ID NO: 2911628 - DNA, 19 bp, Homo sapiens
accagcatcacctgcctgt

SEQ ID NO: 2911629 - DNA, 20 bp, Homo sapiens
accagccacgaacagcccgc

SEQ ID NO: 2911630 - DNA, 15 bp, Homo sapiens
accagcccagatgtt

SEQ ID NO: 2911631 - DNA, 20 bp, Homo sapiens
accagcctggccaacatggt

SEQ ID NO: 2911632 - DNA, 22 bp, Homo sapiens
accagcctttgggtcctgggca

SEQ ID NO: 2911633 - DNA, 23 bp, Homo sapiens
accagcgaggaggctccagaggg

SEQ ID NO: 2911634 - DNA, 21 bp, Homo sapiens
accagcgtatatataagaaag

SEQ ID NO: 2911635 - DNA, 14 bp, Homo sapiens
accagctcaggaca

SEQ ID NO: 2911636 - DNA, 12 bp, Homo sapiens
accagctcaggg

SEQ ID NO: 2911637 - DNA, 22 bp, Homo sapiens
accagctcaggggacactggcc

SEQ ID NO: 2911638 - DNA, 20 bp, Homo sapiens
acctcgtcctccccctgcca

SEQ ID NO: 2911639 - DNA, 15 bp, Homo sapiens
acctctccatcttca

SEQ ID NO: 2911640 - DNA, 19 bp, Homo sapiens
acctctccatcttcagctt

SEQ ID NO: 2911641 - DNA, 17 bp, Homo sapiens
acctctccctgaccctg

SEQ ID NO: 2911642 - DNA, 14 bp, Homo sapiens
acctctcctcatgt

SEQ ID NO: 2911643 - DNA, 20 bp, Homo sapiens
acctctcggccccatcgccc

SEQ ID NO: 2911644 - DNA, 14 bp, Homo sapiens
acctctctcggccc

SEQ ID NO: 2911645 - DNA, 19 bp, Homo sapiens
acctctctgtcccttgctg

SEQ ID NO: 2911646 - DNA, 22 bp, Homo sapiens
acctctctgtcccttgctgtat

SEQ ID NO: 2911647 - DNA, 13 bp, Homo sapiens
acctctctgtctt

SEQ ID NO: 2911648 - DNA, 18 bp, Homo sapiens
acctctctgtctttttcc

SEQ ID NO: 2911649 - DNA, 21 bp, Homo sapiens
acctctctgtctttttccttc

SEQ ID NO: 2911650 - DNA, 15 bp, Homo sapiens
acctctcttttcctc

SEQ ID NO: 2911651 - DNA, 20 bp, Homo sapiens
acctctcttttcctctctgt

SEQ ID NO: 2911652 - DNA, 21 bp, Homo sapiens
acctctcttttcctctctgtc

SEQ ID NO: 2911653 - DNA, 23 bp, Homo sapiens
acctctcttttcctctctgtctg

SEQ ID NO: 2911654 - DNA, 20 bp, Homo sapiens
acctctgaaaccctggacca

SEQ ID NO: 2911655 - DNA, 14 bp, Homo sapiens
acctctgcctcaat

SEQ ID NO: 2911656 - DNA, 15 bp, Homo sapiens
acctctgcctcaatg

SEQ ID NO: 2911657 - DNA, 14 bp, Homo sapiens
acctctgcttccca

SEQ ID NO: 2911658 - DNA, 19 bp, Homo sapiens
acctctgcttcccaggttc

SEQ ID NO: 2911659 - DNA, 13 bp, Homo sapiens
acctctggagtgc

SEQ ID NO: 2911660 - DNA, 22 bp, Homo sapiens
acctctgtcttggctttcatgt

SEQ ID NO: 2911661 - DNA, 11 bp, Homo sapiens
acctctgtgtg

SEQ ID NO: 2911662 - DNA, 15 bp, Homo sapiens
acctctgtgtgctcc

SEQ ID NO: 2911663 - DNA, 17 bp, Homo sapiens
acctctgttcagtgtaa

SEQ ID NO: 2911664 - DNA, 18 bp, Homo sapiens
acctctgttcagtgtaaa

SEQ ID NO: 2911665 - DNA, 18 bp, Homo sapiens
acctcttcagaggccctc

SEQ ID NO: 2911666 - DNA, 17 bp, Homo sapiens
acctctttttcttacca

SEQ ID NO: 2911667 - DNA, 11 bp, Homo sapiens
acctgaaaaca

SEQ ID NO: 2911668 - DNA, 18 bp, Homo sapiens
acctgaaaacactgtgca

SEQ ID NO: 2911669 - DNA, 21 bp, Homo sapiens
acctgaaaacactgtgcacat

SEQ ID NO: 2911670 - DNA, 12 bp, Homo sapiens
acctgaaaagta

SEQ ID NO: 2911671 - DNA, 16 bp, Homo sapiens
acctgaaaggaaggtt

SEQ ID NO: 2911672 - DNA, 15 bp, Homo sapiens
acctgaaattccaaa

SEQ ID NO: 2911673 - DNA, 16 bp, Homo sapiens
acctgaaattccaaag

SEQ ID NO: 2911674 - DNA, 20 bp, Homo sapiens
acctgaaattccaaagtctc

SEQ ID NO: 2911675 - DNA, 14 bp, Homo sapiens
acctgaacattgta

SEQ ID NO: 2911676 - DNA, 21 bp, Homo sapiens
acctgaaccccagaggcagag

SEQ ID NO: 2911677 - DNA, 14 bp, Homo sapiens
acctgaacctagga

SEQ ID NO: 2911678 - DNA, 15 bp, Homo sapiens
acctgaactctgcaa

SEQ ID NO: 2911679 - DNA, 16 bp, Homo sapiens
acctgaactctgcaac

SEQ ID NO: 2911680 - DNA, 22 bp, Homo sapiens
acctgaaggtcccctggcagtg

SEQ ID NO: 2911681 - DNA, 15 bp, Homo sapiens
acctgaagttcacca

SEQ ID NO: 2911682 - DNA, 15 bp, Homo sapiens
acctgaatttgtata

SEQ ID NO: 2911683 - DNA, 17 bp, Homo sapiens
acctgaccgctgcccag

SEQ ID NO: 2911684 - DNA, 18 bp, Homo sapiens
acctgagcccgcagccca

SEQ ID NO: 2911685 - DNA, 19 bp, Homo sapiens
acctgagcccgcagcccag

SEQ ID NO: 2911686 - DNA, 21 bp, Homo sapiens
acctgagcccgcagcccagac

SEQ ID NO: 2911687 - DNA, 13 bp, Homo sapiens
acctgaggaagcg

SEQ ID NO: 2911688 - DNA, 13 bp, Homo sapiens
acctgatcctgga

SEQ ID NO: 2911689 - DNA, 14 bp, Homo sapiens
acctgatggagagt

SEQ ID NO: 2911690 - DNA, 13 bp, Homo sapiens
acctgatgtgtac

SEQ ID NO: 2911691 - DNA, 19 bp, Homo sapiens
acctgattcaactaaaaaa

SEQ ID NO: 2911692 - DNA, 18 bp, Homo sapiens
acctgcaatcccagctac

SEQ ID NO: 2911693 - DNA, 22 bp, Homo sapiens
acctgcacctccccccactgca

SEQ ID NO: 2911694 - DNA, 21 bp, Homo sapiens
acctgcagtgccagctccctc

SEQ ID NO: 2911695 - DNA, 17 bp, Homo sapiens
acctgcatatctctagt

SEQ ID NO: 2911696 - DNA, 19 bp, Homo sapiens
acctgcatccgtagttccc

SEQ ID NO: 2911697 - DNA, 21 bp, Homo sapiens
acctgcatccgtagttccctg

SEQ ID NO: 2911698 - DNA, 15 bp, Homo sapiens
acctgcatttttaaa

SEQ ID NO: 2911699 - DNA, 23 bp, Homo sapiens
acctgccgagagtccatcagcct

SEQ ID NO: 2911700 - DNA, 18 bp, Homo sapiens
acctgcctagctcttggg

SEQ ID NO: 2911701 - DNA, 19 bp, Homo sapiens
acctgcctagctcttgggc

SEQ ID NO: 2911702 - DNA, 18 bp, Homo sapiens
acctgcctcagctaccta

SEQ ID NO: 2911703 - DNA, 23 bp, Homo sapiens
acctgcctcggcctcccaaagtg

SEQ ID NO: 2911704 - DNA, 18 bp, Homo sapiens
acctgcctggccggccag

SEQ ID NO: 2911705 - DNA, 11 bp, Homo sapiens
acctgcctgta

SEQ ID NO: 2911706 - DNA, 16 bp, Homo sapiens
acctgcgcacaggtgg

SEQ ID NO: 2911707 - DNA, 17 bp, Homo sapiens
acctgctcccttcgctc

SEQ ID NO: 2911708 - DNA, 22 bp, Homo sapiens
acctgctcccttcgctctgctg

SEQ ID NO: 2911709 - DNA, 14 bp, Homo sapiens
acctgctctccggc

SEQ ID NO: 2911710 - DNA, 23 bp, Homo sapiens
acctgcttgggtggagaagccat

SEQ ID NO: 2911711 - DNA, 23 bp, Homo sapiens
acctggaagcatttgtttctact

SEQ ID NO: 2911712 - DNA, 14 bp, Homo sapiens
acctggacacaggc

SEQ ID NO: 2911713 - DNA, 18 bp, Homo sapiens
acctggaccccctgcccg

SEQ ID NO: 2911714 - DNA, 17 bp, Homo sapiens
acctggactagggcctc

SEQ ID NO: 2911715 - DNA, 20 bp, Homo sapiens
acctggcagcaaactgctgc

SEQ ID NO: 2911716 - DNA, 10 bp, Homo sapiens
acctggcagt

SEQ ID NO: 2911717 - DNA, 23 bp, Homo sapiens
acctggccccatgtctctcagaa

SEQ ID NO: 2911718 - DNA, 23 bp, Homo sapiens
acctggccccctcagctctgtcc

SEQ ID NO: 2911719 - DNA, 16 bp, Homo sapiens
acctggctgccatact

SEQ ID NO: 2911720 - DNA, 15 bp, Homo sapiens
acctggcttgtttat

SEQ ID NO: 2911721 - DNA, 22 bp, Homo sapiens
acctggcttgtttattttgtgg

SEQ ID NO: 2911722 - DNA, 18 bp, Homo sapiens
acctgggattcaggaatg

SEQ ID NO: 2911723 - DNA, 18 bp, Homo sapiens
acctgggcgccaactgct

SEQ ID NO: 2911724 - DNA, 21 bp, Homo sapiens
acctggggttgtcagctctca

SEQ ID NO: 2911725 - DNA, 14 bp, Homo sapiens
acctggtacctgga

SEQ ID NO: 2911726 - DNA, 15 bp, Homo sapiens
acctggtccacaggg

SEQ ID NO: 2911727 - DNA, 21 bp, Homo sapiens
acctggtgctcgggaagggag

SEQ ID NO: 2911728 - DNA, 16 bp, Homo sapiens
acctggtgctgcctct

SEQ ID NO: 2911729 - DNA, 22 bp, Homo sapiens
acctggttaaacaaaccagaat

SEQ ID NO: 2911730 - DNA, 15 bp, Homo sapiens
acctgtaacttttgt

SEQ ID NO: 2911731 - DNA, 17 bp, Homo sapiens
acctgtaatcccagcac

SEQ ID NO: 2911732 - DNA, 19 bp, Homo sapiens
acctgtaatcccagcactt

SEQ ID NO: 2911733 - DNA, 15 bp, Homo sapiens
acctgtagatgcaga

SEQ ID NO: 2911734 - DNA, 17 bp, Homo sapiens
acctgtaggatattgga

SEQ ID NO: 2911735 - DNA, 14 bp, Homo sapiens
acctgtagtcccag

SEQ ID NO: 2911736 - DNA, 19 bp, Homo sapiens
acctgtcaaacaaagccag

SEQ ID NO: 2911737 - DNA, 19 bp, Homo sapiens
acctgtccttactcagagc

SEQ ID NO: 2911738 - DNA, 20 bp, Homo sapiens
acctgtcgtctctcccaccc

SEQ ID NO: 2911739 - DNA, 18 bp, Homo sapiens
acctgtcttgctcctggg

SEQ ID NO: 2911740 - DNA, 22 bp, Homo sapiens
acctgtcttgctcctggggaga

SEQ ID NO: 2911741 - DNA, 15 bp, Homo sapiens
acctgtgagcccagc

SEQ ID NO: 2911742 - DNA, 10 bp, Homo sapiens
acctgtgcct

SEQ ID NO: 2911743 - DNA, 19 bp, Homo sapiens
acctgtgcctgagaattta

SEQ ID NO: 2911744 - DNA, 13 bp, Homo sapiens
acctgtgctggag

SEQ ID NO: 2911745 - DNA, 14 bp, Homo sapiens
acctgtgctggagc

SEQ ID NO: 2911746 - DNA, 23 bp, Homo sapiens
acctgtgcttcgggcccttccca

SEQ ID NO: 2911747 - DNA, 22 bp, Homo sapiens
acctgtgtctgcgaagtcctat

SEQ ID NO: 2911748 - DNA, 15 bp, Homo sapiens
acctgttcacagaaa

SEQ ID NO: 2911749 - DNA, 13 bp, Homo sapiens
acctgttctgtag

SEQ ID NO: 2911750 - DNA, 15 bp, Homo sapiens
acctgttctgtagct

SEQ ID NO: 2911751 - DNA, 20 bp, Homo sapiens
acctgttgagcatcacagaa

SEQ ID NO: 2911752 - DNA, 18 bp, Homo sapiens
acctgttgcttacaattt

SEQ ID NO: 2911753 - DNA, 19 bp, Homo sapiens
acctgttgcttacaatttt

SEQ ID NO: 2911754 - DNA, 18 bp, Homo sapiens
acctgtttttttttcatt

SEQ ID NO: 2911755 - DNA, 12 bp, Homo sapiens
accttaagacct

SEQ ID NO: 2911756 - DNA, 14 bp, Homo sapiens
accttaatttaact

SEQ ID NO: 2911757 - DNA, 15 bp, Homo sapiens
accttaggcagggaa

SEQ ID NO: 2911758 - DNA, 15 bp, Homo sapiens
accttaggccttcct

SEQ ID NO: 2911759 - DNA, 16 bp, Homo sapiens
accttaggccttcctc

SEQ ID NO: 2911760 - DNA, 21 bp, Homo sapiens
accttaggccttcctctctcc

SEQ ID NO: 2911761 - DNA, 15 bp, Homo sapiens
accttagtgtttctg

SEQ ID NO: 2911762 - DNA, 19 bp, Homo sapiens
accttatacatcacttcct

SEQ ID NO: 2911763 - DNA, 16 bp, Homo sapiens
accttcagctcacgct

SEQ ID NO: 2911764 - DNA, 17 bp, Homo sapiens
accttcagctcacgctt

SEQ ID NO: 2911765 - DNA, 14 bp, Homo sapiens
accttcatttcatg

SEQ ID NO: 2911766 - DNA, 17 bp, Homo sapiens
accttccaagagcctga

SEQ ID NO: 2911767 - DNA, 14 bp, Homo sapiens
accttcccaaacgc

SEQ ID NO: 2911768 - DNA, 13 bp, Homo sapiens
accttcccagctc

SEQ ID NO: 2911769 - DNA, 18 bp, Homo sapiens
accttcccagctctccct

SEQ ID NO: 2911770 - DNA, 13 bp, Homo sapiens
accttccccagac

SEQ ID NO: 2911771 - DNA, 13 bp, Homo sapiens
actctctgagctg

SEQ ID NO: 2911772 - DNA, 20 bp, Homo sapiens
actctctgagtacattgtgc

SEQ ID NO: 2911773 - DNA, 14 bp, Homo sapiens
actctctgtcttct

SEQ ID NO: 2911774 - DNA, 20 bp, Homo sapiens
actctctgtcttctctccac

SEQ ID NO: 2911775 - DNA, 14 bp, Homo sapiens
actctgagtgtttt

SEQ ID NO: 2911776 - DNA, 16 bp, Homo sapiens
actctgcaactgaata

SEQ ID NO: 2911777 - DNA, 21 bp, Homo sapiens
actctgcaactgaatacttga

SEQ ID NO: 2911778 - DNA, 22 bp, Homo sapiens
actctgcacatgtcttgtacat

SEQ ID NO: 2911779 - DNA, 22 bp, Homo sapiens
actctgccctctgctgctgccc

SEQ ID NO: 2911780 - DNA, 18 bp, Homo sapiens
actctgctcgccttagca

SEQ ID NO: 2911781 - DNA, 9 bp, Homo sapiens
actctgctg

SEQ ID NO: 2911782 - DNA, 11 bp, Homo sapiens
actctgctgcc

SEQ ID NO: 2911783 - DNA, 12 bp, Homo sapiens
actctgctgcct

SEQ ID NO: 2911784 - DNA, 19 bp, Homo sapiens
actctggcggtggccacag

SEQ ID NO: 2911785 - DNA, 15 bp, Homo sapiens
actctggctccaggc

SEQ ID NO: 2911786 - DNA, 16 bp, Homo sapiens
actctggcttggccta

SEQ ID NO: 2911787 - DNA, 14 bp, Homo sapiens
actctgggcaggga

SEQ ID NO: 2911788 - DNA, 17 bp, Homo sapiens
actctggtcttggaatt

SEQ ID NO: 2911789 - DNA, 14 bp, Homo sapiens
actctggtgcctcc

SEQ ID NO: 2911790 - DNA, 17 bp, Homo sapiens
actctggtgcctccaga

SEQ ID NO: 2911791 - DNA, 17 bp, Homo sapiens
actctgtaaccacctct

SEQ ID NO: 2911792 - DNA, 22 bp, Homo sapiens
actctgtgtaaatatttttccc

SEQ ID NO: 2911793 - DNA, 14 bp, Homo sapiens
actctgttccttca

SEQ ID NO: 2911794 - DNA, 20 bp, Homo sapiens
actctgttccttcacatcct

SEQ ID NO: 2911795 - DNA, 14 bp, Homo sapiens
actctgttgcctcc

SEQ ID NO: 2911796 - DNA, 17 bp, Homo sapiens
actctgttgcctcctct

SEQ ID NO: 2911797 - DNA, 19 bp, Homo sapiens
actctgttgcctcctctct

SEQ ID NO: 2911798 - DNA, 15 bp, Homo sapiens
actcttaatgatgtt

SEQ ID NO: 2911799 - DNA, 16 bp, Homo sapiens
actcttaatgatgtta

SEQ ID NO: 2911800 - DNA, 15 bp, Homo sapiens
actcttcaaatgcct

SEQ ID NO: 2911801 - DNA, 15 bp, Homo sapiens
actcttcactcttca

SEQ ID NO: 2911802 - DNA, 16 bp, Homo sapiens
actcttcactcttcaa

SEQ ID NO: 2911803 - DNA, 16 bp, Homo sapiens
actcttcagagaaatc

SEQ ID NO: 2911804 - DNA, 18 bp, Homo sapiens
actcttcagttaattctt

SEQ ID NO: 2911805 - DNA, 21 bp, Homo sapiens
actcttcagttaattcttaga

SEQ ID NO: 2911806 - DNA, 19 bp, Homo sapiens
actcttccaccagagcagg

SEQ ID NO: 2911807 - DNA, 23 bp, Homo sapiens
actcttccaccagagcaggggct

SEQ ID NO: 2911808 - DNA, 22 bp, Homo sapiens
actcttccaggactctctgctt

SEQ ID NO: 2911809 - DNA, 16 bp, Homo sapiens
actcttctatgaccca

SEQ ID NO: 2911810 - DNA, 19 bp, Homo sapiens
actcttgaagtccaggact

SEQ ID NO: 2911811 - DNA, 12 bp, Homo sapiens
actcttgagaat

SEQ ID NO: 2911812 - DNA, 19 bp, Homo sapiens
actcttgctattgaattga

SEQ ID NO: 2911813 - DNA, 16 bp, Homo sapiens
actcttggagcctgca

SEQ ID NO: 2911814 - DNA, 23 bp, Homo sapiens
actcttggagcctgcagagctgc

SEQ ID NO: 2911815 - DNA, 15 bp, Homo sapiens
actcttggctcgttt

SEQ ID NO: 2911816 - DNA, 20 bp, Homo sapiens
actcttggtcagcttttgtt

SEQ ID NO: 2911817 - DNA, 14 bp, Homo sapiens
actctttatgcttg

SEQ ID NO: 2911818 - DNA, 17 bp, Homo sapiens
actctttatgcttgcaa

SEQ ID NO: 2911819 - DNA, 13 bp, Homo sapiens
actctttcaaaac

SEQ ID NO: 2911820 - DNA, 13 bp, Homo sapiens
actctttgagaaa

SEQ ID NO: 2911821 - DNA, 18 bp, Homo sapiens
actctttgagaaacaaca

SEQ ID NO: 2911822 - DNA, 15 bp, Homo sapiens
actctttggctttaa

SEQ ID NO: 2911823 - DNA, 14 bp, Homo sapiens
actcttttgcttta

SEQ ID NO: 2911824 - DNA, 20 bp, Homo sapiens
actcttttgctttattccag

SEQ ID NO: 2911825 - DNA, 18 bp, Homo sapiens
actctttttgggtccagt

SEQ ID NO: 2911826 - DNA, 15 bp, Homo sapiens
actgaaaaaatacta

SEQ ID NO: 2911827 - DNA, 14 bp, Homo sapiens
actgaaaacatctg

SEQ ID NO: 2911828 - DNA, 13 bp, Homo sapiens
actgaaaagagag

SEQ ID NO: 2911829 - DNA, 14 bp, Homo sapiens
actgaaaagagagc

SEQ ID NO: 2911830 - DNA, 15 bp, Homo sapiens
actgaaaagagagca

SEQ ID NO: 2911831 - DNA, 20 bp, Homo sapiens
actgaaaagagagcagagaa

SEQ ID NO: 2911832 - DNA, 23 bp, Homo sapiens
actgaaaagagagcagagaatat

SEQ ID NO: 2911833 - DNA, 13 bp, Homo sapiens
actgaaagcttta

SEQ ID NO: 2911834 - DNA, 15 bp, Homo sapiens
actgaaatcttgtaa

SEQ ID NO: 2911835 - DNA, 14 bp, Homo sapiens
actgaaattgcctg

SEQ ID NO: 2911836 - DNA, 15 bp, Homo sapiens
actgaaattgcctga

SEQ ID NO: 2911837 - DNA, 22 bp, Homo sapiens
actgaaccaaattgcactgaag

SEQ ID NO: 2911838 - DNA, 24 bp, Homo sapiens
actgaaccaaattgcactgaagtt

SEQ ID NO: 2911839 - DNA, 13 bp, Homo sapiens
actgaactttgaa

SEQ ID NO: 2911840 - DNA, 15 bp, Homo sapiens
actgaagaaagagaa

SEQ ID NO: 2911841 - DNA, 15 bp, Homo sapiens
actgaagatattcca

SEQ ID NO: 2911842 - DNA, 17 bp, Homo sapiens
actgaagatttattttt

SEQ ID NO: 2911843 - DNA, 17 bp, Homo sapiens
actgaagcccagacctc

SEQ ID NO: 2911844 - DNA, 16 bp, Homo sapiens
actgaagcgaacatct

SEQ ID NO: 2911845 - DNA, 17 bp, Homo sapiens
actgaagcgaacatctt

SEQ ID NO: 2911846 - DNA, 14 bp, Homo sapiens
actgaagctgctgt

SEQ ID NO: 2911847 - DNA, 15 bp, Homo sapiens
actgaagctgctgta

SEQ ID NO: 2911848 - DNA, 11 bp, Homo sapiens
actgaaggaga

SEQ ID NO: 2911849 - DNA, 21 bp, Homo sapiens
actgaaggagaaggtgcccca

SEQ ID NO: 2911850 - DNA, 21 bp, Homo sapiens
actgaagtcttactacagaaa

SEQ ID NO: 2911851 - DNA, 16 bp, Homo sapiens
actgaagtgcttgcag

SEQ ID NO: 2911852 - DNA, 18 bp, Homo sapiens
actgaagtttttgaaata

SEQ ID NO: 2911853 - DNA, 19 bp, Homo sapiens
actgaagtttttgaaatac

SEQ ID NO: 2911854 - DNA, 20 bp, Homo sapiens
actgaagtttttgaaatacc

SEQ ID NO: 2911855 - DNA, 16 bp, Homo sapiens
actgaatacaaataga

SEQ ID NO: 2911856 - DNA, 14 bp, Homo sapiens
actgaatacttgaa

SEQ ID NO: 2911857 - DNA, 16 bp, Homo sapiens
actgaatacttgaagt

SEQ ID NO: 2911858 - DNA, 16 bp, Homo sapiens
actgaatcaggaaact

SEQ ID NO: 2911859 - DNA, 12 bp, Homo sapiens
actgaatttcaa

SEQ ID NO: 2911860 - DNA, 17 bp, Homo sapiens
actgacaatgtattttg

SEQ ID NO: 2911861 - DNA, 16 bp, Homo sapiens
actgacacatcagcat

SEQ ID NO: 2911862 - DNA, 20 bp, Homo sapiens
actgacactcccacccagtc

SEQ ID NO: 2911863 - DNA, 12 bp, Homo sapiens
actgaccagaac

SEQ ID NO: 2911864 - DNA, 13 bp, Homo sapiens
actgaccctgggg

SEQ ID NO: 2911865 - DNA, 15 bp, Homo sapiens
actgaccctggggct

SEQ ID NO: 2911866 - DNA, 22 bp, Homo sapiens
actgacctggtccacagggcac

SEQ ID NO: 2911867 - DNA, 20 bp, Homo sapiens
actgacttggatcccaaagc

SEQ ID NO: 2911868 - DNA, 22 bp, Homo sapiens
actgacttggatcccaaagcaa

SEQ ID NO: 2911869 - DNA, 20 bp, Homo sapiens
actgagatccttccttttga

SEQ ID NO: 2911870 - DNA, 13 bp, Homo sapiens
actgagatttctt

SEQ ID NO: 2911871 - DNA, 16 bp, Homo sapiens
actgagatttcttaaa

SEQ ID NO: 2911872 - DNA, 17 bp, Homo sapiens
actgagatttcttaaat

SEQ ID NO: 2911873 - DNA, 15 bp, Homo sapiens
actgagcatctccag

SEQ ID NO: 2911874 - DNA, 13 bp, Homo sapiens
actgagccagatt

SEQ ID NO: 2911875 - DNA, 15 bp, Homo sapiens
actgagcgaggaaaa

SEQ ID NO: 2911876 - DNA, 20 bp, Homo sapiens
actgagcgaggaaaaacaac

SEQ ID NO: 2911877 - DNA, 14 bp, Homo sapiens
actgagctctccag

SEQ ID NO: 2911878 - DNA, 14 bp, Homo sapiens
actgagctctgcct

SEQ ID NO: 2911879 - DNA, 17 bp, Homo sapiens
actgagctctgcctcaa

SEQ ID NO: 2911880 - DNA, 21 bp, Homo sapiens
actgaggcctgagacccagga

SEQ ID NO: 2911881 - DNA, 21 bp, Homo sapiens
actgaggccttgtgtgtcagg

SEQ ID NO: 2911882 - DNA, 22 bp, Homo sapiens
actgaggccttgtgtgtcaggc

SEQ ID NO: 2911883 - DNA, 12 bp, Homo sapiens
actgagggcagt

SEQ ID NO: 2911884 - DNA, 23 bp, Homo sapiens
actgagggcagtcgatagagctg

SEQ ID NO: 2911885 - DNA, 21 bp, Homo sapiens
actgagtagctttcatttact

SEQ ID NO: 2911886 - DNA, 22 bp, Homo sapiens
actgagtagctttcatttactg

SEQ ID NO: 2911887 - DNA, 22 bp, Homo sapiens
actgagtgaaggaagagagaca

SEQ ID NO: 2911888 - DNA, 15 bp, Homo sapiens
actgataaaaatgat

SEQ ID NO: 2911889 - DNA, 16 bp, Homo sapiens
actgataaaaatgata

SEQ ID NO: 2911890 - DNA, 15 bp, Homo sapiens
actgatagttactgt

SEQ ID NO: 2911891 - DNA, 17 bp, Homo sapiens
actgatagttactgttg

SEQ ID NO: 2911892 - DNA, 13 bp, Homo sapiens
actgatattcaga

SEQ ID NO: 2911893 - DNA, 15 bp, Homo sapiens
actgatcacaaaaac

SEQ ID NO: 2911894 - DNA, 16 bp, Homo sapiens
actgatcatctgctgt

SEQ ID NO: 2911895 - DNA, 17 bp, Homo sapiens
actgatccctggccact

SEQ ID NO: 2911896 - DNA, 20 bp, Homo sapiens
actgatctttgtatattaca

SEQ ID NO: 2911897 - DNA, 17 bp, Homo sapiens
actgatgacaaacccag

SEQ ID NO: 2911898 - DNA, 18 bp, Homo sapiens
actgatgacaaacccagg

SEQ ID NO: 2911899 - DNA, 12 bp, Homo sapiens
actgatgcaagg

SEQ ID NO: 2911900 - DNA, 13 bp, Homo sapiens
actgatgcaagga

SEQ ID NO: 2911901 - DNA, 12 bp, Homo sapiens
actgatgccaag

SEQ ID NO: 2911902 - DNA, 15 bp, Homo sapiens
actgatgctgcccct

SEQ ID NO: 2911903 - DNA, 15 bp, Homo sapiens
actgatggattccaa

SEQ ID NO: 2911904 - DNA, 15 bp, Homo sapiens
actgattagtattca

SEQ ID NO: 2911905 - DNA, 16 bp, Homo sapiens
actggtgcactttgta

SEQ ID NO: 2911906 - DNA, 18 bp, Homo sapiens
actggtgcactttgtaaa

SEQ ID NO: 2911907 - DNA, 19 bp, Homo sapiens
actggtgtaatctcaatgc

SEQ ID NO: 2911908 - DNA, 15 bp, Homo sapiens
actggtgtatctcag

SEQ ID NO: 2911909 - DNA, 21 bp, Homo sapiens
actggtgttatcaccgtgggc

SEQ ID NO: 2911910 - DNA, 12 bp, Homo sapiens
actggttctcaa

SEQ ID NO: 2911911 - DNA, 21 bp, Homo sapiens
actggtttgtatgatgtatta

SEQ ID NO: 2911912 - DNA, 21 bp, Homo sapiens
actggttttacttacaaaaat

SEQ ID NO: 2911913 - DNA, 17 bp, Homo sapiens
actgtaaaataataact

SEQ ID NO: 2911914 - DNA, 17 bp, Homo sapiens
actgtaaaccaattttt

SEQ ID NO: 2911915 - DNA, 16 bp, Homo sapiens
actgtaaatatgaatc

SEQ ID NO: 2911916 - DNA, 10 bp, Homo sapiens
actgtaaatt

SEQ ID NO: 2911917 - DNA, 14 bp, Homo sapiens
actgtaagaataat

SEQ ID NO: 2911918 - DNA, 15 bp, Homo sapiens
actgtaagaataatt

SEQ ID NO: 2911919 - DNA, 23 bp, Homo sapiens
actgtaagaataatttatagtaa

SEQ ID NO: 2911920 - DNA, 16 bp, Homo sapiens
actgtaataaagatga

SEQ ID NO: 2911921 - DNA, 15 bp, Homo sapiens
actgtagaaatgatg

SEQ ID NO: 2911922 - DNA, 16 bp, Homo sapiens
actgtagaactgattt

SEQ ID NO: 2911923 - DNA, 18 bp, Homo sapiens
actgtagaactgatttta

SEQ ID NO: 2911924 - DNA, 22 bp, Homo sapiens
actgtagaagaagtgaacactt

SEQ ID NO: 2911925 - DNA, 15 bp, Homo sapiens
actgtagatgatgta

SEQ ID NO: 2911926 - DNA, 22 bp, Homo sapiens
actgtatctaggcaacatagta

SEQ ID NO: 2911927 - DNA, 23 bp, Homo sapiens
actgtatctaggcaacatagtat

SEQ ID NO: 2911928 - DNA, 15 bp, Homo sapiens
actgtatgatttata

SEQ ID NO: 2911929 - DNA, 22 bp, Homo sapiens
actgtatgggggagattgaact

SEQ ID NO: 2911930 - DNA, 14 bp, Homo sapiens
actgtatttgtgac

SEQ ID NO: 2911931 - DNA, 15 bp, Homo sapiens
actgtcactcattgc

SEQ ID NO: 2911932 - DNA, 24 bp, Homo sapiens
actgtcactcattgctgagcctct

SEQ ID NO: 2911933 - DNA, 22 bp, Homo sapiens
actgtcactgccgacatccctc

SEQ ID NO: 2911934 - DNA, 12 bp, Homo sapiens
actgtcagggag

SEQ ID NO: 2911935 - DNA, 16 bp, Homo sapiens
actgtcagggagggcc

SEQ ID NO: 2911936 - DNA, 23 bp, Homo sapiens
actgtcagggagggccagggagg

SEQ ID NO: 2911937 - DNA, 12 bp, Homo sapiens
actgtcccagct

SEQ ID NO: 2911938 - DNA, 16 bp, Homo sapiens
actgtcccagtagcca

SEQ ID NO: 2911939 - DNA, 16 bp, Homo sapiens
actgtccctcctggtg

SEQ ID NO: 2911940 - DNA, 21 bp, Homo sapiens
actgtccctcctggtgtcacc

SEQ ID NO: 2911941 - DNA, 15 bp, Homo sapiens
actgtccctctcagt

SEQ ID NO: 2911942 - DNA, 21 bp, Homo sapiens
actgtccctctcagtgccttc

SEQ ID NO: 2911943 - DNA, 14 bp, Homo sapiens
actgtccctgcttt

SEQ ID NO: 2911944 - DNA, 16 bp, Homo sapiens
actgtcctccaagcca

SEQ ID NO: 2911945 - DNA, 16 bp, Homo sapiens
actgtcctgggcctgc

SEQ ID NO: 2911946 - DNA, 19 bp, Homo sapiens
actgtcctgggcctgcaga

SEQ ID NO: 2911947 - DNA, 14 bp, Homo sapiens
actgtcggaggaaa

SEQ ID NO: 2911948 - DNA, 19 bp, Homo sapiens
actgtcggaggaaagacaa

SEQ ID NO: 2911949 - DNA, 21 bp, Homo sapiens
actgtcggaggaaagacaaca

SEQ ID NO: 2911950 - DNA, 21 bp, Homo sapiens
actgtctcgatgcaatgaaca

SEQ ID NO: 2911951 - DNA, 10 bp, Homo sapiens
actgtctctc

SEQ ID NO: 2911952 - DNA, 20 bp, Homo sapiens
actgtctctcttgtcacatg

SEQ ID NO: 2911953 - DNA, 21 bp, Homo sapiens
actgtctctcttgtcacatgg

SEQ ID NO: 2911954 - DNA, 16 bp, Homo sapiens
actgtcttaaatcagt

SEQ ID NO: 2911955 - DNA, 19 bp, Homo sapiens
actgtcttacctggcagca

SEQ ID NO: 2911956 - DNA, 17 bp, Homo sapiens
actgtctttttcttacc

SEQ ID NO: 2911957 - DNA, 23 bp, Homo sapiens
actgtgaagttacatgcataaaa

SEQ ID NO: 2911958 - DNA, 14 bp, Homo sapiens
actgtgacaatgac

SEQ ID NO: 2911959 - DNA, 17 bp, Homo sapiens
actgtgacaatgactaa

SEQ ID NO: 2911960 - DNA, 16 bp, Homo sapiens
actgtgagactgtatg

SEQ ID NO: 2911961 - DNA, 21 bp, Homo sapiens
actgtgagctcccaggtgcag

SEQ ID NO: 2911962 - DNA, 16 bp, Homo sapiens
actgtgagcttacatt

SEQ ID NO: 2911963 - DNA, 22 bp, Homo sapiens
actgtgagcttacattgaaaac

SEQ ID NO: 2911964 - DNA, 21 bp, Homo sapiens
actgtgatgaagccgacctta

SEQ ID NO: 2911965 - DNA, 19 bp, Homo sapiens
actgtgattactctttgct

SEQ ID NO: 2911966 - DNA, 15 bp, Homo sapiens
actgtgcacatctgt

SEQ ID NO: 2911967 - DNA, 21 bp, Homo sapiens
actgtgcagagtctagaagtt

SEQ ID NO: 2911968 - DNA, 21 bp, Homo sapiens
actgtgcggcacaggaaacag

SEQ ID NO: 2911969 - DNA, 15 bp, Homo sapiens
actgtgctcccacgg

SEQ ID NO: 2911970 - DNA, 20 bp, Homo sapiens
actgtggaagtccctcagag

SEQ ID NO: 2911971 - DNA, 22 bp, Homo sapiens
actgtggagactttctgttact

SEQ ID NO: 2911972 - DNA, 19 bp, Homo sapiens
actgtggcacttgcctggg

SEQ ID NO: 2911973 - DNA, 20 bp, Homo sapiens
actgtggcacttgcctgggt

SEQ ID NO: 2911974 - DNA, 17 bp, Homo sapiens
actgtggccgttatctg

SEQ ID NO: 2911975 - DNA, 19 bp, Homo sapiens
actgtgggcaatttagaaa

SEQ ID NO: 2911976 - DNA, 17 bp, Homo sapiens
actgtggtagctccagc

SEQ ID NO: 2911977 - DNA, 18 bp, Homo sapiens
actgtggtagctccagcg

SEQ ID NO: 2911978 - DNA, 22 bp, Homo sapiens
actgtggttaatccaatcaatt

SEQ ID NO: 2911979 - DNA, 13 bp, Homo sapiens
actgtgtcacatc

SEQ ID NO: 2911980 - DNA, 14 bp, Homo sapiens
actgtgtctctatg

SEQ ID NO: 2911981 - DNA, 15 bp, Homo sapiens
actgtgtctctatgt

SEQ ID NO: 2911982 - DNA, 20 bp, Homo sapiens
actgtgtctctatgtgaata

SEQ ID NO: 2911983 - DNA, 18 bp, Homo sapiens
actgtgtgtgtgaatgaa

SEQ ID NO: 2911984 - DNA, 18 bp, Homo sapiens
actgtgtttctgtgctcc

SEQ ID NO: 2911985 - DNA, 21 bp, Homo sapiens
actgttacctgatcaatgaca

SEQ ID NO: 2911986 - DNA, 23 bp, Homo sapiens
actgttacctgatcaatgacaga

SEQ ID NO: 2911987 - DNA, 18 bp, Homo sapiens
actgttactgggccctga

SEQ ID NO: 2911988 - DNA, 15 bp, Homo sapiens
actgttatccatatt

SEQ ID NO: 2911989 - DNA, 16 bp, Homo sapiens
actgttccccctgtgc

SEQ ID NO: 2911990 - DNA, 14 bp, Homo sapiens
actgttctaaagct

SEQ ID NO: 2911991 - DNA, 17 bp, Homo sapiens
actgttctaaagctctg

SEQ ID NO: 2911992 - DNA, 13 bp, Homo sapiens
actgttgaacaat

SEQ ID NO: 2911993 - DNA, 16 bp, Homo sapiens
actgttgcagtggcct

SEQ ID NO: 2911994 - DNA, 20 bp, Homo sapiens
actgttgcttaattgtgaac

SEQ ID NO: 2911995 - DNA, 19 bp, Homo sapiens
actgttgtgacctgaagtt

SEQ ID NO: 2911996 - DNA, 22 bp, Homo sapiens
actgttgtgctccatagagcag

SEQ ID NO: 2911997 - DNA, 18 bp, Homo sapiens
actgtttaaagctttgaa

SEQ ID NO: 2911998 - DNA, 19 bp, Homo sapiens
actgtttaaagctttgaat

SEQ ID NO: 2911999 - DNA, 20 bp, Homo sapiens
actgtttattgaaagaatta

SEQ ID NO: 2912000 - DNA, 20 bp, Homo sapiens
actgtttcacttgctcttgg

SEQ ID NO: 2912001 - DNA, 16 bp, Homo sapiens
actgtttgtttttaaa

SEQ ID NO: 2912002 - DNA, 23 bp, Homo sapiens
actgtttgtttttaaaaagcaaa

SEQ ID NO: 2912003 - DNA, 23 bp, Homo sapiens
actgttttatctccatactttgg

SEQ ID NO: 2912004 - DNA, 22 bp, Homo sapiens
actgtttttccatagttttgat

SEQ ID NO: 2912005 - DNA, 14 bp, Homo sapiens
acttaaaaaaatgg

SEQ ID NO: 2912006 - DNA, 15 bp, Homo sapiens
acttaaaagctggct

SEQ ID NO: 2912007 - DNA, 22 bp, Homo sapiens
acttaaaagtcagtatcatatt

SEQ ID NO: 2912008 - DNA, 15 bp, Homo sapiens
acttaaacagaagca

SEQ ID NO: 2912009 - DNA, 19 bp, Homo sapiens
acttaaacagaagcagagg

SEQ ID NO: 2912010 - DNA, 23 bp, Homo sapiens
acttaaacttccttaaaaagtgg

SEQ ID NO: 2912011 - DNA, 15 bp, Homo sapiens
acttaaagatttatc

SEQ ID NO: 2912012 - DNA, 13 bp, Homo sapiens
acttaaattttag

SEQ ID NO: 2912013 - DNA, 16 bp, Homo sapiens
acttaacttaaaattg

SEQ ID NO: 2912014 - DNA, 18 bp, Homo sapiens
acttaatactaccttgaa

SEQ ID NO: 2912015 - DNA, 17 bp, Homo sapiens
acttaatactgaatttc

SEQ ID NO: 2912016 - DNA, 20 bp, Homo sapiens
acttaatattagcttgctta

SEQ ID NO: 2912017 - DNA, 12 bp, Homo sapiens
acttaatttcaa

SEQ ID NO: 2912018 - DNA, 20 bp, Homo sapiens
acttacaaaaatgggaaaaa

SEQ ID NO: 2912019 - DNA, 15 bp, Homo sapiens
acttacaaccttgtc

SEQ ID NO: 2912020 - DNA, 21 bp, Homo sapiens
acttaccgtgagcgacaaaga

SEQ ID NO: 2912021 - DNA, 16 bp, Homo sapiens
acttactctaagatct

SEQ ID NO: 2912022 - DNA, 18 bp, Homo sapiens
acttagaacctttctgtg

SEQ ID NO: 2912023 - DNA, 15 bp, Homo sapiens
acttagaggaaaatg

SEQ ID NO: 2912024 - DNA, 16 bp, Homo sapiens
acttagaggaaaatga

SEQ ID NO: 2912025 - DNA, 16 bp, Homo sapiens
acttagatatttcatg

SEQ ID NO: 2912026 - DNA, 18 bp, Homo sapiens
acttagatctctcctgca

SEQ ID NO: 2912027 - DNA, 14 bp, Homo sapiens
acttaggctttgta

SEQ ID NO: 2912028 - DNA, 18 bp, Homo sapiens
acttaggtttcaggaagt

SEQ ID NO: 2912029 - DNA, 18 bp, Homo sapiens
acttataaagaaggttgg

SEQ ID NO: 2912030 - DNA, 18 bp, Homo sapiens
acttataaagtagaaatg

SEQ ID NO: 2912031 - DNA, 23 bp, Homo sapiens
acttataaggtgttttctgtgta

SEQ ID NO: 2912032 - DNA, 15 bp, Homo sapiens
acttatcaacactat

SEQ ID NO: 2912033 - DNA, 20 bp, Homo sapiens
acttatcaacactataattg

SEQ ID NO: 2912034 - DNA, 19 bp, Homo sapiens
acttatcatccacattgtt

SEQ ID NO: 2912035 - DNA, 20 bp, Homo sapiens
acttatctctaaaccatcta

SEQ ID NO: 2912036 - DNA, 22 bp, Homo sapiens
agaatgtgtttcaaactgtaaa

SEQ ID NO: 2912037 - DNA, 16 bp, Homo sapiens
agaattaaaatttatt

SEQ ID NO: 2912038 - DNA, 13 bp, Homo sapiens
agaattactgtaa

SEQ ID NO: 2912039 - DNA, 14 bp, Homo sapiens
agaattactgtaac

SEQ ID NO: 2912040 - DNA, 23 bp, Homo sapiens
agaattacttgtgttacttgcca

SEQ ID NO: 2912041 - DNA, 12 bp, Homo sapiens
agaattctagct

SEQ ID NO: 2912042 - DNA, 22 bp, Homo sapiens
agaattctagcttttttcctcc

SEQ ID NO: 2912043 - DNA, 14 bp, Homo sapiens
agaattctggtcct

SEQ ID NO: 2912044 - DNA, 14 bp, Homo sapiens
agaattctgttcta

SEQ ID NO: 2912045 - DNA, 23 bp, Homo sapiens
agaattctgttctaaaactccaa

SEQ ID NO: 2912046 - DNA, 16 bp, Homo sapiens
agaattcttacatgtt

SEQ ID NO: 2912047 - DNA, 20 bp, Homo sapiens
agaattcttacatgttttct

SEQ ID NO: 2912048 - DNA, 17 bp, Homo sapiens
agaattgaacccaggag

SEQ ID NO: 2912049 - DNA, 19 bp, Homo sapiens
agaattgaacccaggaggt

SEQ ID NO: 2912050 - DNA, 20 bp, Homo sapiens
agaattgatatacacggatg

SEQ ID NO: 2912051 - DNA, 15 bp, Homo sapiens
agaattgatttccaa

SEQ ID NO: 2912052 - DNA, 14 bp, Homo sapiens
agaattgccaatct

SEQ ID NO: 2912053 - DNA, 17 bp, Homo sapiens
agaattgccaatcttgt

SEQ ID NO: 2912054 - DNA, 17 bp, Homo sapiens
agaattgttagatggca

SEQ ID NO: 2912055 - DNA, 22 bp, Homo sapiens
agaatttaaattctttttcaaa

SEQ ID NO: 2912056 - DNA, 15 bp, Homo sapiens
agaatttaattttta

SEQ ID NO: 2912057 - DNA, 17 bp, Homo sapiens
agaatttcactgtcttt

SEQ ID NO: 2912058 - DNA, 14 bp, Homo sapiens
agaattttaaaaat

SEQ ID NO: 2912059 - DNA, 16 bp, Homo sapiens
agaattttaaaaatga

SEQ ID NO: 2912060 - DNA, 13 bp, Homo sapiens
agaattttaatgt

SEQ ID NO: 2912061 - DNA, 23 bp, Homo sapiens
agaattttaatgtgaagacattt

SEQ ID NO: 2912062 - DNA, 20 bp, Homo sapiens
agaattttcagaccccagcg

SEQ ID NO: 2912063 - DNA, 15 bp, Homo sapiens
agaatttttaactgt

SEQ ID NO: 2912064 - DNA, 20 bp, Homo sapiens
agaattttttttgttgtttc

SEQ ID NO: 2912065 - DNA, 13 bp, Homo sapiens
agacaaaagaaaa

SEQ ID NO: 2912066 - DNA, 13 bp, Homo sapiens
agacaaaatcaaa

SEQ ID NO: 2912067 - DNA, 24 bp, Homo sapiens
agacaaaatctctatactgccctg

SEQ ID NO: 2912068 - DNA, 10 bp, Homo sapiens
agacaaacac

SEQ ID NO: 2912069 - DNA, 15 bp, Homo sapiens
agacaaagcaggagt

SEQ ID NO: 2912070 - DNA, 18 bp, Homo sapiens
agacaaatactcatgtgt

SEQ ID NO: 2912071 - DNA, 16 bp, Homo sapiens
agacaaatatttggag

SEQ ID NO: 2912072 - DNA, 20 bp, Homo sapiens
agacaaatcctttctgcccc

SEQ ID NO: 2912073 - DNA, 23 bp, Homo sapiens
agacaaatcctttctgcccccca

SEQ ID NO: 2912074 - DNA, 23 bp, Homo sapiens
agacaaattactgataaaaatga

SEQ ID NO: 2912075 - DNA, 13 bp, Homo sapiens
agacaaggagagc

SEQ ID NO: 2912076 - DNA, 20 bp, Homo sapiens
agacaatgtctgcagccctg

SEQ ID NO: 2912077 - DNA, 22 bp, Homo sapiens
agacaatgttgtgtttggattt

SEQ ID NO: 2912078 - DNA, 16 bp, Homo sapiens
agacacacttaactac

SEQ ID NO: 2912079 - DNA, 12 bp, Homo sapiens
agacacagatgt

SEQ ID NO: 2912080 - DNA, 13 bp, Homo sapiens
agacacaggccct

SEQ ID NO: 2912081 - DNA, 15 bp, Homo sapiens
agacaccaaagttct

SEQ ID NO: 2912082 - DNA, 14 bp, Homo sapiens
agacaccagccact

SEQ ID NO: 2912083 - DNA, 19 bp, Homo sapiens
agacaccctcaacctcttc

SEQ ID NO: 2912084 - DNA, 15 bp, Homo sapiens
agacaccctggcagc

SEQ ID NO: 2912085 - DNA, 16 bp, Homo sapiens
agacaccgtggacagc

SEQ ID NO: 2912086 - DNA, 17 bp, Homo sapiens
agacaccgttcattcag

SEQ ID NO: 2912087 - DNA, 16 bp, Homo sapiens
agacacctgcacctcc

SEQ ID NO: 2912088 - DNA, 19 bp, Homo sapiens
agacacctgttcacagaaa

SEQ ID NO: 2912089 - DNA, 12 bp, Homo sapiens
agacaccttcat

SEQ ID NO: 2912090 - DNA, 20 bp, Homo sapiens
agacaccttctgtgctcatg

SEQ ID NO: 2912091 - DNA, 22 bp, Homo sapiens
agacactccccgaagtcttttg

SEQ ID NO: 2912092 - DNA, 14 bp, Homo sapiens
agacagacatacat

SEQ ID NO: 2912093 - DNA, 14 bp, Homo sapiens
agacagaccctctg

SEQ ID NO: 2912094 - DNA, 19 bp, Homo sapiens
agacagagaatatgtctgc

SEQ ID NO: 2912095 - DNA, 16 bp, Homo sapiens
agacagagcctcgctc

SEQ ID NO: 2912096 - DNA, 14 bp, Homo sapiens
agacagatcactcc

SEQ ID NO: 2912097 - DNA, 16 bp, Homo sapiens
agacagatcactcctg

SEQ ID NO: 2912098 - DNA, 20 bp, Homo sapiens
agacagatcactcctggagg

SEQ ID NO: 2912099 - DNA, 21 bp, Homo sapiens
agacagattttcggaacacat

SEQ ID NO: 2912100 - DNA, 11 bp, Homo sapiens
agacagcctct

SEQ ID NO: 2912101 - DNA, 21 bp, Homo sapiens
agacagctccaccctggccga

SEQ ID NO: 2912102 - DNA, 19 bp, Homo sapiens
agacaggaaaatcctctgg

SEQ ID NO: 2912103 - DNA, 19 bp, Homo sapiens
agacaggaaagttcagagt

SEQ ID NO: 2912104 - DNA, 21 bp, Homo sapiens
agacaggaagaccaaggcctc

SEQ ID NO: 2912105 - DNA, 14 bp, Homo sapiens
agacaggagaatca

SEQ ID NO: 2912106 - DNA, 23 bp, Homo sapiens
agacaggcggggcccagcgctct

SEQ ID NO: 2912107 - DNA, 17 bp, Homo sapiens
agacagtatacagtcct

SEQ ID NO: 2912108 - DNA, 14 bp, Homo sapiens
agacagtgggaaat

SEQ ID NO: 2912109 - DNA, 16 bp, Homo sapiens
agacagttcttttcta

SEQ ID NO: 2912110 - DNA, 21 bp, Homo sapiens
agacagttttgagaacgtaaa

SEQ ID NO: 2912111 - DNA, 14 bp, Homo sapiens
agacatacttgaag

SEQ ID NO: 2912112 - DNA, 20 bp, Homo sapiens
agacatacttgaagggccag

SEQ ID NO: 2912113 - DNA, 16 bp, Homo sapiens
agacatagcatccaag

SEQ ID NO: 2912114 - DNA, 20 bp, Homo sapiens
agacatatattatatataga

SEQ ID NO: 2912115 - DNA, 21 bp, Homo sapiens
agacatatttcagtgattttt

SEQ ID NO: 2912116 - DNA, 19 bp, Homo sapiens
agacatccataaagaagca

SEQ ID NO: 2912117 - DNA, 16 bp, Homo sapiens
agacatccttgcagtt

SEQ ID NO: 2912118 - DNA, 16 bp, Homo sapiens
agacatggaggttcta

SEQ ID NO: 2912119 - DNA, 21 bp, Homo sapiens
agacatggaggttctaaggcc

SEQ ID NO: 2912120 - DNA, 17 bp, Homo sapiens
agacatgttttagacaa

SEQ ID NO: 2912121 - DNA, 22 bp, Homo sapiens
agacattaactcattagactgg

SEQ ID NO: 2912122 - DNA, 15 bp, Homo sapiens
agacattctgccagg

SEQ ID NO: 2912123 - DNA, 21 bp, Homo sapiens
agacattgcaattttgcatag

SEQ ID NO: 2912124 - DNA, 23 bp, Homo sapiens
agacattgcaattttgcatagct

SEQ ID NO: 2912125 - DNA, 18 bp, Homo sapiens
agacattgggtctattcc

SEQ ID NO: 2912126 - DNA, 23 bp, Homo sapiens
agacattgggtctattccagctc

SEQ ID NO: 2912127 - DNA, 22 bp, Homo sapiens
agacattgtttggatttccttt

SEQ ID NO: 2912128 - DNA, 13 bp, Homo sapiens
agacatttatgtg

SEQ ID NO: 2912129 - DNA, 13 bp, Homo sapiens
agacatttcaaaa

SEQ ID NO: 2912130 - DNA, 20 bp, Homo sapiens
agacattttaacaagaagat

SEQ ID NO: 2912131 - DNA, 14 bp, Homo sapiens
agacattttcatat

SEQ ID NO: 2912132 - DNA, 15 bp, Homo sapiens
agacattttttgcta

SEQ ID NO: 2912133 - DNA, 17 bp, Homo sapiens
agacattttttgctata

SEQ ID NO: 2912134 - DNA, 18 bp, Homo sapiens
agacattttttgctataa

SEQ ID NO: 2912135 - DNA, 15 bp, Homo sapiens
agaccaaaaatcaac

SEQ ID NO: 2912136 - DNA, 15 bp, Homo sapiens
agaccaaaaggagag

SEQ ID NO: 2912137 - DNA, 14 bp, Homo sapiens
agaccaaattttga

SEQ ID NO: 2912138 - DNA, 21 bp, Homo sapiens
agaccaaattttgaggtcttt

SEQ ID NO: 2912139 - DNA, 21 bp, Homo sapiens
agaccaaggcctcggcagaac

SEQ ID NO: 2912140 - DNA, 16 bp, Homo sapiens
agaccaccacttcgaa

SEQ ID NO: 2912141 - DNA, 22 bp, Homo sapiens
agaccagcctggccaacatggc

SEQ ID NO: 2912142 - DNA, 22 bp, Homo sapiens
agaccagcctgggcaacaaagt

SEQ ID NO: 2912143 - DNA, 14 bp, Homo sapiens
agaccagcctttct

SEQ ID NO: 2912144 - DNA, 23 bp, Homo sapiens
agaccaggggaccagagggatgg

SEQ ID NO: 2912145 - DNA, 14 bp, Homo sapiens
agacccaaggagga

SEQ ID NO: 2912146 - DNA, 19 bp, Homo sapiens
agacccagccctcatcccg

SEQ ID NO: 2912147 - DNA, 11 bp, Homo sapiens
agacccaggac

SEQ ID NO: 2912148 - DNA, 19 bp, Homo sapiens
agacccccggaacaagcct

SEQ ID NO: 2912149 - DNA, 15 bp, Homo sapiens
agacccgaggaaact

SEQ ID NO: 2912150 - DNA, 18 bp, Homo sapiens
agaccctaccccaccacg

SEQ ID NO: 2912151 - DNA, 17 bp, Homo sapiens
agaccctctcaggctgt

SEQ ID NO: 2912152 - DNA, 21 bp, Homo sapiens
agaccctctcaggctgtccca

SEQ ID NO: 2912153 - DNA, 17 bp, Homo sapiens
agaccctctttcttgtt

SEQ ID NO: 2912154 - DNA, 22 bp, Homo sapiens
agaccctctttcttgtttgtca

SEQ ID NO: 2912155 - DNA, 13 bp, Homo sapiens
agaccctgtctca

SEQ ID NO: 2912156 - DNA, 18 bp, Homo sapiens
agacctactgttctaaag

SEQ ID NO: 2912157 - DNA, 19 bp, Homo sapiens
agacctactgttctaaagc

SEQ ID NO: 2912158 - DNA, 22 bp, Homo sapiens
agacctactgttctaaagctct

SEQ ID NO: 2912159 - DNA, 15 bp, Homo sapiens
agacctcagatgtgt

SEQ ID NO: 2912160 - DNA, 17 bp, Homo sapiens
agacctcagatgtgttg

SEQ ID NO: 2912161 - DNA, 12 bp, Homo sapiens
agacctcagcca

SEQ ID NO: 2912162 - DNA, 14 bp, Homo sapiens
agacctcagccatg

SEQ ID NO: 2912163 - DNA, 18 bp, Homo sapiens
agacctcagccatgagga

SEQ ID NO: 2912164 - DNA, 14 bp, Homo sapiens
agacctcagggcac

SEQ ID NO: 2912165 - DNA, 18 bp, Homo sapiens
agacctctgtgcacttat

SEQ ID NO: 2912166 - DNA, 15 bp, Homo sapiens
agacctcttcatgtt

SEQ ID NO: 2912167 - DNA, 22 bp, Homo sapiens
agacctgatcctggaggcccag

SEQ ID NO: 2912168 - DNA, 20 bp, Homo sapiens
agatcccaacactgccagca

SEQ ID NO: 2912169 - DNA, 22 bp, Homo sapiens
agatcccaagtagaatctcagt

SEQ ID NO: 2912170 - DNA, 21 bp, Homo sapiens
agatcctaagggtcgaaagct

SEQ ID NO: 2912171 - DNA, 23 bp, Homo sapiens
agatcctaagggtcgaaagctct

SEQ ID NO: 2912172 - DNA, 19 bp, Homo sapiens
agatcctacttctctgagt

SEQ ID NO: 2912173 - DNA, 14 bp, Homo sapiens
agatcctcttctca

SEQ ID NO: 2912174 - DNA, 20 bp, Homo sapiens
agatcctcttctcaaagctg

SEQ ID NO: 2912175 - DNA, 20 bp, Homo sapiens
agatccttgtttcaaacaca

SEQ ID NO: 2912176 - DNA, 20 bp, Homo sapiens
agatcctttaaatccttcca

SEQ ID NO: 2912177 - DNA, 21 bp, Homo sapiens
agatcgtccactgtcaagtgt

SEQ ID NO: 2912178 - DNA, 16 bp, Homo sapiens
agatctcactctgccc

SEQ ID NO: 2912179 - DNA, 22 bp, Homo sapiens
agatctcggtttgccaaaattc

SEQ ID NO: 2912180 - DNA, 16 bp, Homo sapiens
agatctctgcagggcc

SEQ ID NO: 2912181 - DNA, 16 bp, Homo sapiens
agatctgaacccagct

SEQ ID NO: 2912182 - DNA, 19 bp, Homo sapiens
agatctgctttctgttcat

SEQ ID NO: 2912183 - DNA, 20 bp, Homo sapiens
agatctgctttctgttcatc

SEQ ID NO: 2912184 - DNA, 13 bp, Homo sapiens
agatctggaacct

SEQ ID NO: 2912185 - DNA, 17 bp, Homo sapiens
agatctggaacctcagc

SEQ ID NO: 2912186 - DNA, 19 bp, Homo sapiens
agatctggaacctcagcct

SEQ ID NO: 2912187 - DNA, 13 bp, Homo sapiens
agatctggcatgt

SEQ ID NO: 2912188 - DNA, 14 bp, Homo sapiens
agatctgtcctcag

SEQ ID NO: 2912189 - DNA, 15 bp, Homo sapiens
agatctgtcctcagc

SEQ ID NO: 2912190 - DNA, 14 bp, Homo sapiens
agatcttagattct

SEQ ID NO: 2912191 - DNA, 16 bp, Homo sapiens
agatcttgagagagaa

SEQ ID NO: 2912192 - DNA, 11 bp, Homo sapiens
agatgaaaacc

SEQ ID NO: 2912193 - DNA, 16 bp, Homo sapiens
agatgaaggagaggca

SEQ ID NO: 2912194 - DNA, 19 bp, Homo sapiens
agatgaagttttacattgt

SEQ ID NO: 2912195 - DNA, 15 bp, Homo sapiens
agatgacattgctaa

SEQ ID NO: 2912196 - DNA, 15 bp, Homo sapiens
agatgacattttaaa

SEQ ID NO: 2912197 - DNA, 20 bp, Homo sapiens
agatgaccaaagtcccttcc

SEQ ID NO: 2912198 - DNA, 16 bp, Homo sapiens
agatgacccctacccc

SEQ ID NO: 2912199 - DNA, 21 bp, Homo sapiens
agatgacccctaccccctcat

SEQ ID NO: 2912200 - DNA, 22 bp, Homo sapiens
agatgacccctaccccctcatc

SEQ ID NO: 2912201 - DNA, 20 bp, Homo sapiens
agatgactttgcagatggaa

SEQ ID NO: 2912202 - DNA, 23 bp, Homo sapiens
agatgactttgcagatggaaaga

SEQ ID NO: 2912203 - DNA, 19 bp, Homo sapiens
agatgagcagtgagtgacc

SEQ ID NO: 2912204 - DNA, 18 bp, Homo sapiens
agatgataaaaggaatct

SEQ ID NO: 2912205 - DNA, 18 bp, Homo sapiens
agatgataatttagtgga

SEQ ID NO: 2912206 - DNA, 13 bp, Homo sapiens
agatgatcaggga

SEQ ID NO: 2912207 - DNA, 20 bp, Homo sapiens
agatgattaaataagattct

SEQ ID NO: 2912208 - DNA, 13 bp, Homo sapiens
agatgattgaata

SEQ ID NO: 2912209 - DNA, 16 bp, Homo sapiens
agatgcaagtctcttg

SEQ ID NO: 2912210 - DNA, 20 bp, Homo sapiens
agatgcaatgactcaggaca

SEQ ID NO: 2912211 - DNA, 18 bp, Homo sapiens
agatgcaattgctcccat

SEQ ID NO: 2912212 - DNA, 14 bp, Homo sapiens
agatgcagaaaaag

SEQ ID NO: 2912213 - DNA, 14 bp, Homo sapiens
agatgcagagtaag

SEQ ID NO: 2912214 - DNA, 11 bp, Homo sapiens
agatgcagcct

SEQ ID NO: 2912215 - DNA, 13 bp, Homo sapiens
agatgcagccttc

SEQ ID NO: 2912216 - DNA, 13 bp, Homo sapiens
agatgcagggcag

SEQ ID NO: 2912217 - DNA, 16 bp, Homo sapiens
agatgcattgtagttt

SEQ ID NO: 2912218 - DNA, 20 bp, Homo sapiens
agatgcattttgtgtacagt

SEQ ID NO: 2912219 - DNA, 12 bp, Homo sapiens
agatgcctccac

SEQ ID NO: 2912220 - DNA, 14 bp, Homo sapiens
agatgcctccaccg

SEQ ID NO: 2912221 - DNA, 15 bp, Homo sapiens
agatgcctccaccgc

SEQ ID NO: 2912222 - DNA, 21 bp, Homo sapiens
agatgcctccaccgctgccta

SEQ ID NO: 2912223 - DNA, 18 bp, Homo sapiens
agatgcgcagccccatct

SEQ ID NO: 2912224 - DNA, 19 bp, Homo sapiens
agatgcgcagccccatctg

SEQ ID NO: 2912225 - DNA, 20 bp, Homo sapiens
agatgcggggacaggctgga

SEQ ID NO: 2912226 - DNA, 15 bp, Homo sapiens
agatgcgtcccaaga

SEQ ID NO: 2912227 - DNA, 21 bp, Homo sapiens
agatgctacttcccactgtat

SEQ ID NO: 2912228 - DNA, 22 bp, Homo sapiens
agatgctacttcccactgtatg

SEQ ID NO: 2912229 - DNA, 16 bp, Homo sapiens
agatgctagaaaaatg

SEQ ID NO: 2912230 - DNA, 20 bp, Homo sapiens
agatgctagcgcgttgcctg

SEQ ID NO: 2912231 - DNA, 10 bp, Homo sapiens
agatgctcaa

SEQ ID NO: 2912232 - DNA, 13 bp, Homo sapiens
agatgctccaaga

SEQ ID NO: 2912233 - DNA, 23 bp, Homo sapiens
agatgctccaagattctagatga

SEQ ID NO: 2912234 - DNA, 21 bp, Homo sapiens
agatgctctatcttgctctgt

SEQ ID NO: 2912235 - DNA, 22 bp, Homo sapiens
agatgctcttggggttcatagg

SEQ ID NO: 2912236 - DNA, 15 bp, Homo sapiens
agatgctgactggca

SEQ ID NO: 2912237 - DNA, 13 bp, Homo sapiens
agatgctgatgtt

SEQ ID NO: 2912238 - DNA, 15 bp, Homo sapiens
agatgctgatgttca

SEQ ID NO: 2912239 - DNA, 17 bp, Homo sapiens
agatgctgatgttcagt

SEQ ID NO: 2912240 - DNA, 20 bp, Homo sapiens
agatgctgatgttcagtgta

SEQ ID NO: 2912241 - DNA, 19 bp, Homo sapiens
agatgctggcatctctgca

SEQ ID NO: 2912242 - DNA, 20 bp, Homo sapiens
agatgctggcatctctgcag

SEQ ID NO: 2912243 - DNA, 19 bp, Homo sapiens
agatgctggcccagggccc

SEQ ID NO: 2912244 - DNA, 23 bp, Homo sapiens
agatgctggcccagggcccagag

SEQ ID NO: 2912245 - DNA, 14 bp, Homo sapiens
agatgctggcctct

SEQ ID NO: 2912246 - DNA, 18 bp, Homo sapiens
agatgctggcttgggcag

SEQ ID NO: 2912247 - DNA, 20 bp, Homo sapiens
agatgctgtgagtctttggt

SEQ ID NO: 2912248 - DNA, 18 bp, Homo sapiens
agatgctgtgtaacagaa

SEQ ID NO: 2912249 - DNA, 18 bp, Homo sapiens
agatgctgtgtatatggt

SEQ ID NO: 2912250 - DNA, 14 bp, Homo sapiens
agatgcttggagca

SEQ ID NO: 2912251 - DNA, 18 bp, Homo sapiens
agatgcttggagcaatca

SEQ ID NO: 2912252 - DNA, 18 bp, Homo sapiens
agatgcttttaacagagt

SEQ ID NO: 2912253 - DNA, 14 bp, Homo sapiens
agatggaccccagc

SEQ ID NO: 2912254 - DNA, 17 bp, Homo sapiens
agatggacgcaggccct

SEQ ID NO: 2912255 - DNA, 23 bp, Homo sapiens
agatggagtcccttttcattctc

SEQ ID NO: 2912256 - DNA, 19 bp, Homo sapiens
agatggagttcttgtgcca

SEQ ID NO: 2912257 - DNA, 16 bp, Homo sapiens
agatggagtttctaag

SEQ ID NO: 2912258 - DNA, 18 bp, Homo sapiens
agatggagtttctctctt

SEQ ID NO: 2912259 - DNA, 13 bp, Homo sapiens
agatggattctcc

SEQ ID NO: 2912260 - DNA, 15 bp, Homo sapiens
agatggcagggctga

SEQ ID NO: 2912261 - DNA, 16 bp, Homo sapiens
agatggcagggctgag

SEQ ID NO: 2912262 - DNA, 15 bp, Homo sapiens
agatggctcctctca

SEQ ID NO: 2912263 - DNA, 15 bp, Homo sapiens
agatgggacagcaac

SEQ ID NO: 2912264 - DNA, 14 bp, Homo sapiens
agatgggaggagac

SEQ ID NO: 2912265 - DNA, 17 bp, Homo sapiens
agatgggtgaaggctgg

SEQ ID NO: 2912266 - DNA, 19 bp, Homo sapiens
agatggtatatttggtact

SEQ ID NO: 2912267 - DNA, 19 bp, Homo sapiens
agatggtcacgcacctggg

SEQ ID NO: 2912268 - DNA, 22 bp, Homo sapiens
agatggtgctgggtaataaaat

SEQ ID NO: 2912269 - DNA, 14 bp, Homo sapiens
agatggttgccaag

SEQ ID NO: 2912270 - DNA, 21 bp, Homo sapiens
agatgtaaatcgggaaggatg

SEQ ID NO: 2912271 - DNA, 17 bp, Homo sapiens
agatgtaatgttttctt

SEQ ID NO: 2912272 - DNA, 19 bp, Homo sapiens
agatgtagataaactcaga

SEQ ID NO: 2912273 - DNA, 15 bp, Homo sapiens
agatgtccctgaagt

SEQ ID NO: 2912274 - DNA, 12 bp, Homo sapiens
agatgtctattc

SEQ ID NO: 2912275 - DNA, 23 bp, Homo sapiens
agatgtctgagagaccatctcct

SEQ ID NO: 2912276 - DNA, 11 bp, Homo sapiens
agatgtctgtt

SEQ ID NO: 2912277 - DNA, 15 bp, Homo sapiens
agatgtgatattcta

SEQ ID NO: 2912278 - DNA, 16 bp, Homo sapiens
agatgtgatattctaa

SEQ ID NO: 2912279 - DNA, 15 bp, Homo sapiens
agatgtgcagcagat

SEQ ID NO: 2912280 - DNA, 18 bp, Homo sapiens
agatgtgcagcagattgg

SEQ ID NO: 2912281 - DNA, 15 bp, Homo sapiens
agatgttagactcat

SEQ ID NO: 2912282 - DNA, 14 bp, Homo sapiens
agatgttcggtttt

SEQ ID NO: 2912283 - DNA, 22 bp, Homo sapiens
agatgttgatttttactgtgtt

SEQ ID NO: 2912284 - DNA, 18 bp, Homo sapiens
agatgttgccatgtgttt

SEQ ID NO: 2912285 - DNA, 18 bp, Homo sapiens
agatgtttattcttctag

SEQ ID NO: 2912286 - DNA, 19 bp, Homo sapiens
agatgtttattcttctaga

SEQ ID NO: 2912287 - DNA, 21 bp, Homo sapiens
agatgtttattcttctagagt

SEQ ID NO: 2912288 - DNA, 13 bp, Homo sapiens
agatgttttaact

SEQ ID NO: 2912289 - DNA, 23 bp, Homo sapiens
agatgttttggtcaagtagtttg

SEQ ID NO: 2912290 - DNA, 14 bp, Homo sapiens
agattaaggtatct

SEQ ID NO: 2912291 - DNA, 15 bp, Homo sapiens
agattagaagctgaa

SEQ ID NO: 2912292 - DNA, 17 bp, Homo sapiens
agattagcccttccttg

SEQ ID NO: 2912293 - DNA, 14 bp, Homo sapiens
agattatagattct

SEQ ID NO: 2912294 - DNA, 16 bp, Homo sapiens
agattatagattctaa

SEQ ID NO: 2912295 - DNA, 17 bp, Homo sapiens
agattatagattctaaa

SEQ ID NO: 2912296 - DNA, 18 bp, Homo sapiens
agattatagattctaaag

SEQ ID NO: 2912297 - DNA, 22 bp, Homo sapiens
agattattaaatcgtttaatgt

SEQ ID NO: 2912298 - DNA, 14 bp, Homo sapiens
agattattgaaata

SEQ ID NO: 2912299 - DNA, 16 bp, Homo sapiens
agattattgaaatatt

SEQ ID NO: 2912300 - DNA, 16 bp, Homo sapiens
agattatttaaatgct

SEQ ID NO: 2912301 - DNA, 14 bp, Homo sapiens
agcaatgtgatttt

SEQ ID NO: 2912302 - DNA, 13 bp, Homo sapiens
agcaattaaaaat

SEQ ID NO: 2912303 - DNA, 23 bp, Homo sapiens
agcaattctcctgcctcagcctc

SEQ ID NO: 2912304 - DNA, 21 bp, Homo sapiens
agcaattttgtatccatttaa

SEQ ID NO: 2912305 - DNA, 15 bp, Homo sapiens
agcacaaaatggatt

SEQ ID NO: 2912306 - DNA, 14 bp, Homo sapiens
agcacaagaaactt

SEQ ID NO: 2912307 - DNA, 21 bp, Homo sapiens
agcacaaggccttgcctggcc

SEQ ID NO: 2912308 - DNA, 16 bp, Homo sapiens
agcacaatctgttcta

SEQ ID NO: 2912309 - DNA, 18 bp, Homo sapiens
agcacaatctgttctact

SEQ ID NO: 2912310 - DNA, 16 bp, Homo sapiens
agcacaccacaattct

SEQ ID NO: 2912311 - DNA, 17 bp, Homo sapiens
agcacaccacaattctc

SEQ ID NO: 2912312 - DNA, 12 bp, Homo sapiens
agcacagccaac

SEQ ID NO: 2912313 - DNA, 13 bp, Homo sapiens
agcacagctcctc

SEQ ID NO: 2912314 - DNA, 15 bp, Homo sapiens
agcacagctcctccc

SEQ ID NO: 2912315 - DNA, 16 bp, Homo sapiens
agcacagctcctcccc

SEQ ID NO: 2912316 - DNA, 20 bp, Homo sapiens
agcacagctcctcccctgcc

SEQ ID NO: 2912317 - DNA, 23 bp, Homo sapiens
agcacagtggtggcagggcctag

SEQ ID NO: 2912318 - DNA, 17 bp, Homo sapiens
agcacagtttgaacaaa

SEQ ID NO: 2912319 - DNA, 17 bp, Homo sapiens
agcacatgccagggaaa

SEQ ID NO: 2912320 - DNA, 20 bp, Homo sapiens
agcacatgccagggaaaaag

SEQ ID NO: 2912321 - DNA, 22 bp, Homo sapiens
agcacattttgacacaatgttg

SEQ ID NO: 2912322 - DNA, 16 bp, Homo sapiens
agcaccacggccagaa

SEQ ID NO: 2912323 - DNA, 17 bp, Homo sapiens
agcaccacggccagaag

SEQ ID NO: 2912324 - DNA, 14 bp, Homo sapiens
agcaccaggcacga

SEQ ID NO: 2912325 - DNA, 23 bp, Homo sapiens
agcaccctgccctcatgggacct

SEQ ID NO: 2912326 - DNA, 14 bp, Homo sapiens
agcaccgaggggcc

SEQ ID NO: 2912327 - DNA, 17 bp, Homo sapiens
agcaccgaggggccttt

SEQ ID NO: 2912328 - DNA, 13 bp, Homo sapiens
agcacctgccaga

SEQ ID NO: 2912329 - DNA, 15 bp, Homo sapiens
agcacctgccaggga

SEQ ID NO: 2912330 - DNA, 11 bp, Homo sapiens
agcacctgccg

SEQ ID NO: 2912331 - DNA, 16 bp, Homo sapiens
agcacctgccgacctc

SEQ ID NO: 2912332 - DNA, 19 bp, Homo sapiens
agcacctgccgacctcgtc

SEQ ID NO: 2912333 - DNA, 16 bp, Homo sapiens
agcacctggaccccct

SEQ ID NO: 2912334 - DNA, 15 bp, Homo sapiens
agcaccttggcccag

SEQ ID NO: 2912335 - DNA, 19 bp, Homo sapiens
agcaccttggcccaggagc

SEQ ID NO: 2912336 - DNA, 18 bp, Homo sapiens
agcaccttgtgcctgggg

SEQ ID NO: 2912337 - DNA, 19 bp, Homo sapiens
agcaccttgtgcctggggt

SEQ ID NO: 2912338 - DNA, 16 bp, Homo sapiens
agcaccttttctcctc

SEQ ID NO: 2912339 - DNA, 20 bp, Homo sapiens
agcacgcctgccatcttctc

SEQ ID NO: 2912340 - DNA, 19 bp, Homo sapiens
agcacggcccggcccctca

SEQ ID NO: 2912341 - DNA, 19 bp, Homo sapiens
agcactagaaattgggcag

SEQ ID NO: 2912342 - DNA, 13 bp, Homo sapiens
agcactattgttt

SEQ ID NO: 2912343 - DNA, 14 bp, Homo sapiens
agcactgccaccag

SEQ ID NO: 2912344 - DNA, 12 bp, Homo sapiens
agcactgctgcc

SEQ ID NO: 2912345 - DNA, 14 bp, Homo sapiens
agcactgctgcctc

SEQ ID NO: 2912346 - DNA, 16 bp, Homo sapiens
agcactgctgcctcag

SEQ ID NO: 2912347 - DNA, 19 bp, Homo sapiens
agcactgctgcctcagctc

SEQ ID NO: 2912348 - DNA, 17 bp, Homo sapiens
agcactgcttgaggaaa

SEQ ID NO: 2912349 - DNA, 19 bp, Homo sapiens
agcactggaaccacctgga

SEQ ID NO: 2912350 - DNA, 15 bp, Homo sapiens
agcactgggaagctg

SEQ ID NO: 2912351 - DNA, 16 bp, Homo sapiens
agcactgtttttccat

SEQ ID NO: 2912352 - DNA, 21 bp, Homo sapiens
agcactgtttttccatagttt

SEQ ID NO: 2912353 - DNA, 23 bp, Homo sapiens
agcacttaaacagaagcagaggc

SEQ ID NO: 2912354 - DNA, 15 bp, Homo sapiens
agcacttatttaatg

SEQ ID NO: 2912355 - DNA, 19 bp, Homo sapiens
agcacttcatctggctgcc

SEQ ID NO: 2912356 - DNA, 16 bp, Homo sapiens
agcacttcccaggatc

SEQ ID NO: 2912357 - DNA, 15 bp, Homo sapiens
agcacttctttttct

SEQ ID NO: 2912358 - DNA, 22 bp, Homo sapiens
agcacttgggggttcaggcccg

SEQ ID NO: 2912359 - DNA, 21 bp, Homo sapiens
agcactttgattgaagtattc

SEQ ID NO: 2912360 - DNA, 19 bp, Homo sapiens
agcactttgcaaggaatgt

SEQ ID NO: 2912361 - DNA, 12 bp, Homo sapiens
agcactttggga

SEQ ID NO: 2912362 - DNA, 18 bp, Homo sapiens
agcagaaaccaagtctac

SEQ ID NO: 2912363 - DNA, 22 bp, Homo sapiens
agcagaaaggaaaagattcctg

SEQ ID NO: 2912364 - DNA, 21 bp, Homo sapiens
agcagaaagtaagcatttcca

SEQ ID NO: 2912365 - DNA, 14 bp, Homo sapiens
agcagaaagtgcct

SEQ ID NO: 2912366 - DNA, 15 bp, Homo sapiens
agcagaaagtgcctt

SEQ ID NO: 2912367 - DNA, 20 bp, Homo sapiens
agcagaacagatcttttact

SEQ ID NO: 2912368 - DNA, 14 bp, Homo sapiens
agcagaacctgtag

SEQ ID NO: 2912369 - DNA, 16 bp, Homo sapiens
agcagaacctgtagga

SEQ ID NO: 2912370 - DNA, 11 bp, Homo sapiens
agcagaaggag

SEQ ID NO: 2912371 - DNA, 22 bp, Homo sapiens
agcagaatacaatgggaaaaga

SEQ ID NO: 2912372 - DNA, 16 bp, Homo sapiens
agcagaatggaggcag

SEQ ID NO: 2912373 - DNA, 18 bp, Homo sapiens
agcagaatggaggcaggg

SEQ ID NO: 2912374 - DNA, 15 bp, Homo sapiens
agcagaattttaatg

SEQ ID NO: 2912375 - DNA, 19 bp, Homo sapiens
agcagaattttaatgtgaa

SEQ ID NO: 2912376 - DNA, 16 bp, Homo sapiens
agcagacagaagtgta

SEQ ID NO: 2912377 - DNA, 20 bp, Homo sapiens
agcagacaggcctggccctg

SEQ ID NO: 2912378 - DNA, 18 bp, Homo sapiens
agcagactagaattctgg

SEQ ID NO: 2912379 - DNA, 16 bp, Homo sapiens
agcagactgatcagga

SEQ ID NO: 2912380 - DNA, 24 bp, Homo sapiens
agcagagaatataacatgaaatga

SEQ ID NO: 2912381 - DNA, 15 bp, Homo sapiens
agcagagagccctgg

SEQ ID NO: 2912382 - DNA, 19 bp, Homo sapiens
agcagagagccctgggtga

SEQ ID NO: 2912383 - DNA, 14 bp, Homo sapiens
agcagagaggtggc

SEQ ID NO: 2912384 - DNA, 20 bp, Homo sapiens
agcagagcaaaatgctcttg

SEQ ID NO: 2912385 - DNA, 22 bp, Homo sapiens
agcagagcaaaatgctcttgtc

SEQ ID NO: 2912386 - DNA, 13 bp, Homo sapiens
agcagaggaccag

SEQ ID NO: 2912387 - DNA, 12 bp, Homo sapiens
agcagaggaggg

SEQ ID NO: 2912388 - DNA, 14 bp, Homo sapiens
agcagaggcagtgg

SEQ ID NO: 2912389 - DNA, 22 bp, Homo sapiens
agcagaggcctttattgtcttg

SEQ ID NO: 2912390 - DNA, 14 bp, Homo sapiens
agcagaggggctga

SEQ ID NO: 2912391 - DNA, 15 bp, Homo sapiens
agcagagttctttgc

SEQ ID NO: 2912392 - DNA, 23 bp, Homo sapiens
agcagagttctttgcaagcttat

SEQ ID NO: 2912393 - DNA, 13 bp, Homo sapiens
agcagatgcaaag

SEQ ID NO: 2912394 - DNA, 20 bp, Homo sapiens
agcagatgcaaagaggcaag

SEQ ID NO: 2912395 - DNA, 21 bp, Homo sapiens
agcagatgcaaagaggcaaga

SEQ ID NO: 2912396 - DNA, 13 bp, Homo sapiens
agcagattggaag

SEQ ID NO: 2912397 - DNA, 23 bp, Homo sapiens
agcagattggaaggagacacaga

SEQ ID NO: 2912398 - DNA, 14 bp, Homo sapiens
agcagattttccta

SEQ ID NO: 2912399 - DNA, 14 bp, Homo sapiens
agcagcaaaatcct

SEQ ID NO: 2912400 - DNA, 13 bp, Homo sapiens
agcagcaagaaaa

SEQ ID NO: 2912401 - DNA, 23 bp, Homo sapiens
agcagcaagaaaaaaaaatgcca

SEQ ID NO: 2912402 - DNA, 18 bp, Homo sapiens
agcagcaccgttctgtgc

SEQ ID NO: 2912403 - DNA, 19 bp, Homo sapiens
agcagcaccgttctgtgca

SEQ ID NO: 2912404 - DNA, 20 bp, Homo sapiens
agcagcaccgttctgtgcac

SEQ ID NO: 2912405 - DNA, 13 bp, Homo sapiens
agcagcagagagc

SEQ ID NO: 2912406 - DNA, 16 bp, Homo sapiens
agcagcatcccagcct

SEQ ID NO: 2912407 - DNA, 18 bp, Homo sapiens
agcagcatcccagccttg

SEQ ID NO: 2912408 - DNA, 20 bp, Homo sapiens
agcagccaagctccttggga

SEQ ID NO: 2912409 - DNA, 22 bp, Homo sapiens
agcagccaagctccttgggagg

SEQ ID NO: 2912410 - DNA, 10 bp, Homo sapiens
agcagccacg

SEQ ID NO: 2912411 - DNA, 14 bp, Homo sapiens
agcagcccaccctg

SEQ ID NO: 2912412 - DNA, 15 bp, Homo sapiens
agcagcccagcattt

SEQ ID NO: 2912413 - DNA, 12 bp, Homo sapiens
agcagccctcct

SEQ ID NO: 2912414 - DNA, 17 bp, Homo sapiens
agcagccctctgcctcc

SEQ ID NO: 2912415 - DNA, 16 bp, Homo sapiens
agcagcccttgtttat

SEQ ID NO: 2912416 - DNA, 20 bp, Homo sapiens
agcagcctcgcacaggccct

SEQ ID NO: 2912417 - DNA, 23 bp, Homo sapiens
agcagcctgagcaactcttgatt

SEQ ID NO: 2912418 - DNA, 12 bp, Homo sapiens
agcagcctgcca

SEQ ID NO: 2912419 - DNA, 14 bp, Homo sapiens
agcagcctgccagc

SEQ ID NO: 2912420 - DNA, 23 bp, Homo sapiens
agcagcctgcgctcggcaggaag

SEQ ID NO: 2912421 - DNA, 14 bp, Homo sapiens
agcagcgcctttcc

SEQ ID NO: 2912422 - DNA, 15 bp, Homo sapiens
agcagcgcctttccc

SEQ ID NO: 2912423 - DNA, 17 bp, Homo sapiens
agcagcgcgcaggcctg

SEQ ID NO: 2912424 - DNA, 15 bp, Homo sapiens
agcagcggctctggt

SEQ ID NO: 2912425 - DNA, 17 bp, Homo sapiens
agcagctaaattttctg

SEQ ID NO: 2912426 - DNA, 16 bp, Homo sapiens
agcagctcaaaggcac

SEQ ID NO: 2912427 - DNA, 20 bp, Homo sapiens
agcagctcaaaggcacagtg

SEQ ID NO: 2912428 - DNA, 16 bp, Homo sapiens
agcagctctgccttct

SEQ ID NO: 2912429 - DNA, 23 bp, Homo sapiens
agcagctgaaatatgctggctgg

SEQ ID NO: 2912430 - DNA, 12 bp, Homo sapiens
agcagctgctac

SEQ ID NO: 2912431 - DNA, 22 bp, Homo sapiens
agcagctggtaatcttgctctg

SEQ ID NO: 2912432 - DNA, 15 bp, Homo sapiens
agcaggaaataccaa

SEQ ID NO: 2912433 - DNA, 12 bp, Homo sapiens
agcaggaagctc

SEQ ID NO: 2912434 - DNA, 20 bp, Homo sapiens
agcctcgcacaggccctagc

SEQ ID NO: 2912435 - DNA, 12 bp, Homo sapiens
agcctctcctcc

SEQ ID NO: 2912436 - DNA, 20 bp, Homo sapiens
agcctctcttcactgctaca

SEQ ID NO: 2912437 - DNA, 13 bp, Homo sapiens
agcctctgctccc

SEQ ID NO: 2912438 - DNA, 19 bp, Homo sapiens
agcctctggatctagaagg

SEQ ID NO: 2912439 - DNA, 13 bp, Homo sapiens
agcctctgggtca

SEQ ID NO: 2912440 - DNA, 22 bp, Homo sapiens
agcctctgggtcagtggtccac

SEQ ID NO: 2912441 - DNA, 16 bp, Homo sapiens
agcctctgtccgcctt

SEQ ID NO: 2912442 - DNA, 18 bp, Homo sapiens
agcctctttgtaataaaa

SEQ ID NO: 2912443 - DNA, 16 bp, Homo sapiens
agcctctttttgatac

SEQ ID NO: 2912444 - DNA, 16 bp, Homo sapiens
agcctgaataaaccaa

SEQ ID NO: 2912445 - DNA, 22 bp, Homo sapiens
agcctgaatttgggatggaagc

SEQ ID NO: 2912446 - DNA, 17 bp, Homo sapiens
agcctgacaagtgaagt

SEQ ID NO: 2912447 - DNA, 21 bp, Homo sapiens
agcctgagcaactcttgatta

SEQ ID NO: 2912448 - DNA, 15 bp, Homo sapiens
agcctgaggcaggag

SEQ ID NO: 2912449 - DNA, 16 bp, Homo sapiens
agcctgagtcacctgc

SEQ ID NO: 2912450 - DNA, 20 bp, Homo sapiens
agcctgatcaggcttcctgg

SEQ ID NO: 2912451 - DNA, 19 bp, Homo sapiens
agcctgatgagatttttaa

SEQ ID NO: 2912452 - DNA, 15 bp, Homo sapiens
agcctgcagagctgc

SEQ ID NO: 2912453 - DNA, 18 bp, Homo sapiens
agcctgcctcgccttgtg

SEQ ID NO: 2912454 - DNA, 21 bp, Homo sapiens
agcctgcctcgccttgtgtta

SEQ ID NO: 2912455 - DNA, 14 bp, Homo sapiens
agcctgcctggcag

SEQ ID NO: 2912456 - DNA, 16 bp, Homo sapiens
agcctgcgctcggcag

SEQ ID NO: 2912457 - DNA, 19 bp, Homo sapiens
agcctgcgctcggcaggaa

SEQ ID NO: 2912458 - DNA, 23 bp, Homo sapiens
agcctgcgctcggcaggaaggag

SEQ ID NO: 2912459 - DNA, 11 bp, Homo sapiens
agcctgctccc

SEQ ID NO: 2912460 - DNA, 14 bp, Homo sapiens
agcctgctccccca

SEQ ID NO: 2912461 - DNA, 23 bp, Homo sapiens
agcctgctcccccaccccctccc

SEQ ID NO: 2912462 - DNA, 13 bp, Homo sapiens
agcctggaagcac

SEQ ID NO: 2912463 - DNA, 17 bp, Homo sapiens
agcctggatagccttga

SEQ ID NO: 2912464 - DNA, 21 bp, Homo sapiens
agcctggatagccttgaaaac

SEQ ID NO: 2912465 - DNA, 18 bp, Homo sapiens
agcctggccaacatggtg

SEQ ID NO: 2912466 - DNA, 18 bp, Homo sapiens
agcctggccagacacagg

SEQ ID NO: 2912467 - DNA, 17 bp, Homo sapiens
agcctggccccatggtc

SEQ ID NO: 2912468 - DNA, 16 bp, Homo sapiens
agcctgggaggcacag

SEQ ID NO: 2912469 - DNA, 19 bp, Homo sapiens
agcctgggatttctatgca

SEQ ID NO: 2912470 - DNA, 12 bp, Homo sapiens
agcctgggcccc

SEQ ID NO: 2912471 - DNA, 17 bp, Homo sapiens
agcctggggcaaaccta

SEQ ID NO: 2912472 - DNA, 17 bp, Homo sapiens
agcctggggcttgaatt

SEQ ID NO: 2912473 - DNA, 20 bp, Homo sapiens
agcctggggcttgaatttgc

SEQ ID NO: 2912474 - DNA, 22 bp, Homo sapiens
agcctggggcttgaatttgcat

SEQ ID NO: 2912475 - DNA, 20 bp, Homo sapiens
agcctggggtggggtcatgc

SEQ ID NO: 2912476 - DNA, 11 bp, Homo sapiens
agcctgggtga

SEQ ID NO: 2912477 - DNA, 17 bp, Homo sapiens
agcctgtaatcccagct

SEQ ID NO: 2912478 - DNA, 14 bp, Homo sapiens
agcctgtcccagga

SEQ ID NO: 2912479 - DNA, 15 bp, Homo sapiens
agcctgtcccaggac

SEQ ID NO: 2912480 - DNA, 18 bp, Homo sapiens
agcctgtcctcaccgtct

SEQ ID NO: 2912481 - DNA, 16 bp, Homo sapiens
agcctgtctctttcca

SEQ ID NO: 2912482 - DNA, 17 bp, Homo sapiens
agcctgtgaccttggga

SEQ ID NO: 2912483 - DNA, 20 bp, Homo sapiens
agcctgtgagggagtgcaga

SEQ ID NO: 2912484 - DNA, 19 bp, Homo sapiens
agcctgtggccctgtcctg

SEQ ID NO: 2912485 - DNA, 20 bp, Homo sapiens
agcctgtggcggtgcctggg

SEQ ID NO: 2912486 - DNA, 22 bp, Homo sapiens
agcctgtttattgccattatag

SEQ ID NO: 2912487 - DNA, 16 bp, Homo sapiens
agccttagtcaataaa

SEQ ID NO: 2912488 - DNA, 21 bp, Homo sapiens
agccttcaagaatcagaagaa

SEQ ID NO: 2912489 - DNA, 20 bp, Homo sapiens
agccttctgaggacattcca

SEQ ID NO: 2912490 - DNA, 15 bp, Homo sapiens
agccttgaaaacaaa

SEQ ID NO: 2912491 - DNA, 14 bp, Homo sapiens
agccttgaactctg

SEQ ID NO: 2912492 - DNA, 14 bp, Homo sapiens
agccttgccagaga

SEQ ID NO: 2912493 - DNA, 19 bp, Homo sapiens
agccttgccagagatccaa

SEQ ID NO: 2912494 - DNA, 11 bp, Homo sapiens
agccttgctgc

SEQ ID NO: 2912495 - DNA, 15 bp, Homo sapiens
agccttgctgccaag

SEQ ID NO: 2912496 - DNA, 23 bp, Homo sapiens
agccttgctgccaagtcctgcct

SEQ ID NO: 2912497 - DNA, 18 bp, Homo sapiens
agccttgctgtagagact

SEQ ID NO: 2912498 - DNA, 19 bp, Homo sapiens
agccttgctgtagagactt

SEQ ID NO: 2912499 - DNA, 17 bp, Homo sapiens
agccttgggcctttcag

SEQ ID NO: 2912500 - DNA, 21 bp, Homo sapiens
agccttgggggggctgccttt

SEQ ID NO: 2912501 - DNA, 17 bp, Homo sapiens
agccttggtgtccacct

SEQ ID NO: 2912502 - DNA, 22 bp, Homo sapiens
agccttggtgtccacctggccc

SEQ ID NO: 2912503 - DNA, 17 bp, Homo sapiens
agcctttgggaaatgct

SEQ ID NO: 2912504 - DNA, 17 bp, Homo sapiens
agcctttgggtcctggg

SEQ ID NO: 2912505 - DNA, 19 bp, Homo sapiens
agcctttgggtcctgggca

SEQ ID NO: 2912506 - DNA, 21 bp, Homo sapiens
agcctttgggtcctgggcagg

SEQ ID NO: 2912507 - DNA, 22 bp, Homo sapiens
agcctttgggtcctgggcaggt

SEQ ID NO: 2912508 - DNA, 17 bp, Homo sapiens
agcgaacatcttcatat

SEQ ID NO: 2912509 - DNA, 18 bp, Homo sapiens
agcgaacatgcctgattt

SEQ ID NO: 2912510 - DNA, 13 bp, Homo sapiens
agcgaattttaaa

SEQ ID NO: 2912511 - DNA, 21 bp, Homo sapiens
agcgacttttgttctcttctg

SEQ ID NO: 2912512 - DNA, 22 bp, Homo sapiens
agcgagcccctcggctctggag

SEQ ID NO: 2912513 - DNA, 15 bp, Homo sapiens
agcgaggaaaaacaa

SEQ ID NO: 2912514 - DNA, 21 bp, Homo sapiens
agcgaggaaaaacaacaaata

SEQ ID NO: 2912515 - DNA, 15 bp, Homo sapiens
agcgaggaggctcca

SEQ ID NO: 2912516 - DNA, 22 bp, Homo sapiens
agcgaggtcaacagagaaggca

SEQ ID NO: 2912517 - DNA, 23 bp, Homo sapiens
agcgaggtcaacagagaaggcag

SEQ ID NO: 2912518 - DNA, 16 bp, Homo sapiens
agcgataatacactat

SEQ ID NO: 2912519 - DNA, 18 bp, Homo sapiens
agcgatgggcccctggcc

SEQ ID NO: 2912520 - DNA, 18 bp, Homo sapiens
agcgatgtatgcagctat

SEQ ID NO: 2912521 - DNA, 21 bp, Homo sapiens
agcgattctcctgcctcagcc

SEQ ID NO: 2912522 - DNA, 17 bp, Homo sapiens
agcgcaagccacagcct

SEQ ID NO: 2912523 - DNA, 18 bp, Homo sapiens
agcgcaagccacagcctg

SEQ ID NO: 2912524 - DNA, 21 bp, Homo sapiens
agcgccaggctgaccacagca

SEQ ID NO: 2912525 - DNA, 15 bp, Homo sapiens
agcgccagggcccag

SEQ ID NO: 2912526 - DNA, 16 bp, Homo sapiens
agcgccagggcccagg

SEQ ID NO: 2912527 - DNA, 15 bp, Homo sapiens
agcgcccacccaggt

SEQ ID NO: 2912528 - DNA, 17 bp, Homo sapiens
agcgcccacccaggtcc

SEQ ID NO: 2912529 - DNA, 18 bp, Homo sapiens
agcgcccacccaggtccc

SEQ ID NO: 2912530 - DNA, 15 bp, Homo sapiens
agcgcccccaggcct

SEQ ID NO: 2912531 - DNA, 16 bp, Homo sapiens
agcgcccccaggcctg

SEQ ID NO: 2912532 - DNA, 22 bp, Homo sapiens
agcgcccccaggcctgccctgc

SEQ ID NO: 2912533 - DNA, 18 bp, Homo sapiens
agcgcctgcccctcccag

SEQ ID NO: 2912534 - DNA, 11 bp, Homo sapiens
agcgcctggcc

SEQ ID NO: 2912535 - DNA, 21 bp, Homo sapiens
agcgcctggctgctgcttctt

SEQ ID NO: 2912536 - DNA, 13 bp, Homo sapiens
agcgcctgtataa

SEQ ID NO: 2912537 - DNA, 22 bp, Homo sapiens
agcgcctgtcccctcacagact

SEQ ID NO: 2912538 - DNA, 13 bp, Homo sapiens
agcgcggctggct

SEQ ID NO: 2912539 - DNA, 15 bp, Homo sapiens
agcgctctggacaga

SEQ ID NO: 2912540 - DNA, 22 bp, Homo sapiens
agcgctggccgggaccccgagc

SEQ ID NO: 2912541 - DNA, 22 bp, Homo sapiens
agcgctggtcccctccctctgt

SEQ ID NO: 2912542 - DNA, 13 bp, Homo sapiens
agcggaaagcagc

SEQ ID NO: 2912543 - DNA, 14 bp, Homo sapiens
agcggaaagcagct

SEQ ID NO: 2912544 - DNA, 14 bp, Homo sapiens
agcggaggaggaag

SEQ ID NO: 2912545 - DNA, 18 bp, Homo sapiens
agcggatgattcttcaag

SEQ ID NO: 2912546 - DNA, 14 bp, Homo sapiens
agcggcccaagagc

SEQ ID NO: 2912547 - DNA, 15 bp, Homo sapiens
agcggcccaagagcc

SEQ ID NO: 2912548 - DNA, 23 bp, Homo sapiens
agcggccgatgggagtctccctc

SEQ ID NO: 2912549 - DNA, 11 bp, Homo sapiens
agcggccggcc

SEQ ID NO: 2912550 - DNA, 18 bp, Homo sapiens
agcggccggccagcccct

SEQ ID NO: 2912551 - DNA, 15 bp, Homo sapiens
agcggcgccctggac

SEQ ID NO: 2912552 - DNA, 21 bp, Homo sapiens
agcggcgccctggacttggta

SEQ ID NO: 2912553 - DNA, 12 bp, Homo sapiens
agcggctctggt

SEQ ID NO: 2912554 - DNA, 16 bp, Homo sapiens
agcggctgagtcatga

SEQ ID NO: 2912555 - DNA, 19 bp, Homo sapiens
agcggctgagtcatgatct

SEQ ID NO: 2912556 - DNA, 12 bp, Homo sapiens
agcggctgcctc

SEQ ID NO: 2912557 - DNA, 15 bp, Homo sapiens
agcggctgcctcctg

SEQ ID NO: 2912558 - DNA, 16 bp, Homo sapiens
agcggctgcctcctga

SEQ ID NO: 2912559 - DNA, 19 bp, Homo sapiens
agcggctgctcgcccagga

SEQ ID NO: 2912560 - DNA, 22 bp, Homo sapiens
agcggctgctcgcccaggaagg

SEQ ID NO: 2912561 - DNA, 23 bp, Homo sapiens
agcgggggccttgaagactccct

SEQ ID NO: 2912562 - DNA, 13 bp, Homo sapiens
agcggtcagactg

SEQ ID NO: 2912563 - DNA, 15 bp, Homo sapiens
agcggtggccccgag

SEQ ID NO: 2912564 - DNA, 14 bp, Homo sapiens
agcggtgggaagga

SEQ ID NO: 2912565 - DNA, 14 bp, Homo sapiens
agcggttgccagga

SEQ ID NO: 2912566 - DNA, 21 bp, Homo sapiens
aggaaggagactcacctctgc

SEQ ID NO: 2912567 - DNA, 16 bp, Homo sapiens
aggaaggcagcattcc

SEQ ID NO: 2912568 - DNA, 19 bp, Homo sapiens
aggaaggcaggaagagagc

SEQ ID NO: 2912569 - DNA, 22 bp, Homo sapiens
aggaaggctctcgggtggggga

SEQ ID NO: 2912570 - DNA, 22 bp, Homo sapiens
aggaaggcttgttgtgctttta

SEQ ID NO: 2912571 - DNA, 20 bp, Homo sapiens
aggaaggggttggattgcaa

SEQ ID NO: 2912572 - DNA, 18 bp, Homo sapiens
aggaaggtctgatttgca

SEQ ID NO: 2912573 - DNA, 14 bp, Homo sapiens
aggaagtcacagat

SEQ ID NO: 2912574 - DNA, 13 bp, Homo sapiens
aggaataaataaa

SEQ ID NO: 2912575 - DNA, 14 bp, Homo sapiens
aggaataaatgaga

SEQ ID NO: 2912576 - DNA, 21 bp, Homo sapiens
aggaataaatgagagggaatc

SEQ ID NO: 2912577 - DNA, 22 bp, Homo sapiens
aggaatatcaatataatgtttt

SEQ ID NO: 2912578 - DNA, 22 bp, Homo sapiens
aggaatcaaatcttacaaaatc

SEQ ID NO: 2912579 - DNA, 22 bp, Homo sapiens
aggaatcactttagaaagccag

SEQ ID NO: 2912580 - DNA, 12 bp, Homo sapiens
aggaatctgcct

SEQ ID NO: 2912581 - DNA, 18 bp, Homo sapiens
aggaatctgccttccagc

SEQ ID NO: 2912582 - DNA, 22 bp, Homo sapiens
aggaatctgccttccagcccag

SEQ ID NO: 2912583 - DNA, 19 bp, Homo sapiens
aggaatctgtgggtctggg

SEQ ID NO: 2912584 - DNA, 16 bp, Homo sapiens
aggaatctttaaaaga

SEQ ID NO: 2912585 - DNA, 22 bp, Homo sapiens
aggaatctttaaaagatgcttt

SEQ ID NO: 2912586 - DNA, 20 bp, Homo sapiens
aggaatgactcatgcctctg

SEQ ID NO: 2912587 - DNA, 22 bp, Homo sapiens
aggaatggaggccatatttcca

SEQ ID NO: 2912588 - DNA, 19 bp, Homo sapiens
aggaatgtgtgccttgttc

SEQ ID NO: 2912589 - DNA, 16 bp, Homo sapiens
aggaatgtgtggcctg

SEQ ID NO: 2912590 - DNA, 18 bp, Homo sapiens
aggaattccaattaaatt

SEQ ID NO: 2912591 - DNA, 13 bp, Homo sapiens
aggaattgaagat

SEQ ID NO: 2912592 - DNA, 20 bp, Homo sapiens
aggaattgaagatgtaagga

SEQ ID NO: 2912593 - DNA, 13 bp, Homo sapiens
aggaatttaaaat

SEQ ID NO: 2912594 - DNA, 19 bp, Homo sapiens
aggaatttaaaattaagta

SEQ ID NO: 2912595 - DNA, 15 bp, Homo sapiens
aggaatttcccagga

SEQ ID NO: 2912596 - DNA, 18 bp, Homo sapiens
aggaatttcccaggaccc

SEQ ID NO: 2912597 - DNA, 16 bp, Homo sapiens
aggaatttggctgctt

SEQ ID NO: 2912598 - DNA, 14 bp, Homo sapiens
aggacaaaatgtta

SEQ ID NO: 2912599 - DNA, 11 bp, Homo sapiens
aggacaaacag

SEQ ID NO: 2912600 - DNA, 15 bp, Homo sapiens
aggacaaacagtgaa

SEQ ID NO: 2912601 - DNA, 18 bp, Homo sapiens
aggacaaacagtgaattt

SEQ ID NO: 2912602 - DNA, 19 bp, Homo sapiens
aggacaaagtgccaaagaa

SEQ ID NO: 2912603 - DNA, 21 bp, Homo sapiens
aggacaaagtgccaaagaaag

SEQ ID NO: 2912604 - DNA, 18 bp, Homo sapiens
aggacaaattgagacagt

SEQ ID NO: 2912605 - DNA, 17 bp, Homo sapiens
aggacaacgaggaagcc

SEQ ID NO: 2912606 - DNA, 23 bp, Homo sapiens
aggacaactttatgtagagaaaa

SEQ ID NO: 2912607 - DNA, 13 bp, Homo sapiens
aggacaagaccct

SEQ ID NO: 2912608 - DNA, 16 bp, Homo sapiens
aggacaagaccctctc

SEQ ID NO: 2912609 - DNA, 23 bp, Homo sapiens
aggacacgcgcccccctcccaga

SEQ ID NO: 2912610 - DNA, 16 bp, Homo sapiens
aggacactaccctgag

SEQ ID NO: 2912611 - DNA, 17 bp, Homo sapiens
aggacactaccctgaga

SEQ ID NO: 2912612 - DNA, 13 bp, Homo sapiens
aggacagaaagga

SEQ ID NO: 2912613 - DNA, 13 bp, Homo sapiens
aggacagagccag

SEQ ID NO: 2912614 - DNA, 14 bp, Homo sapiens
aggacagagccagc

SEQ ID NO: 2912615 - DNA, 12 bp, Homo sapiens
aggacagctctt

SEQ ID NO: 2912616 - DNA, 12 bp, Homo sapiens
aggacaggcccg

SEQ ID NO: 2912617 - DNA, 15 bp, Homo sapiens
aggacataatggggt

SEQ ID NO: 2912618 - DNA, 20 bp, Homo sapiens
aggacatccccccgccaaaa

SEQ ID NO: 2912619 - DNA, 20 bp, Homo sapiens
aggacatgcggtagccagca

SEQ ID NO: 2912620 - DNA, 17 bp, Homo sapiens
aggacattccaagacag

SEQ ID NO: 2912621 - DNA, 15 bp, Homo sapiens
aggacatttcccagg

SEQ ID NO: 2912622 - DNA, 21 bp, Homo sapiens
aggacattttctctttaaaag

SEQ ID NO: 2912623 - DNA, 22 bp, Homo sapiens
aggaccacacgcaggcctccct

SEQ ID NO: 2912624 - DNA, 18 bp, Homo sapiens
aggaccagggcagggcca

SEQ ID NO: 2912625 - DNA, 15 bp, Homo sapiens
aggaccagggccttt

SEQ ID NO: 2912626 - DNA, 20 bp, Homo sapiens
aggaccagggccttttctgg

SEQ ID NO: 2912627 - DNA, 14 bp, Homo sapiens
aggaccagggtgga

SEQ ID NO: 2912628 - DNA, 17 bp, Homo sapiens
aggaccagggtggagct

SEQ ID NO: 2912629 - DNA, 19 bp, Homo sapiens
aggacccacactgctacac

SEQ ID NO: 2912630 - DNA, 16 bp, Homo sapiens
aggacccgccagcccc

SEQ ID NO: 2912631 - DNA, 17 bp, Homo sapiens
aggacccgccagccccg

SEQ ID NO: 2912632 - DNA, 18 bp, Homo sapiens
aggacccgccagccccgc

SEQ ID NO: 2912633 - DNA, 15 bp, Homo sapiens
aggaccctgaagggg

SEQ ID NO: 2912634 - DNA, 20 bp, Homo sapiens
aggaccgccatggtgctggg

SEQ ID NO: 2912635 - DNA, 20 bp, Homo sapiens
aggaccgggcactcccggga

SEQ ID NO: 2912636 - DNA, 23 bp, Homo sapiens
aggacctcatccaaacaatttaa

SEQ ID NO: 2912637 - DNA, 16 bp, Homo sapiens
aggacctggctgccat

SEQ ID NO: 2912638 - DNA, 16 bp, Homo sapiens
aggaccttaaatgcta

SEQ ID NO: 2912639 - DNA, 20 bp, Homo sapiens
aggaccttcgggctgtgccc

SEQ ID NO: 2912640 - DNA, 19 bp, Homo sapiens
aggacggcaaggctgaggt

SEQ ID NO: 2912641 - DNA, 15 bp, Homo sapiens
aggacgttggcctca

SEQ ID NO: 2912642 - DNA, 20 bp, Homo sapiens
aggacgttggcctcagggcc

SEQ ID NO: 2912643 - DNA, 20 bp, Homo sapiens
aggactatatttgggcctgc

SEQ ID NO: 2912644 - DNA, 19 bp, Homo sapiens
aggactccatttctttctt

SEQ ID NO: 2912645 - DNA, 23 bp, Homo sapiens
aggactgcacagcgtcctgtcca

SEQ ID NO: 2912646 - DNA, 16 bp, Homo sapiens
aggactgcaccattgc

SEQ ID NO: 2912647 - DNA, 19 bp, Homo sapiens
aggactggaaaaatgaact

SEQ ID NO: 2912648 - DNA, 15 bp, Homo sapiens
aggactggactgttt

SEQ ID NO: 2912649 - DNA, 16 bp, Homo sapiens
aggactggccgtggct

SEQ ID NO: 2912650 - DNA, 19 bp, Homo sapiens
aggactggccgtggctcca

SEQ ID NO: 2912651 - DNA, 15 bp, Homo sapiens
aggactgtatttgtg

SEQ ID NO: 2912652 - DNA, 14 bp, Homo sapiens
aggactgtgatgcc

SEQ ID NO: 2912653 - DNA, 12 bp, Homo sapiens
aggactgtggca

SEQ ID NO: 2912654 - DNA, 16 bp, Homo sapiens
aggacttccacatttt

SEQ ID NO: 2912655 - DNA, 17 bp, Homo sapiens
aggactttcttctaaat

SEQ ID NO: 2912656 - DNA, 17 bp, Homo sapiens
aggacttttaaacaaaa

SEQ ID NO: 2912657 - DNA, 21 bp, Homo sapiens
aggacttttaaacaaaagtgt

SEQ ID NO: 2912658 - DNA, 16 bp, Homo sapiens
aggagaaattttggtt

SEQ ID NO: 2912659 - DNA, 11 bp, Homo sapiens
aggagaagcca

SEQ ID NO: 2912660 - DNA, 13 bp, Homo sapiens
aggagaagctgca

SEQ ID NO: 2912661 - DNA, 12 bp, Homo sapiens
aggagaaggaag

SEQ ID NO: 2912662 - DNA, 22 bp, Homo sapiens
aggagaatcacctgaaccccag

SEQ ID NO: 2912663 - DNA, 18 bp, Homo sapiens
aggagaatccaagcgagg

SEQ ID NO: 2912664 - DNA, 20 bp, Homo sapiens
aggagaatcgcttgaacctg

SEQ ID NO: 2912665 - DNA, 15 bp, Homo sapiens
aggagaattaaactc

SEQ ID NO: 2912666 - DNA, 14 bp, Homo sapiens
aggagacaaagcag

SEQ ID NO: 2912667 - DNA, 16 bp, Homo sapiens
aggagacaaagcagga

SEQ ID NO: 2912668 - DNA, 13 bp, Homo sapiens
aggagacacagat

SEQ ID NO: 2912669 - DNA, 14 bp, Homo sapiens
aggagaccagcggt

SEQ ID NO: 2912670 - DNA, 15 bp, Homo sapiens
aggagacctgctctc

SEQ ID NO: 2912671 - DNA, 13 bp, Homo sapiens
aggagactcacct

SEQ ID NO: 2912672 - DNA, 16 bp, Homo sapiens
aggagactggtaggag

SEQ ID NO: 2912673 - DNA, 16 bp, Homo sapiens
aggagagaaaatatat

SEQ ID NO: 2912674 - DNA, 17 bp, Homo sapiens
aggagagaaaatatatg

SEQ ID NO: 2912675 - DNA, 22 bp, Homo sapiens
aggagagaaaatatatgtattt

SEQ ID NO: 2912676 - DNA, 13 bp, Homo sapiens
aggagagaagaat

SEQ ID NO: 2912677 - DNA, 15 bp, Homo sapiens
aggagagaagaatga

SEQ ID NO: 2912678 - DNA, 21 bp, Homo sapiens
aggagagataccttgaaaaag

SEQ ID NO: 2912679 - DNA, 17 bp, Homo sapiens
aggagagatagcctgtg

SEQ ID NO: 2912680 - DNA, 13 bp, Homo sapiens
aggagagatgacc

SEQ ID NO: 2912681 - DNA, 16 bp, Homo sapiens
aggagaggagagccag

SEQ ID NO: 2912682 - DNA, 19 bp, Homo sapiens
aggagagtgagtgcctttc

SEQ ID NO: 2912683 - DNA, 16 bp, Homo sapiens
aggagatcagaaaaat

SEQ ID NO: 2912684 - DNA, 22 bp, Homo sapiens
aggagatccagggcaaggccat

SEQ ID NO: 2912685 - DNA, 16 bp, Homo sapiens
aggagatgctccttgg

SEQ ID NO: 2912686 - DNA, 23 bp, Homo sapiens
aggagcacctggaccccctgccc

SEQ ID NO: 2912687 - DNA, 20 bp, Homo sapiens
aggagcagagaggtggccac

SEQ ID NO: 2912688 - DNA, 16 bp, Homo sapiens
aggagcattaagccca

SEQ ID NO: 2912689 - DNA, 20 bp, Homo sapiens
aggagcattaagcccaatct

SEQ ID NO: 2912690 - DNA, 18 bp, Homo sapiens
aggagcattttttaaaaa

SEQ ID NO: 2912691 - DNA, 23 bp, Homo sapiens
aggagcccagtgggctgcacgct

SEQ ID NO: 2912692 - DNA, 17 bp, Homo sapiens
aggagccccatctgtct

SEQ ID NO: 2912693 - DNA, 21 bp, Homo sapiens
aggagccggacacttctcagg

SEQ ID NO: 2912694 - DNA, 12 bp, Homo sapiens
aggagcctcaga

SEQ ID NO: 2912695 - DNA, 16 bp, Homo sapiens
aggagcctttttaaaa

SEQ ID NO: 2912696 - DNA, 19 bp, Homo sapiens
aggagcctttttaaaacac

SEQ ID NO: 2912697 - DNA, 18 bp, Homo sapiens
aggagcgctagtgccttg

SEQ ID NO: 2912698 - DNA, 19 bp, Homo sapiens
aggcttcctggtgagaact

SEQ ID NO: 2912699 - DNA, 16 bp, Homo sapiens
aggcttctctctgtgg

SEQ ID NO: 2912700 - DNA, 19 bp, Homo sapiens
aggcttgattccaacaggc

SEQ ID NO: 2912701 - DNA, 22 bp, Homo sapiens
aggcttgccgcacatgaaacat

SEQ ID NO: 2912702 - DNA, 19 bp, Homo sapiens
aggcttggatggaacatgc

SEQ ID NO: 2912703 - DNA, 16 bp, Homo sapiens
aggcttggtcccatcg

SEQ ID NO: 2912704 - DNA, 22 bp, Homo sapiens
aggctttatgataatagattct

SEQ ID NO: 2912705 - DNA, 12 bp, Homo sapiens
aggctttcagct

SEQ ID NO: 2912706 - DNA, 13 bp, Homo sapiens
aggctttcagctt

SEQ ID NO: 2912707 - DNA, 23 bp, Homo sapiens
aggctttcccacttcccaccctg

SEQ ID NO: 2912708 - DNA, 19 bp, Homo sapiens
aggctttgattagttttct

SEQ ID NO: 2912709 - DNA, 20 bp, Homo sapiens
aggctttggggtcctagccc

SEQ ID NO: 2912710 - DNA, 13 bp, Homo sapiens
agggaaaagcaga

SEQ ID NO: 2912711 - DNA, 16 bp, Homo sapiens
agggaaaagcagctct

SEQ ID NO: 2912712 - DNA, 13 bp, Homo sapiens
agggaaactggct

SEQ ID NO: 2912713 - DNA, 15 bp, Homo sapiens
agggaaactggctga

SEQ ID NO: 2912714 - DNA, 17 bp, Homo sapiens
agggaaaggtaaataca

SEQ ID NO: 2912715 - DNA, 13 bp, Homo sapiens
agggaacagacag

SEQ ID NO: 2912716 - DNA, 18 bp, Homo sapiens
agggaacagacaggagaa

SEQ ID NO: 2912717 - DNA, 23 bp, Homo sapiens
agggaactgcttgcccagggtgc

SEQ ID NO: 2912718 - DNA, 16 bp, Homo sapiens
agggaagctacaggtt

SEQ ID NO: 2912719 - DNA, 21 bp, Homo sapiens
agggaaggacaatcccaggaa

SEQ ID NO: 2912720 - DNA, 19 bp, Homo sapiens
agggaaggacagctgtgcc

SEQ ID NO: 2912721 - DNA, 17 bp, Homo sapiens
agggaaggcaaaggcag

SEQ ID NO: 2912722 - DNA, 19 bp, Homo sapiens
agggaaggcaaaggcagag

SEQ ID NO: 2912723 - DNA, 16 bp, Homo sapiens
agggaagggcctgcca

SEQ ID NO: 2912724 - DNA, 17 bp, Homo sapiens
agggaaggggcctccct

SEQ ID NO: 2912725 - DNA, 12 bp, Homo sapiens
agggaagtgtgt

SEQ ID NO: 2912726 - DNA, 23 bp, Homo sapiens
agggaagtgtgtgtgtgtccatg

SEQ ID NO: 2912727 - DNA, 22 bp, Homo sapiens
agggacaagtggactcagggca

SEQ ID NO: 2912728 - DNA, 14 bp, Homo sapiens
agggacacctggga

SEQ ID NO: 2912729 - DNA, 18 bp, Homo sapiens
agggacagagacacctgc

SEQ ID NO: 2912730 - DNA, 21 bp, Homo sapiens
agggacagaggccccagcctc

SEQ ID NO: 2912731 - DNA, 22 bp, Homo sapiens
agggacagaggccccagcctcc

SEQ ID NO: 2912732 - DNA, 19 bp, Homo sapiens
agggacccaaagcaggatg

SEQ ID NO: 2912733 - DNA, 15 bp, Homo sapiens
agggaccgagcccag

SEQ ID NO: 2912734 - DNA, 16 bp, Homo sapiens
agggacctctcccagg

SEQ ID NO: 2912735 - DNA, 21 bp, Homo sapiens
agggacgaagaagagccacag

SEQ ID NO: 2912736 - DNA, 22 bp, Homo sapiens
agggacgcctgggggtgccagg

SEQ ID NO: 2912737 - DNA, 16 bp, Homo sapiens
agggacggctgtggga

SEQ ID NO: 2912738 - DNA, 19 bp, Homo sapiens
agggactcggcccagggcc

SEQ ID NO: 2912739 - DNA, 12 bp, Homo sapiens
agggactgctga

SEQ ID NO: 2912740 - DNA, 20 bp, Homo sapiens
agggactgctgacccaccaa

SEQ ID NO: 2912741 - DNA, 16 bp, Homo sapiens
agggagaaagaaaact

SEQ ID NO: 2912742 - DNA, 14 bp, Homo sapiens
agggagaaaggaga

SEQ ID NO: 2912743 - DNA, 14 bp, Homo sapiens
agggagaacttatg

SEQ ID NO: 2912744 - DNA, 15 bp, Homo sapiens
agggagaagaagtca

SEQ ID NO: 2912745 - DNA, 20 bp, Homo sapiens
agggagacccagggggctga

SEQ ID NO: 2912746 - DNA, 22 bp, Homo sapiens
agggagacctggacacaggcct

SEQ ID NO: 2912747 - DNA, 19 bp, Homo sapiens
agggagaggctgtgtccct

SEQ ID NO: 2912748 - DNA, 17 bp, Homo sapiens
agggagatggagaaaat

SEQ ID NO: 2912749 - DNA, 19 bp, Homo sapiens
agggagcaggcggtgggca

SEQ ID NO: 2912750 - DNA, 17 bp, Homo sapiens
agggagcattttcctcc

SEQ ID NO: 2912751 - DNA, 18 bp, Homo sapiens
agggagccatggaaggtg

SEQ ID NO: 2912752 - DNA, 16 bp, Homo sapiens
agggagccatgtttca

SEQ ID NO: 2912753 - DNA, 17 bp, Homo sapiens
agggagccatttgagag

SEQ ID NO: 2912754 - DNA, 14 bp, Homo sapiens
agggagcctggccc

SEQ ID NO: 2912755 - DNA, 17 bp, Homo sapiens
agggagcggaaagcagc

SEQ ID NO: 2912756 - DNA, 22 bp, Homo sapiens
agggagcggccggccagcccct

SEQ ID NO: 2912757 - DNA, 23 bp, Homo sapiens
agggagctagccagaggactgtg

SEQ ID NO: 2912758 - DNA, 19 bp, Homo sapiens
agggagctgaggcctccct

SEQ ID NO: 2912759 - DNA, 15 bp, Homo sapiens
agggagctgggcccg

SEQ ID NO: 2912760 - DNA, 18 bp, Homo sapiens
agggaggaccacaggtgt

SEQ ID NO: 2912761 - DNA, 19 bp, Homo sapiens
agggaggcactagtcaccg

SEQ ID NO: 2912762 - DNA, 15 bp, Homo sapiens
agggaggcagtggct

SEQ ID NO: 2912763 - DNA, 14 bp, Homo sapiens
agggaggcccagcc

SEQ ID NO: 2912764 - DNA, 11 bp, Homo sapiens
agggaggcccc

SEQ ID NO: 2912765 - DNA, 23 bp, Homo sapiens
agggaggcctttagcttaagagg

SEQ ID NO: 2912766 - DNA, 13 bp, Homo sapiens
agggagggaagtc

SEQ ID NO: 2912767 - DNA, 17 bp, Homo sapiens
agggaggggaaggggcc

SEQ ID NO: 2912768 - DNA, 17 bp, Homo sapiens
agggaggggccggccct

SEQ ID NO: 2912769 - DNA, 21 bp, Homo sapiens
agggaggggccggctggcctg

SEQ ID NO: 2912770 - DNA, 20 bp, Homo sapiens
agggagtctcaggaggaggc

SEQ ID NO: 2912771 - DNA, 19 bp, Homo sapiens
agggagtgcagaacacctg

SEQ ID NO: 2912772 - DNA, 21 bp, Homo sapiens
agggagtgcagaacacctggc

SEQ ID NO: 2912773 - DNA, 20 bp, Homo sapiens
agggatgccctggaggtggc

SEQ ID NO: 2912774 - DNA, 17 bp, Homo sapiens
agggatgggcagcccaa

SEQ ID NO: 2912775 - DNA, 14 bp, Homo sapiens
agggatggtgttca

SEQ ID NO: 2912776 - DNA, 14 bp, Homo sapiens
agggatttcttagg

SEQ ID NO: 2912777 - DNA, 15 bp, Homo sapiens
agggatttcttaggg

SEQ ID NO: 2912778 - DNA, 20 bp, Homo sapiens
agggcaaaatcgccataggc

SEQ ID NO: 2912779 - DNA, 19 bp, Homo sapiens
agggcaagtggatgggaat

SEQ ID NO: 2912780 - DNA, 21 bp, Homo sapiens
agggcaagtggatgggaattt

SEQ ID NO: 2912781 - DNA, 16 bp, Homo sapiens
agggcacaaagatggg

SEQ ID NO: 2912782 - DNA, 19 bp, Homo sapiens
agggcacacccctggggct

SEQ ID NO: 2912783 - DNA, 22 bp, Homo sapiens
agggcacacccctggggctgag

SEQ ID NO: 2912784 - DNA, 15 bp, Homo sapiens
agggcaccaccaaga

SEQ ID NO: 2912785 - DNA, 18 bp, Homo sapiens
agggcactggagctggga

SEQ ID NO: 2912786 - DNA, 17 bp, Homo sapiens
agggcagaggaagagac

SEQ ID NO: 2912787 - DNA, 22 bp, Homo sapiens
agggcagaggctggaggcaggg

SEQ ID NO: 2912788 - DNA, 23 bp, Homo sapiens
agggcagaggtgctacctggcct

SEQ ID NO: 2912789 - DNA, 17 bp, Homo sapiens
agggcagatggacttct

SEQ ID NO: 2912790 - DNA, 12 bp, Homo sapiens
agggcagcactg

SEQ ID NO: 2912791 - DNA, 22 bp, Homo sapiens
agggcagcactgggaagctgga

SEQ ID NO: 2912792 - DNA, 14 bp, Homo sapiens
agggcagcagggct

SEQ ID NO: 2912793 - DNA, 12 bp, Homo sapiens
agggcagccctc

SEQ ID NO: 2912794 - DNA, 15 bp, Homo sapiens
agggcagccctccat

SEQ ID NO: 2912795 - DNA, 20 bp, Homo sapiens
agggcagccctccatggtcc

SEQ ID NO: 2912796 - DNA, 15 bp, Homo sapiens
agggcagccctcctt

SEQ ID NO: 2912797 - DNA, 14 bp, Homo sapiens
agggcagctgcctg

SEQ ID NO: 2912798 - DNA, 18 bp, Homo sapiens
agggcagctgcctggcca

SEQ ID NO: 2912799 - DNA, 13 bp, Homo sapiens
agggcagtggacg

SEQ ID NO: 2912800 - DNA, 19 bp, Homo sapiens
agggcagtggcttctttcc

SEQ ID NO: 2912801 - DNA, 20 bp, Homo sapiens
agggcagtggcttctttcca

SEQ ID NO: 2912802 - DNA, 16 bp, Homo sapiens
agggcatctctgagtg

SEQ ID NO: 2912803 - DNA, 19 bp, Homo sapiens
agggcatgggtcgggagag

SEQ ID NO: 2912804 - DNA, 20 bp, Homo sapiens
agggcatgggtcgggagagg

SEQ ID NO: 2912805 - DNA, 12 bp, Homo sapiens
agggccaacaac

SEQ ID NO: 2912806 - DNA, 17 bp, Homo sapiens
agggccacggggaggcc

SEQ ID NO: 2912807 - DNA, 15 bp, Homo sapiens
agggccacgtgccag

SEQ ID NO: 2912808 - DNA, 23 bp, Homo sapiens
agggccactggtccccaacaatg

SEQ ID NO: 2912809 - DNA, 11 bp, Homo sapiens
agggccagagc

SEQ ID NO: 2912810 - DNA, 14 bp, Homo sapiens
agggccagagccag

SEQ ID NO: 2912811 - DNA, 13 bp, Homo sapiens
agggccaggaagg

SEQ ID NO: 2912812 - DNA, 22 bp, Homo sapiens
agggccaggaaggacagactgg

SEQ ID NO: 2912813 - DNA, 12 bp, Homo sapiens
agggccaggtgc

SEQ ID NO: 2912814 - DNA, 16 bp, Homo sapiens
agggccatggctcagg

SEQ ID NO: 2912815 - DNA, 15 bp, Homo sapiens
agggcccagagccca

SEQ ID NO: 2912816 - DNA, 12 bp, Homo sapiens
agggcccagagt

SEQ ID NO: 2912817 - DNA, 13 bp, Homo sapiens
agggcccaggcca

SEQ ID NO: 2912818 - DNA, 14 bp, Homo sapiens
agggcccaggcctg

SEQ ID NO: 2912819 - DNA, 17 bp, Homo sapiens
agggcccaggcctggag

SEQ ID NO: 2912820 - DNA, 22 bp, Homo sapiens
agggccgaccagaggagccttt

SEQ ID NO: 2912821 - DNA, 15 bp, Homo sapiens
agggccgcctgcctt

SEQ ID NO: 2912822 - DNA, 14 bp, Homo sapiens
agggccggggatgg

SEQ ID NO: 2912823 - DNA, 18 bp, Homo sapiens
agggccggggatggatct

SEQ ID NO: 2912824 - DNA, 14 bp, Homo sapiens
agggccgtcaagga

SEQ ID NO: 2912825 - DNA, 21 bp, Homo sapiens
agggcctagctgctacaaaga

SEQ ID NO: 2912826 - DNA, 18 bp, Homo sapiens
agggcctcggaggctcct

SEQ ID NO: 2912827 - DNA, 15 bp, Homo sapiens
agggcctctgcctgg

SEQ ID NO: 2912828 - DNA, 17 bp, Homo sapiens
agggcctctgcctggga

SEQ ID NO: 2912829 - DNA, 15 bp, Homo sapiens
agggcctgagcctgg

SEQ ID NO: 2912830 - DNA, 22 bp, Homo sapiens
agggcctgcaggacctgcctgt

SEQ ID NO: 2912831 - DNA, 22 bp, Homo sapiens
aggtggctgacccagtccctgg

SEQ ID NO: 2912832 - DNA, 13 bp, Homo sapiens
aggtggctgcctg

SEQ ID NO: 2912833 - DNA, 18 bp, Homo sapiens
aggtgggcggacaaaagg

SEQ ID NO: 2912834 - DNA, 22 bp, Homo sapiens
aggtgggcggacaaaagggcca

SEQ ID NO: 2912835 - DNA, 21 bp, Homo sapiens
aggtggggtagtgccgcagtg

SEQ ID NO: 2912836 - DNA, 20 bp, Homo sapiens
aggtggggtgatggccagag

SEQ ID NO: 2912837 - DNA, 17 bp, Homo sapiens
aggtggggtttcctgca

SEQ ID NO: 2912838 - DNA, 21 bp, Homo sapiens
aggtgggtggtgggcttctgc

SEQ ID NO: 2912839 - DNA, 21 bp, Homo sapiens
aggtgggttttcttcccatca

SEQ ID NO: 2912840 - DNA, 22 bp, Homo sapiens
aggtggtagtaaaacacagagg

SEQ ID NO: 2912841 - DNA, 21 bp, Homo sapiens
aggtggtgtcactgtccctcc

SEQ ID NO: 2912842 - DNA, 19 bp, Homo sapiens
aggtgtagccacaccagga

SEQ ID NO: 2912843 - DNA, 22 bp, Homo sapiens
aggtgtcaggcccgtcggagct

SEQ ID NO: 2912844 - DNA, 17 bp, Homo sapiens
aggtgtcatccacaggc

SEQ ID NO: 2912845 - DNA, 23 bp, Homo sapiens
aggtgtggctttaggagcagtgg

SEQ ID NO: 2912846 - DNA, 16 bp, Homo sapiens
aggtgtgtgagactac

SEQ ID NO: 2912847 - DNA, 17 bp, Homo sapiens
aggtgttaacattccaa

SEQ ID NO: 2912848 - DNA, 18 bp, Homo sapiens
aggtgttaacattccaag

SEQ ID NO: 2912849 - DNA, 23 bp, Homo sapiens
aggtgttaacattccaagactct

SEQ ID NO: 2912850 - DNA, 15 bp, Homo sapiens
aggtgttactgtaat

SEQ ID NO: 2912851 - DNA, 18 bp, Homo sapiens
aggtgttggtgacaattg

SEQ ID NO: 2912852 - DNA, 18 bp, Homo sapiens
aggttaaagcaaaccagc

SEQ ID NO: 2912853 - DNA, 17 bp, Homo sapiens
aggttaatttttccttc

SEQ ID NO: 2912854 - DNA, 16 bp, Homo sapiens
aggttacaacagattt

SEQ ID NO: 2912855 - DNA, 19 bp, Homo sapiens
aggttacaacagatttgtg

SEQ ID NO: 2912856 - DNA, 21 bp, Homo sapiens
aggttacaacagatttgtgaa

SEQ ID NO: 2912857 - DNA, 22 bp, Homo sapiens
aggttacaacagatttgtgaac

SEQ ID NO: 2912858 - DNA, 24 bp, Homo sapiens
aggttacaacagatttgtgaactc

SEQ ID NO: 2912859 - DNA, 16 bp, Homo sapiens
aggttatatgaatata

SEQ ID NO: 2912860 - DNA, 19 bp, Homo sapiens
aggttatttaaaataaatt

SEQ ID NO: 2912861 - DNA, 14 bp, Homo sapiens
aggttcaacttatt

SEQ ID NO: 2912862 - DNA, 22 bp, Homo sapiens
aggttcccgacaccagaagctg

SEQ ID NO: 2912863 - DNA, 22 bp, Homo sapiens
aggttccctgccttgtttggat

SEQ ID NO: 2912864 - DNA, 23 bp, Homo sapiens
aggttccgcttggagcagagggg

SEQ ID NO: 2912865 - DNA, 24 bp, Homo sapiens
aggttcctaagacttcagtcctgg

SEQ ID NO: 2912866 - DNA, 16 bp, Homo sapiens
aggttctaaagttcta

SEQ ID NO: 2912867 - DNA, 18 bp, Homo sapiens
aggttctaaagttctaag

SEQ ID NO: 2912868 - DNA, 15 bp, Homo sapiens
aggttctatttggaa

SEQ ID NO: 2912869 - DNA, 20 bp, Homo sapiens
aggttctgtagagccaatta

SEQ ID NO: 2912870 - DNA, 19 bp, Homo sapiens
aggttcttcttcctgaagc

SEQ ID NO: 2912871 - DNA, 17 bp, Homo sapiens
aggttgagctcttctta

SEQ ID NO: 2912872 - DNA, 24 bp, Homo sapiens
aggttgagctcttcttaaagtatt

SEQ ID NO: 2912873 - DNA, 15 bp, Homo sapiens
aggttggaaaagaaa

SEQ ID NO: 2912874 - DNA, 18 bp, Homo sapiens
aggttggcggcagacaca

SEQ ID NO: 2912875 - DNA, 15 bp, Homo sapiens
aggttggcgggggca

SEQ ID NO: 2912876 - DNA, 16 bp, Homo sapiens
aggttggcgggggcac

SEQ ID NO: 2912877 - DNA, 16 bp, Homo sapiens
aggttggggtgtacta

SEQ ID NO: 2912878 - DNA, 19 bp, Homo sapiens
aggttggggtgtactagtt

SEQ ID NO: 2912879 - DNA, 18 bp, Homo sapiens
aggttgtagtgagccaag

SEQ ID NO: 2912880 - DNA, 15 bp, Homo sapiens
aggttgtggggaggc

SEQ ID NO: 2912881 - DNA, 16 bp, Homo sapiens
aggttgtttatgaggg

SEQ ID NO: 2912882 - DNA, 14 bp, Homo sapiens
aggtttaaagagtc

SEQ ID NO: 2912883 - DNA, 15 bp, Homo sapiens
aggtttaaagagtct

SEQ ID NO: 2912884 - DNA, 19 bp, Homo sapiens
aggtttactagcacctgcc

SEQ ID NO: 2912885 - DNA, 20 bp, Homo sapiens
aggtttaggctggtggccca

SEQ ID NO: 2912886 - DNA, 13 bp, Homo sapiens
aggtttcaaagat

SEQ ID NO: 2912887 - DNA, 17 bp, Homo sapiens
aggtttcaaagatgctg

SEQ ID NO: 2912888 - DNA, 19 bp, Homo sapiens
aggtttggtttttttgtac

SEQ ID NO: 2912889 - DNA, 20 bp, Homo sapiens
aggtttggtttttttgtaca

SEQ ID NO: 2912890 - DNA, 16 bp, Homo sapiens
aggttttaggttctaa

SEQ ID NO: 2912891 - DNA, 17 bp, Homo sapiens
aggttttgtttgctatc

SEQ ID NO: 2912892 - DNA, 19 bp, Homo sapiens
aggttttgtttgctatctt

SEQ ID NO: 2912893 - DNA, 21 bp, Homo sapiens
aggtttttaaagtaaatctct

SEQ ID NO: 2912894 - DNA, 15 bp, Homo sapiens
agtaaaaattaaaaa

SEQ ID NO: 2912895 - DNA, 13 bp, Homo sapiens
agtaaaacacaga

SEQ ID NO: 2912896 - DNA, 14 bp, Homo sapiens
agtaaaacacagag

SEQ ID NO: 2912897 - DNA, 23 bp, Homo sapiens
agtaaagaactgcacatgaagaa

SEQ ID NO: 2912898 - DNA, 18 bp, Homo sapiens
agtaaaggcattccacag

SEQ ID NO: 2912899 - DNA, 22 bp, Homo sapiens
agtaaatatcccaaactgtgat

SEQ ID NO: 2912900 - DNA, 17 bp, Homo sapiens
agtaaatcagatgttga

SEQ ID NO: 2912901 - DNA, 18 bp, Homo sapiens
agtaaatcagatgttgaa

SEQ ID NO: 2912902 - DNA, 15 bp, Homo sapiens
agtaacataataaat

SEQ ID NO: 2912903 - DNA, 22 bp, Homo sapiens
agtaacatcaaagattaggtga

SEQ ID NO: 2912904 - DNA, 18 bp, Homo sapiens
agtaacattctacttgct

SEQ ID NO: 2912905 - DNA, 23 bp, Homo sapiens
agtaaccatcactggttgcactt

SEQ ID NO: 2912906 - DNA, 20 bp, Homo sapiens
agtaacctttaaaaatgtat

SEQ ID NO: 2912907 - DNA, 22 bp, Homo sapiens
agtaacgggtcgtaatgactta

SEQ ID NO: 2912908 - DNA, 19 bp, Homo sapiens
agtaactataacaaaaaaa

SEQ ID NO: 2912909 - DNA, 20 bp, Homo sapiens
agtaactcagtgaaggccca

SEQ ID NO: 2912910 - DNA, 19 bp, Homo sapiens
agtaactcccactcctaat

SEQ ID NO: 2912911 - DNA, 23 bp, Homo sapiens
agtaactggttgtcacctatgag

SEQ ID NO: 2912912 - DNA, 22 bp, Homo sapiens
agtaactgtccctgctttctgg

SEQ ID NO: 2912913 - DNA, 16 bp, Homo sapiens
agtaacttattttgta

SEQ ID NO: 2912914 - DNA, 17 bp, Homo sapiens
agtaactttatgtgtaa

SEQ ID NO: 2912915 - DNA, 14 bp, Homo sapiens
agtaagaacagctc

SEQ ID NO: 2912916 - DNA, 12 bp, Homo sapiens
agtaagaagagg

SEQ ID NO: 2912917 - DNA, 20 bp, Homo sapiens
agtaagaagaggagcctcag

SEQ ID NO: 2912918 - DNA, 14 bp, Homo sapiens
agtaagaggctgga

SEQ ID NO: 2912919 - DNA, 23 bp, Homo sapiens
agtaagatggttttcaaatcatt

SEQ ID NO: 2912920 - DNA, 20 bp, Homo sapiens
agtaagcagagttctttgca

SEQ ID NO: 2912921 - DNA, 17 bp, Homo sapiens
agtaagtgcgaagactg

SEQ ID NO: 2912922 - DNA, 19 bp, Homo sapiens
agtaatctgtgtacaaaga

SEQ ID NO: 2912923 - DNA, 17 bp, Homo sapiens
agtaatgagtttaaaaa

SEQ ID NO: 2912924 - DNA, 21 bp, Homo sapiens
agtaatgctaaatgtgtaata

SEQ ID NO: 2912925 - DNA, 20 bp, Homo sapiens
agtaatgctacgtgtgattt

SEQ ID NO: 2912926 - DNA, 16 bp, Homo sapiens
agtaattataggaagt

SEQ ID NO: 2912927 - DNA, 15 bp, Homo sapiens
agtaattttctgatg

SEQ ID NO: 2912928 - DNA, 20 bp, Homo sapiens
agtacactgtgtctctatgt

SEQ ID NO: 2912929 - DNA, 22 bp, Homo sapiens
agtacactgtgtctctatgtga

SEQ ID NO: 2912930 - DNA, 15 bp, Homo sapiens
agtacagatactgtg

SEQ ID NO: 2912931 - DNA, 21 bp, Homo sapiens
agtacataattgattaaaatc

SEQ ID NO: 2912932 - DNA, 22 bp, Homo sapiens
agtacataattgattaaaatct

SEQ ID NO: 2912933 - DNA, 12 bp, Homo sapiens
agtaccttgctt

SEQ ID NO: 2912934 - DNA, 16 bp, Homo sapiens
agtacctttcagaact

SEQ ID NO: 2912935 - DNA, 14 bp, Homo sapiens
agtactaagagtat

SEQ ID NO: 2912936 - DNA, 14 bp, Homo sapiens
agtactaaggtgac

SEQ ID NO: 2912937 - DNA, 17 bp, Homo sapiens
agtactaaggtgacttt

SEQ ID NO: 2912938 - DNA, 13 bp, Homo sapiens
agtactgtgggca

SEQ ID NO: 2912939 - DNA, 17 bp, Homo sapiens
agtactgtgggcaattt

SEQ ID NO: 2912940 - DNA, 20 bp, Homo sapiens
agtactgtgggcaatttaga

SEQ ID NO: 2912941 - DNA, 21 bp, Homo sapiens
agtactgtgggcaatttagaa

SEQ ID NO: 2912942 - DNA, 19 bp, Homo sapiens
agtacttcagcaagagaga

SEQ ID NO: 2912943 - DNA, 13 bp, Homo sapiens
agtacttccctca

SEQ ID NO: 2912944 - DNA, 16 bp, Homo sapiens
agtacttccctcaggc

SEQ ID NO: 2912945 - DNA, 23 bp, Homo sapiens
agtacttggttgggtcagattta

SEQ ID NO: 2912946 - DNA, 19 bp, Homo sapiens
agtactttggaggccccta

SEQ ID NO: 2912947 - DNA, 22 bp, Homo sapiens
agtactttggaggcccctatgt

SEQ ID NO: 2912948 - DNA, 14 bp, Homo sapiens
agtacttttaacgt

SEQ ID NO: 2912949 - DNA, 15 bp, Homo sapiens
agtacttttagactt

SEQ ID NO: 2912950 - DNA, 16 bp, Homo sapiens
agtacttttttaaata

SEQ ID NO: 2912951 - DNA, 11 bp, Homo sapiens
agtagaaaaat

SEQ ID NO: 2912952 - DNA, 18 bp, Homo sapiens
agtagaaagcttgaaaag

SEQ ID NO: 2912953 - DNA, 18 bp, Homo sapiens
agtagaatggacaatttc

SEQ ID NO: 2912954 - DNA, 15 bp, Homo sapiens
agtagaattgcattg

SEQ ID NO: 2912955 - DNA, 14 bp, Homo sapiens
agtagacattttaa

SEQ ID NO: 2912956 - DNA, 23 bp, Homo sapiens
agtagatctgctttctgttcatc

SEQ ID NO: 2912957 - DNA, 20 bp, Homo sapiens
agtagatgcgcagccccatc

SEQ ID NO: 2912958 - DNA, 21 bp, Homo sapiens
agtagatgcgcagccccatct

SEQ ID NO: 2912959 - DNA, 17 bp, Homo sapiens
agtagattttctttaaa

SEQ ID NO: 2912960 - DNA, 18 bp, Homo sapiens
agtagattttctttaaaa

SEQ ID NO: 2912961 - DNA, 23 bp, Homo sapiens
agtgcttgcagatcatctgggga

SEQ ID NO: 2912962 - DNA, 19 bp, Homo sapiens
agtgcttgtgtaatttatg

SEQ ID NO: 2912963 - DNA, 16 bp, Homo sapiens
agtgctttaagaatga

SEQ ID NO: 2912964 - DNA, 17 bp, Homo sapiens
agtggaaaggatcacag

SEQ ID NO: 2912965 - DNA, 17 bp, Homo sapiens
agtggaacacaaatgaa

SEQ ID NO: 2912966 - DNA, 17 bp, Homo sapiens
agtggaagccactggac

SEQ ID NO: 2912967 - DNA, 17 bp, Homo sapiens
agtggaaggacactctt

SEQ ID NO: 2912968 - DNA, 17 bp, Homo sapiens
agtggacaagtcatgga

SEQ ID NO: 2912969 - DNA, 13 bp, Homo sapiens
agtggaccaggac

SEQ ID NO: 2912970 - DNA, 23 bp, Homo sapiens
agtggaccttaggccttcctctc

SEQ ID NO: 2912971 - DNA, 17 bp, Homo sapiens
agtggagaaatgaaaag

SEQ ID NO: 2912972 - DNA, 19 bp, Homo sapiens
agtggaggcgggcttggaa

SEQ ID NO: 2912973 - DNA, 15 bp, Homo sapiens
agtggatgctgtgct

SEQ ID NO: 2912974 - DNA, 21 bp, Homo sapiens
agtggatttttttgtcattaa

SEQ ID NO: 2912975 - DNA, 20 bp, Homo sapiens
agtggccacggcccagggag

SEQ ID NO: 2912976 - DNA, 22 bp, Homo sapiens
agtggccacgttcagggagggg

SEQ ID NO: 2912977 - DNA, 19 bp, Homo sapiens
agtggccagcgccagggcc

SEQ ID NO: 2912978 - DNA, 23 bp, Homo sapiens
agtggccagcgccagggcccagg

SEQ ID NO: 2912979 - DNA, 18 bp, Homo sapiens
agtggccccacctgtgtc

SEQ ID NO: 2912980 - DNA, 19 bp, Homo sapiens
agtggccccttaggccagt

SEQ ID NO: 2912981 - DNA, 21 bp, Homo sapiens
agtggcctctttgtctaaaac

SEQ ID NO: 2912982 - DNA, 23 bp, Homo sapiens
agtggcctctttgtctaaaacaa

SEQ ID NO: 2912983 - DNA, 18 bp, Homo sapiens
agtggccttacccctgcc

SEQ ID NO: 2912984 - DNA, 20 bp, Homo sapiens
agtggccttacccctgcctt

SEQ ID NO: 2912985 - DNA, 19 bp, Homo sapiens
agtggccttgcttcttaga

SEQ ID NO: 2912986 - DNA, 17 bp, Homo sapiens
agtggctagtcctcact

SEQ ID NO: 2912987 - DNA, 15 bp, Homo sapiens
agtggctcgccaggc

SEQ ID NO: 2912988 - DNA, 14 bp, Homo sapiens
agtgggagaaaaca

SEQ ID NO: 2912989 - DNA, 16 bp, Homo sapiens
agtgggagatgaaaac

SEQ ID NO: 2912990 - DNA, 22 bp, Homo sapiens
agtgggagggtaccagcagaaa

SEQ ID NO: 2912991 - DNA, 18 bp, Homo sapiens
agtgggcattttgacaac

SEQ ID NO: 2912992 - DNA, 22 bp, Homo sapiens
agtgggcattttgacaacatgg

SEQ ID NO: 2912993 - DNA, 23 bp, Homo sapiens
agtgggccttcattaaatgtttg

SEQ ID NO: 2912994 - DNA, 12 bp, Homo sapiens
agtgggctgcac

SEQ ID NO: 2912995 - DNA, 21 bp, Homo sapiens
agtgggctgcacgctcccctc

SEQ ID NO: 2912996 - DNA, 10 bp, Homo sapiens
agtgggctgt

SEQ ID NO: 2912997 - DNA, 16 bp, Homo sapiens
agtgggcttgattctg

SEQ ID NO: 2912998 - DNA, 22 bp, Homo sapiens
agtgggcttgattctgcagtaa

SEQ ID NO: 2912999 - DNA, 19 bp, Homo sapiens
agtggggaaggaggccaag

SEQ ID NO: 2913000 - DNA, 18 bp, Homo sapiens
agtggggctaaatgaagt

SEQ ID NO: 2913001 - DNA, 13 bp, Homo sapiens
agtggggctctct

SEQ ID NO: 2913002 - DNA, 20 bp, Homo sapiens
agtggggctctctgagtcct

SEQ ID NO: 2913003 - DNA, 18 bp, Homo sapiens
agtggggtcaagctgagc

SEQ ID NO: 2913004 - DNA, 19 bp, Homo sapiens
agtggggtcaagctgagct

SEQ ID NO: 2913005 - DNA, 18 bp, Homo sapiens
agtggggtctccctctcc

SEQ ID NO: 2913006 - DNA, 22 bp, Homo sapiens
agtggggtgaacagctggtgcc

SEQ ID NO: 2913007 - DNA, 15 bp, Homo sapiens
agtgggtttcacaag

SEQ ID NO: 2913008 - DNA, 21 bp, Homo sapiens
agtgggtttcacaagtgaaaa

SEQ ID NO: 2913009 - DNA, 17 bp, Homo sapiens
agtggtccacatcccgg

SEQ ID NO: 2913010 - DNA, 16 bp, Homo sapiens
agtggtctctactgtg

SEQ ID NO: 2913011 - DNA, 19 bp, Homo sapiens
agtggtctctactgtggca

SEQ ID NO: 2913012 - DNA, 21 bp, Homo sapiens
agtggtgcgatctcggctcag

SEQ ID NO: 2913013 - DNA, 17 bp, Homo sapiens
agtggtgctcagttgta

SEQ ID NO: 2913014 - DNA, 18 bp, Homo sapiens
agtggtggcagggcctag

SEQ ID NO: 2913015 - DNA, 19 bp, Homo sapiens
agtggtggtaaccctggtg

SEQ ID NO: 2913016 - DNA, 20 bp, Homo sapiens
agtggtggtaaccctggtgg

SEQ ID NO: 2913017 - DNA, 21 bp, Homo sapiens
agtggtgtcatttttgaatgc

SEQ ID NO: 2913018 - DNA, 17 bp, Homo sapiens
agtggtgtgtgaagttt

SEQ ID NO: 2913019 - DNA, 21 bp, Homo sapiens
agtggtgttggcagtgtttgt

SEQ ID NO: 2913020 - DNA, 21 bp, Homo sapiens
agtggttcaatacctgtttag

SEQ ID NO: 2913021 - DNA, 21 bp, Homo sapiens
agtggttcagtctagaagaat

SEQ ID NO: 2913022 - DNA, 17 bp, Homo sapiens
agtggttgggctgtgcc

SEQ ID NO: 2913023 - DNA, 19 bp, Homo sapiens
agtggttgttagttataga

SEQ ID NO: 2913024 - DNA, 13 bp, Homo sapiens
agtgtaaagcatt

SEQ ID NO: 2913025 - DNA, 16 bp, Homo sapiens
agtgtaaagcattcca

SEQ ID NO: 2913026 - DNA, 22 bp, Homo sapiens
agtgtaaagcattccaacaaag

SEQ ID NO: 2913027 - DNA, 21 bp, Homo sapiens
agtgtaatttctttgcctgtt

SEQ ID NO: 2913028 - DNA, 12 bp, Homo sapiens
agtgtacatgta

SEQ ID NO: 2913029 - DNA, 20 bp, Homo sapiens
agtgtacatttctataaata

SEQ ID NO: 2913030 - DNA, 16 bp, Homo sapiens
agtgtagccaggtccc

SEQ ID NO: 2913031 - DNA, 17 bp, Homo sapiens
agtgtagccaggtcccc

SEQ ID NO: 2913032 - DNA, 23 bp, Homo sapiens
agtgtagccaggtccccctgcag

SEQ ID NO: 2913033 - DNA, 16 bp, Homo sapiens
agtgtagtttacagaa

SEQ ID NO: 2913034 - DNA, 15 bp, Homo sapiens
agtgtatttcagttc

SEQ ID NO: 2913035 - DNA, 21 bp, Homo sapiens
agtgtattttctgtcactgta

SEQ ID NO: 2913036 - DNA, 17 bp, Homo sapiens
agtgtcaaccagacaga

SEQ ID NO: 2913037 - DNA, 14 bp, Homo sapiens
agtgtcaagtcctg

SEQ ID NO: 2913038 - DNA, 16 bp, Homo sapiens
agtgtcaagtcctgac

SEQ ID NO: 2913039 - DNA, 23 bp, Homo sapiens
agtgtcaagtcctgactgggctg

SEQ ID NO: 2913040 - DNA, 16 bp, Homo sapiens
agtgtcacatgaggaa

SEQ ID NO: 2913041 - DNA, 16 bp, Homo sapiens
agtgtcactcaaggcg

SEQ ID NO: 2913042 - DNA, 17 bp, Homo sapiens
agtgtccattttgtgaa

SEQ ID NO: 2913043 - DNA, 20 bp, Homo sapiens
agtgtccattttgtgaagcc

SEQ ID NO: 2913044 - DNA, 18 bp, Homo sapiens
agtgtcccccacccccac

SEQ ID NO: 2913045 - DNA, 14 bp, Homo sapiens
agtgtcccccaggt

SEQ ID NO: 2913046 - DNA, 16 bp, Homo sapiens
agtgtctctgcctgga

SEQ ID NO: 2913047 - DNA, 13 bp, Homo sapiens
agtgtctggagcg

SEQ ID NO: 2913048 - DNA, 21 bp, Homo sapiens
agtgtctggagcggctgctcg

SEQ ID NO: 2913049 - DNA, 19 bp, Homo sapiens
agtgtctgggtttggccca

SEQ ID NO: 2913050 - DNA, 21 bp, Homo sapiens
agtgtctgggtttggcccaag

SEQ ID NO: 2913051 - DNA, 15 bp, Homo sapiens
agtgtgaagctttgc

SEQ ID NO: 2913052 - DNA, 17 bp, Homo sapiens
agtgtgaccaaaagtta

SEQ ID NO: 2913053 - DNA, 15 bp, Homo sapiens
agtgtgagggcagca

SEQ ID NO: 2913054 - DNA, 16 bp, Homo sapiens
agtgtgagtggtctgt

SEQ ID NO: 2913055 - DNA, 15 bp, Homo sapiens
agtgtgccacatgga

SEQ ID NO: 2913056 - DNA, 13 bp, Homo sapiens
agtgtggccaggc

SEQ ID NO: 2913057 - DNA, 14 bp, Homo sapiens
agtgtggccaggct

SEQ ID NO: 2913058 - DNA, 16 bp, Homo sapiens
agtgtgggactccagg

SEQ ID NO: 2913059 - DNA, 14 bp, Homo sapiens
agtgtgggaggctc

SEQ ID NO: 2913060 - DNA, 18 bp, Homo sapiens
agtgtgggaggctcctgt

SEQ ID NO: 2913061 - DNA, 19 bp, Homo sapiens
agtgtgggcgctctcccta

SEQ ID NO: 2913062 - DNA, 22 bp, Homo sapiens
agtgtggttatgaactttatag

SEQ ID NO: 2913063 - DNA, 13 bp, Homo sapiens
agtgtgtcagagc

SEQ ID NO: 2913064 - DNA, 18 bp, Homo sapiens
agtgtgtcagagcccagg

SEQ ID NO: 2913065 - DNA, 19 bp, Homo sapiens
agtgtgtcctgtgtaaatt

SEQ ID NO: 2913066 - DNA, 16 bp, Homo sapiens
agtgtgtggtgttagg

SEQ ID NO: 2913067 - DNA, 14 bp, Homo sapiens
agtgtgtgtgcaga

SEQ ID NO: 2913068 - DNA, 13 bp, Homo sapiens
agtgtgtgtgcat

SEQ ID NO: 2913069 - DNA, 19 bp, Homo sapiens
agtgtgtttccttcagtgc

SEQ ID NO: 2913070 - DNA, 18 bp, Homo sapiens
agtgtgtttttgcactgt

SEQ ID NO: 2913071 - DNA, 22 bp, Homo sapiens
agtgtgtttttgcactgtctgt

SEQ ID NO: 2913072 - DNA, 18 bp, Homo sapiens
agtgttagggaagggcct

SEQ ID NO: 2913073 - DNA, 23 bp, Homo sapiens
agtgttagggaagggcctgccac

SEQ ID NO: 2913074 - DNA, 16 bp, Homo sapiens
agtgttccccttccac

SEQ ID NO: 2913075 - DNA, 13 bp, Homo sapiens
agtgttcctgaga

SEQ ID NO: 2913076 - DNA, 16 bp, Homo sapiens
agtgttcctgtctcaa

SEQ ID NO: 2913077 - DNA, 22 bp, Homo sapiens
agtgttcctgtctcaatagctc

SEQ ID NO: 2913078 - DNA, 20 bp, Homo sapiens
agtgttcctttttaaatgtg

SEQ ID NO: 2913079 - DNA, 19 bp, Homo sapiens
agtgttctaaaatgaaata

SEQ ID NO: 2913080 - DNA, 21 bp, Homo sapiens
agtgttcttcagtgtaatgtg

SEQ ID NO: 2913081 - DNA, 19 bp, Homo sapiens
agtgttgcctcttgcaatg

SEQ ID NO: 2913082 - DNA, 13 bp, Homo sapiens
agtgttgctatgt

SEQ ID NO: 2913083 - DNA, 11 bp, Homo sapiens
agtgttgtcca

SEQ ID NO: 2913084 - DNA, 14 bp, Homo sapiens
agtgtttctgtgaa

SEQ ID NO: 2913085 - DNA, 13 bp, Homo sapiens
agtgtttctgtgc

SEQ ID NO: 2913086 - DNA, 12 bp, Homo sapiens
agtgtttggaat

SEQ ID NO: 2913087 - DNA, 12 bp, Homo sapiens
agtgtttggggg

SEQ ID NO: 2913088 - DNA, 21 bp, Homo sapiens
agtgttttggactccatctct

SEQ ID NO: 2913089 - DNA, 16 bp, Homo sapiens
agtgtttttacctctg

SEQ ID NO: 2913090 - DNA, 22 bp, Homo sapiens
agtgtttttcctgtgtattaaa

SEQ ID NO: 2913091 - DNA, 14 bp, Homo sapiens
agttaaatgtatca

SEQ ID NO: 2913092 - DNA, 15 bp, Homo sapiens
ataatcccagctact

SEQ ID NO: 2913093 - DNA, 19 bp, Homo sapiens
ataatctcacaaaacatat

SEQ ID NO: 2913094 - DNA, 14 bp, Homo sapiens
ataatctgtacaat

SEQ ID NO: 2913095 - DNA, 12 bp, Homo sapiens
ataatgaacttt

SEQ ID NO: 2913096 - DNA, 23 bp, Homo sapiens
ataatgactgccctgtttctgtt

SEQ ID NO: 2913097 - DNA, 14 bp, Homo sapiens
ataatgcaaagaat

SEQ ID NO: 2913098 - DNA, 19 bp, Homo sapiens
ataatgcaaagaatcccta

SEQ ID NO: 2913099 - DNA, 11 bp, Homo sapiens
ataatgcagta

SEQ ID NO: 2913100 - DNA, 13 bp, Homo sapiens
ataatgcagtatg

SEQ ID NO: 2913101 - DNA, 18 bp, Homo sapiens
ataatgctgttgcctcat

SEQ ID NO: 2913102 - DNA, 14 bp, Homo sapiens
ataatggaaaaaaa

SEQ ID NO: 2913103 - DNA, 22 bp, Homo sapiens
ataatggaaaaaaaaaaaagag

SEQ ID NO: 2913104 - DNA, 23 bp, Homo sapiens
ataatgggattagaaacaaacaa

SEQ ID NO: 2913105 - DNA, 17 bp, Homo sapiens
ataatgggccactgaaa

SEQ ID NO: 2913106 - DNA, 15 bp, Homo sapiens
ataatggtaccagat

SEQ ID NO: 2913107 - DNA, 17 bp, Homo sapiens
ataatggtaccagataa

SEQ ID NO: 2913108 - DNA, 18 bp, Homo sapiens
ataatggtaccagataaa

SEQ ID NO: 2913109 - DNA, 23 bp, Homo sapiens
ataatgtaatcggcttgaatttt

SEQ ID NO: 2913110 - DNA, 16 bp, Homo sapiens
ataatgtgaaatatga

SEQ ID NO: 2913111 - DNA, 12 bp, Homo sapiens
ataatgtgcctg

SEQ ID NO: 2913112 - DNA, 17 bp, Homo sapiens
ataatgtttttaatatt

SEQ ID NO: 2913113 - DNA, 16 bp, Homo sapiens
ataattaatcagctcg

SEQ ID NO: 2913114 - DNA, 17 bp, Homo sapiens
ataattcagtatgtttt

SEQ ID NO: 2913115 - DNA, 19 bp, Homo sapiens
ataattgagttttcagtgg

SEQ ID NO: 2913116 - DNA, 12 bp, Homo sapiens
ataattgattaa

SEQ ID NO: 2913117 - DNA, 19 bp, Homo sapiens
ataattgattaaaatctct

SEQ ID NO: 2913118 - DNA, 21 bp, Homo sapiens
ataattgtatcgtatagctgt

SEQ ID NO: 2913119 - DNA, 20 bp, Homo sapiens
ataattgtgaccaatacatt

SEQ ID NO: 2913120 - DNA, 15 bp, Homo sapiens
ataatttattttgct

SEQ ID NO: 2913121 - DNA, 13 bp, Homo sapiens
ataatttgaactt

SEQ ID NO: 2913122 - DNA, 12 bp, Homo sapiens
ataatttgttta

SEQ ID NO: 2913123 - DNA, 16 bp, Homo sapiens
ataatttgtttaaaat

SEQ ID NO: 2913124 - DNA, 19 bp, Homo sapiens
ataatttgtttaaaattct

SEQ ID NO: 2913125 - DNA, 16 bp, Homo sapiens
ataattttaaaaatgg

SEQ ID NO: 2913126 - DNA, 18 bp, Homo sapiens
atacaaaaatactcagat

SEQ ID NO: 2913127 - DNA, 20 bp, Homo sapiens
atacaaaaattagccgggca

SEQ ID NO: 2913128 - DNA, 16 bp, Homo sapiens
atacaaaataaaactg

SEQ ID NO: 2913129 - DNA, 11 bp, Homo sapiens
atacaaaatgt

SEQ ID NO: 2913130 - DNA, 14 bp, Homo sapiens
atacaaatctgtat

SEQ ID NO: 2913131 - DNA, 24 bp, Homo sapiens
atacaaatctgtataaatgtctat

SEQ ID NO: 2913132 - DNA, 19 bp, Homo sapiens
atacaaattttcagaaggt

SEQ ID NO: 2913133 - DNA, 15 bp, Homo sapiens
atacaacagtgctaa

SEQ ID NO: 2913134 - DNA, 18 bp, Homo sapiens
atacaacagtgctaaaaa

SEQ ID NO: 2913135 - DNA, 17 bp, Homo sapiens
atacaacatgattttat

SEQ ID NO: 2913136 - DNA, 18 bp, Homo sapiens
atacaactgtaaagcaaa

SEQ ID NO: 2913137 - DNA, 19 bp, Homo sapiens
atacaactgtaaagcaaat

SEQ ID NO: 2913138 - DNA, 16 bp, Homo sapiens
atacaacttaaataat

SEQ ID NO: 2913139 - DNA, 16 bp, Homo sapiens
atacaattattgtata

SEQ ID NO: 2913140 - DNA, 17 bp, Homo sapiens
atacacaaggagctttc

SEQ ID NO: 2913141 - DNA, 19 bp, Homo sapiens
atacacaaggagctttctt

SEQ ID NO: 2913142 - DNA, 18 bp, Homo sapiens
atacacacacacacacag

SEQ ID NO: 2913143 - DNA, 19 bp, Homo sapiens
atacacacacacacacagc

SEQ ID NO: 2913144 - DNA, 18 bp, Homo sapiens
atacacatctctgtcagt

SEQ ID NO: 2913145 - DNA, 14 bp, Homo sapiens
atacacatttcaca

SEQ ID NO: 2913146 - DNA, 16 bp, Homo sapiens
atacacgggacagttg

SEQ ID NO: 2913147 - DNA, 14 bp, Homo sapiens
atacactaaaaatc

SEQ ID NO: 2913148 - DNA, 17 bp, Homo sapiens
atacactgacttggtgc

SEQ ID NO: 2913149 - DNA, 14 bp, Homo sapiens
atacagaactcttt

SEQ ID NO: 2913150 - DNA, 16 bp, Homo sapiens
atacagaactctttca

SEQ ID NO: 2913151 - DNA, 20 bp, Homo sapiens
atacagaactctttcaaaac

SEQ ID NO: 2913152 - DNA, 14 bp, Homo sapiens
atacagagtaatta

SEQ ID NO: 2913153 - DNA, 13 bp, Homo sapiens
atacagcagcaag

SEQ ID NO: 2913154 - DNA, 16 bp, Homo sapiens
atacagcagcaagaaa

SEQ ID NO: 2913155 - DNA, 17 bp, Homo sapiens
atacagcagcaagaaaa

SEQ ID NO: 2913156 - DNA, 19 bp, Homo sapiens
atacagcagcaagaaaaaa

SEQ ID NO: 2913157 - DNA, 22 bp, Homo sapiens
atacagcctgaataaaccaaga

SEQ ID NO: 2913158 - DNA, 12 bp, Homo sapiens
atacagctttct

SEQ ID NO: 2913159 - DNA, 19 bp, Homo sapiens
atacagctttctgaccttc

SEQ ID NO: 2913160 - DNA, 15 bp, Homo sapiens
atacaggagacccaa

SEQ ID NO: 2913161 - DNA, 16 bp, Homo sapiens
atacagggatggtgtt

SEQ ID NO: 2913162 - DNA, 22 bp, Homo sapiens
atacaggttactaccctcaccc

SEQ ID NO: 2913163 - DNA, 16 bp, Homo sapiens
atacagtacaggcagc

SEQ ID NO: 2913164 - DNA, 24 bp, Homo sapiens
atacagtcattatttaaagcacat

SEQ ID NO: 2913165 - DNA, 14 bp, Homo sapiens
atacagtgtacatg

SEQ ID NO: 2913166 - DNA, 21 bp, Homo sapiens
atacagttcggtgagctacaa

SEQ ID NO: 2913167 - DNA, 12 bp, Homo sapiens
atacataaatag

SEQ ID NO: 2913168 - DNA, 23 bp, Homo sapiens
atacatacaccagcattcctttt

SEQ ID NO: 2913169 - DNA, 17 bp, Homo sapiens
atacatacagaattact

SEQ ID NO: 2913170 - DNA, 14 bp, Homo sapiens
atacatacagagat

SEQ ID NO: 2913171 - DNA, 15 bp, Homo sapiens
atacatcaatatgta

SEQ ID NO: 2913172 - DNA, 19 bp, Homo sapiens
atacatcctttttctgcta

SEQ ID NO: 2913173 - DNA, 13 bp, Homo sapiens
atacattctagat

SEQ ID NO: 2913174 - DNA, 17 bp, Homo sapiens
atacattctgtaataca

SEQ ID NO: 2913175 - DNA, 14 bp, Homo sapiens
atacatttgtattt

SEQ ID NO: 2913176 - DNA, 16 bp, Homo sapiens
atacatttgtattttg

SEQ ID NO: 2913177 - DNA, 18 bp, Homo sapiens
atacatttgtattttgtg

SEQ ID NO: 2913178 - DNA, 22 bp, Homo sapiens
atacatttgtattttgtgatga

SEQ ID NO: 2913179 - DNA, 19 bp, Homo sapiens
ataccaatgaaaaaatgta

SEQ ID NO: 2913180 - DNA, 16 bp, Homo sapiens
ataccaattatggaaa

SEQ ID NO: 2913181 - DNA, 16 bp, Homo sapiens
ataccatatgaatgaa

SEQ ID NO: 2913182 - DNA, 16 bp, Homo sapiens
atacccaaccccagat

SEQ ID NO: 2913183 - DNA, 15 bp, Homo sapiens
atacccatgaactta

SEQ ID NO: 2913184 - DNA, 17 bp, Homo sapiens
ataccgcctcgtgccag

SEQ ID NO: 2913185 - DNA, 15 bp, Homo sapiens
atacctactgactga

SEQ ID NO: 2913186 - DNA, 19 bp, Homo sapiens
atacctactgactgatgac

SEQ ID NO: 2913187 - DNA, 16 bp, Homo sapiens
atacctctgtgtgctc

SEQ ID NO: 2913188 - DNA, 16 bp, Homo sapiens
ataccttgaaaaagta

SEQ ID NO: 2913189 - DNA, 23 bp, Homo sapiens
ataccttgaaaaagtagagaaca

SEQ ID NO: 2913190 - DNA, 13 bp, Homo sapiens
atacctttgtagt

SEQ ID NO: 2913191 - DNA, 22 bp, Homo sapiens
atacctttgtagttactcaagc

SEQ ID NO: 2913192 - DNA, 20 bp, Homo sapiens
atacgagagcagaggtctcc

SEQ ID NO: 2913193 - DNA, 22 bp, Homo sapiens
atacgtgttttgaattgcaaac

SEQ ID NO: 2913194 - DNA, 19 bp, Homo sapiens
atacgtttgtgcagaatct

SEQ ID NO: 2913195 - DNA, 13 bp, Homo sapiens
atactaaaaatca

SEQ ID NO: 2913196 - DNA, 23 bp, Homo sapiens
atactacctagaagtaagaagag

SEQ ID NO: 2913197 - DNA, 17 bp, Homo sapiens
atactaccttgaaaata

SEQ ID NO: 2913198 - DNA, 18 bp, Homo sapiens
atactactactgttatca

SEQ ID NO: 2913199 - DNA, 14 bp, Homo sapiens
atactagttgtgac

SEQ ID NO: 2913200 - DNA, 22 bp, Homo sapiens
atactcaaagtggaaaggatca

SEQ ID NO: 2913201 - DNA, 16 bp, Homo sapiens
atactcataatgtgaa

SEQ ID NO: 2913202 - DNA, 20 bp, Homo sapiens
atactcataatgtgaagtgt

SEQ ID NO: 2913203 - DNA, 11 bp, Homo sapiens
atactcatgtg

SEQ ID NO: 2913204 - DNA, 14 bp, Homo sapiens
atactcatgtgtat

SEQ ID NO: 2913205 - DNA, 22 bp, Homo sapiens
atactccctttttgagtaattt

SEQ ID NO: 2913206 - DNA, 14 bp, Homo sapiens
atactctcttccct

SEQ ID NO: 2913207 - DNA, 16 bp, Homo sapiens
atactctgttgcctcc

SEQ ID NO: 2913208 - DNA, 17 bp, Homo sapiens
atactctttctgtatat

SEQ ID NO: 2913209 - DNA, 17 bp, Homo sapiens
atactgacaatgtattt

SEQ ID NO: 2913210 - DNA, 22 bp, Homo sapiens
atactgacaatgtattttggaa

SEQ ID NO: 2913211 - DNA, 15 bp, Homo sapiens
atactgagctgctaa

SEQ ID NO: 2913212 - DNA, 18 bp, Homo sapiens
atactgagctgctaaaat

SEQ ID NO: 2913213 - DNA, 15 bp, Homo sapiens
atactgattttgaaa

SEQ ID NO: 2913214 - DNA, 20 bp, Homo sapiens
atactgcacttacaatccca

SEQ ID NO: 2913215 - DNA, 18 bp, Homo sapiens
atactgcactttagtgta

SEQ ID NO: 2913216 - DNA, 21 bp, Homo sapiens
atactgccaaaacatttatga

SEQ ID NO: 2913217 - DNA, 22 bp, Homo sapiens
atactgccaaaacatttatgac

SEQ ID NO: 2913218 - DNA, 18 bp, Homo sapiens
atactgccagatgctgat

SEQ ID NO: 2913219 - DNA, 18 bp, Homo sapiens
atactgctgagatacata

SEQ ID NO: 2913220 - DNA, 19 bp, Homo sapiens
atactgctgagatacatac

SEQ ID NO: 2913221 - DNA, 14 bp, Homo sapiens
atactgctgatgct

SEQ ID NO: 2913222 - DNA, 21 bp, Homo sapiens
atactgcttggagctgagcaa

SEQ ID NO: 2913223 - DNA, 15 bp, Homo sapiens
atactggaggaacac

SEQ ID NO: 2913224 - DNA, 17 bp, Homo sapiens
atactggttatcctgtg

SEQ ID NO: 2913225 - DNA, 17 bp, Homo sapiens
atccaggtaactttgaa

SEQ ID NO: 2913226 - DNA, 22 bp, Homo sapiens
atccaggtacgcacagacaggt

SEQ ID NO: 2913227 - DNA, 14 bp, Homo sapiens
atccagtagggaaa

SEQ ID NO: 2913228 - DNA, 19 bp, Homo sapiens
atccagtgttacaatcagt

SEQ ID NO: 2913229 - DNA, 17 bp, Homo sapiens
atccatagtaactgaca

SEQ ID NO: 2913230 - DNA, 12 bp, Homo sapiens
atccatcagcaa

SEQ ID NO: 2913231 - DNA, 17 bp, Homo sapiens
atccatcagcaatgctt

SEQ ID NO: 2913232 - DNA, 21 bp, Homo sapiens
atccatgcggagtccattatt

SEQ ID NO: 2913233 - DNA, 16 bp, Homo sapiens
atccattatcatgtgt

SEQ ID NO: 2913234 - DNA, 17 bp, Homo sapiens
atccattatcatgtgta

SEQ ID NO: 2913235 - DNA, 22 bp, Homo sapiens
atccattcctcagggacagaga

SEQ ID NO: 2913236 - DNA, 23 bp, Homo sapiens
atccatttaaactaaccttttat

SEQ ID NO: 2913237 - DNA, 14 bp, Homo sapiens
atccatttggcaga

SEQ ID NO: 2913238 - DNA, 22 bp, Homo sapiens
atccatttggcagaactgctgg

SEQ ID NO: 2913239 - DNA, 23 bp, Homo sapiens
atccatttggcagaactgctggg

SEQ ID NO: 2913240 - DNA, 14 bp, Homo sapiens
atcccaaactgtga

SEQ ID NO: 2913241 - DNA, 20 bp, Homo sapiens
atcccaagtagaatctcagt

SEQ ID NO: 2913242 - DNA, 12 bp, Homo sapiens
atcccacagccc

SEQ ID NO: 2913243 - DNA, 18 bp, Homo sapiens
atcccacccacatgtgac

SEQ ID NO: 2913244 - DNA, 20 bp, Homo sapiens
atcccactaatgcaaactgg

SEQ ID NO: 2913245 - DNA, 16 bp, Homo sapiens
atcccactggatctgg

SEQ ID NO: 2913246 - DNA, 22 bp, Homo sapiens
atcccagacctgtcgtctctcc

SEQ ID NO: 2913247 - DNA, 19 bp, Homo sapiens
atcccagcactttgggaga

SEQ ID NO: 2913248 - DNA, 18 bp, Homo sapiens
atcccagctactcaggag

SEQ ID NO: 2913249 - DNA, 20 bp, Homo sapiens
atcccagctactcaggaggc

SEQ ID NO: 2913250 - DNA, 18 bp, Homo sapiens
atcccagtagtgtttgga

SEQ ID NO: 2913251 - DNA, 21 bp, Homo sapiens
atcccagtagtgtttggaatt

SEQ ID NO: 2913252 - DNA, 13 bp, Homo sapiens
atcccatcaaaga

SEQ ID NO: 2913253 - DNA, 19 bp, Homo sapiens
atcccatgtaacagaaagg

SEQ ID NO: 2913254 - DNA, 14 bp, Homo sapiens
atcccattcacttc

SEQ ID NO: 2913255 - DNA, 15 bp, Homo sapiens
atcccattcacttct

SEQ ID NO: 2913256 - DNA, 14 bp, Homo sapiens
atcccattgccctg

SEQ ID NO: 2913257 - DNA, 19 bp, Homo sapiens
atccccaataattgcagaa

SEQ ID NO: 2913258 - DNA, 21 bp, Homo sapiens
atccccaataattgcagaact

SEQ ID NO: 2913259 - DNA, 12 bp, Homo sapiens
atccccagagcc

SEQ ID NO: 2913260 - DNA, 15 bp, Homo sapiens
atccccagagcccag

SEQ ID NO: 2913261 - DNA, 23 bp, Homo sapiens
atccccagagcccagctcttgct

SEQ ID NO: 2913262 - DNA, 13 bp, Homo sapiens
atccccagggaca

SEQ ID NO: 2913263 - DNA, 16 bp, Homo sapiens
atccccatcggccctg

SEQ ID NO: 2913264 - DNA, 19 bp, Homo sapiens
atccccatcggccctgtcc

SEQ ID NO: 2913265 - DNA, 12 bp, Homo sapiens
atccccctctca

SEQ ID NO: 2913266 - DNA, 23 bp, Homo sapiens
atccccctctcacgccacccccg

SEQ ID NO: 2913267 - DNA, 16 bp, Homo sapiens
atcccctgtcccctgg

SEQ ID NO: 2913268 - DNA, 19 bp, Homo sapiens
atcccctgtcccctggggc

SEQ ID NO: 2913269 - DNA, 21 bp, Homo sapiens
atcccctgtcccctggggctg

SEQ ID NO: 2913270 - DNA, 23 bp, Homo sapiens
atcccctgtcccctggggctggt

SEQ ID NO: 2913271 - DNA, 13 bp, Homo sapiens
atccccttaccct

SEQ ID NO: 2913272 - DNA, 20 bp, Homo sapiens
atcccctttggttttactac

SEQ ID NO: 2913273 - DNA, 19 bp, Homo sapiens
atcccgagcacctccacat

SEQ ID NO: 2913274 - DNA, 23 bp, Homo sapiens
atcccgcttagcgctctggacag

SEQ ID NO: 2913275 - DNA, 20 bp, Homo sapiens
atcccggctgaccctgtgcc

SEQ ID NO: 2913276 - DNA, 16 bp, Homo sapiens
atcccgttcagaaaac

SEQ ID NO: 2913277 - DNA, 16 bp, Homo sapiens
atcccgttttccccat

SEQ ID NO: 2913278 - DNA, 21 bp, Homo sapiens
atccctagactttaggctttc

SEQ ID NO: 2913279 - DNA, 18 bp, Homo sapiens
atccctcaccttctgagt

SEQ ID NO: 2913280 - DNA, 17 bp, Homo sapiens
atccctcccccagcaga

SEQ ID NO: 2913281 - DNA, 13 bp, Homo sapiens
atccctccctgcc

SEQ ID NO: 2913282 - DNA, 14 bp, Homo sapiens
atccctgccagctc

SEQ ID NO: 2913283 - DNA, 12 bp, Homo sapiens
atccctgcccat

SEQ ID NO: 2913284 - DNA, 14 bp, Homo sapiens
atccctggccactg

SEQ ID NO: 2913285 - DNA, 16 bp, Homo sapiens
atccctgggcattgct

SEQ ID NO: 2913286 - DNA, 16 bp, Homo sapiens
atccgccagtgtttct

SEQ ID NO: 2913287 - DNA, 18 bp, Homo sapiens
atccgtagttattttgca

SEQ ID NO: 2913288 - DNA, 21 bp, Homo sapiens
atccgtctttggcctcctcca

SEQ ID NO: 2913289 - DNA, 14 bp, Homo sapiens
atcctaaaatatgt

SEQ ID NO: 2913290 - DNA, 17 bp, Homo sapiens
atcctaagcatctaagt

SEQ ID NO: 2913291 - DNA, 19 bp, Homo sapiens
atcctaagggtcgaaagct

SEQ ID NO: 2913292 - DNA, 19 bp, Homo sapiens
atcctaatcatccaatgct

SEQ ID NO: 2913293 - DNA, 15 bp, Homo sapiens
atcctacaatatttt

SEQ ID NO: 2913294 - DNA, 21 bp, Homo sapiens
atcctagagatttggtgtaca

SEQ ID NO: 2913295 - DNA, 16 bp, Homo sapiens
atcctagcacatgctt

SEQ ID NO: 2913296 - DNA, 13 bp, Homo sapiens
atcctatgcaata

SEQ ID NO: 2913297 - DNA, 12 bp, Homo sapiens
atcctcaatcca

SEQ ID NO: 2913298 - DNA, 23 bp, Homo sapiens
atcctcagtgcaaaatgtcttgt

SEQ ID NO: 2913299 - DNA, 17 bp, Homo sapiens
atcctcagttctcaaat

SEQ ID NO: 2913300 - DNA, 21 bp, Homo sapiens
atcctcagttctcaaatgtgt

SEQ ID NO: 2913301 - DNA, 11 bp, Homo sapiens
atcctccagca

SEQ ID NO: 2913302 - DNA, 13 bp, Homo sapiens
atcctccagcagg

SEQ ID NO: 2913303 - DNA, 15 bp, Homo sapiens
atcctccagcaggga

SEQ ID NO: 2913304 - DNA, 14 bp, Homo sapiens
atcctccagccctg

SEQ ID NO: 2913305 - DNA, 20 bp, Homo sapiens
atcctccccaccagagctgc

SEQ ID NO: 2913306 - DNA, 22 bp, Homo sapiens
atcctcctacctcagcctcctg

SEQ ID NO: 2913307 - DNA, 12 bp, Homo sapiens
atcctcctcctc

SEQ ID NO: 2913308 - DNA, 19 bp, Homo sapiens
atcctcctctccatgcaag

SEQ ID NO: 2913309 - DNA, 16 bp, Homo sapiens
atcctcgctcccggga

SEQ ID NO: 2913310 - DNA, 10 bp, Homo sapiens
atcctctggc

SEQ ID NO: 2913311 - DNA, 14 bp, Homo sapiens
atcctctggctggc

SEQ ID NO: 2913312 - DNA, 19 bp, Homo sapiens
atcctcttctcaaagctgg

SEQ ID NO: 2913313 - DNA, 20 bp, Homo sapiens
atcctcttctcaaagctggg

SEQ ID NO: 2913314 - DNA, 15 bp, Homo sapiens
atcctgaacagcatg

SEQ ID NO: 2913315 - DNA, 15 bp, Homo sapiens
atcctgacacattct

SEQ ID NO: 2913316 - DNA, 16 bp, Homo sapiens
atcctgcaagggacag

SEQ ID NO: 2913317 - DNA, 13 bp, Homo sapiens
atcctgcccccaa

SEQ ID NO: 2913318 - DNA, 16 bp, Homo sapiens
atcctgcccccaagtc

SEQ ID NO: 2913319 - DNA, 14 bp, Homo sapiens
atcctgctgttcta

SEQ ID NO: 2913320 - DNA, 19 bp, Homo sapiens
atcctgcttctcttttcct

SEQ ID NO: 2913321 - DNA, 15 bp, Homo sapiens
atcctgctttacagg

SEQ ID NO: 2913322 - DNA, 15 bp, Homo sapiens
atcctggaggcccag

SEQ ID NO: 2913323 - DNA, 21 bp, Homo sapiens
atcctggaggtcttttctagt

SEQ ID NO: 2913324 - DNA, 14 bp, Homo sapiens
atcctgggccccca

SEQ ID NO: 2913325 - DNA, 21 bp, Homo sapiens
atcctgggctgggtggcccct

SEQ ID NO: 2913326 - DNA, 11 bp, Homo sapiens
atcctgtgagg

SEQ ID NO: 2913327 - DNA, 21 bp, Homo sapiens
atcctgtgaggagccccatct

SEQ ID NO: 2913328 - DNA, 13 bp, Homo sapiens
atcctgtgtcccc

SEQ ID NO: 2913329 - DNA, 15 bp, Homo sapiens
atcctgtgtcccctg

SEQ ID NO: 2913330 - DNA, 18 bp, Homo sapiens
atcctgtgtttctaggga

SEQ ID NO: 2913331 - DNA, 18 bp, Homo sapiens
atcctgtttgtatgaaat

SEQ ID NO: 2913332 - DNA, 17 bp, Homo sapiens
atccttacttccagcaa

SEQ ID NO: 2913333 - DNA, 17 bp, Homo sapiens
atccttccctttggaga

SEQ ID NO: 2913334 - DNA, 21 bp, Homo sapiens
atccttccctttggagatgct

SEQ ID NO: 2913335 - DNA, 14 bp, Homo sapiens
atccttctggctgt

SEQ ID NO: 2913336 - DNA, 16 bp, Homo sapiens
atccttgagattctga

SEQ ID NO: 2913337 - DNA, 13 bp, Homo sapiens
atccttgcctgtc

SEQ ID NO: 2913338 - DNA, 19 bp, Homo sapiens
atccttgcctgtctaaagc

SEQ ID NO: 2913339 - DNA, 18 bp, Homo sapiens
atccttggtgctcttgct

SEQ ID NO: 2913340 - DNA, 12 bp, Homo sapiens
atccttgtttca

SEQ ID NO: 2913341 - DNA, 14 bp, Homo sapiens
atccttgtttcctt

SEQ ID NO: 2913342 - DNA, 15 bp, Homo sapiens
atccttgtttcctta

SEQ ID NO: 2913343 - DNA, 19 bp, Homo sapiens
atcctttatttctgataag

SEQ ID NO: 2913344 - DNA, 22 bp, Homo sapiens
atcctttcctcattaaattacc

SEQ ID NO: 2913345 - DNA, 19 bp, Homo sapiens
atcctttctgccccccagg

SEQ ID NO: 2913346 - DNA, 20 bp, Homo sapiens
atcctttctgccccccaggg

SEQ ID NO: 2913347 - DNA, 17 bp, Homo sapiens
atccttttgttttgaag

SEQ ID NO: 2913348 - DNA, 19 bp, Homo sapiens
atccttttgttttgaagct

SEQ ID NO: 2913349 - DNA, 14 bp, Homo sapiens
atccttttttctct

SEQ ID NO: 2913350 - DNA, 15 bp, Homo sapiens
atcgaaccgttttga

SEQ ID NO: 2913351 - DNA, 16 bp, Homo sapiens
atcgacttagcctgag

SEQ ID NO: 2913352 - DNA, 17 bp, Homo sapiens
atcgatatgaaaaataa

SEQ ID NO: 2913353 - DNA, 16 bp, Homo sapiens
atcgccacaaactcta

SEQ ID NO: 2913354 - DNA, 19 bp, Homo sapiens
atcgccagaggtgcttcac

SEQ ID NO: 2913355 - DNA, 20 bp, Homo sapiens
atcgccagaggtgcttcacc

SEQ ID NO: 2913356 - DNA, 23 bp, Homo sapiens
atcgccccaactccaacctctcg

SEQ ID NO: 2913357 - DNA, 16 bp, Homo sapiens
atcgccccaccgcagc

SEQ ID NO: 2913358 - DNA, 23 bp, Homo sapiens
atgagatatatctttatacttaa

SEQ ID NO: 2913359 - DNA, 24 bp, Homo sapiens
atgagatgatacatccaaagcaga

SEQ ID NO: 2913360 - DNA, 18 bp, Homo sapiens
atgagatgcctgaagcca

SEQ ID NO: 2913361 - DNA, 19 bp, Homo sapiens
atgagatgctggcttgggc

SEQ ID NO: 2913362 - DNA, 22 bp, Homo sapiens
atgagatgctggcttgggcagc

SEQ ID NO: 2913363 - DNA, 20 bp, Homo sapiens
atgagatttttaaaaaatat

SEQ ID NO: 2913364 - DNA, 18 bp, Homo sapiens
atgagcatctcaaatgtt

SEQ ID NO: 2913365 - DNA, 22 bp, Homo sapiens
atgagcatctcaaatgttttct

SEQ ID NO: 2913366 - DNA, 18 bp, Homo sapiens
atgagccaccgcgcccag

SEQ ID NO: 2913367 - DNA, 21 bp, Homo sapiens
atgagccaccgcgcccagcct

SEQ ID NO: 2913368 - DNA, 16 bp, Homo sapiens
atgagcctacgctgaa

SEQ ID NO: 2913369 - DNA, 19 bp, Homo sapiens
atgagcctacgctgaagat

SEQ ID NO: 2913370 - DNA, 14 bp, Homo sapiens
atgagcctgtttat

SEQ ID NO: 2913371 - DNA, 23 bp, Homo sapiens
atgagctacttcttattcacttt

SEQ ID NO: 2913372 - DNA, 22 bp, Homo sapiens
atgagctcctcttcctggcttc

SEQ ID NO: 2913373 - DNA, 19 bp, Homo sapiens
atgagctccttaaggctct

SEQ ID NO: 2913374 - DNA, 15 bp, Homo sapiens
atgagctctacccag

SEQ ID NO: 2913375 - DNA, 19 bp, Homo sapiens
atgagctctacccagggcc

SEQ ID NO: 2913376 - DNA, 22 bp, Homo sapiens
atgagctctacccagggcctgc

SEQ ID NO: 2913377 - DNA, 21 bp, Homo sapiens
atgaggaaaataatgtaattg

SEQ ID NO: 2913378 - DNA, 18 bp, Homo sapiens
atgaggaacaatcacaaa

SEQ ID NO: 2913379 - DNA, 21 bp, Homo sapiens
atgaggagaaaaaaagcatgt

SEQ ID NO: 2913380 - DNA, 17 bp, Homo sapiens
atgaggagagaaaatat

SEQ ID NO: 2913381 - DNA, 18 bp, Homo sapiens
atgaggagagaaaatata

SEQ ID NO: 2913382 - DNA, 18 bp, Homo sapiens
atgaggaggatgctaaaa

SEQ ID NO: 2913383 - DNA, 13 bp, Homo sapiens
atgaggctttcca

SEQ ID NO: 2913384 - DNA, 19 bp, Homo sapiens
atgaggggaaaaaaacagt

SEQ ID NO: 2913385 - DNA, 18 bp, Homo sapiens
atgagtcactgagcatca

SEQ ID NO: 2913386 - DNA, 21 bp, Homo sapiens
atgagtccttgaaaatatttt

SEQ ID NO: 2913387 - DNA, 17 bp, Homo sapiens
atgagtctacctgagca

SEQ ID NO: 2913388 - DNA, 12 bp, Homo sapiens
atgagtctagat

SEQ ID NO: 2913389 - DNA, 18 bp, Homo sapiens
atgagtctgttgtgtgtc

SEQ ID NO: 2913390 - DNA, 16 bp, Homo sapiens
atgagtggccagcgcc

SEQ ID NO: 2913391 - DNA, 17 bp, Homo sapiens
atgagttaattgtttta

SEQ ID NO: 2913392 - DNA, 17 bp, Homo sapiens
atgagttactgtgcatt

SEQ ID NO: 2913393 - DNA, 20 bp, Homo sapiens
atgagttgtgaaatttaatg

SEQ ID NO: 2913394 - DNA, 19 bp, Homo sapiens
atgagttgttttcagactc

SEQ ID NO: 2913395 - DNA, 23 bp, Homo sapiens
atgagttgttttcagactcagac

SEQ ID NO: 2913396 - DNA, 12 bp, Homo sapiens
atgagtttaaaa

SEQ ID NO: 2913397 - DNA, 15 bp, Homo sapiens
atgagtttaaaaatc

SEQ ID NO: 2913398 - DNA, 22 bp, Homo sapiens
atgagtttaaaaatcaactttt

SEQ ID NO: 2913399 - DNA, 15 bp, Homo sapiens
atgataatagattct

SEQ ID NO: 2913400 - DNA, 17 bp, Homo sapiens
atgatacaagattagaa

SEQ ID NO: 2913401 - DNA, 14 bp, Homo sapiens
atgatacagtgttt

SEQ ID NO: 2913402 - DNA, 13 bp, Homo sapiens
atgatactgatgc

SEQ ID NO: 2913403 - DNA, 22 bp, Homo sapiens
atgatagaactgtactgttttc

SEQ ID NO: 2913404 - DNA, 19 bp, Homo sapiens
atgatagtaataggataca

SEQ ID NO: 2913405 - DNA, 23 bp, Homo sapiens
atgatagttttctagatgacata

SEQ ID NO: 2913406 - DNA, 18 bp, Homo sapiens
atgatatttcttgctttc

SEQ ID NO: 2913407 - DNA, 17 bp, Homo sapiens
atgatccaagcaagact

SEQ ID NO: 2913408 - DNA, 14 bp, Homo sapiens
atgatcctcagtgc

SEQ ID NO: 2913409 - DNA, 12 bp, Homo sapiens
atgatcgctgta

SEQ ID NO: 2913410 - DNA, 12 bp, Homo sapiens
atgatctccctg

SEQ ID NO: 2913411 - DNA, 22 bp, Homo sapiens
atgatctcttcttttggcttcc

SEQ ID NO: 2913412 - DNA, 18 bp, Homo sapiens
atgatgaaaaggttgcct

SEQ ID NO: 2913413 - DNA, 21 bp, Homo sapiens
atgatgacttgagccctgcca

SEQ ID NO: 2913414 - DNA, 19 bp, Homo sapiens
atgatgcaaccaaaaggga

SEQ ID NO: 2913415 - DNA, 15 bp, Homo sapiens
atgatgcatggagga

SEQ ID NO: 2913416 - DNA, 21 bp, Homo sapiens
atgatgcatggagtgtttgac

SEQ ID NO: 2913417 - DNA, 22 bp, Homo sapiens
atgatgcctctgtcttctggac

SEQ ID NO: 2913418 - DNA, 10 bp, Homo sapiens
atgatgctca

SEQ ID NO: 2913419 - DNA, 13 bp, Homo sapiens
atgatggaaagga

SEQ ID NO: 2913420 - DNA, 14 bp, Homo sapiens
atgatggaaaggaa

SEQ ID NO: 2913421 - DNA, 15 bp, Homo sapiens
atgatgggaaaatat

SEQ ID NO: 2913422 - DNA, 16 bp, Homo sapiens
atgatgggaaaatatt

SEQ ID NO: 2913423 - DNA, 18 bp, Homo sapiens
atgatgggaaaatatttc

SEQ ID NO: 2913424 - DNA, 18 bp, Homo sapiens
atgatgggctccccagga

SEQ ID NO: 2913425 - DNA, 20 bp, Homo sapiens
atgatgtaagtttacctatg

SEQ ID NO: 2913426 - DNA, 22 bp, Homo sapiens
atgatgttatacatcaatatgt

SEQ ID NO: 2913427 - DNA, 17 bp, Homo sapiens
atgatgttatcttaaca

SEQ ID NO: 2913428 - DNA, 14 bp, Homo sapiens
atgatgttgataat

SEQ ID NO: 2913429 - DNA, 16 bp, Homo sapiens
atgattaaaatggtga

SEQ ID NO: 2913430 - DNA, 20 bp, Homo sapiens
atgattaaataagattctaa

SEQ ID NO: 2913431 - DNA, 24 bp, Homo sapiens
atgattaaataagattctaacggt

SEQ ID NO: 2913432 - DNA, 18 bp, Homo sapiens
atgattcgtgtaattact

SEQ ID NO: 2913433 - DNA, 23 bp, Homo sapiens
atgattctagtacataattgatt

SEQ ID NO: 2913434 - DNA, 20 bp, Homo sapiens
atgattctcctgcctcagct

SEQ ID NO: 2913435 - DNA, 21 bp, Homo sapiens
atgattctgaagcttatgttt

SEQ ID NO: 2913436 - DNA, 19 bp, Homo sapiens
atgattgcttgagctcagg

SEQ ID NO: 2913437 - DNA, 19 bp, Homo sapiens
atgattgttcttttgtttc

SEQ ID NO: 2913438 - DNA, 20 bp, Homo sapiens
atgattgttcttttgtttca

SEQ ID NO: 2913439 - DNA, 18 bp, Homo sapiens
atgattgtttcttcttca

SEQ ID NO: 2913440 - DNA, 16 bp, Homo sapiens
atgatttaaaagggaa

SEQ ID NO: 2913441 - DNA, 22 bp, Homo sapiens
atgatttccctccagagaaagc

SEQ ID NO: 2913442 - DNA, 24 bp, Homo sapiens
atgatttccctccagagaaagcac

SEQ ID NO: 2913443 - DNA, 13 bp, Homo sapiens
atgatttccttga

SEQ ID NO: 2913444 - DNA, 19 bp, Homo sapiens
atgatttccttgaatgtgg

SEQ ID NO: 2913445 - DNA, 15 bp, Homo sapiens
atgatttgttttgaa

SEQ ID NO: 2913446 - DNA, 14 bp, Homo sapiens
atgatttttgtgta

SEQ ID NO: 2913447 - DNA, 21 bp, Homo sapiens
atgatttttgtgtatccagta

SEQ ID NO: 2913448 - DNA, 19 bp, Homo sapiens
atgcaaaagcaatcataga

SEQ ID NO: 2913449 - DNA, 14 bp, Homo sapiens
atgcaaagaggcaa

SEQ ID NO: 2913450 - DNA, 23 bp, Homo sapiens
atgcaactcgccctgtttggcat

SEQ ID NO: 2913451 - DNA, 17 bp, Homo sapiens
atgcaagcagaggacca

SEQ ID NO: 2913452 - DNA, 17 bp, Homo sapiens
atgcaagccccaacttt

SEQ ID NO: 2913453 - DNA, 18 bp, Homo sapiens
atgcaagccccaactttc

SEQ ID NO: 2913454 - DNA, 20 bp, Homo sapiens
atgcaaggattacagaaact

SEQ ID NO: 2913455 - DNA, 21 bp, Homo sapiens
atgcaagtgctgtttgggcag

SEQ ID NO: 2913456 - DNA, 19 bp, Homo sapiens
atgcaagtgggagatgaaa

SEQ ID NO: 2913457 - DNA, 22 bp, Homo sapiens
atgcaagtgggagatgaaaacc

SEQ ID NO: 2913458 - DNA, 22 bp, Homo sapiens
atgcaatagaagtgctcccctc

SEQ ID NO: 2913459 - DNA, 15 bp, Homo sapiens
atgcaatatatctaa

SEQ ID NO: 2913460 - DNA, 13 bp, Homo sapiens
atgcaatcaattt

SEQ ID NO: 2913461 - DNA, 24 bp, Homo sapiens
atgcaatgtaagcatactttgtaa

SEQ ID NO: 2913462 - DNA, 18 bp, Homo sapiens
atgcaatgtgctactgat

SEQ ID NO: 2913463 - DNA, 23 bp, Homo sapiens
atgcacacagcggctgcctcctg

SEQ ID NO: 2913464 - DNA, 19 bp, Homo sapiens
atgcacacggctggtcact

SEQ ID NO: 2913465 - DNA, 21 bp, Homo sapiens
atgcacacggctggtcactct

SEQ ID NO: 2913466 - DNA, 21 bp, Homo sapiens
atgcacatatggactctgcac

SEQ ID NO: 2913467 - DNA, 22 bp, Homo sapiens
atgcacctaaaatctaattaga

SEQ ID NO: 2913468 - DNA, 18 bp, Homo sapiens
atgcaccttgtgtctgta

SEQ ID NO: 2913469 - DNA, 19 bp, Homo sapiens
atgcacggtttctgttctg

SEQ ID NO: 2913470 - DNA, 17 bp, Homo sapiens
atgcactgctgtaactg

SEQ ID NO: 2913471 - DNA, 16 bp, Homo sapiens
atgcagaaaaagaaaa

SEQ ID NO: 2913472 - DNA, 17 bp, Homo sapiens
atgcagaagcagagatg

SEQ ID NO: 2913473 - DNA, 18 bp, Homo sapiens
atgcagaggcctggggga

SEQ ID NO: 2913474 - DNA, 17 bp, Homo sapiens
atgcagagtaagtatta

SEQ ID NO: 2913475 - DNA, 13 bp, Homo sapiens
atgcagcactgct

SEQ ID NO: 2913476 - DNA, 11 bp, Homo sapiens
atgcagcccat

SEQ ID NO: 2913477 - DNA, 14 bp, Homo sapiens
atgcagcccatttc

SEQ ID NO: 2913478 - DNA, 16 bp, Homo sapiens
atgcagcccatttctc

SEQ ID NO: 2913479 - DNA, 20 bp, Homo sapiens
atgcagcccatttctccaga

SEQ ID NO: 2913480 - DNA, 14 bp, Homo sapiens
atgcaggaaggaaa

SEQ ID NO: 2913481 - DNA, 18 bp, Homo sapiens
atgcaggaaggaaaacta

SEQ ID NO: 2913482 - DNA, 19 bp, Homo sapiens
atgcagggattgctgccac

SEQ ID NO: 2913483 - DNA, 20 bp, Homo sapiens
atgcagggattgctgccact

SEQ ID NO: 2913484 - DNA, 22 bp, Homo sapiens
atgcagggattgctgccacttt

SEQ ID NO: 2913485 - DNA, 13 bp, Homo sapiens
atgcagggcagtc

SEQ ID NO: 2913486 - DNA, 14 bp, Homo sapiens
atgcaggtctccat

SEQ ID NO: 2913487 - DNA, 15 bp, Homo sapiens
atgcagtaacattct

SEQ ID NO: 2913488 - DNA, 23 bp, Homo sapiens
atgcagtatggtacatttttcaa

SEQ ID NO: 2913489 - DNA, 19 bp, Homo sapiens
atgtatttatttaaaagat

SEQ ID NO: 2913490 - DNA, 20 bp, Homo sapiens
atgtatttcattgctgtgtc

SEQ ID NO: 2913491 - DNA, 13 bp, Homo sapiens
atgtatttgatgt

SEQ ID NO: 2913492 - DNA, 23 bp, Homo sapiens
atgtattttaataacatatctaa

SEQ ID NO: 2913493 - DNA, 20 bp, Homo sapiens
atgtattttgaaaacactta

SEQ ID NO: 2913494 - DNA, 18 bp, Homo sapiens
atgtattttggaagacat

SEQ ID NO: 2913495 - DNA, 19 bp, Homo sapiens
atgtattttggaagacata

SEQ ID NO: 2913496 - DNA, 21 bp, Homo sapiens
atgtattttggaagacatata

SEQ ID NO: 2913497 - DNA, 18 bp, Homo sapiens
atgtcaaagatatgttaa

SEQ ID NO: 2913498 - DNA, 15 bp, Homo sapiens
atgtcaaattgtcag

SEQ ID NO: 2913499 - DNA, 19 bp, Homo sapiens
atgtcaagaaattctgctg

SEQ ID NO: 2913500 - DNA, 13 bp, Homo sapiens
atgtcaccacctt

SEQ ID NO: 2913501 - DNA, 20 bp, Homo sapiens
atgtcaccaccttcccagct

SEQ ID NO: 2913502 - DNA, 14 bp, Homo sapiens
atgtcagaattaaa

SEQ ID NO: 2913503 - DNA, 14 bp, Homo sapiens
atgtcagatacaat

SEQ ID NO: 2913504 - DNA, 16 bp, Homo sapiens
atgtcagatacaatgt

SEQ ID NO: 2913505 - DNA, 20 bp, Homo sapiens
atgtcagctgctgttgaact

SEQ ID NO: 2913506 - DNA, 22 bp, Homo sapiens
atgtcagctgctgttgaacttt

SEQ ID NO: 2913507 - DNA, 23 bp, Homo sapiens
atgtcagctgctgttgaactttt

SEQ ID NO: 2913508 - DNA, 23 bp, Homo sapiens
atgtcaggggcggggagggtgac

SEQ ID NO: 2913509 - DNA, 20 bp, Homo sapiens
atgtcagttggccctttaat

SEQ ID NO: 2913510 - DNA, 13 bp, Homo sapiens
atgtcatttcctt

SEQ ID NO: 2913511 - DNA, 12 bp, Homo sapiens
atgtcatttctc

SEQ ID NO: 2913512 - DNA, 16 bp, Homo sapiens
atgtccagcaccttgt

SEQ ID NO: 2913513 - DNA, 19 bp, Homo sapiens
atgtccatttatatcattt

SEQ ID NO: 2913514 - DNA, 22 bp, Homo sapiens
atgtcccatcacgtgtactggc

SEQ ID NO: 2913515 - DNA, 13 bp, Homo sapiens
atgtccctattta

SEQ ID NO: 2913516 - DNA, 19 bp, Homo sapiens
atgtccctatttatgattt

SEQ ID NO: 2913517 - DNA, 20 bp, Homo sapiens
atgtccctgaagtcttgcat

SEQ ID NO: 2913518 - DNA, 23 bp, Homo sapiens
atgtcgtcaaagctgaaatggac

SEQ ID NO: 2913519 - DNA, 20 bp, Homo sapiens
atgtctaattcatttactca

SEQ ID NO: 2913520 - DNA, 17 bp, Homo sapiens
atgtctatgatagataa

SEQ ID NO: 2913521 - DNA, 14 bp, Homo sapiens
atgtctattattat

SEQ ID NO: 2913522 - DNA, 15 bp, Homo sapiens
atgtctattattatg

SEQ ID NO: 2913523 - DNA, 16 bp, Homo sapiens
atgtctctcagaattc

SEQ ID NO: 2913524 - DNA, 21 bp, Homo sapiens
atgtctctcagaattcttcag

SEQ ID NO: 2913525 - DNA, 16 bp, Homo sapiens
atgtctctgcttccat

SEQ ID NO: 2913526 - DNA, 14 bp, Homo sapiens
atgtctgaactttg

SEQ ID NO: 2913527 - DNA, 17 bp, Homo sapiens
atgtctgaactttggga

SEQ ID NO: 2913528 - DNA, 11 bp, Homo sapiens
atgtctgcagc

SEQ ID NO: 2913529 - DNA, 15 bp, Homo sapiens
atgtctgcagccctg

SEQ ID NO: 2913530 - DNA, 16 bp, Homo sapiens
atgtctgccaattttt

SEQ ID NO: 2913531 - DNA, 21 bp, Homo sapiens
atgtctgccaatttttgcctt

SEQ ID NO: 2913532 - DNA, 23 bp, Homo sapiens
atgtctgccaatttttgccttca

SEQ ID NO: 2913533 - DNA, 15 bp, Homo sapiens
atgtctgcctggagt

SEQ ID NO: 2913534 - DNA, 13 bp, Homo sapiens
atgtctgtcattg

SEQ ID NO: 2913535 - DNA, 13 bp, Homo sapiens
atgtctgtgctgt

SEQ ID NO: 2913536 - DNA, 16 bp, Homo sapiens
atgtcttcaaggcttc

SEQ ID NO: 2913537 - DNA, 19 bp, Homo sapiens
atgtcttcaaggcttcagt

SEQ ID NO: 2913538 - DNA, 19 bp, Homo sapiens
atgtcttgctgttgacata

SEQ ID NO: 2913539 - DNA, 22 bp, Homo sapiens
atgtcttgctgttgacatattt

SEQ ID NO: 2913540 - DNA, 19 bp, Homo sapiens
atgtcttggacactgtaca

SEQ ID NO: 2913541 - DNA, 20 bp, Homo sapiens
atgtcttggacactgtacaa

SEQ ID NO: 2913542 - DNA, 14 bp, Homo sapiens
atgtcttgtacatg

SEQ ID NO: 2913543 - DNA, 14 bp, Homo sapiens
atgtcttgtgtatt

SEQ ID NO: 2913544 - DNA, 15 bp, Homo sapiens
atgtcttgtgtattt

SEQ ID NO: 2913545 - DNA, 20 bp, Homo sapiens
atgtctttccacttctctgg

SEQ ID NO: 2913546 - DNA, 19 bp, Homo sapiens
atgtcttttttttaatgtg

SEQ ID NO: 2913547 - DNA, 21 bp, Homo sapiens
atgtgaaaatggtccaggaga

SEQ ID NO: 2913548 - DNA, 17 bp, Homo sapiens
atgtgaaagattattta

SEQ ID NO: 2913549 - DNA, 10 bp, Homo sapiens
atgtgaaatt

SEQ ID NO: 2913550 - DNA, 18 bp, Homo sapiens
atgtgaactctcccctcc

SEQ ID NO: 2913551 - DNA, 15 bp, Homo sapiens
atgtgaagacatttt

SEQ ID NO: 2913552 - DNA, 14 bp, Homo sapiens
atgtgaagatgcat

SEQ ID NO: 2913553 - DNA, 23 bp, Homo sapiens
atgtgaagatgcattgtagttta

SEQ ID NO: 2913554 - DNA, 21 bp, Homo sapiens
atgtgaagccaattcagacag

SEQ ID NO: 2913555 - DNA, 14 bp, Homo sapiens
atgtgaagtgttaa

SEQ ID NO: 2913556 - DNA, 16 bp, Homo sapiens
atgtgaagtgttaata

SEQ ID NO: 2913557 - DNA, 19 bp, Homo sapiens
atgtgaagtgttaatacta

SEQ ID NO: 2913558 - DNA, 16 bp, Homo sapiens
atgtgaatcagaccct

SEQ ID NO: 2913559 - DNA, 14 bp, Homo sapiens
atgtgaatttgagt

SEQ ID NO: 2913560 - DNA, 21 bp, Homo sapiens
atgtgacaattttgtacaaat

SEQ ID NO: 2913561 - DNA, 18 bp, Homo sapiens
atgtgacattcttaaaaa

SEQ ID NO: 2913562 - DNA, 13 bp, Homo sapiens
atgtgaccatgtg

SEQ ID NO: 2913563 - DNA, 13 bp, Homo sapiens
atgtgactctgaa

SEQ ID NO: 2913564 - DNA, 18 bp, Homo sapiens
atgtgactctgaagctga

SEQ ID NO: 2913565 - DNA, 15 bp, Homo sapiens
atgtgactctggctt

SEQ ID NO: 2913566 - DNA, 18 bp, Homo sapiens
atgtgagtgccttttgca

SEQ ID NO: 2913567 - DNA, 18 bp, Homo sapiens
atgtgataaggaaatcaa

SEQ ID NO: 2913568 - DNA, 18 bp, Homo sapiens
atgtgatcatctttgctg

SEQ ID NO: 2913569 - DNA, 17 bp, Homo sapiens
atgtgatgaatactgta

SEQ ID NO: 2913570 - DNA, 14 bp, Homo sapiens
atgtgatgttctaa

SEQ ID NO: 2913571 - DNA, 15 bp, Homo sapiens
atgtgatgttctaag

SEQ ID NO: 2913572 - DNA, 20 bp, Homo sapiens
atgtgatgttctaaggctct

SEQ ID NO: 2913573 - DNA, 17 bp, Homo sapiens
atgtgattaactcttag

SEQ ID NO: 2913574 - DNA, 18 bp, Homo sapiens
atgtgattaactcttaga

SEQ ID NO: 2913575 - DNA, 14 bp, Homo sapiens
atgtgattgtggaa

SEQ ID NO: 2913576 - DNA, 17 bp, Homo sapiens
atgtgattgtggaatgg

SEQ ID NO: 2913577 - DNA, 16 bp, Homo sapiens
atgtgatttaatagtg

SEQ ID NO: 2913578 - DNA, 16 bp, Homo sapiens
atgtgattttaactct

SEQ ID NO: 2913579 - DNA, 15 bp, Homo sapiens
atgtgcaactcttgt

SEQ ID NO: 2913580 - DNA, 16 bp, Homo sapiens
atgtgcaactcttgta

SEQ ID NO: 2913581 - DNA, 19 bp, Homo sapiens
atgtgcactgcattagaaa

SEQ ID NO: 2913582 - DNA, 13 bp, Homo sapiens
atgtgcagcagat

SEQ ID NO: 2913583 - DNA, 14 bp, Homo sapiens
atgtgccaggcttg

SEQ ID NO: 2913584 - DNA, 20 bp, Homo sapiens
atgtgccagggcaatgatga

SEQ ID NO: 2913585 - DNA, 21 bp, Homo sapiens
atgtgccagggcaatgatgaa

SEQ ID NO: 2913586 - DNA, 16 bp, Homo sapiens
atgtgcctctgtcctt

SEQ ID NO: 2913587 - DNA, 14 bp, Homo sapiens
atgtgcgtggaagt

SEQ ID NO: 2913588 - DNA, 17 bp, Homo sapiens
atgtgcgtggaagtgtt

SEQ ID NO: 2913589 - DNA, 21 bp, Homo sapiens
atgtgcgtggaagtgttcctg

SEQ ID NO: 2913590 - DNA, 23 bp, Homo sapiens
atgtgcgtggaagtgttcctgtc

SEQ ID NO: 2913591 - DNA, 16 bp, Homo sapiens
atgtgcgtgtgcgtgt

SEQ ID NO: 2913592 - DNA, 15 bp, Homo sapiens
atgtgctgtaattta

SEQ ID NO: 2913593 - DNA, 11 bp, Homo sapiens
atgtgctgtgt

SEQ ID NO: 2913594 - DNA, 19 bp, Homo sapiens
atgtgctgtgtaaagttag

SEQ ID NO: 2913595 - DNA, 17 bp, Homo sapiens
atgtggatacagtcatt

SEQ ID NO: 2913596 - DNA, 14 bp, Homo sapiens
atgtggccctggcc

SEQ ID NO: 2913597 - DNA, 16 bp, Homo sapiens
atgtggcctgcccagc

SEQ ID NO: 2913598 - DNA, 18 bp, Homo sapiens
atgtggcctgcccagcct

SEQ ID NO: 2913599 - DNA, 20 bp, Homo sapiens
atgtggcctgcccagcctca

SEQ ID NO: 2913600 - DNA, 24 bp, Homo sapiens
atgtggcttctctgtctctgtgga

SEQ ID NO: 2913601 - DNA, 16 bp, Homo sapiens
atgtggcttgagaaat

SEQ ID NO: 2913602 - DNA, 13 bp, Homo sapiens
atgtggcttttat

SEQ ID NO: 2913603 - DNA, 22 bp, Homo sapiens
atgtgggaatctcccagacttg

SEQ ID NO: 2913604 - DNA, 13 bp, Homo sapiens
atgtggggctgag

SEQ ID NO: 2913605 - DNA, 19 bp, Homo sapiens
atgtgggtggcttctagtt

SEQ ID NO: 2913606 - DNA, 18 bp, Homo sapiens
atgtgggttgtgatattg

SEQ ID NO: 2913607 - DNA, 19 bp, Homo sapiens
atgtgtaaagatctacatg

SEQ ID NO: 2913608 - DNA, 15 bp, Homo sapiens
atgtgtaataatgta

SEQ ID NO: 2913609 - DNA, 22 bp, Homo sapiens
atgtgtaataatgtaacatgat

SEQ ID NO: 2913610 - DNA, 17 bp, Homo sapiens
atgtgtaatcaataaac

SEQ ID NO: 2913611 - DNA, 20 bp, Homo sapiens
atgtgtaatcaataaacgat

SEQ ID NO: 2913612 - DNA, 22 bp, Homo sapiens
atgtgtaatcaataaacgattt

SEQ ID NO: 2913613 - DNA, 20 bp, Homo sapiens
atgtgtatgtacgtttgtat

SEQ ID NO: 2913614 - DNA, 17 bp, Homo sapiens
atgtgtattttattaca

SEQ ID NO: 2913615 - DNA, 18 bp, Homo sapiens
atgtgtcccagtgaacag

SEQ ID NO: 2913616 - DNA, 21 bp, Homo sapiens
atgtgtcccagtgaacagttt

SEQ ID NO: 2913617 - DNA, 22 bp, Homo sapiens
atgtgtccctggcgctgtgcta

SEQ ID NO: 2913618 - DNA, 13 bp, Homo sapiens
atgtgtcccttcc

SEQ ID NO: 2913619 - DNA, 13 bp, Homo sapiens
atgtgtctggaag

SEQ ID NO: 2913620 - DNA, 14 bp, Homo sapiens
atgtgtctggaaga

SEQ ID NO: 2913621 - DNA, 13 bp, Homo sapiens
attatagattcta

SEQ ID NO: 2913622 - DNA, 22 bp, Homo sapiens
attatagcaatgtgattttgta

SEQ ID NO: 2913623 - DNA, 17 bp, Homo sapiens
attatagcgcctgtata

SEQ ID NO: 2913624 - DNA, 23 bp, Homo sapiens
attatagcgcctgtataagtaga

SEQ ID NO: 2913625 - DNA, 21 bp, Homo sapiens
attataggaatatcaatataa

SEQ ID NO: 2913626 - DNA, 23 bp, Homo sapiens
attatagtgatgtaatcttgaat

SEQ ID NO: 2913627 - DNA, 19 bp, Homo sapiens
attatagtttctgaggctt

SEQ ID NO: 2913628 - DNA, 16 bp, Homo sapiens
attatataaggacaga

SEQ ID NO: 2913629 - DNA, 23 bp, Homo sapiens
attatatagcaaagatatatatt

SEQ ID NO: 2913630 - DNA, 18 bp, Homo sapiens
attatatcaaagtatttg

SEQ ID NO: 2913631 - DNA, 20 bp, Homo sapiens
attatatggcttgagtttaa

SEQ ID NO: 2913632 - DNA, 17 bp, Homo sapiens
attatatttacaaatgg

SEQ ID NO: 2913633 - DNA, 14 bp, Homo sapiens
attatatttgacat

SEQ ID NO: 2913634 - DNA, 15 bp, Homo sapiens
attatatttgacatg

SEQ ID NO: 2913635 - DNA, 20 bp, Homo sapiens
attatatttgacatgggtat

SEQ ID NO: 2913636 - DNA, 15 bp, Homo sapiens
attatcatgcaaatg

SEQ ID NO: 2913637 - DNA, 12 bp, Homo sapiens
attatcatgtgt

SEQ ID NO: 2913638 - DNA, 14 bp, Homo sapiens
attatcatgtgtaa

SEQ ID NO: 2913639 - DNA, 16 bp, Homo sapiens
attatcatgtgtaatc

SEQ ID NO: 2913640 - DNA, 21 bp, Homo sapiens
attatcctagattatatcaaa

SEQ ID NO: 2913641 - DNA, 20 bp, Homo sapiens
attatcctcctgttctgaaa

SEQ ID NO: 2913642 - DNA, 21 bp, Homo sapiens
attatcctttcctcattaaat

SEQ ID NO: 2913643 - DNA, 23 bp, Homo sapiens
attatctacctgttctgtagctt

SEQ ID NO: 2913644 - DNA, 23 bp, Homo sapiens
attatctttagttgaattccaag

SEQ ID NO: 2913645 - DNA, 13 bp, Homo sapiens
attatgaagaatt

SEQ ID NO: 2913646 - DNA, 21 bp, Homo sapiens
attatgactaaagtaccagat

SEQ ID NO: 2913647 - DNA, 15 bp, Homo sapiens
attatgtaaataact

SEQ ID NO: 2913648 - DNA, 14 bp, Homo sapiens
attatgtggtttta

SEQ ID NO: 2913649 - DNA, 16 bp, Homo sapiens
attatgttttttaaaa

SEQ ID NO: 2913650 - DNA, 20 bp, Homo sapiens
attatgttttttaaaatatt

SEQ ID NO: 2913651 - DNA, 20 bp, Homo sapiens
attattaaatcgtttaatgt

SEQ ID NO: 2913652 - DNA, 13 bp, Homo sapiens
attattaattgca

SEQ ID NO: 2913653 - DNA, 23 bp, Homo sapiens
attattactgttgataattctta

SEQ ID NO: 2913654 - DNA, 14 bp, Homo sapiens
attattacttttta

SEQ ID NO: 2913655 - DNA, 22 bp, Homo sapiens
attattagccaggtaatgtgaa

SEQ ID NO: 2913656 - DNA, 15 bp, Homo sapiens
attattattattatt

SEQ ID NO: 2913657 - DNA, 15 bp, Homo sapiens
attattatttaactc

SEQ ID NO: 2913658 - DNA, 16 bp, Homo sapiens
attattatttaactct

SEQ ID NO: 2913659 - DNA, 17 bp, Homo sapiens
attattatttaactctt

SEQ ID NO: 2913660 - DNA, 18 bp, Homo sapiens
attattgttaataataat

SEQ ID NO: 2913661 - DNA, 18 bp, Homo sapiens
attatttaaatgctttta

SEQ ID NO: 2913662 - DNA, 16 bp, Homo sapiens
attatttgtactttgt

SEQ ID NO: 2913663 - DNA, 18 bp, Homo sapiens
attatttgtactttgttt

SEQ ID NO: 2913664 - DNA, 13 bp, Homo sapiens
attattttaaaag

SEQ ID NO: 2913665 - DNA, 15 bp, Homo sapiens
attattttaaaatat

SEQ ID NO: 2913666 - DNA, 17 bp, Homo sapiens
attattttaaaatattt

SEQ ID NO: 2913667 - DNA, 13 bp, Homo sapiens
attattttccttc

SEQ ID NO: 2913668 - DNA, 14 bp, Homo sapiens
attatttttaaaag

SEQ ID NO: 2913669 - DNA, 21 bp, Homo sapiens
attcaaaaagacagcagacaa

SEQ ID NO: 2913670 - DNA, 22 bp, Homo sapiens
attcaaaagagagagagagatc

SEQ ID NO: 2913671 - DNA, 13 bp, Homo sapiens
attcaaaagttcc

SEQ ID NO: 2913672 - DNA, 21 bp, Homo sapiens
attcaaaagttccaagagtct

SEQ ID NO: 2913673 - DNA, 15 bp, Homo sapiens
attcaaaatatttaa

SEQ ID NO: 2913674 - DNA, 15 bp, Homo sapiens
attcaaactacctat

SEQ ID NO: 2913675 - DNA, 21 bp, Homo sapiens
attcaaactacctatattcct

SEQ ID NO: 2913676 - DNA, 13 bp, Homo sapiens
attcaaactttta

SEQ ID NO: 2913677 - DNA, 12 bp, Homo sapiens
attcaaagatga

SEQ ID NO: 2913678 - DNA, 16 bp, Homo sapiens
attcaaagcagctgta

SEQ ID NO: 2913679 - DNA, 14 bp, Homo sapiens
attcaaaggttcta

SEQ ID NO: 2913680 - DNA, 15 bp, Homo sapiens
attcaaaggttctag

SEQ ID NO: 2913681 - DNA, 18 bp, Homo sapiens
attcaaggagaatatgat

SEQ ID NO: 2913682 - DNA, 22 bp, Homo sapiens
attcaataaaatactattcttt

SEQ ID NO: 2913683 - DNA, 16 bp, Homo sapiens
attcaatatcctttgc

SEQ ID NO: 2913684 - DNA, 17 bp, Homo sapiens
attcacaaacttttata

SEQ ID NO: 2913685 - DNA, 17 bp, Homo sapiens
attcacaatgcattttt

SEQ ID NO: 2913686 - DNA, 21 bp, Homo sapiens
attcacatttcaagatccaaa

SEQ ID NO: 2913687 - DNA, 13 bp, Homo sapiens
attcaccaatgtt

SEQ ID NO: 2913688 - DNA, 21 bp, Homo sapiens
attcacctaagagattctgat

SEQ ID NO: 2913689 - DNA, 23 bp, Homo sapiens
attcacctctctcactgactatt

SEQ ID NO: 2913690 - DNA, 13 bp, Homo sapiens
attcacctgagca

SEQ ID NO: 2913691 - DNA, 20 bp, Homo sapiens
attcactttattgtagaaaa

SEQ ID NO: 2913692 - DNA, 14 bp, Homo sapiens
attcagacagatga

SEQ ID NO: 2913693 - DNA, 13 bp, Homo sapiens
attcagacaggca

SEQ ID NO: 2913694 - DNA, 18 bp, Homo sapiens
attcagagaaaggcaagg

SEQ ID NO: 2913695 - DNA, 19 bp, Homo sapiens
attcagcagcaaattttca

SEQ ID NO: 2913696 - DNA, 17 bp, Homo sapiens
attcagccatgtacaga

SEQ ID NO: 2913697 - DNA, 17 bp, Homo sapiens
attcaggcactgagaat

SEQ ID NO: 2913698 - DNA, 15 bp, Homo sapiens
attcaggcagcactg

SEQ ID NO: 2913699 - DNA, 15 bp, Homo sapiens
attcagtagtttgag

SEQ ID NO: 2913700 - DNA, 13 bp, Homo sapiens
attcagtatgttt

SEQ ID NO: 2913701 - DNA, 21 bp, Homo sapiens
attcagtctgctctcccttgt

SEQ ID NO: 2913702 - DNA, 19 bp, Homo sapiens
attcagtggcgagaaataa

SEQ ID NO: 2913703 - DNA, 19 bp, Homo sapiens
attcagtgttaaatgtgat

SEQ ID NO: 2913704 - DNA, 15 bp, Homo sapiens
attcagttagcagac

SEQ ID NO: 2913705 - DNA, 13 bp, Homo sapiens
attcagttttcat

SEQ ID NO: 2913706 - DNA, 14 bp, Homo sapiens
attcagttttcatt

SEQ ID NO: 2913707 - DNA, 13 bp, Homo sapiens
attcatactctgt

SEQ ID NO: 2913708 - DNA, 22 bp, Homo sapiens
attcatactctgttgcctcctc

SEQ ID NO: 2913709 - DNA, 14 bp, Homo sapiens
attcatattctttt

SEQ ID NO: 2913710 - DNA, 17 bp, Homo sapiens
attcatcttgtgtttta

SEQ ID NO: 2913711 - DNA, 16 bp, Homo sapiens
attcatcttttaatca

SEQ ID NO: 2913712 - DNA, 21 bp, Homo sapiens
attcatcttttaatcatgagc

SEQ ID NO: 2913713 - DNA, 22 bp, Homo sapiens
attcatcttttaatcatgagcc

SEQ ID NO: 2913714 - DNA, 20 bp, Homo sapiens
attcatgttcatgtgattaa

SEQ ID NO: 2913715 - DNA, 17 bp, Homo sapiens
attcattgttttgcaaa

SEQ ID NO: 2913716 - DNA, 14 bp, Homo sapiens
attcatttactcac

SEQ ID NO: 2913717 - DNA, 19 bp, Homo sapiens
attcatttataagaagaga

SEQ ID NO: 2913718 - DNA, 22 bp, Homo sapiens
attcattttatattgaaaaaaa

SEQ ID NO: 2913719 - DNA, 20 bp, Homo sapiens
attccaaagagtagaattgc

SEQ ID NO: 2913720 - DNA, 13 bp, Homo sapiens
attccaaagagtg

SEQ ID NO: 2913721 - DNA, 18 bp, Homo sapiens
attccaaagtctctaatt

SEQ ID NO: 2913722 - DNA, 15 bp, Homo sapiens
attccaacaaagggt

SEQ ID NO: 2913723 - DNA, 19 bp, Homo sapiens
attccaacaaagggtttta

SEQ ID NO: 2913724 - DNA, 17 bp, Homo sapiens
attccaaccttcctttt

SEQ ID NO: 2913725 - DNA, 18 bp, Homo sapiens
attccaagactctagagt

SEQ ID NO: 2913726 - DNA, 13 bp, Homo sapiens
attccaagtgtat

SEQ ID NO: 2913727 - DNA, 16 bp, Homo sapiens
attccaagtgtatttt

SEQ ID NO: 2913728 - DNA, 14 bp, Homo sapiens
attccacaggatca

SEQ ID NO: 2913729 - DNA, 14 bp, Homo sapiens
attccagaatgctg

SEQ ID NO: 2913730 - DNA, 19 bp, Homo sapiens
attccagaatgctgtacat

SEQ ID NO: 2913731 - DNA, 14 bp, Homo sapiens
attccagagttaaa

SEQ ID NO: 2913732 - DNA, 22 bp, Homo sapiens
attccagagttaaaatgtttac

SEQ ID NO: 2913733 - DNA, 16 bp, Homo sapiens
attccagctcattcat

SEQ ID NO: 2913734 - DNA, 20 bp, Homo sapiens
attccagtcaaatctgggct

SEQ ID NO: 2913735 - DNA, 17 bp, Homo sapiens
attccagttgcaattca

SEQ ID NO: 2913736 - DNA, 22 bp, Homo sapiens
attccatagtggaccacttgga

SEQ ID NO: 2913737 - DNA, 23 bp, Homo sapiens
attccatcaataggcaaaagtgt

SEQ ID NO: 2913738 - DNA, 23 bp, Homo sapiens
attccatgaccagaaacagggac

SEQ ID NO: 2913739 - DNA, 23 bp, Homo sapiens
attccatgttttaaaattatata

SEQ ID NO: 2913740 - DNA, 12 bp, Homo sapiens
attcccagagac

SEQ ID NO: 2913741 - DNA, 14 bp, Homo sapiens
attcccaggccagg

SEQ ID NO: 2913742 - DNA, 19 bp, Homo sapiens
attcccaggccagggctgg

SEQ ID NO: 2913743 - DNA, 21 bp, Homo sapiens
attccccaggtggctgaccca

SEQ ID NO: 2913744 - DNA, 22 bp, Homo sapiens
attccccatatttgtgttcagt

SEQ ID NO: 2913745 - DNA, 18 bp, Homo sapiens
attccccatctcaggcca

SEQ ID NO: 2913746 - DNA, 15 bp, Homo sapiens
attcccgggcccttc

SEQ ID NO: 2913747 - DNA, 19 bp, Homo sapiens
attccctgagtcaccagga

SEQ ID NO: 2913748 - DNA, 20 bp, Homo sapiens
attccctgagtcaccaggaa

SEQ ID NO: 2913749 - DNA, 13 bp, Homo sapiens
attcccttttaat

SEQ ID NO: 2913750 - DNA, 19 bp, Homo sapiens
attccggatcctaagcatc

SEQ ID NO: 2913751 - DNA, 18 bp, Homo sapiens
attcctaacttttcaatg

SEQ ID NO: 2913752 - DNA, 13 bp, Homo sapiens
attcctacaactt

SEQ ID NO: 2913753 - DNA, 19 bp, Homo sapiens
atttctttatataaggtca

SEQ ID NO: 2913754 - DNA, 13 bp, Homo sapiens
atttctttcttcc

SEQ ID NO: 2913755 - DNA, 15 bp, Homo sapiens
atttctttcttccat

SEQ ID NO: 2913756 - DNA, 23 bp, Homo sapiens
atttctttcttccattccttcat

SEQ ID NO: 2913757 - DNA, 18 bp, Homo sapiens
atttctttgatttaactg

SEQ ID NO: 2913758 - DNA, 20 bp, Homo sapiens
atttctttgcctgttcagtt

SEQ ID NO: 2913759 - DNA, 14 bp, Homo sapiens
atttctttttaatt

SEQ ID NO: 2913760 - DNA, 18 bp, Homo sapiens
atttgaacacttggtgct

SEQ ID NO: 2913761 - DNA, 16 bp, Homo sapiens
atttgaagaacatgtg

SEQ ID NO: 2913762 - DNA, 17 bp, Homo sapiens
atttgaagaccaaagtt

SEQ ID NO: 2913763 - DNA, 20 bp, Homo sapiens
atttgaagatctgatttata

SEQ ID NO: 2913764 - DNA, 13 bp, Homo sapiens
atttgaagcagct

SEQ ID NO: 2913765 - DNA, 17 bp, Homo sapiens
atttgaatgtatgcttc

SEQ ID NO: 2913766 - DNA, 23 bp, Homo sapiens
atttgaatgtatgcttcatacag

SEQ ID NO: 2913767 - DNA, 13 bp, Homo sapiens
atttgacagacat

SEQ ID NO: 2913768 - DNA, 22 bp, Homo sapiens
atttgacagacatccttgcagt

SEQ ID NO: 2913769 - DNA, 21 bp, Homo sapiens
atttgacctcctccctgttat

SEQ ID NO: 2913770 - DNA, 17 bp, Homo sapiens
atttgactaattttaca

SEQ ID NO: 2913771 - DNA, 23 bp, Homo sapiens
atttgagaatagacccttactag

SEQ ID NO: 2913772 - DNA, 14 bp, Homo sapiens
atttgagtgctctg

SEQ ID NO: 2913773 - DNA, 18 bp, Homo sapiens
atttgagtttgacattta

SEQ ID NO: 2913774 - DNA, 17 bp, Homo sapiens
atttgattaacatttgt

SEQ ID NO: 2913775 - DNA, 15 bp, Homo sapiens
atttgattcaaaata

SEQ ID NO: 2913776 - DNA, 16 bp, Homo sapiens
atttgattcaaaatat

SEQ ID NO: 2913777 - DNA, 16 bp, Homo sapiens
atttgattgatttgaa

SEQ ID NO: 2913778 - DNA, 14 bp, Homo sapiens
atttgatttaaaca

SEQ ID NO: 2913779 - DNA, 16 bp, Homo sapiens
atttgatttcgatgta

SEQ ID NO: 2913780 - DNA, 15 bp, Homo sapiens
atttgatttgtttag

SEQ ID NO: 2913781 - DNA, 17 bp, Homo sapiens
atttgcaaagtactgta

SEQ ID NO: 2913782 - DNA, 18 bp, Homo sapiens
atttgcaaagtactgtaa

SEQ ID NO: 2913783 - DNA, 20 bp, Homo sapiens
atttgcaagggaaaagtctc

SEQ ID NO: 2913784 - DNA, 14 bp, Homo sapiens
atttgcaggatttt

SEQ ID NO: 2913785 - DNA, 21 bp, Homo sapiens
atttgcataacaattcctcta

SEQ ID NO: 2913786 - DNA, 22 bp, Homo sapiens
atttgcataacaattcctctac

SEQ ID NO: 2913787 - DNA, 19 bp, Homo sapiens
atttgcattaaattcacaa

SEQ ID NO: 2913788 - DNA, 21 bp, Homo sapiens
atttgcattgaacacaaactg

SEQ ID NO: 2913789 - DNA, 22 bp, Homo sapiens
atttgcctgtaacaagccagat

SEQ ID NO: 2913790 - DNA, 15 bp, Homo sapiens
atttgcgaatggttc

SEQ ID NO: 2913791 - DNA, 22 bp, Homo sapiens
atttggaaccaaagtctaaact

SEQ ID NO: 2913792 - DNA, 16 bp, Homo sapiens
atttggaattgacatt

SEQ ID NO: 2913793 - DNA, 13 bp, Homo sapiens
atttggataataa

SEQ ID NO: 2913794 - DNA, 14 bp, Homo sapiens
atttggatatttgg

SEQ ID NO: 2913795 - DNA, 13 bp, Homo sapiens
atttggatctatt

SEQ ID NO: 2913796 - DNA, 14 bp, Homo sapiens
atttggatttacga

SEQ ID NO: 2913797 - DNA, 23 bp, Homo sapiens
atttggcagaactgctggggctg

SEQ ID NO: 2913798 - DNA, 18 bp, Homo sapiens
atttgggaagtgaagact

SEQ ID NO: 2913799 - DNA, 22 bp, Homo sapiens
atttgggaccctgctttagagc

SEQ ID NO: 2913800 - DNA, 21 bp, Homo sapiens
atttgggcctgctccagacct

SEQ ID NO: 2913801 - DNA, 22 bp, Homo sapiens
atttgggcttatttagaaaaaa

SEQ ID NO: 2913802 - DNA, 21 bp, Homo sapiens
atttggggtagctagaggaac

SEQ ID NO: 2913803 - DNA, 17 bp, Homo sapiens
atttgggtggtttttat

SEQ ID NO: 2913804 - DNA, 20 bp, Homo sapiens
atttgggtttgttggtcaca

SEQ ID NO: 2913805 - DNA, 19 bp, Homo sapiens
atttggtccaaaaaaagga

SEQ ID NO: 2913806 - DNA, 22 bp, Homo sapiens
atttggtccaaaaaaaggaaaa

SEQ ID NO: 2913807 - DNA, 21 bp, Homo sapiens
atttggttcattaattctata

SEQ ID NO: 2913808 - DNA, 14 bp, Homo sapiens
atttggtttttact

SEQ ID NO: 2913809 - DNA, 17 bp, Homo sapiens
atttgtaaagctattta

SEQ ID NO: 2913810 - DNA, 19 bp, Homo sapiens
atttgtaaagctatttatg

SEQ ID NO: 2913811 - DNA, 17 bp, Homo sapiens
atttgtaattttagtat

SEQ ID NO: 2913812 - DNA, 13 bp, Homo sapiens
atttgtaccttat

SEQ ID NO: 2913813 - DNA, 19 bp, Homo sapiens
atttgtaccttattgatct

SEQ ID NO: 2913814 - DNA, 23 bp, Homo sapiens
atttgtactattagcaagaatca

SEQ ID NO: 2913815 - DNA, 21 bp, Homo sapiens
atttgtactgtttaatgttct

SEQ ID NO: 2913816 - DNA, 15 bp, Homo sapiens
atttgtacttggaag

SEQ ID NO: 2913817 - DNA, 14 bp, Homo sapiens
atttgtactttgtt

SEQ ID NO: 2913818 - DNA, 14 bp, Homo sapiens
atttgtcaatgaca

SEQ ID NO: 2913819 - DNA, 16 bp, Homo sapiens
atttgtccaaacaggt

SEQ ID NO: 2913820 - DNA, 18 bp, Homo sapiens
atttgtcttggtagtata

SEQ ID NO: 2913821 - DNA, 11 bp, Homo sapiens
atttgtgacta

SEQ ID NO: 2913822 - DNA, 16 bp, Homo sapiens
atttgtgactaattgt

SEQ ID NO: 2913823 - DNA, 20 bp, Homo sapiens
atttgtgactaattgtataa

SEQ ID NO: 2913824 - DNA, 13 bp, Homo sapiens
atttgtgactttt

SEQ ID NO: 2913825 - DNA, 17 bp, Homo sapiens
atttgtgatatatgtat

SEQ ID NO: 2913826 - DNA, 20 bp, Homo sapiens
atttgtgctagaaattttca

SEQ ID NO: 2913827 - DNA, 14 bp, Homo sapiens
atttgtgctttgaa

SEQ ID NO: 2913828 - DNA, 20 bp, Homo sapiens
atttgtggtgatatagaatt

SEQ ID NO: 2913829 - DNA, 14 bp, Homo sapiens
atttgtgtatttaa

SEQ ID NO: 2913830 - DNA, 18 bp, Homo sapiens
atttgtgtcactgtacag

SEQ ID NO: 2913831 - DNA, 15 bp, Homo sapiens
atttgttaacagagc

SEQ ID NO: 2913832 - DNA, 16 bp, Homo sapiens
atttgttaacagagca

SEQ ID NO: 2913833 - DNA, 17 bp, Homo sapiens
atttgttattttgcaac

SEQ ID NO: 2913834 - DNA, 19 bp, Homo sapiens
atttgttcttataaacctt

SEQ ID NO: 2913835 - DNA, 13 bp, Homo sapiens
atttgttgagagt

SEQ ID NO: 2913836 - DNA, 20 bp, Homo sapiens
atttgttgcaccaattaagt

SEQ ID NO: 2913837 - DNA, 20 bp, Homo sapiens
atttgttgctgctgctgctc

SEQ ID NO: 2913838 - DNA, 15 bp, Homo sapiens
atttgttgttttctg

SEQ ID NO: 2913839 - DNA, 12 bp, Homo sapiens
atttgtttaaaa

SEQ ID NO: 2913840 - DNA, 14 bp, Homo sapiens
atttgtttaaaagg

SEQ ID NO: 2913841 - DNA, 13 bp, Homo sapiens
atttgtttctact

SEQ ID NO: 2913842 - DNA, 14 bp, Homo sapiens
atttgtttgatttt

SEQ ID NO: 2913843 - DNA, 15 bp, Homo sapiens
atttgtttgattttc

SEQ ID NO: 2913844 - DNA, 20 bp, Homo sapiens
atttgtttgtagctttcctg

SEQ ID NO: 2913845 - DNA, 21 bp, Homo sapiens
atttgtttgtagctttcctgg

SEQ ID NO: 2913846 - DNA, 12 bp, Homo sapiens
atttgtttgtat

SEQ ID NO: 2913847 - DNA, 23 bp, Homo sapiens
atttgtttgttttcttgtctgtg

SEQ ID NO: 2913848 - DNA, 17 bp, Homo sapiens
atttgttttgaattttg

SEQ ID NO: 2913849 - DNA, 14 bp, Homo sapiens
attttaaaaatgaa

SEQ ID NO: 2913850 - DNA, 15 bp, Homo sapiens
attttaaaaatggtg

SEQ ID NO: 2913851 - DNA, 20 bp, Homo sapiens
attttaaaagataaatatta

SEQ ID NO: 2913852 - DNA, 18 bp, Homo sapiens
attttaaactagatgacc

SEQ ID NO: 2913853 - DNA, 18 bp, Homo sapiens
attttaaatatttgttct

SEQ ID NO: 2913854 - DNA, 14 bp, Homo sapiens
attttaacaagaag

SEQ ID NO: 2913855 - DNA, 16 bp, Homo sapiens
attttaactctgtctt

SEQ ID NO: 2913856 - DNA, 16 bp, Homo sapiens
attttaagactgattt

SEQ ID NO: 2913857 - DNA, 16 bp, Homo sapiens
attttaagaggctttg

SEQ ID NO: 2913858 - DNA, 17 bp, Homo sapiens
attttaagcattgtgag

SEQ ID NO: 2913859 - DNA, 18 bp, Homo sapiens
attttaagtgatgtcatt

SEQ ID NO: 2913860 - DNA, 19 bp, Homo sapiens
attttaataacatatctaa

SEQ ID NO: 2913861 - DNA, 15 bp, Homo sapiens
attttaatagaaata

SEQ ID NO: 2913862 - DNA, 12 bp, Homo sapiens
attttaatgtga

SEQ ID NO: 2913863 - DNA, 21 bp, Homo sapiens
attttaatgtgaagacatttt

SEQ ID NO: 2913864 - DNA, 16 bp, Homo sapiens
attttaattggaggaa

SEQ ID NO: 2913865 - DNA, 15 bp, Homo sapiens
attttaatttagtaa

SEQ ID NO: 2913866 - DNA, 14 bp, Homo sapiens
attttaattttgtt

SEQ ID NO: 2913867 - DNA, 15 bp, Homo sapiens
attttacacagaaac

SEQ ID NO: 2913868 - DNA, 18 bp, Homo sapiens
attttacacagaaacact

SEQ ID NO: 2913869 - DNA, 17 bp, Homo sapiens
attttacatctgaacaa

SEQ ID NO: 2913870 - DNA, 18 bp, Homo sapiens
attttacgttttagaaaa

SEQ ID NO: 2913871 - DNA, 22 bp, Homo sapiens
attttacgttttagaaaatttt

SEQ ID NO: 2913872 - DNA, 16 bp, Homo sapiens
attttactttttcctg

SEQ ID NO: 2913873 - DNA, 14 bp, Homo sapiens
attttagaaataat

SEQ ID NO: 2913874 - DNA, 20 bp, Homo sapiens
attttagaaataataaaaag

SEQ ID NO: 2913875 - DNA, 16 bp, Homo sapiens
attttagaattaaaat

SEQ ID NO: 2913876 - DNA, 23 bp, Homo sapiens
attttagagttcttttggatcat

SEQ ID NO: 2913877 - DNA, 19 bp, Homo sapiens
attttagctaggatttgaa

SEQ ID NO: 2913878 - DNA, 15 bp, Homo sapiens
attttagctgcagaa

SEQ ID NO: 2913879 - DNA, 18 bp, Homo sapiens
attttaggagctaaggct

SEQ ID NO: 2913880 - DNA, 18 bp, Homo sapiens
attttagtattaactctg

SEQ ID NO: 2913881 - DNA, 18 bp, Homo sapiens
attttagtttctgttctg

SEQ ID NO: 2913882 - DNA, 11 bp, Homo sapiens
attttatactg

SEQ ID NO: 2913883 - DNA, 13 bp, Homo sapiens
attttatactgca

SEQ ID NO: 2913884 - DNA, 22 bp, Homo sapiens
attttatactgcactttagtgt

SEQ ID NO: 2913885 - DNA, 13 bp, Homo sapiens
attttatattgaa

SEQ ID NO: 2913886 - DNA, 16 bp, Homo sapiens
caaataaataaataat

SEQ ID NO: 2913887 - DNA, 17 bp, Homo sapiens
caaataatttgaacttt

SEQ ID NO: 2913888 - DNA, 21 bp, Homo sapiens
caaataatttgaactttggaa

SEQ ID NO: 2913889 - DNA, 20 bp, Homo sapiens
caaatacaaaaatggtaact

SEQ ID NO: 2913890 - DNA, 14 bp, Homo sapiens
caaatacacatttc

SEQ ID NO: 2913891 - DNA, 17 bp, Homo sapiens
caaatacacatttcaca

SEQ ID NO: 2913892 - DNA, 17 bp, Homo sapiens
caaatactcatgtgtat

SEQ ID NO: 2913893 - DNA, 16 bp, Homo sapiens
caaatagaaaaagtga

SEQ ID NO: 2913894 - DNA, 15 bp, Homo sapiens
caaatagccccagac

SEQ ID NO: 2913895 - DNA, 16 bp, Homo sapiens
caaatagccccagact

SEQ ID NO: 2913896 - DNA, 17 bp, Homo sapiens
caaatagccccagactg

SEQ ID NO: 2913897 - DNA, 16 bp, Homo sapiens
caaatataacaagtat

SEQ ID NO: 2913898 - DNA, 13 bp, Homo sapiens
caaatatagagat

SEQ ID NO: 2913899 - DNA, 20 bp, Homo sapiens
caaatatgtagaatgtaata

SEQ ID NO: 2913900 - DNA, 16 bp, Homo sapiens
caaatatgttaaagtt

SEQ ID NO: 2913901 - DNA, 18 bp, Homo sapiens
caaatatgttaaagttta

SEQ ID NO: 2913902 - DNA, 15 bp, Homo sapiens
caaatattagatgtg

SEQ ID NO: 2913903 - DNA, 23 bp, Homo sapiens
caaatattagatgtgatttaata

SEQ ID NO: 2913904 - DNA, 13 bp, Homo sapiens
caaatatttggag

SEQ ID NO: 2913905 - DNA, 17 bp, Homo sapiens
caaatcaatctgtaaaa

SEQ ID NO: 2913906 - DNA, 19 bp, Homo sapiens
caaatcaccacaaactgta

SEQ ID NO: 2913907 - DNA, 13 bp, Homo sapiens
caaatcagtcagt

SEQ ID NO: 2913908 - DNA, 22 bp, Homo sapiens
caaatccgaacctcctctgtga

SEQ ID NO: 2913909 - DNA, 17 bp, Homo sapiens
caaatccgccagtgttt

SEQ ID NO: 2913910 - DNA, 17 bp, Homo sapiens
caaatcctatgtgattt

SEQ ID NO: 2913911 - DNA, 21 bp, Homo sapiens
caaatccttagatctggcatg

SEQ ID NO: 2913912 - DNA, 14 bp, Homo sapiens
caaatccttggagt

SEQ ID NO: 2913913 - DNA, 16 bp, Homo sapiens
caaatcctttctgccc

SEQ ID NO: 2913914 - DNA, 18 bp, Homo sapiens
caaatctcccacaagtat

SEQ ID NO: 2913915 - DNA, 13 bp, Homo sapiens
caaatctgggctc

SEQ ID NO: 2913916 - DNA, 20 bp, Homo sapiens
caaatctgggtatctttcca

SEQ ID NO: 2913917 - DNA, 15 bp, Homo sapiens
caaatctgtataaat

SEQ ID NO: 2913918 - DNA, 16 bp, Homo sapiens
caaatctgtataaatg

SEQ ID NO: 2913919 - DNA, 19 bp, Homo sapiens
caaatctgtataaatgtct

SEQ ID NO: 2913920 - DNA, 13 bp, Homo sapiens
caaatctgtcctc

SEQ ID NO: 2913921 - DNA, 17 bp, Homo sapiens
caaatctgtcctctgta

SEQ ID NO: 2913922 - DNA, 12 bp, Homo sapiens
caaatctgtcta

SEQ ID NO: 2913923 - DNA, 21 bp, Homo sapiens
caaatcttccttactgtctct

SEQ ID NO: 2913924 - DNA, 19 bp, Homo sapiens
caaatgcagggattgctgc

SEQ ID NO: 2913925 - DNA, 20 bp, Homo sapiens
caaatgcagggattgctgcc

SEQ ID NO: 2913926 - DNA, 20 bp, Homo sapiens
caaatgctgtgcaaacagtg

SEQ ID NO: 2913927 - DNA, 19 bp, Homo sapiens
caaatggagctttctgtat

SEQ ID NO: 2913928 - DNA, 22 bp, Homo sapiens
caaatggcgtctggaagtccaa

SEQ ID NO: 2913929 - DNA, 22 bp, Homo sapiens
caaatggctctgtgaaatcaga

SEQ ID NO: 2913930 - DNA, 14 bp, Homo sapiens
caaatggggccaga

SEQ ID NO: 2913931 - DNA, 18 bp, Homo sapiens
caaatggggccagatcca

SEQ ID NO: 2913932 - DNA, 23 bp, Homo sapiens
caaatggttaccttgttatttaa

SEQ ID NO: 2913933 - DNA, 20 bp, Homo sapiens
caaatgtcagatacaatgta

SEQ ID NO: 2913934 - DNA, 14 bp, Homo sapiens
caaatgtgaagatg

SEQ ID NO: 2913935 - DNA, 18 bp, Homo sapiens
caaatgtgaccatgtgaa

SEQ ID NO: 2913936 - DNA, 20 bp, Homo sapiens
caaatgtgtacatggcagag

SEQ ID NO: 2913937 - DNA, 23 bp, Homo sapiens
caaatgttctaagtttctaagat

SEQ ID NO: 2913938 - DNA, 17 bp, Homo sapiens
caaatgtttatgttttc

SEQ ID NO: 2913939 - DNA, 18 bp, Homo sapiens
caaatgttttctgcagaa

SEQ ID NO: 2913940 - DNA, 18 bp, Homo sapiens
caaattactttgtgaata

SEQ ID NO: 2913941 - DNA, 21 bp, Homo sapiens
caaattactttgtgaatagaa

SEQ ID NO: 2913942 - DNA, 23 bp, Homo sapiens
caaattagaaacaccattcatct

SEQ ID NO: 2913943 - DNA, 19 bp, Homo sapiens
caaattatttttaaaagaa

SEQ ID NO: 2913944 - DNA, 22 bp, Homo sapiens
caaattatttttaaaagaaaaa

SEQ ID NO: 2913945 - DNA, 17 bp, Homo sapiens
caaattccatcacatca

SEQ ID NO: 2913946 - DNA, 19 bp, Homo sapiens
caaattctcttctttttct

SEQ ID NO: 2913947 - DNA, 14 bp, Homo sapiens
caaattctgtttct

SEQ ID NO: 2913948 - DNA, 23 bp, Homo sapiens
caaattcttttgaattgttacat

SEQ ID NO: 2913949 - DNA, 22 bp, Homo sapiens
caaattgattgtcatatttcat

SEQ ID NO: 2913950 - DNA, 17 bp, Homo sapiens
caaattgcactgaagtt

SEQ ID NO: 2913951 - DNA, 21 bp, Homo sapiens
caaattgcactgaagtttttg

SEQ ID NO: 2913952 - DNA, 14 bp, Homo sapiens
caaattgcttctag

SEQ ID NO: 2913953 - DNA, 16 bp, Homo sapiens
caaattttcagaaggt

SEQ ID NO: 2913954 - DNA, 13 bp, Homo sapiens
caacaaaaggaag

SEQ ID NO: 2913955 - DNA, 12 bp, Homo sapiens
caacaaacagtg

SEQ ID NO: 2913956 - DNA, 23 bp, Homo sapiens
caacaaaggattaattgctgcaa

SEQ ID NO: 2913957 - DNA, 20 bp, Homo sapiens
caacaaagggttttaatgta

SEQ ID NO: 2913958 - DNA, 17 bp, Homo sapiens
caacaaataatttaagt

SEQ ID NO: 2913959 - DNA, 12 bp, Homo sapiens
caacaagaatgc

SEQ ID NO: 2913960 - DNA, 14 bp, Homo sapiens
caacaagaatgcat

SEQ ID NO: 2913961 - DNA, 16 bp, Homo sapiens
caacaagaatgcattg

SEQ ID NO: 2913962 - DNA, 20 bp, Homo sapiens
caacaagaatgcattgatat

SEQ ID NO: 2913963 - DNA, 13 bp, Homo sapiens
caacaataaaata

SEQ ID NO: 2913964 - DNA, 15 bp, Homo sapiens
caacaataaaatttt

SEQ ID NO: 2913965 - DNA, 22 bp, Homo sapiens
caacaataataaagatgtgaaa

SEQ ID NO: 2913966 - DNA, 19 bp, Homo sapiens
caacaatgaatcagaacag

SEQ ID NO: 2913967 - DNA, 21 bp, Homo sapiens
caacaatgattaatcagctgt

SEQ ID NO: 2913968 - DNA, 12 bp, Homo sapiens
caacaattagag

SEQ ID NO: 2913969 - DNA, 19 bp, Homo sapiens
caacaatttctactttgaa

SEQ ID NO: 2913970 - DNA, 15 bp, Homo sapiens
caacaccaagcacag

SEQ ID NO: 2913971 - DNA, 22 bp, Homo sapiens
caacaccaagcacagcagcctg

SEQ ID NO: 2913972 - DNA, 22 bp, Homo sapiens
caacaccccgcctgcctcctgg

SEQ ID NO: 2913973 - DNA, 23 bp, Homo sapiens
caacaccccgcctgcctcctggc

SEQ ID NO: 2913974 - DNA, 18 bp, Homo sapiens
caacacctcttggggagt

SEQ ID NO: 2913975 - DNA, 17 bp, Homo sapiens
caacacgcacctgcctc

SEQ ID NO: 2913976 - DNA, 19 bp, Homo sapiens
caacacgcacctgcctcag

SEQ ID NO: 2913977 - DNA, 15 bp, Homo sapiens
caacacgcaggagca

SEQ ID NO: 2913978 - DNA, 22 bp, Homo sapiens
caacactgaagtgcttgcagat

SEQ ID NO: 2913979 - DNA, 14 bp, Homo sapiens
caacactgccagca

SEQ ID NO: 2913980 - DNA, 13 bp, Homo sapiens
caacagaatgaaa

SEQ ID NO: 2913981 - DNA, 18 bp, Homo sapiens
caacagaatgaaaaatga

SEQ ID NO: 2913982 - DNA, 19 bp, Homo sapiens
caacagaatgaaaaatgaa

SEQ ID NO: 2913983 - DNA, 21 bp, Homo sapiens
caacagaatgaaaaatgaaag

SEQ ID NO: 2913984 - DNA, 17 bp, Homo sapiens
caacagatttgtgaact

SEQ ID NO: 2913985 - DNA, 15 bp, Homo sapiens
caacagcctcacttg

SEQ ID NO: 2913986 - DNA, 14 bp, Homo sapiens
caacagctacaaca

SEQ ID NO: 2913987 - DNA, 15 bp, Homo sapiens
caacaggagctggga

SEQ ID NO: 2913988 - DNA, 16 bp, Homo sapiens
caacaggaggacaatt

SEQ ID NO: 2913989 - DNA, 21 bp, Homo sapiens
caacaggcgtgggatcagatt

SEQ ID NO: 2913990 - DNA, 20 bp, Homo sapiens
caacagtaattattatttaa

SEQ ID NO: 2913991 - DNA, 22 bp, Homo sapiens
caacagtaattattatttaact

SEQ ID NO: 2913992 - DNA, 18 bp, Homo sapiens
caacagtgctaaaaatgg

SEQ ID NO: 2913993 - DNA, 14 bp, Homo sapiens
caacagtgtgaagt

SEQ ID NO: 2913994 - DNA, 16 bp, Homo sapiens
caacagtgtgaagtta

SEQ ID NO: 2913995 - DNA, 21 bp, Homo sapiens
caacagtgtgaagttagaatt

SEQ ID NO: 2913996 - DNA, 13 bp, Homo sapiens
caacagttttcct

SEQ ID NO: 2913997 - DNA, 22 bp, Homo sapiens
caacagttttcctatgctttga

SEQ ID NO: 2913998 - DNA, 12 bp, Homo sapiens
caacataaaact

SEQ ID NO: 2913999 - DNA, 21 bp, Homo sapiens
caacatagtgagaccttgtct

SEQ ID NO: 2914000 - DNA, 13 bp, Homo sapiens
caacatataaaat

SEQ ID NO: 2914001 - DNA, 20 bp, Homo sapiens
caacatcatcaggaagcctg

SEQ ID NO: 2914002 - DNA, 20 bp, Homo sapiens
caacatcccattgccctggt

SEQ ID NO: 2914003 - DNA, 21 bp, Homo sapiens
caacatctttgcgaaaagata

SEQ ID NO: 2914004 - DNA, 21 bp, Homo sapiens
caacatggattccaaagcatt

SEQ ID NO: 2914005 - DNA, 18 bp, Homo sapiens
caacatggcttctccttt

SEQ ID NO: 2914006 - DNA, 16 bp, Homo sapiens
caacatgtatctgtct

SEQ ID NO: 2914007 - DNA, 18 bp, Homo sapiens
caacatgtatctgtctac

SEQ ID NO: 2914008 - DNA, 19 bp, Homo sapiens
caacatgtatctgtctact

SEQ ID NO: 2914009 - DNA, 15 bp, Homo sapiens
caacatgtatgtgga

SEQ ID NO: 2914010 - DNA, 22 bp, Homo sapiens
caacattcattgccaagggccc

SEQ ID NO: 2914011 - DNA, 19 bp, Homo sapiens
caacatttatatattgtct

SEQ ID NO: 2914012 - DNA, 14 bp, Homo sapiens
caacatttctcaat

SEQ ID NO: 2914013 - DNA, 20 bp, Homo sapiens
caacattttgagaacaaaga

SEQ ID NO: 2914014 - DNA, 21 bp, Homo sapiens
caacattttgagaacaaagat

SEQ ID NO: 2914015 - DNA, 14 bp, Homo sapiens
caaccaaaagggaa

SEQ ID NO: 2914016 - DNA, 16 bp, Homo sapiens
caaccaaggaaggagc

SEQ ID NO: 2914017 - DNA, 22 bp, Homo sapiens
caatcagcaaacacaataagag

SEQ ID NO: 2914018 - DNA, 15 bp, Homo sapiens
caatcagtgtgaatg

SEQ ID NO: 2914019 - DNA, 17 bp, Homo sapiens
caatcatagagaaacct

SEQ ID NO: 2914020 - DNA, 19 bp, Homo sapiens
caatccaggtacgcacaga

SEQ ID NO: 2914021 - DNA, 16 bp, Homo sapiens
caatccatttggcaga

SEQ ID NO: 2914022 - DNA, 23 bp, Homo sapiens
caatccatttggcagaactgctg

SEQ ID NO: 2914023 - DNA, 15 bp, Homo sapiens
caatcccctcattca

SEQ ID NO: 2914024 - DNA, 11 bp, Homo sapiens
caatccctcaa

SEQ ID NO: 2914025 - DNA, 12 bp, Homo sapiens
caatccctcaaa

SEQ ID NO: 2914026 - DNA, 20 bp, Homo sapiens
caatcctatgtttttgttca

SEQ ID NO: 2914027 - DNA, 17 bp, Homo sapiens
caatcctgtctttctga

SEQ ID NO: 2914028 - DNA, 14 bp, Homo sapiens
caatcgcaaagcaa

SEQ ID NO: 2914029 - DNA, 16 bp, Homo sapiens
caatctagttccagag

SEQ ID NO: 2914030 - DNA, 19 bp, Homo sapiens
caatctcacaccttagcta

SEQ ID NO: 2914031 - DNA, 15 bp, Homo sapiens
caatctgtacaaaat

SEQ ID NO: 2914032 - DNA, 16 bp, Homo sapiens
caatctgtacaaaatg

SEQ ID NO: 2914033 - DNA, 17 bp, Homo sapiens
caatctgtacaaaatgg

SEQ ID NO: 2914034 - DNA, 21 bp, Homo sapiens
caatctgttctactcttaatg

SEQ ID NO: 2914035 - DNA, 12 bp, Homo sapiens
caatcttgtttt

SEQ ID NO: 2914036 - DNA, 20 bp, Homo sapiens
caatctttcctactttctat

SEQ ID NO: 2914037 - DNA, 19 bp, Homo sapiens
caatctttgaaagacttcc

SEQ ID NO: 2914038 - DNA, 23 bp, Homo sapiens
caatctttgaaagacttccaaag

SEQ ID NO: 2914039 - DNA, 21 bp, Homo sapiens
caatgaaaaatagtgtctttg

SEQ ID NO: 2914040 - DNA, 19 bp, Homo sapiens
caatgaaatatgtgaagcc

SEQ ID NO: 2914041 - DNA, 21 bp, Homo sapiens
caatgaaatatgtgaagccca

SEQ ID NO: 2914042 - DNA, 21 bp, Homo sapiens
caatgaaatgctctcctttcc

SEQ ID NO: 2914043 - DNA, 20 bp, Homo sapiens
caatgaacccccatgatgta

SEQ ID NO: 2914044 - DNA, 16 bp, Homo sapiens
caatgactaagccaag

SEQ ID NO: 2914045 - DNA, 17 bp, Homo sapiens
caatgactaagccaagc

SEQ ID NO: 2914046 - DNA, 14 bp, Homo sapiens
caatgatgaatgag

SEQ ID NO: 2914047 - DNA, 21 bp, Homo sapiens
caatgatgaatgagaatctac

SEQ ID NO: 2914048 - DNA, 19 bp, Homo sapiens
caatgattaatcagctgtt

SEQ ID NO: 2914049 - DNA, 15 bp, Homo sapiens
caatgattgttaatt

SEQ ID NO: 2914050 - DNA, 22 bp, Homo sapiens
caatgattgttaatttacagct

SEQ ID NO: 2914051 - DNA, 19 bp, Homo sapiens
caatgcattctggagacag

SEQ ID NO: 2914052 - DNA, 19 bp, Homo sapiens
caatgccaagtcactcttt

SEQ ID NO: 2914053 - DNA, 20 bp, Homo sapiens
caatgccaagtcactctttt

SEQ ID NO: 2914054 - DNA, 12 bp, Homo sapiens
caatgcgtggca

SEQ ID NO: 2914055 - DNA, 14 bp, Homo sapiens
caatgctgatttgg

SEQ ID NO: 2914056 - DNA, 13 bp, Homo sapiens
caatgctgtgaat

SEQ ID NO: 2914057 - DNA, 18 bp, Homo sapiens
caatgcttctagagtttt

SEQ ID NO: 2914058 - DNA, 20 bp, Homo sapiens
caatgcttctctcatagtgt

SEQ ID NO: 2914059 - DNA, 16 bp, Homo sapiens
caatggaaaatataat

SEQ ID NO: 2914060 - DNA, 17 bp, Homo sapiens
caatggatttgatgctg

SEQ ID NO: 2914061 - DNA, 19 bp, Homo sapiens
caatggatttgatgctgtt

SEQ ID NO: 2914062 - DNA, 19 bp, Homo sapiens
caatggctacctaaaaaga

SEQ ID NO: 2914063 - DNA, 18 bp, Homo sapiens
caatgggaaaagagtctc

SEQ ID NO: 2914064 - DNA, 23 bp, Homo sapiens
caatgggagctgaggccacactc

SEQ ID NO: 2914065 - DNA, 16 bp, Homo sapiens
caatgggattttctag

SEQ ID NO: 2914066 - DNA, 23 bp, Homo sapiens
caatgggattttctagtttcctg

SEQ ID NO: 2914067 - DNA, 22 bp, Homo sapiens
caatgggtcttagctctttctc

SEQ ID NO: 2914068 - DNA, 20 bp, Homo sapiens
caatggtgtggtgaatgtgt

SEQ ID NO: 2914069 - DNA, 21 bp, Homo sapiens
caatggtgtggtgaatgtgtg

SEQ ID NO: 2914070 - DNA, 21 bp, Homo sapiens
caatgtacaaggtatgtacag

SEQ ID NO: 2914071 - DNA, 18 bp, Homo sapiens
caatgtatttatttaaaa

SEQ ID NO: 2914072 - DNA, 17 bp, Homo sapiens
caatgtattttggaaga

SEQ ID NO: 2914073 - DNA, 21 bp, Homo sapiens
caatgtattttggaagacata

SEQ ID NO: 2914074 - DNA, 17 bp, Homo sapiens
caatgtctgcagccctg

SEQ ID NO: 2914075 - DNA, 11 bp, Homo sapiens
caatgtcttga

SEQ ID NO: 2914076 - DNA, 14 bp, Homo sapiens
caatgtgacattta

SEQ ID NO: 2914077 - DNA, 18 bp, Homo sapiens
caatgtgaggggtcccta

SEQ ID NO: 2914078 - DNA, 16 bp, Homo sapiens
caatgtgctactgatt

SEQ ID NO: 2914079 - DNA, 23 bp, Homo sapiens
caatgtggcaaggaaaaacaggt

SEQ ID NO: 2914080 - DNA, 21 bp, Homo sapiens
caatgtggttgcaaggccgct

SEQ ID NO: 2914081 - DNA, 20 bp, Homo sapiens
caatgtgtggctgaagactt

SEQ ID NO: 2914082 - DNA, 16 bp, Homo sapiens
caatgttctttatata

SEQ ID NO: 2914083 - DNA, 17 bp, Homo sapiens
caatgttgtgtgttgca

SEQ ID NO: 2914084 - DNA, 18 bp, Homo sapiens
caatgttgtgtgttgcac

SEQ ID NO: 2914085 - DNA, 13 bp, Homo sapiens
caatgtttctttt

SEQ ID NO: 2914086 - DNA, 22 bp, Homo sapiens
caattaaaaaaaattaaaacca

SEQ ID NO: 2914087 - DNA, 20 bp, Homo sapiens
caattaaaaacgaaaacctg

SEQ ID NO: 2914088 - DNA, 11 bp, Homo sapiens
caattaaaatt

SEQ ID NO: 2914089 - DNA, 19 bp, Homo sapiens
caattaaaattacaaaaga

SEQ ID NO: 2914090 - DNA, 15 bp, Homo sapiens
caattaaatttattt

SEQ ID NO: 2914091 - DNA, 17 bp, Homo sapiens
caattaaatttatttta

SEQ ID NO: 2914092 - DNA, 23 bp, Homo sapiens
caattaattgctattgtgttatt

SEQ ID NO: 2914093 - DNA, 13 bp, Homo sapiens
caattagacttga

SEQ ID NO: 2914094 - DNA, 22 bp, Homo sapiens
caattatagtttctgaggcttt

SEQ ID NO: 2914095 - DNA, 18 bp, Homo sapiens
caattatttaaagaaagt

SEQ ID NO: 2914096 - DNA, 12 bp, Homo sapiens
caattcaaaaca

SEQ ID NO: 2914097 - DNA, 20 bp, Homo sapiens
caattcacagcctttctgaa

SEQ ID NO: 2914098 - DNA, 13 bp, Homo sapiens
caattcagacagg

SEQ ID NO: 2914099 - DNA, 21 bp, Homo sapiens
caattcagtgctgtacttgat

SEQ ID NO: 2914100 - DNA, 15 bp, Homo sapiens
caattcatgaacttc

SEQ ID NO: 2914101 - DNA, 21 bp, Homo sapiens
caattcatgaacttcgcatca

SEQ ID NO: 2914102 - DNA, 14 bp, Homo sapiens
caattcatgaagtg

SEQ ID NO: 2914103 - DNA, 14 bp, Homo sapiens
caattctcctgcct

SEQ ID NO: 2914104 - DNA, 21 bp, Homo sapiens
caattctcctgcctttgcctc

SEQ ID NO: 2914105 - DNA, 23 bp, Homo sapiens
caattctgtttttaatgctattt

SEQ ID NO: 2914106 - DNA, 13 bp, Homo sapiens
caattctttatac

SEQ ID NO: 2914107 - DNA, 19 bp, Homo sapiens
caattctttatacaacagt

SEQ ID NO: 2914108 - DNA, 13 bp, Homo sapiens
caattctttcaac

SEQ ID NO: 2914109 - DNA, 22 bp, Homo sapiens
caattgaaggatcatctgaagg

SEQ ID NO: 2914110 - DNA, 14 bp, Homo sapiens
caattgacaacagt

SEQ ID NO: 2914111 - DNA, 20 bp, Homo sapiens
caattgtttgttctgttttc

SEQ ID NO: 2914112 - DNA, 17 bp, Homo sapiens
caatttaaacaccagtc

SEQ ID NO: 2914113 - DNA, 20 bp, Homo sapiens
caatttaaacccattttagt

SEQ ID NO: 2914114 - DNA, 11 bp, Homo sapiens
caatttaaatg

SEQ ID NO: 2914115 - DNA, 16 bp, Homo sapiens
caatttaaatgtttac

SEQ ID NO: 2914116 - DNA, 19 bp, Homo sapiens
caatttaaatgtttactat

SEQ ID NO: 2914117 - DNA, 17 bp, Homo sapiens
caatttaaattgttata

SEQ ID NO: 2914118 - DNA, 13 bp, Homo sapiens
caatttaattcct

SEQ ID NO: 2914119 - DNA, 21 bp, Homo sapiens
caatttactttttaaacagtg

SEQ ID NO: 2914120 - DNA, 13 bp, Homo sapiens
caatttatttggg

SEQ ID NO: 2914121 - DNA, 15 bp, Homo sapiens
caatttcaaggttct

SEQ ID NO: 2914122 - DNA, 14 bp, Homo sapiens
caatttcagactcc

SEQ ID NO: 2914123 - DNA, 12 bp, Homo sapiens
caatttcagctc

SEQ ID NO: 2914124 - DNA, 18 bp, Homo sapiens
caatttctttaaaaaaga

SEQ ID NO: 2914125 - DNA, 23 bp, Homo sapiens
caatttgggtttgttggtcacat

SEQ ID NO: 2914126 - DNA, 19 bp, Homo sapiens
caatttgttaacagagcaa

SEQ ID NO: 2914127 - DNA, 18 bp, Homo sapiens
caattttaatttagtaaa

SEQ ID NO: 2914128 - DNA, 22 bp, Homo sapiens
caattttaatttagtaaatgtt

SEQ ID NO: 2914129 - DNA, 15 bp, Homo sapiens
caattttatctgttt

SEQ ID NO: 2914130 - DNA, 15 bp, Homo sapiens
caatttttgccttca

SEQ ID NO: 2914131 - DNA, 15 bp, Homo sapiens
caattttttaaacca

SEQ ID NO: 2914132 - DNA, 17 bp, Homo sapiens
caatttttttaattttg

SEQ ID NO: 2914133 - DNA, 22 bp, Homo sapiens
caatttttttaattttgtattt

SEQ ID NO: 2914134 - DNA, 21 bp, Homo sapiens
cacaaaaaggagcgggcaggg

SEQ ID NO: 2914135 - DNA, 18 bp, Homo sapiens
cacaaaaatgttcacttc

SEQ ID NO: 2914136 - DNA, 13 bp, Homo sapiens
cacaaaacagcct

SEQ ID NO: 2914137 - DNA, 16 bp, Homo sapiens
cacaaaacccagacct

SEQ ID NO: 2914138 - DNA, 16 bp, Homo sapiens
cacaaaagctgtgtct

SEQ ID NO: 2914139 - DNA, 16 bp, Homo sapiens
cacaaaattgggaaag

SEQ ID NO: 2914140 - DNA, 16 bp, Homo sapiens
cacaaacacaaggtca

SEQ ID NO: 2914141 - DNA, 23 bp, Homo sapiens
cacaaacacattgttattttcag

SEQ ID NO: 2914142 - DNA, 18 bp, Homo sapiens
cacaaacggagcccctga

SEQ ID NO: 2914143 - DNA, 13 bp, Homo sapiens
cacaaactgtaaa

SEQ ID NO: 2914144 - DNA, 14 bp, Homo sapiens
cacaaactgtaaat

SEQ ID NO: 2914145 - DNA, 21 bp, Homo sapiens
cacaaacttgtgagcatcaga

SEQ ID NO: 2914146 - DNA, 18 bp, Homo sapiens
cacaaagcacagtttgaa

SEQ ID NO: 2914147 - DNA, 12 bp, Homo sapiens
cacaaagcccaa

SEQ ID NO: 2914148 - DNA, 14 bp, Homo sapiens
cacaaagcccaagg

SEQ ID NO: 2914149 - DNA, 22 bp, Homo sapiens
caccccagggcctgagcctggc

SEQ ID NO: 2914150 - DNA, 17 bp, Homo sapiens
cacccccctccccaact

SEQ ID NO: 2914151 - DNA, 13 bp, Homo sapiens
cacccccctgggc

SEQ ID NO: 2914152 - DNA, 18 bp, Homo sapiens
cacccccgctttggttct

SEQ ID NO: 2914153 - DNA, 23 bp, Homo sapiens
cacccccgctttggttcttcaga

SEQ ID NO: 2914154 - DNA, 20 bp, Homo sapiens
cacccccgggatcctgcccc

SEQ ID NO: 2914155 - DNA, 16 bp, Homo sapiens
caccccctccccaggg

SEQ ID NO: 2914156 - DNA, 15 bp, Homo sapiens
caccccctctcctgg

SEQ ID NO: 2914157 - DNA, 17 bp, Homo sapiens
caccccctctcctggag

SEQ ID NO: 2914158 - DNA, 18 bp, Homo sapiens
cacccccttctccatcca

SEQ ID NO: 2914159 - DNA, 17 bp, Homo sapiens
caccccgaggccctgca

SEQ ID NO: 2914160 - DNA, 19 bp, Homo sapiens
caccccgaggccctgcatg

SEQ ID NO: 2914161 - DNA, 14 bp, Homo sapiens
caccccgcctgcct

SEQ ID NO: 2914162 - DNA, 18 bp, Homo sapiens
caccccggccccctgccc

SEQ ID NO: 2914163 - DNA, 23 bp, Homo sapiens
caccccggccccctgcccgttct

SEQ ID NO: 2914164 - DNA, 13 bp, Homo sapiens
cacccctccagga

SEQ ID NO: 2914165 - DNA, 13 bp, Homo sapiens
cacccctgcacag

SEQ ID NO: 2914166 - DNA, 15 bp, Homo sapiens
cacccctgccactca

SEQ ID NO: 2914167 - DNA, 10 bp, Homo sapiens
cacccctgct

SEQ ID NO: 2914168 - DNA, 15 bp, Homo sapiens
cacccctggaaccag

SEQ ID NO: 2914169 - DNA, 16 bp, Homo sapiens
cacccctttccccagc

SEQ ID NO: 2914170 - DNA, 15 bp, Homo sapiens
caccctaagggcagc

SEQ ID NO: 2914171 - DNA, 20 bp, Homo sapiens
caccctaagggcagccctcc

SEQ ID NO: 2914172 - DNA, 17 bp, Homo sapiens
caccctaccttccccag

SEQ ID NO: 2914173 - DNA, 19 bp, Homo sapiens
caccctaccttccccagac

SEQ ID NO: 2914174 - DNA, 17 bp, Homo sapiens
caccctagcctccacca

SEQ ID NO: 2914175 - DNA, 14 bp, Homo sapiens
caccctcccagctc

SEQ ID NO: 2914176 - DNA, 19 bp, Homo sapiens
caccctcctggcctcagac

SEQ ID NO: 2914177 - DNA, 22 bp, Homo sapiens
caccctcctggcctcagactgc

SEQ ID NO: 2914178 - DNA, 11 bp, Homo sapiens
caccctctgtc

SEQ ID NO: 2914179 - DNA, 20 bp, Homo sapiens
caccctgctgctggtgcaca

SEQ ID NO: 2914180 - DNA, 14 bp, Homo sapiens
caccctggcctggt

SEQ ID NO: 2914181 - DNA, 20 bp, Homo sapiens
caccctgtgaccctctcact

SEQ ID NO: 2914182 - DNA, 22 bp, Homo sapiens
caccctgtgaccctctcacttt

SEQ ID NO: 2914183 - DNA, 18 bp, Homo sapiens
caccctgtttggattttt

SEQ ID NO: 2914184 - DNA, 20 bp, Homo sapiens
caccctgtttggatttttaa

SEQ ID NO: 2914185 - DNA, 18 bp, Homo sapiens
cacccttccctgcctcca

SEQ ID NO: 2914186 - DNA, 15 bp, Homo sapiens
cacccttcctggccc

SEQ ID NO: 2914187 - DNA, 14 bp, Homo sapiens
caccgaccccgggc

SEQ ID NO: 2914188 - DNA, 18 bp, Homo sapiens
caccgacccgaggcccag

SEQ ID NO: 2914189 - DNA, 13 bp, Homo sapiens
caccgactgccca

SEQ ID NO: 2914190 - DNA, 20 bp, Homo sapiens
caccgactgcccagccactc

SEQ ID NO: 2914191 - DNA, 15 bp, Homo sapiens
caccgagctctgtgg

SEQ ID NO: 2914192 - DNA, 16 bp, Homo sapiens
caccgcagcctgtcag

SEQ ID NO: 2914193 - DNA, 20 bp, Homo sapiens
caccgcagcctgtcagccaa

SEQ ID NO: 2914194 - DNA, 17 bp, Homo sapiens
caccgcagctgctgcca

SEQ ID NO: 2914195 - DNA, 21 bp, Homo sapiens
caccgcagctgctgccactct

SEQ ID NO: 2914196 - DNA, 16 bp, Homo sapiens
caccgccggctttcag

SEQ ID NO: 2914197 - DNA, 20 bp, Homo sapiens
caccgccggctttcagggca

SEQ ID NO: 2914198 - DNA, 19 bp, Homo sapiens
caccgccggggtcctggga

SEQ ID NO: 2914199 - DNA, 21 bp, Homo sapiens
caccgccggggtcctgggagg

SEQ ID NO: 2914200 - DNA, 19 bp, Homo sapiens
caccgcctccccacctcca

SEQ ID NO: 2914201 - DNA, 13 bp, Homo sapiens
caccgcctgccct

SEQ ID NO: 2914202 - DNA, 20 bp, Homo sapiens
caccgcggacgtgctggcct

SEQ ID NO: 2914203 - DNA, 21 bp, Homo sapiens
caccgcggacgtgctggcctt

SEQ ID NO: 2914204 - DNA, 22 bp, Homo sapiens
caccgctgcctaagtggctgct

SEQ ID NO: 2914205 - DNA, 21 bp, Homo sapiens
caccggatcctgggtggtctg

SEQ ID NO: 2914206 - DNA, 12 bp, Homo sapiens
caccgggctgca

SEQ ID NO: 2914207 - DNA, 14 bp, Homo sapiens
caccgggctgcagg

SEQ ID NO: 2914208 - DNA, 21 bp, Homo sapiens
caccgggctgcaggtgctgct

SEQ ID NO: 2914209 - DNA, 20 bp, Homo sapiens
caccgggctggctgcttgca

SEQ ID NO: 2914210 - DNA, 18 bp, Homo sapiens
caccgggggtggctctgt

SEQ ID NO: 2914211 - DNA, 14 bp, Homo sapiens
caccgtggcctggg

SEQ ID NO: 2914212 - DNA, 15 bp, Homo sapiens
caccgtgggcaggga

SEQ ID NO: 2914213 - DNA, 20 bp, Homo sapiens
caccgtggggaaggggtgca

SEQ ID NO: 2914214 - DNA, 13 bp, Homo sapiens
caccgttcagtca

SEQ ID NO: 2914215 - DNA, 13 bp, Homo sapiens
caccgttctgtgc

SEQ ID NO: 2914216 - DNA, 23 bp, Homo sapiens
cacctaaaaccagttttgctgct

SEQ ID NO: 2914217 - DNA, 13 bp, Homo sapiens
cacctaagggaca

SEQ ID NO: 2914218 - DNA, 17 bp, Homo sapiens
cacctacaatacatctg

SEQ ID NO: 2914219 - DNA, 18 bp, Homo sapiens
cacctacatgttattcta

SEQ ID NO: 2914220 - DNA, 13 bp, Homo sapiens
cacctacttagat

SEQ ID NO: 2914221 - DNA, 16 bp, Homo sapiens
cacctacttagatatt

SEQ ID NO: 2914222 - DNA, 19 bp, Homo sapiens
cacctacttagatatttca

SEQ ID NO: 2914223 - DNA, 14 bp, Homo sapiens
cacctagcagcacc

SEQ ID NO: 2914224 - DNA, 16 bp, Homo sapiens
cacctaggccactcct

SEQ ID NO: 2914225 - DNA, 18 bp, Homo sapiens
cacctaggctagggtggg

SEQ ID NO: 2914226 - DNA, 19 bp, Homo sapiens
cacctaggctagggtgggg

SEQ ID NO: 2914227 - DNA, 15 bp, Homo sapiens
cacctagtcgacact

SEQ ID NO: 2914228 - DNA, 20 bp, Homo sapiens
cacctagtgccccagactga

SEQ ID NO: 2914229 - DNA, 22 bp, Homo sapiens
cacctagtgccccagactgagc

SEQ ID NO: 2914230 - DNA, 14 bp, Homo sapiens
cacctataaaacag

SEQ ID NO: 2914231 - DNA, 13 bp, Homo sapiens
cacctatctcagc

SEQ ID NO: 2914232 - DNA, 15 bp, Homo sapiens
cacctatctcagcca

SEQ ID NO: 2914233 - DNA, 16 bp, Homo sapiens
cacctatctcagccat

SEQ ID NO: 2914234 - DNA, 14 bp, Homo sapiens
cacctcaccctctc

SEQ ID NO: 2914235 - DNA, 12 bp, Homo sapiens
cacctcagcctg

SEQ ID NO: 2914236 - DNA, 12 bp, Homo sapiens
cacctcagcctt

SEQ ID NO: 2914237 - DNA, 13 bp, Homo sapiens
cacctcagccttg

SEQ ID NO: 2914238 - DNA, 22 bp, Homo sapiens
cacctcattctgaaccctttcg

SEQ ID NO: 2914239 - DNA, 15 bp, Homo sapiens
cacctccatcccaga

SEQ ID NO: 2914240 - DNA, 14 bp, Homo sapiens
cacctccccagcct

SEQ ID NO: 2914241 - DNA, 16 bp, Homo sapiens
cacctccccccactgc

SEQ ID NO: 2914242 - DNA, 14 bp, Homo sapiens
cacctcccctatcc

SEQ ID NO: 2914243 - DNA, 15 bp, Homo sapiens
cacctcgagaagtaa

SEQ ID NO: 2914244 - DNA, 20 bp, Homo sapiens
cacctcggccctccctgcgc

SEQ ID NO: 2914245 - DNA, 19 bp, Homo sapiens
cacctctccctgaccctgt

SEQ ID NO: 2914246 - DNA, 13 bp, Homo sapiens
cacctctctgtct

SEQ ID NO: 2914247 - DNA, 14 bp, Homo sapiens
cacctctcttttcc

SEQ ID NO: 2914248 - DNA, 13 bp, Homo sapiens
cacctctgctcca

SEQ ID NO: 2914249 - DNA, 20 bp, Homo sapiens
cacctctgggccaggttgga

SEQ ID NO: 2914250 - DNA, 19 bp, Homo sapiens
cacctgaaagcctgtctct

SEQ ID NO: 2914251 - DNA, 21 bp, Homo sapiens
cacctgaaccccagaggcaga

SEQ ID NO: 2914252 - DNA, 18 bp, Homo sapiens
cacctgaccgctgcccag

SEQ ID NO: 2914253 - DNA, 19 bp, Homo sapiens
cacctgaccgctgcccagg

SEQ ID NO: 2914254 - DNA, 19 bp, Homo sapiens
cacctgagcaggacctctg

SEQ ID NO: 2914255 - DNA, 15 bp, Homo sapiens
cacctgattcaacta

SEQ ID NO: 2914256 - DNA, 16 bp, Homo sapiens
cacctgattcaactaa

SEQ ID NO: 2914257 - DNA, 11 bp, Homo sapiens
cacctgcacct

SEQ ID NO: 2914258 - DNA, 19 bp, Homo sapiens
cacctgcacctccccccac

SEQ ID NO: 2914259 - DNA, 17 bp, Homo sapiens
cacctgcagtgccagct

SEQ ID NO: 2914260 - DNA, 22 bp, Homo sapiens
cacctgcagtgccagctccctc

SEQ ID NO: 2914261 - DNA, 16 bp, Homo sapiens
cacctgccccaactct

SEQ ID NO: 2914262 - DNA, 23 bp, Homo sapiens
cacctgccgacctcgtcctcccc

SEQ ID NO: 2914263 - DNA, 15 bp, Homo sapiens
cacctgcctagctct

SEQ ID NO: 2914264 - DNA, 12 bp, Homo sapiens
cacctgcctcag

SEQ ID NO: 2914265 - DNA, 13 bp, Homo sapiens
cacctgcctcagc

SEQ ID NO: 2914266 - DNA, 10 bp, Homo sapiens
cacctgcctg

SEQ ID NO: 2914267 - DNA, 12 bp, Homo sapiens
cacctgcctggc

SEQ ID NO: 2914268 - DNA, 22 bp, Homo sapiens
cacctgcctggccggccagcca

SEQ ID NO: 2914269 - DNA, 20 bp, Homo sapiens
cacctgcgcacaggtgggag

SEQ ID NO: 2914270 - DNA, 15 bp, Homo sapiens
cacctgctggagtga

SEQ ID NO: 2914271 - DNA, 22 bp, Homo sapiens
cacctggaagcatttgtttcta

SEQ ID NO: 2914272 - DNA, 17 bp, Homo sapiens
cacctggaccccctgcc

SEQ ID NO: 2914273 - DNA, 15 bp, Homo sapiens
cacctggccaggatt

SEQ ID NO: 2914274 - DNA, 20 bp, Homo sapiens
cacctggccccatgtctctc

SEQ ID NO: 2914275 - DNA, 21 bp, Homo sapiens
cacctggccccctcagctctg

SEQ ID NO: 2914276 - DNA, 22 bp, Homo sapiens
cacctggccgggtcaccctgtg

SEQ ID NO: 2914277 - DNA, 23 bp, Homo sapiens
cacctggccgggtcaccctgtga

SEQ ID NO: 2914278 - DNA, 16 bp, Homo sapiens
cacctggcttgtttat

SEQ ID NO: 2914279 - DNA, 13 bp, Homo sapiens
cacctgggctggg

SEQ ID NO: 2914280 - DNA, 16 bp, Homo sapiens
cacctgggctgggcgc

SEQ ID NO: 2914281 - DNA, 20 bp, Homo sapiens
cacctggggtgtgggaggcc

SEQ ID NO: 2914282 - DNA, 21 bp, Homo sapiens
cagaattatgatggaagacag

SEQ ID NO: 2914283 - DNA, 15 bp, Homo sapiens
cagaattgaaacact

SEQ ID NO: 2914284 - DNA, 17 bp, Homo sapiens
cagaattgaaacacttt

SEQ ID NO: 2914285 - DNA, 19 bp, Homo sapiens
cagaattttaatgtgaaga

SEQ ID NO: 2914286 - DNA, 24 bp, Homo sapiens
cagaattttaatgtgaagacattt

SEQ ID NO: 2914287 - DNA, 16 bp, Homo sapiens
cagaatttttaactgt

SEQ ID NO: 2914288 - DNA, 18 bp, Homo sapiens
cagaatttttaactgtac

SEQ ID NO: 2914289 - DNA, 19 bp, Homo sapiens
cagaattttttttgttgtt

SEQ ID NO: 2914290 - DNA, 18 bp, Homo sapiens
cagacaaaaacagcctca

SEQ ID NO: 2914291 - DNA, 20 bp, Homo sapiens
cagacaaaaacagcctcaca

SEQ ID NO: 2914292 - DNA, 17 bp, Homo sapiens
cagacaaggagagcgga

SEQ ID NO: 2914293 - DNA, 17 bp, Homo sapiens
cagacaaggcaggcctg

SEQ ID NO: 2914294 - DNA, 16 bp, Homo sapiens
cagacaatacgtttga

SEQ ID NO: 2914295 - DNA, 20 bp, Homo sapiens
cagacacaacccaataggag

SEQ ID NO: 2914296 - DNA, 17 bp, Homo sapiens
cagacacccaggactta

SEQ ID NO: 2914297 - DNA, 22 bp, Homo sapiens
cagacacctgttcacagaaaaa

SEQ ID NO: 2914298 - DNA, 22 bp, Homo sapiens
cagacactggtttgaagaatgt

SEQ ID NO: 2914299 - DNA, 21 bp, Homo sapiens
cagacacttttttgagtggat

SEQ ID NO: 2914300 - DNA, 12 bp, Homo sapiens
cagacagaggat

SEQ ID NO: 2914301 - DNA, 14 bp, Homo sapiens
cagacagaggatga

SEQ ID NO: 2914302 - DNA, 12 bp, Homo sapiens
cagacagccccc

SEQ ID NO: 2914303 - DNA, 13 bp, Homo sapiens
cagacagctgctc

SEQ ID NO: 2914304 - DNA, 14 bp, Homo sapiens
cagacagctgctca

SEQ ID NO: 2914305 - DNA, 19 bp, Homo sapiens
cagacagctgctcagagcc

SEQ ID NO: 2914306 - DNA, 23 bp, Homo sapiens
cagacaggttttcacataaatgc

SEQ ID NO: 2914307 - DNA, 22 bp, Homo sapiens
cagacatagaagagccaagagt

SEQ ID NO: 2914308 - DNA, 13 bp, Homo sapiens
cagacatatttaa

SEQ ID NO: 2914309 - DNA, 17 bp, Homo sapiens
cagacatatttaactgg

SEQ ID NO: 2914310 - DNA, 19 bp, Homo sapiens
cagacatggtgtctcacac

SEQ ID NO: 2914311 - DNA, 16 bp, Homo sapiens
cagacattctgccagg

SEQ ID NO: 2914312 - DNA, 21 bp, Homo sapiens
cagacattctgccaggccccc

SEQ ID NO: 2914313 - DNA, 14 bp, Homo sapiens
cagaccaaaaatca

SEQ ID NO: 2914314 - DNA, 23 bp, Homo sapiens
cagacccacagaaggtgttcaaa

SEQ ID NO: 2914315 - DNA, 22 bp, Homo sapiens
cagacccagcccgcggcctgga

SEQ ID NO: 2914316 - DNA, 12 bp, Homo sapiens
cagaccccagcg

SEQ ID NO: 2914317 - DNA, 15 bp, Homo sapiens
cagaccccagcggct

SEQ ID NO: 2914318 - DNA, 16 bp, Homo sapiens
cagaccccagcggctg

SEQ ID NO: 2914319 - DNA, 15 bp, Homo sapiens
cagaccctaccccac

SEQ ID NO: 2914320 - DNA, 14 bp, Homo sapiens
cagacctgatcctg

SEQ ID NO: 2914321 - DNA, 16 bp, Homo sapiens
cagacctgtcgtctct

SEQ ID NO: 2914322 - DNA, 19 bp, Homo sapiens
cagacctgtcgtctctccc

SEQ ID NO: 2914323 - DNA, 20 bp, Homo sapiens
cagacctgtcgtctctccca

SEQ ID NO: 2914324 - DNA, 20 bp, Homo sapiens
cagacctgttagcagacagg

SEQ ID NO: 2914325 - DNA, 19 bp, Homo sapiens
cagaccttactcaggggat

SEQ ID NO: 2914326 - DNA, 20 bp, Homo sapiens
cagaccttactcaggggatg

SEQ ID NO: 2914327 - DNA, 13 bp, Homo sapiens
cagaccttttatc

SEQ ID NO: 2914328 - DNA, 15 bp, Homo sapiens
cagacgtctcaagac

SEQ ID NO: 2914329 - DNA, 15 bp, Homo sapiens
cagacgtctggccct

SEQ ID NO: 2914330 - DNA, 19 bp, Homo sapiens
cagacgtgtgacctccata

SEQ ID NO: 2914331 - DNA, 15 bp, Homo sapiens
cagactagtatcaag

SEQ ID NO: 2914332 - DNA, 15 bp, Homo sapiens
cagactattccctag

SEQ ID NO: 2914333 - DNA, 13 bp, Homo sapiens
cagactcatcctg

SEQ ID NO: 2914334 - DNA, 18 bp, Homo sapiens
cagactcatcctgaacag

SEQ ID NO: 2914335 - DNA, 19 bp, Homo sapiens
cagactcatcctgaacagc

SEQ ID NO: 2914336 - DNA, 22 bp, Homo sapiens
cagactcatcctgaacagcatg

SEQ ID NO: 2914337 - DNA, 14 bp, Homo sapiens
cagactcccattcc

SEQ ID NO: 2914338 - DNA, 17 bp, Homo sapiens
cagactcccattcctga

SEQ ID NO: 2914339 - DNA, 19 bp, Homo sapiens
cagactcccattcctgaag

SEQ ID NO: 2914340 - DNA, 23 bp, Homo sapiens
cagactcctgactgtctcccggg

SEQ ID NO: 2914341 - DNA, 13 bp, Homo sapiens
cagactcctgagg

SEQ ID NO: 2914342 - DNA, 12 bp, Homo sapiens
cagactctgcct

SEQ ID NO: 2914343 - DNA, 13 bp, Homo sapiens
cagactctgccta

SEQ ID NO: 2914344 - DNA, 17 bp, Homo sapiens
cagactcttccaccaga

SEQ ID NO: 2914345 - DNA, 21 bp, Homo sapiens
cagactcttccaccagagcag

SEQ ID NO: 2914346 - DNA, 14 bp, Homo sapiens
cagactgagctctc

SEQ ID NO: 2914347 - DNA, 13 bp, Homo sapiens
cagactgcaccca

SEQ ID NO: 2914348 - DNA, 18 bp, Homo sapiens
cagactgcacccaggagg

SEQ ID NO: 2914349 - DNA, 19 bp, Homo sapiens
cagactgcacccaggaggg

SEQ ID NO: 2914350 - DNA, 15 bp, Homo sapiens
cagactgccccagcc

SEQ ID NO: 2914351 - DNA, 17 bp, Homo sapiens
cagactgccccagccaa

SEQ ID NO: 2914352 - DNA, 12 bp, Homo sapiens
cagactgcttgg

SEQ ID NO: 2914353 - DNA, 16 bp, Homo sapiens
cagactgcttggccag

SEQ ID NO: 2914354 - DNA, 12 bp, Homo sapiens
cagactggaggt

SEQ ID NO: 2914355 - DNA, 15 bp, Homo sapiens
cagactggaggtcga

SEQ ID NO: 2914356 - DNA, 15 bp, Homo sapiens
cagactggccgggca

SEQ ID NO: 2914357 - DNA, 18 bp, Homo sapiens
cagactggccgggcaggc

SEQ ID NO: 2914358 - DNA, 20 bp, Homo sapiens
cagactggccgggcaggcgt

SEQ ID NO: 2914359 - DNA, 12 bp, Homo sapiens
cagactgggccc

SEQ ID NO: 2914360 - DNA, 15 bp, Homo sapiens
cagactgggcccagg

SEQ ID NO: 2914361 - DNA, 16 bp, Homo sapiens
cagactgggcccaggc

SEQ ID NO: 2914362 - DNA, 19 bp, Homo sapiens
cagactgggcccaggcagg

SEQ ID NO: 2914363 - DNA, 24 bp, Homo sapiens
cagactgggcccaggcaggtctgc

SEQ ID NO: 2914364 - DNA, 12 bp, Homo sapiens
cagactgtgtaa

SEQ ID NO: 2914365 - DNA, 14 bp, Homo sapiens
cagactgtgtaaaa

SEQ ID NO: 2914366 - DNA, 22 bp, Homo sapiens
cagacttcccacggctcctcga

SEQ ID NO: 2914367 - DNA, 18 bp, Homo sapiens
cagacttgccatgtgact

SEQ ID NO: 2914368 - DNA, 13 bp, Homo sapiens
cagacttgtcaag

SEQ ID NO: 2914369 - DNA, 16 bp, Homo sapiens
cagacttgtttcctgt

SEQ ID NO: 2914370 - DNA, 17 bp, Homo sapiens
cagacttgtttcctgtg

SEQ ID NO: 2914371 - DNA, 13 bp, Homo sapiens
cagacttttctct

SEQ ID NO: 2914372 - DNA, 16 bp, Homo sapiens
cagagaaaacactttc

SEQ ID NO: 2914373 - DNA, 19 bp, Homo sapiens
cagagaaaatcaaagcagt

SEQ ID NO: 2914374 - DNA, 19 bp, Homo sapiens
cagagaaaatgagaaagga

SEQ ID NO: 2914375 - DNA, 17 bp, Homo sapiens
cagagaaaggcaaggga

SEQ ID NO: 2914376 - DNA, 15 bp, Homo sapiens
cagagaaagggacaa

SEQ ID NO: 2914377 - DNA, 18 bp, Homo sapiens
cagagaaaggggagccca

SEQ ID NO: 2914378 - DNA, 18 bp, Homo sapiens
cagagaagaaaaacgtga

SEQ ID NO: 2914379 - DNA, 14 bp, Homo sapiens
cagagaaggaaaag

SEQ ID NO: 2914380 - DNA, 15 bp, Homo sapiens
cagagaaggaaaaga

SEQ ID NO: 2914381 - DNA, 22 bp, Homo sapiens
cagagaaggaaaagactgaatc

SEQ ID NO: 2914382 - DNA, 17 bp, Homo sapiens
cagagaaggcaggaatg

SEQ ID NO: 2914383 - DNA, 13 bp, Homo sapiens
cagagaagtgaca

SEQ ID NO: 2914384 - DNA, 15 bp, Homo sapiens
cagagaagtgacagg

SEQ ID NO: 2914385 - DNA, 20 bp, Homo sapiens
cagagaagtgacagggaagc

SEQ ID NO: 2914386 - DNA, 24 bp, Homo sapiens
cagagaagtgacagggaagctaca

SEQ ID NO: 2914387 - DNA, 15 bp, Homo sapiens
cagagacacctgcac

SEQ ID NO: 2914388 - DNA, 18 bp, Homo sapiens
cagagacacctgcacctc

SEQ ID NO: 2914389 - DNA, 22 bp, Homo sapiens
cagagacaggaaaatcctctgg

SEQ ID NO: 2914390 - DNA, 23 bp, Homo sapiens
cagagacaggaaaatcctctggc

SEQ ID NO: 2914391 - DNA, 15 bp, Homo sapiens
cagagacatacttga

SEQ ID NO: 2914392 - DNA, 18 bp, Homo sapiens
cagagacatgtggcagca

SEQ ID NO: 2914393 - DNA, 15 bp, Homo sapiens
cagagaccaggccct

SEQ ID NO: 2914394 - DNA, 20 bp, Homo sapiens
cagagaccttcaaatgcgaa

SEQ ID NO: 2914395 - DNA, 13 bp, Homo sapiens
cagagacctttgc

SEQ ID NO: 2914396 - DNA, 17 bp, Homo sapiens
cagagacctttgcccac

SEQ ID NO: 2914397 - DNA, 21 bp, Homo sapiens
cagagacctttgcccacacac

SEQ ID NO: 2914398 - DNA, 16 bp, Homo sapiens
cagagactggcatttt

SEQ ID NO: 2914399 - DNA, 13 bp, Homo sapiens
cagagagaaaaag

SEQ ID NO: 2914400 - DNA, 22 bp, Homo sapiens
cagagagaggggagaagcctgg

SEQ ID NO: 2914401 - DNA, 13 bp, Homo sapiens
cagagagccctgg

SEQ ID NO: 2914402 - DNA, 13 bp, Homo sapiens
cagagaggaatca

SEQ ID NO: 2914403 - DNA, 17 bp, Homo sapiens
cagagagggtgacaaga

SEQ ID NO: 2914404 - DNA, 18 bp, Homo sapiens
cagagagggtgacaagat

SEQ ID NO: 2914405 - DNA, 16 bp, Homo sapiens
cagagagtccaattta

SEQ ID NO: 2914406 - DNA, 13 bp, Homo sapiens
cagagataaataa

SEQ ID NO: 2914407 - DNA, 16 bp, Homo sapiens
cagagataaataaaag

SEQ ID NO: 2914408 - DNA, 19 bp, Homo sapiens
cagagataaataaaagata

SEQ ID NO: 2914409 - DNA, 20 bp, Homo sapiens
cagagatccaaaagaagccc

SEQ ID NO: 2914410 - DNA, 17 bp, Homo sapiens
cagagatcctacttctc

SEQ ID NO: 2914411 - DNA, 16 bp, Homo sapiens
cagagatgcctccacc

SEQ ID NO: 2914412 - DNA, 18 bp, Homo sapiens
cagagatgcctccaccgc

SEQ ID NO: 2914413 - DNA, 20 bp, Homo sapiens
cagagcaaaaatgtaaaaaa

SEQ ID NO: 2914414 - DNA, 18 bp, Homo sapiens
cagagcaaagcgcccacc

SEQ ID NO: 2914415 - DNA, 20 bp, Homo sapiens
cagcagcaagaaaaaaaaat

SEQ ID NO: 2914416 - DNA, 22 bp, Homo sapiens
cagcagcactggaaccacctgg

SEQ ID NO: 2914417 - DNA, 15 bp, Homo sapiens
cagcagcagagagcc

SEQ ID NO: 2914418 - DNA, 18 bp, Homo sapiens
cagcagcagagagccctg

SEQ ID NO: 2914419 - DNA, 16 bp, Homo sapiens
cagcagcagctcacac

SEQ ID NO: 2914420 - DNA, 10 bp, Homo sapiens
cagcagcata

SEQ ID NO: 2914421 - DNA, 13 bp, Homo sapiens
cagcagcatccca

SEQ ID NO: 2914422 - DNA, 14 bp, Homo sapiens
cagcagcatcccag

SEQ ID NO: 2914423 - DNA, 20 bp, Homo sapiens
cagcagcatcccagccttga

SEQ ID NO: 2914424 - DNA, 11 bp, Homo sapiens
cagcagccctc

SEQ ID NO: 2914425 - DNA, 15 bp, Homo sapiens
cagcagccctcctca

SEQ ID NO: 2914426 - DNA, 19 bp, Homo sapiens
cagcagccctcctcacccc

SEQ ID NO: 2914427 - DNA, 18 bp, Homo sapiens
cagcagcccttgtttata

SEQ ID NO: 2914428 - DNA, 14 bp, Homo sapiens
cagcagcctcgcac

SEQ ID NO: 2914429 - DNA, 17 bp, Homo sapiens
cagcagcctcgcacagg

SEQ ID NO: 2914430 - DNA, 21 bp, Homo sapiens
cagcagcctcgcacaggccct

SEQ ID NO: 2914431 - DNA, 13 bp, Homo sapiens
cagcagcctgcca

SEQ ID NO: 2914432 - DNA, 20 bp, Homo sapiens
cagcagcctggggctggcct

SEQ ID NO: 2914433 - DNA, 13 bp, Homo sapiens
cagcagcctgtga

SEQ ID NO: 2914434 - DNA, 21 bp, Homo sapiens
cagcagcctgtgagggagtgc

SEQ ID NO: 2914435 - DNA, 17 bp, Homo sapiens
cagcagcgcctttccca

SEQ ID NO: 2914436 - DNA, 18 bp, Homo sapiens
cagcaggaggccaggccg

SEQ ID NO: 2914437 - DNA, 22 bp, Homo sapiens
cagcagggaaaatgcagcaggg

SEQ ID NO: 2914438 - DNA, 19 bp, Homo sapiens
cagcagggctaccctgagc

SEQ ID NO: 2914439 - DNA, 19 bp, Homo sapiens
cagcaggggccctcactct

SEQ ID NO: 2914440 - DNA, 20 bp, Homo sapiens
cagcaggggccctcactctt

SEQ ID NO: 2914441 - DNA, 21 bp, Homo sapiens
cagcaggggccctcactcttg

SEQ ID NO: 2914442 - DNA, 19 bp, Homo sapiens
cagcagggtttgagcacaa

SEQ ID NO: 2914443 - DNA, 23 bp, Homo sapiens
cagcagggtttgagcacaatctg

SEQ ID NO: 2914444 - DNA, 13 bp, Homo sapiens
cagcagtctctgc

SEQ ID NO: 2914445 - DNA, 21 bp, Homo sapiens
cagcagtctctgccttgcctt

SEQ ID NO: 2914446 - DNA, 17 bp, Homo sapiens
cagcagtgtgaggccag

SEQ ID NO: 2914447 - DNA, 22 bp, Homo sapiens
cagcagtgtgaggccagggcag

SEQ ID NO: 2914448 - DNA, 13 bp, Homo sapiens
cagcatcaaacat

SEQ ID NO: 2914449 - DNA, 21 bp, Homo sapiens
cagcatcaaacatgaaaacat

SEQ ID NO: 2914450 - DNA, 14 bp, Homo sapiens
cagcatcacctgcc

SEQ ID NO: 2914451 - DNA, 13 bp, Homo sapiens
cagcatcccagcc

SEQ ID NO: 2914452 - DNA, 23 bp, Homo sapiens
cagcatccgcaggtgctggtccc

SEQ ID NO: 2914453 - DNA, 21 bp, Homo sapiens
cagcatcggacaagaccccca

SEQ ID NO: 2914454 - DNA, 13 bp, Homo sapiens
cagcatctcttct

SEQ ID NO: 2914455 - DNA, 11 bp, Homo sapiens
cagcatctgac

SEQ ID NO: 2914456 - DNA, 14 bp, Homo sapiens
cagcatctgaccat

SEQ ID NO: 2914457 - DNA, 22 bp, Homo sapiens
cagcatctgaccatctgtgact

SEQ ID NO: 2914458 - DNA, 17 bp, Homo sapiens
cagcatggatgaaacct

SEQ ID NO: 2914459 - DNA, 19 bp, Homo sapiens
cagcatggcactccctcca

SEQ ID NO: 2914460 - DNA, 20 bp, Homo sapiens
cagcatggcactccctccag

SEQ ID NO: 2914461 - DNA, 17 bp, Homo sapiens
cagcatgttttctgctt

SEQ ID NO: 2914462 - DNA, 19 bp, Homo sapiens
cagcatgttttctgcttta

SEQ ID NO: 2914463 - DNA, 14 bp, Homo sapiens
cagcattgctttct

SEQ ID NO: 2914464 - DNA, 23 bp, Homo sapiens
cagcattgttgagctgtcatcaa

SEQ ID NO: 2914465 - DNA, 22 bp, Homo sapiens
cagcatttagctggccacatgg

SEQ ID NO: 2914466 - DNA, 20 bp, Homo sapiens
cagccaacgagattgctgga

SEQ ID NO: 2914467 - DNA, 14 bp, Homo sapiens
cagccaactagccc

SEQ ID NO: 2914468 - DNA, 16 bp, Homo sapiens
cagccaactagcccct

SEQ ID NO: 2914469 - DNA, 17 bp, Homo sapiens
cagccaactagcccctg

SEQ ID NO: 2914470 - DNA, 11 bp, Homo sapiens
cagccaagcac

SEQ ID NO: 2914471 - DNA, 23 bp, Homo sapiens
cagccaagcacagtggtggcagg

SEQ ID NO: 2914472 - DNA, 13 bp, Homo sapiens
cagccaaggccga

SEQ ID NO: 2914473 - DNA, 11 bp, Homo sapiens
cagccacacac

SEQ ID NO: 2914474 - DNA, 14 bp, Homo sapiens
cagccacacacaca

SEQ ID NO: 2914475 - DNA, 15 bp, Homo sapiens
cagccacacacacag

SEQ ID NO: 2914476 - DNA, 16 bp, Homo sapiens
cagccacacacacaga

SEQ ID NO: 2914477 - DNA, 20 bp, Homo sapiens
cagccacacacacagaaaat

SEQ ID NO: 2914478 - DNA, 23 bp, Homo sapiens
cagccacacacacagaaaatata

SEQ ID NO: 2914479 - DNA, 10 bp, Homo sapiens
cagccacagg

SEQ ID NO: 2914480 - DNA, 12 bp, Homo sapiens
cagccacaggcc

SEQ ID NO: 2914481 - DNA, 16 bp, Homo sapiens
cagccacatgccccag

SEQ ID NO: 2914482 - DNA, 19 bp, Homo sapiens
cagccacatgccccaggct

SEQ ID NO: 2914483 - DNA, 15 bp, Homo sapiens
cagccacccctcaga

SEQ ID NO: 2914484 - DNA, 17 bp, Homo sapiens
cagccacccctgccact

SEQ ID NO: 2914485 - DNA, 17 bp, Homo sapiens
cagccacgaacagcccg

SEQ ID NO: 2914486 - DNA, 19 bp, Homo sapiens
cagccacgaacagcccgcc

SEQ ID NO: 2914487 - DNA, 18 bp, Homo sapiens
cagccactccaagccccc

SEQ ID NO: 2914488 - DNA, 22 bp, Homo sapiens
cagccactggaggggtcatcct

SEQ ID NO: 2914489 - DNA, 15 bp, Homo sapiens
cagccagccacccct

SEQ ID NO: 2914490 - DNA, 16 bp, Homo sapiens
cagccagcccagccca

SEQ ID NO: 2914491 - DNA, 12 bp, Homo sapiens
cagccagctgcc

SEQ ID NO: 2914492 - DNA, 13 bp, Homo sapiens
cagccaggaggga

SEQ ID NO: 2914493 - DNA, 18 bp, Homo sapiens
cagccaggccactggccc

SEQ ID NO: 2914494 - DNA, 17 bp, Homo sapiens
cagccaggccctgccag

SEQ ID NO: 2914495 - DNA, 14 bp, Homo sapiens
cagccaggcctcgc

SEQ ID NO: 2914496 - DNA, 15 bp, Homo sapiens
cagccaggcctcgcc

SEQ ID NO: 2914497 - DNA, 24 bp, Homo sapiens
cagccaggcctcgcctgccctcct

SEQ ID NO: 2914498 - DNA, 21 bp, Homo sapiens
cagccagtgacctgaggaagc

SEQ ID NO: 2914499 - DNA, 13 bp, Homo sapiens
cagccatcaaaat

SEQ ID NO: 2914500 - DNA, 17 bp, Homo sapiens
cagccatcaaaatgctt

SEQ ID NO: 2914501 - DNA, 15 bp, Homo sapiens
cagccatcagccatg

SEQ ID NO: 2914502 - DNA, 14 bp, Homo sapiens
cagccatccgcaga

SEQ ID NO: 2914503 - DNA, 18 bp, Homo sapiens
cagccatgaggagttgct

SEQ ID NO: 2914504 - DNA, 19 bp, Homo sapiens
cagccatgtacagacagag

SEQ ID NO: 2914505 - DNA, 23 bp, Homo sapiens
cagccattacccagctaaataat

SEQ ID NO: 2914506 - DNA, 17 bp, Homo sapiens
cagccattgcacccagc

SEQ ID NO: 2914507 - DNA, 20 bp, Homo sapiens
cagccattggctatttaaaa

SEQ ID NO: 2914508 - DNA, 19 bp, Homo sapiens
cagccatttttagattggt

SEQ ID NO: 2914509 - DNA, 14 bp, Homo sapiens
cagcccaacagcac

SEQ ID NO: 2914510 - DNA, 17 bp, Homo sapiens
cagcccaacagcacttt

SEQ ID NO: 2914511 - DNA, 16 bp, Homo sapiens
cagcccaatccaggta

SEQ ID NO: 2914512 - DNA, 22 bp, Homo sapiens
cagcccaatccaggtacgcaca

SEQ ID NO: 2914513 - DNA, 17 bp, Homo sapiens
cagcccacagagcctga

SEQ ID NO: 2914514 - DNA, 12 bp, Homo sapiens
cagcccaccctg

SEQ ID NO: 2914515 - DNA, 14 bp, Homo sapiens
cagcccaccctgct

SEQ ID NO: 2914516 - DNA, 16 bp, Homo sapiens
cagcccaccctgctgc

SEQ ID NO: 2914517 - DNA, 18 bp, Homo sapiens
cagcccaccctgctgctg

SEQ ID NO: 2914518 - DNA, 12 bp, Homo sapiens
cagcccccaccc

SEQ ID NO: 2914519 - DNA, 15 bp, Homo sapiens
cagcccccgcgccct

SEQ ID NO: 2914520 - DNA, 18 bp, Homo sapiens
cagcccccgcgccctccc

SEQ ID NO: 2914521 - DNA, 13 bp, Homo sapiens
cagcccctacccc

SEQ ID NO: 2914522 - DNA, 18 bp, Homo sapiens
cagcccctacccctgccc

SEQ ID NO: 2914523 - DNA, 20 bp, Homo sapiens
cagcccctcctctgccacct

SEQ ID NO: 2914524 - DNA, 21 bp, Homo sapiens
cagcccctcctctgccacctc

SEQ ID NO: 2914525 - DNA, 23 bp, Homo sapiens
cagcccctcctctgccacctccc

SEQ ID NO: 2914526 - DNA, 17 bp, Homo sapiens
cagcccctgctggctgg

SEQ ID NO: 2914527 - DNA, 21 bp, Homo sapiens
cagcccctggccccaggacct

SEQ ID NO: 2914528 - DNA, 15 bp, Homo sapiens
cagcccctttccaaa

SEQ ID NO: 2914529 - DNA, 23 bp, Homo sapiens
cagcccgagtggtctcctctcag

SEQ ID NO: 2914530 - DNA, 24 bp, Homo sapiens
cagcccgagtggtctcctctcagc

SEQ ID NO: 2914531 - DNA, 16 bp, Homo sapiens
cagcccgcacacctgc

SEQ ID NO: 2914532 - DNA, 15 bp, Homo sapiens
cagcccgcggcctgg

SEQ ID NO: 2914533 - DNA, 16 bp, Homo sapiens
cagcccggacctctgg

SEQ ID NO: 2914534 - DNA, 17 bp, Homo sapiens
cagcccggacctctgga

SEQ ID NO: 2914535 - DNA, 18 bp, Homo sapiens
cagcccggacctctggag

SEQ ID NO: 2914536 - DNA, 22 bp, Homo sapiens
cagcccggcggggaccttggtc

SEQ ID NO: 2914537 - DNA, 18 bp, Homo sapiens
cagcccggctcggcccag

SEQ ID NO: 2914538 - DNA, 17 bp, Homo sapiens
cagccctcatcccgagc

SEQ ID NO: 2914539 - DNA, 15 bp, Homo sapiens
cagccctccatggtc

SEQ ID NO: 2914540 - DNA, 20 bp, Homo sapiens
cagccctccccatggagcca

SEQ ID NO: 2914541 - DNA, 15 bp, Homo sapiens
cagccctccctgtcc

SEQ ID NO: 2914542 - DNA, 19 bp, Homo sapiens
cagccctccctgtcctcct

SEQ ID NO: 2914543 - DNA, 12 bp, Homo sapiens
cagccctcctca

SEQ ID NO: 2914544 - DNA, 16 bp, Homo sapiens
cagccctcctcacccc

SEQ ID NO: 2914545 - DNA, 12 bp, Homo sapiens
cagccctcctta

SEQ ID NO: 2914546 - DNA, 21 bp, Homo sapiens
cagccctccttaccactgtgg

SEQ ID NO: 2914547 - DNA, 16 bp, Homo sapiens
cagccctctgcctcct

SEQ ID NO: 2914548 - DNA, 20 bp, Homo sapiens
caggcagtgatgctggatgc

SEQ ID NO: 2914549 - DNA, 22 bp, Homo sapiens
caggcagtgatgctggatgctc

SEQ ID NO: 2914550 - DNA, 20 bp, Homo sapiens
caggcagtgtcttaaggaga

SEQ ID NO: 2914551 - DNA, 20 bp, Homo sapiens
caggcatcggggagccggga

SEQ ID NO: 2914552 - DNA, 14 bp, Homo sapiens
caggcatggccctg

SEQ ID NO: 2914553 - DNA, 15 bp, Homo sapiens
caggcatggccctgg

SEQ ID NO: 2914554 - DNA, 14 bp, Homo sapiens
caggcatggcttcc

SEQ ID NO: 2914555 - DNA, 13 bp, Homo sapiens
caggcatgtgcca

SEQ ID NO: 2914556 - DNA, 18 bp, Homo sapiens
caggccaagttaaaggct

SEQ ID NO: 2914557 - DNA, 13 bp, Homo sapiens
caggccagcccgg

SEQ ID NO: 2914558 - DNA, 12 bp, Homo sapiens
caggccagggct

SEQ ID NO: 2914559 - DNA, 15 bp, Homo sapiens
caggccagggctcct

SEQ ID NO: 2914560 - DNA, 15 bp, Homo sapiens
caggccagggctggg

SEQ ID NO: 2914561 - DNA, 18 bp, Homo sapiens
caggccagggctgggtca

SEQ ID NO: 2914562 - DNA, 19 bp, Homo sapiens
caggccagggctgggtcac

SEQ ID NO: 2914563 - DNA, 21 bp, Homo sapiens
caggccagggctgggtcacag

SEQ ID NO: 2914564 - DNA, 17 bp, Homo sapiens
caggccaggtgggcgga

SEQ ID NO: 2914565 - DNA, 19 bp, Homo sapiens
caggccatgtggcctgccc

SEQ ID NO: 2914566 - DNA, 20 bp, Homo sapiens
caggccatgtggcctgccca

SEQ ID NO: 2914567 - DNA, 24 bp, Homo sapiens
caggcccaccggatgctgtgcctg

SEQ ID NO: 2914568 - DNA, 13 bp, Homo sapiens
caggcccactcag

SEQ ID NO: 2914569 - DNA, 14 bp, Homo sapiens
caggccccaggaag

SEQ ID NO: 2914570 - DNA, 15 bp, Homo sapiens
caggccccaggaagc

SEQ ID NO: 2914571 - DNA, 18 bp, Homo sapiens
caggccccaggcagggcc

SEQ ID NO: 2914572 - DNA, 18 bp, Homo sapiens
caggcccccaccacacat

SEQ ID NO: 2914573 - DNA, 21 bp, Homo sapiens
caggcccccaccacacatccc

SEQ ID NO: 2914574 - DNA, 15 bp, Homo sapiens
caggcccctctcctc

SEQ ID NO: 2914575 - DNA, 17 bp, Homo sapiens
caggcccctctcctccg

SEQ ID NO: 2914576 - DNA, 18 bp, Homo sapiens
caggcccctctcctccgt

SEQ ID NO: 2914577 - DNA, 17 bp, Homo sapiens
caggcccgcgggcacag

SEQ ID NO: 2914578 - DNA, 18 bp, Homo sapiens
caggcccgcgggcacagc

SEQ ID NO: 2914579 - DNA, 17 bp, Homo sapiens
caggcccgtcggagctg

SEQ ID NO: 2914580 - DNA, 21 bp, Homo sapiens
caggcccgtcggagctgcctg

SEQ ID NO: 2914581 - DNA, 23 bp, Homo sapiens
caggcccgtctgtccatctgccc

SEQ ID NO: 2914582 - DNA, 12 bp, Homo sapiens
caggccctcagc

SEQ ID NO: 2914583 - DNA, 16 bp, Homo sapiens
caggccctcccaccac

SEQ ID NO: 2914584 - DNA, 23 bp, Homo sapiens
caggccctgccagtggggaagga

SEQ ID NO: 2914585 - DNA, 13 bp, Homo sapiens
caggccctggagg

SEQ ID NO: 2914586 - DNA, 14 bp, Homo sapiens
caggccctggaggg

SEQ ID NO: 2914587 - DNA, 18 bp, Homo sapiens
caggccctggagggcaga

SEQ ID NO: 2914588 - DNA, 21 bp, Homo sapiens
caggccctggagggcagagac

SEQ ID NO: 2914589 - DNA, 22 bp, Homo sapiens
caggccctggagggcagagaca

SEQ ID NO: 2914590 - DNA, 21 bp, Homo sapiens
caggccctgggtcttgccatg

SEQ ID NO: 2914591 - DNA, 14 bp, Homo sapiens
caggccctgtccag

SEQ ID NO: 2914592 - DNA, 15 bp, Homo sapiens
caggccctgtccagc

SEQ ID NO: 2914593 - DNA, 16 bp, Homo sapiens
caggccggagcccaga

SEQ ID NO: 2914594 - DNA, 16 bp, Homo sapiens
caggccgggcctgtac

SEQ ID NO: 2914595 - DNA, 15 bp, Homo sapiens
caggcctcactggct

SEQ ID NO: 2914596 - DNA, 17 bp, Homo sapiens
caggcctcactggctca

SEQ ID NO: 2914597 - DNA, 21 bp, Homo sapiens
caggcctcactggctcatgcc

SEQ ID NO: 2914598 - DNA, 14 bp, Homo sapiens
caggcctccagctc

SEQ ID NO: 2914599 - DNA, 17 bp, Homo sapiens
caggcctccagctcagc

SEQ ID NO: 2914600 - DNA, 20 bp, Homo sapiens
caggcctccctgaaacactg

SEQ ID NO: 2914601 - DNA, 22 bp, Homo sapiens
caggcctcgcacttgcagagga

SEQ ID NO: 2914602 - DNA, 16 bp, Homo sapiens
caggcctcgcctgccc

SEQ ID NO: 2914603 - DNA, 23 bp, Homo sapiens
caggcctcgcctgccctcctctc

SEQ ID NO: 2914604 - DNA, 20 bp, Homo sapiens
caggcctctcggtgctccat

SEQ ID NO: 2914605 - DNA, 12 bp, Homo sapiens
caggcctcttgg

SEQ ID NO: 2914606 - DNA, 15 bp, Homo sapiens
caggcctgccctgct

SEQ ID NO: 2914607 - DNA, 16 bp, Homo sapiens
caggcctgccctgcta

SEQ ID NO: 2914608 - DNA, 21 bp, Homo sapiens
caggcctgccttctcagggac

SEQ ID NO: 2914609 - DNA, 22 bp, Homo sapiens
caggcctgcgtgcgctggttcc

SEQ ID NO: 2914610 - DNA, 13 bp, Homo sapiens
caggcctggcgta

SEQ ID NO: 2914611 - DNA, 14 bp, Homo sapiens
caggcctggctccc

SEQ ID NO: 2914612 - DNA, 15 bp, Homo sapiens
caggcctggctcccc

SEQ ID NO: 2914613 - DNA, 16 bp, Homo sapiens
caggcctggctccccg

SEQ ID NO: 2914614 - DNA, 17 bp, Homo sapiens
caggcctggctccccga

SEQ ID NO: 2914615 - DNA, 18 bp, Homo sapiens
caggcctggctccccgag

SEQ ID NO: 2914616 - DNA, 22 bp, Homo sapiens
caggcctggctccccgagggct

SEQ ID NO: 2914617 - DNA, 20 bp, Homo sapiens
caggcctgtgtgactccatt

SEQ ID NO: 2914618 - DNA, 16 bp, Homo sapiens
caggccttgctgactc

SEQ ID NO: 2914619 - DNA, 21 bp, Homo sapiens
caggcgcctataatcccagct

SEQ ID NO: 2914620 - DNA, 14 bp, Homo sapiens
caggcgctgcaggg

SEQ ID NO: 2914621 - DNA, 16 bp, Homo sapiens
caggcgctgcagggcc

SEQ ID NO: 2914622 - DNA, 23 bp, Homo sapiens
caggcgctgcggacaccgtggcc

SEQ ID NO: 2914623 - DNA, 13 bp, Homo sapiens
caggcggccaggg

SEQ ID NO: 2914624 - DNA, 19 bp, Homo sapiens
caggcggccagggcggcca

SEQ ID NO: 2914625 - DNA, 19 bp, Homo sapiens
caggcggggggggcgcctg

SEQ ID NO: 2914626 - DNA, 23 bp, Homo sapiens
caggcggggggggcgcctggaga

SEQ ID NO: 2914627 - DNA, 18 bp, Homo sapiens
caggcgtgactcagcagc

SEQ ID NO: 2914628 - DNA, 16 bp, Homo sapiens
caggcgtgagccactg

SEQ ID NO: 2914629 - DNA, 21 bp, Homo sapiens
caggcgtgagccactgttccc

SEQ ID NO: 2914630 - DNA, 15 bp, Homo sapiens
caggcgtgtggcagc

SEQ ID NO: 2914631 - DNA, 18 bp, Homo sapiens
caggctagctggagcctg

SEQ ID NO: 2914632 - DNA, 11 bp, Homo sapiens
caggctcagag

SEQ ID NO: 2914633 - DNA, 14 bp, Homo sapiens
caggctcccaggga

SEQ ID NO: 2914634 - DNA, 16 bp, Homo sapiens
caggctcccagggaca

SEQ ID NO: 2914635 - DNA, 15 bp, Homo sapiens
caggctcccctgagg

SEQ ID NO: 2914636 - DNA, 16 bp, Homo sapiens
caggctccgggctttc

SEQ ID NO: 2914637 - DNA, 21 bp, Homo sapiens
caggctcctccctccctctgc

SEQ ID NO: 2914638 - DNA, 13 bp, Homo sapiens
caggctctcaaca

SEQ ID NO: 2914639 - DNA, 12 bp, Homo sapiens
caggctctgccc

SEQ ID NO: 2914640 - DNA, 15 bp, Homo sapiens
caggctctgcccagg

SEQ ID NO: 2914641 - DNA, 17 bp, Homo sapiens
caggctgaccacagcac

SEQ ID NO: 2914642 - DNA, 16 bp, Homo sapiens
caggctgatttctagg

SEQ ID NO: 2914643 - DNA, 18 bp, Homo sapiens
caggctgcggtgggcagc

SEQ ID NO: 2914644 - DNA, 21 bp, Homo sapiens
caggctgcggtgggcagccat

SEQ ID NO: 2914645 - DNA, 21 bp, Homo sapiens
caggctgctggggcctcagac

SEQ ID NO: 2914646 - DNA, 23 bp, Homo sapiens
caggctgctggggcctcagacga

SEQ ID NO: 2914647 - DNA, 16 bp, Homo sapiens
caggctggaatgaggg

SEQ ID NO: 2914648 - DNA, 14 bp, Homo sapiens
caggctggccagcc

SEQ ID NO: 2914649 - DNA, 17 bp, Homo sapiens
caggctggccagccgct

SEQ ID NO: 2914650 - DNA, 14 bp, Homo sapiens
caggctggccagtg

SEQ ID NO: 2914651 - DNA, 21 bp, Homo sapiens
caggctggccagtgctgccca

SEQ ID NO: 2914652 - DNA, 20 bp, Homo sapiens
caggctggctccagatgcag

SEQ ID NO: 2914653 - DNA, 12 bp, Homo sapiens
caggctgggccg

SEQ ID NO: 2914654 - DNA, 19 bp, Homo sapiens
caggctgggccgcaagggc

SEQ ID NO: 2914655 - DNA, 21 bp, Homo sapiens
caggctgggccgcaagggcct

SEQ ID NO: 2914656 - DNA, 22 bp, Homo sapiens
caggctgggctgagccaaagcc

SEQ ID NO: 2914657 - DNA, 23 bp, Homo sapiens
caggctgggtgacagagcgagac

SEQ ID NO: 2914658 - DNA, 21 bp, Homo sapiens
caggctggtccgagctgagga

SEQ ID NO: 2914659 - DNA, 18 bp, Homo sapiens
caggctggtctaaaactc

SEQ ID NO: 2914660 - DNA, 14 bp, Homo sapiens
caggctggtctcaa

SEQ ID NO: 2914661 - DNA, 22 bp, Homo sapiens
caggctggtctcgaactcctga

SEQ ID NO: 2914662 - DNA, 22 bp, Homo sapiens
caggctgtgtttggctttcagg

SEQ ID NO: 2914663 - DNA, 12 bp, Homo sapiens
caggcttcctgg

SEQ ID NO: 2914664 - DNA, 16 bp, Homo sapiens
caggcttcctggtgag

SEQ ID NO: 2914665 - DNA, 17 bp, Homo sapiens
caggcttcctggtgaga

SEQ ID NO: 2914666 - DNA, 14 bp, Homo sapiens
caggcttctcccgg

SEQ ID NO: 2914667 - DNA, 15 bp, Homo sapiens
caggcttgcctgggc

SEQ ID NO: 2914668 - DNA, 17 bp, Homo sapiens
caggcttgcctgggctg

SEQ ID NO: 2914669 - DNA, 13 bp, Homo sapiens
caggctttcccac

SEQ ID NO: 2914670 - DNA, 19 bp, Homo sapiens
cagggaaaaagaccaaatt

SEQ ID NO: 2914671 - DNA, 20 bp, Homo sapiens
cagggaaaatgcagcaggga

SEQ ID NO: 2914672 - DNA, 20 bp, Homo sapiens
cagggaaaattatttgcata

SEQ ID NO: 2914673 - DNA, 14 bp, Homo sapiens
cagggaaattaatc

SEQ ID NO: 2914674 - DNA, 17 bp, Homo sapiens
cagggaacatatttaag

SEQ ID NO: 2914675 - DNA, 16 bp, Homo sapiens
cagggaaccccagggg

SEQ ID NO: 2914676 - DNA, 14 bp, Homo sapiens
cagggaactgcttg

SEQ ID NO: 2914677 - DNA, 20 bp, Homo sapiens
cagggaagctacaggttaca

SEQ ID NO: 2914678 - DNA, 21 bp, Homo sapiens
cagggaagctacaggttacaa

SEQ ID NO: 2914679 - DNA, 13 bp, Homo sapiens
cagggaaggatcc

SEQ ID NO: 2914680 - DNA, 21 bp, Homo sapiens
cagggtttgagcacaatctgt

SEQ ID NO: 2914681 - DNA, 13 bp, Homo sapiens
caggtactgcatt

SEQ ID NO: 2914682 - DNA, 14 bp, Homo sapiens
caggtacttggagg

SEQ ID NO: 2914683 - DNA, 21 bp, Homo sapiens
caggtacttgtaaattattaa

SEQ ID NO: 2914684 - DNA, 23 bp, Homo sapiens
caggtagcagcaaatagcaaatg

SEQ ID NO: 2914685 - DNA, 20 bp, Homo sapiens
caggtagctgcccctggctc

SEQ ID NO: 2914686 - DNA, 21 bp, Homo sapiens
caggtagctgcccctggctct

SEQ ID NO: 2914687 - DNA, 22 bp, Homo sapiens
caggtagctgcccctggctctg

SEQ ID NO: 2914688 - DNA, 15 bp, Homo sapiens
caggtatgttgcctt

SEQ ID NO: 2914689 - DNA, 13 bp, Homo sapiens
caggtcaacagaa

SEQ ID NO: 2914690 - DNA, 14 bp, Homo sapiens
caggtcaacagaat

SEQ ID NO: 2914691 - DNA, 16 bp, Homo sapiens
caggtcaacagaatga

SEQ ID NO: 2914692 - DNA, 17 bp, Homo sapiens
caggtcaacagaatgaa

SEQ ID NO: 2914693 - DNA, 21 bp, Homo sapiens
caggtcaacagaatgaaaaat

SEQ ID NO: 2914694 - DNA, 22 bp, Homo sapiens
caggtcaacagaatgaaaaatg

SEQ ID NO: 2914695 - DNA, 16 bp, Homo sapiens
caggtcaataaactta

SEQ ID NO: 2914696 - DNA, 21 bp, Homo sapiens
caggtcaataaacttagagga

SEQ ID NO: 2914697 - DNA, 22 bp, Homo sapiens
caggtcaatacagtacaggcag

SEQ ID NO: 2914698 - DNA, 12 bp, Homo sapiens
caggtcactgtc

SEQ ID NO: 2914699 - DNA, 13 bp, Homo sapiens
caggtcactgtca

SEQ ID NO: 2914700 - DNA, 15 bp, Homo sapiens
caggtcactgtcact

SEQ ID NO: 2914701 - DNA, 16 bp, Homo sapiens
caggtcactgtcactg

SEQ ID NO: 2914702 - DNA, 20 bp, Homo sapiens
caggtcaggaccaggaccca

SEQ ID NO: 2914703 - DNA, 21 bp, Homo sapiens
caggtccagctttactgtggc

SEQ ID NO: 2914704 - DNA, 23 bp, Homo sapiens
caggtccagctttactgtggctg

SEQ ID NO: 2914705 - DNA, 13 bp, Homo sapiens
caggtccaggctg

SEQ ID NO: 2914706 - DNA, 13 bp, Homo sapiens
caggtcccagcga

SEQ ID NO: 2914707 - DNA, 17 bp, Homo sapiens
caggtcccagcgagcca

SEQ ID NO: 2914708 - DNA, 19 bp, Homo sapiens
caggtcccagcgagccaca

SEQ ID NO: 2914709 - DNA, 16 bp, Homo sapiens
caggtccccctgcagc

SEQ ID NO: 2914710 - DNA, 19 bp, Homo sapiens
caggtcctagtcgggcagg

SEQ ID NO: 2914711 - DNA, 21 bp, Homo sapiens
caggtcctgctccgctgcctg

SEQ ID NO: 2914712 - DNA, 22 bp, Homo sapiens
caggtcctgctccgctgcctgg

SEQ ID NO: 2914713 - DNA, 23 bp, Homo sapiens
caggtcctgctccgctgcctgga

SEQ ID NO: 2914714 - DNA, 15 bp, Homo sapiens
caggtcgttcttatc

SEQ ID NO: 2914715 - DNA, 13 bp, Homo sapiens
caggtctcccggg

SEQ ID NO: 2914716 - DNA, 15 bp, Homo sapiens
caggtctctgagaca

SEQ ID NO: 2914717 - DNA, 15 bp, Homo sapiens
caggtctctgtttag

SEQ ID NO: 2914718 - DNA, 19 bp, Homo sapiens
caggtctgcaagggcccag

SEQ ID NO: 2914719 - DNA, 20 bp, Homo sapiens
caggtctgcaagggcccaga

SEQ ID NO: 2914720 - DNA, 16 bp, Homo sapiens
caggtgaaacccagtc

SEQ ID NO: 2914721 - DNA, 20 bp, Homo sapiens
caggtgaataataaaatcaa

SEQ ID NO: 2914722 - DNA, 15 bp, Homo sapiens
caggtgcagaggaag

SEQ ID NO: 2914723 - DNA, 16 bp, Homo sapiens
caggtgcagaggtacc

SEQ ID NO: 2914724 - DNA, 15 bp, Homo sapiens
caggtgcagccagag

SEQ ID NO: 2914725 - DNA, 14 bp, Homo sapiens
caggtgcctttcaa

SEQ ID NO: 2914726 - DNA, 14 bp, Homo sapiens
caggtgcggcctgg

SEQ ID NO: 2914727 - DNA, 14 bp, Homo sapiens
caggtgcgggacca

SEQ ID NO: 2914728 - DNA, 21 bp, Homo sapiens
caggtgctacacccttttcca

SEQ ID NO: 2914729 - DNA, 20 bp, Homo sapiens
caggtgctgacttcatctcc

SEQ ID NO: 2914730 - DNA, 15 bp, Homo sapiens
caggtgctggcccag

SEQ ID NO: 2914731 - DNA, 19 bp, Homo sapiens
caggtgctggcccagcatg

SEQ ID NO: 2914732 - DNA, 20 bp, Homo sapiens
caggtgctggcccagcatgg

SEQ ID NO: 2914733 - DNA, 21 bp, Homo sapiens
caggtgctggcccagcatgga

SEQ ID NO: 2914734 - DNA, 22 bp, Homo sapiens
caggtgctggcccagcatggaa

SEQ ID NO: 2914735 - DNA, 17 bp, Homo sapiens
caggtggccgcccctga

SEQ ID NO: 2914736 - DNA, 15 bp, Homo sapiens
caggtggcctctgct

SEQ ID NO: 2914737 - DNA, 18 bp, Homo sapiens
caggtggcctctgctggt

SEQ ID NO: 2914738 - DNA, 15 bp, Homo sapiens
caggtggctattttg

SEQ ID NO: 2914739 - DNA, 19 bp, Homo sapiens
caggtggggagactgggct

SEQ ID NO: 2914740 - DNA, 21 bp, Homo sapiens
caggtggtggctgcaaggtgg

SEQ ID NO: 2914741 - DNA, 18 bp, Homo sapiens
caggtggtgtcactgtcc

SEQ ID NO: 2914742 - DNA, 17 bp, Homo sapiens
caggtggtgtccttctt

SEQ ID NO: 2914743 - DNA, 17 bp, Homo sapiens
caggtgtagctgagctg

SEQ ID NO: 2914744 - DNA, 23 bp, Homo sapiens
caggtgtagctgagctgtgacat

SEQ ID NO: 2914745 - DNA, 22 bp, Homo sapiens
caggtgttactgtaattcctca

SEQ ID NO: 2914746 - DNA, 14 bp, Homo sapiens
caggtgtttttcca

SEQ ID NO: 2914747 - DNA, 11 bp, Homo sapiens
caggttacaac

SEQ ID NO: 2914748 - DNA, 12 bp, Homo sapiens
caggttacaaca

SEQ ID NO: 2914749 - DNA, 15 bp, Homo sapiens
caggttacaacagat

SEQ ID NO: 2914750 - DNA, 21 bp, Homo sapiens
caggttacaacagatttgtga

SEQ ID NO: 2914751 - DNA, 14 bp, Homo sapiens
caggttagaagaac

SEQ ID NO: 2914752 - DNA, 11 bp, Homo sapiens
caggttagaga

SEQ ID NO: 2914753 - DNA, 18 bp, Homo sapiens
caggttaggaaggcagca

SEQ ID NO: 2914754 - DNA, 14 bp, Homo sapiens
caggttattttagt

SEQ ID NO: 2914755 - DNA, 16 bp, Homo sapiens
caggttattttagttt

SEQ ID NO: 2914756 - DNA, 17 bp, Homo sapiens
caggttcacagcagctt

SEQ ID NO: 2914757 - DNA, 18 bp, Homo sapiens
caggttcacagcagcttt

SEQ ID NO: 2914758 - DNA, 16 bp, Homo sapiens
caggttcagtattatg

SEQ ID NO: 2914759 - DNA, 15 bp, Homo sapiens
caggttcccaagctc

SEQ ID NO: 2914760 - DNA, 16 bp, Homo sapiens
caggttctatttggaa

SEQ ID NO: 2914761 - DNA, 17 bp, Homo sapiens
caggttctatttggaat

SEQ ID NO: 2914762 - DNA, 17 bp, Homo sapiens
caggttctctctcactg

SEQ ID NO: 2914763 - DNA, 16 bp, Homo sapiens
caggttggaaaagaaa

SEQ ID NO: 2914764 - DNA, 19 bp, Homo sapiens
caggttggaaaagaaatca

SEQ ID NO: 2914765 - DNA, 19 bp, Homo sapiens
caggttggcaaacgggctt

SEQ ID NO: 2914766 - DNA, 21 bp, Homo sapiens
caggttggcaaacgggcttga

SEQ ID NO: 2914767 - DNA, 18 bp, Homo sapiens
caggttggcttttttccc

SEQ ID NO: 2914768 - DNA, 15 bp, Homo sapiens
caggtttgggacccc

SEQ ID NO: 2914769 - DNA, 18 bp, Homo sapiens
caggtttgggacccctgg

SEQ ID NO: 2914770 - DNA, 23 bp, Homo sapiens
caggtttgggacccctggtggtt

SEQ ID NO: 2914771 - DNA, 20 bp, Homo sapiens
caggttttcttctaatcata

SEQ ID NO: 2914772 - DNA, 12 bp, Homo sapiens
cagtaaatcttt

SEQ ID NO: 2914773 - DNA, 19 bp, Homo sapiens
cagtaactgtccctgcttt

SEQ ID NO: 2914774 - DNA, 21 bp, Homo sapiens
cagtaactgtccctgctttct

SEQ ID NO: 2914775 - DNA, 17 bp, Homo sapiens
cagtaactttatgtgta

SEQ ID NO: 2914776 - DNA, 19 bp, Homo sapiens
cagtaactttatgtgtaaa

SEQ ID NO: 2914777 - DNA, 18 bp, Homo sapiens
cagtaagtataacaaact

SEQ ID NO: 2914778 - DNA, 19 bp, Homo sapiens
cagtaagtataacaaacta

SEQ ID NO: 2914779 - DNA, 17 bp, Homo sapiens
cagtaatagcactgcca

SEQ ID NO: 2914780 - DNA, 20 bp, Homo sapiens
cagtaattattatttaactc

SEQ ID NO: 2914781 - DNA, 12 bp, Homo sapiens
cagtacaggcag

SEQ ID NO: 2914782 - DNA, 13 bp, Homo sapiens
cagtacaggcagc

SEQ ID NO: 2914783 - DNA, 16 bp, Homo sapiens
cagtacaggcagcaca

SEQ ID NO: 2914784 - DNA, 23 bp, Homo sapiens
cagtacctgtgcctgagaattta

SEQ ID NO: 2914785 - DNA, 18 bp, Homo sapiens
cagtactaaggtgacttt

SEQ ID NO: 2914786 - DNA, 18 bp, Homo sapiens
cagtacttcagcaagaga

SEQ ID NO: 2914787 - DNA, 23 bp, Homo sapiens
cagtacttttttaaatattttct

SEQ ID NO: 2914788 - DNA, 21 bp, Homo sapiens
cagtagacattttaacaagaa

SEQ ID NO: 2914789 - DNA, 21 bp, Homo sapiens
cagtagagtagggtagaagga

SEQ ID NO: 2914790 - DNA, 24 bp, Homo sapiens
cagtagagtagggtagaaggaaag

SEQ ID NO: 2914791 - DNA, 16 bp, Homo sapiens
cagtagcatctcagtg

SEQ ID NO: 2914792 - DNA, 20 bp, Homo sapiens
cagtagcattgaagtgtttg

SEQ ID NO: 2914793 - DNA, 17 bp, Homo sapiens
cagtagcttaagggaat

SEQ ID NO: 2914794 - DNA, 12 bp, Homo sapiens
cagtaggagccc

SEQ ID NO: 2914795 - DNA, 22 bp, Homo sapiens
cagtaggttatttagcttggga

SEQ ID NO: 2914796 - DNA, 17 bp, Homo sapiens
cagtagtaccttgtttt

SEQ ID NO: 2914797 - DNA, 15 bp, Homo sapiens
cagtagtgtttggaa

SEQ ID NO: 2914798 - DNA, 23 bp, Homo sapiens
cagtagtgtttggaattttctgt

SEQ ID NO: 2914799 - DNA, 17 bp, Homo sapiens
cagtatcatgccctgtg

SEQ ID NO: 2914800 - DNA, 23 bp, Homo sapiens
cagtatcctgctggttcactcta

SEQ ID NO: 2914801 - DNA, 16 bp, Homo sapiens
cagtatctatatatgt

SEQ ID NO: 2914802 - DNA, 17 bp, Homo sapiens
cagtatgcttgctctaa

SEQ ID NO: 2914803 - DNA, 17 bp, Homo sapiens
cagtatggtacattttt

SEQ ID NO: 2914804 - DNA, 14 bp, Homo sapiens
cagtattaaactct

SEQ ID NO: 2914805 - DNA, 16 bp, Homo sapiens
cagtattactgctgct

SEQ ID NO: 2914806 - DNA, 18 bp, Homo sapiens
cagtattactgctgctgt

SEQ ID NO: 2914807 - DNA, 19 bp, Homo sapiens
cagtattactgctgctgtg

SEQ ID NO: 2914808 - DNA, 12 bp, Homo sapiens
cagtattatgta

SEQ ID NO: 2914809 - DNA, 14 bp, Homo sapiens
cagtattttctgtt

SEQ ID NO: 2914810 - DNA, 22 bp, Homo sapiens
cagtatttttcagatataaata

SEQ ID NO: 2914811 - DNA, 16 bp, Homo sapiens
cagtcaaatctgggct

SEQ ID NO: 2914812 - DNA, 14 bp, Homo sapiens
catcactgtatacc

SEQ ID NO: 2914813 - DNA, 14 bp, Homo sapiens
catcactgttcatg

SEQ ID NO: 2914814 - DNA, 20 bp, Homo sapiens
catcagaagtaactcccact

SEQ ID NO: 2914815 - DNA, 23 bp, Homo sapiens
catcagaagtaactcccactcct

SEQ ID NO: 2914816 - DNA, 14 bp, Homo sapiens
catcagagggctga

SEQ ID NO: 2914817 - DNA, 17 bp, Homo sapiens
catcagaggggagcagc

SEQ ID NO: 2914818 - DNA, 17 bp, Homo sapiens
catcagcactttaccag

SEQ ID NO: 2914819 - DNA, 22 bp, Homo sapiens
catcagcactttaccagaggca

SEQ ID NO: 2914820 - DNA, 16 bp, Homo sapiens
catcagcatgttttct

SEQ ID NO: 2914821 - DNA, 14 bp, Homo sapiens
catcagccagctgc

SEQ ID NO: 2914822 - DNA, 15 bp, Homo sapiens
catcagccagctgcc

SEQ ID NO: 2914823 - DNA, 20 bp, Homo sapiens
catcagctaaacaccacgtc

SEQ ID NO: 2914824 - DNA, 22 bp, Homo sapiens
catcagctgtctgtcatctgct

SEQ ID NO: 2914825 - DNA, 18 bp, Homo sapiens
catcaggaagcctgtggt

SEQ ID NO: 2914826 - DNA, 14 bp, Homo sapiens
catcaggagactgg

SEQ ID NO: 2914827 - DNA, 19 bp, Homo sapiens
catcaggagttccagtgct

SEQ ID NO: 2914828 - DNA, 20 bp, Homo sapiens
catcaggatactcaaagtgg

SEQ ID NO: 2914829 - DNA, 18 bp, Homo sapiens
catcaggtcccccccagg

SEQ ID NO: 2914830 - DNA, 19 bp, Homo sapiens
catcaggtcccccccaggt

SEQ ID NO: 2914831 - DNA, 15 bp, Homo sapiens
catcagtgccagccc

SEQ ID NO: 2914832 - DNA, 15 bp, Homo sapiens
catcagtgctccctc

SEQ ID NO: 2914833 - DNA, 24 bp, Homo sapiens
catcagtgctccctcacatgtcag

SEQ ID NO: 2914834 - DNA, 19 bp, Homo sapiens
catcatagaacagaaatat

SEQ ID NO: 2914835 - DNA, 22 bp, Homo sapiens
catcatagcaagacctcatctc

SEQ ID NO: 2914836 - DNA, 22 bp, Homo sapiens
catcatattaaaaatatacaag

SEQ ID NO: 2914837 - DNA, 13 bp, Homo sapiens
catcatccctccc

SEQ ID NO: 2914838 - DNA, 21 bp, Homo sapiens
catcatcctttgttctgagca

SEQ ID NO: 2914839 - DNA, 14 bp, Homo sapiens
catcatctctgcct

SEQ ID NO: 2914840 - DNA, 16 bp, Homo sapiens
catcatctctgccttt

SEQ ID NO: 2914841 - DNA, 13 bp, Homo sapiens
catcatctgctgc

SEQ ID NO: 2914842 - DNA, 15 bp, Homo sapiens
catcatgaactggct

SEQ ID NO: 2914843 - DNA, 23 bp, Homo sapiens
catcatgaactggcttgtacatt

SEQ ID NO: 2914844 - DNA, 16 bp, Homo sapiens
catcatgcatcttact

SEQ ID NO: 2914845 - DNA, 22 bp, Homo sapiens
catcatgctggaacctgcaaaa

SEQ ID NO: 2914846 - DNA, 10 bp, Homo sapiens
catcattaga

SEQ ID NO: 2914847 - DNA, 22 bp, Homo sapiens
catcattctctgtctcatccat

SEQ ID NO: 2914848 - DNA, 24 bp, Homo sapiens
catcattctctgtctcatccatca

SEQ ID NO: 2914849 - DNA, 18 bp, Homo sapiens
catcattgctgtctgcag

SEQ ID NO: 2914850 - DNA, 12 bp, Homo sapiens
catcattggata

SEQ ID NO: 2914851 - DNA, 18 bp, Homo sapiens
catcattgtccccatgca

SEQ ID NO: 2914852 - DNA, 22 bp, Homo sapiens
catcatttaaaaaaaaagaatt

SEQ ID NO: 2914853 - DNA, 14 bp, Homo sapiens
catcatttcagcca

SEQ ID NO: 2914854 - DNA, 15 bp, Homo sapiens
catcatttcagccaa

SEQ ID NO: 2914855 - DNA, 16 bp, Homo sapiens
catcatttcagccaaa

SEQ ID NO: 2914856 - DNA, 21 bp, Homo sapiens
catcatttcagccaaagtcct

SEQ ID NO: 2914857 - DNA, 17 bp, Homo sapiens
catccaaagcagacagc

SEQ ID NO: 2914858 - DNA, 18 bp, Homo sapiens
catccaaagcagacagct

SEQ ID NO: 2914859 - DNA, 14 bp, Homo sapiens
catccaatgctcaa

SEQ ID NO: 2914860 - DNA, 18 bp, Homo sapiens
catccacattgttttaaa

SEQ ID NO: 2914861 - DNA, 20 bp, Homo sapiens
catccagaactgctaccttc

SEQ ID NO: 2914862 - DNA, 12 bp, Homo sapiens
catccagacagt

SEQ ID NO: 2914863 - DNA, 18 bp, Homo sapiens
catccagagtccctgcct

SEQ ID NO: 2914864 - DNA, 21 bp, Homo sapiens
catccagagtccctgcctgga

SEQ ID NO: 2914865 - DNA, 17 bp, Homo sapiens
catccagcagtctctgc

SEQ ID NO: 2914866 - DNA, 20 bp, Homo sapiens
catccaggccagggctcctg

SEQ ID NO: 2914867 - DNA, 22 bp, Homo sapiens
catccaggccagggctcctgtg

SEQ ID NO: 2914868 - DNA, 21 bp, Homo sapiens
catccagggcccccatctcat

SEQ ID NO: 2914869 - DNA, 16 bp, Homo sapiens
catccagggctgccag

SEQ ID NO: 2914870 - DNA, 14 bp, Homo sapiens
catccataaagaag

SEQ ID NO: 2914871 - DNA, 16 bp, Homo sapiens
catccatagtagtatg

SEQ ID NO: 2914872 - DNA, 19 bp, Homo sapiens
catccatgttccgagaaga

SEQ ID NO: 2914873 - DNA, 18 bp, Homo sapiens
catccattcctcagggac

SEQ ID NO: 2914874 - DNA, 19 bp, Homo sapiens
catccattcctcagggaca

SEQ ID NO: 2914875 - DNA, 21 bp, Homo sapiens
catccattgtgttctctttaa

SEQ ID NO: 2914876 - DNA, 15 bp, Homo sapiens
catcccaagcccagt

SEQ ID NO: 2914877 - DNA, 17 bp, Homo sapiens
catcccaagcccagtga

SEQ ID NO: 2914878 - DNA, 15 bp, Homo sapiens
catcccacaagtggt

SEQ ID NO: 2914879 - DNA, 17 bp, Homo sapiens
catcccagacaggtccc

SEQ ID NO: 2914880 - DNA, 12 bp, Homo sapiens
catcccagcctt

SEQ ID NO: 2914881 - DNA, 20 bp, Homo sapiens
catcccagtagtgtttggaa

SEQ ID NO: 2914882 - DNA, 21 bp, Homo sapiens
catcccagtagtgtttggaat

SEQ ID NO: 2914883 - DNA, 22 bp, Homo sapiens
catcccagtagtgtttggaatt

SEQ ID NO: 2914884 - DNA, 16 bp, Homo sapiens
catcccatgtaacaga

SEQ ID NO: 2914885 - DNA, 17 bp, Homo sapiens
catcccatgtaacagaa

SEQ ID NO: 2914886 - DNA, 13 bp, Homo sapiens
catcccattgccc

SEQ ID NO: 2914887 - DNA, 15 bp, Homo sapiens
catcccattgccctg

SEQ ID NO: 2914888 - DNA, 17 bp, Homo sapiens
catcccattgccctggt

SEQ ID NO: 2914889 - DNA, 20 bp, Homo sapiens
catccccacgacccctgcct

SEQ ID NO: 2914890 - DNA, 13 bp, Homo sapiens
catccccagagcc

SEQ ID NO: 2914891 - DNA, 14 bp, Homo sapiens
catccccagagccc

SEQ ID NO: 2914892 - DNA, 16 bp, Homo sapiens
catccccagagcccag

SEQ ID NO: 2914893 - DNA, 21 bp, Homo sapiens
catccccatcggccctgtccc

SEQ ID NO: 2914894 - DNA, 16 bp, Homo sapiens
catccccctctcacgc

SEQ ID NO: 2914895 - DNA, 18 bp, Homo sapiens
catccccctctcacgcca

SEQ ID NO: 2914896 - DNA, 19 bp, Homo sapiens
catcccgcgcgcccttcct

SEQ ID NO: 2914897 - DNA, 23 bp, Homo sapiens
catcccgcttagcgctctggaca

SEQ ID NO: 2914898 - DNA, 20 bp, Homo sapiens
catcccggctgaccctgtgc

SEQ ID NO: 2914899 - DNA, 21 bp, Homo sapiens
catcccggctgaccctgtgcc

SEQ ID NO: 2914900 - DNA, 21 bp, Homo sapiens
catccctgccagctcttctgc

SEQ ID NO: 2914901 - DNA, 14 bp, Homo sapiens
catccgcagactgc

SEQ ID NO: 2914902 - DNA, 20 bp, Homo sapiens
catccgcaggtgctggtccc

SEQ ID NO: 2914903 - DNA, 17 bp, Homo sapiens
catccgcgtgtgcctgt

SEQ ID NO: 2914904 - DNA, 16 bp, Homo sapiens
catccgtagttccctg

SEQ ID NO: 2914905 - DNA, 14 bp, Homo sapiens
catcctaaatattg

SEQ ID NO: 2914906 - DNA, 15 bp, Homo sapiens
catcctaccccctgt

SEQ ID NO: 2914907 - DNA, 18 bp, Homo sapiens
catcctccacgttctgct

SEQ ID NO: 2914908 - DNA, 13 bp, Homo sapiens
catcctccagcag

SEQ ID NO: 2914909 - DNA, 16 bp, Homo sapiens
catcctccagcaggga

SEQ ID NO: 2914910 - DNA, 14 bp, Homo sapiens
catcctccagccct

SEQ ID NO: 2914911 - DNA, 19 bp, Homo sapiens
catcctccagtaccttgct

SEQ ID NO: 2914912 - DNA, 18 bp, Homo sapiens
catcctccccaccagagc

SEQ ID NO: 2914913 - DNA, 19 bp, Homo sapiens
catcctccccaccagagct

SEQ ID NO: 2914914 - DNA, 21 bp, Homo sapiens
catcctccccaccagagctgc

SEQ ID NO: 2914915 - DNA, 19 bp, Homo sapiens
catcctcctctccatgcaa

SEQ ID NO: 2914916 - DNA, 15 bp, Homo sapiens
catcctgaacagcat

SEQ ID NO: 2914917 - DNA, 13 bp, Homo sapiens
catcctgacctgc

SEQ ID NO: 2914918 - DNA, 17 bp, Homo sapiens
catcctggctggagaat

SEQ ID NO: 2914919 - DNA, 16 bp, Homo sapiens
catcctgttggctgct

SEQ ID NO: 2914920 - DNA, 17 bp, Homo sapiens
catcctgtttgtatgaa

SEQ ID NO: 2914921 - DNA, 20 bp, Homo sapiens
catcctgtttgtatgaaatt

SEQ ID NO: 2914922 - DNA, 22 bp, Homo sapiens
catccttcccaagaagagagaa

SEQ ID NO: 2914923 - DNA, 22 bp, Homo sapiens
catccttccctgtctgccaggg

SEQ ID NO: 2914924 - DNA, 14 bp, Homo sapiens
catccttgcctgtc

SEQ ID NO: 2914925 - DNA, 15 bp, Homo sapiens
catccttgcctgtct

SEQ ID NO: 2914926 - DNA, 16 bp, Homo sapiens
catccttgcctgtcta

SEQ ID NO: 2914927 - DNA, 16 bp, Homo sapiens
catccttggtgctctt

SEQ ID NO: 2914928 - DNA, 15 bp, Homo sapiens
catcctttgttctga

SEQ ID NO: 2914929 - DNA, 18 bp, Homo sapiens
catcctttgttctgagca

SEQ ID NO: 2914930 - DNA, 14 bp, Homo sapiens
catcctttttctgc

SEQ ID NO: 2914931 - DNA, 18 bp, Homo sapiens
catcgacccccaagggac

SEQ ID NO: 2914932 - DNA, 13 bp, Homo sapiens
catcggccctgtc

SEQ ID NO: 2914933 - DNA, 16 bp, Homo sapiens
catcggccctgtcccc

SEQ ID NO: 2914934 - DNA, 22 bp, Homo sapiens
catcgtattaaaaaacaattaa

SEQ ID NO: 2914935 - DNA, 15 bp, Homo sapiens
catcgttccccaccc

SEQ ID NO: 2914936 - DNA, 22 bp, Homo sapiens
catcgttttcttcactgtcctc

SEQ ID NO: 2914937 - DNA, 18 bp, Homo sapiens
catctaacctcatcttct

SEQ ID NO: 2914938 - DNA, 19 bp, Homo sapiens
catctaacctcatcttctt

SEQ ID NO: 2914939 - DNA, 16 bp, Homo sapiens
catctaagcctgaagg

SEQ ID NO: 2914940 - DNA, 20 bp, Homo sapiens
catctaagttataagactct

SEQ ID NO: 2914941 - DNA, 17 bp, Homo sapiens
catctactctggaccaa

SEQ ID NO: 2914942 - DNA, 23 bp, Homo sapiens
catctactctggaccaaggagca

SEQ ID NO: 2914943 - DNA, 16 bp, Homo sapiens
catctactcttttgaa

SEQ ID NO: 2914944 - DNA, 23 bp, Homo sapiens
cattgctgctccttagctgccaa

SEQ ID NO: 2914945 - DNA, 16 bp, Homo sapiens
cattgctgtctgcagc

SEQ ID NO: 2914946 - DNA, 17 bp, Homo sapiens
cattgctgttctacttt

SEQ ID NO: 2914947 - DNA, 16 bp, Homo sapiens
cattggaagcctcaaa

SEQ ID NO: 2914948 - DNA, 20 bp, Homo sapiens
cattggattctgagagctgt

SEQ ID NO: 2914949 - DNA, 20 bp, Homo sapiens
cattggctatataaaatgtg

SEQ ID NO: 2914950 - DNA, 19 bp, Homo sapiens
cattgggtctattccagct

SEQ ID NO: 2914951 - DNA, 20 bp, Homo sapiens
cattgggtctattccagctc

SEQ ID NO: 2914952 - DNA, 14 bp, Homo sapiens
cattggtccaagat

SEQ ID NO: 2914953 - DNA, 17 bp, Homo sapiens
cattggttaaaatatta

SEQ ID NO: 2914954 - DNA, 18 bp, Homo sapiens
cattgtaaataaattttg

SEQ ID NO: 2914955 - DNA, 22 bp, Homo sapiens
cattgtaaataaattttgtgca

SEQ ID NO: 2914956 - DNA, 15 bp, Homo sapiens
cattgtaattatgta

SEQ ID NO: 2914957 - DNA, 19 bp, Homo sapiens
cattgtaattatgtaaata

SEQ ID NO: 2914958 - DNA, 21 bp, Homo sapiens
cattgtaattatgtaaataac

SEQ ID NO: 2914959 - DNA, 21 bp, Homo sapiens
cattgtatcgatgttatgtaa

SEQ ID NO: 2914960 - DNA, 14 bp, Homo sapiens
cattgtccctctgc

SEQ ID NO: 2914961 - DNA, 22 bp, Homo sapiens
cattgtcgtataggcatgtaaa

SEQ ID NO: 2914962 - DNA, 19 bp, Homo sapiens
cattgtctcctatatattt

SEQ ID NO: 2914963 - DNA, 11 bp, Homo sapiens
cattgtcttta

SEQ ID NO: 2914964 - DNA, 18 bp, Homo sapiens
cattgtgaactgacaggc

SEQ ID NO: 2914965 - DNA, 19 bp, Homo sapiens
cattgtgcttggcccctgg

SEQ ID NO: 2914966 - DNA, 15 bp, Homo sapiens
cattgttattttcag

SEQ ID NO: 2914967 - DNA, 19 bp, Homo sapiens
cattgttattttcagtgat

SEQ ID NO: 2914968 - DNA, 19 bp, Homo sapiens
cattgttcacctttgtagc

SEQ ID NO: 2914969 - DNA, 18 bp, Homo sapiens
cattgtttagaaagaata

SEQ ID NO: 2914970 - DNA, 21 bp, Homo sapiens
cattgtttgaaacaaagaagg

SEQ ID NO: 2914971 - DNA, 23 bp, Homo sapiens
cattgttttaaaaagaaacaaga

SEQ ID NO: 2914972 - DNA, 23 bp, Homo sapiens
catttaaaatgtaaactcttcac

SEQ ID NO: 2914973 - DNA, 19 bp, Homo sapiens
catttaaacaagtatttta

SEQ ID NO: 2914974 - DNA, 20 bp, Homo sapiens
catttaaatacagtcttcca

SEQ ID NO: 2914975 - DNA, 11 bp, Homo sapiens
catttaaatcc

SEQ ID NO: 2914976 - DNA, 23 bp, Homo sapiens
catttaaattttaccctttagac

SEQ ID NO: 2914977 - DNA, 17 bp, Homo sapiens
catttaataactttgct

SEQ ID NO: 2914978 - DNA, 19 bp, Homo sapiens
catttaataactttgctgg

SEQ ID NO: 2914979 - DNA, 17 bp, Homo sapiens
catttacaccacacttt

SEQ ID NO: 2914980 - DNA, 20 bp, Homo sapiens
catttacatgtattatttca

SEQ ID NO: 2914981 - DNA, 15 bp, Homo sapiens
catttaccaacatgt

SEQ ID NO: 2914982 - DNA, 19 bp, Homo sapiens
catttaccaacatgtatct

SEQ ID NO: 2914983 - DNA, 20 bp, Homo sapiens
catttaccagcaacttgaac

SEQ ID NO: 2914984 - DNA, 17 bp, Homo sapiens
catttacctctaaattt

SEQ ID NO: 2914985 - DNA, 22 bp, Homo sapiens
catttactgatcatctgctgtg

SEQ ID NO: 2914986 - DNA, 14 bp, Homo sapiens
catttacttaggac

SEQ ID NO: 2914987 - DNA, 22 bp, Homo sapiens
catttagaacgagcctggaagc

SEQ ID NO: 2914988 - DNA, 15 bp, Homo sapiens
catttagaagcctga

SEQ ID NO: 2914989 - DNA, 20 bp, Homo sapiens
catttagattgaaaactttt

SEQ ID NO: 2914990 - DNA, 22 bp, Homo sapiens
catttagctaaacggattccaa

SEQ ID NO: 2914991 - DNA, 13 bp, Homo sapiens
catttaggagaag

SEQ ID NO: 2914992 - DNA, 16 bp, Homo sapiens
catttaggagaagttg

SEQ ID NO: 2914993 - DNA, 21 bp, Homo sapiens
catttagtctctttattccta

SEQ ID NO: 2914994 - DNA, 23 bp, Homo sapiens
catttagtctctttattcctagt

SEQ ID NO: 2914995 - DNA, 17 bp, Homo sapiens
catttagtttgattatt

SEQ ID NO: 2914996 - DNA, 15 bp, Homo sapiens
catttatatattgtc

SEQ ID NO: 2914997 - DNA, 17 bp, Homo sapiens
catttatattaaataac

SEQ ID NO: 2914998 - DNA, 14 bp, Homo sapiens
catttatgtagaca

SEQ ID NO: 2914999 - DNA, 18 bp, Homo sapiens
catttatgtgtcagttca

SEQ ID NO: 2915000 - DNA, 13 bp, Homo sapiens
catttattttatg

SEQ ID NO: 2915001 - DNA, 14 bp, Homo sapiens
catttattttatga

SEQ ID NO: 2915002 - DNA, 15 bp, Homo sapiens
catttattttatgag

SEQ ID NO: 2915003 - DNA, 19 bp, Homo sapiens
catttattttatgagaaat

SEQ ID NO: 2915004 - DNA, 18 bp, Homo sapiens
catttatttttagccatt

SEQ ID NO: 2915005 - DNA, 15 bp, Homo sapiens
catttcaaaattaat

SEQ ID NO: 2915006 - DNA, 16 bp, Homo sapiens
catttcaaagccctgc

SEQ ID NO: 2915007 - DNA, 20 bp, Homo sapiens
catttcaaagccctgcctct

SEQ ID NO: 2915008 - DNA, 19 bp, Homo sapiens
catttcaaatctgtagcat

SEQ ID NO: 2915009 - DNA, 18 bp, Homo sapiens
catttcaattcctggccc

SEQ ID NO: 2915010 - DNA, 16 bp, Homo sapiens
catttcacattgaatc

SEQ ID NO: 2915011 - DNA, 17 bp, Homo sapiens
catttcacattgaatca

SEQ ID NO: 2915012 - DNA, 12 bp, Homo sapiens
catttcagccaa

SEQ ID NO: 2915013 - DNA, 14 bp, Homo sapiens
catttcagccaaag

SEQ ID NO: 2915014 - DNA, 15 bp, Homo sapiens
catttcatcctgttg

SEQ ID NO: 2915015 - DNA, 15 bp, Homo sapiens
catttcatgtatagt

SEQ ID NO: 2915016 - DNA, 19 bp, Homo sapiens
catttccacaccaagcagc

SEQ ID NO: 2915017 - DNA, 14 bp, Homo sapiens
catttcccacatct

SEQ ID NO: 2915018 - DNA, 19 bp, Homo sapiens
catttccgttttgcctgtg

SEQ ID NO: 2915019 - DNA, 12 bp, Homo sapiens
catttcctaatg

SEQ ID NO: 2915020 - DNA, 19 bp, Homo sapiens
catttcctatgtaactgca

SEQ ID NO: 2915021 - DNA, 14 bp, Homo sapiens
catttcctcacgtg

SEQ ID NO: 2915022 - DNA, 22 bp, Homo sapiens
catttcgggaagggcatgcacg

SEQ ID NO: 2915023 - DNA, 21 bp, Homo sapiens
catttcggtggctagtcaagc

SEQ ID NO: 2915024 - DNA, 12 bp, Homo sapiens
catttctaaaat

SEQ ID NO: 2915025 - DNA, 22 bp, Homo sapiens
catttctaccaaggcatatcat

SEQ ID NO: 2915026 - DNA, 14 bp, Homo sapiens
catttctataaata

SEQ ID NO: 2915027 - DNA, 20 bp, Homo sapiens
catttctatgccatttttag

SEQ ID NO: 2915028 - DNA, 12 bp, Homo sapiens
catttctcatgt

SEQ ID NO: 2915029 - DNA, 21 bp, Homo sapiens
catttctcatgttttccattg

SEQ ID NO: 2915030 - DNA, 16 bp, Homo sapiens
catttctttcttccat

SEQ ID NO: 2915031 - DNA, 24 bp, Homo sapiens
catttctttcttccattccttcat

SEQ ID NO: 2915032 - DNA, 18 bp, Homo sapiens
catttctttgtgctttgg

SEQ ID NO: 2915033 - DNA, 15 bp, Homo sapiens
catttgaaagaaagg

SEQ ID NO: 2915034 - DNA, 17 bp, Homo sapiens
catttgattaacatttg

SEQ ID NO: 2915035 - DNA, 15 bp, Homo sapiens
catttgatttaaaca

SEQ ID NO: 2915036 - DNA, 16 bp, Homo sapiens
catttgatttgtttag

SEQ ID NO: 2915037 - DNA, 22 bp, Homo sapiens
catttgcacaaacttgtgagca

SEQ ID NO: 2915038 - DNA, 20 bp, Homo sapiens
catttgcagggtcctcttct

SEQ ID NO: 2915039 - DNA, 21 bp, Homo sapiens
catttgcgaatggttccattc

SEQ ID NO: 2915040 - DNA, 17 bp, Homo sapiens
catttgctggcctggca

SEQ ID NO: 2915041 - DNA, 18 bp, Homo sapiens
catttgctggcctggcag

SEQ ID NO: 2915042 - DNA, 19 bp, Homo sapiens
catttgctggcctggcagg

SEQ ID NO: 2915043 - DNA, 18 bp, Homo sapiens
catttggaaccaaagtct

SEQ ID NO: 2915044 - DNA, 18 bp, Homo sapiens
catttggaatgcacacag

SEQ ID NO: 2915045 - DNA, 20 bp, Homo sapiens
catttggaattagtggattt

SEQ ID NO: 2915046 - DNA, 17 bp, Homo sapiens
catttggaatttttgct

SEQ ID NO: 2915047 - DNA, 23 bp, Homo sapiens
catttggagctcttgggtcagag

SEQ ID NO: 2915048 - DNA, 23 bp, Homo sapiens
catttggattggggtccctctaa

SEQ ID NO: 2915049 - DNA, 12 bp, Homo sapiens
catttggcagaa

SEQ ID NO: 2915050 - DNA, 20 bp, Homo sapiens
catttggcagaactgctggg

SEQ ID NO: 2915051 - DNA, 23 bp, Homo sapiens
catttggcagaactgctggggct

SEQ ID NO: 2915052 - DNA, 16 bp, Homo sapiens
catttggccccagggg

SEQ ID NO: 2915053 - DNA, 16 bp, Homo sapiens
catttggttcattaat

SEQ ID NO: 2915054 - DNA, 20 bp, Homo sapiens
catttggtttgattttccct

SEQ ID NO: 2915055 - DNA, 18 bp, Homo sapiens
catttgtaccttattgat

SEQ ID NO: 2915056 - DNA, 18 bp, Homo sapiens
catttgtattttgtgatg

SEQ ID NO: 2915057 - DNA, 21 bp, Homo sapiens
catttgtattttgtgatgaat

SEQ ID NO: 2915058 - DNA, 19 bp, Homo sapiens
catttgtcagagaagaaaa

SEQ ID NO: 2915059 - DNA, 18 bp, Homo sapiens
catttgtctctacttttc

SEQ ID NO: 2915060 - DNA, 17 bp, Homo sapiens
catttgttgctgctgct

SEQ ID NO: 2915061 - DNA, 15 bp, Homo sapiens
catttgtttctactt

SEQ ID NO: 2915062 - DNA, 16 bp, Homo sapiens
cattttaacaagaaga

SEQ ID NO: 2915063 - DNA, 17 bp, Homo sapiens
cattttaacaagaagat

SEQ ID NO: 2915064 - DNA, 20 bp, Homo sapiens
cattttaacaagaagatgaa

SEQ ID NO: 2915065 - DNA, 22 bp, Homo sapiens
cattttaagtggagacatattt

SEQ ID NO: 2915066 - DNA, 17 bp, Homo sapiens
cattttaagttttactg

SEQ ID NO: 2915067 - DNA, 23 bp, Homo sapiens
cattttaatagttggttaggcta

SEQ ID NO: 2915068 - DNA, 16 bp, Homo sapiens
cattttacgttttaga

SEQ ID NO: 2915069 - DNA, 22 bp, Homo sapiens
cattttacgttttagaaaattt

SEQ ID NO: 2915070 - DNA, 22 bp, Homo sapiens
cattttactttttcctggctca

SEQ ID NO: 2915071 - DNA, 19 bp, Homo sapiens
cattttagaattaaaattt

SEQ ID NO: 2915072 - DNA, 15 bp, Homo sapiens
cattttataaagtgc

SEQ ID NO: 2915073 - DNA, 18 bp, Homo sapiens
cattttatattgaaaaaa

SEQ ID NO: 2915074 - DNA, 14 bp, Homo sapiens
cattttattgcttg

SEQ ID NO: 2915075 - DNA, 23 bp, Homo sapiens
ccaccccttagattgaagtaaac

SEQ ID NO: 2915076 - DNA, 19 bp, Homo sapiens
ccaccctaagggcagccct

SEQ ID NO: 2915077 - DNA, 15 bp, Homo sapiens
ccaccctcccagctc

SEQ ID NO: 2915078 - DNA, 12 bp, Homo sapiens
ccaccctcctgg

SEQ ID NO: 2915079 - DNA, 13 bp, Homo sapiens
ccaccctcctggc

SEQ ID NO: 2915080 - DNA, 16 bp, Homo sapiens
ccaccctgctgctggt

SEQ ID NO: 2915081 - DNA, 21 bp, Homo sapiens
ccaccctgctgctggtgcaca

SEQ ID NO: 2915082 - DNA, 17 bp, Homo sapiens
ccaccctggaatgccaa

SEQ ID NO: 2915083 - DNA, 13 bp, Homo sapiens
ccaccctgggacc

SEQ ID NO: 2915084 - DNA, 11 bp, Homo sapiens
ccacccttccc

SEQ ID NO: 2915085 - DNA, 19 bp, Homo sapiens
ccaccctttcatagagagg

SEQ ID NO: 2915086 - DNA, 15 bp, Homo sapiens
ccaccgagctctgtg

SEQ ID NO: 2915087 - DNA, 16 bp, Homo sapiens
ccaccgagctctgtgg

SEQ ID NO: 2915088 - DNA, 13 bp, Homo sapiens
ccaccgcagctac

SEQ ID NO: 2915089 - DNA, 14 bp, Homo sapiens
ccaccgcagctact

SEQ ID NO: 2915090 - DNA, 14 bp, Homo sapiens
ccaccgcagctgct

SEQ ID NO: 2915091 - DNA, 13 bp, Homo sapiens
ccaccgcccagag

SEQ ID NO: 2915092 - DNA, 13 bp, Homo sapiens
ccaccgcctccta

SEQ ID NO: 2915093 - DNA, 15 bp, Homo sapiens
ccaccgggctgcagg

SEQ ID NO: 2915094 - DNA, 17 bp, Homo sapiens
ccaccggggcaagaggg

SEQ ID NO: 2915095 - DNA, 19 bp, Homo sapiens
ccacctaggcaatgaagaa

SEQ ID NO: 2915096 - DNA, 15 bp, Homo sapiens
ccacctcagccttgg

SEQ ID NO: 2915097 - DNA, 22 bp, Homo sapiens
ccacctcccctatccacccagc

SEQ ID NO: 2915098 - DNA, 16 bp, Homo sapiens
ccacctccctctgcca

SEQ ID NO: 2915099 - DNA, 16 bp, Homo sapiens
ccacctccctgcctcc

SEQ ID NO: 2915100 - DNA, 20 bp, Homo sapiens
ccacctcggcctcccagagt

SEQ ID NO: 2915101 - DNA, 15 bp, Homo sapiens
ccacctctctgtctt

SEQ ID NO: 2915102 - DNA, 21 bp, Homo sapiens
ccacctctcttttcctctctg

SEQ ID NO: 2915103 - DNA, 23 bp, Homo sapiens
ccacctctcttttcctctctgtc

SEQ ID NO: 2915104 - DNA, 15 bp, Homo sapiens
ccacctgaaagcctg

SEQ ID NO: 2915105 - DNA, 20 bp, Homo sapiens
ccacctgaataaagaatgaa

SEQ ID NO: 2915106 - DNA, 15 bp, Homo sapiens
ccacctgcctggccg

SEQ ID NO: 2915107 - DNA, 20 bp, Homo sapiens
ccacctgcctggccggccag

SEQ ID NO: 2915108 - DNA, 21 bp, Homo sapiens
ccacctggacgaagagcaggc

SEQ ID NO: 2915109 - DNA, 21 bp, Homo sapiens
ccacctggccccatgtctctc

SEQ ID NO: 2915110 - DNA, 14 bp, Homo sapiens
ccacctgggctggg

SEQ ID NO: 2915111 - DNA, 21 bp, Homo sapiens
ccacctggtactccctctcag

SEQ ID NO: 2915112 - DNA, 16 bp, Homo sapiens
ccacctgtgcgagacc

SEQ ID NO: 2915113 - DNA, 12 bp, Homo sapiens
ccaccttcccag

SEQ ID NO: 2915114 - DNA, 14 bp, Homo sapiens
ccaccttcccagct

SEQ ID NO: 2915115 - DNA, 16 bp, Homo sapiens
ccaccttcccagctct

SEQ ID NO: 2915116 - DNA, 14 bp, Homo sapiens
ccaccttttcagcg

SEQ ID NO: 2915117 - DNA, 18 bp, Homo sapiens
ccaccttttgtttttcca

SEQ ID NO: 2915118 - DNA, 19 bp, Homo sapiens
ccaccttttgtttttccag

SEQ ID NO: 2915119 - DNA, 20 bp, Homo sapiens
ccacgacaaaaacaagactg

SEQ ID NO: 2915120 - DNA, 20 bp, Homo sapiens
ccacgagggctggctggcct

SEQ ID NO: 2915121 - DNA, 19 bp, Homo sapiens
ccacgaggggacccatggg

SEQ ID NO: 2915122 - DNA, 23 bp, Homo sapiens
ccacgaggggacccatgggggct

SEQ ID NO: 2915123 - DNA, 20 bp, Homo sapiens
ccacgatgtggccctggcct

SEQ ID NO: 2915124 - DNA, 21 bp, Homo sapiens
ccacgcacctccacgccactg

SEQ ID NO: 2915125 - DNA, 16 bp, Homo sapiens
ccacgctccagctgcc

SEQ ID NO: 2915126 - DNA, 22 bp, Homo sapiens
ccacggagcagttcagagtgga

SEQ ID NO: 2915127 - DNA, 13 bp, Homo sapiens
ccacggccagaag

SEQ ID NO: 2915128 - DNA, 19 bp, Homo sapiens
ccacggggaccactgggcc

SEQ ID NO: 2915129 - DNA, 22 bp, Homo sapiens
ccacggtccgcggcctgcaccg

SEQ ID NO: 2915130 - DNA, 19 bp, Homo sapiens
ccacgtaccaagccaccgc

SEQ ID NO: 2915131 - DNA, 21 bp, Homo sapiens
ccacgtcagctgggacacccc

SEQ ID NO: 2915132 - DNA, 20 bp, Homo sapiens
ccacgtctctctgcctgctg

SEQ ID NO: 2915133 - DNA, 14 bp, Homo sapiens
ccacgtcttcctcc

SEQ ID NO: 2915134 - DNA, 23 bp, Homo sapiens
ccacgtggctgcgtgcccctgct

SEQ ID NO: 2915135 - DNA, 14 bp, Homo sapiens
ccacgttcagggag

SEQ ID NO: 2915136 - DNA, 20 bp, Homo sapiens
ccacgttcagggaggggccg

SEQ ID NO: 2915137 - DNA, 20 bp, Homo sapiens
ccacgttccttactgcagaa

SEQ ID NO: 2915138 - DNA, 21 bp, Homo sapiens
ccactaagaattcaaactggg

SEQ ID NO: 2915139 - DNA, 22 bp, Homo sapiens
ccactaagcagaggaggggccg

SEQ ID NO: 2915140 - DNA, 12 bp, Homo sapiens
ccactcaagcca

SEQ ID NO: 2915141 - DNA, 16 bp, Homo sapiens
ccactcaagccaagca

SEQ ID NO: 2915142 - DNA, 21 bp, Homo sapiens
ccactcaatccatccatgtac

SEQ ID NO: 2915143 - DNA, 16 bp, Homo sapiens
ccactcaggtgcacac

SEQ ID NO: 2915144 - DNA, 22 bp, Homo sapiens
ccactcatgtgactctttccaa

SEQ ID NO: 2915145 - DNA, 13 bp, Homo sapiens
ccactccaagccc

SEQ ID NO: 2915146 - DNA, 20 bp, Homo sapiens
ccactccagctccttcgctt

SEQ ID NO: 2915147 - DNA, 16 bp, Homo sapiens
ccactcctccaaagga

SEQ ID NO: 2915148 - DNA, 11 bp, Homo sapiens
ccactcctccc

SEQ ID NO: 2915149 - DNA, 14 bp, Homo sapiens
ccactcctcctagc

SEQ ID NO: 2915150 - DNA, 14 bp, Homo sapiens
ccactcctctaaga

SEQ ID NO: 2915151 - DNA, 13 bp, Homo sapiens
ccactcctctgac

SEQ ID NO: 2915152 - DNA, 14 bp, Homo sapiens
ccactcctctgact

SEQ ID NO: 2915153 - DNA, 20 bp, Homo sapiens
ccactcctgccagcccggct

SEQ ID NO: 2915154 - DNA, 19 bp, Homo sapiens
ccactctaccagtgcaggc

SEQ ID NO: 2915155 - DNA, 14 bp, Homo sapiens
ccactctcattccc

SEQ ID NO: 2915156 - DNA, 16 bp, Homo sapiens
ccactctcattcccca

SEQ ID NO: 2915157 - DNA, 19 bp, Homo sapiens
ccactctcattccccaggt

SEQ ID NO: 2915158 - DNA, 13 bp, Homo sapiens
ccactctgctgcc

SEQ ID NO: 2915159 - DNA, 16 bp, Homo sapiens
ccactctgctgcctgt

SEQ ID NO: 2915160 - DNA, 17 bp, Homo sapiens
ccactctgctgcctgta

SEQ ID NO: 2915161 - DNA, 21 bp, Homo sapiens
ccactgaattgacatgaccct

SEQ ID NO: 2915162 - DNA, 23 bp, Homo sapiens
ccactgaattgacatgaccctct

SEQ ID NO: 2915163 - DNA, 18 bp, Homo sapiens
ccactgcaagtccttttg

SEQ ID NO: 2915164 - DNA, 18 bp, Homo sapiens
ccactgcactccagcctg

SEQ ID NO: 2915165 - DNA, 18 bp, Homo sapiens
ccactgcataccaacctg

SEQ ID NO: 2915166 - DNA, 11 bp, Homo sapiens
ccactgccagg

SEQ ID NO: 2915167 - DNA, 15 bp, Homo sapiens
ccactgcccatggca

SEQ ID NO: 2915168 - DNA, 19 bp, Homo sapiens
ccactgccccttcattgat

SEQ ID NO: 2915169 - DNA, 16 bp, Homo sapiens
ccactgcccttctcat

SEQ ID NO: 2915170 - DNA, 17 bp, Homo sapiens
ccactgcccttctcatt

SEQ ID NO: 2915171 - DNA, 23 bp, Homo sapiens
ccactgcctcctccctggctgca

SEQ ID NO: 2915172 - DNA, 19 bp, Homo sapiens
ccactgctctccagcctgg

SEQ ID NO: 2915173 - DNA, 19 bp, Homo sapiens
ccactgctgcttctccatg

SEQ ID NO: 2915174 - DNA, 13 bp, Homo sapiens
ccactggaaggag

SEQ ID NO: 2915175 - DNA, 18 bp, Homo sapiens
ccactggaaggagcacat

SEQ ID NO: 2915176 - DNA, 20 bp, Homo sapiens
ccactggaaggagcacatac

SEQ ID NO: 2915177 - DNA, 18 bp, Homo sapiens
ccactggactgacctggt

SEQ ID NO: 2915178 - DNA, 13 bp, Homo sapiens
ccactggcatttt

SEQ ID NO: 2915179 - DNA, 12 bp, Homo sapiens
ccactgggcccc

SEQ ID NO: 2915180 - DNA, 13 bp, Homo sapiens
ccactgggcccct

SEQ ID NO: 2915181 - DNA, 18 bp, Homo sapiens
ccactggggtccagggag

SEQ ID NO: 2915182 - DNA, 16 bp, Homo sapiens
ccactggtaacatgtg

SEQ ID NO: 2915183 - DNA, 20 bp, Homo sapiens
ccactgtgtttctgtgctcc

SEQ ID NO: 2915184 - DNA, 17 bp, Homo sapiens
ccactgttttaaaagat

SEQ ID NO: 2915185 - DNA, 13 bp, Homo sapiens
ccacttaaaatgt

SEQ ID NO: 2915186 - DNA, 16 bp, Homo sapiens
ccacttattttacatt

SEQ ID NO: 2915187 - DNA, 19 bp, Homo sapiens
ccacttctcatcacacaca

SEQ ID NO: 2915188 - DNA, 15 bp, Homo sapiens
ccacttctctgggtc

SEQ ID NO: 2915189 - DNA, 14 bp, Homo sapiens
ccacttctggtcaa

SEQ ID NO: 2915190 - DNA, 18 bp, Homo sapiens
ccacttctggtcaatcaa

SEQ ID NO: 2915191 - DNA, 14 bp, Homo sapiens
ccacttctggtccc

SEQ ID NO: 2915192 - DNA, 17 bp, Homo sapiens
ccacttctggtcccctg

SEQ ID NO: 2915193 - DNA, 18 bp, Homo sapiens
ccacttctggtcccctgt

SEQ ID NO: 2915194 - DNA, 21 bp, Homo sapiens
ccacttctggtcccctgtggt

SEQ ID NO: 2915195 - DNA, 23 bp, Homo sapiens
ccacttgccagggctctgggggc

SEQ ID NO: 2915196 - DNA, 21 bp, Homo sapiens
ccacttggaggcctttcatcc

SEQ ID NO: 2915197 - DNA, 15 bp, Homo sapiens
ccacttgtgggtcct

SEQ ID NO: 2915198 - DNA, 20 bp, Homo sapiens
ccactttcttctaccagacc

SEQ ID NO: 2915199 - DNA, 16 bp, Homo sapiens
ccactttgctgttcct

SEQ ID NO: 2915200 - DNA, 16 bp, Homo sapiens
ccactttgttggccct

SEQ ID NO: 2915201 - DNA, 12 bp, Homo sapiens
ccactttttaac

SEQ ID NO: 2915202 - DNA, 19 bp, Homo sapiens
ccactttttcagaggtgaa

SEQ ID NO: 2915203 - DNA, 22 bp, Homo sapiens
ccagaaacctgggagagacttg

SEQ ID NO: 2915204 - DNA, 24 bp, Homo sapiens
ccagaaactgttcccacctgctgg

SEQ ID NO: 2915205 - DNA, 19 bp, Homo sapiens
ccagaacacactccatcag

SEQ ID NO: 2915206 - DNA, 18 bp, Homo sapiens
ccagaacgtggctctgct

SEQ ID NO: 2915207 - DNA, 11 bp, Homo sapiens
ccagtttctta

SEQ ID NO: 2915208 - DNA, 20 bp, Homo sapiens
ccagtttcttaaactgaaag

SEQ ID NO: 2915209 - DNA, 11 bp, Homo sapiens
ccagtttcttt

SEQ ID NO: 2915210 - DNA, 13 bp, Homo sapiens
ccagtttgcagaa

SEQ ID NO: 2915211 - DNA, 23 bp, Homo sapiens
ccagtttgcagaaaagcacctgc

SEQ ID NO: 2915212 - DNA, 20 bp, Homo sapiens
ccagttttctgttcagcttt

SEQ ID NO: 2915213 - DNA, 12 bp, Homo sapiens
ccagttttgctg

SEQ ID NO: 2915214 - DNA, 22 bp, Homo sapiens
ccataaggtttcgtttctgtat

SEQ ID NO: 2915215 - DNA, 20 bp, Homo sapiens
ccataagtggagaaatgaaa

SEQ ID NO: 2915216 - DNA, 19 bp, Homo sapiens
ccataataaaaggctttga

SEQ ID NO: 2915217 - DNA, 21 bp, Homo sapiens
ccataatgctactgtctcact

SEQ ID NO: 2915218 - DNA, 11 bp, Homo sapiens
ccatactttgg

SEQ ID NO: 2915219 - DNA, 19 bp, Homo sapiens
ccatactttgtctgaaaaa

SEQ ID NO: 2915220 - DNA, 15 bp, Homo sapiens
ccatagatttgaaga

SEQ ID NO: 2915221 - DNA, 22 bp, Homo sapiens
ccatagctcttcacttcctcca

SEQ ID NO: 2915222 - DNA, 13 bp, Homo sapiens
ccatagtaactga

SEQ ID NO: 2915223 - DNA, 21 bp, Homo sapiens
ccatagtaactgacatgatta

SEQ ID NO: 2915224 - DNA, 22 bp, Homo sapiens
ccatagttatttacttgaaaga

SEQ ID NO: 2915225 - DNA, 16 bp, Homo sapiens
ccatatggacactgtg

SEQ ID NO: 2915226 - DNA, 20 bp, Homo sapiens
ccatatggacactgtgacaa

SEQ ID NO: 2915227 - DNA, 22 bp, Homo sapiens
ccatatgtcagtgtaaatcctt

SEQ ID NO: 2915228 - DNA, 16 bp, Homo sapiens
ccatatttacttactg

SEQ ID NO: 2915229 - DNA, 16 bp, Homo sapiens
ccatatttgaattggc

SEQ ID NO: 2915230 - DNA, 14 bp, Homo sapiens
ccatatttgtgttc

SEQ ID NO: 2915231 - DNA, 20 bp, Homo sapiens
ccatattttattgtattttg

SEQ ID NO: 2915232 - DNA, 21 bp, Homo sapiens
ccatattttattgtattttga

SEQ ID NO: 2915233 - DNA, 12 bp, Homo sapiens
ccatcaagcact

SEQ ID NO: 2915234 - DNA, 20 bp, Homo sapiens
ccatcaataggcaaaagtgt

SEQ ID NO: 2915235 - DNA, 15 bp, Homo sapiens
ccatcacatgaccac

SEQ ID NO: 2915236 - DNA, 16 bp, Homo sapiens
ccatcactattcaagg

SEQ ID NO: 2915237 - DNA, 14 bp, Homo sapiens
ccatcactcagccc

SEQ ID NO: 2915238 - DNA, 16 bp, Homo sapiens
ccatcactcagcccct

SEQ ID NO: 2915239 - DNA, 14 bp, Homo sapiens
ccatcactggagca

SEQ ID NO: 2915240 - DNA, 14 bp, Homo sapiens
ccatcagtgcatga

SEQ ID NO: 2915241 - DNA, 12 bp, Homo sapiens
ccatcagtgctc

SEQ ID NO: 2915242 - DNA, 13 bp, Homo sapiens
ccatcatcctact

SEQ ID NO: 2915243 - DNA, 17 bp, Homo sapiens
ccatcatcctttgttct

SEQ ID NO: 2915244 - DNA, 23 bp, Homo sapiens
ccatcatcctttgttctgagcat

SEQ ID NO: 2915245 - DNA, 16 bp, Homo sapiens
ccatcatctctgcctt

SEQ ID NO: 2915246 - DNA, 18 bp, Homo sapiens
ccatcatctgctgcacat

SEQ ID NO: 2915247 - DNA, 18 bp, Homo sapiens
ccatcattgctgtctgca

SEQ ID NO: 2915248 - DNA, 13 bp, Homo sapiens
ccatccagcttgc

SEQ ID NO: 2915249 - DNA, 16 bp, Homo sapiens
ccatccatctgtccgt

SEQ ID NO: 2915250 - DNA, 20 bp, Homo sapiens
ccatcccactgctcccccaa

SEQ ID NO: 2915251 - DNA, 18 bp, Homo sapiens
ccatccccatcggccctg

SEQ ID NO: 2915252 - DNA, 14 bp, Homo sapiens
ccatccgcagactg

SEQ ID NO: 2915253 - DNA, 15 bp, Homo sapiens
ccatcctcccaatct

SEQ ID NO: 2915254 - DNA, 13 bp, Homo sapiens
ccatcctcctctc

SEQ ID NO: 2915255 - DNA, 15 bp, Homo sapiens
ccatcctcctctcca

SEQ ID NO: 2915256 - DNA, 19 bp, Homo sapiens
ccatcctcctctccatgca

SEQ ID NO: 2915257 - DNA, 22 bp, Homo sapiens
ccatcctcctctccatgcaagt

SEQ ID NO: 2915258 - DNA, 11 bp, Homo sapiens
ccatcctgacc

SEQ ID NO: 2915259 - DNA, 20 bp, Homo sapiens
ccatccttgactgaagcgaa

SEQ ID NO: 2915260 - DNA, 14 bp, Homo sapiens
ccatcggccctgtc

SEQ ID NO: 2915261 - DNA, 15 bp, Homo sapiens
ccatcggccctgtcc

SEQ ID NO: 2915262 - DNA, 18 bp, Homo sapiens
ccatcggccctgtcccct

SEQ ID NO: 2915263 - DNA, 20 bp, Homo sapiens
ccatcggccctgtcccctgg

SEQ ID NO: 2915264 - DNA, 15 bp, Homo sapiens
ccatcgggtgccaaa

SEQ ID NO: 2915265 - DNA, 17 bp, Homo sapiens
ccatcgtattaaaaaac

SEQ ID NO: 2915266 - DNA, 17 bp, Homo sapiens
ccatctaatggcttcag

SEQ ID NO: 2915267 - DNA, 11 bp, Homo sapiens
ccatctcaggc

SEQ ID NO: 2915268 - DNA, 21 bp, Homo sapiens
ccatctcatgcccctggctgg

SEQ ID NO: 2915269 - DNA, 22 bp, Homo sapiens
ccatctcgctccctcccaggac

SEQ ID NO: 2915270 - DNA, 14 bp, Homo sapiens
ccatctctctccct

SEQ ID NO: 2915271 - DNA, 18 bp, Homo sapiens
ccatctctttaaaaacaa

SEQ ID NO: 2915272 - DNA, 14 bp, Homo sapiens
ccatctgcgcaggg

SEQ ID NO: 2915273 - DNA, 20 bp, Homo sapiens
ccatctgcgtgacaataaaa

SEQ ID NO: 2915274 - DNA, 12 bp, Homo sapiens
ccatctgggctc

SEQ ID NO: 2915275 - DNA, 22 bp, Homo sapiens
ccatctggttaggatggcagga

SEQ ID NO: 2915276 - DNA, 19 bp, Homo sapiens
ccatctgtaaaggggcagc

SEQ ID NO: 2915277 - DNA, 20 bp, Homo sapiens
ccatctgtacttggtccaac

SEQ ID NO: 2915278 - DNA, 23 bp, Homo sapiens
ccatctgtccacatccccagagc

SEQ ID NO: 2915279 - DNA, 18 bp, Homo sapiens
ccatctgtccatcctcct

SEQ ID NO: 2915280 - DNA, 21 bp, Homo sapiens
ccatctgtccatcctcctctc

SEQ ID NO: 2915281 - DNA, 22 bp, Homo sapiens
ccatctgtccatcctcctctcc

SEQ ID NO: 2915282 - DNA, 23 bp, Homo sapiens
ccatctgtccgtccagagccggc

SEQ ID NO: 2915283 - DNA, 19 bp, Homo sapiens
ccatctgtctaaagataga

SEQ ID NO: 2915284 - DNA, 23 bp, Homo sapiens
ccatctgtgactataaagctgtt

SEQ ID NO: 2915285 - DNA, 13 bp, Homo sapiens
ccatctgtgcatt

SEQ ID NO: 2915286 - DNA, 13 bp, Homo sapiens
ccatctgtgttct

SEQ ID NO: 2915287 - DNA, 14 bp, Homo sapiens
ccatcttcacccag

SEQ ID NO: 2915288 - DNA, 15 bp, Homo sapiens
ccatcttcagcttct

SEQ ID NO: 2915289 - DNA, 20 bp, Homo sapiens
ccatcttcccgcctcagcct

SEQ ID NO: 2915290 - DNA, 18 bp, Homo sapiens
ccatcttcgggaccagga

SEQ ID NO: 2915291 - DNA, 19 bp, Homo sapiens
ccatcttgcttccaagacc

SEQ ID NO: 2915292 - DNA, 12 bp, Homo sapiens
ccatctttttct

SEQ ID NO: 2915293 - DNA, 16 bp, Homo sapiens
ccatgaccagaaacag

SEQ ID NO: 2915294 - DNA, 18 bp, Homo sapiens
ccatgaggagttgctgtt

SEQ ID NO: 2915295 - DNA, 17 bp, Homo sapiens
ccatgagtccttgaaaa

SEQ ID NO: 2915296 - DNA, 21 bp, Homo sapiens
ccatgagttggggtctggcag

SEQ ID NO: 2915297 - DNA, 23 bp, Homo sapiens
ccatgagttggggtctggcagcc

SEQ ID NO: 2915298 - DNA, 15 bp, Homo sapiens
ccatgatggcaacag

SEQ ID NO: 2915299 - DNA, 15 bp, Homo sapiens
ccatgcaagcagagg

SEQ ID NO: 2915300 - DNA, 20 bp, Homo sapiens
ccatgcaagcagaggaccag

SEQ ID NO: 2915301 - DNA, 15 bp, Homo sapiens
ccatgcaagtgctgt

SEQ ID NO: 2915302 - DNA, 16 bp, Homo sapiens
ccatgcaagtgctgtt

SEQ ID NO: 2915303 - DNA, 13 bp, Homo sapiens
ccatgcactgtga

SEQ ID NO: 2915304 - DNA, 16 bp, Homo sapiens
ccatgcactgtgaagg

SEQ ID NO: 2915305 - DNA, 17 bp, Homo sapiens
ccatgcactgtgaagga

SEQ ID NO: 2915306 - DNA, 20 bp, Homo sapiens
ccatgcactgtgaaggaccc

SEQ ID NO: 2915307 - DNA, 13 bp, Homo sapiens
ccatgcccagcta

SEQ ID NO: 2915308 - DNA, 12 bp, Homo sapiens
ccatgcctcagc

SEQ ID NO: 2915309 - DNA, 14 bp, Homo sapiens
ccatgcctcagccc

SEQ ID NO: 2915310 - DNA, 17 bp, Homo sapiens
ccatgcctgtggctgcg

SEQ ID NO: 2915311 - DNA, 21 bp, Homo sapiens
ccatgcgacactgggaggcca

SEQ ID NO: 2915312 - DNA, 22 bp, Homo sapiens
ccatgcgacactgggaggccag

SEQ ID NO: 2915313 - DNA, 12 bp, Homo sapiens
ccatgctcccaa

SEQ ID NO: 2915314 - DNA, 15 bp, Homo sapiens
ccatgctcccaactc

SEQ ID NO: 2915315 - DNA, 19 bp, Homo sapiens
ccatgctgtccctgcactg

SEQ ID NO: 2915316 - DNA, 22 bp, Homo sapiens
ccatgctgttgattgctaaatg

SEQ ID NO: 2915317 - DNA, 19 bp, Homo sapiens
ccatgcttacgtgatcctc

SEQ ID NO: 2915318 - DNA, 14 bp, Homo sapiens
ccatggaaggtgcc

SEQ ID NO: 2915319 - DNA, 17 bp, Homo sapiens
ccatggaaggtgccaga

SEQ ID NO: 2915320 - DNA, 19 bp, Homo sapiens
ccatggaaggtgccagaag

SEQ ID NO: 2915321 - DNA, 16 bp, Homo sapiens
ccatggacaggctggc

SEQ ID NO: 2915322 - DNA, 18 bp, Homo sapiens
ccatggacaggctggctc

SEQ ID NO: 2915323 - DNA, 22 bp, Homo sapiens
ccatggaggagacaggaagcct

SEQ ID NO: 2915324 - DNA, 23 bp, Homo sapiens
ccatggagtgagacccaggagcc

SEQ ID NO: 2915325 - DNA, 23 bp, Homo sapiens
ccatggcatgcgccaccatgccc

SEQ ID NO: 2915326 - DNA, 14 bp, Homo sapiens
ccatggcatgtctt

SEQ ID NO: 2915327 - DNA, 15 bp, Homo sapiens
ccatggccctcatta

SEQ ID NO: 2915328 - DNA, 20 bp, Homo sapiens
ccatggctttcatcctgtgt

SEQ ID NO: 2915329 - DNA, 22 bp, Homo sapiens
ccatggctttcatcctgtgtcc

SEQ ID NO: 2915330 - DNA, 16 bp, Homo sapiens
ccatggggaggtggca

SEQ ID NO: 2915331 - DNA, 13 bp, Homo sapiens
ccatgggtctggc

SEQ ID NO: 2915332 - DNA, 15 bp, Homo sapiens
ccatgggtctggcta

SEQ ID NO: 2915333 - DNA, 16 bp, Homo sapiens
ccatgggtctggctag

SEQ ID NO: 2915334 - DNA, 19 bp, Homo sapiens
ccatggtcctgtctgtcct

SEQ ID NO: 2915335 - DNA, 23 bp, Homo sapiens
ccatggtcctgtctgtccttctg

SEQ ID NO: 2915336 - DNA, 21 bp, Homo sapiens
ccatggttctcaatttatttg

SEQ ID NO: 2915337 - DNA, 18 bp, Homo sapiens
ccatgtaaataagatgat

SEQ ID NO: 2915338 - DNA, 15 bp, Homo sapiens
ccatgtaacagaaag

SEQ ID NO: 2915339 - DNA, 14 bp, Homo sapiens
cccagtgcttctcc

SEQ ID NO: 2915340 - DNA, 22 bp, Homo sapiens
cccagtgcttctccaacactga

SEQ ID NO: 2915341 - DNA, 16 bp, Homo sapiens
cccagtgggctgtgtt

SEQ ID NO: 2915342 - DNA, 14 bp, Homo sapiens
cccagttcaccctg

SEQ ID NO: 2915343 - DNA, 20 bp, Homo sapiens
cccagttcgcctggagccct

SEQ ID NO: 2915344 - DNA, 21 bp, Homo sapiens
cccagttcgcctggagccctc

SEQ ID NO: 2915345 - DNA, 17 bp, Homo sapiens
cccagttgccatctgcg

SEQ ID NO: 2915346 - DNA, 15 bp, Homo sapiens
cccagtttgcagaaa

SEQ ID NO: 2915347 - DNA, 17 bp, Homo sapiens
cccagttttgaaaaggt

SEQ ID NO: 2915348 - DNA, 17 bp, Homo sapiens
cccataaaatgatcctg

SEQ ID NO: 2915349 - DNA, 20 bp, Homo sapiens
cccataaaatgatcctgcca

SEQ ID NO: 2915350 - DNA, 21 bp, Homo sapiens
cccataagcacagatttttct

SEQ ID NO: 2915351 - DNA, 19 bp, Homo sapiens
cccataggcccacacacag

SEQ ID NO: 2915352 - DNA, 13 bp, Homo sapiens
cccatagggagct

SEQ ID NO: 2915353 - DNA, 14 bp, Homo sapiens
cccatcagaaggag

SEQ ID NO: 2915354 - DNA, 19 bp, Homo sapiens
cccatcatctctgcctttg

SEQ ID NO: 2915355 - DNA, 16 bp, Homo sapiens
cccatccccgcagtgt

SEQ ID NO: 2915356 - DNA, 22 bp, Homo sapiens
cccatcccgcttagcgctctgg

SEQ ID NO: 2915357 - DNA, 16 bp, Homo sapiens
cccatccctgtcttta

SEQ ID NO: 2915358 - DNA, 16 bp, Homo sapiens
cccatcggccctgtcc

SEQ ID NO: 2915359 - DNA, 17 bp, Homo sapiens
cccatcggccctgtccc

SEQ ID NO: 2915360 - DNA, 11 bp, Homo sapiens
cccatctcagg

SEQ ID NO: 2915361 - DNA, 22 bp, Homo sapiens
cccatctcatgcccctggctgg

SEQ ID NO: 2915362 - DNA, 14 bp, Homo sapiens
cccatctctccctt

SEQ ID NO: 2915363 - DNA, 17 bp, Homo sapiens
cccatctgtccatcctc

SEQ ID NO: 2915364 - DNA, 19 bp, Homo sapiens
cccatctgtccatcctcct

SEQ ID NO: 2915365 - DNA, 15 bp, Homo sapiens
cccatctgtggtttt

SEQ ID NO: 2915366 - DNA, 15 bp, Homo sapiens
cccatctgtgttcta

SEQ ID NO: 2915367 - DNA, 13 bp, Homo sapiens
cccatcttcaccc

SEQ ID NO: 2915368 - DNA, 21 bp, Homo sapiens
cccatcttcgggaccaggatt

SEQ ID NO: 2915369 - DNA, 21 bp, Homo sapiens
cccatcttgcttccaagacca

SEQ ID NO: 2915370 - DNA, 23 bp, Homo sapiens
cccatgacaatgttgtagtgtcc

SEQ ID NO: 2915371 - DNA, 15 bp, Homo sapiens
cccatgagctcctta

SEQ ID NO: 2915372 - DNA, 16 bp, Homo sapiens
cccatgcaagcagagg

SEQ ID NO: 2915373 - DNA, 21 bp, Homo sapiens
cccatgcaagcagaggaccag

SEQ ID NO: 2915374 - DNA, 18 bp, Homo sapiens
cccatgcctgtggctgcg

SEQ ID NO: 2915375 - DNA, 17 bp, Homo sapiens
cccatggaatatttcca

SEQ ID NO: 2915376 - DNA, 15 bp, Homo sapiens
cccatggacaggctg

SEQ ID NO: 2915377 - DNA, 13 bp, Homo sapiens
cccatggagccag

SEQ ID NO: 2915378 - DNA, 19 bp, Homo sapiens
cccatggagccagctccct

SEQ ID NO: 2915379 - DNA, 18 bp, Homo sapiens
cccatggtcatctctgtt

SEQ ID NO: 2915380 - DNA, 15 bp, Homo sapiens
cccatggtccctagc

SEQ ID NO: 2915381 - DNA, 21 bp, Homo sapiens
cccatgtagccccctggcctc

SEQ ID NO: 2915382 - DNA, 23 bp, Homo sapiens
cccatgtagccccctggcctctg

SEQ ID NO: 2915383 - DNA, 17 bp, Homo sapiens
cccatgtgacttttatc

SEQ ID NO: 2915384 - DNA, 18 bp, Homo sapiens
cccattcctgaagaacca

SEQ ID NO: 2915385 - DNA, 17 bp, Homo sapiens
cccattcgcgctctgct

SEQ ID NO: 2915386 - DNA, 18 bp, Homo sapiens
cccattcttttcacttcc

SEQ ID NO: 2915387 - DNA, 22 bp, Homo sapiens
cccattcttttgtaatttaaat

SEQ ID NO: 2915388 - DNA, 14 bp, Homo sapiens
cccattgccctggt

SEQ ID NO: 2915389 - DNA, 14 bp, Homo sapiens
cccattgtccctct

SEQ ID NO: 2915390 - DNA, 13 bp, Homo sapiens
cccattgtggagg

SEQ ID NO: 2915391 - DNA, 19 bp, Homo sapiens
cccatttcgtgagccccat

SEQ ID NO: 2915392 - DNA, 20 bp, Homo sapiens
cccatttcgtgagccccatc

SEQ ID NO: 2915393 - DNA, 21 bp, Homo sapiens
cccatttcgtgagccccatct

SEQ ID NO: 2915394 - DNA, 18 bp, Homo sapiens
cccatttctccagaaccc

SEQ ID NO: 2915395 - DNA, 18 bp, Homo sapiens
cccatttgttgctgctgc

SEQ ID NO: 2915396 - DNA, 14 bp, Homo sapiens
cccattttagtcac

SEQ ID NO: 2915397 - DNA, 14 bp, Homo sapiens
cccattttctgtgg

SEQ ID NO: 2915398 - DNA, 18 bp, Homo sapiens
ccccaaagcagcccttcc

SEQ ID NO: 2915399 - DNA, 16 bp, Homo sapiens
ccccaaagccactgga

SEQ ID NO: 2915400 - DNA, 15 bp, Homo sapiens
ccccaaagtaaaaga

SEQ ID NO: 2915401 - DNA, 23 bp, Homo sapiens
ccccaaatccgaacctcctctgt

SEQ ID NO: 2915402 - DNA, 12 bp, Homo sapiens
ccccaacagtgt

SEQ ID NO: 2915403 - DNA, 17 bp, Homo sapiens
ccccaaccaaggaagga

SEQ ID NO: 2915404 - DNA, 13 bp, Homo sapiens
ccccaactcctgg

SEQ ID NO: 2915405 - DNA, 23 bp, Homo sapiens
ccccaagacctctatatttgctc

SEQ ID NO: 2915406 - DNA, 17 bp, Homo sapiens
ccccaagcgcctggctg

SEQ ID NO: 2915407 - DNA, 14 bp, Homo sapiens
ccccaatccctcaa

SEQ ID NO: 2915408 - DNA, 12 bp, Homo sapiens
ccccacaaggcc

SEQ ID NO: 2915409 - DNA, 13 bp, Homo sapiens
ccccacaaggcct

SEQ ID NO: 2915410 - DNA, 21 bp, Homo sapiens
ccccacaggcacattaactgt

SEQ ID NO: 2915411 - DNA, 23 bp, Homo sapiens
ccccaccacgatgtggccctggc

SEQ ID NO: 2915412 - DNA, 17 bp, Homo sapiens
ccccaccacttctttta

SEQ ID NO: 2915413 - DNA, 17 bp, Homo sapiens
ccccaccagagctgcct

SEQ ID NO: 2915414 - DNA, 22 bp, Homo sapiens
ccccaccagagctgcctcccca

SEQ ID NO: 2915415 - DNA, 12 bp, Homo sapiens
ccccacccctgg

SEQ ID NO: 2915416 - DNA, 20 bp, Homo sapiens
ccccacccctgggggctctc

SEQ ID NO: 2915417 - DNA, 15 bp, Homo sapiens
ccccaccctcctggc

SEQ ID NO: 2915418 - DNA, 22 bp, Homo sapiens
ccccaccctcctggcctcagac

SEQ ID NO: 2915419 - DNA, 21 bp, Homo sapiens
ccccaccgccggggtcctggg

SEQ ID NO: 2915420 - DNA, 14 bp, Homo sapiens
ccccaccgctgaga

SEQ ID NO: 2915421 - DNA, 17 bp, Homo sapiens
ccccacctctccctgac

SEQ ID NO: 2915422 - DNA, 18 bp, Homo sapiens
ccccacgacccctgcctc

SEQ ID NO: 2915423 - DNA, 13 bp, Homo sapiens
ccccacgagggct

SEQ ID NO: 2915424 - DNA, 14 bp, Homo sapiens
ccccacgagggctg

SEQ ID NO: 2915425 - DNA, 18 bp, Homo sapiens
ccccacgagggctggctg

SEQ ID NO: 2915426 - DNA, 21 bp, Homo sapiens
ccccacgagggctggctggcc

SEQ ID NO: 2915427 - DNA, 22 bp, Homo sapiens
ccccacgtctctctgcctgctg

SEQ ID NO: 2915428 - DNA, 23 bp, Homo sapiens
ccccacgtctctctgcctgctgg

SEQ ID NO: 2915429 - DNA, 14 bp, Homo sapiens
ccccactgaccaga

SEQ ID NO: 2915430 - DNA, 15 bp, Homo sapiens
ccccactgaccagaa

SEQ ID NO: 2915431 - DNA, 15 bp, Homo sapiens
ccccagacagctgct

SEQ ID NO: 2915432 - DNA, 19 bp, Homo sapiens
ccccagacagctgctcaga

SEQ ID NO: 2915433 - DNA, 23 bp, Homo sapiens
ccccagacagctgctcagagcca

SEQ ID NO: 2915434 - DNA, 16 bp, Homo sapiens
ccccagactctgccta

SEQ ID NO: 2915435 - DNA, 14 bp, Homo sapiens
ccccagactgagct

SEQ ID NO: 2915436 - DNA, 19 bp, Homo sapiens
ccccagactgagctctcca

SEQ ID NO: 2915437 - DNA, 11 bp, Homo sapiens
ccccagactgg

SEQ ID NO: 2915438 - DNA, 17 bp, Homo sapiens
ccccagagacctttgcc

SEQ ID NO: 2915439 - DNA, 20 bp, Homo sapiens
ccccagagacctttgcccac

SEQ ID NO: 2915440 - DNA, 22 bp, Homo sapiens
ccccagagacctttgcccacac

SEQ ID NO: 2915441 - DNA, 14 bp, Homo sapiens
ccccagagccacac

SEQ ID NO: 2915442 - DNA, 18 bp, Homo sapiens
ccccagagccacacatgg

SEQ ID NO: 2915443 - DNA, 19 bp, Homo sapiens
ccccagagcccagctcttg

SEQ ID NO: 2915444 - DNA, 21 bp, Homo sapiens
ccccagagcccagctcttgct

SEQ ID NO: 2915445 - DNA, 12 bp, Homo sapiens
ccccagaggcag

SEQ ID NO: 2915446 - DNA, 13 bp, Homo sapiens
ccccagaggcaga

SEQ ID NO: 2915447 - DNA, 19 bp, Homo sapiens
ccccagattcttcagcttg

SEQ ID NO: 2915448 - DNA, 14 bp, Homo sapiens
ccccagcacagctc

SEQ ID NO: 2915449 - DNA, 11 bp, Homo sapiens
ccccagcactt

SEQ ID NO: 2915450 - DNA, 14 bp, Homo sapiens
ccccagcagaatgg

SEQ ID NO: 2915451 - DNA, 22 bp, Homo sapiens
ccccagcattctcaggcaccag

SEQ ID NO: 2915452 - DNA, 12 bp, Homo sapiens
ccccagccacag

SEQ ID NO: 2915453 - DNA, 23 bp, Homo sapiens
ccccagccagatggactccagcc

SEQ ID NO: 2915454 - DNA, 13 bp, Homo sapiens
ccccagcccacag

SEQ ID NO: 2915455 - DNA, 15 bp, Homo sapiens
ccccagcccagagac

SEQ ID NO: 2915456 - DNA, 22 bp, Homo sapiens
ccccagcccccaaagcagccct

SEQ ID NO: 2915457 - DNA, 13 bp, Homo sapiens
ccccagccctggc

SEQ ID NO: 2915458 - DNA, 19 bp, Homo sapiens
ccccagcctctcctccttg

SEQ ID NO: 2915459 - DNA, 21 bp, Homo sapiens
ccccagctaagaacctggaac

SEQ ID NO: 2915460 - DNA, 19 bp, Homo sapiens
ccccagctccgacctctct

SEQ ID NO: 2915461 - DNA, 12 bp, Homo sapiens
ccccagctggcc

SEQ ID NO: 2915462 - DNA, 21 bp, Homo sapiens
ccccagctggcccgtgacaga

SEQ ID NO: 2915463 - DNA, 17 bp, Homo sapiens
ccccaggaaaagcacaa

SEQ ID NO: 2915464 - DNA, 11 bp, Homo sapiens
ccccaggccca

SEQ ID NO: 2915465 - DNA, 20 bp, Homo sapiens
ccccaggcccgcgggcacag

SEQ ID NO: 2915466 - DNA, 21 bp, Homo sapiens
ccccaggcccgcgggcacagc

SEQ ID NO: 2915467 - DNA, 13 bp, Homo sapiens
ccccaggccctcc

SEQ ID NO: 2915468 - DNA, 19 bp, Homo sapiens
ccccaggccggagcccaga

SEQ ID NO: 2915469 - DNA, 17 bp, Homo sapiens
ccccaggcctgccctgc

SEQ ID NO: 2915470 - DNA, 19 bp, Homo sapiens
ccccaggcctgccctgcta

SEQ ID NO: 2915471 - DNA, 16 bp, Homo sapiens
ccccaggcctggctcc

SEQ ID NO: 2915472 - DNA, 13 bp, Homo sapiens
cctgaggcttcac

SEQ ID NO: 2915473 - DNA, 13 bp, Homo sapiens
cctgagggagctc

SEQ ID NO: 2915474 - DNA, 23 bp, Homo sapiens
cctgaggtcgggagttggagacc

SEQ ID NO: 2915475 - DNA, 22 bp, Homo sapiens
cctgagtaaaaaagctgtgtgc

SEQ ID NO: 2915476 - DNA, 17 bp, Homo sapiens
cctgagtccgcctgcgc

SEQ ID NO: 2915477 - DNA, 19 bp, Homo sapiens
cctgagtccgcctgcgcct

SEQ ID NO: 2915478 - DNA, 13 bp, Homo sapiens
cctgagtctgggc

SEQ ID NO: 2915479 - DNA, 16 bp, Homo sapiens
cctgagtctgggcagc

SEQ ID NO: 2915480 - DNA, 14 bp, Homo sapiens
cctgagttcctagc

SEQ ID NO: 2915481 - DNA, 21 bp, Homo sapiens
cctgagttcctagccaccgcc

SEQ ID NO: 2915482 - DNA, 20 bp, Homo sapiens
cctgatatgatttaaaacat

SEQ ID NO: 2915483 - DNA, 15 bp, Homo sapiens
cctgatcaatgacag

SEQ ID NO: 2915484 - DNA, 14 bp, Homo sapiens
cctgatcagaccac

SEQ ID NO: 2915485 - DNA, 19 bp, Homo sapiens
cctgatcaggcttcctggt

SEQ ID NO: 2915486 - DNA, 20 bp, Homo sapiens
cctgatcaggcttcctggtg

SEQ ID NO: 2915487 - DNA, 19 bp, Homo sapiens
cctgatgagactccactca

SEQ ID NO: 2915488 - DNA, 17 bp, Homo sapiens
cctgatgagatttttaa

SEQ ID NO: 2915489 - DNA, 15 bp, Homo sapiens
cctgatgatttttat

SEQ ID NO: 2915490 - DNA, 21 bp, Homo sapiens
cctgatgccataaatacaaga

SEQ ID NO: 2915491 - DNA, 18 bp, Homo sapiens
cctgatggagagtgagag

SEQ ID NO: 2915492 - DNA, 13 bp, Homo sapiens
cctgatgtagctt

SEQ ID NO: 2915493 - DNA, 17 bp, Homo sapiens
cctgattgtgccagtgc

SEQ ID NO: 2915494 - DNA, 19 bp, Homo sapiens
cctgatttaggagaagcca

SEQ ID NO: 2915495 - DNA, 19 bp, Homo sapiens
cctgcaaaaggactctcag

SEQ ID NO: 2915496 - DNA, 16 bp, Homo sapiens
cctgcaaacgctgcct

SEQ ID NO: 2915497 - DNA, 17 bp, Homo sapiens
cctgcaaacgctgcctg

SEQ ID NO: 2915498 - DNA, 13 bp, Homo sapiens
cctgcaagcagaa

SEQ ID NO: 2915499 - DNA, 16 bp, Homo sapiens
cctgcaagtatccaga

SEQ ID NO: 2915500 - DNA, 18 bp, Homo sapiens
cctgcacagattcccagg

SEQ ID NO: 2915501 - DNA, 19 bp, Homo sapiens
cctgcacagtgtcccccag

SEQ ID NO: 2915502 - DNA, 20 bp, Homo sapiens
cctgcacagtgtcccccagg

SEQ ID NO: 2915503 - DNA, 14 bp, Homo sapiens
cctgcaccctcttc

SEQ ID NO: 2915504 - DNA, 23 bp, Homo sapiens
cctgcaccctcttctcctctggc

SEQ ID NO: 2915505 - DNA, 23 bp, Homo sapiens
cctgcaccgacccgaggcccaga

SEQ ID NO: 2915506 - DNA, 15 bp, Homo sapiens
cctgcaccggggcct

SEQ ID NO: 2915507 - DNA, 22 bp, Homo sapiens
cctgcacctccccccactgcag

SEQ ID NO: 2915508 - DNA, 18 bp, Homo sapiens
cctgcactccctcctgga

SEQ ID NO: 2915509 - DNA, 15 bp, Homo sapiens
cctgcactccctggc

SEQ ID NO: 2915510 - DNA, 18 bp, Homo sapiens
cctgcactccctggcctt

SEQ ID NO: 2915511 - DNA, 19 bp, Homo sapiens
cctgcactccctggccttg

SEQ ID NO: 2915512 - DNA, 20 bp, Homo sapiens
cctgcactgtgccccgcggg

SEQ ID NO: 2915513 - DNA, 22 bp, Homo sapiens
cctgcactttgggtttttaact

SEQ ID NO: 2915514 - DNA, 19 bp, Homo sapiens
cctgcagacgtctggccct

SEQ ID NO: 2915515 - DNA, 20 bp, Homo sapiens
cctgcagacgtctggccctg

SEQ ID NO: 2915516 - DNA, 22 bp, Homo sapiens
cctgcagacgtctggccctggc

SEQ ID NO: 2915517 - DNA, 12 bp, Homo sapiens
cctgcagcacat

SEQ ID NO: 2915518 - DNA, 22 bp, Homo sapiens
cctgcagcacatgcgggctcgc

SEQ ID NO: 2915519 - DNA, 15 bp, Homo sapiens
cctgcaggagcaggg

SEQ ID NO: 2915520 - DNA, 12 bp, Homo sapiens
cctgcaggccag

SEQ ID NO: 2915521 - DNA, 14 bp, Homo sapiens
cctgcaggctgcag

SEQ ID NO: 2915522 - DNA, 21 bp, Homo sapiens
cctgcaggctgcaggagggca

SEQ ID NO: 2915523 - DNA, 12 bp, Homo sapiens
cctgcagggcca

SEQ ID NO: 2915524 - DNA, 17 bp, Homo sapiens
cctgcagggccatggct

SEQ ID NO: 2915525 - DNA, 20 bp, Homo sapiens
cctgcaggggttgagagctt

SEQ ID NO: 2915526 - DNA, 22 bp, Homo sapiens
cctgcagtattacagaggtcgt

SEQ ID NO: 2915527 - DNA, 12 bp, Homo sapiens
cctgcagtgcca

SEQ ID NO: 2915528 - DNA, 20 bp, Homo sapiens
cctgcagtgccagctccctc

SEQ ID NO: 2915529 - DNA, 22 bp, Homo sapiens
cctgcatatctctagtccctgt

SEQ ID NO: 2915530 - DNA, 17 bp, Homo sapiens
cctgcatctaagcccat

SEQ ID NO: 2915531 - DNA, 18 bp, Homo sapiens
cctgcatgggccagcccc

SEQ ID NO: 2915532 - DNA, 21 bp, Homo sapiens
cctgcatgtaaacacgcctgc

SEQ ID NO: 2915533 - DNA, 10 bp, Homo sapiens
cctgcatttt

SEQ ID NO: 2915534 - DNA, 12 bp, Homo sapiens
cctgccacagcc

SEQ ID NO: 2915535 - DNA, 19 bp, Homo sapiens
cctgccacattagaacttc

SEQ ID NO: 2915536 - DNA, 24 bp, Homo sapiens
cctgccaccctgggcctggcagct

SEQ ID NO: 2915537 - DNA, 17 bp, Homo sapiens
cctgccaccgactgccc

SEQ ID NO: 2915538 - DNA, 14 bp, Homo sapiens
cctgccactcaggc

SEQ ID NO: 2915539 - DNA, 22 bp, Homo sapiens
cctgccactcaggcccaaagcc

SEQ ID NO: 2915540 - DNA, 12 bp, Homo sapiens
cctgccagacac

SEQ ID NO: 2915541 - DNA, 18 bp, Homo sapiens
cctgccagaggatgctct

SEQ ID NO: 2915542 - DNA, 20 bp, Homo sapiens
cctgccagcccggctcggcc

SEQ ID NO: 2915543 - DNA, 22 bp, Homo sapiens
cctgccagcccggctcggccca

SEQ ID NO: 2915544 - DNA, 14 bp, Homo sapiens
cctgccagctctgt

SEQ ID NO: 2915545 - DNA, 16 bp, Homo sapiens
cctgccagctgcactg

SEQ ID NO: 2915546 - DNA, 17 bp, Homo sapiens
cctgccagggcagggcc

SEQ ID NO: 2915547 - DNA, 19 bp, Homo sapiens
cctgccagggcagggcccc

SEQ ID NO: 2915548 - DNA, 21 bp, Homo sapiens
cctgccagtgccttacctcct

SEQ ID NO: 2915549 - DNA, 14 bp, Homo sapiens
cctgccatccccct

SEQ ID NO: 2915550 - DNA, 17 bp, Homo sapiens
cctgcccaagtgaccag

SEQ ID NO: 2915551 - DNA, 18 bp, Homo sapiens
cctgcccaagtgaccagg

SEQ ID NO: 2915552 - DNA, 22 bp, Homo sapiens
cctgcccacacaggttcacgtg

SEQ ID NO: 2915553 - DNA, 14 bp, Homo sapiens
cctgcccacccccg

SEQ ID NO: 2915554 - DNA, 16 bp, Homo sapiens
cctgcccacccccggg

SEQ ID NO: 2915555 - DNA, 15 bp, Homo sapiens
cctgcccacctgcct

SEQ ID NO: 2915556 - DNA, 19 bp, Homo sapiens
cctgcccacctgcctggcc

SEQ ID NO: 2915557 - DNA, 12 bp, Homo sapiens
cctgcccagcca

SEQ ID NO: 2915558 - DNA, 12 bp, Homo sapiens
cctgcccagcct

SEQ ID NO: 2915559 - DNA, 16 bp, Homo sapiens
cctgcccagcctgggg

SEQ ID NO: 2915560 - DNA, 23 bp, Homo sapiens
cctgcccaggagagccagccctc

SEQ ID NO: 2915561 - DNA, 16 bp, Homo sapiens
cctgcccattggagag

SEQ ID NO: 2915562 - DNA, 21 bp, Homo sapiens
cctgccccaactctcccctga

SEQ ID NO: 2915563 - DNA, 20 bp, Homo sapiens
cctgccccaatccctttatt

SEQ ID NO: 2915564 - DNA, 14 bp, Homo sapiens
cctgcccccaagtc

SEQ ID NO: 2915565 - DNA, 18 bp, Homo sapiens
cctgccccgcaggcctgc

SEQ ID NO: 2915566 - DNA, 21 bp, Homo sapiens
cctgccccgcaggcctgcctt

SEQ ID NO: 2915567 - DNA, 19 bp, Homo sapiens
cctgcccctccctagatcc

SEQ ID NO: 2915568 - DNA, 20 bp, Homo sapiens
cctgcccctccctagatcca

SEQ ID NO: 2915569 - DNA, 24 bp, Homo sapiens
cctgcccgcaccctggcctggtcc

SEQ ID NO: 2915570 - DNA, 18 bp, Homo sapiens
cctgcccgcagacctctg

SEQ ID NO: 2915571 - DNA, 22 bp, Homo sapiens
cctgcccgtaaacacgcctgca

SEQ ID NO: 2915572 - DNA, 16 bp, Homo sapiens
cctgcccgtgtacata

SEQ ID NO: 2915573 - DNA, 13 bp, Homo sapiens
cctgccctcatgg

SEQ ID NO: 2915574 - DNA, 13 bp, Homo sapiens
cctgccctcctct

SEQ ID NO: 2915575 - DNA, 19 bp, Homo sapiens
cctgccctcctgagcctcc

SEQ ID NO: 2915576 - DNA, 15 bp, Homo sapiens
cctgccctgctccta

SEQ ID NO: 2915577 - DNA, 18 bp, Homo sapiens
cctgccctgctcctaagg

SEQ ID NO: 2915578 - DNA, 13 bp, Homo sapiens
cctgccctgtgcc

SEQ ID NO: 2915579 - DNA, 18 bp, Homo sapiens
cctgccctgtgccgcact

SEQ ID NO: 2915580 - DNA, 13 bp, Homo sapiens
cctgcccttggca

SEQ ID NO: 2915581 - DNA, 17 bp, Homo sapiens
cctgccgcctcccggga

SEQ ID NO: 2915582 - DNA, 17 bp, Homo sapiens
cctgccggaatgaactg

SEQ ID NO: 2915583 - DNA, 16 bp, Homo sapiens
cctgccggagaggaag

SEQ ID NO: 2915584 - DNA, 18 bp, Homo sapiens
cctgccggagaggaagag

SEQ ID NO: 2915585 - DNA, 21 bp, Homo sapiens
cctgccggtaaacacgcctgc

SEQ ID NO: 2915586 - DNA, 17 bp, Homo sapiens
cctgcctagctcttggg

SEQ ID NO: 2915587 - DNA, 10 bp, Homo sapiens
cctgcctcac

SEQ ID NO: 2915588 - DNA, 20 bp, Homo sapiens
cctgcctcagcctccccagt

SEQ ID NO: 2915589 - DNA, 19 bp, Homo sapiens
cctgcctcagcctcccgag

SEQ ID NO: 2915590 - DNA, 15 bp, Homo sapiens
cctgcctcagccttc

SEQ ID NO: 2915591 - DNA, 12 bp, Homo sapiens
cctgcctcagga

SEQ ID NO: 2915592 - DNA, 22 bp, Homo sapiens
cctgcctcgagggccgcctgcc

SEQ ID NO: 2915593 - DNA, 13 bp, Homo sapiens
cctgcctcgcctt

SEQ ID NO: 2915594 - DNA, 16 bp, Homo sapiens
cctgcctcgccttgtg

SEQ ID NO: 2915595 - DNA, 13 bp, Homo sapiens
cctgcctgccacc

SEQ ID NO: 2915596 - DNA, 12 bp, Homo sapiens
cctgcctggacc

SEQ ID NO: 2915597 - DNA, 12 bp, Homo sapiens
cctgcctggccg

SEQ ID NO: 2915598 - DNA, 14 bp, Homo sapiens
cctgcctggccggc

SEQ ID NO: 2915599 - DNA, 17 bp, Homo sapiens
cctgcctggccggccag

SEQ ID NO: 2915600 - DNA, 16 bp, Homo sapiens
cctgcctgtagcccac

SEQ ID NO: 2915601 - DNA, 16 bp, Homo sapiens
cctgccttcctcctgg

SEQ ID NO: 2915602 - DNA, 18 bp, Homo sapiens
cctgccttcttcggggaa

SEQ ID NO: 2915603 - DNA, 23 bp, Homo sapiens
cctgccttggagtcgtctggcat

SEQ ID NO: 2915604 - DNA, 13 bp, Homo sapiens
ccttacccctgcc

SEQ ID NO: 2915605 - DNA, 17 bp, Homo sapiens
ccttaccctccttggga

SEQ ID NO: 2915606 - DNA, 15 bp, Homo sapiens
ccttacccttagaat

SEQ ID NO: 2915607 - DNA, 17 bp, Homo sapiens
ccttacgatcaggcaca

SEQ ID NO: 2915608 - DNA, 23 bp, Homo sapiens
ccttactattcccactttcattc

SEQ ID NO: 2915609 - DNA, 13 bp, Homo sapiens
ccttactcagagc

SEQ ID NO: 2915610 - DNA, 20 bp, Homo sapiens
ccttactcaggggatgttta

SEQ ID NO: 2915611 - DNA, 14 bp, Homo sapiens
ccttacttccagca

SEQ ID NO: 2915612 - DNA, 15 bp, Homo sapiens
ccttacttccagcaa

SEQ ID NO: 2915613 - DNA, 13 bp, Homo sapiens
ccttacttcttgc

SEQ ID NO: 2915614 - DNA, 21 bp, Homo sapiens
ccttactttactgcctgaata

SEQ ID NO: 2915615 - DNA, 23 bp, Homo sapiens
ccttactttactgcctgaataaa

SEQ ID NO: 2915616 - DNA, 14 bp, Homo sapiens
ccttagacctgagg

SEQ ID NO: 2915617 - DNA, 16 bp, Homo sapiens
ccttagaccttccata

SEQ ID NO: 2915618 - DNA, 20 bp, Homo sapiens
ccttagatttagtagtgtaa

SEQ ID NO: 2915619 - DNA, 20 bp, Homo sapiens
ccttagcaatgggggcctcc

SEQ ID NO: 2915620 - DNA, 15 bp, Homo sapiens
ccttagcagcccagc

SEQ ID NO: 2915621 - DNA, 15 bp, Homo sapiens
ccttagccttgctgt

SEQ ID NO: 2915622 - DNA, 16 bp, Homo sapiens
ccttagccttgctgta

SEQ ID NO: 2915623 - DNA, 23 bp, Homo sapiens
ccttagccttgctgtagagactt

SEQ ID NO: 2915624 - DNA, 22 bp, Homo sapiens
ccttagctacaatcctaccttt

SEQ ID NO: 2915625 - DNA, 20 bp, Homo sapiens
ccttagctgccaagccccat

SEQ ID NO: 2915626 - DNA, 15 bp, Homo sapiens
ccttaggcagggaag

SEQ ID NO: 2915627 - DNA, 14 bp, Homo sapiens
ccttaggccttcct

SEQ ID NO: 2915628 - DNA, 19 bp, Homo sapiens
ccttagtgtttctgtgcat

SEQ ID NO: 2915629 - DNA, 14 bp, Homo sapiens
ccttatccccactt

SEQ ID NO: 2915630 - DNA, 16 bp, Homo sapiens
ccttatccttcatctt

SEQ ID NO: 2915631 - DNA, 20 bp, Homo sapiens
ccttatccttcctctccttc

SEQ ID NO: 2915632 - DNA, 22 bp, Homo sapiens
ccttatctccaagaccagagat

SEQ ID NO: 2915633 - DNA, 16 bp, Homo sapiens
ccttattagagtgtct

SEQ ID NO: 2915634 - DNA, 19 bp, Homo sapiens
ccttattgagcgtgattct

SEQ ID NO: 2915635 - DNA, 19 bp, Homo sapiens
ccttcaacgtttcttcact

SEQ ID NO: 2915636 - DNA, 12 bp, Homo sapiens
ccttcacaaagc

SEQ ID NO: 2915637 - DNA, 18 bp, Homo sapiens
ccttcacaaagcccaagg

SEQ ID NO: 2915638 - DNA, 15 bp, Homo sapiens
ccttcactggcgcct

SEQ ID NO: 2915639 - DNA, 19 bp, Homo sapiens
ccttcactggcgccttctc

SEQ ID NO: 2915640 - DNA, 13 bp, Homo sapiens
ccttcactgtgct

SEQ ID NO: 2915641 - DNA, 18 bp, Homo sapiens
ccttcacttttctgagtt

SEQ ID NO: 2915642 - DNA, 17 bp, Homo sapiens
ccttcagaacagaggca

SEQ ID NO: 2915643 - DNA, 17 bp, Homo sapiens
ccttcagacaccctcaa

SEQ ID NO: 2915644 - DNA, 16 bp, Homo sapiens
ccttcagcagcagctc

SEQ ID NO: 2915645 - DNA, 19 bp, Homo sapiens
ccttcagctttatttttct

SEQ ID NO: 2915646 - DNA, 18 bp, Homo sapiens
ccttcagggtgatgccag

SEQ ID NO: 2915647 - DNA, 15 bp, Homo sapiens
ccttcagtgcccacc

SEQ ID NO: 2915648 - DNA, 17 bp, Homo sapiens
ccttcattaaatgtttg

SEQ ID NO: 2915649 - DNA, 21 bp, Homo sapiens
ccttcattaccttttttgata

SEQ ID NO: 2915650 - DNA, 22 bp, Homo sapiens
ccttcattgatttcctgtgtca

SEQ ID NO: 2915651 - DNA, 17 bp, Homo sapiens
ccttcatttcatcctgt

SEQ ID NO: 2915652 - DNA, 15 bp, Homo sapiens
ccttccaagagcctg

SEQ ID NO: 2915653 - DNA, 16 bp, Homo sapiens
ccttccaagagcctga

SEQ ID NO: 2915654 - DNA, 17 bp, Homo sapiens
ccttccaagagcctgag

SEQ ID NO: 2915655 - DNA, 14 bp, Homo sapiens
ccttccacctcaca

SEQ ID NO: 2915656 - DNA, 20 bp, Homo sapiens
ccttccacctcacaactcct

SEQ ID NO: 2915657 - DNA, 21 bp, Homo sapiens
ccttccacggatccatgtagc

SEQ ID NO: 2915658 - DNA, 17 bp, Homo sapiens
ccttccactgagggcag

SEQ ID NO: 2915659 - DNA, 13 bp, Homo sapiens
ccttccagcccag

SEQ ID NO: 2915660 - DNA, 23 bp, Homo sapiens
ccttccatagcctaatccctggg

SEQ ID NO: 2915661 - DNA, 16 bp, Homo sapiens
ccttccatgctcccaa

SEQ ID NO: 2915662 - DNA, 14 bp, Homo sapiens
ccttcccaagaaga

SEQ ID NO: 2915663 - DNA, 20 bp, Homo sapiens
ccttcccaagtaagaggctg

SEQ ID NO: 2915664 - DNA, 13 bp, Homo sapiens
ccttcccagctct

SEQ ID NO: 2915665 - DNA, 19 bp, Homo sapiens
ccttcccagctctccctct

SEQ ID NO: 2915666 - DNA, 21 bp, Homo sapiens
ccttcccagctctccctctgg

SEQ ID NO: 2915667 - DNA, 13 bp, Homo sapiens
ccttcccagtggg

SEQ ID NO: 2915668 - DNA, 15 bp, Homo sapiens
ccttccccagacttg

SEQ ID NO: 2915669 - DNA, 23 bp, Homo sapiens
ccttccctcaccttggcaccaga

SEQ ID NO: 2915670 - DNA, 15 bp, Homo sapiens
ccttccctcactctt

SEQ ID NO: 2915671 - DNA, 10 bp, Homo sapiens
ccttccctgc

SEQ ID NO: 2915672 - DNA, 21 bp, Homo sapiens
ccttccctgcctccagctgtc

SEQ ID NO: 2915673 - DNA, 11 bp, Homo sapiens
ccttccctggc

SEQ ID NO: 2915674 - DNA, 22 bp, Homo sapiens
ccttccgcagtgtggccaggct

SEQ ID NO: 2915675 - DNA, 16 bp, Homo sapiens
ccttccgccttctccc

SEQ ID NO: 2915676 - DNA, 17 bp, Homo sapiens
ccttccgggttcaagtg

SEQ ID NO: 2915677 - DNA, 17 bp, Homo sapiens
ccttcctaagcctgtgg

SEQ ID NO: 2915678 - DNA, 23 bp, Homo sapiens
ccttcctaagcctgtggctgtgg

SEQ ID NO: 2915679 - DNA, 18 bp, Homo sapiens
ccttcctcatctgtgcct

SEQ ID NO: 2915680 - DNA, 21 bp, Homo sapiens
ccttcctctccttccttgtta

SEQ ID NO: 2915681 - DNA, 16 bp, Homo sapiens
ccttcctgcagtctcc

SEQ ID NO: 2915682 - DNA, 14 bp, Homo sapiens
ccttcctgcttcct

SEQ ID NO: 2915683 - DNA, 20 bp, Homo sapiens
ccttcctggagactgcccag

SEQ ID NO: 2915684 - DNA, 14 bp, Homo sapiens
ccttcctggcccag

SEQ ID NO: 2915685 - DNA, 19 bp, Homo sapiens
ccttcctggcccaggcctt

SEQ ID NO: 2915686 - DNA, 15 bp, Homo sapiens
ccttcctgtgccctg

SEQ ID NO: 2915687 - DNA, 12 bp, Homo sapiens
ccttcctttttt

SEQ ID NO: 2915688 - DNA, 14 bp, Homo sapiens
ccttcgggctgtgc

SEQ ID NO: 2915689 - DNA, 15 bp, Homo sapiens
ccttcgggctgtgcc

SEQ ID NO: 2915690 - DNA, 16 bp, Homo sapiens
ccttcgggctgtgccc

SEQ ID NO: 2915691 - DNA, 17 bp, Homo sapiens
ccttcgtttactatgcc

SEQ ID NO: 2915692 - DNA, 14 bp, Homo sapiens
ccttcgtttatatt

SEQ ID NO: 2915693 - DNA, 12 bp, Homo sapiens
ccttctcaccag

SEQ ID NO: 2915694 - DNA, 14 bp, Homo sapiens
ccttctcaccagct

SEQ ID NO: 2915695 - DNA, 15 bp, Homo sapiens
ccttctcaccagctg

SEQ ID NO: 2915696 - DNA, 17 bp, Homo sapiens
ccttctcaccagctgca

SEQ ID NO: 2915697 - DNA, 19 bp, Homo sapiens
ccttctcaccagctgcaaa

SEQ ID NO: 2915698 - DNA, 20 bp, Homo sapiens
ccttctcaccagctgcaaag

SEQ ID NO: 2915699 - DNA, 14 bp, Homo sapiens
ccttctcagctctc

SEQ ID NO: 2915700 - DNA, 22 bp, Homo sapiens
ccttctccatccacatgggagc

SEQ ID NO: 2915701 - DNA, 15 bp, Homo sapiens
ccttctcctcttgta

SEQ ID NO: 2915702 - DNA, 16 bp, Homo sapiens
ccttctcctcttgtaa

SEQ ID NO: 2915703 - DNA, 17 bp, Homo sapiens
ccttctcctcttgtaaa

SEQ ID NO: 2915704 - DNA, 19 bp, Homo sapiens
ccttctcggagctggccca

SEQ ID NO: 2915705 - DNA, 13 bp, Homo sapiens
ccttctctcagct

SEQ ID NO: 2915706 - DNA, 16 bp, Homo sapiens
ccttctctcagctccc

SEQ ID NO: 2915707 - DNA, 11 bp, Homo sapiens
ccttctctgtg

SEQ ID NO: 2915708 - DNA, 12 bp, Homo sapiens
ccttctctgtga

SEQ ID NO: 2915709 - DNA, 18 bp, Homo sapiens
ccttctcttctcttcttt

SEQ ID NO: 2915710 - DNA, 23 bp, Homo sapiens
ccttctcttctcttctttgggat

SEQ ID NO: 2915711 - DNA, 14 bp, Homo sapiens
ccttctctttaaat

SEQ ID NO: 2915712 - DNA, 20 bp, Homo sapiens
ccttctgaaaaagtatcctg

SEQ ID NO: 2915713 - DNA, 23 bp, Homo sapiens
ccttctgatcttggaaaaacagc

SEQ ID NO: 2915714 - DNA, 16 bp, Homo sapiens
ccttctggaaactgtg

SEQ ID NO: 2915715 - DNA, 19 bp, Homo sapiens
ccttctggaaactgtgaag

SEQ ID NO: 2915716 - DNA, 20 bp, Homo sapiens
ccttctggcctcccacagac

SEQ ID NO: 2915717 - DNA, 18 bp, Homo sapiens
ccttctgtccctcacagc

SEQ ID NO: 2915718 - DNA, 12 bp, Homo sapiens
ccttctgtgaag

SEQ ID NO: 2915719 - DNA, 18 bp, Homo sapiens
ccttcttattctcactcc

SEQ ID NO: 2915720 - DNA, 18 bp, Homo sapiens
ccttcttcaggctgccta

SEQ ID NO: 2915721 - DNA, 17 bp, Homo sapiens
ccttcttcagggcctgg

SEQ ID NO: 2915722 - DNA, 18 bp, Homo sapiens
ccttcttcagggcctggt

SEQ ID NO: 2915723 - DNA, 20 bp, Homo sapiens
ccttcttccaaggagcagag

SEQ ID NO: 2915724 - DNA, 11 bp, Homo sapiens
ccttcttcctc

SEQ ID NO: 2915725 - DNA, 15 bp, Homo sapiens
ccttctttaccttca

SEQ ID NO: 2915726 - DNA, 19 bp, Homo sapiens
ccttgaaaacaaacaaatc

SEQ ID NO: 2915727 - DNA, 21 bp, Homo sapiens
ccttgaaaataagaatagaaa

SEQ ID NO: 2915728 - DNA, 13 bp, Homo sapiens
ccttgaaaggaag

SEQ ID NO: 2915729 - DNA, 18 bp, Homo sapiens
ccttgaaatacctgtttc

SEQ ID NO: 2915730 - DNA, 20 bp, Homo sapiens
ccttgaacaaaaagtttttt

SEQ ID NO: 2915731 - DNA, 15 bp, Homo sapiens
ccttgaagacagagc

SEQ ID NO: 2915732 - DNA, 23 bp, Homo sapiens
ccttgacaaagtcaagccacatg

SEQ ID NO: 2915733 - DNA, 16 bp, Homo sapiens
ccttgacaactggcag

SEQ ID NO: 2915734 - DNA, 17 bp, Homo sapiens
ccttgacagagcagcta

SEQ ID NO: 2915735 - DNA, 14 bp, Homo sapiens
ccttgaccattggc

SEQ ID NO: 2915736 - DNA, 21 bp, Homo sapiens
ccttgactgaagcgaacatct

SEQ ID NO: 2915737 - DNA, 14 bp, Homo sapiens
cgcctgtcccctca

SEQ ID NO: 2915738 - DNA, 20 bp, Homo sapiens
cgcctgtcccctcacagact

SEQ ID NO: 2915739 - DNA, 22 bp, Homo sapiens
cgcctgtcccctcacagactct

SEQ ID NO: 2915740 - DNA, 13 bp, Homo sapiens
cgccttctccctt

SEQ ID NO: 2915741 - DNA, 23 bp, Homo sapiens
cgccttctcggagctggcccagg

SEQ ID NO: 2915742 - DNA, 15 bp, Homo sapiens
cgcgagaggccgagc

SEQ ID NO: 2915743 - DNA, 19 bp, Homo sapiens
cgcgcccccctcccagagg

SEQ ID NO: 2915744 - DNA, 11 bp, Homo sapiens
cgcgcctgcct

SEQ ID NO: 2915745 - DNA, 20 bp, Homo sapiens
cgcggacgtgctggccttgg

SEQ ID NO: 2915746 - DNA, 21 bp, Homo sapiens
cgcggacgtgctggccttggt

SEQ ID NO: 2915747 - DNA, 15 bp, Homo sapiens
cgcggagacctcctg

SEQ ID NO: 2915748 - DNA, 11 bp, Homo sapiens
cgcggcccaga

SEQ ID NO: 2915749 - DNA, 14 bp, Homo sapiens
cgcggcccagaccc

SEQ ID NO: 2915750 - DNA, 15 bp, Homo sapiens
cgcggcccagaccca

SEQ ID NO: 2915751 - DNA, 16 bp, Homo sapiens
cgcggcccagacccag

SEQ ID NO: 2915752 - DNA, 11 bp, Homo sapiens
cgcggcctccc

SEQ ID NO: 2915753 - DNA, 14 bp, Homo sapiens
cgcggcctccccga

SEQ ID NO: 2915754 - DNA, 13 bp, Homo sapiens
cgcgggctttgtt

SEQ ID NO: 2915755 - DNA, 14 bp, Homo sapiens
cgcgtgccgggccc

SEQ ID NO: 2915756 - DNA, 17 bp, Homo sapiens
cgcgtgccgggccccca

SEQ ID NO: 2915757 - DNA, 16 bp, Homo sapiens
cgcgtggcgtggcccg

SEQ ID NO: 2915758 - DNA, 17 bp, Homo sapiens
cgcgttgcctgtcgctt

SEQ ID NO: 2915759 - DNA, 15 bp, Homo sapiens
cgctaacccccagcc

SEQ ID NO: 2915760 - DNA, 23 bp, Homo sapiens
cgctacaaaacgcgcagatgtgc

SEQ ID NO: 2915761 - DNA, 23 bp, Homo sapiens
cgctacaaaataaagctgttctc

SEQ ID NO: 2915762 - DNA, 14 bp, Homo sapiens
cgctacctccctcc

SEQ ID NO: 2915763 - DNA, 17 bp, Homo sapiens
cgctacctctctgtccc

SEQ ID NO: 2915764 - DNA, 13 bp, Homo sapiens
cgctcagcccagc

SEQ ID NO: 2915765 - DNA, 12 bp, Homo sapiens
cgctcagtctgt

SEQ ID NO: 2915766 - DNA, 16 bp, Homo sapiens
cgctccagctgccccg

SEQ ID NO: 2915767 - DNA, 18 bp, Homo sapiens
cgctccagctgccccggc

SEQ ID NO: 2915768 - DNA, 10 bp, Homo sapiens
cgctccaggt

SEQ ID NO: 2915769 - DNA, 12 bp, Homo sapiens
cgctcccctcca

SEQ ID NO: 2915770 - DNA, 13 bp, Homo sapiens
cgctcccgggact

SEQ ID NO: 2915771 - DNA, 20 bp, Homo sapiens
cgctccctcccaggactctg

SEQ ID NO: 2915772 - DNA, 13 bp, Homo sapiens
cgctcggcaggaa

SEQ ID NO: 2915773 - DNA, 13 bp, Homo sapiens
cgctctcctggac

SEQ ID NO: 2915774 - DNA, 15 bp, Homo sapiens
cgctctgctcagtgg

SEQ ID NO: 2915775 - DNA, 12 bp, Homo sapiens
cgctctggacag

SEQ ID NO: 2915776 - DNA, 13 bp, Homo sapiens
cgctctggacaga

SEQ ID NO: 2915777 - DNA, 20 bp, Homo sapiens
cgctgaagcggtcagactgg

SEQ ID NO: 2915778 - DNA, 21 bp, Homo sapiens
cgctgaagcggtcagactgga

SEQ ID NO: 2915779 - DNA, 17 bp, Homo sapiens
cgctgaccctgggcctg

SEQ ID NO: 2915780 - DNA, 20 bp, Homo sapiens
cgctgaccctgggcctggag

SEQ ID NO: 2915781 - DNA, 21 bp, Homo sapiens
cgctgagaggctgcctccgca

SEQ ID NO: 2915782 - DNA, 22 bp, Homo sapiens
cgctgagaggctgcctccgcac

SEQ ID NO: 2915783 - DNA, 21 bp, Homo sapiens
cgctgaggtgtctggcctgag

SEQ ID NO: 2915784 - DNA, 22 bp, Homo sapiens
cgctgaggtgtctggcctgagg

SEQ ID NO: 2915785 - DNA, 15 bp, Homo sapiens
cgctgcccgctcagc

SEQ ID NO: 2915786 - DNA, 20 bp, Homo sapiens
cgctgcccgctcagcccagc

SEQ ID NO: 2915787 - DNA, 22 bp, Homo sapiens
cgctgccctgggtcctgcctgc

SEQ ID NO: 2915788 - DNA, 13 bp, Homo sapiens
cgctgccgcaccc

SEQ ID NO: 2915789 - DNA, 21 bp, Homo sapiens
cgctgccgcaccccagagtgt

SEQ ID NO: 2915790 - DNA, 13 bp, Homo sapiens
cgctgcctcaggc

SEQ ID NO: 2915791 - DNA, 17 bp, Homo sapiens
cgctgcctcctggtaac

SEQ ID NO: 2915792 - DNA, 13 bp, Homo sapiens
cgctgcctggcca

SEQ ID NO: 2915793 - DNA, 23 bp, Homo sapiens
cgctgcggacaccgtggcctggg

SEQ ID NO: 2915794 - DNA, 15 bp, Homo sapiens
cgctgcttccaggct

SEQ ID NO: 2915795 - DNA, 20 bp, Homo sapiens
cgctggactctcagtctctg

SEQ ID NO: 2915796 - DNA, 23 bp, Homo sapiens
cgctggcccctttgggccctgca

SEQ ID NO: 2915797 - DNA, 23 bp, Homo sapiens
cgctggccgggaccccgagcctg

SEQ ID NO: 2915798 - DNA, 15 bp, Homo sapiens
cgctgggcacttccc

SEQ ID NO: 2915799 - DNA, 16 bp, Homo sapiens
cgctgggcacttccct

SEQ ID NO: 2915800 - DNA, 22 bp, Homo sapiens
cgctggggaccggttcccacaa

SEQ ID NO: 2915801 - DNA, 13 bp, Homo sapiens
cgctggtgctgag

SEQ ID NO: 2915802 - DNA, 15 bp, Homo sapiens
cgctggttccgccag

SEQ ID NO: 2915803 - DNA, 18 bp, Homo sapiens
cgctgtattttgagtttc

SEQ ID NO: 2915804 - DNA, 20 bp, Homo sapiens
cgctgtgctatcatgatgga

SEQ ID NO: 2915805 - DNA, 15 bp, Homo sapiens
cgctgtgctggttct

SEQ ID NO: 2915806 - DNA, 15 bp, Homo sapiens
cgcttagcgctctgg

SEQ ID NO: 2915807 - DNA, 14 bp, Homo sapiens
cgcttggagcagag

SEQ ID NO: 2915808 - DNA, 20 bp, Homo sapiens
cgcttgtccagcgcctagtg

SEQ ID NO: 2915809 - DNA, 15 bp, Homo sapiens
cggaaacaaaaatga

SEQ ID NO: 2915810 - DNA, 20 bp, Homo sapiens
cggaaagcagctcaaaggca

SEQ ID NO: 2915811 - DNA, 13 bp, Homo sapiens
cggaagcctgtcc

SEQ ID NO: 2915812 - DNA, 21 bp, Homo sapiens
cggaaggacgcggaacctggg

SEQ ID NO: 2915813 - DNA, 19 bp, Homo sapiens
cggaatttacctgatttct

SEQ ID NO: 2915814 - DNA, 17 bp, Homo sapiens
cggacaaaagggccagg

SEQ ID NO: 2915815 - DNA, 18 bp, Homo sapiens
cggacaaaagggccaggt

SEQ ID NO: 2915816 - DNA, 14 bp, Homo sapiens
cggacaccccctcg

SEQ ID NO: 2915817 - DNA, 18 bp, Homo sapiens
cggacagtcggaaaagcg

SEQ ID NO: 2915818 - DNA, 16 bp, Homo sapiens
cggacctgagcccgca

SEQ ID NO: 2915819 - DNA, 21 bp, Homo sapiens
cggacctgagcccgcagccca

SEQ ID NO: 2915820 - DNA, 22 bp, Homo sapiens
cggacgcaggtgctgcggcgcg

SEQ ID NO: 2915821 - DNA, 16 bp, Homo sapiens
cggacgtgctggcctt

SEQ ID NO: 2915822 - DNA, 19 bp, Homo sapiens
cggagaggaagagacactc

SEQ ID NO: 2915823 - DNA, 11 bp, Homo sapiens
cggagcccaga

SEQ ID NO: 2915824 - DNA, 13 bp, Homo sapiens
cggagcccctgaa

SEQ ID NO: 2915825 - DNA, 20 bp, Homo sapiens
cggagcccctgaaagcctca

SEQ ID NO: 2915826 - DNA, 21 bp, Homo sapiens
cggagcccctgaaagcctcac

SEQ ID NO: 2915827 - DNA, 19 bp, Homo sapiens
cggagctcttctgtgccct

SEQ ID NO: 2915828 - DNA, 17 bp, Homo sapiens
cggagctgcccctctct

SEQ ID NO: 2915829 - DNA, 20 bp, Homo sapiens
cggagctgcccctctctggg

SEQ ID NO: 2915830 - DNA, 16 bp, Homo sapiens
cggagctgcctgcagc

SEQ ID NO: 2915831 - DNA, 21 bp, Homo sapiens
cggagctggttcctctctccc

SEQ ID NO: 2915832 - DNA, 21 bp, Homo sapiens
cggaggcctgcgaccctgggg

SEQ ID NO: 2915833 - DNA, 22 bp, Homo sapiens
cggaggcctgcgaccctggggg

SEQ ID NO: 2915834 - DNA, 21 bp, Homo sapiens
cggaggccttggggtgggggc

SEQ ID NO: 2915835 - DNA, 23 bp, Homo sapiens
cggaggctcctccctctgcctca

SEQ ID NO: 2915836 - DNA, 19 bp, Homo sapiens
cggagggaaactgtgaatg

SEQ ID NO: 2915837 - DNA, 19 bp, Homo sapiens
cggagtgtgtatgccaaga

SEQ ID NO: 2915838 - DNA, 22 bp, Homo sapiens
cggagttttgctcttgtagccc

SEQ ID NO: 2915839 - DNA, 17 bp, Homo sapiens
cggatcctaagcatcta

SEQ ID NO: 2915840 - DNA, 15 bp, Homo sapiens
cggatctcactcagc

SEQ ID NO: 2915841 - DNA, 16 bp, Homo sapiens
cggatctttggacaga

SEQ ID NO: 2915842 - DNA, 19 bp, Homo sapiens
cggatctttggacagaagc

SEQ ID NO: 2915843 - DNA, 15 bp, Homo sapiens
cggatggcaggatcc

SEQ ID NO: 2915844 - DNA, 16 bp, Homo sapiens
cggatggcaggatcca

SEQ ID NO: 2915845 - DNA, 20 bp, Homo sapiens
cggattattatttgtacttt

SEQ ID NO: 2915846 - DNA, 12 bp, Homo sapiens
cggattggccct

SEQ ID NO: 2915847 - DNA, 15 bp, Homo sapiens
cggattggccctgcc

SEQ ID NO: 2915848 - DNA, 18 bp, Homo sapiens
cggattggccctgcccct

SEQ ID NO: 2915849 - DNA, 17 bp, Homo sapiens
cggcacggtcttccctc

SEQ ID NO: 2915850 - DNA, 14 bp, Homo sapiens
cggcagaactctct

SEQ ID NO: 2915851 - DNA, 15 bp, Homo sapiens
cggcagaactctctg

SEQ ID NO: 2915852 - DNA, 14 bp, Homo sapiens
cggcagatgatgct

SEQ ID NO: 2915853 - DNA, 20 bp, Homo sapiens
cggcagctcttctgggcaga

SEQ ID NO: 2915854 - DNA, 21 bp, Homo sapiens
cggcagctcttctgggcagag

SEQ ID NO: 2915855 - DNA, 21 bp, Homo sapiens
cggcaggacaacgaggaagcc

SEQ ID NO: 2915856 - DNA, 15 bp, Homo sapiens
cggcagggccaggct

SEQ ID NO: 2915857 - DNA, 20 bp, Homo sapiens
cggcagggcgggcagagggc

SEQ ID NO: 2915858 - DNA, 22 bp, Homo sapiens
cggcagggcgggcagagggctg

SEQ ID NO: 2915859 - DNA, 23 bp, Homo sapiens
cggcagggcgggcagagggctgg

SEQ ID NO: 2915860 - DNA, 15 bp, Homo sapiens
cggcagtattttctg

SEQ ID NO: 2915861 - DNA, 20 bp, Homo sapiens
cggcagttctgggtgctccc

SEQ ID NO: 2915862 - DNA, 21 bp, Homo sapiens
cggcatccttgcctgtctaaa

SEQ ID NO: 2915863 - DNA, 23 bp, Homo sapiens
cggcatccttgcctgtctaaagc

SEQ ID NO: 2915864 - DNA, 18 bp, Homo sapiens
cggcatgagactcagtgc

SEQ ID NO: 2915865 - DNA, 21 bp, Homo sapiens
cggcatgagactcagtgcaga

SEQ ID NO: 2915866 - DNA, 23 bp, Homo sapiens
cggcatgagactcagtgcagatg

SEQ ID NO: 2915867 - DNA, 16 bp, Homo sapiens
cggcatgccaggaccc

SEQ ID NO: 2915868 - DNA, 14 bp, Homo sapiens
cggccagccagcca

SEQ ID NO: 2915869 - DNA, 16 bp, Homo sapiens
cgtgccacccccagcc

SEQ ID NO: 2915870 - DNA, 13 bp, Homo sapiens
cgtgccagcagcc

SEQ ID NO: 2915871 - DNA, 16 bp, Homo sapiens
cgtgccagcagcctcg

SEQ ID NO: 2915872 - DNA, 18 bp, Homo sapiens
cgtgccattgtactccag

SEQ ID NO: 2915873 - DNA, 21 bp, Homo sapiens
cgtgccattgtactccagcct

SEQ ID NO: 2915874 - DNA, 15 bp, Homo sapiens
cgtgcccctgctgct

SEQ ID NO: 2915875 - DNA, 18 bp, Homo sapiens
cgtgcccctgctgctgtc

SEQ ID NO: 2915876 - DNA, 19 bp, Homo sapiens
cgtgcccggctaatttttt

SEQ ID NO: 2915877 - DNA, 14 bp, Homo sapiens
cgtgccctaccaca

SEQ ID NO: 2915878 - DNA, 15 bp, Homo sapiens
cgtgccgcctgcact

SEQ ID NO: 2915879 - DNA, 14 bp, Homo sapiens
cgtgccgggccccc

SEQ ID NO: 2915880 - DNA, 23 bp, Homo sapiens
cgtgccttaggaatactgtttta

SEQ ID NO: 2915881 - DNA, 23 bp, Homo sapiens
cgtgcgctgggcacttccctgct

SEQ ID NO: 2915882 - DNA, 15 bp, Homo sapiens
cgtgctgacagctgc

SEQ ID NO: 2915883 - DNA, 15 bp, Homo sapiens
cgtgctggcgacact

SEQ ID NO: 2915884 - DNA, 13 bp, Homo sapiens
cgtggactctgca

SEQ ID NO: 2915885 - DNA, 17 bp, Homo sapiens
cgtggattcgcttgagt

SEQ ID NO: 2915886 - DNA, 14 bp, Homo sapiens
cgtggcccgtggcc

SEQ ID NO: 2915887 - DNA, 16 bp, Homo sapiens
cgtggcccgtggcctg

SEQ ID NO: 2915888 - DNA, 17 bp, Homo sapiens
cgtggcccgtggcctgg

SEQ ID NO: 2915889 - DNA, 17 bp, Homo sapiens
cgtggcctggcatctgt

SEQ ID NO: 2915890 - DNA, 21 bp, Homo sapiens
cgtggcctggcatctgtgtgc

SEQ ID NO: 2915891 - DNA, 13 bp, Homo sapiens
cgtggcctgggct

SEQ ID NO: 2915892 - DNA, 19 bp, Homo sapiens
cgtggcctgggcttggccc

SEQ ID NO: 2915893 - DNA, 23 bp, Homo sapiens
cgtggctccagaatgtgctgcct

SEQ ID NO: 2915894 - DNA, 15 bp, Homo sapiens
cgtggctctgctggc

SEQ ID NO: 2915895 - DNA, 23 bp, Homo sapiens
cgtggctgtggcatccagagtcc

SEQ ID NO: 2915896 - DNA, 18 bp, Homo sapiens
cgtggcttccctgtccca

SEQ ID NO: 2915897 - DNA, 15 bp, Homo sapiens
cgtggcttggcatct

SEQ ID NO: 2915898 - DNA, 17 bp, Homo sapiens
cgtggcttggcatctgt

SEQ ID NO: 2915899 - DNA, 18 bp, Homo sapiens
cgtggcttgggctggtca

SEQ ID NO: 2915900 - DNA, 23 bp, Homo sapiens
cgtgggattcagagaaaggcaag

SEQ ID NO: 2915901 - DNA, 21 bp, Homo sapiens
cgtgggcatatctggggagcc

SEQ ID NO: 2915902 - DNA, 14 bp, Homo sapiens
cgtgggcattgtct

SEQ ID NO: 2915903 - DNA, 19 bp, Homo sapiens
cgtgggccctgcaggctgc

SEQ ID NO: 2915904 - DNA, 20 bp, Homo sapiens
cgtgggctcccgtgttttgt

SEQ ID NO: 2915905 - DNA, 13 bp, Homo sapiens
cgtgggctccctg

SEQ ID NO: 2915906 - DNA, 13 bp, Homo sapiens
cgtggggaagggg

SEQ ID NO: 2915907 - DNA, 17 bp, Homo sapiens
cgtggggaatgggcagg

SEQ ID NO: 2915908 - DNA, 22 bp, Homo sapiens
cgtggtgacgccccggggcgcc

SEQ ID NO: 2915909 - DNA, 14 bp, Homo sapiens
cgtggtgtggcccg

SEQ ID NO: 2915910 - DNA, 13 bp, Homo sapiens
cgtgtatatgtgc

SEQ ID NO: 2915911 - DNA, 17 bp, Homo sapiens
cgtgtatatgtgcttgt

SEQ ID NO: 2915912 - DNA, 13 bp, Homo sapiens
cgtgtccccgggg

SEQ ID NO: 2915913 - DNA, 18 bp, Homo sapiens
cgtgtccccggggcccag

SEQ ID NO: 2915914 - DNA, 14 bp, Homo sapiens
cgtgtctggcacag

SEQ ID NO: 2915915 - DNA, 19 bp, Homo sapiens
cgtgtgaaatctgtctttg

SEQ ID NO: 2915916 - DNA, 11 bp, Homo sapiens
cgtgtgatttt

SEQ ID NO: 2915917 - DNA, 24 bp, Homo sapiens
cgtgtgcatagcgtcctgccctgc

SEQ ID NO: 2915918 - DNA, 13 bp, Homo sapiens
cgtgtggcagcca

SEQ ID NO: 2915919 - DNA, 23 bp, Homo sapiens
cgtgtgggccgtggcttgggctg

SEQ ID NO: 2915920 - DNA, 17 bp, Homo sapiens
cgtgtgtttagaagcct

SEQ ID NO: 2915921 - DNA, 18 bp, Homo sapiens
cgtgtgtttagaagccta

SEQ ID NO: 2915922 - DNA, 15 bp, Homo sapiens
cgtgttacccactgc

SEQ ID NO: 2915923 - DNA, 11 bp, Homo sapiens
cgtgtttgcac

SEQ ID NO: 2915924 - DNA, 11 bp, Homo sapiens
cgttatattaa

SEQ ID NO: 2915925 - DNA, 16 bp, Homo sapiens
cgttattataaatgtt

SEQ ID NO: 2915926 - DNA, 15 bp, Homo sapiens
cgttcaaaagtggag

SEQ ID NO: 2915927 - DNA, 12 bp, Homo sapiens
cgttcaaattct

SEQ ID NO: 2915928 - DNA, 15 bp, Homo sapiens
cgttcagcctgtctc

SEQ ID NO: 2915929 - DNA, 15 bp, Homo sapiens
cgttcagggaggggc

SEQ ID NO: 2915930 - DNA, 14 bp, Homo sapiens
cgttcgcctctggc

SEQ ID NO: 2915931 - DNA, 21 bp, Homo sapiens
cgttctaaatatgaatgaatg

SEQ ID NO: 2915932 - DNA, 16 bp, Homo sapiens
cgttgagggaatgaca

SEQ ID NO: 2915933 - DNA, 19 bp, Homo sapiens
cgttgccctaattcatctt

SEQ ID NO: 2915934 - DNA, 14 bp, Homo sapiens
cgttgctttcactc

SEQ ID NO: 2915935 - DNA, 13 bp, Homo sapiens
cgttggtctctgc

SEQ ID NO: 2915936 - DNA, 14 bp, Homo sapiens
cgttggttgtttct

SEQ ID NO: 2915937 - DNA, 13 bp, Homo sapiens
cgttgtgggcagg

SEQ ID NO: 2915938 - DNA, 22 bp, Homo sapiens
cgttgttcatagaatcgttgga

SEQ ID NO: 2915939 - DNA, 18 bp, Homo sapiens
cgtttaaagtactgagca

SEQ ID NO: 2915940 - DNA, 22 bp, Homo sapiens
cgtttaaagtactgagcagtat

SEQ ID NO: 2915941 - DNA, 23 bp, Homo sapiens
cgtttacaagcccccccttccac

SEQ ID NO: 2915942 - DNA, 23 bp, Homo sapiens
cgtttagtgccaatgttgtgtgt

SEQ ID NO: 2915943 - DNA, 13 bp, Homo sapiens
cgtttcaaaaaca

SEQ ID NO: 2915944 - DNA, 22 bp, Homo sapiens
cgtttcatcaggctctgttcct

SEQ ID NO: 2915945 - DNA, 19 bp, Homo sapiens
cgtttggaagatcctgtga

SEQ ID NO: 2915946 - DNA, 22 bp, Homo sapiens
cgtttggaagatcctgtgagga

SEQ ID NO: 2915947 - DNA, 18 bp, Homo sapiens
cgtttggtcttaggtctt

SEQ ID NO: 2915948 - DNA, 14 bp, Homo sapiens
cgtttgtacatggg

SEQ ID NO: 2915949 - DNA, 18 bp, Homo sapiens
cgtttgtgcagaatctct

SEQ ID NO: 2915950 - DNA, 20 bp, Homo sapiens
cgttttgaagctactgtgtg

SEQ ID NO: 2915951 - DNA, 21 bp, Homo sapiens
cgtttttcaagaaaactggaa

SEQ ID NO: 2915952 - DNA, 16 bp, Homo sapiens
cgttttttcctcagtg

SEQ ID NO: 2915953 - DNA, 18 bp, Homo sapiens
ctaaaaaaaaaaaagtat

SEQ ID NO: 2915954 - DNA, 17 bp, Homo sapiens
ctaaaaaaaaaaactgt

SEQ ID NO: 2915955 - DNA, 21 bp, Homo sapiens
ctaaaaatctgagaaactcta

SEQ ID NO: 2915956 - DNA, 15 bp, Homo sapiens
ctaaaaatgaaaaaa

SEQ ID NO: 2915957 - DNA, 22 bp, Homo sapiens
ctaaaaatgggacttcttttca

SEQ ID NO: 2915958 - DNA, 23 bp, Homo sapiens
ctaaaacatagactgaagattta

SEQ ID NO: 2915959 - DNA, 22 bp, Homo sapiens
ctaaaagacttccctaacactt

SEQ ID NO: 2915960 - DNA, 20 bp, Homo sapiens
ctaaaagaggcctgttcata

SEQ ID NO: 2915961 - DNA, 23 bp, Homo sapiens
ctaaaagcatggccctgctgccc

SEQ ID NO: 2915962 - DNA, 20 bp, Homo sapiens
ctaaaagtgggcttgattct

SEQ ID NO: 2915963 - DNA, 13 bp, Homo sapiens
ctaaaagtgtcac

SEQ ID NO: 2915964 - DNA, 18 bp, Homo sapiens
ctaaaagttctcaatgta

SEQ ID NO: 2915965 - DNA, 20 bp, Homo sapiens
ctaaaatggcgaacatgtgt

SEQ ID NO: 2915966 - DNA, 18 bp, Homo sapiens
ctaaaattcaaaaacaaa

SEQ ID NO: 2915967 - DNA, 12 bp, Homo sapiens
ctaaaattcaga

SEQ ID NO: 2915968 - DNA, 18 bp, Homo sapiens
ctaaacacgtgacacaaa

SEQ ID NO: 2915969 - DNA, 18 bp, Homo sapiens
ctaaacactgcgctttat

SEQ ID NO: 2915970 - DNA, 19 bp, Homo sapiens
ctaaaccatctatgtgaat

SEQ ID NO: 2915971 - DNA, 15 bp, Homo sapiens
ctaaacccaatccaa

SEQ ID NO: 2915972 - DNA, 12 bp, Homo sapiens
ctaaacctcagt

SEQ ID NO: 2915973 - DNA, 13 bp, Homo sapiens
ctaaacctcagtt

SEQ ID NO: 2915974 - DNA, 21 bp, Homo sapiens
ctaaactgagctcgcagcccc

SEQ ID NO: 2915975 - DNA, 14 bp, Homo sapiens
ctaaagaagatctg

SEQ ID NO: 2915976 - DNA, 16 bp, Homo sapiens
ctaaagaagatctgta

SEQ ID NO: 2915977 - DNA, 18 bp, Homo sapiens
ctaaagaatataaagcct

SEQ ID NO: 2915978 - DNA, 19 bp, Homo sapiens
ctaaagagttattcaaatg

SEQ ID NO: 2915979 - DNA, 22 bp, Homo sapiens
ctaaagagttattcaaatgaag

SEQ ID NO: 2915980 - DNA, 21 bp, Homo sapiens
ctaaagatggagtttctaagg

SEQ ID NO: 2915981 - DNA, 14 bp, Homo sapiens
ctaaagattctata

SEQ ID NO: 2915982 - DNA, 17 bp, Homo sapiens
ctaaagccaaccagcct

SEQ ID NO: 2915983 - DNA, 16 bp, Homo sapiens
ctaaaggatgctgctg

SEQ ID NO: 2915984 - DNA, 15 bp, Homo sapiens
ctaaaggtccacagg

SEQ ID NO: 2915985 - DNA, 20 bp, Homo sapiens
ctaaaggtccacaggtctag

SEQ ID NO: 2915986 - DNA, 19 bp, Homo sapiens
ctaaaggtgttgtcccttc

SEQ ID NO: 2915987 - DNA, 20 bp, Homo sapiens
ctaaaggtgttgtcccttct

SEQ ID NO: 2915988 - DNA, 20 bp, Homo sapiens
ctaaagtgctgggattacag

SEQ ID NO: 2915989 - DNA, 11 bp, Homo sapiens
ctaaagttata

SEQ ID NO: 2915990 - DNA, 14 bp, Homo sapiens
ctaaagttctaaga

SEQ ID NO: 2915991 - DNA, 15 bp, Homo sapiens
ctaaagttctaagat

SEQ ID NO: 2915992 - DNA, 19 bp, Homo sapiens
ctaaagttctaagattctg

SEQ ID NO: 2915993 - DNA, 15 bp, Homo sapiens
ctaaataaaatttgt

SEQ ID NO: 2915994 - DNA, 11 bp, Homo sapiens
ctaaataacta

SEQ ID NO: 2915995 - DNA, 12 bp, Homo sapiens
ctaaataactat

SEQ ID NO: 2915996 - DNA, 23 bp, Homo sapiens
ctaaataactatataagacatta

SEQ ID NO: 2915997 - DNA, 20 bp, Homo sapiens
ctaaataatcttactctaga

SEQ ID NO: 2915998 - DNA, 23 bp, Homo sapiens
ctaaatattcagaatctttgtta

SEQ ID NO: 2915999 - DNA, 13 bp, Homo sapiens
ctaaatatttctt

SEQ ID NO: 2916000 - DNA, 23 bp, Homo sapiens
ctaaatccttttgttttgaagct

SEQ ID NO: 2916001 - DNA, 19 bp, Homo sapiens
ctaaatgagctaaataagt

SEQ ID NO: 2916002 - DNA, 15 bp, Homo sapiens
ctagggagagaccct

SEQ ID NO: 2916003 - DNA, 17 bp, Homo sapiens
ctagggatccctcatct

SEQ ID NO: 2916004 - DNA, 15 bp, Homo sapiens
ctagggcagggtggg

SEQ ID NO: 2916005 - DNA, 19 bp, Homo sapiens
ctagggcagggtgggagcc

SEQ ID NO: 2916006 - DNA, 16 bp, Homo sapiens
ctagggccaagcccag

SEQ ID NO: 2916007 - DNA, 14 bp, Homo sapiens
ctagggtgggaagg

SEQ ID NO: 2916008 - DNA, 18 bp, Homo sapiens
ctagggtgggaaggggct

SEQ ID NO: 2916009 - DNA, 16 bp, Homo sapiens
ctagggtttcttaaat

SEQ ID NO: 2916010 - DNA, 16 bp, Homo sapiens
ctagggttttggcctg

SEQ ID NO: 2916011 - DNA, 17 bp, Homo sapiens
ctagggttttggcctgc

SEQ ID NO: 2916012 - DNA, 20 bp, Homo sapiens
ctaggtaaccagtttaaatt

SEQ ID NO: 2916013 - DNA, 21 bp, Homo sapiens
ctaggtacataagttaaatga

SEQ ID NO: 2916014 - DNA, 14 bp, Homo sapiens
ctaggtacttcagg

SEQ ID NO: 2916015 - DNA, 19 bp, Homo sapiens
ctaggtgcagctcctcagc

SEQ ID NO: 2916016 - DNA, 22 bp, Homo sapiens
ctaggtgcccttggaggccagc

SEQ ID NO: 2916017 - DNA, 15 bp, Homo sapiens
ctagtaactgctgtc

SEQ ID NO: 2916018 - DNA, 14 bp, Homo sapiens
ctagtacataattg

SEQ ID NO: 2916019 - DNA, 16 bp, Homo sapiens
ctagtacataattgat

SEQ ID NO: 2916020 - DNA, 16 bp, Homo sapiens
ctagtagaacaatgta

SEQ ID NO: 2916021 - DNA, 18 bp, Homo sapiens
ctagtatgtcttgaaaca

SEQ ID NO: 2916022 - DNA, 18 bp, Homo sapiens
ctagtcactggcagcctg

SEQ ID NO: 2916023 - DNA, 19 bp, Homo sapiens
ctagtcactggcagcctgc

SEQ ID NO: 2916024 - DNA, 13 bp, Homo sapiens
ctagtcagagaga

SEQ ID NO: 2916025 - DNA, 15 bp, Homo sapiens
ctagtctagtttcct

SEQ ID NO: 2916026 - DNA, 15 bp, Homo sapiens
ctagtctcctttgaa

SEQ ID NO: 2916027 - DNA, 20 bp, Homo sapiens
ctagtctctatcattaaagt

SEQ ID NO: 2916028 - DNA, 19 bp, Homo sapiens
ctagtcttgaatttctgac

SEQ ID NO: 2916029 - DNA, 21 bp, Homo sapiens
ctagtgaaggcttctctctgt

SEQ ID NO: 2916030 - DNA, 23 bp, Homo sapiens
ctagtgactaagccccgcatatg

SEQ ID NO: 2916031 - DNA, 19 bp, Homo sapiens
ctagtgagtcagcaccttg

SEQ ID NO: 2916032 - DNA, 14 bp, Homo sapiens
ctagtgccccagac

SEQ ID NO: 2916033 - DNA, 15 bp, Homo sapiens
ctagtgccccagact

SEQ ID NO: 2916034 - DNA, 23 bp, Homo sapiens
ctagtgccccagactgagctctc

SEQ ID NO: 2916035 - DNA, 13 bp, Homo sapiens
ctagtgccttgcc

SEQ ID NO: 2916036 - DNA, 17 bp, Homo sapiens
ctagtgccttgcccaca

SEQ ID NO: 2916037 - DNA, 13 bp, Homo sapiens
ctagtgctttcct

SEQ ID NO: 2916038 - DNA, 18 bp, Homo sapiens
ctagtggggtctccctct

SEQ ID NO: 2916039 - DNA, 21 bp, Homo sapiens
ctagtggggtctccctctcct

SEQ ID NO: 2916040 - DNA, 23 bp, Homo sapiens
ctagtgtacctcctctcagtgtt

SEQ ID NO: 2916041 - DNA, 22 bp, Homo sapiens
ctagttaaccaatcgcaaagca

SEQ ID NO: 2916042 - DNA, 19 bp, Homo sapiens
ctagttagcatccaggctg

SEQ ID NO: 2916043 - DNA, 23 bp, Homo sapiens
ctagttagcatccaggctggcca

SEQ ID NO: 2916044 - DNA, 16 bp, Homo sapiens
ctagttattggatcag

SEQ ID NO: 2916045 - DNA, 13 bp, Homo sapiens
ctagttctcagct

SEQ ID NO: 2916046 - DNA, 13 bp, Homo sapiens
ctagttctgccag

SEQ ID NO: 2916047 - DNA, 17 bp, Homo sapiens
ctagttggggagctaag

SEQ ID NO: 2916048 - DNA, 19 bp, Homo sapiens
ctagttggtgagaaacctg

SEQ ID NO: 2916049 - DNA, 13 bp, Homo sapiens
ctagtttgcattc

SEQ ID NO: 2916050 - DNA, 14 bp, Homo sapiens
ctagtttttaattt

SEQ ID NO: 2916051 - DNA, 23 bp, Homo sapiens
ctataaaatgcagtaacattcta

SEQ ID NO: 2916052 - DNA, 20 bp, Homo sapiens
ctataaaatgcccatttcga

SEQ ID NO: 2916053 - DNA, 19 bp, Homo sapiens
ctataaaatgtcttcaagg

SEQ ID NO: 2916054 - DNA, 17 bp, Homo sapiens
ctataaacaattacatg

SEQ ID NO: 2916055 - DNA, 18 bp, Homo sapiens
ctataaagctagatgctt

SEQ ID NO: 2916056 - DNA, 14 bp, Homo sapiens
ctataaagctgtta

SEQ ID NO: 2916057 - DNA, 14 bp, Homo sapiens
ctataaatacaaat

SEQ ID NO: 2916058 - DNA, 17 bp, Homo sapiens
ctataaatacaaatctg

SEQ ID NO: 2916059 - DNA, 19 bp, Homo sapiens
ctataaatacaaatctgta

SEQ ID NO: 2916060 - DNA, 15 bp, Homo sapiens
ctataaattcctctt

SEQ ID NO: 2916061 - DNA, 21 bp, Homo sapiens
ctataaatttactctgttgaa

SEQ ID NO: 2916062 - DNA, 13 bp, Homo sapiens
ctataactttttt

SEQ ID NO: 2916063 - DNA, 12 bp, Homo sapiens
ctataagaaaaa

SEQ ID NO: 2916064 - DNA, 15 bp, Homo sapiens
ctataataaagaagt

SEQ ID NO: 2916065 - DNA, 11 bp, Homo sapiens
ctataatcatt

SEQ ID NO: 2916066 - DNA, 14 bp, Homo sapiens
ctataatgtgcctg

SEQ ID NO: 2916067 - DNA, 13 bp, Homo sapiens
ctataattctata

SEQ ID NO: 2916068 - DNA, 17 bp, Homo sapiens
ctataattctatactgt

SEQ ID NO: 2916069 - DNA, 12 bp, Homo sapiens
ctataatttaaa

SEQ ID NO: 2916070 - DNA, 13 bp, Homo sapiens
ctataatttaaat

SEQ ID NO: 2916071 - DNA, 15 bp, Homo sapiens
ctatacaaatataaa

SEQ ID NO: 2916072 - DNA, 19 bp, Homo sapiens
ctatacctgtgcctcggct

SEQ ID NO: 2916073 - DNA, 11 bp, Homo sapiens
ctatagacatt

SEQ ID NO: 2916074 - DNA, 18 bp, Homo sapiens
ctatagtatttgattcaa

SEQ ID NO: 2916075 - DNA, 22 bp, Homo sapiens
ctatagtatttgattcaaaata

SEQ ID NO: 2916076 - DNA, 20 bp, Homo sapiens
ctatagttattaagttcttt

SEQ ID NO: 2916077 - DNA, 14 bp, Homo sapiens
ctatataagacatt

SEQ ID NO: 2916078 - DNA, 19 bp, Homo sapiens
ctatatagctgatcagttt

SEQ ID NO: 2916079 - DNA, 13 bp, Homo sapiens
ctatatatgtgta

SEQ ID NO: 2916080 - DNA, 12 bp, Homo sapiens
ctatatatttct

SEQ ID NO: 2916081 - DNA, 13 bp, Homo sapiens
ctatatatttcta

SEQ ID NO: 2916082 - DNA, 15 bp, Homo sapiens
ctatatcattaaaag

SEQ ID NO: 2916083 - DNA, 12 bp, Homo sapiens
ctatattccttg

SEQ ID NO: 2916084 - DNA, 19 bp, Homo sapiens
ctatcaaccccagacactg

SEQ ID NO: 2916085 - DNA, 20 bp, Homo sapiens
ctatcaaccccagacactgg

SEQ ID NO: 2916086 - DNA, 20 bp, Homo sapiens
ctatcaagaggctgagacag

SEQ ID NO: 2916087 - DNA, 20 bp, Homo sapiens
ctatcacacactttctcttc

SEQ ID NO: 2916088 - DNA, 21 bp, Homo sapiens
ctatcactgacacatcagcat

SEQ ID NO: 2916089 - DNA, 15 bp, Homo sapiens
ctatcaggcagaaga

SEQ ID NO: 2916090 - DNA, 16 bp, Homo sapiens
ctatcaggcagaagaa

SEQ ID NO: 2916091 - DNA, 13 bp, Homo sapiens
ctatcattaaagt

SEQ ID NO: 2916092 - DNA, 16 bp, Homo sapiens
ctatcattaaagttct

SEQ ID NO: 2916093 - DNA, 17 bp, Homo sapiens
ctatcattaaagttcta

SEQ ID NO: 2916094 - DNA, 14 bp, Homo sapiens
ctatccacccagcc

SEQ ID NO: 2916095 - DNA, 17 bp, Homo sapiens
ctatccacccagcccat

SEQ ID NO: 2916096 - DNA, 13 bp, Homo sapiens
ctatcctctctct

SEQ ID NO: 2916097 - DNA, 22 bp, Homo sapiens
ctatcggagaacatgaatcaaa

SEQ ID NO: 2916098 - DNA, 14 bp, Homo sapiens
ctatcgttattata

SEQ ID NO: 2916099 - DNA, 18 bp, Homo sapiens
ctatcgttattataaatg

SEQ ID NO: 2916100 - DNA, 16 bp, Homo sapiens
ctatctactaagtttc

SEQ ID NO: 2916101 - DNA, 17 bp, Homo sapiens
ctatctatcctgaatct

SEQ ID NO: 2916102 - DNA, 13 bp, Homo sapiens
ctatctcactgct

SEQ ID NO: 2916103 - DNA, 12 bp, Homo sapiens
ctatctcagcca

SEQ ID NO: 2916104 - DNA, 14 bp, Homo sapiens
ctatctcagccata

SEQ ID NO: 2916105 - DNA, 15 bp, Homo sapiens
ctatctctaataaaa

SEQ ID NO: 2916106 - DNA, 21 bp, Homo sapiens
ctatctggtcaacctcctgga

SEQ ID NO: 2916107 - DNA, 20 bp, Homo sapiens
ctatctgtttacagtgttcc

SEQ ID NO: 2916108 - DNA, 15 bp, Homo sapiens
ctatcttaattttgg

SEQ ID NO: 2916109 - DNA, 17 bp, Homo sapiens
ctatcttgttccaaggc

SEQ ID NO: 2916110 - DNA, 15 bp, Homo sapiens
ctatcttttatttca

SEQ ID NO: 2916111 - DNA, 15 bp, Homo sapiens
ctatcttttttagtg

SEQ ID NO: 2916112 - DNA, 19 bp, Homo sapiens
ctatcttttttagtgttaa

SEQ ID NO: 2916113 - DNA, 21 bp, Homo sapiens
ctatcttttttagtgttaaag

SEQ ID NO: 2916114 - DNA, 19 bp, Homo sapiens
ctatgaagtaaagaactgc

SEQ ID NO: 2916115 - DNA, 13 bp, Homo sapiens
ctatgagggcctt

SEQ ID NO: 2916116 - DNA, 13 bp, Homo sapiens
ctatgagtctaga

SEQ ID NO: 2916117 - DNA, 15 bp, Homo sapiens
ctatgagtctagatg

SEQ ID NO: 2916118 - DNA, 16 bp, Homo sapiens
ctatgataagattgaa

SEQ ID NO: 2916119 - DNA, 19 bp, Homo sapiens
ctatgataagattgaaatt

SEQ ID NO: 2916120 - DNA, 17 bp, Homo sapiens
ctatgatagataataaa

SEQ ID NO: 2916121 - DNA, 14 bp, Homo sapiens
ctatgatcatcttg

SEQ ID NO: 2916122 - DNA, 13 bp, Homo sapiens
ctatgatgtttct

SEQ ID NO: 2916123 - DNA, 20 bp, Homo sapiens
ctatgatgtttcttttgcaa

SEQ ID NO: 2916124 - DNA, 13 bp, Homo sapiens
ctatgattgaaaa

SEQ ID NO: 2916125 - DNA, 12 bp, Homo sapiens
ctatgcaaaatg

SEQ ID NO: 2916126 - DNA, 12 bp, Homo sapiens
ctatgcacatat

SEQ ID NO: 2916127 - DNA, 21 bp, Homo sapiens
ctatgcacatatggactctgc

SEQ ID NO: 2916128 - DNA, 22 bp, Homo sapiens
ctatgcacatatggactctgca

SEQ ID NO: 2916129 - DNA, 17 bp, Homo sapiens
ctatgcagaggcctggg

SEQ ID NO: 2916130 - DNA, 13 bp, Homo sapiens
ctatgcatggtgc

SEQ ID NO: 2916131 - DNA, 19 bp, Homo sapiens
ctatgccatttttagttta

SEQ ID NO: 2916132 - DNA, 18 bp, Homo sapiens
ctatgccgtcttctgccc

SEQ ID NO: 2916133 - DNA, 19 bp, Homo sapiens
ctatgccgtcttctgccct

SEQ ID NO: 2916134 - DNA, 13 bp, Homo sapiens
ctatgctgctttt

SEQ ID NO: 2916135 - DNA, 23 bp, Homo sapiens
ctatgctggggtacacagtgaga

SEQ ID NO: 2916136 - DNA, 20 bp, Homo sapiens
ctcccttttacattctgtgt

SEQ ID NO: 2916137 - DNA, 19 bp, Homo sapiens
ctccgaaattccaaggccc

SEQ ID NO: 2916138 - DNA, 13 bp, Homo sapiens
ctccgacctctct

SEQ ID NO: 2916139 - DNA, 15 bp, Homo sapiens
ctccgacctctctca

SEQ ID NO: 2916140 - DNA, 17 bp, Homo sapiens
ctccgacctctctcagc

SEQ ID NO: 2916141 - DNA, 23 bp, Homo sapiens
ctccgagagcagtgggcaggtgg

SEQ ID NO: 2916142 - DNA, 14 bp, Homo sapiens
ctccgaggactgga

SEQ ID NO: 2916143 - DNA, 12 bp, Homo sapiens
ctccgagtgagt

SEQ ID NO: 2916144 - DNA, 20 bp, Homo sapiens
ctccgatgcctggcctgcca

SEQ ID NO: 2916145 - DNA, 18 bp, Homo sapiens
ctccgcacacctctggct

SEQ ID NO: 2916146 - DNA, 13 bp, Homo sapiens
ctccgcctccaca

SEQ ID NO: 2916147 - DNA, 22 bp, Homo sapiens
ctccgcctccacactgaccaag

SEQ ID NO: 2916148 - DNA, 15 bp, Homo sapiens
ctccgcctcccatcc

SEQ ID NO: 2916149 - DNA, 12 bp, Homo sapiens
ctccgccttcac

SEQ ID NO: 2916150 - DNA, 13 bp, Homo sapiens
ctccgctgcctgg

SEQ ID NO: 2916151 - DNA, 15 bp, Homo sapiens
ctccgcttatcctgc

SEQ ID NO: 2916152 - DNA, 15 bp, Homo sapiens
ctccggcctgcgtct

SEQ ID NO: 2916153 - DNA, 18 bp, Homo sapiens
ctccggcctgggtgacag

SEQ ID NO: 2916154 - DNA, 14 bp, Homo sapiens
ctccgggcagggga

SEQ ID NO: 2916155 - DNA, 20 bp, Homo sapiens
ctccgggcaggggagccagg

SEQ ID NO: 2916156 - DNA, 17 bp, Homo sapiens
ctccggggttcagcctc

SEQ ID NO: 2916157 - DNA, 21 bp, Homo sapiens
ctccggggttcagcctcctgt

SEQ ID NO: 2916158 - DNA, 24 bp, Homo sapiens
ctccgtccctctgtccacttgtgg

SEQ ID NO: 2916159 - DNA, 15 bp, Homo sapiens
ctccgtcctcgatgg

SEQ ID NO: 2916160 - DNA, 19 bp, Homo sapiens
ctccgtgaggctgctgcca

SEQ ID NO: 2916161 - DNA, 13 bp, Homo sapiens
ctccgtggactgc

SEQ ID NO: 2916162 - DNA, 13 bp, Homo sapiens
ctccgtggcacat

SEQ ID NO: 2916163 - DNA, 16 bp, Homo sapiens
ctccgtggccccgccc

SEQ ID NO: 2916164 - DNA, 20 bp, Homo sapiens
ctcctaatcaagagtctctc

SEQ ID NO: 2916165 - DNA, 21 bp, Homo sapiens
ctcctaatcaagagtctctcc

SEQ ID NO: 2916166 - DNA, 22 bp, Homo sapiens
ctcctaatcaagagtctctcca

SEQ ID NO: 2916167 - DNA, 17 bp, Homo sapiens
ctcctaatgctctgaaa

SEQ ID NO: 2916168 - DNA, 15 bp, Homo sapiens
ctcctaccctgcgcc

SEQ ID NO: 2916169 - DNA, 13 bp, Homo sapiens
ctcctacctcagc

SEQ ID NO: 2916170 - DNA, 18 bp, Homo sapiens
ctcctacctcagcctcct

SEQ ID NO: 2916171 - DNA, 19 bp, Homo sapiens
ctcctagagggaggggcct

SEQ ID NO: 2916172 - DNA, 14 bp, Homo sapiens
ctcctagccccttc

SEQ ID NO: 2916173 - DNA, 13 bp, Homo sapiens
ctcctaggccctt

SEQ ID NO: 2916174 - DNA, 15 bp, Homo sapiens
ctcctatatatttct

SEQ ID NO: 2916175 - DNA, 14 bp, Homo sapiens
ctcctatcttttat

SEQ ID NO: 2916176 - DNA, 16 bp, Homo sapiens
ctcctcacactccaga

SEQ ID NO: 2916177 - DNA, 10 bp, Homo sapiens
ctcctcactc

SEQ ID NO: 2916178 - DNA, 17 bp, Homo sapiens
ctcctcactcaccttca

SEQ ID NO: 2916179 - DNA, 23 bp, Homo sapiens
ctcctcactccctaggcccaagt

SEQ ID NO: 2916180 - DNA, 23 bp, Homo sapiens
ctcctcaggcacacagctactct

SEQ ID NO: 2916181 - DNA, 18 bp, Homo sapiens
ctcctcagggcagcctcc

SEQ ID NO: 2916182 - DNA, 18 bp, Homo sapiens
ctcctcatagcatgatat

SEQ ID NO: 2916183 - DNA, 11 bp, Homo sapiens
ctcctccaggg

SEQ ID NO: 2916184 - DNA, 19 bp, Homo sapiens
ctcctccagggccacgtgc

SEQ ID NO: 2916185 - DNA, 20 bp, Homo sapiens
ctcctccagggccacgtgcc

SEQ ID NO: 2916186 - DNA, 15 bp, Homo sapiens
ctcctcccagtgcct

SEQ ID NO: 2916187 - DNA, 16 bp, Homo sapiens
ctcctcccagtgcctt

SEQ ID NO: 2916188 - DNA, 17 bp, Homo sapiens
ctcctcccagtgccttc

SEQ ID NO: 2916189 - DNA, 20 bp, Homo sapiens
ctcctccccaccctcctggc

SEQ ID NO: 2916190 - DNA, 21 bp, Homo sapiens
ctcctcccccctcctctgaaa

SEQ ID NO: 2916191 - DNA, 20 bp, Homo sapiens
ctcctcccccggctgggcct

SEQ ID NO: 2916192 - DNA, 21 bp, Homo sapiens
ctcctccccgctccgtctctg

SEQ ID NO: 2916193 - DNA, 15 bp, Homo sapiens
ctcctcccctgccgc

SEQ ID NO: 2916194 - DNA, 14 bp, Homo sapiens
ctcctccctgcatc

SEQ ID NO: 2916195 - DNA, 15 bp, Homo sapiens
ctcctccctgcatct

SEQ ID NO: 2916196 - DNA, 14 bp, Homo sapiens
ctcctccctggctg

SEQ ID NO: 2916197 - DNA, 15 bp, Homo sapiens
ctcctccctggctgc

SEQ ID NO: 2916198 - DNA, 20 bp, Homo sapiens
ctcctccctgttattttcaa

SEQ ID NO: 2916199 - DNA, 22 bp, Homo sapiens
ctcctccctgttattttcaagt

SEQ ID NO: 2916200 - DNA, 13 bp, Homo sapiens
ctcctcctccctc

SEQ ID NO: 2916201 - DNA, 12 bp, Homo sapiens
ctcctcctgcca

SEQ ID NO: 2916202 - DNA, 21 bp, Homo sapiens
ctcctcctgccagctctgtca

SEQ ID NO: 2916203 - DNA, 14 bp, Homo sapiens
ctcctcctgggcta

SEQ ID NO: 2916204 - DNA, 20 bp, Homo sapiens
ctcctccttgggcagggtct

SEQ ID NO: 2916205 - DNA, 16 bp, Homo sapiens
ctcctcgacatcactg

SEQ ID NO: 2916206 - DNA, 14 bp, Homo sapiens
ctcctcgcaagctg

SEQ ID NO: 2916207 - DNA, 18 bp, Homo sapiens
ctcctcggacacccaggg

SEQ ID NO: 2916208 - DNA, 17 bp, Homo sapiens
ctcctctacctctctcc

SEQ ID NO: 2916209 - DNA, 15 bp, Homo sapiens
ctcctctcagtgttt

SEQ ID NO: 2916210 - DNA, 21 bp, Homo sapiens
ctcctctccatgcaagtgctg

SEQ ID NO: 2916211 - DNA, 23 bp, Homo sapiens
ctcctctcccattgtccctctgc

SEQ ID NO: 2916212 - DNA, 17 bp, Homo sapiens
ctcctctccccagccca

SEQ ID NO: 2916213 - DNA, 21 bp, Homo sapiens
ctcctctccccagcccagaga

SEQ ID NO: 2916214 - DNA, 19 bp, Homo sapiens
ctcctctcccgtctcgcct

SEQ ID NO: 2916215 - DNA, 19 bp, Homo sapiens
ctcctctcctttttctctt

SEQ ID NO: 2916216 - DNA, 18 bp, Homo sapiens
ctcctctctccctgcctc

SEQ ID NO: 2916217 - DNA, 11 bp, Homo sapiens
ctcctctgaaa

SEQ ID NO: 2916218 - DNA, 13 bp, Homo sapiens
ctcctctgaaaca

SEQ ID NO: 2916219 - DNA, 18 bp, Homo sapiens
ctcctctgaaacagctgc

SEQ ID NO: 2916220 - DNA, 19 bp, Homo sapiens
ctcctctgactcagggctc

SEQ ID NO: 2916221 - DNA, 22 bp, Homo sapiens
ctcctctgactcagggctcctg

SEQ ID NO: 2916222 - DNA, 15 bp, Homo sapiens
ctcctctgccacctc

SEQ ID NO: 2916223 - DNA, 17 bp, Homo sapiens
ctcctctgccacctccc

SEQ ID NO: 2916224 - DNA, 14 bp, Homo sapiens
ctcctctggcttcc

SEQ ID NO: 2916225 - DNA, 22 bp, Homo sapiens
ctcctctgtgaccaatgtcttg

SEQ ID NO: 2916226 - DNA, 12 bp, Homo sapiens
ctcctcttgtaa

SEQ ID NO: 2916227 - DNA, 13 bp, Homo sapiens
ctcctctttgaac

SEQ ID NO: 2916228 - DNA, 20 bp, Homo sapiens
ctcctgaaatgccaagtgcc

SEQ ID NO: 2916229 - DNA, 21 bp, Homo sapiens
ctcctgaagggaaggcaaagg

SEQ ID NO: 2916230 - DNA, 19 bp, Homo sapiens
ctcctgacaacgtctcttc

SEQ ID NO: 2916231 - DNA, 16 bp, Homo sapiens
ctcctgacaagttatt

SEQ ID NO: 2916232 - DNA, 15 bp, Homo sapiens
ctcctgactggtgct

SEQ ID NO: 2916233 - DNA, 15 bp, Homo sapiens
ctcctgaggacagct

SEQ ID NO: 2916234 - DNA, 16 bp, Homo sapiens
ctcctgaggacagctg

SEQ ID NO: 2916235 - DNA, 18 bp, Homo sapiens
ctcctgaggacagctgtc

SEQ ID NO: 2916236 - DNA, 19 bp, Homo sapiens
ctcctgaggacagctgtcc

SEQ ID NO: 2916237 - DNA, 16 bp, Homo sapiens
ctcctgaggctttgga

SEQ ID NO: 2916238 - DNA, 19 bp, Homo sapiens
ctcctgatgtagcttgaga

SEQ ID NO: 2916239 - DNA, 18 bp, Homo sapiens
ctcctgatgtttgtatca

SEQ ID NO: 2916240 - DNA, 20 bp, Homo sapiens
ctcctgcagcactttttcct

SEQ ID NO: 2916241 - DNA, 14 bp, Homo sapiens
ctcctgcatgtgta

SEQ ID NO: 2916242 - DNA, 21 bp, Homo sapiens
ctcctgccacattagaacttc

SEQ ID NO: 2916243 - DNA, 15 bp, Homo sapiens
ctcctgccaccagca

SEQ ID NO: 2916244 - DNA, 11 bp, Homo sapiens
ctcctgccagc

SEQ ID NO: 2916245 - DNA, 22 bp, Homo sapiens
ctcctgcccagccacccctcag

SEQ ID NO: 2916246 - DNA, 22 bp, Homo sapiens
ctcctgcccgcagacctctgga

SEQ ID NO: 2916247 - DNA, 14 bp, Homo sapiens
ctcctgcctactca

SEQ ID NO: 2916248 - DNA, 12 bp, Homo sapiens
ctcctgcctcag

SEQ ID NO: 2916249 - DNA, 21 bp, Homo sapiens
ctcctgcctcagccttccaag

SEQ ID NO: 2916250 - DNA, 16 bp, Homo sapiens
ctcctgccttcctcct

SEQ ID NO: 2916251 - DNA, 18 bp, Homo sapiens
ctcctgccttcctcctgg

SEQ ID NO: 2916252 - DNA, 19 bp, Homo sapiens
ctcctgccttcctcctggg

SEQ ID NO: 2916253 - DNA, 16 bp, Homo sapiens
ctcctgcctttgcctc

SEQ ID NO: 2916254 - DNA, 23 bp, Homo sapiens
ctcctgcttgtactaagccagga

SEQ ID NO: 2916255 - DNA, 15 bp, Homo sapiens
ctcctggaagctgtg

SEQ ID NO: 2916256 - DNA, 20 bp, Homo sapiens
ctcctggactggttatcttg

SEQ ID NO: 2916257 - DNA, 21 bp, Homo sapiens
ctcctggactggttatcttgt

SEQ ID NO: 2916258 - DNA, 18 bp, Homo sapiens
ctcctggagcagaaagtg

SEQ ID NO: 2916259 - DNA, 13 bp, Homo sapiens
ctcctggagggcg

SEQ ID NO: 2916260 - DNA, 24 bp, Homo sapiens
ctcctggagggcgcccagcagcct

SEQ ID NO: 2916261 - DNA, 20 bp, Homo sapiens
ctcctggctcaagccctgaa

SEQ ID NO: 2916262 - DNA, 17 bp, Homo sapiens
ctcctggctcaggccca

SEQ ID NO: 2916263 - DNA, 18 bp, Homo sapiens
ctcctggctcaggcccag

SEQ ID NO: 2916264 - DNA, 23 bp, Homo sapiens
ctcctgggccgttacatctgtgc

SEQ ID NO: 2916265 - DNA, 15 bp, Homo sapiens
ctcctggggccaggc

SEQ ID NO: 2916266 - DNA, 16 bp, Homo sapiens
ctcctggggccaggcc

SEQ ID NO: 2916267 - DNA, 23 bp, Homo sapiens
ctcctggggccaggccgggcctg

SEQ ID NO: 2916268 - DNA, 16 bp, Homo sapiens
ctcctggggcgtccag

SEQ ID NO: 2916269 - DNA, 16 bp, Homo sapiens
ctctgttgcctcctct

SEQ ID NO: 2916270 - DNA, 18 bp, Homo sapiens
ctctgttgcctcctctct

SEQ ID NO: 2916271 - DNA, 21 bp, Homo sapiens
ctctgttgcctcctctctccc

SEQ ID NO: 2916272 - DNA, 22 bp, Homo sapiens
ctctgttgcctcctctctccct

SEQ ID NO: 2916273 - DNA, 23 bp, Homo sapiens
ctctgttgcctcctctctccctg

SEQ ID NO: 2916274 - DNA, 22 bp, Homo sapiens
ctcttaaactctcttcttccat

SEQ ID NO: 2916275 - DNA, 14 bp, Homo sapiens
ctcttaaatctctt

SEQ ID NO: 2916276 - DNA, 19 bp, Homo sapiens
ctcttaaatctcttaaact

SEQ ID NO: 2916277 - DNA, 17 bp, Homo sapiens
ctcttaactgaagaaag

SEQ ID NO: 2916278 - DNA, 19 bp, Homo sapiens
ctcttaagatgtccagggc

SEQ ID NO: 2916279 - DNA, 13 bp, Homo sapiens
ctcttaagccatc

SEQ ID NO: 2916280 - DNA, 14 bp, Homo sapiens
ctcttaagccatct

SEQ ID NO: 2916281 - DNA, 20 bp, Homo sapiens
ctcttaagccatcttggtaa

SEQ ID NO: 2916282 - DNA, 21 bp, Homo sapiens
ctcttaagtcctaaaagttct

SEQ ID NO: 2916283 - DNA, 23 bp, Homo sapiens
ctcttaagtcctaaaagttctca

SEQ ID NO: 2916284 - DNA, 19 bp, Homo sapiens
ctcttaatgatgttatctt

SEQ ID NO: 2916285 - DNA, 14 bp, Homo sapiens
ctcttaattctgat

SEQ ID NO: 2916286 - DNA, 17 bp, Homo sapiens
ctcttacagctttgcct

SEQ ID NO: 2916287 - DNA, 20 bp, Homo sapiens
ctcttacagctttgccttgt

SEQ ID NO: 2916288 - DNA, 18 bp, Homo sapiens
ctcttacttcccccaccc

SEQ ID NO: 2916289 - DNA, 20 bp, Homo sapiens
ctcttacttcccccaccctg

SEQ ID NO: 2916290 - DNA, 22 bp, Homo sapiens
ctcttacttcccccaccctggg

SEQ ID NO: 2916291 - DNA, 14 bp, Homo sapiens
ctcttactttcagt

SEQ ID NO: 2916292 - DNA, 22 bp, Homo sapiens
ctcttagattgggccatggctt

SEQ ID NO: 2916293 - DNA, 16 bp, Homo sapiens
ctcttagcctctggat

SEQ ID NO: 2916294 - DNA, 16 bp, Homo sapiens
ctcttagctactgtat

SEQ ID NO: 2916295 - DNA, 17 bp, Homo sapiens
ctcttaggcactttggg

SEQ ID NO: 2916296 - DNA, 18 bp, Homo sapiens
ctcttcaaggactttctg

SEQ ID NO: 2916297 - DNA, 16 bp, Homo sapiens
ctcttcaccttggttt

SEQ ID NO: 2916298 - DNA, 14 bp, Homo sapiens
ctcttcagaggagc

SEQ ID NO: 2916299 - DNA, 17 bp, Homo sapiens
ctcttcagttaattctt

SEQ ID NO: 2916300 - DNA, 18 bp, Homo sapiens
ctcttcagttaattctta

SEQ ID NO: 2916301 - DNA, 17 bp, Homo sapiens
ctcttccaccagagcag

SEQ ID NO: 2916302 - DNA, 17 bp, Homo sapiens
ctcttccctcagtccca

SEQ ID NO: 2916303 - DNA, 20 bp, Homo sapiens
ctcttcccttttttttctgg

SEQ ID NO: 2916304 - DNA, 22 bp, Homo sapiens
ctcttcccttttttttctgggt

SEQ ID NO: 2916305 - DNA, 16 bp, Homo sapiens
ctcttccgggagctgg

SEQ ID NO: 2916306 - DNA, 16 bp, Homo sapiens
ctcttcctcatcctgc

SEQ ID NO: 2916307 - DNA, 16 bp, Homo sapiens
ctcttccttttatcag

SEQ ID NO: 2916308 - DNA, 22 bp, Homo sapiens
ctcttctccttgattttaaaat

SEQ ID NO: 2916309 - DNA, 15 bp, Homo sapiens
ctcttctcttctttg

SEQ ID NO: 2916310 - DNA, 16 bp, Homo sapiens
ctcttctcttctttgg

SEQ ID NO: 2916311 - DNA, 22 bp, Homo sapiens
ctcttctcttgacagtctgaag

SEQ ID NO: 2916312 - DNA, 16 bp, Homo sapiens
ctcttctgcatcttgg

SEQ ID NO: 2916313 - DNA, 15 bp, Homo sapiens
ctcttctgggcagag

SEQ ID NO: 2916314 - DNA, 15 bp, Homo sapiens
ctcttctgggcctga

SEQ ID NO: 2916315 - DNA, 13 bp, Homo sapiens
ctcttcttgaaaa

SEQ ID NO: 2916316 - DNA, 16 bp, Homo sapiens
ctcttcttggggccca

SEQ ID NO: 2916317 - DNA, 17 bp, Homo sapiens
ctcttgaactgagcttg

SEQ ID NO: 2916318 - DNA, 15 bp, Homo sapiens
ctcttgataaaggag

SEQ ID NO: 2916319 - DNA, 23 bp, Homo sapiens
ctcttgcaatccacaatctgaca

SEQ ID NO: 2916320 - DNA, 18 bp, Homo sapiens
ctcttgcaggctgagtcc

SEQ ID NO: 2916321 - DNA, 19 bp, Homo sapiens
ctcttgcccttcctactcc

SEQ ID NO: 2916322 - DNA, 16 bp, Homo sapiens
ctcttgctttatacta

SEQ ID NO: 2916323 - DNA, 21 bp, Homo sapiens
ctcttggaattagatgtttat

SEQ ID NO: 2916324 - DNA, 18 bp, Homo sapiens
ctcttggcacctgcctag

SEQ ID NO: 2916325 - DNA, 21 bp, Homo sapiens
ctcttggcacctgcctagctc

SEQ ID NO: 2916326 - DNA, 23 bp, Homo sapiens
ctcttggcacctgcctagctctt

SEQ ID NO: 2916327 - DNA, 12 bp, Homo sapiens
ctcttgggcctg

SEQ ID NO: 2916328 - DNA, 22 bp, Homo sapiens
ctcttggtgttaaaacacttct

SEQ ID NO: 2916329 - DNA, 17 bp, Homo sapiens
ctcttgtaaataaagcc

SEQ ID NO: 2916330 - DNA, 20 bp, Homo sapiens
ctcttgtaaataaagccctg

SEQ ID NO: 2916331 - DNA, 24 bp, Homo sapiens
ctcttgtaaataaagccctgggat

SEQ ID NO: 2916332 - DNA, 21 bp, Homo sapiens
ctcttgtatccctagtgctcc

SEQ ID NO: 2916333 - DNA, 23 bp, Homo sapiens
ctcttgtattgctccattttctt

SEQ ID NO: 2916334 - DNA, 16 bp, Homo sapiens
ctcttgtcctttaata

SEQ ID NO: 2916335 - DNA, 20 bp, Homo sapiens
ctcttgtgactcagcagagg

SEQ ID NO: 2916336 - DNA, 15 bp, Homo sapiens
ctcttgtgctcagtc

SEQ ID NO: 2916337 - DNA, 18 bp, Homo sapiens
ctcttgtttaaaaaaaga

SEQ ID NO: 2916338 - DNA, 11 bp, Homo sapiens
ctcttgtttct

SEQ ID NO: 2916339 - DNA, 16 bp, Homo sapiens
ctcttgtttctgttta

SEQ ID NO: 2916340 - DNA, 17 bp, Homo sapiens
ctctttaaaaacatttt

SEQ ID NO: 2916341 - DNA, 18 bp, Homo sapiens
ctctttaaaaacattttc

SEQ ID NO: 2916342 - DNA, 17 bp, Homo sapiens
ctctttaatgctgtctt

SEQ ID NO: 2916343 - DNA, 19 bp, Homo sapiens
ctctttaatgctgtctttg

SEQ ID NO: 2916344 - DNA, 22 bp, Homo sapiens
ctctttatatggcctcaagatc

SEQ ID NO: 2916345 - DNA, 13 bp, Homo sapiens
ctctttattccta

SEQ ID NO: 2916346 - DNA, 14 bp, Homo sapiens
ctctttcaatgcag

SEQ ID NO: 2916347 - DNA, 15 bp, Homo sapiens
ctctttcccaggacg

SEQ ID NO: 2916348 - DNA, 17 bp, Homo sapiens
ctctttcctgccctttt

SEQ ID NO: 2916349 - DNA, 15 bp, Homo sapiens
ctctttctagcctgg

SEQ ID NO: 2916350 - DNA, 19 bp, Homo sapiens
ctctttctctattatgtta

SEQ ID NO: 2916351 - DNA, 19 bp, Homo sapiens
ctctttgactgtcagcaag

SEQ ID NO: 2916352 - DNA, 22 bp, Homo sapiens
ctctttgagataatacattccg

SEQ ID NO: 2916353 - DNA, 20 bp, Homo sapiens
ctctttgcaactcctgtaat

SEQ ID NO: 2916354 - DNA, 22 bp, Homo sapiens
ctctttgctttgctttctgctc

SEQ ID NO: 2916355 - DNA, 13 bp, Homo sapiens
ctctttgggcagt

SEQ ID NO: 2916356 - DNA, 21 bp, Homo sapiens
ctctttggtggcatggaaggg

SEQ ID NO: 2916357 - DNA, 14 bp, Homo sapiens
ctctttgtcctgaa

SEQ ID NO: 2916358 - DNA, 20 bp, Homo sapiens
ctctttgtcctgaatggctt

SEQ ID NO: 2916359 - DNA, 22 bp, Homo sapiens
ctctttgtctaaaacaataaaa

SEQ ID NO: 2916360 - DNA, 20 bp, Homo sapiens
ctctttgttctaaagatgga

SEQ ID NO: 2916361 - DNA, 15 bp, Homo sapiens
ctcttttatatttgt

SEQ ID NO: 2916362 - DNA, 16 bp, Homo sapiens
ctcttttatatttgta

SEQ ID NO: 2916363 - DNA, 23 bp, Homo sapiens
ctcttttccactccattgtcgta

SEQ ID NO: 2916364 - DNA, 16 bp, Homo sapiens
ctcttttcctctctgt

SEQ ID NO: 2916365 - DNA, 22 bp, Homo sapiens
ctcttttcctttggtccttcaa

SEQ ID NO: 2916366 - DNA, 17 bp, Homo sapiens
ctcttttctaaaagact

SEQ ID NO: 2916367 - DNA, 19 bp, Homo sapiens
ctcttttctaagtggcgtg

SEQ ID NO: 2916368 - DNA, 12 bp, Homo sapiens
ctcttttctcta

SEQ ID NO: 2916369 - DNA, 21 bp, Homo sapiens
ctcttttgaagtgttttagtc

SEQ ID NO: 2916370 - DNA, 19 bp, Homo sapiens
ctctttttctctgtatatt

SEQ ID NO: 2916371 - DNA, 13 bp, Homo sapiens
ctctttttttcct

SEQ ID NO: 2916372 - DNA, 13 bp, Homo sapiens
ctgaaaaaatact

SEQ ID NO: 2916373 - DNA, 14 bp, Homo sapiens
ctgaaaaaatacta

SEQ ID NO: 2916374 - DNA, 14 bp, Homo sapiens
ctgaaaaatgaatg

SEQ ID NO: 2916375 - DNA, 14 bp, Homo sapiens
ctgaaaacccagag

SEQ ID NO: 2916376 - DNA, 23 bp, Homo sapiens
ctgaaaacccaggccacaaatgt

SEQ ID NO: 2916377 - DNA, 14 bp, Homo sapiens
ctgaaaacctctcc

SEQ ID NO: 2916378 - DNA, 16 bp, Homo sapiens
ctgaaaacttgcctta

SEQ ID NO: 2916379 - DNA, 13 bp, Homo sapiens
ctgaaaagaaata

SEQ ID NO: 2916380 - DNA, 17 bp, Homo sapiens
ctgaaaagagagcagag

SEQ ID NO: 2916381 - DNA, 21 bp, Homo sapiens
ctgaaaatcctcgcacacact

SEQ ID NO: 2916382 - DNA, 16 bp, Homo sapiens
ctgaaacaacttggaa

SEQ ID NO: 2916383 - DNA, 20 bp, Homo sapiens
ctgaaacaacttggaaagat

SEQ ID NO: 2916384 - DNA, 15 bp, Homo sapiens
ctgaaacactgcttc

SEQ ID NO: 2916385 - DNA, 17 bp, Homo sapiens
ctgaaacactgcttctc

SEQ ID NO: 2916386 - DNA, 17 bp, Homo sapiens
ctgaaacagctgcctta

SEQ ID NO: 2916387 - DNA, 23 bp, Homo sapiens
ctgaaacagctgccttagcttca

SEQ ID NO: 2916388 - DNA, 18 bp, Homo sapiens
ctgaaaccacagtttcat

SEQ ID NO: 2916389 - DNA, 14 bp, Homo sapiens
ctgaaaccagtgtt

SEQ ID NO: 2916390 - DNA, 12 bp, Homo sapiens
ctgaaaccattt

SEQ ID NO: 2916391 - DNA, 15 bp, Homo sapiens
ctgaaaccattttcc

SEQ ID NO: 2916392 - DNA, 22 bp, Homo sapiens
ctgaaaccattttcccatcatc

SEQ ID NO: 2916393 - DNA, 21 bp, Homo sapiens
ctgaaacccatttacttagga

SEQ ID NO: 2916394 - DNA, 23 bp, Homo sapiens
ctgaaaccttagtttcaagagtc

SEQ ID NO: 2916395 - DNA, 17 bp, Homo sapiens
ctgaaacctttaagaaa

SEQ ID NO: 2916396 - DNA, 13 bp, Homo sapiens
ctgaaacggcccc

SEQ ID NO: 2916397 - DNA, 19 bp, Homo sapiens
ctgaaactatttacaatgt

SEQ ID NO: 2916398 - DNA, 21 bp, Homo sapiens
ctgaaactatttacaatgtgt

SEQ ID NO: 2916399 - DNA, 14 bp, Homo sapiens
ctgaaactcccttg

SEQ ID NO: 2916400 - DNA, 15 bp, Homo sapiens
ctgcaccaccatgcc

SEQ ID NO: 2916401 - DNA, 14 bp, Homo sapiens
ctgcaccattgctg

SEQ ID NO: 2916402 - DNA, 17 bp, Homo sapiens
ctgcaccattgctgctc

SEQ ID NO: 2916403 - DNA, 18 bp, Homo sapiens
ctgcacccagaacagtgg

SEQ ID NO: 2916404 - DNA, 12 bp, Homo sapiens
ctgcacccagga

SEQ ID NO: 2916405 - DNA, 13 bp, Homo sapiens
ctgcacccaggag

SEQ ID NO: 2916406 - DNA, 15 bp, Homo sapiens
ctgcacccaggaggg

SEQ ID NO: 2916407 - DNA, 23 bp, Homo sapiens
ctgcaccctcttctcctctggct

SEQ ID NO: 2916408 - DNA, 14 bp, Homo sapiens
ctgcaccgacccga

SEQ ID NO: 2916409 - DNA, 22 bp, Homo sapiens
ctgcaccgacccgaggcccaga

SEQ ID NO: 2916410 - DNA, 16 bp, Homo sapiens
ctgcaccggggcctgg

SEQ ID NO: 2916411 - DNA, 19 bp, Homo sapiens
ctgcaccggggcctgggca

SEQ ID NO: 2916412 - DNA, 17 bp, Homo sapiens
ctgcaccgtactgtgga

SEQ ID NO: 2916413 - DNA, 14 bp, Homo sapiens
ctgcacctcccccc

SEQ ID NO: 2916414 - DNA, 18 bp, Homo sapiens
ctgcacctccccccactg

SEQ ID NO: 2916415 - DNA, 20 bp, Homo sapiens
ctgcacctccccccactgca

SEQ ID NO: 2916416 - DNA, 17 bp, Homo sapiens
ctgcactcaaccttaag

SEQ ID NO: 2916417 - DNA, 11 bp, Homo sapiens
ctgcactccag

SEQ ID NO: 2916418 - DNA, 12 bp, Homo sapiens
ctgcactccaga

SEQ ID NO: 2916419 - DNA, 14 bp, Homo sapiens
ctgcactccagcct

SEQ ID NO: 2916420 - DNA, 16 bp, Homo sapiens
ctgcactccagcctga

SEQ ID NO: 2916421 - DNA, 17 bp, Homo sapiens
ctgcactccagcctgag

SEQ ID NO: 2916422 - DNA, 19 bp, Homo sapiens
ctgcactccctggccttgc

SEQ ID NO: 2916423 - DNA, 21 bp, Homo sapiens
ctgcactccctggccttgccc

SEQ ID NO: 2916424 - DNA, 14 bp, Homo sapiens
ctgcactcctcagg

SEQ ID NO: 2916425 - DNA, 17 bp, Homo sapiens
ctgcactgatgctgccc

SEQ ID NO: 2916426 - DNA, 22 bp, Homo sapiens
ctgcactggagccacaggcagg

SEQ ID NO: 2916427 - DNA, 16 bp, Homo sapiens
ctgcactgtgccccgc

SEQ ID NO: 2916428 - DNA, 18 bp, Homo sapiens
ctgcacttcatatctaga

SEQ ID NO: 2916429 - DNA, 19 bp, Homo sapiens
ctgcagaacatatcaaaat

SEQ ID NO: 2916430 - DNA, 14 bp, Homo sapiens
ctgcagacgtctgg

SEQ ID NO: 2916431 - DNA, 17 bp, Homo sapiens
ctgcagacgtctggccc

SEQ ID NO: 2916432 - DNA, 22 bp, Homo sapiens
ctgcagacgtctggccctggcg

SEQ ID NO: 2916433 - DNA, 15 bp, Homo sapiens
ctgcagactggcagt

SEQ ID NO: 2916434 - DNA, 23 bp, Homo sapiens
ctgcagagcagtgggcctggcca

SEQ ID NO: 2916435 - DNA, 17 bp, Homo sapiens
ctgcagagtctgcccca

SEQ ID NO: 2916436 - DNA, 18 bp, Homo sapiens
ctgcagagtctgccccac

SEQ ID NO: 2916437 - DNA, 18 bp, Homo sapiens
ctgcagcaatctttgaaa

SEQ ID NO: 2916438 - DNA, 22 bp, Homo sapiens
ctgcagcaccgaggggcctttg

SEQ ID NO: 2916439 - DNA, 10 bp, Homo sapiens
ctgcagccag

SEQ ID NO: 2916440 - DNA, 16 bp, Homo sapiens
ctgcagccagcccagc

SEQ ID NO: 2916441 - DNA, 22 bp, Homo sapiens
ctgcagccagcccagcccagct

SEQ ID NO: 2916442 - DNA, 23 bp, Homo sapiens
ctgcagccagcccagcccagctg

SEQ ID NO: 2916443 - DNA, 12 bp, Homo sapiens
ctgcagccaggc

SEQ ID NO: 2916444 - DNA, 18 bp, Homo sapiens
ctgcagccaggcctcgcc

SEQ ID NO: 2916445 - DNA, 21 bp, Homo sapiens
ctgcagccaggcctcgcctgc

SEQ ID NO: 2916446 - DNA, 14 bp, Homo sapiens
ctgcagcctcaacc

SEQ ID NO: 2916447 - DNA, 23 bp, Homo sapiens
ctgcagcctcaacctcctgggtt

SEQ ID NO: 2916448 - DNA, 14 bp, Homo sapiens
ctgcagcctccggg

SEQ ID NO: 2916449 - DNA, 16 bp, Homo sapiens
ctgcagcggcaggacc

SEQ ID NO: 2916450 - DNA, 17 bp, Homo sapiens
ctgcagcggcaggaccg

SEQ ID NO: 2916451 - DNA, 21 bp, Homo sapiens
ctgcagcggcaggaccgccat

SEQ ID NO: 2916452 - DNA, 22 bp, Homo sapiens
ctgcagcggcaggaccgccatg

SEQ ID NO: 2916453 - DNA, 13 bp, Homo sapiens
ctgcagctgcttg

SEQ ID NO: 2916454 - DNA, 17 bp, Homo sapiens
ctgcaggacctgcctgt

SEQ ID NO: 2916455 - DNA, 21 bp, Homo sapiens
ctgcaggacctgcctgtagcc

SEQ ID NO: 2916456 - DNA, 16 bp, Homo sapiens
ctgcaggagcagggcg

SEQ ID NO: 2916457 - DNA, 14 bp, Homo sapiens
ctgcaggagggcac

SEQ ID NO: 2916458 - DNA, 16 bp, Homo sapiens
ctgcaggagggcactg

SEQ ID NO: 2916459 - DNA, 15 bp, Homo sapiens
ctgcaggcaccgggc

SEQ ID NO: 2916460 - DNA, 19 bp, Homo sapiens
ctgcaggcagcaaaaacag

SEQ ID NO: 2916461 - DNA, 23 bp, Homo sapiens
ctgcaggccaggccagctgcctc

SEQ ID NO: 2916462 - DNA, 23 bp, Homo sapiens
ctgcaggccccgcttgtccagcg

SEQ ID NO: 2916463 - DNA, 22 bp, Homo sapiens
ctgcaggcctaggtgcagctcc

SEQ ID NO: 2916464 - DNA, 20 bp, Homo sapiens
ctgcaggctgcaggagggca

SEQ ID NO: 2916465 - DNA, 12 bp, Homo sapiens
ctgcagggaaaa

SEQ ID NO: 2916466 - DNA, 22 bp, Homo sapiens
ctgcagggaaaattatttgcat

SEQ ID NO: 2916467 - DNA, 21 bp, Homo sapiens
ctgcagggagcaccacggcca

SEQ ID NO: 2916468 - DNA, 18 bp, Homo sapiens
ctgcagggccatggctca

SEQ ID NO: 2916469 - DNA, 20 bp, Homo sapiens
ctgcagggccatggctcagg

SEQ ID NO: 2916470 - DNA, 21 bp, Homo sapiens
ctgcagggccatggctcaggg

SEQ ID NO: 2916471 - DNA, 19 bp, Homo sapiens
ctgcagggccgccagggag

SEQ ID NO: 2916472 - DNA, 23 bp, Homo sapiens
ctgcaggggttatgtggaagtgt

SEQ ID NO: 2916473 - DNA, 15 bp, Homo sapiens
ctgcaggtgctgctg

SEQ ID NO: 2916474 - DNA, 17 bp, Homo sapiens
ctgcagtaaatctttta

SEQ ID NO: 2916475 - DNA, 19 bp, Homo sapiens
ctgcagtcatcaacaatga

SEQ ID NO: 2916476 - DNA, 16 bp, Homo sapiens
ctgcagtcgcttgcca

SEQ ID NO: 2916477 - DNA, 18 bp, Homo sapiens
ctgcagtcggcatgccag

SEQ ID NO: 2916478 - DNA, 19 bp, Homo sapiens
ctgcagtctccgcctcctg

SEQ ID NO: 2916479 - DNA, 16 bp, Homo sapiens
ctgcagtgccagctcc

SEQ ID NO: 2916480 - DNA, 18 bp, Homo sapiens
ctgcagtgtccagaagcg

SEQ ID NO: 2916481 - DNA, 14 bp, Homo sapiens
ctgcagttaattag

SEQ ID NO: 2916482 - DNA, 21 bp, Homo sapiens
ctgcagttaattagcattctg

SEQ ID NO: 2916483 - DNA, 18 bp, Homo sapiens
ctgcagttgaagagcctg

SEQ ID NO: 2916484 - DNA, 15 bp, Homo sapiens
ctgcataccaacctg

SEQ ID NO: 2916485 - DNA, 14 bp, Homo sapiens
ctgcatatgttgaa

SEQ ID NO: 2916486 - DNA, 16 bp, Homo sapiens
ctgcatcagttcactg

SEQ ID NO: 2916487 - DNA, 20 bp, Homo sapiens
ctgcatccgtagttccctga

SEQ ID NO: 2916488 - DNA, 17 bp, Homo sapiens
ctgcatctaagcccatg

SEQ ID NO: 2916489 - DNA, 19 bp, Homo sapiens
ctgcatctgaccagcagcg

SEQ ID NO: 2916490 - DNA, 21 bp, Homo sapiens
ctgcatcttggggacatctct

SEQ ID NO: 2916491 - DNA, 16 bp, Homo sapiens
ctgcatgggccagccc

SEQ ID NO: 2916492 - DNA, 23 bp, Homo sapiens
ctgcatgtaaaatcttcagctgg

SEQ ID NO: 2916493 - DNA, 17 bp, Homo sapiens
ctgcatgtctactcagc

SEQ ID NO: 2916494 - DNA, 19 bp, Homo sapiens
ctgcatgtggcttctctgt

SEQ ID NO: 2916495 - DNA, 19 bp, Homo sapiens
ctgcatgtttgctgttcca

SEQ ID NO: 2916496 - DNA, 20 bp, Homo sapiens
ctgcattcaccttagtgcaa

SEQ ID NO: 2916497 - DNA, 18 bp, Homo sapiens
ctgcatttttaaaggaca

SEQ ID NO: 2916498 - DNA, 21 bp, Homo sapiens
ctgccaagccccatcctgccg

SEQ ID NO: 2916499 - DNA, 18 bp, Homo sapiens
ctgccaagtcctgccttt

SEQ ID NO: 2916500 - DNA, 23 bp, Homo sapiens
ctgccaatccttaaatatgtgaa

SEQ ID NO: 2916501 - DNA, 22 bp, Homo sapiens
ctgccacagcctcccctgccag

SEQ ID NO: 2916502 - DNA, 17 bp, Homo sapiens
ctgccaccaaatctgtc

SEQ ID NO: 2916503 - DNA, 17 bp, Homo sapiens
ctgccacccacctccct

SEQ ID NO: 2916504 - DNA, 23 bp, Homo sapiens
ctgccacccacctccctgcctcc

SEQ ID NO: 2916505 - DNA, 15 bp, Homo sapiens
ctgccaccgactgcc

SEQ ID NO: 2916506 - DNA, 18 bp, Homo sapiens
ctgccaccgactgcccag

SEQ ID NO: 2916507 - DNA, 22 bp, Homo sapiens
ctgccaccgactgcccagccac

SEQ ID NO: 2916508 - DNA, 23 bp, Homo sapiens
ctgccaccgactgcccagccact

SEQ ID NO: 2916509 - DNA, 22 bp, Homo sapiens
ctgccacgtgccttaggaatac

SEQ ID NO: 2916510 - DNA, 18 bp, Homo sapiens
ctgccactcaatgggaga

SEQ ID NO: 2916511 - DNA, 14 bp, Homo sapiens
ctgccactcaccct

SEQ ID NO: 2916512 - DNA, 16 bp, Homo sapiens
ctgccactcacccttc

SEQ ID NO: 2916513 - DNA, 23 bp, Homo sapiens
ctgccactcaggcccaaagcctc

SEQ ID NO: 2916514 - DNA, 19 bp, Homo sapiens
ctgccactctgctgcctgt

SEQ ID NO: 2916515 - DNA, 19 bp, Homo sapiens
ctgccagaccccctggaga

SEQ ID NO: 2916516 - DNA, 23 bp, Homo sapiens
ctgccagatgctgatgttcagtg

SEQ ID NO: 2916517 - DNA, 12 bp, Homo sapiens
ctgccagctctg

SEQ ID NO: 2916518 - DNA, 13 bp, Homo sapiens
ctgccagctctgt

SEQ ID NO: 2916519 - DNA, 11 bp, Homo sapiens
ctgccagctgc

SEQ ID NO: 2916520 - DNA, 12 bp, Homo sapiens
ctgccagctgca

SEQ ID NO: 2916521 - DNA, 17 bp, Homo sapiens
ctgccagctgcactgat

SEQ ID NO: 2916522 - DNA, 18 bp, Homo sapiens
ctgccaggaaacaaggga

SEQ ID NO: 2916523 - DNA, 17 bp, Homo sapiens
ctgccaggattttgtat

SEQ ID NO: 2916524 - DNA, 14 bp, Homo sapiens
ctgccaggccccca

SEQ ID NO: 2916525 - DNA, 18 bp, Homo sapiens
ctgccaggcccccaagcc

SEQ ID NO: 2916526 - DNA, 22 bp, Homo sapiens
ctgccaggcccccaagcctgca

SEQ ID NO: 2916527 - DNA, 15 bp, Homo sapiens
ctgccaggcccccac

SEQ ID NO: 2916528 - DNA, 19 bp, Homo sapiens
ctgccaggcccccaccaca

SEQ ID NO: 2916529 - DNA, 22 bp, Homo sapiens
ctgccaggcccccaccacacat

SEQ ID NO: 2916530 - DNA, 11 bp, Homo sapiens
ctgccagggca

SEQ ID NO: 2916531 - DNA, 19 bp, Homo sapiens
ctggagcgtttgctgtgcc

SEQ ID NO: 2916532 - DNA, 23 bp, Homo sapiens
ctggagcgtttgctgtgccagga

SEQ ID NO: 2916533 - DNA, 13 bp, Homo sapiens
ctggaggagagaa

SEQ ID NO: 2916534 - DNA, 14 bp, Homo sapiens
ctggaggagagaag

SEQ ID NO: 2916535 - DNA, 17 bp, Homo sapiens
ctggaggagagaagaat

SEQ ID NO: 2916536 - DNA, 14 bp, Homo sapiens
ctggaggcagggcc

SEQ ID NO: 2916537 - DNA, 13 bp, Homo sapiens
ctggaggcccagg

SEQ ID NO: 2916538 - DNA, 15 bp, Homo sapiens
ctggaggcccaggct

SEQ ID NO: 2916539 - DNA, 11 bp, Homo sapiens
ctggaggctgc

SEQ ID NO: 2916540 - DNA, 18 bp, Homo sapiens
ctggaggctggggatggt

SEQ ID NO: 2916541 - DNA, 16 bp, Homo sapiens
ctggagggcagagaca

SEQ ID NO: 2916542 - DNA, 17 bp, Homo sapiens
ctggagggcgcccagca

SEQ ID NO: 2916543 - DNA, 18 bp, Homo sapiens
ctggagggcgcccagcag

SEQ ID NO: 2916544 - DNA, 20 bp, Homo sapiens
ctggagggtgagaggaaggg

SEQ ID NO: 2916545 - DNA, 23 bp, Homo sapiens
ctggagggtgctaggcccctgtg

SEQ ID NO: 2916546 - DNA, 22 bp, Homo sapiens
ctggaggtcgaagcaatcagca

SEQ ID NO: 2916547 - DNA, 18 bp, Homo sapiens
ctggaggtctgaaaagag

SEQ ID NO: 2916548 - DNA, 20 bp, Homo sapiens
ctggaggtgctggtagctga

SEQ ID NO: 2916549 - DNA, 15 bp, Homo sapiens
ctggaggttgataac

SEQ ID NO: 2916550 - DNA, 19 bp, Homo sapiens
ctggaggttgataactttg

SEQ ID NO: 2916551 - DNA, 21 bp, Homo sapiens
ctggaggttgataactttgct

SEQ ID NO: 2916552 - DNA, 15 bp, Homo sapiens
ctggagtgaggaaaa

SEQ ID NO: 2916553 - DNA, 16 bp, Homo sapiens
ctggagtgctgcttgt

SEQ ID NO: 2916554 - DNA, 15 bp, Homo sapiens
ctggagtgctgtgct

SEQ ID NO: 2916555 - DNA, 20 bp, Homo sapiens
ctggagtgctgtgctgtgtt

SEQ ID NO: 2916556 - DNA, 18 bp, Homo sapiens
ctggagtggctcgccagg

SEQ ID NO: 2916557 - DNA, 21 bp, Homo sapiens
ctggagtgtgtcagagcccag

SEQ ID NO: 2916558 - DNA, 20 bp, Homo sapiens
ctggagttgatctggaaccc

SEQ ID NO: 2916559 - DNA, 22 bp, Homo sapiens
ctggagttgatctggaacccag

SEQ ID NO: 2916560 - DNA, 15 bp, Homo sapiens
ctggataaaaaagaa

SEQ ID NO: 2916561 - DNA, 20 bp, Homo sapiens
ctggatataaattaattgtg

SEQ ID NO: 2916562 - DNA, 20 bp, Homo sapiens
ctggatcagtcctttgatca

SEQ ID NO: 2916563 - DNA, 21 bp, Homo sapiens
ctggatcagtcctttgatcag

SEQ ID NO: 2916564 - DNA, 15 bp, Homo sapiens
ctggatccttcccaa

SEQ ID NO: 2916565 - DNA, 16 bp, Homo sapiens
ctggatccttcccaag

SEQ ID NO: 2916566 - DNA, 18 bp, Homo sapiens
ctggatccttcccaaggt

SEQ ID NO: 2916567 - DNA, 16 bp, Homo sapiens
ctggatctagaaggga

SEQ ID NO: 2916568 - DNA, 14 bp, Homo sapiens
ctggatctggctta

SEQ ID NO: 2916569 - DNA, 15 bp, Homo sapiens
ctggatgccttcccc

SEQ ID NO: 2916570 - DNA, 16 bp, Homo sapiens
ctggatgctccttcca

SEQ ID NO: 2916571 - DNA, 13 bp, Homo sapiens
ctggatgtctgaa

SEQ ID NO: 2916572 - DNA, 16 bp, Homo sapiens
ctggatgtctgaactt

SEQ ID NO: 2916573 - DNA, 21 bp, Homo sapiens
ctggatgtctgaactttggga

SEQ ID NO: 2916574 - DNA, 20 bp, Homo sapiens
ctggattccccatctcaggc

SEQ ID NO: 2916575 - DNA, 12 bp, Homo sapiens
ctggcacacatc

SEQ ID NO: 2916576 - DNA, 21 bp, Homo sapiens
ctggcacacatcaggagttca

SEQ ID NO: 2916577 - DNA, 14 bp, Homo sapiens
ctggcacagcctgg

SEQ ID NO: 2916578 - DNA, 15 bp, Homo sapiens
ctggcacagcctggc

SEQ ID NO: 2916579 - DNA, 16 bp, Homo sapiens
ctggcacagcctggct

SEQ ID NO: 2916580 - DNA, 21 bp, Homo sapiens
ctggcacctgtgttccagccc

SEQ ID NO: 2916581 - DNA, 15 bp, Homo sapiens
ctggcagactgtgta

SEQ ID NO: 2916582 - DNA, 18 bp, Homo sapiens
ctggcagccccagcacca

SEQ ID NO: 2916583 - DNA, 20 bp, Homo sapiens
ctggcagcctcccatccagg

SEQ ID NO: 2916584 - DNA, 23 bp, Homo sapiens
ctggcagcctcccatccagggcc

SEQ ID NO: 2916585 - DNA, 21 bp, Homo sapiens
ctggcagctctggacagcccc

SEQ ID NO: 2916586 - DNA, 16 bp, Homo sapiens
ctggcagctgcccctc

SEQ ID NO: 2916587 - DNA, 24 bp, Homo sapiens
ctggcaggcaggctcccagggaca

SEQ ID NO: 2916588 - DNA, 16 bp, Homo sapiens
ctggcagtcgcacaca

SEQ ID NO: 2916589 - DNA, 22 bp, Homo sapiens
ctggcagttttgacatcagcca

SEQ ID NO: 2916590 - DNA, 15 bp, Homo sapiens
ctggcatagtttcat

SEQ ID NO: 2916591 - DNA, 15 bp, Homo sapiens
ctggcatctgtgtgc

SEQ ID NO: 2916592 - DNA, 13 bp, Homo sapiens
ctggcattttata

SEQ ID NO: 2916593 - DNA, 23 bp, Homo sapiens
ctggcattttatagacaccctgg

SEQ ID NO: 2916594 - DNA, 19 bp, Homo sapiens
ctggccaaagagcctttcc

SEQ ID NO: 2916595 - DNA, 13 bp, Homo sapiens
ctggccaccaccc

SEQ ID NO: 2916596 - DNA, 22 bp, Homo sapiens
ctggccaccacccaacctgtcc

SEQ ID NO: 2916597 - DNA, 13 bp, Homo sapiens
ctggccagaatgc

SEQ ID NO: 2916598 - DNA, 13 bp, Homo sapiens
ctggccagccgct

SEQ ID NO: 2916599 - DNA, 12 bp, Homo sapiens
ctggccaggccc

SEQ ID NO: 2916600 - DNA, 17 bp, Homo sapiens
ctggccaggccctgggt

SEQ ID NO: 2916601 - DNA, 17 bp, Homo sapiens
ctggccagggccacgct

SEQ ID NO: 2916602 - DNA, 20 bp, Homo sapiens
ctggccagggccacgctcca

SEQ ID NO: 2916603 - DNA, 23 bp, Homo sapiens
ctggccagggccacgctccagct

SEQ ID NO: 2916604 - DNA, 19 bp, Homo sapiens
ctggccagtcctggtcctg

SEQ ID NO: 2916605 - DNA, 21 bp, Homo sapiens
ctggccagtcctggtcctggc

SEQ ID NO: 2916606 - DNA, 17 bp, Homo sapiens
ctggccagtgctgccca

SEQ ID NO: 2916607 - DNA, 14 bp, Homo sapiens
ctggccatgctgtc

SEQ ID NO: 2916608 - DNA, 22 bp, Homo sapiens
ctggccatgctgtccctgcact

SEQ ID NO: 2916609 - DNA, 19 bp, Homo sapiens
ctggccatttggccccagg

SEQ ID NO: 2916610 - DNA, 18 bp, Homo sapiens
ctggcccactgctggctg

SEQ ID NO: 2916611 - DNA, 20 bp, Homo sapiens
ctggcccactgctggctgca

SEQ ID NO: 2916612 - DNA, 12 bp, Homo sapiens
ctggcccaggag

SEQ ID NO: 2916613 - DNA, 13 bp, Homo sapiens
ctggcccaggcct

SEQ ID NO: 2916614 - DNA, 18 bp, Homo sapiens
ctggcccaggccttgctg

SEQ ID NO: 2916615 - DNA, 21 bp, Homo sapiens
ctggcccaggccttgctgact

SEQ ID NO: 2916616 - DNA, 12 bp, Homo sapiens
ctggcccagggc

SEQ ID NO: 2916617 - DNA, 18 bp, Homo sapiens
ctggcccagggcccagag

SEQ ID NO: 2916618 - DNA, 14 bp, Homo sapiens
ctggccccacagga

SEQ ID NO: 2916619 - DNA, 21 bp, Homo sapiens
ctggccccaggacctggctgc

SEQ ID NO: 2916620 - DNA, 20 bp, Homo sapiens
ctggccccaggtagaaactt

SEQ ID NO: 2916621 - DNA, 18 bp, Homo sapiens
ctggccccctcagctctg

SEQ ID NO: 2916622 - DNA, 22 bp, Homo sapiens
ctggccccgccgcctggtactc

SEQ ID NO: 2916623 - DNA, 23 bp, Homo sapiens
ctggccccgccgcctggtactca

SEQ ID NO: 2916624 - DNA, 14 bp, Homo sapiens
ctggccccgcctgc

SEQ ID NO: 2916625 - DNA, 16 bp, Homo sapiens
ctggccccgcctgcct

SEQ ID NO: 2916626 - DNA, 12 bp, Homo sapiens
ctggcccctcca

SEQ ID NO: 2916627 - DNA, 18 bp, Homo sapiens
ctggcccctgagatctct

SEQ ID NO: 2916628 - DNA, 22 bp, Homo sapiens
ctggcccctttgggccctgcat

SEQ ID NO: 2916629 - DNA, 18 bp, Homo sapiens
ctggcccgtgacagactc

SEQ ID NO: 2916630 - DNA, 13 bp, Homo sapiens
ctggccctgtgca

SEQ ID NO: 2916631 - DNA, 14 bp, Homo sapiens
ctggccctgtgcag

SEQ ID NO: 2916632 - DNA, 17 bp, Homo sapiens
ctggccgagtccaagct

SEQ ID NO: 2916633 - DNA, 13 bp, Homo sapiens
ctggccggccagc

SEQ ID NO: 2916634 - DNA, 22 bp, Homo sapiens
ctggccgggaccccgagcctgg

SEQ ID NO: 2916635 - DNA, 14 bp, Homo sapiens
ctggccgggcaggc

SEQ ID NO: 2916636 - DNA, 18 bp, Homo sapiens
ctggccgggtcaccctgt

SEQ ID NO: 2916637 - DNA, 22 bp, Homo sapiens
ctggccgggtcaccctgtgacc

SEQ ID NO: 2916638 - DNA, 13 bp, Homo sapiens
ctggccgtacttg

SEQ ID NO: 2916639 - DNA, 17 bp, Homo sapiens
ctggccgtggctccaga

SEQ ID NO: 2916640 - DNA, 16 bp, Homo sapiens
ctggccgttcagcctg

SEQ ID NO: 2916641 - DNA, 19 bp, Homo sapiens
ctggcctaggggccagggc

SEQ ID NO: 2916642 - DNA, 15 bp, Homo sapiens
ctggcctccaggccc

SEQ ID NO: 2916643 - DNA, 13 bp, Homo sapiens
ctggcctcccaca

SEQ ID NO: 2916644 - DNA, 13 bp, Homo sapiens
ctggcctctgtgc

SEQ ID NO: 2916645 - DNA, 14 bp, Homo sapiens
ctggcctctgtgcc

SEQ ID NO: 2916646 - DNA, 19 bp, Homo sapiens
ctggcctcttggcacctgc

SEQ ID NO: 2916647 - DNA, 10 bp, Homo sapiens
ctggcctgag

SEQ ID NO: 2916648 - DNA, 14 bp, Homo sapiens
ctggcctgctctta

SEQ ID NO: 2916649 - DNA, 21 bp, Homo sapiens
ctggcctgctcttacttcccc

SEQ ID NO: 2916650 - DNA, 22 bp, Homo sapiens
ctggcctgctcttacttccccc

SEQ ID NO: 2916651 - DNA, 14 bp, Homo sapiens
ctggcctggcaggg

SEQ ID NO: 2916652 - DNA, 16 bp, Homo sapiens
ctggcctggcaggggg

SEQ ID NO: 2916653 - DNA, 19 bp, Homo sapiens
ctggcctggtccctggtcc

SEQ ID NO: 2916654 - DNA, 20 bp, Homo sapiens
ctggcctggtccctggtcct

SEQ ID NO: 2916655 - DNA, 21 bp, Homo sapiens
ctggcctggtccctggtcctt

SEQ ID NO: 2916656 - DNA, 22 bp, Homo sapiens
ctggccttgcccgtcgtgtgct

SEQ ID NO: 2916657 - DNA, 23 bp, Homo sapiens
ctggccttgcccgtcgtgtgctg

SEQ ID NO: 2916658 - DNA, 22 bp, Homo sapiens
ctggccttggtatgtgccaggc

SEQ ID NO: 2916659 - DNA, 23 bp, Homo sapiens
ctggccttggtatgtgccaggct

SEQ ID NO: 2916660 - DNA, 19 bp, Homo sapiens
ctggccttgtcctcagcca

SEQ ID NO: 2916661 - DNA, 17 bp, Homo sapiens
ctggcgacactcagggc

SEQ ID NO: 2916662 - DNA, 22 bp, Homo sapiens
ctggcgacactcagggcagctg

SEQ ID NO: 2916663 - DNA, 19 bp, Homo sapiens
ctggtgctcctgcccagcc

SEQ ID NO: 2916664 - DNA, 22 bp, Homo sapiens
ctggtgctcctgcccagccacc

SEQ ID NO: 2916665 - DNA, 20 bp, Homo sapiens
ctggtgctcgggaagggagg

SEQ ID NO: 2916666 - DNA, 14 bp, Homo sapiens
ctggtgctgcctct

SEQ ID NO: 2916667 - DNA, 19 bp, Homo sapiens
ctggtggaggagctgaggg

SEQ ID NO: 2916668 - DNA, 20 bp, Homo sapiens
ctggtggaggagctgaggga

SEQ ID NO: 2916669 - DNA, 17 bp, Homo sapiens
ctggtggatggtgactt

SEQ ID NO: 2916670 - DNA, 17 bp, Homo sapiens
ctggtggattgggcaga

SEQ ID NO: 2916671 - DNA, 15 bp, Homo sapiens
ctggtggcacaggag

SEQ ID NO: 2916672 - DNA, 13 bp, Homo sapiens
ctggtggcccagg

SEQ ID NO: 2916673 - DNA, 20 bp, Homo sapiens
ctggtggctgggcccagcag

SEQ ID NO: 2916674 - DNA, 15 bp, Homo sapiens
ctggtgggagcacct

SEQ ID NO: 2916675 - DNA, 20 bp, Homo sapiens
ctggtgggagcacctgccag

SEQ ID NO: 2916676 - DNA, 19 bp, Homo sapiens
ctggtgggtggtgtcctga

SEQ ID NO: 2916677 - DNA, 22 bp, Homo sapiens
ctggtgggtggtgtcctgaagc

SEQ ID NO: 2916678 - DNA, 22 bp, Homo sapiens
ctggtggtggctcgggaggcga

SEQ ID NO: 2916679 - DNA, 20 bp, Homo sapiens
ctggtggttcactcttggag

SEQ ID NO: 2916680 - DNA, 21 bp, Homo sapiens
ctggtggttcactcttggagc

SEQ ID NO: 2916681 - DNA, 23 bp, Homo sapiens
ctggtggttcactcttggagcct

SEQ ID NO: 2916682 - DNA, 16 bp, Homo sapiens
ctggtgtcaccccaga

SEQ ID NO: 2916683 - DNA, 19 bp, Homo sapiens
ctggtgtcaccccagagcc

SEQ ID NO: 2916684 - DNA, 22 bp, Homo sapiens
ctggtgtcaccccagagccaca

SEQ ID NO: 2916685 - DNA, 23 bp, Homo sapiens
ctggtgtcaccccagagccacac

SEQ ID NO: 2916686 - DNA, 16 bp, Homo sapiens
ctggttataagcagca

SEQ ID NO: 2916687 - DNA, 22 bp, Homo sapiens
ctggttcactctaattggtcat

SEQ ID NO: 2916688 - DNA, 14 bp, Homo sapiens
ctggttccgccagg

SEQ ID NO: 2916689 - DNA, 23 bp, Homo sapiens
ctggttccgccaggcgctgcagg

SEQ ID NO: 2916690 - DNA, 12 bp, Homo sapiens
ctggttcctgct

SEQ ID NO: 2916691 - DNA, 16 bp, Homo sapiens
ctggttcctgctgtcc

SEQ ID NO: 2916692 - DNA, 17 bp, Homo sapiens
ctggttcctgctgtcct

SEQ ID NO: 2916693 - DNA, 21 bp, Homo sapiens
ctggttcctgctgtcctggtg

SEQ ID NO: 2916694 - DNA, 22 bp, Homo sapiens
ctggttcctgctgtcctggtgg

SEQ ID NO: 2916695 - DNA, 15 bp, Homo sapiens
ctggttctcaatgaa

SEQ ID NO: 2916696 - DNA, 17 bp, Homo sapiens
ctggttctcaatgaaaa

SEQ ID NO: 2916697 - DNA, 20 bp, Homo sapiens
ctggttctgtctagactggc

SEQ ID NO: 2916698 - DNA, 13 bp, Homo sapiens
ctggttcttgcct

SEQ ID NO: 2916699 - DNA, 14 bp, Homo sapiens
ctggttcttgcctt

SEQ ID NO: 2916700 - DNA, 16 bp, Homo sapiens
ctggttcttgccttcc

SEQ ID NO: 2916701 - DNA, 17 bp, Homo sapiens
ctggttcttgccttccc

SEQ ID NO: 2916702 - DNA, 19 bp, Homo sapiens
ctggttcttgccttcccct

SEQ ID NO: 2916703 - DNA, 18 bp, Homo sapiens
ctggttggcatttgctgg

SEQ ID NO: 2916704 - DNA, 21 bp, Homo sapiens
ctggttgtcacctatgagacc

SEQ ID NO: 2916705 - DNA, 16 bp, Homo sapiens
ctggtttcctgcccag

SEQ ID NO: 2916706 - DNA, 17 bp, Homo sapiens
ctggtttcctgcccagc

SEQ ID NO: 2916707 - DNA, 20 bp, Homo sapiens
ctggttttacttacaaaaat

SEQ ID NO: 2916708 - DNA, 23 bp, Homo sapiens
ctggttttcgtcatcttccctgc

SEQ ID NO: 2916709 - DNA, 21 bp, Homo sapiens
ctggttttgatggctgggtcc

SEQ ID NO: 2916710 - DNA, 13 bp, Homo sapiens
ctgtaaaaaagaa

SEQ ID NO: 2916711 - DNA, 19 bp, Homo sapiens
ctgtaaaaaagaaaaacaa

SEQ ID NO: 2916712 - DNA, 14 bp, Homo sapiens
ctgtaaaagtgtct

SEQ ID NO: 2916713 - DNA, 16 bp, Homo sapiens
ctgtaaagaaagagag

SEQ ID NO: 2916714 - DNA, 18 bp, Homo sapiens
ctgtaaagaaagagagaa

SEQ ID NO: 2916715 - DNA, 16 bp, Homo sapiens
ctgtaaagcgcagata

SEQ ID NO: 2916716 - DNA, 11 bp, Homo sapiens
ctgtaaatcat

SEQ ID NO: 2916717 - DNA, 13 bp, Homo sapiens
ctgtaaatgtgac

SEQ ID NO: 2916718 - DNA, 18 bp, Homo sapiens
ctgtaaccacctctctgt

SEQ ID NO: 2916719 - DNA, 20 bp, Homo sapiens
ctgtaaccacctctctgtct

SEQ ID NO: 2916720 - DNA, 17 bp, Homo sapiens
ctgtaaccagactttga

SEQ ID NO: 2916721 - DNA, 22 bp, Homo sapiens
ctgtaacctcttcagaggccct

SEQ ID NO: 2916722 - DNA, 17 bp, Homo sapiens
ctgtaactaaaggaatc

SEQ ID NO: 2916723 - DNA, 21 bp, Homo sapiens
ctgtaactggtagtgttcagt

SEQ ID NO: 2916724 - DNA, 22 bp, Homo sapiens
ctgtaactggtagtgttcagta

SEQ ID NO: 2916725 - DNA, 21 bp, Homo sapiens
ctgtaagaaaatgctgtcaca

SEQ ID NO: 2916726 - DNA, 18 bp, Homo sapiens
ctgtaagaataatttata

SEQ ID NO: 2916727 - DNA, 12 bp, Homo sapiens
ctgtaagacatt

SEQ ID NO: 2916728 - DNA, 16 bp, Homo sapiens
ctgtaagacattagta

SEQ ID NO: 2916729 - DNA, 21 bp, Homo sapiens
ctgtaagatgtctgtttgctg

SEQ ID NO: 2916730 - DNA, 13 bp, Homo sapiens
ctgtaaggctcta

SEQ ID NO: 2916731 - DNA, 15 bp, Homo sapiens
ctgtaaggctctaga

SEQ ID NO: 2916732 - DNA, 18 bp, Homo sapiens
ctgtaaggctctagatca

SEQ ID NO: 2916733 - DNA, 12 bp, Homo sapiens
ctgtaaggggca

SEQ ID NO: 2916734 - DNA, 20 bp, Homo sapiens
ctgtaataaagatgattgtg

SEQ ID NO: 2916735 - DNA, 18 bp, Homo sapiens
ctgtaatcatttgtttac

SEQ ID NO: 2916736 - DNA, 13 bp, Homo sapiens
ctgtaatcccaga

SEQ ID NO: 2916737 - DNA, 18 bp, Homo sapiens
ctgtaatcccagcacact

SEQ ID NO: 2916738 - DNA, 18 bp, Homo sapiens
ctgtaatcccagcacttt

SEQ ID NO: 2916739 - DNA, 22 bp, Homo sapiens
ctgtaatcccagcactttgaga

SEQ ID NO: 2916740 - DNA, 14 bp, Homo sapiens
ctgtaatcccagct

SEQ ID NO: 2916741 - DNA, 19 bp, Homo sapiens
ctgtaatctcgtttcaaaa

SEQ ID NO: 2916742 - DNA, 22 bp, Homo sapiens
ctgtaatctcgtttcaaaaaca

SEQ ID NO: 2916743 - DNA, 15 bp, Homo sapiens
ctgtaatctttttct

SEQ ID NO: 2916744 - DNA, 14 bp, Homo sapiens
ctgtaattcagtgt

SEQ ID NO: 2916745 - DNA, 16 bp, Homo sapiens
ctgtacacgtgtcctg

SEQ ID NO: 2916746 - DNA, 22 bp, Homo sapiens
ctgtacagaagaaactgaatct

SEQ ID NO: 2916747 - DNA, 11 bp, Homo sapiens
ctgtacagtct

SEQ ID NO: 2916748 - DNA, 22 bp, Homo sapiens
ctgtacagtctgtcttctgtat

SEQ ID NO: 2916749 - DNA, 23 bp, Homo sapiens
ctgtacagttttgtggactgagc

SEQ ID NO: 2916750 - DNA, 14 bp, Homo sapiens
ctgtacatctattt

SEQ ID NO: 2916751 - DNA, 12 bp, Homo sapiens
ctgtacattttt

SEQ ID NO: 2916752 - DNA, 15 bp, Homo sapiens
ctgtacctaaagcaa

SEQ ID NO: 2916753 - DNA, 17 bp, Homo sapiens
ctgtactaaggagcatg

SEQ ID NO: 2916754 - DNA, 18 bp, Homo sapiens
ctgtactaaggagcatga

SEQ ID NO: 2916755 - DNA, 18 bp, Homo sapiens
ctgtactatttaaaatgc

SEQ ID NO: 2916756 - DNA, 18 bp, Homo sapiens
ctgtactgttactgggcc

SEQ ID NO: 2916757 - DNA, 20 bp, Homo sapiens
ctgtactgttactgggccct

SEQ ID NO: 2916758 - DNA, 14 bp, Homo sapiens
ctgtactgttttct

SEQ ID NO: 2916759 - DNA, 14 bp, Homo sapiens
ctgtacttggtcca

SEQ ID NO: 2916760 - DNA, 17 bp, Homo sapiens
ctgtacttggtccaact

SEQ ID NO: 2916761 - DNA, 23 bp, Homo sapiens
ctgtacttggtccaactgcaact

SEQ ID NO: 2916762 - DNA, 16 bp, Homo sapiens
ctgtagaactgatttt

SEQ ID NO: 2916763 - DNA, 20 bp, Homo sapiens
ctgtagaagaagtgaacact

SEQ ID NO: 2916764 - DNA, 21 bp, Homo sapiens
ctgtagaagaagtgaacactt

SEQ ID NO: 2916765 - DNA, 21 bp, Homo sapiens
ctgtagaatagcctgtggcct

SEQ ID NO: 2916766 - DNA, 13 bp, Homo sapiens
ctgtagagacttc

SEQ ID NO: 2916767 - DNA, 17 bp, Homo sapiens
ctgtagagacttccgtc

SEQ ID NO: 2916768 - DNA, 16 bp, Homo sapiens
ctgtagagccaattag

SEQ ID NO: 2916769 - DNA, 14 bp, Homo sapiens
ctgtagataaataa

SEQ ID NO: 2916770 - DNA, 15 bp, Homo sapiens
ctgtagataacagca

SEQ ID NO: 2916771 - DNA, 13 bp, Homo sapiens
ctgtagatgatgt

SEQ ID NO: 2916772 - DNA, 15 bp, Homo sapiens
ctgtagattctgtgg

SEQ ID NO: 2916773 - DNA, 21 bp, Homo sapiens
ctgtagcccactctgctcgcc

SEQ ID NO: 2916774 - DNA, 17 bp, Homo sapiens
ctgtagccccagtgaca

SEQ ID NO: 2916775 - DNA, 20 bp, Homo sapiens
ctgtagccccagtgacagct

SEQ ID NO: 2916776 - DNA, 13 bp, Homo sapiens
ctgtagccttctg

SEQ ID NO: 2916777 - DNA, 18 bp, Homo sapiens
ctgtaggatcttatttgg

SEQ ID NO: 2916778 - DNA, 24 bp, Homo sapiens
ctgtagggtaattagtaacatgtg

SEQ ID NO: 2916779 - DNA, 20 bp, Homo sapiens
ctgtagtgagatagcattgt

SEQ ID NO: 2916780 - DNA, 20 bp, Homo sapiens
ctgtagttgcgtggactctg

SEQ ID NO: 2916781 - DNA, 21 bp, Homo sapiens
ctgtagtttatggcagaaggg

SEQ ID NO: 2916782 - DNA, 13 bp, Homo sapiens
ctgtataaatgtc

SEQ ID NO: 2916783 - DNA, 15 bp, Homo sapiens
ctgtataaatgtcta

SEQ ID NO: 2916784 - DNA, 20 bp, Homo sapiens
ctgtataaatgtctattatt

SEQ ID NO: 2916785 - DNA, 16 bp, Homo sapiens
ctgtataaccctgtta

SEQ ID NO: 2916786 - DNA, 17 bp, Homo sapiens
ctgtataaccctgttac

SEQ ID NO: 2916787 - DNA, 14 bp, Homo sapiens
ctgtataagtagat

SEQ ID NO: 2916788 - DNA, 17 bp, Homo sapiens
ctgtataagtagatctg

SEQ ID NO: 2916789 - DNA, 21 bp, Homo sapiens
ctgtataagtagatctgcttt

SEQ ID NO: 2916790 - DNA, 23 bp, Homo sapiens
ctgtataagtagatctgctttct

SEQ ID NO: 2916791 - DNA, 19 bp, Homo sapiens
ctgtatacaaccctggcat

SEQ ID NO: 2916792 - DNA, 14 bp, Homo sapiens
ctgtatagctcctt

SEQ ID NO: 2916793 - DNA, 15 bp, Homo sapiens
ctgtatataaaataa

SEQ ID NO: 2916794 - DNA, 15 bp, Homo sapiens
ctgtatataaatata

SEQ ID NO: 2916795 - DNA, 16 bp, Homo sapiens
ctgtggtaaatgccac

SEQ ID NO: 2916796 - DNA, 23 bp, Homo sapiens
ctgtggtaaatgccacacacctt

SEQ ID NO: 2916797 - DNA, 15 bp, Homo sapiens
ctgtggtagctccag

SEQ ID NO: 2916798 - DNA, 13 bp, Homo sapiens
ctgtggtcccacc

SEQ ID NO: 2916799 - DNA, 14 bp, Homo sapiens
ctgtggtcccaccc

SEQ ID NO: 2916800 - DNA, 16 bp, Homo sapiens
ctgtggtcccacccag

SEQ ID NO: 2916801 - DNA, 18 bp, Homo sapiens
ctgtggtcccacccagga

SEQ ID NO: 2916802 - DNA, 19 bp, Homo sapiens
ctgtggtcccacccaggaa

SEQ ID NO: 2916803 - DNA, 20 bp, Homo sapiens
ctgtggtcccacccaggaag

SEQ ID NO: 2916804 - DNA, 14 bp, Homo sapiens
ctgtggtggcctgg

SEQ ID NO: 2916805 - DNA, 18 bp, Homo sapiens
ctgtggtggctccccctc

SEQ ID NO: 2916806 - DNA, 13 bp, Homo sapiens
ctgtggtgtctgc

SEQ ID NO: 2916807 - DNA, 22 bp, Homo sapiens
ctgtggtgtgtccccctctgtc

SEQ ID NO: 2916808 - DNA, 19 bp, Homo sapiens
ctgtggttgcctgccctcc

SEQ ID NO: 2916809 - DNA, 16 bp, Homo sapiens
ctgtggtttggtttta

SEQ ID NO: 2916810 - DNA, 15 bp, Homo sapiens
ctgtgtaaaatgtaa

SEQ ID NO: 2916811 - DNA, 19 bp, Homo sapiens
ctgtgtaaaatgtaatgca

SEQ ID NO: 2916812 - DNA, 14 bp, Homo sapiens
ctgtgtaaagttag

SEQ ID NO: 2916813 - DNA, 15 bp, Homo sapiens
ctgtgtaaagttagt

SEQ ID NO: 2916814 - DNA, 18 bp, Homo sapiens
ctgtgtaaagttagtcta

SEQ ID NO: 2916815 - DNA, 19 bp, Homo sapiens
ctgtgtaaatatttttccc

SEQ ID NO: 2916816 - DNA, 15 bp, Homo sapiens
ctgtgtaaccttggg

SEQ ID NO: 2916817 - DNA, 14 bp, Homo sapiens
ctgtgtaagctttt

SEQ ID NO: 2916818 - DNA, 17 bp, Homo sapiens
ctgtgtagccgccctga

SEQ ID NO: 2916819 - DNA, 23 bp, Homo sapiens
ctgtgtattaaacctttccattt

SEQ ID NO: 2916820 - DNA, 20 bp, Homo sapiens
ctgtgtcaatccagatggtg

SEQ ID NO: 2916821 - DNA, 22 bp, Homo sapiens
ctgtgtcagagcccagcccagg

SEQ ID NO: 2916822 - DNA, 23 bp, Homo sapiens
ctgtgtcagggaacatatttaag

SEQ ID NO: 2916823 - DNA, 17 bp, Homo sapiens
ctgtgtcccctgacctg

SEQ ID NO: 2916824 - DNA, 22 bp, Homo sapiens
ctgtgtcccctgacctgtccag

SEQ ID NO: 2916825 - DNA, 13 bp, Homo sapiens
ctgtgtccctgct

SEQ ID NO: 2916826 - DNA, 12 bp, Homo sapiens
ctgtgtcctccc

SEQ ID NO: 2916827 - DNA, 15 bp, Homo sapiens
ctgtgtcctccctcc

SEQ ID NO: 2916828 - DNA, 16 bp, Homo sapiens
ctgtgtcctccctccc

SEQ ID NO: 2916829 - DNA, 19 bp, Homo sapiens
ctgtgtccttgcacctgca

SEQ ID NO: 2916830 - DNA, 13 bp, Homo sapiens
ctgtgtctaagat

SEQ ID NO: 2916831 - DNA, 19 bp, Homo sapiens
ctgtgtctaagattctaga

SEQ ID NO: 2916832 - DNA, 21 bp, Homo sapiens
ctgtgtctaagattctagatc

SEQ ID NO: 2916833 - DNA, 14 bp, Homo sapiens
ctgtgtctctatgt

SEQ ID NO: 2916834 - DNA, 17 bp, Homo sapiens
ctgtgtctctatgtgaa

SEQ ID NO: 2916835 - DNA, 23 bp, Homo sapiens
ctgtgtctctgtatatagctcta

SEQ ID NO: 2916836 - DNA, 21 bp, Homo sapiens
ctgtgtgattgacagctttgc

SEQ ID NO: 2916837 - DNA, 22 bp, Homo sapiens
ctgtgtgattgacagctttgct

SEQ ID NO: 2916838 - DNA, 23 bp, Homo sapiens
ctgtgtgattgacagctttgctg

SEQ ID NO: 2916839 - DNA, 15 bp, Homo sapiens
ctgtgtgcgctctgt

SEQ ID NO: 2916840 - DNA, 19 bp, Homo sapiens
ctgtgtgcgtggcgtggcc

SEQ ID NO: 2916841 - DNA, 20 bp, Homo sapiens
ctgtgtgcgtggcgtggccc

SEQ ID NO: 2916842 - DNA, 18 bp, Homo sapiens
ctgtgtgtgacccctcct

SEQ ID NO: 2916843 - DNA, 20 bp, Homo sapiens
ctgtgtgtgacccctcctgg

SEQ ID NO: 2916844 - DNA, 16 bp, Homo sapiens
ctgtgtgtgtgaatga

SEQ ID NO: 2916845 - DNA, 23 bp, Homo sapiens
ctgtgtgtgtgaatgaacactct

SEQ ID NO: 2916846 - DNA, 14 bp, Homo sapiens
ctgtgttacttgaa

SEQ ID NO: 2916847 - DNA, 15 bp, Homo sapiens
ctgtgttacttgaag

SEQ ID NO: 2916848 - DNA, 17 bp, Homo sapiens
ctgtgttacttgaagta

SEQ ID NO: 2916849 - DNA, 18 bp, Homo sapiens
ctgtgttctaacttattt

SEQ ID NO: 2916850 - DNA, 11 bp, Homo sapiens
ctgtgttgaaa

SEQ ID NO: 2916851 - DNA, 13 bp, Homo sapiens
ctgtgttgaaaca

SEQ ID NO: 2916852 - DNA, 17 bp, Homo sapiens
ctgtgttgaaacagaaa

SEQ ID NO: 2916853 - DNA, 20 bp, Homo sapiens
ctgtgttgactgctgctccc

SEQ ID NO: 2916854 - DNA, 22 bp, Homo sapiens
ctgtgttgactgctgctcccca

SEQ ID NO: 2916855 - DNA, 16 bp, Homo sapiens
ctgtgtttataaaata

SEQ ID NO: 2916856 - DNA, 17 bp, Homo sapiens
ctgtgtttataaaatat

SEQ ID NO: 2916857 - DNA, 19 bp, Homo sapiens
ctgtgtttataaaatataa

SEQ ID NO: 2916858 - DNA, 16 bp, Homo sapiens
ctgtgtttggctttca

SEQ ID NO: 2916859 - DNA, 18 bp, Homo sapiens
ctgtgtttggctttcagg

SEQ ID NO: 2916860 - DNA, 16 bp, Homo sapiens
ctgttacactggagga

SEQ ID NO: 2916861 - DNA, 20 bp, Homo sapiens
ctgttacctgatcaatgaca

SEQ ID NO: 2916862 - DNA, 23 bp, Homo sapiens
ctgttacctgtcttgctcctggg

SEQ ID NO: 2916863 - DNA, 18 bp, Homo sapiens
ctgttacttgcttctgct

SEQ ID NO: 2916864 - DNA, 18 bp, Homo sapiens
ctgttaggccaactgcct

SEQ ID NO: 2916865 - DNA, 19 bp, Homo sapiens
ctgttaggccaactgcctc

SEQ ID NO: 2916866 - DNA, 17 bp, Homo sapiens
ctgttatcagctgggca

SEQ ID NO: 2916867 - DNA, 16 bp, Homo sapiens
ctgttattatatttga

SEQ ID NO: 2916868 - DNA, 15 bp, Homo sapiens
ctgttattcttgtta

SEQ ID NO: 2916869 - DNA, 12 bp, Homo sapiens
ctgttcacccac

SEQ ID NO: 2916870 - DNA, 13 bp, Homo sapiens
ctgttcagttaca

SEQ ID NO: 2916871 - DNA, 15 bp, Homo sapiens
ctgttcagttacaga

SEQ ID NO: 2916872 - DNA, 21 bp, Homo sapiens
ctgttcagttacagaaagtgg

SEQ ID NO: 2916873 - DNA, 20 bp, Homo sapiens
ctgttcatctctttgtcctg

SEQ ID NO: 2916874 - DNA, 22 bp, Homo sapiens
ctgttcatctctttgtcctgaa

SEQ ID NO: 2916875 - DNA, 12 bp, Homo sapiens
ctgttccacaaa

SEQ ID NO: 2916876 - DNA, 21 bp, Homo sapiens
ctgttccacaaagcagtggct

SEQ ID NO: 2916877 - DNA, 15 bp, Homo sapiens
ctgttccccagagaa

SEQ ID NO: 2916878 - DNA, 17 bp, Homo sapiens
ctgttccccctgtgcag

SEQ ID NO: 2916879 - DNA, 15 bp, Homo sapiens
ctgttcccccttcac

SEQ ID NO: 2916880 - DNA, 16 bp, Homo sapiens
ctgttcccccttcaca

SEQ ID NO: 2916881 - DNA, 23 bp, Homo sapiens
ctgttcccccttcacaaagccca

SEQ ID NO: 2916882 - DNA, 17 bp, Homo sapiens
ctgttcctccctcccac

SEQ ID NO: 2916883 - DNA, 16 bp, Homo sapiens
ctgttcctgttcagta

SEQ ID NO: 2916884 - DNA, 15 bp, Homo sapiens
ctgttcgttcaaaag

SEQ ID NO: 2916885 - DNA, 22 bp, Homo sapiens
ctgttcgttcaaaagtggagtt

SEQ ID NO: 2916886 - DNA, 17 bp, Homo sapiens
ctgttctactcttaatg

SEQ ID NO: 2916887 - DNA, 22 bp, Homo sapiens
ctgttctagcacttcatctggc

SEQ ID NO: 2916888 - DNA, 21 bp, Homo sapiens
ctgttctcgttgccctaattc

SEQ ID NO: 2916889 - DNA, 21 bp, Homo sapiens
ctgttctcttgggaactgaac

SEQ ID NO: 2916890 - DNA, 22 bp, Homo sapiens
ctgttctgatcggccagttttc

SEQ ID NO: 2916891 - DNA, 16 bp, Homo sapiens
ctgttctgccccctca

SEQ ID NO: 2916892 - DNA, 11 bp, Homo sapiens
ctgttctgtgg

SEQ ID NO: 2916893 - DNA, 14 bp, Homo sapiens
ctgttctgtggaaa

SEQ ID NO: 2916894 - DNA, 21 bp, Homo sapiens
ctgttctgtggaaagtgtaaa

SEQ ID NO: 2916895 - DNA, 15 bp, Homo sapiens
ctgttcttcatctgc

SEQ ID NO: 2916896 - DNA, 19 bp, Homo sapiens
ctgttcttgaggtctcttt

SEQ ID NO: 2916897 - DNA, 20 bp, Homo sapiens
ctgttcttgaggtctctttt

SEQ ID NO: 2916898 - DNA, 14 bp, Homo sapiens
ctgttgaaagcaaa

SEQ ID NO: 2916899 - DNA, 18 bp, Homo sapiens
ctgttgaaagcaaaaatg

SEQ ID NO: 2916900 - DNA, 22 bp, Homo sapiens
ctgttgaaagcaaaaatgctaa

SEQ ID NO: 2916901 - DNA, 20 bp, Homo sapiens
ctgttgaatatttagcataa

SEQ ID NO: 2916902 - DNA, 17 bp, Homo sapiens
ctgttgacacaggtctt

SEQ ID NO: 2916903 - DNA, 21 bp, Homo sapiens
ctgttgacacaggtctttcct

SEQ ID NO: 2916904 - DNA, 15 bp, Homo sapiens
ctgttgacatattta

SEQ ID NO: 2916905 - DNA, 17 bp, Homo sapiens
ctgttgacatatttaat

SEQ ID NO: 2916906 - DNA, 18 bp, Homo sapiens
ctgttgacatatttaatg

SEQ ID NO: 2916907 - DNA, 23 bp, Homo sapiens
ctgttgacatatttaatgtttta

SEQ ID NO: 2916908 - DNA, 22 bp, Homo sapiens
ctgttgactggctgtgtgacct

SEQ ID NO: 2916909 - DNA, 19 bp, Homo sapiens
ctgttgagaccttgtggtc

SEQ ID NO: 2916910 - DNA, 20 bp, Homo sapiens
ctgttgatctacccgtgcct

SEQ ID NO: 2916911 - DNA, 23 bp, Homo sapiens
ctgttgatctacccgtgcctggg

SEQ ID NO: 2916912 - DNA, 15 bp, Homo sapiens
ctgttgattgctaaa

SEQ ID NO: 2916913 - DNA, 18 bp, Homo sapiens
ctgttgattgctaaatgt

SEQ ID NO: 2916914 - DNA, 20 bp, Homo sapiens
ctgttgattgctaaatgtaa

SEQ ID NO: 2916915 - DNA, 22 bp, Homo sapiens
ctgttgattgctaaatgtaaca

SEQ ID NO: 2916916 - DNA, 23 bp, Homo sapiens
ctgttgattgctaaatgtaacag

SEQ ID NO: 2916917 - DNA, 19 bp, Homo sapiens
ctgttgcacttttgaatgt

SEQ ID NO: 2916918 - DNA, 20 bp, Homo sapiens
ctgttgcagtggcctggccg

SEQ ID NO: 2916919 - DNA, 16 bp, Homo sapiens
ctgttgcatagaattc

SEQ ID NO: 2916920 - DNA, 12 bp, Homo sapiens
ctgttgcatggg

SEQ ID NO: 2916921 - DNA, 18 bp, Homo sapiens
ctgttgccatggtgatgg

SEQ ID NO: 2916922 - DNA, 14 bp, Homo sapiens
ctgttgcctcctct

SEQ ID NO: 2916923 - DNA, 14 bp, Homo sapiens
ctgttgctgctcca

SEQ ID NO: 2916924 - DNA, 16 bp, Homo sapiens
ctgttgggagaaagca

SEQ ID NO: 2916925 - DNA, 15 bp, Homo sapiens
ctgttgtgccacaga

SEQ ID NO: 2916926 - DNA, 14 bp, Homo sapiens
cttcctgtctattt

SEQ ID NO: 2916927 - DNA, 20 bp, Homo sapiens
cttcctgtctatttttgttt

SEQ ID NO: 2916928 - DNA, 16 bp, Homo sapiens
cttcctgtgccctgca

SEQ ID NO: 2916929 - DNA, 15 bp, Homo sapiens
cttcctgtgcctttc

SEQ ID NO: 2916930 - DNA, 14 bp, Homo sapiens
cttcctgtggctcc

SEQ ID NO: 2916931 - DNA, 15 bp, Homo sapiens
cttcctgtggctccc

SEQ ID NO: 2916932 - DNA, 20 bp, Homo sapiens
cttcctgtggctccctctct

SEQ ID NO: 2916933 - DNA, 22 bp, Homo sapiens
cttcctgtggctccctctctcc

SEQ ID NO: 2916934 - DNA, 16 bp, Homo sapiens
cttcctgttacctgtc

SEQ ID NO: 2916935 - DNA, 16 bp, Homo sapiens
cttcctgttctgtgac

SEQ ID NO: 2916936 - DNA, 17 bp, Homo sapiens
cttcctgttctgtgact

SEQ ID NO: 2916937 - DNA, 17 bp, Homo sapiens
cttccttattttaagca

SEQ ID NO: 2916938 - DNA, 13 bp, Homo sapiens
cttccttccctgg

SEQ ID NO: 2916939 - DNA, 14 bp, Homo sapiens
cttccttcctctcc

SEQ ID NO: 2916940 - DNA, 23 bp, Homo sapiens
cttccttgagacacggagcccag

SEQ ID NO: 2916941 - DNA, 13 bp, Homo sapiens
cttccttgccagt

SEQ ID NO: 2916942 - DNA, 17 bp, Homo sapiens
cttccttgcttaaggta

SEQ ID NO: 2916943 - DNA, 11 bp, Homo sapiens
cttccttggcc

SEQ ID NO: 2916944 - DNA, 21 bp, Homo sapiens
cttccttgttacccatgaaaa

SEQ ID NO: 2916945 - DNA, 13 bp, Homo sapiens
cttcctttcagaa

SEQ ID NO: 2916946 - DNA, 19 bp, Homo sapiens
cttcctttcccaagccttc

SEQ ID NO: 2916947 - DNA, 16 bp, Homo sapiens
cttcgacatgctgcca

SEQ ID NO: 2916948 - DNA, 21 bp, Homo sapiens
cttcgcatcaaaagacaattc

SEQ ID NO: 2916949 - DNA, 14 bp, Homo sapiens
cttcgctctgctgg

SEQ ID NO: 2916950 - DNA, 18 bp, Homo sapiens
cttcggccgagctggttt

SEQ ID NO: 2916951 - DNA, 17 bp, Homo sapiens
cttcgggcccttcccac

SEQ ID NO: 2916952 - DNA, 18 bp, Homo sapiens
cttcggggaactcctgga

SEQ ID NO: 2916953 - DNA, 15 bp, Homo sapiens
cttcggtgtgcagat

SEQ ID NO: 2916954 - DNA, 18 bp, Homo sapiens
cttcgttctttttaagtt

SEQ ID NO: 2916955 - DNA, 23 bp, Homo sapiens
cttcgttggtgaccagtttctta

SEQ ID NO: 2916956 - DNA, 14 bp, Homo sapiens
cttcgttttctaaa

SEQ ID NO: 2916957 - DNA, 21 bp, Homo sapiens
cttctaaaacttgtatgttta

SEQ ID NO: 2916958 - DNA, 18 bp, Homo sapiens
cttctaaatgagctaaat

SEQ ID NO: 2916959 - DNA, 15 bp, Homo sapiens
cttctaaatgcccag

SEQ ID NO: 2916960 - DNA, 22 bp, Homo sapiens
cttctaatcataacatagttga

SEQ ID NO: 2916961 - DNA, 15 bp, Homo sapiens
cttctaattgctgtg

SEQ ID NO: 2916962 - DNA, 23 bp, Homo sapiens
cttctaattttgtgctctttcct

SEQ ID NO: 2916963 - DNA, 20 bp, Homo sapiens
cttctagaagataacatttt

SEQ ID NO: 2916964 - DNA, 18 bp, Homo sapiens
cttctagatctcagccat

SEQ ID NO: 2916965 - DNA, 19 bp, Homo sapiens
cttctagatggaccccagc

SEQ ID NO: 2916966 - DNA, 19 bp, Homo sapiens
cttctaggagtcaactggc

SEQ ID NO: 2916967 - DNA, 23 bp, Homo sapiens
cttctaggagtcaactggctggc

SEQ ID NO: 2916968 - DNA, 22 bp, Homo sapiens
cttctaggatagctaactgtaa

SEQ ID NO: 2916969 - DNA, 13 bp, Homo sapiens
cttctatatttta

SEQ ID NO: 2916970 - DNA, 15 bp, Homo sapiens
cttctatattttaat

SEQ ID NO: 2916971 - DNA, 13 bp, Homo sapiens
cttctatgaccca

SEQ ID NO: 2916972 - DNA, 20 bp, Homo sapiens
cttctatgacccagcatggg

SEQ ID NO: 2916973 - DNA, 15 bp, Homo sapiens
cttctcaagttctaa

SEQ ID NO: 2916974 - DNA, 18 bp, Homo sapiens
cttctcaagttctaagat

SEQ ID NO: 2916975 - DNA, 14 bp, Homo sapiens
cttctcatcacaca

SEQ ID NO: 2916976 - DNA, 14 bp, Homo sapiens
cttctcatgtatat

SEQ ID NO: 2916977 - DNA, 18 bp, Homo sapiens
cttctccaacactgaagt

SEQ ID NO: 2916978 - DNA, 22 bp, Homo sapiens
cttctccccgaggctgccccag

SEQ ID NO: 2916979 - DNA, 15 bp, Homo sapiens
cttctcccggacctg

SEQ ID NO: 2916980 - DNA, 15 bp, Homo sapiens
cttctcctcttgtaa

SEQ ID NO: 2916981 - DNA, 17 bp, Homo sapiens
cttctcctcttgtaaat

SEQ ID NO: 2916982 - DNA, 18 bp, Homo sapiens
cttctcctcttgtaaata

SEQ ID NO: 2916983 - DNA, 21 bp, Homo sapiens
cttctcctggagttgcattga

SEQ ID NO: 2916984 - DNA, 23 bp, Homo sapiens
cttctccttggaggacagtggga

SEQ ID NO: 2916985 - DNA, 13 bp, Homo sapiens
cttctcctttggc

SEQ ID NO: 2916986 - DNA, 15 bp, Homo sapiens
cttctcctttggcat

SEQ ID NO: 2916987 - DNA, 17 bp, Homo sapiens
cttctcgcctaggattt

SEQ ID NO: 2916988 - DNA, 18 bp, Homo sapiens
cttctcggagctggccca

SEQ ID NO: 2916989 - DNA, 14 bp, Homo sapiens
cttctcggccagcc

SEQ ID NO: 2916990 - DNA, 15 bp, Homo sapiens
cttctcggccagccc

SEQ ID NO: 2916991 - DNA, 22 bp, Homo sapiens
cttctcggccagcccgtcctcc

SEQ ID NO: 2916992 - DNA, 23 bp, Homo sapiens
cttctcggcttggatcctgggct

SEQ ID NO: 2916993 - DNA, 19 bp, Homo sapiens
cttctcggggtccagtgca

SEQ ID NO: 2916994 - DNA, 23 bp, Homo sapiens
cttctctatcctctctctctcta

SEQ ID NO: 2916995 - DNA, 15 bp, Homo sapiens
cttctctcagctccc

SEQ ID NO: 2916996 - DNA, 18 bp, Homo sapiens
cttctctcagctcccagg

SEQ ID NO: 2916997 - DNA, 12 bp, Homo sapiens
cttctctccact

SEQ ID NO: 2916998 - DNA, 14 bp, Homo sapiens
cttctctgtctctg

SEQ ID NO: 2916999 - DNA, 15 bp, Homo sapiens
cttctctgtctctgt

SEQ ID NO: 2917000 - DNA, 13 bp, Homo sapiens
cttctctgtgacc

SEQ ID NO: 2917001 - DNA, 22 bp, Homo sapiens
cttctcttccttttatcagtag

SEQ ID NO: 2917002 - DNA, 13 bp, Homo sapiens
cttctcttgcttt

SEQ ID NO: 2917003 - DNA, 17 bp, Homo sapiens
cttctcttttcctcgca

SEQ ID NO: 2917004 - DNA, 19 bp, Homo sapiens
cttctgacataatccagta

SEQ ID NO: 2917005 - DNA, 15 bp, Homo sapiens
cttctgagcacagat

SEQ ID NO: 2917006 - DNA, 14 bp, Homo sapiens
cttctgatttagca

SEQ ID NO: 2917007 - DNA, 21 bp, Homo sapiens
cttctgccctaacctgacaga

SEQ ID NO: 2917008 - DNA, 22 bp, Homo sapiens
cttctgccctaacctgacagag

SEQ ID NO: 2917009 - DNA, 15 bp, Homo sapiens
cttctgcccttgcca

SEQ ID NO: 2917010 - DNA, 13 bp, Homo sapiens
cttctgccttttc

SEQ ID NO: 2917011 - DNA, 17 bp, Homo sapiens
cttctgcgtccaccagg

SEQ ID NO: 2917012 - DNA, 18 bp, Homo sapiens
cttctgcgtccaccaggc

SEQ ID NO: 2917013 - DNA, 20 bp, Homo sapiens
cttctgcgtccaccaggcct

SEQ ID NO: 2917014 - DNA, 22 bp, Homo sapiens
cttctgcgtccaccaggcctca

SEQ ID NO: 2917015 - DNA, 11 bp, Homo sapiens
cttctgctact

SEQ ID NO: 2917016 - DNA, 13 bp, Homo sapiens
cttctgctactgg

SEQ ID NO: 2917017 - DNA, 15 bp, Homo sapiens
cttctgctcagctct

SEQ ID NO: 2917018 - DNA, 15 bp, Homo sapiens
cttctgcttgtccca

SEQ ID NO: 2917019 - DNA, 14 bp, Homo sapiens
cttctggaaactgt

SEQ ID NO: 2917020 - DNA, 14 bp, Homo sapiens
cttctggcctccca

SEQ ID NO: 2917021 - DNA, 15 bp, Homo sapiens
cttctggcctcccac

SEQ ID NO: 2917022 - DNA, 15 bp, Homo sapiens
cttctgggagggcag

SEQ ID NO: 2917023 - DNA, 15 bp, Homo sapiens
cttctgggcagagcc

SEQ ID NO: 2917024 - DNA, 16 bp, Homo sapiens
cttctgggcagagcct

SEQ ID NO: 2917025 - DNA, 17 bp, Homo sapiens
cttctgggcagagcctg

SEQ ID NO: 2917026 - DNA, 16 bp, Homo sapiens
cttctgggcctgacca

SEQ ID NO: 2917027 - DNA, 18 bp, Homo sapiens
cttctggtcccctgtggt

SEQ ID NO: 2917028 - DNA, 12 bp, Homo sapiens
cttctgtatata

SEQ ID NO: 2917029 - DNA, 17 bp, Homo sapiens
cttctgtatataaatgg

SEQ ID NO: 2917030 - DNA, 14 bp, Homo sapiens
cttctgtgaagaag

SEQ ID NO: 2917031 - DNA, 16 bp, Homo sapiens
cttctgtgaagaagcc

SEQ ID NO: 2917032 - DNA, 14 bp, Homo sapiens
cttctgtgccaccc

SEQ ID NO: 2917033 - DNA, 16 bp, Homo sapiens
cttcttacgcaatgct

SEQ ID NO: 2917034 - DNA, 22 bp, Homo sapiens
cttcttatggaattgatttgca

SEQ ID NO: 2917035 - DNA, 14 bp, Homo sapiens
cttcttattctcac

SEQ ID NO: 2917036 - DNA, 17 bp, Homo sapiens
cttcttattctcactcc

SEQ ID NO: 2917037 - DNA, 18 bp, Homo sapiens
cttcttcagatcagtgct

SEQ ID NO: 2917038 - DNA, 21 bp, Homo sapiens
cttcttccccttccctgactg

SEQ ID NO: 2917039 - DNA, 17 bp, Homo sapiens
cttcttcggggaactcc

SEQ ID NO: 2917040 - DNA, 21 bp, Homo sapiens
cttcttcggggaactcctgga

SEQ ID NO: 2917041 - DNA, 12 bp, Homo sapiens
cttcttgaaggt

SEQ ID NO: 2917042 - DNA, 21 bp, Homo sapiens
cttcttggggcccagtgcatg

SEQ ID NO: 2917043 - DNA, 23 bp, Homo sapiens
cttcttggggcccagtgcatggt

SEQ ID NO: 2917044 - DNA, 18 bp, Homo sapiens
cttcttgtaatatttctt

SEQ ID NO: 2917045 - DNA, 13 bp, Homo sapiens
cttcttgtgaagg

SEQ ID NO: 2917046 - DNA, 14 bp, Homo sapiens
cttctttaccttca

SEQ ID NO: 2917047 - DNA, 19 bp, Homo sapiens
cttctttaccttcatttca

SEQ ID NO: 2917048 - DNA, 14 bp, Homo sapiens
cttctttagaacag

SEQ ID NO: 2917049 - DNA, 12 bp, Homo sapiens
cttctttccttt

SEQ ID NO: 2917050 - DNA, 17 bp, Homo sapiens
cttctttcttgctttga

SEQ ID NO: 2917051 - DNA, 16 bp, Homo sapiens
cttctttgcagagcct

SEQ ID NO: 2917052 - DNA, 21 bp, Homo sapiens
cttctttgctgcattcctttt

SEQ ID NO: 2917053 - DNA, 17 bp, Homo sapiens
cttctttggacttctga

SEQ ID NO: 2917054 - DNA, 14 bp, Homo sapiens
cttcttttcacatt

SEQ ID NO: 2917055 - DNA, 18 bp, Homo sapiens
cttcttttcctgcagggg

SEQ ID NO: 2917056 - DNA, 13 bp, Homo sapiens
cttcttttgatta

SEQ ID NO: 2917057 - DNA, 14 bp, Homo sapiens
cttcttttgattat

SEQ ID NO: 2917058 - DNA, 16 bp, Homo sapiens
cttcttttgattatgt

SEQ ID NO: 2917059 - DNA, 21 bp, Homo sapiens
ctttccacggagccactcctc

SEQ ID NO: 2917060 - DNA, 22 bp, Homo sapiens
ctttccacggagccactcctct

SEQ ID NO: 2917061 - DNA, 12 bp, Homo sapiens
ctttccactccc

SEQ ID NO: 2917062 - DNA, 21 bp, Homo sapiens
ctttccactcctcctagccac

SEQ ID NO: 2917063 - DNA, 17 bp, Homo sapiens
ctttcccaacacctctt

SEQ ID NO: 2917064 - DNA, 11 bp, Homo sapiens
ctttcccaagc

SEQ ID NO: 2917065 - DNA, 22 bp, Homo sapiens
ctttcccaccccacgccttatc

SEQ ID NO: 2917066 - DNA, 18 bp, Homo sapiens
ctttcccactttcttcta

SEQ ID NO: 2917067 - DNA, 21 bp, Homo sapiens
ctttcccatttcgtgtaatat

SEQ ID NO: 2917068 - DNA, 11 bp, Homo sapiens
ctttccccagc

SEQ ID NO: 2917069 - DNA, 15 bp, Homo sapiens
ctttccccagcctct

SEQ ID NO: 2917070 - DNA, 17 bp, Homo sapiens
ctttccccagcctctcc

SEQ ID NO: 2917071 - DNA, 20 bp, Homo sapiens
ctttccccagcctctcctcc

SEQ ID NO: 2917072 - DNA, 13 bp, Homo sapiens
ctttccctcttcc

SEQ ID NO: 2917073 - DNA, 15 bp, Homo sapiens
ctttcccttatcaaa

SEQ ID NO: 2917074 - DNA, 15 bp, Homo sapiens
ctttcctaaatgttt

SEQ ID NO: 2917075 - DNA, 18 bp, Homo sapiens
ctttcctcattaaattac

SEQ ID NO: 2917076 - DNA, 21 bp, Homo sapiens
ctttcctcttactttcagttt

SEQ ID NO: 2917077 - DNA, 18 bp, Homo sapiens
ctttcctgcccttttcct

SEQ ID NO: 2917078 - DNA, 22 bp, Homo sapiens
ctttcctggataaaaaagaaaa

SEQ ID NO: 2917079 - DNA, 19 bp, Homo sapiens
ctttcctgtgtgaagaaag

SEQ ID NO: 2917080 - DNA, 18 bp, Homo sapiens
ctttcgtccacagcttcc

SEQ ID NO: 2917081 - DNA, 19 bp, Homo sapiens
ctttcgtccacagcttcct

SEQ ID NO: 2917082 - DNA, 16 bp, Homo sapiens
ctttcgttggttgttt

SEQ ID NO: 2917083 - DNA, 21 bp, Homo sapiens
ctttcgttggttgtttctctg

SEQ ID NO: 2917084 - DNA, 23 bp, Homo sapiens
ctttcgttggttgtttctctgag

SEQ ID NO: 2917085 - DNA, 14 bp, Homo sapiens
ctttctactttgtt

SEQ ID NO: 2917086 - DNA, 18 bp, Homo sapiens
ctttctacttttttcatt

SEQ ID NO: 2917087 - DNA, 17 bp, Homo sapiens
ctttctagatgtctctg

SEQ ID NO: 2917088 - DNA, 11 bp, Homo sapiens
ctttctagcct

SEQ ID NO: 2917089 - DNA, 13 bp, Homo sapiens
ctttctagtttgt

SEQ ID NO: 2917090 - DNA, 19 bp, Homo sapiens
ctttctatgctgcttttat

SEQ ID NO: 2917091 - DNA, 20 bp, Homo sapiens
ctttctatgctgcttttata

SEQ ID NO: 2917092 - DNA, 17 bp, Homo sapiens
ctttctatttttatgat

SEQ ID NO: 2917093 - DNA, 18 bp, Homo sapiens
ctttctccaagacagatt

SEQ ID NO: 2917094 - DNA, 12 bp, Homo sapiens
ctttctctgtat

SEQ ID NO: 2917095 - DNA, 13 bp, Homo sapiens
ctttctcttgttt

SEQ ID NO: 2917096 - DNA, 16 bp, Homo sapiens
ctttctcttgtttaaa

SEQ ID NO: 2917097 - DNA, 17 bp, Homo sapiens
ctttctcttttctaaaa

SEQ ID NO: 2917098 - DNA, 22 bp, Homo sapiens
ctttctgaaactcccttgtgtt

SEQ ID NO: 2917099 - DNA, 15 bp, Homo sapiens
ctttctgacatcagc

SEQ ID NO: 2917100 - DNA, 17 bp, Homo sapiens
ctttctgatcaaggcct

SEQ ID NO: 2917101 - DNA, 18 bp, Homo sapiens
ctttctgatcaaggcctt

SEQ ID NO: 2917102 - DNA, 20 bp, Homo sapiens
ctttctgatcaaggccttat

SEQ ID NO: 2917103 - DNA, 15 bp, Homo sapiens
ctttctgccccccag

SEQ ID NO: 2917104 - DNA, 17 bp, Homo sapiens
ctttctgctcagcttct

SEQ ID NO: 2917105 - DNA, 17 bp, Homo sapiens
ctttctgtaaacagaat

SEQ ID NO: 2917106 - DNA, 23 bp, Homo sapiens
ctttctgtcccttctgtccctca

SEQ ID NO: 2917107 - DNA, 16 bp, Homo sapiens
ctttctgttcatctct

SEQ ID NO: 2917108 - DNA, 17 bp, Homo sapiens
ctttctgttcatctctt

SEQ ID NO: 2917109 - DNA, 22 bp, Homo sapiens
ctttctgttcatctctttgtcc

SEQ ID NO: 2917110 - DNA, 16 bp, Homo sapiens
ctttcttattctgtat

SEQ ID NO: 2917111 - DNA, 13 bp, Homo sapiens
ctttcttccaaac

SEQ ID NO: 2917112 - DNA, 19 bp, Homo sapiens
ctttcttccaaacaggctc

SEQ ID NO: 2917113 - DNA, 20 bp, Homo sapiens
ctttcttccattccttcatg

SEQ ID NO: 2917114 - DNA, 22 bp, Homo sapiens
ctttcttcctccagtctgttct

SEQ ID NO: 2917115 - DNA, 19 bp, Homo sapiens
ctttcttcctttcttcctt

SEQ ID NO: 2917116 - DNA, 13 bp, Homo sapiens
ctttcttctttcc

SEQ ID NO: 2917117 - DNA, 17 bp, Homo sapiens
ctttcttggtgcattcg

SEQ ID NO: 2917118 - DNA, 13 bp, Homo sapiens
ctttcttgtttct

SEQ ID NO: 2917119 - DNA, 21 bp, Homo sapiens
ctttcttgtttgtcagcatct

SEQ ID NO: 2917120 - DNA, 13 bp, Homo sapiens
ctttctttaaatt

SEQ ID NO: 2917121 - DNA, 11 bp, Homo sapiens
ctttctttgct

SEQ ID NO: 2917122 - DNA, 15 bp, Homo sapiens
ctttctttgctgctg

SEQ ID NO: 2917123 - DNA, 21 bp, Homo sapiens
ctttctttgctgctgtggaaa

SEQ ID NO: 2917124 - DNA, 17 bp, Homo sapiens
ctttctttggggaaaaa

SEQ ID NO: 2917125 - DNA, 21 bp, Homo sapiens
ctttctttggtaggtaaatct

SEQ ID NO: 2917126 - DNA, 20 bp, Homo sapiens
ctttctttttgaatctctca

SEQ ID NO: 2917127 - DNA, 23 bp, Homo sapiens
ctttgaaaaatcacttgattcat

SEQ ID NO: 2917128 - DNA, 13 bp, Homo sapiens
ctttgaaacagaa

SEQ ID NO: 2917129 - DNA, 14 bp, Homo sapiens
ctttgaacgtgcca

SEQ ID NO: 2917130 - DNA, 18 bp, Homo sapiens
ctttgaacgtgccagcag

SEQ ID NO: 2917131 - DNA, 20 bp, Homo sapiens
ctttgaagtgggaaagcatt

SEQ ID NO: 2917132 - DNA, 20 bp, Homo sapiens
ctttgaatagtcctaaaaag

SEQ ID NO: 2917133 - DNA, 12 bp, Homo sapiens
ctttgaattttc

SEQ ID NO: 2917134 - DNA, 16 bp, Homo sapiens
ctttgacgggccaggc

SEQ ID NO: 2917135 - DNA, 18 bp, Homo sapiens
ctttgacgggccaggccc

SEQ ID NO: 2917136 - DNA, 13 bp, Homo sapiens
ctttgactgtcag

SEQ ID NO: 2917137 - DNA, 14 bp, Homo sapiens
ctttgactttcttc

SEQ ID NO: 2917138 - DNA, 21 bp, Homo sapiens
ctttgagataatacattccga

SEQ ID NO: 2917139 - DNA, 19 bp, Homo sapiens
ctttgaggccgaagctgct

SEQ ID NO: 2917140 - DNA, 16 bp, Homo sapiens
ctttgagtacagatac

SEQ ID NO: 2917141 - DNA, 24 bp, Homo sapiens
ctttgagtacagatactgtgagct

SEQ ID NO: 2917142 - DNA, 17 bp, Homo sapiens
ctttgatcacaggagca

SEQ ID NO: 2917143 - DNA, 15 bp, Homo sapiens
ctttgatgttaacac

SEQ ID NO: 2917144 - DNA, 17 bp, Homo sapiens
ctttgatgttaacacat

SEQ ID NO: 2917145 - DNA, 23 bp, Homo sapiens
ctttgatgttaacacattttgta

SEQ ID NO: 2917146 - DNA, 20 bp, Homo sapiens
ctttgattaaagactccagt

SEQ ID NO: 2917147 - DNA, 13 bp, Homo sapiens
ctttgatttaact

SEQ ID NO: 2917148 - DNA, 20 bp, Homo sapiens
ctttgcaaagtattgtaaat

SEQ ID NO: 2917149 - DNA, 21 bp, Homo sapiens
ctttgcaaagtattgtaaatt

SEQ ID NO: 2917150 - DNA, 22 bp, Homo sapiens
ctttgcaaagtattgtaaatta

SEQ ID NO: 2917151 - DNA, 18 bp, Homo sapiens
ctttgcaactcctgtaat

SEQ ID NO: 2917152 - DNA, 22 bp, Homo sapiens
ctttgcaatactgcttaattgc

SEQ ID NO: 2917153 - DNA, 13 bp, Homo sapiens
ctttgcagagcct

SEQ ID NO: 2917154 - DNA, 18 bp, Homo sapiens
ctttgcagggcacagatg

SEQ ID NO: 2917155 - DNA, 17 bp, Homo sapiens
ctttgcatcgtcccctc

SEQ ID NO: 2917156 - DNA, 22 bp, Homo sapiens
ctttgcatcgtcccctccccca

SEQ ID NO: 2917157 - DNA, 16 bp, Homo sapiens
ctttgcattttgatat

SEQ ID NO: 2917158 - DNA, 14 bp, Homo sapiens
ctttgcattttgga

SEQ ID NO: 2917159 - DNA, 19 bp, Homo sapiens
ctttgccaacttgccatgt

SEQ ID NO: 2917160 - DNA, 15 bp, Homo sapiens
ctttgcccacacaca

SEQ ID NO: 2917161 - DNA, 19 bp, Homo sapiens
ctttgcccacacacactcc

SEQ ID NO: 2917162 - DNA, 23 bp, Homo sapiens
ctttgcccatggaagtctcaaag

SEQ ID NO: 2917163 - DNA, 19 bp, Homo sapiens
ctttgcccccgacggctgt

SEQ ID NO: 2917164 - DNA, 15 bp, Homo sapiens
ctttgcccttcactg

SEQ ID NO: 2917165 - DNA, 12 bp, Homo sapiens
ctttgcctccag

SEQ ID NO: 2917166 - DNA, 20 bp, Homo sapiens
ctttgcctgtagagccagcc

SEQ ID NO: 2917167 - DNA, 21 bp, Homo sapiens
ctttgcctgtagagccagcct

SEQ ID NO: 2917168 - DNA, 23 bp, Homo sapiens
ctttgcctgtagagccagccttg

SEQ ID NO: 2917169 - DNA, 21 bp, Homo sapiens
ctttgcggggcctgtctcagt

SEQ ID NO: 2917170 - DNA, 11 bp, Homo sapiens
ctttgctcttg

SEQ ID NO: 2917171 - DNA, 16 bp, Homo sapiens
ctttgctgaatgtcat

SEQ ID NO: 2917172 - DNA, 10 bp, Homo sapiens
ctttgctgcc

SEQ ID NO: 2917173 - DNA, 14 bp, Homo sapiens
ctttgctgcccttg

SEQ ID NO: 2917174 - DNA, 11 bp, Homo sapiens
ctttgctgctg

SEQ ID NO: 2917175 - DNA, 19 bp, Homo sapiens
ctttgctgctgaaggctca

SEQ ID NO: 2917176 - DNA, 16 bp, Homo sapiens
ctttgctgctgtggaa

SEQ ID NO: 2917177 - DNA, 13 bp, Homo sapiens
ctttgctgtaaga

SEQ ID NO: 2917178 - DNA, 22 bp, Homo sapiens
ctttgctgtttagcttcctcca

SEQ ID NO: 2917179 - DNA, 19 bp, Homo sapiens
ctttgcttccttgctttta

SEQ ID NO: 2917180 - DNA, 21 bp, Homo sapiens
ctttgctttctgctcagcttc

SEQ ID NO: 2917181 - DNA, 13 bp, Homo sapiens
ctttgctttgtag

SEQ ID NO: 2917182 - DNA, 14 bp, Homo sapiens
ctttgctttgtagg

SEQ ID NO: 2917183 - DNA, 17 bp, Homo sapiens
ctttgctttgtagtttg

SEQ ID NO: 2917184 - DNA, 19 bp, Homo sapiens
ctttggaaaatgcattgta

SEQ ID NO: 2917185 - DNA, 22 bp, Homo sapiens
ctttggaacagggttggcattc

SEQ ID NO: 2917186 - DNA, 19 bp, Homo sapiens
ctttggaagatgcagaagc

SEQ ID NO: 2917187 - DNA, 20 bp, Homo sapiens
ctttggacagaagcagctct

SEQ ID NO: 2917188 - DNA, 20 bp, Homo sapiens
ctttggacccaaggaaaact

SEQ ID NO: 2917189 - DNA, 14 bp, Homo sapiens
ctttggaggcccct

SEQ ID NO: 2917190 - DNA, 17 bp, Homo sapiens
ctttggcagtgttttgg

SEQ ID NO: 2917191 - DNA, 16 bp, Homo sapiens
gaaagctagagatatg

SEQ ID NO: 2917192 - DNA, 12 bp, Homo sapiens
gaaagctctaga

SEQ ID NO: 2917193 - DNA, 23 bp, Homo sapiens
gaaagctgaaagggaaggacagc

SEQ ID NO: 2917194 - DNA, 15 bp, Homo sapiens
gaaagcttgaaaaga

SEQ ID NO: 2917195 - DNA, 17 bp, Homo sapiens
gaaaggaaaagattcct

SEQ ID NO: 2917196 - DNA, 13 bp, Homo sapiens
gaaaggaataaaa

SEQ ID NO: 2917197 - DNA, 12 bp, Homo sapiens
gaaaggacagag

SEQ ID NO: 2917198 - DNA, 15 bp, Homo sapiens
gaaaggacagagcca

SEQ ID NO: 2917199 - DNA, 17 bp, Homo sapiens
gaaaggacagagccagc

SEQ ID NO: 2917200 - DNA, 22 bp, Homo sapiens
gaaaggagagaacgggcgtcag

SEQ ID NO: 2917201 - DNA, 20 bp, Homo sapiens
gaaaggatgtaaacagtgcc

SEQ ID NO: 2917202 - DNA, 14 bp, Homo sapiens
gaaaggattcatgt

SEQ ID NO: 2917203 - DNA, 18 bp, Homo sapiens
gaaaggattctaaacaga

SEQ ID NO: 2917204 - DNA, 16 bp, Homo sapiens
gaaaggcattctctga

SEQ ID NO: 2917205 - DNA, 16 bp, Homo sapiens
gaaagggaaactggct

SEQ ID NO: 2917206 - DNA, 16 bp, Homo sapiens
gaaagggacaatgata

SEQ ID NO: 2917207 - DNA, 20 bp, Homo sapiens
gaaagggagagaaaactctt

SEQ ID NO: 2917208 - DNA, 20 bp, Homo sapiens
gaaagggcaacaataaaata

SEQ ID NO: 2917209 - DNA, 17 bp, Homo sapiens
gaaagggcccttcccct

SEQ ID NO: 2917210 - DNA, 22 bp, Homo sapiens
gaaagggcccttcccctccccc

SEQ ID NO: 2917211 - DNA, 13 bp, Homo sapiens
gaaagggcctggc

SEQ ID NO: 2917212 - DNA, 16 bp, Homo sapiens
gaaagggcctggccag

SEQ ID NO: 2917213 - DNA, 15 bp, Homo sapiens
gaaaggggaaacgtc

SEQ ID NO: 2917214 - DNA, 17 bp, Homo sapiens
gaaagggtcttccttct

SEQ ID NO: 2917215 - DNA, 19 bp, Homo sapiens
gaaagggttaatcatattt

SEQ ID NO: 2917216 - DNA, 19 bp, Homo sapiens
gaaaggtgccatgtcttta

SEQ ID NO: 2917217 - DNA, 18 bp, Homo sapiens
gaaaggttaccctgtaac

SEQ ID NO: 2917218 - DNA, 16 bp, Homo sapiens
gaaaggtttcaagact

SEQ ID NO: 2917219 - DNA, 22 bp, Homo sapiens
gaaagtctgtcaggtttggttt

SEQ ID NO: 2917220 - DNA, 21 bp, Homo sapiens
gaaagtgaaaaatgtaaaaca

SEQ ID NO: 2917221 - DNA, 13 bp, Homo sapiens
gaaagtgaggaaa

SEQ ID NO: 2917222 - DNA, 13 bp, Homo sapiens
gaaagtgatttta

SEQ ID NO: 2917223 - DNA, 23 bp, Homo sapiens
gaaagtgattttatttttgcaaa

SEQ ID NO: 2917224 - DNA, 14 bp, Homo sapiens
gaaagtgcctttat

SEQ ID NO: 2917225 - DNA, 23 bp, Homo sapiens
gaaagtgtaaagcattccaacaa

SEQ ID NO: 2917226 - DNA, 15 bp, Homo sapiens
gaaagtgtaaatgtt

SEQ ID NO: 2917227 - DNA, 13 bp, Homo sapiens
gaaagtgtctctg

SEQ ID NO: 2917228 - DNA, 17 bp, Homo sapiens
gaaagttgtacatgaaa

SEQ ID NO: 2917229 - DNA, 19 bp, Homo sapiens
gaaagtttgtaaaaatata

SEQ ID NO: 2917230 - DNA, 14 bp, Homo sapiens
gaaagtttttaatt

SEQ ID NO: 2917231 - DNA, 23 bp, Homo sapiens
gaaataaaaggaagccaaagagt

SEQ ID NO: 2917232 - DNA, 12 bp, Homo sapiens
gaaataaaatta

SEQ ID NO: 2917233 - DNA, 13 bp, Homo sapiens
gaaataaactagg

SEQ ID NO: 2917234 - DNA, 23 bp, Homo sapiens
gaaataaactagggttttggcct

SEQ ID NO: 2917235 - DNA, 20 bp, Homo sapiens
gaaataaaggatgtgattgt

SEQ ID NO: 2917236 - DNA, 17 bp, Homo sapiens
gaaataaagtttgctta

SEQ ID NO: 2917237 - DNA, 12 bp, Homo sapiens
gaaataaatgtt

SEQ ID NO: 2917238 - DNA, 13 bp, Homo sapiens
gaaataataaaaa

SEQ ID NO: 2917239 - DNA, 13 bp, Homo sapiens
gaaataataatat

SEQ ID NO: 2917240 - DNA, 16 bp, Homo sapiens
gaaataataatatcca

SEQ ID NO: 2917241 - DNA, 15 bp, Homo sapiens
gaaatacctttgtag

SEQ ID NO: 2917242 - DNA, 19 bp, Homo sapiens
gaaatacttcgatgatgat

SEQ ID NO: 2917243 - DNA, 12 bp, Homo sapiens
gaaatatataaa

SEQ ID NO: 2917244 - DNA, 15 bp, Homo sapiens
gaaatatcctgcttg

SEQ ID NO: 2917245 - DNA, 14 bp, Homo sapiens
gaaatatgctcttt

SEQ ID NO: 2917246 - DNA, 18 bp, Homo sapiens
gaaatattgtaaatgcta

SEQ ID NO: 2917247 - DNA, 14 bp, Homo sapiens
gaaatccaatcaga

SEQ ID NO: 2917248 - DNA, 19 bp, Homo sapiens
gaaatcgccttatgagaac

SEQ ID NO: 2917249 - DNA, 20 bp, Homo sapiens
gaaatcgccttatgagaaca

SEQ ID NO: 2917250 - DNA, 15 bp, Homo sapiens
gaaatctagtatttc

SEQ ID NO: 2917251 - DNA, 18 bp, Homo sapiens
gaaatctatgattccagg

SEQ ID NO: 2917252 - DNA, 22 bp, Homo sapiens
gaaatctggcttctggccagga

SEQ ID NO: 2917253 - DNA, 22 bp, Homo sapiens
gaaatctgtatctgtagtgaga

SEQ ID NO: 2917254 - DNA, 20 bp, Homo sapiens
gaaatctgtcaagagtagtt

SEQ ID NO: 2917255 - DNA, 20 bp, Homo sapiens
gaaatctgtgcctgagaaca

SEQ ID NO: 2917256 - DNA, 21 bp, Homo sapiens
gaaatgaactttgtcagtgtt

SEQ ID NO: 2917257 - DNA, 19 bp, Homo sapiens
gaaatgactaaaaaacaaa

SEQ ID NO: 2917258 - DNA, 15 bp, Homo sapiens
gaaatgaggaggatg

SEQ ID NO: 2917259 - DNA, 15 bp, Homo sapiens
gaaatgagtggccag

SEQ ID NO: 2917260 - DNA, 17 bp, Homo sapiens
gaaatgagtggccagcg

SEQ ID NO: 2917261 - DNA, 16 bp, Homo sapiens
gaaatgatagatttga

SEQ ID NO: 2917262 - DNA, 15 bp, Homo sapiens
gaaatgccagatgaa

SEQ ID NO: 2917263 - DNA, 20 bp, Homo sapiens
gaaatggtttcacttgctct

SEQ ID NO: 2917264 - DNA, 19 bp, Homo sapiens
gaaatggtttcctctggat

SEQ ID NO: 2917265 - DNA, 12 bp, Homo sapiens
gaaatgtaatgc

SEQ ID NO: 2917266 - DNA, 20 bp, Homo sapiens
gaaattaaaactattcatgc

SEQ ID NO: 2917267 - DNA, 13 bp, Homo sapiens
gaaattaaagttt

SEQ ID NO: 2917268 - DNA, 21 bp, Homo sapiens
gaaattacttatcatccacat

SEQ ID NO: 2917269 - DNA, 19 bp, Homo sapiens
gaaattatctttagttgaa

SEQ ID NO: 2917270 - DNA, 21 bp, Homo sapiens
gaaattatctttagttgaatt

SEQ ID NO: 2917271 - DNA, 15 bp, Homo sapiens
gaaattctgaatttg

SEQ ID NO: 2917272 - DNA, 18 bp, Homo sapiens
gaaattctgaatttgcaa

SEQ ID NO: 2917273 - DNA, 14 bp, Homo sapiens
gaaattctgctgtt

SEQ ID NO: 2917274 - DNA, 18 bp, Homo sapiens
gaaattctttatacattc

SEQ ID NO: 2917275 - DNA, 21 bp, Homo sapiens
gaaattgacacaagtggacct

SEQ ID NO: 2917276 - DNA, 12 bp, Homo sapiens
gaaattgacaga

SEQ ID NO: 2917277 - DNA, 13 bp, Homo sapiens
gaaattgacagat

SEQ ID NO: 2917278 - DNA, 20 bp, Homo sapiens
gaaattgcctatcctgctgt

SEQ ID NO: 2917279 - DNA, 16 bp, Homo sapiens
gaaattggaagagcac

SEQ ID NO: 2917280 - DNA, 18 bp, Homo sapiens
gaaattgtattacaaatc

SEQ ID NO: 2917281 - DNA, 16 bp, Homo sapiens
gaaatttaattcatgt

SEQ ID NO: 2917282 - DNA, 20 bp, Homo sapiens
gaaatttaattcatgtttct

SEQ ID NO: 2917283 - DNA, 22 bp, Homo sapiens
gaaatttttccacactatgtgt

SEQ ID NO: 2917284 - DNA, 22 bp, Homo sapiens
gaacaaaacctcttctgtattt

SEQ ID NO: 2917285 - DNA, 15 bp, Homo sapiens
gaacaacttggaaga

SEQ ID NO: 2917286 - DNA, 15 bp, Homo sapiens
gaacaagacagcctt

SEQ ID NO: 2917287 - DNA, 13 bp, Homo sapiens
gaacaagcctaaa

SEQ ID NO: 2917288 - DNA, 17 bp, Homo sapiens
gaacaataggtaaagct

SEQ ID NO: 2917289 - DNA, 19 bp, Homo sapiens
gaacaatattgactttgtc

SEQ ID NO: 2917290 - DNA, 20 bp, Homo sapiens
gaacaatattgactttgtct

SEQ ID NO: 2917291 - DNA, 14 bp, Homo sapiens
gaacaatcacaaaa

SEQ ID NO: 2917292 - DNA, 19 bp, Homo sapiens
gaacaatcacaaaagctgt

SEQ ID NO: 2917293 - DNA, 23 bp, Homo sapiens
gaacaatcacaaaagctgtgtct

SEQ ID NO: 2917294 - DNA, 20 bp, Homo sapiens
gaacacaaacacattgttat

SEQ ID NO: 2917295 - DNA, 17 bp, Homo sapiens
gaacacaaactgtaaat

SEQ ID NO: 2917296 - DNA, 18 bp, Homo sapiens
gaacacacaccagtttac

SEQ ID NO: 2917297 - DNA, 19 bp, Homo sapiens
gaacacagagtgtgttttt

SEQ ID NO: 2917298 - DNA, 14 bp, Homo sapiens
gaacacagcagacc

SEQ ID NO: 2917299 - DNA, 23 bp, Homo sapiens
gaacacagccaaagtaaactgtg

SEQ ID NO: 2917300 - DNA, 20 bp, Homo sapiens
gaacaccataggtagaatgt

SEQ ID NO: 2917301 - DNA, 11 bp, Homo sapiens
gaacacctggc

SEQ ID NO: 2917302 - DNA, 15 bp, Homo sapiens
gaacacctggccggg

SEQ ID NO: 2917303 - DNA, 17 bp, Homo sapiens
gaacactagacaagcca

SEQ ID NO: 2917304 - DNA, 21 bp, Homo sapiens
gaacactgccctcgcacggcc

SEQ ID NO: 2917305 - DNA, 19 bp, Homo sapiens
gaacactggcagactgtgt

SEQ ID NO: 2917306 - DNA, 14 bp, Homo sapiens
gaacagaagaaaat

SEQ ID NO: 2917307 - DNA, 16 bp, Homo sapiens
gaacagacaggagaaa

SEQ ID NO: 2917308 - DNA, 17 bp, Homo sapiens
gaacagacaggagaaat

SEQ ID NO: 2917309 - DNA, 14 bp, Homo sapiens
gaacagaggcattt

SEQ ID NO: 2917310 - DNA, 17 bp, Homo sapiens
gaacagataatccctgt

SEQ ID NO: 2917311 - DNA, 19 bp, Homo sapiens
gaacagatgctgagccata

SEQ ID NO: 2917312 - DNA, 13 bp, Homo sapiens
gaacagatgtaaa

SEQ ID NO: 2917313 - DNA, 14 bp, Homo sapiens
gaacagatgtaaat

SEQ ID NO: 2917314 - DNA, 21 bp, Homo sapiens
gaacagcagactcagctctga

SEQ ID NO: 2917315 - DNA, 20 bp, Homo sapiens
gaacagcatggcactccctc

SEQ ID NO: 2917316 - DNA, 17 bp, Homo sapiens
gaacagccttttccctt

SEQ ID NO: 2917317 - DNA, 21 bp, Homo sapiens
gaacagcggctggacttggag

SEQ ID NO: 2917318 - DNA, 14 bp, Homo sapiens
gaacagctcatctt

SEQ ID NO: 2917319 - DNA, 16 bp, Homo sapiens
gaacagctgttcctgt

SEQ ID NO: 2917320 - DNA, 18 bp, Homo sapiens
gaacagctgttcctgtgt

SEQ ID NO: 2917321 - DNA, 18 bp, Homo sapiens
gaacagggcccaggcctg

SEQ ID NO: 2917322 - DNA, 15 bp, Homo sapiens
gaacaggtgtttttc

SEQ ID NO: 2917323 - DNA, 21 bp, Homo sapiens
gaacagtcatgaggcagcttt

SEQ ID NO: 2917324 - DNA, 14 bp, Homo sapiens
gaatccattgaaag

SEQ ID NO: 2917325 - DNA, 22 bp, Homo sapiens
gaatcccacccacatgtgacac

SEQ ID NO: 2917326 - DNA, 17 bp, Homo sapiens
gaatcccactgtatgat

SEQ ID NO: 2917327 - DNA, 18 bp, Homo sapiens
gaatcccggcggaaagcc

SEQ ID NO: 2917328 - DNA, 10 bp, Homo sapiens
gaatcctcct

SEQ ID NO: 2917329 - DNA, 19 bp, Homo sapiens
gaatcctgggcccccagag

SEQ ID NO: 2917330 - DNA, 14 bp, Homo sapiens
gaatcctgtcgatt

SEQ ID NO: 2917331 - DNA, 22 bp, Homo sapiens
gaatcctgtcgattagactgga

SEQ ID NO: 2917332 - DNA, 14 bp, Homo sapiens
gaatcgcttctctt

SEQ ID NO: 2917333 - DNA, 19 bp, Homo sapiens
gaatcgcttgaacctggga

SEQ ID NO: 2917334 - DNA, 22 bp, Homo sapiens
gaatctaaggataatgaaataa

SEQ ID NO: 2917335 - DNA, 14 bp, Homo sapiens
gaatctacatttgt

SEQ ID NO: 2917336 - DNA, 21 bp, Homo sapiens
gaatctacatttgtttgtatt

SEQ ID NO: 2917337 - DNA, 18 bp, Homo sapiens
gaatctacccccagatcc

SEQ ID NO: 2917338 - DNA, 15 bp, Homo sapiens
gaatctactaattcc

SEQ ID NO: 2917339 - DNA, 16 bp, Homo sapiens
gaatctcaatgtacat

SEQ ID NO: 2917340 - DNA, 20 bp, Homo sapiens
gaatctcccagacttgtttc

SEQ ID NO: 2917341 - DNA, 18 bp, Homo sapiens
gaatctgaaaagaacaac

SEQ ID NO: 2917342 - DNA, 23 bp, Homo sapiens
gaatctgaaaagaacaaccctga

SEQ ID NO: 2917343 - DNA, 15 bp, Homo sapiens
gaatctgcaattcaa

SEQ ID NO: 2917344 - DNA, 22 bp, Homo sapiens
gaatctgcaattcaaaagttcc

SEQ ID NO: 2917345 - DNA, 17 bp, Homo sapiens
gaatctgccttccagcc

SEQ ID NO: 2917346 - DNA, 18 bp, Homo sapiens
gaatctgccttccagccc

SEQ ID NO: 2917347 - DNA, 20 bp, Homo sapiens
gaatctgccttccagcccag

SEQ ID NO: 2917348 - DNA, 13 bp, Homo sapiens
gaatctgctcact

SEQ ID NO: 2917349 - DNA, 18 bp, Homo sapiens
gaatctggagaccaggga

SEQ ID NO: 2917350 - DNA, 21 bp, Homo sapiens
gaatctggcattctacacctg

SEQ ID NO: 2917351 - DNA, 23 bp, Homo sapiens
gaatctggcattctacacctgga

SEQ ID NO: 2917352 - DNA, 15 bp, Homo sapiens
gaatcttggtttgcc

SEQ ID NO: 2917353 - DNA, 23 bp, Homo sapiens
gaatcttttggattttaagcagt

SEQ ID NO: 2917354 - DNA, 13 bp, Homo sapiens
gaatgaaaaatga

SEQ ID NO: 2917355 - DNA, 20 bp, Homo sapiens
gaatgaaaaatgaaagatga

SEQ ID NO: 2917356 - DNA, 22 bp, Homo sapiens
gaatgaaaaatgaaagatgatt

SEQ ID NO: 2917357 - DNA, 16 bp, Homo sapiens
gaatgaaaataactga

SEQ ID NO: 2917358 - DNA, 19 bp, Homo sapiens
gaatgaaacccccacacac

SEQ ID NO: 2917359 - DNA, 20 bp, Homo sapiens
gaatgaaacccccacacaca

SEQ ID NO: 2917360 - DNA, 12 bp, Homo sapiens
gaatgaaagagt

SEQ ID NO: 2917361 - DNA, 14 bp, Homo sapiens
gaatgaaatgtatg

SEQ ID NO: 2917362 - DNA, 20 bp, Homo sapiens
gaatgaacactcttttgctt

SEQ ID NO: 2917363 - DNA, 21 bp, Homo sapiens
gaatgaatgggatattttgaa

SEQ ID NO: 2917364 - DNA, 16 bp, Homo sapiens
gaatgactgaaagaag

SEQ ID NO: 2917365 - DNA, 14 bp, Homo sapiens
gaatgagaaatgga

SEQ ID NO: 2917366 - DNA, 14 bp, Homo sapiens
gaatgagagtgtga

SEQ ID NO: 2917367 - DNA, 16 bp, Homo sapiens
gaatgatctcttcttt

SEQ ID NO: 2917368 - DNA, 15 bp, Homo sapiens
gaatgattcagtgtt

SEQ ID NO: 2917369 - DNA, 20 bp, Homo sapiens
gaatgatttccaaagagaaa

SEQ ID NO: 2917370 - DNA, 13 bp, Homo sapiens
gaatgcacacagc

SEQ ID NO: 2917371 - DNA, 22 bp, Homo sapiens
gaatgcacacagcggctgcctc

SEQ ID NO: 2917372 - DNA, 14 bp, Homo sapiens
gaatgcagcactgc

SEQ ID NO: 2917373 - DNA, 20 bp, Homo sapiens
gaatgcagcccaccaggagc

SEQ ID NO: 2917374 - DNA, 21 bp, Homo sapiens
gaatgcagcccaccaggagca

SEQ ID NO: 2917375 - DNA, 22 bp, Homo sapiens
gaatgcagcccaccaggagcac

SEQ ID NO: 2917376 - DNA, 17 bp, Homo sapiens
gaatgccattggaacct

SEQ ID NO: 2917377 - DNA, 18 bp, Homo sapiens
gaatgcccccagctggcc

SEQ ID NO: 2917378 - DNA, 16 bp, Homo sapiens
gaatgcctcataaatt

SEQ ID NO: 2917379 - DNA, 15 bp, Homo sapiens
gaatgctgtacatct

SEQ ID NO: 2917380 - DNA, 13 bp, Homo sapiens
gaatggcagctgc

SEQ ID NO: 2917381 - DNA, 16 bp, Homo sapiens
gaatggcagctgccac

SEQ ID NO: 2917382 - DNA, 14 bp, Homo sapiens
gaatggcgtccgtg

SEQ ID NO: 2917383 - DNA, 16 bp, Homo sapiens
gaatggctttgtcttg

SEQ ID NO: 2917384 - DNA, 17 bp, Homo sapiens
gaatgggatcatgaaag

SEQ ID NO: 2917385 - DNA, 22 bp, Homo sapiens
gaatgggggctttcggggaggg

SEQ ID NO: 2917386 - DNA, 16 bp, Homo sapiens
gaatggttataaaagt

SEQ ID NO: 2917387 - DNA, 15 bp, Homo sapiens
gaatgtaaagcttgt

SEQ ID NO: 2917388 - DNA, 13 bp, Homo sapiens
gaatgtattgtac

SEQ ID NO: 2917389 - DNA, 14 bp, Homo sapiens
gaatgtattgtacc

SEQ ID NO: 2917390 - DNA, 23 bp, Homo sapiens
gaatgtattgtaccttttaacac

SEQ ID NO: 2917391 - DNA, 13 bp, Homo sapiens
gaatgtatttatt

SEQ ID NO: 2917392 - DNA, 23 bp, Homo sapiens
gaatgtatttatttgggagaccg

SEQ ID NO: 2917393 - DNA, 20 bp, Homo sapiens
gaatgtccaaaatttatatt

SEQ ID NO: 2917394 - DNA, 16 bp, Homo sapiens
gaatgtcttttgaata

SEQ ID NO: 2917395 - DNA, 17 bp, Homo sapiens
gaatgtgtgccttgttc

SEQ ID NO: 2917396 - DNA, 18 bp, Homo sapiens
gaatgtgtttcaaactgt

SEQ ID NO: 2917397 - DNA, 16 bp, Homo sapiens
gaatgttaaagtcagt

SEQ ID NO: 2917398 - DNA, 23 bp, Homo sapiens
gaatgttaattttttggtacaaa

SEQ ID NO: 2917399 - DNA, 23 bp, Homo sapiens
gaatgttgggactgctaaataaa

SEQ ID NO: 2917400 - DNA, 20 bp, Homo sapiens
gaatgtttcagctgcagttg

SEQ ID NO: 2917401 - DNA, 16 bp, Homo sapiens
gaatgtttgtgtctgt

SEQ ID NO: 2917402 - DNA, 20 bp, Homo sapiens
gaatgtttgtgtctgtggtt

SEQ ID NO: 2917403 - DNA, 16 bp, Homo sapiens
gaatgttttgcactga

SEQ ID NO: 2917404 - DNA, 12 bp, Homo sapiens
gaattaaaattt

SEQ ID NO: 2917405 - DNA, 20 bp, Homo sapiens
gaattaaacccacaagctgc

SEQ ID NO: 2917406 - DNA, 16 bp, Homo sapiens
gaattaagctgtgcaa

SEQ ID NO: 2917407 - DNA, 17 bp, Homo sapiens
gaattaatgatgaggat

SEQ ID NO: 2917408 - DNA, 18 bp, Homo sapiens
gaattaccaagagaaggg

SEQ ID NO: 2917409 - DNA, 15 bp, Homo sapiens
gaattacccttcctc

SEQ ID NO: 2917410 - DNA, 20 bp, Homo sapiens
gaattacccttcctcatctg

SEQ ID NO: 2917411 - DNA, 16 bp, Homo sapiens
gaattactccaaaaag

SEQ ID NO: 2917412 - DNA, 16 bp, Homo sapiens
gaattacttttttcca

SEQ ID NO: 2917413 - DNA, 15 bp, Homo sapiens
gaattagatgtttat

SEQ ID NO: 2917414 - DNA, 12 bp, Homo sapiens
gaattatactcc

SEQ ID NO: 2917415 - DNA, 19 bp, Homo sapiens
gaattatactttgttgttt

SEQ ID NO: 2917416 - DNA, 16 bp, Homo sapiens
gaattattttaaaaga

SEQ ID NO: 2917417 - DNA, 21 bp, Homo sapiens
gaattcaaactggggcctcca

SEQ ID NO: 2917418 - DNA, 22 bp, Homo sapiens
gaattcaaactggggcctccag

SEQ ID NO: 2917419 - DNA, 23 bp, Homo sapiens
gaattcaaactggggcctccaga

SEQ ID NO: 2917420 - DNA, 17 bp, Homo sapiens
gaattcaagaaaggaaa

SEQ ID NO: 2917421 - DNA, 17 bp, Homo sapiens
gaattcatactctgttg

SEQ ID NO: 2917422 - DNA, 23 bp, Homo sapiens
gaattcatactctgttgcctcct

SEQ ID NO: 2917423 - DNA, 18 bp, Homo sapiens
gaattccaagtgtatttt

SEQ ID NO: 2917424 - DNA, 22 bp, Homo sapiens
gaattccaagtgtattttaaaa

SEQ ID NO: 2917425 - DNA, 18 bp, Homo sapiens
gaattcctaacttttcaa

SEQ ID NO: 2917426 - DNA, 15 bp, Homo sapiens
gaattccttaaagtt

SEQ ID NO: 2917427 - DNA, 17 bp, Homo sapiens
gaattcggtgtgcacca

SEQ ID NO: 2917428 - DNA, 18 bp, Homo sapiens
gaattctcagtgccaact

SEQ ID NO: 2917429 - DNA, 15 bp, Homo sapiens
gaattctggtcctgt

SEQ ID NO: 2917430 - DNA, 13 bp, Homo sapiens
gaattctgttcta

SEQ ID NO: 2917431 - DNA, 22 bp, Homo sapiens
gaattctgttctaaaactccaa

SEQ ID NO: 2917432 - DNA, 22 bp, Homo sapiens
gaattcttacatgttttctttg

SEQ ID NO: 2917433 - DNA, 19 bp, Homo sapiens
gaattcttggttgaggaaa

SEQ ID NO: 2917434 - DNA, 19 bp, Homo sapiens
gaattctttaaaattacaa

SEQ ID NO: 2917435 - DNA, 15 bp, Homo sapiens
gaattgacattctct

SEQ ID NO: 2917436 - DNA, 20 bp, Homo sapiens
gaattgcaatacattgttca

SEQ ID NO: 2917437 - DNA, 22 bp, Homo sapiens
gaattggaccatcctatttaac

SEQ ID NO: 2917438 - DNA, 20 bp, Homo sapiens
gaattgggtggggggcttca

SEQ ID NO: 2917439 - DNA, 23 bp, Homo sapiens
gaattgggtggggggcttcatac

SEQ ID NO: 2917440 - DNA, 14 bp, Homo sapiens
gaattgggtttctg

SEQ ID NO: 2917441 - DNA, 15 bp, Homo sapiens
gaattggtgattctg

SEQ ID NO: 2917442 - DNA, 14 bp, Homo sapiens
gaattgtccccagt

SEQ ID NO: 2917443 - DNA, 18 bp, Homo sapiens
gaatttataattcagtat

SEQ ID NO: 2917444 - DNA, 12 bp, Homo sapiens
gaatttatatag

SEQ ID NO: 2917445 - DNA, 18 bp, Homo sapiens
gaatttcatatctacaga

SEQ ID NO: 2917446 - DNA, 17 bp, Homo sapiens
gaatttcccaggaccct

SEQ ID NO: 2917447 - DNA, 14 bp, Homo sapiens
gaatttcttctttt

SEQ ID NO: 2917448 - DNA, 14 bp, Homo sapiens
gaatttgcatgtct

SEQ ID NO: 2917449 - DNA, 23 bp, Homo sapiens
gaatttgccctgggaaacccctt

SEQ ID NO: 2917450 - DNA, 13 bp, Homo sapiens
gaatttgtaagca

SEQ ID NO: 2917451 - DNA, 15 bp, Homo sapiens
gaattttaatgtgaa

SEQ ID NO: 2917452 - DNA, 14 bp, Homo sapiens
gaattttcagaccc

SEQ ID NO: 2917453 - DNA, 13 bp, Homo sapiens
gaattttctgtgt

SEQ ID NO: 2917454 - DNA, 17 bp, Homo sapiens
gaattttctgtgttttg

SEQ ID NO: 2917455 - DNA, 22 bp, Homo sapiens
gaattttctttttaataaaaag

SEQ ID NO: 2917456 - DNA, 12 bp, Homo sapiens
gacgtagagttg

SEQ ID NO: 2917457 - DNA, 20 bp, Homo sapiens
gacgtaggaacggtaaattt

SEQ ID NO: 2917458 - DNA, 16 bp, Homo sapiens
gacgtctcaagactga

SEQ ID NO: 2917459 - DNA, 16 bp, Homo sapiens
gacgtctggccctggc

SEQ ID NO: 2917460 - DNA, 11 bp, Homo sapiens
gacgtgaaata

SEQ ID NO: 2917461 - DNA, 13 bp, Homo sapiens
gacgtgactcaga

SEQ ID NO: 2917462 - DNA, 14 bp, Homo sapiens
gacgtgactcagag

SEQ ID NO: 2917463 - DNA, 17 bp, Homo sapiens
gacgtgactcagagctt

SEQ ID NO: 2917464 - DNA, 17 bp, Homo sapiens
gacgtgctggccttggt

SEQ ID NO: 2917465 - DNA, 14 bp, Homo sapiens
gacgtggctcagcc

SEQ ID NO: 2917466 - DNA, 14 bp, Homo sapiens
gacgtgtttgtgtt

SEQ ID NO: 2917467 - DNA, 21 bp, Homo sapiens
gacgttggcctcagggccagg

SEQ ID NO: 2917468 - DNA, 22 bp, Homo sapiens
gacgttggcctcagggccagga

SEQ ID NO: 2917469 - DNA, 23 bp, Homo sapiens
gacgttggcctcagggccaggaa

SEQ ID NO: 2917470 - DNA, 22 bp, Homo sapiens
gactaagccaagctgtgttcat

SEQ ID NO: 2917471 - DNA, 16 bp, Homo sapiens
gactaatgctttctgt

SEQ ID NO: 2917472 - DNA, 17 bp, Homo sapiens
gactaatgctttctgtg

SEQ ID NO: 2917473 - DNA, 16 bp, Homo sapiens
gactaatggcatgaga

SEQ ID NO: 2917474 - DNA, 21 bp, Homo sapiens
gactaattgtataacaggtta

SEQ ID NO: 2917475 - DNA, 12 bp, Homo sapiens
gactaatttcaa

SEQ ID NO: 2917476 - DNA, 22 bp, Homo sapiens
gactaatttcaaaatgcttttt

SEQ ID NO: 2917477 - DNA, 14 bp, Homo sapiens
gactacatttagag

SEQ ID NO: 2917478 - DNA, 21 bp, Homo sapiens
gactacctactggtgtaatct

SEQ ID NO: 2917479 - DNA, 14 bp, Homo sapiens
gactagaaattctt

SEQ ID NO: 2917480 - DNA, 21 bp, Homo sapiens
gactagatgatggatgccaat

SEQ ID NO: 2917481 - DNA, 19 bp, Homo sapiens
gactagcctggccaacatg

SEQ ID NO: 2917482 - DNA, 22 bp, Homo sapiens
gactagggcctcggaggctcct

SEQ ID NO: 2917483 - DNA, 13 bp, Homo sapiens
gactagtatcaag

SEQ ID NO: 2917484 - DNA, 19 bp, Homo sapiens
gactagtgagtcagcacct

SEQ ID NO: 2917485 - DNA, 15 bp, Homo sapiens
gactataaagctgtt

SEQ ID NO: 2917486 - DNA, 22 bp, Homo sapiens
gactatatttgggcctgctcca

SEQ ID NO: 2917487 - DNA, 23 bp, Homo sapiens
gactatcacacactttctcttca

SEQ ID NO: 2917488 - DNA, 22 bp, Homo sapiens
gactatcccaacagtcatgttt

SEQ ID NO: 2917489 - DNA, 18 bp, Homo sapiens
gactatgcagaggcctgg

SEQ ID NO: 2917490 - DNA, 22 bp, Homo sapiens
gactatgcagaggcctggggga

SEQ ID NO: 2917491 - DNA, 21 bp, Homo sapiens
gactatgccgtcttctgccct

SEQ ID NO: 2917492 - DNA, 16 bp, Homo sapiens
gactattatgttgtta

SEQ ID NO: 2917493 - DNA, 18 bp, Homo sapiens
gactattccttttctgta

SEQ ID NO: 2917494 - DNA, 19 bp, Homo sapiens
gactattccttttctgtat

SEQ ID NO: 2917495 - DNA, 21 bp, Homo sapiens
gactatttgacccccacaaca

SEQ ID NO: 2917496 - DNA, 16 bp, Homo sapiens
gactcaaatgttctaa

SEQ ID NO: 2917497 - DNA, 17 bp, Homo sapiens
gactcaaatgttctaag

SEQ ID NO: 2917498 - DNA, 23 bp, Homo sapiens
gactcaaatgttctaagtttcta

SEQ ID NO: 2917499 - DNA, 23 bp, Homo sapiens
gactcaaggactgaattgtttta

SEQ ID NO: 2917500 - DNA, 18 bp, Homo sapiens
gactcaagtttttacaaa

SEQ ID NO: 2917501 - DNA, 12 bp, Homo sapiens
gactcacccaag

SEQ ID NO: 2917502 - DNA, 13 bp, Homo sapiens
gactcacctctgc

SEQ ID NO: 2917503 - DNA, 17 bp, Homo sapiens
gactcacctctgcctca

SEQ ID NO: 2917504 - DNA, 18 bp, Homo sapiens
gactcacctctgcctcaa

SEQ ID NO: 2917505 - DNA, 21 bp, Homo sapiens
gactcactggcagccccagca

SEQ ID NO: 2917506 - DNA, 13 bp, Homo sapiens
gactcagaagcct

SEQ ID NO: 2917507 - DNA, 17 bp, Homo sapiens
gactcagaagcctctgg

SEQ ID NO: 2917508 - DNA, 19 bp, Homo sapiens
gactcagaagcctctgggt

SEQ ID NO: 2917509 - DNA, 11 bp, Homo sapiens
gactcagagaa

SEQ ID NO: 2917510 - DNA, 15 bp, Homo sapiens
gactcagcagaggca

SEQ ID NO: 2917511 - DNA, 18 bp, Homo sapiens
gactcagcctgcagttaa

SEQ ID NO: 2917512 - DNA, 16 bp, Homo sapiens
gactcagctctgtctg

SEQ ID NO: 2917513 - DNA, 16 bp, Homo sapiens
gactcagggctcctgg

SEQ ID NO: 2917514 - DNA, 19 bp, Homo sapiens
gactcagggctcctgggtt

SEQ ID NO: 2917515 - DNA, 20 bp, Homo sapiens
gactcaggtggtgtccttct

SEQ ID NO: 2917516 - DNA, 20 bp, Homo sapiens
gactcatcctgaacagcatg

SEQ ID NO: 2917517 - DNA, 22 bp, Homo sapiens
gactcatgaggaggggcccccc

SEQ ID NO: 2917518 - DNA, 19 bp, Homo sapiens
gactcatggtgtgttacac

SEQ ID NO: 2917519 - DNA, 13 bp, Homo sapiens
gactcattctgaa

SEQ ID NO: 2917520 - DNA, 20 bp, Homo sapiens
gactccagcctgcctggcag

SEQ ID NO: 2917521 - DNA, 12 bp, Homo sapiens
gactccaggccc

SEQ ID NO: 2917522 - DNA, 14 bp, Homo sapiens
gactccaggcccaa

SEQ ID NO: 2917523 - DNA, 19 bp, Homo sapiens
gactccaggcccaaggctc

SEQ ID NO: 2917524 - DNA, 12 bp, Homo sapiens
gactccatctct

SEQ ID NO: 2917525 - DNA, 17 bp, Homo sapiens
gactccatctctcatcc

SEQ ID NO: 2917526 - DNA, 21 bp, Homo sapiens
gactccatctctcatcctcca

SEQ ID NO: 2917527 - DNA, 13 bp, Homo sapiens
gactcccattcct

SEQ ID NO: 2917528 - DNA, 19 bp, Homo sapiens
gactcccccaaccaaggaa

SEQ ID NO: 2917529 - DNA, 18 bp, Homo sapiens
gactcccgccccgggctg

SEQ ID NO: 2917530 - DNA, 20 bp, Homo sapiens
gactcccgccccgggctggc

SEQ ID NO: 2917531 - DNA, 13 bp, Homo sapiens
gactccctcccca

SEQ ID NO: 2917532 - DNA, 16 bp, Homo sapiens
gactccctccccaccc

SEQ ID NO: 2917533 - DNA, 20 bp, Homo sapiens
gactccctccccacccaaga

SEQ ID NO: 2917534 - DNA, 18 bp, Homo sapiens
gactccctgatcccagac

SEQ ID NO: 2917535 - DNA, 15 bp, Homo sapiens
gactccggccctcct

SEQ ID NO: 2917536 - DNA, 13 bp, Homo sapiens
gactcctccccac

SEQ ID NO: 2917537 - DNA, 17 bp, Homo sapiens
gactcggcccagggccg

SEQ ID NO: 2917538 - DNA, 16 bp, Homo sapiens
gactctagagtccaag

SEQ ID NO: 2917539 - DNA, 19 bp, Homo sapiens
gactctagagtccaaggtt

SEQ ID NO: 2917540 - DNA, 17 bp, Homo sapiens
gactctaggtgcccttg

SEQ ID NO: 2917541 - DNA, 20 bp, Homo sapiens
gactctcagtctctgagcag

SEQ ID NO: 2917542 - DNA, 16 bp, Homo sapiens
gactctctgagctggg

SEQ ID NO: 2917543 - DNA, 20 bp, Homo sapiens
gactctgcacatgtcttgta

SEQ ID NO: 2917544 - DNA, 18 bp, Homo sapiens
gactcttccaccagagca

SEQ ID NO: 2917545 - DNA, 19 bp, Homo sapiens
gactcttccaccagagcag

SEQ ID NO: 2917546 - DNA, 9 bp, Homo sapiens
gactcttgt

SEQ ID NO: 2917547 - DNA, 17 bp, Homo sapiens
gactgaagaaggacatt

SEQ ID NO: 2917548 - DNA, 22 bp, Homo sapiens
gactgaagatttatttttaata

SEQ ID NO: 2917549 - DNA, 16 bp, Homo sapiens
gactgaagcgaacatc

SEQ ID NO: 2917550 - DNA, 18 bp, Homo sapiens
gactgaagcgaacatctt

SEQ ID NO: 2917551 - DNA, 21 bp, Homo sapiens
gactgaatgggatcatgaaag

SEQ ID NO: 2917552 - DNA, 23 bp, Homo sapiens
gactgacctggtccacagggcac

SEQ ID NO: 2917553 - DNA, 21 bp, Homo sapiens
gactgaccttgtaaaagacag

SEQ ID NO: 2917554 - DNA, 13 bp, Homo sapiens
gactgagccagat

SEQ ID NO: 2917555 - DNA, 16 bp, Homo sapiens
gactgagcgaggaaaa

SEQ ID NO: 2917556 - DNA, 21 bp, Homo sapiens
gactgagctctccaggccagg

SEQ ID NO: 2917557 - DNA, 15 bp, Homo sapiens
gactgatcaggacct

SEQ ID NO: 2917558 - DNA, 20 bp, Homo sapiens
gactgattctgttgtgttca

SEQ ID NO: 2917559 - DNA, 14 bp, Homo sapiens
gactgcacccagga

SEQ ID NO: 2917560 - DNA, 16 bp, Homo sapiens
gactgcacccaggagg

SEQ ID NO: 2917561 - DNA, 21 bp, Homo sapiens
gactgcagtcggcatgccagg

SEQ ID NO: 2917562 - DNA, 20 bp, Homo sapiens
gactgccacgtgccttagga

SEQ ID NO: 2917563 - DNA, 21 bp, Homo sapiens
gactgccacgtgccttaggaa

SEQ ID NO: 2917564 - DNA, 10 bp, Homo sapiens
gactgcccag

SEQ ID NO: 2917565 - DNA, 11 bp, Homo sapiens
gactgcccagc

SEQ ID NO: 2917566 - DNA, 12 bp, Homo sapiens
gactgcccagcc

SEQ ID NO: 2917567 - DNA, 19 bp, Homo sapiens
gactgccccagccaacgag

SEQ ID NO: 2917568 - DNA, 10 bp, Homo sapiens
gactgcctgt

SEQ ID NO: 2917569 - DNA, 18 bp, Homo sapiens
gactgcctgtctccatga

SEQ ID NO: 2917570 - DNA, 12 bp, Homo sapiens
gactgcgctgct

SEQ ID NO: 2917571 - DNA, 12 bp, Homo sapiens
gactgctaaata

SEQ ID NO: 2917572 - DNA, 17 bp, Homo sapiens
gactgctaaataaaatt

SEQ ID NO: 2917573 - DNA, 17 bp, Homo sapiens
gactgctgctccccacc

SEQ ID NO: 2917574 - DNA, 12 bp, Homo sapiens
gactgctggctc

SEQ ID NO: 2917575 - DNA, 14 bp, Homo sapiens
gactgcttggccag

SEQ ID NO: 2917576 - DNA, 14 bp, Homo sapiens
gactggaaaaatga

SEQ ID NO: 2917577 - DNA, 21 bp, Homo sapiens
gactggacagcttgtggcaag

SEQ ID NO: 2917578 - DNA, 21 bp, Homo sapiens
gactggcctaggggccagggc

SEQ ID NO: 2917579 - DNA, 20 bp, Homo sapiens
gactggcttttattaatgca

SEQ ID NO: 2917580 - DNA, 16 bp, Homo sapiens
gactgggccatgggtc

SEQ ID NO: 2917581 - DNA, 14 bp, Homo sapiens
gactgggcccaggc

SEQ ID NO: 2917582 - DNA, 18 bp, Homo sapiens
gactgggcccaggcaggt

SEQ ID NO: 2917583 - DNA, 17 bp, Homo sapiens
gactgggctctggctct

SEQ ID NO: 2917584 - DNA, 19 bp, Homo sapiens
gactgggctgggtttgctg

SEQ ID NO: 2917585 - DNA, 21 bp, Homo sapiens
gactgggctgggtttgctgtc

SEQ ID NO: 2917586 - DNA, 20 bp, Homo sapiens
gactgggtctgacctggtgg

SEQ ID NO: 2917587 - DNA, 22 bp, Homo sapiens
gactggtaggaggaggcatgga

SEQ ID NO: 2917588 - DNA, 17 bp, Homo sapiens
gaggccttgtgtgtcag

SEQ ID NO: 2917589 - DNA, 21 bp, Homo sapiens
gaggccttgtgtgtcaggccc

SEQ ID NO: 2917590 - DNA, 20 bp, Homo sapiens
gaggcgaagcgttgtcctca

SEQ ID NO: 2917591 - DNA, 12 bp, Homo sapiens
gaggcgcggcct

SEQ ID NO: 2917592 - DNA, 14 bp, Homo sapiens
gaggctccagaggg

SEQ ID NO: 2917593 - DNA, 12 bp, Homo sapiens
gaggctcctccc

SEQ ID NO: 2917594 - DNA, 13 bp, Homo sapiens
gaggctcctccct

SEQ ID NO: 2917595 - DNA, 17 bp, Homo sapiens
gaggctcctccctctgc

SEQ ID NO: 2917596 - DNA, 22 bp, Homo sapiens
gaggctcctccctctgcctcat

SEQ ID NO: 2917597 - DNA, 15 bp, Homo sapiens
gaggctgaggcacaa

SEQ ID NO: 2917598 - DNA, 20 bp, Homo sapiens
gaggctgaggctggcacagg

SEQ ID NO: 2917599 - DNA, 19 bp, Homo sapiens
gaggctgcaatgagccatg

SEQ ID NO: 2917600 - DNA, 22 bp, Homo sapiens
gaggctgcactggagccacagg

SEQ ID NO: 2917601 - DNA, 13 bp, Homo sapiens
gaggctgcagcca

SEQ ID NO: 2917602 - DNA, 14 bp, Homo sapiens
gaggctgcagccag

SEQ ID NO: 2917603 - DNA, 19 bp, Homo sapiens
gaggctgcagccaggccac

SEQ ID NO: 2917604 - DNA, 20 bp, Homo sapiens
gaggctgcagccaggcctcg

SEQ ID NO: 2917605 - DNA, 15 bp, Homo sapiens
gaggctgccccaggc

SEQ ID NO: 2917606 - DNA, 19 bp, Homo sapiens
gaggctgcctgctgtgctg

SEQ ID NO: 2917607 - DNA, 16 bp, Homo sapiens
gaggctggaggcaggg

SEQ ID NO: 2917608 - DNA, 17 bp, Homo sapiens
gaggctggaggcagggc

SEQ ID NO: 2917609 - DNA, 18 bp, Homo sapiens
gaggctggaggcagggcc

SEQ ID NO: 2917610 - DNA, 13 bp, Homo sapiens
gaggctggcacag

SEQ ID NO: 2917611 - DNA, 18 bp, Homo sapiens
gaggctggcctctacatc

SEQ ID NO: 2917612 - DNA, 21 bp, Homo sapiens
gaggctggttttgatggctgg

SEQ ID NO: 2917613 - DNA, 22 bp, Homo sapiens
gaggctggttttgatggctggg

SEQ ID NO: 2917614 - DNA, 16 bp, Homo sapiens
gaggctttggatttga

SEQ ID NO: 2917615 - DNA, 15 bp, Homo sapiens
gagggaacagacagg

SEQ ID NO: 2917616 - DNA, 19 bp, Homo sapiens
gagggaacagacaggagaa

SEQ ID NO: 2917617 - DNA, 17 bp, Homo sapiens
gagggaaggatttagga

SEQ ID NO: 2917618 - DNA, 18 bp, Homo sapiens
gagggaagtcctgggagg

SEQ ID NO: 2917619 - DNA, 20 bp, Homo sapiens
gagggaagtcctgggaggat

SEQ ID NO: 2917620 - DNA, 15 bp, Homo sapiens
gagggacctctccca

SEQ ID NO: 2917621 - DNA, 12 bp, Homo sapiens
gagggagaaagg

SEQ ID NO: 2917622 - DNA, 14 bp, Homo sapiens
gagggagaagactg

SEQ ID NO: 2917623 - DNA, 17 bp, Homo sapiens
gagggagacccaggggg

SEQ ID NO: 2917624 - DNA, 18 bp, Homo sapiens
gagggagagaactgagca

SEQ ID NO: 2917625 - DNA, 18 bp, Homo sapiens
gagggagctgaggcctcc

SEQ ID NO: 2917626 - DNA, 21 bp, Homo sapiens
gagggagctgaggcctccctt

SEQ ID NO: 2917627 - DNA, 11 bp, Homo sapiens
gagggaggccc

SEQ ID NO: 2917628 - DNA, 16 bp, Homo sapiens
gagggaggccccaggg

SEQ ID NO: 2917629 - DNA, 17 bp, Homo sapiens
gagggaggccccagggg

SEQ ID NO: 2917630 - DNA, 16 bp, Homo sapiens
gagggagggagccatg

SEQ ID NO: 2917631 - DNA, 12 bp, Homo sapiens
gagggaggggcc

SEQ ID NO: 2917632 - DNA, 15 bp, Homo sapiens
gagggagtctcagga

SEQ ID NO: 2917633 - DNA, 22 bp, Homo sapiens
gagggagtctcaggaggaggct

SEQ ID NO: 2917634 - DNA, 23 bp, Homo sapiens
gagggagtctcaggaggaggctg

SEQ ID NO: 2917635 - DNA, 19 bp, Homo sapiens
gagggagtgcagaacacct

SEQ ID NO: 2917636 - DNA, 12 bp, Homo sapiens
gagggatgggag

SEQ ID NO: 2917637 - DNA, 14 bp, Homo sapiens
gagggatgggagag

SEQ ID NO: 2917638 - DNA, 19 bp, Homo sapiens
gagggatttctttgctgta

SEQ ID NO: 2917639 - DNA, 16 bp, Homo sapiens
gagggcactggagctg

SEQ ID NO: 2917640 - DNA, 14 bp, Homo sapiens
gagggcagaggctg

SEQ ID NO: 2917641 - DNA, 22 bp, Homo sapiens
gagggcagcactgggaagctgg

SEQ ID NO: 2917642 - DNA, 15 bp, Homo sapiens
gagggcagcagggct

SEQ ID NO: 2917643 - DNA, 15 bp, Homo sapiens
gagggcatctctgag

SEQ ID NO: 2917644 - DNA, 16 bp, Homo sapiens
gagggcatctctgagt

SEQ ID NO: 2917645 - DNA, 14 bp, Homo sapiens
gagggccagggagg

SEQ ID NO: 2917646 - DNA, 16 bp, Homo sapiens
gagggccagggaggca

SEQ ID NO: 2917647 - DNA, 19 bp, Homo sapiens
gagggccagggaggcagag

SEQ ID NO: 2917648 - DNA, 23 bp, Homo sapiens
gagggccctgtggagtccagctc

SEQ ID NO: 2917649 - DNA, 15 bp, Homo sapiens
gagggccgcctgcct

SEQ ID NO: 2917650 - DNA, 17 bp, Homo sapiens
gagggcctctgcctggg

SEQ ID NO: 2917651 - DNA, 12 bp, Homo sapiens
gagggcgcccag

SEQ ID NO: 2917652 - DNA, 14 bp, Homo sapiens
gagggcgcccagca

SEQ ID NO: 2917653 - DNA, 19 bp, Homo sapiens
gagggcgcccagcagcctg

SEQ ID NO: 2917654 - DNA, 20 bp, Homo sapiens
gagggcgcccagcagcctgc

SEQ ID NO: 2917655 - DNA, 20 bp, Homo sapiens
gagggcgtgactcacccaag

SEQ ID NO: 2917656 - DNA, 10 bp, Homo sapiens
gagggctgga

SEQ ID NO: 2917657 - DNA, 17 bp, Homo sapiens
gagggctggaggcccag

SEQ ID NO: 2917658 - DNA, 16 bp, Homo sapiens
gagggctttcagcgcc

SEQ ID NO: 2917659 - DNA, 14 bp, Homo sapiens
gaggggaaaaaaac

SEQ ID NO: 2917660 - DNA, 16 bp, Homo sapiens
gaggggaacactgccc

SEQ ID NO: 2917661 - DNA, 17 bp, Homo sapiens
gaggggaacactgccct

SEQ ID NO: 2917662 - DNA, 16 bp, Homo sapiens
gaggggaaggggccgg

SEQ ID NO: 2917663 - DNA, 16 bp, Homo sapiens
gaggggacgggacaga

SEQ ID NO: 2917664 - DNA, 17 bp, Homo sapiens
gaggggcccccctgccc

SEQ ID NO: 2917665 - DNA, 18 bp, Homo sapiens
gaggggcccctggcccag

SEQ ID NO: 2917666 - DNA, 18 bp, Homo sapiens
gaggggcccggtggcggc

SEQ ID NO: 2917667 - DNA, 17 bp, Homo sapiens
gaggggccggctggcct

SEQ ID NO: 2917668 - DNA, 23 bp, Homo sapiens
gaggggcctgtgtggaggcctca

SEQ ID NO: 2917669 - DNA, 17 bp, Homo sapiens
gaggggcctttgctgcc

SEQ ID NO: 2917670 - DNA, 14 bp, Homo sapiens
gaggggctggggag

SEQ ID NO: 2917671 - DNA, 19 bp, Homo sapiens
gaggggctggggagggggt

SEQ ID NO: 2917672 - DNA, 23 bp, Homo sapiens
gaggggctggggagggggtacct

SEQ ID NO: 2917673 - DNA, 18 bp, Homo sapiens
gagggggtacctcatgag

SEQ ID NO: 2917674 - DNA, 23 bp, Homo sapiens
gaggggtggtggggggcagggcc

SEQ ID NO: 2917675 - DNA, 15 bp, Homo sapiens
gaggggtgtccgaga

SEQ ID NO: 2917676 - DNA, 20 bp, Homo sapiens
gagggtgagaggaagggtgg

SEQ ID NO: 2917677 - DNA, 14 bp, Homo sapiens
gagggttggagaag

SEQ ID NO: 2917678 - DNA, 16 bp, Homo sapiens
gaggtaaaggatgagg

SEQ ID NO: 2917679 - DNA, 15 bp, Homo sapiens
gaggtataggggtcc

SEQ ID NO: 2917680 - DNA, 22 bp, Homo sapiens
gaggtattcaatatcctttgcc

SEQ ID NO: 2917681 - DNA, 17 bp, Homo sapiens
gaggtctcttttctcta

SEQ ID NO: 2917682 - DNA, 18 bp, Homo sapiens
gaggtctcttttctctac

SEQ ID NO: 2917683 - DNA, 18 bp, Homo sapiens
gaggtgaaaatgaagaag

SEQ ID NO: 2917684 - DNA, 13 bp, Homo sapiens
gaggtgattccag

SEQ ID NO: 2917685 - DNA, 22 bp, Homo sapiens
gaggtgccttcttcagggcctg

SEQ ID NO: 2917686 - DNA, 23 bp, Homo sapiens
gaggtgccttcttcagggcctgg

SEQ ID NO: 2917687 - DNA, 23 bp, Homo sapiens
gaggtgcttctagttctgccagg

SEQ ID NO: 2917688 - DNA, 17 bp, Homo sapiens
gaggtggaagagggctg

SEQ ID NO: 2917689 - DNA, 19 bp, Homo sapiens
gaggtggaggttgcagtga

SEQ ID NO: 2917690 - DNA, 20 bp, Homo sapiens
gaggtggaggttgcagtgag

SEQ ID NO: 2917691 - DNA, 13 bp, Homo sapiens
gaggtggctgcct

SEQ ID NO: 2917692 - DNA, 23 bp, Homo sapiens
gaggtggtagtaaaacacagagg

SEQ ID NO: 2917693 - DNA, 15 bp, Homo sapiens
gaggtgtctggcctg

SEQ ID NO: 2917694 - DNA, 18 bp, Homo sapiens
gaggtgtctggcctgagg

SEQ ID NO: 2917695 - DNA, 19 bp, Homo sapiens
gaggttaaggctgaggaaa

SEQ ID NO: 2917696 - DNA, 14 bp, Homo sapiens
gaggttctaaggcc

SEQ ID NO: 2917697 - DNA, 13 bp, Homo sapiens
gaggttgagtgag

SEQ ID NO: 2917698 - DNA, 17 bp, Homo sapiens
gaggttgtggggaggct

SEQ ID NO: 2917699 - DNA, 23 bp, Homo sapiens
gaggtttttttgtcaacattgtg

SEQ ID NO: 2917700 - DNA, 17 bp, Homo sapiens
gagtaaagctcctatct

SEQ ID NO: 2917701 - DNA, 20 bp, Homo sapiens
gagtaagaaatttcaggttg

SEQ ID NO: 2917702 - DNA, 13 bp, Homo sapiens
gagtaatctgtgt

SEQ ID NO: 2917703 - DNA, 18 bp, Homo sapiens
gagtacaagctcttgttt

SEQ ID NO: 2917704 - DNA, 20 bp, Homo sapiens
gagtacaagctcttgtttct

SEQ ID NO: 2917705 - DNA, 19 bp, Homo sapiens
gagtacaaggacagacagc

SEQ ID NO: 2917706 - DNA, 12 bp, Homo sapiens
gagtacattgtg

SEQ ID NO: 2917707 - DNA, 13 bp, Homo sapiens
gagtacattgtgc

SEQ ID NO: 2917708 - DNA, 16 bp, Homo sapiens
gagtacattgtgccct

SEQ ID NO: 2917709 - DNA, 19 bp, Homo sapiens
gagtactcacttttcactt

SEQ ID NO: 2917710 - DNA, 15 bp, Homo sapiens
gagtactgtgggcaa

SEQ ID NO: 2917711 - DNA, 18 bp, Homo sapiens
gagtactgtgggcaattt

SEQ ID NO: 2917712 - DNA, 17 bp, Homo sapiens
gagtagatgcgcagccc

SEQ ID NO: 2917713 - DNA, 17 bp, Homo sapiens
gagtagccgagagcctg

SEQ ID NO: 2917714 - DNA, 17 bp, Homo sapiens
gagtagggtagaaggaa

SEQ ID NO: 2917715 - DNA, 15 bp, Homo sapiens
gagtatacggaaaca

SEQ ID NO: 2917716 - DNA, 22 bp, Homo sapiens
gagtatcagaattgaaacactt

SEQ ID NO: 2917717 - DNA, 17 bp, Homo sapiens
gagtatctaatccttta

SEQ ID NO: 2917718 - DNA, 23 bp, Homo sapiens
gagtatctcctcgcaagctgggt

SEQ ID NO: 2917719 - DNA, 19 bp, Homo sapiens
gagtcaaaactacaaatca

SEQ ID NO: 2917720 - DNA, 19 bp, Homo sapiens
gagtcaaatggtaggcatt

SEQ ID NO: 2917721 - DNA, 13 bp, Homo sapiens
gatggaggagaag

SEQ ID NO: 2917722 - DNA, 16 bp, Homo sapiens
gatggagttcttgtgc

SEQ ID NO: 2917723 - DNA, 19 bp, Homo sapiens
gatggagttcttgtgccat

SEQ ID NO: 2917724 - DNA, 17 bp, Homo sapiens
gatggataaactgagcc

SEQ ID NO: 2917725 - DNA, 19 bp, Homo sapiens
gatggatagtatgtaattt

SEQ ID NO: 2917726 - DNA, 14 bp, Homo sapiens
gatggattcatcat

SEQ ID NO: 2917727 - DNA, 17 bp, Homo sapiens
gatggattctccactca

SEQ ID NO: 2917728 - DNA, 16 bp, Homo sapiens
gatggcaacagatctg

SEQ ID NO: 2917729 - DNA, 21 bp, Homo sapiens
gatggcaacagatctggaacc

SEQ ID NO: 2917730 - DNA, 20 bp, Homo sapiens
gatggcaggacgtgggctgg

SEQ ID NO: 2917731 - DNA, 21 bp, Homo sapiens
gatggcatcctgtgaagtcct

SEQ ID NO: 2917732 - DNA, 14 bp, Homo sapiens
gatggctcctctca

SEQ ID NO: 2917733 - DNA, 14 bp, Homo sapiens
gatgggaaaatatt

SEQ ID NO: 2917734 - DNA, 13 bp, Homo sapiens
gatgggaatgaag

SEQ ID NO: 2917735 - DNA, 14 bp, Homo sapiens
gatgggaatgaagc

SEQ ID NO: 2917736 - DNA, 16 bp, Homo sapiens
gatgggaatgaagctt

SEQ ID NO: 2917737 - DNA, 15 bp, Homo sapiens
gatgggacagcaaca

SEQ ID NO: 2917738 - DNA, 20 bp, Homo sapiens
gatgggagggaggctcaggt

SEQ ID NO: 2917739 - DNA, 19 bp, Homo sapiens
gatgggatggtggagggcc

SEQ ID NO: 2917740 - DNA, 17 bp, Homo sapiens
gatgggcccctggcccc

SEQ ID NO: 2917741 - DNA, 16 bp, Homo sapiens
gatgggctccccagga

SEQ ID NO: 2917742 - DNA, 18 bp, Homo sapiens
gatgggcttttgttctga

SEQ ID NO: 2917743 - DNA, 20 bp, Homo sapiens
gatggggaggaagagagaga

SEQ ID NO: 2917744 - DNA, 16 bp, Homo sapiens
gatggggggatttttt

SEQ ID NO: 2917745 - DNA, 21 bp, Homo sapiens
gatgggtgaaggctggcatga

SEQ ID NO: 2917746 - DNA, 18 bp, Homo sapiens
gatgggtttgacaaggtt

SEQ ID NO: 2917747 - DNA, 15 bp, Homo sapiens
gatggtaagaaacaa

SEQ ID NO: 2917748 - DNA, 13 bp, Homo sapiens
gatggtctggtct

SEQ ID NO: 2917749 - DNA, 17 bp, Homo sapiens
gatggtgctgcccaggc

SEQ ID NO: 2917750 - DNA, 21 bp, Homo sapiens
gatggtgctgcccaggcctct

SEQ ID NO: 2917751 - DNA, 14 bp, Homo sapiens
gatggtggagggcc

SEQ ID NO: 2917752 - DNA, 15 bp, Homo sapiens
gatggtggagggcca

SEQ ID NO: 2917753 - DNA, 20 bp, Homo sapiens
gatggtgggtggggctgcag

SEQ ID NO: 2917754 - DNA, 17 bp, Homo sapiens
gatggttattttctttt

SEQ ID NO: 2917755 - DNA, 12 bp, Homo sapiens
gatggtttccgt

SEQ ID NO: 2917756 - DNA, 16 bp, Homo sapiens
gatgtaaacagtgcct

SEQ ID NO: 2917757 - DNA, 21 bp, Homo sapiens
gatgtaaacagtgcctgctga

SEQ ID NO: 2917758 - DNA, 19 bp, Homo sapiens
gatgtaaatcgggaaggat

SEQ ID NO: 2917759 - DNA, 20 bp, Homo sapiens
gatgtaaatcgggaaggatg

SEQ ID NO: 2917760 - DNA, 13 bp, Homo sapiens
gatgtaggcattc

SEQ ID NO: 2917761 - DNA, 14 bp, Homo sapiens
gatgtataaaactt

SEQ ID NO: 2917762 - DNA, 20 bp, Homo sapiens
gatgtatcgggaagatttct

SEQ ID NO: 2917763 - DNA, 16 bp, Homo sapiens
gatgtccagggcccca

SEQ ID NO: 2917764 - DNA, 18 bp, Homo sapiens
gatgtccttaaaatgtgg

SEQ ID NO: 2917765 - DNA, 21 bp, Homo sapiens
gatgtctgaactttgggaagc

SEQ ID NO: 2917766 - DNA, 21 bp, Homo sapiens
gatgtctgccaatttttgcct

SEQ ID NO: 2917767 - DNA, 24 bp, Homo sapiens
gatgtcttttttaaggctctgtgc

SEQ ID NO: 2917768 - DNA, 13 bp, Homo sapiens
gatgtgaaaactc

SEQ ID NO: 2917769 - DNA, 14 bp, Homo sapiens
gatgtgaagccaat

SEQ ID NO: 2917770 - DNA, 21 bp, Homo sapiens
gatgtgaatactcttcccaca

SEQ ID NO: 2917771 - DNA, 15 bp, Homo sapiens
gatgtgattgtggaa

SEQ ID NO: 2917772 - DNA, 23 bp, Homo sapiens
gatgtgatttaatagtgttaatc

SEQ ID NO: 2917773 - DNA, 14 bp, Homo sapiens
gatgtgcaattgat

SEQ ID NO: 2917774 - DNA, 19 bp, Homo sapiens
gatgtgcaattgatttctt

SEQ ID NO: 2917775 - DNA, 11 bp, Homo sapiens
gatgtgcattc

SEQ ID NO: 2917776 - DNA, 18 bp, Homo sapiens
gatgtgctttgtggcttc

SEQ ID NO: 2917777 - DNA, 21 bp, Homo sapiens
gatgtggaaaagccaagaggc

SEQ ID NO: 2917778 - DNA, 23 bp, Homo sapiens
gatgtggaaaagccaagaggctg

SEQ ID NO: 2917779 - DNA, 13 bp, Homo sapiens
gatgtggagccag

SEQ ID NO: 2917780 - DNA, 15 bp, Homo sapiens
gatgtggagccaggc

SEQ ID NO: 2917781 - DNA, 14 bp, Homo sapiens
gatgtggccctggc

SEQ ID NO: 2917782 - DNA, 21 bp, Homo sapiens
gatgtggccctggcctgctgg

SEQ ID NO: 2917783 - DNA, 14 bp, Homo sapiens
gatgtgttcggttt

SEQ ID NO: 2917784 - DNA, 14 bp, Homo sapiens
gatgtgtttgcttt

SEQ ID NO: 2917785 - DNA, 14 bp, Homo sapiens
gatgttaaagcatt

SEQ ID NO: 2917786 - DNA, 11 bp, Homo sapiens
gatgttaacac

SEQ ID NO: 2917787 - DNA, 20 bp, Homo sapiens
gatgttatgtaaaaggccaa

SEQ ID NO: 2917788 - DNA, 13 bp, Homo sapiens
gatgttctaaggc

SEQ ID NO: 2917789 - DNA, 14 bp, Homo sapiens
gatgttctaaggct

SEQ ID NO: 2917790 - DNA, 16 bp, Homo sapiens
gatgttctaaggctct

SEQ ID NO: 2917791 - DNA, 14 bp, Homo sapiens
gatgttctcctgat

SEQ ID NO: 2917792 - DNA, 16 bp, Homo sapiens
gatgttgagaaacctg

SEQ ID NO: 2917793 - DNA, 15 bp, Homo sapiens
gatgtttatatcaaa

SEQ ID NO: 2917794 - DNA, 17 bp, Homo sapiens
gatgtttatatcaaatg

SEQ ID NO: 2917795 - DNA, 21 bp, Homo sapiens
gatgtttattcttctagagtt

SEQ ID NO: 2917796 - DNA, 23 bp, Homo sapiens
gatgtttattcttctagagttca

SEQ ID NO: 2917797 - DNA, 13 bp, Homo sapiens
gatgtttccagac

SEQ ID NO: 2917798 - DNA, 14 bp, Homo sapiens
gatgtttgggtggg

SEQ ID NO: 2917799 - DNA, 15 bp, Homo sapiens
gatgttttaacttat

SEQ ID NO: 2917800 - DNA, 21 bp, Homo sapiens
gatgttttacgtctgggagaa

SEQ ID NO: 2917801 - DNA, 13 bp, Homo sapiens
gatgttttctaag

SEQ ID NO: 2917802 - DNA, 18 bp, Homo sapiens
gattaaaatatcctttca

SEQ ID NO: 2917803 - DNA, 13 bp, Homo sapiens
gattaaaatctct

SEQ ID NO: 2917804 - DNA, 12 bp, Homo sapiens
gattaaagaaaa

SEQ ID NO: 2917805 - DNA, 16 bp, Homo sapiens
gattaaataagattct

SEQ ID NO: 2917806 - DNA, 15 bp, Homo sapiens
gattaagatgtatat

SEQ ID NO: 2917807 - DNA, 21 bp, Homo sapiens
gattaatcagctgttgcaggc

SEQ ID NO: 2917808 - DNA, 13 bp, Homo sapiens
gattaatttcatc

SEQ ID NO: 2917809 - DNA, 17 bp, Homo sapiens
gattacagaaactgatg

SEQ ID NO: 2917810 - DNA, 10 bp, Homo sapiens
gattacaggc

SEQ ID NO: 2917811 - DNA, 18 bp, Homo sapiens
gattacaggcgtgagcca

SEQ ID NO: 2917812 - DNA, 20 bp, Homo sapiens
gattacagggatgagccacc

SEQ ID NO: 2917813 - DNA, 13 bp, Homo sapiens
gattacctcctga

SEQ ID NO: 2917814 - DNA, 17 bp, Homo sapiens
gattagaagctgaaaac

SEQ ID NO: 2917815 - DNA, 12 bp, Homo sapiens
gattataaatgt

SEQ ID NO: 2917816 - DNA, 13 bp, Homo sapiens
gattataaatgtt

SEQ ID NO: 2917817 - DNA, 17 bp, Homo sapiens
gattatagattctaaag

SEQ ID NO: 2917818 - DNA, 23 bp, Homo sapiens
gattatagcaatgtgattttgta

SEQ ID NO: 2917819 - DNA, 21 bp, Homo sapiens
gattatagttgtgggtgggag

SEQ ID NO: 2917820 - DNA, 18 bp, Homo sapiens
gattatatcaaagtattt

SEQ ID NO: 2917821 - DNA, 17 bp, Homo sapiens
gattatggttttgtgat

SEQ ID NO: 2917822 - DNA, 21 bp, Homo sapiens
gattatgtattaacttgtaga

SEQ ID NO: 2917823 - DNA, 12 bp, Homo sapiens
gattattaaaat

SEQ ID NO: 2917824 - DNA, 20 bp, Homo sapiens
gattattagccaggtaatgt

SEQ ID NO: 2917825 - DNA, 15 bp, Homo sapiens
gattatttgttttac

SEQ ID NO: 2917826 - DNA, 12 bp, Homo sapiens
gattattttatc

SEQ ID NO: 2917827 - DNA, 23 bp, Homo sapiens
gattattttggaaagtttttgta

SEQ ID NO: 2917828 - DNA, 13 bp, Homo sapiens
gattcaaaatatt

SEQ ID NO: 2917829 - DNA, 14 bp, Homo sapiens
gattcaaaatattt

SEQ ID NO: 2917830 - DNA, 13 bp, Homo sapiens
gattcaaaggttc

SEQ ID NO: 2917831 - DNA, 18 bp, Homo sapiens
gattcaaaggttctaggt

SEQ ID NO: 2917832 - DNA, 23 bp, Homo sapiens
gattcaactaaaaaaaaaaaagt

SEQ ID NO: 2917833 - DNA, 17 bp, Homo sapiens
gattcaaggctcagaag

SEQ ID NO: 2917834 - DNA, 15 bp, Homo sapiens
gattcagttttcatt

SEQ ID NO: 2917835 - DNA, 19 bp, Homo sapiens
gattcagttttcccacttt

SEQ ID NO: 2917836 - DNA, 17 bp, Homo sapiens
gattcatttataagaag

SEQ ID NO: 2917837 - DNA, 19 bp, Homo sapiens
gattcatttttaatcatga

SEQ ID NO: 2917838 - DNA, 9 bp, Homo sapiens
gattccatc

SEQ ID NO: 2917839 - DNA, 14 bp, Homo sapiens
gattcccagagaca

SEQ ID NO: 2917840 - DNA, 19 bp, Homo sapiens
gattcccagagacaggaaa

SEQ ID NO: 2917841 - DNA, 21 bp, Homo sapiens
gattcccagagacaggaaaat

SEQ ID NO: 2917842 - DNA, 12 bp, Homo sapiens
gattcccaggcc

SEQ ID NO: 2917843 - DNA, 19 bp, Homo sapiens
gattcccaggccagggctg

SEQ ID NO: 2917844 - DNA, 23 bp, Homo sapiens
gattcccaggccagggctgggtc

SEQ ID NO: 2917845 - DNA, 21 bp, Homo sapiens
gattccccctgccctgtgccg

SEQ ID NO: 2917846 - DNA, 21 bp, Homo sapiens
gattccctcctgctactctgt

SEQ ID NO: 2917847 - DNA, 22 bp, Homo sapiens
gattccggatcctaagcatcta

SEQ ID NO: 2917848 - DNA, 18 bp, Homo sapiens
gattcctgtaaatgtgac

SEQ ID NO: 2917849 - DNA, 14 bp, Homo sapiens
gattcctttcctgt

SEQ ID NO: 2917850 - DNA, 17 bp, Homo sapiens
gattcgaatgacactgt

SEQ ID NO: 2917851 - DNA, 13 bp, Homo sapiens
gattcgctgtccc

SEQ ID NO: 2917852 - DNA, 20 bp, Homo sapiens
gattcgctgtcccctcagcg

SEQ ID NO: 2917853 - DNA, 22 bp, Homo sapiens
gattctaaacagatgtccctga

SEQ ID NO: 2917854 - DNA, 17 bp, Homo sapiens
gcactctcaccccaagc

SEQ ID NO: 2917855 - DNA, 20 bp, Homo sapiens
gcactctggcggtggccaca

SEQ ID NO: 2917856 - DNA, 21 bp, Homo sapiens
gcactgaagtttttgaaatac

SEQ ID NO: 2917857 - DNA, 13 bp, Homo sapiens
gcactgatgctgc

SEQ ID NO: 2917858 - DNA, 19 bp, Homo sapiens
gcactgatgctgcccctca

SEQ ID NO: 2917859 - DNA, 13 bp, Homo sapiens
gcactgccactgg

SEQ ID NO: 2917860 - DNA, 14 bp, Homo sapiens
gcactgctgcctca

SEQ ID NO: 2917861 - DNA, 16 bp, Homo sapiens
gcactgctgcctcagc

SEQ ID NO: 2917862 - DNA, 17 bp, Homo sapiens
gcactggaaccacctgg

SEQ ID NO: 2917863 - DNA, 13 bp, Homo sapiens
gcactggagccac

SEQ ID NO: 2917864 - DNA, 19 bp, Homo sapiens
gcactgggcgtctgactcc

SEQ ID NO: 2917865 - DNA, 15 bp, Homo sapiens
gcactggggcagggg

SEQ ID NO: 2917866 - DNA, 18 bp, Homo sapiens
gcactggggcaggggccg

SEQ ID NO: 2917867 - DNA, 23 bp, Homo sapiens
gcactggggcaggggccgggggc

SEQ ID NO: 2917868 - DNA, 17 bp, Homo sapiens
gcactgtagttctaaga

SEQ ID NO: 2917869 - DNA, 19 bp, Homo sapiens
gcactgtagttctaagact

SEQ ID NO: 2917870 - DNA, 16 bp, Homo sapiens
gcactgtctgtaccta

SEQ ID NO: 2917871 - DNA, 17 bp, Homo sapiens
gcactgtctgtacctaa

SEQ ID NO: 2917872 - DNA, 21 bp, Homo sapiens
gcactgtctgtacctaaagca

SEQ ID NO: 2917873 - DNA, 17 bp, Homo sapiens
gcactgtgaaggaccct

SEQ ID NO: 2917874 - DNA, 20 bp, Homo sapiens
gcactgtgaatcctggcaag

SEQ ID NO: 2917875 - DNA, 15 bp, Homo sapiens
gcactgttccccctg

SEQ ID NO: 2917876 - DNA, 18 bp, Homo sapiens
gcacttaaacagaagcag

SEQ ID NO: 2917877 - DNA, 20 bp, Homo sapiens
gcacttaatattagcttgct

SEQ ID NO: 2917878 - DNA, 16 bp, Homo sapiens
gcacttatgatttcat

SEQ ID NO: 2917879 - DNA, 22 bp, Homo sapiens
gcacttcccaggatctgctcca

SEQ ID NO: 2917880 - DNA, 12 bp, Homo sapiens
gcacttccctgc

SEQ ID NO: 2917881 - DNA, 23 bp, Homo sapiens
gcacttctttttctcgctgtcct

SEQ ID NO: 2917882 - DNA, 13 bp, Homo sapiens
gcacttgaagaat

SEQ ID NO: 2917883 - DNA, 21 bp, Homo sapiens
gcacttgcagaggagcccagt

SEQ ID NO: 2917884 - DNA, 13 bp, Homo sapiens
gcacttgcctggg

SEQ ID NO: 2917885 - DNA, 14 bp, Homo sapiens
gcacttgcctgggt

SEQ ID NO: 2917886 - DNA, 15 bp, Homo sapiens
gcacttgtatatacg

SEQ ID NO: 2917887 - DNA, 16 bp, Homo sapiens
gcactttaccagaggc

SEQ ID NO: 2917888 - DNA, 18 bp, Homo sapiens
gcactttagtgattgctt

SEQ ID NO: 2917889 - DNA, 20 bp, Homo sapiens
gcactttctatcctctgtaa

SEQ ID NO: 2917890 - DNA, 19 bp, Homo sapiens
gcactttgagaggctgagg

SEQ ID NO: 2917891 - DNA, 20 bp, Homo sapiens
gcactttgggtttttaactc

SEQ ID NO: 2917892 - DNA, 13 bp, Homo sapiens
gcacttttgaatg

SEQ ID NO: 2917893 - DNA, 21 bp, Homo sapiens
gcagaaaccttgtttgtttta

SEQ ID NO: 2917894 - DNA, 14 bp, Homo sapiens
gcagaaagtgcctt

SEQ ID NO: 2917895 - DNA, 22 bp, Homo sapiens
gcagaaagtgcctttatctcag

SEQ ID NO: 2917896 - DNA, 15 bp, Homo sapiens
gcagaaatataaaca

SEQ ID NO: 2917897 - DNA, 19 bp, Homo sapiens
gcagaactaaactcattta

SEQ ID NO: 2917898 - DNA, 17 bp, Homo sapiens
gcagaagaatctttctt

SEQ ID NO: 2917899 - DNA, 18 bp, Homo sapiens
gcagaagaatctttcttc

SEQ ID NO: 2917900 - DNA, 21 bp, Homo sapiens
gcagaaggacaggtctctgag

SEQ ID NO: 2917901 - DNA, 18 bp, Homo sapiens
gcagaaggagagtgagtg

SEQ ID NO: 2917902 - DNA, 17 bp, Homo sapiens
gcagaatcctgggcccc

SEQ ID NO: 2917903 - DNA, 20 bp, Homo sapiens
gcagaatcctgggcccccag

SEQ ID NO: 2917904 - DNA, 20 bp, Homo sapiens
gcagaattttaatgtgaaga

SEQ ID NO: 2917905 - DNA, 15 bp, Homo sapiens
gcagacagctccacc

SEQ ID NO: 2917906 - DNA, 19 bp, Homo sapiens
gcagaccttactcagggga

SEQ ID NO: 2917907 - DNA, 15 bp, Homo sapiens
gcagacgtctggccc

SEQ ID NO: 2917908 - DNA, 16 bp, Homo sapiens
gcagactcagctctga

SEQ ID NO: 2917909 - DNA, 18 bp, Homo sapiens
gcagactgatcaggacct

SEQ ID NO: 2917910 - DNA, 20 bp, Homo sapiens
gcagactgcttggccagatg

SEQ ID NO: 2917911 - DNA, 15 bp, Homo sapiens
gcagacttcccagct

SEQ ID NO: 2917912 - DNA, 18 bp, Homo sapiens
gcagacttcccagctagg

SEQ ID NO: 2917913 - DNA, 15 bp, Homo sapiens
gcagagaggtggcca

SEQ ID NO: 2917914 - DNA, 16 bp, Homo sapiens
gcagagaggtggccac

SEQ ID NO: 2917915 - DNA, 16 bp, Homo sapiens
gcagagataaataaaa

SEQ ID NO: 2917916 - DNA, 20 bp, Homo sapiens
gcagagatatttcttcagga

SEQ ID NO: 2917917 - DNA, 21 bp, Homo sapiens
gcagagcagtgggcctggcca

SEQ ID NO: 2917918 - DNA, 14 bp, Homo sapiens
gcagagcgggaggg

SEQ ID NO: 2917919 - DNA, 19 bp, Homo sapiens
gcagagctgagggccctgt

SEQ ID NO: 2917920 - DNA, 16 bp, Homo sapiens
gcagagcttcttccag

SEQ ID NO: 2917921 - DNA, 22 bp, Homo sapiens
gcagagcttcttccaggtgccc

SEQ ID NO: 2917922 - DNA, 17 bp, Homo sapiens
gcagaggaccagggcct

SEQ ID NO: 2917923 - DNA, 12 bp, Homo sapiens
gcagaggagccc

SEQ ID NO: 2917924 - DNA, 17 bp, Homo sapiens
gcagaggcagtggccac

SEQ ID NO: 2917925 - DNA, 22 bp, Homo sapiens
gcagaggctggaggcagggcct

SEQ ID NO: 2917926 - DNA, 16 bp, Homo sapiens
gcagagggcagaggct

SEQ ID NO: 2917927 - DNA, 18 bp, Homo sapiens
gcagagggctggaggccc

SEQ ID NO: 2917928 - DNA, 24 bp, Homo sapiens
gcagagggctggaggcccaggctg

SEQ ID NO: 2917929 - DNA, 15 bp, Homo sapiens
gcagagggctttcag

SEQ ID NO: 2917930 - DNA, 14 bp, Homo sapiens
gcagaggtaccctg

SEQ ID NO: 2917931 - DNA, 17 bp, Homo sapiens
gcagaggtaccctgggt

SEQ ID NO: 2917932 - DNA, 18 bp, Homo sapiens
gcagaggtaccctgggtg

SEQ ID NO: 2917933 - DNA, 21 bp, Homo sapiens
gcagaggttgcagtgagctga

SEQ ID NO: 2917934 - DNA, 18 bp, Homo sapiens
gcagagtggcctagagca

SEQ ID NO: 2917935 - DNA, 14 bp, Homo sapiens
gcagagttctttgc

SEQ ID NO: 2917936 - DNA, 19 bp, Homo sapiens
gcagagttctttgcaagct

SEQ ID NO: 2917937 - DNA, 22 bp, Homo sapiens
gcagataaacagaaatgctctg

SEQ ID NO: 2917938 - DNA, 15 bp, Homo sapiens
gcagatccaggacta

SEQ ID NO: 2917939 - DNA, 12 bp, Homo sapiens
gcagatctcatg

SEQ ID NO: 2917940 - DNA, 17 bp, Homo sapiens
gcagatctcatgtcctc

SEQ ID NO: 2917941 - DNA, 21 bp, Homo sapiens
gcagatgacaagatggtacaa

SEQ ID NO: 2917942 - DNA, 19 bp, Homo sapiens
gcagatgcaaagaggcaag

SEQ ID NO: 2917943 - DNA, 14 bp, Homo sapiens
gcagattggaagga

SEQ ID NO: 2917944 - DNA, 19 bp, Homo sapiens
gcagatttctgccttgaaa

SEQ ID NO: 2917945 - DNA, 17 bp, Homo sapiens
gcagattttcctaaggc

SEQ ID NO: 2917946 - DNA, 19 bp, Homo sapiens
gcagattttgcccttgaca

SEQ ID NO: 2917947 - DNA, 17 bp, Homo sapiens
gcagcaccgttctgtgc

SEQ ID NO: 2917948 - DNA, 15 bp, Homo sapiens
gcagcacggcccggc

SEQ ID NO: 2917949 - DNA, 21 bp, Homo sapiens
gcagcacggcccggcccctca

SEQ ID NO: 2917950 - DNA, 12 bp, Homo sapiens
gcagcagagagc

SEQ ID NO: 2917951 - DNA, 23 bp, Homo sapiens
gcagcagattggaaggagacaca

SEQ ID NO: 2917952 - DNA, 16 bp, Homo sapiens
gcagcaggaggccagg

SEQ ID NO: 2917953 - DNA, 20 bp, Homo sapiens
gcagcagggctaccctgagc

SEQ ID NO: 2917954 - DNA, 21 bp, Homo sapiens
gcagcagtgtgaggccagggc

SEQ ID NO: 2917955 - DNA, 22 bp, Homo sapiens
gcagcagtgtgaggccagggca

SEQ ID NO: 2917956 - DNA, 17 bp, Homo sapiens
gcagcagttgaggtggg

SEQ ID NO: 2917957 - DNA, 19 bp, Homo sapiens
gcagcattccatgaccaga

SEQ ID NO: 2917958 - DNA, 13 bp, Homo sapiens
gcagccaagctcc

SEQ ID NO: 2917959 - DNA, 17 bp, Homo sapiens
gcagccaagctccttgg

SEQ ID NO: 2917960 - DNA, 14 bp, Homo sapiens
gcagccacacgcag

SEQ ID NO: 2917961 - DNA, 14 bp, Homo sapiens
gcagccagaggcac

SEQ ID NO: 2917962 - DNA, 12 bp, Homo sapiens
gcagccaggaga

SEQ ID NO: 2917963 - DNA, 15 bp, Homo sapiens
gcagccaggagggac

SEQ ID NO: 2917964 - DNA, 20 bp, Homo sapiens
gcagccaggccactggcccc

SEQ ID NO: 2917965 - DNA, 14 bp, Homo sapiens
gcagccaggcctcg

SEQ ID NO: 2917966 - DNA, 16 bp, Homo sapiens
gcagccaggcctcgcc

SEQ ID NO: 2917967 - DNA, 19 bp, Homo sapiens
gcagccaggcctcgcctgc

SEQ ID NO: 2917968 - DNA, 21 bp, Homo sapiens
gcagccaggcctcgcctgccc

SEQ ID NO: 2917969 - DNA, 15 bp, Homo sapiens
gcagccatgagaaca

SEQ ID NO: 2917970 - DNA, 13 bp, Homo sapiens
gcagcccaccagg

SEQ ID NO: 2917971 - DNA, 15 bp, Homo sapiens
gcagcccaccaggag

SEQ ID NO: 2917972 - DNA, 18 bp, Homo sapiens
gcagcccatttctccaga

SEQ ID NO: 2917973 - DNA, 22 bp, Homo sapiens
gcagccccagcaccaccaggtc

SEQ ID NO: 2917974 - DNA, 17 bp, Homo sapiens
gcagccccatctgtgca

SEQ ID NO: 2917975 - DNA, 18 bp, Homo sapiens
gcagcccccgcgccctcc

SEQ ID NO: 2917976 - DNA, 13 bp, Homo sapiens
gcagcccctgcag

SEQ ID NO: 2917977 - DNA, 19 bp, Homo sapiens
gcagccctccatggtcctg

SEQ ID NO: 2917978 - DNA, 24 bp, Homo sapiens
gcagccctccatggtcctgtctgt

SEQ ID NO: 2917979 - DNA, 18 bp, Homo sapiens
gcagccctcctcaccccg

SEQ ID NO: 2917980 - DNA, 10 bp, Homo sapiens
gcagccctct

SEQ ID NO: 2917981 - DNA, 13 bp, Homo sapiens
gcagccctctgcc

SEQ ID NO: 2917982 - DNA, 13 bp, Homo sapiens
gcagccctgccag

SEQ ID NO: 2917983 - DNA, 18 bp, Homo sapiens
gcagccggagggaggcac

SEQ ID NO: 2917984 - DNA, 18 bp, Homo sapiens
gcagccgtttgagaagaa

SEQ ID NO: 2917985 - DNA, 14 bp, Homo sapiens
gcagcctcgcacag

SEQ ID NO: 2917986 - DNA, 13 bp, Homo sapiens
gcatgccaggacc

SEQ ID NO: 2917987 - DNA, 22 bp, Homo sapiens
gcatgcctgtaatcccagaact

SEQ ID NO: 2917988 - DNA, 19 bp, Homo sapiens
gcatgcctgtagtctcagc

SEQ ID NO: 2917989 - DNA, 22 bp, Homo sapiens
gcatgcctgtagtctcagctag

SEQ ID NO: 2917990 - DNA, 14 bp, Homo sapiens
gcatgctctctgca

SEQ ID NO: 2917991 - DNA, 15 bp, Homo sapiens
gcatgctctctgcag

SEQ ID NO: 2917992 - DNA, 17 bp, Homo sapiens
gcatgctctctgcagcc

SEQ ID NO: 2917993 - DNA, 21 bp, Homo sapiens
gcatggaaggggcttctggac

SEQ ID NO: 2917994 - DNA, 11 bp, Homo sapiens
gcatggaagtt

SEQ ID NO: 2917995 - DNA, 11 bp, Homo sapiens
gcatggacagt

SEQ ID NO: 2917996 - DNA, 15 bp, Homo sapiens
gcatggagtgtttga

SEQ ID NO: 2917997 - DNA, 14 bp, Homo sapiens
gcatggcagctggg

SEQ ID NO: 2917998 - DNA, 20 bp, Homo sapiens
gcatggcagctgggcccaca

SEQ ID NO: 2917999 - DNA, 17 bp, Homo sapiens
gcatgggaatacaaaag

SEQ ID NO: 2918000 - DNA, 17 bp, Homo sapiens
gcatgggtcgggagagg

SEQ ID NO: 2918001 - DNA, 18 bp, Homo sapiens
gcatggtcacacactgat

SEQ ID NO: 2918002 - DNA, 15 bp, Homo sapiens
gcatggtggcaccag

SEQ ID NO: 2918003 - DNA, 16 bp, Homo sapiens
gcatggtggccagagg

SEQ ID NO: 2918004 - DNA, 20 bp, Homo sapiens
gcatgtaaaatcttcagctg

SEQ ID NO: 2918005 - DNA, 22 bp, Homo sapiens
gcatgtaaaatcttcagctggt

SEQ ID NO: 2918006 - DNA, 15 bp, Homo sapiens
gcatgtaaacacgcc

SEQ ID NO: 2918007 - DNA, 21 bp, Homo sapiens
gcatgtagccagttaaggaaa

SEQ ID NO: 2918008 - DNA, 22 bp, Homo sapiens
gcatgtagccagttaaggaaag

SEQ ID NO: 2918009 - DNA, 14 bp, Homo sapiens
gcatgtaggagaat

SEQ ID NO: 2918010 - DNA, 15 bp, Homo sapiens
gcatgtaggagaatc

SEQ ID NO: 2918011 - DNA, 21 bp, Homo sapiens
gcatgtcaaacatgagatgtg

SEQ ID NO: 2918012 - DNA, 17 bp, Homo sapiens
gcatgtctctgcttcca

SEQ ID NO: 2918013 - DNA, 22 bp, Homo sapiens
gcatgtctctgcttccatggct

SEQ ID NO: 2918014 - DNA, 15 bp, Homo sapiens
gcatgtctgcctgga

SEQ ID NO: 2918015 - DNA, 16 bp, Homo sapiens
gcatgtctgcctggag

SEQ ID NO: 2918016 - DNA, 14 bp, Homo sapiens
gcatgtcttttaaa

SEQ ID NO: 2918017 - DNA, 20 bp, Homo sapiens
gcatgtgactctgaagctga

SEQ ID NO: 2918018 - DNA, 15 bp, Homo sapiens
gcatgtgcgtggaag

SEQ ID NO: 2918019 - DNA, 16 bp, Homo sapiens
gcatgtgggttgtgat

SEQ ID NO: 2918020 - DNA, 21 bp, Homo sapiens
gcatgttactacagaggaaag

SEQ ID NO: 2918021 - DNA, 18 bp, Homo sapiens
gcatgtttaatgtgaact

SEQ ID NO: 2918022 - DNA, 16 bp, Homo sapiens
gcatgtttaattgtga

SEQ ID NO: 2918023 - DNA, 15 bp, Homo sapiens
gcatgtttgctgttc

SEQ ID NO: 2918024 - DNA, 17 bp, Homo sapiens
gcattaaaataactatc

SEQ ID NO: 2918025 - DNA, 18 bp, Homo sapiens
gcattaaattcacaaact

SEQ ID NO: 2918026 - DNA, 22 bp, Homo sapiens
gcattaaattcacaaactttta

SEQ ID NO: 2918027 - DNA, 22 bp, Homo sapiens
gcattaataatagttatttctt

SEQ ID NO: 2918028 - DNA, 19 bp, Homo sapiens
gcattaattgttccttgct

SEQ ID NO: 2918029 - DNA, 19 bp, Homo sapiens
gcattacgataaacattaa

SEQ ID NO: 2918030 - DNA, 15 bp, Homo sapiens
gcattactttatagc

SEQ ID NO: 2918031 - DNA, 17 bp, Homo sapiens
gcattattgacgaactg

SEQ ID NO: 2918032 - DNA, 14 bp, Homo sapiens
gcattatttacaaa

SEQ ID NO: 2918033 - DNA, 16 bp, Homo sapiens
gcattatttacaaaaa

SEQ ID NO: 2918034 - DNA, 15 bp, Homo sapiens
gcattattttttgtt

SEQ ID NO: 2918035 - DNA, 20 bp, Homo sapiens
gcattcaaaaagacagcaga

SEQ ID NO: 2918036 - DNA, 21 bp, Homo sapiens
gcattcaaccacgcaggaagc

SEQ ID NO: 2918037 - DNA, 11 bp, Homo sapiens
gcattcatgtt

SEQ ID NO: 2918038 - DNA, 17 bp, Homo sapiens
gcattccaacaaagggt

SEQ ID NO: 2918039 - DNA, 11 bp, Homo sapiens
gcattccacag

SEQ ID NO: 2918040 - DNA, 21 bp, Homo sapiens
gcattcctgatatgatttaaa

SEQ ID NO: 2918041 - DNA, 19 bp, Homo sapiens
gcattcctgtaacttttaa

SEQ ID NO: 2918042 - DNA, 21 bp, Homo sapiens
gcattcctgtaacttttaatc

SEQ ID NO: 2918043 - DNA, 16 bp, Homo sapiens
gcattctacacctgga

SEQ ID NO: 2918044 - DNA, 23 bp, Homo sapiens
gcattctatcgttattataaatg

SEQ ID NO: 2918045 - DNA, 15 bp, Homo sapiens
gcattctcagccaca

SEQ ID NO: 2918046 - DNA, 17 bp, Homo sapiens
gcattctgataggaggg

SEQ ID NO: 2918047 - DNA, 16 bp, Homo sapiens
gcattctggagacaga

SEQ ID NO: 2918048 - DNA, 18 bp, Homo sapiens
gcattgaacacaaactgt

SEQ ID NO: 2918049 - DNA, 13 bp, Homo sapiens
gcattgacattat

SEQ ID NO: 2918050 - DNA, 22 bp, Homo sapiens
gcattgaccgcgactaatttca

SEQ ID NO: 2918051 - DNA, 23 bp, Homo sapiens
gcattgaccgcgactaatttcaa

SEQ ID NO: 2918052 - DNA, 17 bp, Homo sapiens
gcattgatattgtgaac

SEQ ID NO: 2918053 - DNA, 16 bp, Homo sapiens
gcattgattcagtatt

SEQ ID NO: 2918054 - DNA, 16 bp, Homo sapiens
gcattgccaagggctt

SEQ ID NO: 2918055 - DNA, 12 bp, Homo sapiens
gcattgctttct

SEQ ID NO: 2918056 - DNA, 13 bp, Homo sapiens
gcattgctttctg

SEQ ID NO: 2918057 - DNA, 18 bp, Homo sapiens
gcattggatacagcagta

SEQ ID NO: 2918058 - DNA, 13 bp, Homo sapiens
gcattgggatttt

SEQ ID NO: 2918059 - DNA, 14 bp, Homo sapiens
gcattgtctgcaat

SEQ ID NO: 2918060 - DNA, 18 bp, Homo sapiens
gcattgtctgcaatggtg

SEQ ID NO: 2918061 - DNA, 15 bp, Homo sapiens
gcattgttagtttag

SEQ ID NO: 2918062 - DNA, 17 bp, Homo sapiens
gcattgtttctgtgggc

SEQ ID NO: 2918063 - DNA, 22 bp, Homo sapiens
gcatttaccaacatgtatctgt

SEQ ID NO: 2918064 - DNA, 23 bp, Homo sapiens
gcatttagaacgagcctggaagc

SEQ ID NO: 2918065 - DNA, 18 bp, Homo sapiens
gcatttatgtagacattg

SEQ ID NO: 2918066 - DNA, 16 bp, Homo sapiens
gcatttattgcagttt

SEQ ID NO: 2918067 - DNA, 16 bp, Homo sapiens
gcatttcaaagccctg

SEQ ID NO: 2918068 - DNA, 17 bp, Homo sapiens
gcatttcaaagccctgc

SEQ ID NO: 2918069 - DNA, 22 bp, Homo sapiens
gcatttcaaagccctgcctctg

SEQ ID NO: 2918070 - DNA, 19 bp, Homo sapiens
gcatttggaaccaaagtct

SEQ ID NO: 2918071 - DNA, 22 bp, Homo sapiens
gcatttggattggggtccctct

SEQ ID NO: 2918072 - DNA, 23 bp, Homo sapiens
gcatttgtgtgtgtgtgtgtgtt

SEQ ID NO: 2918073 - DNA, 20 bp, Homo sapiens
gcattttctaagtgggacat

SEQ ID NO: 2918074 - DNA, 15 bp, Homo sapiens
gcattttgacaacat

SEQ ID NO: 2918075 - DNA, 16 bp, Homo sapiens
gcattttgtgtacagt

SEQ ID NO: 2918076 - DNA, 21 bp, Homo sapiens
gcatttttaaaggacaaacag

SEQ ID NO: 2918077 - DNA, 16 bp, Homo sapiens
gcatttttagctcctt

SEQ ID NO: 2918078 - DNA, 14 bp, Homo sapiens
gccaaaacatttat

SEQ ID NO: 2918079 - DNA, 17 bp, Homo sapiens
gccaaaattcatttcta

SEQ ID NO: 2918080 - DNA, 22 bp, Homo sapiens
gccaaacccctagagacagtga

SEQ ID NO: 2918081 - DNA, 16 bp, Homo sapiens
gccaaacctctgttca

SEQ ID NO: 2918082 - DNA, 17 bp, Homo sapiens
gccaaacctctgttcag

SEQ ID NO: 2918083 - DNA, 19 bp, Homo sapiens
gccaaagagcctttccaaa

SEQ ID NO: 2918084 - DNA, 13 bp, Homo sapiens
gccaaagcagatt

SEQ ID NO: 2918085 - DNA, 18 bp, Homo sapiens
gccaaagcagattttcct

SEQ ID NO: 2918086 - DNA, 16 bp, Homo sapiens
gccaaagttaaatgta

SEQ ID NO: 2918087 - DNA, 21 bp, Homo sapiens
gccaaatagccccagactggg

SEQ ID NO: 2918088 - DNA, 20 bp, Homo sapiens
gccaacaagaatgcattgat

SEQ ID NO: 2918089 - DNA, 17 bp, Homo sapiens
gccaacacgcacctgcc

SEQ ID NO: 2918090 - DNA, 11 bp, Homo sapiens
gccaacagcta

SEQ ID NO: 2918091 - DNA, 14 bp, Homo sapiens
gccaacagctacaa

SEQ ID NO: 2918092 - DNA, 17 bp, Homo sapiens
gccaacagctacaacag

SEQ ID NO: 2918093 - DNA, 18 bp, Homo sapiens
gccaacagctacaacagc

SEQ ID NO: 2918094 - DNA, 14 bp, Homo sapiens
gccaaccagccttt

SEQ ID NO: 2918095 - DNA, 13 bp, Homo sapiens
gccaaccccaccc

SEQ ID NO: 2918096 - DNA, 18 bp, Homo sapiens
gccaacgagattgctgga

SEQ ID NO: 2918097 - DNA, 20 bp, Homo sapiens
gccaactcacaggtgctttt

SEQ ID NO: 2918098 - DNA, 22 bp, Homo sapiens
gccaactctcccaaagggcaca

SEQ ID NO: 2918099 - DNA, 13 bp, Homo sapiens
gccaactgcctcc

SEQ ID NO: 2918100 - DNA, 19 bp, Homo sapiens
gccaactgcctccttgcca

SEQ ID NO: 2918101 - DNA, 13 bp, Homo sapiens
gccaacttgccat

SEQ ID NO: 2918102 - DNA, 15 bp, Homo sapiens
gccaacttgccatgt

SEQ ID NO: 2918103 - DNA, 22 bp, Homo sapiens
gccaagaaacactgcctgccct

SEQ ID NO: 2918104 - DNA, 21 bp, Homo sapiens
gccaagaaacgtcttctaaac

SEQ ID NO: 2918105 - DNA, 19 bp, Homo sapiens
gccaagaaagatgtatata

SEQ ID NO: 2918106 - DNA, 23 bp, Homo sapiens
gccaagaaatcgccttatgagaa

SEQ ID NO: 2918107 - DNA, 12 bp, Homo sapiens
gccaagagaagg

SEQ ID NO: 2918108 - DNA, 12 bp, Homo sapiens
gccaagaggctg

SEQ ID NO: 2918109 - DNA, 21 bp, Homo sapiens
gccaagcacagtggtggcagg

SEQ ID NO: 2918110 - DNA, 15 bp, Homo sapiens
gccaagccccatcct

SEQ ID NO: 2918111 - DNA, 16 bp, Homo sapiens
gccaagctccttggga

SEQ ID NO: 2918112 - DNA, 17 bp, Homo sapiens
gccaagctccttgggag

SEQ ID NO: 2918113 - DNA, 19 bp, Homo sapiens
gccaagctccttgggaggc

SEQ ID NO: 2918114 - DNA, 16 bp, Homo sapiens
gccaagctgtgttcat

SEQ ID NO: 2918115 - DNA, 17 bp, Homo sapiens
gccaagctgtgttcatc

SEQ ID NO: 2918116 - DNA, 23 bp, Homo sapiens
gccaaggagaggagttctttggc

SEQ ID NO: 2918117 - DNA, 16 bp, Homo sapiens
gccaaggagctgctat

SEQ ID NO: 2918118 - DNA, 19 bp, Homo sapiens
gcccagtgggctgcacgct

SEQ ID NO: 2918119 - DNA, 19 bp, Homo sapiens
gcccagttcaccctgattt

SEQ ID NO: 2918120 - DNA, 21 bp, Homo sapiens
gcccatacccgtgacagtggc

SEQ ID NO: 2918121 - DNA, 22 bp, Homo sapiens
gcccatacccgtgacagtggct

SEQ ID NO: 2918122 - DNA, 23 bp, Homo sapiens
gcccatataaaatgctgatattt

SEQ ID NO: 2918123 - DNA, 14 bp, Homo sapiens
gcccatcagtgcca

SEQ ID NO: 2918124 - DNA, 13 bp, Homo sapiens
gcccatcatctct

SEQ ID NO: 2918125 - DNA, 17 bp, Homo sapiens
gcccatcatctctgcct

SEQ ID NO: 2918126 - DNA, 20 bp, Homo sapiens
gcccatccatagtaactgac

SEQ ID NO: 2918127 - DNA, 18 bp, Homo sapiens
gcccatctgtccatcctc

SEQ ID NO: 2918128 - DNA, 22 bp, Homo sapiens
gcccatctgtccatcctcctct

SEQ ID NO: 2918129 - DNA, 13 bp, Homo sapiens
gcccatgaatttg

SEQ ID NO: 2918130 - DNA, 13 bp, Homo sapiens
gcccatggaagtc

SEQ ID NO: 2918131 - DNA, 21 bp, Homo sapiens
gcccatggacaggctggctcc

SEQ ID NO: 2918132 - DNA, 23 bp, Homo sapiens
gcccatggacaggctggctccag

SEQ ID NO: 2918133 - DNA, 15 bp, Homo sapiens
gcccatggaggagac

SEQ ID NO: 2918134 - DNA, 17 bp, Homo sapiens
gcccattctctctcctg

SEQ ID NO: 2918135 - DNA, 21 bp, Homo sapiens
gcccattctctctcctgtcca

SEQ ID NO: 2918136 - DNA, 22 bp, Homo sapiens
gcccatttcgtgagccccatct

SEQ ID NO: 2918137 - DNA, 16 bp, Homo sapiens
gcccatttctccagaa

SEQ ID NO: 2918138 - DNA, 22 bp, Homo sapiens
gccccaaagtaaaagaaaccac

SEQ ID NO: 2918139 - DNA, 16 bp, Homo sapiens
gccccaactcctggaa

SEQ ID NO: 2918140 - DNA, 18 bp, Homo sapiens
gccccaatccctttatta

SEQ ID NO: 2918141 - DNA, 23 bp, Homo sapiens
gccccacatgtccagcaccttgt

SEQ ID NO: 2918142 - DNA, 23 bp, Homo sapiens
gccccaccacctaggccactcct

SEQ ID NO: 2918143 - DNA, 14 bp, Homo sapiens
gccccactctgcct

SEQ ID NO: 2918144 - DNA, 18 bp, Homo sapiens
gccccactgcccttctca

SEQ ID NO: 2918145 - DNA, 13 bp, Homo sapiens
gccccactgggga

SEQ ID NO: 2918146 - DNA, 15 bp, Homo sapiens
gccccactggggaaa

SEQ ID NO: 2918147 - DNA, 24 bp, Homo sapiens
gccccagactgagctctccaggcc

SEQ ID NO: 2918148 - DNA, 20 bp, Homo sapiens
gccccagactgggcccaggc

SEQ ID NO: 2918149 - DNA, 21 bp, Homo sapiens
gccccagactgggcccaggca

SEQ ID NO: 2918150 - DNA, 19 bp, Homo sapiens
gccccagcaccaccaggtc

SEQ ID NO: 2918151 - DNA, 12 bp, Homo sapiens
gccccaggacca

SEQ ID NO: 2918152 - DNA, 15 bp, Homo sapiens
gccccaggaccagct

SEQ ID NO: 2918153 - DNA, 21 bp, Homo sapiens
gccccaggacctggctgccat

SEQ ID NO: 2918154 - DNA, 21 bp, Homo sapiens
gccccaggcagggccaaccct

SEQ ID NO: 2918155 - DNA, 22 bp, Homo sapiens
gccccaggcagggccaaccctt

SEQ ID NO: 2918156 - DNA, 15 bp, Homo sapiens
gccccaggccggagc

SEQ ID NO: 2918157 - DNA, 16 bp, Homo sapiens
gccccaggccggagcc

SEQ ID NO: 2918158 - DNA, 18 bp, Homo sapiens
gccccaggccggagccca

SEQ ID NO: 2918159 - DNA, 20 bp, Homo sapiens
gccccaggccggagcccaga

SEQ ID NO: 2918160 - DNA, 13 bp, Homo sapiens
gccccaggggacg

SEQ ID NO: 2918161 - DNA, 14 bp, Homo sapiens
gccccaggggacgt

SEQ ID NO: 2918162 - DNA, 17 bp, Homo sapiens
gccccaggggacgtggg

SEQ ID NO: 2918163 - DNA, 23 bp, Homo sapiens
gccccaggggacgtgggccctgc

SEQ ID NO: 2918164 - DNA, 20 bp, Homo sapiens
gccccagtcagaagttctgg

SEQ ID NO: 2918165 - DNA, 14 bp, Homo sapiens
gccccagtgacagc

SEQ ID NO: 2918166 - DNA, 18 bp, Homo sapiens
gccccatcctccagcagg

SEQ ID NO: 2918167 - DNA, 16 bp, Homo sapiens
gccccatcgccccacc

SEQ ID NO: 2918168 - DNA, 15 bp, Homo sapiens
gccccatctgtgcat

SEQ ID NO: 2918169 - DNA, 19 bp, Homo sapiens
gccccatgaagccacagcc

SEQ ID NO: 2918170 - DNA, 15 bp, Homo sapiens
gccccatgtctctca

SEQ ID NO: 2918171 - DNA, 18 bp, Homo sapiens
gccccatgtctctcagaa

SEQ ID NO: 2918172 - DNA, 15 bp, Homo sapiens
gccccattcctggga

SEQ ID NO: 2918173 - DNA, 19 bp, Homo sapiens
gcccccaaagcagcccttc

SEQ ID NO: 2918174 - DNA, 15 bp, Homo sapiens
gcccccaccgggctg

SEQ ID NO: 2918175 - DNA, 17 bp, Homo sapiens
gcccccaccgggctgca

SEQ ID NO: 2918176 - DNA, 18 bp, Homo sapiens
gcccccaccgtgggcagg

SEQ ID NO: 2918177 - DNA, 12 bp, Homo sapiens
gcccccactgac

SEQ ID NO: 2918178 - DNA, 17 bp, Homo sapiens
gcccccactgaccagaa

SEQ ID NO: 2918179 - DNA, 12 bp, Homo sapiens
gcccccagctgg

SEQ ID NO: 2918180 - DNA, 15 bp, Homo sapiens
gcccccagctggccc

SEQ ID NO: 2918181 - DNA, 12 bp, Homo sapiens
gcccccaggcct

SEQ ID NO: 2918182 - DNA, 20 bp, Homo sapiens
gcccccaggcctgccctgct

SEQ ID NO: 2918183 - DNA, 18 bp, Homo sapiens
gcccccatctcatgcccc

SEQ ID NO: 2918184 - DNA, 13 bp, Homo sapiens
gccccccagggct

SEQ ID NO: 2918185 - DNA, 16 bp, Homo sapiens
gcccccccccacccct

SEQ ID NO: 2918186 - DNA, 14 bp, Homo sapiens
gcccccctcccaga

SEQ ID NO: 2918187 - DNA, 14 bp, Homo sapiens
gcccccctgccctg

SEQ ID NO: 2918188 - DNA, 16 bp, Homo sapiens
gcccccgacggctgtg

SEQ ID NO: 2918189 - DNA, 18 bp, Homo sapiens
gcccccgcgatgccctgg

SEQ ID NO: 2918190 - DNA, 20 bp, Homo sapiens
gcccccgcgccctccctccg

SEQ ID NO: 2918191 - DNA, 18 bp, Homo sapiens
gcccccgggccgacggag

SEQ ID NO: 2918192 - DNA, 14 bp, Homo sapiens
gccccctcagctct

SEQ ID NO: 2918193 - DNA, 15 bp, Homo sapiens
gccccctctcaggag

SEQ ID NO: 2918194 - DNA, 14 bp, Homo sapiens
gccccctgccctcc

SEQ ID NO: 2918195 - DNA, 11 bp, Homo sapiens
gccccctggca

SEQ ID NO: 2918196 - DNA, 15 bp, Homo sapiens
gccccctggcagctg

SEQ ID NO: 2918197 - DNA, 16 bp, Homo sapiens
gccccctggcagctgc

SEQ ID NO: 2918198 - DNA, 13 bp, Homo sapiens
gccccctggcctc

SEQ ID NO: 2918199 - DNA, 13 bp, Homo sapiens
gccccgccctcag

SEQ ID NO: 2918200 - DNA, 14 bp, Homo sapiens
gccccgccctcagg

SEQ ID NO: 2918201 - DNA, 13 bp, Homo sapiens
gccccgccgcctg

SEQ ID NO: 2918202 - DNA, 22 bp, Homo sapiens
gccccgcgggctttgttgctgg

SEQ ID NO: 2918203 - DNA, 15 bp, Homo sapiens
gccccgctcccacct

SEQ ID NO: 2918204 - DNA, 18 bp, Homo sapiens
gccccgctgtgtcctccc

SEQ ID NO: 2918205 - DNA, 21 bp, Homo sapiens
gccccgctgtgtcctccctcc

SEQ ID NO: 2918206 - DNA, 14 bp, Homo sapiens
gccccgcttgtcca

SEQ ID NO: 2918207 - DNA, 19 bp, Homo sapiens
gccccggcaactctggctc

SEQ ID NO: 2918208 - DNA, 17 bp, Homo sapiens
gccccgggctggccctg

SEQ ID NO: 2918209 - DNA, 18 bp, Homo sapiens
gccccgggctggccctgt

SEQ ID NO: 2918210 - DNA, 22 bp, Homo sapiens
gccccgggctggccctgtgcag

SEQ ID NO: 2918211 - DNA, 14 bp, Homo sapiens
gccccgtctctgtt

SEQ ID NO: 2918212 - DNA, 13 bp, Homo sapiens
gcccctacccctg

SEQ ID NO: 2918213 - DNA, 19 bp, Homo sapiens
gcccctacccctgccctgc

SEQ ID NO: 2918214 - DNA, 20 bp, Homo sapiens
gcccctacccctgccctgct

SEQ ID NO: 2918215 - DNA, 13 bp, Homo sapiens
gcccctcaccctc

SEQ ID NO: 2918216 - DNA, 18 bp, Homo sapiens
gcccctcaccctctgtcc

SEQ ID NO: 2918217 - DNA, 18 bp, Homo sapiens
gcccctcaggggaagctg

SEQ ID NO: 2918218 - DNA, 20 bp, Homo sapiens
gcccctcaggggaagctgct

SEQ ID NO: 2918219 - DNA, 21 bp, Homo sapiens
gcccctcatctctctgcccaa

SEQ ID NO: 2918220 - DNA, 18 bp, Homo sapiens
gcccctccaatcctcccc

SEQ ID NO: 2918221 - DNA, 23 bp, Homo sapiens
gcccctcccacacccaaagctga

SEQ ID NO: 2918222 - DNA, 18 bp, Homo sapiens
gcccctcccacagcgctg

SEQ ID NO: 2918223 - DNA, 20 bp, Homo sapiens
gcccctccccctaccgcatg

SEQ ID NO: 2918224 - DNA, 22 bp, Homo sapiens
gcccctccccctaccgcatggc

SEQ ID NO: 2918225 - DNA, 13 bp, Homo sapiens
gcccctcccctca

SEQ ID NO: 2918226 - DNA, 15 bp, Homo sapiens
gcccctcccctcaga

SEQ ID NO: 2918227 - DNA, 20 bp, Homo sapiens
gcccctccctagatccaggc

SEQ ID NO: 2918228 - DNA, 13 bp, Homo sapiens
gcccctcctctgc

SEQ ID NO: 2918229 - DNA, 16 bp, Homo sapiens
gcccctcctctgccac

SEQ ID NO: 2918230 - DNA, 22 bp, Homo sapiens
gcccctcctctgccacctcccc

SEQ ID NO: 2918231 - DNA, 13 bp, Homo sapiens
gcccctcggctct

SEQ ID NO: 2918232 - DNA, 12 bp, Homo sapiens
gcccctctcctc

SEQ ID NO: 2918233 - DNA, 19 bp, Homo sapiens
gcccctgaggcttcacgcc

SEQ ID NO: 2918234 - DNA, 20 bp, Homo sapiens
gcccctgagtccgcctgcgc

SEQ ID NO: 2918235 - DNA, 22 bp, Homo sapiens
gcccctgagtccgcctgcgcct

SEQ ID NO: 2918236 - DNA, 22 bp, Homo sapiens
gcccctgcagacgtctggccct

SEQ ID NO: 2918237 - DNA, 10 bp, Homo sapiens
gcccctgctg

SEQ ID NO: 2918238 - DNA, 22 bp, Homo sapiens
gcccctgctgctgtcacctctc

SEQ ID NO: 2918239 - DNA, 17 bp, Homo sapiens
gcccctgctgtctctct

SEQ ID NO: 2918240 - DNA, 20 bp, Homo sapiens
gcccctggaacctttccctt

SEQ ID NO: 2918241 - DNA, 23 bp, Homo sapiens
gcccctggaacctttcccttgtg

SEQ ID NO: 2918242 - DNA, 13 bp, Homo sapiens
gcccctggcactc

SEQ ID NO: 2918243 - DNA, 11 bp, Homo sapiens
gcccctggccc

SEQ ID NO: 2918244 - DNA, 18 bp, Homo sapiens
gcccctggccccgcctgc

SEQ ID NO: 2918245 - DNA, 19 bp, Homo sapiens
gcccctggccccgcctgcc

SEQ ID NO: 2918246 - DNA, 20 bp, Homo sapiens
gcccctggccccgcctgcct

SEQ ID NO: 2918247 - DNA, 12 bp, Homo sapiens
gcccctggctgg

SEQ ID NO: 2918248 - DNA, 23 bp, Homo sapiens
gcccctggctgggacgtggctca

SEQ ID NO: 2918249 - DNA, 18 bp, Homo sapiens
gcccctggtaagcagagg

SEQ ID NO: 2918250 - DNA, 23 bp, Homo sapiens
gcctagctcttgggcctgacctc

SEQ ID NO: 2918251 - DNA, 15 bp, Homo sapiens
gcctaggattctaaa

SEQ ID NO: 2918252 - DNA, 14 bp, Homo sapiens
gcctaggatttcag

SEQ ID NO: 2918253 - DNA, 16 bp, Homo sapiens
gcctaggggccagggc

SEQ ID NO: 2918254 - DNA, 17 bp, Homo sapiens
gcctaggtgcagctcct

SEQ ID NO: 2918255 - DNA, 19 bp, Homo sapiens
gcctagtgaaggcttctct

SEQ ID NO: 2918256 - DNA, 22 bp, Homo sapiens
gcctagtgaaggcttctctctg

SEQ ID NO: 2918257 - DNA, 18 bp, Homo sapiens
gcctagtggggtctccct

SEQ ID NO: 2918258 - DNA, 15 bp, Homo sapiens
gcctataatcccagc

SEQ ID NO: 2918259 - DNA, 16 bp, Homo sapiens
gcctataatcccagct

SEQ ID NO: 2918260 - DNA, 21 bp, Homo sapiens
gcctatctaatttctttagtt

SEQ ID NO: 2918261 - DNA, 21 bp, Homo sapiens
gcctatctcctagggctatgg

SEQ ID NO: 2918262 - DNA, 23 bp, Homo sapiens
gcctatgcaaaaagaggatccgt

SEQ ID NO: 2918263 - DNA, 22 bp, Homo sapiens
gcctatgcacatatggactctg

SEQ ID NO: 2918264 - DNA, 16 bp, Homo sapiens
gcctcaacctcctggg

SEQ ID NO: 2918265 - DNA, 18 bp, Homo sapiens
gcctcaagaggaatgaaa

SEQ ID NO: 2918266 - DNA, 21 bp, Homo sapiens
gcctcaagccatcttcccgcc

SEQ ID NO: 2918267 - DNA, 20 bp, Homo sapiens
gcctcaaggttttaggttct

SEQ ID NO: 2918268 - DNA, 15 bp, Homo sapiens
gcctcacagatgctg

SEQ ID NO: 2918269 - DNA, 16 bp, Homo sapiens
gcctcacagatgctgg

SEQ ID NO: 2918270 - DNA, 17 bp, Homo sapiens
gcctcacagatgctggc

SEQ ID NO: 2918271 - DNA, 18 bp, Homo sapiens
gcctcacagatgctggcc

SEQ ID NO: 2918272 - DNA, 21 bp, Homo sapiens
gcctcacagatgctggcctct

SEQ ID NO: 2918273 - DNA, 22 bp, Homo sapiens
gcctcacagatgctggcctctt

SEQ ID NO: 2918274 - DNA, 20 bp, Homo sapiens
gcctcactactcgagcccac

SEQ ID NO: 2918275 - DNA, 20 bp, Homo sapiens
gcctcacttctagggtatgg

SEQ ID NO: 2918276 - DNA, 19 bp, Homo sapiens
gcctcacttggtctgccag

SEQ ID NO: 2918277 - DNA, 22 bp, Homo sapiens
gcctcacttttaatgaacaaat

SEQ ID NO: 2918278 - DNA, 23 bp, Homo sapiens
gcctcacttttaatgaacaaatg

SEQ ID NO: 2918279 - DNA, 9 bp, Homo sapiens
gcctcagaa

SEQ ID NO: 2918280 - DNA, 18 bp, Homo sapiens
gcctcagactgcacccag

SEQ ID NO: 2918281 - DNA, 19 bp, Homo sapiens
gcctcagactgcacccagg

SEQ ID NO: 2918282 - DNA, 17 bp, Homo sapiens
gcctcagccctgaccct

SEQ ID NO: 2918283 - DNA, 13 bp, Homo sapiens
gcctcagcctccc

SEQ ID NO: 2918284 - DNA, 16 bp, Homo sapiens
gcctcagcctcccaag

SEQ ID NO: 2918285 - DNA, 16 bp, Homo sapiens
gcctcagcctcctgag

SEQ ID NO: 2918286 - DNA, 18 bp, Homo sapiens
gcctcagcctcctgagta

SEQ ID NO: 2918287 - DNA, 13 bp, Homo sapiens
gcctcagcctctc

SEQ ID NO: 2918288 - DNA, 21 bp, Homo sapiens
gcctcagcggaccactcttct

SEQ ID NO: 2918289 - DNA, 20 bp, Homo sapiens
gcctcaggcactctcctgtc

SEQ ID NO: 2918290 - DNA, 15 bp, Homo sapiens
gcctcagggccagga

SEQ ID NO: 2918291 - DNA, 17 bp, Homo sapiens
gcctcagggtctaagga

SEQ ID NO: 2918292 - DNA, 12 bp, Homo sapiens
gcctcagtgaaa

SEQ ID NO: 2918293 - DNA, 14 bp, Homo sapiens
gcctcatcctcctc

SEQ ID NO: 2918294 - DNA, 15 bp, Homo sapiens
gcctcatcctcctcc

SEQ ID NO: 2918295 - DNA, 12 bp, Homo sapiens
gcctccacactg

SEQ ID NO: 2918296 - DNA, 12 bp, Homo sapiens
gcctccagctca

SEQ ID NO: 2918297 - DNA, 16 bp, Homo sapiens
gcctccagctcagcag

SEQ ID NO: 2918298 - DNA, 15 bp, Homo sapiens
gcctccaggtgcaga

SEQ ID NO: 2918299 - DNA, 17 bp, Homo sapiens
gcctccaggtgcagagg

SEQ ID NO: 2918300 - DNA, 18 bp, Homo sapiens
gcctccaggtgcagaggt

SEQ ID NO: 2918301 - DNA, 12 bp, Homo sapiens
gcctccagtgca

SEQ ID NO: 2918302 - DNA, 15 bp, Homo sapiens
gcctccatcagctaa

SEQ ID NO: 2918303 - DNA, 13 bp, Homo sapiens
gcctccatccatc

SEQ ID NO: 2918304 - DNA, 18 bp, Homo sapiens
gcctccatccatctgtcc

SEQ ID NO: 2918305 - DNA, 19 bp, Homo sapiens
gcctccatccatctgtccg

SEQ ID NO: 2918306 - DNA, 21 bp, Homo sapiens
gcctccatccatctgtccgtc

SEQ ID NO: 2918307 - DNA, 23 bp, Homo sapiens
gcctccatcctaccccctgtgcc

SEQ ID NO: 2918308 - DNA, 16 bp, Homo sapiens
gcctcccaaagtgctg

SEQ ID NO: 2918309 - DNA, 18 bp, Homo sapiens
gcctcccaaagtgctggg

SEQ ID NO: 2918310 - DNA, 18 bp, Homo sapiens
gcctcccagagtgctggg

SEQ ID NO: 2918311 - DNA, 12 bp, Homo sapiens
gcctcccatccc

SEQ ID NO: 2918312 - DNA, 19 bp, Homo sapiens
gcctccccaacttgagcct

SEQ ID NO: 2918313 - DNA, 22 bp, Homo sapiens
gcctccccaatccatttggcag

SEQ ID NO: 2918314 - DNA, 18 bp, Homo sapiens
gcctccccacctccaggc

SEQ ID NO: 2918315 - DNA, 19 bp, Homo sapiens
gcctcccctctccttcctg

SEQ ID NO: 2918316 - DNA, 14 bp, Homo sapiens
gcctcccctgccag

SEQ ID NO: 2918317 - DNA, 23 bp, Homo sapiens
gcctccctagttagcatccaggc

SEQ ID NO: 2918318 - DNA, 13 bp, Homo sapiens
gcctccctcaacc

SEQ ID NO: 2918319 - DNA, 13 bp, Homo sapiens
gcctccctccgtc

SEQ ID NO: 2918320 - DNA, 22 bp, Homo sapiens
gcctccctccgtccctctgtcc

SEQ ID NO: 2918321 - DNA, 18 bp, Homo sapiens
gcctccgcttatcctgct

SEQ ID NO: 2918322 - DNA, 23 bp, Homo sapiens
gcctccgcttatcctgctagcag

SEQ ID NO: 2918323 - DNA, 15 bp, Homo sapiens
gcctcctagcccctt

SEQ ID NO: 2918324 - DNA, 14 bp, Homo sapiens
gcctcctccccagg

SEQ ID NO: 2918325 - DNA, 13 bp, Homo sapiens
gcctcctccctgg

SEQ ID NO: 2918326 - DNA, 15 bp, Homo sapiens
gcctcctccctggct

SEQ ID NO: 2918327 - DNA, 16 bp, Homo sapiens
gcctcctccctggctg

SEQ ID NO: 2918328 - DNA, 20 bp, Homo sapiens
gcctcctccctggctgcagc

SEQ ID NO: 2918329 - DNA, 14 bp, Homo sapiens
gcctcctctctccc

SEQ ID NO: 2918330 - DNA, 15 bp, Homo sapiens
gcctcctctctccct

SEQ ID NO: 2918331 - DNA, 22 bp, Homo sapiens
gcctcctctctccctgcctcac

SEQ ID NO: 2918332 - DNA, 15 bp, Homo sapiens
gcctcctgctctgca

SEQ ID NO: 2918333 - DNA, 15 bp, Homo sapiens
gcctcctggctcagg

SEQ ID NO: 2918334 - DNA, 18 bp, Homo sapiens
gcctcctggctcaggccc

SEQ ID NO: 2918335 - DNA, 14 bp, Homo sapiens
gcctcctgggttca

SEQ ID NO: 2918336 - DNA, 18 bp, Homo sapiens
gcctccttacattaaaaa

SEQ ID NO: 2918337 - DNA, 15 bp, Homo sapiens
gcctccttgccagcc

SEQ ID NO: 2918338 - DNA, 12 bp, Homo sapiens
gcctcctttttt

SEQ ID NO: 2918339 - DNA, 14 bp, Homo sapiens
gcctcgagggccgc

SEQ ID NO: 2918340 - DNA, 18 bp, Homo sapiens
gcctcgagggccgcctgc

SEQ ID NO: 2918341 - DNA, 20 bp, Homo sapiens
gcctcgagggccgcctgcct

SEQ ID NO: 2918342 - DNA, 21 bp, Homo sapiens
gcctcgagggccgcctgcctt

SEQ ID NO: 2918343 - DNA, 22 bp, Homo sapiens
gcctcgagggccgcctgcctta

SEQ ID NO: 2918344 - DNA, 23 bp, Homo sapiens
gcctcgaggtgccttcttcaggg

SEQ ID NO: 2918345 - DNA, 13 bp, Homo sapiens
gcctcgcacaggc

SEQ ID NO: 2918346 - DNA, 20 bp, Homo sapiens
gcctcgcacttgcagaggag

SEQ ID NO: 2918347 - DNA, 17 bp, Homo sapiens
gcctcgcccccactttt

SEQ ID NO: 2918348 - DNA, 16 bp, Homo sapiens
gcctcgccttgtgtta

SEQ ID NO: 2918349 - DNA, 19 bp, Homo sapiens
gcctcggaggctcctccct

SEQ ID NO: 2918350 - DNA, 13 bp, Homo sapiens
gcctcggcccctc

SEQ ID NO: 2918351 - DNA, 15 bp, Homo sapiens
gcctcgtgccagcag

SEQ ID NO: 2918352 - DNA, 16 bp, Homo sapiens
gcctcgtgccagcagc

SEQ ID NO: 2918353 - DNA, 17 bp, Homo sapiens
gcctctaactccctcct

SEQ ID NO: 2918354 - DNA, 18 bp, Homo sapiens
gcctctaactccctcctc

SEQ ID NO: 2918355 - DNA, 20 bp, Homo sapiens
gcctctaactccctcctcac

SEQ ID NO: 2918356 - DNA, 21 bp, Homo sapiens
gcctctaactccctcctcaca

SEQ ID NO: 2918357 - DNA, 18 bp, Homo sapiens
gcctctaggtaaccagtt

SEQ ID NO: 2918358 - DNA, 23 bp, Homo sapiens
gcctctcacctctgtgcctctgt

SEQ ID NO: 2918359 - DNA, 15 bp, Homo sapiens
gcctctcagaaaact

SEQ ID NO: 2918360 - DNA, 23 bp, Homo sapiens
gcctctcctccttgggcagggtc

SEQ ID NO: 2918361 - DNA, 19 bp, Homo sapiens
gcctctctgtacactgccc

SEQ ID NO: 2918362 - DNA, 21 bp, Homo sapiens
gcctctgacagcagcctgtga

SEQ ID NO: 2918363 - DNA, 11 bp, Homo sapiens
gcctctgcctg

SEQ ID NO: 2918364 - DNA, 12 bp, Homo sapiens
gcctctgcctgg

SEQ ID NO: 2918365 - DNA, 14 bp, Homo sapiens
gcctctgcctggga

SEQ ID NO: 2918366 - DNA, 15 bp, Homo sapiens
gcctctgcctgggac

SEQ ID NO: 2918367 - DNA, 22 bp, Homo sapiens
gcctctgggtcagtggtccaca

SEQ ID NO: 2918368 - DNA, 16 bp, Homo sapiens
gcctctgtctagcatg

SEQ ID NO: 2918369 - DNA, 21 bp, Homo sapiens
gcctctgtctagcatgccaac

SEQ ID NO: 2918370 - DNA, 19 bp, Homo sapiens
gcctctgtcttctggactg

SEQ ID NO: 2918371 - DNA, 19 bp, Homo sapiens
gcctctgtgtagccgccct

SEQ ID NO: 2918372 - DNA, 19 bp, Homo sapiens
gcctcttctcttgacagtc

SEQ ID NO: 2918373 - DNA, 22 bp, Homo sapiens
gcctcttctcttgacagtctga

SEQ ID NO: 2918374 - DNA, 16 bp, Homo sapiens
gcctcttggcacctgc

SEQ ID NO: 2918375 - DNA, 23 bp, Homo sapiens
gcctcttgtatccctagtgctcc

SEQ ID NO: 2918376 - DNA, 17 bp, Homo sapiens
gcctctttctgtccctt

SEQ ID NO: 2918377 - DNA, 17 bp, Homo sapiens
gcctcttttcctgaaga

SEQ ID NO: 2918378 - DNA, 19 bp, Homo sapiens
gcctgaacagatgtaaatc

SEQ ID NO: 2918379 - DNA, 16 bp, Homo sapiens
gcctgaactgaggcct

SEQ ID NO: 2918380 - DNA, 18 bp, Homo sapiens
gcctgaaggggcgtctgt

SEQ ID NO: 2918381 - DNA, 23 bp, Homo sapiens
gcctgaataaagagccctaagtt

SEQ ID NO: 2918382 - DNA, 14 bp, Homo sapiens
gcgtgactcaccca

SEQ ID NO: 2918383 - DNA, 22 bp, Homo sapiens
gcgtgactcagcagcctgcgct

SEQ ID NO: 2918384 - DNA, 13 bp, Homo sapiens
gcgtgattctgtt

SEQ ID NO: 2918385 - DNA, 21 bp, Homo sapiens
gcgtgccgggcccccaccgcc

SEQ ID NO: 2918386 - DNA, 21 bp, Homo sapiens
gcgtgcgcatcttgcctccag

SEQ ID NO: 2918387 - DNA, 23 bp, Homo sapiens
gcgtgcgcatcttgcctccaggt

SEQ ID NO: 2918388 - DNA, 21 bp, Homo sapiens
gcgtgctggcgacactcaggg

SEQ ID NO: 2918389 - DNA, 13 bp, Homo sapiens
gcgtggaaaaaga

SEQ ID NO: 2918390 - DNA, 14 bp, Homo sapiens
gcgtggaaaaagac

SEQ ID NO: 2918391 - DNA, 13 bp, Homo sapiens
gcgtggaagtgtt

SEQ ID NO: 2918392 - DNA, 17 bp, Homo sapiens
gcgtggaagtgttcctg

SEQ ID NO: 2918393 - DNA, 16 bp, Homo sapiens
gcgtggagactggcag

SEQ ID NO: 2918394 - DNA, 20 bp, Homo sapiens
gcgtggagggaggccccagg

SEQ ID NO: 2918395 - DNA, 21 bp, Homo sapiens
gcgtggagggaggccccaggg

SEQ ID NO: 2918396 - DNA, 20 bp, Homo sapiens
gcgtggattaaacttatgaa

SEQ ID NO: 2918397 - DNA, 23 bp, Homo sapiens
gcgtggattaaacttatgaatgt

SEQ ID NO: 2918398 - DNA, 15 bp, Homo sapiens
gcgtggcgtggcccg

SEQ ID NO: 2918399 - DNA, 18 bp, Homo sapiens
gcgtgtcaactttcattt

SEQ ID NO: 2918400 - DNA, 17 bp, Homo sapiens
gcgtgtccccggggccc

SEQ ID NO: 2918401 - DNA, 14 bp, Homo sapiens
gcgtgtttgcacgt

SEQ ID NO: 2918402 - DNA, 19 bp, Homo sapiens
gcgttcaaactgctggaaa

SEQ ID NO: 2918403 - DNA, 20 bp, Homo sapiens
gcgttctaaatatgaatgaa

SEQ ID NO: 2918404 - DNA, 12 bp, Homo sapiens
gcgttctcctgc

SEQ ID NO: 2918405 - DNA, 22 bp, Homo sapiens
gcgttggatttaaaaatgccaa

SEQ ID NO: 2918406 - DNA, 23 bp, Homo sapiens
gcgttggatttaaaaatgccaaa

SEQ ID NO: 2918407 - DNA, 15 bp, Homo sapiens
gcgttggtctctgca

SEQ ID NO: 2918408 - DNA, 15 bp, Homo sapiens
gcgtttgcacggttt

SEQ ID NO: 2918409 - DNA, 13 bp, Homo sapiens
gcgtttgctgtgc

SEQ ID NO: 2918410 - DNA, 20 bp, Homo sapiens
gcgtttgctgtgccaggagg

SEQ ID NO: 2918411 - DNA, 22 bp, Homo sapiens
gctaaaaatatgcagaatctct

SEQ ID NO: 2918412 - DNA, 14 bp, Homo sapiens
gctaaaaatgggac

SEQ ID NO: 2918413 - DNA, 22 bp, Homo sapiens
gctaaaagcatggccctgctgc

SEQ ID NO: 2918414 - DNA, 16 bp, Homo sapiens
gctaaagcctgaattt

SEQ ID NO: 2918415 - DNA, 21 bp, Homo sapiens
gctaaataaaatttgttgcat

SEQ ID NO: 2918416 - DNA, 22 bp, Homo sapiens
gctaaattactcaggaagaaca

SEQ ID NO: 2918417 - DNA, 13 bp, Homo sapiens
gctaaattttctg

SEQ ID NO: 2918418 - DNA, 20 bp, Homo sapiens
gctaacacggtgaaaccccg

SEQ ID NO: 2918419 - DNA, 22 bp, Homo sapiens
gctaacccaggtcccctcattc

SEQ ID NO: 2918420 - DNA, 22 bp, Homo sapiens
gctaacccccagcccacagagc

SEQ ID NO: 2918421 - DNA, 13 bp, Homo sapiens
gctaacgtttttt

SEQ ID NO: 2918422 - DNA, 19 bp, Homo sapiens
gctaactccgagagcagtg

SEQ ID NO: 2918423 - DNA, 13 bp, Homo sapiens
gctaactggaagc

SEQ ID NO: 2918424 - DNA, 23 bp, Homo sapiens
gctaagaacctggaacttgggga

SEQ ID NO: 2918425 - DNA, 19 bp, Homo sapiens
gctaagagtgtcctaggag

SEQ ID NO: 2918426 - DNA, 21 bp, Homo sapiens
gctaagggggaccatggggag

SEQ ID NO: 2918427 - DNA, 14 bp, Homo sapiens
gctaaggttctaag

SEQ ID NO: 2918428 - DNA, 14 bp, Homo sapiens
gctaatattaaaag

SEQ ID NO: 2918429 - DNA, 14 bp, Homo sapiens
gctaatattttatt

SEQ ID NO: 2918430 - DNA, 22 bp, Homo sapiens
gctaattgctgttgaaagcaaa

SEQ ID NO: 2918431 - DNA, 13 bp, Homo sapiens
gctaatttgcatt

SEQ ID NO: 2918432 - DNA, 14 bp, Homo sapiens
gctacaaagaagac

SEQ ID NO: 2918433 - DNA, 22 bp, Homo sapiens
gctacaaaggaggacaagaccc

SEQ ID NO: 2918434 - DNA, 21 bp, Homo sapiens
gctacaatcctaccttttgat

SEQ ID NO: 2918435 - DNA, 19 bp, Homo sapiens
gctacacccttttccagct

SEQ ID NO: 2918436 - DNA, 15 bp, Homo sapiens
gctacagaaagcaca

SEQ ID NO: 2918437 - DNA, 14 bp, Homo sapiens
gctacaggttacaa

SEQ ID NO: 2918438 - DNA, 15 bp, Homo sapiens
gctacatggtttaga

SEQ ID NO: 2918439 - DNA, 22 bp, Homo sapiens
gctaccaagtcagacaccaagg

SEQ ID NO: 2918440 - DNA, 13 bp, Homo sapiens
gctaccccaccca

SEQ ID NO: 2918441 - DNA, 19 bp, Homo sapiens
gctaccccattctctagac

SEQ ID NO: 2918442 - DNA, 12 bp, Homo sapiens
gctaccctgagc

SEQ ID NO: 2918443 - DNA, 15 bp, Homo sapiens
gctacctctctgtcc

SEQ ID NO: 2918444 - DNA, 21 bp, Homo sapiens
gctacctctctgtcccttgct

SEQ ID NO: 2918445 - DNA, 22 bp, Homo sapiens
gctacctctctgtcccttgctg

SEQ ID NO: 2918446 - DNA, 13 bp, Homo sapiens
gctacgtgtgaaa

SEQ ID NO: 2918447 - DNA, 17 bp, Homo sapiens
gctacgtgtgaaatctg

SEQ ID NO: 2918448 - DNA, 21 bp, Homo sapiens
gctacgtgtgaaatctgtctt

SEQ ID NO: 2918449 - DNA, 17 bp, Homo sapiens
gctacgtgtgatttttc

SEQ ID NO: 2918450 - DNA, 12 bp, Homo sapiens
gctactcagcag

SEQ ID NO: 2918451 - DNA, 21 bp, Homo sapiens
gctactcagcagccctcctca

SEQ ID NO: 2918452 - DNA, 23 bp, Homo sapiens
gctactcaggaggctgagacagg

SEQ ID NO: 2918453 - DNA, 23 bp, Homo sapiens
gctactcaggaggctgaggcaga

SEQ ID NO: 2918454 - DNA, 13 bp, Homo sapiens
gctactcatggca

SEQ ID NO: 2918455 - DNA, 22 bp, Homo sapiens
gctactcgggaggctgaggcac

SEQ ID NO: 2918456 - DNA, 23 bp, Homo sapiens
gctactcgggaggctgaggcaca

SEQ ID NO: 2918457 - DNA, 16 bp, Homo sapiens
gctactgaaccagcca

SEQ ID NO: 2918458 - DNA, 23 bp, Homo sapiens
gctactgcccctctccgaaagaa

SEQ ID NO: 2918459 - DNA, 22 bp, Homo sapiens
gctactggggaggctgaggcag

SEQ ID NO: 2918460 - DNA, 23 bp, Homo sapiens
gctactggggaggctgaggcagg

SEQ ID NO: 2918461 - DNA, 19 bp, Homo sapiens
gctactgtgtgtgtgaatg

SEQ ID NO: 2918462 - DNA, 21 bp, Homo sapiens
gctactgtgtgtgtgaatgaa

SEQ ID NO: 2918463 - DNA, 13 bp, Homo sapiens
gctacttagctgg

SEQ ID NO: 2918464 - DNA, 16 bp, Homo sapiens
gctacttagctggcca

SEQ ID NO: 2918465 - DNA, 14 bp, Homo sapiens
gctacttgctctgc

SEQ ID NO: 2918466 - DNA, 19 bp, Homo sapiens
gctacttgggagcctgagg

SEQ ID NO: 2918467 - DNA, 15 bp, Homo sapiens
gctacttttacttgt

SEQ ID NO: 2918468 - DNA, 14 bp, Homo sapiens
gctagaagaaaaca

SEQ ID NO: 2918469 - DNA, 21 bp, Homo sapiens
gctagaagtgggccaggacag

SEQ ID NO: 2918470 - DNA, 15 bp, Homo sapiens
gctagagcagacagg

SEQ ID NO: 2918471 - DNA, 16 bp, Homo sapiens
gctagagcttctgtat

SEQ ID NO: 2918472 - DNA, 20 bp, Homo sapiens
gctagaggaaccaaccccca

SEQ ID NO: 2918473 - DNA, 14 bp, Homo sapiens
gctagagggcccaa

SEQ ID NO: 2918474 - DNA, 16 bp, Homo sapiens
gctagagggcccaaag

SEQ ID NO: 2918475 - DNA, 13 bp, Homo sapiens
gctagccagagga

SEQ ID NO: 2918476 - DNA, 18 bp, Homo sapiens
gctagctatttctatgta

SEQ ID NO: 2918477 - DNA, 22 bp, Homo sapiens
gctagctatttctatgtatgtg

SEQ ID NO: 2918478 - DNA, 17 bp, Homo sapiens
gctaggacgttggcctc

SEQ ID NO: 2918479 - DNA, 19 bp, Homo sapiens
gctaggacgttggcctcag

SEQ ID NO: 2918480 - DNA, 14 bp, Homo sapiens
gctaggcccctgtg

SEQ ID NO: 2918481 - DNA, 16 bp, Homo sapiens
gctaggcccctgtgta

SEQ ID NO: 2918482 - DNA, 17 bp, Homo sapiens
gctaggcccctgtgtag

SEQ ID NO: 2918483 - DNA, 15 bp, Homo sapiens
gctagtcactggcag

SEQ ID NO: 2918484 - DNA, 19 bp, Homo sapiens
gctagtcactggcagcctg

SEQ ID NO: 2918485 - DNA, 20 bp, Homo sapiens
gctagtcactggcagcctgc

SEQ ID NO: 2918486 - DNA, 17 bp, Homo sapiens
gctagtggggtgaacag

SEQ ID NO: 2918487 - DNA, 17 bp, Homo sapiens
gctataaacaattacat

SEQ ID NO: 2918488 - DNA, 18 bp, Homo sapiens
gctatagacattagagag

SEQ ID NO: 2918489 - DNA, 17 bp, Homo sapiens
gctatagcctggggtgg

SEQ ID NO: 2918490 - DNA, 13 bp, Homo sapiens
gctatagtatttg

SEQ ID NO: 2918491 - DNA, 19 bp, Homo sapiens
gctatattgcccaggctgg

SEQ ID NO: 2918492 - DNA, 22 bp, Homo sapiens
gctatattgcccaggctggtct

SEQ ID NO: 2918493 - DNA, 20 bp, Homo sapiens
gctatcaagaggctgagaca

SEQ ID NO: 2918494 - DNA, 17 bp, Homo sapiens
gctatccatttctcatg

SEQ ID NO: 2918495 - DNA, 19 bp, Homo sapiens
gctatcggggaagccagac

SEQ ID NO: 2918496 - DNA, 14 bp, Homo sapiens
gctatcttaatttt

SEQ ID NO: 2918497 - DNA, 16 bp, Homo sapiens
gctatcttaattttgg

SEQ ID NO: 2918498 - DNA, 20 bp, Homo sapiens
gctatcttttttagtgttaa

SEQ ID NO: 2918499 - DNA, 23 bp, Homo sapiens
gctatgacatggaggcactgaag

SEQ ID NO: 2918500 - DNA, 16 bp, Homo sapiens
gctatggtgagatgca

SEQ ID NO: 2918501 - DNA, 12 bp, Homo sapiens
gctatgtaaggg

SEQ ID NO: 2918502 - DNA, 14 bp, Homo sapiens
gctattatactgtt

SEQ ID NO: 2918503 - DNA, 22 bp, Homo sapiens
gctattatactgttatccatat

SEQ ID NO: 2918504 - DNA, 21 bp, Homo sapiens
gctattcccagggaaccccag

SEQ ID NO: 2918505 - DNA, 19 bp, Homo sapiens
gctattgtaaggtctttgt

SEQ ID NO: 2918506 - DNA, 14 bp, Homo sapiens
gctatttaaaactt

SEQ ID NO: 2918507 - DNA, 17 bp, Homo sapiens
gctatttatgggcccct

SEQ ID NO: 2918508 - DNA, 22 bp, Homo sapiens
gctatttatgggcccctggcac

SEQ ID NO: 2918509 - DNA, 22 bp, Homo sapiens
gctatttcaggccctcagctgt

SEQ ID NO: 2918510 - DNA, 18 bp, Homo sapiens
gctatttctatgtatgtg

SEQ ID NO: 2918511 - DNA, 18 bp, Homo sapiens
gctatttgtatttctctt

SEQ ID NO: 2918512 - DNA, 23 bp, Homo sapiens
gctcaaaaacttgatcacatgct

SEQ ID NO: 2918513 - DNA, 18 bp, Homo sapiens
gctgcttccaggctgggc

SEQ ID NO: 2918514 - DNA, 11 bp, Homo sapiens
gctgcttccca

SEQ ID NO: 2918515 - DNA, 13 bp, Homo sapiens
gctgcttcctaac

SEQ ID NO: 2918516 - DNA, 22 bp, Homo sapiens
gctgcttctacggccatgagac

SEQ ID NO: 2918517 - DNA, 13 bp, Homo sapiens
gctgcttcttgct

SEQ ID NO: 2918518 - DNA, 14 bp, Homo sapiens
gctgcttgcagcca

SEQ ID NO: 2918519 - DNA, 17 bp, Homo sapiens
gctgcttgcagccagga

SEQ ID NO: 2918520 - DNA, 16 bp, Homo sapiens
gctgcttgtgcctccc

SEQ ID NO: 2918521 - DNA, 18 bp, Homo sapiens
gctgcttgtgcctccctt

SEQ ID NO: 2918522 - DNA, 21 bp, Homo sapiens
gctgcttgtgcctcccttccc

SEQ ID NO: 2918523 - DNA, 22 bp, Homo sapiens
gctgctttgttgttctgcctgt

SEQ ID NO: 2918524 - DNA, 18 bp, Homo sapiens
gctgcttttatatctgta

SEQ ID NO: 2918525 - DNA, 23 bp, Homo sapiens
gctgcttttccttggggcaggca

SEQ ID NO: 2918526 - DNA, 15 bp, Homo sapiens
gctggaaaagggtct

SEQ ID NO: 2918527 - DNA, 23 bp, Homo sapiens
gctggaaaagggtcttgggaaat

SEQ ID NO: 2918528 - DNA, 18 bp, Homo sapiens
gctggaaaccaagtcagg

SEQ ID NO: 2918529 - DNA, 13 bp, Homo sapiens
gctggaaagcaaa

SEQ ID NO: 2918530 - DNA, 17 bp, Homo sapiens
gctggaatgagggaggc

SEQ ID NO: 2918531 - DNA, 21 bp, Homo sapiens
gctggactctcagtctctgag

SEQ ID NO: 2918532 - DNA, 15 bp, Homo sapiens
gctggactgctgctg

SEQ ID NO: 2918533 - DNA, 19 bp, Homo sapiens
gctggagatctgaacccag

SEQ ID NO: 2918534 - DNA, 22 bp, Homo sapiens
gctggagcccagggagcggaaa

SEQ ID NO: 2918535 - DNA, 12 bp, Homo sapiens
gctggagcccgc

SEQ ID NO: 2918536 - DNA, 13 bp, Homo sapiens
gctggagccctgt

SEQ ID NO: 2918537 - DNA, 22 bp, Homo sapiens
gctggagccctgttcctccctc

SEQ ID NO: 2918538 - DNA, 15 bp, Homo sapiens
gctggaggcagggcc

SEQ ID NO: 2918539 - DNA, 16 bp, Homo sapiens
gctggaggcagggcct

SEQ ID NO: 2918540 - DNA, 21 bp, Homo sapiens
gctggaggcagggccttgccc

SEQ ID NO: 2918541 - DNA, 13 bp, Homo sapiens
gctggaggtgctg

SEQ ID NO: 2918542 - DNA, 20 bp, Homo sapiens
gctggagtacagtggtgcca

SEQ ID NO: 2918543 - DNA, 19 bp, Homo sapiens
gctggagtgctgcttgtgc

SEQ ID NO: 2918544 - DNA, 16 bp, Homo sapiens
gctggagtttcatgta

SEQ ID NO: 2918545 - DNA, 20 bp, Homo sapiens
gctggatgagaatttgagtg

SEQ ID NO: 2918546 - DNA, 19 bp, Homo sapiens
gctggcaacacagaggcag

SEQ ID NO: 2918547 - DNA, 15 bp, Homo sapiens
gctggcagcagagtg

SEQ ID NO: 2918548 - DNA, 21 bp, Homo sapiens
gctggcatgatccaagcaaga

SEQ ID NO: 2918549 - DNA, 20 bp, Homo sapiens
gctggccaaagagcctttcc

SEQ ID NO: 2918550 - DNA, 12 bp, Homo sapiens
gctggccaagga

SEQ ID NO: 2918551 - DNA, 13 bp, Homo sapiens
gctggccagccgc

SEQ ID NO: 2918552 - DNA, 12 bp, Homo sapiens
gctggccagtct

SEQ ID NO: 2918553 - DNA, 23 bp, Homo sapiens
gctggccatctggttaggatggc

SEQ ID NO: 2918554 - DNA, 15 bp, Homo sapiens
gctggcccacccagt

SEQ ID NO: 2918555 - DNA, 23 bp, Homo sapiens
gctggcccacccagtccatgctc

SEQ ID NO: 2918556 - DNA, 16 bp, Homo sapiens
gctggcccagcatgga

SEQ ID NO: 2918557 - DNA, 19 bp, Homo sapiens
gctggcccagggcccagag

SEQ ID NO: 2918558 - DNA, 24 bp, Homo sapiens
gctggccccgccgcctggtactca

SEQ ID NO: 2918559 - DNA, 22 bp, Homo sapiens
gctggcccctttgggccctgca

SEQ ID NO: 2918560 - DNA, 22 bp, Homo sapiens
gctggcccgtgacagactcctg

SEQ ID NO: 2918561 - DNA, 17 bp, Homo sapiens
gctggccctgtgcagac

SEQ ID NO: 2918562 - DNA, 19 bp, Homo sapiens
gctggccctgtgcagacct

SEQ ID NO: 2918563 - DNA, 15 bp, Homo sapiens
gctggcctccctccg

SEQ ID NO: 2918564 - DNA, 21 bp, Homo sapiens
gctggcctccctccgtccctc

SEQ ID NO: 2918565 - DNA, 22 bp, Homo sapiens
gctggcctccctccgtccctct

SEQ ID NO: 2918566 - DNA, 23 bp, Homo sapiens
gctggcctccctccgtccctctg

SEQ ID NO: 2918567 - DNA, 13 bp, Homo sapiens
gctggcctcttgg

SEQ ID NO: 2918568 - DNA, 14 bp, Homo sapiens
gctggcctcttggc

SEQ ID NO: 2918569 - DNA, 19 bp, Homo sapiens
gctggcctcttggcacctg

SEQ ID NO: 2918570 - DNA, 20 bp, Homo sapiens
gctggcctcttggcacctgc

SEQ ID NO: 2918571 - DNA, 21 bp, Homo sapiens
gctggcctcttggcacctgcc

SEQ ID NO: 2918572 - DNA, 12 bp, Homo sapiens
gctggcctgctc

SEQ ID NO: 2918573 - DNA, 15 bp, Homo sapiens
gctggcctggaggct

SEQ ID NO: 2918574 - DNA, 21 bp, Homo sapiens
gctggccttggtatgtgccag

SEQ ID NO: 2918575 - DNA, 12 bp, Homo sapiens
gctggcgacact

SEQ ID NO: 2918576 - DNA, 17 bp, Homo sapiens
gctggctccagatgcag

SEQ ID NO: 2918577 - DNA, 15 bp, Homo sapiens
gctggctcgtaggcc

SEQ ID NO: 2918578 - DNA, 19 bp, Homo sapiens
gctggctctgtggaggggc

SEQ ID NO: 2918579 - DNA, 17 bp, Homo sapiens
gctggctgcttgcagcc

SEQ ID NO: 2918580 - DNA, 20 bp, Homo sapiens
gctggctgcttgcagccagg

SEQ ID NO: 2918581 - DNA, 21 bp, Homo sapiens
gctggctgcttgcagccagga

SEQ ID NO: 2918582 - DNA, 13 bp, Homo sapiens
gctggctggggtg

SEQ ID NO: 2918583 - DNA, 16 bp, Homo sapiens
gctggctggtgcctga

SEQ ID NO: 2918584 - DNA, 19 bp, Homo sapiens
gctggctgtacctgttcct

SEQ ID NO: 2918585 - DNA, 14 bp, Homo sapiens
gctggcttttctgt

SEQ ID NO: 2918586 - DNA, 23 bp, Homo sapiens
gctgggacaccccgacttttgtt

SEQ ID NO: 2918587 - DNA, 15 bp, Homo sapiens
gctgggatcccacag

SEQ ID NO: 2918588 - DNA, 19 bp, Homo sapiens
gctgggatcccacagccct

SEQ ID NO: 2918589 - DNA, 20 bp, Homo sapiens
gctgggatcccacagcccta

SEQ ID NO: 2918590 - DNA, 21 bp, Homo sapiens
gctgggatcccacagccctag

SEQ ID NO: 2918591 - DNA, 18 bp, Homo sapiens
gctgggatggtgggcttc

SEQ ID NO: 2918592 - DNA, 20 bp, Homo sapiens
gctgggcacacgcctcccac

SEQ ID NO: 2918593 - DNA, 12 bp, Homo sapiens
gctgggcagcct

SEQ ID NO: 2918594 - DNA, 20 bp, Homo sapiens
gctgggcagtgccagccaat

SEQ ID NO: 2918595 - DNA, 15 bp, Homo sapiens
gctgggcccacagcc

SEQ ID NO: 2918596 - DNA, 20 bp, Homo sapiens
gctgggcccacagcccccac

SEQ ID NO: 2918597 - DNA, 21 bp, Homo sapiens
gctgggcccacagcccccacc

SEQ ID NO: 2918598 - DNA, 18 bp, Homo sapiens
gctgggcccagcaggggc

SEQ ID NO: 2918599 - DNA, 21 bp, Homo sapiens
gctgggcccgacatggctccg

SEQ ID NO: 2918600 - DNA, 14 bp, Homo sapiens
gctgggcctccttc

SEQ ID NO: 2918601 - DNA, 15 bp, Homo sapiens
gctgggcctccttct

SEQ ID NO: 2918602 - DNA, 18 bp, Homo sapiens
gctgggcctccttcttcc

SEQ ID NO: 2918603 - DNA, 14 bp, Homo sapiens
gctgggctctccac

SEQ ID NO: 2918604 - DNA, 15 bp, Homo sapiens
gctgggctctccacc

SEQ ID NO: 2918605 - DNA, 20 bp, Homo sapiens
gctgggctctccacctcagc

SEQ ID NO: 2918606 - DNA, 20 bp, Homo sapiens
gctgggctcttaactgttgc

SEQ ID NO: 2918607 - DNA, 19 bp, Homo sapiens
gctgggctgagccaaagcc

SEQ ID NO: 2918608 - DNA, 13 bp, Homo sapiens
gctggggaaggaa

SEQ ID NO: 2918609 - DNA, 15 bp, Homo sapiens
gctggggaaggaagc

SEQ ID NO: 2918610 - DNA, 18 bp, Homo sapiens
gctggggaccggttccca

SEQ ID NO: 2918611 - DNA, 22 bp, Homo sapiens
gctggggaccggttcccacaag

SEQ ID NO: 2918612 - DNA, 18 bp, Homo sapiens
gctggggaggtgggaggc

SEQ ID NO: 2918613 - DNA, 17 bp, Homo sapiens
gctggggccggggctga

SEQ ID NO: 2918614 - DNA, 16 bp, Homo sapiens
gctgggggagggactg

SEQ ID NO: 2918615 - DNA, 20 bp, Homo sapiens
gctgggggctccccttgccc

SEQ ID NO: 2918616 - DNA, 15 bp, Homo sapiens
gctgggggtgggcca

SEQ ID NO: 2918617 - DNA, 20 bp, Homo sapiens
gctggggtggcctgtgtggc

SEQ ID NO: 2918618 - DNA, 13 bp, Homo sapiens
gctgggtcacagg

SEQ ID NO: 2918619 - DNA, 22 bp, Homo sapiens
gctgggtcacaggaaggaaaca

SEQ ID NO: 2918620 - DNA, 13 bp, Homo sapiens
gctgggtcaggca

SEQ ID NO: 2918621 - DNA, 14 bp, Homo sapiens
gctgggtcaggcag

SEQ ID NO: 2918622 - DNA, 19 bp, Homo sapiens
gctgggtgacagagcgaga

SEQ ID NO: 2918623 - DNA, 13 bp, Homo sapiens
gctgggtttgctg

SEQ ID NO: 2918624 - DNA, 17 bp, Homo sapiens
gctggtacaacggaggc

SEQ ID NO: 2918625 - DNA, 16 bp, Homo sapiens
gctggtagctgagggg

SEQ ID NO: 2918626 - DNA, 18 bp, Homo sapiens
gctggtagctgaggggac

SEQ ID NO: 2918627 - DNA, 19 bp, Homo sapiens
gctggtagctgaggggacg

SEQ ID NO: 2918628 - DNA, 22 bp, Homo sapiens
gctggtcactctgccctctgct

SEQ ID NO: 2918629 - DNA, 21 bp, Homo sapiens
gctggtcatccttggtgctct

SEQ ID NO: 2918630 - DNA, 22 bp, Homo sapiens
gctggtcccctccctctgtctt

SEQ ID NO: 2918631 - DNA, 19 bp, Homo sapiens
gctggtctcaaactcctga

SEQ ID NO: 2918632 - DNA, 16 bp, Homo sapiens
gctggtctctggctct

SEQ ID NO: 2918633 - DNA, 16 bp, Homo sapiens
gctggtgacagccttg

SEQ ID NO: 2918634 - DNA, 21 bp, Homo sapiens
gctggtgccaaatagccccag

SEQ ID NO: 2918635 - DNA, 23 bp, Homo sapiens
gctggtgccaaatagccccagac

SEQ ID NO: 2918636 - DNA, 12 bp, Homo sapiens
gctggtgccccc

SEQ ID NO: 2918637 - DNA, 12 bp, Homo sapiens
gctggtgcctga

SEQ ID NO: 2918638 - DNA, 15 bp, Homo sapiens
gctggtgcctgaaga

SEQ ID NO: 2918639 - DNA, 23 bp, Homo sapiens
gctggtgcctgaagaccccagat

SEQ ID NO: 2918640 - DNA, 13 bp, Homo sapiens
gctggtgcctgct

SEQ ID NO: 2918641 - DNA, 18 bp, Homo sapiens
gctggtggatggtgactt

SEQ ID NO: 2918642 - DNA, 16 bp, Homo sapiens
gctggtggattgggca

SEQ ID NO: 2918643 - DNA, 18 bp, Homo sapiens
gctggtggattgggcaga

SEQ ID NO: 2918644 - DNA, 13 bp, Homo sapiens
gctggtggcccag

SEQ ID NO: 2918645 - DNA, 22 bp, Homo sapiens
ggaagtaaaggcattccacagg

SEQ ID NO: 2918646 - DNA, 20 bp, Homo sapiens
ggaagtcagaatttttaact

SEQ ID NO: 2918647 - DNA, 22 bp, Homo sapiens
ggaagtcatgggaacgcagcct

SEQ ID NO: 2918648 - DNA, 16 bp, Homo sapiens
ggaagtccaatgtggc

SEQ ID NO: 2918649 - DNA, 17 bp, Homo sapiens
ggaagtcgaggctgcag

SEQ ID NO: 2918650 - DNA, 19 bp, Homo sapiens
ggaagtgtgtgtggcagca

SEQ ID NO: 2918651 - DNA, 12 bp, Homo sapiens
ggaagtgttcct

SEQ ID NO: 2918652 - DNA, 19 bp, Homo sapiens
ggaagtgttcctgtctcaa

SEQ ID NO: 2918653 - DNA, 17 bp, Homo sapiens
ggaagttggggcactgg

SEQ ID NO: 2918654 - DNA, 12 bp, Homo sapiens
ggaataaatatg

SEQ ID NO: 2918655 - DNA, 13 bp, Homo sapiens
ggaataaatatgc

SEQ ID NO: 2918656 - DNA, 22 bp, Homo sapiens
ggaataaatatgcctctccttt

SEQ ID NO: 2918657 - DNA, 23 bp, Homo sapiens
ggaataactcttacagctttgcc

SEQ ID NO: 2918658 - DNA, 14 bp, Homo sapiens
ggaatactgtttta

SEQ ID NO: 2918659 - DNA, 17 bp, Homo sapiens
ggaatactttttgttat

SEQ ID NO: 2918660 - DNA, 16 bp, Homo sapiens
ggaatagttttctcct

SEQ ID NO: 2918661 - DNA, 14 bp, Homo sapiens
ggaatataaatatt

SEQ ID NO: 2918662 - DNA, 14 bp, Homo sapiens
ggaatatcaatata

SEQ ID NO: 2918663 - DNA, 15 bp, Homo sapiens
ggaatcactcttgtg

SEQ ID NO: 2918664 - DNA, 20 bp, Homo sapiens
ggaatcactcttgtggatgt

SEQ ID NO: 2918665 - DNA, 21 bp, Homo sapiens
ggaatcagacttcacactgca

SEQ ID NO: 2918666 - DNA, 14 bp, Homo sapiens
ggaatcagcttcta

SEQ ID NO: 2918667 - DNA, 24 bp, Homo sapiens
ggaatcatttctatttctcctcca

SEQ ID NO: 2918668 - DNA, 20 bp, Homo sapiens
ggaatcccactaatgcaaac

SEQ ID NO: 2918669 - DNA, 16 bp, Homo sapiens
ggaatcctcctccagg

SEQ ID NO: 2918670 - DNA, 19 bp, Homo sapiens
ggaatcctcctccagggtg

SEQ ID NO: 2918671 - DNA, 22 bp, Homo sapiens
ggaatctcccagacttgtttcc

SEQ ID NO: 2918672 - DNA, 15 bp, Homo sapiens
ggaatctgccttcca

SEQ ID NO: 2918673 - DNA, 12 bp, Homo sapiens
ggaatgaagctt

SEQ ID NO: 2918674 - DNA, 15 bp, Homo sapiens
ggaatgaagcttgtg

SEQ ID NO: 2918675 - DNA, 16 bp, Homo sapiens
ggaatgaagcttgtgt

SEQ ID NO: 2918676 - DNA, 22 bp, Homo sapiens
ggaatgactcatgcctctgagc

SEQ ID NO: 2918677 - DNA, 17 bp, Homo sapiens
ggaatgactgaaagaag

SEQ ID NO: 2918678 - DNA, 23 bp, Homo sapiens
ggaatgcggccgcattccctgag

SEQ ID NO: 2918679 - DNA, 17 bp, Homo sapiens
ggaatgtgtgccttgtt

SEQ ID NO: 2918680 - DNA, 14 bp, Homo sapiens
ggaattagatgttt

SEQ ID NO: 2918681 - DNA, 16 bp, Homo sapiens
ggaattagatgtttat

SEQ ID NO: 2918682 - DNA, 20 bp, Homo sapiens
ggaattagatgtttatatca

SEQ ID NO: 2918683 - DNA, 22 bp, Homo sapiens
ggaattccacgcccgggagtgg

SEQ ID NO: 2918684 - DNA, 22 bp, Homo sapiens
ggaattgattgtcagccacctc

SEQ ID NO: 2918685 - DNA, 15 bp, Homo sapiens
ggaattgatttgcat

SEQ ID NO: 2918686 - DNA, 17 bp, Homo sapiens
ggaattgatttgcattg

SEQ ID NO: 2918687 - DNA, 14 bp, Homo sapiens
ggaatttaaaatta

SEQ ID NO: 2918688 - DNA, 15 bp, Homo sapiens
ggaatttaaaattaa

SEQ ID NO: 2918689 - DNA, 23 bp, Homo sapiens
ggaatttaagagcagtccatttc

SEQ ID NO: 2918690 - DNA, 14 bp, Homo sapiens
ggaatttcccagga

SEQ ID NO: 2918691 - DNA, 15 bp, Homo sapiens
ggaatttcccaggac

SEQ ID NO: 2918692 - DNA, 17 bp, Homo sapiens
ggaattttctgttcata

SEQ ID NO: 2918693 - DNA, 17 bp, Homo sapiens
ggaatttttgcttgact

SEQ ID NO: 2918694 - DNA, 13 bp, Homo sapiens
ggacaaaagggcc

SEQ ID NO: 2918695 - DNA, 19 bp, Homo sapiens
ggacaaaagggccaggtgc

SEQ ID NO: 2918696 - DNA, 21 bp, Homo sapiens
ggacaaaagggccaggtgcgg

SEQ ID NO: 2918697 - DNA, 13 bp, Homo sapiens
ggacaaaatgtta

SEQ ID NO: 2918698 - DNA, 19 bp, Homo sapiens
ggacaaatgtgaagatgca

SEQ ID NO: 2918699 - DNA, 14 bp, Homo sapiens
ggacaaattgagac

SEQ ID NO: 2918700 - DNA, 17 bp, Homo sapiens
ggacaaattgagacagt

SEQ ID NO: 2918701 - DNA, 20 bp, Homo sapiens
ggacaaattgagacagtgca

SEQ ID NO: 2918702 - DNA, 15 bp, Homo sapiens
ggacaacgaggaagc

SEQ ID NO: 2918703 - DNA, 16 bp, Homo sapiens
ggacaacgaggaagcc

SEQ ID NO: 2918704 - DNA, 17 bp, Homo sapiens
ggacaacgaggaagccc

SEQ ID NO: 2918705 - DNA, 17 bp, Homo sapiens
ggacaacttatttaaaa

SEQ ID NO: 2918706 - DNA, 16 bp, Homo sapiens
ggacaagacccccagc

SEQ ID NO: 2918707 - DNA, 18 bp, Homo sapiens
ggacaagaccctctcagg

SEQ ID NO: 2918708 - DNA, 20 bp, Homo sapiens
ggacaagaccctctcaggct

SEQ ID NO: 2918709 - DNA, 16 bp, Homo sapiens
ggacaagcaggtaaga

SEQ ID NO: 2918710 - DNA, 16 bp, Homo sapiens
ggacaattcatgaact

SEQ ID NO: 2918711 - DNA, 19 bp, Homo sapiens
ggacacacatggtgagcct

SEQ ID NO: 2918712 - DNA, 13 bp, Homo sapiens
ggacacaggcctg

SEQ ID NO: 2918713 - DNA, 22 bp, Homo sapiens
ggacaccactgagctctgcctc

SEQ ID NO: 2918714 - DNA, 16 bp, Homo sapiens
ggacacccagggtcta

SEQ ID NO: 2918715 - DNA, 15 bp, Homo sapiens
ggacaccgggccagt

SEQ ID NO: 2918716 - DNA, 14 bp, Homo sapiens
ggacaccgtggcct

SEQ ID NO: 2918717 - DNA, 17 bp, Homo sapiens
ggacaccgtggcctggg

SEQ ID NO: 2918718 - DNA, 17 bp, Homo sapiens
ggacacgccgtctgtcc

SEQ ID NO: 2918719 - DNA, 23 bp, Homo sapiens
ggacacgcgcccccctcccagag

SEQ ID NO: 2918720 - DNA, 20 bp, Homo sapiens
ggacactgtggagactttct

SEQ ID NO: 2918721 - DNA, 18 bp, Homo sapiens
ggacacttaacagatgca

SEQ ID NO: 2918722 - DNA, 13 bp, Homo sapiens
ggacacttcttta

SEQ ID NO: 2918723 - DNA, 12 bp, Homo sapiens
ggacagacagca

SEQ ID NO: 2918724 - DNA, 15 bp, Homo sapiens
ggacagactggccgg

SEQ ID NO: 2918725 - DNA, 20 bp, Homo sapiens
ggacagactggccgggcagg

SEQ ID NO: 2918726 - DNA, 14 bp, Homo sapiens
ggacagagacacct

SEQ ID NO: 2918727 - DNA, 18 bp, Homo sapiens
ggacagagacacctgcac

SEQ ID NO: 2918728 - DNA, 12 bp, Homo sapiens
ggacagagccag

SEQ ID NO: 2918729 - DNA, 14 bp, Homo sapiens
ggacagagggcaca

SEQ ID NO: 2918730 - DNA, 16 bp, Homo sapiens
ggacagagggtggctg

SEQ ID NO: 2918731 - DNA, 22 bp, Homo sapiens
ggacagatggacgcaggccctg

SEQ ID NO: 2918732 - DNA, 19 bp, Homo sapiens
ggacagatttcagtaatgt

SEQ ID NO: 2918733 - DNA, 11 bp, Homo sapiens
ggacagccttc

SEQ ID NO: 2918734 - DNA, 13 bp, Homo sapiens
ggacagctgtcct

SEQ ID NO: 2918735 - DNA, 19 bp, Homo sapiens
ggacaggatgaggacagag

SEQ ID NO: 2918736 - DNA, 15 bp, Homo sapiens
ggacaggctggctcc

SEQ ID NO: 2918737 - DNA, 15 bp, Homo sapiens
ggacagttagcattt

SEQ ID NO: 2918738 - DNA, 21 bp, Homo sapiens
ggacagttgtttggagaacaa

SEQ ID NO: 2918739 - DNA, 15 bp, Homo sapiens
ggacagtttgtttcc

SEQ ID NO: 2918740 - DNA, 22 bp, Homo sapiens
ggacagtttgtttcctgtctga

SEQ ID NO: 2918741 - DNA, 22 bp, Homo sapiens
ggacatagagagggagaagaag

SEQ ID NO: 2918742 - DNA, 20 bp, Homo sapiens
ggacatccccccgccaaaag

SEQ ID NO: 2918743 - DNA, 15 bp, Homo sapiens
ggacatgccctgtgt

SEQ ID NO: 2918744 - DNA, 17 bp, Homo sapiens
ggacatgttttgataaa

SEQ ID NO: 2918745 - DNA, 15 bp, Homo sapiens
ggacattttttcagt

SEQ ID NO: 2918746 - DNA, 22 bp, Homo sapiens
ggaccaaacccttagcagccca

SEQ ID NO: 2918747 - DNA, 23 bp, Homo sapiens
ggaccaaacccttagcagcccag

SEQ ID NO: 2918748 - DNA, 19 bp, Homo sapiens
ggaccaaatagccaccttg

SEQ ID NO: 2918749 - DNA, 17 bp, Homo sapiens
ggaccaccgttcagtca

SEQ ID NO: 2918750 - DNA, 15 bp, Homo sapiens
ggaccactcttctct

SEQ ID NO: 2918751 - DNA, 22 bp, Homo sapiens
ggaccactcttctctccaagga

SEQ ID NO: 2918752 - DNA, 13 bp, Homo sapiens
ggaccactgggcc

SEQ ID NO: 2918753 - DNA, 14 bp, Homo sapiens
ggaccactgggccc

SEQ ID NO: 2918754 - DNA, 15 bp, Homo sapiens
ggaccactgggcccc

SEQ ID NO: 2918755 - DNA, 15 bp, Homo sapiens
ggaccagagggatgg

SEQ ID NO: 2918756 - DNA, 12 bp, Homo sapiens
ggaccagcctct

SEQ ID NO: 2918757 - DNA, 13 bp, Homo sapiens
ggaccagctcagg

SEQ ID NO: 2918758 - DNA, 18 bp, Homo sapiens
ggaccagctcaggacaga

SEQ ID NO: 2918759 - DNA, 16 bp, Homo sapiens
ggaccaggacccaggg

SEQ ID NO: 2918760 - DNA, 19 bp, Homo sapiens
ggaccaggacccagggaga

SEQ ID NO: 2918761 - DNA, 17 bp, Homo sapiens
ggaccagggcagggcca

SEQ ID NO: 2918762 - DNA, 14 bp, Homo sapiens
ggaccatcctattt

SEQ ID NO: 2918763 - DNA, 21 bp, Homo sapiens
ggacccagaggaaggggccag

SEQ ID NO: 2918764 - DNA, 11 bp, Homo sapiens
ggacccagtgc

SEQ ID NO: 2918765 - DNA, 22 bp, Homo sapiens
ggacccatgagttggggtctgg

SEQ ID NO: 2918766 - DNA, 12 bp, Homo sapiens
ggaccccagcat

SEQ ID NO: 2918767 - DNA, 14 bp, Homo sapiens
ggaccccagcattt

SEQ ID NO: 2918768 - DNA, 13 bp, Homo sapiens
ggaccccaggccc

SEQ ID NO: 2918769 - DNA, 14 bp, Homo sapiens
ggaccccaggccca

SEQ ID NO: 2918770 - DNA, 22 bp, Homo sapiens
ggacccccgtggggcagggagc

SEQ ID NO: 2918771 - DNA, 16 bp, Homo sapiens
ggaccccctgcccgcc

SEQ ID NO: 2918772 - DNA, 11 bp, Homo sapiens
ggacccctcac

SEQ ID NO: 2918773 - DNA, 17 bp, Homo sapiens
ggacccctcaccacccc

SEQ ID NO: 2918774 - DNA, 20 bp, Homo sapiens
ggacccggcggccctgctga

SEQ ID NO: 2918775 - DNA, 17 bp, Homo sapiens
ggacccggggtctcctg

SEQ ID NO: 2918776 - DNA, 20 bp, Homo sapiens
ggacccggggtctcctggac

SEQ ID NO: 2918777 - DNA, 22 bp, Homo sapiens
ggacccggggtctcctggacct

SEQ ID NO: 2918778 - DNA, 21 bp, Homo sapiens
ggcacatcctatgcaatatat

SEQ ID NO: 2918779 - DNA, 15 bp, Homo sapiens
ggcacatggctgggg

SEQ ID NO: 2918780 - DNA, 18 bp, Homo sapiens
ggcaccagacacccagga

SEQ ID NO: 2918781 - DNA, 18 bp, Homo sapiens
ggcaccagtccctgtccg

SEQ ID NO: 2918782 - DNA, 22 bp, Homo sapiens
ggcacccctttccccagcctct

SEQ ID NO: 2918783 - DNA, 15 bp, Homo sapiens
ggcaccgggctggct

SEQ ID NO: 2918784 - DNA, 16 bp, Homo sapiens
ggcacctaatccaggc

SEQ ID NO: 2918785 - DNA, 19 bp, Homo sapiens
ggcacctaatccaggcaga

SEQ ID NO: 2918786 - DNA, 22 bp, Homo sapiens
ggcacctaatccaggcagatcc

SEQ ID NO: 2918787 - DNA, 16 bp, Homo sapiens
ggcacctcacaggccc

SEQ ID NO: 2918788 - DNA, 19 bp, Homo sapiens
ggcacctcacaggccccag

SEQ ID NO: 2918789 - DNA, 16 bp, Homo sapiens
ggcacgatctcagctc

SEQ ID NO: 2918790 - DNA, 20 bp, Homo sapiens
ggcacggtcttccctcttcc

SEQ ID NO: 2918791 - DNA, 15 bp, Homo sapiens
ggcactatttttatt

SEQ ID NO: 2918792 - DNA, 19 bp, Homo sapiens
ggcactccaacctaacctg

SEQ ID NO: 2918793 - DNA, 20 bp, Homo sapiens
ggcactccaacctaacctgt

SEQ ID NO: 2918794 - DNA, 13 bp, Homo sapiens
ggcactcccggga

SEQ ID NO: 2918795 - DNA, 21 bp, Homo sapiens
ggcactggatcccatcaaaga

SEQ ID NO: 2918796 - DNA, 17 bp, Homo sapiens
ggcactgtagttctaag

SEQ ID NO: 2918797 - DNA, 20 bp, Homo sapiens
ggcactgtagttctaagact

SEQ ID NO: 2918798 - DNA, 14 bp, Homo sapiens
ggcacttccctgct

SEQ ID NO: 2918799 - DNA, 15 bp, Homo sapiens
ggcacttgcctgggt

SEQ ID NO: 2918800 - DNA, 16 bp, Homo sapiens
ggcacttgcctgggtc

SEQ ID NO: 2918801 - DNA, 12 bp, Homo sapiens
ggcactttgggg

SEQ ID NO: 2918802 - DNA, 17 bp, Homo sapiens
ggcagaaacaataaaac

SEQ ID NO: 2918803 - DNA, 17 bp, Homo sapiens
ggcagaactgctggggc

SEQ ID NO: 2918804 - DNA, 18 bp, Homo sapiens
ggcagaactgctggggct

SEQ ID NO: 2918805 - DNA, 22 bp, Homo sapiens
ggcagactctttatgcttgcaa

SEQ ID NO: 2918806 - DNA, 12 bp, Homo sapiens
ggcagagcattt

SEQ ID NO: 2918807 - DNA, 18 bp, Homo sapiens
ggcagagcgggagggagt

SEQ ID NO: 2918808 - DNA, 12 bp, Homo sapiens
ggcagagctgag

SEQ ID NO: 2918809 - DNA, 18 bp, Homo sapiens
ggcagagctgctcccctc

SEQ ID NO: 2918810 - DNA, 12 bp, Homo sapiens
ggcagaggctgg

SEQ ID NO: 2918811 - DNA, 19 bp, Homo sapiens
ggcagagggcagaggctgg

SEQ ID NO: 2918812 - DNA, 12 bp, Homo sapiens
ggcagagggctg

SEQ ID NO: 2918813 - DNA, 16 bp, Homo sapiens
ggcagatgacaagatg

SEQ ID NO: 2918814 - DNA, 19 bp, Homo sapiens
ggcagatggcagggctgag

SEQ ID NO: 2918815 - DNA, 22 bp, Homo sapiens
ggcagatgtggggctgagctgg

SEQ ID NO: 2918816 - DNA, 16 bp, Homo sapiens
ggcagattcccactgc

SEQ ID NO: 2918817 - DNA, 14 bp, Homo sapiens
ggcagcacagagac

SEQ ID NO: 2918818 - DNA, 21 bp, Homo sapiens
ggcagcacagagacccccgga

SEQ ID NO: 2918819 - DNA, 15 bp, Homo sapiens
ggcagcagcatccca

SEQ ID NO: 2918820 - DNA, 18 bp, Homo sapiens
ggcagcagggctaccctg

SEQ ID NO: 2918821 - DNA, 19 bp, Homo sapiens
ggcagcagtgtgaggccag

SEQ ID NO: 2918822 - DNA, 20 bp, Homo sapiens
ggcagccacacgcaggcggc

SEQ ID NO: 2918823 - DNA, 21 bp, Homo sapiens
ggcagccacacgcaggcggcc

SEQ ID NO: 2918824 - DNA, 14 bp, Homo sapiens
ggcagccaggctgg

SEQ ID NO: 2918825 - DNA, 14 bp, Homo sapiens
ggcagccatgagaa

SEQ ID NO: 2918826 - DNA, 13 bp, Homo sapiens
ggcagcccctgca

SEQ ID NO: 2918827 - DNA, 15 bp, Homo sapiens
ggcagccctccatgg

SEQ ID NO: 2918828 - DNA, 21 bp, Homo sapiens
ggcagcctcccatccagggcc

SEQ ID NO: 2918829 - DNA, 21 bp, Homo sapiens
ggcagcgccaggctgaccaca

SEQ ID NO: 2918830 - DNA, 18 bp, Homo sapiens
ggcagcgcctgtcccctc

SEQ ID NO: 2918831 - DNA, 20 bp, Homo sapiens
ggcagcgcctgtcccctcac

SEQ ID NO: 2918832 - DNA, 15 bp, Homo sapiens
ggcagctctggacag

SEQ ID NO: 2918833 - DNA, 20 bp, Homo sapiens
ggcagctcttctgggcagag

SEQ ID NO: 2918834 - DNA, 22 bp, Homo sapiens
ggcagctcttctgggcagagcc

SEQ ID NO: 2918835 - DNA, 19 bp, Homo sapiens
ggcagctgcccctcctgga

SEQ ID NO: 2918836 - DNA, 20 bp, Homo sapiens
ggcagctgcccctcctggag

SEQ ID NO: 2918837 - DNA, 18 bp, Homo sapiens
ggcagctgcccctggcac

SEQ ID NO: 2918838 - DNA, 12 bp, Homo sapiens
ggcagctgcctg

SEQ ID NO: 2918839 - DNA, 13 bp, Homo sapiens
ggcagctgcctgg

SEQ ID NO: 2918840 - DNA, 12 bp, Homo sapiens
ggcagctgggcc

SEQ ID NO: 2918841 - DNA, 13 bp, Homo sapiens
ggcagctgggccc

SEQ ID NO: 2918842 - DNA, 17 bp, Homo sapiens
ggcagctgggcccacag

SEQ ID NO: 2918843 - DNA, 19 bp, Homo sapiens
ggcagctgggcccacagcc

SEQ ID NO: 2918844 - DNA, 19 bp, Homo sapiens
ggcaggaaggagcggcgcc

SEQ ID NO: 2918845 - DNA, 21 bp, Homo sapiens
ggcaggacaacgaggaagccc

SEQ ID NO: 2918846 - DNA, 15 bp, Homo sapiens
ggcaggaccgccatg

SEQ ID NO: 2918847 - DNA, 17 bp, Homo sapiens
ggcaggaccgccatggt

SEQ ID NO: 2918848 - DNA, 20 bp, Homo sapiens
ggcaggaccgccatggtgct

SEQ ID NO: 2918849 - DNA, 23 bp, Homo sapiens
ggcaggagggagggtttctctcc

SEQ ID NO: 2918850 - DNA, 23 bp, Homo sapiens
ggcaggcatcggggagccgggag

SEQ ID NO: 2918851 - DNA, 18 bp, Homo sapiens
ggcaggcatggccctggg

SEQ ID NO: 2918852 - DNA, 20 bp, Homo sapiens
ggcaggcatggccctgggcg

SEQ ID NO: 2918853 - DNA, 15 bp, Homo sapiens
ggcaggcgtgtggca

SEQ ID NO: 2918854 - DNA, 21 bp, Homo sapiens
ggcaggcgtgtggcagccaca

SEQ ID NO: 2918855 - DNA, 16 bp, Homo sapiens
ggcagggccttgccca

SEQ ID NO: 2918856 - DNA, 22 bp, Homo sapiens
ggcaggggacaagggaggcagt

SEQ ID NO: 2918857 - DNA, 15 bp, Homo sapiens
ggcaggggagccagg

SEQ ID NO: 2918858 - DNA, 16 bp, Homo sapiens
ggcaggggctggaggg

SEQ ID NO: 2918859 - DNA, 20 bp, Homo sapiens
ggcaggggtgagagcaccca

SEQ ID NO: 2918860 - DNA, 23 bp, Homo sapiens
ggcagggtgggatggaggagaag

SEQ ID NO: 2918861 - DNA, 18 bp, Homo sapiens
ggcaggtggccgcccctg

SEQ ID NO: 2918862 - DNA, 15 bp, Homo sapiens
ggcaggtgggagctg

SEQ ID NO: 2918863 - DNA, 19 bp, Homo sapiens
ggcagtattttctgttttt

SEQ ID NO: 2918864 - DNA, 11 bp, Homo sapiens
ggcagtccaga

SEQ ID NO: 2918865 - DNA, 14 bp, Homo sapiens
ggcagtccagagct

SEQ ID NO: 2918866 - DNA, 13 bp, Homo sapiens
ggcagtcccggga

SEQ ID NO: 2918867 - DNA, 11 bp, Homo sapiens
ggcagtccctt

SEQ ID NO: 2918868 - DNA, 17 bp, Homo sapiens
ggcagtcgcacacacat

SEQ ID NO: 2918869 - DNA, 20 bp, Homo sapiens
ggcagtctgagagaggccat

SEQ ID NO: 2918870 - DNA, 18 bp, Homo sapiens
ggcagtgatgctggatgc

SEQ ID NO: 2918871 - DNA, 14 bp, Homo sapiens
ggcagtgccagcca

SEQ ID NO: 2918872 - DNA, 16 bp, Homo sapiens
ggcagtgcccaccatg

SEQ ID NO: 2918873 - DNA, 18 bp, Homo sapiens
ggcagtgctgagggaccg

SEQ ID NO: 2918874 - DNA, 16 bp, Homo sapiens
ggcagtggacgtgctg

SEQ ID NO: 2918875 - DNA, 15 bp, Homo sapiens
ggcagtgttttgaga

SEQ ID NO: 2918876 - DNA, 21 bp, Homo sapiens
ggcagttctgggtgctcccta

SEQ ID NO: 2918877 - DNA, 20 bp, Homo sapiens
ggcagttttgacatcagcca

SEQ ID NO: 2918878 - DNA, 22 bp, Homo sapiens
ggcatacgagagcagaggtctc

SEQ ID NO: 2918879 - DNA, 18 bp, Homo sapiens
ggcatcagtccctatgta

SEQ ID NO: 2918880 - DNA, 17 bp, Homo sapiens
ggcatccaggccagggc

SEQ ID NO: 2918881 - DNA, 17 bp, Homo sapiens
ggcatccagggctgcca

SEQ ID NO: 2918882 - DNA, 17 bp, Homo sapiens
ggcatccttgcctgtct

SEQ ID NO: 2918883 - DNA, 18 bp, Homo sapiens
ggcatccttgcctgtcta

SEQ ID NO: 2918884 - DNA, 20 bp, Homo sapiens
ggcatcgaccacaccagcct

SEQ ID NO: 2918885 - DNA, 21 bp, Homo sapiens
ggcatcgaccacaccagcctc

SEQ ID NO: 2918886 - DNA, 22 bp, Homo sapiens
ggcatctctgagtgtctctgcc

SEQ ID NO: 2918887 - DNA, 23 bp, Homo sapiens
ggcatctctgagtgtctctgcct

SEQ ID NO: 2918888 - DNA, 13 bp, Homo sapiens
ggcatctgtgtgt

SEQ ID NO: 2918889 - DNA, 13 bp, Homo sapiens
ggcatgaccagat

SEQ ID NO: 2918890 - DNA, 23 bp, Homo sapiens
ggcatgacccagtgaagatgcag

SEQ ID NO: 2918891 - DNA, 18 bp, Homo sapiens
ggcatgagccactgtgct

SEQ ID NO: 2918892 - DNA, 15 bp, Homo sapiens
ggcatgatccaagca

SEQ ID NO: 2918893 - DNA, 15 bp, Homo sapiens
ggcatgcacacggct

SEQ ID NO: 2918894 - DNA, 14 bp, Homo sapiens
ggcatgcacgggca

SEQ ID NO: 2918895 - DNA, 14 bp, Homo sapiens
ggcatgccaggacc

SEQ ID NO: 2918896 - DNA, 15 bp, Homo sapiens
ggcatgccaggaccc

SEQ ID NO: 2918897 - DNA, 16 bp, Homo sapiens
ggcatgcggtcgggca

SEQ ID NO: 2918898 - DNA, 17 bp, Homo sapiens
ggcatgcggtcgggcag

SEQ ID NO: 2918899 - DNA, 17 bp, Homo sapiens
ggcatggggcatgtcct

SEQ ID NO: 2918900 - DNA, 20 bp, Homo sapiens
ggcatgtcctttccatctgt

SEQ ID NO: 2918901 - DNA, 16 bp, Homo sapiens
ggcatgtctgcctgga

SEQ ID NO: 2918902 - DNA, 18 bp, Homo sapiens
ggcatgtgggttgtgata

SEQ ID NO: 2918903 - DNA, 22 bp, Homo sapiens
ggcattcaaccacgcaggaagc

SEQ ID NO: 2918904 - DNA, 13 bp, Homo sapiens
ggcattccacagg

SEQ ID NO: 2918905 - DNA, 15 bp, Homo sapiens
ggcattctacacctg

SEQ ID NO: 2918906 - DNA, 12 bp, Homo sapiens
ggcattctctga

SEQ ID NO: 2918907 - DNA, 15 bp, Homo sapiens
ggcattgttagttta

SEQ ID NO: 2918908 - DNA, 21 bp, Homo sapiens
ggcatttcaattcctggccct

SEQ ID NO: 2918909 - DNA, 19 bp, Homo sapiens
ggcatttgctggcctggca

SEQ ID NO: 2918910 - DNA, 13 bp, Homo sapiens
ggctcgccaggcc

SEQ ID NO: 2918911 - DNA, 13 bp, Homo sapiens
ggctcgcccatac

SEQ ID NO: 2918912 - DNA, 18 bp, Homo sapiens
ggctcgcccatacccgtg

SEQ ID NO: 2918913 - DNA, 16 bp, Homo sapiens
ggctcggcccagcacc

SEQ ID NO: 2918914 - DNA, 15 bp, Homo sapiens
ggctcgtaggcctgc

SEQ ID NO: 2918915 - DNA, 18 bp, Homo sapiens
ggctcgtaggcctgccgc

SEQ ID NO: 2918916 - DNA, 23 bp, Homo sapiens
ggctctatgagtctagatgttta

SEQ ID NO: 2918917 - DNA, 21 bp, Homo sapiens
ggctctccacctcagccttgg

SEQ ID NO: 2918918 - DNA, 23 bp, Homo sapiens
ggctctcgctgccctgtggacag

SEQ ID NO: 2918919 - DNA, 16 bp, Homo sapiens
ggctctgaagcaaggc

SEQ ID NO: 2918920 - DNA, 22 bp, Homo sapiens
ggctctgaagcaaggcggtgga

SEQ ID NO: 2918921 - DNA, 18 bp, Homo sapiens
ggctctgagagtctagat

SEQ ID NO: 2918922 - DNA, 20 bp, Homo sapiens
ggctctgagagtctagattc

SEQ ID NO: 2918923 - DNA, 12 bp, Homo sapiens
ggctctgcccac

SEQ ID NO: 2918924 - DNA, 17 bp, Homo sapiens
ggctctggctctcccca

SEQ ID NO: 2918925 - DNA, 15 bp, Homo sapiens
ggctctgtgccttgg

SEQ ID NO: 2918926 - DNA, 16 bp, Homo sapiens
ggctctgttcctcaat

SEQ ID NO: 2918927 - DNA, 17 bp, Homo sapiens
ggctcttaactgttgct

SEQ ID NO: 2918928 - DNA, 18 bp, Homo sapiens
ggctcttaactgttgctc

SEQ ID NO: 2918929 - DNA, 23 bp, Homo sapiens
ggctcttctccttggaggacagt

SEQ ID NO: 2918930 - DNA, 14 bp, Homo sapiens
ggctgaacagtgct

SEQ ID NO: 2918931 - DNA, 17 bp, Homo sapiens
ggctgaacagtgctctg

SEQ ID NO: 2918932 - DNA, 18 bp, Homo sapiens
ggctgaacagtgctctgc

SEQ ID NO: 2918933 - DNA, 19 bp, Homo sapiens
ggctgaacagtgctctgcc

SEQ ID NO: 2918934 - DNA, 20 bp, Homo sapiens
ggctgaacggggagaaaagg

SEQ ID NO: 2918935 - DNA, 15 bp, Homo sapiens
ggctgaccacagcac

SEQ ID NO: 2918936 - DNA, 17 bp, Homo sapiens
ggctgaccacagcacag

SEQ ID NO: 2918937 - DNA, 19 bp, Homo sapiens
ggctgacccagtccctggg

SEQ ID NO: 2918938 - DNA, 21 bp, Homo sapiens
ggctgagccaaagccagagtg

SEQ ID NO: 2918939 - DNA, 17 bp, Homo sapiens
ggctgaggaaaggccag

SEQ ID NO: 2918940 - DNA, 22 bp, Homo sapiens
ggctgaggaaaggccagctggc

SEQ ID NO: 2918941 - DNA, 12 bp, Homo sapiens
ggctgaggcagg

SEQ ID NO: 2918942 - DNA, 14 bp, Homo sapiens
ggctgaggctggca

SEQ ID NO: 2918943 - DNA, 15 bp, Homo sapiens
ggctgagggagcctg

SEQ ID NO: 2918944 - DNA, 14 bp, Homo sapiens
ggctgagggcatct

SEQ ID NO: 2918945 - DNA, 21 bp, Homo sapiens
ggctgagggcatctctgagtg

SEQ ID NO: 2918946 - DNA, 18 bp, Homo sapiens
ggctgagtctccagggcc

SEQ ID NO: 2918947 - DNA, 22 bp, Homo sapiens
ggctgatcatttggctcttttt

SEQ ID NO: 2918948 - DNA, 17 bp, Homo sapiens
ggctgatgtggactgtc

SEQ ID NO: 2918949 - DNA, 22 bp, Homo sapiens
ggctgcaaggtttaggctggtg

SEQ ID NO: 2918950 - DNA, 15 bp, Homo sapiens
ggctgcacgctcccc

SEQ ID NO: 2918951 - DNA, 21 bp, Homo sapiens
ggctgcactcttgaactgggc

SEQ ID NO: 2918952 - DNA, 17 bp, Homo sapiens
ggctgcactggagccac

SEQ ID NO: 2918953 - DNA, 14 bp, Homo sapiens
ggctgcaggagggc

SEQ ID NO: 2918954 - DNA, 16 bp, Homo sapiens
ggctgcaggagggcac

SEQ ID NO: 2918955 - DNA, 17 bp, Homo sapiens
ggctgcagtagccatgt

SEQ ID NO: 2918956 - DNA, 19 bp, Homo sapiens
ggctgccccaggccggagc

SEQ ID NO: 2918957 - DNA, 21 bp, Homo sapiens
ggctgccccaggccggagccc

SEQ ID NO: 2918958 - DNA, 12 bp, Homo sapiens
ggctgccctgag

SEQ ID NO: 2918959 - DNA, 15 bp, Homo sapiens
ggctgccctgagggg

SEQ ID NO: 2918960 - DNA, 18 bp, Homo sapiens
ggctgcccttgggccacc

SEQ ID NO: 2918961 - DNA, 22 bp, Homo sapiens
ggctgccgactcccccaaccaa

SEQ ID NO: 2918962 - DNA, 18 bp, Homo sapiens
ggctgcctggagccccac

SEQ ID NO: 2918963 - DNA, 21 bp, Homo sapiens
ggctgcctttgatcacaggag

SEQ ID NO: 2918964 - DNA, 17 bp, Homo sapiens
ggctgcctttgtggtgg

SEQ ID NO: 2918965 - DNA, 22 bp, Homo sapiens
ggctgcctttgtggtgggcgct

SEQ ID NO: 2918966 - DNA, 15 bp, Homo sapiens
ggctgcgctaacccc

SEQ ID NO: 2918967 - DNA, 23 bp, Homo sapiens
ggctgcgcttcctatttctaggg

SEQ ID NO: 2918968 - DNA, 12 bp, Homo sapiens
ggctgctcctcc

SEQ ID NO: 2918969 - DNA, 13 bp, Homo sapiens
ggctgctcctcca

SEQ ID NO: 2918970 - DNA, 23 bp, Homo sapiens
ggctgctcctccagggccacgtg

SEQ ID NO: 2918971 - DNA, 18 bp, Homo sapiens
ggctgctcgcccaggaag

SEQ ID NO: 2918972 - DNA, 21 bp, Homo sapiens
ggctgctcgcccaggaaggcc

SEQ ID NO: 2918973 - DNA, 17 bp, Homo sapiens
ggctgcttgcagccagg

SEQ ID NO: 2918974 - DNA, 18 bp, Homo sapiens
ggctgcttgcagccagga

SEQ ID NO: 2918975 - DNA, 19 bp, Homo sapiens
ggctgcttgcagccaggag

SEQ ID NO: 2918976 - DNA, 14 bp, Homo sapiens
ggctggaatgaggg

SEQ ID NO: 2918977 - DNA, 13 bp, Homo sapiens
ggctggaggcagg

SEQ ID NO: 2918978 - DNA, 15 bp, Homo sapiens
ggctggaggcagggc

SEQ ID NO: 2918979 - DNA, 23 bp, Homo sapiens
ggctggaggcagggccttgccca

SEQ ID NO: 2918980 - DNA, 13 bp, Homo sapiens
ggctggaggccca

SEQ ID NO: 2918981 - DNA, 14 bp, Homo sapiens
ggctggaggcccag

SEQ ID NO: 2918982 - DNA, 20 bp, Homo sapiens
ggctggagtacagtggtgtg

SEQ ID NO: 2918983 - DNA, 14 bp, Homo sapiens
ggctggagtgagga

SEQ ID NO: 2918984 - DNA, 20 bp, Homo sapiens
ggctggagtgcagtggcgca

SEQ ID NO: 2918985 - DNA, 21 bp, Homo sapiens
ggctggattttgaattttctt

SEQ ID NO: 2918986 - DNA, 12 bp, Homo sapiens
ggctggcatgat

SEQ ID NO: 2918987 - DNA, 15 bp, Homo sapiens
ggctggccagccgct

SEQ ID NO: 2918988 - DNA, 11 bp, Homo sapiens
ggctggccctg

SEQ ID NO: 2918989 - DNA, 16 bp, Homo sapiens
ggctggccctgtgcag

SEQ ID NO: 2918990 - DNA, 23 bp, Homo sapiens
ggctggcctcacccacccctgca

SEQ ID NO: 2918991 - DNA, 13 bp, Homo sapiens
ggctggcctggag

SEQ ID NO: 2918992 - DNA, 22 bp, Homo sapiens
ggctggctccagatgcagggca

SEQ ID NO: 2918993 - DNA, 21 bp, Homo sapiens
ggctggctctgtggaggggcc

SEQ ID NO: 2918994 - DNA, 18 bp, Homo sapiens
ggctgggacgtggctcag

SEQ ID NO: 2918995 - DNA, 21 bp, Homo sapiens
ggctgggaggagggcaggcat

SEQ ID NO: 2918996 - DNA, 21 bp, Homo sapiens
ggctgggcagcacaaggcctt

SEQ ID NO: 2918997 - DNA, 14 bp, Homo sapiens
ggctgggcccagca

SEQ ID NO: 2918998 - DNA, 13 bp, Homo sapiens
ggctgggcctcct

SEQ ID NO: 2918999 - DNA, 22 bp, Homo sapiens
ggctgggcctccttcttccact

SEQ ID NO: 2919000 - DNA, 15 bp, Homo sapiens
ggctgggctgagcca

SEQ ID NO: 2919001 - DNA, 13 bp, Homo sapiens
ggctggggagggg

SEQ ID NO: 2919002 - DNA, 15 bp, Homo sapiens
ggctgggggagggac

SEQ ID NO: 2919003 - DNA, 15 bp, Homo sapiens
ggctgggtcacagga

SEQ ID NO: 2919004 - DNA, 15 bp, Homo sapiens
ggctgggtccttggg

SEQ ID NO: 2919005 - DNA, 20 bp, Homo sapiens
ggctgggtgtttcagtttga

SEQ ID NO: 2919006 - DNA, 18 bp, Homo sapiens
ggctgggtttgctgtctt

SEQ ID NO: 2919007 - DNA, 20 bp, Homo sapiens
ggctggtacaacggaggcct

SEQ ID NO: 2919008 - DNA, 22 bp, Homo sapiens
ggctggtattctctctatgcaa

SEQ ID NO: 2919009 - DNA, 18 bp, Homo sapiens
ggctggtcactctgccct

SEQ ID NO: 2919010 - DNA, 19 bp, Homo sapiens
ggctggtcactctgccctc

SEQ ID NO: 2919011 - DNA, 16 bp, Homo sapiens
ggctggtccgagctga

SEQ ID NO: 2919012 - DNA, 19 bp, Homo sapiens
ggctggtccgagctgagga

SEQ ID NO: 2919013 - DNA, 23 bp, Homo sapiens
ggctggtcttgaagtcctggctt

SEQ ID NO: 2919014 - DNA, 21 bp, Homo sapiens
ggctggtgaggccggccctgc

SEQ ID NO: 2919015 - DNA, 23 bp, Homo sapiens
ggctggtgcctgaagaccccaga

SEQ ID NO: 2919016 - DNA, 14 bp, Homo sapiens
ggctggtgcctgag

SEQ ID NO: 2919017 - DNA, 13 bp, Homo sapiens
ggctggtggccca

SEQ ID NO: 2919018 - DNA, 17 bp, Homo sapiens
ggctggtggtcatgaat

SEQ ID NO: 2919019 - DNA, 16 bp, Homo sapiens
ggctggttccatctag

SEQ ID NO: 2919020 - DNA, 21 bp, Homo sapiens
ggctggttttgatggctgggt

SEQ ID NO: 2919021 - DNA, 17 bp, Homo sapiens
ggctgtacctgttcctc

SEQ ID NO: 2919022 - DNA, 13 bp, Homo sapiens
ggctgtcatctga

SEQ ID NO: 2919023 - DNA, 23 bp, Homo sapiens
ggctgtcccaagctcccaagagc

SEQ ID NO: 2919024 - DNA, 23 bp, Homo sapiens
ggctgtctggatccttcccaagg

SEQ ID NO: 2919025 - DNA, 20 bp, Homo sapiens
ggctgtgaatgccaaagcca

SEQ ID NO: 2919026 - DNA, 13 bp, Homo sapiens
ggctgtgctcaga

SEQ ID NO: 2919027 - DNA, 16 bp, Homo sapiens
ggctgtgctgccctga

SEQ ID NO: 2919028 - DNA, 13 bp, Homo sapiens
ggctgtggagaca

SEQ ID NO: 2919029 - DNA, 16 bp, Homo sapiens
ggctgtgttgactgct

SEQ ID NO: 2919030 - DNA, 23 bp, Homo sapiens
ggcttagtgttttaaaacacctc

SEQ ID NO: 2919031 - DNA, 23 bp, Homo sapiens
ggcttattttgggttcaggcctg

SEQ ID NO: 2919032 - DNA, 13 bp, Homo sapiens
ggcttcagctcca

SEQ ID NO: 2919033 - DNA, 15 bp, Homo sapiens
ggcttcagctccagc

SEQ ID NO: 2919034 - DNA, 18 bp, Homo sapiens
ggcttcagggcaggtggg

SEQ ID NO: 2919035 - DNA, 9 bp, Homo sapiens
ggcttcata

SEQ ID NO: 2919036 - DNA, 21 bp, Homo sapiens
ggcttccccttggcctctctg

SEQ ID NO: 2919037 - DNA, 20 bp, Homo sapiens
ggcttccctgacttgcttta

SEQ ID NO: 2919038 - DNA, 17 bp, Homo sapiens
ggcttcctgagaaagcc

SEQ ID NO: 2919039 - DNA, 17 bp, Homo sapiens
ggcttgccccactctgc

SEQ ID NO: 2919040 - DNA, 23 bp, Homo sapiens
ggcttgccccactctgcctgcct

SEQ ID NO: 2919041 - DNA, 23 bp, Homo sapiens
ggcttgcctgggctgggcagcct

SEQ ID NO: 2919042 - DNA, 22 bp, Homo sapiens
ggggagccccttctgctcagct

SEQ ID NO: 2919043 - DNA, 22 bp, Homo sapiens
ggggagccgagggcgtcagaga

SEQ ID NO: 2919044 - DNA, 19 bp, Homo sapiens
ggggagcctgtggtggcct

SEQ ID NO: 2919045 - DNA, 18 bp, Homo sapiens
ggggagggactgctgacc

SEQ ID NO: 2919046 - DNA, 20 bp, Homo sapiens
ggggagggtgacagtggccg

SEQ ID NO: 2919047 - DNA, 19 bp, Homo sapiens
ggggaggtgggaggccagg

SEQ ID NO: 2919048 - DNA, 17 bp, Homo sapiens
ggggagtctgaagcaga

SEQ ID NO: 2919049 - DNA, 14 bp, Homo sapiens
ggggatagtctggg

SEQ ID NO: 2919050 - DNA, 17 bp, Homo sapiens
ggggatagtctgggtca

SEQ ID NO: 2919051 - DNA, 14 bp, Homo sapiens
ggggatggggagga

SEQ ID NO: 2919052 - DNA, 17 bp, Homo sapiens
ggggcactcccccagga

SEQ ID NO: 2919053 - DNA, 14 bp, Homo sapiens
ggggcagagggctt

SEQ ID NO: 2919054 - DNA, 20 bp, Homo sapiens
ggggcagatcttggactcat

SEQ ID NO: 2919055 - DNA, 20 bp, Homo sapiens
ggggcagcagttgaggtggg

SEQ ID NO: 2919056 - DNA, 11 bp, Homo sapiens
ggggcaggcag

SEQ ID NO: 2919057 - DNA, 13 bp, Homo sapiens
ggggcagggagct

SEQ ID NO: 2919058 - DNA, 17 bp, Homo sapiens
ggggcagggagctgggc

SEQ ID NO: 2919059 - DNA, 19 bp, Homo sapiens
ggggcagggagctgggccc

SEQ ID NO: 2919060 - DNA, 18 bp, Homo sapiens
ggggccaagagtcacttc

SEQ ID NO: 2919061 - DNA, 14 bp, Homo sapiens
ggggccagatccag

SEQ ID NO: 2919062 - DNA, 19 bp, Homo sapiens
ggggcccctggcccaggag

SEQ ID NO: 2919063 - DNA, 21 bp, Homo sapiens
ggggcccctggcccaggagga

SEQ ID NO: 2919064 - DNA, 13 bp, Homo sapiens
ggggcccggccag

SEQ ID NO: 2919065 - DNA, 20 bp, Homo sapiens
ggggcctaggcctcagccag

SEQ ID NO: 2919066 - DNA, 13 bp, Homo sapiens
ggggcctcagacg

SEQ ID NO: 2919067 - DNA, 14 bp, Homo sapiens
ggggcctcagacga

SEQ ID NO: 2919068 - DNA, 20 bp, Homo sapiens
ggggccttgaagactccctg

SEQ ID NO: 2919069 - DNA, 16 bp, Homo sapiens
ggggcgcggctgggag

SEQ ID NO: 2919070 - DNA, 15 bp, Homo sapiens
ggggcggcagggctg

SEQ ID NO: 2919071 - DNA, 19 bp, Homo sapiens
ggggcgggcagccaggctg

SEQ ID NO: 2919072 - DNA, 13 bp, Homo sapiens
ggggcggggactg

SEQ ID NO: 2919073 - DNA, 13 bp, Homo sapiens
ggggcgtccaggc

SEQ ID NO: 2919074 - DNA, 23 bp, Homo sapiens
ggggctccccgggtctctcactg

SEQ ID NO: 2919075 - DNA, 24 bp, Homo sapiens
ggggctctcatgttttcaactgcc

SEQ ID NO: 2919076 - DNA, 16 bp, Homo sapiens
ggggctcttctgagca

SEQ ID NO: 2919077 - DNA, 23 bp, Homo sapiens
ggggctgaattgccaggggcgag

SEQ ID NO: 2919078 - DNA, 15 bp, Homo sapiens
ggggctgctcctcca

SEQ ID NO: 2919079 - DNA, 14 bp, Homo sapiens
ggggctgctggggg

SEQ ID NO: 2919080 - DNA, 16 bp, Homo sapiens
ggggctgctgggggct

SEQ ID NO: 2919081 - DNA, 20 bp, Homo sapiens
ggggctgctgtgtggacggc

SEQ ID NO: 2919082 - DNA, 13 bp, Homo sapiens
ggggctggggagg

SEQ ID NO: 2919083 - DNA, 21 bp, Homo sapiens
ggggctggtgaggccggccct

SEQ ID NO: 2919084 - DNA, 18 bp, Homo sapiens
ggggcttgaatttgcatg

SEQ ID NO: 2919085 - DNA, 17 bp, Homo sapiens
ggggctttcggggaggg

SEQ ID NO: 2919086 - DNA, 17 bp, Homo sapiens
gggggaactcagatcca

SEQ ID NO: 2919087 - DNA, 15 bp, Homo sapiens
gggggacccagtgca

SEQ ID NO: 2919088 - DNA, 15 bp, Homo sapiens
gggggcacaggaggc

SEQ ID NO: 2919089 - DNA, 15 bp, Homo sapiens
gggggccaggcctcg

SEQ ID NO: 2919090 - DNA, 16 bp, Homo sapiens
gggggccaggcctcgc

SEQ ID NO: 2919091 - DNA, 11 bp, Homo sapiens
gggggcctgtg

SEQ ID NO: 2919092 - DNA, 18 bp, Homo sapiens
gggggcgcggctgggagg

SEQ ID NO: 2919093 - DNA, 13 bp, Homo sapiens
gggggcggcaggg

SEQ ID NO: 2919094 - DNA, 19 bp, Homo sapiens
gggggctcccgtggcctgt

SEQ ID NO: 2919095 - DNA, 12 bp, Homo sapiens
gggggctgcctt

SEQ ID NO: 2919096 - DNA, 19 bp, Homo sapiens
gggggctttcggggagggc

SEQ ID NO: 2919097 - DNA, 23 bp, Homo sapiens
gggggctttcggggagggcgcct

SEQ ID NO: 2919098 - DNA, 16 bp, Homo sapiens
ggggggatgtggatca

SEQ ID NO: 2919099 - DNA, 16 bp, Homo sapiens
ggggggcggtgtcagg

SEQ ID NO: 2919100 - DNA, 18 bp, Homo sapiens
gggggtctcacccatgca

SEQ ID NO: 2919101 - DNA, 13 bp, Homo sapiens
gggggttcaggga

SEQ ID NO: 2919102 - DNA, 22 bp, Homo sapiens
ggggtaaagggcgcaaagggca

SEQ ID NO: 2919103 - DNA, 16 bp, Homo sapiens
ggggtcctgggaggct

SEQ ID NO: 2919104 - DNA, 20 bp, Homo sapiens
ggggtcctgggaggctgcag

SEQ ID NO: 2919105 - DNA, 22 bp, Homo sapiens
ggggtcctgggaggctgcagcc

SEQ ID NO: 2919106 - DNA, 13 bp, Homo sapiens
ggggtcggaagcc

SEQ ID NO: 2919107 - DNA, 16 bp, Homo sapiens
ggggtcggacggggca

SEQ ID NO: 2919108 - DNA, 17 bp, Homo sapiens
ggggtctcacccatgca

SEQ ID NO: 2919109 - DNA, 23 bp, Homo sapiens
ggggtctgggaggaatggacaga

SEQ ID NO: 2919110 - DNA, 22 bp, Homo sapiens
ggggtgcacagtccacagctga

SEQ ID NO: 2919111 - DNA, 15 bp, Homo sapiens
ggggtgggcagcagc

SEQ ID NO: 2919112 - DNA, 13 bp, Homo sapiens
ggggtgggccagg

SEQ ID NO: 2919113 - DNA, 17 bp, Homo sapiens
ggggtgggggccaggcc

SEQ ID NO: 2919114 - DNA, 16 bp, Homo sapiens
ggggtggggtcatgcc

SEQ ID NO: 2919115 - DNA, 17 bp, Homo sapiens
ggggtgtccgagaggct

SEQ ID NO: 2919116 - DNA, 15 bp, Homo sapiens
ggggtgtggtggcct

SEQ ID NO: 2919117 - DNA, 13 bp, Homo sapiens
ggggttatgtgga

SEQ ID NO: 2919118 - DNA, 22 bp, Homo sapiens
ggggttcagcccctcctctgcc

SEQ ID NO: 2919119 - DNA, 23 bp, Homo sapiens
ggggttcagcccctcctctgcca

SEQ ID NO: 2919120 - DNA, 13 bp, Homo sapiens
ggggtttcctgca

SEQ ID NO: 2919121 - DNA, 19 bp, Homo sapiens
ggggtttcgcagcctgagt

SEQ ID NO: 2919122 - DNA, 14 bp, Homo sapiens
gggtaaggtgcctt

SEQ ID NO: 2919123 - DNA, 17 bp, Homo sapiens
gggtacagaggggacaa

SEQ ID NO: 2919124 - DNA, 19 bp, Homo sapiens
gggtagagtttacagctct

SEQ ID NO: 2919125 - DNA, 22 bp, Homo sapiens
gggtaggccccacaaggcctgg

SEQ ID NO: 2919126 - DNA, 17 bp, Homo sapiens
gggtatatttttgatac

SEQ ID NO: 2919127 - DNA, 16 bp, Homo sapiens
gggtattgcttgccac

SEQ ID NO: 2919128 - DNA, 13 bp, Homo sapiens
gggtcaaacctgt

SEQ ID NO: 2919129 - DNA, 15 bp, Homo sapiens
gggtcaagctgagct

SEQ ID NO: 2919130 - DNA, 14 bp, Homo sapiens
gggtcacaggaagg

SEQ ID NO: 2919131 - DNA, 17 bp, Homo sapiens
gggtcaccctctccagc

SEQ ID NO: 2919132 - DNA, 15 bp, Homo sapiens
gggtcacttgcaatt

SEQ ID NO: 2919133 - DNA, 16 bp, Homo sapiens
gggtcagaaacaggac

SEQ ID NO: 2919134 - DNA, 15 bp, Homo sapiens
gggtcagacccatct

SEQ ID NO: 2919135 - DNA, 20 bp, Homo sapiens
gggtcagacccatctctccc

SEQ ID NO: 2919136 - DNA, 19 bp, Homo sapiens
gggtcagacgcctgaggaa

SEQ ID NO: 2919137 - DNA, 23 bp, Homo sapiens
gggtcagagaaaatgagaaagga

SEQ ID NO: 2919138 - DNA, 15 bp, Homo sapiens
gggtcatcagggagg

SEQ ID NO: 2919139 - DNA, 22 bp, Homo sapiens
gggtcatgacaagatgggacag

SEQ ID NO: 2919140 - DNA, 17 bp, Homo sapiens
gggtccacttgccaggg

SEQ ID NO: 2919141 - DNA, 21 bp, Homo sapiens
gggtccacttgccagggctct

SEQ ID NO: 2919142 - DNA, 17 bp, Homo sapiens
gggtccggaagggtgat

SEQ ID NO: 2919143 - DNA, 14 bp, Homo sapiens
gggtcctagcccag

SEQ ID NO: 2919144 - DNA, 12 bp, Homo sapiens
gggtcctcggcc

SEQ ID NO: 2919145 - DNA, 19 bp, Homo sapiens
gggtcctcttctgggcctg

SEQ ID NO: 2919146 - DNA, 12 bp, Homo sapiens
gggtcctgcctg

SEQ ID NO: 2919147 - DNA, 14 bp, Homo sapiens
gggtcctgcctgca

SEQ ID NO: 2919148 - DNA, 13 bp, Homo sapiens
gggtcctggccat

SEQ ID NO: 2919149 - DNA, 15 bp, Homo sapiens
gggtcctggccatcc

SEQ ID NO: 2919150 - DNA, 17 bp, Homo sapiens
gggtcctggccatccca

SEQ ID NO: 2919151 - DNA, 13 bp, Homo sapiens
gggtcctgggcag

SEQ ID NO: 2919152 - DNA, 20 bp, Homo sapiens
gggtccttgggcctggccag

SEQ ID NO: 2919153 - DNA, 14 bp, Homo sapiens
gggtcgaaagctct

SEQ ID NO: 2919154 - DNA, 16 bp, Homo sapiens
gggtcgaaagctctag

SEQ ID NO: 2919155 - DNA, 14 bp, Homo sapiens
gggtctagggagag

SEQ ID NO: 2919156 - DNA, 15 bp, Homo sapiens
gggtctattccagct

SEQ ID NO: 2919157 - DNA, 15 bp, Homo sapiens
gggtctcaggtccag

SEQ ID NO: 2919158 - DNA, 20 bp, Homo sapiens
gggtctccctctcctgccta

SEQ ID NO: 2919159 - DNA, 22 bp, Homo sapiens
gggtctctcactgttgcagtgg

SEQ ID NO: 2919160 - DNA, 22 bp, Homo sapiens
gggtctggcagcctcccatcca

SEQ ID NO: 2919161 - DNA, 22 bp, Homo sapiens
gggtcttccttctcattgctgc

SEQ ID NO: 2919162 - DNA, 20 bp, Homo sapiens
gggtcttgccatgtgctggg

SEQ ID NO: 2919163 - DNA, 20 bp, Homo sapiens
gggtgaacaaagcagccacg

SEQ ID NO: 2919164 - DNA, 14 bp, Homo sapiens
gggtgaggagctgg

SEQ ID NO: 2919165 - DNA, 16 bp, Homo sapiens
gggtgatgccaggttc

SEQ ID NO: 2919166 - DNA, 23 bp, Homo sapiens
gggtgattttatgatcagtgttg

SEQ ID NO: 2919167 - DNA, 14 bp, Homo sapiens
gggtgcccttttcc

SEQ ID NO: 2919168 - DNA, 18 bp, Homo sapiens
gggtgctagtggtgggca

SEQ ID NO: 2919169 - DNA, 19 bp, Homo sapiens
gggtgctctgaggcctcac

SEQ ID NO: 2919170 - DNA, 12 bp, Homo sapiens
gggtggagaagc

SEQ ID NO: 2919171 - DNA, 13 bp, Homo sapiens
gggtggagtccca

SEQ ID NO: 2919172 - DNA, 17 bp, Homo sapiens
gggtggatgtgagcaga

SEQ ID NO: 2919173 - DNA, 16 bp, Homo sapiens
gggtggcaggtcactg

SEQ ID NO: 2919174 - DNA, 18 bp, Homo sapiens
gggtggcaggtcactgtc

SEQ ID NO: 2919175 - DNA, 21 bp, Homo sapiens
ggtttgtgagccttgctgcca

SEQ ID NO: 2919176 - DNA, 21 bp, Homo sapiens
ggttttacttacaaaaatggg

SEQ ID NO: 2919177 - DNA, 16 bp, Homo sapiens
ggttttaggttctaaa

SEQ ID NO: 2919178 - DNA, 13 bp, Homo sapiens
ggttttcatttgc

SEQ ID NO: 2919179 - DNA, 13 bp, Homo sapiens
ggttttcctgaaa

SEQ ID NO: 2919180 - DNA, 22 bp, Homo sapiens
ggttttcgtcatcttccctgcc

SEQ ID NO: 2919181 - DNA, 17 bp, Homo sapiens
ggttttgcaataacttc

SEQ ID NO: 2919182 - DNA, 18 bp, Homo sapiens
ggttttgtattctctgag

SEQ ID NO: 2919183 - DNA, 12 bp, Homo sapiens
ggttttgtttgc

SEQ ID NO: 2919184 - DNA, 19 bp, Homo sapiens
ggtttttaaagtaaatctc

SEQ ID NO: 2919185 - DNA, 14 bp, Homo sapiens
ggttttttaatata

SEQ ID NO: 2919186 - DNA, 14 bp, Homo sapiens
gtaaaaaacaaaaa

SEQ ID NO: 2919187 - DNA, 23 bp, Homo sapiens
gtaaaaaacaaaaaaaacaacaa

SEQ ID NO: 2919188 - DNA, 11 bp, Homo sapiens
gtaaaaaagaa

SEQ ID NO: 2919189 - DNA, 15 bp, Homo sapiens
gtaaaaaatggaaaa

SEQ ID NO: 2919190 - DNA, 21 bp, Homo sapiens
gtaaaaaatggaaaaaaacat

SEQ ID NO: 2919191 - DNA, 21 bp, Homo sapiens
gtaaaaacagcattgctttct

SEQ ID NO: 2919192 - DNA, 16 bp, Homo sapiens
gtaaaaataatgaatg

SEQ ID NO: 2919193 - DNA, 14 bp, Homo sapiens
gtaaaaatttaatt

SEQ ID NO: 2919194 - DNA, 14 bp, Homo sapiens
gtaaaacacagagg

SEQ ID NO: 2919195 - DNA, 23 bp, Homo sapiens
gtaaaagatgcagagtaagtatt

SEQ ID NO: 2919196 - DNA, 12 bp, Homo sapiens
gtaaaagtagtg

SEQ ID NO: 2919197 - DNA, 14 bp, Homo sapiens
gtaaacagaataaa

SEQ ID NO: 2919198 - DNA, 18 bp, Homo sapiens
gtaaacagtgcctgctga

SEQ ID NO: 2919199 - DNA, 21 bp, Homo sapiens
gtaaaccgctttggcctgagt

SEQ ID NO: 2919200 - DNA, 19 bp, Homo sapiens
gtaaagaaagagagaaaat

SEQ ID NO: 2919201 - DNA, 22 bp, Homo sapiens
gtaaagaaagagagaaaataaa

SEQ ID NO: 2919202 - DNA, 17 bp, Homo sapiens
gtaaagaactttttctt

SEQ ID NO: 2919203 - DNA, 12 bp, Homo sapiens
gtaaagctccta

SEQ ID NO: 2919204 - DNA, 16 bp, Homo sapiens
gtaaagtaatgcattt

SEQ ID NO: 2919205 - DNA, 19 bp, Homo sapiens
gtaaagtccttttcttgct

SEQ ID NO: 2919206 - DNA, 20 bp, Homo sapiens
gtaaagtccttttcttgctt

SEQ ID NO: 2919207 - DNA, 21 bp, Homo sapiens
gtaaagtgtggtcccaacagg

SEQ ID NO: 2919208 - DNA, 18 bp, Homo sapiens
gtaaagttagtctactct

SEQ ID NO: 2919209 - DNA, 14 bp, Homo sapiens
gtaaataaagccct

SEQ ID NO: 2919210 - DNA, 12 bp, Homo sapiens
gtaaataaagtc

SEQ ID NO: 2919211 - DNA, 15 bp, Homo sapiens
gtaaataaagtctat

SEQ ID NO: 2919212 - DNA, 14 bp, Homo sapiens
gtaaataaattttg

SEQ ID NO: 2919213 - DNA, 20 bp, Homo sapiens
gtaaatacatcactgtatac

SEQ ID NO: 2919214 - DNA, 20 bp, Homo sapiens
gtaaatacatcctttttctg

SEQ ID NO: 2919215 - DNA, 22 bp, Homo sapiens
gtaaatacatcctttttctgct

SEQ ID NO: 2919216 - DNA, 14 bp, Homo sapiens
gtaaatagatttta

SEQ ID NO: 2919217 - DNA, 21 bp, Homo sapiens
gtaaatatcccaaactgtgat

SEQ ID NO: 2919218 - DNA, 16 bp, Homo sapiens
gtaaatatggggatag

SEQ ID NO: 2919219 - DNA, 17 bp, Homo sapiens
gtaaatcacatccttat

SEQ ID NO: 2919220 - DNA, 17 bp, Homo sapiens
gtaaatcgggaaggatg

SEQ ID NO: 2919221 - DNA, 18 bp, Homo sapiens
gtaaatcgggaaggatgg

SEQ ID NO: 2919222 - DNA, 15 bp, Homo sapiens
gtaaatctagagttt

SEQ ID NO: 2919223 - DNA, 14 bp, Homo sapiens
gtaaatcttttaca

SEQ ID NO: 2919224 - DNA, 17 bp, Homo sapiens
gtaaatgaactgatttt

SEQ ID NO: 2919225 - DNA, 18 bp, Homo sapiens
gtaaatgaactgattttt

SEQ ID NO: 2919226 - DNA, 21 bp, Homo sapiens
gtaaatgaagatctttatatt

SEQ ID NO: 2919227 - DNA, 11 bp, Homo sapiens
gtaaatgccac

SEQ ID NO: 2919228 - DNA, 22 bp, Homo sapiens
gtaaatgtactggtaattgtac

SEQ ID NO: 2919229 - DNA, 16 bp, Homo sapiens
gtaaatgttagtttct

SEQ ID NO: 2919230 - DNA, 19 bp, Homo sapiens
gtaaatgttagtttcttgg

SEQ ID NO: 2919231 - DNA, 15 bp, Homo sapiens
gtaaattatatttgt

SEQ ID NO: 2919232 - DNA, 19 bp, Homo sapiens
gtaaatttccccaacagtg

SEQ ID NO: 2919233 - DNA, 14 bp, Homo sapiens
gtaaatttggattt

SEQ ID NO: 2919234 - DNA, 13 bp, Homo sapiens
gtaacaagccaga

SEQ ID NO: 2919235 - DNA, 16 bp, Homo sapiens
gtaacaagccagattt

SEQ ID NO: 2919236 - DNA, 23 bp, Homo sapiens
gtaacaagccagattttttaaaa

SEQ ID NO: 2919237 - DNA, 12 bp, Homo sapiens
gtaacagaaagg

SEQ ID NO: 2919238 - DNA, 16 bp, Homo sapiens
gtaacagaaagggcaa

SEQ ID NO: 2919239 - DNA, 21 bp, Homo sapiens
gtaacagaaagggcaacaata

SEQ ID NO: 2919240 - DNA, 23 bp, Homo sapiens
gtaacagaaagggcaacaataaa

SEQ ID NO: 2919241 - DNA, 22 bp, Homo sapiens
gtaacaggtccttcccagattt

SEQ ID NO: 2919242 - DNA, 16 bp, Homo sapiens
gtaacatcagccattt

SEQ ID NO: 2919243 - DNA, 19 bp, Homo sapiens
gtaaccacctctctgtctt

SEQ ID NO: 2919244 - DNA, 17 bp, Homo sapiens
gtaaccagctcagtgtt

SEQ ID NO: 2919245 - DNA, 13 bp, Homo sapiens
gtaactaggttga

SEQ ID NO: 2919246 - DNA, 13 bp, Homo sapiens
gtaactgacaact

SEQ ID NO: 2919247 - DNA, 13 bp, Homo sapiens
gtaactgtccctg

SEQ ID NO: 2919248 - DNA, 19 bp, Homo sapiens
gtaactgtccctgctttct

SEQ ID NO: 2919249 - DNA, 13 bp, Homo sapiens
gtaacttattttg

SEQ ID NO: 2919250 - DNA, 15 bp, Homo sapiens
gtaactttatgtgta

SEQ ID NO: 2919251 - DNA, 18 bp, Homo sapiens
gtaactttattcttgaaa

SEQ ID NO: 2919252 - DNA, 19 bp, Homo sapiens
gtaagaaaatgctagaaga

SEQ ID NO: 2919253 - DNA, 20 bp, Homo sapiens
gtaagaaagtgaagcaaatc

SEQ ID NO: 2919254 - DNA, 17 bp, Homo sapiens
gtaagaacagctcatct

SEQ ID NO: 2919255 - DNA, 16 bp, Homo sapiens
gtaagaagaggagcct

SEQ ID NO: 2919256 - DNA, 21 bp, Homo sapiens
gtaagaagaggagcctcagaa

SEQ ID NO: 2919257 - DNA, 12 bp, Homo sapiens
gtaagacaacat

SEQ ID NO: 2919258 - DNA, 23 bp, Homo sapiens
gtaagagctgatgtgagtgtgtg

SEQ ID NO: 2919259 - DNA, 18 bp, Homo sapiens
gtaagattatagattcta

SEQ ID NO: 2919260 - DNA, 21 bp, Homo sapiens
gtaagattatagattctaaag

SEQ ID NO: 2919261 - DNA, 22 bp, Homo sapiens
gtaagattatagattctaaaga

SEQ ID NO: 2919262 - DNA, 19 bp, Homo sapiens
gtaagcaacttgcttctaa

SEQ ID NO: 2919263 - DNA, 17 bp, Homo sapiens
gtaagcactgtttttcc

SEQ ID NO: 2919264 - DNA, 18 bp, Homo sapiens
gtaagcagagttctttgc

SEQ ID NO: 2919265 - DNA, 23 bp, Homo sapiens
gtaagcataagcttatgcttaaa

SEQ ID NO: 2919266 - DNA, 17 bp, Homo sapiens
gtaagcttttaaaatta

SEQ ID NO: 2919267 - DNA, 13 bp, Homo sapiens
gtaaggtctttgt

SEQ ID NO: 2919268 - DNA, 23 bp, Homo sapiens
gtaaggtgtcttaatactgtcct

SEQ ID NO: 2919269 - DNA, 16 bp, Homo sapiens
gtaagtataacaaact

SEQ ID NO: 2919270 - DNA, 17 bp, Homo sapiens
gtaagtgggcccacccg

SEQ ID NO: 2919271 - DNA, 12 bp, Homo sapiens
gtaataaaatca

SEQ ID NO: 2919272 - DNA, 15 bp, Homo sapiens
gtaatagctttagtg

SEQ ID NO: 2919273 - DNA, 21 bp, Homo sapiens
gtaatatactgagctgctaaa

SEQ ID NO: 2919274 - DNA, 18 bp, Homo sapiens
gtaatattctctgatgtt

SEQ ID NO: 2919275 - DNA, 15 bp, Homo sapiens
gtaatccacctgcct

SEQ ID NO: 2919276 - DNA, 12 bp, Homo sapiens
gtaatcccagca

SEQ ID NO: 2919277 - DNA, 16 bp, Homo sapiens
gtaatcccagcacact

SEQ ID NO: 2919278 - DNA, 20 bp, Homo sapiens
gtaatcccagcactttggga

SEQ ID NO: 2919279 - DNA, 17 bp, Homo sapiens
gtaatcccagctactca

SEQ ID NO: 2919280 - DNA, 20 bp, Homo sapiens
gtaatcccagctacttggga

SEQ ID NO: 2919281 - DNA, 22 bp, Homo sapiens
gtaatctatgtttataatacta

SEQ ID NO: 2919282 - DNA, 16 bp, Homo sapiens
gtaatctcgtttcaaa

SEQ ID NO: 2919283 - DNA, 16 bp, Homo sapiens
gtaatgatgttgataa

SEQ ID NO: 2919284 - DNA, 20 bp, Homo sapiens
gtaatgccacacattgtgct

SEQ ID NO: 2919285 - DNA, 15 bp, Homo sapiens
gtaatgcgattttat

SEQ ID NO: 2919286 - DNA, 20 bp, Homo sapiens
gtaatgcgattttattactg

SEQ ID NO: 2919287 - DNA, 16 bp, Homo sapiens
gtaatgctaaatgtgt

SEQ ID NO: 2919288 - DNA, 22 bp, Homo sapiens
gtaatgctacgtgtgatttttc

SEQ ID NO: 2919289 - DNA, 16 bp, Homo sapiens
gtaatgcttatgtgtt

SEQ ID NO: 2919290 - DNA, 21 bp, Homo sapiens
gtaatgttttctttgcaaagt

SEQ ID NO: 2919291 - DNA, 15 bp, Homo sapiens
gtaattagtaacatg

SEQ ID NO: 2919292 - DNA, 23 bp, Homo sapiens
gtaattgtactaaagccaaacat

SEQ ID NO: 2919293 - DNA, 13 bp, Homo sapiens
gtaattgtgaaaa

SEQ ID NO: 2919294 - DNA, 18 bp, Homo sapiens
gtaatttagattgtaaac

SEQ ID NO: 2919295 - DNA, 14 bp, Homo sapiens
gtaatttctttgcc

SEQ ID NO: 2919296 - DNA, 22 bp, Homo sapiens
gtaatttctttgcctgttcagt

SEQ ID NO: 2919297 - DNA, 21 bp, Homo sapiens
gtaatttctttttttcctttt

SEQ ID NO: 2919298 - DNA, 21 bp, Homo sapiens
gtaatttttttaatttacaaa

SEQ ID NO: 2919299 - DNA, 14 bp, Homo sapiens
gtacaaaatggtcc

SEQ ID NO: 2919300 - DNA, 18 bp, Homo sapiens
gtacaaactaaggtgcta

SEQ ID NO: 2919301 - DNA, 22 bp, Homo sapiens
gtacaacatttatatattgtct

SEQ ID NO: 2919302 - DNA, 23 bp, Homo sapiens
gtacaacatttatatattgtctg

SEQ ID NO: 2919303 - DNA, 23 bp, Homo sapiens
gtacaacggaggcctgcgaccct

SEQ ID NO: 2919304 - DNA, 19 bp, Homo sapiens
gtacaagctcttgtttctg

SEQ ID NO: 2919305 - DNA, 13 bp, Homo sapiens
gtacaaggcatgg

SEQ ID NO: 2919306 - DNA, 13 bp, Homo sapiens
gtacaagttgctt

SEQ ID NO: 2919307 - DNA, 21 bp, Homo sapiens
gtcagcgcctggcctacccag

SEQ ID NO: 2919308 - DNA, 16 bp, Homo sapiens
gtcagcggtatgtgcg

SEQ ID NO: 2919309 - DNA, 19 bp, Homo sapiens
gtcagctctcatctgaggc

SEQ ID NO: 2919310 - DNA, 18 bp, Homo sapiens
gtcagctgaccccctccc

SEQ ID NO: 2919311 - DNA, 22 bp, Homo sapiens
gtcagctgaccccctcccccca

SEQ ID NO: 2919312 - DNA, 19 bp, Homo sapiens
gtcagctgctgttgaactt

SEQ ID NO: 2919313 - DNA, 19 bp, Homo sapiens
gtcagcttttgttgtttat

SEQ ID NO: 2919314 - DNA, 18 bp, Homo sapiens
gtcaggaccaggacccag

SEQ ID NO: 2919315 - DNA, 22 bp, Homo sapiens
gtcaggagttcaagaccagcct

SEQ ID NO: 2919316 - DNA, 23 bp, Homo sapiens
gtcaggagttcaagaccagcctg

SEQ ID NO: 2919317 - DNA, 23 bp, Homo sapiens
gtcaggagttcgagaccagcctg

SEQ ID NO: 2919318 - DNA, 14 bp, Homo sapiens
gtcaggcaattgat

SEQ ID NO: 2919319 - DNA, 20 bp, Homo sapiens
gtcaggcccgtcggagctgc

SEQ ID NO: 2919320 - DNA, 14 bp, Homo sapiens
gtcaggccctctgc

SEQ ID NO: 2919321 - DNA, 19 bp, Homo sapiens
gtcaggccctctgcctgca

SEQ ID NO: 2919322 - DNA, 11 bp, Homo sapiens
gtcaggctggt

SEQ ID NO: 2919323 - DNA, 15 bp, Homo sapiens
gtcagggagggccag

SEQ ID NO: 2919324 - DNA, 22 bp, Homo sapiens
gtcagggagggccagggaggca

SEQ ID NO: 2919325 - DNA, 17 bp, Homo sapiens
gtcaggggtcaggtgtc

SEQ ID NO: 2919326 - DNA, 22 bp, Homo sapiens
gtcaggggtcaggtgtcaggcc

SEQ ID NO: 2919327 - DNA, 21 bp, Homo sapiens
gtcaggggtgacacagactca

SEQ ID NO: 2919328 - DNA, 15 bp, Homo sapiens
gtcaggggtgcacag

SEQ ID NO: 2919329 - DNA, 17 bp, Homo sapiens
gtcaggtcccagcgagc

SEQ ID NO: 2919330 - DNA, 18 bp, Homo sapiens
gtcaggtcccagcgagcc

SEQ ID NO: 2919331 - DNA, 20 bp, Homo sapiens
gtcaggtggaccctgtaaat

SEQ ID NO: 2919332 - DNA, 16 bp, Homo sapiens
gtcagtagccattttt

SEQ ID NO: 2919333 - DNA, 18 bp, Homo sapiens
gtcagtggggctctctga

SEQ ID NO: 2919334 - DNA, 15 bp, Homo sapiens
gtcataccaatgaaa

SEQ ID NO: 2919335 - DNA, 12 bp, Homo sapiens
gtcatagaaatt

SEQ ID NO: 2919336 - DNA, 14 bp, Homo sapiens
gtcatagattcttg

SEQ ID NO: 2919337 - DNA, 14 bp, Homo sapiens
gtcatcaacaatga

SEQ ID NO: 2919338 - DNA, 20 bp, Homo sapiens
gtcatcaacattcttgtgtc

SEQ ID NO: 2919339 - DNA, 14 bp, Homo sapiens
gtcatcatctcttg

SEQ ID NO: 2919340 - DNA, 17 bp, Homo sapiens
gtcatcctcaggaacca

SEQ ID NO: 2919341 - DNA, 18 bp, Homo sapiens
gtcatccttggtgctctt

SEQ ID NO: 2919342 - DNA, 18 bp, Homo sapiens
gtcatcgttccccacccc

SEQ ID NO: 2919343 - DNA, 17 bp, Homo sapiens
gtcatctcattccactg

SEQ ID NO: 2919344 - DNA, 21 bp, Homo sapiens
gtcatctgataatttcacaga

SEQ ID NO: 2919345 - DNA, 14 bp, Homo sapiens
gtcatcttccctgc

SEQ ID NO: 2919346 - DNA, 15 bp, Homo sapiens
gtcatcttccctgcc

SEQ ID NO: 2919347 - DNA, 16 bp, Homo sapiens
gtcatcttccctgccc

SEQ ID NO: 2919348 - DNA, 19 bp, Homo sapiens
gtcatcttccctgcccctg

SEQ ID NO: 2919349 - DNA, 22 bp, Homo sapiens
gtcatgaattcatactctgttg

SEQ ID NO: 2919350 - DNA, 16 bp, Homo sapiens
gtcatgatctccctgc

SEQ ID NO: 2919351 - DNA, 17 bp, Homo sapiens
gtcatgatctccctgcc

SEQ ID NO: 2919352 - DNA, 18 bp, Homo sapiens
gtcatgatctccctgccg

SEQ ID NO: 2919353 - DNA, 19 bp, Homo sapiens
gtcatgatctccctgccgc

SEQ ID NO: 2919354 - DNA, 22 bp, Homo sapiens
gtcatgatctccctgccgcctc

SEQ ID NO: 2919355 - DNA, 12 bp, Homo sapiens
gtcatgcatgaa

SEQ ID NO: 2919356 - DNA, 12 bp, Homo sapiens
gtcatggccaca

SEQ ID NO: 2919357 - DNA, 15 bp, Homo sapiens
gtcatggccacactg

SEQ ID NO: 2919358 - DNA, 16 bp, Homo sapiens
gtcatggccacactgt

SEQ ID NO: 2919359 - DNA, 18 bp, Homo sapiens
gtcatggccacactgtga

SEQ ID NO: 2919360 - DNA, 20 bp, Homo sapiens
gtcatggggatcaattttca

SEQ ID NO: 2919361 - DNA, 16 bp, Homo sapiens
gtcatgttttaaatgt

SEQ ID NO: 2919362 - DNA, 21 bp, Homo sapiens
gtcatgttttaaatgtacagt

SEQ ID NO: 2919363 - DNA, 22 bp, Homo sapiens
gtcattatttgataacattttg

SEQ ID NO: 2919364 - DNA, 15 bp, Homo sapiens
gtcattcaataaatt

SEQ ID NO: 2919365 - DNA, 16 bp, Homo sapiens
gtcattcgttctgtgg

SEQ ID NO: 2919366 - DNA, 15 bp, Homo sapiens
gtcattgagggacca

SEQ ID NO: 2919367 - DNA, 15 bp, Homo sapiens
gtcattgctgtagga

SEQ ID NO: 2919368 - DNA, 20 bp, Homo sapiens
gtcatttactcaaaatctgt

SEQ ID NO: 2919369 - DNA, 20 bp, Homo sapiens
gtcatttagagtttcacaga

SEQ ID NO: 2919370 - DNA, 21 bp, Homo sapiens
gtcatttatgtgtcagttcat

SEQ ID NO: 2919371 - DNA, 18 bp, Homo sapiens
gtcattttggcatctgca

SEQ ID NO: 2919372 - DNA, 18 bp, Homo sapiens
gtccaaaaaaaggaaaaa

SEQ ID NO: 2919373 - DNA, 20 bp, Homo sapiens
gtccaaaaaaaggaaaaata

SEQ ID NO: 2919374 - DNA, 20 bp, Homo sapiens
gtccaaaaagctcctggggc

SEQ ID NO: 2919375 - DNA, 17 bp, Homo sapiens
gtccaaaataataacat

SEQ ID NO: 2919376 - DNA, 20 bp, Homo sapiens
gtccaaacaggtgctggccc

SEQ ID NO: 2919377 - DNA, 17 bp, Homo sapiens
gtccaacctaacccctt

SEQ ID NO: 2919378 - DNA, 20 bp, Homo sapiens
gtccaacctaacccctttcc

SEQ ID NO: 2919379 - DNA, 21 bp, Homo sapiens
gtccaagaccagactcgccaa

SEQ ID NO: 2919380 - DNA, 21 bp, Homo sapiens
gtccaaggtttaaagagtcta

SEQ ID NO: 2919381 - DNA, 17 bp, Homo sapiens
gtccaatcctatgtttt

SEQ ID NO: 2919382 - DNA, 13 bp, Homo sapiens
gtccacagcttcc

SEQ ID NO: 2919383 - DNA, 13 bp, Homo sapiens
gtccacagggcac

SEQ ID NO: 2919384 - DNA, 18 bp, Homo sapiens
gtccacatccccagagcc

SEQ ID NO: 2919385 - DNA, 19 bp, Homo sapiens
gtccacatccccagagccc

SEQ ID NO: 2919386 - DNA, 23 bp, Homo sapiens
gtccacatccccagagcccagct

SEQ ID NO: 2919387 - DNA, 23 bp, Homo sapiens
gtccaccctttcatagagaggcc

SEQ ID NO: 2919388 - DNA, 21 bp, Homo sapiens
gtccacctggccccatgtctc

SEQ ID NO: 2919389 - DNA, 15 bp, Homo sapiens
gtccacgactgtctc

SEQ ID NO: 2919390 - DNA, 17 bp, Homo sapiens
gtccacgcggccacctc

SEQ ID NO: 2919391 - DNA, 20 bp, Homo sapiens
gtccacgcggccacctcacc

SEQ ID NO: 2919392 - DNA, 17 bp, Homo sapiens
gtccacttgccagggct

SEQ ID NO: 2919393 - DNA, 11 bp, Homo sapiens
gtccagaagga

SEQ ID NO: 2919394 - DNA, 20 bp, Homo sapiens
gtccagaaggagacaggcag

SEQ ID NO: 2919395 - DNA, 22 bp, Homo sapiens
gtccagagccggcatccttgcc

SEQ ID NO: 2919396 - DNA, 19 bp, Homo sapiens
gtccagcaccttgtgcctg

SEQ ID NO: 2919397 - DNA, 17 bp, Homo sapiens
gtccagcagtttccagt

SEQ ID NO: 2919398 - DNA, 16 bp, Homo sapiens
gtccagcccccagtgc

SEQ ID NO: 2919399 - DNA, 23 bp, Homo sapiens
gtccagcctgccccggagctgga

SEQ ID NO: 2919400 - DNA, 14 bp, Homo sapiens
gtccagctccaacc

SEQ ID NO: 2919401 - DNA, 18 bp, Homo sapiens
gtccagctcccgctgtgg

SEQ ID NO: 2919402 - DNA, 23 bp, Homo sapiens
gtccagctcccgctgtggccgca

SEQ ID NO: 2919403 - DNA, 19 bp, Homo sapiens
gtccagctgcccttccgca

SEQ ID NO: 2919404 - DNA, 16 bp, Homo sapiens
gtccagcttgctcttc

SEQ ID NO: 2919405 - DNA, 23 bp, Homo sapiens
gtccagtgcattttgtttctgta

SEQ ID NO: 2919406 - DNA, 17 bp, Homo sapiens
gtccatcctcctctcca

SEQ ID NO: 2919407 - DNA, 21 bp, Homo sapiens
gtccatcctcctctccatgca

SEQ ID NO: 2919408 - DNA, 16 bp, Homo sapiens
gtccatctctctccct

SEQ ID NO: 2919409 - DNA, 14 bp, Homo sapiens
gtccatctgcccgc

SEQ ID NO: 2919410 - DNA, 17 bp, Homo sapiens
gtccatgctccagggtc

SEQ ID NO: 2919411 - DNA, 20 bp, Homo sapiens
gtccatgctccagggtcagg

SEQ ID NO: 2919412 - DNA, 13 bp, Homo sapiens
gtccatgggcaga

SEQ ID NO: 2919413 - DNA, 17 bp, Homo sapiens
gtccatgggtctggcct

SEQ ID NO: 2919414 - DNA, 15 bp, Homo sapiens
gtccattttgtgaag

SEQ ID NO: 2919415 - DNA, 22 bp, Homo sapiens
gtccattttgtgaagccctgtt

SEQ ID NO: 2919416 - DNA, 19 bp, Homo sapiens
gtcccaaatccgccagtgt

SEQ ID NO: 2919417 - DNA, 20 bp, Homo sapiens
gtcccaacaggaggacaatt

SEQ ID NO: 2919418 - DNA, 22 bp, Homo sapiens
gtcccaaggtgaaatgaagcaa

SEQ ID NO: 2919419 - DNA, 18 bp, Homo sapiens
gtcccactcaagccaagc

SEQ ID NO: 2919420 - DNA, 12 bp, Homo sapiens
gtcccagagctg

SEQ ID NO: 2919421 - DNA, 17 bp, Homo sapiens
gtcccagagctgcacag

SEQ ID NO: 2919422 - DNA, 18 bp, Homo sapiens
gtcccagcgagccacagg

SEQ ID NO: 2919423 - DNA, 20 bp, Homo sapiens
gtcccagcgagccacaggaa

SEQ ID NO: 2919424 - DNA, 21 bp, Homo sapiens
gtcccagcggcctcagggtct

SEQ ID NO: 2919425 - DNA, 16 bp, Homo sapiens
gtcccaggaagcaggg

SEQ ID NO: 2919426 - DNA, 21 bp, Homo sapiens
gtcccaggggcagccacacca

SEQ ID NO: 2919427 - DNA, 21 bp, Homo sapiens
gtcccatcacgtgtactggct

SEQ ID NO: 2919428 - DNA, 15 bp, Homo sapiens
gtcccatcggaagtt

SEQ ID NO: 2919429 - DNA, 22 bp, Homo sapiens
gtcccattgttggcgctgaggt

SEQ ID NO: 2919430 - DNA, 23 bp, Homo sapiens
gtccccacagactgccccagcca

SEQ ID NO: 2919431 - DNA, 12 bp, Homo sapiens
gtccccatctgt

SEQ ID NO: 2919432 - DNA, 14 bp, Homo sapiens
gtccccatctgtcg

SEQ ID NO: 2919433 - DNA, 20 bp, Homo sapiens
gtcccccagccccatgctcc

SEQ ID NO: 2919434 - DNA, 13 bp, Homo sapiens
gtccccccaccct

SEQ ID NO: 2919435 - DNA, 13 bp, Homo sapiens
gtccccccccagg

SEQ ID NO: 2919436 - DNA, 14 bp, Homo sapiens
gtccccccccaggc

SEQ ID NO: 2919437 - DNA, 15 bp, Homo sapiens
gtccccccccaggcc

SEQ ID NO: 2919438 - DNA, 12 bp, Homo sapiens
gtgaagcccttt

SEQ ID NO: 2919439 - DNA, 23 bp, Homo sapiens
gtgaagccctttgcctgtagagc

SEQ ID NO: 2919440 - DNA, 20 bp, Homo sapiens
gtgaaggccgagaagcaaga

SEQ ID NO: 2919441 - DNA, 12 bp, Homo sapiens
gtgaaggctggc

SEQ ID NO: 2919442 - DNA, 14 bp, Homo sapiens
gtgaaggctggcat

SEQ ID NO: 2919443 - DNA, 17 bp, Homo sapiens
gtgaagtatactgtatt

SEQ ID NO: 2919444 - DNA, 20 bp, Homo sapiens
gtgaagtgaggacaaaatca

SEQ ID NO: 2919445 - DNA, 22 bp, Homo sapiens
gtgaagttacatgcataaaagg

SEQ ID NO: 2919446 - DNA, 17 bp, Homo sapiens
gtgaagttagaattcct

SEQ ID NO: 2919447 - DNA, 15 bp, Homo sapiens
gtgaagttgtaaaca

SEQ ID NO: 2919448 - DNA, 16 bp, Homo sapiens
gtgaataataaataca

SEQ ID NO: 2919449 - DNA, 21 bp, Homo sapiens
gtgaatactcttcccacatac

SEQ ID NO: 2919450 - DNA, 22 bp, Homo sapiens
gtgaatatgcctgtaattcagt

SEQ ID NO: 2919451 - DNA, 21 bp, Homo sapiens
gtgaatatttgtaaaaataat

SEQ ID NO: 2919452 - DNA, 15 bp, Homo sapiens
gtgaatcagacccta

SEQ ID NO: 2919453 - DNA, 17 bp, Homo sapiens
gtgaatgccaaagccat

SEQ ID NO: 2919454 - DNA, 19 bp, Homo sapiens
gtgaatgccagtgtgctga

SEQ ID NO: 2919455 - DNA, 18 bp, Homo sapiens
gtgaatgcttctgattta

SEQ ID NO: 2919456 - DNA, 16 bp, Homo sapiens
gtgaatggtctctgtc

SEQ ID NO: 2919457 - DNA, 14 bp, Homo sapiens
gtgaatgtcttcct

SEQ ID NO: 2919458 - DNA, 19 bp, Homo sapiens
gtgaattaatgatgaggat

SEQ ID NO: 2919459 - DNA, 20 bp, Homo sapiens
gtgaatttgagtttgctgtt

SEQ ID NO: 2919460 - DNA, 14 bp, Homo sapiens
gtgaatttttctct

SEQ ID NO: 2919461 - DNA, 17 bp, Homo sapiens
gtgaatttttgcaataa

SEQ ID NO: 2919462 - DNA, 21 bp, Homo sapiens
gtgacaagcagatactgctgt

SEQ ID NO: 2919463 - DNA, 14 bp, Homo sapiens
gtgacaataaaaca

SEQ ID NO: 2919464 - DNA, 15 bp, Homo sapiens
gtgacaatctgcctt

SEQ ID NO: 2919465 - DNA, 22 bp, Homo sapiens
gtgacaatgactaagccaagct

SEQ ID NO: 2919466 - DNA, 21 bp, Homo sapiens
gtgacaatgcttatggaaagc

SEQ ID NO: 2919467 - DNA, 19 bp, Homo sapiens
gtgacaattctgtttttaa

SEQ ID NO: 2919468 - DNA, 18 bp, Homo sapiens
gtgacacactacaccaca

SEQ ID NO: 2919469 - DNA, 22 bp, Homo sapiens
gtgacacactacaccacacaca

SEQ ID NO: 2919470 - DNA, 18 bp, Homo sapiens
gtgacacccaagagggct

SEQ ID NO: 2919471 - DNA, 16 bp, Homo sapiens
gtgacactctccttgc

SEQ ID NO: 2919472 - DNA, 19 bp, Homo sapiens
gtgacagactcctgaggac

SEQ ID NO: 2919473 - DNA, 13 bp, Homo sapiens
gtgacagggaagc

SEQ ID NO: 2919474 - DNA, 17 bp, Homo sapiens
gtgacagggaagctaca

SEQ ID NO: 2919475 - DNA, 22 bp, Homo sapiens
gtgacagggaagctacaggtta

SEQ ID NO: 2919476 - DNA, 17 bp, Homo sapiens
gtgaccaatacatttgt

SEQ ID NO: 2919477 - DNA, 16 bp, Homo sapiens
gtgaccaatgtcttga

SEQ ID NO: 2919478 - DNA, 16 bp, Homo sapiens
gtgaccaggcagtttt

SEQ ID NO: 2919479 - DNA, 17 bp, Homo sapiens
gtgaccaggcagttttt

SEQ ID NO: 2919480 - DNA, 15 bp, Homo sapiens
gtgaccagtttctta

SEQ ID NO: 2919481 - DNA, 17 bp, Homo sapiens
gtgacccctcctggggc

SEQ ID NO: 2919482 - DNA, 18 bp, Homo sapiens
gtgacccctcctggggcc

SEQ ID NO: 2919483 - DNA, 21 bp, Homo sapiens
gtgaccctctgctgaagactt

SEQ ID NO: 2919484 - DNA, 18 bp, Homo sapiens
gtgaccgcctcctgctct

SEQ ID NO: 2919485 - DNA, 20 bp, Homo sapiens
gtgacctatcagttattaat

SEQ ID NO: 2919486 - DNA, 19 bp, Homo sapiens
gtgacctccatactgggct

SEQ ID NO: 2919487 - DNA, 19 bp, Homo sapiens
gtgacctgaagttcaccat

SEQ ID NO: 2919488 - DNA, 14 bp, Homo sapiens
gtgacctgaggaag

SEQ ID NO: 2919489 - DNA, 20 bp, Homo sapiens
gtgaccttagtgtttctgtg

SEQ ID NO: 2919490 - DNA, 23 bp, Homo sapiens
gtgaccttagtgtttctgtgcat

SEQ ID NO: 2919491 - DNA, 20 bp, Homo sapiens
gtgaccttccaagagcctga

SEQ ID NO: 2919492 - DNA, 18 bp, Homo sapiens
gtgacgccccggggcgcc

SEQ ID NO: 2919493 - DNA, 15 bp, Homo sapiens
gtgacgctgaataaa

SEQ ID NO: 2919494 - DNA, 17 bp, Homo sapiens
gtgacgctgaataaatg

SEQ ID NO: 2919495 - DNA, 18 bp, Homo sapiens
gtgacgctgaataaatgt

SEQ ID NO: 2919496 - DNA, 17 bp, Homo sapiens
gtgacgtgactcagagc

SEQ ID NO: 2919497 - DNA, 18 bp, Homo sapiens
gtgacgtgactcagagct

SEQ ID NO: 2919498 - DNA, 16 bp, Homo sapiens
gtgacgtgcactgtga

SEQ ID NO: 2919499 - DNA, 19 bp, Homo sapiens
gtgactaattgtataacag

SEQ ID NO: 2919500 - DNA, 16 bp, Homo sapiens
gtgactcagcagaggc

SEQ ID NO: 2919501 - DNA, 16 bp, Homo sapiens
gtgactcagcagcctg

SEQ ID NO: 2919502 - DNA, 19 bp, Homo sapiens
gtgactcctgaagggaagg

SEQ ID NO: 2919503 - DNA, 13 bp, Homo sapiens
gtgactctgggca

SEQ ID NO: 2919504 - DNA, 16 bp, Homo sapiens
gtgactctgtccagct

SEQ ID NO: 2919505 - DNA, 18 bp, Homo sapiens
gtgactgaaaccattttc

SEQ ID NO: 2919506 - DNA, 16 bp, Homo sapiens
gtgactgccccaactc

SEQ ID NO: 2919507 - DNA, 14 bp, Homo sapiens
gtgactttctgaaa

SEQ ID NO: 2919508 - DNA, 20 bp, Homo sapiens
gtgagaacctgggttgcaga

SEQ ID NO: 2919509 - DNA, 16 bp, Homo sapiens
gtgagacagtgggaaa

SEQ ID NO: 2919510 - DNA, 14 bp, Homo sapiens
gtgagaccagggga

SEQ ID NO: 2919511 - DNA, 21 bp, Homo sapiens
gtgagaccaggggaccagagg

SEQ ID NO: 2919512 - DNA, 13 bp, Homo sapiens
gtgagacccagga

SEQ ID NO: 2919513 - DNA, 15 bp, Homo sapiens
gtgagactccatctc

SEQ ID NO: 2919514 - DNA, 19 bp, Homo sapiens
gtgagagacattaactcat

SEQ ID NO: 2919515 - DNA, 18 bp, Homo sapiens
gtgagagcatgtgagggg

SEQ ID NO: 2919516 - DNA, 20 bp, Homo sapiens
gtgagagtttggaaggtgtc

SEQ ID NO: 2919517 - DNA, 15 bp, Homo sapiens
gtgagataacttcct

SEQ ID NO: 2919518 - DNA, 15 bp, Homo sapiens
gtgagatgcagctgg

SEQ ID NO: 2919519 - DNA, 15 bp, Homo sapiens
gtgagatgtaattgt

SEQ ID NO: 2919520 - DNA, 23 bp, Homo sapiens
gtgagatttaagttcctgctgcc

SEQ ID NO: 2919521 - DNA, 13 bp, Homo sapiens
gtgagcatgtttg

SEQ ID NO: 2919522 - DNA, 18 bp, Homo sapiens
gtgagcccagctgggtca

SEQ ID NO: 2919523 - DNA, 17 bp, Homo sapiens
gtgagcctagccctggg

SEQ ID NO: 2919524 - DNA, 22 bp, Homo sapiens
gtgagcgagtggatgctgtgct

SEQ ID NO: 2919525 - DNA, 22 bp, Homo sapiens
gtgagctgcccggcgcctgccc

SEQ ID NO: 2919526 - DNA, 13 bp, Homo sapiens
gtgagctggtgcc

SEQ ID NO: 2919527 - DNA, 15 bp, Homo sapiens
gtgagctggtgcctg

SEQ ID NO: 2919528 - DNA, 21 bp, Homo sapiens
gtgaggacaaattgagacagt

SEQ ID NO: 2919529 - DNA, 19 bp, Homo sapiens
gtgaggataaggggtgggg

SEQ ID NO: 2919530 - DNA, 17 bp, Homo sapiens
gtgaggcaggggcggag

SEQ ID NO: 2919531 - DNA, 15 bp, Homo sapiens
gtgaggccagggcag

SEQ ID NO: 2919532 - DNA, 17 bp, Homo sapiens
gtgaggccagggcagag

SEQ ID NO: 2919533 - DNA, 19 bp, Homo sapiens
gtgaggccggccctgcccc

SEQ ID NO: 2919534 - DNA, 22 bp, Homo sapiens
gtgaggccggccctgcccctcc

SEQ ID NO: 2919535 - DNA, 11 bp, Homo sapiens
gtgaggcctgt

SEQ ID NO: 2919536 - DNA, 15 bp, Homo sapiens
gtgaggcctgtctgt

SEQ ID NO: 2919537 - DNA, 13 bp, Homo sapiens
gtgaggctgctgc

SEQ ID NO: 2919538 - DNA, 15 bp, Homo sapiens
gtgagggcagcactg

SEQ ID NO: 2919539 - DNA, 18 bp, Homo sapiens
gtgaggggcccctggccc

SEQ ID NO: 2919540 - DNA, 20 bp, Homo sapiens
gtgaggtgggttttcttccc

SEQ ID NO: 2919541 - DNA, 20 bp, Homo sapiens
gtgagtactgttaagaataa

SEQ ID NO: 2919542 - DNA, 19 bp, Homo sapiens
gtgagtcctagagctacag

SEQ ID NO: 2919543 - DNA, 20 bp, Homo sapiens
gtgagtctggtggaggagct

SEQ ID NO: 2919544 - DNA, 13 bp, Homo sapiens
gtgagtgcctttt

SEQ ID NO: 2919545 - DNA, 16 bp, Homo sapiens
gtgagtggcatgtggg

SEQ ID NO: 2919546 - DNA, 22 bp, Homo sapiens
gtgagtgtgtgtgatgggatct

SEQ ID NO: 2919547 - DNA, 15 bp, Homo sapiens
gtgagtgtttctatg

SEQ ID NO: 2919548 - DNA, 16 bp, Homo sapiens
gtgagtgtttctatga

SEQ ID NO: 2919549 - DNA, 23 bp, Homo sapiens
gtgagtgtttctatgagtggaaa

SEQ ID NO: 2919550 - DNA, 15 bp, Homo sapiens
gtgagttctcactat

SEQ ID NO: 2919551 - DNA, 21 bp, Homo sapiens
gtgataactcctaagaggagc

SEQ ID NO: 2919552 - DNA, 20 bp, Homo sapiens
gtgatacaacttcaagtgca

SEQ ID NO: 2919553 - DNA, 15 bp, Homo sapiens
gtgatagagcctttg

SEQ ID NO: 2919554 - DNA, 17 bp, Homo sapiens
gtgatagagcctttgat

SEQ ID NO: 2919555 - DNA, 20 bp, Homo sapiens
gtgatccgcccgcctcggcc

SEQ ID NO: 2919556 - DNA, 22 bp, Homo sapiens
gtgatccgcctacctcagcctc

SEQ ID NO: 2919557 - DNA, 19 bp, Homo sapiens
gtgatctcggctcactgca

SEQ ID NO: 2919558 - DNA, 14 bp, Homo sapiens
gtgatgaatactgt

SEQ ID NO: 2919559 - DNA, 20 bp, Homo sapiens
gtgatgaatctacatttgtt

SEQ ID NO: 2919560 - DNA, 15 bp, Homo sapiens
gtgatgccaggttct

SEQ ID NO: 2919561 - DNA, 18 bp, Homo sapiens
gtgatgccaggttctatt

SEQ ID NO: 2919562 - DNA, 16 bp, Homo sapiens
gtgatgccctgccctt

SEQ ID NO: 2919563 - DNA, 19 bp, Homo sapiens
gtgatgcttgatattttct

SEQ ID NO: 2919564 - DNA, 15 bp, Homo sapiens
gtgatgggccaccgg

SEQ ID NO: 2919565 - DNA, 21 bp, Homo sapiens
gtgatgggccaccggggcaag

SEQ ID NO: 2919566 - DNA, 19 bp, Homo sapiens
gtgatgtatattcctttga

SEQ ID NO: 2919567 - DNA, 20 bp, Homo sapiens
gtgatgtccttaaaatgtgg

SEQ ID NO: 2919568 - DNA, 15 bp, Homo sapiens
gtgatgttcatgggt

SEQ ID NO: 2919569 - DNA, 13 bp, Homo sapiens
gtgatgttctaag

SEQ ID NO: 2919570 - DNA, 23 bp, Homo sapiens
gtgtatccattatcatgtgtaat

SEQ ID NO: 2919571 - DNA, 19 bp, Homo sapiens
gtgtattctagttttgtca

SEQ ID NO: 2919572 - DNA, 21 bp, Homo sapiens
gtgtatttacgctttgattca

SEQ ID NO: 2919573 - DNA, 13 bp, Homo sapiens
gtgtatttcagtt

SEQ ID NO: 2919574 - DNA, 14 bp, Homo sapiens
gtgtatttcagttc

SEQ ID NO: 2919575 - DNA, 15 bp, Homo sapiens
gtgtatttctctgtg

SEQ ID NO: 2919576 - DNA, 19 bp, Homo sapiens
gtgtattttaaaatagagg

SEQ ID NO: 2919577 - DNA, 14 bp, Homo sapiens
gtgtcaaccagaca

SEQ ID NO: 2919578 - DNA, 15 bp, Homo sapiens
gtgtcaacttcaaca

SEQ ID NO: 2919579 - DNA, 22 bp, Homo sapiens
gtgtcaagtcctgactgggctg

SEQ ID NO: 2919580 - DNA, 16 bp, Homo sapiens
gtgtcaccccagagcc

SEQ ID NO: 2919581 - DNA, 22 bp, Homo sapiens
gtgtcaccccagagccacacat

SEQ ID NO: 2919582 - DNA, 15 bp, Homo sapiens
gtgtcacctttcttc

SEQ ID NO: 2919583 - DNA, 17 bp, Homo sapiens
gtgtcactgtccctcct

SEQ ID NO: 2919584 - DNA, 18 bp, Homo sapiens
gtgtcactgtccctcctg

SEQ ID NO: 2919585 - DNA, 14 bp, Homo sapiens
gtgtcagagcccag

SEQ ID NO: 2919586 - DNA, 21 bp, Homo sapiens
gtgtcagagcccagcccagga

SEQ ID NO: 2919587 - DNA, 19 bp, Homo sapiens
gtgtcagagcccaggggag

SEQ ID NO: 2919588 - DNA, 12 bp, Homo sapiens
gtgtcaggccct

SEQ ID NO: 2919589 - DNA, 19 bp, Homo sapiens
gtgtcaggccctctgcctg

SEQ ID NO: 2919590 - DNA, 15 bp, Homo sapiens
gtgtcaggtcccagc

SEQ ID NO: 2919591 - DNA, 17 bp, Homo sapiens
gtgtcaggtcccagcga

SEQ ID NO: 2919592 - DNA, 15 bp, Homo sapiens
gtgtcatagacttgg

SEQ ID NO: 2919593 - DNA, 19 bp, Homo sapiens
gtgtcattaaccatcttta

SEQ ID NO: 2919594 - DNA, 15 bp, Homo sapiens
gtgtcatttttcctt

SEQ ID NO: 2919595 - DNA, 13 bp, Homo sapiens
gtgtccacctggc

SEQ ID NO: 2919596 - DNA, 23 bp, Homo sapiens
gtgtccatcatattaaaaatata

SEQ ID NO: 2919597 - DNA, 19 bp, Homo sapiens
gtgtcccaggcagggagac

SEQ ID NO: 2919598 - DNA, 13 bp, Homo sapiens
gtgtcccagtgaa

SEQ ID NO: 2919599 - DNA, 19 bp, Homo sapiens
gtgtccccgctgctgtgca

SEQ ID NO: 2919600 - DNA, 18 bp, Homo sapiens
gtgtccccggggcccagg

SEQ ID NO: 2919601 - DNA, 19 bp, Homo sapiens
gtgtcccctgacctgtcca

SEQ ID NO: 2919602 - DNA, 21 bp, Homo sapiens
gtgtcctctctgtgtccctgc

SEQ ID NO: 2919603 - DNA, 19 bp, Homo sapiens
gtgtcctgaagctgctgga

SEQ ID NO: 2919604 - DNA, 21 bp, Homo sapiens
gtgtccttcttcctcaagtct

SEQ ID NO: 2919605 - DNA, 16 bp, Homo sapiens
gtgtctaagattctag

SEQ ID NO: 2919606 - DNA, 17 bp, Homo sapiens
gtgtctaagattctaga

SEQ ID NO: 2919607 - DNA, 22 bp, Homo sapiens
gtgtctctggaacccaggacct

SEQ ID NO: 2919608 - DNA, 13 bp, Homo sapiens
gtgtctctgtata

SEQ ID NO: 2919609 - DNA, 18 bp, Homo sapiens
gtgtctgggtttggccca

SEQ ID NO: 2919610 - DNA, 22 bp, Homo sapiens
gtgtctgggtttggcccaagac

SEQ ID NO: 2919611 - DNA, 22 bp, Homo sapiens
gtgtcttaaggagactggtagg

SEQ ID NO: 2919612 - DNA, 20 bp, Homo sapiens
gtgtcttctccaccacgctg

SEQ ID NO: 2919613 - DNA, 18 bp, Homo sapiens
gtgtcttgttctgtcact

SEQ ID NO: 2919614 - DNA, 18 bp, Homo sapiens
gtgtcttttataaaaagt

SEQ ID NO: 2919615 - DNA, 17 bp, Homo sapiens
gtgtgaagtttggagat

SEQ ID NO: 2919616 - DNA, 16 bp, Homo sapiens
gtgtgacccctcctgg

SEQ ID NO: 2919617 - DNA, 17 bp, Homo sapiens
gtgtgacccctcctggg

SEQ ID NO: 2919618 - DNA, 19 bp, Homo sapiens
gtgtgactctagcaaggct

SEQ ID NO: 2919619 - DNA, 12 bp, Homo sapiens
gtgtgaggccag

SEQ ID NO: 2919620 - DNA, 14 bp, Homo sapiens
gtgtgaggccaggg

SEQ ID NO: 2919621 - DNA, 15 bp, Homo sapiens
gtgtgaggccagggc

SEQ ID NO: 2919622 - DNA, 15 bp, Homo sapiens
gtgtgagtgtgtgtg

SEQ ID NO: 2919623 - DNA, 14 bp, Homo sapiens
gtgtgatcgtctga

SEQ ID NO: 2919624 - DNA, 18 bp, Homo sapiens
gtgtgatctcttcagggt

SEQ ID NO: 2919625 - DNA, 23 bp, Homo sapiens
gtgtgattgacagctttgctgct

SEQ ID NO: 2919626 - DNA, 17 bp, Homo sapiens
gtgtgcagtgtttttcc

SEQ ID NO: 2919627 - DNA, 23 bp, Homo sapiens
gtgtgcatagcgtcctgccctgc

SEQ ID NO: 2919628 - DNA, 18 bp, Homo sapiens
gtgtgcatattgtacact

SEQ ID NO: 2919629 - DNA, 15 bp, Homo sapiens
gtgtgcatctgtgtg

SEQ ID NO: 2919630 - DNA, 16 bp, Homo sapiens
gtgtgcccccttcaag

SEQ ID NO: 2919631 - DNA, 18 bp, Homo sapiens
gtgtgcctgactgcccag

SEQ ID NO: 2919632 - DNA, 15 bp, Homo sapiens
gtgtgccttgttcaa

SEQ ID NO: 2919633 - DNA, 16 bp, Homo sapiens
gtgtgcgctctgtgga

SEQ ID NO: 2919634 - DNA, 13 bp, Homo sapiens
gtgtgcgctgcct

SEQ ID NO: 2919635 - DNA, 14 bp, Homo sapiens
gtgtgcgctgcctg

SEQ ID NO: 2919636 - DNA, 16 bp, Homo sapiens
gtgtgcgctgcctggc

SEQ ID NO: 2919637 - DNA, 14 bp, Homo sapiens
gtgtgctacagaaa

SEQ ID NO: 2919638 - DNA, 17 bp, Homo sapiens
gtgtgctgatgggcgta

SEQ ID NO: 2919639 - DNA, 17 bp, Homo sapiens
gtgtggcacgcacctgt

SEQ ID NO: 2919640 - DNA, 16 bp, Homo sapiens
gtgtggcagcaggcag

SEQ ID NO: 2919641 - DNA, 12 bp, Homo sapiens
gtgtggcagcca

SEQ ID NO: 2919642 - DNA, 17 bp, Homo sapiens
gtgtggccatcactcag

SEQ ID NO: 2919643 - DNA, 15 bp, Homo sapiens
gtgtggcccgtggcc

SEQ ID NO: 2919644 - DNA, 13 bp, Homo sapiens
gtgtggctgtgcc

SEQ ID NO: 2919645 - DNA, 22 bp, Homo sapiens
gtgtgggccgtggcttgggctg

SEQ ID NO: 2919646 - DNA, 16 bp, Homo sapiens
gtgtgggtacctgtat

SEQ ID NO: 2919647 - DNA, 21 bp, Homo sapiens
gtgtggtcagcggtatgtgcg

SEQ ID NO: 2919648 - DNA, 15 bp, Homo sapiens
gtgtggtggcctgtg

SEQ ID NO: 2919649 - DNA, 13 bp, Homo sapiens
gtgtgtaattgtt

SEQ ID NO: 2919650 - DNA, 13 bp, Homo sapiens
gtgtgtcaggccc

SEQ ID NO: 2919651 - DNA, 20 bp, Homo sapiens
gtgtgtcaggccctctgcct

SEQ ID NO: 2919652 - DNA, 19 bp, Homo sapiens
gtgtgtccaaaactgcctc

SEQ ID NO: 2919653 - DNA, 20 bp, Homo sapiens
gtgtgtccacgactgtctcc

SEQ ID NO: 2919654 - DNA, 14 bp, Homo sapiens
gtgtgtcccaggca

SEQ ID NO: 2919655 - DNA, 12 bp, Homo sapiens
gtgtgtctctga

SEQ ID NO: 2919656 - DNA, 17 bp, Homo sapiens
gtgtgtgaatgaacact

SEQ ID NO: 2919657 - DNA, 17 bp, Homo sapiens
gtgtgtgacccctcctg

SEQ ID NO: 2919658 - DNA, 13 bp, Homo sapiens
gtgtgtgtgaatg

SEQ ID NO: 2919659 - DNA, 15 bp, Homo sapiens
gtgtgtgtgcgtgtt

SEQ ID NO: 2919660 - DNA, 10 bp, Homo sapiens
gtgtgtgtgt

SEQ ID NO: 2919661 - DNA, 14 bp, Homo sapiens
gtgtgtgtgtgcac

SEQ ID NO: 2919662 - DNA, 13 bp, Homo sapiens
gtgtgtgtgtgcg

SEQ ID NO: 2919663 - DNA, 13 bp, Homo sapiens
gtgtgtgtgtgtg

SEQ ID NO: 2919664 - DNA, 14 bp, Homo sapiens
gtgtgtgtgtgtgc

SEQ ID NO: 2919665 - DNA, 15 bp, Homo sapiens
gtgtgtgtgtgtgtg

SEQ ID NO: 2919666 - DNA, 24 bp, Homo sapiens
gtgtgttatttccccagccacagg

SEQ ID NO: 2919667 - DNA, 13 bp, Homo sapiens
gtgtgttgtcttg

SEQ ID NO: 2919668 - DNA, 18 bp, Homo sapiens
gtgtgttgtcttgaaaga

SEQ ID NO: 2919669 - DNA, 13 bp, Homo sapiens
gtgtgttgtttcc

SEQ ID NO: 2919670 - DNA, 17 bp, Homo sapiens
gtgtgtttagaagccta

SEQ ID NO: 2919671 - DNA, 17 bp, Homo sapiens
gtgtgttttcagcaaat

SEQ ID NO: 2919672 - DNA, 16 bp, Homo sapiens
gtgttaatcatttcat

SEQ ID NO: 2919673 - DNA, 20 bp, Homo sapiens
gtgttaattataaacagcag

SEQ ID NO: 2919674 - DNA, 21 bp, Homo sapiens
gtgttaattataaacagcagg

SEQ ID NO: 2919675 - DNA, 12 bp, Homo sapiens
gtgttaatttat

SEQ ID NO: 2919676 - DNA, 14 bp, Homo sapiens
gtgttacccactgc

SEQ ID NO: 2919677 - DNA, 16 bp, Homo sapiens
gtgttacctgaaaaca

SEQ ID NO: 2919678 - DNA, 15 bp, Homo sapiens
gtgttactcatcttt

SEQ ID NO: 2919679 - DNA, 22 bp, Homo sapiens
gtgttagggaagggcctgccac

SEQ ID NO: 2919680 - DNA, 15 bp, Homo sapiens
gtgttagtggcaccg

SEQ ID NO: 2919681 - DNA, 21 bp, Homo sapiens
gtgttagtggcaccgcctccc

SEQ ID NO: 2919682 - DNA, 20 bp, Homo sapiens
gtgttataatgggtaatata

SEQ ID NO: 2919683 - DNA, 13 bp, Homo sapiens
gtgttatgtattt

SEQ ID NO: 2919684 - DNA, 12 bp, Homo sapiens
gtgttatgtgaa

SEQ ID NO: 2919685 - DNA, 17 bp, Homo sapiens
gtgttcatacatttgag

SEQ ID NO: 2919686 - DNA, 20 bp, Homo sapiens
gtgttccaagtctctgtgta

SEQ ID NO: 2919687 - DNA, 16 bp, Homo sapiens
gtgttccatgacttca

SEQ ID NO: 2919688 - DNA, 18 bp, Homo sapiens
gtgttccccttccactga

SEQ ID NO: 2919689 - DNA, 19 bp, Homo sapiens
gtgttccccttccactgag

SEQ ID NO: 2919690 - DNA, 13 bp, Homo sapiens
gtgttcctgtgct

SEQ ID NO: 2919691 - DNA, 23 bp, Homo sapiens
gtgttcctgtgcttatattcagt

SEQ ID NO: 2919692 - DNA, 20 bp, Homo sapiens
gtgttcctttttaaatgtga

SEQ ID NO: 2919693 - DNA, 22 bp, Homo sapiens
gtgttcggagctcttctgtgcc

SEQ ID NO: 2919694 - DNA, 19 bp, Homo sapiens
gtgttcggttttgttgttc

SEQ ID NO: 2919695 - DNA, 13 bp, Homo sapiens
gtgttctaagatg

SEQ ID NO: 2919696 - DNA, 15 bp, Homo sapiens
gtgttgaaaaatatc

SEQ ID NO: 2919697 - DNA, 19 bp, Homo sapiens
gtgttgaccactccagaga

SEQ ID NO: 2919698 - DNA, 16 bp, Homo sapiens
gtgttgactgctgctc

SEQ ID NO: 2919699 - DNA, 17 bp, Homo sapiens
gtgttgactgctgctcc

SEQ ID NO: 2919700 - DNA, 15 bp, Homo sapiens
gtgttgcctcttgca

SEQ ID NO: 2919701 - DNA, 20 bp, Homo sapiens
gtgttggacaaatgtgaaga

SEQ ID NO: 2919702 - DNA, 15 bp, Homo sapiens
gtgttgttgcttctt

SEQ ID NO: 2919703 - DNA, 21 bp, Homo sapiens
gtttccaattatttgacttta

SEQ ID NO: 2919704 - DNA, 19 bp, Homo sapiens
gtttcccaatggtgttttt

SEQ ID NO: 2919705 - DNA, 21 bp, Homo sapiens
gtttcccatcccactgctccc

SEQ ID NO: 2919706 - DNA, 22 bp, Homo sapiens
gtttcccatttgttgctgctgc

SEQ ID NO: 2919707 - DNA, 11 bp, Homo sapiens
gtttcctctgg

SEQ ID NO: 2919708 - DNA, 13 bp, Homo sapiens
gtttcctctggat

SEQ ID NO: 2919709 - DNA, 15 bp, Homo sapiens
gtttcctgacattgt

SEQ ID NO: 2919710 - DNA, 14 bp, Homo sapiens
gtttcctgcaggcc

SEQ ID NO: 2919711 - DNA, 16 bp, Homo sapiens
gtttcctgcaggccag

SEQ ID NO: 2919712 - DNA, 17 bp, Homo sapiens
gtttccttccagcccag

SEQ ID NO: 2919713 - DNA, 24 bp, Homo sapiens
gtttctaaccaaagagtctctggc

SEQ ID NO: 2919714 - DNA, 19 bp, Homo sapiens
gtttctaagattctaaagg

SEQ ID NO: 2919715 - DNA, 18 bp, Homo sapiens
gtttctagggaaatgaaa

SEQ ID NO: 2919716 - DNA, 15 bp, Homo sapiens
gtttctcatttgttt

SEQ ID NO: 2919717 - DNA, 21 bp, Homo sapiens
gtttctctcccaacgctgaag

SEQ ID NO: 2919718 - DNA, 17 bp, Homo sapiens
gtttctctcttgttgtc

SEQ ID NO: 2919719 - DNA, 14 bp, Homo sapiens
gtttctctgagctt

SEQ ID NO: 2919720 - DNA, 15 bp, Homo sapiens
gtttctgggggctgg

SEQ ID NO: 2919721 - DNA, 12 bp, Homo sapiens
gtttctgtgtca

SEQ ID NO: 2919722 - DNA, 17 bp, Homo sapiens
gtttctgttctgtggaa

SEQ ID NO: 2919723 - DNA, 22 bp, Homo sapiens
gtttctgttctgtggaaagtgt

SEQ ID NO: 2919724 - DNA, 12 bp, Homo sapiens
gtttcttaaata

SEQ ID NO: 2919725 - DNA, 22 bp, Homo sapiens
gtttcttaaccctttccagagt

SEQ ID NO: 2919726 - DNA, 15 bp, Homo sapiens
gtttcttctgtaaat

SEQ ID NO: 2919727 - DNA, 11 bp, Homo sapiens
gtttcttgctt

SEQ ID NO: 2919728 - DNA, 23 bp, Homo sapiens
gtttcttttttctttcttccttt

SEQ ID NO: 2919729 - DNA, 17 bp, Homo sapiens
gtttgaaacaaagaagg

SEQ ID NO: 2919730 - DNA, 11 bp, Homo sapiens
gtttgaaattc

SEQ ID NO: 2919731 - DNA, 14 bp, Homo sapiens
gtttgaaattctga

SEQ ID NO: 2919732 - DNA, 16 bp, Homo sapiens
gtttgaaattctgaat

SEQ ID NO: 2919733 - DNA, 17 bp, Homo sapiens
gtttgaaattctgaatt

SEQ ID NO: 2919734 - DNA, 17 bp, Homo sapiens
gtttgaaggaaacagtt

SEQ ID NO: 2919735 - DNA, 15 bp, Homo sapiens
gtttgaccaggaaag

SEQ ID NO: 2919736 - DNA, 16 bp, Homo sapiens
gtttgactagatgatg

SEQ ID NO: 2919737 - DNA, 19 bp, Homo sapiens
gtttgactagatgatggat

SEQ ID NO: 2919738 - DNA, 20 bp, Homo sapiens
gtttgacttgtataacatca

SEQ ID NO: 2919739 - DNA, 21 bp, Homo sapiens
gtttgactttaaagatgattg

SEQ ID NO: 2919740 - DNA, 16 bp, Homo sapiens
gtttgagaccaggctg

SEQ ID NO: 2919741 - DNA, 17 bp, Homo sapiens
gtttgagcacaatctgt

SEQ ID NO: 2919742 - DNA, 18 bp, Homo sapiens
gtttgagcacaatctgtt

SEQ ID NO: 2919743 - DNA, 20 bp, Homo sapiens
gtttgagcacaatctgttct

SEQ ID NO: 2919744 - DNA, 13 bp, Homo sapiens
gtttgagctcaga

SEQ ID NO: 2919745 - DNA, 14 bp, Homo sapiens
gtttgaggggcctg

SEQ ID NO: 2919746 - DNA, 17 bp, Homo sapiens
gtttgatagtgcttctt

SEQ ID NO: 2919747 - DNA, 19 bp, Homo sapiens
gtttgatcagacagcttga

SEQ ID NO: 2919748 - DNA, 15 bp, Homo sapiens
gtttgcaccgcctgc

SEQ ID NO: 2919749 - DNA, 18 bp, Homo sapiens
gtttgcaccgcctgccct

SEQ ID NO: 2919750 - DNA, 19 bp, Homo sapiens
gtttgcaccgcctgccctc

SEQ ID NO: 2919751 - DNA, 19 bp, Homo sapiens
gtttgcagaaaagcacctg

SEQ ID NO: 2919752 - DNA, 14 bp, Homo sapiens
gtttgccatacttt

SEQ ID NO: 2919753 - DNA, 15 bp, Homo sapiens
gtttgccatactttg

SEQ ID NO: 2919754 - DNA, 18 bp, Homo sapiens
gtttgctatcttaatttt

SEQ ID NO: 2919755 - DNA, 17 bp, Homo sapiens
gtttgctcacctggggt

SEQ ID NO: 2919756 - DNA, 16 bp, Homo sapiens
gtttgctgatggtctg

SEQ ID NO: 2919757 - DNA, 14 bp, Homo sapiens
gtttgcttgtttct

SEQ ID NO: 2919758 - DNA, 17 bp, Homo sapiens
gtttgcttgtttcttgg

SEQ ID NO: 2919759 - DNA, 16 bp, Homo sapiens
gtttggaattttctgt

SEQ ID NO: 2919760 - DNA, 21 bp, Homo sapiens
gtttggactgcagaagcaagg

SEQ ID NO: 2919761 - DNA, 20 bp, Homo sapiens
gtttggattcttatgtagca

SEQ ID NO: 2919762 - DNA, 16 bp, Homo sapiens
gtttggatttttaatt

SEQ ID NO: 2919763 - DNA, 21 bp, Homo sapiens
gtttggatttttaattaaaaa

SEQ ID NO: 2919764 - DNA, 14 bp, Homo sapiens
gtttggcaaggaaa

SEQ ID NO: 2919765 - DNA, 15 bp, Homo sapiens
gtttgggaaagatgg

SEQ ID NO: 2919766 - DNA, 22 bp, Homo sapiens
gtttggggaatgcggccgcatt

SEQ ID NO: 2919767 - DNA, 20 bp, Homo sapiens
gtttgggggacgtttctcat

SEQ ID NO: 2919768 - DNA, 21 bp, Homo sapiens
gtttgggggttaccaaaaata

SEQ ID NO: 2919769 - DNA, 16 bp, Homo sapiens
gtttggtagttagcca

SEQ ID NO: 2919770 - DNA, 19 bp, Homo sapiens
gtttggtataaattaattt

SEQ ID NO: 2919771 - DNA, 20 bp, Homo sapiens
gtttggtttttttgtacaat

SEQ ID NO: 2919772 - DNA, 12 bp, Homo sapiens
gtttgtagcttt

SEQ ID NO: 2919773 - DNA, 20 bp, Homo sapiens
gtttgtagctttcctggaag

SEQ ID NO: 2919774 - DNA, 12 bp, Homo sapiens
gtttgtattcat

SEQ ID NO: 2919775 - DNA, 16 bp, Homo sapiens
gtttgtcactgccaaa

SEQ ID NO: 2919776 - DNA, 19 bp, Homo sapiens
gtttgtcactgccaaagta

SEQ ID NO: 2919777 - DNA, 15 bp, Homo sapiens
gtttgtcagcatctg

SEQ ID NO: 2919778 - DNA, 23 bp, Homo sapiens
gtttgtcagcatctgaccatctg

SEQ ID NO: 2919779 - DNA, 15 bp, Homo sapiens
gtttgtgagccttgc

SEQ ID NO: 2919780 - DNA, 20 bp, Homo sapiens
gtttgtgagccttgctgcca

SEQ ID NO: 2919781 - DNA, 14 bp, Homo sapiens
gtttgtgtctgtgg

SEQ ID NO: 2919782 - DNA, 16 bp, Homo sapiens
gtttgttaaaaataaa

SEQ ID NO: 2919783 - DNA, 12 bp, Homo sapiens
gtttgttacttt

SEQ ID NO: 2919784 - DNA, 17 bp, Homo sapiens
gtttgttggtcacatgg

SEQ ID NO: 2919785 - DNA, 21 bp, Homo sapiens
gtttgttggtcacatggagct

SEQ ID NO: 2919786 - DNA, 16 bp, Homo sapiens
gtttgtttacataaga

SEQ ID NO: 2919787 - DNA, 21 bp, Homo sapiens
gtttgtttacataagagaaag

SEQ ID NO: 2919788 - DNA, 16 bp, Homo sapiens
gtttgtttttgctttc

SEQ ID NO: 2919789 - DNA, 19 bp, Homo sapiens
gttttaaaacgtgtaaatg

SEQ ID NO: 2919790 - DNA, 13 bp, Homo sapiens
gttttaaaataag

SEQ ID NO: 2919791 - DNA, 22 bp, Homo sapiens
gttttaaaataagttaaaggca

SEQ ID NO: 2919792 - DNA, 21 bp, Homo sapiens
gttttaaaataatatgtaaat

SEQ ID NO: 2919793 - DNA, 11 bp, Homo sapiens
gttttaaaatt

SEQ ID NO: 2919794 - DNA, 16 bp, Homo sapiens
gttttaaaattatata

SEQ ID NO: 2919795 - DNA, 22 bp, Homo sapiens
gttttaaatgtacagacatatt

SEQ ID NO: 2919796 - DNA, 17 bp, Homo sapiens
gttttaagcaaatgcat

SEQ ID NO: 2919797 - DNA, 20 bp, Homo sapiens
gttttaagcaaatgcattct

SEQ ID NO: 2919798 - DNA, 16 bp, Homo sapiens
gttttaattccatgaa

SEQ ID NO: 2919799 - DNA, 12 bp, Homo sapiens
gttttacaaagg

SEQ ID NO: 2919800 - DNA, 12 bp, Homo sapiens
gttttacattgt

SEQ ID NO: 2919801 - DNA, 16 bp, Homo sapiens
gttttacttacaaaaa

SEQ ID NO: 2919802 - DNA, 17 bp, Homo sapiens
gttttagacaaatactc

SEQ ID NO: 2919803 - DNA, 18 bp, Homo sapiens
gttttagagtaagaaatt

SEQ ID NO: 2919804 - DNA, 18 bp, Homo sapiens
gttttagattattttatc

SEQ ID NO: 2919805 - DNA, 12 bp, Homo sapiens
gttttaggttct

SEQ ID NO: 2919806 - DNA, 14 bp, Homo sapiens
gttttatacaaaga

SEQ ID NO: 2919807 - DNA, 18 bp, Homo sapiens
gttttatagcctggactg

SEQ ID NO: 2919808 - DNA, 22 bp, Homo sapiens
gttttatgagatggatcacata

SEQ ID NO: 2919809 - DNA, 17 bp, Homo sapiens
gttttattcttggtttt

SEQ ID NO: 2919810 - DNA, 19 bp, Homo sapiens
gttttcaaggaagaaaacg

SEQ ID NO: 2919811 - DNA, 20 bp, Homo sapiens
gttttcacataaatgcagcc

SEQ ID NO: 2919812 - DNA, 22 bp, Homo sapiens
gttttcacataaatgcagccca

SEQ ID NO: 2919813 - DNA, 14 bp, Homo sapiens
gttttcagactcag

SEQ ID NO: 2919814 - DNA, 13 bp, Homo sapiens
gttttcatcattt

SEQ ID NO: 2919815 - DNA, 15 bp, Homo sapiens
gttttcatcatttca

SEQ ID NO: 2919816 - DNA, 14 bp, Homo sapiens
gttttccactgtgc

SEQ ID NO: 2919817 - DNA, 21 bp, Homo sapiens
gttttcctatgctttgaaaca

SEQ ID NO: 2919818 - DNA, 14 bp, Homo sapiens
gttttcctcccttc

SEQ ID NO: 2919819 - DNA, 15 bp, Homo sapiens
gttttcctcccttct

SEQ ID NO: 2919820 - DNA, 20 bp, Homo sapiens
gttttcgtcatcttccctgc

SEQ ID NO: 2919821 - DNA, 16 bp, Homo sapiens
gttttctatcagacgt

SEQ ID NO: 2919822 - DNA, 17 bp, Homo sapiens
gttttctgaaaatataa

SEQ ID NO: 2919823 - DNA, 22 bp, Homo sapiens
gttttctgcagaaaaaaataaa

SEQ ID NO: 2919824 - DNA, 16 bp, Homo sapiens
gttttctgctttaaat

SEQ ID NO: 2919825 - DNA, 20 bp, Homo sapiens
gttttctgctttaaattaaa

SEQ ID NO: 2919826 - DNA, 22 bp, Homo sapiens
gttttcttaaggtgaggcctgt

SEQ ID NO: 2919827 - DNA, 15 bp, Homo sapiens
gttttcttgttgctt

SEQ ID NO: 2919828 - DNA, 20 bp, Homo sapiens
gttttcttgttgctttgttg

SEQ ID NO: 2919829 - DNA, 22 bp, Homo sapiens
gttttcttgttgctttgttgca

SEQ ID NO: 2919830 - DNA, 18 bp, Homo sapiens
gttttgaagctactgtgt

SEQ ID NO: 2919831 - DNA, 13 bp, Homo sapiens
gttttgaatagat

SEQ ID NO: 2919832 - DNA, 19 bp, Homo sapiens
gttttgatgactggcattt

SEQ ID NO: 2919833 - DNA, 13 bp, Homo sapiens
gttttgcaataac

SEQ ID NO: 2919834 - DNA, 14 bp, Homo sapiens
gttttgcaataact

SEQ ID NO: 2919835 - DNA, 15 bp, Homo sapiens
gttttgtaaatgtac

SEQ ID NO: 2919836 - DNA, 13 bp, Homo sapiens
taacaattcctct

SEQ ID NO: 2919837 - DNA, 19 bp, Homo sapiens
taacacattttgtataatt

SEQ ID NO: 2919838 - DNA, 14 bp, Homo sapiens
taacacctgatgtg

SEQ ID NO: 2919839 - DNA, 17 bp, Homo sapiens
taacacctgatgtgtac

SEQ ID NO: 2919840 - DNA, 16 bp, Homo sapiens
taacacgtgatgtgat

SEQ ID NO: 2919841 - DNA, 19 bp, Homo sapiens
taacactgaaattgcctga

SEQ ID NO: 2919842 - DNA, 22 bp, Homo sapiens
taacagagtagttttggttttt

SEQ ID NO: 2919843 - DNA, 20 bp, Homo sapiens
taacagcgtgtcaactttca

SEQ ID NO: 2919844 - DNA, 12 bp, Homo sapiens
taacagctgtgg

SEQ ID NO: 2919845 - DNA, 15 bp, Homo sapiens
taacaggtattttca

SEQ ID NO: 2919846 - DNA, 21 bp, Homo sapiens
taacaggttattttagtttct

SEQ ID NO: 2919847 - DNA, 23 bp, Homo sapiens
taacaggttattttagtttctgt

SEQ ID NO: 2919848 - DNA, 17 bp, Homo sapiens
taacagtacctgtgcct

SEQ ID NO: 2919849 - DNA, 21 bp, Homo sapiens
taacagtacctgtgcctgaga

SEQ ID NO: 2919850 - DNA, 16 bp, Homo sapiens
taacagtattaaatga

SEQ ID NO: 2919851 - DNA, 18 bp, Homo sapiens
taacagtattaaatgact

SEQ ID NO: 2919852 - DNA, 15 bp, Homo sapiens
taacataacaacctt

SEQ ID NO: 2919853 - DNA, 15 bp, Homo sapiens
taacatatctaaagt

SEQ ID NO: 2919854 - DNA, 21 bp, Homo sapiens
taacatatgcagtgttctaca

SEQ ID NO: 2919855 - DNA, 14 bp, Homo sapiens
taacatcaaagatt

SEQ ID NO: 2919856 - DNA, 11 bp, Homo sapiens
taacatcactg

SEQ ID NO: 2919857 - DNA, 20 bp, Homo sapiens
taacatcagaactgaaataa

SEQ ID NO: 2919858 - DNA, 20 bp, Homo sapiens
taacatctttcttttttcct

SEQ ID NO: 2919859 - DNA, 15 bp, Homo sapiens
taacatgaaatgata

SEQ ID NO: 2919860 - DNA, 20 bp, Homo sapiens
taacatgatttccctccaga

SEQ ID NO: 2919861 - DNA, 15 bp, Homo sapiens
taacatgtaggaagt

SEQ ID NO: 2919862 - DNA, 13 bp, Homo sapiens
taacatgtttctc

SEQ ID NO: 2919863 - DNA, 17 bp, Homo sapiens
taacatgtttctctata

SEQ ID NO: 2919864 - DNA, 12 bp, Homo sapiens
taacattccaag

SEQ ID NO: 2919865 - DNA, 13 bp, Homo sapiens
taacattccaaga

SEQ ID NO: 2919866 - DNA, 18 bp, Homo sapiens
taacattccaagactcta

SEQ ID NO: 2919867 - DNA, 23 bp, Homo sapiens
taacattctacttgcttattaca

SEQ ID NO: 2919868 - DNA, 17 bp, Homo sapiens
taacatttatctaaaag

SEQ ID NO: 2919869 - DNA, 16 bp, Homo sapiens
taacatttcaagggca

SEQ ID NO: 2919870 - DNA, 11 bp, Homo sapiens
taacattttgt

SEQ ID NO: 2919871 - DNA, 16 bp, Homo sapiens
taaccaaacaattatt

SEQ ID NO: 2919872 - DNA, 18 bp, Homo sapiens
taaccaatcgcaaagcaa

SEQ ID NO: 2919873 - DNA, 22 bp, Homo sapiens
taaccacttatcagtgtattga

SEQ ID NO: 2919874 - DNA, 18 bp, Homo sapiens
taaccattttataaagtg

SEQ ID NO: 2919875 - DNA, 19 bp, Homo sapiens
taacccagtggctggaaga

SEQ ID NO: 2919876 - DNA, 16 bp, Homo sapiens
taacccctttcctgcg

SEQ ID NO: 2919877 - DNA, 23 bp, Homo sapiens
taacccttcaacgtttcttcact

SEQ ID NO: 2919878 - DNA, 19 bp, Homo sapiens
taaccgatgctttaccaaa

SEQ ID NO: 2919879 - DNA, 22 bp, Homo sapiens
taacctcccttaagcagcaaca

SEQ ID NO: 2919880 - DNA, 16 bp, Homo sapiens
taacctgcaaaatctg

SEQ ID NO: 2919881 - DNA, 22 bp, Homo sapiens
taacctgtgtctgcgaagtcct

SEQ ID NO: 2919882 - DNA, 18 bp, Homo sapiens
taacctgttgctccagga

SEQ ID NO: 2919883 - DNA, 18 bp, Homo sapiens
taacctttaaaaatgtat

SEQ ID NO: 2919884 - DNA, 23 bp, Homo sapiens
taacgtatgtatttcattgctgt

SEQ ID NO: 2919885 - DNA, 19 bp, Homo sapiens
taacgtcacccaaaagcac

SEQ ID NO: 2919886 - DNA, 22 bp, Homo sapiens
taactactatattgattgtcct

SEQ ID NO: 2919887 - DNA, 13 bp, Homo sapiens
taactactgtaga

SEQ ID NO: 2919888 - DNA, 21 bp, Homo sapiens
taactagacaccaaagttcta

SEQ ID NO: 2919889 - DNA, 17 bp, Homo sapiens
taactagtcctttacta

SEQ ID NO: 2919890 - DNA, 22 bp, Homo sapiens
taactatcaggcagaagaatct

SEQ ID NO: 2919891 - DNA, 14 bp, Homo sapiens
taactatgatcatc

SEQ ID NO: 2919892 - DNA, 22 bp, Homo sapiens
taactcagtgaaggcccatgaa

SEQ ID NO: 2919893 - DNA, 12 bp, Homo sapiens
taactcattaga

SEQ ID NO: 2919894 - DNA, 14 bp, Homo sapiens
taactccagtgaag

SEQ ID NO: 2919895 - DNA, 16 bp, Homo sapiens
taactcccactcctaa

SEQ ID NO: 2919896 - DNA, 19 bp, Homo sapiens
taactcccctgtttcaatc

SEQ ID NO: 2919897 - DNA, 12 bp, Homo sapiens
taactccctcct

SEQ ID NO: 2919898 - DNA, 13 bp, Homo sapiens
taactccctcctc

SEQ ID NO: 2919899 - DNA, 14 bp, Homo sapiens
taactccctcctca

SEQ ID NO: 2919900 - DNA, 21 bp, Homo sapiens
taactccctcctcacactcca

SEQ ID NO: 2919901 - DNA, 17 bp, Homo sapiens
taactctgtaaaagtgt

SEQ ID NO: 2919902 - DNA, 19 bp, Homo sapiens
taactctgtaaaagtgtct

SEQ ID NO: 2919903 - DNA, 20 bp, Homo sapiens
taactcttaactgaagaaag

SEQ ID NO: 2919904 - DNA, 19 bp, Homo sapiens
taactcttagaagtgttgt

SEQ ID NO: 2919905 - DNA, 21 bp, Homo sapiens
taactcttagaagtgttgtaa

SEQ ID NO: 2919906 - DNA, 13 bp, Homo sapiens
taactgaaccaaa

SEQ ID NO: 2919907 - DNA, 15 bp, Homo sapiens
taactgaactttgaa

SEQ ID NO: 2919908 - DNA, 16 bp, Homo sapiens
taactgaaggagaagg

SEQ ID NO: 2919909 - DNA, 13 bp, Homo sapiens
taactgaatgttt

SEQ ID NO: 2919910 - DNA, 23 bp, Homo sapiens
taactgagtagctctcctgactt

SEQ ID NO: 2919911 - DNA, 21 bp, Homo sapiens
taactgatttgcaataaaaat

SEQ ID NO: 2919912 - DNA, 13 bp, Homo sapiens
taactgctgattt

SEQ ID NO: 2919913 - DNA, 18 bp, Homo sapiens
taactgcttttgcccata

SEQ ID NO: 2919914 - DNA, 21 bp, Homo sapiens
taactgcttttgcccatataa

SEQ ID NO: 2919915 - DNA, 24 bp, Homo sapiens
taactggcagttttccattggttt

SEQ ID NO: 2919916 - DNA, 17 bp, Homo sapiens
taactgggggaaaagat

SEQ ID NO: 2919917 - DNA, 20 bp, Homo sapiens
taactggtagtgttcagtaa

SEQ ID NO: 2919918 - DNA, 17 bp, Homo sapiens
taactggtgcactttgt

SEQ ID NO: 2919919 - DNA, 14 bp, Homo sapiens
taactgtactgaag

SEQ ID NO: 2919920 - DNA, 14 bp, Homo sapiens
taactgtactgaat

SEQ ID NO: 2919921 - DNA, 12 bp, Homo sapiens
taactgtgataa

SEQ ID NO: 2919922 - DNA, 14 bp, Homo sapiens
taacttacttccaa

SEQ ID NO: 2919923 - DNA, 20 bp, Homo sapiens
taacttatttataaaaagat

SEQ ID NO: 2919924 - DNA, 24 bp, Homo sapiens
taacttatttatatgaagcaagct

SEQ ID NO: 2919925 - DNA, 13 bp, Homo sapiens
taacttattttgt

SEQ ID NO: 2919926 - DNA, 15 bp, Homo sapiens
taacttcatattaat

SEQ ID NO: 2919927 - DNA, 14 bp, Homo sapiens
taacttcctgtact

SEQ ID NO: 2919928 - DNA, 20 bp, Homo sapiens
taacttcctgtgcctttcct

SEQ ID NO: 2919929 - DNA, 19 bp, Homo sapiens
taacttccttcacatctcc

SEQ ID NO: 2919930 - DNA, 18 bp, Homo sapiens
taacttcttatggaattg

SEQ ID NO: 2919931 - DNA, 13 bp, Homo sapiens
taacttgctttct

SEQ ID NO: 2919932 - DNA, 17 bp, Homo sapiens
taacttgctttcttctt

SEQ ID NO: 2919933 - DNA, 20 bp, Homo sapiens
taacttgctttcttctttcc

SEQ ID NO: 2919934 - DNA, 21 bp, Homo sapiens
taacttgctttcttctttcct

SEQ ID NO: 2919935 - DNA, 15 bp, Homo sapiens
taacttggctttcat

SEQ ID NO: 2919936 - DNA, 15 bp, Homo sapiens
taactttaaaactgt

SEQ ID NO: 2919937 - DNA, 20 bp, Homo sapiens
taactttattcttgaaagaa

SEQ ID NO: 2919938 - DNA, 15 bp, Homo sapiens
taactttgaagagat

SEQ ID NO: 2919939 - DNA, 12 bp, Homo sapiens
taactttgcttg

SEQ ID NO: 2919940 - DNA, 21 bp, Homo sapiens
taacttttaatccctatgttt

SEQ ID NO: 2919941 - DNA, 20 bp, Homo sapiens
taacttttgtaaatacacat

SEQ ID NO: 2919942 - DNA, 21 bp, Homo sapiens
taagaaacaactctttgagaa

SEQ ID NO: 2919943 - DNA, 13 bp, Homo sapiens
taagaaacagagg

SEQ ID NO: 2919944 - DNA, 18 bp, Homo sapiens
taagaaacccagactgaa

SEQ ID NO: 2919945 - DNA, 13 bp, Homo sapiens
taagaaatactag

SEQ ID NO: 2919946 - DNA, 19 bp, Homo sapiens
taagaaatctcccatgtgc

SEQ ID NO: 2919947 - DNA, 16 bp, Homo sapiens
taagaaatgtataaac

SEQ ID NO: 2919948 - DNA, 17 bp, Homo sapiens
taagaactaaagaagat

SEQ ID NO: 2919949 - DNA, 15 bp, Homo sapiens
taagaagaggagcct

SEQ ID NO: 2919950 - DNA, 17 bp, Homo sapiens
taagaagaggagcctca

SEQ ID NO: 2919951 - DNA, 18 bp, Homo sapiens
taagaagaggagcctcag

SEQ ID NO: 2919952 - DNA, 19 bp, Homo sapiens
taagaagaggagcctcaga

SEQ ID NO: 2919953 - DNA, 20 bp, Homo sapiens
taagaagaggagcctcagaa

SEQ ID NO: 2919954 - DNA, 21 bp, Homo sapiens
taagaagagtttttattacaa

SEQ ID NO: 2919955 - DNA, 13 bp, Homo sapiens
taagaaggcaaaa

SEQ ID NO: 2919956 - DNA, 16 bp, Homo sapiens
taagaatacagctttc

SEQ ID NO: 2919957 - DNA, 12 bp, Homo sapiens
taagaattattt

SEQ ID NO: 2919958 - DNA, 17 bp, Homo sapiens
taagaattattttgatg

SEQ ID NO: 2919959 - DNA, 10 bp, Homo sapiens
taagaattgt

SEQ ID NO: 2919960 - DNA, 13 bp, Homo sapiens
taagaatttcact

SEQ ID NO: 2919961 - DNA, 18 bp, Homo sapiens
taagaatttcactgtctt

SEQ ID NO: 2919962 - DNA, 20 bp, Homo sapiens
taagaatttcactgtctttt

SEQ ID NO: 2919963 - DNA, 16 bp, Homo sapiens
taagacatgatttcct

SEQ ID NO: 2919964 - DNA, 21 bp, Homo sapiens
taagacattaagagaacaaag

SEQ ID NO: 2919965 - DNA, 16 bp, Homo sapiens
taagacctactgttct

SEQ ID NO: 2919966 - DNA, 17 bp, Homo sapiens
taagacctactgttcta

SEQ ID NO: 2919967 - DNA, 15 bp, Homo sapiens
taagactcaaatgtt

SEQ ID NO: 2919968 - DNA, 20 bp, Homo sapiens
taagactcccgccccgggct

SEQ ID NO: 2919969 - DNA, 14 bp, Homo sapiens
tacaattgaaatga

SEQ ID NO: 2919970 - DNA, 18 bp, Homo sapiens
tacaattttatctgtttc

SEQ ID NO: 2919971 - DNA, 22 bp, Homo sapiens
tacaatttttttaattttgtat

SEQ ID NO: 2919972 - DNA, 23 bp, Homo sapiens
tacacaaatctatttaattagga

SEQ ID NO: 2919973 - DNA, 23 bp, Homo sapiens
tacacaaatgatagcataacata

SEQ ID NO: 2919974 - DNA, 16 bp, Homo sapiens
tacacaagagctggag

SEQ ID NO: 2919975 - DNA, 16 bp, Homo sapiens
tacacaatgaattctt

SEQ ID NO: 2919976 - DNA, 21 bp, Homo sapiens
tacacaatggtttttaaattt

SEQ ID NO: 2919977 - DNA, 10 bp, Homo sapiens
tacacacaca

SEQ ID NO: 2919978 - DNA, 15 bp, Homo sapiens
tacacacacacacac

SEQ ID NO: 2919979 - DNA, 16 bp, Homo sapiens
tacacacacacacaca

SEQ ID NO: 2919980 - DNA, 21 bp, Homo sapiens
tacacacacacacacagccac

SEQ ID NO: 2919981 - DNA, 11 bp, Homo sapiens
tacacagaaac

SEQ ID NO: 2919982 - DNA, 14 bp, Homo sapiens
tacacagaaacact

SEQ ID NO: 2919983 - DNA, 18 bp, Homo sapiens
tacacagaaacactgcct

SEQ ID NO: 2919984 - DNA, 18 bp, Homo sapiens
tacacagtaagtcattta

SEQ ID NO: 2919985 - DNA, 15 bp, Homo sapiens
tacaccacactttca

SEQ ID NO: 2919986 - DNA, 19 bp, Homo sapiens
tacaccatgtttgagctca

SEQ ID NO: 2919987 - DNA, 24 bp, Homo sapiens
tacaccatgtttgagctcagaccc

SEQ ID NO: 2919988 - DNA, 19 bp, Homo sapiens
tacaccattatcttggaaa

SEQ ID NO: 2919989 - DNA, 23 bp, Homo sapiens
tacacggattattatttgtactt

SEQ ID NO: 2919990 - DNA, 16 bp, Homo sapiens
tacacgtatctcttgg

SEQ ID NO: 2919991 - DNA, 13 bp, Homo sapiens
tacacgtgtcctg

SEQ ID NO: 2919992 - DNA, 17 bp, Homo sapiens
tacacgtgtcctgtagt

SEQ ID NO: 2919993 - DNA, 16 bp, Homo sapiens
tacactacaagtttat

SEQ ID NO: 2919994 - DNA, 13 bp, Homo sapiens
tacactcttatag

SEQ ID NO: 2919995 - DNA, 15 bp, Homo sapiens
tacactgatgcaagg

SEQ ID NO: 2919996 - DNA, 16 bp, Homo sapiens
tacactgatgcaagga

SEQ ID NO: 2919997 - DNA, 13 bp, Homo sapiens
tacactgtgtctc

SEQ ID NO: 2919998 - DNA, 17 bp, Homo sapiens
tacactgtgtctctatg

SEQ ID NO: 2919999 - DNA, 21 bp, Homo sapiens
tacactgtgtctctatgtgaa

SEQ ID NO: 2920000 - DNA, 23 bp, Homo sapiens
tacactgtgtctctatgtgaata

SEQ ID NO: 2920001 - DNA, 12 bp, Homo sapiens
tacacttctgat

SEQ ID NO: 2920002 - DNA, 13 bp, Homo sapiens
tacacttgccctg

SEQ ID NO: 2920003 - DNA, 15 bp, Homo sapiens
tacacttgccctgct

SEQ ID NO: 2920004 - DNA, 16 bp, Homo sapiens
tacacttgccctgctc

SEQ ID NO: 2920005 - DNA, 18 bp, Homo sapiens
tacacttttttggggata

SEQ ID NO: 2920006 - DNA, 15 bp, Homo sapiens
tacagaaaaagactt

SEQ ID NO: 2920007 - DNA, 20 bp, Homo sapiens
tacagaaagtggtgctcagt

SEQ ID NO: 2920008 - DNA, 23 bp, Homo sapiens
tacagaattactgtaactgatta

SEQ ID NO: 2920009 - DNA, 14 bp, Homo sapiens
tacagacagacata

SEQ ID NO: 2920010 - DNA, 15 bp, Homo sapiens
tacagacagacatac

SEQ ID NO: 2920011 - DNA, 22 bp, Homo sapiens
tacagacgtctcaagactgaaa

SEQ ID NO: 2920012 - DNA, 21 bp, Homo sapiens
tacagagaaaatcaaagcagt

SEQ ID NO: 2920013 - DNA, 19 bp, Homo sapiens
tacagagattgtagtattt

SEQ ID NO: 2920014 - DNA, 19 bp, Homo sapiens
tacagagtaattataggaa

SEQ ID NO: 2920015 - DNA, 18 bp, Homo sapiens
tacagatactgtgagctt

SEQ ID NO: 2920016 - DNA, 21 bp, Homo sapiens
tacagatatttttctccagaa

SEQ ID NO: 2920017 - DNA, 14 bp, Homo sapiens
tacagcagcaagaa

SEQ ID NO: 2920018 - DNA, 22 bp, Homo sapiens
tacagcagcaagaaaaaaaaat

SEQ ID NO: 2920019 - DNA, 17 bp, Homo sapiens
tacagcccacctggctt

SEQ ID NO: 2920020 - DNA, 20 bp, Homo sapiens
tacagcttatttttttctac

SEQ ID NO: 2920021 - DNA, 18 bp, Homo sapiens
tacagctttcatgattag

SEQ ID NO: 2920022 - DNA, 21 bp, Homo sapiens
tacagctttctgaccttcagc

SEQ ID NO: 2920023 - DNA, 19 bp, Homo sapiens
tacagctttgggtcatttt

SEQ ID NO: 2920024 - DNA, 17 bp, Homo sapiens
tacaggaaagatgcatt

SEQ ID NO: 2920025 - DNA, 20 bp, Homo sapiens
tacaggagacccaacaatga

SEQ ID NO: 2920026 - DNA, 21 bp, Homo sapiens
tacaggggggtcggaagcctg

SEQ ID NO: 2920027 - DNA, 22 bp, Homo sapiens
tacagggtagcaggtaccactg

SEQ ID NO: 2920028 - DNA, 22 bp, Homo sapiens
tacaggtgtgtgccaccacacc

SEQ ID NO: 2920029 - DNA, 15 bp, Homo sapiens
tacaggttacaacag

SEQ ID NO: 2920030 - DNA, 18 bp, Homo sapiens
tacaggttacaacagatt

SEQ ID NO: 2920031 - DNA, 23 bp, Homo sapiens
tacaggttacaacagatttgtga

SEQ ID NO: 2920032 - DNA, 17 bp, Homo sapiens
tacagtaaatgaactga

SEQ ID NO: 2920033 - DNA, 13 bp, Homo sapiens
tacagtaacttta

SEQ ID NO: 2920034 - DNA, 17 bp, Homo sapiens
tacagtaactttatgtg

SEQ ID NO: 2920035 - DNA, 20 bp, Homo sapiens
tacagtaactttatgtgtaa

SEQ ID NO: 2920036 - DNA, 23 bp, Homo sapiens
tacagtaactttatgtgtaaata

SEQ ID NO: 2920037 - DNA, 18 bp, Homo sapiens
tacagtaggagcccagct

SEQ ID NO: 2920038 - DNA, 20 bp, Homo sapiens
tacagtatattcttgtaaat

SEQ ID NO: 2920039 - DNA, 15 bp, Homo sapiens
tacagtatgcttgct

SEQ ID NO: 2920040 - DNA, 16 bp, Homo sapiens
tacagtatgcttgctc

SEQ ID NO: 2920041 - DNA, 21 bp, Homo sapiens
tacagtctcaattttgtattt

SEQ ID NO: 2920042 - DNA, 22 bp, Homo sapiens
tacagtctcaattttgtattta

SEQ ID NO: 2920043 - DNA, 13 bp, Homo sapiens
tacagtctgtctt

SEQ ID NO: 2920044 - DNA, 18 bp, Homo sapiens
tacagtctgtcttctgta

SEQ ID NO: 2920045 - DNA, 20 bp, Homo sapiens
tacagtctgtcttctgtata

SEQ ID NO: 2920046 - DNA, 21 bp, Homo sapiens
tacagtctgtcttctgtatat

SEQ ID NO: 2920047 - DNA, 18 bp, Homo sapiens
tacagtgtttcttcactt

SEQ ID NO: 2920048 - DNA, 15 bp, Homo sapiens
tacagttcataaatt

SEQ ID NO: 2920049 - DNA, 19 bp, Homo sapiens
tacagttgaaataactgga

SEQ ID NO: 2920050 - DNA, 15 bp, Homo sapiens
tacagttgcaggagc

SEQ ID NO: 2920051 - DNA, 19 bp, Homo sapiens
tacagtttataaagccaag

SEQ ID NO: 2920052 - DNA, 20 bp, Homo sapiens
tacagtttataaagccaaga

SEQ ID NO: 2920053 - DNA, 21 bp, Homo sapiens
tacagtttataaagccaagaa

SEQ ID NO: 2920054 - DNA, 23 bp, Homo sapiens
tacagtttataaagccaagaatt

SEQ ID NO: 2920055 - DNA, 23 bp, Homo sapiens
tacagtttggggcaagtcatgta

SEQ ID NO: 2920056 - DNA, 22 bp, Homo sapiens
tacagtttgtgctctactgtta

SEQ ID NO: 2920057 - DNA, 18 bp, Homo sapiens
tacataactgatctattt

SEQ ID NO: 2920058 - DNA, 20 bp, Homo sapiens
tacataatctgtacaatgaa

SEQ ID NO: 2920059 - DNA, 15 bp, Homo sapiens
tacataattcactct

SEQ ID NO: 2920060 - DNA, 19 bp, Homo sapiens
tacataattgattaaaatc

SEQ ID NO: 2920061 - DNA, 14 bp, Homo sapiens
tacatacaccagca

SEQ ID NO: 2920062 - DNA, 12 bp, Homo sapiens
tacatacagaat

SEQ ID NO: 2920063 - DNA, 15 bp, Homo sapiens
tacatacagtgatat

SEQ ID NO: 2920064 - DNA, 18 bp, Homo sapiens
tacatactaggtgccttt

SEQ ID NO: 2920065 - DNA, 12 bp, Homo sapiens
tacatagacatt

SEQ ID NO: 2920066 - DNA, 17 bp, Homo sapiens
tacatagacatttcaaa

SEQ ID NO: 2920067 - DNA, 22 bp, Homo sapiens
tacataggaaccaaatcaatga

SEQ ID NO: 2920068 - DNA, 16 bp, Homo sapiens
tacatagtaaagtatt

SEQ ID NO: 2920069 - DNA, 15 bp, Homo sapiens
tacatatgtagaaac

SEQ ID NO: 2920070 - DNA, 22 bp, Homo sapiens
tacatatgttaataaactgcaa

SEQ ID NO: 2920071 - DNA, 15 bp, Homo sapiens
tacatattctttaaa

SEQ ID NO: 2920072 - DNA, 20 bp, Homo sapiens
tacatattgcaggagacatt

SEQ ID NO: 2920073 - DNA, 22 bp, Homo sapiens
tacatattgcaggagacatttt

SEQ ID NO: 2920074 - DNA, 15 bp, Homo sapiens
tacatcaatatgtat

SEQ ID NO: 2920075 - DNA, 16 bp, Homo sapiens
tacatcaatatgtata

SEQ ID NO: 2920076 - DNA, 17 bp, Homo sapiens
tacatcaatatgtatat

SEQ ID NO: 2920077 - DNA, 16 bp, Homo sapiens
tacatcacttcctgtt

SEQ ID NO: 2920078 - DNA, 19 bp, Homo sapiens
tacatcacttcctgtttta

SEQ ID NO: 2920079 - DNA, 20 bp, Homo sapiens
tacatccaaagcagacagct

SEQ ID NO: 2920080 - DNA, 23 bp, Homo sapiens
tacatccaaagcagacagctcca

SEQ ID NO: 2920081 - DNA, 20 bp, Homo sapiens
tacatcccatgtaacagaaa

SEQ ID NO: 2920082 - DNA, 22 bp, Homo sapiens
tacatcccatgtaacagaaagg

SEQ ID NO: 2920083 - DNA, 20 bp, Homo sapiens
tacatctattttggattgta

SEQ ID NO: 2920084 - DNA, 17 bp, Homo sapiens
tacatcttttttcacaa

SEQ ID NO: 2920085 - DNA, 15 bp, Homo sapiens
tacatgacatcaaaa

SEQ ID NO: 2920086 - DNA, 16 bp, Homo sapiens
tacatgagaaggaact

SEQ ID NO: 2920087 - DNA, 23 bp, Homo sapiens
tacatgaggaactgtagatgatg

SEQ ID NO: 2920088 - DNA, 11 bp, Homo sapiens
tacatgcatac

SEQ ID NO: 2920089 - DNA, 14 bp, Homo sapiens
tacatgcatacttc

SEQ ID NO: 2920090 - DNA, 22 bp, Homo sapiens
tacatggcagagtttgtgtgtt

SEQ ID NO: 2920091 - DNA, 22 bp, Homo sapiens
tacatggtttagataaaggaaa

SEQ ID NO: 2920092 - DNA, 13 bp, Homo sapiens
tacatgtaatttg

SEQ ID NO: 2920093 - DNA, 23 bp, Homo sapiens
tacatgtacatagtaaagtattt

SEQ ID NO: 2920094 - DNA, 15 bp, Homo sapiens
tacatgtatgcctgc

SEQ ID NO: 2920095 - DNA, 12 bp, Homo sapiens
tacatgtttgca

SEQ ID NO: 2920096 - DNA, 22 bp, Homo sapiens
tacatgtttgcacctttctagt

SEQ ID NO: 2920097 - DNA, 16 bp, Homo sapiens
tacattaaaaagcctt

SEQ ID NO: 2920098 - DNA, 15 bp, Homo sapiens
tacattaaaataaac

SEQ ID NO: 2920099 - DNA, 20 bp, Homo sapiens
tacattaaaataaaccaaat

SEQ ID NO: 2920100 - DNA, 19 bp, Homo sapiens
tagagagggagaagaagtc

SEQ ID NO: 2920101 - DNA, 22 bp, Homo sapiens
tagagatatttaaaagacaaac

SEQ ID NO: 2920102 - DNA, 17 bp, Homo sapiens
tagagatggagtcttgc

SEQ ID NO: 2920103 - DNA, 19 bp, Homo sapiens
tagagattacctcctgaga

SEQ ID NO: 2920104 - DNA, 23 bp, Homo sapiens
tagagcaacagtaattattattt

SEQ ID NO: 2920105 - DNA, 16 bp, Homo sapiens
tagagcactgccacca

SEQ ID NO: 2920106 - DNA, 14 bp, Homo sapiens
tagagcattaaaat

SEQ ID NO: 2920107 - DNA, 16 bp, Homo sapiens
tagagcattaaaataa

SEQ ID NO: 2920108 - DNA, 19 bp, Homo sapiens
tagagcattgaattggaga

SEQ ID NO: 2920109 - DNA, 12 bp, Homo sapiens
tagagccaatta

SEQ ID NO: 2920110 - DNA, 17 bp, Homo sapiens
tagagccagccttggtt

SEQ ID NO: 2920111 - DNA, 12 bp, Homo sapiens
tagagcctttga

SEQ ID NO: 2920112 - DNA, 22 bp, Homo sapiens
tagagcctttgggatcgtcctg

SEQ ID NO: 2920113 - DNA, 16 bp, Homo sapiens
tagagcgcggctggct

SEQ ID NO: 2920114 - DNA, 15 bp, Homo sapiens
tagagctgccactgg

SEQ ID NO: 2920115 - DNA, 22 bp, Homo sapiens
tagagctgccactgggcacctg

SEQ ID NO: 2920116 - DNA, 20 bp, Homo sapiens
tagagctgtattaagccact

SEQ ID NO: 2920117 - DNA, 12 bp, Homo sapiens
tagaggaaaatg

SEQ ID NO: 2920118 - DNA, 13 bp, Homo sapiens
tagaggagctgct

SEQ ID NO: 2920119 - DNA, 22 bp, Homo sapiens
tagaggatgaaggctgtgaaaa

SEQ ID NO: 2920120 - DNA, 16 bp, Homo sapiens
tagaggcagggctgca

SEQ ID NO: 2920121 - DNA, 15 bp, Homo sapiens
tagaggcattgttag

SEQ ID NO: 2920122 - DNA, 19 bp, Homo sapiens
tagaggctttgagcaacta

SEQ ID NO: 2920123 - DNA, 15 bp, Homo sapiens
tagagggacctctcc

SEQ ID NO: 2920124 - DNA, 20 bp, Homo sapiens
tagagggacctctcccaggg

SEQ ID NO: 2920125 - DNA, 18 bp, Homo sapiens
tagagggcattgactggt

SEQ ID NO: 2920126 - DNA, 17 bp, Homo sapiens
tagagggtgctgcccca

SEQ ID NO: 2920127 - DNA, 16 bp, Homo sapiens
tagagtccaaggttta

SEQ ID NO: 2920128 - DNA, 16 bp, Homo sapiens
tagagtgctctgaccc

SEQ ID NO: 2920129 - DNA, 21 bp, Homo sapiens
tagagttttttttttctttca

SEQ ID NO: 2920130 - DNA, 15 bp, Homo sapiens
tagataaactcagaa

SEQ ID NO: 2920131 - DNA, 16 bp, Homo sapiens
tagataaaggaaacat

SEQ ID NO: 2920132 - DNA, 20 bp, Homo sapiens
tagataaaggaaacatataa

SEQ ID NO: 2920133 - DNA, 16 bp, Homo sapiens
tagataactgctcttt

SEQ ID NO: 2920134 - DNA, 14 bp, Homo sapiens
tagatattggaaga

SEQ ID NO: 2920135 - DNA, 19 bp, Homo sapiens
tagatcatttgttctggga

SEQ ID NO: 2920136 - DNA, 14 bp, Homo sapiens
tagatctctcctgc

SEQ ID NO: 2920137 - DNA, 16 bp, Homo sapiens
tagatctgctttctgt

SEQ ID NO: 2920138 - DNA, 20 bp, Homo sapiens
tagatctgctttctgttcat

SEQ ID NO: 2920139 - DNA, 23 bp, Homo sapiens
tagatctgctttctgttcatctc

SEQ ID NO: 2920140 - DNA, 15 bp, Homo sapiens
tagatctggcatgtt

SEQ ID NO: 2920141 - DNA, 16 bp, Homo sapiens
tagatctggcatgtta

SEQ ID NO: 2920142 - DNA, 16 bp, Homo sapiens
tagatcttcaatttgg

SEQ ID NO: 2920143 - DNA, 12 bp, Homo sapiens
tagatctttata

SEQ ID NO: 2920144 - DNA, 16 bp, Homo sapiens
tagatgaagttttaca

SEQ ID NO: 2920145 - DNA, 17 bp, Homo sapiens
tagatgagctgggccgg

SEQ ID NO: 2920146 - DNA, 20 bp, Homo sapiens
tagatgattaaataagattc

SEQ ID NO: 2920147 - DNA, 13 bp, Homo sapiens
tagatgcagaaaa

SEQ ID NO: 2920148 - DNA, 18 bp, Homo sapiens
tagatgcagaaaaagaaa

SEQ ID NO: 2920149 - DNA, 14 bp, Homo sapiens
tagatgctggccca

SEQ ID NO: 2920150 - DNA, 17 bp, Homo sapiens
tagatggaaaaacttgt

SEQ ID NO: 2920151 - DNA, 17 bp, Homo sapiens
tagatggaccccagcat

SEQ ID NO: 2920152 - DNA, 20 bp, Homo sapiens
tagatgggaggatgaattgt

SEQ ID NO: 2920153 - DNA, 21 bp, Homo sapiens
tagatgggagggaggctcagg

SEQ ID NO: 2920154 - DNA, 20 bp, Homo sapiens
tagatgtagataaactcaga

SEQ ID NO: 2920155 - DNA, 21 bp, Homo sapiens
tagatgttctaagtctttcca

SEQ ID NO: 2920156 - DNA, 14 bp, Homo sapiens
tagatgttgccatg

SEQ ID NO: 2920157 - DNA, 11 bp, Homo sapiens
tagatgtttat

SEQ ID NO: 2920158 - DNA, 21 bp, Homo sapiens
tagatgtttattcttctagag

SEQ ID NO: 2920159 - DNA, 15 bp, Homo sapiens
tagatgtttgacttt

SEQ ID NO: 2920160 - DNA, 14 bp, Homo sapiens
tagatgttttaact

SEQ ID NO: 2920161 - DNA, 15 bp, Homo sapiens
tagatgttttaactt

SEQ ID NO: 2920162 - DNA, 15 bp, Homo sapiens
tagattatatcaaag

SEQ ID NO: 2920163 - DNA, 15 bp, Homo sapiens
tagattcgctgtccc

SEQ ID NO: 2920164 - DNA, 16 bp, Homo sapiens
tagattcgctgtcccc

SEQ ID NO: 2920165 - DNA, 14 bp, Homo sapiens
tagattctaacata

SEQ ID NO: 2920166 - DNA, 20 bp, Homo sapiens
tagattctacatattcttta

SEQ ID NO: 2920167 - DNA, 22 bp, Homo sapiens
tagattctctggctgtaaggct

SEQ ID NO: 2920168 - DNA, 19 bp, Homo sapiens
tagattctctgtgtctaag

SEQ ID NO: 2920169 - DNA, 22 bp, Homo sapiens
tagattctctgtgtctaagatt

SEQ ID NO: 2920170 - DNA, 23 bp, Homo sapiens
tagattctcttgtataagatcct

SEQ ID NO: 2920171 - DNA, 20 bp, Homo sapiens
tagattcttgagctgttgtg

SEQ ID NO: 2920172 - DNA, 18 bp, Homo sapiens
tagattgaaaacttttct

SEQ ID NO: 2920173 - DNA, 20 bp, Homo sapiens
tagattgaaaacttttctca

SEQ ID NO: 2920174 - DNA, 15 bp, Homo sapiens
tagattggttctgtt

SEQ ID NO: 2920175 - DNA, 16 bp, Homo sapiens
tagattggttctgttt

SEQ ID NO: 2920176 - DNA, 12 bp, Homo sapiens
tagattgtaaac

SEQ ID NO: 2920177 - DNA, 23 bp, Homo sapiens
tagatttcctcctcccagtgcct

SEQ ID NO: 2920178 - DNA, 15 bp, Homo sapiens
tagattttaagcttc

SEQ ID NO: 2920179 - DNA, 14 bp, Homo sapiens
tagattttctggtt

SEQ ID NO: 2920180 - DNA, 19 bp, Homo sapiens
tagattttctggttctaac

SEQ ID NO: 2920181 - DNA, 15 bp, Homo sapiens
tagattttctgtaaa

SEQ ID NO: 2920182 - DNA, 23 bp, Homo sapiens
tagattttttaaaaaaaatgtga

SEQ ID NO: 2920183 - DNA, 15 bp, Homo sapiens
tagcaaaacttttaa

SEQ ID NO: 2920184 - DNA, 19 bp, Homo sapiens
tagcaaaacttttaaacta

SEQ ID NO: 2920185 - DNA, 21 bp, Homo sapiens
tagcaaaacttttaaactaca

SEQ ID NO: 2920186 - DNA, 14 bp, Homo sapiens
tagcaaagatatat

SEQ ID NO: 2920187 - DNA, 22 bp, Homo sapiens
tagcaaagatatatattcacca

SEQ ID NO: 2920188 - DNA, 13 bp, Homo sapiens
tagcaaggctcat

SEQ ID NO: 2920189 - DNA, 20 bp, Homo sapiens
tagcaagggacaattgtatc

SEQ ID NO: 2920190 - DNA, 13 bp, Homo sapiens
tagcaatgtgttt

SEQ ID NO: 2920191 - DNA, 15 bp, Homo sapiens
tagcaatgtgtttct

SEQ ID NO: 2920192 - DNA, 16 bp, Homo sapiens
tagcaatgtgtttctg

SEQ ID NO: 2920193 - DNA, 19 bp, Homo sapiens
tagcacatgcttcaatagt

SEQ ID NO: 2920194 - DNA, 14 bp, Homo sapiens
tagcaccaaataaa

SEQ ID NO: 2920195 - DNA, 16 bp, Homo sapiens
tagcaccaaataaatt

SEQ ID NO: 2920196 - DNA, 16 bp, Homo sapiens
tagcaccttttctcct

SEQ ID NO: 2920197 - DNA, 20 bp, Homo sapiens
tagcactaccactcctgcca

SEQ ID NO: 2920198 - DNA, 16 bp, Homo sapiens
tagcagaagaaaggaa

SEQ ID NO: 2920199 - DNA, 21 bp, Homo sapiens
tagcagaagaaaggaacattt

SEQ ID NO: 2920200 - DNA, 22 bp, Homo sapiens
tagcagaagaaaggaacattta

SEQ ID NO: 2920201 - DNA, 17 bp, Homo sapiens
tagcagacaacacacaa

SEQ ID NO: 2920202 - DNA, 13 bp, Homo sapiens
tagcagacaggcc

SEQ ID NO: 2920203 - DNA, 14 bp, Homo sapiens
tagcagatggtttc

SEQ ID NO: 2920204 - DNA, 19 bp, Homo sapiens
tagcagcaaatagcaaatg

SEQ ID NO: 2920205 - DNA, 16 bp, Homo sapiens
tagcagcccaccctgc

SEQ ID NO: 2920206 - DNA, 17 bp, Homo sapiens
tagcagcccaccctgct

SEQ ID NO: 2920207 - DNA, 21 bp, Homo sapiens
tagcaggagaggagagccaga

SEQ ID NO: 2920208 - DNA, 18 bp, Homo sapiens
tagcatataattctatat

SEQ ID NO: 2920209 - DNA, 18 bp, Homo sapiens
tagcatctgcattgccca

SEQ ID NO: 2920210 - DNA, 14 bp, Homo sapiens
tagcatctgtacaa

SEQ ID NO: 2920211 - DNA, 17 bp, Homo sapiens
tagcatctgtacaaagg

SEQ ID NO: 2920212 - DNA, 20 bp, Homo sapiens
tagcatgccaacaagaatgc

SEQ ID NO: 2920213 - DNA, 21 bp, Homo sapiens
tagcatgccaacaagaatgca

SEQ ID NO: 2920214 - DNA, 12 bp, Homo sapiens
tagcatgtaatg

SEQ ID NO: 2920215 - DNA, 18 bp, Homo sapiens
tagcatgtcgtcaaagct

SEQ ID NO: 2920216 - DNA, 15 bp, Homo sapiens
tagcattctggcagt

SEQ ID NO: 2920217 - DNA, 20 bp, Homo sapiens
tagcattgtgaactgacagg

SEQ ID NO: 2920218 - DNA, 22 bp, Homo sapiens
tagcatttaccaacatgtatct

SEQ ID NO: 2920219 - DNA, 23 bp, Homo sapiens
tagcatttaccaacatgtatctg

SEQ ID NO: 2920220 - DNA, 17 bp, Homo sapiens
tagccaaggcccggggt

SEQ ID NO: 2920221 - DNA, 14 bp, Homo sapiens
tagccacaccagga

SEQ ID NO: 2920222 - DNA, 21 bp, Homo sapiens
tagccacatttggaatacttt

SEQ ID NO: 2920223 - DNA, 19 bp, Homo sapiens
tagccaccgcctcctacag

SEQ ID NO: 2920224 - DNA, 20 bp, Homo sapiens
tagccagcacacagggcagt

SEQ ID NO: 2920225 - DNA, 19 bp, Homo sapiens
tagccagcacttgtatata

SEQ ID NO: 2920226 - DNA, 18 bp, Homo sapiens
tagccaggtccccctgca

SEQ ID NO: 2920227 - DNA, 21 bp, Homo sapiens
tagccaggtccccctgcagct

SEQ ID NO: 2920228 - DNA, 15 bp, Homo sapiens
tagccagtcattgta

SEQ ID NO: 2920229 - DNA, 17 bp, Homo sapiens
tagccagtcattgtaac

SEQ ID NO: 2920230 - DNA, 15 bp, Homo sapiens
tagccagtgaaacac

SEQ ID NO: 2920231 - DNA, 17 bp, Homo sapiens
tagccattcttttccca

SEQ ID NO: 2920232 - DNA, 23 bp, Homo sapiens
tatatagcaagtgctatttcagc

SEQ ID NO: 2920233 - DNA, 12 bp, Homo sapiens
tatataggtttt

SEQ ID NO: 2920234 - DNA, 24 bp, Homo sapiens
tatataggttttgtttgctatctt

SEQ ID NO: 2920235 - DNA, 21 bp, Homo sapiens
tatatagtatttaattgtttc

SEQ ID NO: 2920236 - DNA, 15 bp, Homo sapiens
tatatatacatatat

SEQ ID NO: 2920237 - DNA, 11 bp, Homo sapiens
tatatatataa

SEQ ID NO: 2920238 - DNA, 16 bp, Homo sapiens
tatatatcttttgtaa

SEQ ID NO: 2920239 - DNA, 13 bp, Homo sapiens
tatatatgctact

SEQ ID NO: 2920240 - DNA, 19 bp, Homo sapiens
tatatatgtacagttatct

SEQ ID NO: 2920241 - DNA, 16 bp, Homo sapiens
tatatatgtatttcta

SEQ ID NO: 2920242 - DNA, 17 bp, Homo sapiens
tatatatgtcaaattgt

SEQ ID NO: 2920243 - DNA, 12 bp, Homo sapiens
tatatatgtgta

SEQ ID NO: 2920244 - DNA, 16 bp, Homo sapiens
tatatatgtgtatgta

SEQ ID NO: 2920245 - DNA, 17 bp, Homo sapiens
tatatattcttataaaa

SEQ ID NO: 2920246 - DNA, 17 bp, Homo sapiens
tatatattgtctgtaaa

SEQ ID NO: 2920247 - DNA, 15 bp, Homo sapiens
tatatatttaacatg

SEQ ID NO: 2920248 - DNA, 11 bp, Homo sapiens
tatatatttcc

SEQ ID NO: 2920249 - DNA, 13 bp, Homo sapiens
tatatatttctat

SEQ ID NO: 2920250 - DNA, 17 bp, Homo sapiens
tatatcaaatgagcatc

SEQ ID NO: 2920251 - DNA, 13 bp, Homo sapiens
tatatcagtgttg

SEQ ID NO: 2920252 - DNA, 14 bp, Homo sapiens
tatatcatatgtat

SEQ ID NO: 2920253 - DNA, 15 bp, Homo sapiens
tatatctctatttga

SEQ ID NO: 2920254 - DNA, 14 bp, Homo sapiens
tatatctgagcaag

SEQ ID NO: 2920255 - DNA, 16 bp, Homo sapiens
tatatctgagcaagga

SEQ ID NO: 2920256 - DNA, 14 bp, Homo sapiens
tatatctgtatgta

SEQ ID NO: 2920257 - DNA, 15 bp, Homo sapiens
tatatctgtatgtat

SEQ ID NO: 2920258 - DNA, 14 bp, Homo sapiens
tatatctttatact

SEQ ID NO: 2920259 - DNA, 18 bp, Homo sapiens
tatatgaagcaagctgtg

SEQ ID NO: 2920260 - DNA, 23 bp, Homo sapiens
tatatgaagcaagctgtgttact

SEQ ID NO: 2920261 - DNA, 13 bp, Homo sapiens
tatatgactgcat

SEQ ID NO: 2920262 - DNA, 19 bp, Homo sapiens
tatatgactgcatttgtgt

SEQ ID NO: 2920263 - DNA, 17 bp, Homo sapiens
tatatgattctctgtgg

SEQ ID NO: 2920264 - DNA, 10 bp, Homo sapiens
tatatgcacc

SEQ ID NO: 2920265 - DNA, 23 bp, Homo sapiens
tatatgcccattcttttcacttc

SEQ ID NO: 2920266 - DNA, 17 bp, Homo sapiens
tatatgccctcaagtaa

SEQ ID NO: 2920267 - DNA, 17 bp, Homo sapiens
tatatggaaattctgct

SEQ ID NO: 2920268 - DNA, 22 bp, Homo sapiens
tatatggtatatatacatatat

SEQ ID NO: 2920269 - DNA, 12 bp, Homo sapiens
tatatgtacagt

SEQ ID NO: 2920270 - DNA, 14 bp, Homo sapiens
tatatgtactgttt

SEQ ID NO: 2920271 - DNA, 13 bp, Homo sapiens
tatatgtacttgt

SEQ ID NO: 2920272 - DNA, 17 bp, Homo sapiens
tatatgtatttttatat

SEQ ID NO: 2920273 - DNA, 21 bp, Homo sapiens
tatatgtattttttgaatcta

SEQ ID NO: 2920274 - DNA, 15 bp, Homo sapiens
tatatgtcatttact

SEQ ID NO: 2920275 - DNA, 12 bp, Homo sapiens
tatatgtgagga

SEQ ID NO: 2920276 - DNA, 14 bp, Homo sapiens
tatatgttcactgt

SEQ ID NO: 2920277 - DNA, 18 bp, Homo sapiens
tatattaaataacatgtt

SEQ ID NO: 2920278 - DNA, 16 bp, Homo sapiens
tatattatttctagga

SEQ ID NO: 2920279 - DNA, 13 bp, Homo sapiens
tatattcaccaat

SEQ ID NO: 2920280 - DNA, 18 bp, Homo sapiens
tatattcccaatagcaac

SEQ ID NO: 2920281 - DNA, 12 bp, Homo sapiens
tatattccttgt

SEQ ID NO: 2920282 - DNA, 14 bp, Homo sapiens
tatattgaaaaaaa

SEQ ID NO: 2920283 - DNA, 16 bp, Homo sapiens
tatattgattatagca

SEQ ID NO: 2920284 - DNA, 14 bp, Homo sapiens
tatatttcaataaa

SEQ ID NO: 2920285 - DNA, 15 bp, Homo sapiens
tatatttcaataaat

SEQ ID NO: 2920286 - DNA, 16 bp, Homo sapiens
tatatttcagatgtaa

SEQ ID NO: 2920287 - DNA, 15 bp, Homo sapiens
tatatttgtaaagct

SEQ ID NO: 2920288 - DNA, 22 bp, Homo sapiens
tatatttgtgctatagtatttg

SEQ ID NO: 2920289 - DNA, 20 bp, Homo sapiens
tatatttgtgtatttaacag

SEQ ID NO: 2920290 - DNA, 23 bp, Homo sapiens
tatattttacacgtatctcttgg

SEQ ID NO: 2920291 - DNA, 14 bp, Homo sapiens
tatattttctattt

SEQ ID NO: 2920292 - DNA, 17 bp, Homo sapiens
tatatttttttaactgt

SEQ ID NO: 2920293 - DNA, 19 bp, Homo sapiens
tatatttttttaactgtga

SEQ ID NO: 2920294 - DNA, 20 bp, Homo sapiens
tatatttttttaactgtgat

SEQ ID NO: 2920295 - DNA, 18 bp, Homo sapiens
tatcaaaaagtataaatt

SEQ ID NO: 2920296 - DNA, 13 bp, Homo sapiens
tatcaaaattcta

SEQ ID NO: 2920297 - DNA, 14 bp, Homo sapiens
tatcaaaattgcct

SEQ ID NO: 2920298 - DNA, 13 bp, Homo sapiens
tatcaaatgagca

SEQ ID NO: 2920299 - DNA, 21 bp, Homo sapiens
tatcaaatgcagtatatttct

SEQ ID NO: 2920300 - DNA, 22 bp, Homo sapiens
tatcaactggggggaccaaata

SEQ ID NO: 2920301 - DNA, 23 bp, Homo sapiens
tatcaagaagtcagagaaaacac

SEQ ID NO: 2920302 - DNA, 16 bp, Homo sapiens
tatcaagacatagcat

SEQ ID NO: 2920303 - DNA, 20 bp, Homo sapiens
tatcaagaggctgagacagg

SEQ ID NO: 2920304 - DNA, 20 bp, Homo sapiens
tatcaagtactacattttct

SEQ ID NO: 2920305 - DNA, 19 bp, Homo sapiens
tatcaattgcaaaatgcgt

SEQ ID NO: 2920306 - DNA, 22 bp, Homo sapiens
tatcaattggaaaggaagaaaa

SEQ ID NO: 2920307 - DNA, 16 bp, Homo sapiens
tatcacctcattctga

SEQ ID NO: 2920308 - DNA, 18 bp, Homo sapiens
tatcacctcattctgaac

SEQ ID NO: 2920309 - DNA, 18 bp, Homo sapiens
tatcacctggcttgttta

SEQ ID NO: 2920310 - DNA, 21 bp, Homo sapiens
tatcactgccttcgtttatat

SEQ ID NO: 2920311 - DNA, 15 bp, Homo sapiens
tatcagaagagaggg

SEQ ID NO: 2920312 - DNA, 11 bp, Homo sapiens
tatcaggcaga

SEQ ID NO: 2920313 - DNA, 17 bp, Homo sapiens
tatcaggcagaagaatc

SEQ ID NO: 2920314 - DNA, 23 bp, Homo sapiens
tatcaggcagaagaatctttctt

SEQ ID NO: 2920315 - DNA, 20 bp, Homo sapiens
tatcagtcaatatttttaga

SEQ ID NO: 2920316 - DNA, 17 bp, Homo sapiens
tatcagtgttgtctcat

SEQ ID NO: 2920317 - DNA, 16 bp, Homo sapiens
tatcagttactcagcc

SEQ ID NO: 2920318 - DNA, 21 bp, Homo sapiens
tatcagttactcagccctggg

SEQ ID NO: 2920319 - DNA, 13 bp, Homo sapiens
tatcataattacc

SEQ ID NO: 2920320 - DNA, 18 bp, Homo sapiens
tatcatcaatgtgacatt

SEQ ID NO: 2920321 - DNA, 17 bp, Homo sapiens
tatcatccacattgttt

SEQ ID NO: 2920322 - DNA, 22 bp, Homo sapiens
tatcatccacattgttttaaaa

SEQ ID NO: 2920323 - DNA, 21 bp, Homo sapiens
tatcatgaagccttgctgaac

SEQ ID NO: 2920324 - DNA, 14 bp, Homo sapiens
tatcatgccctgtg

SEQ ID NO: 2920325 - DNA, 11 bp, Homo sapiens
tatcatgtgta

SEQ ID NO: 2920326 - DNA, 20 bp, Homo sapiens
tatcatgtgtaatcaataaa

SEQ ID NO: 2920327 - DNA, 15 bp, Homo sapiens
tatcattaaagttct

SEQ ID NO: 2920328 - DNA, 22 bp, Homo sapiens
tatcattcaagtgtaaaatatt

SEQ ID NO: 2920329 - DNA, 13 bp, Homo sapiens
tatcatttctact

SEQ ID NO: 2920330 - DNA, 22 bp, Homo sapiens
tatccaaaatgtgtatttctta

SEQ ID NO: 2920331 - DNA, 14 bp, Homo sapiens
tatccaactttttc

SEQ ID NO: 2920332 - DNA, 16 bp, Homo sapiens
tatccacatgaaaata

SEQ ID NO: 2920333 - DNA, 19 bp, Homo sapiens
tatccacccagcccattct

SEQ ID NO: 2920334 - DNA, 22 bp, Homo sapiens
tatccagaagtattgtttacat

SEQ ID NO: 2920335 - DNA, 23 bp, Homo sapiens
tatccagaagtattgtttacatt

SEQ ID NO: 2920336 - DNA, 13 bp, Homo sapiens
tatccagaggaat

SEQ ID NO: 2920337 - DNA, 14 bp, Homo sapiens
tatccagaggaatt

SEQ ID NO: 2920338 - DNA, 19 bp, Homo sapiens
tatccaggtcaacagaatg

SEQ ID NO: 2920339 - DNA, 22 bp, Homo sapiens
tatccaggtcaacagaatgaaa

SEQ ID NO: 2920340 - DNA, 21 bp, Homo sapiens
tatccatattacgttgtttct

SEQ ID NO: 2920341 - DNA, 17 bp, Homo sapiens
tatccatattgagtcaa

SEQ ID NO: 2920342 - DNA, 14 bp, Homo sapiens
tatccattatcatg

SEQ ID NO: 2920343 - DNA, 21 bp, Homo sapiens
tatccatttaaactaaccttt

SEQ ID NO: 2920344 - DNA, 15 bp, Homo sapiens
tatccatttctcatg

SEQ ID NO: 2920345 - DNA, 19 bp, Homo sapiens
tatcccaacagtcatgttt

SEQ ID NO: 2920346 - DNA, 20 bp, Homo sapiens
tatcccacctccatcccaga

SEQ ID NO: 2920347 - DNA, 23 bp, Homo sapiens
tatcccagctttaaaaagaaaaa

SEQ ID NO: 2920348 - DNA, 18 bp, Homo sapiens
tatccctaacaggctgta

SEQ ID NO: 2920349 - DNA, 16 bp, Homo sapiens
tatcccttcctgtctg

SEQ ID NO: 2920350 - DNA, 19 bp, Homo sapiens
tatcctagcacatgcttca

SEQ ID NO: 2920351 - DNA, 20 bp, Homo sapiens
tatcctagcacatgcttcaa

SEQ ID NO: 2920352 - DNA, 12 bp, Homo sapiens
tatcctctctct

SEQ ID NO: 2920353 - DNA, 15 bp, Homo sapiens
tatcctctctctctc

SEQ ID NO: 2920354 - DNA, 15 bp, Homo sapiens
tatcctcttattcct

SEQ ID NO: 2920355 - DNA, 21 bp, Homo sapiens
tatcctgcaagggacaggaag

SEQ ID NO: 2920356 - DNA, 22 bp, Homo sapiens
tatcctgcaagggacaggaagg

SEQ ID NO: 2920357 - DNA, 18 bp, Homo sapiens
tatcctgtgctacagaga

SEQ ID NO: 2920358 - DNA, 22 bp, Homo sapiens
tatcctgtgctacagagaaaat

SEQ ID NO: 2920359 - DNA, 22 bp, Homo sapiens
tatccttcatcttttaaagaaa

SEQ ID NO: 2920360 - DNA, 17 bp, Homo sapiens
tatccttcctctccttc

SEQ ID NO: 2920361 - DNA, 19 bp, Homo sapiens
tatcgatgttatgtaaaag

SEQ ID NO: 2920362 - DNA, 23 bp, Homo sapiens
tatcgccatggcttcccatctgt

SEQ ID NO: 2920363 - DNA, 22 bp, Homo sapiens
tatctaaaagaatttaaattct

SEQ ID NO: 2920364 - DNA, 12 bp, Homo sapiens
tatctaaagtca

SEQ ID NO: 2920365 - DNA, 20 bp, Homo sapiens
tattccagaatgctgtacat

SEQ ID NO: 2920366 - DNA, 17 bp, Homo sapiens
tattccatcttctccat

SEQ ID NO: 2920367 - DNA, 12 bp, Homo sapiens
tattccatgttt

SEQ ID NO: 2920368 - DNA, 13 bp, Homo sapiens
tattccatgtttt

SEQ ID NO: 2920369 - DNA, 22 bp, Homo sapiens
tattcccaagcccatgagtcct

SEQ ID NO: 2920370 - DNA, 21 bp, Homo sapiens
tattccctagaaacttccaaa

SEQ ID NO: 2920371 - DNA, 14 bp, Homo sapiens
tattcctagttggt

SEQ ID NO: 2920372 - DNA, 17 bp, Homo sapiens
tattcctgtatgttgtc

SEQ ID NO: 2920373 - DNA, 15 bp, Homo sapiens
tattccttttctgta

SEQ ID NO: 2920374 - DNA, 11 bp, Homo sapiens
tattctaagac

SEQ ID NO: 2920375 - DNA, 21 bp, Homo sapiens
tattctaagacttactctaag

SEQ ID NO: 2920376 - DNA, 20 bp, Homo sapiens
tattctagggtttcttaaat

SEQ ID NO: 2920377 - DNA, 19 bp, Homo sapiens
tattctcactccaccaccc

SEQ ID NO: 2920378 - DNA, 12 bp, Homo sapiens
tattctctgagc

SEQ ID NO: 2920379 - DNA, 13 bp, Homo sapiens
tattctgataatg

SEQ ID NO: 2920380 - DNA, 11 bp, Homo sapiens
tattctgattg

SEQ ID NO: 2920381 - DNA, 19 bp, Homo sapiens
tattctgtagattctgtgg

SEQ ID NO: 2920382 - DNA, 22 bp, Homo sapiens
tattctgtagattctgtggaac

SEQ ID NO: 2920383 - DNA, 18 bp, Homo sapiens
tattctgtcatttacaca

SEQ ID NO: 2920384 - DNA, 15 bp, Homo sapiens
tattctgttggaagc

SEQ ID NO: 2920385 - DNA, 13 bp, Homo sapiens
tattcttctagag

SEQ ID NO: 2920386 - DNA, 14 bp, Homo sapiens
tattcttgtaaata

SEQ ID NO: 2920387 - DNA, 18 bp, Homo sapiens
tattctttgatgttaaca

SEQ ID NO: 2920388 - DNA, 21 bp, Homo sapiens
tattctttgatgttaacacat

SEQ ID NO: 2920389 - DNA, 23 bp, Homo sapiens
tattctttgatgttaacacattt

SEQ ID NO: 2920390 - DNA, 24 bp, Homo sapiens
tattctttgatgttaacacatttt

SEQ ID NO: 2920391 - DNA, 14 bp, Homo sapiens
tattgaaagaatta

SEQ ID NO: 2920392 - DNA, 21 bp, Homo sapiens
tattgaatataatatatttgt

SEQ ID NO: 2920393 - DNA, 20 bp, Homo sapiens
tattgaatcagtttccaatt

SEQ ID NO: 2920394 - DNA, 16 bp, Homo sapiens
tattgaatctatttaa

SEQ ID NO: 2920395 - DNA, 15 bp, Homo sapiens
tattgaattgagatg

SEQ ID NO: 2920396 - DNA, 23 bp, Homo sapiens
tattgacgaactggctacagtac

SEQ ID NO: 2920397 - DNA, 19 bp, Homo sapiens
tattgattctgcttgagaa

SEQ ID NO: 2920398 - DNA, 21 bp, Homo sapiens
tattgcaaaggttccaactgt

SEQ ID NO: 2920399 - DNA, 17 bp, Homo sapiens
tattgcaaataagactc

SEQ ID NO: 2920400 - DNA, 19 bp, Homo sapiens
tattgcaaataagactctt

SEQ ID NO: 2920401 - DNA, 14 bp, Homo sapiens
tattgcacattgtt

SEQ ID NO: 2920402 - DNA, 15 bp, Homo sapiens
tattgcacattgttc

SEQ ID NO: 2920403 - DNA, 20 bp, Homo sapiens
tattgcagtttatcattcaa

SEQ ID NO: 2920404 - DNA, 21 bp, Homo sapiens
tattgccatcgggtgccaaat

SEQ ID NO: 2920405 - DNA, 20 bp, Homo sapiens
tattgcccaggctggtcttg

SEQ ID NO: 2920406 - DNA, 19 bp, Homo sapiens
tattgccttctcaccagct

SEQ ID NO: 2920407 - DNA, 20 bp, Homo sapiens
tattgccttctcaccagctg

SEQ ID NO: 2920408 - DNA, 22 bp, Homo sapiens
tattgccttctcaccagctgca

SEQ ID NO: 2920409 - DNA, 22 bp, Homo sapiens
tattgctgctgtgcgtggaaaa

SEQ ID NO: 2920410 - DNA, 19 bp, Homo sapiens
tattgctgtgagccttgca

SEQ ID NO: 2920411 - DNA, 23 bp, Homo sapiens
tattgctgtgagccttgcatgac

SEQ ID NO: 2920412 - DNA, 16 bp, Homo sapiens
tattggaaagtgattt

SEQ ID NO: 2920413 - DNA, 17 bp, Homo sapiens
tattggacaaagaacct

SEQ ID NO: 2920414 - DNA, 21 bp, Homo sapiens
tattgggctcagagagtacac

SEQ ID NO: 2920415 - DNA, 16 bp, Homo sapiens
tattgggtttggtcac

SEQ ID NO: 2920416 - DNA, 19 bp, Homo sapiens
tattggtgcgtttttacag

SEQ ID NO: 2920417 - DNA, 14 bp, Homo sapiens
tattgtaaggtctt

SEQ ID NO: 2920418 - DNA, 18 bp, Homo sapiens
tattgtaaggtctttgta

SEQ ID NO: 2920419 - DNA, 15 bp, Homo sapiens
tattgtataaaaagt

SEQ ID NO: 2920420 - DNA, 16 bp, Homo sapiens
tattgtattgctgctg

SEQ ID NO: 2920421 - DNA, 16 bp, Homo sapiens
tattgtattttgatga

SEQ ID NO: 2920422 - DNA, 12 bp, Homo sapiens
tattgtgtgaag

SEQ ID NO: 2920423 - DNA, 16 bp, Homo sapiens
tattgtgtttgtgtat

SEQ ID NO: 2920424 - DNA, 22 bp, Homo sapiens
tattgttaattatgtacaacat

SEQ ID NO: 2920425 - DNA, 14 bp, Homo sapiens
tattgtttatgtaa

SEQ ID NO: 2920426 - DNA, 18 bp, Homo sapiens
tattgtttcaattgcatc

SEQ ID NO: 2920427 - DNA, 15 bp, Homo sapiens
tatttaaaaatagaa

SEQ ID NO: 2920428 - DNA, 17 bp, Homo sapiens
tatttaaaaatgtcttg

SEQ ID NO: 2920429 - DNA, 13 bp, Homo sapiens
tatttaaaagatt

SEQ ID NO: 2920430 - DNA, 20 bp, Homo sapiens
tatttaaacctttttcttga

SEQ ID NO: 2920431 - DNA, 12 bp, Homo sapiens
tatttaaagaca

SEQ ID NO: 2920432 - DNA, 17 bp, Homo sapiens
tatttaaagacaaagac

SEQ ID NO: 2920433 - DNA, 13 bp, Homo sapiens
tatttaaagcaca

SEQ ID NO: 2920434 - DNA, 22 bp, Homo sapiens
tatttaactggtgcactttgta

SEQ ID NO: 2920435 - DNA, 20 bp, Homo sapiens
tatttaagcaacatcttttt

SEQ ID NO: 2920436 - DNA, 17 bp, Homo sapiens
tatttaaggaatcaaat

SEQ ID NO: 2920437 - DNA, 15 bp, Homo sapiens
tatttaatgttttaa

SEQ ID NO: 2920438 - DNA, 22 bp, Homo sapiens
tatttaatgttttaaatgtaca

SEQ ID NO: 2920439 - DNA, 14 bp, Homo sapiens
tatttacgctttga

SEQ ID NO: 2920440 - DNA, 19 bp, Homo sapiens
tatttacgctttgattcat

SEQ ID NO: 2920441 - DNA, 22 bp, Homo sapiens
tatttacgctttgattcatagt

SEQ ID NO: 2920442 - DNA, 15 bp, Homo sapiens
tatttagcataaatt

SEQ ID NO: 2920443 - DNA, 16 bp, Homo sapiens
tatttagcataaattt

SEQ ID NO: 2920444 - DNA, 17 bp, Homo sapiens
tatttagcataaattta

SEQ ID NO: 2920445 - DNA, 16 bp, Homo sapiens
tatttagcttctccca

SEQ ID NO: 2920446 - DNA, 24 bp, Homo sapiens
tatttataaaaagatgatcgctgt

SEQ ID NO: 2920447 - DNA, 15 bp, Homo sapiens
tatttatatgaagca

SEQ ID NO: 2920448 - DNA, 17 bp, Homo sapiens
tatttatatgtacatga

SEQ ID NO: 2920449 - DNA, 22 bp, Homo sapiens
tatttatattcatcaaataaac

SEQ ID NO: 2920450 - DNA, 16 bp, Homo sapiens
tatttatctgattaag

SEQ ID NO: 2920451 - DNA, 21 bp, Homo sapiens
tatttatctgtagtaaactat

SEQ ID NO: 2920452 - DNA, 20 bp, Homo sapiens
tatttattatgctttattgg

SEQ ID NO: 2920453 - DNA, 14 bp, Homo sapiens
tatttattatttat

SEQ ID NO: 2920454 - DNA, 17 bp, Homo sapiens
tatttattgtgtgttct

SEQ ID NO: 2920455 - DNA, 15 bp, Homo sapiens
tatttatttaaaaga

SEQ ID NO: 2920456 - DNA, 19 bp, Homo sapiens
tatttatttaaaagattca

SEQ ID NO: 2920457 - DNA, 11 bp, Homo sapiens
tatttatttat

SEQ ID NO: 2920458 - DNA, 14 bp, Homo sapiens
tatttatttatgta

SEQ ID NO: 2920459 - DNA, 18 bp, Homo sapiens
tatttatttatgtacttt

SEQ ID NO: 2920460 - DNA, 14 bp, Homo sapiens
tatttcaaattgga

SEQ ID NO: 2920461 - DNA, 15 bp, Homo sapiens
tatttcaataaatga

SEQ ID NO: 2920462 - DNA, 16 bp, Homo sapiens
tatttcagatgtaatg

SEQ ID NO: 2920463 - DNA, 15 bp, Homo sapiens
tatttcagtgatttt

SEQ ID NO: 2920464 - DNA, 22 bp, Homo sapiens
tatttcagttccgtcagaaagt

SEQ ID NO: 2920465 - DNA, 21 bp, Homo sapiens
tatttcatgctgggaatgaga

SEQ ID NO: 2920466 - DNA, 14 bp, Homo sapiens
tatttcattcatat

SEQ ID NO: 2920467 - DNA, 16 bp, Homo sapiens
tatttcattcatatcc

SEQ ID NO: 2920468 - DNA, 23 bp, Homo sapiens
tatttccaatgtgaaagattatt

SEQ ID NO: 2920469 - DNA, 21 bp, Homo sapiens
tatttccagaaggatttcttg

SEQ ID NO: 2920470 - DNA, 12 bp, Homo sapiens
tatttcctttgc

SEQ ID NO: 2920471 - DNA, 17 bp, Homo sapiens
tatttccttttctaaat

SEQ ID NO: 2920472 - DNA, 16 bp, Homo sapiens
tatttcgtttggtctt

SEQ ID NO: 2920473 - DNA, 17 bp, Homo sapiens
tatttctaggaagaatt

SEQ ID NO: 2920474 - DNA, 12 bp, Homo sapiens
tatttctatata

SEQ ID NO: 2920475 - DNA, 13 bp, Homo sapiens
tatttctattatt

SEQ ID NO: 2920476 - DNA, 21 bp, Homo sapiens
tatttctattattaattgcaa

SEQ ID NO: 2920477 - DNA, 13 bp, Homo sapiens
tatttctgatcta

SEQ ID NO: 2920478 - DNA, 10 bp, Homo sapiens
tatttcttaa

SEQ ID NO: 2920479 - DNA, 20 bp, Homo sapiens
tatttcttaacctttgctat

SEQ ID NO: 2920480 - DNA, 17 bp, Homo sapiens
tatttcttttgtgcaga

SEQ ID NO: 2920481 - DNA, 22 bp, Homo sapiens
tatttgaaaacatataaagcac

SEQ ID NO: 2920482 - DNA, 21 bp, Homo sapiens
tatttgaaaaccatattttat

SEQ ID NO: 2920483 - DNA, 12 bp, Homo sapiens
tatttgaaactt

SEQ ID NO: 2920484 - DNA, 15 bp, Homo sapiens
tatttgaacaagtgg

SEQ ID NO: 2920485 - DNA, 14 bp, Homo sapiens
tatttgaagcagct

SEQ ID NO: 2920486 - DNA, 15 bp, Homo sapiens
tatttgaagcagctc

SEQ ID NO: 2920487 - DNA, 22 bp, Homo sapiens
tatttgaatgtatgcttcatac

SEQ ID NO: 2920488 - DNA, 17 bp, Homo sapiens
tatttgaattggcctga

SEQ ID NO: 2920489 - DNA, 20 bp, Homo sapiens
tatttgactttaatttatgt

SEQ ID NO: 2920490 - DNA, 20 bp, Homo sapiens
tatttgagttgtgattgaaa

SEQ ID NO: 2920491 - DNA, 18 bp, Homo sapiens
tatttgagtttgacattt

SEQ ID NO: 2920492 - DNA, 21 bp, Homo sapiens
tatttgagtttgacatttaat

SEQ ID NO: 2920493 - DNA, 19 bp, Homo sapiens
tatttgataacattttgtt

SEQ ID NO: 2920494 - DNA, 15 bp, Homo sapiens
tatttgattcaaaat

SEQ ID NO: 2920495 - DNA, 16 bp, Homo sapiens
tatttgattcaaaata

SEQ ID NO: 2920496 - DNA, 23 bp, Homo sapiens
tatttgcagttcacctgcactta

SEQ ID NO: 2920497 - DNA, 19 bp, Homo sapiens
tcaccgcggacgtgctggc

SEQ ID NO: 2920498 - DNA, 22 bp, Homo sapiens
tcaccgcggacgtgctggcctt

SEQ ID NO: 2920499 - DNA, 19 bp, Homo sapiens
tcaccgtgggctccctgac

SEQ ID NO: 2920500 - DNA, 15 bp, Homo sapiens
tcacctagaaattga

SEQ ID NO: 2920501 - DNA, 13 bp, Homo sapiens
tcacctcagcctc

SEQ ID NO: 2920502 - DNA, 15 bp, Homo sapiens
tcacctcattctgaa

SEQ ID NO: 2920503 - DNA, 19 bp, Homo sapiens
tcacctccatatcagaagt

SEQ ID NO: 2920504 - DNA, 15 bp, Homo sapiens
tcacctccttcaatt

SEQ ID NO: 2920505 - DNA, 15 bp, Homo sapiens
tcacctgaggtcagg

SEQ ID NO: 2920506 - DNA, 15 bp, Homo sapiens
tcacctgaggtcggg

SEQ ID NO: 2920507 - DNA, 21 bp, Homo sapiens
tcacctgattcaactaaaaaa

SEQ ID NO: 2920508 - DNA, 11 bp, Homo sapiens
tcacctgcaaa

SEQ ID NO: 2920509 - DNA, 13 bp, Homo sapiens
tcacctggaagca

SEQ ID NO: 2920510 - DNA, 16 bp, Homo sapiens
tcacctggtacctgga

SEQ ID NO: 2920511 - DNA, 14 bp, Homo sapiens
tcacctggtcctcc

SEQ ID NO: 2920512 - DNA, 20 bp, Homo sapiens
tcacctgtgcttcgggccct

SEQ ID NO: 2920513 - DNA, 18 bp, Homo sapiens
tcacctgttgcttacaat

SEQ ID NO: 2920514 - DNA, 19 bp, Homo sapiens
tcacctgttgcttacaatt

SEQ ID NO: 2920515 - DNA, 23 bp, Homo sapiens
tcaccttaagaaagtgtctctgt

SEQ ID NO: 2920516 - DNA, 15 bp, Homo sapiens
tcaccttaggcaggg

SEQ ID NO: 2920517 - DNA, 15 bp, Homo sapiens
tcaccttggtttatg

SEQ ID NO: 2920518 - DNA, 17 bp, Homo sapiens
tcacctttactttagaa

SEQ ID NO: 2920519 - DNA, 19 bp, Homo sapiens
tcacctttgtagcactcag

SEQ ID NO: 2920520 - DNA, 22 bp, Homo sapiens
tcacgaagtgttgcatggatgt

SEQ ID NO: 2920521 - DNA, 20 bp, Homo sapiens
tcacgccacccccgccccca

SEQ ID NO: 2920522 - DNA, 20 bp, Homo sapiens
tcacgccattctcctgcctc

SEQ ID NO: 2920523 - DNA, 21 bp, Homo sapiens
tcacgccattgtactccagcc

SEQ ID NO: 2920524 - DNA, 23 bp, Homo sapiens
tcacgccattgtactccagcctg

SEQ ID NO: 2920525 - DNA, 18 bp, Homo sapiens
tcacgccccgctgtgtcc

SEQ ID NO: 2920526 - DNA, 14 bp, Homo sapiens
tcacgcctgtaatc

SEQ ID NO: 2920527 - DNA, 19 bp, Homo sapiens
tcacgcctgtaatcccagc

SEQ ID NO: 2920528 - DNA, 18 bp, Homo sapiens
tcacgccttggcctccca

SEQ ID NO: 2920529 - DNA, 15 bp, Homo sapiens
tcacggagacagcaa

SEQ ID NO: 2920530 - DNA, 22 bp, Homo sapiens
tcacggcaggacaacgaggaag

SEQ ID NO: 2920531 - DNA, 22 bp, Homo sapiens
tcacgggagatttcttgttgct

SEQ ID NO: 2920532 - DNA, 19 bp, Homo sapiens
tcacgggcggtcctgcaca

SEQ ID NO: 2920533 - DNA, 24 bp, Homo sapiens
tcacgtatttcacagagcacgcct

SEQ ID NO: 2920534 - DNA, 17 bp, Homo sapiens
tcacgtgcagctcaagg

SEQ ID NO: 2920535 - DNA, 20 bp, Homo sapiens
tcacgtgcaggacagctctt

SEQ ID NO: 2920536 - DNA, 22 bp, Homo sapiens
tcacgtgcgctgggcacttccc

SEQ ID NO: 2920537 - DNA, 18 bp, Homo sapiens
tcacgtgtactggctcct

SEQ ID NO: 2920538 - DNA, 15 bp, Homo sapiens
tcacgtttcttcccc

SEQ ID NO: 2920539 - DNA, 15 bp, Homo sapiens
tcactaaaagtgtgt

SEQ ID NO: 2920540 - DNA, 15 bp, Homo sapiens
tcactaatttttgta

SEQ ID NO: 2920541 - DNA, 13 bp, Homo sapiens
tcactagttgtca

SEQ ID NO: 2920542 - DNA, 13 bp, Homo sapiens
tcactattcctat

SEQ ID NO: 2920543 - DNA, 20 bp, Homo sapiens
tcactcaaggcggtgcttga

SEQ ID NO: 2920544 - DNA, 20 bp, Homo sapiens
tcactcagcccctacccctg

SEQ ID NO: 2920545 - DNA, 21 bp, Homo sapiens
tcactcagcccctacccctgc

SEQ ID NO: 2920546 - DNA, 23 bp, Homo sapiens
tcactcagcccctacccctgccc

SEQ ID NO: 2920547 - DNA, 13 bp, Homo sapiens
tcactcaggctgg

SEQ ID NO: 2920548 - DNA, 21 bp, Homo sapiens
tcactcaggctggagtacagt

SEQ ID NO: 2920549 - DNA, 15 bp, Homo sapiens
tcactcattgctgag

SEQ ID NO: 2920550 - DNA, 14 bp, Homo sapiens
tcactccaaccctg

SEQ ID NO: 2920551 - DNA, 16 bp, Homo sapiens
tcactccctaggccca

SEQ ID NO: 2920552 - DNA, 11 bp, Homo sapiens
tcactcctgga

SEQ ID NO: 2920553 - DNA, 13 bp, Homo sapiens
tcactcctggagg

SEQ ID NO: 2920554 - DNA, 14 bp, Homo sapiens
tcactctctattgt

SEQ ID NO: 2920555 - DNA, 15 bp, Homo sapiens
tcactctgagtgttt

SEQ ID NO: 2920556 - DNA, 11 bp, Homo sapiens
tcactctgccc

SEQ ID NO: 2920557 - DNA, 19 bp, Homo sapiens
tcactctgccctctgctgc

SEQ ID NO: 2920558 - DNA, 14 bp, Homo sapiens
tcactcttcctcat

SEQ ID NO: 2920559 - DNA, 17 bp, Homo sapiens
tcactcttcctcatcct

SEQ ID NO: 2920560 - DNA, 18 bp, Homo sapiens
tcactcttgaagtccagg

SEQ ID NO: 2920561 - DNA, 14 bp, Homo sapiens
tcactcttggagcc

SEQ ID NO: 2920562 - DNA, 20 bp, Homo sapiens
tcactcttgtggatgtttta

SEQ ID NO: 2920563 - DNA, 21 bp, Homo sapiens
tcactcttgtggatgttttaa

SEQ ID NO: 2920564 - DNA, 15 bp, Homo sapiens
tcactgaaatgtttg

SEQ ID NO: 2920565 - DNA, 17 bp, Homo sapiens
tcactgaaatgtttgga

SEQ ID NO: 2920566 - DNA, 17 bp, Homo sapiens
tcactgaagcccagacc

SEQ ID NO: 2920567 - DNA, 23 bp, Homo sapiens
tcactgacacatcagcatgtttt

SEQ ID NO: 2920568 - DNA, 21 bp, Homo sapiens
tcactgagttttccatggcag

SEQ ID NO: 2920569 - DNA, 20 bp, Homo sapiens
tcactgatattttttataca

SEQ ID NO: 2920570 - DNA, 19 bp, Homo sapiens
tcactgcaacctctgcctc

SEQ ID NO: 2920571 - DNA, 18 bp, Homo sapiens
tcactgcaagctccaact

SEQ ID NO: 2920572 - DNA, 18 bp, Homo sapiens
tcactgccttcgtttata

SEQ ID NO: 2920573 - DNA, 21 bp, Homo sapiens
tcactgctgctcctctttccc

SEQ ID NO: 2920574 - DNA, 17 bp, Homo sapiens
tcactgcttttggcctg

SEQ ID NO: 2920575 - DNA, 18 bp, Homo sapiens
tcactgcttttggcctgg

SEQ ID NO: 2920576 - DNA, 19 bp, Homo sapiens
tcactgcttttggcctgga

SEQ ID NO: 2920577 - DNA, 23 bp, Homo sapiens
tcactgcttttggcctggagttt

SEQ ID NO: 2920578 - DNA, 22 bp, Homo sapiens
tcactggagcaccaggcacgaa

SEQ ID NO: 2920579 - DNA, 15 bp, Homo sapiens
tcactggcagcccca

SEQ ID NO: 2920580 - DNA, 18 bp, Homo sapiens
tcactggcagccccagca

SEQ ID NO: 2920581 - DNA, 16 bp, Homo sapiens
tcactggcagcctgca

SEQ ID NO: 2920582 - DNA, 16 bp, Homo sapiens
tcactggcgccttctc

SEQ ID NO: 2920583 - DNA, 16 bp, Homo sapiens
tcactggctcatgccc

SEQ ID NO: 2920584 - DNA, 19 bp, Homo sapiens
tcactggttttacttacaa

SEQ ID NO: 2920585 - DNA, 19 bp, Homo sapiens
tcactgtaggtatagaaga

SEQ ID NO: 2920586 - DNA, 16 bp, Homo sapiens
tcactgtcactgccga

SEQ ID NO: 2920587 - DNA, 17 bp, Homo sapiens
tcactgtcactgccgac

SEQ ID NO: 2920588 - DNA, 14 bp, Homo sapiens
tcactgtccctcct

SEQ ID NO: 2920589 - DNA, 15 bp, Homo sapiens
tcactgtcctccaag

SEQ ID NO: 2920590 - DNA, 20 bp, Homo sapiens
tcactgtctgagagtttagt

SEQ ID NO: 2920591 - DNA, 20 bp, Homo sapiens
tcactgtgaaccaaccccca

SEQ ID NO: 2920592 - DNA, 22 bp, Homo sapiens
tcactgtgaaccaacccccatc

SEQ ID NO: 2920593 - DNA, 18 bp, Homo sapiens
tcactgtggctgtctgga

SEQ ID NO: 2920594 - DNA, 20 bp, Homo sapiens
tcactgttgcagtggcctgg

SEQ ID NO: 2920595 - DNA, 22 bp, Homo sapiens
tcactgttgcttaattgtgaac

SEQ ID NO: 2920596 - DNA, 20 bp, Homo sapiens
tcactgtttaaagctttgaa

SEQ ID NO: 2920597 - DNA, 22 bp, Homo sapiens
tcactgtttcacttgctcttgg

SEQ ID NO: 2920598 - DNA, 19 bp, Homo sapiens
tcacttaaaagctggcttt

SEQ ID NO: 2920599 - DNA, 18 bp, Homo sapiens
tcacttaaaatgtgcagt

SEQ ID NO: 2920600 - DNA, 13 bp, Homo sapiens
tcacttacaagaa

SEQ ID NO: 2920601 - DNA, 20 bp, Homo sapiens
tcacttagaacctttctgtg

SEQ ID NO: 2920602 - DNA, 13 bp, Homo sapiens
tcacttcctccag

SEQ ID NO: 2920603 - DNA, 16 bp, Homo sapiens
tcacttcctccagaag

SEQ ID NO: 2920604 - DNA, 20 bp, Homo sapiens
tcacttcctccagaagcctc

SEQ ID NO: 2920605 - DNA, 14 bp, Homo sapiens
tcacttcctctcca

SEQ ID NO: 2920606 - DNA, 20 bp, Homo sapiens
tcacttcctctccacaggag

SEQ ID NO: 2920607 - DNA, 19 bp, Homo sapiens
tcacttcggccagagctga

SEQ ID NO: 2920608 - DNA, 19 bp, Homo sapiens
tcacttctttgcagagcct

SEQ ID NO: 2920609 - DNA, 15 bp, Homo sapiens
tcacttgcatgtccc

SEQ ID NO: 2920610 - DNA, 17 bp, Homo sapiens
tcactttggttggaact

SEQ ID NO: 2920611 - DNA, 19 bp, Homo sapiens
tcacttttaatgaacaaat

SEQ ID NO: 2920612 - DNA, 17 bp, Homo sapiens
tcacttttttctgcctt

SEQ ID NO: 2920613 - DNA, 18 bp, Homo sapiens
tcacttttttctgccttg

SEQ ID NO: 2920614 - DNA, 14 bp, Homo sapiens
tcagaaaaccactt

SEQ ID NO: 2920615 - DNA, 14 bp, Homo sapiens
tcagaaacaggacc

SEQ ID NO: 2920616 - DNA, 19 bp, Homo sapiens
tcagaaaggggctcttctg

SEQ ID NO: 2920617 - DNA, 20 bp, Homo sapiens
tcagaaaggggctcttctga

SEQ ID NO: 2920618 - DNA, 21 bp, Homo sapiens
tcagaacagaggcatttaaaa

SEQ ID NO: 2920619 - DNA, 14 bp, Homo sapiens
tcagaacagcagac

SEQ ID NO: 2920620 - DNA, 22 bp, Homo sapiens
tcagaacagtgtttgattttta

SEQ ID NO: 2920621 - DNA, 15 bp, Homo sapiens
tcagaacccttggct

SEQ ID NO: 2920622 - DNA, 20 bp, Homo sapiens
tcagaacccttggcttgccc

SEQ ID NO: 2920623 - DNA, 24 bp, Homo sapiens
tcagaacccttggcttgcccacgt

SEQ ID NO: 2920624 - DNA, 23 bp, Homo sapiens
tcagaactgaaataaaaaattat

SEQ ID NO: 2920625 - DNA, 14 bp, Homo sapiens
tcagaagaaaacaa

SEQ ID NO: 2920626 - DNA, 18 bp, Homo sapiens
tcagaagaaaacaaagtt

SEQ ID NO: 2920627 - DNA, 13 bp, Homo sapiens
tcagaagaaaggc

SEQ ID NO: 2920628 - DNA, 13 bp, Homo sapiens
tcagtgctccctc

SEQ ID NO: 2920629 - DNA, 19 bp, Homo sapiens
tcagtgctgctgaactaat

SEQ ID NO: 2920630 - DNA, 18 bp, Homo sapiens
tcagtggaacacaaatga

SEQ ID NO: 2920631 - DNA, 14 bp, Homo sapiens
tcagtgggagaaaa

SEQ ID NO: 2920632 - DNA, 16 bp, Homo sapiens
tcagtgggagaaaaca

SEQ ID NO: 2920633 - DNA, 17 bp, Homo sapiens
tcagtggggctctctga

SEQ ID NO: 2920634 - DNA, 21 bp, Homo sapiens
tcagtggtccacatcccggga

SEQ ID NO: 2920635 - DNA, 21 bp, Homo sapiens
tcagtgtaatgtgacttcatg

SEQ ID NO: 2920636 - DNA, 15 bp, Homo sapiens
tcagtgtatttcagt

SEQ ID NO: 2920637 - DNA, 14 bp, Homo sapiens
tcagtgtgaaaatt

SEQ ID NO: 2920638 - DNA, 12 bp, Homo sapiens
tcagtgtgaatg

SEQ ID NO: 2920639 - DNA, 20 bp, Homo sapiens
tcagtgtgtttgctaattaa

SEQ ID NO: 2920640 - DNA, 15 bp, Homo sapiens
tcagtgttaaatgtg

SEQ ID NO: 2920641 - DNA, 17 bp, Homo sapiens
tcagtgttaaatgtgat

SEQ ID NO: 2920642 - DNA, 12 bp, Homo sapiens
tcagtgtttaca

SEQ ID NO: 2920643 - DNA, 22 bp, Homo sapiens
tcagtgtttgggtcacccctcc

SEQ ID NO: 2920644 - DNA, 20 bp, Homo sapiens
tcagtgttttggactccatc

SEQ ID NO: 2920645 - DNA, 17 bp, Homo sapiens
tcagttaattcttagat

SEQ ID NO: 2920646 - DNA, 16 bp, Homo sapiens
tcagttactcagccct

SEQ ID NO: 2920647 - DNA, 17 bp, Homo sapiens
tcagttactcagccctg

SEQ ID NO: 2920648 - DNA, 18 bp, Homo sapiens
tcagttactcagccctgg

SEQ ID NO: 2920649 - DNA, 19 bp, Homo sapiens
tcagttcactgctgcatgt

SEQ ID NO: 2920650 - DNA, 18 bp, Homo sapiens
tcagttccagcttttgta

SEQ ID NO: 2920651 - DNA, 14 bp, Homo sapiens
tcagttctcaaatg

SEQ ID NO: 2920652 - DNA, 15 bp, Homo sapiens
tcagttctgccttat

SEQ ID NO: 2920653 - DNA, 16 bp, Homo sapiens
tcagttgctaaacact

SEQ ID NO: 2920654 - DNA, 15 bp, Homo sapiens
tcagttgggtttcac

SEQ ID NO: 2920655 - DNA, 15 bp, Homo sapiens
tcagtttaattctgt

SEQ ID NO: 2920656 - DNA, 16 bp, Homo sapiens
tcagtttcatatatta

SEQ ID NO: 2920657 - DNA, 20 bp, Homo sapiens
tcagtttccaattatttgac

SEQ ID NO: 2920658 - DNA, 13 bp, Homo sapiens
tcagttttcattt

SEQ ID NO: 2920659 - DNA, 16 bp, Homo sapiens
tcagttttcccacttt

SEQ ID NO: 2920660 - DNA, 23 bp, Homo sapiens
tcagttttggtgataatcgtctt

SEQ ID NO: 2920661 - DNA, 15 bp, Homo sapiens
tcagtttttgtgaaa

SEQ ID NO: 2920662 - DNA, 24 bp, Homo sapiens
tcataaatttgttgtcatgtgtat

SEQ ID NO: 2920663 - DNA, 17 bp, Homo sapiens
tcataacttcctgtact

SEQ ID NO: 2920664 - DNA, 20 bp, Homo sapiens
tcataaggcttcaaaatgtt

SEQ ID NO: 2920665 - DNA, 14 bp, Homo sapiens
tcataatctttgct

SEQ ID NO: 2920666 - DNA, 18 bp, Homo sapiens
tcataatgtgaagtgtta

SEQ ID NO: 2920667 - DNA, 18 bp, Homo sapiens
tcataccgcctcgtgcca

SEQ ID NO: 2920668 - DNA, 16 bp, Homo sapiens
tcatactctgttgcct

SEQ ID NO: 2920669 - DNA, 22 bp, Homo sapiens
tcatagaacagaaatatataaa

SEQ ID NO: 2920670 - DNA, 15 bp, Homo sapiens
tcatagatattggaa

SEQ ID NO: 2920671 - DNA, 21 bp, Homo sapiens
tcatagattcttgagctgttg

SEQ ID NO: 2920672 - DNA, 22 bp, Homo sapiens
tcatagcaataacattcccact

SEQ ID NO: 2920673 - DNA, 13 bp, Homo sapiens
tcatagcattcac

SEQ ID NO: 2920674 - DNA, 14 bp, Homo sapiens
tcatagcttgtttt

SEQ ID NO: 2920675 - DNA, 22 bp, Homo sapiens
tcatagggacctttaaaaagca

SEQ ID NO: 2920676 - DNA, 15 bp, Homo sapiens
tcatagtaacttctt

SEQ ID NO: 2920677 - DNA, 18 bp, Homo sapiens
tcatagtaacttcttatg

SEQ ID NO: 2920678 - DNA, 22 bp, Homo sapiens
tcatagtaagtgcgaagactga

SEQ ID NO: 2920679 - DNA, 12 bp, Homo sapiens
tcatagtgcctt

SEQ ID NO: 2920680 - DNA, 13 bp, Homo sapiens
tcatagtgccttt

SEQ ID NO: 2920681 - DNA, 14 bp, Homo sapiens
tcatagtgcctttt

SEQ ID NO: 2920682 - DNA, 18 bp, Homo sapiens
tcatagtgcctttttcct

SEQ ID NO: 2920683 - DNA, 16 bp, Homo sapiens
tcatataaaagctatg

SEQ ID NO: 2920684 - DNA, 14 bp, Homo sapiens
tcatatacgtgaaa

SEQ ID NO: 2920685 - DNA, 20 bp, Homo sapiens
tcatatctctcccttcttta

SEQ ID NO: 2920686 - DNA, 19 bp, Homo sapiens
tcatatctcttgcccttcc

SEQ ID NO: 2920687 - DNA, 23 bp, Homo sapiens
tcatattagtaaaagatgccata

SEQ ID NO: 2920688 - DNA, 22 bp, Homo sapiens
tcatatttagtattgaatactt

SEQ ID NO: 2920689 - DNA, 17 bp, Homo sapiens
tcatcaaataaaccttg

SEQ ID NO: 2920690 - DNA, 12 bp, Homo sapiens
tcatcaacaatg

SEQ ID NO: 2920691 - DNA, 13 bp, Homo sapiens
tcatcacacacat

SEQ ID NO: 2920692 - DNA, 16 bp, Homo sapiens
tcatcacacacatgga

SEQ ID NO: 2920693 - DNA, 18 bp, Homo sapiens
tcatcagaggggagcagc

SEQ ID NO: 2920694 - DNA, 16 bp, Homo sapiens
tcatcagccaccatcc

SEQ ID NO: 2920695 - DNA, 18 bp, Homo sapiens
tcatcagccaccatccta

SEQ ID NO: 2920696 - DNA, 12 bp, Homo sapiens
tcatcaggctct

SEQ ID NO: 2920697 - DNA, 16 bp, Homo sapiens
tcatcaggctctgttc

SEQ ID NO: 2920698 - DNA, 21 bp, Homo sapiens
tcatcaggctctgttcctcaa

SEQ ID NO: 2920699 - DNA, 14 bp, Homo sapiens
tcatcagtaagtat

SEQ ID NO: 2920700 - DNA, 13 bp, Homo sapiens
tcatcatccctcc

SEQ ID NO: 2920701 - DNA, 17 bp, Homo sapiens
tcatcatgttgaccagg

SEQ ID NO: 2920702 - DNA, 14 bp, Homo sapiens
tcatcattctctgt

SEQ ID NO: 2920703 - DNA, 20 bp, Homo sapiens
tcatcattctctgtctcatc

SEQ ID NO: 2920704 - DNA, 22 bp, Homo sapiens
tcatcattctctgtctcatcca

SEQ ID NO: 2920705 - DNA, 17 bp, Homo sapiens
tcatccacattgtttta

SEQ ID NO: 2920706 - DNA, 22 bp, Homo sapiens
tcatccacattgttttaaaaag

SEQ ID NO: 2920707 - DNA, 16 bp, Homo sapiens
tcatccagctacttag

SEQ ID NO: 2920708 - DNA, 12 bp, Homo sapiens
tcatccatcatc

SEQ ID NO: 2920709 - DNA, 15 bp, Homo sapiens
tcatccatcatcatg

SEQ ID NO: 2920710 - DNA, 22 bp, Homo sapiens
tcatccatcatctgctgcacat

SEQ ID NO: 2920711 - DNA, 11 bp, Homo sapiens
tcatcccctta

SEQ ID NO: 2920712 - DNA, 13 bp, Homo sapiens
tcatcctcctcct

SEQ ID NO: 2920713 - DNA, 12 bp, Homo sapiens
tcatcctgcttc

SEQ ID NO: 2920714 - DNA, 13 bp, Homo sapiens
tcatcctgtgtcc

SEQ ID NO: 2920715 - DNA, 20 bp, Homo sapiens
tcatcctgtgtcccctgacc

SEQ ID NO: 2920716 - DNA, 17 bp, Homo sapiens
tcatcctgttggctgct

SEQ ID NO: 2920717 - DNA, 17 bp, Homo sapiens
tcatccttggtgctctt

SEQ ID NO: 2920718 - DNA, 21 bp, Homo sapiens
tcatccttggtgctcttgctt

SEQ ID NO: 2920719 - DNA, 20 bp, Homo sapiens
tcatcctttgttctgagcat

SEQ ID NO: 2920720 - DNA, 21 bp, Homo sapiens
tcatccttttttctcttctgt

SEQ ID NO: 2920721 - DNA, 14 bp, Homo sapiens
tcatcgaatctact

SEQ ID NO: 2920722 - DNA, 22 bp, Homo sapiens
tcatcgacttagcctgagtcat

SEQ ID NO: 2920723 - DNA, 21 bp, Homo sapiens
tcatcgccagaggtgcttcac

SEQ ID NO: 2920724 - DNA, 13 bp, Homo sapiens
tcatctacttttt

SEQ ID NO: 2920725 - DNA, 13 bp, Homo sapiens
tcatctccctgcc

SEQ ID NO: 2920726 - DNA, 15 bp, Homo sapiens
tcatctccctgccat

SEQ ID NO: 2920727 - DNA, 18 bp, Homo sapiens
tcatctccctgccatccc

SEQ ID NO: 2920728 - DNA, 15 bp, Homo sapiens
tcatctcctgccttc

SEQ ID NO: 2920729 - DNA, 22 bp, Homo sapiens
tcatctcctgccttcctcctgg

SEQ ID NO: 2920730 - DNA, 23 bp, Homo sapiens
tcatctcctgccttcctcctggg

SEQ ID NO: 2920731 - DNA, 14 bp, Homo sapiens
tcatctctgccttt

SEQ ID NO: 2920732 - DNA, 17 bp, Homo sapiens
tcatctctttgtcctga

SEQ ID NO: 2920733 - DNA, 20 bp, Homo sapiens
tcatctgaatttgccctggg

SEQ ID NO: 2920734 - DNA, 16 bp, Homo sapiens
tcatctgcatgtctac

SEQ ID NO: 2920735 - DNA, 17 bp, Homo sapiens
tcatctgcatgtctact

SEQ ID NO: 2920736 - DNA, 13 bp, Homo sapiens
tcatctgccgtgc

SEQ ID NO: 2920737 - DNA, 12 bp, Homo sapiens
tcatctgggaaa

SEQ ID NO: 2920738 - DNA, 14 bp, Homo sapiens
tcatctgggaaaga

SEQ ID NO: 2920739 - DNA, 17 bp, Homo sapiens
tcatctggggacctggt

SEQ ID NO: 2920740 - DNA, 20 bp, Homo sapiens
tcatctggttgaactctggt

SEQ ID NO: 2920741 - DNA, 18 bp, Homo sapiens
tcatctgtccctccggga

SEQ ID NO: 2920742 - DNA, 20 bp, Homo sapiens
tcatctgtgcctgtctgtcc

SEQ ID NO: 2920743 - DNA, 16 bp, Homo sapiens
tcatcttactgtacct

SEQ ID NO: 2920744 - DNA, 15 bp, Homo sapiens
tcatcttagttctgt

SEQ ID NO: 2920745 - DNA, 21 bp, Homo sapiens
tcatcttgaccaagcaggaag

SEQ ID NO: 2920746 - DNA, 23 bp, Homo sapiens
tcatcttgatgtctatgatagat

SEQ ID NO: 2920747 - DNA, 14 bp, Homo sapiens
tcatctttcttcca

SEQ ID NO: 2920748 - DNA, 19 bp, Homo sapiens
tcatctttttgtgtgcagg

SEQ ID NO: 2920749 - DNA, 22 bp, Homo sapiens
tcatgaaagtagacagttttga

SEQ ID NO: 2920750 - DNA, 13 bp, Homo sapiens
tcatgaactggct

SEQ ID NO: 2920751 - DNA, 18 bp, Homo sapiens
tcatgaactggcttgtac

SEQ ID NO: 2920752 - DNA, 21 bp, Homo sapiens
tcatgaacttcgcatcaaaag

SEQ ID NO: 2920753 - DNA, 19 bp, Homo sapiens
tcatgaattcatactctgt

SEQ ID NO: 2920754 - DNA, 22 bp, Homo sapiens
tcatgaattcatactctgttgc

SEQ ID NO: 2920755 - DNA, 16 bp, Homo sapiens
tcatgacaagcatttt

SEQ ID NO: 2920756 - DNA, 19 bp, Homo sapiens
tcatgactgagtctggcaa

SEQ ID NO: 2920757 - DNA, 14 bp, Homo sapiens
tcatgagcctgttt

SEQ ID NO: 2920758 - DNA, 16 bp, Homo sapiens
tcatgagcctgtttat

SEQ ID NO: 2920759 - DNA, 17 bp, Homo sapiens
tcatgagcctgtttatt

SEQ ID NO: 2920760 - DNA, 23 bp, Homo sapiens
tcatgagcctgtttattgccatt

SEQ ID NO: 2920761 - DNA, 17 bp, Homo sapiens
tccagaagcctccttac

SEQ ID NO: 2920762 - DNA, 23 bp, Homo sapiens
tccagaagcctccttacattaaa

SEQ ID NO: 2920763 - DNA, 21 bp, Homo sapiens
tccagaagcggcctgtgcgtt

SEQ ID NO: 2920764 - DNA, 19 bp, Homo sapiens
tccagaaggagacaggcag

SEQ ID NO: 2920765 - DNA, 19 bp, Homo sapiens
tccagaaggatttcttgta

SEQ ID NO: 2920766 - DNA, 18 bp, Homo sapiens
tccagaagtattgtttac

SEQ ID NO: 2920767 - DNA, 15 bp, Homo sapiens
tccagaagtgtgatt

SEQ ID NO: 2920768 - DNA, 14 bp, Homo sapiens
tccagaatctaaag

SEQ ID NO: 2920769 - DNA, 17 bp, Homo sapiens
tccagaatgctgtacat

SEQ ID NO: 2920770 - DNA, 18 bp, Homo sapiens
tccagaatgctgtacatc

SEQ ID NO: 2920771 - DNA, 16 bp, Homo sapiens
tccagaatgtgctgcc

SEQ ID NO: 2920772 - DNA, 17 bp, Homo sapiens
tccagaatgtgctgcct

SEQ ID NO: 2920773 - DNA, 17 bp, Homo sapiens
tccagaattacccttcc

SEQ ID NO: 2920774 - DNA, 11 bp, Homo sapiens
tccagacctga

SEQ ID NO: 2920775 - DNA, 22 bp, Homo sapiens
tccagacgcactgatctttgca

SEQ ID NO: 2920776 - DNA, 22 bp, Homo sapiens
tccagagaaagcacaatttaaa

SEQ ID NO: 2920777 - DNA, 12 bp, Homo sapiens
tccagagacagg

SEQ ID NO: 2920778 - DNA, 19 bp, Homo sapiens
tccagagctgcttctgtct

SEQ ID NO: 2920779 - DNA, 18 bp, Homo sapiens
tccagagtccctgcctgg

SEQ ID NO: 2920780 - DNA, 17 bp, Homo sapiens
tccagagttaaaatgtt

SEQ ID NO: 2920781 - DNA, 17 bp, Homo sapiens
tccagatgcagggcagt

SEQ ID NO: 2920782 - DNA, 14 bp, Homo sapiens
tccagatgtgatgc

SEQ ID NO: 2920783 - DNA, 19 bp, Homo sapiens
tccagattatctatttgtg

SEQ ID NO: 2920784 - DNA, 16 bp, Homo sapiens
tccagcaaaatccaaa

SEQ ID NO: 2920785 - DNA, 20 bp, Homo sapiens
tccagcaacacagcctgggc

SEQ ID NO: 2920786 - DNA, 18 bp, Homo sapiens
tccagcaattctcctgcc

SEQ ID NO: 2920787 - DNA, 21 bp, Homo sapiens
tccagcaattctcctgcctca

SEQ ID NO: 2920788 - DNA, 19 bp, Homo sapiens
tccagcacaaacacaaggt

SEQ ID NO: 2920789 - DNA, 14 bp, Homo sapiens
tccagcaccacact

SEQ ID NO: 2920790 - DNA, 23 bp, Homo sapiens
tccagcaccatccgccagggccc

SEQ ID NO: 2920791 - DNA, 15 bp, Homo sapiens
tccagcaccttgtgc

SEQ ID NO: 2920792 - DNA, 19 bp, Homo sapiens
tccagcaccttgtgcctgg

SEQ ID NO: 2920793 - DNA, 21 bp, Homo sapiens
tccagcattgttgagctgtca

SEQ ID NO: 2920794 - DNA, 21 bp, Homo sapiens
tccagcatttagctggccaca

SEQ ID NO: 2920795 - DNA, 13 bp, Homo sapiens
tccagccacctag

SEQ ID NO: 2920796 - DNA, 20 bp, Homo sapiens
tccagccatcaagagactga

SEQ ID NO: 2920797 - DNA, 24 bp, Homo sapiens
tccagccatcaagagactgagtca

SEQ ID NO: 2920798 - DNA, 16 bp, Homo sapiens
tccagcccctttccaa

SEQ ID NO: 2920799 - DNA, 18 bp, Homo sapiens
tccagcccctttccaaaa

SEQ ID NO: 2920800 - DNA, 22 bp, Homo sapiens
tccagcccgagtggtctcctct

SEQ ID NO: 2920801 - DNA, 15 bp, Homo sapiens
tccagccctgcccac

SEQ ID NO: 2920802 - DNA, 11 bp, Homo sapiens
tccagcctcac

SEQ ID NO: 2920803 - DNA, 14 bp, Homo sapiens
tccagcctcacaga

SEQ ID NO: 2920804 - DNA, 13 bp, Homo sapiens
tccagcctgccac

SEQ ID NO: 2920805 - DNA, 19 bp, Homo sapiens
tccagcctgggaggcacag

SEQ ID NO: 2920806 - DNA, 20 bp, Homo sapiens
tccagcctgggtcacagagt

SEQ ID NO: 2920807 - DNA, 22 bp, Homo sapiens
tccagcctgggtcacagagtga

SEQ ID NO: 2920808 - DNA, 15 bp, Homo sapiens
tccagcgatggtgct

SEQ ID NO: 2920809 - DNA, 19 bp, Homo sapiens
tccagcgatggtgctgccc

SEQ ID NO: 2920810 - DNA, 22 bp, Homo sapiens
tccagctacttagctggccaag

SEQ ID NO: 2920811 - DNA, 19 bp, Homo sapiens
tccagctcattcattttat

SEQ ID NO: 2920812 - DNA, 16 bp, Homo sapiens
tccagctccaacctgc

SEQ ID NO: 2920813 - DNA, 16 bp, Homo sapiens
tccagctgagcgccag

SEQ ID NO: 2920814 - DNA, 16 bp, Homo sapiens
tccagcttgctcttca

SEQ ID NO: 2920815 - DNA, 14 bp, Homo sapiens
tccagcttttgtag

SEQ ID NO: 2920816 - DNA, 20 bp, Homo sapiens
tccaggactgggtctgacct

SEQ ID NO: 2920817 - DNA, 22 bp, Homo sapiens
tccaggagcaacgccagtggca

SEQ ID NO: 2920818 - DNA, 15 bp, Homo sapiens
tccaggcagatccag

SEQ ID NO: 2920819 - DNA, 17 bp, Homo sapiens
tccaggcagatccagga

SEQ ID NO: 2920820 - DNA, 19 bp, Homo sapiens
tccaggcagatccaggact

SEQ ID NO: 2920821 - DNA, 15 bp, Homo sapiens
tccaggccagctcct

SEQ ID NO: 2920822 - DNA, 19 bp, Homo sapiens
tccaggccagctccttttc

SEQ ID NO: 2920823 - DNA, 23 bp, Homo sapiens
tccaggccagctccttttctgtg

SEQ ID NO: 2920824 - DNA, 14 bp, Homo sapiens
tccaggccagggct

SEQ ID NO: 2920825 - DNA, 22 bp, Homo sapiens
tccaggccagggctcctgtggc

SEQ ID NO: 2920826 - DNA, 19 bp, Homo sapiens
tccaggcccaaggctcccg

SEQ ID NO: 2920827 - DNA, 18 bp, Homo sapiens
tccaggcccgtctgtcca

SEQ ID NO: 2920828 - DNA, 23 bp, Homo sapiens
tccaggcccgtctgtccatctgc

SEQ ID NO: 2920829 - DNA, 15 bp, Homo sapiens
tccaggctgggctga

SEQ ID NO: 2920830 - DNA, 15 bp, Homo sapiens
tccaggctgtgtttg

SEQ ID NO: 2920831 - DNA, 19 bp, Homo sapiens
tccaggcttgattccaaca

SEQ ID NO: 2920832 - DNA, 20 bp, Homo sapiens
tccaggctttcccacttccc

SEQ ID NO: 2920833 - DNA, 22 bp, Homo sapiens
tccaggctttcccacttcccac

SEQ ID NO: 2920834 - DNA, 21 bp, Homo sapiens
tccagggacgaagaagagcca

SEQ ID NO: 2920835 - DNA, 19 bp, Homo sapiens
tccagggagcattttcctc

SEQ ID NO: 2920836 - DNA, 17 bp, Homo sapiens
tccagggccacgtgcca

SEQ ID NO: 2920837 - DNA, 23 bp, Homo sapiens
tccagggccacgtgccaggcccg

SEQ ID NO: 2920838 - DNA, 14 bp, Homo sapiens
tccagggctgccag

SEQ ID NO: 2920839 - DNA, 14 bp, Homo sapiens
tccagggtcccctg

SEQ ID NO: 2920840 - DNA, 15 bp, Homo sapiens
tccagggtcccctgc

SEQ ID NO: 2920841 - DNA, 17 bp, Homo sapiens
tccagggtcccctgcca

SEQ ID NO: 2920842 - DNA, 19 bp, Homo sapiens
tccagggtggactctgtct

SEQ ID NO: 2920843 - DNA, 23 bp, Homo sapiens
tccaggtaccttgacctttgtac

SEQ ID NO: 2920844 - DNA, 16 bp, Homo sapiens
tccaggtacgcacaga

SEQ ID NO: 2920845 - DNA, 18 bp, Homo sapiens
tccaggtacgcacagaca

SEQ ID NO: 2920846 - DNA, 23 bp, Homo sapiens
tccagtagggaaaatagggtcct

SEQ ID NO: 2920847 - DNA, 19 bp, Homo sapiens
tccagtcctgctggcctgc

SEQ ID NO: 2920848 - DNA, 14 bp, Homo sapiens
tccagtctcttgta

SEQ ID NO: 2920849 - DNA, 16 bp, Homo sapiens
tccagtctcttgtaca

SEQ ID NO: 2920850 - DNA, 22 bp, Homo sapiens
tccagtctcttgtacagcgttt

SEQ ID NO: 2920851 - DNA, 17 bp, Homo sapiens
tccagtctggagagctg

SEQ ID NO: 2920852 - DNA, 15 bp, Homo sapiens
tccagtctgttctca

SEQ ID NO: 2920853 - DNA, 13 bp, Homo sapiens
tccagttcttccc

SEQ ID NO: 2920854 - DNA, 15 bp, Homo sapiens
tccagttgcaattca

SEQ ID NO: 2920855 - DNA, 20 bp, Homo sapiens
tccagttgcaattcataact

SEQ ID NO: 2920856 - DNA, 16 bp, Homo sapiens
tccagttttttgttgt

SEQ ID NO: 2920857 - DNA, 20 bp, Homo sapiens
tccataaagaagcaataaag

SEQ ID NO: 2920858 - DNA, 12 bp, Homo sapiens
tccataagttta

SEQ ID NO: 2920859 - DNA, 19 bp, Homo sapiens
tccataagtttaactttaa

SEQ ID NO: 2920860 - DNA, 18 bp, Homo sapiens
tccataatgctactgtct

SEQ ID NO: 2920861 - DNA, 13 bp, Homo sapiens
tccatactgggct

SEQ ID NO: 2920862 - DNA, 18 bp, Homo sapiens
tccatactgggctaagga

SEQ ID NO: 2920863 - DNA, 12 bp, Homo sapiens
tccatactttgg

SEQ ID NO: 2920864 - DNA, 17 bp, Homo sapiens
tccatactttggatgac

SEQ ID NO: 2920865 - DNA, 16 bp, Homo sapiens
tccatagtaactgaca

SEQ ID NO: 2920866 - DNA, 15 bp, Homo sapiens
tccatagttttgatg

SEQ ID NO: 2920867 - DNA, 22 bp, Homo sapiens
tccatagttttgatgactggca

SEQ ID NO: 2920868 - DNA, 17 bp, Homo sapiens
tccatatccttctggct

SEQ ID NO: 2920869 - DNA, 22 bp, Homo sapiens
tccatatccttctggctgtaga

SEQ ID NO: 2920870 - DNA, 17 bp, Homo sapiens
tccatattacgttgttt

SEQ ID NO: 2920871 - DNA, 19 bp, Homo sapiens
tccatattacgttgtttct

SEQ ID NO: 2920872 - DNA, 14 bp, Homo sapiens
tccatcaggcagat

SEQ ID NO: 2920873 - DNA, 15 bp, Homo sapiens
tccatcaggcagata

SEQ ID NO: 2920874 - DNA, 13 bp, Homo sapiens
tccatcctcctct

SEQ ID NO: 2920875 - DNA, 17 bp, Homo sapiens
tccatcctcctctccat

SEQ ID NO: 2920876 - DNA, 21 bp, Homo sapiens
tccatcctcctctccatgcaa

SEQ ID NO: 2920877 - DNA, 16 bp, Homo sapiens
tccatcgtattaaaaa

SEQ ID NO: 2920878 - DNA, 22 bp, Homo sapiens
tccatcgtattaaaaaacaatt

SEQ ID NO: 2920879 - DNA, 22 bp, Homo sapiens
tccatctcaaaaaaaaaaaaga

SEQ ID NO: 2920880 - DNA, 23 bp, Homo sapiens
tccatctctatataaaaacaaaa

SEQ ID NO: 2920881 - DNA, 21 bp, Homo sapiens
tccatctgcccgcctgcccac

SEQ ID NO: 2920882 - DNA, 19 bp, Homo sapiens
tccatctgtacttggtcca

SEQ ID NO: 2920883 - DNA, 16 bp, Homo sapiens
tccatctgtccgtcca

SEQ ID NO: 2920884 - DNA, 14 bp, Homo sapiens
tccatcttcagctt

SEQ ID NO: 2920885 - DNA, 13 bp, Homo sapiens
tccatctttacaa

SEQ ID NO: 2920886 - DNA, 13 bp, Homo sapiens
tccatctttttct

SEQ ID NO: 2920887 - DNA, 16 bp, Homo sapiens
tccatgaccagaaaca

SEQ ID NO: 2920888 - DNA, 15 bp, Homo sapiens
tccatgaggtactgg

SEQ ID NO: 2920889 - DNA, 20 bp, Homo sapiens
tccatggccctgcaaaagga

SEQ ID NO: 2920890 - DNA, 15 bp, Homo sapiens
tccatggcttcctga

SEQ ID NO: 2920891 - DNA, 22 bp, Homo sapiens
tccatggcttcctgagaaagcc

SEQ ID NO: 2920892 - DNA, 16 bp, Homo sapiens
tccatgggcagagccc

SEQ ID NO: 2920893 - DNA, 21 bp, Homo sapiens
tccgcagactgcttggccaga

SEQ ID NO: 2920894 - DNA, 18 bp, Homo sapiens
tccgcagctctagtcctt

SEQ ID NO: 2920895 - DNA, 18 bp, Homo sapiens
tccgcagtgtggccaggc

SEQ ID NO: 2920896 - DNA, 15 bp, Homo sapiens
tccgcataagaaaaa

SEQ ID NO: 2920897 - DNA, 17 bp, Homo sapiens
tccgcatccctgcttct

SEQ ID NO: 2920898 - DNA, 16 bp, Homo sapiens
tccgccagtgtttctg

SEQ ID NO: 2920899 - DNA, 19 bp, Homo sapiens
tccgccagtgtttctgaat

SEQ ID NO: 2920900 - DNA, 17 bp, Homo sapiens
tccgcctacctcggcct

SEQ ID NO: 2920901 - DNA, 17 bp, Homo sapiens
tccgcctactgtccctc

SEQ ID NO: 2920902 - DNA, 12 bp, Homo sapiens
tccgcctccaca

SEQ ID NO: 2920903 - DNA, 16 bp, Homo sapiens
tccgcctccacactga

SEQ ID NO: 2920904 - DNA, 20 bp, Homo sapiens
tccgcctccacactgaccaa

SEQ ID NO: 2920905 - DNA, 20 bp, Homo sapiens
tccgcctgcgcctccatcca

SEQ ID NO: 2920906 - DNA, 17 bp, Homo sapiens
tccgcctttacaaggga

SEQ ID NO: 2920907 - DNA, 21 bp, Homo sapiens
tccgcctttacaagggagaag

SEQ ID NO: 2920908 - DNA, 14 bp, Homo sapiens
tccgcgccctccga

SEQ ID NO: 2920909 - DNA, 21 bp, Homo sapiens
tccggcagcctctcttcactg

SEQ ID NO: 2920910 - DNA, 18 bp, Homo sapiens
tccggcagttctgggtgc

SEQ ID NO: 2920911 - DNA, 18 bp, Homo sapiens
tccggcctctgcctttgc

SEQ ID NO: 2920912 - DNA, 23 bp, Homo sapiens
tccggcctgggtgacagagtgag

SEQ ID NO: 2920913 - DNA, 14 bp, Homo sapiens
tccgggagctggtg

SEQ ID NO: 2920914 - DNA, 12 bp, Homo sapiens
tccgggcagggg

SEQ ID NO: 2920915 - DNA, 14 bp, Homo sapiens
tccggtgttctaag

SEQ ID NO: 2920916 - DNA, 14 bp, Homo sapiens
tccgtagttccctg

SEQ ID NO: 2920917 - DNA, 23 bp, Homo sapiens
tccgtcaaaacagattgtttgca

SEQ ID NO: 2920918 - DNA, 22 bp, Homo sapiens
tccgtcacccttggtagagttt

SEQ ID NO: 2920919 - DNA, 23 bp, Homo sapiens
tccgtccagagccggcatccttg

SEQ ID NO: 2920920 - DNA, 16 bp, Homo sapiens
tccgtccccccccagg

SEQ ID NO: 2920921 - DNA, 17 bp, Homo sapiens
tccgtccccccccaggc

SEQ ID NO: 2920922 - DNA, 20 bp, Homo sapiens
tccgtccccccccaggccct

SEQ ID NO: 2920923 - DNA, 23 bp, Homo sapiens
tccgtctagttaacatttcaagg

SEQ ID NO: 2920924 - DNA, 15 bp, Homo sapiens
tccgtctgtgtgggg

SEQ ID NO: 2920925 - DNA, 17 bp, Homo sapiens
tccgtgaggctgctgcc

SEQ ID NO: 2920926 - DNA, 17 bp, Homo sapiens
tccgtgctgacagctgc

SEQ ID NO: 2920927 - DNA, 21 bp, Homo sapiens
tccgtgctgacagctgctcct

SEQ ID NO: 2920928 - DNA, 16 bp, Homo sapiens
tccgtggactgcagtc

SEQ ID NO: 2920929 - DNA, 21 bp, Homo sapiens
tccgtggccccgccctcaggc

SEQ ID NO: 2920930 - DNA, 21 bp, Homo sapiens
tccgtgggttgctaactgaac

SEQ ID NO: 2920931 - DNA, 22 bp, Homo sapiens
tccgtgtgccgttgctccggcc

SEQ ID NO: 2920932 - DNA, 17 bp, Homo sapiens
tcctaaaagttctcaat

SEQ ID NO: 2920933 - DNA, 14 bp, Homo sapiens
tcctaaatattatg

SEQ ID NO: 2920934 - DNA, 21 bp, Homo sapiens
tcctaaatattatgagatgct

SEQ ID NO: 2920935 - DNA, 19 bp, Homo sapiens
tcctaaatattttcaagaa

SEQ ID NO: 2920936 - DNA, 14 bp, Homo sapiens
tcctaacttttcaa

SEQ ID NO: 2920937 - DNA, 15 bp, Homo sapiens
tcctaagacttcagt

SEQ ID NO: 2920938 - DNA, 14 bp, Homo sapiens
tcctaagcatctaa

SEQ ID NO: 2920939 - DNA, 13 bp, Homo sapiens
tcctaagcctgtg

SEQ ID NO: 2920940 - DNA, 16 bp, Homo sapiens
tcctaagcctgtggct

SEQ ID NO: 2920941 - DNA, 20 bp, Homo sapiens
tcctaagcctgtggctgtgg

SEQ ID NO: 2920942 - DNA, 18 bp, Homo sapiens
tcctaagggtcgaaagct

SEQ ID NO: 2920943 - DNA, 18 bp, Homo sapiens
tcctaagtgtcaagtcct

SEQ ID NO: 2920944 - DNA, 20 bp, Homo sapiens
tcctaataatcattggattc

SEQ ID NO: 2920945 - DNA, 14 bp, Homo sapiens
tcctaatatcaaat

SEQ ID NO: 2920946 - DNA, 23 bp, Homo sapiens
tcctaatgaaggttttcatttgc

SEQ ID NO: 2920947 - DNA, 19 bp, Homo sapiens
tcctaatgagatatatctt

SEQ ID NO: 2920948 - DNA, 14 bp, Homo sapiens
tcctacaacttaat

SEQ ID NO: 2920949 - DNA, 14 bp, Homo sapiens
tcctacccatcccc

SEQ ID NO: 2920950 - DNA, 15 bp, Homo sapiens
tcctaccccctgtgc

SEQ ID NO: 2920951 - DNA, 13 bp, Homo sapiens
tcctacccttttc

SEQ ID NO: 2920952 - DNA, 14 bp, Homo sapiens
tcctacccttttct

SEQ ID NO: 2920953 - DNA, 15 bp, Homo sapiens
tcctacctattatcc

SEQ ID NO: 2920954 - DNA, 21 bp, Homo sapiens
tcctacctcagcctcctgggt

SEQ ID NO: 2920955 - DNA, 20 bp, Homo sapiens
tcctacgtcaaacatgaagt

SEQ ID NO: 2920956 - DNA, 18 bp, Homo sapiens
tcctacttataaagtaga

SEQ ID NO: 2920957 - DNA, 13 bp, Homo sapiens
tcctacttctctg

SEQ ID NO: 2920958 - DNA, 18 bp, Homo sapiens
tcctacttctctgagtca

SEQ ID NO: 2920959 - DNA, 21 bp, Homo sapiens
tcctagaggagacagcctgtc

SEQ ID NO: 2920960 - DNA, 17 bp, Homo sapiens
tcctagagggaggggcc

SEQ ID NO: 2920961 - DNA, 21 bp, Homo sapiens
tcctagagggaggggcctagg

SEQ ID NO: 2920962 - DNA, 14 bp, Homo sapiens
tcctagatcctaag

SEQ ID NO: 2920963 - DNA, 19 bp, Homo sapiens
tcctagcacatgcttcaat

SEQ ID NO: 2920964 - DNA, 20 bp, Homo sapiens
tcctagccacccaccacact

SEQ ID NO: 2920965 - DNA, 16 bp, Homo sapiens
tcctagcccagtgctt

SEQ ID NO: 2920966 - DNA, 21 bp, Homo sapiens
tcctagctcctcctcctgggc

SEQ ID NO: 2920967 - DNA, 15 bp, Homo sapiens
tcctagggtgggaag

SEQ ID NO: 2920968 - DNA, 22 bp, Homo sapiens
tcctagtgctttccttttttaa

SEQ ID NO: 2920969 - DNA, 14 bp, Homo sapiens
tcctagtggtgtca

SEQ ID NO: 2920970 - DNA, 14 bp, Homo sapiens
tcctatatatttct

SEQ ID NO: 2920971 - DNA, 15 bp, Homo sapiens
tcctatatatttcta

SEQ ID NO: 2920972 - DNA, 16 bp, Homo sapiens
tcctatatatttctat

SEQ ID NO: 2920973 - DNA, 17 bp, Homo sapiens
tcctatatatttctatt

SEQ ID NO: 2920974 - DNA, 23 bp, Homo sapiens
tcctatatcattaaaagaacata

SEQ ID NO: 2920975 - DNA, 22 bp, Homo sapiens
tcctatcccgtgagtggattgt

SEQ ID NO: 2920976 - DNA, 20 bp, Homo sapiens
tcctatgctttgaaacagaa

SEQ ID NO: 2920977 - DNA, 22 bp, Homo sapiens
tcctatgtgattttaactctgt

SEQ ID NO: 2920978 - DNA, 14 bp, Homo sapiens
tcctattgcaaagg

SEQ ID NO: 2920979 - DNA, 13 bp, Homo sapiens
tcctatttcagta

SEQ ID NO: 2920980 - DNA, 17 bp, Homo sapiens
tcctcaaaaagcagaag

SEQ ID NO: 2920981 - DNA, 17 bp, Homo sapiens
tcctcaacacccaactg

SEQ ID NO: 2920982 - DNA, 14 bp, Homo sapiens
tcctcaatccagct

SEQ ID NO: 2920983 - DNA, 15 bp, Homo sapiens
tcctcacactccaga

SEQ ID NO: 2920984 - DNA, 16 bp, Homo sapiens
tcctcacacttactgt

SEQ ID NO: 2920985 - DNA, 20 bp, Homo sapiens
tcctcaccccgtctggggtt

SEQ ID NO: 2920986 - DNA, 13 bp, Homo sapiens
tcctcacctggtt

SEQ ID NO: 2920987 - DNA, 18 bp, Homo sapiens
tcctcacgccccctgtga

SEQ ID NO: 2920988 - DNA, 16 bp, Homo sapiens
tcctcacgtgcaggac

SEQ ID NO: 2920989 - DNA, 23 bp, Homo sapiens
tcctcacgtgcaggacagctctt

SEQ ID NO: 2920990 - DNA, 17 bp, Homo sapiens
tcctcactcccttccca

SEQ ID NO: 2920991 - DNA, 11 bp, Homo sapiens
tcctcagcccc

SEQ ID NO: 2920992 - DNA, 14 bp, Homo sapiens
tcctcagcttatct

SEQ ID NO: 2920993 - DNA, 22 bp, Homo sapiens
tcctcaggcacacagctactct

SEQ ID NO: 2920994 - DNA, 17 bp, Homo sapiens
tcctcagggtgtcctga

SEQ ID NO: 2920995 - DNA, 16 bp, Homo sapiens
tcctcaggtggccatg

SEQ ID NO: 2920996 - DNA, 14 bp, Homo sapiens
tcctcagtgcaaaa

SEQ ID NO: 2920997 - DNA, 22 bp, Homo sapiens
tcctcagtgcaaaatgtcttgt

SEQ ID NO: 2920998 - DNA, 20 bp, Homo sapiens
tcctcatcctcagatgctca

SEQ ID NO: 2920999 - DNA, 18 bp, Homo sapiens
tcctcatctgtgcctgtc

SEQ ID NO: 2921000 - DNA, 17 bp, Homo sapiens
tcctcatgttctgcttt

SEQ ID NO: 2921001 - DNA, 23 bp, Homo sapiens
tcctcattgttggagtgtaaacc

SEQ ID NO: 2921002 - DNA, 16 bp, Homo sapiens
tcctcatttctccaga

SEQ ID NO: 2921003 - DNA, 15 bp, Homo sapiens
tcctccaccaccgcc

SEQ ID NO: 2921004 - DNA, 12 bp, Homo sapiens
tcctccacccca

SEQ ID NO: 2921005 - DNA, 21 bp, Homo sapiens
tcctccacgttctgctcatca

SEQ ID NO: 2921006 - DNA, 20 bp, Homo sapiens
tcctccagaagcctccttac

SEQ ID NO: 2921007 - DNA, 13 bp, Homo sapiens
tcctccagccctg

SEQ ID NO: 2921008 - DNA, 22 bp, Homo sapiens
tcctccagggtgattttatgat

SEQ ID NO: 2921009 - DNA, 17 bp, Homo sapiens
tcctccagtaccttgct

SEQ ID NO: 2921010 - DNA, 18 bp, Homo sapiens
tcctccagtaccttgctt

SEQ ID NO: 2921011 - DNA, 15 bp, Homo sapiens
tcctccagtctgttc

SEQ ID NO: 2921012 - DNA, 17 bp, Homo sapiens
tcctccattcctgctct

SEQ ID NO: 2921013 - DNA, 23 bp, Homo sapiens
tcctcccaatctcaatacagcct

SEQ ID NO: 2921014 - DNA, 16 bp, Homo sapiens
tcctccccaccagagc

SEQ ID NO: 2921015 - DNA, 17 bp, Homo sapiens
tcctccccaccagagct

SEQ ID NO: 2921016 - DNA, 18 bp, Homo sapiens
tcctccccaccagagctg

SEQ ID NO: 2921017 - DNA, 19 bp, Homo sapiens
tcctccccaccagagctgc

SEQ ID NO: 2921018 - DNA, 23 bp, Homo sapiens
tcctccccaccagagctgcctcc

SEQ ID NO: 2921019 - DNA, 20 bp, Homo sapiens
tcctcccccctcctctgaaa

SEQ ID NO: 2921020 - DNA, 21 bp, Homo sapiens
tcctccccgctccgtctctgt

SEQ ID NO: 2921021 - DNA, 14 bp, Homo sapiens
tcctcccctactct

SEQ ID NO: 2921022 - DNA, 13 bp, Homo sapiens
tcctcccctgccg

SEQ ID NO: 2921023 - DNA, 15 bp, Homo sapiens
tcctcccctgccgcc

SEQ ID NO: 2921024 - DNA, 14 bp, Homo sapiens
tcctccctcccaca

SEQ ID NO: 2921025 - DNA, 14 bp, Homo sapiens
tcgtaccttcccac

SEQ ID NO: 2921026 - DNA, 17 bp, Homo sapiens
tcgtatagctgtattga

SEQ ID NO: 2921027 - DNA, 16 bp, Homo sapiens
tcgtatatttctcata

SEQ ID NO: 2921028 - DNA, 17 bp, Homo sapiens
tcgtattgcaaataaga

SEQ ID NO: 2921029 - DNA, 16 bp, Homo sapiens
tcgtcaggctgccaga

SEQ ID NO: 2921030 - DNA, 17 bp, Homo sapiens
tcgtcctccccctgcca

SEQ ID NO: 2921031 - DNA, 23 bp, Homo sapiens
tcgtcctccccctgccagtgcct

SEQ ID NO: 2921032 - DNA, 17 bp, Homo sapiens
tcgtcctggattcactg

SEQ ID NO: 2921033 - DNA, 21 bp, Homo sapiens
tcgtcgaaaggtgcagctgcg

SEQ ID NO: 2921034 - DNA, 19 bp, Homo sapiens
tcgtgaagagggaagccag

SEQ ID NO: 2921035 - DNA, 21 bp, Homo sapiens
tcgtgaagagggaagccagga

SEQ ID NO: 2921036 - DNA, 19 bp, Homo sapiens
tcgtgaagtatactgtatt

SEQ ID NO: 2921037 - DNA, 17 bp, Homo sapiens
tcgtgacgctgaataaa

SEQ ID NO: 2921038 - DNA, 13 bp, Homo sapiens
tcgtgccagcagc

SEQ ID NO: 2921039 - DNA, 17 bp, Homo sapiens
tcgtgccagcagcctcg

SEQ ID NO: 2921040 - DNA, 20 bp, Homo sapiens
tcgtgccgttactctccaac

SEQ ID NO: 2921041 - DNA, 23 bp, Homo sapiens
tcgtgccgttactctccaacctg

SEQ ID NO: 2921042 - DNA, 20 bp, Homo sapiens
tcgtggctttggcagtgttt

SEQ ID NO: 2921043 - DNA, 23 bp, Homo sapiens
tcgtgttttcaaggaagaaaacg

SEQ ID NO: 2921044 - DNA, 13 bp, Homo sapiens
tcgttattataaa

SEQ ID NO: 2921045 - DNA, 16 bp, Homo sapiens
tcgttattataaatgt

SEQ ID NO: 2921046 - DNA, 13 bp, Homo sapiens
tcgttctctgcct

SEQ ID NO: 2921047 - DNA, 21 bp, Homo sapiens
tcgttctgtactgttactggg

SEQ ID NO: 2921048 - DNA, 18 bp, Homo sapiens
tcgttctttttaagttaa

SEQ ID NO: 2921049 - DNA, 12 bp, Homo sapiens
tcgtttaatgtt

SEQ ID NO: 2921050 - DNA, 20 bp, Homo sapiens
tcgtttaatgtttatacaga

SEQ ID NO: 2921051 - DNA, 15 bp, Homo sapiens
tcgtttactatgcct

SEQ ID NO: 2921052 - DNA, 14 bp, Homo sapiens
tcgtttagtgccaa

SEQ ID NO: 2921053 - DNA, 19 bp, Homo sapiens
tcgtttcaaaaacacagtg

SEQ ID NO: 2921054 - DNA, 13 bp, Homo sapiens
tcgtttggtctta

SEQ ID NO: 2921055 - DNA, 16 bp, Homo sapiens
tcgtttggtcttaggt

SEQ ID NO: 2921056 - DNA, 15 bp, Homo sapiens
tctaaaacaataaaa

SEQ ID NO: 2921057 - DNA, 17 bp, Homo sapiens
tctaaaacatagactga

SEQ ID NO: 2921058 - DNA, 15 bp, Homo sapiens
tctaaaatcctgctt

SEQ ID NO: 2921059 - DNA, 19 bp, Homo sapiens
tctaaaatcttatagttct

SEQ ID NO: 2921060 - DNA, 23 bp, Homo sapiens
tctaaaatcttatagttctaggc

SEQ ID NO: 2921061 - DNA, 18 bp, Homo sapiens
tctaaaatgtgatgttct

SEQ ID NO: 2921062 - DNA, 19 bp, Homo sapiens
tctaaaatgtgatgttcta

SEQ ID NO: 2921063 - DNA, 20 bp, Homo sapiens
tctaaaatgtgatgttctaa

SEQ ID NO: 2921064 - DNA, 22 bp, Homo sapiens
tctaaaatgtgatgttctaagg

SEQ ID NO: 2921065 - DNA, 19 bp, Homo sapiens
tctaaacagatgtccctga

SEQ ID NO: 2921066 - DNA, 16 bp, Homo sapiens
tctaaacccaatccaa

SEQ ID NO: 2921067 - DNA, 20 bp, Homo sapiens
tctaaaccccagattcttca

SEQ ID NO: 2921068 - DNA, 15 bp, Homo sapiens
tctaaacctgtgcct

SEQ ID NO: 2921069 - DNA, 20 bp, Homo sapiens
tctaaacctgtgcctccctc

SEQ ID NO: 2921070 - DNA, 21 bp, Homo sapiens
tctaaacgtaagcactgtttt

SEQ ID NO: 2921071 - DNA, 21 bp, Homo sapiens
tctaaactgagctcgcagccc

SEQ ID NO: 2921072 - DNA, 23 bp, Homo sapiens
tctaaactgagctcgcagccccc

SEQ ID NO: 2921073 - DNA, 20 bp, Homo sapiens
tctaaagattctatagttct

SEQ ID NO: 2921074 - DNA, 16 bp, Homo sapiens
tctaaagccaagcact

SEQ ID NO: 2921075 - DNA, 20 bp, Homo sapiens
tctaaagccattgtagtcct

SEQ ID NO: 2921076 - DNA, 12 bp, Homo sapiens
tctaaagctctg

SEQ ID NO: 2921077 - DNA, 16 bp, Homo sapiens
tctaaaggatgctgct

SEQ ID NO: 2921078 - DNA, 16 bp, Homo sapiens
tctaaaggatggaaaa

SEQ ID NO: 2921079 - DNA, 23 bp, Homo sapiens
tctaaaggatggaaaaataaaac

SEQ ID NO: 2921080 - DNA, 14 bp, Homo sapiens
tctaaaggtccaca

SEQ ID NO: 2921081 - DNA, 23 bp, Homo sapiens
tctaaaggtccacaggtctagac

SEQ ID NO: 2921082 - DNA, 18 bp, Homo sapiens
tctaaaggtggtgaggca

SEQ ID NO: 2921083 - DNA, 12 bp, Homo sapiens
tctaaagttcta

SEQ ID NO: 2921084 - DNA, 16 bp, Homo sapiens
tctaaagttctaagat

SEQ ID NO: 2921085 - DNA, 19 bp, Homo sapiens
tctaaagttctaagattct

SEQ ID NO: 2921086 - DNA, 20 bp, Homo sapiens
tctaaagttctaagattctg

SEQ ID NO: 2921087 - DNA, 16 bp, Homo sapiens
tctaaatagatacttt

SEQ ID NO: 2921088 - DNA, 16 bp, Homo sapiens
tctaaatatgaatgaa

SEQ ID NO: 2921089 - DNA, 20 bp, Homo sapiens
tctaaatcaccagagaccaa

SEQ ID NO: 2921090 - DNA, 12 bp, Homo sapiens
tctaaatgagct

SEQ ID NO: 2921091 - DNA, 15 bp, Homo sapiens
tctaaatgcccagtt

SEQ ID NO: 2921092 - DNA, 13 bp, Homo sapiens
tctaaattgaata

SEQ ID NO: 2921093 - DNA, 19 bp, Homo sapiens
tctaaattgatcattcata

SEQ ID NO: 2921094 - DNA, 18 bp, Homo sapiens
tctaaatttccatatcct

SEQ ID NO: 2921095 - DNA, 18 bp, Homo sapiens
tctaacatatgatactga

SEQ ID NO: 2921096 - DNA, 18 bp, Homo sapiens
tctaaccaaggctgtgtt

SEQ ID NO: 2921097 - DNA, 19 bp, Homo sapiens
tctaaccctatactgtagt

SEQ ID NO: 2921098 - DNA, 20 bp, Homo sapiens
tctaacctcatcttcttcac

SEQ ID NO: 2921099 - DNA, 14 bp, Homo sapiens
tctaacctgtgacc

SEQ ID NO: 2921100 - DNA, 13 bp, Homo sapiens
tctaactccctcc

SEQ ID NO: 2921101 - DNA, 17 bp, Homo sapiens
tctaagaatacagcttt

SEQ ID NO: 2921102 - DNA, 18 bp, Homo sapiens
tctaagactcaaatgttc

SEQ ID NO: 2921103 - DNA, 19 bp, Homo sapiens
tctaagacttactctaaga

SEQ ID NO: 2921104 - DNA, 23 bp, Homo sapiens
tctaagacttactctaagatctt

SEQ ID NO: 2921105 - DNA, 15 bp, Homo sapiens
tctaagatcttagat

SEQ ID NO: 2921106 - DNA, 19 bp, Homo sapiens
tctaagatcttagattctc

SEQ ID NO: 2921107 - DNA, 18 bp, Homo sapiens
tctaagatgtgatattct

SEQ ID NO: 2921108 - DNA, 19 bp, Homo sapiens
tctaagatgtgatattcta

SEQ ID NO: 2921109 - DNA, 20 bp, Homo sapiens
tctaagatgtgatattctaa

SEQ ID NO: 2921110 - DNA, 12 bp, Homo sapiens
tctaagattcta

SEQ ID NO: 2921111 - DNA, 16 bp, Homo sapiens
tctaagattctaaagg

SEQ ID NO: 2921112 - DNA, 15 bp, Homo sapiens
tctaagattctaatg

SEQ ID NO: 2921113 - DNA, 16 bp, Homo sapiens
tctaagattctaatga

SEQ ID NO: 2921114 - DNA, 19 bp, Homo sapiens
tctaagattctaatgatga

SEQ ID NO: 2921115 - DNA, 19 bp, Homo sapiens
tctaagattctagatcaga

SEQ ID NO: 2921116 - DNA, 18 bp, Homo sapiens
tctaagcagttttgtaaa

SEQ ID NO: 2921117 - DNA, 23 bp, Homo sapiens
tctaagcagttttgtaaatgtac

SEQ ID NO: 2921118 - DNA, 16 bp, Homo sapiens
tctaaggactttttct

SEQ ID NO: 2921119 - DNA, 14 bp, Homo sapiens
tctaaggctctgag

SEQ ID NO: 2921120 - DNA, 15 bp, Homo sapiens
tctaaggctctgaga

SEQ ID NO: 2921121 - DNA, 22 bp, Homo sapiens
tctaaggctctgagagtctaga

SEQ ID NO: 2921122 - DNA, 22 bp, Homo sapiens
tctaagggaggcacttcctccc

SEQ ID NO: 2921123 - DNA, 14 bp, Homo sapiens
tctaagttaattta

SEQ ID NO: 2921124 - DNA, 14 bp, Homo sapiens
tctaagttataaga

SEQ ID NO: 2921125 - DNA, 17 bp, Homo sapiens
tctaagttataagactc

SEQ ID NO: 2921126 - DNA, 15 bp, Homo sapiens
tctaagtttctaaga

SEQ ID NO: 2921127 - DNA, 16 bp, Homo sapiens
tctaagtttctaagat

SEQ ID NO: 2921128 - DNA, 20 bp, Homo sapiens
tctaagtttctaagattcta

SEQ ID NO: 2921129 - DNA, 16 bp, Homo sapiens
tctaatacctctgtgt

SEQ ID NO: 2921130 - DNA, 12 bp, Homo sapiens
tctaatagtctt

SEQ ID NO: 2921131 - DNA, 20 bp, Homo sapiens
tctaatgcttgtttatgata

SEQ ID NO: 2921132 - DNA, 20 bp, Homo sapiens
tctaatgtgagtgtgaagct

SEQ ID NO: 2921133 - DNA, 18 bp, Homo sapiens
tctaattaaccttactaa

SEQ ID NO: 2921134 - DNA, 14 bp, Homo sapiens
tctaatttattaat

SEQ ID NO: 2921135 - DNA, 14 bp, Homo sapiens
tctaattttgtgct

SEQ ID NO: 2921136 - DNA, 16 bp, Homo sapiens
tctaattttgtgctct

SEQ ID NO: 2921137 - DNA, 19 bp, Homo sapiens
tctaattttgtgctctttc

SEQ ID NO: 2921138 - DNA, 19 bp, Homo sapiens
tctacaaaaaataaaataa

SEQ ID NO: 2921139 - DNA, 16 bp, Homo sapiens
tctacaaggtgttcat

SEQ ID NO: 2921140 - DNA, 13 bp, Homo sapiens
tctacacctggac

SEQ ID NO: 2921141 - DNA, 18 bp, Homo sapiens
tctacagagcttccctga

SEQ ID NO: 2921142 - DNA, 21 bp, Homo sapiens
tctacagatagagagttgttg

SEQ ID NO: 2921143 - DNA, 16 bp, Homo sapiens
tctacatattctttaa

SEQ ID NO: 2921144 - DNA, 19 bp, Homo sapiens
tctacatcttttttcacaa

SEQ ID NO: 2921145 - DNA, 12 bp, Homo sapiens
tctacatgtgtt

SEQ ID NO: 2921146 - DNA, 16 bp, Homo sapiens
tctacatttgtttgta

SEQ ID NO: 2921147 - DNA, 14 bp, Homo sapiens
tctaccaatacaaa

SEQ ID NO: 2921148 - DNA, 21 bp, Homo sapiens
tctaccagtgcaggctggcca

SEQ ID NO: 2921149 - DNA, 19 bp, Homo sapiens
tctaccatgaacagaaaac

SEQ ID NO: 2921150 - DNA, 13 bp, Homo sapiens
tctacccagggcc

SEQ ID NO: 2921151 - DNA, 13 bp, Homo sapiens
tctacctgagcat

SEQ ID NO: 2921152 - DNA, 14 bp, Homo sapiens
tctacctgagcatt

SEQ ID NO: 2921153 - DNA, 20 bp, Homo sapiens
tctacgtatgcatgctaaat

SEQ ID NO: 2921154 - DNA, 15 bp, Homo sapiens
tctactaattccaca

SEQ ID NO: 2921155 - DNA, 12 bp, Homo sapiens
tctactacctac

SEQ ID NO: 2921156 - DNA, 18 bp, Homo sapiens
tctactacctacgtttgc

SEQ ID NO: 2921157 - DNA, 21 bp, Homo sapiens
tctgaaattcacagaagccta

SEQ ID NO: 2921158 - DNA, 17 bp, Homo sapiens
tctgaacaaaaactgta

SEQ ID NO: 2921159 - DNA, 17 bp, Homo sapiens
tctgaacaaaatgcctt

SEQ ID NO: 2921160 - DNA, 13 bp, Homo sapiens
tctgaacatctgg

SEQ ID NO: 2921161 - DNA, 14 bp, Homo sapiens
tctgaactggagcc

SEQ ID NO: 2921162 - DNA, 20 bp, Homo sapiens
tctgaactggagccatgggc

SEQ ID NO: 2921163 - DNA, 15 bp, Homo sapiens
tctgaactttgggaa

SEQ ID NO: 2921164 - DNA, 13 bp, Homo sapiens
tctgaagagacca

SEQ ID NO: 2921165 - DNA, 15 bp, Homo sapiens
tctgaagagtatttg

SEQ ID NO: 2921166 - DNA, 12 bp, Homo sapiens
tctgaagcagat

SEQ ID NO: 2921167 - DNA, 23 bp, Homo sapiens
tctgaagctcgcatccagacagt

SEQ ID NO: 2921168 - DNA, 18 bp, Homo sapiens
tctgaagcttatgtttct

SEQ ID NO: 2921169 - DNA, 19 bp, Homo sapiens
tctgaagcttatgtttctt

SEQ ID NO: 2921170 - DNA, 20 bp, Homo sapiens
tctgaaggagccccattcct

SEQ ID NO: 2921171 - DNA, 19 bp, Homo sapiens
tctgaaggggcaaattctt

SEQ ID NO: 2921172 - DNA, 15 bp, Homo sapiens
tctgaagttttattt

SEQ ID NO: 2921173 - DNA, 16 bp, Homo sapiens
tctgaatttgcaaagt

SEQ ID NO: 2921174 - DNA, 17 bp, Homo sapiens
tctgaattttaaaacat

SEQ ID NO: 2921175 - DNA, 19 bp, Homo sapiens
tctgacaaagtgtgtctca

SEQ ID NO: 2921176 - DNA, 15 bp, Homo sapiens
tctgacagcagcctg

SEQ ID NO: 2921177 - DNA, 17 bp, Homo sapiens
tctgacagcagcctgtg

SEQ ID NO: 2921178 - DNA, 14 bp, Homo sapiens
tctgacatcagcac

SEQ ID NO: 2921179 - DNA, 21 bp, Homo sapiens
tctgacattctcaggaagccc

SEQ ID NO: 2921180 - DNA, 22 bp, Homo sapiens
tctgacattctcaggaagcccc

SEQ ID NO: 2921181 - DNA, 17 bp, Homo sapiens
tctgacattctgattcg

SEQ ID NO: 2921182 - DNA, 13 bp, Homo sapiens
tctgaccagcagc

SEQ ID NO: 2921183 - DNA, 18 bp, Homo sapiens
tctgaccagcagcgcctt

SEQ ID NO: 2921184 - DNA, 20 bp, Homo sapiens
tctgaccatctgtgactata

SEQ ID NO: 2921185 - DNA, 22 bp, Homo sapiens
tctgaccatctgtgactataaa

SEQ ID NO: 2921186 - DNA, 21 bp, Homo sapiens
tctgacccacagcctccaagt

SEQ ID NO: 2921187 - DNA, 12 bp, Homo sapiens
tctgacccagag

SEQ ID NO: 2921188 - DNA, 23 bp, Homo sapiens
tctgacccagtgcccccactgac

SEQ ID NO: 2921189 - DNA, 21 bp, Homo sapiens
tctgaccgaaacagcgctggg

SEQ ID NO: 2921190 - DNA, 14 bp, Homo sapiens
tctgactcagggct

SEQ ID NO: 2921191 - DNA, 16 bp, Homo sapiens
tctgactccctcccca

SEQ ID NO: 2921192 - DNA, 19 bp, Homo sapiens
tctgactccctccccaccc

SEQ ID NO: 2921193 - DNA, 20 bp, Homo sapiens
tctgacttaagctgcctcaa

SEQ ID NO: 2921194 - DNA, 14 bp, Homo sapiens
tctgactttacact

SEQ ID NO: 2921195 - DNA, 14 bp, Homo sapiens
tctgactttttgtt

SEQ ID NO: 2921196 - DNA, 12 bp, Homo sapiens
tctgagaaaaca

SEQ ID NO: 2921197 - DNA, 20 bp, Homo sapiens
tctgagagaccatctcctat

SEQ ID NO: 2921198 - DNA, 14 bp, Homo sapiens
tctgagagaggcca

SEQ ID NO: 2921199 - DNA, 18 bp, Homo sapiens
tctgagagtctagattct

SEQ ID NO: 2921200 - DNA, 19 bp, Homo sapiens
tctgagagtctagattctc

SEQ ID NO: 2921201 - DNA, 21 bp, Homo sapiens
tctgagagtctagattctctg

SEQ ID NO: 2921202 - DNA, 15 bp, Homo sapiens
tctgagcacacttta

SEQ ID NO: 2921203 - DNA, 19 bp, Homo sapiens
tctgagcgtttaaagtact

SEQ ID NO: 2921204 - DNA, 22 bp, Homo sapiens
tctgagcgtttaaagtactgag

SEQ ID NO: 2921205 - DNA, 16 bp, Homo sapiens
tctgagctgagccagg

SEQ ID NO: 2921206 - DNA, 17 bp, Homo sapiens
tctgagctgagccaggc

SEQ ID NO: 2921207 - DNA, 18 bp, Homo sapiens
tctgagctgagccaggct

SEQ ID NO: 2921208 - DNA, 14 bp, Homo sapiens
tctgagctggggag

SEQ ID NO: 2921209 - DNA, 16 bp, Homo sapiens
tctgagctggggaggt

SEQ ID NO: 2921210 - DNA, 15 bp, Homo sapiens
tctgagctgtcccaa

SEQ ID NO: 2921211 - DNA, 13 bp, Homo sapiens
tctgagctttgtt

SEQ ID NO: 2921212 - DNA, 14 bp, Homo sapiens
tctgagctttgtta

SEQ ID NO: 2921213 - DNA, 23 bp, Homo sapiens
tctgaggcacctgcatatctcta

SEQ ID NO: 2921214 - DNA, 23 bp, Homo sapiens
tctgaggcctcctctctcagttt

SEQ ID NO: 2921215 - DNA, 22 bp, Homo sapiens
tctgaggggtgtccgagaggct

SEQ ID NO: 2921216 - DNA, 15 bp, Homo sapiens
tctgagtcagctgac

SEQ ID NO: 2921217 - DNA, 19 bp, Homo sapiens
tctgagtgtctctgcctgg

SEQ ID NO: 2921218 - DNA, 21 bp, Homo sapiens
tctgagtgtctctgcctggag

SEQ ID NO: 2921219 - DNA, 22 bp, Homo sapiens
tctgagtgtctctgcctggagc

SEQ ID NO: 2921220 - DNA, 17 bp, Homo sapiens
tctgagttcctggaatg

SEQ ID NO: 2921221 - DNA, 13 bp, Homo sapiens
tctgagttcttga

SEQ ID NO: 2921222 - DNA, 18 bp, Homo sapiens
tctgataaagttgagaga

SEQ ID NO: 2921223 - DNA, 12 bp, Homo sapiens
tctgatagaatt

SEQ ID NO: 2921224 - DNA, 23 bp, Homo sapiens
tctgataggagggggcggcaggg

SEQ ID NO: 2921225 - DNA, 15 bp, Homo sapiens
tctgatcaaggcctt

SEQ ID NO: 2921226 - DNA, 21 bp, Homo sapiens
tctgatccctctacagagctt

SEQ ID NO: 2921227 - DNA, 14 bp, Homo sapiens
tctgatcggccagt

SEQ ID NO: 2921228 - DNA, 19 bp, Homo sapiens
tctgatttagcaatgctgt

SEQ ID NO: 2921229 - DNA, 21 bp, Homo sapiens
tctgatttagcaatgctgtga

SEQ ID NO: 2921230 - DNA, 11 bp, Homo sapiens
tctgatttgca

SEQ ID NO: 2921231 - DNA, 13 bp, Homo sapiens
tctgattttctcc

SEQ ID NO: 2921232 - DNA, 12 bp, Homo sapiens
tctgcaacatgg

SEQ ID NO: 2921233 - DNA, 15 bp, Homo sapiens
tctgcaacatggatt

SEQ ID NO: 2921234 - DNA, 23 bp, Homo sapiens
tctgcaagtatactagggagcca

SEQ ID NO: 2921235 - DNA, 19 bp, Homo sapiens
tctgcaagtgtctggagcg

SEQ ID NO: 2921236 - DNA, 19 bp, Homo sapiens
tctgcaattcaaaagttcc

SEQ ID NO: 2921237 - DNA, 15 bp, Homo sapiens
tctgcaatttctact

SEQ ID NO: 2921238 - DNA, 20 bp, Homo sapiens
tctgcacaggtctctgttta

SEQ ID NO: 2921239 - DNA, 19 bp, Homo sapiens
tctgcacagtcagaaggac

SEQ ID NO: 2921240 - DNA, 17 bp, Homo sapiens
tctgcacatgtcttgta

SEQ ID NO: 2921241 - DNA, 20 bp, Homo sapiens
tctgcacatgtcttgtacat

SEQ ID NO: 2921242 - DNA, 15 bp, Homo sapiens
tctgcacccccctgg

SEQ ID NO: 2921243 - DNA, 18 bp, Homo sapiens
tctgcaccgtactgtgga

SEQ ID NO: 2921244 - DNA, 16 bp, Homo sapiens
tctgcagactggcagt

SEQ ID NO: 2921245 - DNA, 19 bp, Homo sapiens
tctgcagacttcccagcta

SEQ ID NO: 2921246 - DNA, 14 bp, Homo sapiens
tctgcagccagccc

SEQ ID NO: 2921247 - DNA, 15 bp, Homo sapiens
tctgcaggcaccggg

SEQ ID NO: 2921248 - DNA, 14 bp, Homo sapiens
tctgcaggcagggc

SEQ ID NO: 2921249 - DNA, 19 bp, Homo sapiens
tctgcaggcttaataaaaa

SEQ ID NO: 2921250 - DNA, 20 bp, Homo sapiens
tctgcagggccgccagggag

SEQ ID NO: 2921251 - DNA, 16 bp, Homo sapiens
tctgcagtcgcttgcc

SEQ ID NO: 2921252 - DNA, 19 bp, Homo sapiens
tctgcagtcgcttgccaaa

SEQ ID NO: 2921253 - DNA, 18 bp, Homo sapiens
tctgcatatgttgaatac

SEQ ID NO: 2921254 - DNA, 19 bp, Homo sapiens
tctgcatatgttgaatact

SEQ ID NO: 2921255 - DNA, 22 bp, Homo sapiens
tctgcatcttggggacatctct

SEQ ID NO: 2921256 - DNA, 21 bp, Homo sapiens
tctgcatgtaaaatcttcagc

SEQ ID NO: 2921257 - DNA, 15 bp, Homo sapiens
tctgcatttcggtgg

SEQ ID NO: 2921258 - DNA, 20 bp, Homo sapiens
tctgcatttttctgcagaag

SEQ ID NO: 2921259 - DNA, 15 bp, Homo sapiens
tctgccaatctgtac

SEQ ID NO: 2921260 - DNA, 19 bp, Homo sapiens
tctgccaatttttgccttc

SEQ ID NO: 2921261 - DNA, 20 bp, Homo sapiens
tctgccacctcccctatcca

SEQ ID NO: 2921262 - DNA, 14 bp, Homo sapiens
tctgccaggccccc

SEQ ID NO: 2921263 - DNA, 22 bp, Homo sapiens
tctgccataacagattatgtat

SEQ ID NO: 2921264 - DNA, 19 bp, Homo sapiens
tctgcccaaaaatatggtt

SEQ ID NO: 2921265 - DNA, 15 bp, Homo sapiens
tctgcccaactttca

SEQ ID NO: 2921266 - DNA, 14 bp, Homo sapiens
tctgccccccaggg

SEQ ID NO: 2921267 - DNA, 16 bp, Homo sapiens
tctgccccccagggct

SEQ ID NO: 2921268 - DNA, 17 bp, Homo sapiens
tctgcccgcctgcccac

SEQ ID NO: 2921269 - DNA, 19 bp, Homo sapiens
tctgcccgcctgcccacct

SEQ ID NO: 2921270 - DNA, 16 bp, Homo sapiens
tctgccctctgctgct

SEQ ID NO: 2921271 - DNA, 12 bp, Homo sapiens
tctgccctgtgg

SEQ ID NO: 2921272 - DNA, 18 bp, Homo sapiens
tctgccgccgcccgctgg

SEQ ID NO: 2921273 - DNA, 18 bp, Homo sapiens
tctgccgctacctccctc

SEQ ID NO: 2921274 - DNA, 20 bp, Homo sapiens
tctgccgctacctccctccc

SEQ ID NO: 2921275 - DNA, 17 bp, Homo sapiens
tctgcctagaaacagtg

SEQ ID NO: 2921276 - DNA, 18 bp, Homo sapiens
tctgcctagaatctttat

SEQ ID NO: 2921277 - DNA, 15 bp, Homo sapiens
tctgcctatcctggc

SEQ ID NO: 2921278 - DNA, 16 bp, Homo sapiens
tctgcctcaactccac

SEQ ID NO: 2921279 - DNA, 19 bp, Homo sapiens
tctgcctctaactccctcc

SEQ ID NO: 2921280 - DNA, 21 bp, Homo sapiens
tctgcctctaactccctcctc

SEQ ID NO: 2921281 - DNA, 22 bp, Homo sapiens
tctgcctctaactccctcctca

SEQ ID NO: 2921282 - DNA, 15 bp, Homo sapiens
tctgcctctctagga

SEQ ID NO: 2921283 - DNA, 9 bp, Homo sapiens
tctgcctgc

SEQ ID NO: 2921284 - DNA, 12 bp, Homo sapiens
tctgcctgcact

SEQ ID NO: 2921285 - DNA, 13 bp, Homo sapiens
tctgcctgctggg

SEQ ID NO: 2921286 - DNA, 16 bp, Homo sapiens
tctgcctgctgggctc

SEQ ID NO: 2921287 - DNA, 13 bp, Homo sapiens
tctgcctggagca

SEQ ID NO: 2921288 - DNA, 15 bp, Homo sapiens
tctgcctggagcagg

SEQ ID NO: 2921289 - DNA, 16 bp, Homo sapiens
tctgcctgttgcgtga

SEQ ID NO: 2921290 - DNA, 14 bp, Homo sapiens
tcttctttgtggtc

SEQ ID NO: 2921291 - DNA, 17 bp, Homo sapiens
tcttgaaagaagaatgt

SEQ ID NO: 2921292 - DNA, 14 bp, Homo sapiens
tcttgaaattaaga

SEQ ID NO: 2921293 - DNA, 20 bp, Homo sapiens
tcttgaaattaagaaggcaa

SEQ ID NO: 2921294 - DNA, 22 bp, Homo sapiens
tcttgaaattaagaaggcaaaa

SEQ ID NO: 2921295 - DNA, 17 bp, Homo sapiens
tcttgaactgagcttgg

SEQ ID NO: 2921296 - DNA, 14 bp, Homo sapiens
tcttgaactgggct

SEQ ID NO: 2921297 - DNA, 22 bp, Homo sapiens
tcttgaactgggctcaagtgat

SEQ ID NO: 2921298 - DNA, 23 bp, Homo sapiens
tcttgaagcatttcaaagccctg

SEQ ID NO: 2921299 - DNA, 16 bp, Homo sapiens
tcttgaagtccaggac

SEQ ID NO: 2921300 - DNA, 17 bp, Homo sapiens
tcttgaagtccaggact

SEQ ID NO: 2921301 - DNA, 12 bp, Homo sapiens
tcttgaagtcct

SEQ ID NO: 2921302 - DNA, 16 bp, Homo sapiens
tcttgaagtcctggct

SEQ ID NO: 2921303 - DNA, 23 bp, Homo sapiens
tcttgaagtcctggcttcaggca

SEQ ID NO: 2921304 - DNA, 14 bp, Homo sapiens
tcttgaatgtcttt

SEQ ID NO: 2921305 - DNA, 16 bp, Homo sapiens
tcttgactacagtcag

SEQ ID NO: 2921306 - DNA, 14 bp, Homo sapiens
tcttgactcaggtg

SEQ ID NO: 2921307 - DNA, 21 bp, Homo sapiens
tcttgactcaggtggtgtcct

SEQ ID NO: 2921308 - DNA, 22 bp, Homo sapiens
tcttgagagagaaatgctgttc

SEQ ID NO: 2921309 - DNA, 20 bp, Homo sapiens
tcttgagagtgttcctgaga

SEQ ID NO: 2921310 - DNA, 14 bp, Homo sapiens
tcttgatctcctga

SEQ ID NO: 2921311 - DNA, 12 bp, Homo sapiens
tcttgatgacca

SEQ ID NO: 2921312 - DNA, 15 bp, Homo sapiens
tcttgattataaatg

SEQ ID NO: 2921313 - DNA, 18 bp, Homo sapiens
tcttgattataaatgttt

SEQ ID NO: 2921314 - DNA, 23 bp, Homo sapiens
tcttgattataaatgtttggaaa

SEQ ID NO: 2921315 - DNA, 23 bp, Homo sapiens
tcttgattatccatattgagtca

SEQ ID NO: 2921316 - DNA, 19 bp, Homo sapiens
tcttgcatggcattaattg

SEQ ID NO: 2921317 - DNA, 16 bp, Homo sapiens
tcttgcattgaattta

SEQ ID NO: 2921318 - DNA, 17 bp, Homo sapiens
tcttgcattgacattat

SEQ ID NO: 2921319 - DNA, 18 bp, Homo sapiens
tcttgcctccaggtgcag

SEQ ID NO: 2921320 - DNA, 12 bp, Homo sapiens
tcttgccttccc

SEQ ID NO: 2921321 - DNA, 18 bp, Homo sapiens
tcttgccttccccttgaa

SEQ ID NO: 2921322 - DNA, 17 bp, Homo sapiens
tcttgctaagctccagc

SEQ ID NO: 2921323 - DNA, 14 bp, Homo sapiens
tcttgctcctgggg

SEQ ID NO: 2921324 - DNA, 14 bp, Homo sapiens
tcttgctctgtaat

SEQ ID NO: 2921325 - DNA, 17 bp, Homo sapiens
tcttgctctgtaatctc

SEQ ID NO: 2921326 - DNA, 21 bp, Homo sapiens
tcttgctgttgacatatttaa

SEQ ID NO: 2921327 - DNA, 14 bp, Homo sapiens
tcttgctttatact

SEQ ID NO: 2921328 - DNA, 19 bp, Homo sapiens
tcttggaactgtcccagct

SEQ ID NO: 2921329 - DNA, 19 bp, Homo sapiens
tcttggagcttttttgcat

SEQ ID NO: 2921330 - DNA, 19 bp, Homo sapiens
tcttggataccagctcagg

SEQ ID NO: 2921331 - DNA, 20 bp, Homo sapiens
tcttggctcgtttgggctca

SEQ ID NO: 2921332 - DNA, 16 bp, Homo sapiens
tcttggcttaatcatt

SEQ ID NO: 2921333 - DNA, 18 bp, Homo sapiens
tcttggcttaatcatttt

SEQ ID NO: 2921334 - DNA, 11 bp, Homo sapiens
tcttgggaaat

SEQ ID NO: 2921335 - DNA, 13 bp, Homo sapiens
tcttgggaactga

SEQ ID NO: 2921336 - DNA, 14 bp, Homo sapiens
tcttgggaactgaa

SEQ ID NO: 2921337 - DNA, 19 bp, Homo sapiens
tcttgggcctgacctccag

SEQ ID NO: 2921338 - DNA, 20 bp, Homo sapiens
tcttgggcctgacctccagt

SEQ ID NO: 2921339 - DNA, 21 bp, Homo sapiens
tcttgggcctgacctccagtc

SEQ ID NO: 2921340 - DNA, 23 bp, Homo sapiens
tcttgggcctgacctccagtcct

SEQ ID NO: 2921341 - DNA, 22 bp, Homo sapiens
tcttggggagtttagggtgggg

SEQ ID NO: 2921342 - DNA, 17 bp, Homo sapiens
tcttggggcccagtgca

SEQ ID NO: 2921343 - DNA, 22 bp, Homo sapiens
tcttggtaaatttccccaacag

SEQ ID NO: 2921344 - DNA, 18 bp, Homo sapiens
tcttggttccagcctgcc

SEQ ID NO: 2921345 - DNA, 18 bp, Homo sapiens
tcttgtaaatgtgttgga

SEQ ID NO: 2921346 - DNA, 19 bp, Homo sapiens
tcttgtaatccgaatctct

SEQ ID NO: 2921347 - DNA, 14 bp, Homo sapiens
tcttgtacatgtgt

SEQ ID NO: 2921348 - DNA, 19 bp, Homo sapiens
tcttgtcttagctctggac

SEQ ID NO: 2921349 - DNA, 21 bp, Homo sapiens
tcttgtgactcagcagaggca

SEQ ID NO: 2921350 - DNA, 14 bp, Homo sapiens
tcttgtgctcagtc

SEQ ID NO: 2921351 - DNA, 15 bp, Homo sapiens
tcttgtggcaagagc

SEQ ID NO: 2921352 - DNA, 23 bp, Homo sapiens
tcttgtgtctccttatggtacac

SEQ ID NO: 2921353 - DNA, 12 bp, Homo sapiens
tcttgttattat

SEQ ID NO: 2921354 - DNA, 15 bp, Homo sapiens
tcttgttctgtcact

SEQ ID NO: 2921355 - DNA, 14 bp, Homo sapiens
tcttgttctgttcc

SEQ ID NO: 2921356 - DNA, 22 bp, Homo sapiens
tcttgttgctcaaaaaatgagc

SEQ ID NO: 2921357 - DNA, 11 bp, Homo sapiens
tcttgttgctt

SEQ ID NO: 2921358 - DNA, 21 bp, Homo sapiens
tcttgtttaaaaaaagaaaaa

SEQ ID NO: 2921359 - DNA, 12 bp, Homo sapiens
tcttgtttctgt

SEQ ID NO: 2921360 - DNA, 11 bp, Homo sapiens
tcttgtttctt

SEQ ID NO: 2921361 - DNA, 12 bp, Homo sapiens
tcttgtttgtca

SEQ ID NO: 2921362 - DNA, 13 bp, Homo sapiens
tcttgtttgtcag

SEQ ID NO: 2921363 - DNA, 21 bp, Homo sapiens
tcttgtttgtcagcatctgac

SEQ ID NO: 2921364 - DNA, 22 bp, Homo sapiens
tcttgttttaagcaaatgcatt

SEQ ID NO: 2921365 - DNA, 15 bp, Homo sapiens
tctttaaaaacattt

SEQ ID NO: 2921366 - DNA, 19 bp, Homo sapiens
tctttaaaagaaagttagg

SEQ ID NO: 2921367 - DNA, 20 bp, Homo sapiens
tctttaaaattacaactaag

SEQ ID NO: 2921368 - DNA, 13 bp, Homo sapiens
tctttaaagccag

SEQ ID NO: 2921369 - DNA, 23 bp, Homo sapiens
tctttaaagtgactaatggcatg

SEQ ID NO: 2921370 - DNA, 13 bp, Homo sapiens
tctttaaatcagt

SEQ ID NO: 2921371 - DNA, 14 bp, Homo sapiens
tctttaaatcagta

SEQ ID NO: 2921372 - DNA, 21 bp, Homo sapiens
tctttaatcaatgtgacatgt

SEQ ID NO: 2921373 - DNA, 15 bp, Homo sapiens
tctttaatgctgtct

SEQ ID NO: 2921374 - DNA, 13 bp, Homo sapiens
tctttacaataaa

SEQ ID NO: 2921375 - DNA, 16 bp, Homo sapiens
tctttaccaaaggttt

SEQ ID NO: 2921376 - DNA, 16 bp, Homo sapiens
tctttacccttgagcc

SEQ ID NO: 2921377 - DNA, 13 bp, Homo sapiens
tctttagagaact

SEQ ID NO: 2921378 - DNA, 22 bp, Homo sapiens
tctttagagaactgaaaagaga

SEQ ID NO: 2921379 - DNA, 15 bp, Homo sapiens
tctttaggagattta

SEQ ID NO: 2921380 - DNA, 16 bp, Homo sapiens
tctttaggagatttat

SEQ ID NO: 2921381 - DNA, 21 bp, Homo sapiens
tctttaggtctttgtaagaac

SEQ ID NO: 2921382 - DNA, 20 bp, Homo sapiens
tctttagttgaattccaagt

SEQ ID NO: 2921383 - DNA, 13 bp, Homo sapiens
tctttatacaaca

SEQ ID NO: 2921384 - DNA, 17 bp, Homo sapiens
tctttatacaacagtgc

SEQ ID NO: 2921385 - DNA, 15 bp, Homo sapiens
tctttatactctctt

SEQ ID NO: 2921386 - DNA, 17 bp, Homo sapiens
tctttatactctcttcc

SEQ ID NO: 2921387 - DNA, 16 bp, Homo sapiens
tctttatatttcaata

SEQ ID NO: 2921388 - DNA, 19 bp, Homo sapiens
tctttatcaaggagatata

SEQ ID NO: 2921389 - DNA, 13 bp, Homo sapiens
tctttatcctaaa

SEQ ID NO: 2921390 - DNA, 19 bp, Homo sapiens
tctttatgagctaaaaata

SEQ ID NO: 2921391 - DNA, 15 bp, Homo sapiens
tctttatgcttgcaa

SEQ ID NO: 2921392 - DNA, 15 bp, Homo sapiens
tctttcaacttgcat

SEQ ID NO: 2921393 - DNA, 19 bp, Homo sapiens
tctttcacaaggtataata

SEQ ID NO: 2921394 - DNA, 10 bp, Homo sapiens
tctttcacat

SEQ ID NO: 2921395 - DNA, 13 bp, Homo sapiens
tctttcacttgaa

SEQ ID NO: 2921396 - DNA, 23 bp, Homo sapiens
tctttcagtacttttttaaatat

SEQ ID NO: 2921397 - DNA, 15 bp, Homo sapiens
tctttcagtattaaa

SEQ ID NO: 2921398 - DNA, 16 bp, Homo sapiens
tctttccacttctctg

SEQ ID NO: 2921399 - DNA, 18 bp, Homo sapiens
tctttcccctcctttgtc

SEQ ID NO: 2921400 - DNA, 20 bp, Homo sapiens
tctttcccctcctttgtctt

SEQ ID NO: 2921401 - DNA, 23 bp, Homo sapiens
tctttcctaaggctgcaaggttt

SEQ ID NO: 2921402 - DNA, 17 bp, Homo sapiens
tctttcctactttctat

SEQ ID NO: 2921403 - DNA, 19 bp, Homo sapiens
tctttcctttactcctggc

SEQ ID NO: 2921404 - DNA, 23 bp, Homo sapiens
tctttcgttggttgtttctctga

SEQ ID NO: 2921405 - DNA, 23 bp, Homo sapiens
tctttctagcctggggcttgaat

SEQ ID NO: 2921406 - DNA, 19 bp, Homo sapiens
tctttctagttcagctgcc

SEQ ID NO: 2921407 - DNA, 15 bp, Homo sapiens
tctttctatgctgct

SEQ ID NO: 2921408 - DNA, 18 bp, Homo sapiens
tctttctatgctgctttt

SEQ ID NO: 2921409 - DNA, 21 bp, Homo sapiens
tctttctatgctgcttttata

SEQ ID NO: 2921410 - DNA, 19 bp, Homo sapiens
tctttctgaaggctttgtg

SEQ ID NO: 2921411 - DNA, 21 bp, Homo sapiens
tctttctgagcacactttagt

SEQ ID NO: 2921412 - DNA, 13 bp, Homo sapiens
tctttctgtccct

SEQ ID NO: 2921413 - DNA, 22 bp, Homo sapiens
tctttcttctcgcctaggattt

SEQ ID NO: 2921414 - DNA, 18 bp, Homo sapiens
tctttcttggtgcattcg

SEQ ID NO: 2921415 - DNA, 23 bp, Homo sapiens
tctttcttgtttgtcagcatctg

SEQ ID NO: 2921416 - DNA, 12 bp, Homo sapiens
tctttgaatttc

SEQ ID NO: 2921417 - DNA, 16 bp, Homo sapiens
tctttgaattttctgt

SEQ ID NO: 2921418 - DNA, 17 bp, Homo sapiens
tctttgatccagaggtg

SEQ ID NO: 2921419 - DNA, 15 bp, Homo sapiens
tctttgatgttaaca

SEQ ID NO: 2921420 - DNA, 17 bp, Homo sapiens
tctttgatgttaacaca

SEQ ID NO: 2921421 - DNA, 15 bp, Homo sapiens
tctttgcaatactgc

SEQ ID NO: 2921422 - DNA, 12 bp, Homo sapiens
tctttgcctctc

SEQ ID NO: 2921423 - DNA, 12 bp, Homo sapiens
tgacaaagtgtt

SEQ ID NO: 2921424 - DNA, 21 bp, Homo sapiens
tgacaaagtgttgaaaatgta

SEQ ID NO: 2921425 - DNA, 18 bp, Homo sapiens
tgacaacatggcttctcc

SEQ ID NO: 2921426 - DNA, 24 bp, Homo sapiens
tgacaacatggcttctcctttggc

SEQ ID NO: 2921427 - DNA, 17 bp, Homo sapiens
tgacaaccgagaaggtt

SEQ ID NO: 2921428 - DNA, 18 bp, Homo sapiens
tgacaactcattttcata

SEQ ID NO: 2921429 - DNA, 17 bp, Homo sapiens
tgacaactggcaggcag

SEQ ID NO: 2921430 - DNA, 13 bp, Homo sapiens
tgacaagatggga

SEQ ID NO: 2921431 - DNA, 16 bp, Homo sapiens
tgacaagatgggacag

SEQ ID NO: 2921432 - DNA, 18 bp, Homo sapiens
tgacaagatgggacagca

SEQ ID NO: 2921433 - DNA, 16 bp, Homo sapiens
tgacaagctgtatcac

SEQ ID NO: 2921434 - DNA, 19 bp, Homo sapiens
tgacaagctgtatcactgc

SEQ ID NO: 2921435 - DNA, 22 bp, Homo sapiens
tgacaagctgtatcactgcctt

SEQ ID NO: 2921436 - DNA, 20 bp, Homo sapiens
tgacaataaaaatgttttga

SEQ ID NO: 2921437 - DNA, 16 bp, Homo sapiens
tgacaataaaacatta

SEQ ID NO: 2921438 - DNA, 23 bp, Homo sapiens
tgacaatagttatgcctgtacta

SEQ ID NO: 2921439 - DNA, 16 bp, Homo sapiens
tgacaatgactaagcc

SEQ ID NO: 2921440 - DNA, 18 bp, Homo sapiens
tgacaatgactaagccaa

SEQ ID NO: 2921441 - DNA, 20 bp, Homo sapiens
tgacaatgactaagccaagc

SEQ ID NO: 2921442 - DNA, 23 bp, Homo sapiens
tgacaatgactaagccaagctgt

SEQ ID NO: 2921443 - DNA, 13 bp, Homo sapiens
tgacaattgtcac

SEQ ID NO: 2921444 - DNA, 17 bp, Homo sapiens
tgacacaagtggacctt

SEQ ID NO: 2921445 - DNA, 19 bp, Homo sapiens
tgacacagactcatcctga

SEQ ID NO: 2921446 - DNA, 22 bp, Homo sapiens
tgacacagactcatcctgaaca

SEQ ID NO: 2921447 - DNA, 16 bp, Homo sapiens
tgacacaggtctttcc

SEQ ID NO: 2921448 - DNA, 21 bp, Homo sapiens
tgacacatatgcaccttgtgt

SEQ ID NO: 2921449 - DNA, 22 bp, Homo sapiens
tgacacatatgcaccttgtgtc

SEQ ID NO: 2921450 - DNA, 12 bp, Homo sapiens
tgacacatcagc

SEQ ID NO: 2921451 - DNA, 17 bp, Homo sapiens
tgacacatcagcatgtt

SEQ ID NO: 2921452 - DNA, 21 bp, Homo sapiens
tgacacatcagcatgttttct

SEQ ID NO: 2921453 - DNA, 16 bp, Homo sapiens
tgacactcccacccag

SEQ ID NO: 2921454 - DNA, 18 bp, Homo sapiens
tgacactcccacccagtc

SEQ ID NO: 2921455 - DNA, 20 bp, Homo sapiens
tgacactcccacccagtctc

SEQ ID NO: 2921456 - DNA, 22 bp, Homo sapiens
tgacactcccttgggctccctg

SEQ ID NO: 2921457 - DNA, 15 bp, Homo sapiens
tgacactctccttgc

SEQ ID NO: 2921458 - DNA, 20 bp, Homo sapiens
tgacactctccttgcagttc

SEQ ID NO: 2921459 - DNA, 14 bp, Homo sapiens
tgacactggaccag

SEQ ID NO: 2921460 - DNA, 18 bp, Homo sapiens
tgacacttcaaggtgaca

SEQ ID NO: 2921461 - DNA, 15 bp, Homo sapiens
tgacacttccaaaga

SEQ ID NO: 2921462 - DNA, 15 bp, Homo sapiens
tgacagactcctgag

SEQ ID NO: 2921463 - DNA, 17 bp, Homo sapiens
tgacagactcctgagga

SEQ ID NO: 2921464 - DNA, 22 bp, Homo sapiens
tgacagagcagctaactccgag

SEQ ID NO: 2921465 - DNA, 23 bp, Homo sapiens
tgacagagcagctaactccgaga

SEQ ID NO: 2921466 - DNA, 22 bp, Homo sapiens
tgacagagccttctgaggacat

SEQ ID NO: 2921467 - DNA, 21 bp, Homo sapiens
tgacagagcgagattccgtct

SEQ ID NO: 2921468 - DNA, 15 bp, Homo sapiens
tgacagatcaagctg

SEQ ID NO: 2921469 - DNA, 16 bp, Homo sapiens
tgacagatcaagctgt

SEQ ID NO: 2921470 - DNA, 17 bp, Homo sapiens
tgacagatcaagctgtg

SEQ ID NO: 2921471 - DNA, 15 bp, Homo sapiens
tgacagcagcctgtg

SEQ ID NO: 2921472 - DNA, 23 bp, Homo sapiens
tgacagcagcctgtgagggagtg

SEQ ID NO: 2921473 - DNA, 20 bp, Homo sapiens
tgacagctctttttgtgaag

SEQ ID NO: 2921474 - DNA, 12 bp, Homo sapiens
tgacagctgctc

SEQ ID NO: 2921475 - DNA, 14 bp, Homo sapiens
tgacagctgctcct

SEQ ID NO: 2921476 - DNA, 13 bp, Homo sapiens
tgacagctgtccc

SEQ ID NO: 2921477 - DNA, 15 bp, Homo sapiens
tgacagctgtccctg

SEQ ID NO: 2921478 - DNA, 18 bp, Homo sapiens
tgacagctgtccctgtca

SEQ ID NO: 2921479 - DNA, 15 bp, Homo sapiens
tgacagctttgctgc

SEQ ID NO: 2921480 - DNA, 16 bp, Homo sapiens
tgacagggaagctaca

SEQ ID NO: 2921481 - DNA, 21 bp, Homo sapiens
tgacagggaagctacaggtta

SEQ ID NO: 2921482 - DNA, 16 bp, Homo sapiens
tgacaggttttccaaa

SEQ ID NO: 2921483 - DNA, 14 bp, Homo sapiens
tgacagtagcattg

SEQ ID NO: 2921484 - DNA, 23 bp, Homo sapiens
tgacagttcttaattaagatcat

SEQ ID NO: 2921485 - DNA, 13 bp, Homo sapiens
tgacataaaattt

SEQ ID NO: 2921486 - DNA, 19 bp, Homo sapiens
tgacataaaatttacattt

SEQ ID NO: 2921487 - DNA, 15 bp, Homo sapiens
tgacataccttttat

SEQ ID NO: 2921488 - DNA, 16 bp, Homo sapiens
tgacataccttttatt

SEQ ID NO: 2921489 - DNA, 14 bp, Homo sapiens
tgacatatttaatg

SEQ ID NO: 2921490 - DNA, 23 bp, Homo sapiens
tgacatatttaatgttttaaatg

SEQ ID NO: 2921491 - DNA, 16 bp, Homo sapiens
tgacatcaaaatgagt

SEQ ID NO: 2921492 - DNA, 11 bp, Homo sapiens
tgacatcagca

SEQ ID NO: 2921493 - DNA, 15 bp, Homo sapiens
tgacatcagcacttt

SEQ ID NO: 2921494 - DNA, 13 bp, Homo sapiens
tgacatcagccag

SEQ ID NO: 2921495 - DNA, 14 bp, Homo sapiens
tgacatcagccagc

SEQ ID NO: 2921496 - DNA, 15 bp, Homo sapiens
tgacatccactgttt

SEQ ID NO: 2921497 - DNA, 13 bp, Homo sapiens
tgacatctctttg

SEQ ID NO: 2921498 - DNA, 15 bp, Homo sapiens
tgacatgaccctctg

SEQ ID NO: 2921499 - DNA, 21 bp, Homo sapiens
tgacatgattagcagaagaaa

SEQ ID NO: 2921500 - DNA, 17 bp, Homo sapiens
tgacatggaggcactga

SEQ ID NO: 2921501 - DNA, 23 bp, Homo sapiens
tgacatggaggcactgaagcccg

SEQ ID NO: 2921502 - DNA, 12 bp, Homo sapiens
tgacattcacct

SEQ ID NO: 2921503 - DNA, 17 bp, Homo sapiens
tgacattgatgtgttcg

SEQ ID NO: 2921504 - DNA, 19 bp, Homo sapiens
tgacattgctaagatgctc

SEQ ID NO: 2921505 - DNA, 20 bp, Homo sapiens
tgacattgctccaagatgtt

SEQ ID NO: 2921506 - DNA, 14 bp, Homo sapiens
tgacattgtctcct

SEQ ID NO: 2921507 - DNA, 16 bp, Homo sapiens
tgacatttaatgccat

SEQ ID NO: 2921508 - DNA, 13 bp, Homo sapiens
tgacatttatatt

SEQ ID NO: 2921509 - DNA, 21 bp, Homo sapiens
tgacatttatttttcatttag

SEQ ID NO: 2921510 - DNA, 16 bp, Homo sapiens
tgaccaacatggagaa

SEQ ID NO: 2921511 - DNA, 18 bp, Homo sapiens
tgaccaagcaggaagctc

SEQ ID NO: 2921512 - DNA, 19 bp, Homo sapiens
tgaccaagcaggaagctca

SEQ ID NO: 2921513 - DNA, 14 bp, Homo sapiens
tgaccacagaagca

SEQ ID NO: 2921514 - DNA, 14 bp, Homo sapiens
tgaccacagcacag

SEQ ID NO: 2921515 - DNA, 15 bp, Homo sapiens
tgaccacagcacagc

SEQ ID NO: 2921516 - DNA, 19 bp, Homo sapiens
tgaccacagcacagccaac

SEQ ID NO: 2921517 - DNA, 16 bp, Homo sapiens
tgaccacgcacctcca

SEQ ID NO: 2921518 - DNA, 13 bp, Homo sapiens
tgaccagagcaaa

SEQ ID NO: 2921519 - DNA, 17 bp, Homo sapiens
tgaccagccgtgagcat

SEQ ID NO: 2921520 - DNA, 12 bp, Homo sapiens
tgaccaggaaag

SEQ ID NO: 2921521 - DNA, 15 bp, Homo sapiens
tgaccagtctgaccc

SEQ ID NO: 2921522 - DNA, 13 bp, Homo sapiens
tgaccagtttctt

SEQ ID NO: 2921523 - DNA, 15 bp, Homo sapiens
tgaccagtttcttaa

SEQ ID NO: 2921524 - DNA, 21 bp, Homo sapiens
tgaccatgtgcggagcagcct

SEQ ID NO: 2921525 - DNA, 18 bp, Homo sapiens
tgaccattggctgcgcta

SEQ ID NO: 2921526 - DNA, 23 bp, Homo sapiens
tgaccattggctgcgctaacccc

SEQ ID NO: 2921527 - DNA, 18 bp, Homo sapiens
tgacccacttctcatcac

SEQ ID NO: 2921528 - DNA, 19 bp, Homo sapiens
tgacccacttctcatcaca

SEQ ID NO: 2921529 - DNA, 15 bp, Homo sapiens
tgacccagctactga

SEQ ID NO: 2921530 - DNA, 12 bp, Homo sapiens
tgacccagtccc

SEQ ID NO: 2921531 - DNA, 16 bp, Homo sapiens
tgacccagtgccccca

SEQ ID NO: 2921532 - DNA, 17 bp, Homo sapiens
tgacccagtgcccccac

SEQ ID NO: 2921533 - DNA, 23 bp, Homo sapiens
tgacccagtgcccccactgacca

SEQ ID NO: 2921534 - DNA, 23 bp, Homo sapiens
tgaccccccccattagaatgtga

SEQ ID NO: 2921535 - DNA, 23 bp, Homo sapiens
tgaccccggtggcggccccagca

SEQ ID NO: 2921536 - DNA, 16 bp, Homo sapiens
tgacccctaccccctc

SEQ ID NO: 2921537 - DNA, 21 bp, Homo sapiens
tgacccctaccccctcatccc

SEQ ID NO: 2921538 - DNA, 11 bp, Homo sapiens
tgacccctcct

SEQ ID NO: 2921539 - DNA, 15 bp, Homo sapiens
tgacccctcctgggg

SEQ ID NO: 2921540 - DNA, 17 bp, Homo sapiens
tgacccctcctggggcc

SEQ ID NO: 2921541 - DNA, 19 bp, Homo sapiens
tgacccctcctggggccag

SEQ ID NO: 2921542 - DNA, 20 bp, Homo sapiens
tgacccctcctggggccagg

SEQ ID NO: 2921543 - DNA, 13 bp, Homo sapiens
tgaccctcccggc

SEQ ID NO: 2921544 - DNA, 22 bp, Homo sapiens
tgaccctcccggcctggcttca

SEQ ID NO: 2921545 - DNA, 21 bp, Homo sapiens
tgaccctctgctgaagacttg

SEQ ID NO: 2921546 - DNA, 12 bp, Homo sapiens
tgaccctctgtc

SEQ ID NO: 2921547 - DNA, 17 bp, Homo sapiens
tgaccctctgtccccag

SEQ ID NO: 2921548 - DNA, 14 bp, Homo sapiens
tgaccctgagctga

SEQ ID NO: 2921549 - DNA, 16 bp, Homo sapiens
tgaccctgggcctgga

SEQ ID NO: 2921550 - DNA, 18 bp, Homo sapiens
tgaccctggggctggctt

SEQ ID NO: 2921551 - DNA, 18 bp, Homo sapiens
tgaccctgtatatagccc

SEQ ID NO: 2921552 - DNA, 16 bp, Homo sapiens
tgaccgcccagctctc

SEQ ID NO: 2921553 - DNA, 22 bp, Homo sapiens
tgaccgcccagctctcccacat

SEQ ID NO: 2921554 - DNA, 15 bp, Homo sapiens
tgaccgctgcccagg

SEQ ID NO: 2921555 - DNA, 19 bp, Homo sapiens
tgaccgctgcccaggtggg

SEQ ID NO: 2921556 - DNA, 15 bp, Homo sapiens
tgatatctgaatgtt

SEQ ID NO: 2921557 - DNA, 16 bp, Homo sapiens
tgatatctgaatgttc

SEQ ID NO: 2921558 - DNA, 19 bp, Homo sapiens
tgatatgatttaaaacatg

SEQ ID NO: 2921559 - DNA, 16 bp, Homo sapiens
tgatatggagcaagag

SEQ ID NO: 2921560 - DNA, 16 bp, Homo sapiens
tgatatgttttatttc

SEQ ID NO: 2921561 - DNA, 23 bp, Homo sapiens
tgatatgttttatttcattggtt

SEQ ID NO: 2921562 - DNA, 21 bp, Homo sapiens
tgatattccccccacttaaga

SEQ ID NO: 2921563 - DNA, 12 bp, Homo sapiens
tgatattctaag

SEQ ID NO: 2921564 - DNA, 15 bp, Homo sapiens
tgatattgttctcca

SEQ ID NO: 2921565 - DNA, 12 bp, Homo sapiens
tgatatttctct

SEQ ID NO: 2921566 - DNA, 16 bp, Homo sapiens
tgatatttctctagta

SEQ ID NO: 2921567 - DNA, 17 bp, Homo sapiens
tgatatttgacagacat

SEQ ID NO: 2921568 - DNA, 18 bp, Homo sapiens
tgatatttgacagacatc

SEQ ID NO: 2921569 - DNA, 18 bp, Homo sapiens
tgatattttgtttttccc

SEQ ID NO: 2921570 - DNA, 16 bp, Homo sapiens
tgatattttttctctc

SEQ ID NO: 2921571 - DNA, 19 bp, Homo sapiens
tgatcaaaattacttttct

SEQ ID NO: 2921572 - DNA, 11 bp, Homo sapiens
tgatcaaggcc

SEQ ID NO: 2921573 - DNA, 12 bp, Homo sapiens
tgatcaaggcct

SEQ ID NO: 2921574 - DNA, 14 bp, Homo sapiens
tgatcaatgacaga

SEQ ID NO: 2921575 - DNA, 20 bp, Homo sapiens
tgatcaattatagtttctga

SEQ ID NO: 2921576 - DNA, 21 bp, Homo sapiens
tgatcaattatagtttctgag

SEQ ID NO: 2921577 - DNA, 22 bp, Homo sapiens
tgatcaattatagtttctgagg

SEQ ID NO: 2921578 - DNA, 12 bp, Homo sapiens
tgatcacaggag

SEQ ID NO: 2921579 - DNA, 21 bp, Homo sapiens
tgatcactgtgaaccaacccc

SEQ ID NO: 2921580 - DNA, 23 bp, Homo sapiens
tgatcagagccgtggtcctttgg

SEQ ID NO: 2921581 - DNA, 17 bp, Homo sapiens
tgatcagcaatgaagaa

SEQ ID NO: 2921582 - DNA, 19 bp, Homo sapiens
tgatcagctttcaaagcat

SEQ ID NO: 2921583 - DNA, 20 bp, Homo sapiens
tgatcagctttcaaagcatt

SEQ ID NO: 2921584 - DNA, 12 bp, Homo sapiens
tgatcaggacct

SEQ ID NO: 2921585 - DNA, 14 bp, Homo sapiens
tgatcaggcttcct

SEQ ID NO: 2921586 - DNA, 17 bp, Homo sapiens
tgatcaggcttcctggt

SEQ ID NO: 2921587 - DNA, 22 bp, Homo sapiens
tgatcaggcttcctggtgagaa

SEQ ID NO: 2921588 - DNA, 17 bp, Homo sapiens
tgatcagggatccaata

SEQ ID NO: 2921589 - DNA, 14 bp, Homo sapiens
tgatcatctgctgt

SEQ ID NO: 2921590 - DNA, 16 bp, Homo sapiens
tgatcatctttgctga

SEQ ID NO: 2921591 - DNA, 18 bp, Homo sapiens
tgatccaagcaagactga

SEQ ID NO: 2921592 - DNA, 18 bp, Homo sapiens
tgatccagccctgagttc

SEQ ID NO: 2921593 - DNA, 12 bp, Homo sapiens
tgatcccagctc

SEQ ID NO: 2921594 - DNA, 21 bp, Homo sapiens
tgatcccgttttccccatgac

SEQ ID NO: 2921595 - DNA, 13 bp, Homo sapiens
tgatcctcagtgc

SEQ ID NO: 2921596 - DNA, 22 bp, Homo sapiens
tgatcctcagtgcaaaatgtct

SEQ ID NO: 2921597 - DNA, 14 bp, Homo sapiens
tgatcctggaggcc

SEQ ID NO: 2921598 - DNA, 20 bp, Homo sapiens
tgatcctgtattcagacaga

SEQ ID NO: 2921599 - DNA, 22 bp, Homo sapiens
tgatcgccttatttatattcat

SEQ ID NO: 2921600 - DNA, 17 bp, Homo sapiens
tgatcgtatatttctca

SEQ ID NO: 2921601 - DNA, 21 bp, Homo sapiens
tgatctacccgtgcctgggcc

SEQ ID NO: 2921602 - DNA, 16 bp, Homo sapiens
tgatctccctgccgcc

SEQ ID NO: 2921603 - DNA, 18 bp, Homo sapiens
tgatctcctgacctcatg

SEQ ID NO: 2921604 - DNA, 22 bp, Homo sapiens
tgatctcctgacctcatgatcc

SEQ ID NO: 2921605 - DNA, 23 bp, Homo sapiens
tgatctcttcttttggcttccat

SEQ ID NO: 2921606 - DNA, 18 bp, Homo sapiens
tgatctgcctgccttggt

SEQ ID NO: 2921607 - DNA, 13 bp, Homo sapiens
tgatctggaaccc

SEQ ID NO: 2921608 - DNA, 19 bp, Homo sapiens
tgatctggaacccagactc

SEQ ID NO: 2921609 - DNA, 24 bp, Homo sapiens
tgatctggccctccccagaacaat

SEQ ID NO: 2921610 - DNA, 18 bp, Homo sapiens
tgatctggtggttattta

SEQ ID NO: 2921611 - DNA, 17 bp, Homo sapiens
tgatcttacctttatga

SEQ ID NO: 2921612 - DNA, 18 bp, Homo sapiens
tgatgaaagctttggcga

SEQ ID NO: 2921613 - DNA, 17 bp, Homo sapiens
tgatgaacttattctgt

SEQ ID NO: 2921614 - DNA, 18 bp, Homo sapiens
tgatgaatctacatttgt

SEQ ID NO: 2921615 - DNA, 20 bp, Homo sapiens
tgatgaatctacatttgttt

SEQ ID NO: 2921616 - DNA, 23 bp, Homo sapiens
tgatgacaaacccaggagtttgt

SEQ ID NO: 2921617 - DNA, 14 bp, Homo sapiens
tgatgacagacact

SEQ ID NO: 2921618 - DNA, 22 bp, Homo sapiens
tgatgacgaatcctgctctaaa

SEQ ID NO: 2921619 - DNA, 13 bp, Homo sapiens
tgatgacttgagc

SEQ ID NO: 2921620 - DNA, 17 bp, Homo sapiens
tgatgacttgagccctg

SEQ ID NO: 2921621 - DNA, 16 bp, Homo sapiens
tgatgagattcactta

SEQ ID NO: 2921622 - DNA, 14 bp, Homo sapiens
tgatgagattttta

SEQ ID NO: 2921623 - DNA, 18 bp, Homo sapiens
tgatgagcactcctgatt

SEQ ID NO: 2921624 - DNA, 16 bp, Homo sapiens
tgatgaggtatttttt

SEQ ID NO: 2921625 - DNA, 18 bp, Homo sapiens
tgatgagtttgacagttt

SEQ ID NO: 2921626 - DNA, 13 bp, Homo sapiens
tgatgataataat

SEQ ID NO: 2921627 - DNA, 15 bp, Homo sapiens
tgatgatgatgatga

SEQ ID NO: 2921628 - DNA, 17 bp, Homo sapiens
tgatgatgatgatgatg

SEQ ID NO: 2921629 - DNA, 19 bp, Homo sapiens
tgatgcaaccaaaagggaa

SEQ ID NO: 2921630 - DNA, 19 bp, Homo sapiens
tgatgcaggatttgttctc

SEQ ID NO: 2921631 - DNA, 21 bp, Homo sapiens
tgatgcctctgtcttctggac

SEQ ID NO: 2921632 - DNA, 11 bp, Homo sapiens
tgatgctcagt

SEQ ID NO: 2921633 - DNA, 15 bp, Homo sapiens
tgatgctgcccctca

SEQ ID NO: 2921634 - DNA, 20 bp, Homo sapiens
tgatgctggatgctccttcc

SEQ ID NO: 2921635 - DNA, 13 bp, Homo sapiens
tgatgcttttctc

SEQ ID NO: 2921636 - DNA, 22 bp, Homo sapiens
tgatggaaaaagcgctgtttcc

SEQ ID NO: 2921637 - DNA, 15 bp, Homo sapiens
tgatggattccaaac

SEQ ID NO: 2921638 - DNA, 19 bp, Homo sapiens
tgatggcaacagatctgga

SEQ ID NO: 2921639 - DNA, 10 bp, Homo sapiens
tgatggctaa

SEQ ID NO: 2921640 - DNA, 23 bp, Homo sapiens
tgatggctgggtccttgggcctg

SEQ ID NO: 2921641 - DNA, 19 bp, Homo sapiens
tgatgggaaaatatttcct

SEQ ID NO: 2921642 - DNA, 16 bp, Homo sapiens
tgatgggattctggac

SEQ ID NO: 2921643 - DNA, 17 bp, Homo sapiens
tgatgggattctggaca

SEQ ID NO: 2921644 - DNA, 17 bp, Homo sapiens
tgatggggaaggaggct

SEQ ID NO: 2921645 - DNA, 12 bp, Homo sapiens
tgatggtgagca

SEQ ID NO: 2921646 - DNA, 21 bp, Homo sapiens
tgatggtgtagccctcccact

SEQ ID NO: 2921647 - DNA, 22 bp, Homo sapiens
tgatggtgttttggggatgaga

SEQ ID NO: 2921648 - DNA, 14 bp, Homo sapiens
tgatgtaatgaaat

SEQ ID NO: 2921649 - DNA, 11 bp, Homo sapiens
tgatgtcttta

SEQ ID NO: 2921650 - DNA, 23 bp, Homo sapiens
tgatgtgcacatatcaagaagtc

SEQ ID NO: 2921651 - DNA, 12 bp, Homo sapiens
tgatgtggactg

SEQ ID NO: 2921652 - DNA, 13 bp, Homo sapiens
tgatgtggttttt

SEQ ID NO: 2921653 - DNA, 11 bp, Homo sapiens
tgatgttaaca

SEQ ID NO: 2921654 - DNA, 20 bp, Homo sapiens
tgatgttaacacattttgta

SEQ ID NO: 2921655 - DNA, 23 bp, Homo sapiens
tgatgttatacatcaatatgtat

SEQ ID NO: 2921656 - DNA, 21 bp, Homo sapiens
tgatgttcagacatttatgtg

SEQ ID NO: 2921657 - DNA, 16 bp, Homo sapiens
tgatgttcagatttct

SEQ ID NO: 2921658 - DNA, 18 bp, Homo sapiens
tgatgttcagtgtaattt

SEQ ID NO: 2921659 - DNA, 17 bp, Homo sapiens
tgatgttctaaggctct

SEQ ID NO: 2921660 - DNA, 19 bp, Homo sapiens
tgatgttctaaggctctga

SEQ ID NO: 2921661 - DNA, 20 bp, Homo sapiens
tgatgttctaaggctctgag

SEQ ID NO: 2921662 - DNA, 22 bp, Homo sapiens
tgatgttctaaggctctgagag

SEQ ID NO: 2921663 - DNA, 13 bp, Homo sapiens
tgatgtttcctgg

SEQ ID NO: 2921664 - DNA, 15 bp, Homo sapiens
tgatgtttcctggaa

SEQ ID NO: 2921665 - DNA, 17 bp, Homo sapiens
tgatgtttcctggaagc

SEQ ID NO: 2921666 - DNA, 17 bp, Homo sapiens
tgattaaataagattct

SEQ ID NO: 2921667 - DNA, 14 bp, Homo sapiens
tgattaactcttag

SEQ ID NO: 2921668 - DNA, 17 bp, Homo sapiens
tgattaaggcagtacaa

SEQ ID NO: 2921669 - DNA, 22 bp, Homo sapiens
tgattactctttgctttgtagt

SEQ ID NO: 2921670 - DNA, 19 bp, Homo sapiens
tgattactgcaatcactgt

SEQ ID NO: 2921671 - DNA, 15 bp, Homo sapiens
tgattagcagaagaa

SEQ ID NO: 2921672 - DNA, 14 bp, Homo sapiens
tgattataaatgtt

SEQ ID NO: 2921673 - DNA, 15 bp, Homo sapiens
tgattataaatgttt

SEQ ID NO: 2921674 - DNA, 20 bp, Homo sapiens
tgattataaatgtttggaaa

SEQ ID NO: 2921675 - DNA, 21 bp, Homo sapiens
tgattataaatgtttggaaag

SEQ ID NO: 2921676 - DNA, 13 bp, Homo sapiens
tgattatatgtca

SEQ ID NO: 2921677 - DNA, 19 bp, Homo sapiens
tgattcaaaatatttaaaa

SEQ ID NO: 2921678 - DNA, 20 bp, Homo sapiens
tgattcaaggctcagaagga

SEQ ID NO: 2921679 - DNA, 16 bp, Homo sapiens
tgattcacatctcatt

SEQ ID NO: 2921680 - DNA, 12 bp, Homo sapiens
tgattcagtgtt

SEQ ID NO: 2921681 - DNA, 17 bp, Homo sapiens
tgattcataataaatat

SEQ ID NO: 2921682 - DNA, 19 bp, Homo sapiens
tgattcatgttcatcaata

SEQ ID NO: 2921683 - DNA, 21 bp, Homo sapiens
tgattccaacaggcgtgggat

SEQ ID NO: 2921684 - DNA, 13 bp, Homo sapiens
tgattcccaactc

SEQ ID NO: 2921685 - DNA, 17 bp, Homo sapiens
tgattccctcctgctac

SEQ ID NO: 2921686 - DNA, 18 bp, Homo sapiens
tgattctagtacataatt

SEQ ID NO: 2921687 - DNA, 13 bp, Homo sapiens
tgattctcctgcc

SEQ ID NO: 2921688 - DNA, 15 bp, Homo sapiens
tgattctctgtggtt

SEQ ID NO: 2921689 - DNA, 17 bp, Homo sapiens
tgccacccattcttccc

SEQ ID NO: 2921690 - DNA, 18 bp, Homo sapiens
tgccacccattcttcccg

SEQ ID NO: 2921691 - DNA, 14 bp, Homo sapiens
tgccacccccagcc

SEQ ID NO: 2921692 - DNA, 16 bp, Homo sapiens
tgccacccccagccct

SEQ ID NO: 2921693 - DNA, 17 bp, Homo sapiens
tgccaccgactgcccag

SEQ ID NO: 2921694 - DNA, 23 bp, Homo sapiens
tgccaccgactgcccagccactc

SEQ ID NO: 2921695 - DNA, 17 bp, Homo sapiens
tgccacctcccctatcc

SEQ ID NO: 2921696 - DNA, 18 bp, Homo sapiens
tgccacctcccctatcca

SEQ ID NO: 2921697 - DNA, 17 bp, Homo sapiens
tgccacgtgccttagga

SEQ ID NO: 2921698 - DNA, 18 bp, Homo sapiens
tgccacgtgccttaggaa

SEQ ID NO: 2921699 - DNA, 21 bp, Homo sapiens
tgccactcacccttcctggcc

SEQ ID NO: 2921700 - DNA, 14 bp, Homo sapiens
tgccactcctccct

SEQ ID NO: 2921701 - DNA, 16 bp, Homo sapiens
tgccactcctccctcc

SEQ ID NO: 2921702 - DNA, 13 bp, Homo sapiens
tgccactctgctg

SEQ ID NO: 2921703 - DNA, 17 bp, Homo sapiens
tgccactctgctgcctg

SEQ ID NO: 2921704 - DNA, 19 bp, Homo sapiens
tgccactctgctgcctgta

SEQ ID NO: 2921705 - DNA, 19 bp, Homo sapiens
tgccactgatattcagaat

SEQ ID NO: 2921706 - DNA, 13 bp, Homo sapiens
tgccactttccac

SEQ ID NO: 2921707 - DNA, 16 bp, Homo sapiens
tgccactttccaccaa

SEQ ID NO: 2921708 - DNA, 14 bp, Homo sapiens
tgccagaaggaagg

SEQ ID NO: 2921709 - DNA, 12 bp, Homo sapiens
tgccagagccgg

SEQ ID NO: 2921710 - DNA, 14 bp, Homo sapiens
tgccagatcctctt

SEQ ID NO: 2921711 - DNA, 21 bp, Homo sapiens
tgccagatgaaaccaactctt

SEQ ID NO: 2921712 - DNA, 14 bp, Homo sapiens
tgccagatgctgat

SEQ ID NO: 2921713 - DNA, 17 bp, Homo sapiens
tgccagatgctgatgtt

SEQ ID NO: 2921714 - DNA, 19 bp, Homo sapiens
tgccagcagcccttgttta

SEQ ID NO: 2921715 - DNA, 19 bp, Homo sapiens
tgccagcagcctcgcacag

SEQ ID NO: 2921716 - DNA, 22 bp, Homo sapiens
tgccagcagcctcgcacaggcc

SEQ ID NO: 2921717 - DNA, 17 bp, Homo sapiens
tgccagcccctgctggc

SEQ ID NO: 2921718 - DNA, 12 bp, Homo sapiens
tgccagctctgt

SEQ ID NO: 2921719 - DNA, 22 bp, Homo sapiens
tgccagctctgtatcaggaccc

SEQ ID NO: 2921720 - DNA, 19 bp, Homo sapiens
tgccagctctgtcaccctg

SEQ ID NO: 2921721 - DNA, 18 bp, Homo sapiens
tgccaggacccgccagcc

SEQ ID NO: 2921722 - DNA, 22 bp, Homo sapiens
tgccaggacccgccagccccgc

SEQ ID NO: 2921723 - DNA, 20 bp, Homo sapiens
tgccaggatcaagcatgaaa

SEQ ID NO: 2921724 - DNA, 17 bp, Homo sapiens
tgccaggcccccaccac

SEQ ID NO: 2921725 - DNA, 22 bp, Homo sapiens
tgccaggcccccaccacacatc

SEQ ID NO: 2921726 - DNA, 23 bp, Homo sapiens
tgccaggctgcggtgggcagcca

SEQ ID NO: 2921727 - DNA, 17 bp, Homo sapiens
tgccaggcttgcctggg

SEQ ID NO: 2921728 - DNA, 20 bp, Homo sapiens
tgccaggcttgcctgggctg

SEQ ID NO: 2921729 - DNA, 17 bp, Homo sapiens
tgccagggaaaaagacc

SEQ ID NO: 2921730 - DNA, 21 bp, Homo sapiens
tgccagggaaaaagaccaaat

SEQ ID NO: 2921731 - DNA, 21 bp, Homo sapiens
tgccagggatgggcagcccaa

SEQ ID NO: 2921732 - DNA, 17 bp, Homo sapiens
tgccagggcaatgatga

SEQ ID NO: 2921733 - DNA, 22 bp, Homo sapiens
tgccagggcaatgatgaatgag

SEQ ID NO: 2921734 - DNA, 13 bp, Homo sapiens
tgccagggctctg

SEQ ID NO: 2921735 - DNA, 16 bp, Homo sapiens
tgccagggctctgggg

SEQ ID NO: 2921736 - DNA, 20 bp, Homo sapiens
tgccagtcgggagagccagg

SEQ ID NO: 2921737 - DNA, 17 bp, Homo sapiens
tgccagtgataagagca

SEQ ID NO: 2921738 - DNA, 15 bp, Homo sapiens
tgccagtgcactccg

SEQ ID NO: 2921739 - DNA, 11 bp, Homo sapiens
tgccagtgcct

SEQ ID NO: 2921740 - DNA, 23 bp, Homo sapiens
tgccagtgccttacctcctgccc

SEQ ID NO: 2921741 - DNA, 19 bp, Homo sapiens
tgccataactttatgaagt

SEQ ID NO: 2921742 - DNA, 14 bp, Homo sapiens
tgccataatacaaa

SEQ ID NO: 2921743 - DNA, 18 bp, Homo sapiens
tgccatactgtatgcagt

SEQ ID NO: 2921744 - DNA, 18 bp, Homo sapiens
tgccatcaaactgtaaaa

SEQ ID NO: 2921745 - DNA, 23 bp, Homo sapiens
tgccatcatctcctgccttcctc

SEQ ID NO: 2921746 - DNA, 14 bp, Homo sapiens
tgccatcattgctg

SEQ ID NO: 2921747 - DNA, 21 bp, Homo sapiens
tgccatccacattttaacagt

SEQ ID NO: 2921748 - DNA, 16 bp, Homo sapiens
tgccatccattctgga

SEQ ID NO: 2921749 - DNA, 13 bp, Homo sapiens
tgccatcccaagc

SEQ ID NO: 2921750 - DNA, 16 bp, Homo sapiens
tgccatcgggtgccaa

SEQ ID NO: 2921751 - DNA, 17 bp, Homo sapiens
tgccatcgggtgccaaa

SEQ ID NO: 2921752 - DNA, 15 bp, Homo sapiens
tgccatctatgcaga

SEQ ID NO: 2921753 - DNA, 22 bp, Homo sapiens
tgccatcttctccccgaggctg

SEQ ID NO: 2921754 - DNA, 22 bp, Homo sapiens
tgccatcttgcttttctttgga

SEQ ID NO: 2921755 - DNA, 19 bp, Homo sapiens
tgccatgatgcctctgtct

SEQ ID NO: 2921756 - DNA, 20 bp, Homo sapiens
tgccatgctatgtgcacagc

SEQ ID NO: 2921757 - DNA, 14 bp, Homo sapiens
tgccatggcaatgg

SEQ ID NO: 2921758 - DNA, 23 bp, Homo sapiens
tgccatgtaaaggcctttaataa

SEQ ID NO: 2921759 - DNA, 13 bp, Homo sapiens
tgccatgtcttta

SEQ ID NO: 2921760 - DNA, 16 bp, Homo sapiens
tgccatgtgactctgg

SEQ ID NO: 2921761 - DNA, 15 bp, Homo sapiens
tgccatgttggccag

SEQ ID NO: 2921762 - DNA, 18 bp, Homo sapiens
tgccatgtttttgccaaa

SEQ ID NO: 2921763 - DNA, 17 bp, Homo sapiens
tgccattacccagtgcc

SEQ ID NO: 2921764 - DNA, 21 bp, Homo sapiens
tgccattatagcgcctgtata

SEQ ID NO: 2921765 - DNA, 20 bp, Homo sapiens
tgcccaaatccttagatctg

SEQ ID NO: 2921766 - DNA, 18 bp, Homo sapiens
tgcccaactgtgtagcat

SEQ ID NO: 2921767 - DNA, 11 bp, Homo sapiens
tgcccaaggat

SEQ ID NO: 2921768 - DNA, 18 bp, Homo sapiens
tgcccaaggatgccttag

SEQ ID NO: 2921769 - DNA, 17 bp, Homo sapiens
tgcccaagtgaccaggg

SEQ ID NO: 2921770 - DNA, 19 bp, Homo sapiens
tgcccaagtgaccagggaa

SEQ ID NO: 2921771 - DNA, 20 bp, Homo sapiens
tgcccacacacactccttcc

SEQ ID NO: 2921772 - DNA, 14 bp, Homo sapiens
tgcccacaggccgc

SEQ ID NO: 2921773 - DNA, 23 bp, Homo sapiens
tgcccaccaacatcccattgccc

SEQ ID NO: 2921774 - DNA, 15 bp, Homo sapiens
tgcccacccccggga

SEQ ID NO: 2921775 - DNA, 22 bp, Homo sapiens
tgcccacccccgggatcctgcc

SEQ ID NO: 2921776 - DNA, 12 bp, Homo sapiens
tgcccacctgcc

SEQ ID NO: 2921777 - DNA, 20 bp, Homo sapiens
tgcccacctgcctggccggc

SEQ ID NO: 2921778 - DNA, 21 bp, Homo sapiens
tgcccacctgcctggccggcc

SEQ ID NO: 2921779 - DNA, 11 bp, Homo sapiens
tgcccacctgt

SEQ ID NO: 2921780 - DNA, 17 bp, Homo sapiens
tgcccagaataagttat

SEQ ID NO: 2921781 - DNA, 11 bp, Homo sapiens
tgcccagagat

SEQ ID NO: 2921782 - DNA, 20 bp, Homo sapiens
tgcccagagatgcctccacc

SEQ ID NO: 2921783 - DNA, 16 bp, Homo sapiens
tgcccagccacccctc

SEQ ID NO: 2921784 - DNA, 12 bp, Homo sapiens
tgcccagccagc

SEQ ID NO: 2921785 - DNA, 18 bp, Homo sapiens
tgcccagccagccacccc

SEQ ID NO: 2921786 - DNA, 19 bp, Homo sapiens
tgcccagccagccacccct

SEQ ID NO: 2921787 - DNA, 23 bp, Homo sapiens
tgcccagccagccacccctgcca

SEQ ID NO: 2921788 - DNA, 22 bp, Homo sapiens
tgcccagctatacctgtgcctc

SEQ ID NO: 2921789 - DNA, 16 bp, Homo sapiens
tgcccaggagagccag

SEQ ID NO: 2921790 - DNA, 20 bp, Homo sapiens
tgcccaggctggagtgcaat

SEQ ID NO: 2921791 - DNA, 15 bp, Homo sapiens
tgcccaggctggtct

SEQ ID NO: 2921792 - DNA, 16 bp, Homo sapiens
tgcccaggctggtctt

SEQ ID NO: 2921793 - DNA, 20 bp, Homo sapiens
tgcccaggctggtcttgaac

SEQ ID NO: 2921794 - DNA, 19 bp, Homo sapiens
tgcccatcatctctgcctt

SEQ ID NO: 2921795 - DNA, 20 bp, Homo sapiens
tgcccatcatctctgccttt

SEQ ID NO: 2921796 - DNA, 22 bp, Homo sapiens
tgcccatcatctctgcctttga

SEQ ID NO: 2921797 - DNA, 16 bp, Homo sapiens
tgcccatgagcaagcc

SEQ ID NO: 2921798 - DNA, 22 bp, Homo sapiens
tgcccatgatggtcacttaaaa

SEQ ID NO: 2921799 - DNA, 21 bp, Homo sapiens
tgcccattctgccctgtggga

SEQ ID NO: 2921800 - DNA, 21 bp, Homo sapiens
tgcccatttcgaagatataca

SEQ ID NO: 2921801 - DNA, 23 bp, Homo sapiens
tgcccatttcgaagatatacaaa

SEQ ID NO: 2921802 - DNA, 13 bp, Homo sapiens
tgccccaactcct

SEQ ID NO: 2921803 - DNA, 16 bp, Homo sapiens
tgccccaactcctgga

SEQ ID NO: 2921804 - DNA, 18 bp, Homo sapiens
tgccccacatgtggccat

SEQ ID NO: 2921805 - DNA, 22 bp, Homo sapiens
tgccccacatgtggccatggcc

SEQ ID NO: 2921806 - DNA, 20 bp, Homo sapiens
tgccccacccctccccatta

SEQ ID NO: 2921807 - DNA, 19 bp, Homo sapiens
tgccccactctgcctgcct

SEQ ID NO: 2921808 - DNA, 23 bp, Homo sapiens
tgccccagacagttcttttctac

SEQ ID NO: 2921809 - DNA, 18 bp, Homo sapiens
tgccccagactgagctct

SEQ ID NO: 2921810 - DNA, 12 bp, Homo sapiens
tgccccagccag

SEQ ID NO: 2921811 - DNA, 12 bp, Homo sapiens
tgccccaggccg

SEQ ID NO: 2921812 - DNA, 13 bp, Homo sapiens
tgccccaggccgg

SEQ ID NO: 2921813 - DNA, 21 bp, Homo sapiens
tgccccaggccggagcccaga

SEQ ID NO: 2921814 - DNA, 22 bp, Homo sapiens
tgccccaggccggagcccagat

SEQ ID NO: 2921815 - DNA, 16 bp, Homo sapiens
tgccccatcagtgctc

SEQ ID NO: 2921816 - DNA, 18 bp, Homo sapiens
tgccccatcagtgctccc

SEQ ID NO: 2921817 - DNA, 21 bp, Homo sapiens
tgccccatcagtgctccctca

SEQ ID NO: 2921818 - DNA, 17 bp, Homo sapiens
tgccccatcctccagca

SEQ ID NO: 2921819 - DNA, 14 bp, Homo sapiens
tgcccccagctggc

SEQ ID NO: 2921820 - DNA, 16 bp, Homo sapiens
tgctctttcaatgcag

SEQ ID NO: 2921821 - DNA, 13 bp, Homo sapiens
tgctctttcccag

SEQ ID NO: 2921822 - DNA, 16 bp, Homo sapiens
tgctctttcctgccct

SEQ ID NO: 2921823 - DNA, 16 bp, Homo sapiens
tgctgaaataaactag

SEQ ID NO: 2921824 - DNA, 22 bp, Homo sapiens
tgctgaacacacaccagtttac

SEQ ID NO: 2921825 - DNA, 19 bp, Homo sapiens
tgctgaacataacttctca

SEQ ID NO: 2921826 - DNA, 22 bp, Homo sapiens
tgctgaacataacttctcatgt

SEQ ID NO: 2921827 - DNA, 22 bp, Homo sapiens
tgctgaactaagttttgtgtgt

SEQ ID NO: 2921828 - DNA, 11 bp, Homo sapiens
tgctgaagctg

SEQ ID NO: 2921829 - DNA, 14 bp, Homo sapiens
tgctgaagctgctg

SEQ ID NO: 2921830 - DNA, 17 bp, Homo sapiens
tgctgacagctgctcct

SEQ ID NO: 2921831 - DNA, 18 bp, Homo sapiens
tgctgacagctgctccta

SEQ ID NO: 2921832 - DNA, 13 bp, Homo sapiens
tgctgacccacca

SEQ ID NO: 2921833 - DNA, 14 bp, Homo sapiens
tgctgacccaccaa

SEQ ID NO: 2921834 - DNA, 23 bp, Homo sapiens
tgctgacccaccaaggtctcaca

SEQ ID NO: 2921835 - DNA, 18 bp, Homo sapiens
tgctgacctcacctggtc

SEQ ID NO: 2921836 - DNA, 17 bp, Homo sapiens
tgctgacggccagggag

SEQ ID NO: 2921837 - DNA, 20 bp, Homo sapiens
tgctgacggccagggagaag

SEQ ID NO: 2921838 - DNA, 20 bp, Homo sapiens
tgctgactatttgaccccca

SEQ ID NO: 2921839 - DNA, 20 bp, Homo sapiens
tgctgactctctgagctggg

SEQ ID NO: 2921840 - DNA, 18 bp, Homo sapiens
tgctgagagacccaagga

SEQ ID NO: 2921841 - DNA, 21 bp, Homo sapiens
tgctgagagacccaaggagga

SEQ ID NO: 2921842 - DNA, 19 bp, Homo sapiens
tgctgagatacatacagaa

SEQ ID NO: 2921843 - DNA, 12 bp, Homo sapiens
tgctgagcctct

SEQ ID NO: 2921844 - DNA, 16 bp, Homo sapiens
tgctgagcctctgctc

SEQ ID NO: 2921845 - DNA, 21 bp, Homo sapiens
tgctgagggaccgagcccagc

SEQ ID NO: 2921846 - DNA, 12 bp, Homo sapiens
tgctgagggtgt

SEQ ID NO: 2921847 - DNA, 16 bp, Homo sapiens
tgctgagtgacagctt

SEQ ID NO: 2921848 - DNA, 15 bp, Homo sapiens
tgctgatcgccttat

SEQ ID NO: 2921849 - DNA, 14 bp, Homo sapiens
tgctgatgaatcac

SEQ ID NO: 2921850 - DNA, 23 bp, Homo sapiens
tgctgatgttcagtgtaatttct

SEQ ID NO: 2921851 - DNA, 18 bp, Homo sapiens
tgctgatttggtgaccaa

SEQ ID NO: 2921852 - DNA, 21 bp, Homo sapiens
tgctgcaaggacattcttgta

SEQ ID NO: 2921853 - DNA, 23 bp, Homo sapiens
tgctgcagcaccgaggggccttt

SEQ ID NO: 2921854 - DNA, 21 bp, Homo sapiens
tgctgcaggacttgagaagac

SEQ ID NO: 2921855 - DNA, 13 bp, Homo sapiens
tgctgcattcctt

SEQ ID NO: 2921856 - DNA, 23 bp, Homo sapiens
tgctgccaagtcctgcctttggg

SEQ ID NO: 2921857 - DNA, 16 bp, Homo sapiens
tgctgccactctgctg

SEQ ID NO: 2921858 - DNA, 18 bp, Homo sapiens
tgctgccactctgctgcc

SEQ ID NO: 2921859 - DNA, 19 bp, Homo sapiens
tgctgccactctgctgcct

SEQ ID NO: 2921860 - DNA, 20 bp, Homo sapiens
tgctgccactctgctgcctg

SEQ ID NO: 2921861 - DNA, 14 bp, Homo sapiens
tgctgccagggctt

SEQ ID NO: 2921862 - DNA, 23 bp, Homo sapiens
tgctgcccatgagcaagcctagg

SEQ ID NO: 2921863 - DNA, 18 bp, Homo sapiens
tgctgccccatcagtgct

SEQ ID NO: 2921864 - DNA, 21 bp, Homo sapiens
tgctgccccatcagtgctccc

SEQ ID NO: 2921865 - DNA, 17 bp, Homo sapiens
tgctgccccatgaagcc

SEQ ID NO: 2921866 - DNA, 24 bp, Homo sapiens
tgctgccccatgaagccacagccc

SEQ ID NO: 2921867 - DNA, 17 bp, Homo sapiens
tgctgcccctccctgcc

SEQ ID NO: 2921868 - DNA, 23 bp, Homo sapiens
tgctgcccggggtggggtgcact

SEQ ID NO: 2921869 - DNA, 20 bp, Homo sapiens
tgctgcccttggtttctggg

SEQ ID NO: 2921870 - DNA, 11 bp, Homo sapiens
tgctgcctggg

SEQ ID NO: 2921871 - DNA, 14 bp, Homo sapiens
tgctgcctgggtag

SEQ ID NO: 2921872 - DNA, 21 bp, Homo sapiens
tgctgcctgggtaggccccac

SEQ ID NO: 2921873 - DNA, 15 bp, Homo sapiens
tgctgcctgtacaga

SEQ ID NO: 2921874 - DNA, 20 bp, Homo sapiens
tgctgctcattccacactgt

SEQ ID NO: 2921875 - DNA, 22 bp, Homo sapiens
tgctgctcattccacactgttg

SEQ ID NO: 2921876 - DNA, 21 bp, Homo sapiens
tgctgctcctctttcccctcc

SEQ ID NO: 2921877 - DNA, 17 bp, Homo sapiens
tgctgctccttagctgc

SEQ ID NO: 2921878 - DNA, 15 bp, Homo sapiens
tgctgctgctgctca

SEQ ID NO: 2921879 - DNA, 18 bp, Homo sapiens
tgctgctggcctccctcc

SEQ ID NO: 2921880 - DNA, 12 bp, Homo sapiens
tgctgctggtgc

SEQ ID NO: 2921881 - DNA, 18 bp, Homo sapiens
tgctgctggtgcacagcc

SEQ ID NO: 2921882 - DNA, 14 bp, Homo sapiens
tgctgctgtggaaa

SEQ ID NO: 2921883 - DNA, 17 bp, Homo sapiens
tgctgcttgtgcctccc

SEQ ID NO: 2921884 - DNA, 22 bp, Homo sapiens
tgctgctttgttgttctgcctg

SEQ ID NO: 2921885 - DNA, 17 bp, Homo sapiens
tgctgcttttccttggg

SEQ ID NO: 2921886 - DNA, 20 bp, Homo sapiens
tgctgcttttccttggggca

SEQ ID NO: 2921887 - DNA, 18 bp, Homo sapiens
tgctggaaaataatactg

SEQ ID NO: 2921888 - DNA, 22 bp, Homo sapiens
tgctggaaaccaagtcaggcca

SEQ ID NO: 2921889 - DNA, 20 bp, Homo sapiens
tgctggagtttcatgtacaa

SEQ ID NO: 2921890 - DNA, 18 bp, Homo sapiens
tgctggatgtctgccaat

SEQ ID NO: 2921891 - DNA, 12 bp, Homo sapiens
tgctggcccagc

SEQ ID NO: 2921892 - DNA, 17 bp, Homo sapiens
tgctggcccagcatgga

SEQ ID NO: 2921893 - DNA, 12 bp, Homo sapiens
tgctggcccagg

SEQ ID NO: 2921894 - DNA, 16 bp, Homo sapiens
tgctggcccagggccc

SEQ ID NO: 2921895 - DNA, 19 bp, Homo sapiens
tgctggcccagggcccaga

SEQ ID NO: 2921896 - DNA, 21 bp, Homo sapiens
tgctggcccagggcccagagc

SEQ ID NO: 2921897 - DNA, 23 bp, Homo sapiens
tgctggcccagggcccagagccc

SEQ ID NO: 2921898 - DNA, 13 bp, Homo sapiens
tgctggcctccct

SEQ ID NO: 2921899 - DNA, 21 bp, Homo sapiens
tgctggcctccctccgtccct

SEQ ID NO: 2921900 - DNA, 14 bp, Homo sapiens
tgctggcctcttgg

SEQ ID NO: 2921901 - DNA, 12 bp, Homo sapiens
tgctggcctgct

SEQ ID NO: 2921902 - DNA, 13 bp, Homo sapiens
tgctggcctgctc

SEQ ID NO: 2921903 - DNA, 15 bp, Homo sapiens
tgctggcctgctctt

SEQ ID NO: 2921904 - DNA, 22 bp, Homo sapiens
tgctggccttggtatgtgccag

SEQ ID NO: 2921905 - DNA, 18 bp, Homo sapiens
tgctggcgacactcaggg

SEQ ID NO: 2921906 - DNA, 23 bp, Homo sapiens
tgctgggaggtataggggtcctg

SEQ ID NO: 2921907 - DNA, 20 bp, Homo sapiens
tgctgggctctccacctcag

SEQ ID NO: 2921908 - DNA, 15 bp, Homo sapiens
tgctggggcctcaga

SEQ ID NO: 2921909 - DNA, 15 bp, Homo sapiens
tgctgggggctcccc

SEQ ID NO: 2921910 - DNA, 21 bp, Homo sapiens
tgctggggtacacagtgagag

SEQ ID NO: 2921911 - DNA, 20 bp, Homo sapiens
tgctggggtctcaggtccag

SEQ ID NO: 2921912 - DNA, 17 bp, Homo sapiens
tgctggtagctgagggg

SEQ ID NO: 2921913 - DNA, 18 bp, Homo sapiens
tgctggttctgttttcta

SEQ ID NO: 2921914 - DNA, 20 bp, Homo sapiens
tgctgtaaataaatgcttta

SEQ ID NO: 2921915 - DNA, 15 bp, Homo sapiens
tgctgtaagatgtct

SEQ ID NO: 2921916 - DNA, 22 bp, Homo sapiens
tgctgtaagatgtctgtttgct

SEQ ID NO: 2921917 - DNA, 16 bp, Homo sapiens
tgctgtacatctattt

SEQ ID NO: 2921918 - DNA, 20 bp, Homo sapiens
tgctgtatgctgatcatcgc

SEQ ID NO: 2921919 - DNA, 15 bp, Homo sapiens
tgctgtccctgcact

SEQ ID NO: 2921920 - DNA, 20 bp, Homo sapiens
tgctgtccctgcactgtgcc

SEQ ID NO: 2921921 - DNA, 12 bp, Homo sapiens
tgctgtcctcag

SEQ ID NO: 2921922 - DNA, 19 bp, Homo sapiens
tgctgtcctcaggtggcca

SEQ ID NO: 2921923 - DNA, 17 bp, Homo sapiens
tgctgtctaacctgtga

SEQ ID NO: 2921924 - DNA, 18 bp, Homo sapiens
tgctgtctaacctgtgac

SEQ ID NO: 2921925 - DNA, 15 bp, Homo sapiens
tgctgtctagcctta

SEQ ID NO: 2921926 - DNA, 23 bp, Homo sapiens
tgctgtctagccttagtcaataa

SEQ ID NO: 2921927 - DNA, 14 bp, Homo sapiens
tgctgtctatgtgg

SEQ ID NO: 2921928 - DNA, 15 bp, Homo sapiens
tgctgtctctctggg

SEQ ID NO: 2921929 - DNA, 12 bp, Homo sapiens
tgctgtctgcag

SEQ ID NO: 2921930 - DNA, 14 bp, Homo sapiens
tgctgtgcgtggaa

SEQ ID NO: 2921931 - DNA, 13 bp, Homo sapiens
tgctgtgctggga

SEQ ID NO: 2921932 - DNA, 15 bp, Homo sapiens
tgctgtgctgtgcta

SEQ ID NO: 2921933 - DNA, 15 bp, Homo sapiens
tgctgtggtgtgtcc

SEQ ID NO: 2921934 - DNA, 12 bp, Homo sapiens
tgctgtgtaaag

SEQ ID NO: 2921935 - DNA, 13 bp, Homo sapiens
tgctgtgtaaagt

SEQ ID NO: 2921936 - DNA, 19 bp, Homo sapiens
tgctgtgtaatggttacac

SEQ ID NO: 2921937 - DNA, 20 bp, Homo sapiens
tgctgtgtggacggcgctgc

SEQ ID NO: 2921938 - DNA, 18 bp, Homo sapiens
tgctgtgtgtcccaggca

SEQ ID NO: 2921939 - DNA, 20 bp, Homo sapiens
tgctgttcgttcaaaagtgg

SEQ ID NO: 2921940 - DNA, 22 bp, Homo sapiens
tgctgttctcttgggaactgaa

SEQ ID NO: 2921941 - DNA, 18 bp, Homo sapiens
tgctgttgaactttttaa

SEQ ID NO: 2921942 - DNA, 15 bp, Homo sapiens
tgctgttgacatatt

SEQ ID NO: 2921943 - DNA, 16 bp, Homo sapiens
tgctgttgattgctaa

SEQ ID NO: 2921944 - DNA, 19 bp, Homo sapiens
tgctgttgattgctaaatg

SEQ ID NO: 2921945 - DNA, 21 bp, Homo sapiens
tgctgttggtcctctctctgt

SEQ ID NO: 2921946 - DNA, 16 bp, Homo sapiens
tgctgtttatgacaca

SEQ ID NO: 2921947 - DNA, 12 bp, Homo sapiens
tgctgtttcctt

SEQ ID NO: 2921948 - DNA, 19 bp, Homo sapiens
tgctgtttgtttgacaaag

SEQ ID NO: 2921949 - DNA, 19 bp, Homo sapiens
tgctgttttcctcccttct

SEQ ID NO: 2921950 - DNA, 21 bp, Homo sapiens
tgctgttttcctcccttctgc

SEQ ID NO: 2921951 - DNA, 17 bp, Homo sapiens
tgctgttttttgttttt

SEQ ID NO: 2921952 - DNA, 24 bp, Homo sapiens
tggcagaactgctggggctggtga

SEQ ID NO: 2921953 - DNA, 22 bp, Homo sapiens
tggcagagtttgtgtgttgtct

SEQ ID NO: 2921954 - DNA, 18 bp, Homo sapiens
tggcagattcccactgcc

SEQ ID NO: 2921955 - DNA, 22 bp, Homo sapiens
tggcagatttagtgaaagctag

SEQ ID NO: 2921956 - DNA, 18 bp, Homo sapiens
tggcagcacctgtctcct

SEQ ID NO: 2921957 - DNA, 17 bp, Homo sapiens
tggcagcacggcccggc

SEQ ID NO: 2921958 - DNA, 21 bp, Homo sapiens
tggcagcacggcccggcccct

SEQ ID NO: 2921959 - DNA, 23 bp, Homo sapiens
tggcagcacggcccggcccctca

SEQ ID NO: 2921960 - DNA, 14 bp, Homo sapiens
tggcagcaggcagc

SEQ ID NO: 2921961 - DNA, 20 bp, Homo sapiens
tggcagcaggcatggcttcc

SEQ ID NO: 2921962 - DNA, 16 bp, Homo sapiens
tggcagccacacgcag

SEQ ID NO: 2921963 - DNA, 14 bp, Homo sapiens
tggcagccccagca

SEQ ID NO: 2921964 - DNA, 21 bp, Homo sapiens
tggcagcctcccatccagggc

SEQ ID NO: 2921965 - DNA, 21 bp, Homo sapiens
tggcagctctggacagcccca

SEQ ID NO: 2921966 - DNA, 16 bp, Homo sapiens
tggcagctgccacgcc

SEQ ID NO: 2921967 - DNA, 13 bp, Homo sapiens
tggcagctgcccc

SEQ ID NO: 2921968 - DNA, 15 bp, Homo sapiens
tggcagctgcccctc

SEQ ID NO: 2921969 - DNA, 19 bp, Homo sapiens
tggcagctgcccctggcac

SEQ ID NO: 2921970 - DNA, 14 bp, Homo sapiens
tggcagctgggccc

SEQ ID NO: 2921971 - DNA, 15 bp, Homo sapiens
tggcagctgggccca

SEQ ID NO: 2921972 - DNA, 21 bp, Homo sapiens
tggcaggacacacatggtgag

SEQ ID NO: 2921973 - DNA, 17 bp, Homo sapiens
tggcaggaggagctgcc

SEQ ID NO: 2921974 - DNA, 19 bp, Homo sapiens
tggcagggcctagctgcta

SEQ ID NO: 2921975 - DNA, 20 bp, Homo sapiens
tggcagggggtgaaggcagg

SEQ ID NO: 2921976 - DNA, 21 bp, Homo sapiens
tggcaggggtggctgcctcat

SEQ ID NO: 2921977 - DNA, 16 bp, Homo sapiens
tggcaggtcactgtca

SEQ ID NO: 2921978 - DNA, 21 bp, Homo sapiens
tggcaggtcactgtcactgcc

SEQ ID NO: 2921979 - DNA, 19 bp, Homo sapiens
tggcagtgatcctgcaagt

SEQ ID NO: 2921980 - DNA, 14 bp, Homo sapiens
tggcagtgtttgta

SEQ ID NO: 2921981 - DNA, 16 bp, Homo sapiens
tggcatagtttcataa

SEQ ID NO: 2921982 - DNA, 23 bp, Homo sapiens
tggcatcctcttgaataggaaga

SEQ ID NO: 2921983 - DNA, 18 bp, Homo sapiens
tggcatctaattcttatt

SEQ ID NO: 2921984 - DNA, 21 bp, Homo sapiens
tggcatctgaatgaaaataac

SEQ ID NO: 2921985 - DNA, 18 bp, Homo sapiens
tggcatctgcaaaggaat

SEQ ID NO: 2921986 - DNA, 14 bp, Homo sapiens
tggcatctgtgtgt

SEQ ID NO: 2921987 - DNA, 22 bp, Homo sapiens
tggcatcttcgtcttcactctt

SEQ ID NO: 2921988 - DNA, 13 bp, Homo sapiens
tggcatcttgcca

SEQ ID NO: 2921989 - DNA, 18 bp, Homo sapiens
tggcatgagaaatacaaa

SEQ ID NO: 2921990 - DNA, 21 bp, Homo sapiens
tggcatgagaaatacaaaaat

SEQ ID NO: 2921991 - DNA, 12 bp, Homo sapiens
tggcatgcaaaa

SEQ ID NO: 2921992 - DNA, 20 bp, Homo sapiens
tggcatgcaaaagaaagcaa

SEQ ID NO: 2921993 - DNA, 22 bp, Homo sapiens
tggcatgcaaaagaaagcaaat

SEQ ID NO: 2921994 - DNA, 19 bp, Homo sapiens
tggcatgcgccaccatgcc

SEQ ID NO: 2921995 - DNA, 16 bp, Homo sapiens
tggcatggaaggggct

SEQ ID NO: 2921996 - DNA, 19 bp, Homo sapiens
tggcatgtgggttgtgata

SEQ ID NO: 2921997 - DNA, 16 bp, Homo sapiens
tggcatgtttaattgt

SEQ ID NO: 2921998 - DNA, 20 bp, Homo sapiens
tggcatttgctggcctggca

SEQ ID NO: 2921999 - DNA, 19 bp, Homo sapiens
tggcatttttagctccttg

SEQ ID NO: 2922000 - DNA, 15 bp, Homo sapiens
tggccaaagagcctt

SEQ ID NO: 2922001 - DNA, 14 bp, Homo sapiens
tggccaacatggtg

SEQ ID NO: 2922002 - DNA, 15 bp, Homo sapiens
tggccaagagaaggg

SEQ ID NO: 2922003 - DNA, 22 bp, Homo sapiens
tggccaaggagaggagttcttt

SEQ ID NO: 2922004 - DNA, 17 bp, Homo sapiens
tggccaaggagctgcta

SEQ ID NO: 2922005 - DNA, 19 bp, Homo sapiens
tggccacaaattctttgac

SEQ ID NO: 2922006 - DNA, 16 bp, Homo sapiens
tggccacactgtgaca

SEQ ID NO: 2922007 - DNA, 23 bp, Homo sapiens
tggccacagcccatccatagtaa

SEQ ID NO: 2922008 - DNA, 16 bp, Homo sapiens
tggccacagcgtgctg

SEQ ID NO: 2922009 - DNA, 17 bp, Homo sapiens
tggccacagcgtgctgg

SEQ ID NO: 2922010 - DNA, 17 bp, Homo sapiens
tggccacagtagtcttg

SEQ ID NO: 2922011 - DNA, 21 bp, Homo sapiens
tggccacattttcagccaaag

SEQ ID NO: 2922012 - DNA, 17 bp, Homo sapiens
tggccaccacccaacct

SEQ ID NO: 2922013 - DNA, 23 bp, Homo sapiens
tggccaccacccaacctgtcctt

SEQ ID NO: 2922014 - DNA, 17 bp, Homo sapiens
tggccaccttttcagcg

SEQ ID NO: 2922015 - DNA, 14 bp, Homo sapiens
tggccacggcccag

SEQ ID NO: 2922016 - DNA, 15 bp, Homo sapiens
tggccacggcccagg

SEQ ID NO: 2922017 - DNA, 17 bp, Homo sapiens
tggccacgttcagggag

SEQ ID NO: 2922018 - DNA, 18 bp, Homo sapiens
tggccacgttcagggagg

SEQ ID NO: 2922019 - DNA, 19 bp, Homo sapiens
tggccacgttcagggaggg

SEQ ID NO: 2922020 - DNA, 19 bp, Homo sapiens
tggccactgaaaagctttc

SEQ ID NO: 2922021 - DNA, 18 bp, Homo sapiens
tggccactgctcttgtga

SEQ ID NO: 2922022 - DNA, 15 bp, Homo sapiens
tggccagactcgatg

SEQ ID NO: 2922023 - DNA, 14 bp, Homo sapiens
tggccagatgcggg

SEQ ID NO: 2922024 - DNA, 24 bp, Homo sapiens
tggccagccgctctcctgccacat

SEQ ID NO: 2922025 - DNA, 20 bp, Homo sapiens
tggccagcgccagggcccag

SEQ ID NO: 2922026 - DNA, 14 bp, Homo sapiens
tggccaggccctgg

SEQ ID NO: 2922027 - DNA, 19 bp, Homo sapiens
tggccaggcctcttggcag

SEQ ID NO: 2922028 - DNA, 13 bp, Homo sapiens
tggccaggctggt

SEQ ID NO: 2922029 - DNA, 20 bp, Homo sapiens
tggccagggccacgctccag

SEQ ID NO: 2922030 - DNA, 16 bp, Homo sapiens
tggccagtcctggtcc

SEQ ID NO: 2922031 - DNA, 17 bp, Homo sapiens
tggccagtcctggtcct

SEQ ID NO: 2922032 - DNA, 20 bp, Homo sapiens
tggccagtcctggtcctggc

SEQ ID NO: 2922033 - DNA, 21 bp, Homo sapiens
tggccagtcctggtcctggct

SEQ ID NO: 2922034 - DNA, 21 bp, Homo sapiens
tggccagtcttcctcttagcc

SEQ ID NO: 2922035 - DNA, 22 bp, Homo sapiens
tggccagtcttcctcttagcct

SEQ ID NO: 2922036 - DNA, 16 bp, Homo sapiens
tggccagtgacgtggt

SEQ ID NO: 2922037 - DNA, 15 bp, Homo sapiens
tggccagtgctgccc

SEQ ID NO: 2922038 - DNA, 14 bp, Homo sapiens
tggccagttttctg

SEQ ID NO: 2922039 - DNA, 21 bp, Homo sapiens
tggccagttttctgttcagct

SEQ ID NO: 2922040 - DNA, 18 bp, Homo sapiens
tggccatgcctcagccct

SEQ ID NO: 2922041 - DNA, 20 bp, Homo sapiens
tggccattctttttttcttg

SEQ ID NO: 2922042 - DNA, 23 bp, Homo sapiens
tggccattctttttttcttggcc

SEQ ID NO: 2922043 - DNA, 22 bp, Homo sapiens
tggcccaagactgggctgtagt

SEQ ID NO: 2922044 - DNA, 13 bp, Homo sapiens
tggcccaatgcct

SEQ ID NO: 2922045 - DNA, 16 bp, Homo sapiens
tggcccactgctggct

SEQ ID NO: 2922046 - DNA, 11 bp, Homo sapiens
tggcccagaga

SEQ ID NO: 2922047 - DNA, 16 bp, Homo sapiens
tggcccaggagctctg

SEQ ID NO: 2922048 - DNA, 17 bp, Homo sapiens
tggcccaggagctctgc

SEQ ID NO: 2922049 - DNA, 22 bp, Homo sapiens
tggcccaggagctctgcgccag

SEQ ID NO: 2922050 - DNA, 12 bp, Homo sapiens
tggcccaggcct

SEQ ID NO: 2922051 - DNA, 14 bp, Homo sapiens
tggcccagggccca

SEQ ID NO: 2922052 - DNA, 20 bp, Homo sapiens
tggcccagggcccagagccc

SEQ ID NO: 2922053 - DNA, 21 bp, Homo sapiens
tggcccagggcccagagccca

SEQ ID NO: 2922054 - DNA, 17 bp, Homo sapiens
tggcccagggggcctgg

SEQ ID NO: 2922055 - DNA, 17 bp, Homo sapiens
tggcccaggtgagtcct

SEQ ID NO: 2922056 - DNA, 15 bp, Homo sapiens
tggcccaggtggcta

SEQ ID NO: 2922057 - DNA, 16 bp, Homo sapiens
tggcccaggtggctat

SEQ ID NO: 2922058 - DNA, 20 bp, Homo sapiens
tggcccaggtggctattttg

SEQ ID NO: 2922059 - DNA, 20 bp, Homo sapiens
tggccccaggacctggctgc

SEQ ID NO: 2922060 - DNA, 19 bp, Homo sapiens
tggccccatgtctctcaga

SEQ ID NO: 2922061 - DNA, 20 bp, Homo sapiens
tggccccctcagctctgtcc

SEQ ID NO: 2922062 - DNA, 13 bp, Homo sapiens
tggccccgccgcc

SEQ ID NO: 2922063 - DNA, 15 bp, Homo sapiens
tggccccgccgcctg

SEQ ID NO: 2922064 - DNA, 21 bp, Homo sapiens
tggccccgccgcctggtactc

SEQ ID NO: 2922065 - DNA, 15 bp, Homo sapiens
tggccccgcctgcct

SEQ ID NO: 2922066 - DNA, 21 bp, Homo sapiens
tggcccctcgaccctgtgcag

SEQ ID NO: 2922067 - DNA, 18 bp, Homo sapiens
tggcccctgtctcggggc

SEQ ID NO: 2922068 - DNA, 23 bp, Homo sapiens
tggcccgtggcctggcatctgtg

SEQ ID NO: 2922069 - DNA, 23 bp, Homo sapiens
tggcccgtggcttggcatctgtg

SEQ ID NO: 2922070 - DNA, 14 bp, Homo sapiens
tggccctgactgtc

SEQ ID NO: 2922071 - DNA, 15 bp, Homo sapiens
tggccctgcccctcc

SEQ ID NO: 2922072 - DNA, 17 bp, Homo sapiens
tggccctgcccctcccc

SEQ ID NO: 2922073 - DNA, 11 bp, Homo sapiens
tggccctgcct

SEQ ID NO: 2922074 - DNA, 12 bp, Homo sapiens
tggccctgcctt

SEQ ID NO: 2922075 - DNA, 16 bp, Homo sapiens
tggccctgtctggagg

SEQ ID NO: 2922076 - DNA, 12 bp, Homo sapiens
tggccctgtgca

SEQ ID NO: 2922077 - DNA, 17 bp, Homo sapiens
tggccctgtgcagacct

SEQ ID NO: 2922078 - DNA, 21 bp, Homo sapiens
tggccctgttctcctccccaa

SEQ ID NO: 2922079 - DNA, 17 bp, Homo sapiens
tggccgcacgcctctcc

SEQ ID NO: 2922080 - DNA, 18 bp, Homo sapiens
tggccgccatctgcgcag

SEQ ID NO: 2922081 - DNA, 20 bp, Homo sapiens
tggccgccatctgcgcaggg

SEQ ID NO: 2922082 - DNA, 15 bp, Homo sapiens
tggccgcccctgagg

SEQ ID NO: 2922083 - DNA, 12 bp, Homo sapiens
tggggtcctggc

SEQ ID NO: 2922084 - DNA, 15 bp, Homo sapiens
tggggtcctggccat

SEQ ID NO: 2922085 - DNA, 19 bp, Homo sapiens
tggggtcctggccatccca

SEQ ID NO: 2922086 - DNA, 17 bp, Homo sapiens
tggggtctcaggtccag

SEQ ID NO: 2922087 - DNA, 17 bp, Homo sapiens
tggggtctggcagcctc

SEQ ID NO: 2922088 - DNA, 19 bp, Homo sapiens
tggggtgagaattgggcgg

SEQ ID NO: 2922089 - DNA, 18 bp, Homo sapiens
tggggtgatggccagagg

SEQ ID NO: 2922090 - DNA, 13 bp, Homo sapiens
tggggtgggggcc

SEQ ID NO: 2922091 - DNA, 15 bp, Homo sapiens
tggggtgtgggaggc

SEQ ID NO: 2922092 - DNA, 22 bp, Homo sapiens
tggggttatagaaggtcagcaa

SEQ ID NO: 2922093 - DNA, 15 bp, Homo sapiens
tggggtttcgcagcc

SEQ ID NO: 2922094 - DNA, 18 bp, Homo sapiens
tggggtttcgcagcctga

SEQ ID NO: 2922095 - DNA, 17 bp, Homo sapiens
tgggtaacttagaagga

SEQ ID NO: 2922096 - DNA, 18 bp, Homo sapiens
tgggtaatcgatggggga

SEQ ID NO: 2922097 - DNA, 20 bp, Homo sapiens
tgggtaatttagattgtaaa

SEQ ID NO: 2922098 - DNA, 16 bp, Homo sapiens
tgggtacctgcaagca

SEQ ID NO: 2922099 - DNA, 12 bp, Homo sapiens
tgggtagaagcc

SEQ ID NO: 2922100 - DNA, 15 bp, Homo sapiens
tgggtagaagccacc

SEQ ID NO: 2922101 - DNA, 19 bp, Homo sapiens
tgggtagaagccacccttc

SEQ ID NO: 2922102 - DNA, 21 bp, Homo sapiens
tgggtagaagccacccttccc

SEQ ID NO: 2922103 - DNA, 14 bp, Homo sapiens
tgggtagtgcttta

SEQ ID NO: 2922104 - DNA, 21 bp, Homo sapiens
tgggtcacagagtgagactcc

SEQ ID NO: 2922105 - DNA, 17 bp, Homo sapiens
tgggtcagacccatctc

SEQ ID NO: 2922106 - DNA, 19 bp, Homo sapiens
tgggtcagatttatttgtt

SEQ ID NO: 2922107 - DNA, 20 bp, Homo sapiens
tgggtccaggggatgggagg

SEQ ID NO: 2922108 - DNA, 19 bp, Homo sapiens
tgggtcctcggcccatctg

SEQ ID NO: 2922109 - DNA, 23 bp, Homo sapiens
tgggtcctcggcccatctgtcca

SEQ ID NO: 2922110 - DNA, 12 bp, Homo sapiens
tgggtcctgcct

SEQ ID NO: 2922111 - DNA, 11 bp, Homo sapiens
tgggtcctggg

SEQ ID NO: 2922112 - DNA, 13 bp, Homo sapiens
tgggtcctggggt

SEQ ID NO: 2922113 - DNA, 15 bp, Homo sapiens
tgggtccttgggcct

SEQ ID NO: 2922114 - DNA, 14 bp, Homo sapiens
tgggtctattccag

SEQ ID NO: 2922115 - DNA, 16 bp, Homo sapiens
tgggtctattccagct

SEQ ID NO: 2922116 - DNA, 19 bp, Homo sapiens
tgggtctattccagctcat

SEQ ID NO: 2922117 - DNA, 13 bp, Homo sapiens
tgggtctgacctg

SEQ ID NO: 2922118 - DNA, 16 bp, Homo sapiens
tgggtctgacctggtg

SEQ ID NO: 2922119 - DNA, 18 bp, Homo sapiens
tgggtctgacctggtggg

SEQ ID NO: 2922120 - DNA, 15 bp, Homo sapiens
tgggtgagctcttcc

SEQ ID NO: 2922121 - DNA, 16 bp, Homo sapiens
tgggtgaggtaataaa

SEQ ID NO: 2922122 - DNA, 16 bp, Homo sapiens
tgggtgatttctagaa

SEQ ID NO: 2922123 - DNA, 16 bp, Homo sapiens
tgggtggagaagccat

SEQ ID NO: 2922124 - DNA, 22 bp, Homo sapiens
tgggtggagaagccattgtctt

SEQ ID NO: 2922125 - DNA, 12 bp, Homo sapiens
tgggtgggagag

SEQ ID NO: 2922126 - DNA, 14 bp, Homo sapiens
tgggtggtttgtga

SEQ ID NO: 2922127 - DNA, 15 bp, Homo sapiens
tgggtggtttttatt

SEQ ID NO: 2922128 - DNA, 22 bp, Homo sapiens
tgggtgttgaccactccagaga

SEQ ID NO: 2922129 - DNA, 23 bp, Homo sapiens
tgggttcctttttcaacttggaa

SEQ ID NO: 2922130 - DNA, 14 bp, Homo sapiens
tgggttctgcctgc

SEQ ID NO: 2922131 - DNA, 22 bp, Homo sapiens
tgggttgattctcgactgcttt

SEQ ID NO: 2922132 - DNA, 16 bp, Homo sapiens
tgggttgcagacagga

SEQ ID NO: 2922133 - DNA, 14 bp, Homo sapiens
tgggtttggcccaa

SEQ ID NO: 2922134 - DNA, 16 bp, Homo sapiens
tgggtttggcccctgg

SEQ ID NO: 2922135 - DNA, 20 bp, Homo sapiens
tgggtttggcccctggaacc

SEQ ID NO: 2922136 - DNA, 18 bp, Homo sapiens
tgggttttccgcccacag

SEQ ID NO: 2922137 - DNA, 24 bp, Homo sapiens
tgggttttcttcccatcactggag

SEQ ID NO: 2922138 - DNA, 19 bp, Homo sapiens
tgggttttgtattctctga

SEQ ID NO: 2922139 - DNA, 21 bp, Homo sapiens
tgggttttgtattctctgagc

SEQ ID NO: 2922140 - DNA, 15 bp, Homo sapiens
tgggtttttaactca

SEQ ID NO: 2922141 - DNA, 13 bp, Homo sapiens
tggtaaatgccac

SEQ ID NO: 2922142 - DNA, 20 bp, Homo sapiens
tggtaactttgcaggcggcc

SEQ ID NO: 2922143 - DNA, 19 bp, Homo sapiens
tggtaagagttaaagagta

SEQ ID NO: 2922144 - DNA, 13 bp, Homo sapiens
tggtaatatatat

SEQ ID NO: 2922145 - DNA, 16 bp, Homo sapiens
tggtaatatatatatt

SEQ ID NO: 2922146 - DNA, 15 bp, Homo sapiens
tggtaatcttgctct

SEQ ID NO: 2922147 - DNA, 19 bp, Homo sapiens
tggtaatgatgttgataat

SEQ ID NO: 2922148 - DNA, 15 bp, Homo sapiens
tggtaattgtacaat

SEQ ID NO: 2922149 - DNA, 15 bp, Homo sapiens
tggtacaaaaataaa

SEQ ID NO: 2922150 - DNA, 19 bp, Homo sapiens
tggtacaaaaataaattta

SEQ ID NO: 2922151 - DNA, 21 bp, Homo sapiens
tggtacaaaaataaatttata

SEQ ID NO: 2922152 - DNA, 21 bp, Homo sapiens
tggtaccaatcatgaatcttt

SEQ ID NO: 2922153 - DNA, 18 bp, Homo sapiens
tggtaccagataaaatta

SEQ ID NO: 2922154 - DNA, 15 bp, Homo sapiens
tggtacctatttgac

SEQ ID NO: 2922155 - DNA, 12 bp, Homo sapiens
tggtacctggac

SEQ ID NO: 2922156 - DNA, 16 bp, Homo sapiens
tggtactaaggagaat

SEQ ID NO: 2922157 - DNA, 17 bp, Homo sapiens
tggtagaggtgtgtgcc

SEQ ID NO: 2922158 - DNA, 20 bp, Homo sapiens
tggtagattcgctgtcccct

SEQ ID NO: 2922159 - DNA, 21 bp, Homo sapiens
tggtaggtagtgattaactgt

SEQ ID NO: 2922160 - DNA, 18 bp, Homo sapiens
tggtagtaaaacacagag

SEQ ID NO: 2922161 - DNA, 14 bp, Homo sapiens
tggtatgaaacaaa

SEQ ID NO: 2922162 - DNA, 12 bp, Homo sapiens
tggtatgagaca

SEQ ID NO: 2922163 - DNA, 15 bp, Homo sapiens
tggtatgtgccaggc

SEQ ID NO: 2922164 - DNA, 14 bp, Homo sapiens
tggtattctgtcat

SEQ ID NO: 2922165 - DNA, 16 bp, Homo sapiens
tggtcaaacaaactct

SEQ ID NO: 2922166 - DNA, 16 bp, Homo sapiens
tggtcacacactgatg

SEQ ID NO: 2922167 - DNA, 10 bp, Homo sapiens
tggtcacatg

SEQ ID NO: 2922168 - DNA, 15 bp, Homo sapiens
tggtcacccagacta

SEQ ID NO: 2922169 - DNA, 15 bp, Homo sapiens
tggtcactatagctc

SEQ ID NO: 2922170 - DNA, 17 bp, Homo sapiens
tggtcactctgccctct

SEQ ID NO: 2922171 - DNA, 22 bp, Homo sapiens
tggtcagccctagggtggagag

SEQ ID NO: 2922172 - DNA, 18 bp, Homo sapiens
tggtcagcggtatgtgcg

SEQ ID NO: 2922173 - DNA, 13 bp, Homo sapiens
tggtcaggctggt

SEQ ID NO: 2922174 - DNA, 21 bp, Homo sapiens
tggtcatccttggtgctcttg

SEQ ID NO: 2922175 - DNA, 19 bp, Homo sapiens
tggtcattcctaatgcatt

SEQ ID NO: 2922176 - DNA, 15 bp, Homo sapiens
tggtccagcttgctc

SEQ ID NO: 2922177 - DNA, 19 bp, Homo sapiens
tggtcccacccaggaaggg

SEQ ID NO: 2922178 - DNA, 17 bp, Homo sapiens
tggtcccaggaagcagg

SEQ ID NO: 2922179 - DNA, 19 bp, Homo sapiens
tggtccctgggaggaaatt

SEQ ID NO: 2922180 - DNA, 19 bp, Homo sapiens
tggtcctcattcaaaggga

SEQ ID NO: 2922181 - DNA, 15 bp, Homo sapiens
tggtcctctctctgt

SEQ ID NO: 2922182 - DNA, 16 bp, Homo sapiens
tggtcctctctctgtg

SEQ ID NO: 2922183 - DNA, 22 bp, Homo sapiens
tggtcctctctctgtggggctg

SEQ ID NO: 2922184 - DNA, 17 bp, Homo sapiens
tggtcctggctgcactc

SEQ ID NO: 2922185 - DNA, 15 bp, Homo sapiens
tggtcctgtctgtcc

SEQ ID NO: 2922186 - DNA, 16 bp, Homo sapiens
tggtcctgtctgtcct

SEQ ID NO: 2922187 - DNA, 18 bp, Homo sapiens
tggtcctgtctgtccttc

SEQ ID NO: 2922188 - DNA, 15 bp, Homo sapiens
tggtccttcactggc

SEQ ID NO: 2922189 - DNA, 18 bp, Homo sapiens
tggtccttcactggcgcc

SEQ ID NO: 2922190 - DNA, 19 bp, Homo sapiens
tggtccttcactggcgcct

SEQ ID NO: 2922191 - DNA, 14 bp, Homo sapiens
tggtctatgttccg

SEQ ID NO: 2922192 - DNA, 19 bp, Homo sapiens
tggtctcaaactcctgact

SEQ ID NO: 2922193 - DNA, 14 bp, Homo sapiens
tggtctcctctcag

SEQ ID NO: 2922194 - DNA, 15 bp, Homo sapiens
tggtctcctctcagc

SEQ ID NO: 2922195 - DNA, 20 bp, Homo sapiens
tggtctcgaactcctgacct

SEQ ID NO: 2922196 - DNA, 22 bp, Homo sapiens
tggtctcgatgctgctggcctc

SEQ ID NO: 2922197 - DNA, 13 bp, Homo sapiens
tggtctctggctc

SEQ ID NO: 2922198 - DNA, 19 bp, Homo sapiens
tggtctcttcttggggccc

SEQ ID NO: 2922199 - DNA, 18 bp, Homo sapiens
tggtctgagctgtcccaa

SEQ ID NO: 2922200 - DNA, 14 bp, Homo sapiens
tggtcttaggtctt

SEQ ID NO: 2922201 - DNA, 20 bp, Homo sapiens
tggtcttaggtcttcctgtg

SEQ ID NO: 2922202 - DNA, 20 bp, Homo sapiens
tggtcttggaattccatttg

SEQ ID NO: 2922203 - DNA, 16 bp, Homo sapiens
tggtctttttcctgaa

SEQ ID NO: 2922204 - DNA, 21 bp, Homo sapiens
tggtgacagccttgggccttt

SEQ ID NO: 2922205 - DNA, 15 bp, Homo sapiens
tggtgaccagtttct

SEQ ID NO: 2922206 - DNA, 14 bp, Homo sapiens
tggtgacttttgaa

SEQ ID NO: 2922207 - DNA, 19 bp, Homo sapiens
tggtgagaactgaggagcg

SEQ ID NO: 2922208 - DNA, 17 bp, Homo sapiens
tggtgagatgcagctgg

SEQ ID NO: 2922209 - DNA, 16 bp, Homo sapiens
tggtgaggccggccct

SEQ ID NO: 2922210 - DNA, 18 bp, Homo sapiens
tggtgaggccggccctgc

SEQ ID NO: 2922211 - DNA, 22 bp, Homo sapiens
tggtgaggccggccctgcccct

SEQ ID NO: 2922212 - DNA, 22 bp, Homo sapiens
tggtgataatcgtcttcaaatt

SEQ ID NO: 2922213 - DNA, 19 bp, Homo sapiens
tggtgatccaaacaaaatg

SEQ ID NO: 2922214 - DNA, 19 bp, Homo sapiens
tggtgcaaaggagccgcca

SEQ ID NO: 2922215 - DNA, 20 bp, Homo sapiens
tggtgcaaggccatctgctt

SEQ ID NO: 2922216 - DNA, 18 bp, Homo sapiens
tgtattttccaagtgtgc

SEQ ID NO: 2922217 - DNA, 16 bp, Homo sapiens
tgtattttctgtcact

SEQ ID NO: 2922218 - DNA, 17 bp, Homo sapiens
tgtattttctgtcactg

SEQ ID NO: 2922219 - DNA, 19 bp, Homo sapiens
tgtattttctgtcactgta

SEQ ID NO: 2922220 - DNA, 18 bp, Homo sapiens
tgtattttgaaaacactt

SEQ ID NO: 2922221 - DNA, 14 bp, Homo sapiens
tgtattttgagttt

SEQ ID NO: 2922222 - DNA, 22 bp, Homo sapiens
tgtattttgtaaataataaaat

SEQ ID NO: 2922223 - DNA, 18 bp, Homo sapiens
tgtattttgttttccttt

SEQ ID NO: 2922224 - DNA, 17 bp, Homo sapiens
tgtatttttaaagcatg

SEQ ID NO: 2922225 - DNA, 18 bp, Homo sapiens
tgtattttttcttgcatt

SEQ ID NO: 2922226 - DNA, 19 bp, Homo sapiens
tgtattttttcttgcattg

SEQ ID NO: 2922227 - DNA, 16 bp, Homo sapiens
tgtcaaacaaagccag

SEQ ID NO: 2922228 - DNA, 16 bp, Homo sapiens
tgtcaaactgtagaaa

SEQ ID NO: 2922229 - DNA, 12 bp, Homo sapiens
tgtcaaagaagg

SEQ ID NO: 2922230 - DNA, 16 bp, Homo sapiens
tgtcaaagatatgtta

SEQ ID NO: 2922231 - DNA, 15 bp, Homo sapiens
tgtcaaccagacaga

SEQ ID NO: 2922232 - DNA, 20 bp, Homo sapiens
tgtcaagagtagttatataa

SEQ ID NO: 2922233 - DNA, 22 bp, Homo sapiens
tgtcaagagtagttatataatt

SEQ ID NO: 2922234 - DNA, 13 bp, Homo sapiens
tgtcaagcatatt

SEQ ID NO: 2922235 - DNA, 16 bp, Homo sapiens
tgtcaagcatattgga

SEQ ID NO: 2922236 - DNA, 19 bp, Homo sapiens
tgtcaagctggtgtcttca

SEQ ID NO: 2922237 - DNA, 17 bp, Homo sapiens
tgtcaatttatgaatat

SEQ ID NO: 2922238 - DNA, 22 bp, Homo sapiens
tgtcaatttgttggagatgcag

SEQ ID NO: 2922239 - DNA, 13 bp, Homo sapiens
tgtcacaattctt

SEQ ID NO: 2922240 - DNA, 14 bp, Homo sapiens
tgtcaccaaggaaa

SEQ ID NO: 2922241 - DNA, 18 bp, Homo sapiens
tgtcaccacatcttgtct

SEQ ID NO: 2922242 - DNA, 17 bp, Homo sapiens
tgtcaccccagagccac

SEQ ID NO: 2922243 - DNA, 18 bp, Homo sapiens
tgtcaccccagagccaca

SEQ ID NO: 2922244 - DNA, 19 bp, Homo sapiens
tgtcaccccagagccacac

SEQ ID NO: 2922245 - DNA, 14 bp, Homo sapiens
tgtcaccctggcca

SEQ ID NO: 2922246 - DNA, 15 bp, Homo sapiens
tgtcaccctggccac

SEQ ID NO: 2922247 - DNA, 12 bp, Homo sapiens
tgtcacctttct

SEQ ID NO: 2922248 - DNA, 14 bp, Homo sapiens
tgtcacgccagact

SEQ ID NO: 2922249 - DNA, 17 bp, Homo sapiens
tgtcactcaaggcggtg

SEQ ID NO: 2922250 - DNA, 22 bp, Homo sapiens
tgtcactcaaggcggtgcttga

SEQ ID NO: 2922251 - DNA, 15 bp, Homo sapiens
tgtcactcaggctgg

SEQ ID NO: 2922252 - DNA, 16 bp, Homo sapiens
tgtcactgcttttggc

SEQ ID NO: 2922253 - DNA, 19 bp, Homo sapiens
tgtcactgcttttggcctg

SEQ ID NO: 2922254 - DNA, 21 bp, Homo sapiens
tgtcactgcttttggcctgga

SEQ ID NO: 2922255 - DNA, 22 bp, Homo sapiens
tgtcactgtccaggtaggaaac

SEQ ID NO: 2922256 - DNA, 19 bp, Homo sapiens
tgtcactgtccctcctggt

SEQ ID NO: 2922257 - DNA, 22 bp, Homo sapiens
tgtcactgtccctcctggtgtc

SEQ ID NO: 2922258 - DNA, 15 bp, Homo sapiens
tgtcacttgcatgtc

SEQ ID NO: 2922259 - DNA, 17 bp, Homo sapiens
tgtcagaattaaaataa

SEQ ID NO: 2922260 - DNA, 17 bp, Homo sapiens
tgtcagagcccagccca

SEQ ID NO: 2922261 - DNA, 19 bp, Homo sapiens
tgtcagagcccaggggaga

SEQ ID NO: 2922262 - DNA, 20 bp, Homo sapiens
tgtcagaggcacaaaagggt

SEQ ID NO: 2922263 - DNA, 10 bp, Homo sapiens
tgtcagcatc

SEQ ID NO: 2922264 - DNA, 16 bp, Homo sapiens
tgtcagcatctgacca

SEQ ID NO: 2922265 - DNA, 17 bp, Homo sapiens
tgtcagcatctgaccat

SEQ ID NO: 2922266 - DNA, 22 bp, Homo sapiens
tgtcagcatctgaccatctgtg

SEQ ID NO: 2922267 - DNA, 23 bp, Homo sapiens
tgtcagcatctgaccatctgtga

SEQ ID NO: 2922268 - DNA, 21 bp, Homo sapiens
tgtcagcatgacaaaagtgac

SEQ ID NO: 2922269 - DNA, 18 bp, Homo sapiens
tgtcagccaacattgcct

SEQ ID NO: 2922270 - DNA, 20 bp, Homo sapiens
tgtcagccattgcacccagc

SEQ ID NO: 2922271 - DNA, 17 bp, Homo sapiens
tgtcagctgctgttgaa

SEQ ID NO: 2922272 - DNA, 21 bp, Homo sapiens
tgtcaggaaacatatttaaga

SEQ ID NO: 2922273 - DNA, 20 bp, Homo sapiens
tgtcaggcccgtcggagctg

SEQ ID NO: 2922274 - DNA, 23 bp, Homo sapiens
tgtcaggcccgtcggagctgcct

SEQ ID NO: 2922275 - DNA, 21 bp, Homo sapiens
tgtcaggccctctgcctgcac

SEQ ID NO: 2922276 - DNA, 22 bp, Homo sapiens
tgtcagggaacatatttaagga

SEQ ID NO: 2922277 - DNA, 14 bp, Homo sapiens
tgtcagggagggcc

SEQ ID NO: 2922278 - DNA, 15 bp, Homo sapiens
tgtcagggagggcca

SEQ ID NO: 2922279 - DNA, 17 bp, Homo sapiens
tgtcagggagggccagg

SEQ ID NO: 2922280 - DNA, 22 bp, Homo sapiens
tgtcagtcacagccacccctga

SEQ ID NO: 2922281 - DNA, 12 bp, Homo sapiens
tgtcagtgtgaa

SEQ ID NO: 2922282 - DNA, 16 bp, Homo sapiens
tgtcataagcattact

SEQ ID NO: 2922283 - DNA, 20 bp, Homo sapiens
tgtcataagcattactttat

SEQ ID NO: 2922284 - DNA, 13 bp, Homo sapiens
tgtcatcagaggg

SEQ ID NO: 2922285 - DNA, 17 bp, Homo sapiens
tgtcatcgttccccacc

SEQ ID NO: 2922286 - DNA, 20 bp, Homo sapiens
tgtcatcgttccccacccct

SEQ ID NO: 2922287 - DNA, 13 bp, Homo sapiens
tgtcatctgtgca

SEQ ID NO: 2922288 - DNA, 22 bp, Homo sapiens
tgtcatgcttcatcattccctc

SEQ ID NO: 2922289 - DNA, 16 bp, Homo sapiens
tgtcatgtttattcta

SEQ ID NO: 2922290 - DNA, 18 bp, Homo sapiens
tgtcatgtttattctaat

SEQ ID NO: 2922291 - DNA, 15 bp, Homo sapiens
tgtcattaacacatt

SEQ ID NO: 2922292 - DNA, 22 bp, Homo sapiens
tgtcattaaccatctttaatca

SEQ ID NO: 2922293 - DNA, 13 bp, Homo sapiens
tgtcattatttga

SEQ ID NO: 2922294 - DNA, 21 bp, Homo sapiens
tgtcattatttgataacattt

SEQ ID NO: 2922295 - DNA, 20 bp, Homo sapiens
tgtcatttagttcagcatcc

SEQ ID NO: 2922296 - DNA, 21 bp, Homo sapiens
tgtcattttggcatctgcaaa

SEQ ID NO: 2922297 - DNA, 14 bp, Homo sapiens
tgtcatttttcctt

SEQ ID NO: 2922298 - DNA, 17 bp, Homo sapiens
tgtcatttttccttcct

SEQ ID NO: 2922299 - DNA, 16 bp, Homo sapiens
tgtccaaaatttatat

SEQ ID NO: 2922300 - DNA, 17 bp, Homo sapiens
tgtccaaaatttatatt

SEQ ID NO: 2922301 - DNA, 18 bp, Homo sapiens
tgtccaaaatttatattt

SEQ ID NO: 2922302 - DNA, 21 bp, Homo sapiens
tgtccaaacaggtgctggccc

SEQ ID NO: 2922303 - DNA, 17 bp, Homo sapiens
tgtccaaaccagcaaac

SEQ ID NO: 2922304 - DNA, 17 bp, Homo sapiens
tgtccaacccctccccc

SEQ ID NO: 2922305 - DNA, 14 bp, Homo sapiens
tgtccaactaaaaa

SEQ ID NO: 2922306 - DNA, 18 bp, Homo sapiens
tgtccacatccccagagc

SEQ ID NO: 2922307 - DNA, 15 bp, Homo sapiens
tgtccacctggcccc

SEQ ID NO: 2922308 - DNA, 13 bp, Homo sapiens
tgtccacttgtgg

SEQ ID NO: 2922309 - DNA, 21 bp, Homo sapiens
tgtccacttgtgggtcctggg

SEQ ID NO: 2922310 - DNA, 20 bp, Homo sapiens
tgtccagcaccttgtgcctg

SEQ ID NO: 2922311 - DNA, 17 bp, Homo sapiens
tgtccagcccccagtgc

SEQ ID NO: 2922312 - DNA, 12 bp, Homo sapiens
tgtccagctcca

SEQ ID NO: 2922313 - DNA, 23 bp, Homo sapiens
tgtccagtgggtaggttggactg

SEQ ID NO: 2922314 - DNA, 13 bp, Homo sapiens
tgtccatcagtgc

SEQ ID NO: 2922315 - DNA, 14 bp, Homo sapiens
tgtccatcctcctc

SEQ ID NO: 2922316 - DNA, 15 bp, Homo sapiens
tgtccatcctcctct

SEQ ID NO: 2922317 - DNA, 16 bp, Homo sapiens
tgtccatcctcctctc

SEQ ID NO: 2922318 - DNA, 20 bp, Homo sapiens
tgtccatcctcctctccatg

SEQ ID NO: 2922319 - DNA, 23 bp, Homo sapiens
tgtccatcctcctctccatgcaa

SEQ ID NO: 2922320 - DNA, 17 bp, Homo sapiens
tgtccatctgcccgcct

SEQ ID NO: 2922321 - DNA, 22 bp, Homo sapiens
tgtccatctgcccgcctgccca

SEQ ID NO: 2922322 - DNA, 12 bp, Homo sapiens
tgtccatgtccc

SEQ ID NO: 2922323 - DNA, 14 bp, Homo sapiens
tgtccatgtccccc

SEQ ID NO: 2922324 - DNA, 18 bp, Homo sapiens
tgtccattttgtgaagcc

SEQ ID NO: 2922325 - DNA, 19 bp, Homo sapiens
tgtccattttgtgaagccc

SEQ ID NO: 2922326 - DNA, 15 bp, Homo sapiens
tgtcccaaatccgcc

SEQ ID NO: 2922327 - DNA, 20 bp, Homo sapiens
tgtcccacaatattacctta

SEQ ID NO: 2922328 - DNA, 17 bp, Homo sapiens
tgtcccactcaagccaa

SEQ ID NO: 2922329 - DNA, 19 bp, Homo sapiens
tgtcccacttctcatctta

SEQ ID NO: 2922330 - DNA, 18 bp, Homo sapiens
tgtcccagctaccaagtc

SEQ ID NO: 2922331 - DNA, 12 bp, Homo sapiens
tgtcccaggact

SEQ ID NO: 2922332 - DNA, 20 bp, Homo sapiens
tgtcccaggactcaccctcc

SEQ ID NO: 2922333 - DNA, 17 bp, Homo sapiens
tgtcccaggcagggaga

SEQ ID NO: 2922334 - DNA, 13 bp, Homo sapiens
tgtccccaggcct

SEQ ID NO: 2922335 - DNA, 16 bp, Homo sapiens
tgtccccaggcctggc

SEQ ID NO: 2922336 - DNA, 13 bp, Homo sapiens
tgtccccatctgt

SEQ ID NO: 2922337 - DNA, 18 bp, Homo sapiens
tgtccccgccttccctca

SEQ ID NO: 2922338 - DNA, 16 bp, Homo sapiens
tgtccccggggcccag

SEQ ID NO: 2922339 - DNA, 16 bp, Homo sapiens
tgtcccctcacagact

SEQ ID NO: 2922340 - DNA, 13 bp, Homo sapiens
tgtcccctcagcg

SEQ ID NO: 2922341 - DNA, 13 bp, Homo sapiens
tgtcccctcccag

SEQ ID NO: 2922342 - DNA, 21 bp, Homo sapiens
tgtcccctcctcactcccttc

SEQ ID NO: 2922343 - DNA, 13 bp, Homo sapiens
tgtcccctggggc

SEQ ID NO: 2922344 - DNA, 23 bp, Homo sapiens
tgtccctacaggaggaacagtgg

SEQ ID NO: 2922345 - DNA, 22 bp, Homo sapiens
tgtccctctcagtgccttctct

SEQ ID NO: 2922346 - DNA, 14 bp, Homo sapiens
tgtccctctgcccc

SEQ ID NO: 2922347 - DNA, 15 bp, Homo sapiens
tgtccctctgcccca

SEQ ID NO: 2922348 - DNA, 13 bp, Homo sapiens
tgtgtgaaggcag

SEQ ID NO: 2922349 - DNA, 21 bp, Homo sapiens
tgtgtgaaggtaactaagaag

SEQ ID NO: 2922350 - DNA, 16 bp, Homo sapiens
tgtgtgaatgaacact

SEQ ID NO: 2922351 - DNA, 22 bp, Homo sapiens
tgtgtgaatgaacactcttttg

SEQ ID NO: 2922352 - DNA, 15 bp, Homo sapiens
tgtgtgacaattctg

SEQ ID NO: 2922353 - DNA, 18 bp, Homo sapiens
tgtgtgacccctcctggg

SEQ ID NO: 2922354 - DNA, 16 bp, Homo sapiens
tgtgtgagactactaa

SEQ ID NO: 2922355 - DNA, 18 bp, Homo sapiens
tgtgtgcagagtccattt

SEQ ID NO: 2922356 - DNA, 16 bp, Homo sapiens
tgtgtgcgctgcctgg

SEQ ID NO: 2922357 - DNA, 17 bp, Homo sapiens
tgtgtgcgctgcctggc

SEQ ID NO: 2922358 - DNA, 21 bp, Homo sapiens
tgtgtggacggcgctgcctca

SEQ ID NO: 2922359 - DNA, 22 bp, Homo sapiens
tgtgtggcagccaggatgacta

SEQ ID NO: 2922360 - DNA, 17 bp, Homo sapiens
tgtgtggccacttctgt

SEQ ID NO: 2922361 - DNA, 18 bp, Homo sapiens
tgtgtggccacttctgtc

SEQ ID NO: 2922362 - DNA, 17 bp, Homo sapiens
tgtgtggggttctcagt

SEQ ID NO: 2922363 - DNA, 14 bp, Homo sapiens
tgtgtggtcagcgg

SEQ ID NO: 2922364 - DNA, 21 bp, Homo sapiens
tgtgtggtggattctccctgg

SEQ ID NO: 2922365 - DNA, 13 bp, Homo sapiens
tgtgtgtatatat

SEQ ID NO: 2922366 - DNA, 21 bp, Homo sapiens
tgtgtgtatatatttaaaaaa

SEQ ID NO: 2922367 - DNA, 16 bp, Homo sapiens
tgtgtgtattttttca

SEQ ID NO: 2922368 - DNA, 14 bp, Homo sapiens
tgtgtgtcaggccc

SEQ ID NO: 2922369 - DNA, 19 bp, Homo sapiens
tgtgtgtccaaaactgcct

SEQ ID NO: 2922370 - DNA, 20 bp, Homo sapiens
tgtgtgtgaatgaacactct

SEQ ID NO: 2922371 - DNA, 22 bp, Homo sapiens
tgtgtgtggtcagcggtatgtg

SEQ ID NO: 2922372 - DNA, 11 bp, Homo sapiens
tgtgtgtgtga

SEQ ID NO: 2922373 - DNA, 14 bp, Homo sapiens
tgtgtgtgtgtgcg

SEQ ID NO: 2922374 - DNA, 16 bp, Homo sapiens
tgtgtgtgtgtgtgcg

SEQ ID NO: 2922375 - DNA, 15 bp, Homo sapiens
tgtgtgttgcaaatc

SEQ ID NO: 2922376 - DNA, 18 bp, Homo sapiens
tgtgttacttgaagtaac

SEQ ID NO: 2922377 - DNA, 14 bp, Homo sapiens
tgtgttcagttcca

SEQ ID NO: 2922378 - DNA, 12 bp, Homo sapiens
tgtgttccttct

SEQ ID NO: 2922379 - DNA, 21 bp, Homo sapiens
tgtgttccttctgtgaagaag

SEQ ID NO: 2922380 - DNA, 10 bp, Homo sapiens
tgtgttctaa

SEQ ID NO: 2922381 - DNA, 12 bp, Homo sapiens
tgtgttgaaaca

SEQ ID NO: 2922382 - DNA, 16 bp, Homo sapiens
tgtgttgcataaacaa

SEQ ID NO: 2922383 - DNA, 14 bp, Homo sapiens
tgtgttgtcttgaa

SEQ ID NO: 2922384 - DNA, 21 bp, Homo sapiens
tgtgttgttgcttcttgtgaa

SEQ ID NO: 2922385 - DNA, 15 bp, Homo sapiens
tgtgtttagaagcct

SEQ ID NO: 2922386 - DNA, 16 bp, Homo sapiens
tgtgtttagaagccta

SEQ ID NO: 2922387 - DNA, 17 bp, Homo sapiens
tgtgtttagaagcctaa

SEQ ID NO: 2922388 - DNA, 13 bp, Homo sapiens
tgtgtttcaaact

SEQ ID NO: 2922389 - DNA, 15 bp, Homo sapiens
tgtgtttctgtgctc

SEQ ID NO: 2922390 - DNA, 14 bp, Homo sapiens
tgtgtttgctttct

SEQ ID NO: 2922391 - DNA, 15 bp, Homo sapiens
tgtgtttgctttctg

SEQ ID NO: 2922392 - DNA, 15 bp, Homo sapiens
tgtgtttggatttgt

SEQ ID NO: 2922393 - DNA, 15 bp, Homo sapiens
tgtgtttggctttca

SEQ ID NO: 2922394 - DNA, 14 bp, Homo sapiens
tgtgttttagagta

SEQ ID NO: 2922395 - DNA, 13 bp, Homo sapiens
tgtgttttgcttt

SEQ ID NO: 2922396 - DNA, 20 bp, Homo sapiens
tgtgtttttaataaagacag

SEQ ID NO: 2922397 - DNA, 18 bp, Homo sapiens
tgtgtttttgcactgtct

SEQ ID NO: 2922398 - DNA, 18 bp, Homo sapiens
tgttaaaacacttctgtc

SEQ ID NO: 2922399 - DNA, 14 bp, Homo sapiens
tgttaaagagataa

SEQ ID NO: 2922400 - DNA, 15 bp, Homo sapiens
tgttaaagagataaa

SEQ ID NO: 2922401 - DNA, 12 bp, Homo sapiens
tgttaaagatat

SEQ ID NO: 2922402 - DNA, 21 bp, Homo sapiens
tgttaaagatatttttattca

SEQ ID NO: 2922403 - DNA, 14 bp, Homo sapiens
tgttaaagcatttc

SEQ ID NO: 2922404 - DNA, 22 bp, Homo sapiens
tgttaacacattttgtataatt

SEQ ID NO: 2922405 - DNA, 20 bp, Homo sapiens
tgttaacattccaagactct

SEQ ID NO: 2922406 - DNA, 21 bp, Homo sapiens
tgttaacattccaagactcta

SEQ ID NO: 2922407 - DNA, 12 bp, Homo sapiens
tgttaactgtac

SEQ ID NO: 2922408 - DNA, 17 bp, Homo sapiens
tgttaagaaatctgttt

SEQ ID NO: 2922409 - DNA, 17 bp, Homo sapiens
tgttaagaataataaaa

SEQ ID NO: 2922410 - DNA, 15 bp, Homo sapiens
tgttaagacttgaca

SEQ ID NO: 2922411 - DNA, 18 bp, Homo sapiens
tgttaagcagctaaattt

SEQ ID NO: 2922412 - DNA, 23 bp, Homo sapiens
tgttaagcagctaaattttctga

SEQ ID NO: 2922413 - DNA, 24 bp, Homo sapiens
tgttaaggtcctgaaagtaactca

SEQ ID NO: 2922414 - DNA, 18 bp, Homo sapiens
tgttaatactagttgtga

SEQ ID NO: 2922415 - DNA, 17 bp, Homo sapiens
tgttaatcaatttaaac

SEQ ID NO: 2922416 - DNA, 19 bp, Homo sapiens
tgttaatgcctataacttt

SEQ ID NO: 2922417 - DNA, 19 bp, Homo sapiens
tgttaattataaacagcag

SEQ ID NO: 2922418 - DNA, 22 bp, Homo sapiens
tgttaattataaacagcagggt

SEQ ID NO: 2922419 - DNA, 13 bp, Homo sapiens
tgttaatttatgc

SEQ ID NO: 2922420 - DNA, 21 bp, Homo sapiens
tgttaattttttggtacaaaa

SEQ ID NO: 2922421 - DNA, 22 bp, Homo sapiens
tgttaattttttggtacaaaaa

SEQ ID NO: 2922422 - DNA, 18 bp, Homo sapiens
tgttacaaagttgtatgt

SEQ ID NO: 2922423 - DNA, 15 bp, Homo sapiens
tgttacaataaaact

SEQ ID NO: 2922424 - DNA, 23 bp, Homo sapiens
tgttacaataaaactaaatgtgt

SEQ ID NO: 2922425 - DNA, 20 bp, Homo sapiens
tgttaccaaatacacatttc

SEQ ID NO: 2922426 - DNA, 15 bp, Homo sapiens
tgttacctgaaaaca

SEQ ID NO: 2922427 - DNA, 16 bp, Homo sapiens
tgttacctgaaaacac

SEQ ID NO: 2922428 - DNA, 23 bp, Homo sapiens
tgttacctgaaaacactgtgcac

SEQ ID NO: 2922429 - DNA, 17 bp, Homo sapiens
tgttactaaagaaaata

SEQ ID NO: 2922430 - DNA, 19 bp, Homo sapiens
tgttactcatcgggcccag

SEQ ID NO: 2922431 - DNA, 18 bp, Homo sapiens
tgttactgacttggatcc

SEQ ID NO: 2922432 - DNA, 14 bp, Homo sapiens
tgttacttaaacat

SEQ ID NO: 2922433 - DNA, 12 bp, Homo sapiens
tgttacttgaag

SEQ ID NO: 2922434 - DNA, 23 bp, Homo sapiens
tgttactttaaaaatcagttttg

SEQ ID NO: 2922435 - DNA, 15 bp, Homo sapiens
tgttagaattgattt

SEQ ID NO: 2922436 - DNA, 14 bp, Homo sapiens
tgttagcagacagg

SEQ ID NO: 2922437 - DNA, 18 bp, Homo sapiens
tgttagctccaaagcatt

SEQ ID NO: 2922438 - DNA, 17 bp, Homo sapiens
tgttagtggacttgttt

SEQ ID NO: 2922439 - DNA, 17 bp, Homo sapiens
tgttagttatagatgtc

SEQ ID NO: 2922440 - DNA, 14 bp, Homo sapiens
tgttagtttcttgg

SEQ ID NO: 2922441 - DNA, 18 bp, Homo sapiens
tgttatcagtaatgctaa

SEQ ID NO: 2922442 - DNA, 22 bp, Homo sapiens
tgttatcttctcaagttctaag

SEQ ID NO: 2922443 - DNA, 23 bp, Homo sapiens
tgttatcttctcaagttctaaga

SEQ ID NO: 2922444 - DNA, 13 bp, Homo sapiens
tgttatgtatttc

SEQ ID NO: 2922445 - DNA, 20 bp, Homo sapiens
tgttattaaacgtatgcatg

SEQ ID NO: 2922446 - DNA, 15 bp, Homo sapiens
tgttattatatttga

SEQ ID NO: 2922447 - DNA, 18 bp, Homo sapiens
tgttattcttttccagaa

SEQ ID NO: 2922448 - DNA, 17 bp, Homo sapiens
tgttatttagactcatc

SEQ ID NO: 2922449 - DNA, 18 bp, Homo sapiens
tgttattttcaagtagct

SEQ ID NO: 2922450 - DNA, 15 bp, Homo sapiens
tgttattttcagtga

SEQ ID NO: 2922451 - DNA, 19 bp, Homo sapiens
tgttatttttgtattttta

SEQ ID NO: 2922452 - DNA, 15 bp, Homo sapiens
tgttcaactatttta

SEQ ID NO: 2922453 - DNA, 14 bp, Homo sapiens
tgttcaccagagaa

SEQ ID NO: 2922454 - DNA, 20 bp, Homo sapiens
tgttcagccaaacagtatga

SEQ ID NO: 2922455 - DNA, 13 bp, Homo sapiens
tgttcagtgtaat

SEQ ID NO: 2922456 - DNA, 17 bp, Homo sapiens
tgttcagttccagcttt

SEQ ID NO: 2922457 - DNA, 14 bp, Homo sapiens
tgttcatctctttg

SEQ ID NO: 2922458 - DNA, 20 bp, Homo sapiens
tgttcatctctttgtcctga

SEQ ID NO: 2922459 - DNA, 13 bp, Homo sapiens
tgttcatgtgatt

SEQ ID NO: 2922460 - DNA, 13 bp, Homo sapiens
tgttcatttctgt

SEQ ID NO: 2922461 - DNA, 17 bp, Homo sapiens
tgttcattttaagtgat

SEQ ID NO: 2922462 - DNA, 22 bp, Homo sapiens
tgttcattttgtcacaagctgt

SEQ ID NO: 2922463 - DNA, 17 bp, Homo sapiens
tgttccacttggaaatg

SEQ ID NO: 2922464 - DNA, 18 bp, Homo sapiens
tgttccagtaatctaata

SEQ ID NO: 2922465 - DNA, 23 bp, Homo sapiens
tgttcccaaggacttccacattt

SEQ ID NO: 2922466 - DNA, 23 bp, Homo sapiens
tgttccccaccgctgagaggctg

SEQ ID NO: 2922467 - DNA, 14 bp, Homo sapiens
tgttccccagagaa

SEQ ID NO: 2922468 - DNA, 21 bp, Homo sapiens
tgttccccttccactgagggc

SEQ ID NO: 2922469 - DNA, 16 bp, Homo sapiens
tgttccccttccctca

SEQ ID NO: 2922470 - DNA, 15 bp, Homo sapiens
tgttcccttgaccat

SEQ ID NO: 2922471 - DNA, 16 bp, Homo sapiens
tgttcccttgaccatt

SEQ ID NO: 2922472 - DNA, 21 bp, Homo sapiens
tgttccgtggttaaactcgct

SEQ ID NO: 2922473 - DNA, 16 bp, Homo sapiens
tgttcctgctttctct

SEQ ID NO: 2922474 - DNA, 17 bp, Homo sapiens
tgttcctgtctcaatag

SEQ ID NO: 2922475 - DNA, 15 bp, Homo sapiens
tgttcctgtgttctt

SEQ ID NO: 2922476 - DNA, 19 bp, Homo sapiens
tgttcctgtttatttttaa

SEQ ID NO: 2922477 - DNA, 23 bp, Homo sapiens
tgttcctgtttatttttaaattt

SEQ ID NO: 2922478 - DNA, 12 bp, Homo sapiens
tgttccttctgt

SEQ ID NO: 2922479 - DNA, 16 bp, Homo sapiens
tgttccttctgtgaag

SEQ ID NO: 2922480 - DNA, 23 bp, Homo sapiens
tgttccttgcttttatagttgta

SEQ ID NO: 2922481 - DNA, 19 bp, Homo sapiens
ttaataataattgaagaat

SEQ ID NO: 2922482 - DNA, 24 bp, Homo sapiens
ttaataatcagcaagaatttgatc

SEQ ID NO: 2922483 - DNA, 13 bp, Homo sapiens
ttaatacagataa

SEQ ID NO: 2922484 - DNA, 15 bp, Homo sapiens
ttaatactaccttga

SEQ ID NO: 2922485 - DNA, 14 bp, Homo sapiens
ttaatactgaattt

SEQ ID NO: 2922486 - DNA, 14 bp, Homo sapiens
ttaatagaatgata

SEQ ID NO: 2922487 - DNA, 21 bp, Homo sapiens
ttaatagaggagctgcttgtt

SEQ ID NO: 2922488 - DNA, 14 bp, Homo sapiens
ttaatagatttggg

SEQ ID NO: 2922489 - DNA, 21 bp, Homo sapiens
ttaatagtgttaatcaattta

SEQ ID NO: 2922490 - DNA, 17 bp, Homo sapiens
ttaatataagtttcttt

SEQ ID NO: 2922491 - DNA, 19 bp, Homo sapiens
ttaatataagtttctttag

SEQ ID NO: 2922492 - DNA, 14 bp, Homo sapiens
ttaatatgattcta

SEQ ID NO: 2922493 - DNA, 16 bp, Homo sapiens
ttaatatgttgacttt

SEQ ID NO: 2922494 - DNA, 16 bp, Homo sapiens
ttaatattgtattgct

SEQ ID NO: 2922495 - DNA, 19 bp, Homo sapiens
ttaatatttgtgctttgaa

SEQ ID NO: 2922496 - DNA, 18 bp, Homo sapiens
ttaatcaatttaaaccca

SEQ ID NO: 2922497 - DNA, 20 bp, Homo sapiens
ttaatcacctctctgtagtt

SEQ ID NO: 2922498 - DNA, 17 bp, Homo sapiens
ttaatcatatttgaaaa

SEQ ID NO: 2922499 - DNA, 18 bp, Homo sapiens
ttaatcatgagcctgttt

SEQ ID NO: 2922500 - DNA, 21 bp, Homo sapiens
ttaatcatgagcctgtttatt

SEQ ID NO: 2922501 - DNA, 19 bp, Homo sapiens
ttaatcattttcattccta

SEQ ID NO: 2922502 - DNA, 22 bp, Homo sapiens
ttaatccaatcaatttaaatgt

SEQ ID NO: 2922503 - DNA, 15 bp, Homo sapiens
ttaatcccagcactt

SEQ ID NO: 2922504 - DNA, 20 bp, Homo sapiens
ttaatcgtttttgttttaag

SEQ ID NO: 2922505 - DNA, 15 bp, Homo sapiens
ttaatgaaaataaga

SEQ ID NO: 2922506 - DNA, 14 bp, Homo sapiens
ttaatgaacaaatg

SEQ ID NO: 2922507 - DNA, 14 bp, Homo sapiens
ttaatgaagaaagt

SEQ ID NO: 2922508 - DNA, 23 bp, Homo sapiens
ttaatgaagaaagtggaaaacaa

SEQ ID NO: 2922509 - DNA, 19 bp, Homo sapiens
ttaatgaaggtgtgctaca

SEQ ID NO: 2922510 - DNA, 17 bp, Homo sapiens
ttaatgacacaccttgg

SEQ ID NO: 2922511 - DNA, 19 bp, Homo sapiens
ttaatgacacttgtcccca

SEQ ID NO: 2922512 - DNA, 14 bp, Homo sapiens
ttaatgattctgaa

SEQ ID NO: 2922513 - DNA, 17 bp, Homo sapiens
ttaatgatttttgtgta

SEQ ID NO: 2922514 - DNA, 18 bp, Homo sapiens
ttaatgatttttgtgtat

SEQ ID NO: 2922515 - DNA, 22 bp, Homo sapiens
ttaatgccatctagctagcaat

SEQ ID NO: 2922516 - DNA, 17 bp, Homo sapiens
ttaatgcctataacttt

SEQ ID NO: 2922517 - DNA, 20 bp, Homo sapiens
ttaatggacacttttcacct

SEQ ID NO: 2922518 - DNA, 15 bp, Homo sapiens
ttaatgtagattttt

SEQ ID NO: 2922519 - DNA, 23 bp, Homo sapiens
ttaatgtgaactctcccctcccc

SEQ ID NO: 2922520 - DNA, 11 bp, Homo sapiens
ttaatgtgaag

SEQ ID NO: 2922521 - DNA, 15 bp, Homo sapiens
ttaatgtgctgtgta

SEQ ID NO: 2922522 - DNA, 17 bp, Homo sapiens
ttaatgtgctgtgtaaa

SEQ ID NO: 2922523 - DNA, 18 bp, Homo sapiens
ttaatgtgctgtgtaaag

SEQ ID NO: 2922524 - DNA, 14 bp, Homo sapiens
ttaatgttctgtga

SEQ ID NO: 2922525 - DNA, 16 bp, Homo sapiens
ttaatgtttatacaga

SEQ ID NO: 2922526 - DNA, 18 bp, Homo sapiens
ttaatgtttatacagagt

SEQ ID NO: 2922527 - DNA, 14 bp, Homo sapiens
ttaattaaaaacta

SEQ ID NO: 2922528 - DNA, 19 bp, Homo sapiens
ttaattaaaaactagtagt

SEQ ID NO: 2922529 - DNA, 13 bp, Homo sapiens
ttaattataaaca

SEQ ID NO: 2922530 - DNA, 13 bp, Homo sapiens
ttaattcatgttt

SEQ ID NO: 2922531 - DNA, 13 bp, Homo sapiens
ttaattcatttgg

SEQ ID NO: 2922532 - DNA, 21 bp, Homo sapiens
ttaattccatgaatcgcttct

SEQ ID NO: 2922533 - DNA, 22 bp, Homo sapiens
ttaattctgatgctaggttgtt

SEQ ID NO: 2922534 - DNA, 13 bp, Homo sapiens
ttaattgctttga

SEQ ID NO: 2922535 - DNA, 13 bp, Homo sapiens
ttaattggaggaa

SEQ ID NO: 2922536 - DNA, 15 bp, Homo sapiens
ttaattgttccttgc

SEQ ID NO: 2922537 - DNA, 21 bp, Homo sapiens
ttaattgttccttgcttttat

SEQ ID NO: 2922538 - DNA, 12 bp, Homo sapiens
ttaatttaactt

SEQ ID NO: 2922539 - DNA, 22 bp, Homo sapiens
ttaatttacaaaaatataaaat

SEQ ID NO: 2922540 - DNA, 14 bp, Homo sapiens
ttaatttacctgtt

SEQ ID NO: 2922541 - DNA, 16 bp, Homo sapiens
ttaatttaggacacat

SEQ ID NO: 2922542 - DNA, 21 bp, Homo sapiens
ttaatttcaaatctgtaatta

SEQ ID NO: 2922543 - DNA, 13 bp, Homo sapiens
ttaatttggataa

SEQ ID NO: 2922544 - DNA, 16 bp, Homo sapiens
ttaatttttaaaagac

SEQ ID NO: 2922545 - DNA, 19 bp, Homo sapiens
ttaatttttaaaagacttt

SEQ ID NO: 2922546 - DNA, 17 bp, Homo sapiens
ttaatttttaatgatga

SEQ ID NO: 2922547 - DNA, 16 bp, Homo sapiens
ttacaaagaaaataat

SEQ ID NO: 2922548 - DNA, 21 bp, Homo sapiens
ttacaaagaaccatgcaggaa

SEQ ID NO: 2922549 - DNA, 14 bp, Homo sapiens
ttacaaagcagtta

SEQ ID NO: 2922550 - DNA, 16 bp, Homo sapiens
ttacaaagcagttact

SEQ ID NO: 2922551 - DNA, 19 bp, Homo sapiens
ttacaaattaatatttgtg

SEQ ID NO: 2922552 - DNA, 16 bp, Homo sapiens
ttacaaattttcactg

SEQ ID NO: 2922553 - DNA, 22 bp, Homo sapiens
ttacaaattttcactgctgctc

SEQ ID NO: 2922554 - DNA, 16 bp, Homo sapiens
ttacaacagatttgtg

SEQ ID NO: 2922555 - DNA, 21 bp, Homo sapiens
ttacaacagatttgtgaactc

SEQ ID NO: 2922556 - DNA, 23 bp, Homo sapiens
ttacaactgcctcgaaacacaga

SEQ ID NO: 2922557 - DNA, 19 bp, Homo sapiens
ttacaagcccccccttcca

SEQ ID NO: 2922558 - DNA, 20 bp, Homo sapiens
ttacaagcccccccttccac

SEQ ID NO: 2922559 - DNA, 20 bp, Homo sapiens
ttacaaggcaggcctttcct

SEQ ID NO: 2922560 - DNA, 23 bp, Homo sapiens
ttacaaggcaggcctttcctaca

SEQ ID NO: 2922561 - DNA, 20 bp, Homo sapiens
ttacaagggagaagacaaca

SEQ ID NO: 2922562 - DNA, 17 bp, Homo sapiens
ttacaataaaactaaat

SEQ ID NO: 2922563 - DNA, 14 bp, Homo sapiens
ttacaatgttttat

SEQ ID NO: 2922564 - DNA, 13 bp, Homo sapiens
ttacaattgaaat

SEQ ID NO: 2922565 - DNA, 17 bp, Homo sapiens
ttacaattgaaatgact

SEQ ID NO: 2922566 - DNA, 14 bp, Homo sapiens
ttacacagaaacac

SEQ ID NO: 2922567 - DNA, 14 bp, Homo sapiens
ttacaccacacttt

SEQ ID NO: 2922568 - DNA, 18 bp, Homo sapiens
ttacaccacactttcaaa

SEQ ID NO: 2922569 - DNA, 17 bp, Homo sapiens
ttacacgtatctcttgg

SEQ ID NO: 2922570 - DNA, 19 bp, Homo sapiens
ttacactgagtttctattt

SEQ ID NO: 2922571 - DNA, 21 bp, Homo sapiens
ttacactgtaccatatagcaa

SEQ ID NO: 2922572 - DNA, 14 bp, Homo sapiens
ttacactttattct

SEQ ID NO: 2922573 - DNA, 18 bp, Homo sapiens
ttacagaaaaagacttta

SEQ ID NO: 2922574 - DNA, 13 bp, Homo sapiens
ttacagaaactga

SEQ ID NO: 2922575 - DNA, 18 bp, Homo sapiens
ttacagaaactgatgcca

SEQ ID NO: 2922576 - DNA, 20 bp, Homo sapiens
ttacagacaaggcaggcctg

SEQ ID NO: 2922577 - DNA, 19 bp, Homo sapiens
ttacagcagttgactcaga

SEQ ID NO: 2922578 - DNA, 11 bp, Homo sapiens
ttacagctgtt

SEQ ID NO: 2922579 - DNA, 13 bp, Homo sapiens
ttacagctgttta

SEQ ID NO: 2922580 - DNA, 20 bp, Homo sapiens
ttacaggcatgagccactgc

SEQ ID NO: 2922581 - DNA, 18 bp, Homo sapiens
ttacagggagctgggaca

SEQ ID NO: 2922582 - DNA, 22 bp, Homo sapiens
ttacaggggagaaggaaatgca

SEQ ID NO: 2922583 - DNA, 17 bp, Homo sapiens
ttacaggggattttatt

SEQ ID NO: 2922584 - DNA, 19 bp, Homo sapiens
ttacaggtgtgcaccacca

SEQ ID NO: 2922585 - DNA, 15 bp, Homo sapiens
ttacaggttcttagg

SEQ ID NO: 2922586 - DNA, 19 bp, Homo sapiens
ttacagttagggttttgca

SEQ ID NO: 2922587 - DNA, 22 bp, Homo sapiens
ttacagttagggttttgcaata

SEQ ID NO: 2922588 - DNA, 13 bp, Homo sapiens
ttacagttatcct

SEQ ID NO: 2922589 - DNA, 14 bp, Homo sapiens
ttacagttgcattt

SEQ ID NO: 2922590 - DNA, 21 bp, Homo sapiens
ttacagtttgtgctctactgt

SEQ ID NO: 2922591 - DNA, 21 bp, Homo sapiens
ttacataactgatctatttat

SEQ ID NO: 2922592 - DNA, 14 bp, Homo sapiens
ttacatactgctgt

SEQ ID NO: 2922593 - DNA, 13 bp, Homo sapiens
ttacatcattttt

SEQ ID NO: 2922594 - DNA, 14 bp, Homo sapiens
ttacatcatttttg

SEQ ID NO: 2922595 - DNA, 21 bp, Homo sapiens
ttacatctgaacaaaatgcct

SEQ ID NO: 2922596 - DNA, 22 bp, Homo sapiens
ttacatctgaacaaaatgcctt

SEQ ID NO: 2922597 - DNA, 12 bp, Homo sapiens
ttacatctgtgc

SEQ ID NO: 2922598 - DNA, 14 bp, Homo sapiens
ttacatctgtgcag

SEQ ID NO: 2922599 - DNA, 21 bp, Homo sapiens
ttacatctgtgcagggctggt

SEQ ID NO: 2922600 - DNA, 20 bp, Homo sapiens
ttacatgcataaaagggtca

SEQ ID NO: 2922601 - DNA, 12 bp, Homo sapiens
ttacatggctct

SEQ ID NO: 2922602 - DNA, 15 bp, Homo sapiens
ttacatgtaatttga

SEQ ID NO: 2922603 - DNA, 12 bp, Homo sapiens
ttacatgtttgc

SEQ ID NO: 2922604 - DNA, 12 bp, Homo sapiens
ttacatgttttc

SEQ ID NO: 2922605 - DNA, 13 bp, Homo sapiens
ttacattaaactc

SEQ ID NO: 2922606 - DNA, 20 bp, Homo sapiens
ttacattaatgcccagccag

SEQ ID NO: 2922607 - DNA, 13 bp, Homo sapiens
ttacattctgtgt

SEQ ID NO: 2922608 - DNA, 17 bp, Homo sapiens
ttacattgaaaacagat

SEQ ID NO: 2922609 - DNA, 20 bp, Homo sapiens
ttacattgcctgactaaaat

SEQ ID NO: 2922610 - DNA, 21 bp, Homo sapiens
ttacattgcctgactaaaatg

SEQ ID NO: 2922611 - DNA, 16 bp, Homo sapiens
ttacatttaatacaga

SEQ ID NO: 2922612 - DNA, 20 bp, Homo sapiens
ttacatttgatgcatgtctt

SEQ ID NO: 2922613 - DNA, 16 bp, Homo sapiens
ttaccaaacagcaaac

SEQ ID NO: 2922614 - DNA, 22 bp, Homo sapiens
ttattgtgtgcgctgcctggcc

SEQ ID NO: 2922615 - DNA, 21 bp, Homo sapiens
ttatttaaaaatatttcagat

SEQ ID NO: 2922616 - DNA, 14 bp, Homo sapiens
ttatttaaatgtac

SEQ ID NO: 2922617 - DNA, 12 bp, Homo sapiens
ttatttaaatta

SEQ ID NO: 2922618 - DNA, 18 bp, Homo sapiens
ttatttaagaagaatgag

SEQ ID NO: 2922619 - DNA, 18 bp, Homo sapiens
ttatttacgcttttattg

SEQ ID NO: 2922620 - DNA, 18 bp, Homo sapiens
ttatttagactcatctta

SEQ ID NO: 2922621 - DNA, 23 bp, Homo sapiens
ttatttagactcatcttactgta

SEQ ID NO: 2922622 - DNA, 17 bp, Homo sapiens
ttatttagggaactgct

SEQ ID NO: 2922623 - DNA, 21 bp, Homo sapiens
ttatttagggaactgcttgac

SEQ ID NO: 2922624 - DNA, 13 bp, Homo sapiens
ttatttatatgaa

SEQ ID NO: 2922625 - DNA, 21 bp, Homo sapiens
ttatttatatgtactgtttta

SEQ ID NO: 2922626 - DNA, 17 bp, Homo sapiens
ttatttcctttgtcctt

SEQ ID NO: 2922627 - DNA, 23 bp, Homo sapiens
ttatttcggagcgcaatgccatc

SEQ ID NO: 2922628 - DNA, 12 bp, Homo sapiens
ttatttctgcat

SEQ ID NO: 2922629 - DNA, 15 bp, Homo sapiens
ttatttctgcatatg

SEQ ID NO: 2922630 - DNA, 14 bp, Homo sapiens
ttatttcttaacct

SEQ ID NO: 2922631 - DNA, 14 bp, Homo sapiens
ttatttgagtttga

SEQ ID NO: 2922632 - DNA, 18 bp, Homo sapiens
ttatttggaattgacatt

SEQ ID NO: 2922633 - DNA, 21 bp, Homo sapiens
ttatttgtcggggaagatgaa

SEQ ID NO: 2922634 - DNA, 14 bp, Homo sapiens
ttatttgttgagag

SEQ ID NO: 2922635 - DNA, 19 bp, Homo sapiens
ttatttgttgagagtgtga

SEQ ID NO: 2922636 - DNA, 13 bp, Homo sapiens
ttattttaaatta

SEQ ID NO: 2922637 - DNA, 12 bp, Homo sapiens
ttattttaagac

SEQ ID NO: 2922638 - DNA, 14 bp, Homo sapiens
ttattttatgagaa

SEQ ID NO: 2922639 - DNA, 19 bp, Homo sapiens
ttattttatgagaaatgta

SEQ ID NO: 2922640 - DNA, 15 bp, Homo sapiens
ttattttcaagtagc

SEQ ID NO: 2922641 - DNA, 15 bp, Homo sapiens
ttatttttaatatgt

SEQ ID NO: 2922642 - DNA, 18 bp, Homo sapiens
ttatttttacgatctgtt

SEQ ID NO: 2922643 - DNA, 21 bp, Homo sapiens
ttcaaaaaaaaaaaaaagaga

SEQ ID NO: 2922644 - DNA, 20 bp, Homo sapiens
ttcaaaaaaaatcaaactgt

SEQ ID NO: 2922645 - DNA, 16 bp, Homo sapiens
ttcaaaaaacttgtaa

SEQ ID NO: 2922646 - DNA, 17 bp, Homo sapiens
ttcaaaaacacagtgtt

SEQ ID NO: 2922647 - DNA, 23 bp, Homo sapiens
ttcaaaaacacagtgtttttgta

SEQ ID NO: 2922648 - DNA, 21 bp, Homo sapiens
ttcaaaacattctcctttgca

SEQ ID NO: 2922649 - DNA, 22 bp, Homo sapiens
ttcaaaagctttttgatgtata

SEQ ID NO: 2922650 - DNA, 21 bp, Homo sapiens
ttcaaaagtaatgcctctgtc

SEQ ID NO: 2922651 - DNA, 21 bp, Homo sapiens
ttcaaaagtattttcctgtaa

SEQ ID NO: 2922652 - DNA, 21 bp, Homo sapiens
ttcaaaataagtatttctgat

SEQ ID NO: 2922653 - DNA, 20 bp, Homo sapiens
ttcaaaatatttaaaaatgt

SEQ ID NO: 2922654 - DNA, 15 bp, Homo sapiens
ttcaaaatccaaaaa

SEQ ID NO: 2922655 - DNA, 15 bp, Homo sapiens
ttcaaaatgttatct

SEQ ID NO: 2922656 - DNA, 18 bp, Homo sapiens
ttcaaactacctatattc

SEQ ID NO: 2922657 - DNA, 17 bp, Homo sapiens
ttcaaactgctggaaat

SEQ ID NO: 2922658 - DNA, 15 bp, Homo sapiens
ttcaaactggggcct

SEQ ID NO: 2922659 - DNA, 16 bp, Homo sapiens
ttcaaactggggcctc

SEQ ID NO: 2922660 - DNA, 22 bp, Homo sapiens
ttcaaagacaatcactgaaaca

SEQ ID NO: 2922661 - DNA, 14 bp, Homo sapiens
ttcaaagactgcca

SEQ ID NO: 2922662 - DNA, 19 bp, Homo sapiens
ttcaaagactgccacgtgc

SEQ ID NO: 2922663 - DNA, 13 bp, Homo sapiens
ttcaaagatgctg

SEQ ID NO: 2922664 - DNA, 21 bp, Homo sapiens
ttcaaagccagcgtcctcctc

SEQ ID NO: 2922665 - DNA, 13 bp, Homo sapiens
ttcaaagccatat

SEQ ID NO: 2922666 - DNA, 23 bp, Homo sapiens
ttcaaagccatatggacactgtg

SEQ ID NO: 2922667 - DNA, 14 bp, Homo sapiens
ttcaaagccctgcc

SEQ ID NO: 2922668 - DNA, 16 bp, Homo sapiens
ttcaaagccctgcctc

SEQ ID NO: 2922669 - DNA, 20 bp, Homo sapiens
ttcaaagccctgcctctgtg

SEQ ID NO: 2922670 - DNA, 15 bp, Homo sapiens
ttcaaatatttacag

SEQ ID NO: 2922671 - DNA, 22 bp, Homo sapiens
ttcaaatcaatctgtaaaacta

SEQ ID NO: 2922672 - DNA, 16 bp, Homo sapiens
ttcaaatctcttcctt

SEQ ID NO: 2922673 - DNA, 20 bp, Homo sapiens
ttcaaattaaagtgctgttt

SEQ ID NO: 2922674 - DNA, 22 bp, Homo sapiens
ttcaaattaaagtgctgtttag

SEQ ID NO: 2922675 - DNA, 13 bp, Homo sapiens
ttcaacaaacagt

SEQ ID NO: 2922676 - DNA, 19 bp, Homo sapiens
ttcaacagtgaagacagaa

SEQ ID NO: 2922677 - DNA, 22 bp, Homo sapiens
ttcaaccaaggaggaattgaaa

SEQ ID NO: 2922678 - DNA, 18 bp, Homo sapiens
ttcaaccacgcaggaagc

SEQ ID NO: 2922679 - DNA, 21 bp, Homo sapiens
ttcaaccccaccctgtttgga

SEQ ID NO: 2922680 - DNA, 15 bp, Homo sapiens
ttcaacgtttcttca

SEQ ID NO: 2922681 - DNA, 18 bp, Homo sapiens
ttcaacgtttcttcactt

SEQ ID NO: 2922682 - DNA, 12 bp, Homo sapiens
ttcaactatttt

SEQ ID NO: 2922683 - DNA, 21 bp, Homo sapiens
ttcaactcctcgacatcactg

SEQ ID NO: 2922684 - DNA, 13 bp, Homo sapiens
ttcaactttgaat

SEQ ID NO: 2922685 - DNA, 20 bp, Homo sapiens
ttcaactttgaataaagaat

SEQ ID NO: 2922686 - DNA, 11 bp, Homo sapiens
ttcaagaatga

SEQ ID NO: 2922687 - DNA, 17 bp, Homo sapiens
ttcaagcaatcctccta

SEQ ID NO: 2922688 - DNA, 19 bp, Homo sapiens
ttcaagcaatcctcctacc

SEQ ID NO: 2922689 - DNA, 17 bp, Homo sapiens
ttcaagcatcctcagaa

SEQ ID NO: 2922690 - DNA, 18 bp, Homo sapiens
ttcaagcatcctcagaag

SEQ ID NO: 2922691 - DNA, 20 bp, Homo sapiens
ttcaagcctgtgcaatgcat

SEQ ID NO: 2922692 - DNA, 18 bp, Homo sapiens
ttcaaggaagaaaacgga

SEQ ID NO: 2922693 - DNA, 22 bp, Homo sapiens
ttcaaggattgttaacatgcct

SEQ ID NO: 2922694 - DNA, 17 bp, Homo sapiens
ttcaaggcactctagat

SEQ ID NO: 2922695 - DNA, 19 bp, Homo sapiens
ttcaaggcactctagattc

SEQ ID NO: 2922696 - DNA, 21 bp, Homo sapiens
ttcaaggcactctagattcca

SEQ ID NO: 2922697 - DNA, 13 bp, Homo sapiens
ttcaaggctcaga

SEQ ID NO: 2922698 - DNA, 15 bp, Homo sapiens
ttcaagggtaatctt

SEQ ID NO: 2922699 - DNA, 16 bp, Homo sapiens
ttcaagtaattgtgaa

SEQ ID NO: 2922700 - DNA, 16 bp, Homo sapiens
ttcaagtagctgggat

SEQ ID NO: 2922701 - DNA, 20 bp, Homo sapiens
ttcaagtgattctcctgcct

SEQ ID NO: 2922702 - DNA, 19 bp, Homo sapiens
ttcaagtgtaaaatatttt

SEQ ID NO: 2922703 - DNA, 17 bp, Homo sapiens
ttcaataaatgatatat

SEQ ID NO: 2922704 - DNA, 12 bp, Homo sapiens
ttcaatcactgt

SEQ ID NO: 2922705 - DNA, 12 bp, Homo sapiens
ttcaatggtaga

SEQ ID NO: 2922706 - DNA, 22 bp, Homo sapiens
ttcaatggtagattcgctgtcc

SEQ ID NO: 2922707 - DNA, 13 bp, Homo sapiens
ttcaattcagtgc

SEQ ID NO: 2922708 - DNA, 15 bp, Homo sapiens
ttcaattcctggccc

SEQ ID NO: 2922709 - DNA, 15 bp, Homo sapiens
ttcaattgcatctcc

SEQ ID NO: 2922710 - DNA, 21 bp, Homo sapiens
ttcaatttactttttaaacag

SEQ ID NO: 2922711 - DNA, 15 bp, Homo sapiens
ttcacaaacttttat

SEQ ID NO: 2922712 - DNA, 16 bp, Homo sapiens
ttcacaaacttttata

SEQ ID NO: 2922713 - DNA, 15 bp, Homo sapiens
ttcacaaagcccaag

SEQ ID NO: 2922714 - DNA, 13 bp, Homo sapiens
ttcacaaataata

SEQ ID NO: 2922715 - DNA, 12 bp, Homo sapiens
ttcacaacctgg

SEQ ID NO: 2922716 - DNA, 14 bp, Homo sapiens
ttcacacagcccag

SEQ ID NO: 2922717 - DNA, 18 bp, Homo sapiens
ttcacagaaaaagcatga

SEQ ID NO: 2922718 - DNA, 12 bp, Homo sapiens
ttcacagagcac

SEQ ID NO: 2922719 - DNA, 16 bp, Homo sapiens
ttcacagagcacgcct

SEQ ID NO: 2922720 - DNA, 13 bp, Homo sapiens
ttcacagcagctt

SEQ ID NO: 2922721 - DNA, 21 bp, Homo sapiens
ttcacagtgatcgatgattca

SEQ ID NO: 2922722 - DNA, 20 bp, Homo sapiens
ttcacagttctttgggccag

SEQ ID NO: 2922723 - DNA, 14 bp, Homo sapiens
ttcacataaatgca

SEQ ID NO: 2922724 - DNA, 20 bp, Homo sapiens
ttcacataaccccttgaaac

SEQ ID NO: 2922725 - DNA, 18 bp, Homo sapiens
ttcacatcctgtgtttct

SEQ ID NO: 2922726 - DNA, 20 bp, Homo sapiens
ttcacatctaacctcatctt

SEQ ID NO: 2922727 - DNA, 13 bp, Homo sapiens
ttcacatctccca

SEQ ID NO: 2922728 - DNA, 21 bp, Homo sapiens
ttcacatgattctcctgcctc

SEQ ID NO: 2922729 - DNA, 16 bp, Homo sapiens
ttcacattagaagaca

SEQ ID NO: 2922730 - DNA, 16 bp, Homo sapiens
ttcacattcttataaa

SEQ ID NO: 2922731 - DNA, 20 bp, Homo sapiens
ttcacattcttataaatatg

SEQ ID NO: 2922732 - DNA, 20 bp, Homo sapiens
ttcacatttcaagatccaaa

SEQ ID NO: 2922733 - DNA, 23 bp, Homo sapiens
ttcaccaatgttgtacagagaag

SEQ ID NO: 2922734 - DNA, 16 bp, Homo sapiens
ttcaccatggccccct

SEQ ID NO: 2922735 - DNA, 21 bp, Homo sapiens
ttcacccaggcctatgttgat

SEQ ID NO: 2922736 - DNA, 17 bp, Homo sapiens
ttcaccccaatcccagc

SEQ ID NO: 2922737 - DNA, 17 bp, Homo sapiens
ttcaccccagggcctga

SEQ ID NO: 2922738 - DNA, 13 bp, Homo sapiens
ttcaccctctgta

SEQ ID NO: 2922739 - DNA, 13 bp, Homo sapiens
ttcacctccttca

SEQ ID NO: 2922740 - DNA, 15 bp, Homo sapiens
ttcacctccttcaat

SEQ ID NO: 2922741 - DNA, 12 bp, Homo sapiens
ttcacctgagca

SEQ ID NO: 2922742 - DNA, 15 bp, Homo sapiens
ttcaccttagtgcaa

SEQ ID NO: 2922743 - DNA, 17 bp, Homo sapiens
ttcacgaagtgttgcat

SEQ ID NO: 2922744 - DNA, 16 bp, Homo sapiens
ttcactcacatagcca

SEQ ID NO: 2922745 - DNA, 14 bp, Homo sapiens
ttcactcttggagc

SEQ ID NO: 2922746 - DNA, 18 bp, Homo sapiens
ttcactcttggagcctgc

SEQ ID NO: 2922747 - DNA, 18 bp, Homo sapiens
ttcctgtgtcaatccaga

SEQ ID NO: 2922748 - DNA, 22 bp, Homo sapiens
ttcctgtgtgtccaaaactgcc

SEQ ID NO: 2922749 - DNA, 10 bp, Homo sapiens
ttcctgtgtt

SEQ ID NO: 2922750 - DNA, 21 bp, Homo sapiens
ttcctgtttatttttaaattt

SEQ ID NO: 2922751 - DNA, 15 bp, Homo sapiens
ttcctgtttctgaaa

SEQ ID NO: 2922752 - DNA, 21 bp, Homo sapiens
ttcctgttttaagcagctcta

SEQ ID NO: 2922753 - DNA, 23 bp, Homo sapiens
ttccttacctttaccccatccct

SEQ ID NO: 2922754 - DNA, 15 bp, Homo sapiens
ttccttatttcaagg

SEQ ID NO: 2922755 - DNA, 15 bp, Homo sapiens
ttccttcagggtgat

SEQ ID NO: 2922756 - DNA, 22 bp, Homo sapiens
ttccttcagggtgatgccaggt

SEQ ID NO: 2922757 - DNA, 15 bp, Homo sapiens
ttccttccagaagag

SEQ ID NO: 2922758 - DNA, 14 bp, Homo sapiens
ttccttccagccca

SEQ ID NO: 2922759 - DNA, 19 bp, Homo sapiens
ttccttccatgctcccaac

SEQ ID NO: 2922760 - DNA, 21 bp, Homo sapiens
ttccttccatgctcccaactc

SEQ ID NO: 2922761 - DNA, 14 bp, Homo sapiens
ttccttccttccct

SEQ ID NO: 2922762 - DNA, 14 bp, Homo sapiens
ttccttctcatctg

SEQ ID NO: 2922763 - DNA, 16 bp, Homo sapiens
ttccttctcatctgtg

SEQ ID NO: 2922764 - DNA, 16 bp, Homo sapiens
ttccttctcattgctg

SEQ ID NO: 2922765 - DNA, 15 bp, Homo sapiens
ttccttctgaaaata

SEQ ID NO: 2922766 - DNA, 13 bp, Homo sapiens
ttccttctgtgaa

SEQ ID NO: 2922767 - DNA, 22 bp, Homo sapiens
ttccttctgtgaagaagccctg

SEQ ID NO: 2922768 - DNA, 14 bp, Homo sapiens
ttccttgcttttat

SEQ ID NO: 2922769 - DNA, 23 bp, Homo sapiens
ttccttgcttttatgtttgtaca

SEQ ID NO: 2922770 - DNA, 17 bp, Homo sapiens
ttccttggggcaggcag

SEQ ID NO: 2922771 - DNA, 16 bp, Homo sapiens
ttcctttactcctggc

SEQ ID NO: 2922772 - DNA, 16 bp, Homo sapiens
ttcctttatactgtga

SEQ ID NO: 2922773 - DNA, 19 bp, Homo sapiens
ttcctttatactgtgaagt

SEQ ID NO: 2922774 - DNA, 19 bp, Homo sapiens
ttcctttcagccctgtcta

SEQ ID NO: 2922775 - DNA, 14 bp, Homo sapiens
ttcctttcccaagc

SEQ ID NO: 2922776 - DNA, 22 bp, Homo sapiens
ttcctttggaacaagacagcct

SEQ ID NO: 2922777 - DNA, 23 bp, Homo sapiens
ttcctttttaaatgtgaattttt

SEQ ID NO: 2922778 - DNA, 16 bp, Homo sapiens
ttccttttttcaaaat

SEQ ID NO: 2922779 - DNA, 16 bp, Homo sapiens
ttcctttttttaaatt

SEQ ID NO: 2922780 - DNA, 22 bp, Homo sapiens
ttcgaaacctgggattcaggaa

SEQ ID NO: 2922781 - DNA, 15 bp, Homo sapiens
ttcgagaccagcctg

SEQ ID NO: 2922782 - DNA, 22 bp, Homo sapiens
ttcgagatcatcacttccttgc

SEQ ID NO: 2922783 - DNA, 23 bp, Homo sapiens
ttcgaggggttccttccacttct

SEQ ID NO: 2922784 - DNA, 18 bp, Homo sapiens
ttcgatgcgtattctgtg

SEQ ID NO: 2922785 - DNA, 22 bp, Homo sapiens
ttcgatgcgtattctgtggccg

SEQ ID NO: 2922786 - DNA, 18 bp, Homo sapiens
ttcgatggtacgtgaccc

SEQ ID NO: 2922787 - DNA, 12 bp, Homo sapiens
ttcgatgtacag

SEQ ID NO: 2922788 - DNA, 16 bp, Homo sapiens
ttcgatgtacagtctc

SEQ ID NO: 2922789 - DNA, 15 bp, Homo sapiens
ttcgatttctgactc

SEQ ID NO: 2922790 - DNA, 14 bp, Homo sapiens
ttcgcatggtcaca

SEQ ID NO: 2922791 - DNA, 19 bp, Homo sapiens
ttcgcatggtcacacactg

SEQ ID NO: 2922792 - DNA, 20 bp, Homo sapiens
ttcgcatggtcacacactga

SEQ ID NO: 2922793 - DNA, 17 bp, Homo sapiens
ttcgcatgtttaatgtg

SEQ ID NO: 2922794 - DNA, 19 bp, Homo sapiens
ttcgccgtctggcgagccc

SEQ ID NO: 2922795 - DNA, 22 bp, Homo sapiens
ttcgcgatggacagactcacaa

SEQ ID NO: 2922796 - DNA, 15 bp, Homo sapiens
ttcgcgctctgctca

SEQ ID NO: 2922797 - DNA, 19 bp, Homo sapiens
ttcggacagtttatttgtt

SEQ ID NO: 2922798 - DNA, 20 bp, Homo sapiens
ttcggacagtttatttgttg

SEQ ID NO: 2922799 - DNA, 17 bp, Homo sapiens
ttcggccgagctggttt

SEQ ID NO: 2922800 - DNA, 22 bp, Homo sapiens
ttcgtattgcaaataagactct

SEQ ID NO: 2922801 - DNA, 13 bp, Homo sapiens
ttcgtcatcttcc

SEQ ID NO: 2922802 - DNA, 15 bp, Homo sapiens
ttcgtcatcttccct

SEQ ID NO: 2922803 - DNA, 17 bp, Homo sapiens
ttcgtcatcttccctgc

SEQ ID NO: 2922804 - DNA, 18 bp, Homo sapiens
ttcgtccacagcttcctg

SEQ ID NO: 2922805 - DNA, 17 bp, Homo sapiens
ttcgttggtgaccagtt

SEQ ID NO: 2922806 - DNA, 21 bp, Homo sapiens
ttcgttggttgtttctctgag

SEQ ID NO: 2922807 - DNA, 13 bp, Homo sapiens
ttcgtttatattt

SEQ ID NO: 2922808 - DNA, 23 bp, Homo sapiens
ttcgtttatatttttttaactgt

SEQ ID NO: 2922809 - DNA, 17 bp, Homo sapiens
ttctaaaaaaaaaaact

SEQ ID NO: 2922810 - DNA, 18 bp, Homo sapiens
ttctaaaaaatgttttta

SEQ ID NO: 2922811 - DNA, 14 bp, Homo sapiens
ttctaaaaagatgt

SEQ ID NO: 2922812 - DNA, 20 bp, Homo sapiens
ttctaaaatgtgatgttcta

SEQ ID NO: 2922813 - DNA, 20 bp, Homo sapiens
ttctaaacagatgtccctga

SEQ ID NO: 2922814 - DNA, 19 bp, Homo sapiens
ttctaaacccaatccaaat

SEQ ID NO: 2922815 - DNA, 21 bp, Homo sapiens
ttctaaacctgtgcctccctc

SEQ ID NO: 2922816 - DNA, 23 bp, Homo sapiens
ttctaaactccctggctgttctg

SEQ ID NO: 2922817 - DNA, 13 bp, Homo sapiens
ttctaaagatgga

SEQ ID NO: 2922818 - DNA, 23 bp, Homo sapiens
ttctaaagattctatagttctag

SEQ ID NO: 2922819 - DNA, 22 bp, Homo sapiens
ttctaaaggtgttgtcccttct

SEQ ID NO: 2922820 - DNA, 13 bp, Homo sapiens
ttctaaagttcta

SEQ ID NO: 2922821 - DNA, 17 bp, Homo sapiens
ttctaaagttctaagat

SEQ ID NO: 2922822 - DNA, 21 bp, Homo sapiens
ttctaaataaaagttttacaa

SEQ ID NO: 2922823 - DNA, 17 bp, Homo sapiens
ttctaaatatgaatgaa

SEQ ID NO: 2922824 - DNA, 15 bp, Homo sapiens
ttctaaatgttatta

SEQ ID NO: 2922825 - DNA, 20 bp, Homo sapiens
ttctaagactcaaatgttct

SEQ ID NO: 2922826 - DNA, 20 bp, Homo sapiens
ttctaagacttactctaaga

SEQ ID NO: 2922827 - DNA, 20 bp, Homo sapiens
ttctaagatgtgatattcta

SEQ ID NO: 2922828 - DNA, 13 bp, Homo sapiens
ttctaagattcta

SEQ ID NO: 2922829 - DNA, 15 bp, Homo sapiens
ttctaagattctaaa

SEQ ID NO: 2922830 - DNA, 14 bp, Homo sapiens
ttctaagattctga

SEQ ID NO: 2922831 - DNA, 13 bp, Homo sapiens
ttctaagcatgta

SEQ ID NO: 2922832 - DNA, 15 bp, Homo sapiens
ttctaaggacttttt

SEQ ID NO: 2922833 - DNA, 15 bp, Homo sapiens
ttctaaggcctagga

SEQ ID NO: 2922834 - DNA, 22 bp, Homo sapiens
ttctaaggcctaggattctaaa

SEQ ID NO: 2922835 - DNA, 20 bp, Homo sapiens
ttctaaggtccggtgttcta

SEQ ID NO: 2922836 - DNA, 21 bp, Homo sapiens
ttctaaggtccggtgttctaa

SEQ ID NO: 2922837 - DNA, 23 bp, Homo sapiens
ttctaaggtccggtgttctaaga

SEQ ID NO: 2922838 - DNA, 17 bp, Homo sapiens
ttctaagtctttccatt

SEQ ID NO: 2922839 - DNA, 12 bp, Homo sapiens
ttctaagtttct

SEQ ID NO: 2922840 - DNA, 17 bp, Homo sapiens
ttctaagtttctaagat

SEQ ID NO: 2922841 - DNA, 21 bp, Homo sapiens
ttctaagtttctaagattcta

SEQ ID NO: 2922842 - DNA, 16 bp, Homo sapiens
ttctaataatttctaa

SEQ ID NO: 2922843 - DNA, 18 bp, Homo sapiens
ttctaataatttctaatg

SEQ ID NO: 2922844 - DNA, 19 bp, Homo sapiens
ttctaataatttctaatgt

SEQ ID NO: 2922845 - DNA, 12 bp, Homo sapiens
ttctaatcttaa

SEQ ID NO: 2922846 - DNA, 13 bp, Homo sapiens
ttctacacctgga

SEQ ID NO: 2922847 - DNA, 16 bp, Homo sapiens
ttctacacctggacca

SEQ ID NO: 2922848 - DNA, 19 bp, Homo sapiens
ttctacataattgtgacca

SEQ ID NO: 2922849 - DNA, 16 bp, Homo sapiens
ttctacatttcttaga

SEQ ID NO: 2922850 - DNA, 20 bp, Homo sapiens
ttctactgagtccctggcaa

SEQ ID NO: 2922851 - DNA, 14 bp, Homo sapiens
ttctacttttaaat

SEQ ID NO: 2922852 - DNA, 18 bp, Homo sapiens
ttctagaaaagcttccta

SEQ ID NO: 2922853 - DNA, 21 bp, Homo sapiens
ttctagaacatccctgccagc

SEQ ID NO: 2922854 - DNA, 17 bp, Homo sapiens
ttctagaagataacatt

SEQ ID NO: 2922855 - DNA, 20 bp, Homo sapiens
ttctagacatggaggttcta

SEQ ID NO: 2922856 - DNA, 22 bp, Homo sapiens
ttctagacatggaggttctaag

SEQ ID NO: 2922857 - DNA, 14 bp, Homo sapiens
ttctagagttcaga

SEQ ID NO: 2922858 - DNA, 12 bp, Homo sapiens
ttctagatgatt

SEQ ID NO: 2922859 - DNA, 19 bp, Homo sapiens
ttctagatgcaagtctctt

SEQ ID NO: 2922860 - DNA, 19 bp, Homo sapiens
ttctaggagtcaactggct

SEQ ID NO: 2922861 - DNA, 21 bp, Homo sapiens
ttctaggcactgtagttctaa

SEQ ID NO: 2922862 - DNA, 19 bp, Homo sapiens
ttctagggctgggaaacac

SEQ ID NO: 2922863 - DNA, 14 bp, Homo sapiens
ttctaggtaggaaa

SEQ ID NO: 2922864 - DNA, 20 bp, Homo sapiens
ttctaggtttcaaagatgct

SEQ ID NO: 2922865 - DNA, 20 bp, Homo sapiens
ttctaggtttctcttgtctt

SEQ ID NO: 2922866 - DNA, 21 bp, Homo sapiens
ttctagtatgtcttgaaacat

SEQ ID NO: 2922867 - DNA, 17 bp, Homo sapiens
ttctagttctgccagga

SEQ ID NO: 2922868 - DNA, 14 bp, Homo sapiens
ttctagttgaaaat

SEQ ID NO: 2922869 - DNA, 13 bp, Homo sapiens
ttctagtttcctg

SEQ ID NO: 2922870 - DNA, 22 bp, Homo sapiens
ttctataagttttatgttaaat

SEQ ID NO: 2922871 - DNA, 16 bp, Homo sapiens
ttctataatgtgcctg

SEQ ID NO: 2922872 - DNA, 20 bp, Homo sapiens
ttctataggaacatatgaaa

SEQ ID NO: 2922873 - DNA, 17 bp, Homo sapiens
ttctatattttaataga

SEQ ID NO: 2922874 - DNA, 23 bp, Homo sapiens
ttctatcagacgtgctccctccc

SEQ ID NO: 2922875 - DNA, 17 bp, Homo sapiens
ttctatcgttattataa

SEQ ID NO: 2922876 - DNA, 22 bp, Homo sapiens
ttctatcgttattataaatgtt

SEQ ID NO: 2922877 - DNA, 20 bp, Homo sapiens
ttctatcttgttccaaggcc

SEQ ID NO: 2922878 - DNA, 21 bp, Homo sapiens
ttgagtgttcctttttaaatg

SEQ ID NO: 2922879 - DNA, 20 bp, Homo sapiens
ttgagttacattaaaataaa

SEQ ID NO: 2922880 - DNA, 15 bp, Homo sapiens
ttgagttgctctgtc

SEQ ID NO: 2922881 - DNA, 19 bp, Homo sapiens
ttgagttttcagtggggca

SEQ ID NO: 2922882 - DNA, 12 bp, Homo sapiens
ttgagttttgtt

SEQ ID NO: 2922883 - DNA, 14 bp, Homo sapiens
ttgataaaatgtaa

SEQ ID NO: 2922884 - DNA, 19 bp, Homo sapiens
ttgataaaatgttcctttt

SEQ ID NO: 2922885 - DNA, 20 bp, Homo sapiens
ttgataaagtagtaaaaatt

SEQ ID NO: 2922886 - DNA, 13 bp, Homo sapiens
ttgataactttgc

SEQ ID NO: 2922887 - DNA, 14 bp, Homo sapiens
ttgataatttcagg

SEQ ID NO: 2922888 - DNA, 23 bp, Homo sapiens
ttgataatttcagggaaattaat

SEQ ID NO: 2922889 - DNA, 16 bp, Homo sapiens
ttgataccttcaatga

SEQ ID NO: 2922890 - DNA, 22 bp, Homo sapiens
ttgatagggtctaccaatacaa

SEQ ID NO: 2922891 - DNA, 21 bp, Homo sapiens
ttgatatcggtgctatgtgtt

SEQ ID NO: 2922892 - DNA, 14 bp, Homo sapiens
ttgatatttccttc

SEQ ID NO: 2922893 - DNA, 17 bp, Homo sapiens
ttgatattttttctctc

SEQ ID NO: 2922894 - DNA, 17 bp, Homo sapiens
ttgatcacatgcttgaa

SEQ ID NO: 2922895 - DNA, 14 bp, Homo sapiens
ttgatcagtataat

SEQ ID NO: 2922896 - DNA, 19 bp, Homo sapiens
ttgatctacccgtgcctgg

SEQ ID NO: 2922897 - DNA, 19 bp, Homo sapiens
ttgatctggaacccagact

SEQ ID NO: 2922898 - DNA, 19 bp, Homo sapiens
ttgatgactggcattttat

SEQ ID NO: 2922899 - DNA, 22 bp, Homo sapiens
ttgatgactggcattttataga

SEQ ID NO: 2922900 - DNA, 13 bp, Homo sapiens
ttgatgcttttct

SEQ ID NO: 2922901 - DNA, 12 bp, Homo sapiens
ttgatggaggag

SEQ ID NO: 2922902 - DNA, 11 bp, Homo sapiens
ttgatggctaa

SEQ ID NO: 2922903 - DNA, 18 bp, Homo sapiens
ttgatggctaagatactg

SEQ ID NO: 2922904 - DNA, 17 bp, Homo sapiens
ttgatgggattctggac

SEQ ID NO: 2922905 - DNA, 16 bp, Homo sapiens
ttgatgtgcactgcat

SEQ ID NO: 2922906 - DNA, 18 bp, Homo sapiens
ttgatgtttcctggaagc

SEQ ID NO: 2922907 - DNA, 14 bp, Homo sapiens
ttgattaaaatctc

SEQ ID NO: 2922908 - DNA, 16 bp, Homo sapiens
ttgattaaaatctctt

SEQ ID NO: 2922909 - DNA, 16 bp, Homo sapiens
ttgattatttgtttta

SEQ ID NO: 2922910 - DNA, 12 bp, Homo sapiens
ttgattcaaaat

SEQ ID NO: 2922911 - DNA, 18 bp, Homo sapiens
ttgattcaaaatatttaa

SEQ ID NO: 2922912 - DNA, 20 bp, Homo sapiens
ttgattctgcagtaaatctt

SEQ ID NO: 2922913 - DNA, 19 bp, Homo sapiens
ttgattgaagtattcaatc

SEQ ID NO: 2922914 - DNA, 13 bp, Homo sapiens
ttgattgctaaat

SEQ ID NO: 2922915 - DNA, 15 bp, Homo sapiens
ttgattgctaaatgt

SEQ ID NO: 2922916 - DNA, 20 bp, Homo sapiens
ttgattgtcagccacctccc

SEQ ID NO: 2922917 - DNA, 12 bp, Homo sapiens
ttgattgtgcat

SEQ ID NO: 2922918 - DNA, 20 bp, Homo sapiens
ttgatttaactgacttaaca

SEQ ID NO: 2922919 - DNA, 16 bp, Homo sapiens
ttgatttcctgtgtca

SEQ ID NO: 2922920 - DNA, 14 bp, Homo sapiens
ttgatttgaagaac

SEQ ID NO: 2922921 - DNA, 13 bp, Homo sapiens
ttgatttgcattg

SEQ ID NO: 2922922 - DNA, 14 bp, Homo sapiens
ttgatttgcattga

SEQ ID NO: 2922923 - DNA, 19 bp, Homo sapiens
ttgcaaaaactacaaccaa

SEQ ID NO: 2922924 - DNA, 15 bp, Homo sapiens
ttgcaaaagtgtatg

SEQ ID NO: 2922925 - DNA, 16 bp, Homo sapiens
ttgcaaaataagtttt

SEQ ID NO: 2922926 - DNA, 14 bp, Homo sapiens
ttgcaaagtactgt

SEQ ID NO: 2922927 - DNA, 13 bp, Homo sapiens
ttgcaaatacctc

SEQ ID NO: 2922928 - DNA, 16 bp, Homo sapiens
ttgcaaatcttgaaat

SEQ ID NO: 2922929 - DNA, 14 bp, Homo sapiens
ttgcaaggccgctg

SEQ ID NO: 2922930 - DNA, 23 bp, Homo sapiens
ttgcaaggccgctgttcacccac

SEQ ID NO: 2922931 - DNA, 14 bp, Homo sapiens
ttgcaataacttct

SEQ ID NO: 2922932 - DNA, 13 bp, Homo sapiens
ttgcaataatgca

SEQ ID NO: 2922933 - DNA, 14 bp, Homo sapiens
ttgcaataatgcag

SEQ ID NO: 2922934 - DNA, 18 bp, Homo sapiens
ttgcaatacattgttcag

SEQ ID NO: 2922935 - DNA, 15 bp, Homo sapiens
ttgcaatatctgaag

SEQ ID NO: 2922936 - DNA, 20 bp, Homo sapiens
ttgcaatccacaatctgaca

SEQ ID NO: 2922937 - DNA, 19 bp, Homo sapiens
ttgcacaatattgaacttt

SEQ ID NO: 2922938 - DNA, 20 bp, Homo sapiens
ttgcacaatattgaactttt

SEQ ID NO: 2922939 - DNA, 21 bp, Homo sapiens
ttgcacaatattgaacttttt

SEQ ID NO: 2922940 - DNA, 19 bp, Homo sapiens
ttgcacacccactcagctc

SEQ ID NO: 2922941 - DNA, 23 bp, Homo sapiens
ttgcacagaagtcctgtatgtct

SEQ ID NO: 2922942 - DNA, 12 bp, Homo sapiens
ttgcacattgtt

SEQ ID NO: 2922943 - DNA, 20 bp, Homo sapiens
ttgcaccaattaagtgttga

SEQ ID NO: 2922944 - DNA, 17 bp, Homo sapiens
ttgcaccattctttctt

SEQ ID NO: 2922945 - DNA, 16 bp, Homo sapiens
ttgcaccgcctgccct

SEQ ID NO: 2922946 - DNA, 16 bp, Homo sapiens
ttgcactcaagttgtt

SEQ ID NO: 2922947 - DNA, 17 bp, Homo sapiens
ttgcacttgtgattatt

SEQ ID NO: 2922948 - DNA, 14 bp, Homo sapiens
ttgcacttttgaat

SEQ ID NO: 2922949 - DNA, 17 bp, Homo sapiens
ttgcagaaaagcacctg

SEQ ID NO: 2922950 - DNA, 20 bp, Homo sapiens
ttgcagaaaagcacctgccg

SEQ ID NO: 2922951 - DNA, 15 bp, Homo sapiens
ttgcagaagagggtg

SEQ ID NO: 2922952 - DNA, 20 bp, Homo sapiens
ttgcagaagagggtgtgttt

SEQ ID NO: 2922953 - DNA, 21 bp, Homo sapiens
ttgcagaagagggtgtgtttg

SEQ ID NO: 2922954 - DNA, 16 bp, Homo sapiens
ttgcagacaggaatct

SEQ ID NO: 2922955 - DNA, 18 bp, Homo sapiens
ttgcagacaggaatctta

SEQ ID NO: 2922956 - DNA, 22 bp, Homo sapiens
ttgcagacagtgttttgcacat

SEQ ID NO: 2922957 - DNA, 16 bp, Homo sapiens
ttgcagaggagcccag

SEQ ID NO: 2922958 - DNA, 19 bp, Homo sapiens
ttgcagatttctgccttga

SEQ ID NO: 2922959 - DNA, 17 bp, Homo sapiens
ttgcagcaattaaaaat

SEQ ID NO: 2922960 - DNA, 17 bp, Homo sapiens
ttgcagccaggagaagg

SEQ ID NO: 2922961 - DNA, 15 bp, Homo sapiens
ttgcagcctggtcac

SEQ ID NO: 2922962 - DNA, 23 bp, Homo sapiens
ttgcagctaaggaggggaaaaaa

SEQ ID NO: 2922963 - DNA, 14 bp, Homo sapiens
ttgcagctggccca

SEQ ID NO: 2922964 - DNA, 15 bp, Homo sapiens
ttgcaggagacattt

SEQ ID NO: 2922965 - DNA, 20 bp, Homo sapiens
ttgcaggagacattttcata

SEQ ID NO: 2922966 - DNA, 19 bp, Homo sapiens
ttgcaggatttttagagca

SEQ ID NO: 2922967 - DNA, 22 bp, Homo sapiens
ttgcaggatttttagagcatta

SEQ ID NO: 2922968 - DNA, 11 bp, Homo sapiens
ttgcaggcagt

SEQ ID NO: 2922969 - DNA, 17 bp, Homo sapiens
ttgcagggcacagatga

SEQ ID NO: 2922970 - DNA, 14 bp, Homo sapiens
ttgcaggggactgg

SEQ ID NO: 2922971 - DNA, 23 bp, Homo sapiens
ttgcagggtcctcttctgggcct

SEQ ID NO: 2922972 - DNA, 14 bp, Homo sapiens
ttgcagtcatagaa

SEQ ID NO: 2922973 - DNA, 17 bp, Homo sapiens
ttgcagtctgtattttc

SEQ ID NO: 2922974 - DNA, 14 bp, Homo sapiens
ttgcagtctttttt

SEQ ID NO: 2922975 - DNA, 14 bp, Homo sapiens
ttgcagtgaagtgt

SEQ ID NO: 2922976 - DNA, 16 bp, Homo sapiens
ttgcagtgagctgaga

SEQ ID NO: 2922977 - DNA, 18 bp, Homo sapiens
ttgcagtggcctggccgt

SEQ ID NO: 2922978 - DNA, 13 bp, Homo sapiens
ttgcagttcacct

SEQ ID NO: 2922979 - DNA, 19 bp, Homo sapiens
ttgcagtttatcattcaag

SEQ ID NO: 2922980 - DNA, 16 bp, Homo sapiens
ttgcagttttgtaagc

SEQ ID NO: 2922981 - DNA, 19 bp, Homo sapiens
ttgcagttttgtaagccct

SEQ ID NO: 2922982 - DNA, 17 bp, Homo sapiens
ttgcataaacaatccaa

SEQ ID NO: 2922983 - DNA, 18 bp, Homo sapiens
ttgcataaacaatccaaa

SEQ ID NO: 2922984 - DNA, 14 bp, Homo sapiens
ttgcatagaattca

SEQ ID NO: 2922985 - DNA, 22 bp, Homo sapiens
ttgcatcatagaacagaaatat

SEQ ID NO: 2922986 - DNA, 14 bp, Homo sapiens
ttgcatctgaaata

SEQ ID NO: 2922987 - DNA, 17 bp, Homo sapiens
ttgcatgggctaatgaa

SEQ ID NO: 2922988 - DNA, 22 bp, Homo sapiens
ttgcatgtctaattcatttact

SEQ ID NO: 2922989 - DNA, 15 bp, Homo sapiens
ttgcatgtgactctg

SEQ ID NO: 2922990 - DNA, 22 bp, Homo sapiens
ttgcattaaattcacaaacttt

SEQ ID NO: 2922991 - DNA, 22 bp, Homo sapiens
ttgcattgaacacaaactgtaa

SEQ ID NO: 2922992 - DNA, 23 bp, Homo sapiens
ttgcattgaacacaaactgtaaa

SEQ ID NO: 2922993 - DNA, 15 bp, Homo sapiens
ttgcattgacattat

SEQ ID NO: 2922994 - DNA, 16 bp, Homo sapiens
ttgcattgagctgaga

SEQ ID NO: 2922995 - DNA, 17 bp, Homo sapiens
ttgcatttattgcagtt

SEQ ID NO: 2922996 - DNA, 21 bp, Homo sapiens
ttgcatttggattggggtccc

SEQ ID NO: 2922997 - DNA, 12 bp, Homo sapiens
ttgcattttgat

SEQ ID NO: 2922998 - DNA, 12 bp, Homo sapiens
ttgccaaagcag

SEQ ID NO: 2922999 - DNA, 22 bp, Homo sapiens
ttgccaactcaggttcacagca

SEQ ID NO: 2923000 - DNA, 21 bp, Homo sapiens
ttgccaagaaaatgaagggat

SEQ ID NO: 2923001 - DNA, 22 bp, Homo sapiens
ttgccaagaaaatgaagggatt

SEQ ID NO: 2923002 - DNA, 20 bp, Homo sapiens
ttgccactgatattcagaat

SEQ ID NO: 2923003 - DNA, 17 bp, Homo sapiens
ttgccaggaatgtttca

SEQ ID NO: 2923004 - DNA, 22 bp, Homo sapiens
ttgccagggatgggcagcccaa

SEQ ID NO: 2923005 - DNA, 14 bp, Homo sapiens
ttgccagggctctg

SEQ ID NO: 2923006 - DNA, 17 bp, Homo sapiens
ttgccagggctctgggg

SEQ ID NO: 2923007 - DNA, 22 bp, Homo sapiens
ttgccatcccaagcccagtgac

SEQ ID NO: 2923008 - DNA, 17 bp, Homo sapiens
ttgccatcgggtgccaa

SEQ ID NO: 2923009 - DNA, 12 bp, Homo sapiens
ttgcccagagat

SEQ ID NO: 2923010 - DNA, 19 bp, Homo sapiens
ttgcccagagatgcctcca

SEQ ID NO: 2923011 - DNA, 18 bp, Homo sapiens
tttatatgccctcaagta

SEQ ID NO: 2923012 - DNA, 13 bp, Homo sapiens
tttatatgtacat

SEQ ID NO: 2923013 - DNA, 18 bp, Homo sapiens
tttatattaaataacatg

SEQ ID NO: 2923014 - DNA, 12 bp, Homo sapiens
tttatattgaaa

SEQ ID NO: 2923015 - DNA, 14 bp, Homo sapiens
tttatattgtaaat

SEQ ID NO: 2923016 - DNA, 16 bp, Homo sapiens
tttatattttatactg

SEQ ID NO: 2923017 - DNA, 14 bp, Homo sapiens
tttatcaaatcagt

SEQ ID NO: 2923018 - DNA, 17 bp, Homo sapiens
tttatcaactcaagaat

SEQ ID NO: 2923019 - DNA, 14 bp, Homo sapiens
tttatcacctaaaa

SEQ ID NO: 2923020 - DNA, 17 bp, Homo sapiens
tttatcacctcattctg

SEQ ID NO: 2923021 - DNA, 14 bp, Homo sapiens
tttatcattcaagt

SEQ ID NO: 2923022 - DNA, 16 bp, Homo sapiens
tttatccaaaatgtgt

SEQ ID NO: 2923023 - DNA, 19 bp, Homo sapiens
tttatccctgcttatctga

SEQ ID NO: 2923024 - DNA, 14 bp, Homo sapiens
tttatcctaaaaat

SEQ ID NO: 2923025 - DNA, 20 bp, Homo sapiens
tttatctaaaagaatttaaa

SEQ ID NO: 2923026 - DNA, 21 bp, Homo sapiens
tttatctaaaagaatttaaat

SEQ ID NO: 2923027 - DNA, 18 bp, Homo sapiens
tttatctccatactttgg

SEQ ID NO: 2923028 - DNA, 17 bp, Homo sapiens
tttatctgggattatgg

SEQ ID NO: 2923029 - DNA, 18 bp, Homo sapiens
tttatctggtatggtgct

SEQ ID NO: 2923030 - DNA, 17 bp, Homo sapiens
tttatgaaacagaaaag

SEQ ID NO: 2923031 - DNA, 14 bp, Homo sapiens
tttatgacagtatc

SEQ ID NO: 2923032 - DNA, 13 bp, Homo sapiens
tttatgagaaatg

SEQ ID NO: 2923033 - DNA, 19 bp, Homo sapiens
tttatgataatagattctc

SEQ ID NO: 2923034 - DNA, 18 bp, Homo sapiens
tttatgatgacaatcaaa

SEQ ID NO: 2923035 - DNA, 14 bp, Homo sapiens
tttatgccacctga

SEQ ID NO: 2923036 - DNA, 17 bp, Homo sapiens
tttatgctataaatttt

SEQ ID NO: 2923037 - DNA, 23 bp, Homo sapiens
tttatgctataaattttttgaaa

SEQ ID NO: 2923038 - DNA, 19 bp, Homo sapiens
tttatggccgtatcaaatg

SEQ ID NO: 2923039 - DNA, 17 bp, Homo sapiens
tttatgggtttcttcca

SEQ ID NO: 2923040 - DNA, 20 bp, Homo sapiens
tttatgggtttcttccagca

SEQ ID NO: 2923041 - DNA, 11 bp, Homo sapiens
tttatgtagac

SEQ ID NO: 2923042 - DNA, 22 bp, Homo sapiens
tttatgttacttaaacatcatt

SEQ ID NO: 2923043 - DNA, 16 bp, Homo sapiens
tttatgtttgtacaca

SEQ ID NO: 2923044 - DNA, 12 bp, Homo sapiens
tttattaaatag

SEQ ID NO: 2923045 - DNA, 14 bp, Homo sapiens
tttattaaatttat

SEQ ID NO: 2923046 - DNA, 14 bp, Homo sapiens
tttattaatagaat

SEQ ID NO: 2923047 - DNA, 12 bp, Homo sapiens
tttattaatgca

SEQ ID NO: 2923048 - DNA, 17 bp, Homo sapiens
tttattaattgctttga

SEQ ID NO: 2923049 - DNA, 17 bp, Homo sapiens
tttattaattttctatg

SEQ ID NO: 2923050 - DNA, 12 bp, Homo sapiens
tttattaccccc

SEQ ID NO: 2923051 - DNA, 14 bp, Homo sapiens
tttattataaattc

SEQ ID NO: 2923052 - DNA, 19 bp, Homo sapiens
tttattcaaactacctata

SEQ ID NO: 2923053 - DNA, 18 bp, Homo sapiens
tttattccagaatgctgt

SEQ ID NO: 2923054 - DNA, 21 bp, Homo sapiens
tttattctagggtttcttaaa

SEQ ID NO: 2923055 - DNA, 18 bp, Homo sapiens
tttattcttctagagttc

SEQ ID NO: 2923056 - DNA, 12 bp, Homo sapiens
tttattgccatt

SEQ ID NO: 2923057 - DNA, 23 bp, Homo sapiens
tttattgccttttaatttttaat

SEQ ID NO: 2923058 - DNA, 15 bp, Homo sapiens
tttatttaaaagatt

SEQ ID NO: 2923059 - DNA, 22 bp, Homo sapiens
tttatttaaaagattcattttt

SEQ ID NO: 2923060 - DNA, 19 bp, Homo sapiens
tttatttaaattacaattt

SEQ ID NO: 2923061 - DNA, 18 bp, Homo sapiens
tttatttgttgagagtgt

SEQ ID NO: 2923062 - DNA, 13 bp, Homo sapiens
tttattttacaca

SEQ ID NO: 2923063 - DNA, 12 bp, Homo sapiens
tttattttatga

SEQ ID NO: 2923064 - DNA, 12 bp, Homo sapiens
tttattttgtgg

SEQ ID NO: 2923065 - DNA, 20 bp, Homo sapiens
tttatttttgtatattgtat

SEQ ID NO: 2923066 - DNA, 20 bp, Homo sapiens
tttatttttttgatggctaa

SEQ ID NO: 2923067 - DNA, 15 bp, Homo sapiens
tttcaaaaacacagt

SEQ ID NO: 2923068 - DNA, 17 bp, Homo sapiens
tttcaaaaattacacta

SEQ ID NO: 2923069 - DNA, 21 bp, Homo sapiens
tttcaaaacggatccgggcaa

SEQ ID NO: 2923070 - DNA, 20 bp, Homo sapiens
tttcaaaactcatttcctat

SEQ ID NO: 2923071 - DNA, 20 bp, Homo sapiens
tttcaaaataaaaaccaaga

SEQ ID NO: 2923072 - DNA, 17 bp, Homo sapiens
tttcaaaatccaaaaag

SEQ ID NO: 2923073 - DNA, 13 bp, Homo sapiens
tttcaaacaaaat

SEQ ID NO: 2923074 - DNA, 22 bp, Homo sapiens
tttcaaactttattgacaagtg

SEQ ID NO: 2923075 - DNA, 13 bp, Homo sapiens
tttcaaagatgct

SEQ ID NO: 2923076 - DNA, 14 bp, Homo sapiens
tttcaaagccctgc

SEQ ID NO: 2923077 - DNA, 17 bp, Homo sapiens
tttcaaagccctgcctc

SEQ ID NO: 2923078 - DNA, 18 bp, Homo sapiens
tttcaaagccctgcctct

SEQ ID NO: 2923079 - DNA, 21 bp, Homo sapiens
tttcaaagccctgcctctgtg

SEQ ID NO: 2923080 - DNA, 19 bp, Homo sapiens
tttcaaatcatgttttttc

SEQ ID NO: 2923081 - DNA, 15 bp, Homo sapiens
tttcaaatctgtaat

SEQ ID NO: 2923082 - DNA, 18 bp, Homo sapiens
tttcaaatttagaaacta

SEQ ID NO: 2923083 - DNA, 20 bp, Homo sapiens
tttcaaatttagaaactaat

SEQ ID NO: 2923084 - DNA, 21 bp, Homo sapiens
tttcaaatttagaaactaatt

SEQ ID NO: 2923085 - DNA, 23 bp, Homo sapiens
tttcaaccccaccctgtttggat

SEQ ID NO: 2923086 - DNA, 19 bp, Homo sapiens
tttcaacctagaaaccttt

SEQ ID NO: 2923087 - DNA, 17 bp, Homo sapiens
tttcaagaaaactggaa

SEQ ID NO: 2923088 - DNA, 18 bp, Homo sapiens
tttcaagaaaactggaaa

SEQ ID NO: 2923089 - DNA, 15 bp, Homo sapiens
tttcaagatccaaat

SEQ ID NO: 2923090 - DNA, 18 bp, Homo sapiens
tttcaaggcactctagat

SEQ ID NO: 2923091 - DNA, 22 bp, Homo sapiens
tttcaaggcactctagattcca

SEQ ID NO: 2923092 - DNA, 18 bp, Homo sapiens
tttcaagggaattaaata

SEQ ID NO: 2923093 - DNA, 16 bp, Homo sapiens
tttcaaggttctaacc

SEQ ID NO: 2923094 - DNA, 11 bp, Homo sapiens
tttcaagtagc

SEQ ID NO: 2923095 - DNA, 14 bp, Homo sapiens
tttcaatcactgtc

SEQ ID NO: 2923096 - DNA, 12 bp, Homo sapiens
tttcaattatat

SEQ ID NO: 2923097 - DNA, 14 bp, Homo sapiens
tttcacaaggtctt

SEQ ID NO: 2923098 - DNA, 13 bp, Homo sapiens
tttcacataaatg

SEQ ID NO: 2923099 - DNA, 18 bp, Homo sapiens
tttcacatagctgtctag

SEQ ID NO: 2923100 - DNA, 18 bp, Homo sapiens
tttcacattagaagacaa

SEQ ID NO: 2923101 - DNA, 19 bp, Homo sapiens
tttcacattagaagacaat

SEQ ID NO: 2923102 - DNA, 16 bp, Homo sapiens
tttcacattcttataa

SEQ ID NO: 2923103 - DNA, 16 bp, Homo sapiens
tttcacattcttggct

SEQ ID NO: 2923104 - DNA, 22 bp, Homo sapiens
tttcaccatttgattatgtagc

SEQ ID NO: 2923105 - DNA, 21 bp, Homo sapiens
tttcacctccttcaattccat

SEQ ID NO: 2923106 - DNA, 16 bp, Homo sapiens
tttcacctttacttta

SEQ ID NO: 2923107 - DNA, 19 bp, Homo sapiens
tttcacctttactttagaa

SEQ ID NO: 2923108 - DNA, 13 bp, Homo sapiens
tttcactgccata

SEQ ID NO: 2923109 - DNA, 12 bp, Homo sapiens
tttcactgctgc

SEQ ID NO: 2923110 - DNA, 16 bp, Homo sapiens
tttcactgctgctcct

SEQ ID NO: 2923111 - DNA, 16 bp, Homo sapiens
tttcactggaaaggaa

SEQ ID NO: 2923112 - DNA, 22 bp, Homo sapiens
tttcacttcccgagcgctggtc

SEQ ID NO: 2923113 - DNA, 14 bp, Homo sapiens
tttcacttcctctc

SEQ ID NO: 2923114 - DNA, 22 bp, Homo sapiens
tttcacttcctctccacaggag

SEQ ID NO: 2923115 - DNA, 13 bp, Homo sapiens
tttcacttgtctt

SEQ ID NO: 2923116 - DNA, 16 bp, Homo sapiens
tttcagacaaattact

SEQ ID NO: 2923117 - DNA, 15 bp, Homo sapiens
tttcagacttgtcaa

SEQ ID NO: 2923118 - DNA, 18 bp, Homo sapiens
tttcagaggtgaattaat

SEQ ID NO: 2923119 - DNA, 19 bp, Homo sapiens
tttcagatataaatactga

SEQ ID NO: 2923120 - DNA, 16 bp, Homo sapiens
tttcagatatcaaaat

SEQ ID NO: 2923121 - DNA, 15 bp, Homo sapiens
tttcagatgtaatgt

SEQ ID NO: 2923122 - DNA, 16 bp, Homo sapiens
tttcagatgtaatgtt

SEQ ID NO: 2923123 - DNA, 17 bp, Homo sapiens
tttcagatgtaatgttt

SEQ ID NO: 2923124 - DNA, 19 bp, Homo sapiens
tttcagatgtaatgttttc

SEQ ID NO: 2923125 - DNA, 20 bp, Homo sapiens
tttcagcaacaaccatctca

SEQ ID NO: 2923126 - DNA, 12 bp, Homo sapiens
tttcagcatcaa

SEQ ID NO: 2923127 - DNA, 20 bp, Homo sapiens
tttcagcatcaaacatgaaa

SEQ ID NO: 2923128 - DNA, 23 bp, Homo sapiens
tttcagcatcaaacatgaaaaca

SEQ ID NO: 2923129 - DNA, 18 bp, Homo sapiens
tttcagcattaagctgtt

SEQ ID NO: 2923130 - DNA, 19 bp, Homo sapiens
tttcagccaatttgtctcc

SEQ ID NO: 2923131 - DNA, 17 bp, Homo sapiens
tttcagcgatgtatgca

SEQ ID NO: 2923132 - DNA, 22 bp, Homo sapiens
tttcagcgatgtatgcagctat

SEQ ID NO: 2923133 - DNA, 12 bp, Homo sapiens
tttcagcgcccc

SEQ ID NO: 2923134 - DNA, 23 bp, Homo sapiens
tttcagcgcccccaggcctgccc

SEQ ID NO: 2923135 - DNA, 14 bp, Homo sapiens
tttcagctggaaac

SEQ ID NO: 2923136 - DNA, 16 bp, Homo sapiens
tttcagctttcttcag

SEQ ID NO: 2923137 - DNA, 21 bp, Homo sapiens
tttcagtacttcagcaagaga

SEQ ID NO: 2923138 - DNA, 23 bp, Homo sapiens
tttcagtacttcagcaagagaga

SEQ ID NO: 2923139 - DNA, 19 bp, Homo sapiens
tttcagtacttttttaaat

SEQ ID NO: 2923140 - DNA, 19 bp, Homo sapiens
tttcagtgaatatgcctgt

SEQ ID NO: 2923141 - DNA, 18 bp, Homo sapiens
tttcagtgatttttagta

SEQ ID NO: 2923142 - DNA, 20 bp, Homo sapiens
tttcagttctttctttttct

SEQ ID NO: 2923143 - DNA, 24 bp, Homo sapiens
tttcagttttggtgataatcgtct

SEQ ID NO: 2923144 - DNA, 20 bp, Homo sapiens
tttgtggccaaggagctgct

SEQ ID NO: 2923145 - DNA, 19 bp, Homo sapiens
tttgtggtctttttcctga

SEQ ID NO: 2923146 - DNA, 16 bp, Homo sapiens
tttgtggtgatataga

SEQ ID NO: 2923147 - DNA, 20 bp, Homo sapiens
tttgtgtatttaacagggag

SEQ ID NO: 2923148 - DNA, 14 bp, Homo sapiens
tttgtgtgtatata

SEQ ID NO: 2923149 - DNA, 23 bp, Homo sapiens
tttgtgtgtcttttataaaaagt

SEQ ID NO: 2923150 - DNA, 14 bp, Homo sapiens
tttgtgtgttatac

SEQ ID NO: 2923151 - DNA, 17 bp, Homo sapiens
tttgtgtgttgtcttga

SEQ ID NO: 2923152 - DNA, 18 bp, Homo sapiens
tttgtgtgttgtcttgaa

SEQ ID NO: 2923153 - DNA, 15 bp, Homo sapiens
tttgtgtttccattt

SEQ ID NO: 2923154 - DNA, 18 bp, Homo sapiens
tttgttaaaaccaaactg

SEQ ID NO: 2923155 - DNA, 24 bp, Homo sapiens
tttgttaaaatacagttctgtcat

SEQ ID NO: 2923156 - DNA, 18 bp, Homo sapiens
tttgttaaggtcctgaaa

SEQ ID NO: 2923157 - DNA, 14 bp, Homo sapiens
tttgttaattaaat

SEQ ID NO: 2923158 - DNA, 17 bp, Homo sapiens
tttgttactttaaaaat

SEQ ID NO: 2923159 - DNA, 19 bp, Homo sapiens
tttgttactttgaatagtc

SEQ ID NO: 2923160 - DNA, 17 bp, Homo sapiens
tttgttaggattttcac

SEQ ID NO: 2923161 - DNA, 16 bp, Homo sapiens
tttgttgagtctctga

SEQ ID NO: 2923162 - DNA, 17 bp, Homo sapiens
tttgttgagtctctgaa

SEQ ID NO: 2923163 - DNA, 15 bp, Homo sapiens
tttgttgtaaaacaa

SEQ ID NO: 2923164 - DNA, 16 bp, Homo sapiens
tttgttgtcatgtgta

SEQ ID NO: 2923165 - DNA, 22 bp, Homo sapiens
tttgttgtctacattaaatcac

SEQ ID NO: 2923166 - DNA, 14 bp, Homo sapiens
tttgttgttttctg

SEQ ID NO: 2923167 - DNA, 14 bp, Homo sapiens
tttgtttaaaattc

SEQ ID NO: 2923168 - DNA, 13 bp, Homo sapiens
tttgtttatgcat

SEQ ID NO: 2923169 - DNA, 21 bp, Homo sapiens
tttgtttatgttacttaaaca

SEQ ID NO: 2923170 - DNA, 16 bp, Homo sapiens
tttgtttcctgtctga

SEQ ID NO: 2923171 - DNA, 15 bp, Homo sapiens
tttgtttgctatctt

SEQ ID NO: 2923172 - DNA, 18 bp, Homo sapiens
tttgtttgtattcatgtt

SEQ ID NO: 2923173 - DNA, 20 bp, Homo sapiens
tttgttttaaggaaaaaaga

SEQ ID NO: 2923174 - DNA, 16 bp, Homo sapiens
ttttaaaaaaaatgtg

SEQ ID NO: 2923175 - DNA, 20 bp, Homo sapiens
ttttaaaaaaaatgtgaaat

SEQ ID NO: 2923176 - DNA, 21 bp, Homo sapiens
ttttaaaaaaatttttgcaaa

SEQ ID NO: 2923177 - DNA, 21 bp, Homo sapiens
ttttaaaaaggaactgcagca

SEQ ID NO: 2923178 - DNA, 17 bp, Homo sapiens
ttttaaaaatagacact

SEQ ID NO: 2923179 - DNA, 14 bp, Homo sapiens
ttttaaaaatgaat

SEQ ID NO: 2923180 - DNA, 13 bp, Homo sapiens
ttttaaaacccag

SEQ ID NO: 2923181 - DNA, 20 bp, Homo sapiens
ttttaaaacgtgtaaatgaa

SEQ ID NO: 2923182 - DNA, 20 bp, Homo sapiens
ttttaaaagatgcaatgtag

SEQ ID NO: 2923183 - DNA, 23 bp, Homo sapiens
ttttaaaaggttgactcaagttt

SEQ ID NO: 2923184 - DNA, 14 bp, Homo sapiens
ttttaaaatagagg

SEQ ID NO: 2923185 - DNA, 19 bp, Homo sapiens
ttttaaaatgttggtgcaa

SEQ ID NO: 2923186 - DNA, 19 bp, Homo sapiens
ttttaaaattatatagcaa

SEQ ID NO: 2923187 - DNA, 15 bp, Homo sapiens
ttttaaacaaatgag

SEQ ID NO: 2923188 - DNA, 15 bp, Homo sapiens
ttttaaacagatatt

SEQ ID NO: 2923189 - DNA, 15 bp, Homo sapiens
ttttaaactagatga

SEQ ID NO: 2923190 - DNA, 19 bp, Homo sapiens
ttttaaagaagtctcttaa

SEQ ID NO: 2923191 - DNA, 23 bp, Homo sapiens
ttttaaagaatatgactttttat

SEQ ID NO: 2923192 - DNA, 21 bp, Homo sapiens
ttttaaagacctgacaccttt

SEQ ID NO: 2923193 - DNA, 16 bp, Homo sapiens
ttttaaaggacaaaca

SEQ ID NO: 2923194 - DNA, 22 bp, Homo sapiens
ttttaaaggacaaacagtgaat

SEQ ID NO: 2923195 - DNA, 21 bp, Homo sapiens
ttttaaagtaaccctacaaaa

SEQ ID NO: 2923196 - DNA, 13 bp, Homo sapiens
ttttaaagtgatt

SEQ ID NO: 2923197 - DNA, 22 bp, Homo sapiens
ttttaaatctgcagcacattga

SEQ ID NO: 2923198 - DNA, 13 bp, Homo sapiens
ttttaaatgtgaa

SEQ ID NO: 2923199 - DNA, 17 bp, Homo sapiens
ttttaaattattatctt

SEQ ID NO: 2923200 - DNA, 15 bp, Homo sapiens
ttttaaattcttact

SEQ ID NO: 2923201 - DNA, 13 bp, Homo sapiens
ttttaaattgcat

SEQ ID NO: 2923202 - DNA, 13 bp, Homo sapiens
ttttaaattttct

SEQ ID NO: 2923203 - DNA, 17 bp, Homo sapiens
ttttaaattttctccag

SEQ ID NO: 2923204 - DNA, 17 bp, Homo sapiens
ttttaaattttgtaatg

SEQ ID NO: 2923205 - DNA, 16 bp, Homo sapiens
ttttaacaagaagatg

SEQ ID NO: 2923206 - DNA, 19 bp, Homo sapiens
ttttaacaagaagatgaat

SEQ ID NO: 2923207 - DNA, 21 bp, Homo sapiens
ttttaacaagaagatgaatgg

SEQ ID NO: 2923208 - DNA, 19 bp, Homo sapiens
ttttaacacctgatgtgta

SEQ ID NO: 2923209 - DNA, 23 bp, Homo sapiens
ttttaacagttagtaatggtgct

SEQ ID NO: 2923210 - DNA, 19 bp, Homo sapiens
ttttaacatttatctaaaa

SEQ ID NO: 2923211 - DNA, 17 bp, Homo sapiens
ttttaacgtatgtattt

SEQ ID NO: 2923212 - DNA, 22 bp, Homo sapiens
ttttaacgtatgtatttcattg

SEQ ID NO: 2923213 - DNA, 11 bp, Homo sapiens
ttttaactgta

SEQ ID NO: 2923214 - DNA, 14 bp, Homo sapiens
ttttaactgtgcaa

SEQ ID NO: 2923215 - DNA, 13 bp, Homo sapiens
ttttaacttattt

SEQ ID NO: 2923216 - DNA, 21 bp, Homo sapiens
ttttaagcaaatgcattctat

SEQ ID NO: 2923217 - DNA, 15 bp, Homo sapiens
ttttaagcagctcta

SEQ ID NO: 2923218 - DNA, 12 bp, Homo sapiens
ttttaaggaaaa

SEQ ID NO: 2923219 - DNA, 12 bp, Homo sapiens
ttttaaggaaac

SEQ ID NO: 2923220 - DNA, 13 bp, Homo sapiens
ttttaaggtagcc

SEQ ID NO: 2923221 - DNA, 20 bp, Homo sapiens
ttttaatgctatttgaacaa

SEQ ID NO: 2923222 - DNA, 20 bp, Homo sapiens
ttttaatgtcatttgttaaa

SEQ ID NO: 2923223 - DNA, 12 bp, Homo sapiens
ttttaatgtgaa

SEQ ID NO: 2923224 - DNA, 11 bp, Homo sapiens
ttttaatgtgc

SEQ ID NO: 2923225 - DNA, 12 bp, Homo sapiens
ttttaattcata

SEQ ID NO: 2923226 - DNA, 21 bp, Homo sapiens
ttttaattccatgaatcgctt

SEQ ID NO: 2923227 - DNA, 14 bp, Homo sapiens
ttttaatttagtaa

SEQ ID NO: 2923228 - DNA, 16 bp, Homo sapiens
ttttaattttgtattt

SEQ ID NO: 2923229 - DNA, 14 bp, Homo sapiens
ttttacaattgaaa

SEQ ID NO: 2923230 - DNA, 15 bp, Homo sapiens
ttttacacagaaaca

SEQ ID NO: 2923231 - DNA, 18 bp, Homo sapiens
ttttacacagaaacactg

SEQ ID NO: 2923232 - DNA, 22 bp, Homo sapiens
ttttacacagaaacactgcctt

SEQ ID NO: 2923233 - DNA, 15 bp, Homo sapiens
ttttacatggagaaa

SEQ ID NO: 2923234 - DNA, 16 bp, Homo sapiens
ttttacgctagattaa

SEQ ID NO: 2923235 - DNA, 15 bp, Homo sapiens
ttttactgaagcctt

SEQ ID NO: 2923236 - DNA, 11 bp, Homo sapiens
ttttacttaca

SEQ ID NO: 2923237 - DNA, 18 bp, Homo sapiens
ttttagacaaatactcat

SEQ ID NO: 2923238 - DNA, 22 bp, Homo sapiens
ttttagacaaatactcatgtgt

SEQ ID NO: 2923239 - DNA, 14 bp, Homo sapiens
ttttagagcattaa

SEQ ID NO: 2923240 - DNA, 22 bp, Homo sapiens
ttttagagcattaaaataacta

SEQ ID NO: 2923241 - DNA, 23 bp, Homo sapiens
ttttagaggcagggctgcattgg

SEQ ID NO: 2923242 - DNA, 16 bp, Homo sapiens
ttttagaggtgagttt

SEQ ID NO: 2923243 - DNA, 15 bp, Homo sapiens
ttttagagtaagaaa

SEQ ID NO: 2923244 - DNA, 17 bp, Homo sapiens
ttttagatggtttcttg

SEQ ID NO: 2923245 - DNA, 23 bp, Homo sapiens
ttttaggaaaagcatctgccaca

SEQ ID NO: 2923246 - DNA, 15 bp, Homo sapiens
ttttaggcttgaaat

SEQ ID NO: 2923247 - DNA, 12 bp, Homo sapiens
ttttaggttcta

SEQ ID NO: 2923248 - DNA, 20 bp, Homo sapiens
ttttagtatttatttatgta

SEQ ID NO: 2923249 - DNA, 23 bp, Homo sapiens
ttttagtatttatttatgtactt

SEQ ID NO: 2923250 - DNA, 13 bp, Homo sapiens
ttttataaacagt

SEQ ID NO: 2923251 - DNA, 19 bp, Homo sapiens
ttttataaagtgcttgtgt

SEQ ID NO: 2923252 - DNA, 18 bp, Homo sapiens
ttttatactctttctgta

SEQ ID NO: 2923253 - DNA, 19 bp, Homo sapiens
ttttatactctttctgtat

SEQ ID NO: 2923254 - DNA, 16 bp, Homo sapiens
ttttatactgcacttt

SEQ ID NO: 2923255 - DNA, 23 bp, Homo sapiens
ttttatagttgtattttgtacat

SEQ ID NO: 2923256 - DNA, 13 bp, Homo sapiens
ttttatattaaaa

SEQ ID NO: 2923257 - DNA, 13 bp, Homo sapiens
ttttatattgaaa

SEQ ID NO: 2923258 - DNA, 14 bp, Homo sapiens
ttttatatttgaaa

SEQ ID NO: 2923259 - DNA, 12 bp, Homo sapiens
ttttatatttgt

SEQ ID NO: 2923260 - DNA, 16 bp, Homo sapiens
ttttatcccttcctgt

SEQ ID NO: 2923261 - DNA, 18 bp, Homo sapiens
ttttatcccttcctgtct

SEQ ID NO: 2923262 - DNA, 22 bp, Homo sapiens
ttttatctattctgagaaaaca

SEQ ID NO: 2923263 - DNA, 20 bp, Homo sapiens
ttttatctccatactttgga

SEQ ID NO: 2923264 - DNA, 21 bp, Homo sapiens
ttttatctccatactttggat

SEQ ID NO: 2923265 - DNA, 17 bp, Homo sapiens
ttttatcttgagtgtta

SEQ ID NO: 2923266 - DNA, 14 bp, Homo sapiens
ttttatgacagtat

SEQ ID NO: 2923267 - DNA, 13 bp, Homo sapiens
ttttatgagaaat

SEQ ID NO: 2923268 - DNA, 16 bp, Homo sapiens
ttttatgagaaatgta

SEQ ID NO: 2923269 - DNA, 12 bp, Homo sapiens
ttttatgagatg

SEQ ID NO: 2923270 - DNA, 22 bp, Homo sapiens
ttttatgccaaattgattgtca

SEQ ID NO: 2923271 - DNA, 23 bp, Homo sapiens
ttttattaagccaggaaacatga

SEQ ID NO: 2923272 - DNA, 14 bp, Homo sapiens
ttttattaatgcac

SEQ ID NO: 2923273 - DNA, 19 bp, Homo sapiens
ttttattaatgcactttct

SEQ ID NO: 2923274 - DNA, 13 bp, Homo sapiens
ttttattcaaact

SEQ ID NO: 2923275 - DNA, 18 bp, Homo sapiens
ttttattcagtagtttga

SEQ ID NO: 2923276 - DNA, 18 bp, Homo sapiens
ttttattgacacagaaaa

SEQ ID NO: 2923277 - DNA, 14 bp, Homo sapiens
aaaaacaacaaata

SEQ ID NO: 2923278 - DNA, 19 bp, Homo sapiens
aaaaacagcattgctttct

SEQ ID NO: 2923279 - DNA, 19 bp, Homo sapiens
aaaaacagcctcacagaag

SEQ ID NO: 2923280 - DNA, 20 bp, Homo sapiens
aaaaacatgtatgtgcattt

SEQ ID NO: 2923281 - DNA, 12 bp, Homo sapiens
aaaaacattgcc

SEQ ID NO: 2923282 - DNA, 23 bp, Homo sapiens
aaaaacattttttaaggagggag

SEQ ID NO: 2923283 - DNA, 14 bp, Homo sapiens
aaaaaccaaaactg

SEQ ID NO: 2923284 - DNA, 17 bp, Homo sapiens
aaaaaccaaagtacttt

SEQ ID NO: 2923285 - DNA, 21 bp, Homo sapiens
aaaaactataaatacaaatct

SEQ ID NO: 2923286 - DNA, 15 bp, Homo sapiens
aaaaactgagtgact

SEQ ID NO: 2923287 - DNA, 14 bp, Homo sapiens
aaaaacttccattc

SEQ ID NO: 2923288 - DNA, 22 bp, Homo sapiens
aaaaacttgtgctataaagcta

SEQ ID NO: 2923289 - DNA, 13 bp, Homo sapiens
aaaaagaaaaaca

SEQ ID NO: 2923290 - DNA, 14 bp, Homo sapiens
aaaaagaaacaaga

SEQ ID NO: 2923291 - DNA, 14 bp, Homo sapiens
aaaaagaagtttgg

SEQ ID NO: 2923292 - DNA, 14 bp, Homo sapiens
aaaaagacagggct

SEQ ID NO: 2923293 - DNA, 16 bp, Homo sapiens
aaaaagacgatgttta

SEQ ID NO: 2923294 - DNA, 23 bp, Homo sapiens
aaaaagacgatgtttatgttctt

SEQ ID NO: 2923295 - DNA, 19 bp, Homo sapiens
aaaaagactttaaaagtga

SEQ ID NO: 2923296 - DNA, 18 bp, Homo sapiens
aaaaagaggaaagaatga

SEQ ID NO: 2923297 - DNA, 11 bp, Homo sapiens
aaaaagcaaat

SEQ ID NO: 2923298 - DNA, 12 bp, Homo sapiens
aaaaagccttac

SEQ ID NO: 2923299 - DNA, 16 bp, Homo sapiens
aaaaagccttacagtt

SEQ ID NO: 2923300 - DNA, 19 bp, Homo sapiens
aaaaaggaaggagagatga

SEQ ID NO: 2923301 - DNA, 17 bp, Homo sapiens
aaaaaggatacataatg

SEQ ID NO: 2923302 - DNA, 18 bp, Homo sapiens
aaaaagggtaagctagag

SEQ ID NO: 2923303 - DNA, 21 bp, Homo sapiens
aaaaagggtaagctagagaga

SEQ ID NO: 2923304 - DNA, 16 bp, Homo sapiens
aaaaaggttaattttt

SEQ ID NO: 2923305 - DNA, 23 bp, Homo sapiens
aaaaagtccaattttaatttagt

SEQ ID NO: 2923306 - DNA, 12 bp, Homo sapiens
aaaaagttatat

SEQ ID NO: 2923307 - DNA, 19 bp, Homo sapiens
aaaaagtttctatttagtt

SEQ ID NO: 2923308 - DNA, 18 bp, Homo sapiens
aaaaagtttgccagaagt

SEQ ID NO: 2923309 - DNA, 17 bp, Homo sapiens
aaaaagtttgttacttt

SEQ ID NO: 2923310 - DNA, 23 bp, Homo sapiens
aaaaagtttgttactttgaatag

SEQ ID NO: 2923311 - DNA, 13 bp, Homo sapiens
aaaaataaaagaa

SEQ ID NO: 2923312 - DNA, 17 bp, Homo sapiens
aaaaataatatactttt

SEQ ID NO: 2923313 - DNA, 19 bp, Homo sapiens
aaaaataatcaagatttta

SEQ ID NO: 2923314 - DNA, 10 bp, Homo sapiens
aaaaatacaa

SEQ ID NO: 2923315 - DNA, 13 bp, Homo sapiens
aaaaatacgtaat

SEQ ID NO: 2923316 - DNA, 12 bp, Homo sapiens
aaaaatactacc

SEQ ID NO: 2923317 - DNA, 13 bp, Homo sapiens
aaaaatactcaga

SEQ ID NO: 2923318 - DNA, 12 bp, Homo sapiens
aaaaatagaaac

SEQ ID NO: 2923319 - DNA, 20 bp, Homo sapiens
aaaaatagatgttttaactt

SEQ ID NO: 2923320 - DNA, 15 bp, Homo sapiens
aaaaatagcaacttg

SEQ ID NO: 2923321 - DNA, 17 bp, Homo sapiens
aaaaatagtgtctttgt

SEQ ID NO: 2923322 - DNA, 18 bp, Homo sapiens
aaaaatattgtcatgttt

SEQ ID NO: 2923323 - DNA, 20 bp, Homo sapiens
aaaaatattgtcatgtttat

SEQ ID NO: 2923324 - DNA, 22 bp, Homo sapiens
aaaaatcaactttttattgcct

SEQ ID NO: 2923325 - DNA, 23 bp, Homo sapiens
aaaaatcaactttttattgcctt

SEQ ID NO: 2923326 - DNA, 12 bp, Homo sapiens
aaaaatcactgt

SEQ ID NO: 2923327 - DNA, 13 bp, Homo sapiens
aaaaatcagtttt

SEQ ID NO: 2923328 - DNA, 16 bp, Homo sapiens
aaaaatctacagtgtt

SEQ ID NO: 2923329 - DNA, 17 bp, Homo sapiens
aaaaatctacagtgttt

SEQ ID NO: 2923330 - DNA, 12 bp, Homo sapiens
aaaaatgaaaga

SEQ ID NO: 2923331 - DNA, 17 bp, Homo sapiens
aaaaatgaaagatgatt

SEQ ID NO: 2923332 - DNA, 19 bp, Homo sapiens
aaaaatgatcctcagtgca

SEQ ID NO: 2923333 - DNA, 16 bp, Homo sapiens
aaaaatgatttcagta

SEQ ID NO: 2923334 - DNA, 15 bp, Homo sapiens
aaaaatgcaaaaaag

SEQ ID NO: 2923335 - DNA, 20 bp, Homo sapiens
aaaaatgcaaatcctatgtg

SEQ ID NO: 2923336 - DNA, 22 bp, Homo sapiens
aaaaatgcaaatcctatgtgat

SEQ ID NO: 2923337 - DNA, 21 bp, Homo sapiens
aaaaatgccataatacaaaag

SEQ ID NO: 2923338 - DNA, 11 bp, Homo sapiens
aaaaatgctgg

SEQ ID NO: 2923339 - DNA, 18 bp, Homo sapiens
aaaaatgggacttctttt

SEQ ID NO: 2923340 - DNA, 12 bp, Homo sapiens
aaaaatgtacat

SEQ ID NO: 2923341 - DNA, 13 bp, Homo sapiens
aaaaatgtgaaat

SEQ ID NO: 2923342 - DNA, 16 bp, Homo sapiens
aaaaatgtgaaatttt

SEQ ID NO: 2923343 - DNA, 11 bp, Homo sapiens
aaaaatgttca

SEQ ID NO: 2923344 - DNA, 14 bp, Homo sapiens
aaaaatgttcactt

SEQ ID NO: 2923345 - DNA, 20 bp, Homo sapiens
aaaaattaaaatctttcttt

SEQ ID NO: 2923346 - DNA, 12 bp, Homo sapiens
aaaaattacaaa

SEQ ID NO: 2923347 - DNA, 12 bp, Homo sapiens
aaaacaaaattt

SEQ ID NO: 2923348 - DNA, 12 bp, Homo sapiens
aaaacaaagaag

SEQ ID NO: 2923349 - DNA, 20 bp, Homo sapiens
aaaacaacaaaaaaagtttg

SEQ ID NO: 2923350 - DNA, 11 bp, Homo sapiens
aaaacaagaaa

SEQ ID NO: 2923351 - DNA, 12 bp, Homo sapiens
aaaacaagaaac

SEQ ID NO: 2923352 - DNA, 18 bp, Homo sapiens
aaaacaagaaaccaagtg

SEQ ID NO: 2923353 - DNA, 16 bp, Homo sapiens
aaaacaataaaatttt

SEQ ID NO: 2923354 - DNA, 18 bp, Homo sapiens
aaaacaatattgtttcta

SEQ ID NO: 2923355 - DNA, 21 bp, Homo sapiens
aaaacaattggttgtatataa

SEQ ID NO: 2923356 - DNA, 23 bp, Homo sapiens
aaaacacagacattctgccaggc

SEQ ID NO: 2923357 - DNA, 12 bp, Homo sapiens
aaaacacagagg

SEQ ID NO: 2923358 - DNA, 21 bp, Homo sapiens
aaaacaccgcttctgcctttt

SEQ ID NO: 2923359 - DNA, 24 bp, Homo sapiens
aaaacactcaaaatgatgcaacca

SEQ ID NO: 2923360 - DNA, 18 bp, Homo sapiens
aaaacactgccatcttag

SEQ ID NO: 2923361 - DNA, 18 bp, Homo sapiens
aaaacacttccagtctgg

SEQ ID NO: 2923362 - DNA, 14 bp, Homo sapiens
aaaacactttcctg

SEQ ID NO: 2923363 - DNA, 16 bp, Homo sapiens
aaaacactttcctgga

SEQ ID NO: 2923364 - DNA, 21 bp, Homo sapiens
aaaacagaacatcattagaac

SEQ ID NO: 2923365 - DNA, 12 bp, Homo sapiens
aaaacagatatt

SEQ ID NO: 2923366 - DNA, 21 bp, Homo sapiens
aaaacaggtcttcatcgaatc

SEQ ID NO: 2923367 - DNA, 17 bp, Homo sapiens
aaaacataatagaattt

SEQ ID NO: 2923368 - DNA, 16 bp, Homo sapiens
aaaacatctattctct

SEQ ID NO: 2923369 - DNA, 21 bp, Homo sapiens
aaaacatctattctctccaaa

SEQ ID NO: 2923370 - DNA, 23 bp, Homo sapiens
aaaacattgcaaatttattttat

SEQ ID NO: 2923371 - DNA, 13 bp, Homo sapiens
aaaacatttatga

SEQ ID NO: 2923372 - DNA, 17 bp, Homo sapiens
aaaacattttaaatgaa

SEQ ID NO: 2923373 - DNA, 16 bp, Homo sapiens
aaaaccaaattagcca

SEQ ID NO: 2923374 - DNA, 18 bp, Homo sapiens
aaaaccaagcctctggaa

SEQ ID NO: 2923375 - DNA, 11 bp, Homo sapiens
aaaaccaggcc

SEQ ID NO: 2923376 - DNA, 17 bp, Homo sapiens
aaaaccagttttgctgc

SEQ ID NO: 2923377 - DNA, 12 bp, Homo sapiens
aaaaccatattt

SEQ ID NO: 2923378 - DNA, 16 bp, Homo sapiens
aaaacgcgcagatgtg

SEQ ID NO: 2923379 - DNA, 21 bp, Homo sapiens
aaaactacaaatcaagtattt

SEQ ID NO: 2923380 - DNA, 16 bp, Homo sapiens
aaaactcaaagaatgt

SEQ ID NO: 2923381 - DNA, 17 bp, Homo sapiens
aaaactccaccttccca

SEQ ID NO: 2923382 - DNA, 21 bp, Homo sapiens
aaaactccagggtcccctgcc

SEQ ID NO: 2923383 - DNA, 19 bp, Homo sapiens
aaaactctatcaaatgtga

SEQ ID NO: 2923384 - DNA, 18 bp, Homo sapiens
aaaactcttaagtcctaa

SEQ ID NO: 2923385 - DNA, 19 bp, Homo sapiens
aaaactgcagtcatcaaca

SEQ ID NO: 2923386 - DNA, 19 bp, Homo sapiens
aaaactgggcctgtagctc

SEQ ID NO: 2923387 - DNA, 14 bp, Homo sapiens
aaaactgtatttaa

SEQ ID NO: 2923388 - DNA, 19 bp, Homo sapiens
aaaacttccattctttctt

SEQ ID NO: 2923389 - DNA, 19 bp, Homo sapiens
aaaactttactaagatgac

SEQ ID NO: 2923390 - DNA, 13 bp, Homo sapiens
aaaacttttaaac

SEQ ID NO: 2923391 - DNA, 13 bp, Homo sapiens
aaaacttttctca

SEQ ID NO: 2923392 - DNA, 15 bp, Homo sapiens
aaaacttttctcaga

SEQ ID NO: 2923393 - DNA, 14 bp, Homo sapiens
aaaagaaaagagaa

SEQ ID NO: 2923394 - DNA, 11 bp, Homo sapiens
aaaagaaacta

SEQ ID NO: 2923395 - DNA, 12 bp, Homo sapiens
aaaagaaagaac

SEQ ID NO: 2923396 - DNA, 20 bp, Homo sapiens
aaaagaaagatacttacatg

SEQ ID NO: 2923397 - DNA, 15 bp, Homo sapiens
aaaagaaatcaattt

SEQ ID NO: 2923398 - DNA, 19 bp, Homo sapiens
aaaagaaattatctttagt

SEQ ID NO: 2923399 - DNA, 22 bp, Homo sapiens
aaaagaacatgcagtttgaaat

SEQ ID NO: 2923400 - DNA, 12 bp, Homo sapiens
aaaagaagtgtg

SEQ ID NO: 2923401 - DNA, 21 bp, Homo sapiens
aaaagaattaccaagagaagg

SEQ ID NO: 2923402 - DNA, 12 bp, Homo sapiens
aaaagactttga

SEQ ID NO: 2923403 - DNA, 20 bp, Homo sapiens
aaaagagctactcagaaatg

SEQ ID NO: 2923404 - DNA, 21 bp, Homo sapiens
aaaagaggagaggaaaactat

SEQ ID NO: 2923405 - DNA, 17 bp, Homo sapiens
aaaagataaatattata

SEQ ID NO: 2923406 - DNA, 23 bp, Homo sapiens
aaaagatctgttttgaaggcaaa

SEQ ID NO: 2923407 - DNA, 11 bp, Homo sapiens
aaaagattcat

SEQ ID NO: 2923408 - DNA, 10 bp, Homo sapiens
aaaagcaaat

SEQ ID NO: 2923409 - DNA, 18 bp, Homo sapiens
aaaagcaatcatagagaa

SEQ ID NO: 2923410 - DNA, 21 bp, Homo sapiens
aaaagcagatggacttgaaaa

SEQ ID NO: 2923411 - DNA, 23 bp, Homo sapiens
aaagacgctaataaaaatttatt

SEQ ID NO: 2923412 - DNA, 20 bp, Homo sapiens
aaagacggatggcaggatcc

SEQ ID NO: 2923413 - DNA, 12 bp, Homo sapiens
aaagactggctt

SEQ ID NO: 2923414 - DNA, 16 bp, Homo sapiens
aaagacttccaaagaa

SEQ ID NO: 2923415 - DNA, 18 bp, Homo sapiens
aaagagaaaaaaagtttg

SEQ ID NO: 2923416 - DNA, 11 bp, Homo sapiens
aaagagaaaga

SEQ ID NO: 2923417 - DNA, 12 bp, Homo sapiens
aaagagaaagag

SEQ ID NO: 2923418 - DNA, 19 bp, Homo sapiens
aaagagagaaaataaaaag

SEQ ID NO: 2923419 - DNA, 21 bp, Homo sapiens
aaagagagaaaataaaaagtt

SEQ ID NO: 2923420 - DNA, 15 bp, Homo sapiens
aaagagagcagagaa

SEQ ID NO: 2923421 - DNA, 14 bp, Homo sapiens
aaagagatacagag

SEQ ID NO: 2923422 - DNA, 17 bp, Homo sapiens
aaagagatatgggaaca

SEQ ID NO: 2923423 - DNA, 19 bp, Homo sapiens
aaagagatgatgaaaatat

SEQ ID NO: 2923424 - DNA, 12 bp, Homo sapiens
aaagagctactc

SEQ ID NO: 2923425 - DNA, 19 bp, Homo sapiens
aaagagctactcagaaatg

SEQ ID NO: 2923426 - DNA, 20 bp, Homo sapiens
aaagagctgggatcccacag

SEQ ID NO: 2923427 - DNA, 23 bp, Homo sapiens
aaagaggagaggaaaactattcc

SEQ ID NO: 2923428 - DNA, 19 bp, Homo sapiens
aaagaggcgttgctttcac

SEQ ID NO: 2923429 - DNA, 19 bp, Homo sapiens
aaagaggtgaaaatgaaga

SEQ ID NO: 2923430 - DNA, 18 bp, Homo sapiens
aaagagtagaattgcatt

SEQ ID NO: 2923431 - DNA, 21 bp, Homo sapiens
aaagagtctagattcaaaggt

SEQ ID NO: 2923432 - DNA, 17 bp, Homo sapiens
aaagagtgaaatattgt

SEQ ID NO: 2923433 - DNA, 16 bp, Homo sapiens
aaagagttattcaaat

SEQ ID NO: 2923434 - DNA, 13 bp, Homo sapiens
aaagataaatatt

SEQ ID NO: 2923435 - DNA, 16 bp, Homo sapiens
aaagataaatattata

SEQ ID NO: 2923436 - DNA, 15 bp, Homo sapiens
aaagatagatatcca

SEQ ID NO: 2923437 - DNA, 20 bp, Homo sapiens
aaagatagcaatatgagaca

SEQ ID NO: 2923438 - DNA, 13 bp, Homo sapiens
aaagatatatatt

SEQ ID NO: 2923439 - DNA, 14 bp, Homo sapiens
aaagatatatattc

SEQ ID NO: 2923440 - DNA, 15 bp, Homo sapiens
aaagatatcttttct

SEQ ID NO: 2923441 - DNA, 19 bp, Homo sapiens
aaagatatttttattcaaa

SEQ ID NO: 2923442 - DNA, 21 bp, Homo sapiens
aaagatatttttattcaaact

SEQ ID NO: 2923443 - DNA, 16 bp, Homo sapiens
aaagatctacatgaat

SEQ ID NO: 2923444 - DNA, 19 bp, Homo sapiens
aaagatctgtcctcagcct

SEQ ID NO: 2923445 - DNA, 21 bp, Homo sapiens
aaagatctgtcctcagccttg

SEQ ID NO: 2923446 - DNA, 16 bp, Homo sapiens
aaagatctgttttgaa

SEQ ID NO: 2923447 - DNA, 21 bp, Homo sapiens
aaagatctgttttgaaggcaa

SEQ ID NO: 2923448 - DNA, 21 bp, Homo sapiens
aaagatctttcgttggttgtt

SEQ ID NO: 2923449 - DNA, 15 bp, Homo sapiens
aaagatgatcgctgt

SEQ ID NO: 2923450 - DNA, 21 bp, Homo sapiens
aaagatgatcgctgtattttg

SEQ ID NO: 2923451 - DNA, 16 bp, Homo sapiens
aaagatgatgctcagt

SEQ ID NO: 2923452 - DNA, 13 bp, Homo sapiens
aaagatgctttta

SEQ ID NO: 2923453 - DNA, 15 bp, Homo sapiens
aaagatggagtttct

SEQ ID NO: 2923454 - DNA, 16 bp, Homo sapiens
aaagatggagtttcta

SEQ ID NO: 2923455 - DNA, 17 bp, Homo sapiens
aaagatggagtttctaa

SEQ ID NO: 2923456 - DNA, 21 bp, Homo sapiens
aaagatggagtttctaaggtc

SEQ ID NO: 2923457 - DNA, 21 bp, Homo sapiens
aaagatggataaactgagcct

SEQ ID NO: 2923458 - DNA, 13 bp, Homo sapiens
aaagatgtatata

SEQ ID NO: 2923459 - DNA, 22 bp, Homo sapiens
aaagattactttttctttatgt

SEQ ID NO: 2923460 - DNA, 22 bp, Homo sapiens
aaagattcacctaagagattct

SEQ ID NO: 2923461 - DNA, 15 bp, Homo sapiens
aaagattcattttta

SEQ ID NO: 2923462 - DNA, 20 bp, Homo sapiens
aaagattcatttttaatcat

SEQ ID NO: 2923463 - DNA, 18 bp, Homo sapiens
aaagattccacagagatg

SEQ ID NO: 2923464 - DNA, 18 bp, Homo sapiens
aaagattctatagttcta

SEQ ID NO: 2923465 - DNA, 19 bp, Homo sapiens
aaagattctatagttctag

SEQ ID NO: 2923466 - DNA, 16 bp, Homo sapiens
aaagattctgaaacca

SEQ ID NO: 2923467 - DNA, 16 bp, Homo sapiens
aaagattgtattactt

SEQ ID NO: 2923468 - DNA, 12 bp, Homo sapiens
aaagatttatca

SEQ ID NO: 2923469 - DNA, 12 bp, Homo sapiens
aaagcaaaaatg

SEQ ID NO: 2923470 - DNA, 15 bp, Homo sapiens
aaagcaaaaatgcta

SEQ ID NO: 2923471 - DNA, 16 bp, Homo sapiens
aaagcaaaaatgctaa

SEQ ID NO: 2923472 - DNA, 19 bp, Homo sapiens
aaagcaaaaatgctaatat

SEQ ID NO: 2923473 - DNA, 14 bp, Homo sapiens
aaagcaaatataga

SEQ ID NO: 2923474 - DNA, 13 bp, Homo sapiens
aaagcaataaaat

SEQ ID NO: 2923475 - DNA, 13 bp, Homo sapiens
aaagcaatagaaa

SEQ ID NO: 2923476 - DNA, 23 bp, Homo sapiens
aaagcaatgctgatgaatcactg

SEQ ID NO: 2923477 - DNA, 20 bp, Homo sapiens
aaagcacactcatcccctca

SEQ ID NO: 2923478 - DNA, 13 bp, Homo sapiens
aaagcacctgccg

SEQ ID NO: 2923479 - DNA, 14 bp, Homo sapiens
aaagcactatacag

SEQ ID NO: 2923480 - DNA, 14 bp, Homo sapiens
aaagcactattgtt

SEQ ID NO: 2923481 - DNA, 15 bp, Homo sapiens
aaagcagaattttaa

SEQ ID NO: 2923482 - DNA, 15 bp, Homo sapiens
aaagcagctctcccc

SEQ ID NO: 2923483 - DNA, 16 bp, Homo sapiens
aaagcaggaaatacca

SEQ ID NO: 2923484 - DNA, 13 bp, Homo sapiens
aaagcaggagtgg

SEQ ID NO: 2923485 - DNA, 20 bp, Homo sapiens
aaagcatcggtcatgtgtgt

SEQ ID NO: 2923486 - DNA, 21 bp, Homo sapiens
aaagcatcggtcatgtgtgta

SEQ ID NO: 2923487 - DNA, 22 bp, Homo sapiens
aaagcatcggtcatgtgtgtat

SEQ ID NO: 2923488 - DNA, 16 bp, Homo sapiens
aaagcatgatgggaaa

SEQ ID NO: 2923489 - DNA, 21 bp, Homo sapiens
aaagcatgatgggaaaatatt

SEQ ID NO: 2923490 - DNA, 22 bp, Homo sapiens
aaagcatgatgggaaaatattt

SEQ ID NO: 2923491 - DNA, 23 bp, Homo sapiens
aaagcatgatgggaaaatatttc

SEQ ID NO: 2923492 - DNA, 15 bp, Homo sapiens
aaagccaaacatata

SEQ ID NO: 2923493 - DNA, 17 bp, Homo sapiens
aaagccaatgtgaacag

SEQ ID NO: 2923494 - DNA, 13 bp, Homo sapiens
aaagccactggaa

SEQ ID NO: 2923495 - DNA, 14 bp, Homo sapiens
aaagccactggaag

SEQ ID NO: 2923496 - DNA, 9 bp, Homo sapiens
aaagccagt

SEQ ID NO: 2923497 - DNA, 23 bp, Homo sapiens
aaagccatatcatgctaaaattc

SEQ ID NO: 2923498 - DNA, 16 bp, Homo sapiens
aaagccattgtgtcct

SEQ ID NO: 2923499 - DNA, 18 bp, Homo sapiens
aaagcccaagggatctgg

SEQ ID NO: 2923500 - DNA, 19 bp, Homo sapiens
aaagcccacctgggctggg

SEQ ID NO: 2923501 - DNA, 12 bp, Homo sapiens
aaagccctgcct

SEQ ID NO: 2923502 - DNA, 13 bp, Homo sapiens
aaagccctgcctc

SEQ ID NO: 2923503 - DNA, 18 bp, Homo sapiens
aaagccctgcctctgtgt

SEQ ID NO: 2923504 - DNA, 17 bp, Homo sapiens
aaagccgaaagggttaa

SEQ ID NO: 2923505 - DNA, 21 bp, Homo sapiens
aaagccgttgtttacttaaag

SEQ ID NO: 2923506 - DNA, 23 bp, Homo sapiens
aaagccgttgtttacttaaagat

SEQ ID NO: 2923507 - DNA, 18 bp, Homo sapiens
aaagcctcagtgaaacag

SEQ ID NO: 2923508 - DNA, 11 bp, Homo sapiens
aaagccttctt

SEQ ID NO: 2923509 - DNA, 18 bp, Homo sapiens
aaagccttcttttggggg

SEQ ID NO: 2923510 - DNA, 15 bp, Homo sapiens
aaagcgctgtttcct

SEQ ID NO: 2923511 - DNA, 18 bp, Homo sapiens
aaagcggccgatgggagt

SEQ ID NO: 2923512 - DNA, 15 bp, Homo sapiens
aaagcgtctttaaga

SEQ ID NO: 2923513 - DNA, 15 bp, Homo sapiens
aaagctatggtgaga

SEQ ID NO: 2923514 - DNA, 20 bp, Homo sapiens
aaagctcctggggcgtccag

SEQ ID NO: 2923515 - DNA, 13 bp, Homo sapiens
aaagctctgtggc

SEQ ID NO: 2923516 - DNA, 19 bp, Homo sapiens
aaagctgacattgccaaaa

SEQ ID NO: 2923517 - DNA, 13 bp, Homo sapiens
aaagctgtgtctc

SEQ ID NO: 2923518 - DNA, 21 bp, Homo sapiens
aaagctgtgtctctgtatata

SEQ ID NO: 2923519 - DNA, 21 bp, Homo sapiens
aaagctgtgttgttgcttctt

SEQ ID NO: 2923520 - DNA, 21 bp, Homo sapiens
aaagctgttattcttgttata

SEQ ID NO: 2923521 - DNA, 21 bp, Homo sapiens
aaagctttgcttatggtaata

SEQ ID NO: 2923522 - DNA, 15 bp, Homo sapiens
aaaggaaatgattga

SEQ ID NO: 2923523 - DNA, 22 bp, Homo sapiens
aaaggaacaaaaattacaaaga

SEQ ID NO: 2923524 - DNA, 15 bp, Homo sapiens
aaaggaactgcagca

SEQ ID NO: 2923525 - DNA, 13 bp, Homo sapiens
aaaggaagaaaaa

SEQ ID NO: 2923526 - DNA, 14 bp, Homo sapiens
aaaggaagccaaag

SEQ ID NO: 2923527 - DNA, 15 bp, Homo sapiens
aaaggaaggagagat

SEQ ID NO: 2923528 - DNA, 14 bp, Homo sapiens
aaaggaagtctagg

SEQ ID NO: 2923529 - DNA, 15 bp, Homo sapiens
aaaggacaaacagtg

SEQ ID NO: 2923530 - DNA, 20 bp, Homo sapiens
aaaggagaattgaattctgg

SEQ ID NO: 2923531 - DNA, 16 bp, Homo sapiens
aaaggagacaaagcag

SEQ ID NO: 2923532 - DNA, 20 bp, Homo sapiens
aaaggagaggttaaagcaaa

SEQ ID NO: 2923533 - DNA, 19 bp, Homo sapiens
aaaggagcccttatctgtg

SEQ ID NO: 2923534 - DNA, 16 bp, Homo sapiens
aaaggagtcaaaacta

SEQ ID NO: 2923535 - DNA, 18 bp, Homo sapiens
aaaggatattatctacct

SEQ ID NO: 2923536 - DNA, 16 bp, Homo sapiens
aaaggcaaatgtgtac

SEQ ID NO: 2923537 - DNA, 14 bp, Homo sapiens
aaaggcaagcactt

SEQ ID NO: 2923538 - DNA, 12 bp, Homo sapiens
aaaggcagagga

SEQ ID NO: 2923539 - DNA, 15 bp, Homo sapiens
aaaggcatgtacaaa

SEQ ID NO: 2923540 - DNA, 17 bp, Homo sapiens
aaaggccaaacctctgt

SEQ ID NO: 2923541 - DNA, 18 bp, Homo sapiens
aaaggccagctggcagca

SEQ ID NO: 2923542 - DNA, 23 bp, Homo sapiens
aaaggccgtgtgtttagaagcct

SEQ ID NO: 2923543 - DNA, 18 bp, Homo sapiens
aaaggctgtgctgccctg

SEQ ID NO: 2923544 - DNA, 14 bp, Homo sapiens
aaagggaaaaaata

SEQ ID NO: 2923545 - DNA, 22 bp, Homo sapiens
aaagggacttttgtaaaatcaa

SEQ ID NO: 2923546 - DNA, 17 bp, Homo sapiens
aaagggagaaagaaaac

SEQ ID NO: 2923547 - DNA, 19 bp, Homo sapiens
aaagggagaaagaaaactg

SEQ ID NO: 2923548 - DNA, 16 bp, Homo sapiens
aaagggagaggaagag

SEQ ID NO: 2923549 - DNA, 17 bp, Homo sapiens
aaagggcagaggaagag

SEQ ID NO: 2923550 - DNA, 12 bp, Homo sapiens
aaagggccaggt

SEQ ID NO: 2923551 - DNA, 22 bp, Homo sapiens
aaaggggaaacgtctcccagat

SEQ ID NO: 2923552 - DNA, 10 bp, Homo sapiens
aaagggtgaa

SEQ ID NO: 2923553 - DNA, 21 bp, Homo sapiens
aaagggtgaagctatttatct

SEQ ID NO: 2923554 - DNA, 22 bp, Homo sapiens
aaagggttaatcatatttgaaa

SEQ ID NO: 2923555 - DNA, 21 bp, Homo sapiens
aaaggtgcctgtgaggcaggg

SEQ ID NO: 2923556 - DNA, 13 bp, Homo sapiens
aaagtaaactgtg

SEQ ID NO: 2923557 - DNA, 23 bp, Homo sapiens
aaagtaagaacagctcatcttca

SEQ ID NO: 2923558 - DNA, 13 bp, Homo sapiens
aaagtactgagca

SEQ ID NO: 2923559 - DNA, 21 bp, Homo sapiens
aaagtacttgactacctactg

SEQ ID NO: 2923560 - DNA, 14 bp, Homo sapiens
aaagtagattaaga

SEQ ID NO: 2923561 - DNA, 16 bp, Homo sapiens
aaagtagcaccaaata

SEQ ID NO: 2923562 - DNA, 18 bp, Homo sapiens
aaagtagtgttgtccagg

SEQ ID NO: 2923563 - DNA, 16 bp, Homo sapiens
aaagtatcaggaatat

SEQ ID NO: 2923564 - DNA, 17 bp, Homo sapiens
aaagtattattttccaa

SEQ ID NO: 2923565 - DNA, 14 bp, Homo sapiens
aaagtattgtaaat

SEQ ID NO: 2923566 - DNA, 23 bp, Homo sapiens
aaagtattgtaaattatatttgt

SEQ ID NO: 2923567 - DNA, 17 bp, Homo sapiens
aaagtattttcctgtaa

SEQ ID NO: 2923568 - DNA, 23 bp, Homo sapiens
aaagtatttttgattaacaatgt

SEQ ID NO: 2923569 - DNA, 14 bp, Homo sapiens
aaagtcacaatgtt

SEQ ID NO: 2923570 - DNA, 14 bp, Homo sapiens
aaagtcagctacaa

SEQ ID NO: 2923571 - DNA, 15 bp, Homo sapiens
aaagtccaagtctgt

SEQ ID NO: 2923572 - DNA, 12 bp, Homo sapiens
aaagtcccttcc

SEQ ID NO: 2923573 - DNA, 18 bp, Homo sapiens
aaagtccctttataaaga

SEQ ID NO: 2923574 - DNA, 13 bp, Homo sapiens
aaagtccttttct

SEQ ID NO: 2923575 - DNA, 16 bp, Homo sapiens
aaagtcctttttttcc

SEQ ID NO: 2923576 - DNA, 15 bp, Homo sapiens
aaagtctctaattct

SEQ ID NO: 2923577 - DNA, 12 bp, Homo sapiens
aaagtctcttgt

SEQ ID NO: 2923578 - DNA, 18 bp, Homo sapiens
aaagtgaattgttgacaa

SEQ ID NO: 2923579 - DNA, 19 bp, Homo sapiens
aaagtgactaatggcatga

SEQ ID NO: 2923580 - DNA, 19 bp, Homo sapiens
aaagtgagaaagaaagtaa

SEQ ID NO: 2923581 - DNA, 16 bp, Homo sapiens
aaagtgagtactgtta

SEQ ID NO: 2923582 - DNA, 17 bp, Homo sapiens
aaagtgatcagcaatga

SEQ ID NO: 2923583 - DNA, 19 bp, Homo sapiens
aaagtgatcagcaatgaag

SEQ ID NO: 2923584 - DNA, 19 bp, Homo sapiens
aaagtgattttatttttgc

SEQ ID NO: 2923585 - DNA, 22 bp, Homo sapiens
aaagtgcctcaagaggaatgaa

SEQ ID NO: 2923586 - DNA, 23 bp, Homo sapiens
aaagtgctaaggttctaaggcct

SEQ ID NO: 2923587 - DNA, 17 bp, Homo sapiens
aaagtgcttgtgtaatt

SEQ ID NO: 2923588 - DNA, 15 bp, Homo sapiens
aaagtggacttctga

SEQ ID NO: 2923589 - DNA, 22 bp, Homo sapiens
aaagtggacttctgaaaaatga

SEQ ID NO: 2923590 - DNA, 14 bp, Homo sapiens
aaagtggcctcttt

SEQ ID NO: 2923591 - DNA, 17 bp, Homo sapiens
aaagtgggcttgattct

SEQ ID NO: 2923592 - DNA, 16 bp, Homo sapiens
aaagtgggtttcaatt

SEQ ID NO: 2923593 - DNA, 17 bp, Homo sapiens
aaagtgggtttcaattt

SEQ ID NO: 2923594 - DNA, 16 bp, Homo sapiens
aaagtggtgctcagtt

SEQ ID NO: 2923595 - DNA, 14 bp, Homo sapiens
aaagtggttgttag

SEQ ID NO: 2923596 - DNA, 18 bp, Homo sapiens
aaagtgtacaagttgctt

SEQ ID NO: 2923597 - DNA, 18 bp, Homo sapiens
aaagtgtattttattcag

SEQ ID NO: 2923598 - DNA, 20 bp, Homo sapiens
aaagtgtattttattcagta

SEQ ID NO: 2923599 - DNA, 19 bp, Homo sapiens
aaagtgtggtcccaacagg

SEQ ID NO: 2923600 - DNA, 23 bp, Homo sapiens
aaagtgtgtgaaacctacagcat

SEQ ID NO: 2923601 - DNA, 19 bp, Homo sapiens
aaagtgttcaaattaaaaa

SEQ ID NO: 2923602 - DNA, 19 bp, Homo sapiens
aaagtgttgaaaatgtatt

SEQ ID NO: 2923603 - DNA, 16 bp, Homo sapiens
aaagtgttttgtacca

SEQ ID NO: 2923604 - DNA, 20 bp, Homo sapiens
aaagttaaggcttgatacca

SEQ ID NO: 2923605 - DNA, 15 bp, Homo sapiens
aaagttaatgcttaa

SEQ ID NO: 2923606 - DNA, 20 bp, Homo sapiens
aaagttactttgtcagaggc

SEQ ID NO: 2923607 - DNA, 14 bp, Homo sapiens
aaagttagtctact

SEQ ID NO: 2923608 - DNA, 14 bp, Homo sapiens
aaagttatatttca

SEQ ID NO: 2923609 - DNA, 22 bp, Homo sapiens
aaagttatatttcagatgtaat

SEQ ID NO: 2923610 - DNA, 18 bp, Homo sapiens
aaagttatttttaaaaac

SEQ ID NO: 2923611 - DNA, 16 bp, Homo sapiens
aaagttcagagttttc

SEQ ID NO: 2923612 - DNA, 18 bp, Homo sapiens
aaagttccaagagtctaa

SEQ ID NO: 2923613 - DNA, 21 bp, Homo sapiens
aaagttccaagagtctaaaga

SEQ ID NO: 2923614 - DNA, 16 bp, Homo sapiens
aaagttctagtgaccg

SEQ ID NO: 2923615 - DNA, 17 bp, Homo sapiens
aaagttgagagacagta

SEQ ID NO: 2923616 - DNA, 19 bp, Homo sapiens
aaagttgagagacagtaac

SEQ ID NO: 2923617 - DNA, 16 bp, Homo sapiens
aaagttgagtttccaa

SEQ ID NO: 2923618 - DNA, 12 bp, Homo sapiens
aaagttgtacat

SEQ ID NO: 2923619 - DNA, 21 bp, Homo sapiens
aaagtttctatttagttattt

SEQ ID NO: 2923620 - DNA, 22 bp, Homo sapiens
aaagtttgcttgtttcttggtc

SEQ ID NO: 2923621 - DNA, 22 bp, Homo sapiens
aaagtttgtaagaaaatgttca

SEQ ID NO: 2923622 - DNA, 14 bp, Homo sapiens
aaagtttgtccttt

SEQ ID NO: 2923623 - DNA, 19 bp, Homo sapiens
aaagtttgttactttgaat

SEQ ID NO: 2923624 - DNA, 15 bp, Homo sapiens
aaagttttacaaagg

SEQ ID NO: 2923625 - DNA, 16 bp, Homo sapiens
aaagttttacaaaggg

SEQ ID NO: 2923626 - DNA, 18 bp, Homo sapiens
aaagttttattataaatt

SEQ ID NO: 2923627 - DNA, 21 bp, Homo sapiens
aaagttttattataaattcta

SEQ ID NO: 2923628 - DNA, 21 bp, Homo sapiens
aaagtttttaattcatatttt

SEQ ID NO: 2923629 - DNA, 22 bp, Homo sapiens
aaagttttttttttgtttgttt

SEQ ID NO: 2923630 - DNA, 17 bp, Homo sapiens
aaataaaaaccaaatta

SEQ ID NO: 2923631 - DNA, 23 bp, Homo sapiens
aaataaaaagggcagccctcctt

SEQ ID NO: 2923632 - DNA, 19 bp, Homo sapiens
aaataaaaagttaaaaagt

SEQ ID NO: 2923633 - DNA, 15 bp, Homo sapiens
aaataaaaatggata

SEQ ID NO: 2923634 - DNA, 18 bp, Homo sapiens
aaataaaaggaagccaaa

SEQ ID NO: 2923635 - DNA, 16 bp, Homo sapiens
aaataaaatttgttgc

SEQ ID NO: 2923636 - DNA, 18 bp, Homo sapiens
aaataaaatttgttgcat

SEQ ID NO: 2923637 - DNA, 14 bp, Homo sapiens
aaataaaccaaata

SEQ ID NO: 2923638 - DNA, 15 bp, Homo sapiens
aaataaagagccata

SEQ ID NO: 2923639 - DNA, 12 bp, Homo sapiens
aaataaagccct

SEQ ID NO: 2923640 - DNA, 12 bp, Homo sapiens
aaataaataaat

SEQ ID NO: 2923641 - DNA, 15 bp, Homo sapiens
aaataaatgtttcaa

SEQ ID NO: 2923642 - DNA, 17 bp, Homo sapiens
aaataaatgtttcaaat

SEQ ID NO: 2923643 - DNA, 19 bp, Homo sapiens
aaataaatgtttcaaatgc

SEQ ID NO: 2923644 - DNA, 14 bp, Homo sapiens
aaataaattcctaa

SEQ ID NO: 2923645 - DNA, 16 bp, Homo sapiens
aaataaattcctacaa

SEQ ID NO: 2923646 - DNA, 12 bp, Homo sapiens
aaataactatat

SEQ ID NO: 2923647 - DNA, 22 bp, Homo sapiens
aaataactatataagacattaa

SEQ ID NO: 2923648 - DNA, 14 bp, Homo sapiens
aaataactatcagg

SEQ ID NO: 2923649 - DNA, 18 bp, Homo sapiens
aaataactatcaggcaga

SEQ ID NO: 2923650 - DNA, 14 bp, Homo sapiens
aaataactgaacca

SEQ ID NO: 2923651 - DNA, 24 bp, Homo sapiens
aaataagaaacaactctttgagaa

SEQ ID NO: 2923652 - DNA, 15 bp, Homo sapiens
aaataagaaattagc

SEQ ID NO: 2923653 - DNA, 17 bp, Homo sapiens
aaataagaatagaaata

SEQ ID NO: 2923654 - DNA, 13 bp, Homo sapiens
aaataagattcta

SEQ ID NO: 2923655 - DNA, 17 bp, Homo sapiens
aaataagtatttctgat

SEQ ID NO: 2923656 - DNA, 13 bp, Homo sapiens
aaataagttaaag

SEQ ID NO: 2923657 - DNA, 17 bp, Homo sapiens
aaataagtttttcttta

SEQ ID NO: 2923658 - DNA, 19 bp, Homo sapiens
aaataagtttttctttaat

SEQ ID NO: 2923659 - DNA, 14 bp, Homo sapiens
aaataataaaaaga

SEQ ID NO: 2923660 - DNA, 15 bp, Homo sapiens
aaataataataatgt

SEQ ID NO: 2923661 - DNA, 13 bp, Homo sapiens
aaataatatactt

SEQ ID NO: 2923662 - DNA, 14 bp, Homo sapiens
aaataatttatttt

SEQ ID NO: 2923663 - DNA, 15 bp, Homo sapiens
aaataatttgaactt

SEQ ID NO: 2923664 - DNA, 20 bp, Homo sapiens
aaataatttgaactttggaa

SEQ ID NO: 2923665 - DNA, 18 bp, Homo sapiens
aaataattttaaaaatgg

SEQ ID NO: 2923666 - DNA, 11 bp, Homo sapiens
aaatacaaaaa

SEQ ID NO: 2923667 - DNA, 14 bp, Homo sapiens
aaatacaagttctt

SEQ ID NO: 2923668 - DNA, 16 bp, Homo sapiens
aaatacaattattgta

SEQ ID NO: 2923669 - DNA, 13 bp, Homo sapiens
aaatacacatttc

SEQ ID NO: 2923670 - DNA, 16 bp, Homo sapiens
aaatacacatttcaca

SEQ ID NO: 2923671 - DNA, 13 bp, Homo sapiens
aaatacatgacat

SEQ ID NO: 2923672 - DNA, 14 bp, Homo sapiens
aaataccaactgaa

SEQ ID NO: 2923673 - DNA, 15 bp, Homo sapiens
aaatactcatgtgta

SEQ ID NO: 2923674 - DNA, 17 bp, Homo sapiens
aaatactgatggaagca

SEQ ID NO: 2923675 - DNA, 17 bp, Homo sapiens
aaatactgccagatgct

SEQ ID NO: 2923676 - DNA, 17 bp, Homo sapiens
aaatacttcgatgatga

SEQ ID NO: 2923677 - DNA, 13 bp, Homo sapiens
aaatttagaaact

SEQ ID NO: 2923678 - DNA, 22 bp, Homo sapiens
aaatttatggccgtatcaaatg

SEQ ID NO: 2923679 - DNA, 18 bp, Homo sapiens
aaatttccccaacagtgt

SEQ ID NO: 2923680 - DNA, 19 bp, Homo sapiens
aaatttccccaacagtgtg

SEQ ID NO: 2923681 - DNA, 23 bp, Homo sapiens
aaatttcctctacttaatttgtt

SEQ ID NO: 2923682 - DNA, 16 bp, Homo sapiens
aaatttgactaatttt

SEQ ID NO: 2923683 - DNA, 22 bp, Homo sapiens
aaatttgttgtcatgtgtatga

SEQ ID NO: 2923684 - DNA, 22 bp, Homo sapiens
aaattttatgtattttaaaata

SEQ ID NO: 2923685 - DNA, 13 bp, Homo sapiens
aaattttatttat

SEQ ID NO: 2923686 - DNA, 10 bp, Homo sapiens
aaattttctt

SEQ ID NO: 2923687 - DNA, 12 bp, Homo sapiens
aaattttgtaat

SEQ ID NO: 2923688 - DNA, 19 bp, Homo sapiens
aaatttttccacactatgt

SEQ ID NO: 2923689 - DNA, 20 bp, Homo sapiens
aaatttttccacactatgtg

SEQ ID NO: 2923690 - DNA, 13 bp, Homo sapiens
aaatttttgtaaa

SEQ ID NO: 2923691 - DNA, 12 bp, Homo sapiens
aaattttttgaa

SEQ ID NO: 2923692 - DNA, 15 bp, Homo sapiens
aaattttttgaaaca

SEQ ID NO: 2923693 - DNA, 17 bp, Homo sapiens
aacaaaaaaaacaacaa

SEQ ID NO: 2923694 - DNA, 17 bp, Homo sapiens
aacaaaaaaagtttgtt

SEQ ID NO: 2923695 - DNA, 21 bp, Homo sapiens
aacaaaaagttttttttttgt

SEQ ID NO: 2923696 - DNA, 14 bp, Homo sapiens
aacaaaaattgtct

SEQ ID NO: 2923697 - DNA, 18 bp, Homo sapiens
aacaaaacaaaacaacat

SEQ ID NO: 2923698 - DNA, 21 bp, Homo sapiens
aacaaaaccgcattcagtgca

SEQ ID NO: 2923699 - DNA, 20 bp, Homo sapiens
aacaaaaggaagactggaga

SEQ ID NO: 2923700 - DNA, 23 bp, Homo sapiens
aacaaaaggaagactggagaaat

SEQ ID NO: 2923701 - DNA, 13 bp, Homo sapiens
aacaaaatgcctt

SEQ ID NO: 2923702 - DNA, 24 bp, Homo sapiens
aacaaaatttgactaattttacat

SEQ ID NO: 2923703 - DNA, 14 bp, Homo sapiens
aacaaacaaacaaa

SEQ ID NO: 2923704 - DNA, 17 bp, Homo sapiens
aacaaagaagacaacat

SEQ ID NO: 2923705 - DNA, 15 bp, Homo sapiens
aacaaagagtgaaat

SEQ ID NO: 2923706 - DNA, 11 bp, Homo sapiens
aacaaagatat

SEQ ID NO: 2923707 - DNA, 22 bp, Homo sapiens
aacaaagatatcttttctttag

SEQ ID NO: 2923708 - DNA, 11 bp, Homo sapiens
aacaaagccag

SEQ ID NO: 2923709 - DNA, 16 bp, Homo sapiens
aacaaagcttagcagg

SEQ ID NO: 2923710 - DNA, 18 bp, Homo sapiens
aacaaagggttttaatgt

SEQ ID NO: 2923711 - DNA, 12 bp, Homo sapiens
aacaaagtaaaa

SEQ ID NO: 2923712 - DNA, 17 bp, Homo sapiens
aacaaagtcacagtcgt

SEQ ID NO: 2923713 - DNA, 18 bp, Homo sapiens
aacaaataatttgaactt

SEQ ID NO: 2923714 - DNA, 23 bp, Homo sapiens
aacaaataatttgaactttggaa

SEQ ID NO: 2923715 - DNA, 16 bp, Homo sapiens
aacaaatagtctatca

SEQ ID NO: 2923716 - DNA, 15 bp, Homo sapiens
aacaaatcaaacaca

SEQ ID NO: 2923717 - DNA, 23 bp, Homo sapiens
aacaaatcaaacacaacacaaga

SEQ ID NO: 2923718 - DNA, 23 bp, Homo sapiens
aacaaattctgaatattttttga

SEQ ID NO: 2923719 - DNA, 15 bp, Homo sapiens
aacaacaaaaaaagt

SEQ ID NO: 2923720 - DNA, 19 bp, Homo sapiens
aacaacaaataatttaagt

SEQ ID NO: 2923721 - DNA, 13 bp, Homo sapiens
aacaacaataata

SEQ ID NO: 2923722 - DNA, 14 bp, Homo sapiens
aacaacaataataa

SEQ ID NO: 2923723 - DNA, 16 bp, Homo sapiens
aacaacaataataaag

SEQ ID NO: 2923724 - DNA, 12 bp, Homo sapiens
aacaacattttg

SEQ ID NO: 2923725 - DNA, 14 bp, Homo sapiens
aacaagaagatgaa

SEQ ID NO: 2923726 - DNA, 11 bp, Homo sapiens
aacaagaatgc

SEQ ID NO: 2923727 - DNA, 15 bp, Homo sapiens
aacaagaatgcattg

SEQ ID NO: 2923728 - DNA, 16 bp, Homo sapiens
aacaagaatgcattga

SEQ ID NO: 2923729 - DNA, 13 bp, Homo sapiens
aacaagacagcct

SEQ ID NO: 2923730 - DNA, 15 bp, Homo sapiens
aacaagactgcctcc

SEQ ID NO: 2923731 - DNA, 21 bp, Homo sapiens
aacaagagcaaaactccgtct

SEQ ID NO: 2923732 - DNA, 23 bp, Homo sapiens
aacaagggaaggggcctccctcc

SEQ ID NO: 2923733 - DNA, 12 bp, Homo sapiens
aacaataaaaga

SEQ ID NO: 2923734 - DNA, 18 bp, Homo sapiens
aacaataggctgttccca

SEQ ID NO: 2923735 - DNA, 16 bp, Homo sapiens
aacaatattgtttcta

SEQ ID NO: 2923736 - DNA, 15 bp, Homo sapiens
aacaatcacaaaagc

SEQ ID NO: 2923737 - DNA, 23 bp, Homo sapiens
aacaatcacaaaagctgtgtctc

SEQ ID NO: 2923738 - DNA, 14 bp, Homo sapiens
aacaatccaaatgc

SEQ ID NO: 2923739 - DNA, 23 bp, Homo sapiens
aacaatccaaatgcattcatgtt

SEQ ID NO: 2923740 - DNA, 17 bp, Homo sapiens
aacaatcctagtgcttt

SEQ ID NO: 2923741 - DNA, 19 bp, Homo sapiens
aacaatgaatcagaacaga

SEQ ID NO: 2923742 - DNA, 21 bp, Homo sapiens
aacaatggtgtggtgaatgtg

SEQ ID NO: 2923743 - DNA, 16 bp, Homo sapiens
aacaatgtattttaat

SEQ ID NO: 2923744 - DNA, 18 bp, Homo sapiens
aacaattggttgtatata

SEQ ID NO: 2923745 - DNA, 19 bp, Homo sapiens
aacaattggttgtatataa

SEQ ID NO: 2923746 - DNA, 20 bp, Homo sapiens
aacaattggttgtatataaa

SEQ ID NO: 2923747 - DNA, 20 bp, Homo sapiens
aacaatttgggcttcctgtt

SEQ ID NO: 2923748 - DNA, 18 bp, Homo sapiens
aacaattttcttgtgaca

SEQ ID NO: 2923749 - DNA, 15 bp, Homo sapiens
aacacaaactgtaaa

SEQ ID NO: 2923750 - DNA, 19 bp, Homo sapiens
aacacaaactgtaaataaa

SEQ ID NO: 2923751 - DNA, 17 bp, Homo sapiens
aacacaaatgaaaatga

SEQ ID NO: 2923752 - DNA, 21 bp, Homo sapiens
aacacaaatgaaaatgaatag

SEQ ID NO: 2923753 - DNA, 20 bp, Homo sapiens
aacacaaatgcagggattgc

SEQ ID NO: 2923754 - DNA, 14 bp, Homo sapiens
aacacaacatttgt

SEQ ID NO: 2923755 - DNA, 22 bp, Homo sapiens
aacacaagaaaaagataagaaa

SEQ ID NO: 2923756 - DNA, 21 bp, Homo sapiens
aacacaatacctacaataaac

SEQ ID NO: 2923757 - DNA, 14 bp, Homo sapiens
aacacacacaaaag

SEQ ID NO: 2923758 - DNA, 20 bp, Homo sapiens
aacacactgaggcagggaag

SEQ ID NO: 2923759 - DNA, 21 bp, Homo sapiens
aacacactgaggcagggaagt

SEQ ID NO: 2923760 - DNA, 19 bp, Homo sapiens
aacacagaaacctttttaa

SEQ ID NO: 2923761 - DNA, 21 bp, Homo sapiens
aacacagtgtttttgtaaagt

SEQ ID NO: 2923762 - DNA, 22 bp, Homo sapiens
aacacagtgtttttgtaaagtg

SEQ ID NO: 2923763 - DNA, 13 bp, Homo sapiens
aacacataaatta

SEQ ID NO: 2923764 - DNA, 14 bp, Homo sapiens
aacacatacaaaag

SEQ ID NO: 2923765 - DNA, 17 bp, Homo sapiens
aacacatgtttttatac

SEQ ID NO: 2923766 - DNA, 23 bp, Homo sapiens
aacacattaaaagacaaatatgt

SEQ ID NO: 2923767 - DNA, 20 bp, Homo sapiens
aacacattgttattttcagt

SEQ ID NO: 2923768 - DNA, 20 bp, Homo sapiens
aacacattttggttcttctc

SEQ ID NO: 2923769 - DNA, 22 bp, Homo sapiens
aacacattttggttcttctcaa

SEQ ID NO: 2923770 - DNA, 15 bp, Homo sapiens
aacacattttgtata

SEQ ID NO: 2923771 - DNA, 19 bp, Homo sapiens
aacacattttgtataattg

SEQ ID NO: 2923772 - DNA, 15 bp, Homo sapiens
aacacatttttgtat

SEQ ID NO: 2923773 - DNA, 18 bp, Homo sapiens
aacaccaagcacagcagc

SEQ ID NO: 2923774 - DNA, 21 bp, Homo sapiens
aacaccaagcacagcagcctg

SEQ ID NO: 2923775 - DNA, 17 bp, Homo sapiens
aacaccagcagcactgg

SEQ ID NO: 2923776 - DNA, 20 bp, Homo sapiens
aacaccataggtagaatgta

SEQ ID NO: 2923777 - DNA, 16 bp, Homo sapiens
aacaccccgcctgcct

SEQ ID NO: 2923778 - DNA, 13 bp, Homo sapiens
aacacccctcagt

SEQ ID NO: 2923779 - DNA, 14 bp, Homo sapiens
aacacgcacctgcc

SEQ ID NO: 2923780 - DNA, 13 bp, Homo sapiens
aacacgcaggagc

SEQ ID NO: 2923781 - DNA, 15 bp, Homo sapiens
aacacgcctgcaaac

SEQ ID NO: 2923782 - DNA, 20 bp, Homo sapiens
aacacgcctgcaaacgctgc

SEQ ID NO: 2923783 - DNA, 16 bp, Homo sapiens
aacacgcgtatttaca

SEQ ID NO: 2923784 - DNA, 13 bp, Homo sapiens
aacacggccacat

SEQ ID NO: 2923785 - DNA, 15 bp, Homo sapiens
aacacgtgatgtgat

SEQ ID NO: 2923786 - DNA, 14 bp, Homo sapiens
aacactatttgtga

SEQ ID NO: 2923787 - DNA, 15 bp, Homo sapiens
aacactatttgtgac

SEQ ID NO: 2923788 - DNA, 16 bp, Homo sapiens
aacactatttgtgact

SEQ ID NO: 2923789 - DNA, 16 bp, Homo sapiens
aacactccttgcatca

SEQ ID NO: 2923790 - DNA, 15 bp, Homo sapiens
aacactgaaaaaata

SEQ ID NO: 2923791 - DNA, 22 bp, Homo sapiens
aacactgccagcatttcccttc

SEQ ID NO: 2923792 - DNA, 13 bp, Homo sapiens
aacactgcctgcc

SEQ ID NO: 2923793 - DNA, 23 bp, Homo sapiens
aacactgcctgccctctgtctgt

SEQ ID NO: 2923794 - DNA, 15 bp, Homo sapiens
aacactggcagactg

SEQ ID NO: 2923795 - DNA, 16 bp, Homo sapiens
aacacttccagtctgg

SEQ ID NO: 2923796 - DNA, 14 bp, Homo sapiens
aacacttctgtcct

SEQ ID NO: 2923797 - DNA, 13 bp, Homo sapiens
aacacttgaacct

SEQ ID NO: 2923798 - DNA, 20 bp, Homo sapiens
aacacttggtgctgggaacc

SEQ ID NO: 2923799 - DNA, 13 bp, Homo sapiens
aacacttttttgg

SEQ ID NO: 2923800 - DNA, 18 bp, Homo sapiens
aacacttttttgggggta

SEQ ID NO: 2923801 - DNA, 14 bp, Homo sapiens
aacagaaaacattc

SEQ ID NO: 2923802 - DNA, 16 bp, Homo sapiens
aacagaaatatataaa

SEQ ID NO: 2923803 - DNA, 19 bp, Homo sapiens
aacagaaatgctctgatta

SEQ ID NO: 2923804 - DNA, 21 bp, Homo sapiens
aacagaaatgtttctgtgtca

SEQ ID NO: 2923805 - DNA, 20 bp, Homo sapiens
aacagaacatcattagaaca

SEQ ID NO: 2923806 - DNA, 14 bp, Homo sapiens
aacagaagcagagg

SEQ ID NO: 2923807 - DNA, 21 bp, Homo sapiens
aacagacaaaaacagcctcac

SEQ ID NO: 2923808 - DNA, 19 bp, Homo sapiens
aacagacaccatcttttgt

SEQ ID NO: 2923809 - DNA, 18 bp, Homo sapiens
aacagaccccctctagaa

SEQ ID NO: 2923810 - DNA, 16 bp, Homo sapiens
aactaagttttgtgtg

SEQ ID NO: 2923811 - DNA, 20 bp, Homo sapiens
aactaagttttgtgtgtata

SEQ ID NO: 2923812 - DNA, 18 bp, Homo sapiens
aactaatgaattgaaatt

SEQ ID NO: 2923813 - DNA, 18 bp, Homo sapiens
aactaattgactttagaa

SEQ ID NO: 2923814 - DNA, 20 bp, Homo sapiens
aactacaaccaatggaatgt

SEQ ID NO: 2923815 - DNA, 13 bp, Homo sapiens
aactacatgttct

SEQ ID NO: 2923816 - DNA, 16 bp, Homo sapiens
aactaccagtgggcat

SEQ ID NO: 2923817 - DNA, 18 bp, Homo sapiens
aactaccagtgggcatgt

SEQ ID NO: 2923818 - DNA, 19 bp, Homo sapiens
aactaccagtgggcatgta

SEQ ID NO: 2923819 - DNA, 20 bp, Homo sapiens
aactaccagtgggcatgtat

SEQ ID NO: 2923820 - DNA, 13 bp, Homo sapiens
aactacctatatt

SEQ ID NO: 2923821 - DNA, 23 bp, Homo sapiens
aactacctcgcatcattgcagat

SEQ ID NO: 2923822 - DNA, 18 bp, Homo sapiens
aactactatctcagagat

SEQ ID NO: 2923823 - DNA, 17 bp, Homo sapiens
aactactgtagaagaag

SEQ ID NO: 2923824 - DNA, 20 bp, Homo sapiens
aactagacaccaaagttcta

SEQ ID NO: 2923825 - DNA, 16 bp, Homo sapiens
aactagagatgtgcaa

SEQ ID NO: 2923826 - DNA, 21 bp, Homo sapiens
aactagagatgtgcaattgat

SEQ ID NO: 2923827 - DNA, 14 bp, Homo sapiens
aactagatgacctc

SEQ ID NO: 2923828 - DNA, 13 bp, Homo sapiens
aactagtaaaact

SEQ ID NO: 2923829 - DNA, 15 bp, Homo sapiens
aactagtcctttact

SEQ ID NO: 2923830 - DNA, 14 bp, Homo sapiens
aactagttttgttt

SEQ ID NO: 2923831 - DNA, 14 bp, Homo sapiens
aactataaatacaa

SEQ ID NO: 2923832 - DNA, 18 bp, Homo sapiens
aactataaatacaaatct

SEQ ID NO: 2923833 - DNA, 19 bp, Homo sapiens
aactatataagacattaag

SEQ ID NO: 2923834 - DNA, 14 bp, Homo sapiens
aactatcaggcaga

SEQ ID NO: 2923835 - DNA, 21 bp, Homo sapiens
aactatcccctgcgctttgaa

SEQ ID NO: 2923836 - DNA, 22 bp, Homo sapiens
aactatcccctgcgctttgaac

SEQ ID NO: 2923837 - DNA, 15 bp, Homo sapiens
aactatgaaaccttt

SEQ ID NO: 2923838 - DNA, 18 bp, Homo sapiens
aactatggatcagaatag

SEQ ID NO: 2923839 - DNA, 21 bp, Homo sapiens
aactattaaggatgtagcttt

SEQ ID NO: 2923840 - DNA, 14 bp, Homo sapiens
aactattcatgcta

SEQ ID NO: 2923841 - DNA, 13 bp, Homo sapiens
aactatttatctg

SEQ ID NO: 2923842 - DNA, 23 bp, Homo sapiens
aactatttatctgtgtttttgaa

SEQ ID NO: 2923843 - DNA, 16 bp, Homo sapiens
aactattttcagatgt

SEQ ID NO: 2923844 - DNA, 22 bp, Homo sapiens
aactcaaacttctggctccctc

SEQ ID NO: 2923845 - DNA, 23 bp, Homo sapiens
aactcaaacttctggctccctct

SEQ ID NO: 2923846 - DNA, 18 bp, Homo sapiens
aactcaaagaatgtgtat

SEQ ID NO: 2923847 - DNA, 22 bp, Homo sapiens
aactcaaatggggccagatcca

SEQ ID NO: 2923848 - DNA, 23 bp, Homo sapiens
aactcaaatggggccagatccag

SEQ ID NO: 2923849 - DNA, 17 bp, Homo sapiens
aactcactatggttttt

SEQ ID NO: 2923850 - DNA, 21 bp, Homo sapiens
aactcagaaacatcagttact

SEQ ID NO: 2923851 - DNA, 23 bp, Homo sapiens
aactcagaactgtcggaggaaag

SEQ ID NO: 2923852 - DNA, 12 bp, Homo sapiens
aactcagccaag

SEQ ID NO: 2923853 - DNA, 14 bp, Homo sapiens
aactcagccaagca

SEQ ID NO: 2923854 - DNA, 21 bp, Homo sapiens
aactcagccaagcacagtggt

SEQ ID NO: 2923855 - DNA, 20 bp, Homo sapiens
aactcaggttcacagcagct

SEQ ID NO: 2923856 - DNA, 23 bp, Homo sapiens
aactcaggttcacagcagctttg

SEQ ID NO: 2923857 - DNA, 17 bp, Homo sapiens
aactcagtgaaggccca

SEQ ID NO: 2923858 - DNA, 22 bp, Homo sapiens
aactcagtgaaggcccatgaag

SEQ ID NO: 2923859 - DNA, 22 bp, Homo sapiens
aactcatttcctatgtaactgc

SEQ ID NO: 2923860 - DNA, 23 bp, Homo sapiens
aactcattttcatattgtaatct

SEQ ID NO: 2923861 - DNA, 23 bp, Homo sapiens
aactccaccaacccatcagaagg

SEQ ID NO: 2923862 - DNA, 18 bp, Homo sapiens
aactccagggtcccctgc

SEQ ID NO: 2923863 - DNA, 19 bp, Homo sapiens
aactcccctgtttcaatca

SEQ ID NO: 2923864 - DNA, 19 bp, Homo sapiens
aactccccttcctcactgc

SEQ ID NO: 2923865 - DNA, 10 bp, Homo sapiens
aactccctcc

SEQ ID NO: 2923866 - DNA, 17 bp, Homo sapiens
aactccctctctgtgca

SEQ ID NO: 2923867 - DNA, 12 bp, Homo sapiens
aactcccttctg

SEQ ID NO: 2923868 - DNA, 18 bp, Homo sapiens
aactcccttgtgttcctt

SEQ ID NO: 2923869 - DNA, 22 bp, Homo sapiens
aactcccttgtgttccttctgt

SEQ ID NO: 2923870 - DNA, 15 bp, Homo sapiens
aactcctactgcttc

SEQ ID NO: 2923871 - DNA, 22 bp, Homo sapiens
aactcctactgcttcctctgaa

SEQ ID NO: 2923872 - DNA, 19 bp, Homo sapiens
aactcctcgacatcactgt

SEQ ID NO: 2923873 - DNA, 18 bp, Homo sapiens
aactcctggaaatatcag

SEQ ID NO: 2923874 - DNA, 19 bp, Homo sapiens
aactcgaggactgtatttg

SEQ ID NO: 2923875 - DNA, 23 bp, Homo sapiens
aactctaaccaaggctgtgttta

SEQ ID NO: 2923876 - DNA, 21 bp, Homo sapiens
aactctcccaaagggcacacc

SEQ ID NO: 2923877 - DNA, 13 bp, Homo sapiens
aactctcccctcc

SEQ ID NO: 2923878 - DNA, 13 bp, Homo sapiens
aactctcctttga

SEQ ID NO: 2923879 - DNA, 15 bp, Homo sapiens
aactctctcccagga

SEQ ID NO: 2923880 - DNA, 11 bp, Homo sapiens
aactctgaaga

SEQ ID NO: 2923881 - DNA, 11 bp, Homo sapiens
aactctgctgt

SEQ ID NO: 2923882 - DNA, 12 bp, Homo sapiens
aactctggtggc

SEQ ID NO: 2923883 - DNA, 13 bp, Homo sapiens
aactctggtggca

SEQ ID NO: 2923884 - DNA, 17 bp, Homo sapiens
aactctgtcttcacctg

SEQ ID NO: 2923885 - DNA, 13 bp, Homo sapiens
aactcttaaaaat

SEQ ID NO: 2923886 - DNA, 15 bp, Homo sapiens
aactcttcactcttc

SEQ ID NO: 2923887 - DNA, 17 bp, Homo sapiens
aactcttcactcttcaa

SEQ ID NO: 2923888 - DNA, 17 bp, Homo sapiens
aactcttgattatccat

SEQ ID NO: 2923889 - DNA, 13 bp, Homo sapiens
aactcttgtattg

SEQ ID NO: 2923890 - DNA, 14 bp, Homo sapiens
aactcttgtttttt

SEQ ID NO: 2923891 - DNA, 12 bp, Homo sapiens
aactctttcaaa

SEQ ID NO: 2923892 - DNA, 21 bp, Homo sapiens
aactgaaaagagagcagagaa

SEQ ID NO: 2923893 - DNA, 20 bp, Homo sapiens
aactgaaataaaaaattatg

SEQ ID NO: 2923894 - DNA, 11 bp, Homo sapiens
aactgaaccaa

SEQ ID NO: 2923895 - DNA, 14 bp, Homo sapiens
aactgaagatattc

SEQ ID NO: 2923896 - DNA, 15 bp, Homo sapiens
aactgaagatgttga

SEQ ID NO: 2923897 - DNA, 13 bp, Homo sapiens
aactgaaggagaa

SEQ ID NO: 2923898 - DNA, 17 bp, Homo sapiens
aactgaattaaacatga

SEQ ID NO: 2923899 - DNA, 12 bp, Homo sapiens
aactgacatgat

SEQ ID NO: 2923900 - DNA, 18 bp, Homo sapiens
aactgactaaccattgat

SEQ ID NO: 2923901 - DNA, 10 bp, Homo sapiens
aactgagcct

SEQ ID NO: 2923902 - DNA, 13 bp, Homo sapiens
aactgagcttgga

SEQ ID NO: 2923903 - DNA, 21 bp, Homo sapiens
aactgagcttggaagcttctg

SEQ ID NO: 2923904 - DNA, 17 bp, Homo sapiens
aactgatagttactgtt

SEQ ID NO: 2923905 - DNA, 19 bp, Homo sapiens
aactgatagttactgttgt

SEQ ID NO: 2923906 - DNA, 20 bp, Homo sapiens
aactgatctcaagtatatgt

SEQ ID NO: 2923907 - DNA, 13 bp, Homo sapiens
aactgattcataa

SEQ ID NO: 2923908 - DNA, 12 bp, Homo sapiens
aactgattttac

SEQ ID NO: 2923909 - DNA, 17 bp, Homo sapiens
aactgcacatgaagaaa

SEQ ID NO: 2923910 - DNA, 21 bp, Homo sapiens
aactgcacatgaagaaatact

SEQ ID NO: 2923911 - DNA, 18 bp, Homo sapiens
aactgccaaaatgctcta

SEQ ID NO: 2923912 - DNA, 18 bp, Homo sapiens
aactgctacttgctctgc

SEQ ID NO: 2923913 - DNA, 16 bp, Homo sapiens
aactgctcagctctgg

SEQ ID NO: 2923914 - DNA, 17 bp, Homo sapiens
aactgctcagctctggt

SEQ ID NO: 2923915 - DNA, 18 bp, Homo sapiens
aactgctgatcaatgaaa

SEQ ID NO: 2923916 - DNA, 12 bp, Homo sapiens
aactgctggggc

SEQ ID NO: 2923917 - DNA, 13 bp, Homo sapiens
aactgctggggct

SEQ ID NO: 2923918 - DNA, 12 bp, Homo sapiens
aactgctgtctc

SEQ ID NO: 2923919 - DNA, 14 bp, Homo sapiens
aactggaaatctgg

SEQ ID NO: 2923920 - DNA, 18 bp, Homo sapiens
aactggaaatctggattt

SEQ ID NO: 2923921 - DNA, 20 bp, Homo sapiens
aactggaagcatgtaggaga

SEQ ID NO: 2923922 - DNA, 14 bp, Homo sapiens
aactggctacagta

SEQ ID NO: 2923923 - DNA, 14 bp, Homo sapiens
aactggcttgtaca

SEQ ID NO: 2923924 - DNA, 23 bp, Homo sapiens
aactgggatgaaactaaagcaat

SEQ ID NO: 2923925 - DNA, 15 bp, Homo sapiens
aactggggggaccaa

SEQ ID NO: 2923926 - DNA, 13 bp, Homo sapiens
aactgggttttca

SEQ ID NO: 2923927 - DNA, 18 bp, Homo sapiens
aactggtatgaataattg

SEQ ID NO: 2923928 - DNA, 13 bp, Homo sapiens
aactgtaatacaa

SEQ ID NO: 2923929 - DNA, 17 bp, Homo sapiens
aactgtactgttttctg

SEQ ID NO: 2923930 - DNA, 16 bp, Homo sapiens
aactgtagaaatgatg

SEQ ID NO: 2923931 - DNA, 13 bp, Homo sapiens
aactgtatcttga

SEQ ID NO: 2923932 - DNA, 16 bp, Homo sapiens
aactgtattattgcaa

SEQ ID NO: 2923933 - DNA, 15 bp, Homo sapiens
aactgtatttaagga

SEQ ID NO: 2923934 - DNA, 21 bp, Homo sapiens
aactgtgaatgcttctgattt

SEQ ID NO: 2923935 - DNA, 23 bp, Homo sapiens
aactgtgataatccccacaggca

SEQ ID NO: 2923936 - DNA, 23 bp, Homo sapiens
aactgtgatgaagccgaccttag

SEQ ID NO: 2923937 - DNA, 16 bp, Homo sapiens
aactgtggtagctcca

SEQ ID NO: 2923938 - DNA, 17 bp, Homo sapiens
aactgtggtagctccag

SEQ ID NO: 2923939 - DNA, 13 bp, Homo sapiens
aactgtgtagcat

SEQ ID NO: 2923940 - DNA, 14 bp, Homo sapiens
aactgtgtgtaatt

SEQ ID NO: 2923941 - DNA, 21 bp, Homo sapiens
aactgttaagaaatctgtttt

SEQ ID NO: 2923942 - DNA, 13 bp, Homo sapiens
aactgttcccacc

SEQ ID NO: 2923943 - DNA, 14 bp, Homo sapiens
aagcccccaccgtg

SEQ ID NO: 2923944 - DNA, 20 bp, Homo sapiens
aagcccccaccgtgggcagg

SEQ ID NO: 2923945 - DNA, 16 bp, Homo sapiens
aagcccccccttccac

SEQ ID NO: 2923946 - DNA, 12 bp, Homo sapiens
aagccccctggc

SEQ ID NO: 2923947 - DNA, 19 bp, Homo sapiens
aagccccctggcagctgcc

SEQ ID NO: 2923948 - DNA, 22 bp, Homo sapiens
aagccccctggcagctgcccct

SEQ ID NO: 2923949 - DNA, 9 bp, Homo sapiens
aagccctcc

SEQ ID NO: 2923950 - DNA, 11 bp, Homo sapiens
aagccctcctt

SEQ ID NO: 2923951 - DNA, 19 bp, Homo sapiens
aagccctgcctctgtgtag

SEQ ID NO: 2923952 - DNA, 12 bp, Homo sapiens
aagccctggccc

SEQ ID NO: 2923953 - DNA, 14 bp, Homo sapiens
aagccctgttctcg

SEQ ID NO: 2923954 - DNA, 18 bp, Homo sapiens
aagccctgttgtgccaca

SEQ ID NO: 2923955 - DNA, 22 bp, Homo sapiens
aagccggggaagagatccaaag

SEQ ID NO: 2923956 - DNA, 14 bp, Homo sapiens
aagccgtgccctgc

SEQ ID NO: 2923957 - DNA, 21 bp, Homo sapiens
aagcctcaaggttttaggttc

SEQ ID NO: 2923958 - DNA, 23 bp, Homo sapiens
aagcctcaagttccagtgcagag

SEQ ID NO: 2923959 - DNA, 14 bp, Homo sapiens
aagcctccttacat

SEQ ID NO: 2923960 - DNA, 17 bp, Homo sapiens
aagcctccttacattaa

SEQ ID NO: 2923961 - DNA, 21 bp, Homo sapiens
aagcctgaaggggcgtctgtt

SEQ ID NO: 2923962 - DNA, 15 bp, Homo sapiens
aagcctgcattctta

SEQ ID NO: 2923963 - DNA, 18 bp, Homo sapiens
aagcctgcctcgccttgt

SEQ ID NO: 2923964 - DNA, 20 bp, Homo sapiens
aagcctgcctcgccttgtgt

SEQ ID NO: 2923965 - DNA, 11 bp, Homo sapiens
aagcctgtcct

SEQ ID NO: 2923966 - DNA, 15 bp, Homo sapiens
aagcctgtctctttc

SEQ ID NO: 2923967 - DNA, 16 bp, Homo sapiens
aagcctgtgcaaaaaa

SEQ ID NO: 2923968 - DNA, 12 bp, Homo sapiens
aagcctgtggct

SEQ ID NO: 2923969 - DNA, 17 bp, Homo sapiens
aagccttaactaagact

SEQ ID NO: 2923970 - DNA, 18 bp, Homo sapiens
aagccttaactaagactc

SEQ ID NO: 2923971 - DNA, 18 bp, Homo sapiens
aagccttacagttatcct

SEQ ID NO: 2923972 - DNA, 21 bp, Homo sapiens
aagccttcttatatctgaaga

SEQ ID NO: 2923973 - DNA, 22 bp, Homo sapiens
aagccttcttatatctgaagat

SEQ ID NO: 2923974 - DNA, 23 bp, Homo sapiens
aagcctttactgaccctggggct

SEQ ID NO: 2923975 - DNA, 22 bp, Homo sapiens
aagcgaacatcttcatataaac

SEQ ID NO: 2923976 - DNA, 18 bp, Homo sapiens
aagcgacttttgttctct

SEQ ID NO: 2923977 - DNA, 18 bp, Homo sapiens
aagcgaggtcaacagaga

SEQ ID NO: 2923978 - DNA, 18 bp, Homo sapiens
aagcgatcacttcctata

SEQ ID NO: 2923979 - DNA, 21 bp, Homo sapiens
aagcgattctcctgcctcagc

SEQ ID NO: 2923980 - DNA, 19 bp, Homo sapiens
aagcgtctttaagagactc

SEQ ID NO: 2923981 - DNA, 23 bp, Homo sapiens
aagcgtgaaggccgagaagcaag

SEQ ID NO: 2923982 - DNA, 21 bp, Homo sapiens
aagctacaggttacaacagat

SEQ ID NO: 2923983 - DNA, 22 bp, Homo sapiens
aagctacaggttacaacagatt

SEQ ID NO: 2923984 - DNA, 19 bp, Homo sapiens
aagctacctcaaacttcca

SEQ ID NO: 2923985 - DNA, 19 bp, Homo sapiens
aagctactgtgtgtgtgaa

SEQ ID NO: 2923986 - DNA, 22 bp, Homo sapiens
aagctactgtgtgtgtgaatga

SEQ ID NO: 2923987 - DNA, 18 bp, Homo sapiens
aagctagagagaaaaaga

SEQ ID NO: 2923988 - DNA, 21 bp, Homo sapiens
aagctagagagaaaaagaaag

SEQ ID NO: 2923989 - DNA, 16 bp, Homo sapiens
aagctagcaaatagta

SEQ ID NO: 2923990 - DNA, 20 bp, Homo sapiens
aagctagtgtacctcctctc

SEQ ID NO: 2923991 - DNA, 18 bp, Homo sapiens
aagctataaattcctctt

SEQ ID NO: 2923992 - DNA, 12 bp, Homo sapiens
aagctatggtga

SEQ ID NO: 2923993 - DNA, 18 bp, Homo sapiens
aagctcaaataaaaataa

SEQ ID NO: 2923994 - DNA, 19 bp, Homo sapiens
aagctcacagttcctcgcc

SEQ ID NO: 2923995 - DNA, 20 bp, Homo sapiens
aagctcacagttcctcgccc

SEQ ID NO: 2923996 - DNA, 23 bp, Homo sapiens
aagctcacagttcctcgccctgg

SEQ ID NO: 2923997 - DNA, 18 bp, Homo sapiens
aagctcacctgttgctta

SEQ ID NO: 2923998 - DNA, 22 bp, Homo sapiens
aagctcacctgttgcttacaat

SEQ ID NO: 2923999 - DNA, 17 bp, Homo sapiens
aagctcagactggttga

SEQ ID NO: 2924000 - DNA, 16 bp, Homo sapiens
aagctcagttgggttt

SEQ ID NO: 2924001 - DNA, 17 bp, Homo sapiens
aagctcctattagaaaa

SEQ ID NO: 2924002 - DNA, 13 bp, Homo sapiens
aagctcctcctcc

SEQ ID NO: 2924003 - DNA, 21 bp, Homo sapiens
aagctcctcctccctgcatct

SEQ ID NO: 2924004 - DNA, 19 bp, Homo sapiens
aagctcctctccccagccc

SEQ ID NO: 2924005 - DNA, 20 bp, Homo sapiens
aagctcctctccccagccca

SEQ ID NO: 2924006 - DNA, 21 bp, Homo sapiens
aagctcctctccccagcccag

SEQ ID NO: 2924007 - DNA, 23 bp, Homo sapiens
aagctcctctccccagcccagag

SEQ ID NO: 2924008 - DNA, 14 bp, Homo sapiens
aagctcctctgtaa

SEQ ID NO: 2924009 - DNA, 12 bp, Homo sapiens
aagctctgacat

SEQ ID NO: 2924010 - DNA, 20 bp, Homo sapiens
aagctcttgtttctgtttag

SEQ ID NO: 2924011 - DNA, 13 bp, Homo sapiens
aagctgaatcccg

SEQ ID NO: 2924012 - DNA, 17 bp, Homo sapiens
aagctgacattgccaaa

SEQ ID NO: 2924013 - DNA, 13 bp, Homo sapiens
aagctgagcctgc

SEQ ID NO: 2924014 - DNA, 15 bp, Homo sapiens
aagctgagcctgcag

SEQ ID NO: 2924015 - DNA, 16 bp, Homo sapiens
aagctgcctcaaggaa

SEQ ID NO: 2924016 - DNA, 11 bp, Homo sapiens
aagctgcctct

SEQ ID NO: 2924017 - DNA, 17 bp, Homo sapiens
aagctggagtgctgctt

SEQ ID NO: 2924018 - DNA, 21 bp, Homo sapiens
aagctggctgtacctgttcct

SEQ ID NO: 2924019 - DNA, 16 bp, Homo sapiens
aagctgggactcattc

SEQ ID NO: 2924020 - DNA, 13 bp, Homo sapiens
aagctgtactttt

SEQ ID NO: 2924021 - DNA, 15 bp, Homo sapiens
aagctgtatcactgc

SEQ ID NO: 2924022 - DNA, 17 bp, Homo sapiens
aagctgtatcactgcct

SEQ ID NO: 2924023 - DNA, 18 bp, Homo sapiens
aagctgtatcactgcctt

SEQ ID NO: 2924024 - DNA, 22 bp, Homo sapiens
aagctgtgcaattactgcctgc

SEQ ID NO: 2924025 - DNA, 23 bp, Homo sapiens
aagctgttaaagatatttttatt

SEQ ID NO: 2924026 - DNA, 18 bp, Homo sapiens
aagctgttattcttgtta

SEQ ID NO: 2924027 - DNA, 20 bp, Homo sapiens
aagcttagcaggagaggaga

SEQ ID NO: 2924028 - DNA, 22 bp, Homo sapiens
aagcttagcaggagaggagagc

SEQ ID NO: 2924029 - DNA, 14 bp, Homo sapiens
aagcttcaaaaact

SEQ ID NO: 2924030 - DNA, 22 bp, Homo sapiens
aagcttcaaagccatatggaca

SEQ ID NO: 2924031 - DNA, 20 bp, Homo sapiens
aagcttccatgattctattt

SEQ ID NO: 2924032 - DNA, 15 bp, Homo sapiens
aagcttgtaaatatg

SEQ ID NO: 2924033 - DNA, 22 bp, Homo sapiens
aagcttgtgtatccattatcat

SEQ ID NO: 2924034 - DNA, 23 bp, Homo sapiens
aagctttcatgtaaactgtgcac

SEQ ID NO: 2924035 - DNA, 20 bp, Homo sapiens
aagctttgtcccctgcttca

SEQ ID NO: 2924036 - DNA, 18 bp, Homo sapiens
aagctttttaatgctgta

SEQ ID NO: 2924037 - DNA, 21 bp, Homo sapiens
aagctttttgatgtataaaac

SEQ ID NO: 2924038 - DNA, 21 bp, Homo sapiens
aaggaaaaaaagactcttttt

SEQ ID NO: 2924039 - DNA, 16 bp, Homo sapiens
aaggaaaaaataacaa

SEQ ID NO: 2924040 - DNA, 17 bp, Homo sapiens
aaggaaaaataatcaag

SEQ ID NO: 2924041 - DNA, 17 bp, Homo sapiens
aaggaaaactgcatgga

SEQ ID NO: 2924042 - DNA, 19 bp, Homo sapiens
aaggaaaactgccataaca

SEQ ID NO: 2924043 - DNA, 21 bp, Homo sapiens
aaggaaaactgccataacata

SEQ ID NO: 2924044 - DNA, 20 bp, Homo sapiens
aaggaaagatgatgctcagt

SEQ ID NO: 2924045 - DNA, 20 bp, Homo sapiens
aaggaaagcaataaatgaat

SEQ ID NO: 2924046 - DNA, 22 bp, Homo sapiens
aaggaaatgagtggccagcgcc

SEQ ID NO: 2924047 - DNA, 24 bp, Homo sapiens
aaggaaatgagtggccagcgccag

SEQ ID NO: 2924048 - DNA, 21 bp, Homo sapiens
aaggaaatgattgaggagtga

SEQ ID NO: 2924049 - DNA, 18 bp, Homo sapiens
aaggaaatgcaagctctg

SEQ ID NO: 2924050 - DNA, 18 bp, Homo sapiens
aaggaacaaaaattacaa

SEQ ID NO: 2924051 - DNA, 22 bp, Homo sapiens
aaggaacaaaaattacaaagaa

SEQ ID NO: 2924052 - DNA, 14 bp, Homo sapiens
aaggaactgcagca

SEQ ID NO: 2924053 - DNA, 17 bp, Homo sapiens
aaggaacttgaaaaata

SEQ ID NO: 2924054 - DNA, 13 bp, Homo sapiens
aaggaagaaaacg

SEQ ID NO: 2924055 - DNA, 19 bp, Homo sapiens
aaggaagccggggaagaga

SEQ ID NO: 2924056 - DNA, 20 bp, Homo sapiens
aaggaaggagactcacctct

SEQ ID NO: 2924057 - DNA, 11 bp, Homo sapiens
aaggaaggagc

SEQ ID NO: 2924058 - DNA, 12 bp, Homo sapiens
aaggaaggctct

SEQ ID NO: 2924059 - DNA, 13 bp, Homo sapiens
aaggaaggctctc

SEQ ID NO: 2924060 - DNA, 21 bp, Homo sapiens
aaggaagtcaaagcaaggaaa

SEQ ID NO: 2924061 - DNA, 13 bp, Homo sapiens
aaggaataaatga

SEQ ID NO: 2924062 - DNA, 18 bp, Homo sapiens
aaggaatcactttagaaa

SEQ ID NO: 2924063 - DNA, 22 bp, Homo sapiens
aaggaatccccagatatttatg

SEQ ID NO: 2924064 - DNA, 21 bp, Homo sapiens
aaggaatgtccatttgctgag

SEQ ID NO: 2924065 - DNA, 16 bp, Homo sapiens
aaggacaaagtgccaa

SEQ ID NO: 2924066 - DNA, 18 bp, Homo sapiens
aaggacaatcccaggaag

SEQ ID NO: 2924067 - DNA, 16 bp, Homo sapiens
aaggacagacagcagg

SEQ ID NO: 2924068 - DNA, 21 bp, Homo sapiens
aaggacagactggccgggcag

SEQ ID NO: 2924069 - DNA, 14 bp, Homo sapiens
aaggacagagccag

SEQ ID NO: 2924070 - DNA, 17 bp, Homo sapiens
aaggacagagtatgaac

SEQ ID NO: 2924071 - DNA, 22 bp, Homo sapiens
aaggacaggtctctgagacagg

SEQ ID NO: 2924072 - DNA, 15 bp, Homo sapiens
aaggacattcttgta

SEQ ID NO: 2924073 - DNA, 13 bp, Homo sapiens
aaggaccagcttt

SEQ ID NO: 2924074 - DNA, 22 bp, Homo sapiens
aagtttagtttgaggaattctt

SEQ ID NO: 2924075 - DNA, 12 bp, Homo sapiens
aagtttataagc

SEQ ID NO: 2924076 - DNA, 13 bp, Homo sapiens
aagtttatatata

SEQ ID NO: 2924077 - DNA, 21 bp, Homo sapiens
aagtttcagagaccattgcaa

SEQ ID NO: 2924078 - DNA, 11 bp, Homo sapiens
aagtttctaag

SEQ ID NO: 2924079 - DNA, 12 bp, Homo sapiens
aagtttctaaga

SEQ ID NO: 2924080 - DNA, 15 bp, Homo sapiens
aagtttctaagattc

SEQ ID NO: 2924081 - DNA, 18 bp, Homo sapiens
aagtttctaagattctaa

SEQ ID NO: 2924082 - DNA, 19 bp, Homo sapiens
aagtttctaagattctaaa

SEQ ID NO: 2924083 - DNA, 20 bp, Homo sapiens
aagtttctaagattctaaag

SEQ ID NO: 2924084 - DNA, 13 bp, Homo sapiens
aagtttctcagat

SEQ ID NO: 2924085 - DNA, 15 bp, Homo sapiens
aagtttctttagaaa

SEQ ID NO: 2924086 - DNA, 16 bp, Homo sapiens
aagtttgaccagtgca

SEQ ID NO: 2924087 - DNA, 21 bp, Homo sapiens
aagtttgacttgtataacatc

SEQ ID NO: 2924088 - DNA, 20 bp, Homo sapiens
aagtttgcactatctttcag

SEQ ID NO: 2924089 - DNA, 16 bp, Homo sapiens
aagtttgccctggatg

SEQ ID NO: 2924090 - DNA, 15 bp, Homo sapiens
aagtttggttttgac

SEQ ID NO: 2924091 - DNA, 18 bp, Homo sapiens
aagtttgtcctttaacta

SEQ ID NO: 2924092 - DNA, 18 bp, Homo sapiens
aagtttgttactttgaat

SEQ ID NO: 2924093 - DNA, 19 bp, Homo sapiens
aagtttgttactttgaata

SEQ ID NO: 2924094 - DNA, 18 bp, Homo sapiens
aagttttattataaattc

SEQ ID NO: 2924095 - DNA, 21 bp, Homo sapiens
aagttttcccttgaggaaaca

SEQ ID NO: 2924096 - DNA, 20 bp, Homo sapiens
aagttttggttattatatat

SEQ ID NO: 2924097 - DNA, 17 bp, Homo sapiens
aagttttgtgtgtatat

SEQ ID NO: 2924098 - DNA, 19 bp, Homo sapiens
aagtttttattcaaagcag

SEQ ID NO: 2924099 - DNA, 16 bp, Homo sapiens
aagtttttttatttct

SEQ ID NO: 2924100 - DNA, 15 bp, Homo sapiens
aataaaaaacaagaa

SEQ ID NO: 2924101 - DNA, 16 bp, Homo sapiens
aataaaaaacaagaaa

SEQ ID NO: 2924102 - DNA, 17 bp, Homo sapiens
aataaaaacttacactc

SEQ ID NO: 2924103 - DNA, 16 bp, Homo sapiens
aataaaaagaaagatt

SEQ ID NO: 2924104 - DNA, 15 bp, Homo sapiens
aataaaaagattcta

SEQ ID NO: 2924105 - DNA, 18 bp, Homo sapiens
aataaaaaggcacctata

SEQ ID NO: 2924106 - DNA, 18 bp, Homo sapiens
aataaaaagggcagccct

SEQ ID NO: 2924107 - DNA, 13 bp, Homo sapiens
aataaaaataaat

SEQ ID NO: 2924108 - DNA, 12 bp, Homo sapiens
aataaaaataat

SEQ ID NO: 2924109 - DNA, 13 bp, Homo sapiens
aataaaaatcaaa

SEQ ID NO: 2924110 - DNA, 13 bp, Homo sapiens
aataaaaatgata

SEQ ID NO: 2924111 - DNA, 13 bp, Homo sapiens
aataaaaatggat

SEQ ID NO: 2924112 - DNA, 21 bp, Homo sapiens
aataaaaattgtagcttttta

SEQ ID NO: 2924113 - DNA, 11 bp, Homo sapiens
aataaaacata

SEQ ID NO: 2924114 - DNA, 11 bp, Homo sapiens
aataaaacatt

SEQ ID NO: 2924115 - DNA, 17 bp, Homo sapiens
aataaaaccaagcctct

SEQ ID NO: 2924116 - DNA, 13 bp, Homo sapiens
aataaaagctgtg

SEQ ID NO: 2924117 - DNA, 21 bp, Homo sapiens
aataaaaggaagccaaagagt

SEQ ID NO: 2924118 - DNA, 14 bp, Homo sapiens
aataaaagttcctc

SEQ ID NO: 2924119 - DNA, 16 bp, Homo sapiens
aataaaagttcctctc

SEQ ID NO: 2924120 - DNA, 20 bp, Homo sapiens
aataaaagttttacaaaggg

SEQ ID NO: 2924121 - DNA, 17 bp, Homo sapiens
aataaaatactttttgt

SEQ ID NO: 2924122 - DNA, 11 bp, Homo sapiens
aataaaatttg

SEQ ID NO: 2924123 - DNA, 16 bp, Homo sapiens
aataaaatttgttgca

SEQ ID NO: 2924124 - DNA, 19 bp, Homo sapiens
aataaacatagcttgtaac

SEQ ID NO: 2924125 - DNA, 12 bp, Homo sapiens
aataaaccaaga

SEQ ID NO: 2924126 - DNA, 15 bp, Homo sapiens
aataaaccaagacaa

SEQ ID NO: 2924127 - DNA, 14 bp, Homo sapiens
aataaaccttgttt

SEQ ID NO: 2924128 - DNA, 21 bp, Homo sapiens
aataaaccttgtttctttctg

SEQ ID NO: 2924129 - DNA, 21 bp, Homo sapiens
aataaacgatttaattctctt

SEQ ID NO: 2924130 - DNA, 16 bp, Homo sapiens
aataaactagagaagg

SEQ ID NO: 2924131 - DNA, 21 bp, Homo sapiens
aataaactagggttttggcct

SEQ ID NO: 2924132 - DNA, 22 bp, Homo sapiens
aataaactagggttttggcctg

SEQ ID NO: 2924133 - DNA, 14 bp, Homo sapiens
aataaagaatactt

SEQ ID NO: 2924134 - DNA, 19 bp, Homo sapiens
aataaagaatacttgaact

SEQ ID NO: 2924135 - DNA, 23 bp, Homo sapiens
aataaagcactattgtttagata

SEQ ID NO: 2924136 - DNA, 15 bp, Homo sapiens
aataaagctgttctc

SEQ ID NO: 2924137 - DNA, 16 bp, Homo sapiens
aataaagggataaaga

SEQ ID NO: 2924138 - DNA, 12 bp, Homo sapiens
aataaagtactt

SEQ ID NO: 2924139 - DNA, 19 bp, Homo sapiens
aataaagtttgcttagaaa

SEQ ID NO: 2924140 - DNA, 22 bp, Homo sapiens
aataaataccaattatggaaat

SEQ ID NO: 2924141 - DNA, 15 bp, Homo sapiens
aataaatatctgtac

SEQ ID NO: 2924142 - DNA, 11 bp, Homo sapiens
aataaatatgc

SEQ ID NO: 2924143 - DNA, 13 bp, Homo sapiens
aataaatatgcct

SEQ ID NO: 2924144 - DNA, 19 bp, Homo sapiens
aataaatatgcctctcctt

SEQ ID NO: 2924145 - DNA, 16 bp, Homo sapiens
aataaatctgacccag

SEQ ID NO: 2924146 - DNA, 13 bp, Homo sapiens
aataaatgtcttt

SEQ ID NO: 2924147 - DNA, 16 bp, Homo sapiens
aataaatgtttccccc

SEQ ID NO: 2924148 - DNA, 18 bp, Homo sapiens
aataaatgtttcccccac

SEQ ID NO: 2924149 - DNA, 16 bp, Homo sapiens
aataaattaatattgt

SEQ ID NO: 2924150 - DNA, 18 bp, Homo sapiens
aataaattaatattgtat

SEQ ID NO: 2924151 - DNA, 21 bp, Homo sapiens
aataaattcctacaacttaat

SEQ ID NO: 2924152 - DNA, 13 bp, Homo sapiens
aataaattctctc

SEQ ID NO: 2924153 - DNA, 20 bp, Homo sapiens
aataaattgtaattgtaaag

SEQ ID NO: 2924154 - DNA, 15 bp, Homo sapiens
aataaatttactgaa

SEQ ID NO: 2924155 - DNA, 16 bp, Homo sapiens
aataaattttgtgcaa

SEQ ID NO: 2924156 - DNA, 15 bp, Homo sapiens
aataacatatctaaa

SEQ ID NO: 2924157 - DNA, 17 bp, Homo sapiens
aataactatcaggcaga

SEQ ID NO: 2924158 - DNA, 20 bp, Homo sapiens
aataactatcaggcagaaga

SEQ ID NO: 2924159 - DNA, 16 bp, Homo sapiens
aataactgaaccaaat

SEQ ID NO: 2924160 - DNA, 23 bp, Homo sapiens
aataactgaaccaaattgcactg

SEQ ID NO: 2924161 - DNA, 23 bp, Homo sapiens
aataacttctatattttaataga

SEQ ID NO: 2924162 - DNA, 15 bp, Homo sapiens
aataagaatggaaaa

SEQ ID NO: 2924163 - DNA, 17 bp, Homo sapiens
aataagagtctccttct

SEQ ID NO: 2924164 - DNA, 15 bp, Homo sapiens
aataagcaaaatcct

SEQ ID NO: 2924165 - DNA, 17 bp, Homo sapiens
aataagcataagaccaa

SEQ ID NO: 2924166 - DNA, 15 bp, Homo sapiens
aataagtcaccattg

SEQ ID NO: 2924167 - DNA, 13 bp, Homo sapiens
aataagttattgc

SEQ ID NO: 2924168 - DNA, 19 bp, Homo sapiens
aataagttgatgttttcta

SEQ ID NO: 2924169 - DNA, 20 bp, Homo sapiens
aataagttgatgttttctaa

SEQ ID NO: 2924170 - DNA, 16 bp, Homo sapiens
aataataaagatgtga

SEQ ID NO: 2924171 - DNA, 16 bp, Homo sapiens
aataataattgaagaa

SEQ ID NO: 2924172 - DNA, 17 bp, Homo sapiens
aataataattgaagaat

SEQ ID NO: 2924173 - DNA, 15 bp, Homo sapiens
aataatatattttct

SEQ ID NO: 2924174 - DNA, 17 bp, Homo sapiens
aataatatattttctgt

SEQ ID NO: 2924175 - DNA, 17 bp, Homo sapiens
aataatcaagattttag

SEQ ID NO: 2924176 - DNA, 20 bp, Homo sapiens
aataatcatgtgaaatgttt

SEQ ID NO: 2924177 - DNA, 13 bp, Homo sapiens
aataatcattgga

SEQ ID NO: 2924178 - DNA, 21 bp, Homo sapiens
aataatcgactttttaaatgt

SEQ ID NO: 2924179 - DNA, 21 bp, Homo sapiens
aataatctcacaaaacatatt

SEQ ID NO: 2924180 - DNA, 21 bp, Homo sapiens
aataatctggtgttcttgcta

SEQ ID NO: 2924181 - DNA, 12 bp, Homo sapiens
aataatgcagta

SEQ ID NO: 2924182 - DNA, 19 bp, Homo sapiens
aataatgcagtatggtaca

SEQ ID NO: 2924183 - DNA, 23 bp, Homo sapiens
aataatgcagtatggtacatttt

SEQ ID NO: 2924184 - DNA, 22 bp, Homo sapiens
aataatggaaaaaaaaaaaaga

SEQ ID NO: 2924185 - DNA, 23 bp, Homo sapiens
aataatggaaaaaaaaaaaagag

SEQ ID NO: 2924186 - DNA, 23 bp, Homo sapiens
aataatggtaccagataaaatta

SEQ ID NO: 2924187 - DNA, 16 bp, Homo sapiens
aataatgtaattgtaa

SEQ ID NO: 2924188 - DNA, 17 bp, Homo sapiens
aataatgtagttttgtt

SEQ ID NO: 2924189 - DNA, 19 bp, Homo sapiens
aataatgtagttttgttta

SEQ ID NO: 2924190 - DNA, 22 bp, Homo sapiens
aataatgtagttttgtttatgc

SEQ ID NO: 2924191 - DNA, 15 bp, Homo sapiens
aataattgaagaatg

SEQ ID NO: 2924192 - DNA, 16 bp, Homo sapiens
aataattgcagaacta

SEQ ID NO: 2924193 - DNA, 13 bp, Homo sapiens
aataatttaagtt

SEQ ID NO: 2924194 - DNA, 15 bp, Homo sapiens
aataatttctaatgt

SEQ ID NO: 2924195 - DNA, 14 bp, Homo sapiens
aataatttgaactt

SEQ ID NO: 2924196 - DNA, 15 bp, Homo sapiens
aataatttgaacttt

SEQ ID NO: 2924197 - DNA, 12 bp, Homo sapiens
aataattttaaa

SEQ ID NO: 2924198 - DNA, 17 bp, Homo sapiens
aataattttaaaaatgg

SEQ ID NO: 2924199 - DNA, 14 bp, Homo sapiens
aataattttatctc

SEQ ID NO: 2924200 - DNA, 13 bp, Homo sapiens
aatacaaatctgt

SEQ ID NO: 2924201 - DNA, 15 bp, Homo sapiens
aatacaaatctgtat

SEQ ID NO: 2924202 - DNA, 19 bp, Homo sapiens
aatacaaatctgtataaat

SEQ ID NO: 2924203 - DNA, 14 bp, Homo sapiens
aatacaacaaagga

SEQ ID NO: 2924204 - DNA, 18 bp, Homo sapiens
aatacaacttaaataata

SEQ ID NO: 2924205 - DNA, 17 bp, Homo sapiens
aatacagcagcaagaaa

SEQ ID NO: 2924206 - DNA, 21 bp, Homo sapiens
aatacagcagcaagaaaaaaa

SEQ ID NO: 2924207 - DNA, 23 bp, Homo sapiens
aatacagcctgaataaaccaaga

SEQ ID NO: 2924208 - DNA, 17 bp, Homo sapiens
aatgctgtctttgtgga

SEQ ID NO: 2924209 - DNA, 13 bp, Homo sapiens
aatgctgtgaata

SEQ ID NO: 2924210 - DNA, 21 bp, Homo sapiens
aatgcttaagagggaatgata

SEQ ID NO: 2924211 - DNA, 15 bp, Homo sapiens
aatgcttatgtgttg

SEQ ID NO: 2924212 - DNA, 19 bp, Homo sapiens
aatgcttctgatttagcaa

SEQ ID NO: 2924213 - DNA, 19 bp, Homo sapiens
aatgctttttatttctgca

SEQ ID NO: 2924214 - DNA, 22 bp, Homo sapiens
aatggaaaaaaaaaaaagagga

SEQ ID NO: 2924215 - DNA, 15 bp, Homo sapiens
aatggaaaatgtata

SEQ ID NO: 2924216 - DNA, 21 bp, Homo sapiens
aatggaatgtgatgttcatgg

SEQ ID NO: 2924217 - DNA, 12 bp, Homo sapiens
aatggacacttt

SEQ ID NO: 2924218 - DNA, 22 bp, Homo sapiens
aatggactcagctctgtctgct

SEQ ID NO: 2924219 - DNA, 23 bp, Homo sapiens
aatggactcagctctgtctgctc

SEQ ID NO: 2924220 - DNA, 20 bp, Homo sapiens
aatggaggccatatttccat

SEQ ID NO: 2924221 - DNA, 20 bp, Homo sapiens
aatggcatgagaaatacaaa

SEQ ID NO: 2924222 - DNA, 15 bp, Homo sapiens
aatggcatgagatag

SEQ ID NO: 2924223 - DNA, 16 bp, Homo sapiens
aatggctctgtgaaat

SEQ ID NO: 2924224 - DNA, 19 bp, Homo sapiens
aatggctctgtgaaatcag

SEQ ID NO: 2924225 - DNA, 17 bp, Homo sapiens
aatggcttagctacttg

SEQ ID NO: 2924226 - DNA, 15 bp, Homo sapiens
aatggctttgtcttg

SEQ ID NO: 2924227 - DNA, 18 bp, Homo sapiens
aatggctttgtcttgaaa

SEQ ID NO: 2924228 - DNA, 19 bp, Homo sapiens
aatggcttttcccaacccc

SEQ ID NO: 2924229 - DNA, 23 bp, Homo sapiens
aatgggaacatttattttatgag

SEQ ID NO: 2924230 - DNA, 23 bp, Homo sapiens
aatgggagaaaacgccagtgtgt

SEQ ID NO: 2924231 - DNA, 21 bp, Homo sapiens
aatgggagctgaggccacact

SEQ ID NO: 2924232 - DNA, 16 bp, Homo sapiens
aatgggattagaaaca

SEQ ID NO: 2924233 - DNA, 15 bp, Homo sapiens
aatgggattttctag

SEQ ID NO: 2924234 - DNA, 13 bp, Homo sapiens
aatggggccagat

SEQ ID NO: 2924235 - DNA, 17 bp, Homo sapiens
aatggggccagatccag

SEQ ID NO: 2924236 - DNA, 16 bp, Homo sapiens
aatgggggcctccgct

SEQ ID NO: 2924237 - DNA, 20 bp, Homo sapiens
aatgggggctttcggggagg

SEQ ID NO: 2924238 - DNA, 23 bp, Homo sapiens
aatgggggctttcggggagggcg

SEQ ID NO: 2924239 - DNA, 18 bp, Homo sapiens
aatggggtcctggccatc

SEQ ID NO: 2924240 - DNA, 16 bp, Homo sapiens
aatggtaccagataaa

SEQ ID NO: 2924241 - DNA, 21 bp, Homo sapiens
aatggtagattcgctgtcccc

SEQ ID NO: 2924242 - DNA, 17 bp, Homo sapiens
aatggtagctgaaaaaa

SEQ ID NO: 2924243 - DNA, 19 bp, Homo sapiens
aatggtccaggagaaggcc

SEQ ID NO: 2924244 - DNA, 17 bp, Homo sapiens
aatggtcctatttttgt

SEQ ID NO: 2924245 - DNA, 17 bp, Homo sapiens
aatggtggcttcagctc

SEQ ID NO: 2924246 - DNA, 23 bp, Homo sapiens
aatggtggcttcagctccagccc

SEQ ID NO: 2924247 - DNA, 18 bp, Homo sapiens
aatggtgtggtgaatgtg

SEQ ID NO: 2924248 - DNA, 23 bp, Homo sapiens
aatggtgtgtttccctagactct

SEQ ID NO: 2924249 - DNA, 19 bp, Homo sapiens
aatggtgtttttcttgtaa

SEQ ID NO: 2924250 - DNA, 14 bp, Homo sapiens
aatggttataaaag

SEQ ID NO: 2924251 - DNA, 15 bp, Homo sapiens
aatggttataaaagt

SEQ ID NO: 2924252 - DNA, 17 bp, Homo sapiens
aatggtttcctctggat

SEQ ID NO: 2924253 - DNA, 21 bp, Homo sapiens
aatggtttttaaattttgtaa

SEQ ID NO: 2924254 - DNA, 15 bp, Homo sapiens
aatgtaaaaaacaaa

SEQ ID NO: 2924255 - DNA, 19 bp, Homo sapiens
aatgtaaaaaagaaaaaca

SEQ ID NO: 2924256 - DNA, 21 bp, Homo sapiens
aatgtaaaacacatacaaaag

SEQ ID NO: 2924257 - DNA, 21 bp, Homo sapiens
aatgtaaaattgaaaatatgt

SEQ ID NO: 2924258 - DNA, 19 bp, Homo sapiens
aatgtaaagcttgtctgat

SEQ ID NO: 2924259 - DNA, 20 bp, Homo sapiens
aatgtaaaggagtcaaaact

SEQ ID NO: 2924260 - DNA, 16 bp, Homo sapiens
aatgtaagcatacttt

SEQ ID NO: 2924261 - DNA, 13 bp, Homo sapiens
aatgtaatgcgat

SEQ ID NO: 2924262 - DNA, 18 bp, Homo sapiens
aatgtaatttcagttcta

SEQ ID NO: 2924263 - DNA, 15 bp, Homo sapiens
aatgtacagacatat

SEQ ID NO: 2924264 - DNA, 17 bp, Homo sapiens
aatgtacagacatattt

SEQ ID NO: 2924265 - DNA, 17 bp, Homo sapiens
aatgtacagttgaaata

SEQ ID NO: 2924266 - DNA, 21 bp, Homo sapiens
aatgtactggtaattgtacaa

SEQ ID NO: 2924267 - DNA, 21 bp, Homo sapiens
aatgtataaactttagagtag

SEQ ID NO: 2924268 - DNA, 19 bp, Homo sapiens
aatgtatccagaggaattg

SEQ ID NO: 2924269 - DNA, 21 bp, Homo sapiens
aatgtatgctatcctcttatt

SEQ ID NO: 2924270 - DNA, 17 bp, Homo sapiens
aatgtatgcttcataca

SEQ ID NO: 2924271 - DNA, 21 bp, Homo sapiens
aatgtatgcttcatacaggga

SEQ ID NO: 2924272 - DNA, 20 bp, Homo sapiens
aatgtatggctcatttgctt

SEQ ID NO: 2924273 - DNA, 14 bp, Homo sapiens
aatgtattgtacct

SEQ ID NO: 2924274 - DNA, 22 bp, Homo sapiens
aatgtattgtaccttttaacac

SEQ ID NO: 2924275 - DNA, 13 bp, Homo sapiens
aatgtattttgaa

SEQ ID NO: 2924276 - DNA, 19 bp, Homo sapiens
aatgtattttgaaaacact

SEQ ID NO: 2924277 - DNA, 20 bp, Homo sapiens
aatgtattttgaaaacactt

SEQ ID NO: 2924278 - DNA, 15 bp, Homo sapiens
aatgtcaccaccttc

SEQ ID NO: 2924279 - DNA, 19 bp, Homo sapiens
aatgtcaccaccttcccag

SEQ ID NO: 2924280 - DNA, 20 bp, Homo sapiens
aatgtcaccaccttcccagc

SEQ ID NO: 2924281 - DNA, 19 bp, Homo sapiens
aatgtcagaattaaaataa

SEQ ID NO: 2924282 - DNA, 21 bp, Homo sapiens
aatgtcagatacaatgtattt

SEQ ID NO: 2924283 - DNA, 15 bp, Homo sapiens
aatgtcattatttga

SEQ ID NO: 2924284 - DNA, 20 bp, Homo sapiens
aatgtcattatttgataaca

SEQ ID NO: 2924285 - DNA, 19 bp, Homo sapiens
aatgtccaaaatttatatt

SEQ ID NO: 2924286 - DNA, 20 bp, Homo sapiens
aatgtccaaaatttatattt

SEQ ID NO: 2924287 - DNA, 16 bp, Homo sapiens
aatgtcgctgtaaatt

SEQ ID NO: 2924288 - DNA, 15 bp, Homo sapiens
aatgtctgcagccct

SEQ ID NO: 2924289 - DNA, 12 bp, Homo sapiens
aatgtctgtgaa

SEQ ID NO: 2924290 - DNA, 18 bp, Homo sapiens
aatgtcttcaaggcttca

SEQ ID NO: 2924291 - DNA, 19 bp, Homo sapiens
aatgtcttcaaggcttcag

SEQ ID NO: 2924292 - DNA, 17 bp, Homo sapiens
aatgtcttgctgttgac

SEQ ID NO: 2924293 - DNA, 13 bp, Homo sapiens
aatgtcttgtgtt

SEQ ID NO: 2924294 - DNA, 13 bp, Homo sapiens
aatgtcttttgaa

SEQ ID NO: 2924295 - DNA, 15 bp, Homo sapiens
aatgtcttttgaata

SEQ ID NO: 2924296 - DNA, 17 bp, Homo sapiens
aatgtcttttgaatatt

SEQ ID NO: 2924297 - DNA, 22 bp, Homo sapiens
aatgtcttttttttaatgtgct

SEQ ID NO: 2924298 - DNA, 11 bp, Homo sapiens
aatgtgaaatt

SEQ ID NO: 2924299 - DNA, 13 bp, Homo sapiens
aatgtgaaatttt

SEQ ID NO: 2924300 - DNA, 17 bp, Homo sapiens
aatgtgaaatttttcca

SEQ ID NO: 2924301 - DNA, 22 bp, Homo sapiens
aatgtgatcgcttggttatcca

SEQ ID NO: 2924302 - DNA, 16 bp, Homo sapiens
aatgtgatgaatactg

SEQ ID NO: 2924303 - DNA, 15 bp, Homo sapiens
aatgtgatgttctaa

SEQ ID NO: 2924304 - DNA, 16 bp, Homo sapiens
aatgtgatgttctaag

SEQ ID NO: 2924305 - DNA, 11 bp, Homo sapiens
aatgtgcctgg

SEQ ID NO: 2924306 - DNA, 14 bp, Homo sapiens
aatgtgctgtgtaa

SEQ ID NO: 2924307 - DNA, 22 bp, Homo sapiens
aatgtggcaaggaaaaacaggt

SEQ ID NO: 2924308 - DNA, 21 bp, Homo sapiens
aatgtggcttgagaaatatgg

SEQ ID NO: 2924309 - DNA, 16 bp, Homo sapiens
aatgtggtagcctcac

SEQ ID NO: 2924310 - DNA, 23 bp, Homo sapiens
aatgtgtaaagatctacatgaat

SEQ ID NO: 2924311 - DNA, 15 bp, Homo sapiens
aatgtgtcaaataca

SEQ ID NO: 2924312 - DNA, 10 bp, Homo sapiens
aatgtgtctg

SEQ ID NO: 2924313 - DNA, 19 bp, Homo sapiens
aatgtgtctgcaacatgga

SEQ ID NO: 2924314 - DNA, 20 bp, Homo sapiens
aatgtgtctgcaacatggat

SEQ ID NO: 2924315 - DNA, 21 bp, Homo sapiens
aatgtgtctgcaacatggatt

SEQ ID NO: 2924316 - DNA, 12 bp, Homo sapiens
aatgtgtgagaa

SEQ ID NO: 2924317 - DNA, 15 bp, Homo sapiens
aatgtgtgagaaaaa

SEQ ID NO: 2924318 - DNA, 15 bp, Homo sapiens
aatgtgtttctggta

SEQ ID NO: 2924319 - DNA, 17 bp, Homo sapiens
aatgtgttttgtacatg

SEQ ID NO: 2924320 - DNA, 14 bp, Homo sapiens
aatgttaaagtcag

SEQ ID NO: 2924321 - DNA, 13 bp, Homo sapiens
aatgttagaattg

SEQ ID NO: 2924322 - DNA, 13 bp, Homo sapiens
aatgttagagcac

SEQ ID NO: 2924323 - DNA, 16 bp, Homo sapiens
aatgttagagcacagt

SEQ ID NO: 2924324 - DNA, 21 bp, Homo sapiens
aatgttatcttatactgtaca

SEQ ID NO: 2924325 - DNA, 20 bp, Homo sapiens
aatgttattgcctaatcact

SEQ ID NO: 2924326 - DNA, 13 bp, Homo sapiens
aatgttctaagtt

SEQ ID NO: 2924327 - DNA, 14 bp, Homo sapiens
aatgttctaagttt

SEQ ID NO: 2924328 - DNA, 16 bp, Homo sapiens
aatgttctaagtttct

SEQ ID NO: 2924329 - DNA, 20 bp, Homo sapiens
aatgttctaagtttctaaga

SEQ ID NO: 2924330 - DNA, 21 bp, Homo sapiens
aatgttctaagtttctaagat

SEQ ID NO: 2924331 - DNA, 18 bp, Homo sapiens
aatgttctgacagttgtg

SEQ ID NO: 2924332 - DNA, 12 bp, Homo sapiens
aatgttctgtga

SEQ ID NO: 2924333 - DNA, 21 bp, Homo sapiens
aatgttctgtgatacagaact

SEQ ID NO: 2924334 - DNA, 16 bp, Homo sapiens
aatgttctttatatac

SEQ ID NO: 2924335 - DNA, 23 bp, Homo sapiens
aatgttctttatatacaataatg

SEQ ID NO: 2924336 - DNA, 13 bp, Homo sapiens
aatgttgcactga

SEQ ID NO: 2924337 - DNA, 13 bp, Homo sapiens
aatgttgggactg

SEQ ID NO: 2924338 - DNA, 15 bp, Homo sapiens
aatgttggtgcaatt

SEQ ID NO: 2924339 - DNA, 16 bp, Homo sapiens
aatgttggtgcaatta

SEQ ID NO: 2924340 - DNA, 13 bp, Homo sapiens
aatttttagaaag

SEQ ID NO: 2924341 - DNA, 21 bp, Homo sapiens
aatttttatttctttttaatt

SEQ ID NO: 2924342 - DNA, 18 bp, Homo sapiens
aatttttattttcaccct

SEQ ID NO: 2924343 - DNA, 20 bp, Homo sapiens
aatttttctctaactcagaa

SEQ ID NO: 2924344 - DNA, 12 bp, Homo sapiens
aatttttgcaaa

SEQ ID NO: 2924345 - DNA, 15 bp, Homo sapiens
aatttttgcaataat

SEQ ID NO: 2924346 - DNA, 21 bp, Homo sapiens
aatttttgcaataatgcagta

SEQ ID NO: 2924347 - DNA, 20 bp, Homo sapiens
aatttttgccttcattacct

SEQ ID NO: 2924348 - DNA, 12 bp, Homo sapiens
aatttttgtatt

SEQ ID NO: 2924349 - DNA, 17 bp, Homo sapiens
aatttttgtattatttt

SEQ ID NO: 2924350 - DNA, 16 bp, Homo sapiens
aattttttaaaccact

SEQ ID NO: 2924351 - DNA, 23 bp, Homo sapiens
aattttttaattatttaaatgta

SEQ ID NO: 2924352 - DNA, 12 bp, Homo sapiens
aattttttgaaa

SEQ ID NO: 2924353 - DNA, 13 bp, Homo sapiens
aattttttgaaac

SEQ ID NO: 2924354 - DNA, 22 bp, Homo sapiens
aattttttgaaacacaatacct

SEQ ID NO: 2924355 - DNA, 16 bp, Homo sapiens
aatttttttaattttg

SEQ ID NO: 2924356 - DNA, 14 bp, Homo sapiens
aattttttttcatg

SEQ ID NO: 2924357 - DNA, 15 bp, Homo sapiens
aattttttttcatgt

SEQ ID NO: 2924358 - DNA, 22 bp, Homo sapiens
aattttttttggttgtttgctg

SEQ ID NO: 2924359 - DNA, 20 bp, Homo sapiens
aattttttttgttgtttcag

SEQ ID NO: 2924360 - DNA, 21 bp, Homo sapiens
aattttttttgttgtttcagt

SEQ ID NO: 2924361 - DNA, 19 bp, Homo sapiens
acaaaaaaaacaacaaaaa

SEQ ID NO: 2924362 - DNA, 23 bp, Homo sapiens
acaaaaaaagtttgttactttga

SEQ ID NO: 2924363 - DNA, 15 bp, Homo sapiens
acaaaaaactcccct

SEQ ID NO: 2924364 - DNA, 13 bp, Homo sapiens
acaaaaacaagac

SEQ ID NO: 2924365 - DNA, 15 bp, Homo sapiens
acaaaaacagcctca

SEQ ID NO: 2924366 - DNA, 11 bp, Homo sapiens
acaaaaatggg

SEQ ID NO: 2924367 - DNA, 14 bp, Homo sapiens
acaaaaattaaaat

SEQ ID NO: 2924368 - DNA, 18 bp, Homo sapiens
acaaaacatattttacat

SEQ ID NO: 2924369 - DNA, 12 bp, Homo sapiens
acaaaagaaaaa

SEQ ID NO: 2924370 - DNA, 15 bp, Homo sapiens
acaaaagcagccctc

SEQ ID NO: 2924371 - DNA, 19 bp, Homo sapiens
acaaaaggaagactggaga

SEQ ID NO: 2924372 - DNA, 14 bp, Homo sapiens
acaaaagggccagg

SEQ ID NO: 2924373 - DNA, 21 bp, Homo sapiens
acaaaagggtttaaactgatt

SEQ ID NO: 2924374 - DNA, 13 bp, Homo sapiens
acaaaaggtttga

SEQ ID NO: 2924375 - DNA, 19 bp, Homo sapiens
acaaaatactatgtgggac

SEQ ID NO: 2924376 - DNA, 18 bp, Homo sapiens
acaaaatcacattctgca

SEQ ID NO: 2924377 - DNA, 15 bp, Homo sapiens
acaaaatgccttttt

SEQ ID NO: 2924378 - DNA, 13 bp, Homo sapiens
acaaaatttgact

SEQ ID NO: 2924379 - DNA, 11 bp, Homo sapiens
acaaacaaaac

SEQ ID NO: 2924380 - DNA, 11 bp, Homo sapiens
acaaacaaatc

SEQ ID NO: 2924381 - DNA, 18 bp, Homo sapiens
acaaacaaatcaaacaca

SEQ ID NO: 2924382 - DNA, 17 bp, Homo sapiens
acaaacacacacaaaag

SEQ ID NO: 2924383 - DNA, 15 bp, Homo sapiens
acaaacacattgtta

SEQ ID NO: 2924384 - DNA, 19 bp, Homo sapiens
acaaacacattgttatttt

SEQ ID NO: 2924385 - DNA, 17 bp, Homo sapiens
acaaacagtgaatttaa

SEQ ID NO: 2924386 - DNA, 22 bp, Homo sapiens
acaaactctctgaacccctccc

SEQ ID NO: 2924387 - DNA, 14 bp, Homo sapiens
acaaactcttcagt

SEQ ID NO: 2924388 - DNA, 16 bp, Homo sapiens
acaaacttgatttctt

SEQ ID NO: 2924389 - DNA, 19 bp, Homo sapiens
acaaagaaccatgcaggaa

SEQ ID NO: 2924390 - DNA, 15 bp, Homo sapiens
acaaagaagacatgt

SEQ ID NO: 2924391 - DNA, 21 bp, Homo sapiens
acaaagaagacatgttttaga

SEQ ID NO: 2924392 - DNA, 22 bp, Homo sapiens
acaaagacaaattctgtttctt

SEQ ID NO: 2924393 - DNA, 20 bp, Homo sapiens
acaaagatatcttttcttta

SEQ ID NO: 2924394 - DNA, 22 bp, Homo sapiens
acaaagatgggtgaaggctggc

SEQ ID NO: 2924395 - DNA, 17 bp, Homo sapiens
acaaagcacagtttgaa

SEQ ID NO: 2924396 - DNA, 20 bp, Homo sapiens
acaaagccagaagctgagca

SEQ ID NO: 2924397 - DNA, 21 bp, Homo sapiens
acaaagcttagcaggagagga

SEQ ID NO: 2924398 - DNA, 23 bp, Homo sapiens
acaaaggatttgatgcttttctc

SEQ ID NO: 2924399 - DNA, 15 bp, Homo sapiens
acaaaggggaaagaa

SEQ ID NO: 2924400 - DNA, 20 bp, Homo sapiens
acaaagtaaaagtagtgttg

SEQ ID NO: 2924401 - DNA, 14 bp, Homo sapiens
acaaagtgccaaag

SEQ ID NO: 2924402 - DNA, 18 bp, Homo sapiens
acaaagtgccaaagaaag

SEQ ID NO: 2924403 - DNA, 14 bp, Homo sapiens
acaaagtgctggga

SEQ ID NO: 2924404 - DNA, 15 bp, Homo sapiens
acaaataaataaata

SEQ ID NO: 2924405 - DNA, 16 bp, Homo sapiens
acaaataatttaagtt

SEQ ID NO: 2924406 - DNA, 22 bp, Homo sapiens
acaaataatttaagttggctag

SEQ ID NO: 2924407 - DNA, 15 bp, Homo sapiens
acaaatactcatgtg

SEQ ID NO: 2924408 - DNA, 18 bp, Homo sapiens
acaaatactcatgtgtat

SEQ ID NO: 2924409 - DNA, 21 bp, Homo sapiens
acaaatattggtgttgtcagt

SEQ ID NO: 2924410 - DNA, 14 bp, Homo sapiens
acaaatctatttaa

SEQ ID NO: 2924411 - DNA, 23 bp, Homo sapiens
acaaatctgtataaatgtctatt

SEQ ID NO: 2924412 - DNA, 13 bp, Homo sapiens
acaaatgaaaatg

SEQ ID NO: 2924413 - DNA, 14 bp, Homo sapiens
acaaatgaaaatga

SEQ ID NO: 2924414 - DNA, 17 bp, Homo sapiens
acaaatgctattaaagt

SEQ ID NO: 2924415 - DNA, 20 bp, Homo sapiens
acaaatgctcccacctgaat

SEQ ID NO: 2924416 - DNA, 23 bp, Homo sapiens
acaaatgctcccacctgaatttg

SEQ ID NO: 2924417 - DNA, 14 bp, Homo sapiens
acaaatgtaaacat

SEQ ID NO: 2924418 - DNA, 18 bp, Homo sapiens
acaaatgtaaacattttc

SEQ ID NO: 2924419 - DNA, 13 bp, Homo sapiens
acaaatgtgaaga

SEQ ID NO: 2924420 - DNA, 14 bp, Homo sapiens
acaaatgtgaagat

SEQ ID NO: 2924421 - DNA, 21 bp, Homo sapiens
acaaatgtgaagatgcattgt

SEQ ID NO: 2924422 - DNA, 15 bp, Homo sapiens
acaaattaatatttg

SEQ ID NO: 2924423 - DNA, 16 bp, Homo sapiens
acaaattaatatttgt

SEQ ID NO: 2924424 - DNA, 17 bp, Homo sapiens
acaaattattaatgaaa

SEQ ID NO: 2924425 - DNA, 12 bp, Homo sapiens
acaaattctgtt

SEQ ID NO: 2924426 - DNA, 9 bp, Homo sapiens
acaacaaaa

SEQ ID NO: 2924427 - DNA, 12 bp, Homo sapiens
acaacaaaaaaa

SEQ ID NO: 2924428 - DNA, 11 bp, Homo sapiens
acaacaaacac

SEQ ID NO: 2924429 - DNA, 14 bp, Homo sapiens
acaacaaataattt

SEQ ID NO: 2924430 - DNA, 14 bp, Homo sapiens
acaacaacaataat

SEQ ID NO: 2924431 - DNA, 13 bp, Homo sapiens
acaacacaagaaa

SEQ ID NO: 2924432 - DNA, 15 bp, Homo sapiens
acaacacaagaaaac

SEQ ID NO: 2924433 - DNA, 16 bp, Homo sapiens
acaacagatttgtgaa

SEQ ID NO: 2924434 - DNA, 18 bp, Homo sapiens
acaacagatttgtgaact

SEQ ID NO: 2924435 - DNA, 17 bp, Homo sapiens
acaacagccaacagcta

SEQ ID NO: 2924436 - DNA, 19 bp, Homo sapiens
acaacatggcttctccttt

SEQ ID NO: 2924437 - DNA, 19 bp, Homo sapiens
acaacatgtttaataaata

SEQ ID NO: 2924438 - DNA, 22 bp, Homo sapiens
acaacatttatatattgtctgt

SEQ ID NO: 2924439 - DNA, 21 bp, Homo sapiens
acaaccaccaccttatacatc

SEQ ID NO: 2924440 - DNA, 15 bp, Homo sapiens
acaaccctctggaag

SEQ ID NO: 2924441 - DNA, 22 bp, Homo sapiens
acaaccctgaagcagaggcctt

SEQ ID NO: 2924442 - DNA, 23 bp, Homo sapiens
acaaccttcagctttatttttct

SEQ ID NO: 2924443 - DNA, 16 bp, Homo sapiens
acaacctttcccattt

SEQ ID NO: 2924444 - DNA, 22 bp, Homo sapiens
acaacggaggcctgcgaccctg

SEQ ID NO: 2924445 - DNA, 16 bp, Homo sapiens
acaactcattttcata

SEQ ID NO: 2924446 - DNA, 15 bp, Homo sapiens
acaactccttccatc

SEQ ID NO: 2924447 - DNA, 19 bp, Homo sapiens
acaactggcaggcaggctc

SEQ ID NO: 2924448 - DNA, 17 bp, Homo sapiens
acaactttaagaggaca

SEQ ID NO: 2924449 - DNA, 13 bp, Homo sapiens
acaactttatgta

SEQ ID NO: 2924450 - DNA, 20 bp, Homo sapiens
acaagaaactcaatgcacaa

SEQ ID NO: 2924451 - DNA, 16 bp, Homo sapiens
acaagaaactttggaa

SEQ ID NO: 2924452 - DNA, 22 bp, Homo sapiens
acaagacccaagtagctgctac

SEQ ID NO: 2924453 - DNA, 15 bp, Homo sapiens
acaagacccccagca

SEQ ID NO: 2924454 - DNA, 13 bp, Homo sapiens
acaagaccctctc

SEQ ID NO: 2924455 - DNA, 15 bp, Homo sapiens
acaagaccctctcag

SEQ ID NO: 2924456 - DNA, 14 bp, Homo sapiens
acaagactgcctcc

SEQ ID NO: 2924457 - DNA, 15 bp, Homo sapiens
acaagagcactacat

SEQ ID NO: 2924458 - DNA, 16 bp, Homo sapiens
acaagagcgaaactcc

SEQ ID NO: 2924459 - DNA, 20 bp, Homo sapiens
acaagagggttcacacagcc

SEQ ID NO: 2924460 - DNA, 14 bp, Homo sapiens
acaagattcccaga

SEQ ID NO: 2924461 - DNA, 18 bp, Homo sapiens
acaagattcccagagaca

SEQ ID NO: 2924462 - DNA, 16 bp, Homo sapiens
acaagcaagttctgag

SEQ ID NO: 2924463 - DNA, 12 bp, Homo sapiens
acaagccaagaa

SEQ ID NO: 2924464 - DNA, 17 bp, Homo sapiens
acaagcccccccttcca

SEQ ID NO: 2924465 - DNA, 20 bp, Homo sapiens
acaagcctggtaggaaaggg

SEQ ID NO: 2924466 - DNA, 21 bp, Homo sapiens
acaagctacagttgtccagat

SEQ ID NO: 2924467 - DNA, 22 bp, Homo sapiens
acaagctcttgtttctgtttag

SEQ ID NO: 2924468 - DNA, 17 bp, Homo sapiens
acaagctgtatcactgc

SEQ ID NO: 2924469 - DNA, 17 bp, Homo sapiens
acaagcttcaaagccat

SEQ ID NO: 2924470 - DNA, 19 bp, Homo sapiens
acaagcttcaaagccatat

SEQ ID NO: 2924471 - DNA, 23 bp, Homo sapiens
acaaggaataaatgagagggaat

SEQ ID NO: 2924472 - DNA, 22 bp, Homo sapiens
acaaggacacgcgcccccctcc

SEQ ID NO: 2924473 - DNA, 19 bp, Homo sapiens
acaggagacccaacaatga

SEQ ID NO: 2924474 - DNA, 20 bp, Homo sapiens
acaggagcaatcacaggaaa

SEQ ID NO: 2924475 - DNA, 22 bp, Homo sapiens
acaggagcctctgcagtcgctt

SEQ ID NO: 2924476 - DNA, 13 bp, Homo sapiens
acaggagctggga

SEQ ID NO: 2924477 - DNA, 17 bp, Homo sapiens
acaggaggacaattcat

SEQ ID NO: 2924478 - DNA, 22 bp, Homo sapiens
acaggaggacaattcatgaact

SEQ ID NO: 2924479 - DNA, 16 bp, Homo sapiens
acaggaggattgcctg

SEQ ID NO: 2924480 - DNA, 17 bp, Homo sapiens
acaggaggattgcctga

SEQ ID NO: 2924481 - DNA, 17 bp, Homo sapiens
acaggaggtgtgataga

SEQ ID NO: 2924482 - DNA, 17 bp, Homo sapiens
acaggagtgtcctcttc

SEQ ID NO: 2924483 - DNA, 15 bp, Homo sapiens
acaggatcatcattt

SEQ ID NO: 2924484 - DNA, 20 bp, Homo sapiens
acaggatcatcatttaaaaa

SEQ ID NO: 2924485 - DNA, 22 bp, Homo sapiens
acaggatcatcatttaaaaaaa

SEQ ID NO: 2924486 - DNA, 14 bp, Homo sapiens
acaggatgaggaca

SEQ ID NO: 2924487 - DNA, 17 bp, Homo sapiens
acaggatgaggacagag

SEQ ID NO: 2924488 - DNA, 20 bp, Homo sapiens
acaggatgtgtttgctttct

SEQ ID NO: 2924489 - DNA, 21 bp, Homo sapiens
acaggatgtgtttgctttctg

SEQ ID NO: 2924490 - DNA, 17 bp, Homo sapiens
acaggcacattaactgt

SEQ ID NO: 2924491 - DNA, 20 bp, Homo sapiens
acaggcacattaactgttgc

SEQ ID NO: 2924492 - DNA, 13 bp, Homo sapiens
acaggcagagctg

SEQ ID NO: 2924493 - DNA, 16 bp, Homo sapiens
acaggcagcctggaca

SEQ ID NO: 2924494 - DNA, 17 bp, Homo sapiens
acaggcccctgggtttc

SEQ ID NO: 2924495 - DNA, 15 bp, Homo sapiens
acaggcggggcccag

SEQ ID NO: 2924496 - DNA, 15 bp, Homo sapiens
acaggcgtgagccac

SEQ ID NO: 2924497 - DNA, 20 bp, Homo sapiens
acaggctggaatgagggagg

SEQ ID NO: 2924498 - DNA, 14 bp, Homo sapiens
acagggaagctaca

SEQ ID NO: 2924499 - DNA, 19 bp, Homo sapiens
acagggaagctacaggtta

SEQ ID NO: 2924500 - DNA, 13 bp, Homo sapiens
acagggacatgcc

SEQ ID NO: 2924501 - DNA, 22 bp, Homo sapiens
acagggactgaaaacctctcct

SEQ ID NO: 2924502 - DNA, 16 bp, Homo sapiens
acagggagctgggaca

SEQ ID NO: 2924503 - DNA, 10 bp, Homo sapiens
acagggaggg

SEQ ID NO: 2924504 - DNA, 17 bp, Homo sapiens
acagggcacctgccacc

SEQ ID NO: 2924505 - DNA, 15 bp, Homo sapiens
acagggcccaggcct

SEQ ID NO: 2924506 - DNA, 18 bp, Homo sapiens
acagggcccaggcctgga

SEQ ID NO: 2924507 - DNA, 20 bp, Homo sapiens
acagggcccaggcctggagc

SEQ ID NO: 2924508 - DNA, 22 bp, Homo sapiens
acagggctaagagctagcgctg

SEQ ID NO: 2924509 - DNA, 16 bp, Homo sapiens
acaggggggtcggaag

SEQ ID NO: 2924510 - DNA, 19 bp, Homo sapiens
acaggggggtcggaagcct

SEQ ID NO: 2924511 - DNA, 21 bp, Homo sapiens
acaggggggtcggaagcctgt

SEQ ID NO: 2924512 - DNA, 22 bp, Homo sapiens
acaggggggtcggaagcctgtc

SEQ ID NO: 2924513 - DNA, 23 bp, Homo sapiens
acaggggggtcggaagcctgtcc

SEQ ID NO: 2924514 - DNA, 18 bp, Homo sapiens
acagggtaccaggataaa

SEQ ID NO: 2924515 - DNA, 23 bp, Homo sapiens
acagggtaccaggataaagccga

SEQ ID NO: 2924516 - DNA, 17 bp, Homo sapiens
acagggtagcaggtacc

SEQ ID NO: 2924517 - DNA, 15 bp, Homo sapiens
acagggtttcaccat

SEQ ID NO: 2924518 - DNA, 15 bp, Homo sapiens
acaggtaatataaaa

SEQ ID NO: 2924519 - DNA, 12 bp, Homo sapiens
acaggtcaataa

SEQ ID NO: 2924520 - DNA, 21 bp, Homo sapiens
acaggtcaggggtgacacaga

SEQ ID NO: 2924521 - DNA, 22 bp, Homo sapiens
acaggtcagtttatgaaacaga

SEQ ID NO: 2924522 - DNA, 13 bp, Homo sapiens
acaggtctctgag

SEQ ID NO: 2924523 - DNA, 17 bp, Homo sapiens
acaggtctctgagacag

SEQ ID NO: 2924524 - DNA, 13 bp, Homo sapiens
acaggtctctgtt

SEQ ID NO: 2924525 - DNA, 14 bp, Homo sapiens
acaggtgctggccc

SEQ ID NO: 2924526 - DNA, 17 bp, Homo sapiens
acaggtgctggcccagc

SEQ ID NO: 2924527 - DNA, 22 bp, Homo sapiens
acaggtgggaggaaagggcctg

SEQ ID NO: 2924528 - DNA, 20 bp, Homo sapiens
acaggtggtgtcactgtccc

SEQ ID NO: 2924529 - DNA, 17 bp, Homo sapiens
acaggtgttggtgacaa

SEQ ID NO: 2924530 - DNA, 13 bp, Homo sapiens
acaggttacaaca

SEQ ID NO: 2924531 - DNA, 18 bp, Homo sapiens
acaggttacaacagattt

SEQ ID NO: 2924532 - DNA, 23 bp, Homo sapiens
acaggttacaacagatttgtgaa

SEQ ID NO: 2924533 - DNA, 20 bp, Homo sapiens
acaggttactaccctcaccc

SEQ ID NO: 2924534 - DNA, 16 bp, Homo sapiens
acaggttttcacataa

SEQ ID NO: 2924535 - DNA, 10 bp, Homo sapiens
acagtaactt

SEQ ID NO: 2924536 - DNA, 17 bp, Homo sapiens
acagtaagtcatttaac

SEQ ID NO: 2924537 - DNA, 14 bp, Homo sapiens
acagtacaggcagc

SEQ ID NO: 2924538 - DNA, 13 bp, Homo sapiens
acagtaggagccc

SEQ ID NO: 2924539 - DNA, 22 bp, Homo sapiens
acagtaggagcccagctctgaa

SEQ ID NO: 2924540 - DNA, 23 bp, Homo sapiens
acagtagttagaattatatcact

SEQ ID NO: 2924541 - DNA, 21 bp, Homo sapiens
acagtatcgaggcttgtgatg

SEQ ID NO: 2924542 - DNA, 18 bp, Homo sapiens
acagtatgcttgctctaa

SEQ ID NO: 2924543 - DNA, 11 bp, Homo sapiens
acagtattttt

SEQ ID NO: 2924544 - DNA, 16 bp, Homo sapiens
acagtatttttcagat

SEQ ID NO: 2924545 - DNA, 15 bp, Homo sapiens
acagtcagcacagaa

SEQ ID NO: 2924546 - DNA, 18 bp, Homo sapiens
acagtcagctcttcatct

SEQ ID NO: 2924547 - DNA, 21 bp, Homo sapiens
acagtcattatttaaagcaca

SEQ ID NO: 2924548 - DNA, 21 bp, Homo sapiens
acagtccgtcaaaacagattg

SEQ ID NO: 2924549 - DNA, 17 bp, Homo sapiens
acagtcgctcagtctgt

SEQ ID NO: 2924550 - DNA, 20 bp, Homo sapiens
acagtcgctcagtctgttca

SEQ ID NO: 2924551 - DNA, 23 bp, Homo sapiens
acagtcggaaaagcgtctttaag

SEQ ID NO: 2924552 - DNA, 22 bp, Homo sapiens
acagtctaagtaagtgtctgtg

SEQ ID NO: 2924553 - DNA, 13 bp, Homo sapiens
acagtctcaattt

SEQ ID NO: 2924554 - DNA, 21 bp, Homo sapiens
acagtctcaattttgtattta

SEQ ID NO: 2924555 - DNA, 13 bp, Homo sapiens
acagtctgtcttc

SEQ ID NO: 2924556 - DNA, 16 bp, Homo sapiens
acagtctgtcttctgt

SEQ ID NO: 2924557 - DNA, 17 bp, Homo sapiens
acagtctgtcttctgta

SEQ ID NO: 2924558 - DNA, 23 bp, Homo sapiens
acagtctgtcttctgtatataaa

SEQ ID NO: 2924559 - DNA, 13 bp, Homo sapiens
acagtgaagagta

SEQ ID NO: 2924560 - DNA, 17 bp, Homo sapiens
acagtgaaggctgtcct

SEQ ID NO: 2924561 - DNA, 16 bp, Homo sapiens
acagtgaatttaagca

SEQ ID NO: 2924562 - DNA, 17 bp, Homo sapiens
acagtgaatttaagcat

SEQ ID NO: 2924563 - DNA, 22 bp, Homo sapiens
acagtgacactggaccaggtcc

SEQ ID NO: 2924564 - DNA, 20 bp, Homo sapiens
acagtgacgtgactcagagc

SEQ ID NO: 2924565 - DNA, 22 bp, Homo sapiens
acagtgacgtgactcagagctt

SEQ ID NO: 2924566 - DNA, 18 bp, Homo sapiens
acagtgagggagatccca

SEQ ID NO: 2924567 - DNA, 18 bp, Homo sapiens
acagtgatgatgcatgga

SEQ ID NO: 2924568 - DNA, 13 bp, Homo sapiens
acagtgcacatga

SEQ ID NO: 2924569 - DNA, 13 bp, Homo sapiens
acagtgcctgctg

SEQ ID NO: 2924570 - DNA, 13 bp, Homo sapiens
acagtgctctgcc

SEQ ID NO: 2924571 - DNA, 23 bp, Homo sapiens
acagtggagagggctacaaagga

SEQ ID NO: 2924572 - DNA, 15 bp, Homo sapiens
acagtgggaaatatt

SEQ ID NO: 2924573 - DNA, 17 bp, Homo sapiens
acagtgggaactggagg

SEQ ID NO: 2924574 - DNA, 17 bp, Homo sapiens
acagtggtggcaacatt

SEQ ID NO: 2924575 - DNA, 13 bp, Homo sapiens
acagtggtggcag

SEQ ID NO: 2924576 - DNA, 17 bp, Homo sapiens
acagtggtggcagggcc

SEQ ID NO: 2924577 - DNA, 17 bp, Homo sapiens
acagtgtacatgtacat

SEQ ID NO: 2924578 - DNA, 13 bp, Homo sapiens
acagtgtatgtag

SEQ ID NO: 2924579 - DNA, 12 bp, Homo sapiens
acagtgtgaagt

SEQ ID NO: 2924580 - DNA, 18 bp, Homo sapiens
acagtgtgaagttagaat

SEQ ID NO: 2924581 - DNA, 22 bp, Homo sapiens
acagtgtgaagttagaattcct

SEQ ID NO: 2924582 - DNA, 11 bp, Homo sapiens
acagtgttccg

SEQ ID NO: 2924583 - DNA, 12 bp, Homo sapiens
acagtgtttgat

SEQ ID NO: 2924584 - DNA, 13 bp, Homo sapiens
acagtgtttgccc

SEQ ID NO: 2924585 - DNA, 13 bp, Homo sapiens
acagtgtttttta

SEQ ID NO: 2924586 - DNA, 23 bp, Homo sapiens
acagtgttttttaggaaaagcat

SEQ ID NO: 2924587 - DNA, 19 bp, Homo sapiens
acagttacataattcactc

SEQ ID NO: 2924588 - DNA, 16 bp, Homo sapiens
acagttacttaagatt

SEQ ID NO: 2924589 - DNA, 23 bp, Homo sapiens
acagttagcaaactttgtatgtc

SEQ ID NO: 2924590 - DNA, 18 bp, Homo sapiens
acagttagcatttaccaa

SEQ ID NO: 2924591 - DNA, 18 bp, Homo sapiens
acagttagggttttgcaa

SEQ ID NO: 2924592 - DNA, 19 bp, Homo sapiens
acagttagggttttgcaat

SEQ ID NO: 2924593 - DNA, 17 bp, Homo sapiens
acagttatctaagttaa

SEQ ID NO: 2924594 - DNA, 14 bp, Homo sapiens
acagttcctcgccc

SEQ ID NO: 2924595 - DNA, 13 bp, Homo sapiens
acagttctaggtg

SEQ ID NO: 2924596 - DNA, 13 bp, Homo sapiens
acagttctgaaga

SEQ ID NO: 2924597 - DNA, 20 bp, Homo sapiens
acagttcttaatacaggaga

SEQ ID NO: 2924598 - DNA, 21 bp, Homo sapiens
acagttctttgggccagacat

SEQ ID NO: 2924599 - DNA, 15 bp, Homo sapiens
acagttcttttctac

SEQ ID NO: 2924600 - DNA, 18 bp, Homo sapiens
acagttgcagcccttgtg

SEQ ID NO: 2924601 - DNA, 22 bp, Homo sapiens
acagttgcaggagcgtgaagga

SEQ ID NO: 2924602 - DNA, 16 bp, Homo sapiens
acagttggccttcaga

SEQ ID NO: 2924603 - DNA, 18 bp, Homo sapiens
acagtttaacagagtttt

SEQ ID NO: 2924604 - DNA, 15 bp, Homo sapiens
acagtttgaacaaaa

SEQ ID NO: 2924605 - DNA, 13 bp, Homo sapiens
accagctcaggac

SEQ ID NO: 2924606 - DNA, 20 bp, Homo sapiens
accagctcaggggacactgg

SEQ ID NO: 2924607 - DNA, 20 bp, Homo sapiens
accagctgcaaagtgttttg

SEQ ID NO: 2924608 - DNA, 22 bp, Homo sapiens
accagctgcaaagtgttttgta

SEQ ID NO: 2924609 - DNA, 23 bp, Homo sapiens
accaggagaagggctggggccgg

SEQ ID NO: 2924610 - DNA, 14 bp, Homo sapiens
accaggatagagac

SEQ ID NO: 2924611 - DNA, 17 bp, Homo sapiens
accaggatagagactgg

SEQ ID NO: 2924612 - DNA, 19 bp, Homo sapiens
accaggatagagactggaa

SEQ ID NO: 2924613 - DNA, 13 bp, Homo sapiens
accaggatttata

SEQ ID NO: 2924614 - DNA, 15 bp, Homo sapiens
accaggcaaattcac

SEQ ID NO: 2924615 - DNA, 21 bp, Homo sapiens
accaggcacgaacccacctgc

SEQ ID NO: 2924616 - DNA, 12 bp, Homo sapiens
accagggaagtg

SEQ ID NO: 2924617 - DNA, 22 bp, Homo sapiens
accagggactcggcccagggcc

SEQ ID NO: 2924618 - DNA, 13 bp, Homo sapiens
accagggcctttt

SEQ ID NO: 2924619 - DNA, 18 bp, Homo sapiens
accaggtcctgctccgct

SEQ ID NO: 2924620 - DNA, 22 bp, Homo sapiens
accaggtcctgctccgctgcct

SEQ ID NO: 2924621 - DNA, 13 bp, Homo sapiens
accaggtctgtgg

SEQ ID NO: 2924622 - DNA, 17 bp, Homo sapiens
accaggtcttgacctga

SEQ ID NO: 2924623 - DNA, 17 bp, Homo sapiens
accaggtgcctttcaaa

SEQ ID NO: 2924624 - DNA, 17 bp, Homo sapiens
accagtccccccaccct

SEQ ID NO: 2924625 - DNA, 12 bp, Homo sapiens
accagtccctgt

SEQ ID NO: 2924626 - DNA, 14 bp, Homo sapiens
accagtctcctccc

SEQ ID NO: 2924627 - DNA, 17 bp, Homo sapiens
accagtgaatttttgca

SEQ ID NO: 2924628 - DNA, 22 bp, Homo sapiens
accagtgaatttttgcaataat

SEQ ID NO: 2924629 - DNA, 22 bp, Homo sapiens
accagtgagtggccccacctgt

SEQ ID NO: 2924630 - DNA, 13 bp, Homo sapiens
accagtgcaggct

SEQ ID NO: 2924631 - DNA, 19 bp, Homo sapiens
accagtgcaggctggccag

SEQ ID NO: 2924632 - DNA, 22 bp, Homo sapiens
accagtgcaggctggccagccg

SEQ ID NO: 2924633 - DNA, 12 bp, Homo sapiens
accagtggtctc

SEQ ID NO: 2924634 - DNA, 17 bp, Homo sapiens
accagtggtctcacatg

SEQ ID NO: 2924635 - DNA, 17 bp, Homo sapiens
accagtgtaaattcagt

SEQ ID NO: 2924636 - DNA, 15 bp, Homo sapiens
accagtttacaggaa

SEQ ID NO: 2924637 - DNA, 12 bp, Homo sapiens
accagtttctta

SEQ ID NO: 2924638 - DNA, 14 bp, Homo sapiens
accagttttgctgc

SEQ ID NO: 2924639 - DNA, 13 bp, Homo sapiens
accataaaaagag

SEQ ID NO: 2924640 - DNA, 22 bp, Homo sapiens
accataaggtttcgtttctgta

SEQ ID NO: 2924641 - DNA, 15 bp, Homo sapiens
accataatgttcctt

SEQ ID NO: 2924642 - DNA, 16 bp, Homo sapiens
accatatgcccacatt

SEQ ID NO: 2924643 - DNA, 12 bp, Homo sapiens
accatcatccta

SEQ ID NO: 2924644 - DNA, 17 bp, Homo sapiens
accatccgccagggccc

SEQ ID NO: 2924645 - DNA, 17 bp, Homo sapiens
accatcgctggcccctt

SEQ ID NO: 2924646 - DNA, 12 bp, Homo sapiens
accatctgtgac

SEQ ID NO: 2924647 - DNA, 23 bp, Homo sapiens
accatgaacagaaaacattctga

SEQ ID NO: 2924648 - DNA, 15 bp, Homo sapiens
accatgcaggaagga

SEQ ID NO: 2924649 - DNA, 17 bp, Homo sapiens
accatgcaggaaggaaa

SEQ ID NO: 2924650 - DNA, 21 bp, Homo sapiens
accatgcaggaaggaaaacta

SEQ ID NO: 2924651 - DNA, 20 bp, Homo sapiens
accatgcccagctaattttt

SEQ ID NO: 2924652 - DNA, 20 bp, Homo sapiens
accatgcccggctaattttt

SEQ ID NO: 2924653 - DNA, 17 bp, Homo sapiens
accatgcctcactaatt

SEQ ID NO: 2924654 - DNA, 16 bp, Homo sapiens
accatggaaagaaata

SEQ ID NO: 2924655 - DNA, 12 bp, Homo sapiens
accatggggagg

SEQ ID NO: 2924656 - DNA, 16 bp, Homo sapiens
accatgtattttgtaa

SEQ ID NO: 2924657 - DNA, 15 bp, Homo sapiens
accatgtgactaaaa

SEQ ID NO: 2924658 - DNA, 15 bp, Homo sapiens
accatgtttaaagaa

SEQ ID NO: 2924659 - DNA, 20 bp, Homo sapiens
accatgtttgagctcagacc

SEQ ID NO: 2924660 - DNA, 23 bp, Homo sapiens
accattgatgagcactcctgatt

SEQ ID NO: 2924661 - DNA, 23 bp, Homo sapiens
accattgctgctccttagctgcc

SEQ ID NO: 2924662 - DNA, 15 bp, Homo sapiens
accattttataaagt

SEQ ID NO: 2924663 - DNA, 17 bp, Homo sapiens
accattttataaagtgc

SEQ ID NO: 2924664 - DNA, 15 bp, Homo sapiens
acccaaaacaagcct

SEQ ID NO: 2924665 - DNA, 21 bp, Homo sapiens
acccaaaacaagcctggtagg

SEQ ID NO: 2924666 - DNA, 21 bp, Homo sapiens
acccaaagcctgtcccaggac

SEQ ID NO: 2924667 - DNA, 11 bp, Homo sapiens
acccaaagctg

SEQ ID NO: 2924668 - DNA, 16 bp, Homo sapiens
acccaaagctgagcct

SEQ ID NO: 2924669 - DNA, 16 bp, Homo sapiens
acccaactgacctgcc

SEQ ID NO: 2924670 - DNA, 18 bp, Homo sapiens
acccaagacctcagggca

SEQ ID NO: 2924671 - DNA, 17 bp, Homo sapiens
acccaagagaggaagga

SEQ ID NO: 2924672 - DNA, 15 bp, Homo sapiens
acccaagcttagaac

SEQ ID NO: 2924673 - DNA, 17 bp, Homo sapiens
acccaaggaaaactgca

SEQ ID NO: 2924674 - DNA, 15 bp, Homo sapiens
acccaaggaggaaaa

SEQ ID NO: 2924675 - DNA, 20 bp, Homo sapiens
acccacaaccctctggaagt

SEQ ID NO: 2924676 - DNA, 14 bp, Homo sapiens
acccacaagctgcc

SEQ ID NO: 2924677 - DNA, 18 bp, Homo sapiens
acccacaagtggcagaca

SEQ ID NO: 2924678 - DNA, 13 bp, Homo sapiens
acccacagcctcc

SEQ ID NO: 2924679 - DNA, 15 bp, Homo sapiens
acccaccccacacct

SEQ ID NO: 2924680 - DNA, 22 bp, Homo sapiens
acccaccctgtggctcacagtg

SEQ ID NO: 2924681 - DNA, 14 bp, Homo sapiens
acccacctcagcct

SEQ ID NO: 2924682 - DNA, 13 bp, Homo sapiens
acccacctgctga

SEQ ID NO: 2924683 - DNA, 17 bp, Homo sapiens
acccacctgctgagaga

SEQ ID NO: 2924684 - DNA, 21 bp, Homo sapiens
acccacgtccacgcggccacc

SEQ ID NO: 2924685 - DNA, 17 bp, Homo sapiens
acccacttctcatcaca

SEQ ID NO: 2924686 - DNA, 17 bp, Homo sapiens
acccagagaggaatcag

SEQ ID NO: 2924687 - DNA, 11 bp, Homo sapiens
acccagcccat

SEQ ID NO: 2924688 - DNA, 14 bp, Homo sapiens
acccagcccattct

SEQ ID NO: 2924689 - DNA, 16 bp, Homo sapiens
acccagctccaggccc

SEQ ID NO: 2924690 - DNA, 17 bp, Homo sapiens
acccagctccaggccca

SEQ ID NO: 2924691 - DNA, 18 bp, Homo sapiens
acccagctccaggcccac

SEQ ID NO: 2924692 - DNA, 20 bp, Homo sapiens
acccagctgtgcccctcccc

SEQ ID NO: 2924693 - DNA, 23 bp, Homo sapiens
acccaggaggcagaggttgcagt

SEQ ID NO: 2924694 - DNA, 19 bp, Homo sapiens
acccaggaggggaacactg

SEQ ID NO: 2924695 - DNA, 21 bp, Homo sapiens
acccaggaggggaacactgcc

SEQ ID NO: 2924696 - DNA, 11 bp, Homo sapiens
acccaggaggt

SEQ ID NO: 2924697 - DNA, 23 bp, Homo sapiens
acccaggaggtggaggttgcagt

SEQ ID NO: 2924698 - DNA, 17 bp, Homo sapiens
acccaggcctatgttga

SEQ ID NO: 2924699 - DNA, 19 bp, Homo sapiens
acccaggctagagtgcagt

SEQ ID NO: 2924700 - DNA, 13 bp, Homo sapiens
acccagggaacag

SEQ ID NO: 2924701 - DNA, 22 bp, Homo sapiens
acccagggaacagccactcccc

SEQ ID NO: 2924702 - DNA, 21 bp, Homo sapiens
acccagggagaggctgtgtcc

SEQ ID NO: 2924703 - DNA, 13 bp, Homo sapiens
acccagggcctgc

SEQ ID NO: 2924704 - DNA, 21 bp, Homo sapiens
acccagggggctgaaacttga

SEQ ID NO: 2924705 - DNA, 15 bp, Homo sapiens
acccagggtggagtg

SEQ ID NO: 2924706 - DNA, 14 bp, Homo sapiens
acccaggtcccctc

SEQ ID NO: 2924707 - DNA, 16 bp, Homo sapiens
acccagtccatgctcc

SEQ ID NO: 2924708 - DNA, 17 bp, Homo sapiens
acccagtccatgctcca

SEQ ID NO: 2924709 - DNA, 13 bp, Homo sapiens
acccagtccctgg

SEQ ID NO: 2924710 - DNA, 13 bp, Homo sapiens
acccagtcgccct

SEQ ID NO: 2924711 - DNA, 14 bp, Homo sapiens
acccagtcgccctt

SEQ ID NO: 2924712 - DNA, 12 bp, Homo sapiens
acccagtgcaga

SEQ ID NO: 2924713 - DNA, 22 bp, Homo sapiens
acccagtgcccccactgaccag

SEQ ID NO: 2924714 - DNA, 12 bp, Homo sapiens
acccagtggctg

SEQ ID NO: 2924715 - DNA, 18 bp, Homo sapiens
acccagttgccatctgcg

SEQ ID NO: 2924716 - DNA, 19 bp, Homo sapiens
acccataggcccacacaca

SEQ ID NO: 2924717 - DNA, 14 bp, Homo sapiens
acccatagggagct

SEQ ID NO: 2924718 - DNA, 15 bp, Homo sapiens
acccatctctccctt

SEQ ID NO: 2924719 - DNA, 13 bp, Homo sapiens
acccatctgcacc

SEQ ID NO: 2924720 - DNA, 14 bp, Homo sapiens
acccatcttgcttc

SEQ ID NO: 2924721 - DNA, 11 bp, Homo sapiens
acccatgaaaa

SEQ ID NO: 2924722 - DNA, 20 bp, Homo sapiens
acccatgagttggggtctgg

SEQ ID NO: 2924723 - DNA, 18 bp, Homo sapiens
acccatgcaagcagagga

SEQ ID NO: 2924724 - DNA, 22 bp, Homo sapiens
acccatgcaagcagaggaccag

SEQ ID NO: 2924725 - DNA, 18 bp, Homo sapiens
acccatgggggctgtctt

SEQ ID NO: 2924726 - DNA, 19 bp, Homo sapiens
acccattctacacagagca

SEQ ID NO: 2924727 - DNA, 14 bp, Homo sapiens
acccattcttcccg

SEQ ID NO: 2924728 - DNA, 17 bp, Homo sapiens
accccaaagagaaagag

SEQ ID NO: 2924729 - DNA, 18 bp, Homo sapiens
accccaagccagcccggc

SEQ ID NO: 2924730 - DNA, 17 bp, Homo sapiens
accccaaggagggagat

SEQ ID NO: 2924731 - DNA, 16 bp, Homo sapiens
accccaatatatgtat

SEQ ID NO: 2924732 - DNA, 14 bp, Homo sapiens
accccaatcccagc

SEQ ID NO: 2924733 - DNA, 22 bp, Homo sapiens
accccaccacgatgtggccctg

SEQ ID NO: 2924734 - DNA, 22 bp, Homo sapiens
accccacccccttcagtgccca

SEQ ID NO: 2924735 - DNA, 15 bp, Homo sapiens
accccaccctgtttg

SEQ ID NO: 2924736 - DNA, 10 bp, Homo sapiens
accccagagc

SEQ ID NO: 2924737 - DNA, 16 bp, Homo sapiens
accccagagccacaca

SEQ ID NO: 2924738 - DNA, 17 bp, Homo sapiens
accccagagccacacat

SEQ ID NO: 2924739 - DNA, 19 bp, Homo sapiens
actactatttttctttcca

SEQ ID NO: 2924740 - DNA, 14 bp, Homo sapiens
actactcgagccca

SEQ ID NO: 2924741 - DNA, 21 bp, Homo sapiens
actactcgagcccacccagca

SEQ ID NO: 2924742 - DNA, 22 bp, Homo sapiens
actactgttatcagtaatgcta

SEQ ID NO: 2924743 - DNA, 14 bp, Homo sapiens
actacttagcactg

SEQ ID NO: 2924744 - DNA, 13 bp, Homo sapiens
actagaaattctt

SEQ ID NO: 2924745 - DNA, 15 bp, Homo sapiens
actagacaagccaga

SEQ ID NO: 2924746 - DNA, 17 bp, Homo sapiens
actagacaccaaagttc

SEQ ID NO: 2924747 - DNA, 18 bp, Homo sapiens
actagacaccaaagttct

SEQ ID NO: 2924748 - DNA, 16 bp, Homo sapiens
actagacaccttctgt

SEQ ID NO: 2924749 - DNA, 16 bp, Homo sapiens
actagagatgtgcaat

SEQ ID NO: 2924750 - DNA, 18 bp, Homo sapiens
actagagggacctctccc

SEQ ID NO: 2924751 - DNA, 19 bp, Homo sapiens
actagagggacctctccca

SEQ ID NO: 2924752 - DNA, 15 bp, Homo sapiens
actagatgacctcat

SEQ ID NO: 2924753 - DNA, 18 bp, Homo sapiens
actagatgacctcattaa

SEQ ID NO: 2924754 - DNA, 14 bp, Homo sapiens
actagctatggtgt

SEQ ID NO: 2924755 - DNA, 16 bp, Homo sapiens
actagctctttgagat

SEQ ID NO: 2924756 - DNA, 20 bp, Homo sapiens
actagggaaaggtaaataca

SEQ ID NO: 2924757 - DNA, 15 bp, Homo sapiens
actagggagccatgt

SEQ ID NO: 2924758 - DNA, 18 bp, Homo sapiens
actagggatccctcatct

SEQ ID NO: 2924759 - DNA, 15 bp, Homo sapiens
actagggcctcggag

SEQ ID NO: 2924760 - DNA, 23 bp, Homo sapiens
actagggcctcggaggctcctcc

SEQ ID NO: 2924761 - DNA, 24 bp, Homo sapiens
actagggcctcggaggctcctccc

SEQ ID NO: 2924762 - DNA, 20 bp, Homo sapiens
actagggttttggcctgcct

SEQ ID NO: 2924763 - DNA, 23 bp, Homo sapiens
actagggttttggcctgcctgcg

SEQ ID NO: 2924764 - DNA, 18 bp, Homo sapiens
actaggtcaaaaatctgt

SEQ ID NO: 2924765 - DNA, 15 bp, Homo sapiens
actagttacacatct

SEQ ID NO: 2924766 - DNA, 17 bp, Homo sapiens
actagtttatgctacct

SEQ ID NO: 2924767 - DNA, 13 bp, Homo sapiens
actataaaatgca

SEQ ID NO: 2924768 - DNA, 19 bp, Homo sapiens
actataaaatgtcttcaag

SEQ ID NO: 2924769 - DNA, 12 bp, Homo sapiens
actataaataca

SEQ ID NO: 2924770 - DNA, 14 bp, Homo sapiens
actataaatacaaa

SEQ ID NO: 2924771 - DNA, 15 bp, Homo sapiens
actataaatacaaat

SEQ ID NO: 2924772 - DNA, 19 bp, Homo sapiens
actataaatacaaatctgt

SEQ ID NO: 2924773 - DNA, 16 bp, Homo sapiens
actatattctggccag

SEQ ID NO: 2924774 - DNA, 23 bp, Homo sapiens
actatatttgggcctgctccaga

SEQ ID NO: 2924775 - DNA, 15 bp, Homo sapiens
actatgaaacctttt

SEQ ID NO: 2924776 - DNA, 14 bp, Homo sapiens
actatgcaaagaac

SEQ ID NO: 2924777 - DNA, 15 bp, Homo sapiens
actatgcaaagaact

SEQ ID NO: 2924778 - DNA, 20 bp, Homo sapiens
actatgcatggtgccccagg

SEQ ID NO: 2924779 - DNA, 16 bp, Homo sapiens
actatgggatgtatat

SEQ ID NO: 2924780 - DNA, 14 bp, Homo sapiens
actatgtattaatt

SEQ ID NO: 2924781 - DNA, 12 bp, Homo sapiens
actatgtgtgtt

SEQ ID NO: 2924782 - DNA, 21 bp, Homo sapiens
actatgtgtgttgtttccata

SEQ ID NO: 2924783 - DNA, 14 bp, Homo sapiens
actattaagaggca

SEQ ID NO: 2924784 - DNA, 21 bp, Homo sapiens
actattaagaggcagaaaatt

SEQ ID NO: 2924785 - DNA, 19 bp, Homo sapiens
actattaaggatgtagctt

SEQ ID NO: 2924786 - DNA, 21 bp, Homo sapiens
actattatgttgttagagaaa

SEQ ID NO: 2924787 - DNA, 15 bp, Homo sapiens
actattcagttgtgt

SEQ ID NO: 2924788 - DNA, 16 bp, Homo sapiens
actattccatgtttta

SEQ ID NO: 2924789 - DNA, 17 bp, Homo sapiens
actattcccactttcat

SEQ ID NO: 2924790 - DNA, 18 bp, Homo sapiens
actattccttttctgtat

SEQ ID NO: 2924791 - DNA, 12 bp, Homo sapiens
actatttcttca

SEQ ID NO: 2924792 - DNA, 13 bp, Homo sapiens
actatttcttcag

SEQ ID NO: 2924793 - DNA, 16 bp, Homo sapiens
actatttcttcagagt

SEQ ID NO: 2924794 - DNA, 15 bp, Homo sapiens
actattttattctaa

SEQ ID NO: 2924795 - DNA, 15 bp, Homo sapiens
actattttcattttt

SEQ ID NO: 2924796 - DNA, 12 bp, Homo sapiens
actcaaaaataa

SEQ ID NO: 2924797 - DNA, 14 bp, Homo sapiens
actcaaaaataagt

SEQ ID NO: 2924798 - DNA, 16 bp, Homo sapiens
actcaaaatctgtcat

SEQ ID NO: 2924799 - DNA, 21 bp, Homo sapiens
actcaaaatgatgcaaccaaa

SEQ ID NO: 2924800 - DNA, 22 bp, Homo sapiens
actcaaaatgatgcaaccaaaa

SEQ ID NO: 2924801 - DNA, 13 bp, Homo sapiens
actcaaagaatgt

SEQ ID NO: 2924802 - DNA, 21 bp, Homo sapiens
actcaaatgctcagaccagct

SEQ ID NO: 2924803 - DNA, 23 bp, Homo sapiens
actcaaatgctcagaccagctct

SEQ ID NO: 2924804 - DNA, 17 bp, Homo sapiens
actcaaatggggccaga

SEQ ID NO: 2924805 - DNA, 22 bp, Homo sapiens
actcaaatggggccagatccag

SEQ ID NO: 2924806 - DNA, 19 bp, Homo sapiens
actcaacaataaagactga

SEQ ID NO: 2924807 - DNA, 15 bp, Homo sapiens
actcaacagagagga

SEQ ID NO: 2924808 - DNA, 12 bp, Homo sapiens
actcaaccaaat

SEQ ID NO: 2924809 - DNA, 16 bp, Homo sapiens
actcaagccaagcagc

SEQ ID NO: 2924810 - DNA, 19 bp, Homo sapiens
actcaagccaagcagccaa

SEQ ID NO: 2924811 - DNA, 14 bp, Homo sapiens
actcaagcccgcgg

SEQ ID NO: 2924812 - DNA, 14 bp, Homo sapiens
actcaagttgttta

SEQ ID NO: 2924813 - DNA, 19 bp, Homo sapiens
actcaagtttttacaaaat

SEQ ID NO: 2924814 - DNA, 22 bp, Homo sapiens
actcaatgaaatatgtgaagcc

SEQ ID NO: 2924815 - DNA, 16 bp, Homo sapiens
actcaccatatttgaa

SEQ ID NO: 2924816 - DNA, 12 bp, Homo sapiens
actcacccaagc

SEQ ID NO: 2924817 - DNA, 20 bp, Homo sapiens
actcacccttcctggcccag

SEQ ID NO: 2924818 - DNA, 23 bp, Homo sapiens
actcacctttctccactgggtgc

SEQ ID NO: 2924819 - DNA, 17 bp, Homo sapiens
actcactgaagcccaga

SEQ ID NO: 2924820 - DNA, 12 bp, Homo sapiens
actcagaagcct

SEQ ID NO: 2924821 - DNA, 20 bp, Homo sapiens
actcagaagcctctgggtca

SEQ ID NO: 2924822 - DNA, 12 bp, Homo sapiens
actcagagctgc

SEQ ID NO: 2924823 - DNA, 17 bp, Homo sapiens
actcagagctgcgggct

SEQ ID NO: 2924824 - DNA, 18 bp, Homo sapiens
actcagagctgcgggctg

SEQ ID NO: 2924825 - DNA, 11 bp, Homo sapiens
actcagatcca

SEQ ID NO: 2924826 - DNA, 14 bp, Homo sapiens
actcagatccaggg

SEQ ID NO: 2924827 - DNA, 14 bp, Homo sapiens
actcagcagaggca

SEQ ID NO: 2924828 - DNA, 19 bp, Homo sapiens
actcagcagcagagagccc

SEQ ID NO: 2924829 - DNA, 18 bp, Homo sapiens
actcagcagccctcctca

SEQ ID NO: 2924830 - DNA, 19 bp, Homo sapiens
actcagcagccctcctcac

SEQ ID NO: 2924831 - DNA, 22 bp, Homo sapiens
actcagcatttgattaacattt

SEQ ID NO: 2924832 - DNA, 22 bp, Homo sapiens
actcagccaagcacagtggtgg

SEQ ID NO: 2924833 - DNA, 13 bp, Homo sapiens
actcagcccctac

SEQ ID NO: 2924834 - DNA, 21 bp, Homo sapiens
actcagcccctacccctgccc

SEQ ID NO: 2924835 - DNA, 11 bp, Homo sapiens
actcagccctg

SEQ ID NO: 2924836 - DNA, 12 bp, Homo sapiens
actcagccctgg

SEQ ID NO: 2924837 - DNA, 14 bp, Homo sapiens
actcagccctgggc

SEQ ID NO: 2924838 - DNA, 21 bp, Homo sapiens
actcagcctgcagttaattag

SEQ ID NO: 2924839 - DNA, 17 bp, Homo sapiens
actcagctttagttttt

SEQ ID NO: 2924840 - DNA, 13 bp, Homo sapiens
actcaggaggctg

SEQ ID NO: 2924841 - DNA, 19 bp, Homo sapiens
actcaggaggctgagacag

SEQ ID NO: 2924842 - DNA, 20 bp, Homo sapiens
actcaggaggctgagacagg

SEQ ID NO: 2924843 - DNA, 16 bp, Homo sapiens
actcaggcccaaagcc

SEQ ID NO: 2924844 - DNA, 12 bp, Homo sapiens
actcaggctgga

SEQ ID NO: 2924845 - DNA, 17 bp, Homo sapiens
actcagggcagcgccag

SEQ ID NO: 2924846 - DNA, 22 bp, Homo sapiens
actcagggcagctgcctggcca

SEQ ID NO: 2924847 - DNA, 23 bp, Homo sapiens
actcagggcagctgcctggccat

SEQ ID NO: 2924848 - DNA, 16 bp, Homo sapiens
actcaggggatgttta

SEQ ID NO: 2924849 - DNA, 21 bp, Homo sapiens
actcaggggatgtttacctgg

SEQ ID NO: 2924850 - DNA, 22 bp, Homo sapiens
actcaggtgcacacatcaccag

SEQ ID NO: 2924851 - DNA, 23 bp, Homo sapiens
actcaggtggtgtccttcttcct

SEQ ID NO: 2924852 - DNA, 23 bp, Homo sapiens
actcagtttcatatattattccg

SEQ ID NO: 2924853 - DNA, 16 bp, Homo sapiens
actcataatgtgaagt

SEQ ID NO: 2924854 - DNA, 18 bp, Homo sapiens
actcatggccttgtctaa

SEQ ID NO: 2924855 - DNA, 16 bp, Homo sapiens
actcatgtgactcttt

SEQ ID NO: 2924856 - DNA, 18 bp, Homo sapiens
actcatgtgactctttcc

SEQ ID NO: 2924857 - DNA, 19 bp, Homo sapiens
actcatgtgactctttcca

SEQ ID NO: 2924858 - DNA, 13 bp, Homo sapiens
actcattcaaaag

SEQ ID NO: 2924859 - DNA, 17 bp, Homo sapiens
actcattgaaatgtaat

SEQ ID NO: 2924860 - DNA, 21 bp, Homo sapiens
actcattgctgagcctctgct

SEQ ID NO: 2924861 - DNA, 21 bp, Homo sapiens
actcatttataaagctaaaat

SEQ ID NO: 2924862 - DNA, 22 bp, Homo sapiens
actcattttcatattgtaatct

SEQ ID NO: 2924863 - DNA, 14 bp, Homo sapiens
actccaaaaagaca

SEQ ID NO: 2924864 - DNA, 15 bp, Homo sapiens
actccaaaaagacaa

SEQ ID NO: 2924865 - DNA, 14 bp, Homo sapiens
actccaagccccct

SEQ ID NO: 2924866 - DNA, 15 bp, Homo sapiens
actccaagccccctg

SEQ ID NO: 2924867 - DNA, 16 bp, Homo sapiens
actccaagccccctgg

SEQ ID NO: 2924868 - DNA, 14 bp, Homo sapiens
actccaccacccaa

SEQ ID NO: 2924869 - DNA, 17 bp, Homo sapiens
actccactcactgaagc

SEQ ID NO: 2924870 - DNA, 12 bp, Homo sapiens
actccactcagg

SEQ ID NO: 2924871 - DNA, 19 bp, Homo sapiens
actccagcctgggtcacag

SEQ ID NO: 2924872 - DNA, 16 bp, Homo sapiens
acttctcatcacacac

SEQ ID NO: 2924873 - DNA, 15 bp, Homo sapiens
acttctcatcttaaa

SEQ ID NO: 2924874 - DNA, 18 bp, Homo sapiens
acttctgaaaaatgaatg

SEQ ID NO: 2924875 - DNA, 21 bp, Homo sapiens
acttctgaaaaatgaatgtaa

SEQ ID NO: 2924876 - DNA, 16 bp, Homo sapiens
acttctgaagagacca

SEQ ID NO: 2924877 - DNA, 13 bp, Homo sapiens
acttctgcctctt

SEQ ID NO: 2924878 - DNA, 16 bp, Homo sapiens
acttctggctccctct

SEQ ID NO: 2924879 - DNA, 18 bp, Homo sapiens
acttctggctccctcttc

SEQ ID NO: 2924880 - DNA, 15 bp, Homo sapiens
acttctggtcaatca

SEQ ID NO: 2924881 - DNA, 20 bp, Homo sapiens
acttctggtcccctgtggtg

SEQ ID NO: 2924882 - DNA, 16 bp, Homo sapiens
acttctgtgtctgtca

SEQ ID NO: 2924883 - DNA, 17 bp, Homo sapiens
acttcttacgcaatgct

SEQ ID NO: 2924884 - DNA, 13 bp, Homo sapiens
acttcttgaaggt

SEQ ID NO: 2924885 - DNA, 22 bp, Homo sapiens
acttctttatactctcttccct

SEQ ID NO: 2924886 - DNA, 17 bp, Homo sapiens
acttcttttcacattct

SEQ ID NO: 2924887 - DNA, 12 bp, Homo sapiens
acttgaaagatt

SEQ ID NO: 2924888 - DNA, 10 bp, Homo sapiens
acttgaagaa

SEQ ID NO: 2924889 - DNA, 19 bp, Homo sapiens
acttgaagggccagagcca

SEQ ID NO: 2924890 - DNA, 22 bp, Homo sapiens
acttgaagggccagagccaggg

SEQ ID NO: 2924891 - DNA, 13 bp, Homo sapiens
acttgaagtaact

SEQ ID NO: 2924892 - DNA, 22 bp, Homo sapiens
acttgaagtctaaaagcagaaa

SEQ ID NO: 2924893 - DNA, 19 bp, Homo sapiens
acttgaataatagtatgag

SEQ ID NO: 2924894 - DNA, 13 bp, Homo sapiens
acttgacagtgga

SEQ ID NO: 2924895 - DNA, 23 bp, Homo sapiens
acttgagccctgccactcaatgg

SEQ ID NO: 2924896 - DNA, 15 bp, Homo sapiens
acttgaggtggcctc

SEQ ID NO: 2924897 - DNA, 15 bp, Homo sapiens
acttgagtctatttt

SEQ ID NO: 2924898 - DNA, 15 bp, Homo sapiens
acttgagtgttcctt

SEQ ID NO: 2924899 - DNA, 15 bp, Homo sapiens
acttgatatttcctt

SEQ ID NO: 2924900 - DNA, 20 bp, Homo sapiens
acttgatgtttcctggaagc

SEQ ID NO: 2924901 - DNA, 17 bp, Homo sapiens
acttgatttcttctaga

SEQ ID NO: 2924902 - DNA, 22 bp, Homo sapiens
acttgcaattgttaatcaaaga

SEQ ID NO: 2924903 - DNA, 17 bp, Homo sapiens
acttgcagaggagccca

SEQ ID NO: 2924904 - DNA, 18 bp, Homo sapiens
acttgcagaggagcccag

SEQ ID NO: 2924905 - DNA, 20 bp, Homo sapiens
acttgcagaggagcccagtg

SEQ ID NO: 2924906 - DNA, 20 bp, Homo sapiens
acttgcattccagagttaaa

SEQ ID NO: 2924907 - DNA, 20 bp, Homo sapiens
acttgccagaagttgtggat

SEQ ID NO: 2924908 - DNA, 18 bp, Homo sapiens
acttgcctccgtgtcacc

SEQ ID NO: 2924909 - DNA, 21 bp, Homo sapiens
acttgccttcctaagcctgtg

SEQ ID NO: 2924910 - DNA, 20 bp, Homo sapiens
acttgctcaggtacttgtaa

SEQ ID NO: 2924911 - DNA, 15 bp, Homo sapiens
acttgctctttgact

SEQ ID NO: 2924912 - DNA, 14 bp, Homo sapiens
acttgctttcttct

SEQ ID NO: 2924913 - DNA, 18 bp, Homo sapiens
acttggaaaaagaaagaa

SEQ ID NO: 2924914 - DNA, 23 bp, Homo sapiens
acttggaaaaagaaagaaacact

SEQ ID NO: 2924915 - DNA, 22 bp, Homo sapiens
acttggaaataaaccattggac

SEQ ID NO: 2924916 - DNA, 16 bp, Homo sapiens
acttggctgcaggaat

SEQ ID NO: 2924917 - DNA, 13 bp, Homo sapiens
acttggctttcat

SEQ ID NO: 2924918 - DNA, 16 bp, Homo sapiens
acttggtaattgtact

SEQ ID NO: 2924919 - DNA, 22 bp, Homo sapiens
acttggtcccgtggatgctctt

SEQ ID NO: 2924920 - DNA, 16 bp, Homo sapiens
acttggtgtaattaat

SEQ ID NO: 2924921 - DNA, 18 bp, Homo sapiens
acttggtgtaattaataa

SEQ ID NO: 2924922 - DNA, 17 bp, Homo sapiens
acttggttgatgtttaa

SEQ ID NO: 2924923 - DNA, 22 bp, Homo sapiens
acttggttgggtcagatttatt

SEQ ID NO: 2924924 - DNA, 19 bp, Homo sapiens
acttgtaaaggaatttaaa

SEQ ID NO: 2924925 - DNA, 14 bp, Homo sapiens
acttgtagattcag

SEQ ID NO: 2924926 - DNA, 18 bp, Homo sapiens
acttgtaggaatctgcct

SEQ ID NO: 2924927 - DNA, 13 bp, Homo sapiens
acttgtcaaagaa

SEQ ID NO: 2924928 - DNA, 20 bp, Homo sapiens
acttgtcaagcctgtgcaaa

SEQ ID NO: 2924929 - DNA, 17 bp, Homo sapiens
acttgtcacttgcatgt

SEQ ID NO: 2924930 - DNA, 17 bp, Homo sapiens
acttgtccccaaatccg

SEQ ID NO: 2924931 - DNA, 22 bp, Homo sapiens
acttgtccccaaatccgaacct

SEQ ID NO: 2924932 - DNA, 23 bp, Homo sapiens
acttgtcccgggacacctaggct

SEQ ID NO: 2924933 - DNA, 19 bp, Homo sapiens
acttgtgagcatcagaggg

SEQ ID NO: 2924934 - DNA, 16 bp, Homo sapiens
acttgtgattatttat

SEQ ID NO: 2924935 - DNA, 12 bp, Homo sapiens
acttgtgccagc

SEQ ID NO: 2924936 - DNA, 16 bp, Homo sapiens
acttgtgggtcctggg

SEQ ID NO: 2924937 - DNA, 18 bp, Homo sapiens
acttgttcatttttctct

SEQ ID NO: 2924938 - DNA, 11 bp, Homo sapiens
acttgtttcct

SEQ ID NO: 2924939 - DNA, 23 bp, Homo sapiens
acttgtttcctgtgcccatcatc

SEQ ID NO: 2924940 - DNA, 16 bp, Homo sapiens
actttaaatttaaagt

SEQ ID NO: 2924941 - DNA, 19 bp, Homo sapiens
actttactgcctgaataaa

SEQ ID NO: 2924942 - DNA, 14 bp, Homo sapiens
actttaggctttca

SEQ ID NO: 2924943 - DNA, 19 bp, Homo sapiens
actttaggctttcagctta

SEQ ID NO: 2924944 - DNA, 21 bp, Homo sapiens
actttaggctttcagcttaca

SEQ ID NO: 2924945 - DNA, 19 bp, Homo sapiens
actttagggggtgggaggg

SEQ ID NO: 2924946 - DNA, 15 bp, Homo sapiens
actttagtgattgct

SEQ ID NO: 2924947 - DNA, 19 bp, Homo sapiens
actttagtgattgctttta

SEQ ID NO: 2924948 - DNA, 23 bp, Homo sapiens
actttatctaatacctctgtgtg

SEQ ID NO: 2924949 - DNA, 13 bp, Homo sapiens
actttatgcatct

SEQ ID NO: 2924950 - DNA, 21 bp, Homo sapiens
actttattcttgaaagaagaa

SEQ ID NO: 2924951 - DNA, 17 bp, Homo sapiens
actttattgacaagtga

SEQ ID NO: 2924952 - DNA, 20 bp, Homo sapiens
actttattgccctaacaatt

SEQ ID NO: 2924953 - DNA, 19 bp, Homo sapiens
actttatttttctgataga

SEQ ID NO: 2924954 - DNA, 10 bp, Homo sapiens
actttcaaaa

SEQ ID NO: 2924955 - DNA, 20 bp, Homo sapiens
actttcctggataaaaaaga

SEQ ID NO: 2924956 - DNA, 23 bp, Homo sapiens
actttcctggatgtctgaacttt

SEQ ID NO: 2924957 - DNA, 18 bp, Homo sapiens
actttcgtaatagctcag

SEQ ID NO: 2924958 - DNA, 17 bp, Homo sapiens
actttctatcctctgta

SEQ ID NO: 2924959 - DNA, 20 bp, Homo sapiens
actttctatttttatgatga

SEQ ID NO: 2924960 - DNA, 14 bp, Homo sapiens
actttctcaatgct

SEQ ID NO: 2924961 - DNA, 16 bp, Homo sapiens
actttctcttgtttaa

SEQ ID NO: 2924962 - DNA, 16 bp, Homo sapiens
actttcttattctgta

SEQ ID NO: 2924963 - DNA, 17 bp, Homo sapiens
actttcttattctgtat

SEQ ID NO: 2924964 - DNA, 14 bp, Homo sapiens
actttcttctaaat

SEQ ID NO: 2924965 - DNA, 16 bp, Homo sapiens
actttcttctaccaga

SEQ ID NO: 2924966 - DNA, 23 bp, Homo sapiens
actttcttctaccagacccttct

SEQ ID NO: 2924967 - DNA, 14 bp, Homo sapiens
actttcttctgaat

SEQ ID NO: 2924968 - DNA, 18 bp, Homo sapiens
actttctttaaattatgt

SEQ ID NO: 2924969 - DNA, 21 bp, Homo sapiens
actttgaagacccgctacaaa

SEQ ID NO: 2924970 - DNA, 17 bp, Homo sapiens
actttgagaggctgagg

SEQ ID NO: 2924971 - DNA, 16 bp, Homo sapiens
actttgagtacagata

SEQ ID NO: 2924972 - DNA, 20 bp, Homo sapiens
actttgattccattttaagt

SEQ ID NO: 2924973 - DNA, 18 bp, Homo sapiens
actttgcccttcactgtt

SEQ ID NO: 2924974 - DNA, 19 bp, Homo sapiens
actttgctgttccttactt

SEQ ID NO: 2924975 - DNA, 11 bp, Homo sapiens
actttggaagc

SEQ ID NO: 2924976 - DNA, 16 bp, Homo sapiens
actttgggaggcaggg

SEQ ID NO: 2924977 - DNA, 16 bp, Homo sapiens
actttgggaggccaag

SEQ ID NO: 2924978 - DNA, 18 bp, Homo sapiens
actttgggtttttaactc

SEQ ID NO: 2924979 - DNA, 19 bp, Homo sapiens
actttggtcacccagacta

SEQ ID NO: 2924980 - DNA, 13 bp, Homo sapiens
actttgtaaatag

SEQ ID NO: 2924981 - DNA, 23 bp, Homo sapiens
actttgtaaataggatttttaga

SEQ ID NO: 2924982 - DNA, 12 bp, Homo sapiens
actttgtaaatt

SEQ ID NO: 2924983 - DNA, 13 bp, Homo sapiens
actttgtcaccct

SEQ ID NO: 2924984 - DNA, 20 bp, Homo sapiens
actttgttaggattttcaca

SEQ ID NO: 2924985 - DNA, 19 bp, Homo sapiens
actttgttggcccttccag

SEQ ID NO: 2924986 - DNA, 21 bp, Homo sapiens
actttgttggcccttccagtg

SEQ ID NO: 2924987 - DNA, 17 bp, Homo sapiens
actttgtttttccatgt

SEQ ID NO: 2924988 - DNA, 20 bp, Homo sapiens
acttttaaaataaattctct

SEQ ID NO: 2924989 - DNA, 21 bp, Homo sapiens
acttttaaaataaattctctc

SEQ ID NO: 2924990 - DNA, 22 bp, Homo sapiens
acttttaaataaattatgaata

SEQ ID NO: 2924991 - DNA, 22 bp, Homo sapiens
acttttaacgtatgtatttcat

SEQ ID NO: 2924992 - DNA, 14 bp, Homo sapiens
acttttaatcaagt

SEQ ID NO: 2924993 - DNA, 18 bp, Homo sapiens
acttttaatgaacaaatg

SEQ ID NO: 2924994 - DNA, 13 bp, Homo sapiens
acttttagacttt

SEQ ID NO: 2924995 - DNA, 23 bp, Homo sapiens
acttttatactctttctgtatat

SEQ ID NO: 2924996 - DNA, 18 bp, Homo sapiens
acttttatatttgaaaaa

SEQ ID NO: 2924997 - DNA, 23 bp, Homo sapiens
acttttattagccagtgaaacac

SEQ ID NO: 2924998 - DNA, 18 bp, Homo sapiens
acttttattgatggatat

SEQ ID NO: 2924999 - DNA, 18 bp, Homo sapiens
acttttattttacacaga

SEQ ID NO: 2925000 - DNA, 21 bp, Homo sapiens
acttttcatctaacgtgcatt

SEQ ID NO: 2925001 - DNA, 18 bp, Homo sapiens
acttttcattctctttta

SEQ ID NO: 2925002 - DNA, 18 bp, Homo sapiens
acttttctcctgcatgtg

SEQ ID NO: 2925003 - DNA, 17 bp, Homo sapiens
acttttctgaccatgtg

SEQ ID NO: 2925004 - DNA, 22 bp, Homo sapiens
agacatactccttccatcaaat

SEQ ID NO: 2925005 - DNA, 17 bp, Homo sapiens
agacatacttgaagggc

SEQ ID NO: 2925006 - DNA, 21 bp, Homo sapiens
agacatacttgaagggccaga

SEQ ID NO: 2925007 - DNA, 23 bp, Homo sapiens
agacatacttgaagggccagagc

SEQ ID NO: 2925008 - DNA, 22 bp, Homo sapiens
agacatagcatccaagtggcat

SEQ ID NO: 2925009 - DNA, 15 bp, Homo sapiens
agacatagtctctac

SEQ ID NO: 2925010 - DNA, 18 bp, Homo sapiens
agacatagtctctaccta

SEQ ID NO: 2925011 - DNA, 14 bp, Homo sapiens
agacatatattata

SEQ ID NO: 2925012 - DNA, 21 bp, Homo sapiens
agacatatattatatatagaa

SEQ ID NO: 2925013 - DNA, 14 bp, Homo sapiens
agacatatttcagt

SEQ ID NO: 2925014 - DNA, 23 bp, Homo sapiens
agacatcagcctccttctttcac

SEQ ID NO: 2925015 - DNA, 15 bp, Homo sapiens
agacatccataaaga

SEQ ID NO: 2925016 - DNA, 18 bp, Homo sapiens
agacatccataaagaagc

SEQ ID NO: 2925017 - DNA, 22 bp, Homo sapiens
agacatccataaagaagcaata

SEQ ID NO: 2925018 - DNA, 13 bp, Homo sapiens
agacatctttctc

SEQ ID NO: 2925019 - DNA, 15 bp, Homo sapiens
agacatggaaaagga

SEQ ID NO: 2925020 - DNA, 17 bp, Homo sapiens
agacatggaggttctaa

SEQ ID NO: 2925021 - DNA, 19 bp, Homo sapiens
agacatggaggttctaagg

SEQ ID NO: 2925022 - DNA, 20 bp, Homo sapiens
agacatggaggttctaaggc

SEQ ID NO: 2925023 - DNA, 12 bp, Homo sapiens
agacatggtggc

SEQ ID NO: 2925024 - DNA, 15 bp, Homo sapiens
agacatgttttagac

SEQ ID NO: 2925025 - DNA, 23 bp, Homo sapiens
agacatgttttagacaaatactc

SEQ ID NO: 2925026 - DNA, 14 bp, Homo sapiens
agacattctgccag

SEQ ID NO: 2925027 - DNA, 22 bp, Homo sapiens
agacattgggtctattccagct

SEQ ID NO: 2925028 - DNA, 11 bp, Homo sapiens
agacattgtaa

SEQ ID NO: 2925029 - DNA, 14 bp, Homo sapiens
agacatttaaagac

SEQ ID NO: 2925030 - DNA, 18 bp, Homo sapiens
agacatttcaaaattaat

SEQ ID NO: 2925031 - DNA, 15 bp, Homo sapiens
agacattttaacaag

SEQ ID NO: 2925032 - DNA, 16 bp, Homo sapiens
agacattttaacaaga

SEQ ID NO: 2925033 - DNA, 21 bp, Homo sapiens
agacattttaacaagaagatg

SEQ ID NO: 2925034 - DNA, 19 bp, Homo sapiens
agaccagcctggccaacat

SEQ ID NO: 2925035 - DNA, 16 bp, Homo sapiens
agaccagcctttcttc

SEQ ID NO: 2925036 - DNA, 12 bp, Homo sapiens
agaccaggctgg

SEQ ID NO: 2925037 - DNA, 22 bp, Homo sapiens
agaccagttagattattgaaat

SEQ ID NO: 2925038 - DNA, 18 bp, Homo sapiens
agaccatctcctatcttt

SEQ ID NO: 2925039 - DNA, 12 bp, Homo sapiens
agaccatttgta

SEQ ID NO: 2925040 - DNA, 19 bp, Homo sapiens
agacccagcccgcggcctg

SEQ ID NO: 2925041 - DNA, 21 bp, Homo sapiens
agacccagcccgcggcctgga

SEQ ID NO: 2925042 - DNA, 18 bp, Homo sapiens
agacccagccctcatccc

SEQ ID NO: 2925043 - DNA, 13 bp, Homo sapiens
agacccaggactc

SEQ ID NO: 2925044 - DNA, 22 bp, Homo sapiens
agacccagggggctgaaacttg

SEQ ID NO: 2925045 - DNA, 18 bp, Homo sapiens
agaccccagatgtgaggg

SEQ ID NO: 2925046 - DNA, 12 bp, Homo sapiens
agacccccactc

SEQ ID NO: 2925047 - DNA, 14 bp, Homo sapiens
agaccccctggaga

SEQ ID NO: 2925048 - DNA, 15 bp, Homo sapiens
agaccccctgtcctg

SEQ ID NO: 2925049 - DNA, 17 bp, Homo sapiens
agacccgggaaggaagg

SEQ ID NO: 2925050 - DNA, 21 bp, Homo sapiens
agacccgggaaggaaggctct

SEQ ID NO: 2925051 - DNA, 14 bp, Homo sapiens
agaccctctcaggc

SEQ ID NO: 2925052 - DNA, 16 bp, Homo sapiens
agaccctctttcttgt

SEQ ID NO: 2925053 - DNA, 16 bp, Homo sapiens
agacccttctggtgcc

SEQ ID NO: 2925054 - DNA, 21 bp, Homo sapiens
agacctactgttctaaagctc

SEQ ID NO: 2925055 - DNA, 11 bp, Homo sapiens
agacctcagcc

SEQ ID NO: 2925056 - DNA, 13 bp, Homo sapiens
agacctcagggca

SEQ ID NO: 2925057 - DNA, 17 bp, Homo sapiens
agacctcatctctacta

SEQ ID NO: 2925058 - DNA, 11 bp, Homo sapiens
agacctctgga

SEQ ID NO: 2925059 - DNA, 23 bp, Homo sapiens
agacctctggattaggtctctgt

SEQ ID NO: 2925060 - DNA, 14 bp, Homo sapiens
agacctgatcctgg

SEQ ID NO: 2925061 - DNA, 15 bp, Homo sapiens
agacctgatcctgga

SEQ ID NO: 2925062 - DNA, 23 bp, Homo sapiens
agacctgatcctggaggcccagt

SEQ ID NO: 2925063 - DNA, 18 bp, Homo sapiens
agacctggacacaggcct

SEQ ID NO: 2925064 - DNA, 15 bp, Homo sapiens
agacctggcagctct

SEQ ID NO: 2925065 - DNA, 18 bp, Homo sapiens
agacctgttagcagacag

SEQ ID NO: 2925066 - DNA, 17 bp, Homo sapiens
agaccttactcagggga

SEQ ID NO: 2925067 - DNA, 18 bp, Homo sapiens
agaccttactcaggggat

SEQ ID NO: 2925068 - DNA, 22 bp, Homo sapiens
agaccttccataatgctactgt

SEQ ID NO: 2925069 - DNA, 23 bp, Homo sapiens
agaccttccataatgctactgtc

SEQ ID NO: 2925070 - DNA, 16 bp, Homo sapiens
agacctttgcccacac

SEQ ID NO: 2925071 - DNA, 21 bp, Homo sapiens
agacgaatgccattggaacct

SEQ ID NO: 2925072 - DNA, 19 bp, Homo sapiens
agacgatgtttatgttctt

SEQ ID NO: 2925073 - DNA, 14 bp, Homo sapiens
agacgcatttcggt

SEQ ID NO: 2925074 - DNA, 21 bp, Homo sapiens
agacgctaataaaaatttatt

SEQ ID NO: 2925075 - DNA, 17 bp, Homo sapiens
agacggagtgtgggagt

SEQ ID NO: 2925076 - DNA, 13 bp, Homo sapiens
agacggatggcag

SEQ ID NO: 2925077 - DNA, 20 bp, Homo sapiens
agacggcacggtcttccctc

SEQ ID NO: 2925078 - DNA, 21 bp, Homo sapiens
agacggtgtcttgttctgtca

SEQ ID NO: 2925079 - DNA, 16 bp, Homo sapiens
agacggtttccaggga

SEQ ID NO: 2925080 - DNA, 14 bp, Homo sapiens
agacgtgtttgtgt

SEQ ID NO: 2925081 - DNA, 22 bp, Homo sapiens
agactaggataatgtccaacta

SEQ ID NO: 2925082 - DNA, 23 bp, Homo sapiens
agactatggaatgtcagtgttca

SEQ ID NO: 2925083 - DNA, 19 bp, Homo sapiens
agactattccttttctgta

SEQ ID NO: 2925084 - DNA, 13 bp, Homo sapiens
agactcaaatgct

SEQ ID NO: 2925085 - DNA, 20 bp, Homo sapiens
agactcacaacctgaaccta

SEQ ID NO: 2925086 - DNA, 12 bp, Homo sapiens
agactcacctct

SEQ ID NO: 2925087 - DNA, 14 bp, Homo sapiens
agactcacctctgc

SEQ ID NO: 2925088 - DNA, 18 bp, Homo sapiens
agactcacctctgcctca

SEQ ID NO: 2925089 - DNA, 19 bp, Homo sapiens
agactcacctctgcctcaa

SEQ ID NO: 2925090 - DNA, 15 bp, Homo sapiens
agactcagactccat

SEQ ID NO: 2925091 - DNA, 13 bp, Homo sapiens
agactcagctctg

SEQ ID NO: 2925092 - DNA, 23 bp, Homo sapiens
agactcaggccaagaaacgtctt

SEQ ID NO: 2925093 - DNA, 18 bp, Homo sapiens
agactcagtgcagatgga

SEQ ID NO: 2925094 - DNA, 21 bp, Homo sapiens
agactcatcctgaacagcatg

SEQ ID NO: 2925095 - DNA, 22 bp, Homo sapiens
agactcatcctgaacagcatgg

SEQ ID NO: 2925096 - DNA, 18 bp, Homo sapiens
agactcatcttactgtac

SEQ ID NO: 2925097 - DNA, 21 bp, Homo sapiens
agactccatctctttaaaaac

SEQ ID NO: 2925098 - DNA, 18 bp, Homo sapiens
agactcccgccccgggct

SEQ ID NO: 2925099 - DNA, 19 bp, Homo sapiens
agactcccgccccgggctg

SEQ ID NO: 2925100 - DNA, 22 bp, Homo sapiens
agactcccgccccgggctggcc

SEQ ID NO: 2925101 - DNA, 17 bp, Homo sapiens
agactccctgatcccag

SEQ ID NO: 2925102 - DNA, 20 bp, Homo sapiens
agactccctgatcccagacc

SEQ ID NO: 2925103 - DNA, 16 bp, Homo sapiens
agactcctaggccctt

SEQ ID NO: 2925104 - DNA, 20 bp, Homo sapiens
agactcgattcatattgaat

SEQ ID NO: 2925105 - DNA, 19 bp, Homo sapiens
agactcgccaacatggtga

SEQ ID NO: 2925106 - DNA, 21 bp, Homo sapiens
agactctagagtccaaggttt

SEQ ID NO: 2925107 - DNA, 22 bp, Homo sapiens
agactctgcctagaaacagtgt

SEQ ID NO: 2925108 - DNA, 22 bp, Homo sapiens
agactctgtaaccacctctctg

SEQ ID NO: 2925109 - DNA, 23 bp, Homo sapiens
agactctgtaaccacctctctgt

SEQ ID NO: 2925110 - DNA, 18 bp, Homo sapiens
agactcttccaccagagc

SEQ ID NO: 2925111 - DNA, 18 bp, Homo sapiens
agactgaacttaccgtga

SEQ ID NO: 2925112 - DNA, 13 bp, Homo sapiens
agactgaagattt

SEQ ID NO: 2925113 - DNA, 23 bp, Homo sapiens
agactgagctctccaggccaggt

SEQ ID NO: 2925114 - DNA, 14 bp, Homo sapiens
agactgatcaggac

SEQ ID NO: 2925115 - DNA, 16 bp, Homo sapiens
agactgatcaggacct

SEQ ID NO: 2925116 - DNA, 17 bp, Homo sapiens
agactgcacccaggagg

SEQ ID NO: 2925117 - DNA, 20 bp, Homo sapiens
agactgcacccaggagggga

SEQ ID NO: 2925118 - DNA, 21 bp, Homo sapiens
agactgccacgtgccttagga

SEQ ID NO: 2925119 - DNA, 15 bp, Homo sapiens
agactgccccagcca

SEQ ID NO: 2925120 - DNA, 18 bp, Homo sapiens
agactgccccagccaacg

SEQ ID NO: 2925121 - DNA, 12 bp, Homo sapiens
agactgcctccc

SEQ ID NO: 2925122 - DNA, 21 bp, Homo sapiens
agactgcctccctctcttccg

SEQ ID NO: 2925123 - DNA, 20 bp, Homo sapiens
agactgctgctgaatttata

SEQ ID NO: 2925124 - DNA, 15 bp, Homo sapiens
agactggaacactag

SEQ ID NO: 2925125 - DNA, 23 bp, Homo sapiens
agactggaacttgaactgattca

SEQ ID NO: 2925126 - DNA, 12 bp, Homo sapiens
agactggcaggc

SEQ ID NO: 2925127 - DNA, 13 bp, Homo sapiens
agactggccgggc

SEQ ID NO: 2925128 - DNA, 23 bp, Homo sapiens
agactggcttttattaatgcact

SEQ ID NO: 2925129 - DNA, 19 bp, Homo sapiens
agactgggcccaggcaggt

SEQ ID NO: 2925130 - DNA, 20 bp, Homo sapiens
agactgggctgagggagcct

SEQ ID NO: 2925131 - DNA, 15 bp, Homo sapiens
agactgggctgtagt

SEQ ID NO: 2925132 - DNA, 18 bp, Homo sapiens
agactggtaggaggaggc

SEQ ID NO: 2925133 - DNA, 22 bp, Homo sapiens
agactggtaggaggaggcatgg

SEQ ID NO: 2925134 - DNA, 23 bp, Homo sapiens
agactggtaggaggaggcatgga

SEQ ID NO: 2925135 - DNA, 14 bp, Homo sapiens
agatcctaagggtc

SEQ ID NO: 2925136 - DNA, 18 bp, Homo sapiens
agatcctacttctctgag

SEQ ID NO: 2925137 - DNA, 18 bp, Homo sapiens
agatcctagatcctaagg

SEQ ID NO: 2925138 - DNA, 21 bp, Homo sapiens
agatcctcttctcaaagctgg

SEQ ID NO: 2925139 - DNA, 20 bp, Homo sapiens
agatcctgatcttaagaggc

SEQ ID NO: 2925140 - DNA, 16 bp, Homo sapiens
agatcctgggtttcca

SEQ ID NO: 2925141 - DNA, 13 bp, Homo sapiens
agatcctgtgagg

SEQ ID NO: 2925142 - DNA, 23 bp, Homo sapiens
agatcctgtgaggagccccatct

SEQ ID NO: 2925143 - DNA, 20 bp, Homo sapiens
agatcgcaccactgcactcc

SEQ ID NO: 2925144 - DNA, 17 bp, Homo sapiens
agatcgctcccttggct

SEQ ID NO: 2925145 - DNA, 14 bp, Homo sapiens
agatcgtcaggacc

SEQ ID NO: 2925146 - DNA, 16 bp, Homo sapiens
agatcgtccactgtca

SEQ ID NO: 2925147 - DNA, 16 bp, Homo sapiens
agatcgttctctgcct

SEQ ID NO: 2925148 - DNA, 14 bp, Homo sapiens
agatctacatgaat

SEQ ID NO: 2925149 - DNA, 16 bp, Homo sapiens
agatctcggtttgcca

SEQ ID NO: 2925150 - DNA, 15 bp, Homo sapiens
agatctctcctgcaa

SEQ ID NO: 2925151 - DNA, 17 bp, Homo sapiens
agatctctgcagggccg

SEQ ID NO: 2925152 - DNA, 17 bp, Homo sapiens
agatctgaacccagctg

SEQ ID NO: 2925153 - DNA, 16 bp, Homo sapiens
agatctgctttctgtt

SEQ ID NO: 2925154 - DNA, 14 bp, Homo sapiens
agatctggaacctc

SEQ ID NO: 2925155 - DNA, 20 bp, Homo sapiens
agatctggtgtccagcatgg

SEQ ID NO: 2925156 - DNA, 21 bp, Homo sapiens
agatctgttttgaaggcaaaa

SEQ ID NO: 2925157 - DNA, 21 bp, Homo sapiens
agatctttcgttggttgtttc

SEQ ID NO: 2925158 - DNA, 22 bp, Homo sapiens
agatctttcgttggttgtttct

SEQ ID NO: 2925159 - DNA, 15 bp, Homo sapiens
agatgaagttttaca

SEQ ID NO: 2925160 - DNA, 21 bp, Homo sapiens
agatgaattatcctatttcag

SEQ ID NO: 2925161 - DNA, 11 bp, Homo sapiens
agatgacactt

SEQ ID NO: 2925162 - DNA, 17 bp, Homo sapiens
agatgacacttttaaaa

SEQ ID NO: 2925163 - DNA, 16 bp, Homo sapiens
agatgaccataaccac

SEQ ID NO: 2925164 - DNA, 13 bp, Homo sapiens
agatgacccctac

SEQ ID NO: 2925165 - DNA, 14 bp, Homo sapiens
agatgactttgcag

SEQ ID NO: 2925166 - DNA, 15 bp, Homo sapiens
agatgactttgcaga

SEQ ID NO: 2925167 - DNA, 15 bp, Homo sapiens
agatgataaaaggaa

SEQ ID NO: 2925168 - DNA, 16 bp, Homo sapiens
agatgatcaacataat

SEQ ID NO: 2925169 - DNA, 23 bp, Homo sapiens
agatgatgaaaatatttaaaggc

SEQ ID NO: 2925170 - DNA, 19 bp, Homo sapiens
agatgatggatgccaatat

SEQ ID NO: 2925171 - DNA, 20 bp, Homo sapiens
agatgattgttcttttgttt

SEQ ID NO: 2925172 - DNA, 21 bp, Homo sapiens
agatgatttaatgttgatttt

SEQ ID NO: 2925173 - DNA, 13 bp, Homo sapiens
agatgatttgtac

SEQ ID NO: 2925174 - DNA, 21 bp, Homo sapiens
agatgatttgtacttggaagc

SEQ ID NO: 2925175 - DNA, 14 bp, Homo sapiens
agatgcaaagaggc

SEQ ID NO: 2925176 - DNA, 15 bp, Homo sapiens
agatgcaaagaggca

SEQ ID NO: 2925177 - DNA, 17 bp, Homo sapiens
agatgcaaagaggcaag

SEQ ID NO: 2925178 - DNA, 20 bp, Homo sapiens
agatgcaaagaggcaagagg

SEQ ID NO: 2925179 - DNA, 18 bp, Homo sapiens
agatgcaatgtgctactg

SEQ ID NO: 2925180 - DNA, 15 bp, Homo sapiens
agatgcagctggaaa

SEQ ID NO: 2925181 - DNA, 16 bp, Homo sapiens
agatgcagggcagtca

SEQ ID NO: 2925182 - DNA, 17 bp, Homo sapiens
agatgcatgttgaccat

SEQ ID NO: 2925183 - DNA, 15 bp, Homo sapiens
agatgcattgtagtt

SEQ ID NO: 2925184 - DNA, 13 bp, Homo sapiens
agatgcctccacc

SEQ ID NO: 2925185 - DNA, 18 bp, Homo sapiens
agatgcggggacaggctg

SEQ ID NO: 2925186 - DNA, 15 bp, Homo sapiens
agatgctcaaagttg

SEQ ID NO: 2925187 - DNA, 16 bp, Homo sapiens
agatgctcatctgagc

SEQ ID NO: 2925188 - DNA, 15 bp, Homo sapiens
agatgctccaagatt

SEQ ID NO: 2925189 - DNA, 17 bp, Homo sapiens
agatgctctatcttgct

SEQ ID NO: 2925190 - DNA, 23 bp, Homo sapiens
agatgctctatcttgctctgtaa

SEQ ID NO: 2925191 - DNA, 13 bp, Homo sapiens
agatgctgagcca

SEQ ID NO: 2925192 - DNA, 14 bp, Homo sapiens
agatgctgatgttc

SEQ ID NO: 2925193 - DNA, 21 bp, Homo sapiens
agatgctggatgtctgccaat

SEQ ID NO: 2925194 - DNA, 15 bp, Homo sapiens
agatgctggcccagg

SEQ ID NO: 2925195 - DNA, 18 bp, Homo sapiens
agatgctggcccagggcc

SEQ ID NO: 2925196 - DNA, 20 bp, Homo sapiens
agatgctggcccagggccca

SEQ ID NO: 2925197 - DNA, 21 bp, Homo sapiens
agatgctggcccagggcccag

SEQ ID NO: 2925198 - DNA, 18 bp, Homo sapiens
agatgctggcctcttggc

SEQ ID NO: 2925199 - DNA, 23 bp, Homo sapiens
agatgcttcactttccttctctg

SEQ ID NO: 2925200 - DNA, 12 bp, Homo sapiens
agatgcttctgg

SEQ ID NO: 2925201 - DNA, 16 bp, Homo sapiens
agatgcttctgggaga

SEQ ID NO: 2925202 - DNA, 19 bp, Homo sapiens
agatgcttggagcaatcag

SEQ ID NO: 2925203 - DNA, 20 bp, Homo sapiens
agatggaaccgcaggaagct

SEQ ID NO: 2925204 - DNA, 21 bp, Homo sapiens
agatggaaccgcaggaagctg

SEQ ID NO: 2925205 - DNA, 19 bp, Homo sapiens
agatggacagtttgtttcc

SEQ ID NO: 2925206 - DNA, 20 bp, Homo sapiens
agatggacagtttgtttcct

SEQ ID NO: 2925207 - DNA, 21 bp, Homo sapiens
agatggacagtttgtttcctg

SEQ ID NO: 2925208 - DNA, 15 bp, Homo sapiens
agatggaccccagca

SEQ ID NO: 2925209 - DNA, 18 bp, Homo sapiens
agatggaccccagcattt

SEQ ID NO: 2925210 - DNA, 13 bp, Homo sapiens
agatggacttgaa

SEQ ID NO: 2925211 - DNA, 12 bp, Homo sapiens
agatggagaaaa

SEQ ID NO: 2925212 - DNA, 15 bp, Homo sapiens
agatggagtttctaa

SEQ ID NO: 2925213 - DNA, 19 bp, Homo sapiens
agatggagtttctctcttg

SEQ ID NO: 2925214 - DNA, 15 bp, Homo sapiens
agatggataaactga

SEQ ID NO: 2925215 - DNA, 14 bp, Homo sapiens
agatgggaatgaag

SEQ ID NO: 2925216 - DNA, 15 bp, Homo sapiens
agatgggaatgaagc

SEQ ID NO: 2925217 - DNA, 16 bp, Homo sapiens
agatgggaatgaagct

SEQ ID NO: 2925218 - DNA, 13 bp, Homo sapiens
agatgggacagca

SEQ ID NO: 2925219 - DNA, 16 bp, Homo sapiens
agatgggacagcaaca

SEQ ID NO: 2925220 - DNA, 17 bp, Homo sapiens
agatgggaggagaccag

SEQ ID NO: 2925221 - DNA, 22 bp, Homo sapiens
agatgggaggggaaaggggaga

SEQ ID NO: 2925222 - DNA, 21 bp, Homo sapiens
agatgggggtgtattggaatt

SEQ ID NO: 2925223 - DNA, 21 bp, Homo sapiens
agatgggtgaaggctggcatg

SEQ ID NO: 2925224 - DNA, 22 bp, Homo sapiens
agatgggtggatcacttgaggt

SEQ ID NO: 2925225 - DNA, 22 bp, Homo sapiens
agatggtacaacctttattctt

SEQ ID NO: 2925226 - DNA, 21 bp, Homo sapiens
agatggtcacgcacctgggtg

SEQ ID NO: 2925227 - DNA, 12 bp, Homo sapiens
agatggtgggat

SEQ ID NO: 2925228 - DNA, 20 bp, Homo sapiens
agatggttagaaccagcaga

SEQ ID NO: 2925229 - DNA, 18 bp, Homo sapiens
agatgtaaatcgggaagg

SEQ ID NO: 2925230 - DNA, 22 bp, Homo sapiens
agatgtaaatcgggaaggatgg

SEQ ID NO: 2925231 - DNA, 14 bp, Homo sapiens
agatgtaaggaatt

SEQ ID NO: 2925232 - DNA, 22 bp, Homo sapiens
agatgtaatgtagttctttgtt

SEQ ID NO: 2925233 - DNA, 14 bp, Homo sapiens
agatgtaatgtttt

SEQ ID NO: 2925234 - DNA, 23 bp, Homo sapiens
agatgtaatgttttctttgcaaa

SEQ ID NO: 2925235 - DNA, 18 bp, Homo sapiens
agatgtccctgaagtctt

SEQ ID NO: 2925236 - DNA, 21 bp, Homo sapiens
agatgtccctgaagtcttgca

SEQ ID NO: 2925237 - DNA, 15 bp, Homo sapiens
agatgtctgtctctg

SEQ ID NO: 2925238 - DNA, 13 bp, Homo sapiens
agatgtgaaaact

SEQ ID NO: 2925239 - DNA, 17 bp, Homo sapiens
agatgtgatattctaag

SEQ ID NO: 2925240 - DNA, 20 bp, Homo sapiens
agatgtgatattctaagact

SEQ ID NO: 2925241 - DNA, 20 bp, Homo sapiens
agatgtgatttaatagtgtt

SEQ ID NO: 2925242 - DNA, 14 bp, Homo sapiens
agatgtgcagcaga

SEQ ID NO: 2925243 - DNA, 23 bp, Homo sapiens
agatgtgcagcagattggaagga

SEQ ID NO: 2925244 - DNA, 22 bp, Homo sapiens
agatgtggaaaagccaagaggc

SEQ ID NO: 2925245 - DNA, 12 bp, Homo sapiens
agatgtggagcc

SEQ ID NO: 2925246 - DNA, 14 bp, Homo sapiens
agatgtggagccag

SEQ ID NO: 2925247 - DNA, 19 bp, Homo sapiens
agatgtgtggactgtggca

SEQ ID NO: 2925248 - DNA, 12 bp, Homo sapiens
agatgttaaaaa

SEQ ID NO: 2925249 - DNA, 23 bp, Homo sapiens
agatgttacaagtttatatatat

SEQ ID NO: 2925250 - DNA, 20 bp, Homo sapiens
agatgttatttttgtatttt

SEQ ID NO: 2925251 - DNA, 14 bp, Homo sapiens
agatgttcccccat

SEQ ID NO: 2925252 - DNA, 22 bp, Homo sapiens
agatgttgagaaacctgggctc

SEQ ID NO: 2925253 - DNA, 17 bp, Homo sapiens
agatgttgccatgtgtt

SEQ ID NO: 2925254 - DNA, 21 bp, Homo sapiens
agatgtttccagacttccttg

SEQ ID NO: 2925255 - DNA, 23 bp, Homo sapiens
agatgtttccagacttccttgag

SEQ ID NO: 2925256 - DNA, 20 bp, Homo sapiens
agatgtttgtttacataaga

SEQ ID NO: 2925257 - DNA, 11 bp, Homo sapiens
agatgttttaa

SEQ ID NO: 2925258 - DNA, 12 bp, Homo sapiens
agatgttttaac

SEQ ID NO: 2925259 - DNA, 14 bp, Homo sapiens
agatgttttaactt

SEQ ID NO: 2925260 - DNA, 15 bp, Homo sapiens
agatgttttaactta

SEQ ID NO: 2925261 - DNA, 20 bp, Homo sapiens
agatgttttacgcaaggaag

SEQ ID NO: 2925262 - DNA, 17 bp, Homo sapiens
agatgttttacgtctgg

SEQ ID NO: 2925263 - DNA, 21 bp, Homo sapiens
agattaaaaattataggaata

SEQ ID NO: 2925264 - DNA, 11 bp, Homo sapiens
agattaatatt

SEQ ID NO: 2925265 - DNA, 20 bp, Homo sapiens
agattatagattctaaagat

SEQ ID NO: 2925266 - DNA, 23 bp, Homo sapiens
agattatagattctaaagattct

SEQ ID NO: 2925267 - DNA, 20 bp, Homo sapiens
agccaacagctacaacagcc

SEQ ID NO: 2925268 - DNA, 21 bp, Homo sapiens
agccaacattgccttgcattt

SEQ ID NO: 2925269 - DNA, 15 bp, Homo sapiens
agccaaccagccttt

SEQ ID NO: 2925270 - DNA, 20 bp, Homo sapiens
agccaacgagattgctggaa

SEQ ID NO: 2925271 - DNA, 16 bp, Homo sapiens
agccaactagcccctg

SEQ ID NO: 2925272 - DNA, 15 bp, Homo sapiens
agccaactctcccaa

SEQ ID NO: 2925273 - DNA, 18 bp, Homo sapiens
agccaagatcgcaccact

SEQ ID NO: 2925274 - DNA, 16 bp, Homo sapiens
agccaagcacagtggt

SEQ ID NO: 2925275 - DNA, 17 bp, Homo sapiens
agccaagcacagtggtg

SEQ ID NO: 2925276 - DNA, 21 bp, Homo sapiens
agccaagcacagtggtggcag

SEQ ID NO: 2925277 - DNA, 23 bp, Homo sapiens
agccaagctccttgggaggcccc

SEQ ID NO: 2925278 - DNA, 17 bp, Homo sapiens
agccaagttatacccaa

SEQ ID NO: 2925279 - DNA, 20 bp, Homo sapiens
agccaatctggacacttctt

SEQ ID NO: 2925280 - DNA, 21 bp, Homo sapiens
agccaatctggacacttcttt

SEQ ID NO: 2925281 - DNA, 17 bp, Homo sapiens
agccaatttgtctccta

SEQ ID NO: 2925282 - DNA, 10 bp, Homo sapiens
agccacacac

SEQ ID NO: 2925283 - DNA, 12 bp, Homo sapiens
agccacacacac

SEQ ID NO: 2925284 - DNA, 13 bp, Homo sapiens
agccacacacaca

SEQ ID NO: 2925285 - DNA, 15 bp, Homo sapiens
agccacacacacaga

SEQ ID NO: 2925286 - DNA, 13 bp, Homo sapiens
agccacaccagga

SEQ ID NO: 2925287 - DNA, 24 bp, Homo sapiens
agccacaccaggatagagactgga

SEQ ID NO: 2925288 - DNA, 22 bp, Homo sapiens
agccacacgcaggcggccaggg

SEQ ID NO: 2925289 - DNA, 17 bp, Homo sapiens
agccacagcccaggcct

SEQ ID NO: 2925290 - DNA, 19 bp, Homo sapiens
agccacagcccaggcctcc

SEQ ID NO: 2925291 - DNA, 12 bp, Homo sapiens
agccacaggaac

SEQ ID NO: 2925292 - DNA, 16 bp, Homo sapiens
agccacaggaacggcc

SEQ ID NO: 2925293 - DNA, 21 bp, Homo sapiens
agccacaggaacggccctgca

SEQ ID NO: 2925294 - DNA, 15 bp, Homo sapiens
agccacaggagccct

SEQ ID NO: 2925295 - DNA, 20 bp, Homo sapiens
agccacagtgagggagatcc

SEQ ID NO: 2925296 - DNA, 14 bp, Homo sapiens
agccacatgcccca

SEQ ID NO: 2925297 - DNA, 19 bp, Homo sapiens
agccacatgccccaggctc

SEQ ID NO: 2925298 - DNA, 15 bp, Homo sapiens
agccacatttggaat

SEQ ID NO: 2925299 - DNA, 15 bp, Homo sapiens
agccaccacacctgg

SEQ ID NO: 2925300 - DNA, 17 bp, Homo sapiens
agccaccacacctggct

SEQ ID NO: 2925301 - DNA, 19 bp, Homo sapiens
agccaccctcccagctctg

SEQ ID NO: 2925302 - DNA, 20 bp, Homo sapiens
agccaccctcccagctctga

SEQ ID NO: 2925303 - DNA, 13 bp, Homo sapiens
agccacccttccc

SEQ ID NO: 2925304 - DNA, 15 bp, Homo sapiens
agccacccttccctg

SEQ ID NO: 2925305 - DNA, 15 bp, Homo sapiens
agccaccgaagccgc

SEQ ID NO: 2925306 - DNA, 12 bp, Homo sapiens
agccaccgcagc

SEQ ID NO: 2925307 - DNA, 14 bp, Homo sapiens
agccacctctcttt

SEQ ID NO: 2925308 - DNA, 18 bp, Homo sapiens
agccacctctctttttca

SEQ ID NO: 2925309 - DNA, 17 bp, Homo sapiens
agccacgaacagcccgc

SEQ ID NO: 2925310 - DNA, 23 bp, Homo sapiens
agccacgttccttactgcagaat

SEQ ID NO: 2925311 - DNA, 15 bp, Homo sapiens
agccactccaagccc

SEQ ID NO: 2925312 - DNA, 19 bp, Homo sapiens
agccactccaagccccctg

SEQ ID NO: 2925313 - DNA, 20 bp, Homo sapiens
agccactccaagccccctgg

SEQ ID NO: 2925314 - DNA, 19 bp, Homo sapiens
agccactcccctccactct

SEQ ID NO: 2925315 - DNA, 12 bp, Homo sapiens
agccactcctct

SEQ ID NO: 2925316 - DNA, 15 bp, Homo sapiens
agccactcctctgac

SEQ ID NO: 2925317 - DNA, 21 bp, Homo sapiens
agccactcctctgactcaggg

SEQ ID NO: 2925318 - DNA, 22 bp, Homo sapiens
agccactctaccagtgcaggct

SEQ ID NO: 2925319 - DNA, 12 bp, Homo sapiens
agccactggaag

SEQ ID NO: 2925320 - DNA, 14 bp, Homo sapiens
agccactggaagga

SEQ ID NO: 2925321 - DNA, 19 bp, Homo sapiens
agccactggaaggagcaca

SEQ ID NO: 2925322 - DNA, 20 bp, Homo sapiens
agccactggaaggagcacat

SEQ ID NO: 2925323 - DNA, 13 bp, Homo sapiens
agccagaaattga

SEQ ID NO: 2925324 - DNA, 22 bp, Homo sapiens
agccagaacttgaccctgagct

SEQ ID NO: 2925325 - DNA, 12 bp, Homo sapiens
agccagaagctg

SEQ ID NO: 2925326 - DNA, 20 bp, Homo sapiens
agccagaagctgagcaccag

SEQ ID NO: 2925327 - DNA, 12 bp, Homo sapiens
agccagagaagg

SEQ ID NO: 2925328 - DNA, 17 bp, Homo sapiens
agccagagaagtgacag

SEQ ID NO: 2925329 - DNA, 21 bp, Homo sapiens
agccagagaagtgacagggaa

SEQ ID NO: 2925330 - DNA, 18 bp, Homo sapiens
agccagattggccaatta

SEQ ID NO: 2925331 - DNA, 18 bp, Homo sapiens
agccagattttttaaaat

SEQ ID NO: 2925332 - DNA, 15 bp, Homo sapiens
agccagcacacaggg

SEQ ID NO: 2925333 - DNA, 17 bp, Homo sapiens
agccagcacacagggca

SEQ ID NO: 2925334 - DNA, 20 bp, Homo sapiens
agccagcacttgtccagctg

SEQ ID NO: 2925335 - DNA, 21 bp, Homo sapiens
agccagcacttgtccagctga

SEQ ID NO: 2925336 - DNA, 15 bp, Homo sapiens
agccagccacccctg

SEQ ID NO: 2925337 - DNA, 19 bp, Homo sapiens
agccagcccaaaccttggg

SEQ ID NO: 2925338 - DNA, 20 bp, Homo sapiens
agccagcccaaaccttgggc

SEQ ID NO: 2925339 - DNA, 15 bp, Homo sapiens
agccagcccagccca

SEQ ID NO: 2925340 - DNA, 16 bp, Homo sapiens
agccagccctccctgt

SEQ ID NO: 2925341 - DNA, 20 bp, Homo sapiens
agccagccctccctgtcctc

SEQ ID NO: 2925342 - DNA, 11 bp, Homo sapiens
agccagccttg

SEQ ID NO: 2925343 - DNA, 12 bp, Homo sapiens
agccagccttgg

SEQ ID NO: 2925344 - DNA, 18 bp, Homo sapiens
agccagcgtcctcctctg

SEQ ID NO: 2925345 - DNA, 17 bp, Homo sapiens
agccagctccctctatt

SEQ ID NO: 2925346 - DNA, 17 bp, Homo sapiens
agccaggaatttcccag

SEQ ID NO: 2925347 - DNA, 17 bp, Homo sapiens
agccaggagaaggtcag

SEQ ID NO: 2925348 - DNA, 12 bp, Homo sapiens
agccaggcctcg

SEQ ID NO: 2925349 - DNA, 15 bp, Homo sapiens
agccaggcctcgcct

SEQ ID NO: 2925350 - DNA, 21 bp, Homo sapiens
agccaggcctcgcctgccctc

SEQ ID NO: 2925351 - DNA, 22 bp, Homo sapiens
agccaggcctcgcctgccctcc

SEQ ID NO: 2925352 - DNA, 20 bp, Homo sapiens
agccaggctagctggagcct

SEQ ID NO: 2925353 - DNA, 22 bp, Homo sapiens
agccaggctgggccgcaagggc

SEQ ID NO: 2925354 - DNA, 18 bp, Homo sapiens
agccaggtccccctgcag

SEQ ID NO: 2925355 - DNA, 20 bp, Homo sapiens
agccaggtccccctgcagct

SEQ ID NO: 2925356 - DNA, 17 bp, Homo sapiens
agccagtcatcatctct

SEQ ID NO: 2925357 - DNA, 21 bp, Homo sapiens
agccagtcatcatctcttgat

SEQ ID NO: 2925358 - DNA, 17 bp, Homo sapiens
agccagtgacctgagga

SEQ ID NO: 2925359 - DNA, 22 bp, Homo sapiens
agccagttgcttcttcagctga

SEQ ID NO: 2925360 - DNA, 20 bp, Homo sapiens
agccagttgtcctatggaca

SEQ ID NO: 2925361 - DNA, 20 bp, Homo sapiens
agccatagagatatttaaaa

SEQ ID NO: 2925362 - DNA, 21 bp, Homo sapiens
agccatagtttgggtattttt

SEQ ID NO: 2925363 - DNA, 14 bp, Homo sapiens
agccatatggacac

SEQ ID NO: 2925364 - DNA, 15 bp, Homo sapiens
agccatatggacact

SEQ ID NO: 2925365 - DNA, 13 bp, Homo sapiens
agccatcaaaatg

SEQ ID NO: 2925366 - DNA, 16 bp, Homo sapiens
agccatcaaaatgctt

SEQ ID NO: 2925367 - DNA, 18 bp, Homo sapiens
agccatcaaaatgctttt

SEQ ID NO: 2925368 - DNA, 17 bp, Homo sapiens
agccatcaagagactga

SEQ ID NO: 2925369 - DNA, 20 bp, Homo sapiens
agccatcaagcacttcccag

SEQ ID NO: 2925370 - DNA, 23 bp, Homo sapiens
agccatctaatgcttgtttatga

SEQ ID NO: 2925371 - DNA, 16 bp, Homo sapiens
agccatctcaggttgg

SEQ ID NO: 2925372 - DNA, 22 bp, Homo sapiens
agccatcttcccgcctcagcct

SEQ ID NO: 2925373 - DNA, 23 bp, Homo sapiens
agccatcttcccgcctcagcctc

SEQ ID NO: 2925374 - DNA, 19 bp, Homo sapiens
agccatgaggagttgctgt

SEQ ID NO: 2925375 - DNA, 20 bp, Homo sapiens
agccatgaggagttgctgtt

SEQ ID NO: 2925376 - DNA, 24 bp, Homo sapiens
agccatgcgcgcgctctctctctt

SEQ ID NO: 2925377 - DNA, 17 bp, Homo sapiens
agccatggaaggtgcca

SEQ ID NO: 2925378 - DNA, 20 bp, Homo sapiens
agccatgtacagacagagaa

SEQ ID NO: 2925379 - DNA, 14 bp, Homo sapiens
agccatgtctgcat

SEQ ID NO: 2925380 - DNA, 15 bp, Homo sapiens
agccatgtctgcatt

SEQ ID NO: 2925381 - DNA, 19 bp, Homo sapiens
agccattctgcctttgccg

SEQ ID NO: 2925382 - DNA, 18 bp, Homo sapiens
agccatttctaagcagat

SEQ ID NO: 2925383 - DNA, 12 bp, Homo sapiens
agccatttttag

SEQ ID NO: 2925384 - DNA, 22 bp, Homo sapiens
agccatttttcaatttttcttt

SEQ ID NO: 2925385 - DNA, 23 bp, Homo sapiens
agcccaacagacaccatcttttg

SEQ ID NO: 2925386 - DNA, 16 bp, Homo sapiens
agcccaatccaggtac

SEQ ID NO: 2925387 - DNA, 22 bp, Homo sapiens
agcccaatccaggtacgcacag

SEQ ID NO: 2925388 - DNA, 14 bp, Homo sapiens
agcccacagagcct

SEQ ID NO: 2925389 - DNA, 16 bp, Homo sapiens
agcccacagagcctga

SEQ ID NO: 2925390 - DNA, 14 bp, Homo sapiens
agcccaccaggagc

SEQ ID NO: 2925391 - DNA, 24 bp, Homo sapiens
agcccaccaggagcacctggaccc

SEQ ID NO: 2925392 - DNA, 13 bp, Homo sapiens
agcccacccagca

SEQ ID NO: 2925393 - DNA, 18 bp, Homo sapiens
agcccacctcggccctcc

SEQ ID NO: 2925394 - DNA, 10 bp, Homo sapiens
agcccacctg

SEQ ID NO: 2925395 - DNA, 22 bp, Homo sapiens
agcccacctgaaagcctgtctc

SEQ ID NO: 2925396 - DNA, 14 bp, Homo sapiens
agcccactctgctc

SEQ ID NO: 2925397 - DNA, 23 bp, Homo sapiens
agcccactgcctcctccctggct

SEQ ID NO: 2925398 - DNA, 20 bp, Homo sapiens
agcccactgtcctgggcctg

SEQ ID NO: 2925399 - DNA, 14 bp, Homo sapiens
agctcttgtttctg

SEQ ID NO: 2925400 - DNA, 12 bp, Homo sapiens
agctcttgtttg

SEQ ID NO: 2925401 - DNA, 23 bp, Homo sapiens
agctctttgagataatacattcc

SEQ ID NO: 2925402 - DNA, 18 bp, Homo sapiens
agctgaaaaaactatatt

SEQ ID NO: 2925403 - DNA, 22 bp, Homo sapiens
agctgaaaacctaagtccttta

SEQ ID NO: 2925404 - DNA, 22 bp, Homo sapiens
agctgaaaaggatcgaggcatg

SEQ ID NO: 2925405 - DNA, 21 bp, Homo sapiens
agctgaacaataggctgttcc

SEQ ID NO: 2925406 - DNA, 15 bp, Homo sapiens
agctgaagagcaagg

SEQ ID NO: 2925407 - DNA, 16 bp, Homo sapiens
agctgacattgccaaa

SEQ ID NO: 2925408 - DNA, 18 bp, Homo sapiens
agctgacattgccaaaaa

SEQ ID NO: 2925409 - DNA, 22 bp, Homo sapiens
agctgaccagccgtgagcatgt

SEQ ID NO: 2925410 - DNA, 13 bp, Homo sapiens
agctgaccccctc

SEQ ID NO: 2925411 - DNA, 17 bp, Homo sapiens
agctgagaagaggagga

SEQ ID NO: 2925412 - DNA, 20 bp, Homo sapiens
agctgagaagaggaggaggt

SEQ ID NO: 2925413 - DNA, 21 bp, Homo sapiens
agctgagatcgtgccactgca

SEQ ID NO: 2925414 - DNA, 15 bp, Homo sapiens
agctgagcaccaggg

SEQ ID NO: 2925415 - DNA, 12 bp, Homo sapiens
agctgagccagg

SEQ ID NO: 2925416 - DNA, 13 bp, Homo sapiens
agctgagccaggc

SEQ ID NO: 2925417 - DNA, 14 bp, Homo sapiens
agctgagcctgcag

SEQ ID NO: 2925418 - DNA, 14 bp, Homo sapiens
agctgagcgccagg

SEQ ID NO: 2925419 - DNA, 16 bp, Homo sapiens
agctgaggactctgca

SEQ ID NO: 2925420 - DNA, 18 bp, Homo sapiens
agctgaggactctgcaag

SEQ ID NO: 2925421 - DNA, 15 bp, Homo sapiens
agctgaggcagcagt

SEQ ID NO: 2925422 - DNA, 17 bp, Homo sapiens
agctgaggcagcagtgt

SEQ ID NO: 2925423 - DNA, 22 bp, Homo sapiens
agctgaggccacactcagcaca

SEQ ID NO: 2925424 - DNA, 16 bp, Homo sapiens
agctgaggcctccctt

SEQ ID NO: 2925425 - DNA, 18 bp, Homo sapiens
agctgaggctgagaaagc

SEQ ID NO: 2925426 - DNA, 19 bp, Homo sapiens
agctgaggctgagaaagct

SEQ ID NO: 2925427 - DNA, 21 bp, Homo sapiens
agctgagggagggagccatgg

SEQ ID NO: 2925428 - DNA, 21 bp, Homo sapiens
agctgagggccctgtggagtc

SEQ ID NO: 2925429 - DNA, 24 bp, Homo sapiens
agctgagggccctgtggagtccag

SEQ ID NO: 2925430 - DNA, 22 bp, Homo sapiens
agctgatgtgagtgtgtgtgat

SEQ ID NO: 2925431 - DNA, 19 bp, Homo sapiens
agctgcaaagtgttttgta

SEQ ID NO: 2925432 - DNA, 19 bp, Homo sapiens
agctgcactgatgctgccc

SEQ ID NO: 2925433 - DNA, 22 bp, Homo sapiens
agctgcactgatgctgcccctc

SEQ ID NO: 2925434 - DNA, 19 bp, Homo sapiens
agctgcatttcacatgcct

SEQ ID NO: 2925435 - DNA, 11 bp, Homo sapiens
agctgccactg

SEQ ID NO: 2925436 - DNA, 15 bp, Homo sapiens
agctgccactgggca

SEQ ID NO: 2925437 - DNA, 20 bp, Homo sapiens
agctgccactgggcacctgc

SEQ ID NO: 2925438 - DNA, 23 bp, Homo sapiens
agctgccactgggcacctgcgca

SEQ ID NO: 2925439 - DNA, 16 bp, Homo sapiens
agctgccatcttgctt

SEQ ID NO: 2925440 - DNA, 22 bp, Homo sapiens
agctgcccatttcgtgagcccc

SEQ ID NO: 2925441 - DNA, 16 bp, Homo sapiens
agctgccccggcccct

SEQ ID NO: 2925442 - DNA, 14 bp, Homo sapiens
agctgcccctcctg

SEQ ID NO: 2925443 - DNA, 20 bp, Homo sapiens
agctgcccctcctggagcag

SEQ ID NO: 2925444 - DNA, 20 bp, Homo sapiens
agctgcccctggcacctgtg

SEQ ID NO: 2925445 - DNA, 19 bp, Homo sapiens
agctgcccggcgcctgccc

SEQ ID NO: 2925446 - DNA, 16 bp, Homo sapiens
agctgccctaaataac

SEQ ID NO: 2925447 - DNA, 22 bp, Homo sapiens
agctgccctaaataacccttca

SEQ ID NO: 2925448 - DNA, 14 bp, Homo sapiens
agctgcctccccaa

SEQ ID NO: 2925449 - DNA, 18 bp, Homo sapiens
agctgcctctgacagcag

SEQ ID NO: 2925450 - DNA, 10 bp, Homo sapiens
agctgcctgc

SEQ ID NO: 2925451 - DNA, 13 bp, Homo sapiens
agctgcctgcagc

SEQ ID NO: 2925452 - DNA, 23 bp, Homo sapiens
agctgcctggccatgctgtccct

SEQ ID NO: 2925453 - DNA, 16 bp, Homo sapiens
agctgccttagcttca

SEQ ID NO: 2925454 - DNA, 18 bp, Homo sapiens
agctgccttagcttcagg

SEQ ID NO: 2925455 - DNA, 23 bp, Homo sapiens
agctgccttagcttcaggaacct

SEQ ID NO: 2925456 - DNA, 20 bp, Homo sapiens
agctgccttggctcagacat

SEQ ID NO: 2925457 - DNA, 19 bp, Homo sapiens
agctgctacaaagaagaca

SEQ ID NO: 2925458 - DNA, 14 bp, Homo sapiens
agctgctaccttct

SEQ ID NO: 2925459 - DNA, 16 bp, Homo sapiens
agctgctatagcctgg

SEQ ID NO: 2925460 - DNA, 15 bp, Homo sapiens
agctgctcagagcca

SEQ ID NO: 2925461 - DNA, 16 bp, Homo sapiens
agctgctcagggaaaa

SEQ ID NO: 2925462 - DNA, 21 bp, Homo sapiens
agctgctcagggaaaagcagc

SEQ ID NO: 2925463 - DNA, 14 bp, Homo sapiens
agctgctccccacg

SEQ ID NO: 2925464 - DNA, 18 bp, Homo sapiens
agctgctcctagagggag

SEQ ID NO: 2925465 - DNA, 22 bp, Homo sapiens
agctgctcctagagggaggggc

SEQ ID NO: 2925466 - DNA, 16 bp, Homo sapiens
agctgctgagtgacag

SEQ ID NO: 2925467 - DNA, 16 bp, Homo sapiens
agctgctgcagccctg

SEQ ID NO: 2925468 - DNA, 21 bp, Homo sapiens
agctgctgcagccctgccagt

SEQ ID NO: 2925469 - DNA, 15 bp, Homo sapiens
agctgctgccactct

SEQ ID NO: 2925470 - DNA, 12 bp, Homo sapiens
agctgctggagc

SEQ ID NO: 2925471 - DNA, 23 bp, Homo sapiens
agctgcttgttgtcaagtataaa

SEQ ID NO: 2925472 - DNA, 17 bp, Homo sapiens
agctggagaaatatggt

SEQ ID NO: 2925473 - DNA, 15 bp, Homo sapiens
agctggagtgctgct

SEQ ID NO: 2925474 - DNA, 14 bp, Homo sapiens
agctggatgagaat

SEQ ID NO: 2925475 - DNA, 21 bp, Homo sapiens
agctggccaaagagcctttcc

SEQ ID NO: 2925476 - DNA, 13 bp, Homo sapiens
agctggccaagga

SEQ ID NO: 2925477 - DNA, 13 bp, Homo sapiens
agctggccccgcc

SEQ ID NO: 2925478 - DNA, 15 bp, Homo sapiens
agctggccccgccgc

SEQ ID NO: 2925479 - DNA, 18 bp, Homo sapiens
agctggccccgccgcctg

SEQ ID NO: 2925480 - DNA, 14 bp, Homo sapiens
agctggctcacctt

SEQ ID NO: 2925481 - DNA, 13 bp, Homo sapiens
agctggctggggt

SEQ ID NO: 2925482 - DNA, 15 bp, Homo sapiens
agctggctggggtgg

SEQ ID NO: 2925483 - DNA, 20 bp, Homo sapiens
agctggctggggtggcctgt

SEQ ID NO: 2925484 - DNA, 22 bp, Homo sapiens
agctggctgtacctgttcctcc

SEQ ID NO: 2925485 - DNA, 14 bp, Homo sapiens
agctgggaaattca

SEQ ID NO: 2925486 - DNA, 16 bp, Homo sapiens
agctgggcagtgccag

SEQ ID NO: 2925487 - DNA, 13 bp, Homo sapiens
agctgggcccaca

SEQ ID NO: 2925488 - DNA, 14 bp, Homo sapiens
agctgggcccacag

SEQ ID NO: 2925489 - DNA, 16 bp, Homo sapiens
agctgggcccacagcc

SEQ ID NO: 2925490 - DNA, 22 bp, Homo sapiens
agctgggcccacagcccccacc

SEQ ID NO: 2925491 - DNA, 23 bp, Homo sapiens
agctgggcccacagcccccaccc

SEQ ID NO: 2925492 - DNA, 11 bp, Homo sapiens
agctgggcccg

SEQ ID NO: 2925493 - DNA, 18 bp, Homo sapiens
agctggggaggtgggagg

SEQ ID NO: 2925494 - DNA, 22 bp, Homo sapiens
agctggggaggtgggaggccag

SEQ ID NO: 2925495 - DNA, 18 bp, Homo sapiens
agctgggggtgggccagg

SEQ ID NO: 2925496 - DNA, 14 bp, Homo sapiens
agctgggggtgggg

SEQ ID NO: 2925497 - DNA, 15 bp, Homo sapiens
agctgggtcaggcag

SEQ ID NO: 2925498 - DNA, 12 bp, Homo sapiens
agctggtgccaa

SEQ ID NO: 2925499 - DNA, 13 bp, Homo sapiens
agctggtgcctgc

SEQ ID NO: 2925500 - DNA, 12 bp, Homo sapiens
agctggtggatg

SEQ ID NO: 2925501 - DNA, 14 bp, Homo sapiens
agctggtttcctgc

SEQ ID NO: 2925502 - DNA, 15 bp, Homo sapiens
agctggtttcctgcc

SEQ ID NO: 2925503 - DNA, 16 bp, Homo sapiens
agctggtttcctgccc

SEQ ID NO: 2925504 - DNA, 22 bp, Homo sapiens
agctgtatgatttgttttgaat

SEQ ID NO: 2925505 - DNA, 11 bp, Homo sapiens
agctgtattga

SEQ ID NO: 2925506 - DNA, 15 bp, Homo sapiens
agctgtattgaatca

SEQ ID NO: 2925507 - DNA, 19 bp, Homo sapiens
agctgtattgaatcatgta

SEQ ID NO: 2925508 - DNA, 15 bp, Homo sapiens
agctgtcacaacttg

SEQ ID NO: 2925509 - DNA, 18 bp, Homo sapiens
agctgtcacaacttgtgt

SEQ ID NO: 2925510 - DNA, 11 bp, Homo sapiens
agctgtcccaa

SEQ ID NO: 2925511 - DNA, 18 bp, Homo sapiens
agctgtccctgtcaccaa

SEQ ID NO: 2925512 - DNA, 18 bp, Homo sapiens
agctgtcgggggccactg

SEQ ID NO: 2925513 - DNA, 22 bp, Homo sapiens
agctgtcgggggccactgtgtt

SEQ ID NO: 2925514 - DNA, 17 bp, Homo sapiens
agctgtgacattgctgg

SEQ ID NO: 2925515 - DNA, 20 bp, Homo sapiens
agctgtgacattgctggtca

SEQ ID NO: 2925516 - DNA, 21 bp, Homo sapiens
agctgtgacattgctggtcat

SEQ ID NO: 2925517 - DNA, 21 bp, Homo sapiens
agctgtgagacagtgggaaat

SEQ ID NO: 2925518 - DNA, 21 bp, Homo sapiens
agctgtgcaattactgcctgc

SEQ ID NO: 2925519 - DNA, 19 bp, Homo sapiens
agctgtgcaggtggggaga

SEQ ID NO: 2925520 - DNA, 13 bp, Homo sapiens
agctgtgcccctc

SEQ ID NO: 2925521 - DNA, 18 bp, Homo sapiens
agctgtgcccctccccca

SEQ ID NO: 2925522 - DNA, 14 bp, Homo sapiens
agctgtggtcccac

SEQ ID NO: 2925523 - DNA, 19 bp, Homo sapiens
agctgtggtcccacccagg

SEQ ID NO: 2925524 - DNA, 15 bp, Homo sapiens
agctgtgtccttgca

SEQ ID NO: 2925525 - DNA, 18 bp, Homo sapiens
agctgtgtgctctccaag

SEQ ID NO: 2925526 - DNA, 18 bp, Homo sapiens
agctgtgttaactgttca

SEQ ID NO: 2925527 - DNA, 17 bp, Homo sapiens
agctgtgttacttgaag

SEQ ID NO: 2925528 - DNA, 19 bp, Homo sapiens
agctgtgttacttgaagta

SEQ ID NO: 2925529 - DNA, 22 bp, Homo sapiens
agctgtgttcatccagctactt

SEQ ID NO: 2925530 - DNA, 14 bp, Homo sapiens
agctgtgttgaaac

SEQ ID NO: 2925531 - DNA, 23 bp, Homo sapiens
agctgttaaagatatttttattc

SEQ ID NO: 2925532 - DNA, 14 bp, Homo sapiens
aggagcaacgccag

SEQ ID NO: 2925533 - DNA, 23 bp, Homo sapiens
aggagcaagggtggccttgaaga

SEQ ID NO: 2925534 - DNA, 16 bp, Homo sapiens
aggagcaatcacagga

SEQ ID NO: 2925535 - DNA, 22 bp, Homo sapiens
aggagcacatactacctagaag

SEQ ID NO: 2925536 - DNA, 19 bp, Homo sapiens
aggagcacctggaccccct

SEQ ID NO: 2925537 - DNA, 22 bp, Homo sapiens
aggagcacctggaccccctgcc

SEQ ID NO: 2925538 - DNA, 13 bp, Homo sapiens
aggagcagagagg

SEQ ID NO: 2925539 - DNA, 19 bp, Homo sapiens
aggagcagggcggctgccg

SEQ ID NO: 2925540 - DNA, 15 bp, Homo sapiens
aggagccagagaagg

SEQ ID NO: 2925541 - DNA, 11 bp, Homo sapiens
aggagcccagt

SEQ ID NO: 2925542 - DNA, 20 bp, Homo sapiens
aggagcccagtgggctgcac

SEQ ID NO: 2925543 - DNA, 15 bp, Homo sapiens
aggagccccattcct

SEQ ID NO: 2925544 - DNA, 18 bp, Homo sapiens
aggagccccattcctggg

SEQ ID NO: 2925545 - DNA, 18 bp, Homo sapiens
aggagcccccagctgcca

SEQ ID NO: 2925546 - DNA, 16 bp, Homo sapiens
aggagcccctgagtcc

SEQ ID NO: 2925547 - DNA, 21 bp, Homo sapiens
aggagcccttatctgtgctca

SEQ ID NO: 2925548 - DNA, 19 bp, Homo sapiens
aggagccggacacttctca

SEQ ID NO: 2925549 - DNA, 23 bp, Homo sapiens
aggagccggacacttctcaggaa

SEQ ID NO: 2925550 - DNA, 13 bp, Homo sapiens
aggagcctcagaa

SEQ ID NO: 2925551 - DNA, 20 bp, Homo sapiens
aggagcctcagaagaaaaca

SEQ ID NO: 2925552 - DNA, 20 bp, Homo sapiens
aggagcggcgccctggactt

SEQ ID NO: 2925553 - DNA, 13 bp, Homo sapiens
aggagcgggcagg

SEQ ID NO: 2925554 - DNA, 17 bp, Homo sapiens
aggagcgggcagggccg

SEQ ID NO: 2925555 - DNA, 12 bp, Homo sapiens
aggagctaaggc

SEQ ID NO: 2925556 - DNA, 13 bp, Homo sapiens
aggagctaaggct

SEQ ID NO: 2925557 - DNA, 16 bp, Homo sapiens
aggagctaaggctcta

SEQ ID NO: 2925558 - DNA, 19 bp, Homo sapiens
aggagctctgcgccaggca

SEQ ID NO: 2925559 - DNA, 20 bp, Homo sapiens
aggagctctgcgccaggcag

SEQ ID NO: 2925560 - DNA, 21 bp, Homo sapiens
aggagctctgcgccaggcaga

SEQ ID NO: 2925561 - DNA, 15 bp, Homo sapiens
aggagctgagggagg

SEQ ID NO: 2925562 - DNA, 19 bp, Homo sapiens
aggagctgagggagggagc

SEQ ID NO: 2925563 - DNA, 14 bp, Homo sapiens
aggagctgcctctt

SEQ ID NO: 2925564 - DNA, 18 bp, Homo sapiens
aggagctgccttggctca

SEQ ID NO: 2925565 - DNA, 22 bp, Homo sapiens
aggagctgccttggctcagaca

SEQ ID NO: 2925566 - DNA, 23 bp, Homo sapiens
aggagctgccttggctcagacat

SEQ ID NO: 2925567 - DNA, 21 bp, Homo sapiens
aggagctgctatagcctgggg

SEQ ID NO: 2925568 - DNA, 21 bp, Homo sapiens
aggagctgtcaccaaggaaac

SEQ ID NO: 2925569 - DNA, 11 bp, Homo sapiens
aggagcttcct

SEQ ID NO: 2925570 - DNA, 20 bp, Homo sapiens
aggagcttcctgtcctccca

SEQ ID NO: 2925571 - DNA, 15 bp, Homo sapiens
aggaggaagtcatgg

SEQ ID NO: 2925572 - DNA, 11 bp, Homo sapiens
aggaggagaaa

SEQ ID NO: 2925573 - DNA, 16 bp, Homo sapiens
aggaggagcttctggg

SEQ ID NO: 2925574 - DNA, 21 bp, Homo sapiens
aggaggcaaatggcactgcag

SEQ ID NO: 2925575 - DNA, 17 bp, Homo sapiens
aggaggcgcggcctccc

SEQ ID NO: 2925576 - DNA, 14 bp, Homo sapiens
aggaggctgagaca

SEQ ID NO: 2925577 - DNA, 16 bp, Homo sapiens
aggaggctgaggcaga

SEQ ID NO: 2925578 - DNA, 13 bp, Homo sapiens
aggaggctgccct

SEQ ID NO: 2925579 - DNA, 15 bp, Homo sapiens
aggaggctgccctga

SEQ ID NO: 2925580 - DNA, 16 bp, Homo sapiens
aggagggagaaaggag

SEQ ID NO: 2925581 - DNA, 22 bp, Homo sapiens
aggagggcgtgactcacccaag

SEQ ID NO: 2925582 - DNA, 16 bp, Homo sapiens
aggagggcgttcttag

SEQ ID NO: 2925583 - DNA, 19 bp, Homo sapiens
aggaggggaaaaaaatgtt

SEQ ID NO: 2925584 - DNA, 16 bp, Homo sapiens
aggaggggaacactgc

SEQ ID NO: 2925585 - DNA, 23 bp, Homo sapiens
aggaggggcccccctgccctgtg

SEQ ID NO: 2925586 - DNA, 22 bp, Homo sapiens
aggaggtgggggctggaggtgc

SEQ ID NO: 2925587 - DNA, 21 bp, Homo sapiens
aggagtaatctgtgtacaaag

SEQ ID NO: 2925588 - DNA, 17 bp, Homo sapiens
aggagtcaactggctgg

SEQ ID NO: 2925589 - DNA, 19 bp, Homo sapiens
aggagtcaatttgcctctg

SEQ ID NO: 2925590 - DNA, 19 bp, Homo sapiens
aggagtcaccatgcaaggg

SEQ ID NO: 2925591 - DNA, 23 bp, Homo sapiens
aggagtcagccatgtctgtgctg

SEQ ID NO: 2925592 - DNA, 21 bp, Homo sapiens
aggagtggttgggctgtgcct

SEQ ID NO: 2925593 - DNA, 21 bp, Homo sapiens
aggagttgggggcaggtcagg

SEQ ID NO: 2925594 - DNA, 20 bp, Homo sapiens
aggagtttgagaccaggctg

SEQ ID NO: 2925595 - DNA, 16 bp, Homo sapiens
aggagtttgaggctgc

SEQ ID NO: 2925596 - DNA, 21 bp, Homo sapiens
aggagtttgtgtgtcttttat

SEQ ID NO: 2925597 - DNA, 19 bp, Homo sapiens
aggataaaaaggaaggaga

SEQ ID NO: 2925598 - DNA, 21 bp, Homo sapiens
aggataaaaaggaaggagaga

SEQ ID NO: 2925599 - DNA, 18 bp, Homo sapiens
aggataatgaaataatca

SEQ ID NO: 2925600 - DNA, 16 bp, Homo sapiens
aggatactcaaagtgg

SEQ ID NO: 2925601 - DNA, 14 bp, Homo sapiens
aggatagatgctgg

SEQ ID NO: 2925602 - DNA, 20 bp, Homo sapiens
aggatagatgctggcccagg

SEQ ID NO: 2925603 - DNA, 23 bp, Homo sapiens
aggatagctaactgtaaatcatg

SEQ ID NO: 2925604 - DNA, 15 bp, Homo sapiens
aggatatcagagctg

SEQ ID NO: 2925605 - DNA, 18 bp, Homo sapiens
aggatatcagagctggga

SEQ ID NO: 2925606 - DNA, 14 bp, Homo sapiens
aggatatttctaca

SEQ ID NO: 2925607 - DNA, 20 bp, Homo sapiens
aggatatttctacaaggtgt

SEQ ID NO: 2925608 - DNA, 19 bp, Homo sapiens
aggatattttgtcaccaga

SEQ ID NO: 2925609 - DNA, 16 bp, Homo sapiens
aggatcacagattttt

SEQ ID NO: 2925610 - DNA, 19 bp, Homo sapiens
aggatcacctgaggtcagg

SEQ ID NO: 2925611 - DNA, 20 bp, Homo sapiens
aggatcatcatttaaaaaaa

SEQ ID NO: 2925612 - DNA, 18 bp, Homo sapiens
aggatcccctccaagcct

SEQ ID NO: 2925613 - DNA, 23 bp, Homo sapiens
aggatcccctgtcccctggggct

SEQ ID NO: 2925614 - DNA, 12 bp, Homo sapiens
aggatcgaggca

SEQ ID NO: 2925615 - DNA, 14 bp, Homo sapiens
aggatcgaggcatg

SEQ ID NO: 2925616 - DNA, 15 bp, Homo sapiens
aggatcgaggcatgg

SEQ ID NO: 2925617 - DNA, 18 bp, Homo sapiens
aggatctcgcctggaaac

SEQ ID NO: 2925618 - DNA, 19 bp, Homo sapiens
aggatctcgcctggaaaca

SEQ ID NO: 2925619 - DNA, 21 bp, Homo sapiens
aggatctcgcctggaaacaga

SEQ ID NO: 2925620 - DNA, 15 bp, Homo sapiens
aggatctgaaaactt

SEQ ID NO: 2925621 - DNA, 16 bp, Homo sapiens
aggatctgctccaaca

SEQ ID NO: 2925622 - DNA, 17 bp, Homo sapiens
aggatctttgtggccaa

SEQ ID NO: 2925623 - DNA, 18 bp, Homo sapiens
aggatgaaggctgtgaaa

SEQ ID NO: 2925624 - DNA, 19 bp, Homo sapiens
aggatgaattgtcacatct

SEQ ID NO: 2925625 - DNA, 20 bp, Homo sapiens
aggatgagctctacccaggg

SEQ ID NO: 2925626 - DNA, 13 bp, Homo sapiens
aggatgaggacag

SEQ ID NO: 2925627 - DNA, 23 bp, Homo sapiens
aggatgcagcgccgtgtcctctc

SEQ ID NO: 2925628 - DNA, 23 bp, Homo sapiens
aggatgcattctgataggagggg

SEQ ID NO: 2925629 - DNA, 21 bp, Homo sapiens
aggatgctcagttgctaaaca

SEQ ID NO: 2925630 - DNA, 15 bp, Homo sapiens
aggatgctgctgttg

SEQ ID NO: 2925631 - DNA, 22 bp, Homo sapiens
aggatggaaaaataaaacgcaa

SEQ ID NO: 2925632 - DNA, 14 bp, Homo sapiens
aggatggaacacgg

SEQ ID NO: 2925633 - DNA, 22 bp, Homo sapiens
aggatggcaggacgtgggctgg

SEQ ID NO: 2925634 - DNA, 20 bp, Homo sapiens
aggatgggaaaaactgcagt

SEQ ID NO: 2925635 - DNA, 22 bp, Homo sapiens
aggatgtaaacagtgcctgctg

SEQ ID NO: 2925636 - DNA, 16 bp, Homo sapiens
aggatgtagaaacaat

SEQ ID NO: 2925637 - DNA, 14 bp, Homo sapiens
aggatgtagctttt

SEQ ID NO: 2925638 - DNA, 15 bp, Homo sapiens
aggatgtagcttttc

SEQ ID NO: 2925639 - DNA, 18 bp, Homo sapiens
aggatgtagcttttcacc

SEQ ID NO: 2925640 - DNA, 19 bp, Homo sapiens
aggatgtagcttttcacct

SEQ ID NO: 2925641 - DNA, 19 bp, Homo sapiens
aggatgtgtttgctttctg

SEQ ID NO: 2925642 - DNA, 19 bp, Homo sapiens
aggattacagaaactgatg

SEQ ID NO: 2925643 - DNA, 18 bp, Homo sapiens
aggattccccctgccctg

SEQ ID NO: 2925644 - DNA, 22 bp, Homo sapiens
aggattccccctgccctgtgcc

SEQ ID NO: 2925645 - DNA, 23 bp, Homo sapiens
aggattccccctgccctgtgccg

SEQ ID NO: 2925646 - DNA, 11 bp, Homo sapiens
aggatttatac

SEQ ID NO: 2925647 - DNA, 14 bp, Homo sapiens
aggatttcagccat

SEQ ID NO: 2925648 - DNA, 18 bp, Homo sapiens
aggatttcttgtattggt

SEQ ID NO: 2925649 - DNA, 13 bp, Homo sapiens
aggatttgatgct

SEQ ID NO: 2925650 - DNA, 22 bp, Homo sapiens
aggatttgatgcttttctctca

SEQ ID NO: 2925651 - DNA, 23 bp, Homo sapiens
aggatttgcacagaagcacatgc

SEQ ID NO: 2925652 - DNA, 14 bp, Homo sapiens
aggattttgtattg

SEQ ID NO: 2925653 - DNA, 23 bp, Homo sapiens
aggatttttagagcattaaaata

SEQ ID NO: 2925654 - DNA, 23 bp, Homo sapiens
aggcaaaaataatttattttgct

SEQ ID NO: 2925655 - DNA, 15 bp, Homo sapiens
aggcaaaaatgtaaa

SEQ ID NO: 2925656 - DNA, 13 bp, Homo sapiens
aggcaaaattgca

SEQ ID NO: 2925657 - DNA, 19 bp, Homo sapiens
aggcaaaattgcaaatctt

SEQ ID NO: 2925658 - DNA, 19 bp, Homo sapiens
aggcaaagggtccagaagg

SEQ ID NO: 2925659 - DNA, 20 bp, Homo sapiens
aggcaaagggtccagaagga

SEQ ID NO: 2925660 - DNA, 15 bp, Homo sapiens
aggcaaatggcactg

SEQ ID NO: 2925661 - DNA, 17 bp, Homo sapiens
aggcaaatgtgtacatg

SEQ ID NO: 2925662 - DNA, 16 bp, Homo sapiens
aggcaacatccaaaat

SEQ ID NO: 2925663 - DNA, 15 bp, Homo sapiens
agggccgcgagaggc

SEQ ID NO: 2925664 - DNA, 20 bp, Homo sapiens
agggccgctcgatgcctttg

SEQ ID NO: 2925665 - DNA, 19 bp, Homo sapiens
agggccgtcaaggaaaggg

SEQ ID NO: 2925666 - DNA, 12 bp, Homo sapiens
agggcctcctca

SEQ ID NO: 2925667 - DNA, 19 bp, Homo sapiens
agggcctcggaggctcctc

SEQ ID NO: 2925668 - DNA, 21 bp, Homo sapiens
agggcctcggaggctcctccc

SEQ ID NO: 2925669 - DNA, 23 bp, Homo sapiens
agggcctcggaggctcctccctc

SEQ ID NO: 2925670 - DNA, 13 bp, Homo sapiens
agggcctctgcct

SEQ ID NO: 2925671 - DNA, 18 bp, Homo sapiens
agggcctgagcctggcca

SEQ ID NO: 2925672 - DNA, 22 bp, Homo sapiens
agggcctgagcctggccagcct

SEQ ID NO: 2925673 - DNA, 20 bp, Homo sapiens
agggcctgcaggacctgcct

SEQ ID NO: 2925674 - DNA, 23 bp, Homo sapiens
agggcctgcaggacctgcctgta

SEQ ID NO: 2925675 - DNA, 19 bp, Homo sapiens
agggccttttctggcaccg

SEQ ID NO: 2925676 - DNA, 13 bp, Homo sapiens
agggcgagtgaat

SEQ ID NO: 2925677 - DNA, 14 bp, Homo sapiens
agggcgcccagcag

SEQ ID NO: 2925678 - DNA, 17 bp, Homo sapiens
agggcgcccagcagcct

SEQ ID NO: 2925679 - DNA, 22 bp, Homo sapiens
agggcgcccagcagcctgccag

SEQ ID NO: 2925680 - DNA, 16 bp, Homo sapiens
agggcgtgactcaccc

SEQ ID NO: 2925681 - DNA, 17 bp, Homo sapiens
agggcgtgactcaccca

SEQ ID NO: 2925682 - DNA, 21 bp, Homo sapiens
agggcgttcttaggctgctgg

SEQ ID NO: 2925683 - DNA, 20 bp, Homo sapiens
agggctacaaaggaggacaa

SEQ ID NO: 2925684 - DNA, 18 bp, Homo sapiens
agggctaccctgagctga

SEQ ID NO: 2925685 - DNA, 20 bp, Homo sapiens
agggctaccctgagctgagg

SEQ ID NO: 2925686 - DNA, 15 bp, Homo sapiens
agggctatggtgtgg

SEQ ID NO: 2925687 - DNA, 15 bp, Homo sapiens
agggctatgtggatt

SEQ ID NO: 2925688 - DNA, 14 bp, Homo sapiens
agggctcagggcag

SEQ ID NO: 2925689 - DNA, 15 bp, Homo sapiens
agggctccctgccct

SEQ ID NO: 2925690 - DNA, 14 bp, Homo sapiens
agggctcctgcagg

SEQ ID NO: 2925691 - DNA, 14 bp, Homo sapiens
agggctctgggggc

SEQ ID NO: 2925692 - DNA, 15 bp, Homo sapiens
agggctctgggggca

SEQ ID NO: 2925693 - DNA, 16 bp, Homo sapiens
agggctctgggggcag

SEQ ID NO: 2925694 - DNA, 20 bp, Homo sapiens
agggctgatggattccaaac

SEQ ID NO: 2925695 - DNA, 20 bp, Homo sapiens
agggctgctgggggcaactg

SEQ ID NO: 2925696 - DNA, 15 bp, Homo sapiens
agggctggaggccca

SEQ ID NO: 2925697 - DNA, 16 bp, Homo sapiens
agggctgggaaacact

SEQ ID NO: 2925698 - DNA, 20 bp, Homo sapiens
agggctgggtcacaggaagg

SEQ ID NO: 2925699 - DNA, 15 bp, Homo sapiens
agggctgtcatctga

SEQ ID NO: 2925700 - DNA, 20 bp, Homo sapiens
agggctgtcatctgtgcact

SEQ ID NO: 2925701 - DNA, 15 bp, Homo sapiens
agggctttcagcgcc

SEQ ID NO: 2925702 - DNA, 16 bp, Homo sapiens
agggctttcagcgccc

SEQ ID NO: 2925703 - DNA, 20 bp, Homo sapiens
agggctttcagcgcccccag

SEQ ID NO: 2925704 - DNA, 22 bp, Homo sapiens
agggctttcagcgcccccaggc

SEQ ID NO: 2925705 - DNA, 17 bp, Homo sapiens
aggggaaaaaaatgttg

SEQ ID NO: 2925706 - DNA, 18 bp, Homo sapiens
aggggaaacgtctcccag

SEQ ID NO: 2925707 - DNA, 16 bp, Homo sapiens
aggggaaatgaatgtg

SEQ ID NO: 2925708 - DNA, 14 bp, Homo sapiens
aggggaaggactgg

SEQ ID NO: 2925709 - DNA, 14 bp, Homo sapiens
aggggacactggcc

SEQ ID NO: 2925710 - DNA, 15 bp, Homo sapiens
aggggaccagaggga

SEQ ID NO: 2925711 - DNA, 17 bp, Homo sapiens
aggggacccatgggggc

SEQ ID NO: 2925712 - DNA, 14 bp, Homo sapiens
aggggacccccgcc

SEQ ID NO: 2925713 - DNA, 15 bp, Homo sapiens
aggggacccccgccc

SEQ ID NO: 2925714 - DNA, 18 bp, Homo sapiens
aggggacccccgccccct

SEQ ID NO: 2925715 - DNA, 15 bp, Homo sapiens
aggggacgcaggccc

SEQ ID NO: 2925716 - DNA, 16 bp, Homo sapiens
aggggacgcaggcccc

SEQ ID NO: 2925717 - DNA, 17 bp, Homo sapiens
aggggacgcaggcccct

SEQ ID NO: 2925718 - DNA, 19 bp, Homo sapiens
aggggacgcaggcccctct

SEQ ID NO: 2925719 - DNA, 14 bp, Homo sapiens
aggggacgggcaag

SEQ ID NO: 2925720 - DNA, 21 bp, Homo sapiens
aggggactaattcactggcga

SEQ ID NO: 2925721 - DNA, 14 bp, Homo sapiens
aggggactgggcca

SEQ ID NO: 2925722 - DNA, 15 bp, Homo sapiens
aggggactgggccat

SEQ ID NO: 2925723 - DNA, 16 bp, Homo sapiens
aggggagaatgcagcc

SEQ ID NO: 2925724 - DNA, 10 bp, Homo sapiens
aggggagagg

SEQ ID NO: 2925725 - DNA, 20 bp, Homo sapiens
aggggagcagcggctctggt

SEQ ID NO: 2925726 - DNA, 21 bp, Homo sapiens
aggggagcagcggctctggtc

SEQ ID NO: 2925727 - DNA, 12 bp, Homo sapiens
aggggagccagg

SEQ ID NO: 2925728 - DNA, 16 bp, Homo sapiens
aggggagccagggtag

SEQ ID NO: 2925729 - DNA, 21 bp, Homo sapiens
aggggagcccactgtcctggg

SEQ ID NO: 2925730 - DNA, 17 bp, Homo sapiens
aggggaggcatcagtgt

SEQ ID NO: 2925731 - DNA, 13 bp, Homo sapiens
aggggagggaggg

SEQ ID NO: 2925732 - DNA, 16 bp, Homo sapiens
aggggagttgtgtctg

SEQ ID NO: 2925733 - DNA, 14 bp, Homo sapiens
aggggatggggagg

SEQ ID NO: 2925734 - DNA, 22 bp, Homo sapiens
aggggatgtttacctggtgctc

SEQ ID NO: 2925735 - DNA, 13 bp, Homo sapiens
aggggcagccaca

SEQ ID NO: 2925736 - DNA, 14 bp, Homo sapiens
aggggcagccacac

SEQ ID NO: 2925737 - DNA, 13 bp, Homo sapiens
aggggcaggagga

SEQ ID NO: 2925738 - DNA, 16 bp, Homo sapiens
aggggccatttggcat

SEQ ID NO: 2925739 - DNA, 19 bp, Homo sapiens
aggggcccctggcccagga

SEQ ID NO: 2925740 - DNA, 15 bp, Homo sapiens
aggggcccggccagc

SEQ ID NO: 2925741 - DNA, 21 bp, Homo sapiens
aggggcccggccagccatgtc

SEQ ID NO: 2925742 - DNA, 20 bp, Homo sapiens
aggggcccggtggcggcagg

SEQ ID NO: 2925743 - DNA, 19 bp, Homo sapiens
aggggccctcactcttgaa

SEQ ID NO: 2925744 - DNA, 16 bp, Homo sapiens
aggggccggctggcct

SEQ ID NO: 2925745 - DNA, 20 bp, Homo sapiens
aggggccggctggcctggag

SEQ ID NO: 2925746 - DNA, 15 bp, Homo sapiens
aggggccggggaggg

SEQ ID NO: 2925747 - DNA, 15 bp, Homo sapiens
aggggcctttgctgc

SEQ ID NO: 2925748 - DNA, 16 bp, Homo sapiens
aggggcctttgctgcc

SEQ ID NO: 2925749 - DNA, 17 bp, Homo sapiens
aggggcctttgctgccc

SEQ ID NO: 2925750 - DNA, 21 bp, Homo sapiens
aggggcgggaatattgtttct

SEQ ID NO: 2925751 - DNA, 16 bp, Homo sapiens
aggggcgtctgttccc

SEQ ID NO: 2925752 - DNA, 12 bp, Homo sapiens
aggggctaggga

SEQ ID NO: 2925753 - DNA, 22 bp, Homo sapiens
aggggctgctgggggctcccct

SEQ ID NO: 2925754 - DNA, 13 bp, Homo sapiens
aggggctggggag

SEQ ID NO: 2925755 - DNA, 15 bp, Homo sapiens
aggggctggggaggg

SEQ ID NO: 2925756 - DNA, 15 bp, Homo sapiens
aggggcttcaggtcc

SEQ ID NO: 2925757 - DNA, 21 bp, Homo sapiens
agggggagccccttctgctca

SEQ ID NO: 2925758 - DNA, 15 bp, Homo sapiens
agggggaggggaagc

SEQ ID NO: 2925759 - DNA, 16 bp, Homo sapiens
agggggatgccactcc

SEQ ID NO: 2925760 - DNA, 22 bp, Homo sapiens
agggggcggcagggctgggcct

SEQ ID NO: 2925761 - DNA, 18 bp, Homo sapiens
agggggctgaaacttgaa

SEQ ID NO: 2925762 - DNA, 18 bp, Homo sapiens
agggggtacctcatgagg

SEQ ID NO: 2925763 - DNA, 14 bp, Homo sapiens
agggggtgaaggca

SEQ ID NO: 2925764 - DNA, 14 bp, Homo sapiens
aggggtccctagca

SEQ ID NO: 2925765 - DNA, 18 bp, Homo sapiens
aggggtgacacagactca

SEQ ID NO: 2925766 - DNA, 16 bp, Homo sapiens
aggggtgagagcaccc

SEQ ID NO: 2925767 - DNA, 14 bp, Homo sapiens
aggggtgcaggtgg

SEQ ID NO: 2925768 - DNA, 20 bp, Homo sapiens
aggggtggctgcctcattta

SEQ ID NO: 2925769 - DNA, 21 bp, Homo sapiens
aggggtggctgcctcatttag

SEQ ID NO: 2925770 - DNA, 23 bp, Homo sapiens
aggggtggtttctacggtgacag

SEQ ID NO: 2925771 - DNA, 21 bp, Homo sapiens
aggggttccttccacttctgg

SEQ ID NO: 2925772 - DNA, 14 bp, Homo sapiens
agggtaccagcaga

SEQ ID NO: 2925773 - DNA, 17 bp, Homo sapiens
agggtagagcaaaggag

SEQ ID NO: 2925774 - DNA, 19 bp, Homo sapiens
agggtcagacgcctgagga

SEQ ID NO: 2925775 - DNA, 17 bp, Homo sapiens
agggtcaggcggagctg

SEQ ID NO: 2925776 - DNA, 19 bp, Homo sapiens
agggtccagaaggagacag

SEQ ID NO: 2925777 - DNA, 20 bp, Homo sapiens
agggtccatttttcttccag

SEQ ID NO: 2925778 - DNA, 17 bp, Homo sapiens
agggtcccctgccaccg

SEQ ID NO: 2925779 - DNA, 14 bp, Homo sapiens
agggtccctgacct

SEQ ID NO: 2925780 - DNA, 23 bp, Homo sapiens
agggtcctggtcctaaagagtta

SEQ ID NO: 2925781 - DNA, 18 bp, Homo sapiens
agggtcctttagtacctg

SEQ ID NO: 2925782 - DNA, 14 bp, Homo sapiens
agggtcgaaagctc

SEQ ID NO: 2925783 - DNA, 18 bp, Homo sapiens
agggtcgaaagctctaga

SEQ ID NO: 2925784 - DNA, 22 bp, Homo sapiens
agggtcgaaagctctagaatct

SEQ ID NO: 2925785 - DNA, 23 bp, Homo sapiens
agggtctaccaatacaaaatgta

SEQ ID NO: 2925786 - DNA, 19 bp, Homo sapiens
agggtctagggagagaccc

SEQ ID NO: 2925787 - DNA, 17 bp, Homo sapiens
agggtctctgctccagc

SEQ ID NO: 2925788 - DNA, 13 bp, Homo sapiens
agggtctggagaa

SEQ ID NO: 2925789 - DNA, 14 bp, Homo sapiens
agggtctggagaag

SEQ ID NO: 2925790 - DNA, 17 bp, Homo sapiens
agggtctgtttggactg

SEQ ID NO: 2925791 - DNA, 16 bp, Homo sapiens
agggtcttccttctca

SEQ ID NO: 2925792 - DNA, 15 bp, Homo sapiens
agggtcttgggaaat

SEQ ID NO: 2925793 - DNA, 22 bp, Homo sapiens
agggtcttggttccagcctgcc

SEQ ID NO: 2925794 - DNA, 14 bp, Homo sapiens
agggtgatgccagg

SEQ ID NO: 2925795 - DNA, 19 bp, Homo sapiens
agggtgctagtggtgggca

SEQ ID NO: 2925796 - DNA, 15 bp, Homo sapiens
agtactattaataga

SEQ ID NO: 2925797 - DNA, 22 bp, Homo sapiens
agtactcacttttcacttgtct

SEQ ID NO: 2925798 - DNA, 17 bp, Homo sapiens
agtactgagcagtatta

SEQ ID NO: 2925799 - DNA, 17 bp, Homo sapiens
agtactgctcttgtttc

SEQ ID NO: 2925800 - DNA, 23 bp, Homo sapiens
agtactgtgggcaatttagaaaa

SEQ ID NO: 2925801 - DNA, 16 bp, Homo sapiens
agtactgttaagaata

SEQ ID NO: 2925802 - DNA, 23 bp, Homo sapiens
agtacttagctagttttattctt

SEQ ID NO: 2925803 - DNA, 12 bp, Homo sapiens
agtacttatctt

SEQ ID NO: 2925804 - DNA, 17 bp, Homo sapiens
agtacttcagcaagaga

SEQ ID NO: 2925805 - DNA, 18 bp, Homo sapiens
agtacttcagcaagagag

SEQ ID NO: 2925806 - DNA, 22 bp, Homo sapiens
agtacttcagcaagagagaacc

SEQ ID NO: 2925807 - DNA, 15 bp, Homo sapiens
agtacttcaggcacg

SEQ ID NO: 2925808 - DNA, 17 bp, Homo sapiens
agtactttggaggcccc

SEQ ID NO: 2925809 - DNA, 11 bp, Homo sapiens
agtactttgtg

SEQ ID NO: 2925810 - DNA, 13 bp, Homo sapiens
agtactttgtgct

SEQ ID NO: 2925811 - DNA, 15 bp, Homo sapiens
agtacttttttaaat

SEQ ID NO: 2925812 - DNA, 14 bp, Homo sapiens
agtagaatctcagt

SEQ ID NO: 2925813 - DNA, 14 bp, Homo sapiens
agtagaattgcatt

SEQ ID NO: 2925814 - DNA, 16 bp, Homo sapiens
agtagacattttaaca

SEQ ID NO: 2925815 - DNA, 20 bp, Homo sapiens
agtagacattttaacaagaa

SEQ ID NO: 2925816 - DNA, 22 bp, Homo sapiens
agtagacattttaacaagaaga

SEQ ID NO: 2925817 - DNA, 14 bp, Homo sapiens
agtagataagcaga

SEQ ID NO: 2925818 - DNA, 15 bp, Homo sapiens
agtagatctgctttc

SEQ ID NO: 2925819 - DNA, 17 bp, Homo sapiens
agtagatctgctttctg

SEQ ID NO: 2925820 - DNA, 22 bp, Homo sapiens
agtagatctgctttctgttcat

SEQ ID NO: 2925821 - DNA, 22 bp, Homo sapiens
agtagattctggacagtcagct

SEQ ID NO: 2925822 - DNA, 20 bp, Homo sapiens
agtagattttctttaaaaga

SEQ ID NO: 2925823 - DNA, 21 bp, Homo sapiens
agtagattttctttaaaagaa

SEQ ID NO: 2925824 - DNA, 21 bp, Homo sapiens
agtagcagtcatcatcttttt

SEQ ID NO: 2925825 - DNA, 23 bp, Homo sapiens
agtagcatctcagtggtgtgtga

SEQ ID NO: 2925826 - DNA, 15 bp, Homo sapiens
agtagccgagagcct

SEQ ID NO: 2925827 - DNA, 22 bp, Homo sapiens
agtagctgctaccttctttggc

SEQ ID NO: 2925828 - DNA, 20 bp, Homo sapiens
agtagctgtcagatgtcaca

SEQ ID NO: 2925829 - DNA, 21 bp, Homo sapiens
agtagctttggaaaggtgccc

SEQ ID NO: 2925830 - DNA, 13 bp, Homo sapiens
agtaggcatgtta

SEQ ID NO: 2925831 - DNA, 13 bp, Homo sapiens
agtaggccctggt

SEQ ID NO: 2925832 - DNA, 13 bp, Homo sapiens
agtaggtgatgag

SEQ ID NO: 2925833 - DNA, 14 bp, Homo sapiens
agtagtaaaaatta

SEQ ID NO: 2925834 - DNA, 12 bp, Homo sapiens
agtagttaaaaa

SEQ ID NO: 2925835 - DNA, 23 bp, Homo sapiens
agtagttaaaaaaaaaaaaagga

SEQ ID NO: 2925836 - DNA, 21 bp, Homo sapiens
agtataaaatacaacaaagga

SEQ ID NO: 2925837 - DNA, 19 bp, Homo sapiens
agtataaattcgctgtgag

SEQ ID NO: 2925838 - DNA, 19 bp, Homo sapiens
agtatacgtttttaaatag

SEQ ID NO: 2925839 - DNA, 17 bp, Homo sapiens
agtatagcctatggcag

SEQ ID NO: 2925840 - DNA, 15 bp, Homo sapiens
agtatatacttttaa

SEQ ID NO: 2925841 - DNA, 21 bp, Homo sapiens
agtatatacttttaaattatg

SEQ ID NO: 2925842 - DNA, 20 bp, Homo sapiens
agtatatgaaatattttgaa

SEQ ID NO: 2925843 - DNA, 17 bp, Homo sapiens
agtatattatgtattta

SEQ ID NO: 2925844 - DNA, 14 bp, Homo sapiens
agtatattcttgta

SEQ ID NO: 2925845 - DNA, 20 bp, Homo sapiens
agtatattcttgtaaataca

SEQ ID NO: 2925846 - DNA, 21 bp, Homo sapiens
agtatattcttgtaaatacat

SEQ ID NO: 2925847 - DNA, 19 bp, Homo sapiens
agtatcaaatattagatgt

SEQ ID NO: 2925848 - DNA, 23 bp, Homo sapiens
agtatcaagtgttctaaaatgaa

SEQ ID NO: 2925849 - DNA, 18 bp, Homo sapiens
agtatcagaattgaaaca

SEQ ID NO: 2925850 - DNA, 13 bp, Homo sapiens
agtatcagcacta

SEQ ID NO: 2925851 - DNA, 15 bp, Homo sapiens
agtatcttctatttt

SEQ ID NO: 2925852 - DNA, 17 bp, Homo sapiens
agtatgaaagctggggg

SEQ ID NO: 2925853 - DNA, 13 bp, Homo sapiens
agtatggtacatt

SEQ ID NO: 2925854 - DNA, 14 bp, Homo sapiens
agtatgtgccagga

SEQ ID NO: 2925855 - DNA, 20 bp, Homo sapiens
agtattaaactctcctttga

SEQ ID NO: 2925856 - DNA, 20 bp, Homo sapiens
agtattaacagaaatgtttc

SEQ ID NO: 2925857 - DNA, 23 bp, Homo sapiens
agtattaacagaaatgtttctgt

SEQ ID NO: 2925858 - DNA, 14 bp, Homo sapiens
agtattaactctgt

SEQ ID NO: 2925859 - DNA, 15 bp, Homo sapiens
agtattactgctgct

SEQ ID NO: 2925860 - DNA, 17 bp, Homo sapiens
agtattactgctgctgt

SEQ ID NO: 2925861 - DNA, 19 bp, Homo sapiens
agtattactgctgctgtgc

SEQ ID NO: 2925862 - DNA, 23 bp, Homo sapiens
agtattataggactttcttctaa

SEQ ID NO: 2925863 - DNA, 21 bp, Homo sapiens
agtattatgccccagttcaga

SEQ ID NO: 2925864 - DNA, 23 bp, Homo sapiens
agtattatgccccagttcagaaa

SEQ ID NO: 2925865 - DNA, 13 bp, Homo sapiens
agtattattttcc

SEQ ID NO: 2925866 - DNA, 16 bp, Homo sapiens
agtattcacatcattt

SEQ ID NO: 2925867 - DNA, 14 bp, Homo sapiens
agtattcaggcact

SEQ ID NO: 2925868 - DNA, 15 bp, Homo sapiens
agtattcttttcaat

SEQ ID NO: 2925869 - DNA, 20 bp, Homo sapiens
agtattcttttcaattatat

SEQ ID NO: 2925870 - DNA, 23 bp, Homo sapiens
agtattgattctgcttgagaata

SEQ ID NO: 2925871 - DNA, 17 bp, Homo sapiens
agtattgtaaattatat

SEQ ID NO: 2925872 - DNA, 18 bp, Homo sapiens
agtattgtaaattatatt

SEQ ID NO: 2925873 - DNA, 15 bp, Homo sapiens
agtattgtttacatt

SEQ ID NO: 2925874 - DNA, 16 bp, Homo sapiens
agtattgtttacatta

SEQ ID NO: 2925875 - DNA, 16 bp, Homo sapiens
agtatttagtatatga

SEQ ID NO: 2925876 - DNA, 13 bp, Homo sapiens
agtatttatttat

SEQ ID NO: 2925877 - DNA, 17 bp, Homo sapiens
agtatttatttatgtac

SEQ ID NO: 2925878 - DNA, 18 bp, Homo sapiens
agtatttatttatgtact

SEQ ID NO: 2925879 - DNA, 16 bp, Homo sapiens
agtatttcaaattgga

SEQ ID NO: 2925880 - DNA, 16 bp, Homo sapiens
agtatttcatgctggg

SEQ ID NO: 2925881 - DNA, 19 bp, Homo sapiens
agtatttgattcaaaatat

SEQ ID NO: 2925882 - DNA, 18 bp, Homo sapiens
agtattttagtgaacttg

SEQ ID NO: 2925883 - DNA, 12 bp, Homo sapiens
agtattttcctg

SEQ ID NO: 2925884 - DNA, 21 bp, Homo sapiens
agtattttctgtttttatgtt

SEQ ID NO: 2925885 - DNA, 13 bp, Homo sapiens
agtatttttcaga

SEQ ID NO: 2925886 - DNA, 19 bp, Homo sapiens
agtatttttgattaacaat

SEQ ID NO: 2925887 - DNA, 22 bp, Homo sapiens
agtatttttgattaacaatgta

SEQ ID NO: 2925888 - DNA, 14 bp, Homo sapiens
agtcaaaaggaaca

SEQ ID NO: 2925889 - DNA, 23 bp, Homo sapiens
agtcaaaaggaacaaaaattaca

SEQ ID NO: 2925890 - DNA, 15 bp, Homo sapiens
agtcaaaaggtgcct

SEQ ID NO: 2925891 - DNA, 16 bp, Homo sapiens
agtcaaaaggtgcctg

SEQ ID NO: 2925892 - DNA, 21 bp, Homo sapiens
agtcaaaaggtgcctgtgagg

SEQ ID NO: 2925893 - DNA, 22 bp, Homo sapiens
agtcaaaatatttttaaaagat

SEQ ID NO: 2925894 - DNA, 15 bp, Homo sapiens
agtcaaataaatgtt

SEQ ID NO: 2925895 - DNA, 14 bp, Homo sapiens
agtcaaatatttat

SEQ ID NO: 2925896 - DNA, 22 bp, Homo sapiens
agtcaaatggtaggcatttcct

SEQ ID NO: 2925897 - DNA, 14 bp, Homo sapiens
agtcaacctgggca

SEQ ID NO: 2925898 - DNA, 18 bp, Homo sapiens
agtcaactggctggccag

SEQ ID NO: 2925899 - DNA, 16 bp, Homo sapiens
agtcaataaacttgta

SEQ ID NO: 2925900 - DNA, 18 bp, Homo sapiens
agtcaatcccctcattca

SEQ ID NO: 2925901 - DNA, 15 bp, Homo sapiens
agtcacaacaaaagg

SEQ ID NO: 2925902 - DNA, 16 bp, Homo sapiens
agtcacaacaaaagga

SEQ ID NO: 2925903 - DNA, 13 bp, Homo sapiens
agtcacaatgttc

SEQ ID NO: 2925904 - DNA, 23 bp, Homo sapiens
agtcacatggcctatgcacatat

SEQ ID NO: 2925905 - DNA, 11 bp, Homo sapiens
agtcaccatgc

SEQ ID NO: 2925906 - DNA, 17 bp, Homo sapiens
agtcaccgacagcggcc

SEQ ID NO: 2925907 - DNA, 15 bp, Homo sapiens
agtcactggcagcct

SEQ ID NO: 2925908 - DNA, 16 bp, Homo sapiens
agtcactggcagcctg

SEQ ID NO: 2925909 - DNA, 20 bp, Homo sapiens
agtcacttcggccagagctg

SEQ ID NO: 2925910 - DNA, 19 bp, Homo sapiens
agtcagaaggacggcagga

SEQ ID NO: 2925911 - DNA, 21 bp, Homo sapiens
agtcagagaaaacactttcct

SEQ ID NO: 2925912 - DNA, 19 bp, Homo sapiens
agtcagcaccttggcccag

SEQ ID NO: 2925913 - DNA, 21 bp, Homo sapiens
agtcagccgacaactatttcg

SEQ ID NO: 2925914 - DNA, 17 bp, Homo sapiens
agtcagctcttcatctg

SEQ ID NO: 2925915 - DNA, 22 bp, Homo sapiens
agtcagctcttcatctgcccaa

SEQ ID NO: 2925916 - DNA, 19 bp, Homo sapiens
agtcagctgaccccctccc

SEQ ID NO: 2925917 - DNA, 23 bp, Homo sapiens
agtcagctgaccccctcccccca

SEQ ID NO: 2925918 - DNA, 18 bp, Homo sapiens
agtcagctttcatctttg

SEQ ID NO: 2925919 - DNA, 16 bp, Homo sapiens
agtcaggacctggctt

SEQ ID NO: 2925920 - DNA, 13 bp, Homo sapiens
agtcaggccaggt

SEQ ID NO: 2925921 - DNA, 14 bp, Homo sapiens
agtcaggccaggtg

SEQ ID NO: 2925922 - DNA, 17 bp, Homo sapiens
agtcaggggtcaggtgt

SEQ ID NO: 2925923 - DNA, 23 bp, Homo sapiens
agtcaggggtcaggtgtcaggcc

SEQ ID NO: 2925924 - DNA, 16 bp, Homo sapiens
agtcagtgcaaatgtc

SEQ ID NO: 2925925 - DNA, 20 bp, Homo sapiens
agtcagtgcccaactgttat

SEQ ID NO: 2925926 - DNA, 21 bp, Homo sapiens
agtcatcatctttttgtgtgc

SEQ ID NO: 2925927 - DNA, 22 bp, Homo sapiens
agtcatcatctttttgtgtgca

SEQ ID NO: 2925928 - DNA, 12 bp, Homo sapiens
agttgcaggagc

SEQ ID NO: 2925929 - DNA, 16 bp, Homo sapiens
agttgcagtattggac

SEQ ID NO: 2925930 - DNA, 14 bp, Homo sapiens
agttgcatagagta

SEQ ID NO: 2925931 - DNA, 14 bp, Homo sapiens
agttgcttgtaaaa

SEQ ID NO: 2925932 - DNA, 17 bp, Homo sapiens
agttgctttgttacaat

SEQ ID NO: 2925933 - DNA, 17 bp, Homo sapiens
agttggggcactgggcg

SEQ ID NO: 2925934 - DNA, 18 bp, Homo sapiens
agttggtcttactttgtg

SEQ ID NO: 2925935 - DNA, 14 bp, Homo sapiens
agttggtgctgctc

SEQ ID NO: 2925936 - DNA, 15 bp, Homo sapiens
agttgtacatgaaat

SEQ ID NO: 2925937 - DNA, 22 bp, Homo sapiens
agttgtacatgaaatttttgta

SEQ ID NO: 2925938 - DNA, 14 bp, Homo sapiens
agttgtagactatg

SEQ ID NO: 2925939 - DNA, 20 bp, Homo sapiens
agttgtagcaggtttcacta

SEQ ID NO: 2925940 - DNA, 18 bp, Homo sapiens
agttgtccagatcactga

SEQ ID NO: 2925941 - DNA, 13 bp, Homo sapiens
agttgtctaaaca

SEQ ID NO: 2925942 - DNA, 18 bp, Homo sapiens
agttgtgaccttagtgtt

SEQ ID NO: 2925943 - DNA, 13 bp, Homo sapiens
agttgtgattgaa

SEQ ID NO: 2925944 - DNA, 14 bp, Homo sapiens
agttgtgcagcttt

SEQ ID NO: 2925945 - DNA, 17 bp, Homo sapiens
agttgtggatttcagtt

SEQ ID NO: 2925946 - DNA, 14 bp, Homo sapiens
agttgtgtgaccct

SEQ ID NO: 2925947 - DNA, 20 bp, Homo sapiens
agttgtgtttgttgctggct

SEQ ID NO: 2925948 - DNA, 22 bp, Homo sapiens
agttgttaccaaatacacattt

SEQ ID NO: 2925949 - DNA, 20 bp, Homo sapiens
agttgttcaactattttatt

SEQ ID NO: 2925950 - DNA, 18 bp, Homo sapiens
agttgttgtgggttctat

SEQ ID NO: 2925951 - DNA, 16 bp, Homo sapiens
agttgttgtgtacaga

SEQ ID NO: 2925952 - DNA, 17 bp, Homo sapiens
agttgtttaactgtgca

SEQ ID NO: 2925953 - DNA, 18 bp, Homo sapiens
agttgtttaactgtgcat

SEQ ID NO: 2925954 - DNA, 18 bp, Homo sapiens
agttgtttattccaaaga

SEQ ID NO: 2925955 - DNA, 15 bp, Homo sapiens
agttgttttaacaga

SEQ ID NO: 2925956 - DNA, 19 bp, Homo sapiens
agttgttttcagactcaga

SEQ ID NO: 2925957 - DNA, 21 bp, Homo sapiens
agttgttttttgtgtttccat

SEQ ID NO: 2925958 - DNA, 17 bp, Homo sapiens
agtttaaaaatcaactt

SEQ ID NO: 2925959 - DNA, 18 bp, Homo sapiens
agtttaaaaatcaacttt

SEQ ID NO: 2925960 - DNA, 17 bp, Homo sapiens
agtttaaaatcttgcat

SEQ ID NO: 2925961 - DNA, 17 bp, Homo sapiens
agtttaacagagttttc

SEQ ID NO: 2925962 - DNA, 14 bp, Homo sapiens
agtttaaccatatg

SEQ ID NO: 2925963 - DNA, 17 bp, Homo sapiens
agtttaactttaaaact

SEQ ID NO: 2925964 - DNA, 18 bp, Homo sapiens
agtttaactttaaaactg

SEQ ID NO: 2925965 - DNA, 16 bp, Homo sapiens
agtttactttgccaac

SEQ ID NO: 2925966 - DNA, 13 bp, Homo sapiens
agtttagaacaga

SEQ ID NO: 2925967 - DNA, 15 bp, Homo sapiens
agtttagaacagagg

SEQ ID NO: 2925968 - DNA, 16 bp, Homo sapiens
agtttataagcccaaa

SEQ ID NO: 2925969 - DNA, 14 bp, Homo sapiens
agtttattaaatct

SEQ ID NO: 2925970 - DNA, 15 bp, Homo sapiens
agtttattaaatctg

SEQ ID NO: 2925971 - DNA, 16 bp, Homo sapiens
agtttcaaatctgtaa

SEQ ID NO: 2925972 - DNA, 17 bp, Homo sapiens
agtttcaaatctgtaat

SEQ ID NO: 2925973 - DNA, 16 bp, Homo sapiens
agtttcaattcagtgc

SEQ ID NO: 2925974 - DNA, 17 bp, Homo sapiens
agtttcacaggtcaata

SEQ ID NO: 2925975 - DNA, 23 bp, Homo sapiens
agtttcacaggtcaataaactta

SEQ ID NO: 2925976 - DNA, 23 bp, Homo sapiens
agtttcagctggaaacttctgta

SEQ ID NO: 2925977 - DNA, 15 bp, Homo sapiens
agtttcagctttctt

SEQ ID NO: 2925978 - DNA, 21 bp, Homo sapiens
agtttcatgtacaagatgaag

SEQ ID NO: 2925979 - DNA, 15 bp, Homo sapiens
agtttcattattctc

SEQ ID NO: 2925980 - DNA, 15 bp, Homo sapiens
agtttccaacagagg

SEQ ID NO: 2925981 - DNA, 13 bp, Homo sapiens
agtttcctgcctt

SEQ ID NO: 2925982 - DNA, 14 bp, Homo sapiens
agtttcctttaaat

SEQ ID NO: 2925983 - DNA, 13 bp, Homo sapiens
agtttccttttaa

SEQ ID NO: 2925984 - DNA, 18 bp, Homo sapiens
agtttccttttaattcta

SEQ ID NO: 2925985 - DNA, 15 bp, Homo sapiens
agtttctaagattct

SEQ ID NO: 2925986 - DNA, 19 bp, Homo sapiens
agtttctaagattctaaag

SEQ ID NO: 2925987 - DNA, 11 bp, Homo sapiens
agtttctaagg

SEQ ID NO: 2925988 - DNA, 12 bp, Homo sapiens
agtttctaaggt

SEQ ID NO: 2925989 - DNA, 15 bp, Homo sapiens
agtttctatttagtt

SEQ ID NO: 2925990 - DNA, 22 bp, Homo sapiens
agtttctcagatccttgtttca

SEQ ID NO: 2925991 - DNA, 15 bp, Homo sapiens
agtttctgttctgtg

SEQ ID NO: 2925992 - DNA, 21 bp, Homo sapiens
agtttctgttctgtggaaagt

SEQ ID NO: 2925993 - DNA, 23 bp, Homo sapiens
agtttcttaaactgaaagcttta

SEQ ID NO: 2925994 - DNA, 15 bp, Homo sapiens
agtttgaaattctga

SEQ ID NO: 2925995 - DNA, 15 bp, Homo sapiens
agtttgaaggaaaca

SEQ ID NO: 2925996 - DNA, 18 bp, Homo sapiens
agtttgaaggaaacagtt

SEQ ID NO: 2925997 - DNA, 12 bp, Homo sapiens
agtttgacattt

SEQ ID NO: 2925998 - DNA, 14 bp, Homo sapiens
agtttgacttgtat

SEQ ID NO: 2925999 - DNA, 16 bp, Homo sapiens
agtttgacttgtataa

SEQ ID NO: 2926000 - DNA, 19 bp, Homo sapiens
agtttgagaccaggctggg

SEQ ID NO: 2926001 - DNA, 20 bp, Homo sapiens
agtttgatcagacagcttga

SEQ ID NO: 2926002 - DNA, 17 bp, Homo sapiens
agtttgattattcagtg

SEQ ID NO: 2926003 - DNA, 18 bp, Homo sapiens
agtttgattattcagtgt

SEQ ID NO: 2926004 - DNA, 13 bp, Homo sapiens
agtttgcagaaaa

SEQ ID NO: 2926005 - DNA, 13 bp, Homo sapiens
agtttgccagaag

SEQ ID NO: 2926006 - DNA, 21 bp, Homo sapiens
agtttgctgttttaaattgca

SEQ ID NO: 2926007 - DNA, 18 bp, Homo sapiens
agtttggcaaactctcca

SEQ ID NO: 2926008 - DNA, 19 bp, Homo sapiens
agtttgggatccctgtctt

SEQ ID NO: 2926009 - DNA, 20 bp, Homo sapiens
agtttgggggttttgctgtt

SEQ ID NO: 2926010 - DNA, 19 bp, Homo sapiens
agtttggttaatcagtgtt

SEQ ID NO: 2926011 - DNA, 12 bp, Homo sapiens
agtttgtattaa

SEQ ID NO: 2926012 - DNA, 16 bp, Homo sapiens
agtttgtgctctactg

SEQ ID NO: 2926013 - DNA, 16 bp, Homo sapiens
agtttgttactttaaa

SEQ ID NO: 2926014 - DNA, 19 bp, Homo sapiens
agtttgttatgtgtctgga

SEQ ID NO: 2926015 - DNA, 21 bp, Homo sapiens
agtttgttatgtgtctggaag

SEQ ID NO: 2926016 - DNA, 13 bp, Homo sapiens
agtttgtttcctg

SEQ ID NO: 2926017 - DNA, 18 bp, Homo sapiens
agtttgtttcctgtctga

SEQ ID NO: 2926018 - DNA, 15 bp, Homo sapiens
agttttaaagaagtc

SEQ ID NO: 2926019 - DNA, 13 bp, Homo sapiens
agttttacaaagg

SEQ ID NO: 2926020 - DNA, 15 bp, Homo sapiens
agttttactgtgatt

SEQ ID NO: 2926021 - DNA, 18 bp, Homo sapiens
agttttagattattttat

SEQ ID NO: 2926022 - DNA, 20 bp, Homo sapiens
agttttagggtacagtttgg

SEQ ID NO: 2926023 - DNA, 12 bp, Homo sapiens
agttttcagtgg

SEQ ID NO: 2926024 - DNA, 21 bp, Homo sapiens
agttttcatttagaaaataga

SEQ ID NO: 2926025 - DNA, 15 bp, Homo sapiens
agttttcccactttt

SEQ ID NO: 2926026 - DNA, 18 bp, Homo sapiens
agttttcccttgaggaaa

SEQ ID NO: 2926027 - DNA, 18 bp, Homo sapiens
agttttccttctcatctg

SEQ ID NO: 2926028 - DNA, 17 bp, Homo sapiens
agttttcggaaacactg

SEQ ID NO: 2926029 - DNA, 22 bp, Homo sapiens
agttttcggaaacactgactta

SEQ ID NO: 2926030 - DNA, 13 bp, Homo sapiens
agttttcttgttg

SEQ ID NO: 2926031 - DNA, 18 bp, Homo sapiens
agttttcttgttgctttg

SEQ ID NO: 2926032 - DNA, 22 bp, Homo sapiens
agttttgacatcagccagctgc

SEQ ID NO: 2926033 - DNA, 12 bp, Homo sapiens
agttttgagaac

SEQ ID NO: 2926034 - DNA, 18 bp, Homo sapiens
agttttgagaacgtaaag

SEQ ID NO: 2926035 - DNA, 21 bp, Homo sapiens
agttttgatgactggcatttt

SEQ ID NO: 2926036 - DNA, 23 bp, Homo sapiens
agttttgatgactggcattttat

SEQ ID NO: 2926037 - DNA, 13 bp, Homo sapiens
agttttgctgcta

SEQ ID NO: 2926038 - DNA, 17 bp, Homo sapiens
agttttgtaagccctct

SEQ ID NO: 2926039 - DNA, 13 bp, Homo sapiens
agttttgtcttga

SEQ ID NO: 2926040 - DNA, 23 bp, Homo sapiens
agttttgtgtgtatatatttaaa

SEQ ID NO: 2926041 - DNA, 17 bp, Homo sapiens
agtttttatggggctga

SEQ ID NO: 2926042 - DNA, 23 bp, Homo sapiens
agtttttcccagctacacctttc

SEQ ID NO: 2926043 - DNA, 23 bp, Homo sapiens
agtttttctgttttgtttggcaa

SEQ ID NO: 2926044 - DNA, 19 bp, Homo sapiens
agtttttctttaatatgat

SEQ ID NO: 2926045 - DNA, 21 bp, Homo sapiens
agtttttctttaatatgattc

SEQ ID NO: 2926046 - DNA, 16 bp, Homo sapiens
agtttttgacatttat

SEQ ID NO: 2926047 - DNA, 18 bp, Homo sapiens
ataaaaaagaaaacattc

SEQ ID NO: 2926048 - DNA, 23 bp, Homo sapiens
ataaaaaagaaaacattccagat

SEQ ID NO: 2926049 - DNA, 22 bp, Homo sapiens
ataaaaagaggatgatttcaga

SEQ ID NO: 2926050 - DNA, 17 bp, Homo sapiens
ataaaaagcttccatga

SEQ ID NO: 2926051 - DNA, 12 bp, Homo sapiens
ataaaaaggcac

SEQ ID NO: 2926052 - DNA, 21 bp, Homo sapiens
ataaaaaggcacctataaaac

SEQ ID NO: 2926053 - DNA, 17 bp, Homo sapiens
ataaaaagtcacaatga

SEQ ID NO: 2926054 - DNA, 11 bp, Homo sapiens
ataaaaagtta

SEQ ID NO: 2926055 - DNA, 13 bp, Homo sapiens
ataaaaagtttca

SEQ ID NO: 2926056 - DNA, 21 bp, Homo sapiens
ataaaaagtttcacaggtcaa

SEQ ID NO: 2926057 - DNA, 15 bp, Homo sapiens
ataaaaataaatcta

SEQ ID NO: 2926058 - DNA, 16 bp, Homo sapiens
ataaaaatcaaacaac

SEQ ID NO: 2926059 - DNA, 12 bp, Homo sapiens
ataaaacaggta

SEQ ID NO: 2926060 - DNA, 13 bp, Homo sapiens
ataaaacattaat

SEQ ID NO: 2926061 - DNA, 19 bp, Homo sapiens
atagattctcttgtataag

SEQ ID NO: 2926062 - DNA, 17 bp, Homo sapiens
atagattgtatctctta

SEQ ID NO: 2926063 - DNA, 22 bp, Homo sapiens
atagattttttaaaaaaaatgt

SEQ ID NO: 2926064 - DNA, 19 bp, Homo sapiens
atagcaagtgaatttttct

SEQ ID NO: 2926065 - DNA, 12 bp, Homo sapiens
atagcaattaaa

SEQ ID NO: 2926066 - DNA, 15 bp, Homo sapiens
atagcattgtgaact

SEQ ID NO: 2926067 - DNA, 13 bp, Homo sapiens
atagccccagact

SEQ ID NO: 2926068 - DNA, 21 bp, Homo sapiens
atagccccagactgggcccag

SEQ ID NO: 2926069 - DNA, 20 bp, Homo sapiens
atagccgaactccaggctgg

SEQ ID NO: 2926070 - DNA, 14 bp, Homo sapiens
atagccgggcatgg

SEQ ID NO: 2926071 - DNA, 18 bp, Homo sapiens
atagccgggcatggtggc

SEQ ID NO: 2926072 - DNA, 13 bp, Homo sapiens
atagcctgtggcc

SEQ ID NO: 2926073 - DNA, 15 bp, Homo sapiens
atagccttgaaaaca

SEQ ID NO: 2926074 - DNA, 17 bp, Homo sapiens
atagccttgaaaacaaa

SEQ ID NO: 2926075 - DNA, 14 bp, Homo sapiens
atagctactaattt

SEQ ID NO: 2926076 - DNA, 22 bp, Homo sapiens
atagctagctatttctatgtat

SEQ ID NO: 2926077 - DNA, 18 bp, Homo sapiens
atagctccaagctgttaa

SEQ ID NO: 2926078 - DNA, 23 bp, Homo sapiens
atagctcttcacttcctccagaa

SEQ ID NO: 2926079 - DNA, 21 bp, Homo sapiens
atagcttcaccccaatcccag

SEQ ID NO: 2926080 - DNA, 22 bp, Homo sapiens
atagcttcaccccaatcccagc

SEQ ID NO: 2926081 - DNA, 18 bp, Homo sapiens
ataggaaaacaataattt

SEQ ID NO: 2926082 - DNA, 14 bp, Homo sapiens
ataggaaataaaat

SEQ ID NO: 2926083 - DNA, 21 bp, Homo sapiens
ataggaacatatgaaaataca

SEQ ID NO: 2926084 - DNA, 21 bp, Homo sapiens
ataggactccatttctttctt

SEQ ID NO: 2926085 - DNA, 17 bp, Homo sapiens
ataggactttcttctaa

SEQ ID NO: 2926086 - DNA, 23 bp, Homo sapiens
ataggattgcttcaattaaaatt

SEQ ID NO: 2926087 - DNA, 16 bp, Homo sapiens
ataggatttcttaaat

SEQ ID NO: 2926088 - DNA, 13 bp, Homo sapiens
ataggatttttag

SEQ ID NO: 2926089 - DNA, 16 bp, Homo sapiens
ataggatttttagaat

SEQ ID NO: 2926090 - DNA, 20 bp, Homo sapiens
ataggcaaaagtgtaacaac

SEQ ID NO: 2926091 - DNA, 15 bp, Homo sapiens
ataggcatgagccac

SEQ ID NO: 2926092 - DNA, 22 bp, Homo sapiens
ataggcatgagccactgtgctt

SEQ ID NO: 2926093 - DNA, 17 bp, Homo sapiens
ataggcccacacacagg

SEQ ID NO: 2926094 - DNA, 20 bp, Homo sapiens
ataggtagaatgtaaagctt

SEQ ID NO: 2926095 - DNA, 23 bp, Homo sapiens
ataggtagaatgtaaagcttgtc

SEQ ID NO: 2926096 - DNA, 17 bp, Homo sapiens
ataggtatgcttactat

SEQ ID NO: 2926097 - DNA, 22 bp, Homo sapiens
ataggtctaaataggatcctgg

SEQ ID NO: 2926098 - DNA, 15 bp, Homo sapiens
ataggtttaataatt

SEQ ID NO: 2926099 - DNA, 19 bp, Homo sapiens
atagtaacttcttatggaa

SEQ ID NO: 2926100 - DNA, 23 bp, Homo sapiens
atagtaatgagtttaaaaatcaa

SEQ ID NO: 2926101 - DNA, 18 bp, Homo sapiens
atagtaccttcaatactt

SEQ ID NO: 2926102 - DNA, 16 bp, Homo sapiens
atagtactaagcattt

SEQ ID NO: 2926103 - DNA, 13 bp, Homo sapiens
atagtagaaaaat

SEQ ID NO: 2926104 - DNA, 22 bp, Homo sapiens
atagtagagtgatatggagcaa

SEQ ID NO: 2926105 - DNA, 22 bp, Homo sapiens
atagtagccaaagttaaatgta

SEQ ID NO: 2926106 - DNA, 23 bp, Homo sapiens
atagtagccaaagttaaatgtat

SEQ ID NO: 2926107 - DNA, 13 bp, Homo sapiens
atagtagtatgat

SEQ ID NO: 2926108 - DNA, 13 bp, Homo sapiens
atagtatgtaatt

SEQ ID NO: 2926109 - DNA, 22 bp, Homo sapiens
atagtcattaaaaacatagaaa

SEQ ID NO: 2926110 - DNA, 21 bp, Homo sapiens
atagtcccaccttggagcatt

SEQ ID NO: 2926111 - DNA, 23 bp, Homo sapiens
atagtcccaccttggagcattta

SEQ ID NO: 2926112 - DNA, 14 bp, Homo sapiens
atagtcctaaaaag

SEQ ID NO: 2926113 - DNA, 14 bp, Homo sapiens
atagtctagtgtag

SEQ ID NO: 2926114 - DNA, 15 bp, Homo sapiens
atagtctagtgtagt

SEQ ID NO: 2926115 - DNA, 20 bp, Homo sapiens
atagtctctacctatagaaa

SEQ ID NO: 2926116 - DNA, 14 bp, Homo sapiens
atagtgaacacagc

SEQ ID NO: 2926117 - DNA, 12 bp, Homo sapiens
atagtgcctttt

SEQ ID NO: 2926118 - DNA, 17 bp, Homo sapiens
atagtgcttcttgtaat

SEQ ID NO: 2926119 - DNA, 18 bp, Homo sapiens
atagtggaccacttggaa

SEQ ID NO: 2926120 - DNA, 20 bp, Homo sapiens
atagtggatctcagttttta

SEQ ID NO: 2926121 - DNA, 16 bp, Homo sapiens
atagtggggagacttc

SEQ ID NO: 2926122 - DNA, 16 bp, Homo sapiens
atagtgttaatcaatt

SEQ ID NO: 2926123 - DNA, 21 bp, Homo sapiens
atagtgttaatcaatttaaac

SEQ ID NO: 2926124 - DNA, 14 bp, Homo sapiens
atagttaatatagt

SEQ ID NO: 2926125 - DNA, 23 bp, Homo sapiens
atagttaatgaaggtgtgctaca

SEQ ID NO: 2926126 - DNA, 22 bp, Homo sapiens
atagttatttacttgaaagatg

SEQ ID NO: 2926127 - DNA, 12 bp, Homo sapiens
atagttctagac

SEQ ID NO: 2926128 - DNA, 19 bp, Homo sapiens
atagttctgagctgccagt

SEQ ID NO: 2926129 - DNA, 23 bp, Homo sapiens
atagttggaggtgattccagtga

SEQ ID NO: 2926130 - DNA, 15 bp, Homo sapiens
atagttgtagactat

SEQ ID NO: 2926131 - DNA, 19 bp, Homo sapiens
atagttgtattttgtacat

SEQ ID NO: 2926132 - DNA, 18 bp, Homo sapiens
atagttgtctttctttgc

SEQ ID NO: 2926133 - DNA, 16 bp, Homo sapiens
atagtttcaaatctgt

SEQ ID NO: 2926134 - DNA, 12 bp, Homo sapiens
atagtttggcat

SEQ ID NO: 2926135 - DNA, 14 bp, Homo sapiens
atagtttggcattt

SEQ ID NO: 2926136 - DNA, 16 bp, Homo sapiens
atataaaaatatatgt

SEQ ID NO: 2926137 - DNA, 19 bp, Homo sapiens
atataaaaatatatgttga

SEQ ID NO: 2926138 - DNA, 20 bp, Homo sapiens
atataaaaggcaaatgtgta

SEQ ID NO: 2926139 - DNA, 14 bp, Homo sapiens
atataaaatatgaa

SEQ ID NO: 2926140 - DNA, 21 bp, Homo sapiens
atataaaggaaaggccctgca

SEQ ID NO: 2926141 - DNA, 22 bp, Homo sapiens
atataaatactgacaatgtatt

SEQ ID NO: 2926142 - DNA, 23 bp, Homo sapiens
atataaatatattttctttctag

SEQ ID NO: 2926143 - DNA, 14 bp, Homo sapiens
atataaatgggaac

SEQ ID NO: 2926144 - DNA, 14 bp, Homo sapiens
atataaatgtggag

SEQ ID NO: 2926145 - DNA, 22 bp, Homo sapiens
atataaattgagcttgcttctt

SEQ ID NO: 2926146 - DNA, 16 bp, Homo sapiens
atataacatatatgga

SEQ ID NO: 2926147 - DNA, 18 bp, Homo sapiens
atataacatgaaatgata

SEQ ID NO: 2926148 - DNA, 18 bp, Homo sapiens
atataagaaagacatctt

SEQ ID NO: 2926149 - DNA, 17 bp, Homo sapiens
atataagtttctttaga

SEQ ID NO: 2926150 - DNA, 17 bp, Homo sapiens
atataatatatttgtgt

SEQ ID NO: 2926151 - DNA, 20 bp, Homo sapiens
atataatatttgaagcagct

SEQ ID NO: 2926152 - DNA, 14 bp, Homo sapiens
atatacaataatgg

SEQ ID NO: 2926153 - DNA, 17 bp, Homo sapiens
atatacaataatggaaa

SEQ ID NO: 2926154 - DNA, 12 bp, Homo sapiens
atatacacacac

SEQ ID NO: 2926155 - DNA, 13 bp, Homo sapiens
atatacacacaca

SEQ ID NO: 2926156 - DNA, 21 bp, Homo sapiens
atatacacggattattatttg

SEQ ID NO: 2926157 - DNA, 14 bp, Homo sapiens
atatacagtaactt

SEQ ID NO: 2926158 - DNA, 17 bp, Homo sapiens
atatacagtaactttat

SEQ ID NO: 2926159 - DNA, 22 bp, Homo sapiens
atataccttttgttaccacaga

SEQ ID NO: 2926160 - DNA, 20 bp, Homo sapiens
atatacgtgaaaattatttg

SEQ ID NO: 2926161 - DNA, 13 bp, Homo sapiens
atatactggaagt

SEQ ID NO: 2926162 - DNA, 13 bp, Homo sapiens
atatactgtaaag

SEQ ID NO: 2926163 - DNA, 20 bp, Homo sapiens
atatactgtaaagaaagaga

SEQ ID NO: 2926164 - DNA, 21 bp, Homo sapiens
atatactgtaaagaaagagag

SEQ ID NO: 2926165 - DNA, 22 bp, Homo sapiens
atatactgtaaagaaagagaga

SEQ ID NO: 2926166 - DNA, 23 bp, Homo sapiens
atatactgtaaagaaagagagaa

SEQ ID NO: 2926167 - DNA, 15 bp, Homo sapiens
atatacttaaatgga

SEQ ID NO: 2926168 - DNA, 13 bp, Homo sapiens
atatacttttaaa

SEQ ID NO: 2926169 - DNA, 16 bp, Homo sapiens
atatacttttaaatta

SEQ ID NO: 2926170 - DNA, 19 bp, Homo sapiens
atatagaaaacaaaggagc

SEQ ID NO: 2926171 - DNA, 20 bp, Homo sapiens
atatagacagtccttaaaaa

SEQ ID NO: 2926172 - DNA, 16 bp, Homo sapiens
atatagacttggagaa

SEQ ID NO: 2926173 - DNA, 21 bp, Homo sapiens
atatagcaaaacttttaaact

SEQ ID NO: 2926174 - DNA, 17 bp, Homo sapiens
atatagctctacacaac

SEQ ID NO: 2926175 - DNA, 20 bp, Homo sapiens
atatagctctacacaacatg

SEQ ID NO: 2926176 - DNA, 23 bp, Homo sapiens
atatagctctacacaacatgtat

SEQ ID NO: 2926177 - DNA, 17 bp, Homo sapiens
atatagctgatcagttt

SEQ ID NO: 2926178 - DNA, 18 bp, Homo sapiens
atataggacaaaatgtta

SEQ ID NO: 2926179 - DNA, 21 bp, Homo sapiens
atataggttttgtttgctatc

SEQ ID NO: 2926180 - DNA, 23 bp, Homo sapiens
atataggttttgtttgctatctt

SEQ ID NO: 2926181 - DNA, 22 bp, Homo sapiens
atatagttgtctttctttgctg

SEQ ID NO: 2926182 - DNA, 13 bp, Homo sapiens
atatataagaaag

SEQ ID NO: 2926183 - DNA, 14 bp, Homo sapiens
atatataagaaaga

SEQ ID NO: 2926184 - DNA, 17 bp, Homo sapiens
atatataagaaagacat

SEQ ID NO: 2926185 - DNA, 18 bp, Homo sapiens
atatataagaaagacatc

SEQ ID NO: 2926186 - DNA, 22 bp, Homo sapiens
atatatacatagcatgacattt

SEQ ID NO: 2926187 - DNA, 13 bp, Homo sapiens
atatatactggaa

SEQ ID NO: 2926188 - DNA, 15 bp, Homo sapiens
atatatactggaagt

SEQ ID NO: 2926189 - DNA, 16 bp, Homo sapiens
atatatataacatata

SEQ ID NO: 2926190 - DNA, 15 bp, Homo sapiens
atatatatacacaca

SEQ ID NO: 2926191 - DNA, 15 bp, Homo sapiens
atatatatatataca

SEQ ID NO: 2926192 - DNA, 15 bp, Homo sapiens
atcatgtgtaatcaa

SEQ ID NO: 2926193 - DNA, 19 bp, Homo sapiens
atcatgtgtaatcaataaa

SEQ ID NO: 2926194 - DNA, 20 bp, Homo sapiens
atcatgtgtaatcaataaac

SEQ ID NO: 2926195 - DNA, 14 bp, Homo sapiens
atcatgttttggtg

SEQ ID NO: 2926196 - DNA, 19 bp, Homo sapiens
atcatgttttggtgaaaat

SEQ ID NO: 2926197 - DNA, 13 bp, Homo sapiens
atcattactataa

SEQ ID NO: 2926198 - DNA, 15 bp, Homo sapiens
atcattcataatttt

SEQ ID NO: 2926199 - DNA, 22 bp, Homo sapiens
atcattccctctcatctcaggt

SEQ ID NO: 2926200 - DNA, 14 bp, Homo sapiens
atcattcctttcca

SEQ ID NO: 2926201 - DNA, 12 bp, Homo sapiens
atcattctctgt

SEQ ID NO: 2926202 - DNA, 16 bp, Homo sapiens
atcattctctgtctca

SEQ ID NO: 2926203 - DNA, 21 bp, Homo sapiens
atcattctctgtctcatccat

SEQ ID NO: 2926204 - DNA, 21 bp, Homo sapiens
atcattggattctgagagctg

SEQ ID NO: 2926205 - DNA, 15 bp, Homo sapiens
atcatttcagccaaa

SEQ ID NO: 2926206 - DNA, 20 bp, Homo sapiens
atcatttccgttttgcctgt

SEQ ID NO: 2926207 - DNA, 15 bp, Homo sapiens
atcatttctatttct

SEQ ID NO: 2926208 - DNA, 20 bp, Homo sapiens
atcatttgatttaaacaatg

SEQ ID NO: 2926209 - DNA, 19 bp, Homo sapiens
atcatttgttctgggagta

SEQ ID NO: 2926210 - DNA, 13 bp, Homo sapiens
atcattttagaat

SEQ ID NO: 2926211 - DNA, 17 bp, Homo sapiens
atcattttagaattaaa

SEQ ID NO: 2926212 - DNA, 11 bp, Homo sapiens
atcattttcat

SEQ ID NO: 2926213 - DNA, 17 bp, Homo sapiens
atccaaaaaagcaaaca

SEQ ID NO: 2926214 - DNA, 22 bp, Homo sapiens
atccaaaagaagcccccagcta

SEQ ID NO: 2926215 - DNA, 16 bp, Homo sapiens
atccaaaagtggaagt

SEQ ID NO: 2926216 - DNA, 19 bp, Homo sapiens
atccaaaatgtgtatttct

SEQ ID NO: 2926217 - DNA, 23 bp, Homo sapiens
atccaaaatgtgtatttcttata

SEQ ID NO: 2926218 - DNA, 13 bp, Homo sapiens
atccaaacaattt

SEQ ID NO: 2926219 - DNA, 13 bp, Homo sapiens
atccaaactgctg

SEQ ID NO: 2926220 - DNA, 16 bp, Homo sapiens
atccaaactgctgtct

SEQ ID NO: 2926221 - DNA, 10 bp, Homo sapiens
atccaaagac

SEQ ID NO: 2926222 - DNA, 15 bp, Homo sapiens
atccaaagcagacag

SEQ ID NO: 2926223 - DNA, 21 bp, Homo sapiens
atccaaaggaatcagctgcag

SEQ ID NO: 2926224 - DNA, 15 bp, Homo sapiens
atccaaatctgtcct

SEQ ID NO: 2926225 - DNA, 21 bp, Homo sapiens
atccaaatctgtcctctgtag

SEQ ID NO: 2926226 - DNA, 22 bp, Homo sapiens
atccaaatctgtcctctgtagt

SEQ ID NO: 2926227 - DNA, 18 bp, Homo sapiens
atccaaatgctgtgcaaa

SEQ ID NO: 2926228 - DNA, 19 bp, Homo sapiens
atccaaatgctgtgcaaac

SEQ ID NO: 2926229 - DNA, 19 bp, Homo sapiens
atccaacacaactatcaaa

SEQ ID NO: 2926230 - DNA, 21 bp, Homo sapiens
atccaacagacctggtgctct

SEQ ID NO: 2926231 - DNA, 16 bp, Homo sapiens
atccaactttttcata

SEQ ID NO: 2926232 - DNA, 19 bp, Homo sapiens
atccaagatattttaaaat

SEQ ID NO: 2926233 - DNA, 16 bp, Homo sapiens
atccaagcaagactga

SEQ ID NO: 2926234 - DNA, 13 bp, Homo sapiens
atccaatcaattt

SEQ ID NO: 2926235 - DNA, 18 bp, Homo sapiens
atccaatgtcgctgtaaa

SEQ ID NO: 2926236 - DNA, 18 bp, Homo sapiens
atccacattgttttaaaa

SEQ ID NO: 2926237 - DNA, 19 bp, Homo sapiens
atccacattgttttaaaaa

SEQ ID NO: 2926238 - DNA, 13 bp, Homo sapiens
atccacccagccc

SEQ ID NO: 2926239 - DNA, 22 bp, Homo sapiens
atccagaggcaaacggaggcaa

SEQ ID NO: 2926240 - DNA, 15 bp, Homo sapiens
atccagatggtggga

SEQ ID NO: 2926241 - DNA, 16 bp, Homo sapiens
atccagcagtctctgc

SEQ ID NO: 2926242 - DNA, 12 bp, Homo sapiens
atccagcctggg

SEQ ID NO: 2926243 - DNA, 20 bp, Homo sapiens
atccagctacttagctggcc

SEQ ID NO: 2926244 - DNA, 15 bp, Homo sapiens
atccagctatgttat

SEQ ID NO: 2926245 - DNA, 22 bp, Homo sapiens
atccaggactatatttgggcct

SEQ ID NO: 2926246 - DNA, 21 bp, Homo sapiens
atccaggagcaacgccagtgg

SEQ ID NO: 2926247 - DNA, 19 bp, Homo sapiens
atccaggcagatccaggac

SEQ ID NO: 2926248 - DNA, 15 bp, Homo sapiens
atccaggcttctccc

SEQ ID NO: 2926249 - DNA, 13 bp, Homo sapiens
atccagggacaga

SEQ ID NO: 2926250 - DNA, 14 bp, Homo sapiens
atccagggacagag

SEQ ID NO: 2926251 - DNA, 20 bp, Homo sapiens
atccagggacagaggcccca

SEQ ID NO: 2926252 - DNA, 15 bp, Homo sapiens
atccaggtacgcaca

SEQ ID NO: 2926253 - DNA, 16 bp, Homo sapiens
atccaggtacgcacag

SEQ ID NO: 2926254 - DNA, 21 bp, Homo sapiens
atccaggtacgcacagacagg

SEQ ID NO: 2926255 - DNA, 15 bp, Homo sapiens
atccaggtcaacaga

SEQ ID NO: 2926256 - DNA, 16 bp, Homo sapiens
atccaggtcaacagaa

SEQ ID NO: 2926257 - DNA, 17 bp, Homo sapiens
atccaggtcaacagaat

SEQ ID NO: 2926258 - DNA, 21 bp, Homo sapiens
atccaggtcaacagaatgaaa

SEQ ID NO: 2926259 - DNA, 13 bp, Homo sapiens
atccataaagaag

SEQ ID NO: 2926260 - DNA, 14 bp, Homo sapiens
atccataaagaagc

SEQ ID NO: 2926261 - DNA, 16 bp, Homo sapiens
atccatagtagtatga

SEQ ID NO: 2926262 - DNA, 20 bp, Homo sapiens
atccatattacgttgtttct

SEQ ID NO: 2926263 - DNA, 18 bp, Homo sapiens
atccatcatcatgtgtgt

SEQ ID NO: 2926264 - DNA, 13 bp, Homo sapiens
atccatctgtccg

SEQ ID NO: 2926265 - DNA, 23 bp, Homo sapiens
atccatctgtccgtccagagccg

SEQ ID NO: 2926266 - DNA, 12 bp, Homo sapiens
atccatgtaatg

SEQ ID NO: 2926267 - DNA, 13 bp, Homo sapiens
atccatgtaatga

SEQ ID NO: 2926268 - DNA, 17 bp, Homo sapiens
atccattgaaagtgctt

SEQ ID NO: 2926269 - DNA, 14 bp, Homo sapiens
atccatttaaacta

SEQ ID NO: 2926270 - DNA, 15 bp, Homo sapiens
atcccaaagcaagga

SEQ ID NO: 2926271 - DNA, 16 bp, Homo sapiens
atcccaacactgccag

SEQ ID NO: 2926272 - DNA, 15 bp, Homo sapiens
atcccacagccctag

SEQ ID NO: 2926273 - DNA, 18 bp, Homo sapiens
atcccacctccatcccag

SEQ ID NO: 2926274 - DNA, 19 bp, Homo sapiens
atcccactaatgcaaactg

SEQ ID NO: 2926275 - DNA, 14 bp, Homo sapiens
atcccactggatct

SEQ ID NO: 2926276 - DNA, 19 bp, Homo sapiens
atcccagctttaaaaagaa

SEQ ID NO: 2926277 - DNA, 21 bp, Homo sapiens
atcccagctttaaaaagaaaa

SEQ ID NO: 2926278 - DNA, 17 bp, Homo sapiens
atcccattgccctggtt

SEQ ID NO: 2926279 - DNA, 16 bp, Homo sapiens
atccccaagtgtgaac

SEQ ID NO: 2926280 - DNA, 12 bp, Homo sapiens
atccccaataat

SEQ ID NO: 2926281 - DNA, 22 bp, Homo sapiens
atccccacaggcacattaactg

SEQ ID NO: 2926282 - DNA, 17 bp, Homo sapiens
atccccagagcccagct

SEQ ID NO: 2926283 - DNA, 22 bp, Homo sapiens
atccccagttcgcctggagccc

SEQ ID NO: 2926284 - DNA, 23 bp, Homo sapiens
atccccatcggccctgtcccctg

SEQ ID NO: 2926285 - DNA, 19 bp, Homo sapiens
atcccccccacctctccct

SEQ ID NO: 2926286 - DNA, 22 bp, Homo sapiens
atccccgcagtgtgcactaagg

SEQ ID NO: 2926287 - DNA, 20 bp, Homo sapiens
atcccctccctccttcactc

SEQ ID NO: 2926288 - DNA, 12 bp, Homo sapiens
atccccttgaac

SEQ ID NO: 2926289 - DNA, 22 bp, Homo sapiens
atcccgcttagcgctctggaca

SEQ ID NO: 2926290 - DNA, 18 bp, Homo sapiens
atcccggctgaccctgtg

SEQ ID NO: 2926291 - DNA, 22 bp, Homo sapiens
atcccggctgaccctgtgcccc

SEQ ID NO: 2926292 - DNA, 20 bp, Homo sapiens
atcccgtgaaagtttttaat

SEQ ID NO: 2926293 - DNA, 17 bp, Homo sapiens
atccctatgtttgtctc

SEQ ID NO: 2926294 - DNA, 23 bp, Homo sapiens
atccctcaaaccttgaggagaag

SEQ ID NO: 2926295 - DNA, 16 bp, Homo sapiens
atccctcaccttctga

SEQ ID NO: 2926296 - DNA, 11 bp, Homo sapiens
atccctcatct

SEQ ID NO: 2926297 - DNA, 18 bp, Homo sapiens
atccctcccccccatgca

SEQ ID NO: 2926298 - DNA, 21 bp, Homo sapiens
atccctctacagagcttccct

SEQ ID NO: 2926299 - DNA, 22 bp, Homo sapiens
atccctctacagagcttccctg

SEQ ID NO: 2926300 - DNA, 17 bp, Homo sapiens
atccctgggcattgctt

SEQ ID NO: 2926301 - DNA, 15 bp, Homo sapiens
atcccttcctgtctg

SEQ ID NO: 2926302 - DNA, 16 bp, Homo sapiens
atcccttcctgtctga

SEQ ID NO: 2926303 - DNA, 20 bp, Homo sapiens
atccgaacctcctctgtgaa

SEQ ID NO: 2926304 - DNA, 14 bp, Homo sapiens
atccgaatctcttt

SEQ ID NO: 2926305 - DNA, 22 bp, Homo sapiens
atccgcagactgcttggccaga

SEQ ID NO: 2926306 - DNA, 13 bp, Homo sapiens
atccgccagggcc

SEQ ID NO: 2926307 - DNA, 16 bp, Homo sapiens
atccgcccgcctcggc

SEQ ID NO: 2926308 - DNA, 15 bp, Homo sapiens
atccgcgtgtgcctg

SEQ ID NO: 2926309 - DNA, 16 bp, Homo sapiens
atccgcgtgtgcctgt

SEQ ID NO: 2926310 - DNA, 14 bp, Homo sapiens
atccgggcaatgct

SEQ ID NO: 2926311 - DNA, 14 bp, Homo sapiens
atcctaaaaatctg

SEQ ID NO: 2926312 - DNA, 17 bp, Homo sapiens
atcctaaagattattac

SEQ ID NO: 2926313 - DNA, 18 bp, Homo sapiens
atcctaagggtcgaaagc

SEQ ID NO: 2926314 - DNA, 18 bp, Homo sapiens
atcctacaatattttatt

SEQ ID NO: 2926315 - DNA, 14 bp, Homo sapiens
atcctaccccctgt

SEQ ID NO: 2926316 - DNA, 22 bp, Homo sapiens
atcctaccttttgataaaatgt

SEQ ID NO: 2926317 - DNA, 20 bp, Homo sapiens
atcctagattatatcaaagt

SEQ ID NO: 2926318 - DNA, 19 bp, Homo sapiens
atcctagcacatgcttcaa

SEQ ID NO: 2926319 - DNA, 21 bp, Homo sapiens
atcctagccctcattttaatt

SEQ ID NO: 2926320 - DNA, 23 bp, Homo sapiens
atcctagtctctatcattaaagt

SEQ ID NO: 2926321 - DNA, 13 bp, Homo sapiens
atcctagtgcttt

SEQ ID NO: 2926322 - DNA, 12 bp, Homo sapiens
atcctatgtgat

SEQ ID NO: 2926323 - DNA, 14 bp, Homo sapiens
atcctatgtgattt

SEQ ID NO: 2926324 - DNA, 12 bp, Homo sapiens
atcctatgtttt

SEQ ID NO: 2926325 - DNA, 15 bp, Homo sapiens
atgaaacttctcagt

SEQ ID NO: 2926326 - DNA, 14 bp, Homo sapiens
atgaaagaaaggcc

SEQ ID NO: 2926327 - DNA, 16 bp, Homo sapiens
atgaaagattccacag

SEQ ID NO: 2926328 - DNA, 16 bp, Homo sapiens
atgaaaggcttttaaa

SEQ ID NO: 2926329 - DNA, 14 bp, Homo sapiens
atgaaataaaatta

SEQ ID NO: 2926330 - DNA, 13 bp, Homo sapiens
atgaaatattgct

SEQ ID NO: 2926331 - DNA, 19 bp, Homo sapiens
atgaaatgaggagaaacag

SEQ ID NO: 2926332 - DNA, 23 bp, Homo sapiens
atgaaattacttatcatccacat

SEQ ID NO: 2926333 - DNA, 16 bp, Homo sapiens
atgaaattttgcctgc

SEQ ID NO: 2926334 - DNA, 16 bp, Homo sapiens
atgaacacaatcacgt

SEQ ID NO: 2926335 - DNA, 21 bp, Homo sapiens
atgaacagggcccaggcctgg

SEQ ID NO: 2926336 - DNA, 20 bp, Homo sapiens
atgaacattagaaaaatagc

SEQ ID NO: 2926337 - DNA, 21 bp, Homo sapiens
atgaacattttatttttgaaa

SEQ ID NO: 2926338 - DNA, 18 bp, Homo sapiens
atgaacctgcaagccttc

SEQ ID NO: 2926339 - DNA, 21 bp, Homo sapiens
atgaaccttctggcctcccac

SEQ ID NO: 2926340 - DNA, 13 bp, Homo sapiens
atgaactattccc

SEQ ID NO: 2926341 - DNA, 12 bp, Homo sapiens
atgaactggctt

SEQ ID NO: 2926342 - DNA, 17 bp, Homo sapiens
atgaactggcttgtaca

SEQ ID NO: 2926343 - DNA, 18 bp, Homo sapiens
atgaactggcttgtacat

SEQ ID NO: 2926344 - DNA, 12 bp, Homo sapiens
atgaactgtccg

SEQ ID NO: 2926345 - DNA, 17 bp, Homo sapiens
atgaacttcgcatcaaa

SEQ ID NO: 2926346 - DNA, 18 bp, Homo sapiens
atgaacttgtaaaggaat

SEQ ID NO: 2926347 - DNA, 14 bp, Homo sapiens
atgaagaaagggag

SEQ ID NO: 2926348 - DNA, 22 bp, Homo sapiens
atgaagaaagggaggcccagcc

SEQ ID NO: 2926349 - DNA, 14 bp, Homo sapiens
atgaagaaagtgga

SEQ ID NO: 2926350 - DNA, 14 bp, Homo sapiens
atgaagaaggaagc

SEQ ID NO: 2926351 - DNA, 21 bp, Homo sapiens
atgaagaatataccatttcaa

SEQ ID NO: 2926352 - DNA, 17 bp, Homo sapiens
atgaagaccaaatgata

SEQ ID NO: 2926353 - DNA, 19 bp, Homo sapiens
atgaagatctttatatttc

SEQ ID NO: 2926354 - DNA, 16 bp, Homo sapiens
atgaagatgaagagct

SEQ ID NO: 2926355 - DNA, 14 bp, Homo sapiens
atgaagcaagctgt

SEQ ID NO: 2926356 - DNA, 20 bp, Homo sapiens
atgaagcaagctgtgttact

SEQ ID NO: 2926357 - DNA, 21 bp, Homo sapiens
atgaagcaagctgtgttactt

SEQ ID NO: 2926358 - DNA, 23 bp, Homo sapiens
atgaagcaagctgtgttacttga

SEQ ID NO: 2926359 - DNA, 20 bp, Homo sapiens
atgaagcataatttgtttaa

SEQ ID NO: 2926360 - DNA, 18 bp, Homo sapiens
atgaagccgaccttagat

SEQ ID NO: 2926361 - DNA, 14 bp, Homo sapiens
atgaagctacctca

SEQ ID NO: 2926362 - DNA, 15 bp, Homo sapiens
atgaagctacctcaa

SEQ ID NO: 2926363 - DNA, 13 bp, Homo sapiens
atgaagcttgtgt

SEQ ID NO: 2926364 - DNA, 17 bp, Homo sapiens
atgaagggcgagtgaat

SEQ ID NO: 2926365 - DNA, 16 bp, Homo sapiens
atgaaggtgtgctaca

SEQ ID NO: 2926366 - DNA, 17 bp, Homo sapiens
atgaaggtgtgctacag

SEQ ID NO: 2926367 - DNA, 18 bp, Homo sapiens
atgaaggttttcatttgc

SEQ ID NO: 2926368 - DNA, 20 bp, Homo sapiens
atgaagtgctacagaaagca

SEQ ID NO: 2926369 - DNA, 16 bp, Homo sapiens
atgaagttttacattg

SEQ ID NO: 2926370 - DNA, 15 bp, Homo sapiens
atgaatacagcagca

SEQ ID NO: 2926371 - DNA, 21 bp, Homo sapiens
atgaatactgtattttgtatt

SEQ ID NO: 2926372 - DNA, 16 bp, Homo sapiens
atgaatataatgaatg

SEQ ID NO: 2926373 - DNA, 21 bp, Homo sapiens
atgaatcaaaagtgcctcaag

SEQ ID NO: 2926374 - DNA, 19 bp, Homo sapiens
atgaatcactgtttttaga

SEQ ID NO: 2926375 - DNA, 23 bp, Homo sapiens
atgaatcactgtttttagacacc

SEQ ID NO: 2926376 - DNA, 20 bp, Homo sapiens
atgaatcgcttctcttttga

SEQ ID NO: 2926377 - DNA, 15 bp, Homo sapiens
atgaatctacatttg

SEQ ID NO: 2926378 - DNA, 22 bp, Homo sapiens
atgaatgaggaacaatcacaaa

SEQ ID NO: 2926379 - DNA, 21 bp, Homo sapiens
atgaatgcagcactgctgcct

SEQ ID NO: 2926380 - DNA, 20 bp, Homo sapiens
atgaatgcccccagctggcc

SEQ ID NO: 2926381 - DNA, 21 bp, Homo sapiens
atgaatgcccccagctggccc

SEQ ID NO: 2926382 - DNA, 18 bp, Homo sapiens
atgaatggactcatctta

SEQ ID NO: 2926383 - DNA, 14 bp, Homo sapiens
atgaatgtaaaaga

SEQ ID NO: 2926384 - DNA, 17 bp, Homo sapiens
atgaatgtatttatttg

SEQ ID NO: 2926385 - DNA, 22 bp, Homo sapiens
atgaatttattgcacattgttc

SEQ ID NO: 2926386 - DNA, 14 bp, Homo sapiens
atgaatttgactgg

SEQ ID NO: 2926387 - DNA, 14 bp, Homo sapiens
atgacaaaaaatgt

SEQ ID NO: 2926388 - DNA, 13 bp, Homo sapiens
atgacaaacccag

SEQ ID NO: 2926389 - DNA, 14 bp, Homo sapiens
atgacaagatggta

SEQ ID NO: 2926390 - DNA, 14 bp, Homo sapiens
atgacaagctgtat

SEQ ID NO: 2926391 - DNA, 19 bp, Homo sapiens
atgacaagctgtatcactg

SEQ ID NO: 2926392 - DNA, 20 bp, Homo sapiens
atgacaagctgtatcactgc

SEQ ID NO: 2926393 - DNA, 14 bp, Homo sapiens
atgacacaatgaca

SEQ ID NO: 2926394 - DNA, 19 bp, Homo sapiens
atgacaccatcagacatta

SEQ ID NO: 2926395 - DNA, 20 bp, Homo sapiens
atgacagtccgtcaaaacag

SEQ ID NO: 2926396 - DNA, 12 bp, Homo sapiens
atgacatcaaaa

SEQ ID NO: 2926397 - DNA, 15 bp, Homo sapiens
atgacatcaaaatga

SEQ ID NO: 2926398 - DNA, 22 bp, Homo sapiens
atgacatgaggaaaataatgta

SEQ ID NO: 2926399 - DNA, 21 bp, Homo sapiens
atgacatttctttgtgctttg

SEQ ID NO: 2926400 - DNA, 22 bp, Homo sapiens
atgacatttctttgtgctttgg

SEQ ID NO: 2926401 - DNA, 21 bp, Homo sapiens
atgaccaaagtcccttcctgc

SEQ ID NO: 2926402 - DNA, 16 bp, Homo sapiens
atgaccacgcacctcc

SEQ ID NO: 2926403 - DNA, 22 bp, Homo sapiens
atgaccctctgtccccaggcct

SEQ ID NO: 2926404 - DNA, 19 bp, Homo sapiens
atgacctcaagtagcactg

SEQ ID NO: 2926405 - DNA, 21 bp, Homo sapiens
atgaccttatccttcctctcc

SEQ ID NO: 2926406 - DNA, 18 bp, Homo sapiens
atgaccttccaagtttga

SEQ ID NO: 2926407 - DNA, 17 bp, Homo sapiens
atgacgtttaaggccac

SEQ ID NO: 2926408 - DNA, 18 bp, Homo sapiens
atgactaaagtaccagat

SEQ ID NO: 2926409 - DNA, 15 bp, Homo sapiens
atgactcatgcctct

SEQ ID NO: 2926410 - DNA, 16 bp, Homo sapiens
atgactcatgcctctg

SEQ ID NO: 2926411 - DNA, 17 bp, Homo sapiens
atgactcatgcctctga

SEQ ID NO: 2926412 - DNA, 23 bp, Homo sapiens
atgactgaaagaagaacagctgt

SEQ ID NO: 2926413 - DNA, 16 bp, Homo sapiens
atgactgcatttgtgt

SEQ ID NO: 2926414 - DNA, 20 bp, Homo sapiens
atgactgcatttgtgtgtgt

SEQ ID NO: 2926415 - DNA, 13 bp, Homo sapiens
atgactggcattt

SEQ ID NO: 2926416 - DNA, 14 bp, Homo sapiens
atgactggcatttt

SEQ ID NO: 2926417 - DNA, 15 bp, Homo sapiens
atgactggcatttta

SEQ ID NO: 2926418 - DNA, 16 bp, Homo sapiens
atgacttagaaacaat

SEQ ID NO: 2926419 - DNA, 22 bp, Homo sapiens
atgacttattgtggataacaaa

SEQ ID NO: 2926420 - DNA, 18 bp, Homo sapiens
atgactttttataaaatg

SEQ ID NO: 2926421 - DNA, 14 bp, Homo sapiens
atgagaaactgcat

SEQ ID NO: 2926422 - DNA, 19 bp, Homo sapiens
atgagaaagccttcttttg

SEQ ID NO: 2926423 - DNA, 20 bp, Homo sapiens
atgagaaaggacagagccag

SEQ ID NO: 2926424 - DNA, 22 bp, Homo sapiens
atgagaaatacaaaaatactca

SEQ ID NO: 2926425 - DNA, 15 bp, Homo sapiens
atgagacaaacatgc

SEQ ID NO: 2926426 - DNA, 22 bp, Homo sapiens
atgagacataggccatgaaaaa

SEQ ID NO: 2926427 - DNA, 19 bp, Homo sapiens
atgagacttgagtctattt

SEQ ID NO: 2926428 - DNA, 17 bp, Homo sapiens
atgagatattaaattct

SEQ ID NO: 2926429 - DNA, 21 bp, Homo sapiens
atgagatattaaattctcaaa

SEQ ID NO: 2926430 - DNA, 12 bp, Homo sapiens
atgagatgtgtg

SEQ ID NO: 2926431 - DNA, 14 bp, Homo sapiens
atgagattcagtga

SEQ ID NO: 2926432 - DNA, 16 bp, Homo sapiens
atgagcactcctgatt

SEQ ID NO: 2926433 - DNA, 20 bp, Homo sapiens
atgagcactcctgattttta

SEQ ID NO: 2926434 - DNA, 15 bp, Homo sapiens
atgagccaaaaactg

SEQ ID NO: 2926435 - DNA, 17 bp, Homo sapiens
atgagcctgtttattgc

SEQ ID NO: 2926436 - DNA, 14 bp, Homo sapiens
atgagctcctcttc

SEQ ID NO: 2926437 - DNA, 16 bp, Homo sapiens
atgagctctacccagg

SEQ ID NO: 2926438 - DNA, 18 bp, Homo sapiens
atgagctctacccagggc

SEQ ID NO: 2926439 - DNA, 22 bp, Homo sapiens
atgaggaactgtagatgatgta

SEQ ID NO: 2926440 - DNA, 14 bp, Homo sapiens
atgaggagttgctg

SEQ ID NO: 2926441 - DNA, 23 bp, Homo sapiens
atgaggccactgctgcttctcca

SEQ ID NO: 2926442 - DNA, 21 bp, Homo sapiens
atgaggggttaatttatcagt

SEQ ID NO: 2926443 - DNA, 20 bp, Homo sapiens
atgagggtcttggttccagc

SEQ ID NO: 2926444 - DNA, 15 bp, Homo sapiens
atgaggtcagactag

SEQ ID NO: 2926445 - DNA, 13 bp, Homo sapiens
atgaggtgggggt

SEQ ID NO: 2926446 - DNA, 17 bp, Homo sapiens
atgagtatttggtccaa

SEQ ID NO: 2926447 - DNA, 23 bp, Homo sapiens
atgagtatttggtccaaaaaaag

SEQ ID NO: 2926448 - DNA, 16 bp, Homo sapiens
atgagtccttgaaaat

SEQ ID NO: 2926449 - DNA, 15 bp, Homo sapiens
atgagtggaaaaagc

SEQ ID NO: 2926450 - DNA, 13 bp, Homo sapiens
atgagtggccagc

SEQ ID NO: 2926451 - DNA, 16 bp, Homo sapiens
atgagttactgtgcat

SEQ ID NO: 2926452 - DNA, 16 bp, Homo sapiens
atgagttatctaagaa

SEQ ID NO: 2926453 - DNA, 17 bp, Homo sapiens
atgagttatgagttatt

SEQ ID NO: 2926454 - DNA, 13 bp, Homo sapiens
atgagtttaaaaa

SEQ ID NO: 2926455 - DNA, 16 bp, Homo sapiens
atgataataataataa

SEQ ID NO: 2926456 - DNA, 17 bp, Homo sapiens
atgatagatttgacctc

SEQ ID NO: 2926457 - DNA, 16 bp, Homo sapiens
atgggctgtgattact

SEQ ID NO: 2926458 - DNA, 20 bp, Homo sapiens
atgggcttttacctgtgcac

SEQ ID NO: 2926459 - DNA, 21 bp, Homo sapiens
atggggaggtggcactaggga

SEQ ID NO: 2926460 - DNA, 18 bp, Homo sapiens
atggggatagtctgggtc

SEQ ID NO: 2926461 - DNA, 15 bp, Homo sapiens
atggggccagatcca

SEQ ID NO: 2926462 - DNA, 20 bp, Homo sapiens
atggggccctaattcagcca

SEQ ID NO: 2926463 - DNA, 19 bp, Homo sapiens
atgggggagattgaacttt

SEQ ID NO: 2926464 - DNA, 19 bp, Homo sapiens
atgggggagtctgaagcag

SEQ ID NO: 2926465 - DNA, 20 bp, Homo sapiens
atgggggagtctgaagcaga

SEQ ID NO: 2926466 - DNA, 21 bp, Homo sapiens
atgggggagtctgaagcagat

SEQ ID NO: 2926467 - DNA, 12 bp, Homo sapiens
atgggggctttc

SEQ ID NO: 2926468 - DNA, 22 bp, Homo sapiens
atgggggctttcggggagggcg

SEQ ID NO: 2926469 - DNA, 15 bp, Homo sapiens
atggggggatttttt

SEQ ID NO: 2926470 - DNA, 13 bp, Homo sapiens
atgggtacagagg

SEQ ID NO: 2926471 - DNA, 15 bp, Homo sapiens
atgggtcatgacaag

SEQ ID NO: 2926472 - DNA, 19 bp, Homo sapiens
atgggtcctcggcccatct

SEQ ID NO: 2926473 - DNA, 20 bp, Homo sapiens
atgggtcgggagaggggacg

SEQ ID NO: 2926474 - DNA, 22 bp, Homo sapiens
atgggtctggctagagggccca

SEQ ID NO: 2926475 - DNA, 21 bp, Homo sapiens
atgggtgtatgaatggtctag

SEQ ID NO: 2926476 - DNA, 16 bp, Homo sapiens
atgggttttatgagat

SEQ ID NO: 2926477 - DNA, 20 bp, Homo sapiens
atggtaccaatcatgaatct

SEQ ID NO: 2926478 - DNA, 16 bp, Homo sapiens
atggtaccagatgcag

SEQ ID NO: 2926479 - DNA, 23 bp, Homo sapiens
atggtagaaaatgcaccaaatag

SEQ ID NO: 2926480 - DNA, 21 bp, Homo sapiens
atggtagattcgctgtcccct

SEQ ID NO: 2926481 - DNA, 23 bp, Homo sapiens
atggtagattcgctgtcccctca

SEQ ID NO: 2926482 - DNA, 17 bp, Homo sapiens
atggtagctgaaaaaac

SEQ ID NO: 2926483 - DNA, 24 bp, Homo sapiens
atggtagctgaaaaaactatattt

SEQ ID NO: 2926484 - DNA, 12 bp, Homo sapiens
atggtatatata

SEQ ID NO: 2926485 - DNA, 16 bp, Homo sapiens
atggtatatatacata

SEQ ID NO: 2926486 - DNA, 21 bp, Homo sapiens
atggtatatttggtactgtat

SEQ ID NO: 2926487 - DNA, 19 bp, Homo sapiens
atggtcacacactgatgct

SEQ ID NO: 2926488 - DNA, 22 bp, Homo sapiens
atggtcacttaaaatgtgcagt

SEQ ID NO: 2926489 - DNA, 18 bp, Homo sapiens
atggtcagccctagggtg

SEQ ID NO: 2926490 - DNA, 17 bp, Homo sapiens
atggtcattgcagttta

SEQ ID NO: 2926491 - DNA, 19 bp, Homo sapiens
atggtccaggagaaggcca

SEQ ID NO: 2926492 - DNA, 13 bp, Homo sapiens
atggtccatcact

SEQ ID NO: 2926493 - DNA, 16 bp, Homo sapiens
atggtcccacctgtgc

SEQ ID NO: 2926494 - DNA, 17 bp, Homo sapiens
atggtgactgatttcaa

SEQ ID NO: 2926495 - DNA, 19 bp, Homo sapiens
atggtgagatgcagctgga

SEQ ID NO: 2926496 - DNA, 13 bp, Homo sapiens
atggtgatttctt

SEQ ID NO: 2926497 - DNA, 16 bp, Homo sapiens
atggtgatttcttgct

SEQ ID NO: 2926498 - DNA, 23 bp, Homo sapiens
atggtgatttcttgctaagctcc

SEQ ID NO: 2926499 - DNA, 19 bp, Homo sapiens
atggtgcattacgtgggca

SEQ ID NO: 2926500 - DNA, 21 bp, Homo sapiens
atggtgccccaggaccagctc

SEQ ID NO: 2926501 - DNA, 22 bp, Homo sapiens
atggtgctaatattttatttga

SEQ ID NO: 2926502 - DNA, 13 bp, Homo sapiens
atggtgctgccca

SEQ ID NO: 2926503 - DNA, 20 bp, Homo sapiens
atggtgctgggtaataaaat

SEQ ID NO: 2926504 - DNA, 14 bp, Homo sapiens
atggtggagggcca

SEQ ID NO: 2926505 - DNA, 19 bp, Homo sapiens
atggtggcatgcacctgca

SEQ ID NO: 2926506 - DNA, 19 bp, Homo sapiens
atggtgtgtgtctctgaca

SEQ ID NO: 2926507 - DNA, 14 bp, Homo sapiens
atggtgtgttacac

SEQ ID NO: 2926508 - DNA, 21 bp, Homo sapiens
atggtgttgtcacaaactgtg

SEQ ID NO: 2926509 - DNA, 17 bp, Homo sapiens
atggtgtttttcttgta

SEQ ID NO: 2926510 - DNA, 19 bp, Homo sapiens
atggtgtttttcttgtaaa

SEQ ID NO: 2926511 - DNA, 18 bp, Homo sapiens
atggttaagagtccaaga

SEQ ID NO: 2926512 - DNA, 13 bp, Homo sapiens
atggttctcaatt

SEQ ID NO: 2926513 - DNA, 14 bp, Homo sapiens
atggttctcaattt

SEQ ID NO: 2926514 - DNA, 15 bp, Homo sapiens
atggttgagttacat

SEQ ID NO: 2926515 - DNA, 13 bp, Homo sapiens
atggtttcctctg

SEQ ID NO: 2926516 - DNA, 14 bp, Homo sapiens
atgtaaaaaacaaa

SEQ ID NO: 2926517 - DNA, 17 bp, Homo sapiens
atgtaaaaaacaaaaaa

SEQ ID NO: 2926518 - DNA, 11 bp, Homo sapiens
atgtaaaaaag

SEQ ID NO: 2926519 - DNA, 13 bp, Homo sapiens
atgtaaaaaagaa

SEQ ID NO: 2926520 - DNA, 19 bp, Homo sapiens
atgtaaaaaagaaaaacac

SEQ ID NO: 2926521 - DNA, 13 bp, Homo sapiens
atgtaaaacacat

SEQ ID NO: 2926522 - DNA, 16 bp, Homo sapiens
atgtaaaagacactgg

SEQ ID NO: 2926523 - DNA, 18 bp, Homo sapiens
atgtaaaaggccaaacct

SEQ ID NO: 2926524 - DNA, 17 bp, Homo sapiens
atgtaaaatcttcagct

SEQ ID NO: 2926525 - DNA, 24 bp, Homo sapiens
atgtaaaatcttcagctggtggat

SEQ ID NO: 2926526 - DNA, 13 bp, Homo sapiens
atgtaaaatgttt

SEQ ID NO: 2926527 - DNA, 22 bp, Homo sapiens
atgtaaacagtgcctgctgaat

SEQ ID NO: 2926528 - DNA, 12 bp, Homo sapiens
atgtaaacattt

SEQ ID NO: 2926529 - DNA, 13 bp, Homo sapiens
atgtaaagccatg

SEQ ID NO: 2926530 - DNA, 14 bp, Homo sapiens
atgtaaagccatgc

SEQ ID NO: 2926531 - DNA, 14 bp, Homo sapiens
atgtaaagcttgtc

SEQ ID NO: 2926532 - DNA, 14 bp, Homo sapiens
atgtaaataactct

SEQ ID NO: 2926533 - DNA, 15 bp, Homo sapiens
atgtaaatgctcaaa

SEQ ID NO: 2926534 - DNA, 16 bp, Homo sapiens
atgtaacagtctgatc

SEQ ID NO: 2926535 - DNA, 12 bp, Homo sapiens
atgtaacatgat

SEQ ID NO: 2926536 - DNA, 19 bp, Homo sapiens
atgtaagaattcagaagac

SEQ ID NO: 2926537 - DNA, 22 bp, Homo sapiens
atgtaagattatagattctaaa

SEQ ID NO: 2926538 - DNA, 17 bp, Homo sapiens
atgtaagggtctttggt

SEQ ID NO: 2926539 - DNA, 21 bp, Homo sapiens
atgtaataactgcatgtgtct

SEQ ID NO: 2926540 - DNA, 17 bp, Homo sapiens
atgtaataatcatttta

SEQ ID NO: 2926541 - DNA, 18 bp, Homo sapiens
atgtaataatcattttag

SEQ ID NO: 2926542 - DNA, 18 bp, Homo sapiens
atgtaatatatcctgaaa

SEQ ID NO: 2926543 - DNA, 17 bp, Homo sapiens
atgtaatcggcttgaat

SEQ ID NO: 2926544 - DNA, 19 bp, Homo sapiens
atgtaatcttgaattgtaa

SEQ ID NO: 2926545 - DNA, 18 bp, Homo sapiens
atgtaatgcgattttatt

SEQ ID NO: 2926546 - DNA, 12 bp, Homo sapiens
atgtaatgtttt

SEQ ID NO: 2926547 - DNA, 19 bp, Homo sapiens
atgtaattgtaattttgaa

SEQ ID NO: 2926548 - DNA, 18 bp, Homo sapiens
atgtacaaaaattatgca

SEQ ID NO: 2926549 - DNA, 15 bp, Homo sapiens
atgtacaaggtatgt

SEQ ID NO: 2926550 - DNA, 13 bp, Homo sapiens
atgtacagacaga

SEQ ID NO: 2926551 - DNA, 18 bp, Homo sapiens
atgtacagacatatttaa

SEQ ID NO: 2926552 - DNA, 19 bp, Homo sapiens
atgtacagacatatttaac

SEQ ID NO: 2926553 - DNA, 23 bp, Homo sapiens
atgtacagttcataaatttgttg

SEQ ID NO: 2926554 - DNA, 17 bp, Homo sapiens
atgtacatagaccctct

SEQ ID NO: 2926555 - DNA, 17 bp, Homo sapiens
atgtacatagtaaagta

SEQ ID NO: 2926556 - DNA, 14 bp, Homo sapiens
atgtacatttggaa

SEQ ID NO: 2926557 - DNA, 15 bp, Homo sapiens
atgtactggagagtg

SEQ ID NO: 2926558 - DNA, 16 bp, Homo sapiens
atgtactggtaattgt

SEQ ID NO: 2926559 - DNA, 19 bp, Homo sapiens
atgtactggtaattgtaca

SEQ ID NO: 2926560 - DNA, 20 bp, Homo sapiens
atgtactggtaattgtacaa

SEQ ID NO: 2926561 - DNA, 17 bp, Homo sapiens
atgtacttgtcaaagaa

SEQ ID NO: 2926562 - DNA, 12 bp, Homo sapiens
atgtagaaagct

SEQ ID NO: 2926563 - DNA, 20 bp, Homo sapiens
atgtagacattgtaaataaa

SEQ ID NO: 2926564 - DNA, 12 bp, Homo sapiens
atgtagcagcag

SEQ ID NO: 2926565 - DNA, 19 bp, Homo sapiens
atgtagcagcagcctactg

SEQ ID NO: 2926566 - DNA, 19 bp, Homo sapiens
atgtagccagttaaggaaa

SEQ ID NO: 2926567 - DNA, 20 bp, Homo sapiens
atgtagccagttaaggaaag

SEQ ID NO: 2926568 - DNA, 20 bp, Homo sapiens
atgtagcccatccttccctt

SEQ ID NO: 2926569 - DNA, 21 bp, Homo sapiens
atgtagccccctggcctctgt

SEQ ID NO: 2926570 - DNA, 18 bp, Homo sapiens
atgtagcttttcaccttt

SEQ ID NO: 2926571 - DNA, 18 bp, Homo sapiens
atgtagggtaaggtgcct

SEQ ID NO: 2926572 - DNA, 17 bp, Homo sapiens
atgtagtaattgacatg

SEQ ID NO: 2926573 - DNA, 18 bp, Homo sapiens
atgtagtaattgacatgt

SEQ ID NO: 2926574 - DNA, 18 bp, Homo sapiens
atgtagtattcaatgatt

SEQ ID NO: 2926575 - DNA, 22 bp, Homo sapiens
atgtagtgtgggaggctcctgt

SEQ ID NO: 2926576 - DNA, 16 bp, Homo sapiens
atgtagttctttgttc

SEQ ID NO: 2926577 - DNA, 18 bp, Homo sapiens
atgtatacacaaatatat

SEQ ID NO: 2926578 - DNA, 15 bp, Homo sapiens
atgtatattcctttg

SEQ ID NO: 2926579 - DNA, 22 bp, Homo sapiens
atgtatattcttccttgattgt

SEQ ID NO: 2926580 - DNA, 17 bp, Homo sapiens
atgtatcataattacca

SEQ ID NO: 2926581 - DNA, 15 bp, Homo sapiens
atgtatccagaggaa

SEQ ID NO: 2926582 - DNA, 14 bp, Homo sapiens
atgtatcgcatatt

SEQ ID NO: 2926583 - DNA, 22 bp, Homo sapiens
atgtatcgcatattagttaatc

SEQ ID NO: 2926584 - DNA, 14 bp, Homo sapiens
atgtatctgtctac

SEQ ID NO: 2926585 - DNA, 15 bp, Homo sapiens
atgtatctgtctact

SEQ ID NO: 2926586 - DNA, 21 bp, Homo sapiens
atgtatctgtctactttctct

SEQ ID NO: 2926587 - DNA, 23 bp, Homo sapiens
atgtatctgtctactttctcttg

SEQ ID NO: 2926588 - DNA, 14 bp, Homo sapiens
atgtatctgttttg

SEQ ID NO: 2926589 - DNA, 16 bp, Homo sapiens
attagactggacagct

SEQ ID NO: 2926590 - DNA, 16 bp, Homo sapiens
attagagtgtctttcc

SEQ ID NO: 2926591 - DNA, 21 bp, Homo sapiens
attagataatcttttacattg

SEQ ID NO: 2926592 - DNA, 17 bp, Homo sapiens
attagatcccatattta

SEQ ID NO: 2926593 - DNA, 20 bp, Homo sapiens
attagatcccatatttactt

SEQ ID NO: 2926594 - DNA, 23 bp, Homo sapiens
attagatgaattatcctatttca

SEQ ID NO: 2926595 - DNA, 13 bp, Homo sapiens
attagatgcatgt

SEQ ID NO: 2926596 - DNA, 14 bp, Homo sapiens
attagatgcatgtt

SEQ ID NO: 2926597 - DNA, 22 bp, Homo sapiens
attagatgttacaagtttatat

SEQ ID NO: 2926598 - DNA, 13 bp, Homo sapiens
attagatgtttat

SEQ ID NO: 2926599 - DNA, 17 bp, Homo sapiens
attagattcctttcctg

SEQ ID NO: 2926600 - DNA, 17 bp, Homo sapiens
attagcattctggcagt

SEQ ID NO: 2926601 - DNA, 18 bp, Homo sapiens
attagccgggcatgatgg

SEQ ID NO: 2926602 - DNA, 18 bp, Homo sapiens
attagccgggcatggtgg

SEQ ID NO: 2926603 - DNA, 13 bp, Homo sapiens
attagccgtccca

SEQ ID NO: 2926604 - DNA, 18 bp, Homo sapiens
attagcttgcttaaggca

SEQ ID NO: 2926605 - DNA, 17 bp, Homo sapiens
attagcttggggccagg

SEQ ID NO: 2926606 - DNA, 16 bp, Homo sapiens
attagctttttcatcc

SEQ ID NO: 2926607 - DNA, 20 bp, Homo sapiens
attaggaagtcacagattct

SEQ ID NO: 2926608 - DNA, 23 bp, Homo sapiens
attagtaacataataaattaaaa

SEQ ID NO: 2926609 - DNA, 19 bp, Homo sapiens
attagtactgctcttgttt

SEQ ID NO: 2926610 - DNA, 12 bp, Homo sapiens
attagtataata

SEQ ID NO: 2926611 - DNA, 13 bp, Homo sapiens
attagtattcagg

SEQ ID NO: 2926612 - DNA, 17 bp, Homo sapiens
attagtattcaggcact

SEQ ID NO: 2926613 - DNA, 18 bp, Homo sapiens
attagtattcaggcactg

SEQ ID NO: 2926614 - DNA, 23 bp, Homo sapiens
attagtcacctaaccctctgtca

SEQ ID NO: 2926615 - DNA, 17 bp, Homo sapiens
attagtgaactaagtta

SEQ ID NO: 2926616 - DNA, 16 bp, Homo sapiens
attagtgatatttctc

SEQ ID NO: 2926617 - DNA, 23 bp, Homo sapiens
attagtgatgtccttaaaatgtg

SEQ ID NO: 2926618 - DNA, 16 bp, Homo sapiens
attagttttcttgttg

SEQ ID NO: 2926619 - DNA, 14 bp, Homo sapiens
attataaaatattg

SEQ ID NO: 2926620 - DNA, 16 bp, Homo sapiens
attataaacagcaggg

SEQ ID NO: 2926621 - DNA, 17 bp, Homo sapiens
attataaacagcagggt

SEQ ID NO: 2926622 - DNA, 12 bp, Homo sapiens
attataaatgtt

SEQ ID NO: 2926623 - DNA, 13 bp, Homo sapiens
attataaatgtta

SEQ ID NO: 2926624 - DNA, 15 bp, Homo sapiens
attataaatgttagt

SEQ ID NO: 2926625 - DNA, 13 bp, Homo sapiens
attataaatgttt

SEQ ID NO: 2926626 - DNA, 18 bp, Homo sapiens
attataaatgtttggaaa

SEQ ID NO: 2926627 - DNA, 19 bp, Homo sapiens
attataaatgtttggaaag

SEQ ID NO: 2926628 - DNA, 22 bp, Homo sapiens
attataaatgtttggaaaggtt

SEQ ID NO: 2926629 - DNA, 16 bp, Homo sapiens
attataaattctacta

SEQ ID NO: 2926630 - DNA, 20 bp, Homo sapiens
attataaattctactaagtt

SEQ ID NO: 2926631 - DNA, 22 bp, Homo sapiens
attataagggagagctgagcca

SEQ ID NO: 2926632 - DNA, 14 bp, Homo sapiens
attataatcatact

SEQ ID NO: 2926633 - DNA, 14 bp, Homo sapiens
attataatgccaga

SEQ ID NO: 2926634 - DNA, 15 bp, Homo sapiens
attataatgccagaa

SEQ ID NO: 2926635 - DNA, 20 bp, Homo sapiens
attataatgccagaatataa

SEQ ID NO: 2926636 - DNA, 21 bp, Homo sapiens
attataatgccagaatataat

SEQ ID NO: 2926637 - DNA, 17 bp, Homo sapiens
attatacgtatgcattt

SEQ ID NO: 2926638 - DNA, 19 bp, Homo sapiens
attatacgtatgcattttt

SEQ ID NO: 2926639 - DNA, 16 bp, Homo sapiens
attatactgttatcca

SEQ ID NO: 2926640 - DNA, 15 bp, Homo sapiens
attatactttgttgt

SEQ ID NO: 2926641 - DNA, 19 bp, Homo sapiens
attatagattctaaagatt

SEQ ID NO: 2926642 - DNA, 20 bp, Homo sapiens
attatagcaatgtgattttg

SEQ ID NO: 2926643 - DNA, 15 bp, Homo sapiens
attatagcgcctgta

SEQ ID NO: 2926644 - DNA, 18 bp, Homo sapiens
attatagcgcctgtataa

SEQ ID NO: 2926645 - DNA, 21 bp, Homo sapiens
attatagcgcctgtataagta

SEQ ID NO: 2926646 - DNA, 12 bp, Homo sapiens
attatatagcaa

SEQ ID NO: 2926647 - DNA, 18 bp, Homo sapiens
attatatagcaaagatat

SEQ ID NO: 2926648 - DNA, 14 bp, Homo sapiens
attatatatagaaa

SEQ ID NO: 2926649 - DNA, 16 bp, Homo sapiens
attatatatagaaaag

SEQ ID NO: 2926650 - DNA, 20 bp, Homo sapiens
attatattattagttttgat

SEQ ID NO: 2926651 - DNA, 22 bp, Homo sapiens
attatattggtgcgtttttaca

SEQ ID NO: 2926652 - DNA, 16 bp, Homo sapiens
attatcaccaggattt

SEQ ID NO: 2926653 - DNA, 16 bp, Homo sapiens
attatcctagattata

SEQ ID NO: 2926654 - DNA, 17 bp, Homo sapiens
attatcctatttcagta

SEQ ID NO: 2926655 - DNA, 19 bp, Homo sapiens
attatctaaaatctgctag

SEQ ID NO: 2926656 - DNA, 18 bp, Homo sapiens
attatcttggaaagaaac

SEQ ID NO: 2926657 - DNA, 17 bp, Homo sapiens
attatcttttggctctg

SEQ ID NO: 2926658 - DNA, 18 bp, Homo sapiens
attatcttttggctctga

SEQ ID NO: 2926659 - DNA, 20 bp, Homo sapiens
attatgagaggcaatgattg

SEQ ID NO: 2926660 - DNA, 16 bp, Homo sapiens
attatgatggaagaca

SEQ ID NO: 2926661 - DNA, 18 bp, Homo sapiens
attatgcaattcagtgtt

SEQ ID NO: 2926662 - DNA, 16 bp, Homo sapiens
attatgcattcttata

SEQ ID NO: 2926663 - DNA, 17 bp, Homo sapiens
attatgtccactgtgta

SEQ ID NO: 2926664 - DNA, 16 bp, Homo sapiens
attatgtggttttaga

SEQ ID NO: 2926665 - DNA, 16 bp, Homo sapiens
attatgttgttagaga

SEQ ID NO: 2926666 - DNA, 20 bp, Homo sapiens
attatgttgttagagaaaaa

SEQ ID NO: 2926667 - DNA, 23 bp, Homo sapiens
attatgtttttattaagattatt

SEQ ID NO: 2926668 - DNA, 22 bp, Homo sapiens
attattaatgaaaataagaatt

SEQ ID NO: 2926669 - DNA, 22 bp, Homo sapiens
attattagtttacatcattttt

SEQ ID NO: 2926670 - DNA, 22 bp, Homo sapiens
attattagttttgatttaatgt

SEQ ID NO: 2926671 - DNA, 14 bp, Homo sapiens
attattatgaagaa

SEQ ID NO: 2926672 - DNA, 15 bp, Homo sapiens
attattcagtgtcac

SEQ ID NO: 2926673 - DNA, 18 bp, Homo sapiens
attattccgtattacatt

SEQ ID NO: 2926674 - DNA, 12 bp, Homo sapiens
attattcttgta

SEQ ID NO: 2926675 - DNA, 11 bp, Homo sapiens
attatttaaag

SEQ ID NO: 2926676 - DNA, 15 bp, Homo sapiens
attatttaaagaaag

SEQ ID NO: 2926677 - DNA, 17 bp, Homo sapiens
attatttaaatgtactt

SEQ ID NO: 2926678 - DNA, 21 bp, Homo sapiens
attatttaaatgtacttatat

SEQ ID NO: 2926679 - DNA, 14 bp, Homo sapiens
attatttaactctt

SEQ ID NO: 2926680 - DNA, 13 bp, Homo sapiens
attatttattatt

SEQ ID NO: 2926681 - DNA, 23 bp, Homo sapiens
attatttgaaaacatataaagca

SEQ ID NO: 2926682 - DNA, 17 bp, Homo sapiens
attatttgataacattt

SEQ ID NO: 2926683 - DNA, 18 bp, Homo sapiens
attatttgataacatttt

SEQ ID NO: 2926684 - DNA, 11 bp, Homo sapiens
attatttgcat

SEQ ID NO: 2926685 - DNA, 17 bp, Homo sapiens
attatttgtttagatgt

SEQ ID NO: 2926686 - DNA, 14 bp, Homo sapiens
attattttaaaaga

SEQ ID NO: 2926687 - DNA, 14 bp, Homo sapiens
attattttaaaata

SEQ ID NO: 2926688 - DNA, 16 bp, Homo sapiens
attattttaaaatatt

SEQ ID NO: 2926689 - DNA, 14 bp, Homo sapiens
attattttattatg

SEQ ID NO: 2926690 - DNA, 14 bp, Homo sapiens
attattttccaaaa

SEQ ID NO: 2926691 - DNA, 16 bp, Homo sapiens
attattttccttccat

SEQ ID NO: 2926692 - DNA, 15 bp, Homo sapiens
attattttggaaagt

SEQ ID NO: 2926693 - DNA, 14 bp, Homo sapiens
attatttttgtaga

SEQ ID NO: 2926694 - DNA, 16 bp, Homo sapiens
attcaaaagttccaag

SEQ ID NO: 2926695 - DNA, 12 bp, Homo sapiens
attcaaaatatt

SEQ ID NO: 2926696 - DNA, 16 bp, Homo sapiens
attcaaaatatttaaa

SEQ ID NO: 2926697 - DNA, 15 bp, Homo sapiens
attcaaagatgataa

SEQ ID NO: 2926698 - DNA, 14 bp, Homo sapiens
attcaaagcagctg

SEQ ID NO: 2926699 - DNA, 15 bp, Homo sapiens
attcaaagcagctgt

SEQ ID NO: 2926700 - DNA, 16 bp, Homo sapiens
attcaaaggttctagg

SEQ ID NO: 2926701 - DNA, 17 bp, Homo sapiens
attcaaaggttctaggt

SEQ ID NO: 2926702 - DNA, 22 bp, Homo sapiens
attcaacacactgccttattac

SEQ ID NO: 2926703 - DNA, 13 bp, Homo sapiens
attcaactaaaaa

SEQ ID NO: 2926704 - DNA, 14 bp, Homo sapiens
attcaactaaaaaa

SEQ ID NO: 2926705 - DNA, 21 bp, Homo sapiens
attcaagaatgccagtagaaa

SEQ ID NO: 2926706 - DNA, 19 bp, Homo sapiens
attcaaggagaatatgata

SEQ ID NO: 2926707 - DNA, 13 bp, Homo sapiens
attcaataaattg

SEQ ID NO: 2926708 - DNA, 13 bp, Homo sapiens
attcacaaacttt

SEQ ID NO: 2926709 - DNA, 22 bp, Homo sapiens
attcacaaacttttatactctt

SEQ ID NO: 2926710 - DNA, 11 bp, Homo sapiens
attcacagcct

SEQ ID NO: 2926711 - DNA, 21 bp, Homo sapiens
attcacataaccccttgaaac

SEQ ID NO: 2926712 - DNA, 17 bp, Homo sapiens
attcacatctaacctca

SEQ ID NO: 2926713 - DNA, 15 bp, Homo sapiens
attcacatctcattt

SEQ ID NO: 2926714 - DNA, 18 bp, Homo sapiens
attcaccaatgttgtaca

SEQ ID NO: 2926715 - DNA, 18 bp, Homo sapiens
attcacctaagagattct

SEQ ID NO: 2926716 - DNA, 22 bp, Homo sapiens
attcacctaagagattctgatt

SEQ ID NO: 2926717 - DNA, 17 bp, Homo sapiens
attcactgtttcactga

SEQ ID NO: 2926718 - DNA, 20 bp, Homo sapiens
attcagacagatgaggcttt

SEQ ID NO: 2926719 - DNA, 24 bp, Homo sapiens
attcagatttaccataatgttcct

SEQ ID NO: 2926720 - DNA, 18 bp, Homo sapiens
attcagcacactgtgaaa

SEQ ID NO: 2926721 - DNA, 20 bp, Homo sapiens
attcagcacactgtgaaaat

SEQ ID NO: 2926722 - DNA, 21 bp, Homo sapiens
atttcactgtcttttaaaaaa

SEQ ID NO: 2926723 - DNA, 13 bp, Homo sapiens
atttcagatgtaa

SEQ ID NO: 2926724 - DNA, 16 bp, Homo sapiens
atttcagcagctgcag

SEQ ID NO: 2926725 - DNA, 18 bp, Homo sapiens
atttcaggaatttaaaat

SEQ ID NO: 2926726 - DNA, 14 bp, Homo sapiens
atttcaggccctca

SEQ ID NO: 2926727 - DNA, 17 bp, Homo sapiens
atttcagtacttcagca

SEQ ID NO: 2926728 - DNA, 15 bp, Homo sapiens
atttcatattctttc

SEQ ID NO: 2926729 - DNA, 19 bp, Homo sapiens
atttcatgtgctatagaca

SEQ ID NO: 2926730 - DNA, 14 bp, Homo sapiens
atttcattggttaa

SEQ ID NO: 2926731 - DNA, 19 bp, Homo sapiens
atttcatttttacccttac

SEQ ID NO: 2926732 - DNA, 17 bp, Homo sapiens
atttccaaattcacaag

SEQ ID NO: 2926733 - DNA, 13 bp, Homo sapiens
atttccaatgtga

SEQ ID NO: 2926734 - DNA, 14 bp, Homo sapiens
atttccaatgtgaa

SEQ ID NO: 2926735 - DNA, 23 bp, Homo sapiens
atttccatgtcccctcccagagc

SEQ ID NO: 2926736 - DNA, 14 bp, Homo sapiens
atttcccacatctt

SEQ ID NO: 2926737 - DNA, 21 bp, Homo sapiens
atttcccactgcactccagcc

SEQ ID NO: 2926738 - DNA, 23 bp, Homo sapiens
atttcccactgcactccagcctg

SEQ ID NO: 2926739 - DNA, 15 bp, Homo sapiens
atttcccagggttaa

SEQ ID NO: 2926740 - DNA, 15 bp, Homo sapiens
atttccccaacagtg

SEQ ID NO: 2926741 - DNA, 11 bp, Homo sapiens
atttccccagc

SEQ ID NO: 2926742 - DNA, 22 bp, Homo sapiens
atttcccctctgcacccagaac

SEQ ID NO: 2926743 - DNA, 18 bp, Homo sapiens
atttccctccagagaaag

SEQ ID NO: 2926744 - DNA, 20 bp, Homo sapiens
atttccctccagagaaagca

SEQ ID NO: 2926745 - DNA, 16 bp, Homo sapiens
atttcccttccttcct

SEQ ID NO: 2926746 - DNA, 23 bp, Homo sapiens
atttccgtccccccccaggccct

SEQ ID NO: 2926747 - DNA, 19 bp, Homo sapiens
atttcctacacaaatgata

SEQ ID NO: 2926748 - DNA, 17 bp, Homo sapiens
atttcctcacgtgcagg

SEQ ID NO: 2926749 - DNA, 15 bp, Homo sapiens
atttcctctgttctt

SEQ ID NO: 2926750 - DNA, 20 bp, Homo sapiens
atttcctgaaataaatgttt

SEQ ID NO: 2926751 - DNA, 16 bp, Homo sapiens
atttcctgacttgagt

SEQ ID NO: 2926752 - DNA, 22 bp, Homo sapiens
atttcctgttggatttgtttaa

SEQ ID NO: 2926753 - DNA, 18 bp, Homo sapiens
atttcctttgcgcaaact

SEQ ID NO: 2926754 - DNA, 14 bp, Homo sapiens
atttcgatgtacag

SEQ ID NO: 2926755 - DNA, 13 bp, Homo sapiens
atttcgtgtaata

SEQ ID NO: 2926756 - DNA, 22 bp, Homo sapiens
atttcgtttggtcttaggtctt

SEQ ID NO: 2926757 - DNA, 20 bp, Homo sapiens
atttctaccaaggcatatca

SEQ ID NO: 2926758 - DNA, 24 bp, Homo sapiens
atttctagaaaagcttcctagctt

SEQ ID NO: 2926759 - DNA, 20 bp, Homo sapiens
atttctaggaagaattttaa

SEQ ID NO: 2926760 - DNA, 19 bp, Homo sapiens
atttctaggtaggaaatgt

SEQ ID NO: 2926761 - DNA, 20 bp, Homo sapiens
atttctatgtatgtgccaat

SEQ ID NO: 2926762 - DNA, 18 bp, Homo sapiens
atttctcagactttggaa

SEQ ID NO: 2926763 - DNA, 20 bp, Homo sapiens
atttctcataatgtgaaata

SEQ ID NO: 2926764 - DNA, 14 bp, Homo sapiens
atttctcatgtttt

SEQ ID NO: 2926765 - DNA, 16 bp, Homo sapiens
atttctccagaaccca

SEQ ID NO: 2926766 - DNA, 20 bp, Homo sapiens
atttctcctccatgggagaa

SEQ ID NO: 2926767 - DNA, 17 bp, Homo sapiens
atttctctagtagttaa

SEQ ID NO: 2926768 - DNA, 12 bp, Homo sapiens
atttctctgtga

SEQ ID NO: 2926769 - DNA, 14 bp, Homo sapiens
atttctctgtgaat

SEQ ID NO: 2926770 - DNA, 13 bp, Homo sapiens
atttctcttgtcc

SEQ ID NO: 2926771 - DNA, 15 bp, Homo sapiens
atttctcttgtcctt

SEQ ID NO: 2926772 - DNA, 16 bp, Homo sapiens
atttctgagcaaagca

SEQ ID NO: 2926773 - DNA, 17 bp, Homo sapiens
atttctgagcaaagcat

SEQ ID NO: 2926774 - DNA, 18 bp, Homo sapiens
atttctgataagacatga

SEQ ID NO: 2926775 - DNA, 21 bp, Homo sapiens
atttctgcacaggtctctgtt

SEQ ID NO: 2926776 - DNA, 16 bp, Homo sapiens
atttctgcaggttctt

SEQ ID NO: 2926777 - DNA, 13 bp, Homo sapiens
atttctgcatatg

SEQ ID NO: 2926778 - DNA, 22 bp, Homo sapiens
atttctgcatatgttgaatact

SEQ ID NO: 2926779 - DNA, 23 bp, Homo sapiens
atttctgcatatgttgaatactt

SEQ ID NO: 2926780 - DNA, 15 bp, Homo sapiens
atttctgccttgaaa

SEQ ID NO: 2926781 - DNA, 22 bp, Homo sapiens
atttcttaaatctttcttcaaa

SEQ ID NO: 2926782 - DNA, 13 bp, Homo sapiens
atttcttaaattt

SEQ ID NO: 2926783 - DNA, 11 bp, Homo sapiens
atttcttatag

SEQ ID NO: 2926784 - DNA, 18 bp, Homo sapiens
atttcttcttttcctgca

SEQ ID NO: 2926785 - DNA, 20 bp, Homo sapiens
atttcttcttttcctgcagg

SEQ ID NO: 2926786 - DNA, 12 bp, Homo sapiens
atttcttgcttt

SEQ ID NO: 2926787 - DNA, 19 bp, Homo sapiens
atttctttaaaaaagaaat

SEQ ID NO: 2926788 - DNA, 20 bp, Homo sapiens
atttctttaaaaaagaaatt

SEQ ID NO: 2926789 - DNA, 21 bp, Homo sapiens
atttctttaatctgttgtttg

SEQ ID NO: 2926790 - DNA, 17 bp, Homo sapiens
atttctttgcctgttca

SEQ ID NO: 2926791 - DNA, 21 bp, Homo sapiens
atttctttgcctgttcagtta

SEQ ID NO: 2926792 - DNA, 14 bp, Homo sapiens
atttctttgctgta

SEQ ID NO: 2926793 - DNA, 22 bp, Homo sapiens
atttcttttgtaataaactatt

SEQ ID NO: 2926794 - DNA, 13 bp, Homo sapiens
atttcttttgtgc

SEQ ID NO: 2926795 - DNA, 16 bp, Homo sapiens
atttctttttttcctt

SEQ ID NO: 2926796 - DNA, 21 bp, Homo sapiens
atttgaaaaaagttactgcaa

SEQ ID NO: 2926797 - DNA, 12 bp, Homo sapiens
atttgaaaaaat

SEQ ID NO: 2926798 - DNA, 14 bp, Homo sapiens
atttgaaaaaatta

SEQ ID NO: 2926799 - DNA, 23 bp, Homo sapiens
atttgaaaaccatattttattgt

SEQ ID NO: 2926800 - DNA, 18 bp, Homo sapiens
atttgaaaataattgttc

SEQ ID NO: 2926801 - DNA, 15 bp, Homo sapiens
atttgaactttggaa

SEQ ID NO: 2926802 - DNA, 20 bp, Homo sapiens
atttgaagaccaaagttgtt

SEQ ID NO: 2926803 - DNA, 16 bp, Homo sapiens
atttgaagatctgatt

SEQ ID NO: 2926804 - DNA, 20 bp, Homo sapiens
atttgaagcagctctgcctt

SEQ ID NO: 2926805 - DNA, 19 bp, Homo sapiens
atttgaataattccatgat

SEQ ID NO: 2926806 - DNA, 18 bp, Homo sapiens
atttgaatcaatgtatta

SEQ ID NO: 2926807 - DNA, 22 bp, Homo sapiens
atttgaatgtatgcttcataca

SEQ ID NO: 2926808 - DNA, 13 bp, Homo sapiens
atttgacccccac

SEQ ID NO: 2926809 - DNA, 22 bp, Homo sapiens
atttgacctcctccctgttatt

SEQ ID NO: 2926810 - DNA, 16 bp, Homo sapiens
atttgagcactggtct

SEQ ID NO: 2926811 - DNA, 21 bp, Homo sapiens
atttgagcatggccagactat

SEQ ID NO: 2926812 - DNA, 22 bp, Homo sapiens
atttgaggatttagaagtgtca

SEQ ID NO: 2926813 - DNA, 23 bp, Homo sapiens
atttgaggatttagaagtgtcat

SEQ ID NO: 2926814 - DNA, 17 bp, Homo sapiens
atttgagttgtgattga

SEQ ID NO: 2926815 - DNA, 17 bp, Homo sapiens
atttgatcgttccagtt

SEQ ID NO: 2926816 - DNA, 23 bp, Homo sapiens
atttgatcgttccagttcccact

SEQ ID NO: 2926817 - DNA, 16 bp, Homo sapiens
atttgatgctgtttga

SEQ ID NO: 2926818 - DNA, 17 bp, Homo sapiens
atttgatgcttttctct

SEQ ID NO: 2926819 - DNA, 19 bp, Homo sapiens
atttgatgcttttctctca

SEQ ID NO: 2926820 - DNA, 16 bp, Homo sapiens
atttgattaacatttg

SEQ ID NO: 2926821 - DNA, 13 bp, Homo sapiens
atttgattgattt

SEQ ID NO: 2926822 - DNA, 19 bp, Homo sapiens
atttgcaaccatcagaatt

SEQ ID NO: 2926823 - DNA, 15 bp, Homo sapiens
atttgcaagggaaaa

SEQ ID NO: 2926824 - DNA, 21 bp, Homo sapiens
atttgcaatgggatgtatgaa

SEQ ID NO: 2926825 - DNA, 15 bp, Homo sapiens
atttgcacaagtttt

SEQ ID NO: 2926826 - DNA, 23 bp, Homo sapiens
atttgcacagaagcacatgcacc

SEQ ID NO: 2926827 - DNA, 19 bp, Homo sapiens
atttgcagaagctgtgagt

SEQ ID NO: 2926828 - DNA, 15 bp, Homo sapiens
atttgcatctgaaat

SEQ ID NO: 2926829 - DNA, 21 bp, Homo sapiens
atttgcatctgaaataggaaa

SEQ ID NO: 2926830 - DNA, 18 bp, Homo sapiens
atttgcattaaattcaca

SEQ ID NO: 2926831 - DNA, 18 bp, Homo sapiens
atttgccctgggaaaccc

SEQ ID NO: 2926832 - DNA, 13 bp, Homo sapiens
atttgcctgtaac

SEQ ID NO: 2926833 - DNA, 16 bp, Homo sapiens
atttgcctgtaacaag

SEQ ID NO: 2926834 - DNA, 17 bp, Homo sapiens
atttgccttctccctgg

SEQ ID NO: 2926835 - DNA, 17 bp, Homo sapiens
atttgctggcctggcag

SEQ ID NO: 2926836 - DNA, 20 bp, Homo sapiens
atttgctggcctggcagggg

SEQ ID NO: 2926837 - DNA, 21 bp, Homo sapiens
atttgctgtgaagggagaaag

SEQ ID NO: 2926838 - DNA, 13 bp, Homo sapiens
atttgcttcagga

SEQ ID NO: 2926839 - DNA, 18 bp, Homo sapiens
atttggaatttatataca

SEQ ID NO: 2926840 - DNA, 21 bp, Homo sapiens
atttggagtgttccccttcca

SEQ ID NO: 2926841 - DNA, 19 bp, Homo sapiens
atttggataataaaaattg

SEQ ID NO: 2926842 - DNA, 19 bp, Homo sapiens
atttggcagaactgctggg

SEQ ID NO: 2926843 - DNA, 22 bp, Homo sapiens
atttggcagaactgctggggct

SEQ ID NO: 2926844 - DNA, 19 bp, Homo sapiens
atttggccccaggggacgt

SEQ ID NO: 2926845 - DNA, 16 bp, Homo sapiens
atttggcttgttttat

SEQ ID NO: 2926846 - DNA, 19 bp, Homo sapiens
atttgggaaacttgtcact

SEQ ID NO: 2926847 - DNA, 19 bp, Homo sapiens
atttgggcctgctccagac

SEQ ID NO: 2926848 - DNA, 23 bp, Homo sapiens
atttgggcctgctccagacctga

SEQ ID NO: 2926849 - DNA, 23 bp, Homo sapiens
atttgggtggtttttatttttat

SEQ ID NO: 2926850 - DNA, 17 bp, Homo sapiens
atttgggttctgcctgc

SEQ ID NO: 2926851 - DNA, 18 bp, Homo sapiens
atttggtcagaatgcagt

SEQ ID NO: 2926852 - DNA, 17 bp, Homo sapiens
atttggtccaaaaaaag

SEQ ID NO: 2926853 - DNA, 22 bp, Homo sapiens
caaagcaaaggcagtcccggga

SEQ ID NO: 2926854 - DNA, 13 bp, Homo sapiens
caaagcaaggaaa

SEQ ID NO: 2926855 - DNA, 17 bp, Homo sapiens
caaagcacagtttgaac

SEQ ID NO: 2926856 - DNA, 23 bp, Homo sapiens
caaagcagattttcctaaggcca

SEQ ID NO: 2926857 - DNA, 12 bp, Homo sapiens
caaagcagccac

SEQ ID NO: 2926858 - DNA, 23 bp, Homo sapiens
caaagcagctgtaatttagttaa

SEQ ID NO: 2926859 - DNA, 10 bp, Homo sapiens
caaagcagga

SEQ ID NO: 2926860 - DNA, 15 bp, Homo sapiens
caaagcaggagtgga

SEQ ID NO: 2926861 - DNA, 22 bp, Homo sapiens
caaagcagtggcttagctgcca

SEQ ID NO: 2926862 - DNA, 16 bp, Homo sapiens
caaagcatgaaatgga

SEQ ID NO: 2926863 - DNA, 16 bp, Homo sapiens
caaagccaagaaagaa

SEQ ID NO: 2926864 - DNA, 17 bp, Homo sapiens
caaagccactggaagga

SEQ ID NO: 2926865 - DNA, 18 bp, Homo sapiens
caaagccactggaaggag

SEQ ID NO: 2926866 - DNA, 14 bp, Homo sapiens
caaagccagagtgg

SEQ ID NO: 2926867 - DNA, 15 bp, Homo sapiens
caaagccagagtggc

SEQ ID NO: 2926868 - DNA, 21 bp, Homo sapiens
caaagccagcgtcctcctctg

SEQ ID NO: 2926869 - DNA, 23 bp, Homo sapiens
caaagccagcgtcctcctctgtg

SEQ ID NO: 2926870 - DNA, 16 bp, Homo sapiens
caaagccatatggaca

SEQ ID NO: 2926871 - DNA, 20 bp, Homo sapiens
caaagccatatggacactgt

SEQ ID NO: 2926872 - DNA, 17 bp, Homo sapiens
caaagccattctccccc

SEQ ID NO: 2926873 - DNA, 13 bp, Homo sapiens
caaagccctgcct

SEQ ID NO: 2926874 - DNA, 19 bp, Homo sapiens
caaagccctgcctctgtgt

SEQ ID NO: 2926875 - DNA, 23 bp, Homo sapiens
caaagccggcctgagaaacacta

SEQ ID NO: 2926876 - DNA, 19 bp, Homo sapiens
caaagcctgtcccaggact

SEQ ID NO: 2926877 - DNA, 19 bp, Homo sapiens
caaagcgaattttaaaaga

SEQ ID NO: 2926878 - DNA, 20 bp, Homo sapiens
caaagcgaattttaaaagat

SEQ ID NO: 2926879 - DNA, 12 bp, Homo sapiens
caaagcggctct

SEQ ID NO: 2926880 - DNA, 18 bp, Homo sapiens
caaagctcaaataaaaat

SEQ ID NO: 2926881 - DNA, 20 bp, Homo sapiens
caaagctcgggtctccctcc

SEQ ID NO: 2926882 - DNA, 17 bp, Homo sapiens
caaagctgagcctgcag

SEQ ID NO: 2926883 - DNA, 24 bp, Homo sapiens
caaagctgagcctgcagggaagcc

SEQ ID NO: 2926884 - DNA, 17 bp, Homo sapiens
caaagctggctcacctt

SEQ ID NO: 2926885 - DNA, 18 bp, Homo sapiens
caaagcttagcaggagag

SEQ ID NO: 2926886 - DNA, 19 bp, Homo sapiens
caaagcttggagggaagcc

SEQ ID NO: 2926887 - DNA, 16 bp, Homo sapiens
caaaggaagtctagga

SEQ ID NO: 2926888 - DNA, 19 bp, Homo sapiens
caaaggagacaaagcagga

SEQ ID NO: 2926889 - DNA, 17 bp, Homo sapiens
caaaggagctcgaagga

SEQ ID NO: 2926890 - DNA, 13 bp, Homo sapiens
caaaggcagagga

SEQ ID NO: 2926891 - DNA, 16 bp, Homo sapiens
caaaggcagtcccggg

SEQ ID NO: 2926892 - DNA, 17 bp, Homo sapiens
caaaggcatccaggcca

SEQ ID NO: 2926893 - DNA, 17 bp, Homo sapiens
caaagggacttttgtaa

SEQ ID NO: 2926894 - DNA, 13 bp, Homo sapiens
caaagggcctcct

SEQ ID NO: 2926895 - DNA, 15 bp, Homo sapiens
caaagggcctcctca

SEQ ID NO: 2926896 - DNA, 17 bp, Homo sapiens
caaaggggaaagaacat

SEQ ID NO: 2926897 - DNA, 21 bp, Homo sapiens
caaaggggaaagaacataaag

SEQ ID NO: 2926898 - DNA, 22 bp, Homo sapiens
caaagggggaggctaaagccca

SEQ ID NO: 2926899 - DNA, 16 bp, Homo sapiens
caaagggtccagaagg

SEQ ID NO: 2926900 - DNA, 20 bp, Homo sapiens
caaagggtgaagctatttat

SEQ ID NO: 2926901 - DNA, 18 bp, Homo sapiens
caaagggttttaatgtag

SEQ ID NO: 2926902 - DNA, 19 bp, Homo sapiens
caaagggttttaatgtaga

SEQ ID NO: 2926903 - DNA, 16 bp, Homo sapiens
caaaggtgtgcaaact

SEQ ID NO: 2926904 - DNA, 12 bp, Homo sapiens
caaaggttctag

SEQ ID NO: 2926905 - DNA, 14 bp, Homo sapiens
caaagtaaactgtg

SEQ ID NO: 2926906 - DNA, 11 bp, Homo sapiens
caaagtactgt

SEQ ID NO: 2926907 - DNA, 13 bp, Homo sapiens
caaagtatgccag

SEQ ID NO: 2926908 - DNA, 16 bp, Homo sapiens
caaagtattgtaaatt

SEQ ID NO: 2926909 - DNA, 20 bp, Homo sapiens
caaagtattgtaaattatat

SEQ ID NO: 2926910 - DNA, 16 bp, Homo sapiens
caaagtcaagccacat

SEQ ID NO: 2926911 - DNA, 12 bp, Homo sapiens
caaagtctaaac

SEQ ID NO: 2926912 - DNA, 13 bp, Homo sapiens
caaagtctaaact

SEQ ID NO: 2926913 - DNA, 20 bp, Homo sapiens
caaagtctccagaagaaaat

SEQ ID NO: 2926914 - DNA, 19 bp, Homo sapiens
caaagtgaaagacatttca

SEQ ID NO: 2926915 - DNA, 14 bp, Homo sapiens
caaagttaaatgta

SEQ ID NO: 2926916 - DNA, 13 bp, Homo sapiens
caaagttccagtt

SEQ ID NO: 2926917 - DNA, 20 bp, Homo sapiens
caaagttctaataatttcta

SEQ ID NO: 2926918 - DNA, 23 bp, Homo sapiens
caaagttctaataatttctaatg

SEQ ID NO: 2926919 - DNA, 20 bp, Homo sapiens
caaataaaaaacagaaaccg

SEQ ID NO: 2926920 - DNA, 23 bp, Homo sapiens
caaataaaacataatagaatttc

SEQ ID NO: 2926921 - DNA, 18 bp, Homo sapiens
caaataaaccttgtttct

SEQ ID NO: 2926922 - DNA, 23 bp, Homo sapiens
caaataaagtttgtaagaaaatg

SEQ ID NO: 2926923 - DNA, 12 bp, Homo sapiens
caaataaatgtt

SEQ ID NO: 2926924 - DNA, 22 bp, Homo sapiens
caaataaatgtttcccccactc

SEQ ID NO: 2926925 - DNA, 14 bp, Homo sapiens
caaataaattacac

SEQ ID NO: 2926926 - DNA, 23 bp, Homo sapiens
caaataaattacactttattctt

SEQ ID NO: 2926927 - DNA, 13 bp, Homo sapiens
caaataagactct

SEQ ID NO: 2926928 - DNA, 12 bp, Homo sapiens
caaataatttaa

SEQ ID NO: 2926929 - DNA, 14 bp, Homo sapiens
caaataatttaagt

SEQ ID NO: 2926930 - DNA, 23 bp, Homo sapiens
caaataatttaagttggctagag

SEQ ID NO: 2926931 - DNA, 20 bp, Homo sapiens
caaataatttgaactttgga

SEQ ID NO: 2926932 - DNA, 23 bp, Homo sapiens
caaataatttgaactttggaaca

SEQ ID NO: 2926933 - DNA, 15 bp, Homo sapiens
caaatacacatttca

SEQ ID NO: 2926934 - DNA, 14 bp, Homo sapiens
caaatactcatgtg

SEQ ID NO: 2926935 - DNA, 15 bp, Homo sapiens
caaatactcatgtgt

SEQ ID NO: 2926936 - DNA, 14 bp, Homo sapiens
caaatagccccaga

SEQ ID NO: 2926937 - DNA, 13 bp, Homo sapiens
caaatatgttaaa

SEQ ID NO: 2926938 - DNA, 21 bp, Homo sapiens
caaatatgttaaagtttaagt

SEQ ID NO: 2926939 - DNA, 17 bp, Homo sapiens
caaatattagatgtgat

SEQ ID NO: 2926940 - DNA, 19 bp, Homo sapiens
caaatattagatgtgattt

SEQ ID NO: 2926941 - DNA, 20 bp, Homo sapiens
caaatattagatgtgattta

SEQ ID NO: 2926942 - DNA, 16 bp, Homo sapiens
caaatattggtgttgt

SEQ ID NO: 2926943 - DNA, 17 bp, Homo sapiens
caaatatttgatcactt

SEQ ID NO: 2926944 - DNA, 19 bp, Homo sapiens
caaatcaaacacaacacaa

SEQ ID NO: 2926945 - DNA, 20 bp, Homo sapiens
caaatcaatctgtaaaacta

SEQ ID NO: 2926946 - DNA, 14 bp, Homo sapiens
caaatcaccacaaa

SEQ ID NO: 2926947 - DNA, 17 bp, Homo sapiens
caaatcactctgcaatg

SEQ ID NO: 2926948 - DNA, 16 bp, Homo sapiens
caaatcctatgtgatt

SEQ ID NO: 2926949 - DNA, 21 bp, Homo sapiens
caaatcctatgtgattttaac

SEQ ID NO: 2926950 - DNA, 22 bp, Homo sapiens
caaatcctatgtgattttaact

SEQ ID NO: 2926951 - DNA, 17 bp, Homo sapiens
caaatccttagatctgg

SEQ ID NO: 2926952 - DNA, 23 bp, Homo sapiens
caaatcctttctgccccccaggg

SEQ ID NO: 2926953 - DNA, 17 bp, Homo sapiens
caaatctatttaattag

SEQ ID NO: 2926954 - DNA, 14 bp, Homo sapiens
caaatctgatggct

SEQ ID NO: 2926955 - DNA, 17 bp, Homo sapiens
caaatctgtataaatgt

SEQ ID NO: 2926956 - DNA, 12 bp, Homo sapiens
caaatcttgaaa

SEQ ID NO: 2926957 - DNA, 13 bp, Homo sapiens
caaatcttgaaat

SEQ ID NO: 2926958 - DNA, 23 bp, Homo sapiens
caaatctttctgtaaacagaata

SEQ ID NO: 2926959 - DNA, 22 bp, Homo sapiens
caaatgagggtcttggttccag

SEQ ID NO: 2926960 - DNA, 16 bp, Homo sapiens
caaatgcattcatgtt

SEQ ID NO: 2926961 - DNA, 14 bp, Homo sapiens
caaatgcattctat

SEQ ID NO: 2926962 - DNA, 19 bp, Homo sapiens
caaatgccaactgttggaa

SEQ ID NO: 2926963 - DNA, 14 bp, Homo sapiens
caaatgcccaagga

SEQ ID NO: 2926964 - DNA, 16 bp, Homo sapiens
caaatgcgaacactat

SEQ ID NO: 2926965 - DNA, 13 bp, Homo sapiens
caaatgctattaa

SEQ ID NO: 2926966 - DNA, 17 bp, Homo sapiens
caaatgctattaaagtg

SEQ ID NO: 2926967 - DNA, 22 bp, Homo sapiens
caaatgctcccacctgaatttg

SEQ ID NO: 2926968 - DNA, 15 bp, Homo sapiens
caaatgctgtattct

SEQ ID NO: 2926969 - DNA, 15 bp, Homo sapiens
caaatgctgtgcaaa

SEQ ID NO: 2926970 - DNA, 21 bp, Homo sapiens
caaatgctgtgcaaacagtgt

SEQ ID NO: 2926971 - DNA, 16 bp, Homo sapiens
caaatggaaaatgtat

SEQ ID NO: 2926972 - DNA, 15 bp, Homo sapiens
caaatggcactgcag

SEQ ID NO: 2926973 - DNA, 18 bp, Homo sapiens
caaatggcgtctggaagt

SEQ ID NO: 2926974 - DNA, 18 bp, Homo sapiens
caaatggctctgtgaaat

SEQ ID NO: 2926975 - DNA, 19 bp, Homo sapiens
caaatggggccagatccag

SEQ ID NO: 2926976 - DNA, 18 bp, Homo sapiens
caaatggtagctgaaaaa

SEQ ID NO: 2926977 - DNA, 15 bp, Homo sapiens
caaatggtaggcatt

SEQ ID NO: 2926978 - DNA, 22 bp, Homo sapiens
caaatggttccagatacttcag

SEQ ID NO: 2926979 - DNA, 14 bp, Homo sapiens
caaatgtaaacatt

SEQ ID NO: 2926980 - DNA, 14 bp, Homo sapiens
caaatgtattaatg

SEQ ID NO: 2926981 - DNA, 19 bp, Homo sapiens
caaatgtcagatacaatgt

SEQ ID NO: 2926982 - DNA, 19 bp, Homo sapiens
caaatgtctgggaagccct

SEQ ID NO: 2926983 - DNA, 11 bp, Homo sapiens
caaatgtgaag

SEQ ID NO: 2926984 - DNA, 18 bp, Homo sapiens
caaatgtgaagatgcatt

SEQ ID NO: 2926985 - DNA, 19 bp, Homo sapiens
caagtatttgggaagtgaa

SEQ ID NO: 2926986 - DNA, 23 bp, Homo sapiens
caagtcaaaatatttttaaaaga

SEQ ID NO: 2926987 - DNA, 19 bp, Homo sapiens
caagtcaaccaatgtagaa

SEQ ID NO: 2926988 - DNA, 13 bp, Homo sapiens
caagtcctttaac

SEQ ID NO: 2926989 - DNA, 19 bp, Homo sapiens
caagtctggatctgggacc

SEQ ID NO: 2926990 - DNA, 14 bp, Homo sapiens
caagtctgtttact

SEQ ID NO: 2926991 - DNA, 18 bp, Homo sapiens
caagtcttctcccgtcca

SEQ ID NO: 2926992 - DNA, 21 bp, Homo sapiens
caagtctttaggtctttgtaa

SEQ ID NO: 2926993 - DNA, 15 bp, Homo sapiens
caagtgacatctctt

SEQ ID NO: 2926994 - DNA, 16 bp, Homo sapiens
caagtgacatctcttt

SEQ ID NO: 2926995 - DNA, 16 bp, Homo sapiens
caagtgaccagggaag

SEQ ID NO: 2926996 - DNA, 23 bp, Homo sapiens
caagtgactctcctgcctcagcc

SEQ ID NO: 2926997 - DNA, 13 bp, Homo sapiens
caagtgagagggg

SEQ ID NO: 2926998 - DNA, 15 bp, Homo sapiens
caagtgagaggggag

SEQ ID NO: 2926999 - DNA, 18 bp, Homo sapiens
caagtgagaggggaggga

SEQ ID NO: 2927000 - DNA, 19 bp, Homo sapiens
caagtgagtctggtggagg

SEQ ID NO: 2927001 - DNA, 22 bp, Homo sapiens
caagtgagtctggtggaggagc

SEQ ID NO: 2927002 - DNA, 12 bp, Homo sapiens
caagtgagtggc

SEQ ID NO: 2927003 - DNA, 17 bp, Homo sapiens
caagtgatcctcacgcc

SEQ ID NO: 2927004 - DNA, 21 bp, Homo sapiens
caagtgatcctcacgccttgg

SEQ ID NO: 2927005 - DNA, 19 bp, Homo sapiens
caagtgatctgcccacctc

SEQ ID NO: 2927006 - DNA, 14 bp, Homo sapiens
caagtgattctcct

SEQ ID NO: 2927007 - DNA, 22 bp, Homo sapiens
caagtgattctcctgcctcagc

SEQ ID NO: 2927008 - DNA, 19 bp, Homo sapiens
caagtgcatgctctctgca

SEQ ID NO: 2927009 - DNA, 16 bp, Homo sapiens
caagtgccgcaaattg

SEQ ID NO: 2927010 - DNA, 21 bp, Homo sapiens
caagtgctgtttgggcaggag

SEQ ID NO: 2927011 - DNA, 22 bp, Homo sapiens
caagtgctgtttgggcaggagt

SEQ ID NO: 2927012 - DNA, 18 bp, Homo sapiens
caagtggactcagggcag

SEQ ID NO: 2927013 - DNA, 16 bp, Homo sapiens
caagtgtaaaaagatg

SEQ ID NO: 2927014 - DNA, 15 bp, Homo sapiens
caagtgtaaaatatt

SEQ ID NO: 2927015 - DNA, 21 bp, Homo sapiens
caagtgtaaaatattttgaat

SEQ ID NO: 2927016 - DNA, 23 bp, Homo sapiens
caagtgtaaaatattttgaatca

SEQ ID NO: 2927017 - DNA, 15 bp, Homo sapiens
caagtgtattttaaa

SEQ ID NO: 2927018 - DNA, 16 bp, Homo sapiens
caagtgtattttaaaa

SEQ ID NO: 2927019 - DNA, 14 bp, Homo sapiens
caagtgtgaacaaa

SEQ ID NO: 2927020 - DNA, 19 bp, Homo sapiens
caagtgtgaacaaaagatg

SEQ ID NO: 2927021 - DNA, 17 bp, Homo sapiens
caagtgtgcatattgta

SEQ ID NO: 2927022 - DNA, 23 bp, Homo sapiens
caagtgtgcatattgtacacttt

SEQ ID NO: 2927023 - DNA, 22 bp, Homo sapiens
caagttatacacgggacagttg

SEQ ID NO: 2927024 - DNA, 16 bp, Homo sapiens
caagttatacccaacc

SEQ ID NO: 2927025 - DNA, 13 bp, Homo sapiens
caagttctaagat

SEQ ID NO: 2927026 - DNA, 15 bp, Homo sapiens
caagttctaagattc

SEQ ID NO: 2927027 - DNA, 19 bp, Homo sapiens
caagttgaagactttgttt

SEQ ID NO: 2927028 - DNA, 16 bp, Homo sapiens
caagttgccattttgt

SEQ ID NO: 2927029 - DNA, 22 bp, Homo sapiens
caagttgttccttaagtcagaa

SEQ ID NO: 2927030 - DNA, 19 bp, Homo sapiens
caagttgtttattccaaag

SEQ ID NO: 2927031 - DNA, 20 bp, Homo sapiens
caagttgtttattccaaaga

SEQ ID NO: 2927032 - DNA, 18 bp, Homo sapiens
caagtttataagcccaaa

SEQ ID NO: 2927033 - DNA, 23 bp, Homo sapiens
caagtttataagcccaaatggct

SEQ ID NO: 2927034 - DNA, 15 bp, Homo sapiens
caagtttatatatat

SEQ ID NO: 2927035 - DNA, 21 bp, Homo sapiens
caagttttcttccatgatttt

SEQ ID NO: 2927036 - DNA, 19 bp, Homo sapiens
caagtttttaatcgttttt

SEQ ID NO: 2927037 - DNA, 21 bp, Homo sapiens
caataaaaccaagcctctgga

SEQ ID NO: 2927038 - DNA, 22 bp, Homo sapiens
caataaaaccaagcctctggaa

SEQ ID NO: 2927039 - DNA, 17 bp, Homo sapiens
caataaaactaaatgtg

SEQ ID NO: 2927040 - DNA, 21 bp, Homo sapiens
caataaaactaaatgtgtaca

SEQ ID NO: 2927041 - DNA, 22 bp, Homo sapiens
caataaaattttttttcatgtt

SEQ ID NO: 2927042 - DNA, 17 bp, Homo sapiens
caataaacatagcttgt

SEQ ID NO: 2927043 - DNA, 18 bp, Homo sapiens
caataaacgatttaattc

SEQ ID NO: 2927044 - DNA, 18 bp, Homo sapiens
caataaacttagaggaaa

SEQ ID NO: 2927045 - DNA, 20 bp, Homo sapiens
caataaacttagaggaaaat

SEQ ID NO: 2927046 - DNA, 20 bp, Homo sapiens
caataaacttgtaggacttt

SEQ ID NO: 2927047 - DNA, 14 bp, Homo sapiens
caataaatgtctgt

SEQ ID NO: 2927048 - DNA, 20 bp, Homo sapiens
caataaattccatgtttagc

SEQ ID NO: 2927049 - DNA, 23 bp, Homo sapiens
caataacttctatattttaatag

SEQ ID NO: 2927050 - DNA, 17 bp, Homo sapiens
caataagagtctccttc

SEQ ID NO: 2927051 - DNA, 21 bp, Homo sapiens
caataagagtctccttctctt

SEQ ID NO: 2927052 - DNA, 16 bp, Homo sapiens
caataagtaaatccac

SEQ ID NO: 2927053 - DNA, 21 bp, Homo sapiens
caataagtacttatctttatt

SEQ ID NO: 2927054 - DNA, 20 bp, Homo sapiens
caataataaaaaacaagaaa

SEQ ID NO: 2927055 - DNA, 22 bp, Homo sapiens
caataataaagatgtgaaaact

SEQ ID NO: 2927056 - DNA, 13 bp, Homo sapiens
caataatatattt

SEQ ID NO: 2927057 - DNA, 15 bp, Homo sapiens
caataatggaaaaaa

SEQ ID NO: 2927058 - DNA, 16 bp, Homo sapiens
caataatggaaaaaaa

SEQ ID NO: 2927059 - DNA, 22 bp, Homo sapiens
caatacagcctgaataaaccaa

SEQ ID NO: 2927060 - DNA, 17 bp, Homo sapiens
caatacagtacaggcag

SEQ ID NO: 2927061 - DNA, 12 bp, Homo sapiens
caatacatttgt

SEQ ID NO: 2927062 - DNA, 15 bp, Homo sapiens
caatacatttgtatt

SEQ ID NO: 2927063 - DNA, 21 bp, Homo sapiens
caatacatttgtattttgtga

SEQ ID NO: 2927064 - DNA, 19 bp, Homo sapiens
caataccctgtaaaaatac

SEQ ID NO: 2927065 - DNA, 21 bp, Homo sapiens
caatacctacaataaactggt

SEQ ID NO: 2927066 - DNA, 22 bp, Homo sapiens
caatacgtttgtgcagaatctc

SEQ ID NO: 2927067 - DNA, 23 bp, Homo sapiens
caatacgtttgtgcagaatctct

SEQ ID NO: 2927068 - DNA, 20 bp, Homo sapiens
caatagctccaagctgttaa

SEQ ID NO: 2927069 - DNA, 20 bp, Homo sapiens
caataggcaaaagtgtaaca

SEQ ID NO: 2927070 - DNA, 23 bp, Homo sapiens
caatagttttagattattttatc

SEQ ID NO: 2927071 - DNA, 21 bp, Homo sapiens
caatataatgtttttaatatt

SEQ ID NO: 2927072 - DNA, 21 bp, Homo sapiens
caatatacaactgtaaagcaa

SEQ ID NO: 2927073 - DNA, 22 bp, Homo sapiens
caatatacaactgtaaagcaaa

SEQ ID NO: 2927074 - DNA, 23 bp, Homo sapiens
caatatacaactgtaaagcaaat

SEQ ID NO: 2927075 - DNA, 13 bp, Homo sapiens
caatatagcaaga

SEQ ID NO: 2927076 - DNA, 19 bp, Homo sapiens
caatatatctaaattgaat

SEQ ID NO: 2927077 - DNA, 21 bp, Homo sapiens
caatatatctaaattgaataa

SEQ ID NO: 2927078 - DNA, 20 bp, Homo sapiens
caatatatgtattttttgaa

SEQ ID NO: 2927079 - DNA, 13 bp, Homo sapiens
caatatcctcgct

SEQ ID NO: 2927080 - DNA, 14 bp, Homo sapiens
caatatcctcgctc

SEQ ID NO: 2927081 - DNA, 20 bp, Homo sapiens
caatatcctttgcctcaagg

SEQ ID NO: 2927082 - DNA, 14 bp, Homo sapiens
caatatgaaaagga

SEQ ID NO: 2927083 - DNA, 23 bp, Homo sapiens
caatatgaaaaggatattatcta

SEQ ID NO: 2927084 - DNA, 20 bp, Homo sapiens
caatattaccttaagatttt

SEQ ID NO: 2927085 - DNA, 18 bp, Homo sapiens
caatcaaaggaaaatagt

SEQ ID NO: 2927086 - DNA, 12 bp, Homo sapiens
caatcaacacta

SEQ ID NO: 2927087 - DNA, 23 bp, Homo sapiens
caatcaacctgcacttcatatct

SEQ ID NO: 2927088 - DNA, 18 bp, Homo sapiens
caatcaagtctgtttact

SEQ ID NO: 2927089 - DNA, 13 bp, Homo sapiens
caatcaagttttt

SEQ ID NO: 2927090 - DNA, 16 bp, Homo sapiens
caatcaatttaaatgt

SEQ ID NO: 2927091 - DNA, 20 bp, Homo sapiens
caatcaatttaaatgtttac

SEQ ID NO: 2927092 - DNA, 23 bp, Homo sapiens
caatcacaaaagctgtgtctctg

SEQ ID NO: 2927093 - DNA, 13 bp, Homo sapiens
caatcacaggaaa

SEQ ID NO: 2927094 - DNA, 21 bp, Homo sapiens
caatcacgggcggtcctgcac

SEQ ID NO: 2927095 - DNA, 23 bp, Homo sapiens
caatcactgaaacaaaaattgtc

SEQ ID NO: 2927096 - DNA, 15 bp, Homo sapiens
caatcactgtgctat

SEQ ID NO: 2927097 - DNA, 21 bp, Homo sapiens
caatcagagaccaggccctgg

SEQ ID NO: 2927098 - DNA, 12 bp, Homo sapiens
caatcagcaaac

SEQ ID NO: 2927099 - DNA, 15 bp, Homo sapiens
caatcagctccttcc

SEQ ID NO: 2927100 - DNA, 17 bp, Homo sapiens
caatccaaatgcattca

SEQ ID NO: 2927101 - DNA, 20 bp, Homo sapiens
caatccatttggcagaactg

SEQ ID NO: 2927102 - DNA, 22 bp, Homo sapiens
caatcccctcattcaggaaaac

SEQ ID NO: 2927103 - DNA, 15 bp, Homo sapiens
caatccctcaaacct

SEQ ID NO: 2927104 - DNA, 15 bp, Homo sapiens
caatcctagtgcttt

SEQ ID NO: 2927105 - DNA, 14 bp, Homo sapiens
caatcctatgtttt

SEQ ID NO: 2927106 - DNA, 15 bp, Homo sapiens
caatcctccccgctc

SEQ ID NO: 2927107 - DNA, 21 bp, Homo sapiens
caatcctccccgctctgccgc

SEQ ID NO: 2927108 - DNA, 11 bp, Homo sapiens
caatcctggac

SEQ ID NO: 2927109 - DNA, 14 bp, Homo sapiens
caatccttaaatat

SEQ ID NO: 2927110 - DNA, 14 bp, Homo sapiens
caatcgcatcccgg

SEQ ID NO: 2927111 - DNA, 16 bp, Homo sapiens
caatcgcatcccggct

SEQ ID NO: 2927112 - DNA, 21 bp, Homo sapiens
caatcgcatcccggctgaccc

SEQ ID NO: 2927113 - DNA, 17 bp, Homo sapiens
caatctcaatacagcct

SEQ ID NO: 2927114 - DNA, 18 bp, Homo sapiens
caatctcaatacagcctg

SEQ ID NO: 2927115 - DNA, 19 bp, Homo sapiens
caccaagcacagcagcctg

SEQ ID NO: 2927116 - DNA, 19 bp, Homo sapiens
caccaaggtctcacactcc

SEQ ID NO: 2927117 - DNA, 20 bp, Homo sapiens
caccaaggtctcacactcct

SEQ ID NO: 2927118 - DNA, 23 bp, Homo sapiens
caccaaggtctcacactcctcct

SEQ ID NO: 2927119 - DNA, 14 bp, Homo sapiens
caccacaattctcc

SEQ ID NO: 2927120 - DNA, 12 bp, Homo sapiens
caccacacacaa

SEQ ID NO: 2927121 - DNA, 17 bp, Homo sapiens
caccacacacaacagcc

SEQ ID NO: 2927122 - DNA, 14 bp, Homo sapiens
caccacacatccca

SEQ ID NO: 2927123 - DNA, 22 bp, Homo sapiens
caccacacgcaaaccaaccttt

SEQ ID NO: 2927124 - DNA, 19 bp, Homo sapiens
caccacactgatccagccc

SEQ ID NO: 2927125 - DNA, 18 bp, Homo sapiens
caccacactttcaaagac

SEQ ID NO: 2927126 - DNA, 15 bp, Homo sapiens
caccacatcttgtct

SEQ ID NO: 2927127 - DNA, 22 bp, Homo sapiens
caccacctaggccactcctcca

SEQ ID NO: 2927128 - DNA, 15 bp, Homo sapiens
caccaccttcccagc

SEQ ID NO: 2927129 - DNA, 21 bp, Homo sapiens
caccaccttcccagctctccc

SEQ ID NO: 2927130 - DNA, 17 bp, Homo sapiens
caccactgcactccagc

SEQ ID NO: 2927131 - DNA, 18 bp, Homo sapiens
caccactgcactccagcc

SEQ ID NO: 2927132 - DNA, 22 bp, Homo sapiens
caccactgccattacccagtgc

SEQ ID NO: 2927133 - DNA, 16 bp, Homo sapiens
caccacttcttttata

SEQ ID NO: 2927134 - DNA, 22 bp, Homo sapiens
caccagagcaggggctgctggg

SEQ ID NO: 2927135 - DNA, 23 bp, Homo sapiens
caccagagcaggggctgctgggg

SEQ ID NO: 2927136 - DNA, 11 bp, Homo sapiens
caccagagctg

SEQ ID NO: 2927137 - DNA, 12 bp, Homo sapiens
caccagagctgc

SEQ ID NO: 2927138 - DNA, 13 bp, Homo sapiens
caccagagctgcc

SEQ ID NO: 2927139 - DNA, 19 bp, Homo sapiens
caccagcatcacctgcctg

SEQ ID NO: 2927140 - DNA, 20 bp, Homo sapiens
caccagcatcacctgcctgt

SEQ ID NO: 2927141 - DNA, 22 bp, Homo sapiens
caccagcccatcgccacaaact

SEQ ID NO: 2927142 - DNA, 20 bp, Homo sapiens
caccagccctgctgcttcct

SEQ ID NO: 2927143 - DNA, 12 bp, Homo sapiens
caccagctgcaa

SEQ ID NO: 2927144 - DNA, 17 bp, Homo sapiens
caccagctgcaaagtgt

SEQ ID NO: 2927145 - DNA, 12 bp, Homo sapiens
caccaggaatgt

SEQ ID NO: 2927146 - DNA, 14 bp, Homo sapiens
caccaggagcacct

SEQ ID NO: 2927147 - DNA, 22 bp, Homo sapiens
caccaggatagagactggaaca

SEQ ID NO: 2927148 - DNA, 24 bp, Homo sapiens
caccaggcacgaacccacctgctg

SEQ ID NO: 2927149 - DNA, 23 bp, Homo sapiens
caccagggttgaccccagaggat

SEQ ID NO: 2927150 - DNA, 19 bp, Homo sapiens
caccaggtgcctttcaaat

SEQ ID NO: 2927151 - DNA, 17 bp, Homo sapiens
caccataggtagaatgt

SEQ ID NO: 2927152 - DNA, 14 bp, Homo sapiens
caccatatttgaat

SEQ ID NO: 2927153 - DNA, 17 bp, Homo sapiens
caccatatttgaattgg

SEQ ID NO: 2927154 - DNA, 18 bp, Homo sapiens
caccatatttgaattggc

SEQ ID NO: 2927155 - DNA, 17 bp, Homo sapiens
caccatccaacagacct

SEQ ID NO: 2927156 - DNA, 14 bp, Homo sapiens
caccatcgctggcc

SEQ ID NO: 2927157 - DNA, 15 bp, Homo sapiens
caccatgatggccag

SEQ ID NO: 2927158 - DNA, 18 bp, Homo sapiens
caccatggccttgatgat

SEQ ID NO: 2927159 - DNA, 19 bp, Homo sapiens
caccatgttggccaggctg

SEQ ID NO: 2927160 - DNA, 20 bp, Homo sapiens
caccatgttggccaggctgg

SEQ ID NO: 2927161 - DNA, 22 bp, Homo sapiens
caccatgtttgagctcagaccc

SEQ ID NO: 2927162 - DNA, 22 bp, Homo sapiens
caccattaaaagggattaccca

SEQ ID NO: 2927163 - DNA, 13 bp, Homo sapiens
caccattgctgct

SEQ ID NO: 2927164 - DNA, 16 bp, Homo sapiens
cacccaaaccccttcc

SEQ ID NO: 2927165 - DNA, 20 bp, Homo sapiens
cacccaaagcctgtcccagg

SEQ ID NO: 2927166 - DNA, 23 bp, Homo sapiens
cacccaaagcctgtcccaggact

SEQ ID NO: 2927167 - DNA, 18 bp, Homo sapiens
cacccaaagctgagcctg

SEQ ID NO: 2927168 - DNA, 22 bp, Homo sapiens
cacccaaagctgagcctgcagg

SEQ ID NO: 2927169 - DNA, 15 bp, Homo sapiens
cacccaaccccaagc

SEQ ID NO: 2927170 - DNA, 15 bp, Homo sapiens
cacccaacctgtcct

SEQ ID NO: 2927171 - DNA, 14 bp, Homo sapiens
cacccaagagggct

SEQ ID NO: 2927172 - DNA, 16 bp, Homo sapiens
cacccaagagggctgc

SEQ ID NO: 2927173 - DNA, 17 bp, Homo sapiens
cacccaattccactctg

SEQ ID NO: 2927174 - DNA, 13 bp, Homo sapiens
cacccacagggct

SEQ ID NO: 2927175 - DNA, 19 bp, Homo sapiens
cacccacagtggagagggc

SEQ ID NO: 2927176 - DNA, 19 bp, Homo sapiens
cacccacatgtgacacata

SEQ ID NO: 2927177 - DNA, 21 bp, Homo sapiens
cacccacatgtgacacatatg

SEQ ID NO: 2927178 - DNA, 16 bp, Homo sapiens
cacccacccctgcaca

SEQ ID NO: 2927179 - DNA, 13 bp, Homo sapiens
cacccaccctggg

SEQ ID NO: 2927180 - DNA, 14 bp, Homo sapiens
cacccacctcagcc

SEQ ID NO: 2927181 - DNA, 14 bp, Homo sapiens
cacccacctccctg

SEQ ID NO: 2927182 - DNA, 21 bp, Homo sapiens
cacccacctccctgcctccag

SEQ ID NO: 2927183 - DNA, 23 bp, Homo sapiens
cacccacctccctgcctccagga

SEQ ID NO: 2927184 - DNA, 19 bp, Homo sapiens
cacccacgtggagacagct

SEQ ID NO: 2927185 - DNA, 13 bp, Homo sapiens
cacccactcagct

SEQ ID NO: 2927186 - DNA, 14 bp, Homo sapiens
cacccactcagctc

SEQ ID NO: 2927187 - DNA, 12 bp, Homo sapiens
cacccagcccag

SEQ ID NO: 2927188 - DNA, 13 bp, Homo sapiens
cacccagctccag

SEQ ID NO: 2927189 - DNA, 14 bp, Homo sapiens
cacccaggaaggga

SEQ ID NO: 2927190 - DNA, 21 bp, Homo sapiens
cacccaggaggggaacactgc

SEQ ID NO: 2927191 - DNA, 22 bp, Homo sapiens
cacccaggaggggaacactgcc

SEQ ID NO: 2927192 - DNA, 18 bp, Homo sapiens
cacccagtccatgctcca

SEQ ID NO: 2927193 - DNA, 14 bp, Homo sapiens
cacccagtcctctg

SEQ ID NO: 2927194 - DNA, 19 bp, Homo sapiens
cacccagtctctgctccac

SEQ ID NO: 2927195 - DNA, 18 bp, Homo sapiens
cacccagtctgttgctgc

SEQ ID NO: 2927196 - DNA, 22 bp, Homo sapiens
cacccagtctgttgctgctcca

SEQ ID NO: 2927197 - DNA, 17 bp, Homo sapiens
caccccaacacttccag

SEQ ID NO: 2927198 - DNA, 22 bp, Homo sapiens
caccccacccccttcagtgccc

SEQ ID NO: 2927199 - DNA, 19 bp, Homo sapiens
caccccagagccacacatg

SEQ ID NO: 2927200 - DNA, 15 bp, Homo sapiens
caccccagcacagct

SEQ ID NO: 2927201 - DNA, 21 bp, Homo sapiens
caccccagcacagctcctccc

SEQ ID NO: 2927202 - DNA, 13 bp, Homo sapiens
caccccagctccg

SEQ ID NO: 2927203 - DNA, 15 bp, Homo sapiens
caccccagggcctga

SEQ ID NO: 2927204 - DNA, 17 bp, Homo sapiens
caccccattttctgtgg

SEQ ID NO: 2927205 - DNA, 12 bp, Homo sapiens
cacccccactgg

SEQ ID NO: 2927206 - DNA, 16 bp, Homo sapiens
cacccccagccctggc

SEQ ID NO: 2927207 - DNA, 12 bp, Homo sapiens
caccccccaggc

SEQ ID NO: 2927208 - DNA, 19 bp, Homo sapiens
cacccccgggatcctgccc

SEQ ID NO: 2927209 - DNA, 11 bp, Homo sapiens
caccccctccc

SEQ ID NO: 2927210 - DNA, 16 bp, Homo sapiens
caccccctccccaaag

SEQ ID NO: 2927211 - DNA, 17 bp, Homo sapiens
caccccctccccagggg

SEQ ID NO: 2927212 - DNA, 18 bp, Homo sapiens
caccccctccccagggga

SEQ ID NO: 2927213 - DNA, 16 bp, Homo sapiens
caccccgacttttgtt

SEQ ID NO: 2927214 - DNA, 20 bp, Homo sapiens
caccccgaggccctgcatgg

SEQ ID NO: 2927215 - DNA, 15 bp, Homo sapiens
caccccgcctgcctc

SEQ ID NO: 2927216 - DNA, 18 bp, Homo sapiens
caccccgcctgcctcctg

SEQ ID NO: 2927217 - DNA, 18 bp, Homo sapiens
caccccgcgcaaggggaa

SEQ ID NO: 2927218 - DNA, 22 bp, Homo sapiens
caccccgtctggggttcagccc

SEQ ID NO: 2927219 - DNA, 23 bp, Homo sapiens
caccccgtctggggttcagcccc

SEQ ID NO: 2927220 - DNA, 13 bp, Homo sapiens
cacccctccccat

SEQ ID NO: 2927221 - DNA, 14 bp, Homo sapiens
cacccctgccactc

SEQ ID NO: 2927222 - DNA, 18 bp, Homo sapiens
cacccctggggctgagtc

SEQ ID NO: 2927223 - DNA, 23 bp, Homo sapiens
cacccctggggctgagtctccag

SEQ ID NO: 2927224 - DNA, 12 bp, Homo sapiens
cacccctggggg

SEQ ID NO: 2927225 - DNA, 21 bp, Homo sapiens
cacccggtgggacccccgtgg

SEQ ID NO: 2927226 - DNA, 17 bp, Homo sapiens
caccctaagggcagccc

SEQ ID NO: 2927227 - DNA, 19 bp, Homo sapiens
caccctaagggcagccctc

SEQ ID NO: 2927228 - DNA, 22 bp, Homo sapiens
caccctccacaaagcaaaggca

SEQ ID NO: 2927229 - DNA, 15 bp, Homo sapiens
caccctcccagctct

SEQ ID NO: 2927230 - DNA, 11 bp, Homo sapiens
caccctcctgg

SEQ ID NO: 2927231 - DNA, 15 bp, Homo sapiens
caccctctgtcccca

SEQ ID NO: 2927232 - DNA, 20 bp, Homo sapiens
caccctgcccacccccggga

SEQ ID NO: 2927233 - DNA, 13 bp, Homo sapiens
caccctgcctgct

SEQ ID NO: 2927234 - DNA, 18 bp, Homo sapiens
caccctgcctgctgtgga

SEQ ID NO: 2927235 - DNA, 17 bp, Homo sapiens
caccctgctgctggtgc

SEQ ID NO: 2927236 - DNA, 17 bp, Homo sapiens
caccctggccaccaccc

SEQ ID NO: 2927237 - DNA, 21 bp, Homo sapiens
caccctggccgagtccaagct

SEQ ID NO: 2927238 - DNA, 15 bp, Homo sapiens
caccctggcctggtc

SEQ ID NO: 2927239 - DNA, 19 bp, Homo sapiens
caccctgggtttggcccct

SEQ ID NO: 2927240 - DNA, 22 bp, Homo sapiens
caccctgggtttggcccctgga

SEQ ID NO: 2927241 - DNA, 11 bp, Homo sapiens
caccctgtgac

SEQ ID NO: 2927242 - DNA, 21 bp, Homo sapiens
caccctgtttggatttttaat

SEQ ID NO: 2927243 - DNA, 13 bp, Homo sapiens
cacccttcctggc

SEQ ID NO: 2927244 - DNA, 21 bp, Homo sapiens
cacccttttccagctggatga

SEQ ID NO: 2927245 - DNA, 16 bp, Homo sapiens
caccgaccccgggccg

SEQ ID NO: 2927246 - DNA, 14 bp, Homo sapiens
caccgcagctgctg

SEQ ID NO: 2927247 - DNA, 14 bp, Homo sapiens
cacttcagaatcag

SEQ ID NO: 2927248 - DNA, 14 bp, Homo sapiens
cacttccagtctgg

SEQ ID NO: 2927249 - DNA, 13 bp, Homo sapiens
cacttccatggga

SEQ ID NO: 2927250 - DNA, 21 bp, Homo sapiens
cacttcccaggatctgctcca

SEQ ID NO: 2927251 - DNA, 19 bp, Homo sapiens
cacttcctccagaagcctc

SEQ ID NO: 2927252 - DNA, 18 bp, Homo sapiens
cacttctaaatgaagtgc

SEQ ID NO: 2927253 - DNA, 12 bp, Homo sapiens
cacttctcagga

SEQ ID NO: 2927254 - DNA, 18 bp, Homo sapiens
cacttctcatcacacaca

SEQ ID NO: 2927255 - DNA, 20 bp, Homo sapiens
cacttctcatcacacacatg

SEQ ID NO: 2927256 - DNA, 17 bp, Homo sapiens
cacttctggtcccctgt

SEQ ID NO: 2927257 - DNA, 22 bp, Homo sapiens
cacttctggtcccctgtggtga

SEQ ID NO: 2927258 - DNA, 14 bp, Homo sapiens
cacttctgtccata

SEQ ID NO: 2927259 - DNA, 15 bp, Homo sapiens
cacttctttatactc

SEQ ID NO: 2927260 - DNA, 12 bp, Homo sapiens
cacttgaaagat

SEQ ID NO: 2927261 - DNA, 15 bp, Homo sapiens
cacttgaaagatttt

SEQ ID NO: 2927262 - DNA, 18 bp, Homo sapiens
cacttgaggtcaggagtt

SEQ ID NO: 2927263 - DNA, 12 bp, Homo sapiens
cacttgcaacct

SEQ ID NO: 2927264 - DNA, 21 bp, Homo sapiens
cacttgcagaggagcccagtg

SEQ ID NO: 2927265 - DNA, 22 bp, Homo sapiens
cacttgcagaggagcccagtgg

SEQ ID NO: 2927266 - DNA, 12 bp, Homo sapiens
cacttgcatgtc

SEQ ID NO: 2927267 - DNA, 13 bp, Homo sapiens
cacttgccagggc

SEQ ID NO: 2927268 - DNA, 14 bp, Homo sapiens
cacttgccagggct

SEQ ID NO: 2927269 - DNA, 21 bp, Homo sapiens
cacttgccagggctctggggg

SEQ ID NO: 2927270 - DNA, 18 bp, Homo sapiens
cacttggaaataaaccat

SEQ ID NO: 2927271 - DNA, 16 bp, Homo sapiens
cacttggagatctttg

SEQ ID NO: 2927272 - DNA, 23 bp, Homo sapiens
cacttggagatctttgcttcctt

SEQ ID NO: 2927273 - DNA, 22 bp, Homo sapiens
cacttggccagttttctgttca

SEQ ID NO: 2927274 - DNA, 23 bp, Homo sapiens
cacttgtccagctgagcgccagg

SEQ ID NO: 2927275 - DNA, 15 bp, Homo sapiens
cacttgtgccagccc

SEQ ID NO: 2927276 - DNA, 16 bp, Homo sapiens
cacttgtgccagcccg

SEQ ID NO: 2927277 - DNA, 18 bp, Homo sapiens
cacttgtgggtcctgggg

SEQ ID NO: 2927278 - DNA, 21 bp, Homo sapiens
cacttgtgtttaagcaccatg

SEQ ID NO: 2927279 - DNA, 17 bp, Homo sapiens
cactttagaaagccagc

SEQ ID NO: 2927280 - DNA, 18 bp, Homo sapiens
cactttagtgtattttct

SEQ ID NO: 2927281 - DNA, 18 bp, Homo sapiens
cactttattgtagaaaaa

SEQ ID NO: 2927282 - DNA, 13 bp, Homo sapiens
cactttcattttt

SEQ ID NO: 2927283 - DNA, 21 bp, Homo sapiens
cactttcctggataaaaaaga

SEQ ID NO: 2927284 - DNA, 19 bp, Homo sapiens
cactttgagcctgggaaat

SEQ ID NO: 2927285 - DNA, 23 bp, Homo sapiens
cactttgggaggccaaggagggc

SEQ ID NO: 2927286 - DNA, 23 bp, Homo sapiens
cacttttaaaataaattctctcc

SEQ ID NO: 2927287 - DNA, 21 bp, Homo sapiens
cacttttatatttgaaaaaat

SEQ ID NO: 2927288 - DNA, 18 bp, Homo sapiens
cacttttcacctccttca

SEQ ID NO: 2927289 - DNA, 14 bp, Homo sapiens
cacttttcacttgt

SEQ ID NO: 2927290 - DNA, 17 bp, Homo sapiens
cacttttcattgcaaag

SEQ ID NO: 2927291 - DNA, 14 bp, Homo sapiens
cacttttctagtta

SEQ ID NO: 2927292 - DNA, 17 bp, Homo sapiens
cacttttgacaaaggca

SEQ ID NO: 2927293 - DNA, 18 bp, Homo sapiens
cacttttgacaaaggcaa

SEQ ID NO: 2927294 - DNA, 21 bp, Homo sapiens
cacttttgcaaggttccacag

SEQ ID NO: 2927295 - DNA, 18 bp, Homo sapiens
cactttttccttctgaaa

SEQ ID NO: 2927296 - DNA, 21 bp, Homo sapiens
cactttttggtaatatatata

SEQ ID NO: 2927297 - DNA, 23 bp, Homo sapiens
cactttttttttccaaaaaaata

SEQ ID NO: 2927298 - DNA, 20 bp, Homo sapiens
cagaaaaaaaaaatgcattt

SEQ ID NO: 2927299 - DNA, 12 bp, Homo sapiens
cagaaaaagaaa

SEQ ID NO: 2927300 - DNA, 13 bp, Homo sapiens
cagaaaaagcatg

SEQ ID NO: 2927301 - DNA, 14 bp, Homo sapiens
cagaaaagcacctg

SEQ ID NO: 2927302 - DNA, 15 bp, Homo sapiens
cagaaaagtaggaat

SEQ ID NO: 2927303 - DNA, 14 bp, Homo sapiens
cagaaaatatactg

SEQ ID NO: 2927304 - DNA, 15 bp, Homo sapiens
cagaaaatatactgt

SEQ ID NO: 2927305 - DNA, 17 bp, Homo sapiens
cagaaaatatactgtaa

SEQ ID NO: 2927306 - DNA, 18 bp, Homo sapiens
cagaaaatatactgtaaa

SEQ ID NO: 2927307 - DNA, 12 bp, Homo sapiens
cagaaacactgc

SEQ ID NO: 2927308 - DNA, 13 bp, Homo sapiens
cagaaacactgcc

SEQ ID NO: 2927309 - DNA, 14 bp, Homo sapiens
cagaaacactgcct

SEQ ID NO: 2927310 - DNA, 19 bp, Homo sapiens
cagaaacactgccttttta

SEQ ID NO: 2927311 - DNA, 13 bp, Homo sapiens
cagaaacaggacc

SEQ ID NO: 2927312 - DNA, 17 bp, Homo sapiens
cagaaacctgggagaga

SEQ ID NO: 2927313 - DNA, 11 bp, Homo sapiens
cagaaaccttg

SEQ ID NO: 2927314 - DNA, 19 bp, Homo sapiens
cagaaaccttgtttgtttt

SEQ ID NO: 2927315 - DNA, 13 bp, Homo sapiens
cagaaactgatgc

SEQ ID NO: 2927316 - DNA, 14 bp, Homo sapiens
cagaaactgatgcc

SEQ ID NO: 2927317 - DNA, 19 bp, Homo sapiens
cagaaactgttcccacctg

SEQ ID NO: 2927318 - DNA, 13 bp, Homo sapiens
cagaaagagggac

SEQ ID NO: 2927319 - DNA, 17 bp, Homo sapiens
cagaaagggcaacaata

SEQ ID NO: 2927320 - DNA, 20 bp, Homo sapiens
cagaaaggttttcttctttt

SEQ ID NO: 2927321 - DNA, 23 bp, Homo sapiens
cagaaatataaacacattaaaag

SEQ ID NO: 2927322 - DNA, 18 bp, Homo sapiens
cagaaatgaggaggatgc

SEQ ID NO: 2927323 - DNA, 21 bp, Homo sapiens
cagaaatggacaaagaaaacg

SEQ ID NO: 2927324 - DNA, 13 bp, Homo sapiens
cagaacacctggc

SEQ ID NO: 2927325 - DNA, 15 bp, Homo sapiens
cagaacacctggccg

SEQ ID NO: 2927326 - DNA, 18 bp, Homo sapiens
cagaacacctggccgggt

SEQ ID NO: 2927327 - DNA, 19 bp, Homo sapiens
cagaacagatgctgagcca

SEQ ID NO: 2927328 - DNA, 24 bp, Homo sapiens
cagaacaggtgttggtgacaattg

SEQ ID NO: 2927329 - DNA, 15 bp, Homo sapiens
cagaacagtgtttga

SEQ ID NO: 2927330 - DNA, 17 bp, Homo sapiens
cagaacagtgtttgatt

SEQ ID NO: 2927331 - DNA, 22 bp, Homo sapiens
cagaacagtgtttgatttttat

SEQ ID NO: 2927332 - DNA, 15 bp, Homo sapiens
cagaacatcattaga

SEQ ID NO: 2927333 - DNA, 16 bp, Homo sapiens
cagaaccaaagctcaa

SEQ ID NO: 2927334 - DNA, 20 bp, Homo sapiens
cagaaccaccccggccccct

SEQ ID NO: 2927335 - DNA, 18 bp, Homo sapiens
cagaaccttgttatttct

SEQ ID NO: 2927336 - DNA, 19 bp, Homo sapiens
cagaactaaactcatttat

SEQ ID NO: 2927337 - DNA, 20 bp, Homo sapiens
cagaactcaaatggggccag

SEQ ID NO: 2927338 - DNA, 21 bp, Homo sapiens
cagaactcaaatggggccaga

SEQ ID NO: 2927339 - DNA, 18 bp, Homo sapiens
cagaactcactggggcct

SEQ ID NO: 2927340 - DNA, 22 bp, Homo sapiens
cagaactctctgtcttctctcc

SEQ ID NO: 2927341 - DNA, 17 bp, Homo sapiens
cagaactcttaaaaatg

SEQ ID NO: 2927342 - DNA, 19 bp, Homo sapiens
cagaactcttaaaaatgtt

SEQ ID NO: 2927343 - DNA, 13 bp, Homo sapiens
cagaactgctggg

SEQ ID NO: 2927344 - DNA, 14 bp, Homo sapiens
cagaactgctgggg

SEQ ID NO: 2927345 - DNA, 18 bp, Homo sapiens
cagaactgctggggctgg

SEQ ID NO: 2927346 - DNA, 19 bp, Homo sapiens
cagaactgctggggctggt

SEQ ID NO: 2927347 - DNA, 19 bp, Homo sapiens
cagaacttcagcattgtaa

SEQ ID NO: 2927348 - DNA, 19 bp, Homo sapiens
cagaacttcaggtgtgact

SEQ ID NO: 2927349 - DNA, 21 bp, Homo sapiens
cagaacttgaccctgagctga

SEQ ID NO: 2927350 - DNA, 16 bp, Homo sapiens
cagaagaatctttctt

SEQ ID NO: 2927351 - DNA, 17 bp, Homo sapiens
cagaagaattgaaccca

SEQ ID NO: 2927352 - DNA, 21 bp, Homo sapiens
cagaagaattgaacccaggag

SEQ ID NO: 2927353 - DNA, 22 bp, Homo sapiens
cagaagaattgaacccaggagg

SEQ ID NO: 2927354 - DNA, 18 bp, Homo sapiens
cagaagactatttaccag

SEQ ID NO: 2927355 - DNA, 17 bp, Homo sapiens
cagaagactcctaggcc

SEQ ID NO: 2927356 - DNA, 16 bp, Homo sapiens
cagaagagaggggaag

SEQ ID NO: 2927357 - DNA, 14 bp, Homo sapiens
cagaagagggggag

SEQ ID NO: 2927358 - DNA, 15 bp, Homo sapiens
cagaagcagaggcta

SEQ ID NO: 2927359 - DNA, 13 bp, Homo sapiens
cagaagcagctct

SEQ ID NO: 2927360 - DNA, 14 bp, Homo sapiens
cagaagcagctctt

SEQ ID NO: 2927361 - DNA, 14 bp, Homo sapiens
cagaagccagaggg

SEQ ID NO: 2927362 - DNA, 21 bp, Homo sapiens
cagaagccagagggtgggagg

SEQ ID NO: 2927363 - DNA, 19 bp, Homo sapiens
cagaagcctccttacatta

SEQ ID NO: 2927364 - DNA, 20 bp, Homo sapiens
cagaagcctccttacattaa

SEQ ID NO: 2927365 - DNA, 21 bp, Homo sapiens
cagaagcctccttacattaaa

SEQ ID NO: 2927366 - DNA, 23 bp, Homo sapiens
cagaagcctccttacattaaaaa

SEQ ID NO: 2927367 - DNA, 18 bp, Homo sapiens
cagaagcggcctgtgcgt

SEQ ID NO: 2927368 - DNA, 16 bp, Homo sapiens
cagaagctaggtacat

SEQ ID NO: 2927369 - DNA, 21 bp, Homo sapiens
cagaagctgagcaccagggga

SEQ ID NO: 2927370 - DNA, 15 bp, Homo sapiens
cagaagctgtgagtt

SEQ ID NO: 2927371 - DNA, 19 bp, Homo sapiens
cagaagctgttgggagaaa

SEQ ID NO: 2927372 - DNA, 16 bp, Homo sapiens
cagaagcttctgccca

SEQ ID NO: 2927373 - DNA, 24 bp, Homo sapiens
cagaaggacaggtctctgagacag

SEQ ID NO: 2927374 - DNA, 18 bp, Homo sapiens
cagaaggacggcaggagt

SEQ ID NO: 2927375 - DNA, 15 bp, Homo sapiens
cagaaggatttcttg

SEQ ID NO: 2927376 - DNA, 16 bp, Homo sapiens
cagaaggatttcttgt

SEQ ID NO: 2927377 - DNA, 19 bp, Homo sapiens
cagaagggagctagccaga

SEQ ID NO: 2927378 - DNA, 21 bp, Homo sapiens
cagaagggagctagccagagg

SEQ ID NO: 2927379 - DNA, 13 bp, Homo sapiens
cagagctgcctcc

SEQ ID NO: 2927380 - DNA, 22 bp, Homo sapiens
cagagctgcctccccaatccat

SEQ ID NO: 2927381 - DNA, 13 bp, Homo sapiens
cagagctgcgggc

SEQ ID NO: 2927382 - DNA, 16 bp, Homo sapiens
cagagctgcgggctgg

SEQ ID NO: 2927383 - DNA, 18 bp, Homo sapiens
cagagctggtggacccag

SEQ ID NO: 2927384 - DNA, 20 bp, Homo sapiens
cagagctggtggacccaggg

SEQ ID NO: 2927385 - DNA, 21 bp, Homo sapiens
cagagctggtggacccaggga

SEQ ID NO: 2927386 - DNA, 23 bp, Homo sapiens
cagagcttccctgactcattctg

SEQ ID NO: 2927387 - DNA, 21 bp, Homo sapiens
cagagcttttcgaactgtgct

SEQ ID NO: 2927388 - DNA, 23 bp, Homo sapiens
cagagcttttcgaactgtgctcc

SEQ ID NO: 2927389 - DNA, 22 bp, Homo sapiens
cagaggaatatgaacattttat

SEQ ID NO: 2927390 - DNA, 23 bp, Homo sapiens
cagaggaattgattgtcagccac

SEQ ID NO: 2927391 - DNA, 22 bp, Homo sapiens
cagaggagagatagcctgtggc

SEQ ID NO: 2927392 - DNA, 21 bp, Homo sapiens
cagaggagcatcagctgtctg

SEQ ID NO: 2927393 - DNA, 21 bp, Homo sapiens
cagaggagcccagcggcccaa

SEQ ID NO: 2927394 - DNA, 15 bp, Homo sapiens
cagaggagcccagtg

SEQ ID NO: 2927395 - DNA, 16 bp, Homo sapiens
cagaggagcccagtgg

SEQ ID NO: 2927396 - DNA, 18 bp, Homo sapiens
cagaggagcccagtgggc

SEQ ID NO: 2927397 - DNA, 14 bp, Homo sapiens
cagaggagcctttt

SEQ ID NO: 2927398 - DNA, 22 bp, Homo sapiens
cagaggagcctttttaaaacac

SEQ ID NO: 2927399 - DNA, 14 bp, Homo sapiens
cagaggaggagaaa

SEQ ID NO: 2927400 - DNA, 19 bp, Homo sapiens
cagaggatgagctctaccc

SEQ ID NO: 2927401 - DNA, 21 bp, Homo sapiens
cagaggatgagctctacccag

SEQ ID NO: 2927402 - DNA, 15 bp, Homo sapiens
cagaggatgctcttt

SEQ ID NO: 2927403 - DNA, 18 bp, Homo sapiens
cagaggatgctctttccc

SEQ ID NO: 2927404 - DNA, 22 bp, Homo sapiens
cagaggatgctctttcccagga

SEQ ID NO: 2927405 - DNA, 11 bp, Homo sapiens
cagaggcagag

SEQ ID NO: 2927406 - DNA, 19 bp, Homo sapiens
cagaggcagaggttgcagt

SEQ ID NO: 2927407 - DNA, 14 bp, Homo sapiens
cagaggccaacact

SEQ ID NO: 2927408 - DNA, 17 bp, Homo sapiens
cagaggccaacactgtg

SEQ ID NO: 2927409 - DNA, 14 bp, Homo sapiens
cagaggccccagcc

SEQ ID NO: 2927410 - DNA, 16 bp, Homo sapiens
cagaggccccagcctc

SEQ ID NO: 2927411 - DNA, 15 bp, Homo sapiens
cagaggcctggggga

SEQ ID NO: 2927412 - DNA, 22 bp, Homo sapiens
cagaggcgtcccgcacctgtct

SEQ ID NO: 2927413 - DNA, 14 bp, Homo sapiens
cagaggctggaggc

SEQ ID NO: 2927414 - DNA, 19 bp, Homo sapiens
cagaggctggaggcagggc

SEQ ID NO: 2927415 - DNA, 20 bp, Homo sapiens
cagaggcttcttcagatcag

SEQ ID NO: 2927416 - DNA, 18 bp, Homo sapiens
cagagggaccaaattgct

SEQ ID NO: 2927417 - DNA, 20 bp, Homo sapiens
cagagggaccaaattgcttc

SEQ ID NO: 2927418 - DNA, 23 bp, Homo sapiens
cagagggaccaaattgcttctag

SEQ ID NO: 2927419 - DNA, 18 bp, Homo sapiens
cagagggatgggagagtc

SEQ ID NO: 2927420 - DNA, 17 bp, Homo sapiens
cagagggcacatgaaca

SEQ ID NO: 2927421 - DNA, 18 bp, Homo sapiens
cagagggcacatgaacag

SEQ ID NO: 2927422 - DNA, 14 bp, Homo sapiens
cagagggcactctg

SEQ ID NO: 2927423 - DNA, 18 bp, Homo sapiens
cagagggctggaggccca

SEQ ID NO: 2927424 - DNA, 21 bp, Homo sapiens
cagagggctggaggcccaggc

SEQ ID NO: 2927425 - DNA, 21 bp, Homo sapiens
cagaggggagcagcggctctg

SEQ ID NO: 2927426 - DNA, 22 bp, Homo sapiens
cagaggggagcagcggctctgg

SEQ ID NO: 2927427 - DNA, 13 bp, Homo sapiens
cagagggtcacag

SEQ ID NO: 2927428 - DNA, 16 bp, Homo sapiens
cagagggtcacagtgt

SEQ ID NO: 2927429 - DNA, 17 bp, Homo sapiens
cagagggtggctggagt

SEQ ID NO: 2927430 - DNA, 17 bp, Homo sapiens
cagagggtgggaggggc

SEQ ID NO: 2927431 - DNA, 19 bp, Homo sapiens
cagaggtaaaaaaaagaag

SEQ ID NO: 2927432 - DNA, 22 bp, Homo sapiens
cagaggtaaaaaaaagaagtgt

SEQ ID NO: 2927433 - DNA, 14 bp, Homo sapiens
cagaggtaccctgg

SEQ ID NO: 2927434 - DNA, 18 bp, Homo sapiens
cagaggtaccctgggtgt

SEQ ID NO: 2927435 - DNA, 14 bp, Homo sapiens
cagagtacatccat

SEQ ID NO: 2927436 - DNA, 17 bp, Homo sapiens
cagagtagttttggttt

SEQ ID NO: 2927437 - DNA, 22 bp, Homo sapiens
cagagtatctaatcctttaatg

SEQ ID NO: 2927438 - DNA, 23 bp, Homo sapiens
cagagtccatttcccacatcttt

SEQ ID NO: 2927439 - DNA, 19 bp, Homo sapiens
cagagtctcgctctgtcgc

SEQ ID NO: 2927440 - DNA, 23 bp, Homo sapiens
cagagtctcgctctgttgcccag

SEQ ID NO: 2927441 - DNA, 20 bp, Homo sapiens
cagagtgagacccagccctc

SEQ ID NO: 2927442 - DNA, 18 bp, Homo sapiens
cagagtgcaagaagtctg

SEQ ID NO: 2927443 - DNA, 18 bp, Homo sapiens
cagagtgcaagcccctgc

SEQ ID NO: 2927444 - DNA, 23 bp, Homo sapiens
cagagtgcaagcccctgctccag

SEQ ID NO: 2927445 - DNA, 13 bp, Homo sapiens
cagagtgctggga

SEQ ID NO: 2927446 - DNA, 19 bp, Homo sapiens
cagagtggccacggcccag

SEQ ID NO: 2927447 - DNA, 19 bp, Homo sapiens
cagagtggcgtgagctgcc

SEQ ID NO: 2927448 - DNA, 14 bp, Homo sapiens
cagagtgtcccttt

SEQ ID NO: 2927449 - DNA, 23 bp, Homo sapiens
cagagtgtgtttttgcactgtct

SEQ ID NO: 2927450 - DNA, 13 bp, Homo sapiens
cagagttaaagca

SEQ ID NO: 2927451 - DNA, 16 bp, Homo sapiens
cagagttctgtgaaga

SEQ ID NO: 2927452 - DNA, 22 bp, Homo sapiens
cagagttctgtgaagaggaaca

SEQ ID NO: 2927453 - DNA, 15 bp, Homo sapiens
cagagtttcagcttt

SEQ ID NO: 2927454 - DNA, 22 bp, Homo sapiens
cagagttttttaaacaaatgag

SEQ ID NO: 2927455 - DNA, 15 bp, Homo sapiens
cagataacatttgtg

SEQ ID NO: 2927456 - DNA, 13 bp, Homo sapiens
cagataatgtgaa

SEQ ID NO: 2927457 - DNA, 14 bp, Homo sapiens
cagataatgtgaaa

SEQ ID NO: 2927458 - DNA, 19 bp, Homo sapiens
cagataccttgaaaggaag

SEQ ID NO: 2927459 - DNA, 15 bp, Homo sapiens
cagatactgtgagct

SEQ ID NO: 2927460 - DNA, 14 bp, Homo sapiens
cagatagaaagcat

SEQ ID NO: 2927461 - DNA, 23 bp, Homo sapiens
cagatataaatactgacaatgta

SEQ ID NO: 2927462 - DNA, 13 bp, Homo sapiens
cagatatcaaaat

SEQ ID NO: 2927463 - DNA, 14 bp, Homo sapiens
cagatatcaaaatt

SEQ ID NO: 2927464 - DNA, 15 bp, Homo sapiens
cagatatcaaaattc

SEQ ID NO: 2927465 - DNA, 23 bp, Homo sapiens
cagatatcaaaattctagctgta

SEQ ID NO: 2927466 - DNA, 24 bp, Homo sapiens
cagatatcaaaattctagctgtat

SEQ ID NO: 2927467 - DNA, 18 bp, Homo sapiens
cagatatctttttcatta

SEQ ID NO: 2927468 - DNA, 14 bp, Homo sapiens
cagatatttatgta

SEQ ID NO: 2927469 - DNA, 15 bp, Homo sapiens
cagatatttttctcc

SEQ ID NO: 2927470 - DNA, 17 bp, Homo sapiens
cagatcaaagtatgtat

SEQ ID NO: 2927471 - DNA, 15 bp, Homo sapiens
cagatcaagctgtga

SEQ ID NO: 2927472 - DNA, 14 bp, Homo sapiens
cagatcacagtgtc

SEQ ID NO: 2927473 - DNA, 14 bp, Homo sapiens
cagatcactcctgg

SEQ ID NO: 2927474 - DNA, 18 bp, Homo sapiens
cagatcactcctggaggc

SEQ ID NO: 2927475 - DNA, 16 bp, Homo sapiens
cagatcagtgtaccat

SEQ ID NO: 2927476 - DNA, 19 bp, Homo sapiens
cagatcatgttttggtgaa

SEQ ID NO: 2927477 - DNA, 18 bp, Homo sapiens
cagatccagcctggggtc

SEQ ID NO: 2927478 - DNA, 22 bp, Homo sapiens
cagatcctgatcttaagaggct

SEQ ID NO: 2927479 - DNA, 15 bp, Homo sapiens
cagatccttgtttca

SEQ ID NO: 2927480 - DNA, 18 bp, Homo sapiens
cagatcgctcccttggct

SEQ ID NO: 2927481 - DNA, 19 bp, Homo sapiens
cagatcgctcccttggctt

SEQ ID NO: 2927482 - DNA, 15 bp, Homo sapiens
cagatctggaacctc

SEQ ID NO: 2927483 - DNA, 19 bp, Homo sapiens
cagatctggaacctcagcc

SEQ ID NO: 2927484 - DNA, 18 bp, Homo sapiens
cagatgaaaaggagcctg

SEQ ID NO: 2927485 - DNA, 18 bp, Homo sapiens
cagatgaaaggagacaat

SEQ ID NO: 2927486 - DNA, 19 bp, Homo sapiens
cagatgcaattgctcccat

SEQ ID NO: 2927487 - DNA, 13 bp, Homo sapiens
cagatgcagggca

SEQ ID NO: 2927488 - DNA, 12 bp, Homo sapiens
cagatgcgggga

SEQ ID NO: 2927489 - DNA, 18 bp, Homo sapiens
cagatgcggggacaggct

SEQ ID NO: 2927490 - DNA, 20 bp, Homo sapiens
cagatgcggggacaggctgg

SEQ ID NO: 2927491 - DNA, 20 bp, Homo sapiens
cagatgcgtcccaagatgtt

SEQ ID NO: 2927492 - DNA, 22 bp, Homo sapiens
cagatgcgtcccaagatgttga

SEQ ID NO: 2927493 - DNA, 22 bp, Homo sapiens
cagatgcgttcgcctctggccc

SEQ ID NO: 2927494 - DNA, 14 bp, Homo sapiens
cagatgctccaaga

SEQ ID NO: 2927495 - DNA, 20 bp, Homo sapiens
cagatgctccaagattctag

SEQ ID NO: 2927496 - DNA, 21 bp, Homo sapiens
cagatgctccaagattctaga

SEQ ID NO: 2927497 - DNA, 22 bp, Homo sapiens
cagatgctccaagattctagat

SEQ ID NO: 2927498 - DNA, 23 bp, Homo sapiens
cagatgctccaagattctagatg

SEQ ID NO: 2927499 - DNA, 16 bp, Homo sapiens
cagatgctgatgttca

SEQ ID NO: 2927500 - DNA, 20 bp, Homo sapiens
cagatgctgatgttcagtgt

SEQ ID NO: 2927501 - DNA, 14 bp, Homo sapiens
cagatgctgtgtaa

SEQ ID NO: 2927502 - DNA, 20 bp, Homo sapiens
cagatggaaagaggtgaaaa

SEQ ID NO: 2927503 - DNA, 21 bp, Homo sapiens
cagatggaaccgcaggaagct

SEQ ID NO: 2927504 - DNA, 23 bp, Homo sapiens
cagatgggcatatgtgtcagtgg

SEQ ID NO: 2927505 - DNA, 13 bp, Homo sapiens
cagatgtaatgtt

SEQ ID NO: 2927506 - DNA, 12 bp, Homo sapiens
cagatgtccctg

SEQ ID NO: 2927507 - DNA, 13 bp, Homo sapiens
cagatgtccctga

SEQ ID NO: 2927508 - DNA, 20 bp, Homo sapiens
cagatgtgagggcaccacca

SEQ ID NO: 2927509 - DNA, 16 bp, Homo sapiens
cagatgtgatgcttga

SEQ ID NO: 2927510 - DNA, 23 bp, Homo sapiens
cagctctccctctggccctgcct

SEQ ID NO: 2927511 - DNA, 19 bp, Homo sapiens
cagctctgaaaccagtgtt

SEQ ID NO: 2927512 - DNA, 21 bp, Homo sapiens
cagctctgacattctgattcg

SEQ ID NO: 2927513 - DNA, 21 bp, Homo sapiens
cagctctgcaggcttaataaa

SEQ ID NO: 2927514 - DNA, 19 bp, Homo sapiens
cagctctgccgtctctgga

SEQ ID NO: 2927515 - DNA, 20 bp, Homo sapiens
cagctctgccgtctctggag

SEQ ID NO: 2927516 - DNA, 21 bp, Homo sapiens
cagctctggacagccccaccc

SEQ ID NO: 2927517 - DNA, 23 bp, Homo sapiens
cagctctggacagccccaccctg

SEQ ID NO: 2927518 - DNA, 20 bp, Homo sapiens
cagctctggtccaggccctg

SEQ ID NO: 2927519 - DNA, 22 bp, Homo sapiens
cagctctgtcaccctggccacc

SEQ ID NO: 2927520 - DNA, 19 bp, Homo sapiens
cagctcttcatctgcccaa

SEQ ID NO: 2927521 - DNA, 15 bp, Homo sapiens
cagctcttctgggca

SEQ ID NO: 2927522 - DNA, 17 bp, Homo sapiens
cagctcttggctccact

SEQ ID NO: 2927523 - DNA, 13 bp, Homo sapiens
cagctcttgtttg

SEQ ID NO: 2927524 - DNA, 11 bp, Homo sapiens
cagctcttttt

SEQ ID NO: 2927525 - DNA, 14 bp, Homo sapiens
cagctgaccccctc

SEQ ID NO: 2927526 - DNA, 14 bp, Homo sapiens
cagctgagcgccag

SEQ ID NO: 2927527 - DNA, 16 bp, Homo sapiens
cagctgagcgccagga

SEQ ID NO: 2927528 - DNA, 18 bp, Homo sapiens
cagctgcactgatgctgc

SEQ ID NO: 2927529 - DNA, 21 bp, Homo sapiens
cagctgcagttgaagagcctg

SEQ ID NO: 2927530 - DNA, 12 bp, Homo sapiens
cagctgccccgg

SEQ ID NO: 2927531 - DNA, 22 bp, Homo sapiens
cagctgccccggcccctccccc

SEQ ID NO: 2927532 - DNA, 17 bp, Homo sapiens
cagctgcccctcctgga

SEQ ID NO: 2927533 - DNA, 21 bp, Homo sapiens
cagctgcccctcctggagcag

SEQ ID NO: 2927534 - DNA, 16 bp, Homo sapiens
cagctgcctggccatg

SEQ ID NO: 2927535 - DNA, 22 bp, Homo sapiens
cagctgcctggccatgctgtcc

SEQ ID NO: 2927536 - DNA, 23 bp, Homo sapiens
cagctgccttagcttcaggaacc

SEQ ID NO: 2927537 - DNA, 12 bp, Homo sapiens
cagctgctcaga

SEQ ID NO: 2927538 - DNA, 17 bp, Homo sapiens
cagctgctgccactctg

SEQ ID NO: 2927539 - DNA, 20 bp, Homo sapiens
cagctgctgccactctgctg

SEQ ID NO: 2927540 - DNA, 13 bp, Homo sapiens
cagctgctgttga

SEQ ID NO: 2927541 - DNA, 18 bp, Homo sapiens
cagctgctgttgaacttt

SEQ ID NO: 2927542 - DNA, 19 bp, Homo sapiens
cagctgctgttgaactttt

SEQ ID NO: 2927543 - DNA, 22 bp, Homo sapiens
cagctggaaaagggtcttggga

SEQ ID NO: 2927544 - DNA, 13 bp, Homo sapiens
cagctggaaactt

SEQ ID NO: 2927545 - DNA, 19 bp, Homo sapiens
cagctggaaacttctgtaa

SEQ ID NO: 2927546 - DNA, 17 bp, Homo sapiens
cagctggaattatgctg

SEQ ID NO: 2927547 - DNA, 14 bp, Homo sapiens
cagctggcagcaga

SEQ ID NO: 2927548 - DNA, 20 bp, Homo sapiens
cagctggccagatttcctca

SEQ ID NO: 2927549 - DNA, 12 bp, Homo sapiens
cagctggcccac

SEQ ID NO: 2927550 - DNA, 15 bp, Homo sapiens
cagctggcccactgc

SEQ ID NO: 2927551 - DNA, 20 bp, Homo sapiens
cagctggcccactgctggct

SEQ ID NO: 2927552 - DNA, 22 bp, Homo sapiens
cagctggcccactgctggctgc

SEQ ID NO: 2927553 - DNA, 17 bp, Homo sapiens
cagctggcccgtgacag

SEQ ID NO: 2927554 - DNA, 19 bp, Homo sapiens
cagctggcccgtgacagac

SEQ ID NO: 2927555 - DNA, 13 bp, Homo sapiens
cagctgggcagtg

SEQ ID NO: 2927556 - DNA, 19 bp, Homo sapiens
cagctgggcagtgccagcc

SEQ ID NO: 2927557 - DNA, 12 bp, Homo sapiens
cagctgggccca

SEQ ID NO: 2927558 - DNA, 14 bp, Homo sapiens
cagctgggcccaca

SEQ ID NO: 2927559 - DNA, 15 bp, Homo sapiens
cagctgggcccacag

SEQ ID NO: 2927560 - DNA, 23 bp, Homo sapiens
cagctgggcccacagcccccacc

SEQ ID NO: 2927561 - DNA, 16 bp, Homo sapiens
cagctggggctgtgga

SEQ ID NO: 2927562 - DNA, 14 bp, Homo sapiens
cagctgggtcaggc

SEQ ID NO: 2927563 - DNA, 15 bp, Homo sapiens
cagctgggtcaggca

SEQ ID NO: 2927564 - DNA, 13 bp, Homo sapiens
cagctggtgccaa

SEQ ID NO: 2927565 - DNA, 24 bp, Homo sapiens
cagctggtgccaaatagccccaga

SEQ ID NO: 2927566 - DNA, 16 bp, Homo sapiens
cagctggtgcccccag

SEQ ID NO: 2927567 - DNA, 23 bp, Homo sapiens
cagctggtgcccccagacagctg

SEQ ID NO: 2927568 - DNA, 11 bp, Homo sapiens
cagctggtgga

SEQ ID NO: 2927569 - DNA, 15 bp, Homo sapiens
cagctggtggatggt

SEQ ID NO: 2927570 - DNA, 19 bp, Homo sapiens
cagctggtggatggtgact

SEQ ID NO: 2927571 - DNA, 22 bp, Homo sapiens
cagctggtgggaagcgtctgtc

SEQ ID NO: 2927572 - DNA, 18 bp, Homo sapiens
cagctgtagtcatatctg

SEQ ID NO: 2927573 - DNA, 14 bp, Homo sapiens
cagctgtcagcctg

SEQ ID NO: 2927574 - DNA, 12 bp, Homo sapiens
cagctgtccctg

SEQ ID NO: 2927575 - DNA, 18 bp, Homo sapiens
cagctgtccctgtcacca

SEQ ID NO: 2927576 - DNA, 17 bp, Homo sapiens
cagctgtcgggggccac

SEQ ID NO: 2927577 - DNA, 21 bp, Homo sapiens
cagctgtcgggggccactgtg

SEQ ID NO: 2927578 - DNA, 22 bp, Homo sapiens
cagctgtcgggggccactgtgt

SEQ ID NO: 2927579 - DNA, 11 bp, Homo sapiens
cagctgtgctt

SEQ ID NO: 2927580 - DNA, 14 bp, Homo sapiens
cagctgtggtccca

SEQ ID NO: 2927581 - DNA, 16 bp, Homo sapiens
cagctgtggtcccacc

SEQ ID NO: 2927582 - DNA, 13 bp, Homo sapiens
cagctgttcctgt

SEQ ID NO: 2927583 - DNA, 15 bp, Homo sapiens
cagctgttcctgtgt

SEQ ID NO: 2927584 - DNA, 14 bp, Homo sapiens
cagctgttgcaggc

SEQ ID NO: 2927585 - DNA, 16 bp, Homo sapiens
cagctgttgcaggcag

SEQ ID NO: 2927586 - DNA, 16 bp, Homo sapiens
cagctgtttacagaca

SEQ ID NO: 2927587 - DNA, 18 bp, Homo sapiens
cagctgtttacagacaag

SEQ ID NO: 2927588 - DNA, 22 bp, Homo sapiens
cagcttatctcttttatatttg

SEQ ID NO: 2927589 - DNA, 18 bp, Homo sapiens
cagcttatttttttctac

SEQ ID NO: 2927590 - DNA, 18 bp, Homo sapiens
cagcttcctgtccccatc

SEQ ID NO: 2927591 - DNA, 15 bp, Homo sapiens
cagcttcgagctaca

SEQ ID NO: 2927592 - DNA, 17 bp, Homo sapiens
cagcttcgtgcctgggt

SEQ ID NO: 2927593 - DNA, 21 bp, Homo sapiens
cagcttgccagatgctgcaga

SEQ ID NO: 2927594 - DNA, 23 bp, Homo sapiens
cagcttgctcttcagtgggagaa

SEQ ID NO: 2927595 - DNA, 21 bp, Homo sapiens
cagcttgtggcaagtgaattt

SEQ ID NO: 2927596 - DNA, 17 bp, Homo sapiens
cagctttaaaaagaaaa

SEQ ID NO: 2927597 - DNA, 21 bp, Homo sapiens
cagctttcatctttgtggatg

SEQ ID NO: 2927598 - DNA, 20 bp, Homo sapiens
cagctttcatgattagcaag

SEQ ID NO: 2927599 - DNA, 22 bp, Homo sapiens
cagctttcctcaaaaagcagaa

SEQ ID NO: 2927600 - DNA, 13 bp, Homo sapiens
cagctttcttcag

SEQ ID NO: 2927601 - DNA, 20 bp, Homo sapiens
cagctttgatccctgacatc

SEQ ID NO: 2927602 - DNA, 14 bp, Homo sapiens
cagctttgctgctg

SEQ ID NO: 2927603 - DNA, 20 bp, Homo sapiens
cagctttgggtcatttttaa

SEQ ID NO: 2927604 - DNA, 16 bp, Homo sapiens
cagcttttcctcaggg

SEQ ID NO: 2927605 - DNA, 18 bp, Homo sapiens
cagcttttgttgtttata

SEQ ID NO: 2927606 - DNA, 18 bp, Homo sapiens
cagcttttttagaggtga

SEQ ID NO: 2927607 - DNA, 21 bp, Homo sapiens
caggaaaatgtatccagagga

SEQ ID NO: 2927608 - DNA, 19 bp, Homo sapiens
caggaaacatatttaagaa

SEQ ID NO: 2927609 - DNA, 20 bp, Homo sapiens
caggaaaccacaaccttgca

SEQ ID NO: 2927610 - DNA, 23 bp, Homo sapiens
caggaaaccacaaccttgcagta

SEQ ID NO: 2927611 - DNA, 11 bp, Homo sapiens
caggaaagaat

SEQ ID NO: 2927612 - DNA, 15 bp, Homo sapiens
caggaaaggaatcat

SEQ ID NO: 2927613 - DNA, 18 bp, Homo sapiens
caggaaaggcccagccac

SEQ ID NO: 2927614 - DNA, 18 bp, Homo sapiens
caggaaagttcagagttt

SEQ ID NO: 2927615 - DNA, 22 bp, Homo sapiens
caggaaagttcagagttttctg

SEQ ID NO: 2927616 - DNA, 20 bp, Homo sapiens
caggaacctcgagtactgtg

SEQ ID NO: 2927617 - DNA, 21 bp, Homo sapiens
caggaacggccctgcaggagc

SEQ ID NO: 2927618 - DNA, 15 bp, Homo sapiens
caggaactataaaaa

SEQ ID NO: 2927619 - DNA, 23 bp, Homo sapiens
caggaactcgcacctgtgctgga

SEQ ID NO: 2927620 - DNA, 14 bp, Homo sapiens
caggaagcagggag

SEQ ID NO: 2927621 - DNA, 20 bp, Homo sapiens
caggaagcccactgcctcct

SEQ ID NO: 2927622 - DNA, 21 bp, Homo sapiens
caggaagcccactgcctcctc

SEQ ID NO: 2927623 - DNA, 19 bp, Homo sapiens
caggaagcccccaagttga

SEQ ID NO: 2927624 - DNA, 20 bp, Homo sapiens
caggaagcctactatttaaa

SEQ ID NO: 2927625 - DNA, 12 bp, Homo sapiens
caggaagctcag

SEQ ID NO: 2927626 - DNA, 17 bp, Homo sapiens
caggaagctgctccgtg

SEQ ID NO: 2927627 - DNA, 18 bp, Homo sapiens
caggaagctgctccgtgc

SEQ ID NO: 2927628 - DNA, 22 bp, Homo sapiens
caggaagctttggtgagaacct

SEQ ID NO: 2927629 - DNA, 14 bp, Homo sapiens
caggaaggaaaact

SEQ ID NO: 2927630 - DNA, 20 bp, Homo sapiens
caggaaggaaaactatgtat

SEQ ID NO: 2927631 - DNA, 18 bp, Homo sapiens
caggaaggaaacaacatt

SEQ ID NO: 2927632 - DNA, 23 bp, Homo sapiens
caggaaggaaacaacattttctt

SEQ ID NO: 2927633 - DNA, 18 bp, Homo sapiens
caggaaggagccagactt

SEQ ID NO: 2927634 - DNA, 12 bp, Homo sapiens
caggaaggagcg

SEQ ID NO: 2927635 - DNA, 13 bp, Homo sapiens
caggaaggagcgg

SEQ ID NO: 2927636 - DNA, 15 bp, Homo sapiens
caggaaggagcggcg

SEQ ID NO: 2927637 - DNA, 16 bp, Homo sapiens
caggaaggagcggcgc

SEQ ID NO: 2927638 - DNA, 23 bp, Homo sapiens
caggaaggagcggcgccctggac

SEQ ID NO: 2927639 - DNA, 13 bp, Homo sapiens
caggaaggcttgt

SEQ ID NO: 2927640 - DNA, 18 bp, Homo sapiens
caggaagggagggagctg

SEQ ID NO: 2927641 - DNA, 21 bp, Homo sapiens
caggaagggagggagctgagg

SEQ ID NO: 2927642 - DNA, 14 bp, Homo sapiens
cagggtggcccagg

SEQ ID NO: 2927643 - DNA, 13 bp, Homo sapiens
cagggtgggcctc

SEQ ID NO: 2927644 - DNA, 20 bp, Homo sapiens
cagggtggtggtattctgtc

SEQ ID NO: 2927645 - DNA, 17 bp, Homo sapiens
cagggtgtctcctgaag

SEQ ID NO: 2927646 - DNA, 14 bp, Homo sapiens
cagggtttgagcac

SEQ ID NO: 2927647 - DNA, 15 bp, Homo sapiens
cagggtttgagcaca

SEQ ID NO: 2927648 - DNA, 20 bp, Homo sapiens
cagggtttgagcacaatctg

SEQ ID NO: 2927649 - DNA, 14 bp, Homo sapiens
caggtacgcacaga

SEQ ID NO: 2927650 - DNA, 16 bp, Homo sapiens
caggtactatgcagat

SEQ ID NO: 2927651 - DNA, 22 bp, Homo sapiens
caggtagaaggttgacacagtt

SEQ ID NO: 2927652 - DNA, 14 bp, Homo sapiens
caggtagcagcaaa

SEQ ID NO: 2927653 - DNA, 16 bp, Homo sapiens
caggtagcagcaaata

SEQ ID NO: 2927654 - DNA, 14 bp, Homo sapiens
caggtagctgcccc

SEQ ID NO: 2927655 - DNA, 15 bp, Homo sapiens
caggtagctgcccct

SEQ ID NO: 2927656 - DNA, 23 bp, Homo sapiens
caggtagctgcccctggctctga

SEQ ID NO: 2927657 - DNA, 14 bp, Homo sapiens
caggtaggaaacaa

SEQ ID NO: 2927658 - DNA, 16 bp, Homo sapiens
caggtatgttgccttt

SEQ ID NO: 2927659 - DNA, 19 bp, Homo sapiens
caggtcaacagaatgaaaa

SEQ ID NO: 2927660 - DNA, 13 bp, Homo sapiens
caggtcaataaac

SEQ ID NO: 2927661 - DNA, 22 bp, Homo sapiens
caggtcaataaacttagaggaa

SEQ ID NO: 2927662 - DNA, 23 bp, Homo sapiens
caggtcaataaacttagaggaaa

SEQ ID NO: 2927663 - DNA, 23 bp, Homo sapiens
caggtcaatacagtacaggcagc

SEQ ID NO: 2927664 - DNA, 17 bp, Homo sapiens
caggtcactgtcactgc

SEQ ID NO: 2927665 - DNA, 20 bp, Homo sapiens
caggtcaggggtgacacaga

SEQ ID NO: 2927666 - DNA, 16 bp, Homo sapiens
caggtccattctgttt

SEQ ID NO: 2927667 - DNA, 18 bp, Homo sapiens
caggtccattttgcctga

SEQ ID NO: 2927668 - DNA, 20 bp, Homo sapiens
caggtcccagcgagccacag

SEQ ID NO: 2927669 - DNA, 17 bp, Homo sapiens
caggtcccccgactgcc

SEQ ID NO: 2927670 - DNA, 22 bp, Homo sapiens
caggtcccccgactgcctgtct

SEQ ID NO: 2927671 - DNA, 15 bp, Homo sapiens
caggtccccctgcag

SEQ ID NO: 2927672 - DNA, 18 bp, Homo sapiens
caggtccttcccagattt

SEQ ID NO: 2927673 - DNA, 12 bp, Homo sapiens
caggtctagact

SEQ ID NO: 2927674 - DNA, 11 bp, Homo sapiens
caggtctctga

SEQ ID NO: 2927675 - DNA, 20 bp, Homo sapiens
caggtctctgagacaggatc

SEQ ID NO: 2927676 - DNA, 12 bp, Homo sapiens
caggtctctgtt

SEQ ID NO: 2927677 - DNA, 13 bp, Homo sapiens
caggtctgcaagg

SEQ ID NO: 2927678 - DNA, 15 bp, Homo sapiens
caggtctgcaagggc

SEQ ID NO: 2927679 - DNA, 20 bp, Homo sapiens
caggtcttcatcgaatctac

SEQ ID NO: 2927680 - DNA, 15 bp, Homo sapiens
caggtgagcagacag

SEQ ID NO: 2927681 - DNA, 20 bp, Homo sapiens
caggtgagtgtgagggcagc

SEQ ID NO: 2927682 - DNA, 15 bp, Homo sapiens
caggtgcacacatca

SEQ ID NO: 2927683 - DNA, 24 bp, Homo sapiens
caggtgcacacatcaccaggtgca

SEQ ID NO: 2927684 - DNA, 12 bp, Homo sapiens
caggtgcagagg

SEQ ID NO: 2927685 - DNA, 13 bp, Homo sapiens
caggtgcagagga

SEQ ID NO: 2927686 - DNA, 23 bp, Homo sapiens
caggtgcagaggtaccctgggtg

SEQ ID NO: 2927687 - DNA, 16 bp, Homo sapiens
caggtgcagccagagg

SEQ ID NO: 2927688 - DNA, 19 bp, Homo sapiens
caggtgcagccagaggcac

SEQ ID NO: 2927689 - DNA, 15 bp, Homo sapiens
caggtgcatctgcag

SEQ ID NO: 2927690 - DNA, 22 bp, Homo sapiens
caggtgcccagctatacctgtg

SEQ ID NO: 2927691 - DNA, 15 bp, Homo sapiens
caggtgcctttcaaa

SEQ ID NO: 2927692 - DNA, 16 bp, Homo sapiens
caggtgcggcctgggg

SEQ ID NO: 2927693 - DNA, 17 bp, Homo sapiens
caggtgcggcctggggg

SEQ ID NO: 2927694 - DNA, 20 bp, Homo sapiens
caggtgcggcctggggggaa

SEQ ID NO: 2927695 - DNA, 18 bp, Homo sapiens
caggtgcgggaccatctg

SEQ ID NO: 2927696 - DNA, 23 bp, Homo sapiens
caggtgctgacttcatctcccac

SEQ ID NO: 2927697 - DNA, 17 bp, Homo sapiens
caggtgctggcccagca

SEQ ID NO: 2927698 - DNA, 15 bp, Homo sapiens
caggtgctggtcccg

SEQ ID NO: 2927699 - DNA, 13 bp, Homo sapiens
caggtggaccctg

SEQ ID NO: 2927700 - DNA, 20 bp, Homo sapiens
caggtggagagcactagaag

SEQ ID NO: 2927701 - DNA, 13 bp, Homo sapiens
caggtggccgccc

SEQ ID NO: 2927702 - DNA, 20 bp, Homo sapiens
caggtggccgcccctgaggc

SEQ ID NO: 2927703 - DNA, 22 bp, Homo sapiens
caggtggctagcaaattagaaa

SEQ ID NO: 2927704 - DNA, 14 bp, Homo sapiens
caggtggctgaccc

SEQ ID NO: 2927705 - DNA, 15 bp, Homo sapiens
caggtggctgaccca

SEQ ID NO: 2927706 - DNA, 20 bp, Homo sapiens
caggtggctgacccagtccc

SEQ ID NO: 2927707 - DNA, 22 bp, Homo sapiens
caggtggctgacccagtccctg

SEQ ID NO: 2927708 - DNA, 23 bp, Homo sapiens
caggtggctgacccagtccctgg

SEQ ID NO: 2927709 - DNA, 21 bp, Homo sapiens
caggtgggaggaaagggcctg

SEQ ID NO: 2927710 - DNA, 20 bp, Homo sapiens
caggtggggagactgggctg

SEQ ID NO: 2927711 - DNA, 23 bp, Homo sapiens
caggtggggagtcagggacccct

SEQ ID NO: 2927712 - DNA, 22 bp, Homo sapiens
caggtggggtggagtcccagag

SEQ ID NO: 2927713 - DNA, 16 bp, Homo sapiens
caggtggtgtcactgt

SEQ ID NO: 2927714 - DNA, 19 bp, Homo sapiens
caggtggtgtcactgtccc

SEQ ID NO: 2927715 - DNA, 13 bp, Homo sapiens
caggtggtgtcct

SEQ ID NO: 2927716 - DNA, 15 bp, Homo sapiens
caggtgtagctgagc

SEQ ID NO: 2927717 - DNA, 16 bp, Homo sapiens
caggtgtcagccattg

SEQ ID NO: 2927718 - DNA, 15 bp, Homo sapiens
caggtgtcaggcccg

SEQ ID NO: 2927719 - DNA, 23 bp, Homo sapiens
caggtgtgactctagcaaggctc

SEQ ID NO: 2927720 - DNA, 23 bp, Homo sapiens
caggtgtgagccaccacacctgg

SEQ ID NO: 2927721 - DNA, 17 bp, Homo sapiens
caggtgttaacattcca

SEQ ID NO: 2927722 - DNA, 14 bp, Homo sapiens
caggttacaacaga

SEQ ID NO: 2927723 - DNA, 16 bp, Homo sapiens
caggttacaacagatt

SEQ ID NO: 2927724 - DNA, 19 bp, Homo sapiens
caggttacaacagatttgt

SEQ ID NO: 2927725 - DNA, 12 bp, Homo sapiens
caggttagagaa

SEQ ID NO: 2927726 - DNA, 16 bp, Homo sapiens
caggttaggaaggcag

SEQ ID NO: 2927727 - DNA, 20 bp, Homo sapiens
caggttagtgacatttaatg

SEQ ID NO: 2927728 - DNA, 22 bp, Homo sapiens
caggttcaagcgattctcctgc

SEQ ID NO: 2927729 - DNA, 14 bp, Homo sapiens
caggttcccaagct

SEQ ID NO: 2927730 - DNA, 15 bp, Homo sapiens
caggttctatttgga

SEQ ID NO: 2927731 - DNA, 19 bp, Homo sapiens
caggttctatttggaattt

SEQ ID NO: 2927732 - DNA, 20 bp, Homo sapiens
caggttcttcttcctgaagc

SEQ ID NO: 2927733 - DNA, 18 bp, Homo sapiens
caggtttgaccaggaaag

SEQ ID NO: 2927734 - DNA, 21 bp, Homo sapiens
caggtttgcacctaagtgtgt

SEQ ID NO: 2927735 - DNA, 20 bp, Homo sapiens
caggttttcacataaatgca

SEQ ID NO: 2927736 - DNA, 22 bp, Homo sapiens
caggtttttgcccatcctccca

SEQ ID NO: 2927737 - DNA, 15 bp, Homo sapiens
cagtaaacggtgtat

SEQ ID NO: 2927738 - DNA, 19 bp, Homo sapiens
cagtaaatgaactgatttt

SEQ ID NO: 2927739 - DNA, 18 bp, Homo sapiens
cagtaacaagtattggga

SEQ ID NO: 2927740 - DNA, 17 bp, Homo sapiens
cagtaacagtattcagt

SEQ ID NO: 2927741 - DNA, 22 bp, Homo sapiens
cagtaacgggtcgtaatgactt

SEQ ID NO: 2927742 - DNA, 20 bp, Homo sapiens
cagtaactgtccctgctttc

SEQ ID NO: 2927743 - DNA, 14 bp, Homo sapiens
cagtaactttatgt

SEQ ID NO: 2927744 - DNA, 18 bp, Homo sapiens
cagtaactttatgtgtaa

SEQ ID NO: 2927745 - DNA, 23 bp, Homo sapiens
cagtaagtataacaaactatgta

SEQ ID NO: 2927746 - DNA, 22 bp, Homo sapiens
cagtaatgctaaatgtgtaata

SEQ ID NO: 2927747 - DNA, 13 bp, Homo sapiens
cagtaattattat

SEQ ID NO: 2927748 - DNA, 19 bp, Homo sapiens
cagtacaggcagcacagag

SEQ ID NO: 2927749 - DNA, 20 bp, Homo sapiens
cagtacaggcagcacagaga

SEQ ID NO: 2927750 - DNA, 14 bp, Homo sapiens
cagtaccaaatttc

SEQ ID NO: 2927751 - DNA, 13 bp, Homo sapiens
cagtaccttgctt

SEQ ID NO: 2927752 - DNA, 22 bp, Homo sapiens
cagtactaaggtgactttctga

SEQ ID NO: 2927753 - DNA, 15 bp, Homo sapiens
cagtacttcagcaag

SEQ ID NO: 2927754 - DNA, 19 bp, Homo sapiens
cagtactttggaggcccct

SEQ ID NO: 2927755 - DNA, 21 bp, Homo sapiens
cagtacttttttaaatatttt

SEQ ID NO: 2927756 - DNA, 12 bp, Homo sapiens
cagtagacattt

SEQ ID NO: 2927757 - DNA, 20 bp, Homo sapiens
cagtagacattttaacaaga

SEQ ID NO: 2927758 - DNA, 18 bp, Homo sapiens
cagtagcacaagttattt

SEQ ID NO: 2927759 - DNA, 16 bp, Homo sapiens
cagtagcattgaagtg

SEQ ID NO: 2927760 - DNA, 13 bp, Homo sapiens
cagtagccaaggc

SEQ ID NO: 2927761 - DNA, 20 bp, Homo sapiens
cagtagctgtggtgaggtgg

SEQ ID NO: 2927762 - DNA, 21 bp, Homo sapiens
cagtaggagcccagctctgaa

SEQ ID NO: 2927763 - DNA, 21 bp, Homo sapiens
cagtagtaccttgttttgcca

SEQ ID NO: 2927764 - DNA, 17 bp, Homo sapiens
cagtagtcacctctggg

SEQ ID NO: 2927765 - DNA, 18 bp, Homo sapiens
cagtagtcacctctgggc

SEQ ID NO: 2927766 - DNA, 12 bp, Homo sapiens
cagtagtttgag

SEQ ID NO: 2927767 - DNA, 15 bp, Homo sapiens
cagtatattcttgta

SEQ ID NO: 2927768 - DNA, 17 bp, Homo sapiens
cagtatattcttgtaaa

SEQ ID NO: 2927769 - DNA, 18 bp, Homo sapiens
cagtatattcttgtaaat

SEQ ID NO: 2927770 - DNA, 16 bp, Homo sapiens
cagtatcatgccctgt

SEQ ID NO: 2927771 - DNA, 16 bp, Homo sapiens
cagtatcctgctggtt

SEQ ID NO: 2927772 - DNA, 19 bp, Homo sapiens
cagtatctatatatgtgta

SEQ ID NO: 2927773 - DNA, 20 bp, Homo sapiens
cagtatctatatatgtgtat

SEQ ID NO: 2927774 - DNA, 14 bp, Homo sapiens
catcctaccctttt

SEQ ID NO: 2927775 - DNA, 13 bp, Homo sapiens
catcctagtctct

SEQ ID NO: 2927776 - DNA, 20 bp, Homo sapiens
catcctagtctctatcatta

SEQ ID NO: 2927777 - DNA, 17 bp, Homo sapiens
catcctcagaagcctcg

SEQ ID NO: 2927778 - DNA, 15 bp, Homo sapiens
catcctcagatgctc

SEQ ID NO: 2927779 - DNA, 13 bp, Homo sapiens
catcctccagccc

SEQ ID NO: 2927780 - DNA, 17 bp, Homo sapiens
catcctccccaccagag

SEQ ID NO: 2927781 - DNA, 12 bp, Homo sapiens
catcctcctctc

SEQ ID NO: 2927782 - DNA, 14 bp, Homo sapiens
catcctcctctcca

SEQ ID NO: 2927783 - DNA, 14 bp, Homo sapiens
catcctgaacagca

SEQ ID NO: 2927784 - DNA, 16 bp, Homo sapiens
catcctgaacagcatg

SEQ ID NO: 2927785 - DNA, 14 bp, Homo sapiens
catcctgcttctct

SEQ ID NO: 2927786 - DNA, 19 bp, Homo sapiens
catcctgtgcctccatcag

SEQ ID NO: 2927787 - DNA, 19 bp, Homo sapiens
catcctgttggctgctgcc

SEQ ID NO: 2927788 - DNA, 19 bp, Homo sapiens
catcctgtttgtatgaaat

SEQ ID NO: 2927789 - DNA, 15 bp, Homo sapiens
catccttatccttca

SEQ ID NO: 2927790 - DNA, 19 bp, Homo sapiens
catccttatccttcatctt

SEQ ID NO: 2927791 - DNA, 20 bp, Homo sapiens
catccttcccaagaagagag

SEQ ID NO: 2927792 - DNA, 15 bp, Homo sapiens
catccttccctgtct

SEQ ID NO: 2927793 - DNA, 16 bp, Homo sapiens
catccttgcagtttaa

SEQ ID NO: 2927794 - DNA, 20 bp, Homo sapiens
catccttggtgctcttgctt

SEQ ID NO: 2927795 - DNA, 22 bp, Homo sapiens
catccttggtgctcttgctttt

SEQ ID NO: 2927796 - DNA, 21 bp, Homo sapiens
catcgaccacaccagcctcct

SEQ ID NO: 2927797 - DNA, 19 bp, Homo sapiens
catcgacttagcctgagtc

SEQ ID NO: 2927798 - DNA, 13 bp, Homo sapiens
catcgatatgaaa

SEQ ID NO: 2927799 - DNA, 15 bp, Homo sapiens
catcgctggcccctt

SEQ ID NO: 2927800 - DNA, 19 bp, Homo sapiens
catcggacaagacccccag

SEQ ID NO: 2927801 - DNA, 16 bp, Homo sapiens
catcgggcccagggac

SEQ ID NO: 2927802 - DNA, 16 bp, Homo sapiens
catcgtcttttagttc

SEQ ID NO: 2927803 - DNA, 15 bp, Homo sapiens
catctaacctcatct

SEQ ID NO: 2927804 - DNA, 18 bp, Homo sapiens
catctaatgcttgtttat

SEQ ID NO: 2927805 - DNA, 21 bp, Homo sapiens
catctaattctctgtggaatg

SEQ ID NO: 2927806 - DNA, 23 bp, Homo sapiens
catctactcttttgaagtgtttt

SEQ ID NO: 2927807 - DNA, 21 bp, Homo sapiens
catctatgtgaatatttgtaa

SEQ ID NO: 2927808 - DNA, 20 bp, Homo sapiens
catctattctctccaaaaat

SEQ ID NO: 2927809 - DNA, 18 bp, Homo sapiens
catctcaggcctccctca

SEQ ID NO: 2927810 - DNA, 17 bp, Homo sapiens
catctcattgaggacaa

SEQ ID NO: 2927811 - DNA, 20 bp, Homo sapiens
catctccagtatcctgctgg

SEQ ID NO: 2927812 - DNA, 16 bp, Homo sapiens
catctccatgtagaat

SEQ ID NO: 2927813 - DNA, 21 bp, Homo sapiens
catctccatgtagaataaatg

SEQ ID NO: 2927814 - DNA, 21 bp, Homo sapiens
catctcccacctagcagcacc

SEQ ID NO: 2927815 - DNA, 20 bp, Homo sapiens
catctcccccatagcaccct

SEQ ID NO: 2927816 - DNA, 21 bp, Homo sapiens
catctcccccatagcaccctg

SEQ ID NO: 2927817 - DNA, 13 bp, Homo sapiens
catctccctgcca

SEQ ID NO: 2927818 - DNA, 23 bp, Homo sapiens
catctccctgccatccccctctc

SEQ ID NO: 2927819 - DNA, 21 bp, Homo sapiens
catctcgctccctcccaggac

SEQ ID NO: 2927820 - DNA, 15 bp, Homo sapiens
catctcggggctgct

SEQ ID NO: 2927821 - DNA, 15 bp, Homo sapiens
catctctactaaaaa

SEQ ID NO: 2927822 - DNA, 16 bp, Homo sapiens
catctctcatcctcca

SEQ ID NO: 2927823 - DNA, 17 bp, Homo sapiens
catctctcatcctccag

SEQ ID NO: 2927824 - DNA, 16 bp, Homo sapiens
catctctctgcccaac

SEQ ID NO: 2927825 - DNA, 18 bp, Homo sapiens
catctctctgcccaaccc

SEQ ID NO: 2927826 - DNA, 11 bp, Homo sapiens
catctctgagt

SEQ ID NO: 2927827 - DNA, 18 bp, Homo sapiens
catctctgagtgtctctg

SEQ ID NO: 2927828 - DNA, 22 bp, Homo sapiens
catctctgagtgtctctgcctg

SEQ ID NO: 2927829 - DNA, 12 bp, Homo sapiens
catctctgcctt

SEQ ID NO: 2927830 - DNA, 14 bp, Homo sapiens
catctctgcctttg

SEQ ID NO: 2927831 - DNA, 19 bp, Homo sapiens
catctctttgaattttctg

SEQ ID NO: 2927832 - DNA, 15 bp, Homo sapiens
catctctttgtcctg

SEQ ID NO: 2927833 - DNA, 12 bp, Homo sapiens
catctgaaagcc

SEQ ID NO: 2927834 - DNA, 14 bp, Homo sapiens
catctgaaagccac

SEQ ID NO: 2927835 - DNA, 16 bp, Homo sapiens
catctgaaagccacgt

SEQ ID NO: 2927836 - DNA, 19 bp, Homo sapiens
catctgaatgaaaataact

SEQ ID NO: 2927837 - DNA, 20 bp, Homo sapiens
catctgaatgaaaataactg

SEQ ID NO: 2927838 - DNA, 19 bp, Homo sapiens
catctgaatttgccctggg

SEQ ID NO: 2927839 - DNA, 23 bp, Homo sapiens
catctgaatttgccctgggaaac

SEQ ID NO: 2927840 - DNA, 18 bp, Homo sapiens
catctgacaaattcaaaa

SEQ ID NO: 2927841 - DNA, 19 bp, Homo sapiens
catctgacaaattcaaaag

SEQ ID NO: 2927842 - DNA, 19 bp, Homo sapiens
catctgaccagcagcgcct

SEQ ID NO: 2927843 - DNA, 17 bp, Homo sapiens
catctgaccatctgtga

SEQ ID NO: 2927844 - DNA, 18 bp, Homo sapiens
catctgaccatctgtgac

SEQ ID NO: 2927845 - DNA, 16 bp, Homo sapiens
catctgaggcatccag

SEQ ID NO: 2927846 - DNA, 19 bp, Homo sapiens
catctgcacccccctgggc

SEQ ID NO: 2927847 - DNA, 17 bp, Homo sapiens
catctgcatgtctactc

SEQ ID NO: 2927848 - DNA, 17 bp, Homo sapiens
catctgcattgcccagt

SEQ ID NO: 2927849 - DNA, 20 bp, Homo sapiens
catctgccacaaaaatgttc

SEQ ID NO: 2927850 - DNA, 17 bp, Homo sapiens
catctgcccaactgtgt

SEQ ID NO: 2927851 - DNA, 19 bp, Homo sapiens
catctgcccaactgtgtag

SEQ ID NO: 2927852 - DNA, 13 bp, Homo sapiens
catctgcccgcct

SEQ ID NO: 2927853 - DNA, 22 bp, Homo sapiens
catctgcccgcctgcccacctg

SEQ ID NO: 2927854 - DNA, 15 bp, Homo sapiens
catctgctgcacata

SEQ ID NO: 2927855 - DNA, 21 bp, Homo sapiens
catctgctgcacatagcagac

SEQ ID NO: 2927856 - DNA, 11 bp, Homo sapiens
catctgctgcg

SEQ ID NO: 2927857 - DNA, 16 bp, Homo sapiens
catctgctgtgactgt

SEQ ID NO: 2927858 - DNA, 20 bp, Homo sapiens
catctggcccaagtgaagca

SEQ ID NO: 2927859 - DNA, 16 bp, Homo sapiens
catctgggtgccctga

SEQ ID NO: 2927860 - DNA, 22 bp, Homo sapiens
catctggttgaactctggtggc

SEQ ID NO: 2927861 - DNA, 21 bp, Homo sapiens
catctgtacttggtccaactg

SEQ ID NO: 2927862 - DNA, 14 bp, Homo sapiens
catctgtagtcagc

SEQ ID NO: 2927863 - DNA, 23 bp, Homo sapiens
catctgtccacatccccagagcc

SEQ ID NO: 2927864 - DNA, 13 bp, Homo sapiens
catctgtccatcc

SEQ ID NO: 2927865 - DNA, 12 bp, Homo sapiens
catctgtcctga

SEQ ID NO: 2927866 - DNA, 18 bp, Homo sapiens
catctgtgactataaagc

SEQ ID NO: 2927867 - DNA, 23 bp, Homo sapiens
catctgtgactataaagctgtta

SEQ ID NO: 2927868 - DNA, 17 bp, Homo sapiens
catctgtgcactgccca

SEQ ID NO: 2927869 - DNA, 18 bp, Homo sapiens
catctgtgcactgcccat

SEQ ID NO: 2927870 - DNA, 19 bp, Homo sapiens
catctgtgcctgtctgtcc

SEQ ID NO: 2927871 - DNA, 20 bp, Homo sapiens
catctgtgcctgtctgtcca

SEQ ID NO: 2927872 - DNA, 21 bp, Homo sapiens
catctgtgcctgtctgtccaa

SEQ ID NO: 2927873 - DNA, 10 bp, Homo sapiens
catctgtgcg

SEQ ID NO: 2927874 - DNA, 17 bp, Homo sapiens
catctgtggagatgccc

SEQ ID NO: 2927875 - DNA, 14 bp, Homo sapiens
catctgtggttttc

SEQ ID NO: 2927876 - DNA, 14 bp, Homo sapiens
catctgtgtctctg

SEQ ID NO: 2927877 - DNA, 14 bp, Homo sapiens
catctgtgtcttgt

SEQ ID NO: 2927878 - DNA, 23 bp, Homo sapiens
catctgtgtgcgtggtgtggccc

SEQ ID NO: 2927879 - DNA, 13 bp, Homo sapiens
catcttcagcttc

SEQ ID NO: 2927880 - DNA, 14 bp, Homo sapiens
catcttcatataaa

SEQ ID NO: 2927881 - DNA, 23 bp, Homo sapiens
catcttccacctcacctctttgt

SEQ ID NO: 2927882 - DNA, 20 bp, Homo sapiens
catcttcccgcctcagcctc

SEQ ID NO: 2927883 - DNA, 12 bp, Homo sapiens
catcttccctgc

SEQ ID NO: 2927884 - DNA, 14 bp, Homo sapiens
catcttccctgccc

SEQ ID NO: 2927885 - DNA, 17 bp, Homo sapiens
catcttccctgcccctg

SEQ ID NO: 2927886 - DNA, 18 bp, Homo sapiens
catcttccctgcccctgt

SEQ ID NO: 2927887 - DNA, 19 bp, Homo sapiens
catcttcgtcttcactctt

SEQ ID NO: 2927888 - DNA, 18 bp, Homo sapiens
catcttctccccgaggct

SEQ ID NO: 2927889 - DNA, 20 bp, Homo sapiens
catcttctccccgaggctgc

SEQ ID NO: 2927890 - DNA, 22 bp, Homo sapiens
catcttctccccgaggctgccc

SEQ ID NO: 2927891 - DNA, 23 bp, Homo sapiens
catcttctccccgaggctgcccc

SEQ ID NO: 2927892 - DNA, 14 bp, Homo sapiens
catcttcttcacca

SEQ ID NO: 2927893 - DNA, 19 bp, Homo sapiens
catcttcttcaccatttgg

SEQ ID NO: 2927894 - DNA, 20 bp, Homo sapiens
catcttgaagttacacataa

SEQ ID NO: 2927895 - DNA, 15 bp, Homo sapiens
catcttgaccaagca

SEQ ID NO: 2927896 - DNA, 21 bp, Homo sapiens
catcttgaccaagcaggaagc

SEQ ID NO: 2927897 - DNA, 23 bp, Homo sapiens
catcttgaccaagcaggaagctc

SEQ ID NO: 2927898 - DNA, 22 bp, Homo sapiens
catcttgcctccaggtgcagag

SEQ ID NO: 2927899 - DNA, 15 bp, Homo sapiens
catcttggggacatc

SEQ ID NO: 2927900 - DNA, 12 bp, Homo sapiens
catcttggtaaa

SEQ ID NO: 2927901 - DNA, 13 bp, Homo sapiens
catcttggtaaat

SEQ ID NO: 2927902 - DNA, 14 bp, Homo sapiens
catcttggtaaatt

SEQ ID NO: 2927903 - DNA, 22 bp, Homo sapiens
catctttacaaaactacatgag

SEQ ID NO: 2927904 - DNA, 20 bp, Homo sapiens
catctttctcttttctaaaa

SEQ ID NO: 2927905 - DNA, 17 bp, Homo sapiens
catctttgcgaaaagat

SEQ ID NO: 2927906 - DNA, 16 bp, Homo sapiens
cattctctctcctgtc

SEQ ID NO: 2927907 - DNA, 20 bp, Homo sapiens
cattctctctcctgtccaac

SEQ ID NO: 2927908 - DNA, 12 bp, Homo sapiens
cattctctgaag

SEQ ID NO: 2927909 - DNA, 23 bp, Homo sapiens
cattctctgtctcatccatcatc

SEQ ID NO: 2927910 - DNA, 19 bp, Homo sapiens
cattctgataggagggggc

SEQ ID NO: 2927911 - DNA, 23 bp, Homo sapiens
cattctgattcgaatgacactgt

SEQ ID NO: 2927912 - DNA, 17 bp, Homo sapiens
cattctgcaagtatact

SEQ ID NO: 2927913 - DNA, 18 bp, Homo sapiens
cattctgccctgtgggac

SEQ ID NO: 2927914 - DNA, 20 bp, Homo sapiens
cattctgccctgtgggaccc

SEQ ID NO: 2927915 - DNA, 20 bp, Homo sapiens
cattctgctttcatcttggt

SEQ ID NO: 2927916 - DNA, 17 bp, Homo sapiens
cattctggcagttttga

SEQ ID NO: 2927917 - DNA, 17 bp, Homo sapiens
cattctgtgtgtatcta

SEQ ID NO: 2927918 - DNA, 15 bp, Homo sapiens
cattcttataaatat

SEQ ID NO: 2927919 - DNA, 16 bp, Homo sapiens
cattcttataaatatg

SEQ ID NO: 2927920 - DNA, 11 bp, Homo sapiens
cattcttcccg

SEQ ID NO: 2927921 - DNA, 17 bp, Homo sapiens
cattcttggcatctact

SEQ ID NO: 2927922 - DNA, 12 bp, Homo sapiens
cattcttttgta

SEQ ID NO: 2927923 - DNA, 14 bp, Homo sapiens
cattcttttgtaat

SEQ ID NO: 2927924 - DNA, 18 bp, Homo sapiens
cattctttttttcttggc

SEQ ID NO: 2927925 - DNA, 19 bp, Homo sapiens
cattctttttttcttggcc

SEQ ID NO: 2927926 - DNA, 17 bp, Homo sapiens
cattgaaagaagagatg

SEQ ID NO: 2927927 - DNA, 14 bp, Homo sapiens
cattgaaagtgctt

SEQ ID NO: 2927928 - DNA, 19 bp, Homo sapiens
cattgaaatgtaatttcag

SEQ ID NO: 2927929 - DNA, 14 bp, Homo sapiens
cattgaacacaaac

SEQ ID NO: 2927930 - DNA, 15 bp, Homo sapiens
cattgaacacaaact

SEQ ID NO: 2927931 - DNA, 18 bp, Homo sapiens
cattgaacacaaactgta

SEQ ID NO: 2927932 - DNA, 14 bp, Homo sapiens
cattgaaggcctgg

SEQ ID NO: 2927933 - DNA, 19 bp, Homo sapiens
cattgaagtaatgaatttt

SEQ ID NO: 2927934 - DNA, 19 bp, Homo sapiens
cattgaagtgtttgctgca

SEQ ID NO: 2927935 - DNA, 23 bp, Homo sapiens
cattgaattcttggttgaggaaa

SEQ ID NO: 2927936 - DNA, 22 bp, Homo sapiens
cattgaccgcgactaatttcaa

SEQ ID NO: 2927937 - DNA, 18 bp, Homo sapiens
cattgagaactgcatatg

SEQ ID NO: 2927938 - DNA, 18 bp, Homo sapiens
cattgagagttttgtctt

SEQ ID NO: 2927939 - DNA, 14 bp, Homo sapiens
cattgagctgtgca

SEQ ID NO: 2927940 - DNA, 22 bp, Homo sapiens
cattgataagatggtttccgtg

SEQ ID NO: 2927941 - DNA, 14 bp, Homo sapiens
cattgatggggaag

SEQ ID NO: 2927942 - DNA, 16 bp, Homo sapiens
cattgatggggaagga

SEQ ID NO: 2927943 - DNA, 13 bp, Homo sapiens
cattgatgtgttc

SEQ ID NO: 2927944 - DNA, 14 bp, Homo sapiens
cattgatttcctgt

SEQ ID NO: 2927945 - DNA, 14 bp, Homo sapiens
cattgcacccagcc

SEQ ID NO: 2927946 - DNA, 18 bp, Homo sapiens
cattgcacccagcccaga

SEQ ID NO: 2927947 - DNA, 21 bp, Homo sapiens
cattgcacctatctcagccat

SEQ ID NO: 2927948 - DNA, 14 bp, Homo sapiens
cattgcagccatga

SEQ ID NO: 2927949 - DNA, 12 bp, Homo sapiens
cattgcagttta

SEQ ID NO: 2927950 - DNA, 20 bp, Homo sapiens
cattgcagtttaagagcaga

SEQ ID NO: 2927951 - DNA, 10 bp, Homo sapiens
cattgcattt

SEQ ID NO: 2927952 - DNA, 21 bp, Homo sapiens
cattgccgaagtccagctttc

SEQ ID NO: 2927953 - DNA, 22 bp, Homo sapiens
cattgcctttgaatgttaattt

SEQ ID NO: 2927954 - DNA, 23 bp, Homo sapiens
cattgcgtttgaccttttatgta

SEQ ID NO: 2927955 - DNA, 14 bp, Homo sapiens
cattgctgagcctc

SEQ ID NO: 2927956 - DNA, 15 bp, Homo sapiens
cattgctgagcctct

SEQ ID NO: 2927957 - DNA, 18 bp, Homo sapiens
cattgctgattttgtctg

SEQ ID NO: 2927958 - DNA, 13 bp, Homo sapiens
cattgctgctcct

SEQ ID NO: 2927959 - DNA, 20 bp, Homo sapiens
cattgctgctccttagctgc

SEQ ID NO: 2927960 - DNA, 19 bp, Homo sapiens
cattgctgtctgcagcctt

SEQ ID NO: 2927961 - DNA, 20 bp, Homo sapiens
cattgctgtctgcagccttg

SEQ ID NO: 2927962 - DNA, 21 bp, Homo sapiens
cattgctgtctgcagccttga

SEQ ID NO: 2927963 - DNA, 20 bp, Homo sapiens
cattgctgtgtcacactctg

SEQ ID NO: 2927964 - DNA, 18 bp, Homo sapiens
cattgctgttagagaaat

SEQ ID NO: 2927965 - DNA, 12 bp, Homo sapiens
cattgctttctg

SEQ ID NO: 2927966 - DNA, 15 bp, Homo sapiens
cattgctttctgaaa

SEQ ID NO: 2927967 - DNA, 14 bp, Homo sapiens
cattggatacagca

SEQ ID NO: 2927968 - DNA, 14 bp, Homo sapiens
cattggatgcattt

SEQ ID NO: 2927969 - DNA, 21 bp, Homo sapiens
cattggcacctaatccaggca

SEQ ID NO: 2927970 - DNA, 22 bp, Homo sapiens
cattggctatataaaatgtggc

SEQ ID NO: 2927971 - DNA, 14 bp, Homo sapiens
cattggctatttaa

SEQ ID NO: 2927972 - DNA, 23 bp, Homo sapiens
cattgggaaggggacccccgccc

SEQ ID NO: 2927973 - DNA, 18 bp, Homo sapiens
cattgggtctattccagc

SEQ ID NO: 2927974 - DNA, 21 bp, Homo sapiens
cattgggtctattccagctca

SEQ ID NO: 2927975 - DNA, 13 bp, Homo sapiens
cattggtccaaga

SEQ ID NO: 2927976 - DNA, 14 bp, Homo sapiens
cattggttaatttt

SEQ ID NO: 2927977 - DNA, 15 bp, Homo sapiens
cattggttaattttt

SEQ ID NO: 2927978 - DNA, 13 bp, Homo sapiens
cattgtaaaccac

SEQ ID NO: 2927979 - DNA, 11 bp, Homo sapiens
cattgtaaata

SEQ ID NO: 2927980 - DNA, 16 bp, Homo sapiens
cattgtaattatgtaa

SEQ ID NO: 2927981 - DNA, 13 bp, Homo sapiens
cattgtactccag

SEQ ID NO: 2927982 - DNA, 17 bp, Homo sapiens
cattgtactccagcctg

SEQ ID NO: 2927983 - DNA, 19 bp, Homo sapiens
cattgtactccagcctggg

SEQ ID NO: 2927984 - DNA, 22 bp, Homo sapiens
cattgtactccagcctgggcaa

SEQ ID NO: 2927985 - DNA, 20 bp, Homo sapiens
cattgtactccagcctgggt

SEQ ID NO: 2927986 - DNA, 16 bp, Homo sapiens
cattgtatcgatgtta

SEQ ID NO: 2927987 - DNA, 22 bp, Homo sapiens
cattgtatcgatgttatgtaaa

SEQ ID NO: 2927988 - DNA, 21 bp, Homo sapiens
cattgtccaatcctatgtttt

SEQ ID NO: 2927989 - DNA, 19 bp, Homo sapiens
cattgtccctctgccccat

SEQ ID NO: 2927990 - DNA, 20 bp, Homo sapiens
cattgtcgtttcattcattt

SEQ ID NO: 2927991 - DNA, 13 bp, Homo sapiens
cattgtctgcaat

SEQ ID NO: 2927992 - DNA, 23 bp, Homo sapiens
cattgtcttcggaaaccttggtg

SEQ ID NO: 2927993 - DNA, 14 bp, Homo sapiens
cattgtctttttag

SEQ ID NO: 2927994 - DNA, 22 bp, Homo sapiens
cattgtgatgtatattcctttg

SEQ ID NO: 2927995 - DNA, 23 bp, Homo sapiens
cattgtgcccttgatttttatct

SEQ ID NO: 2927996 - DNA, 16 bp, Homo sapiens
cattgttatttctgta

SEQ ID NO: 2927997 - DNA, 17 bp, Homo sapiens
cattgttgagctgtcat

SEQ ID NO: 2927998 - DNA, 17 bp, Homo sapiens
cattgttggcgctgagg

SEQ ID NO: 2927999 - DNA, 19 bp, Homo sapiens
cattgttggcgctgaggtg

SEQ ID NO: 2928000 - DNA, 18 bp, Homo sapiens
cattgtttgaaacaaaga

SEQ ID NO: 2928001 - DNA, 12 bp, Homo sapiens
catttaaaaaaa

SEQ ID NO: 2928002 - DNA, 22 bp, Homo sapiens
catttaaaatggaaaagagaga

SEQ ID NO: 2928003 - DNA, 15 bp, Homo sapiens
catttaaacaagtat

SEQ ID NO: 2928004 - DNA, 20 bp, Homo sapiens
catttaaactaaccttttat

SEQ ID NO: 2928005 - DNA, 17 bp, Homo sapiens
catttaaatacagtctt

SEQ ID NO: 2928006 - DNA, 14 bp, Homo sapiens
catttaagtgacct

SEQ ID NO: 2928007 - DNA, 15 bp, Homo sapiens
catttaatacagata

SEQ ID NO: 2928008 - DNA, 14 bp, Homo sapiens
catttaccaacatg

SEQ ID NO: 2928009 - DNA, 17 bp, Homo sapiens
catttaccaacatgtat

SEQ ID NO: 2928010 - DNA, 19 bp, Homo sapiens
catttactgatcatctgct

SEQ ID NO: 2928011 - DNA, 15 bp, Homo sapiens
catttagaaaataga

SEQ ID NO: 2928012 - DNA, 18 bp, Homo sapiens
catttagaacgagcctgg

SEQ ID NO: 2928013 - DNA, 20 bp, Homo sapiens
catttagaagcctgacaact

SEQ ID NO: 2928014 - DNA, 21 bp, Homo sapiens
catttagaagcctgacaactc

SEQ ID NO: 2928015 - DNA, 22 bp, Homo sapiens
catttagatcctggtttcataa

SEQ ID NO: 2928016 - DNA, 15 bp, Homo sapiens
catttagtctcttta

SEQ ID NO: 2928017 - DNA, 17 bp, Homo sapiens
catttagtctctttatt

SEQ ID NO: 2928018 - DNA, 23 bp, Homo sapiens
catttagtttgattattcagtgt

SEQ ID NO: 2928019 - DNA, 21 bp, Homo sapiens
catttataaagctaaaataac

SEQ ID NO: 2928020 - DNA, 15 bp, Homo sapiens
catttatagaagaaa

SEQ ID NO: 2928021 - DNA, 21 bp, Homo sapiens
catttatatattgtctgtaaa

SEQ ID NO: 2928022 - DNA, 19 bp, Homo sapiens
catttatgacaagctgtat

SEQ ID NO: 2928023 - DNA, 19 bp, Homo sapiens
catttatgtagacattgta

SEQ ID NO: 2928024 - DNA, 21 bp, Homo sapiens
catttatgtagacattgtaaa

SEQ ID NO: 2928025 - DNA, 23 bp, Homo sapiens
catttatgtagacattgtaaata

SEQ ID NO: 2928026 - DNA, 21 bp, Homo sapiens
catttatgtgtcagttcattt

SEQ ID NO: 2928027 - DNA, 12 bp, Homo sapiens
catttatgtgtt

SEQ ID NO: 2928028 - DNA, 17 bp, Homo sapiens
catttattgcagtttat

SEQ ID NO: 2928029 - DNA, 18 bp, Homo sapiens
catttattgtttatgtaa

SEQ ID NO: 2928030 - DNA, 17 bp, Homo sapiens
catttattttatgagaa

SEQ ID NO: 2928031 - DNA, 23 bp, Homo sapiens
catttattttatgagaaatgtaa

SEQ ID NO: 2928032 - DNA, 17 bp, Homo sapiens
catttcaaaattaatag

SEQ ID NO: 2928033 - DNA, 15 bp, Homo sapiens
catttcaaagccctg

SEQ ID NO: 2928034 - DNA, 18 bp, Homo sapiens
catttcaaagccctgcct

SEQ ID NO: 2928035 - DNA, 22 bp, Homo sapiens
catttcaaagccctgcctctgt

SEQ ID NO: 2928036 - DNA, 17 bp, Homo sapiens
catttcaagatccaaat

SEQ ID NO: 2928037 - DNA, 20 bp, Homo sapiens
catttcacaaaacagccttt

SEQ ID NO: 2928038 - DNA, 22 bp, Homo sapiens
ccacaggagttgtgagccctct

SEQ ID NO: 2928039 - DNA, 19 bp, Homo sapiens
ccacaggcacattaactgt

SEQ ID NO: 2928040 - DNA, 20 bp, Homo sapiens
ccacaggcacattaactgtt

SEQ ID NO: 2928041 - DNA, 15 bp, Homo sapiens
ccacaggtctagact

SEQ ID NO: 2928042 - DNA, 19 bp, Homo sapiens
ccacatattaaaagggggc

SEQ ID NO: 2928043 - DNA, 18 bp, Homo sapiens
ccacatcccactggatct

SEQ ID NO: 2928044 - DNA, 16 bp, Homo sapiens
ccacatccccagagcc

SEQ ID NO: 2928045 - DNA, 19 bp, Homo sapiens
ccacatccccagagcccag

SEQ ID NO: 2928046 - DNA, 17 bp, Homo sapiens
ccacatctgtgtctctg

SEQ ID NO: 2928047 - DNA, 14 bp, Homo sapiens
ccacatgaaaccta

SEQ ID NO: 2928048 - DNA, 16 bp, Homo sapiens
ccacatgggaggctca

SEQ ID NO: 2928049 - DNA, 16 bp, Homo sapiens
ccacatggtgtggcca

SEQ ID NO: 2928050 - DNA, 19 bp, Homo sapiens
ccacatggtgtggccatca

SEQ ID NO: 2928051 - DNA, 19 bp, Homo sapiens
ccacatttggaatactttt

SEQ ID NO: 2928052 - DNA, 16 bp, Homo sapiens
ccacattttcagccaa

SEQ ID NO: 2928053 - DNA, 18 bp, Homo sapiens
ccaccaactttttccaag

SEQ ID NO: 2928054 - DNA, 17 bp, Homo sapiens
ccaccaaggtctcacac

SEQ ID NO: 2928055 - DNA, 19 bp, Homo sapiens
ccaccaaggtctcacactc

SEQ ID NO: 2928056 - DNA, 21 bp, Homo sapiens
ccaccaaggtctcacactcct

SEQ ID NO: 2928057 - DNA, 14 bp, Homo sapiens
ccaccacacatccc

SEQ ID NO: 2928058 - DNA, 11 bp, Homo sapiens
ccaccacccaa

SEQ ID NO: 2928059 - DNA, 19 bp, Homo sapiens
ccaccacgatgtggccctg

SEQ ID NO: 2928060 - DNA, 20 bp, Homo sapiens
ccaccacgatgtggccctgg

SEQ ID NO: 2928061 - DNA, 16 bp, Homo sapiens
ccaccactcttgactc

SEQ ID NO: 2928062 - DNA, 16 bp, Homo sapiens
ccaccagaagcaggcc

SEQ ID NO: 2928063 - DNA, 21 bp, Homo sapiens
ccaccagagcaggggctgctg

SEQ ID NO: 2928064 - DNA, 23 bp, Homo sapiens
ccaccagagcaggggctgctggg

SEQ ID NO: 2928065 - DNA, 13 bp, Homo sapiens
ccaccagagctgc

SEQ ID NO: 2928066 - DNA, 17 bp, Homo sapiens
ccaccagagctgcctcc

SEQ ID NO: 2928067 - DNA, 19 bp, Homo sapiens
ccaccagagctgcctcccc

SEQ ID NO: 2928068 - DNA, 19 bp, Homo sapiens
ccaccagcatcacctgcct

SEQ ID NO: 2928069 - DNA, 15 bp, Homo sapiens
ccaccaggcctcact

SEQ ID NO: 2928070 - DNA, 23 bp, Homo sapiens
ccaccaggtctcccgggaagcca

SEQ ID NO: 2928071 - DNA, 20 bp, Homo sapiens
ccacccaaaccccttcccac

SEQ ID NO: 2928072 - DNA, 21 bp, Homo sapiens
ccacccaaaccccttcccacg

SEQ ID NO: 2928073 - DNA, 21 bp, Homo sapiens
ccacccaaccccaagccagcc

SEQ ID NO: 2928074 - DNA, 15 bp, Homo sapiens
ccacccaacctgtcc

SEQ ID NO: 2928075 - DNA, 14 bp, Homo sapiens
ccacccaagagagg

SEQ ID NO: 2928076 - DNA, 22 bp, Homo sapiens
ccacccaattcaaaacattgtg

SEQ ID NO: 2928077 - DNA, 16 bp, Homo sapiens
ccacccacctcagcct

SEQ ID NO: 2928078 - DNA, 12 bp, Homo sapiens
ccacccagccca

SEQ ID NO: 2928079 - DNA, 12 bp, Homo sapiens
ccacccagctcc

SEQ ID NO: 2928080 - DNA, 14 bp, Homo sapiens
ccacccagtccatg

SEQ ID NO: 2928081 - DNA, 22 bp, Homo sapiens
ccacccagtccatgctccaggg

SEQ ID NO: 2928082 - DNA, 16 bp, Homo sapiens
ccacccattcttcccg

SEQ ID NO: 2928083 - DNA, 14 bp, Homo sapiens
ccaccccaccccct

SEQ ID NO: 2928084 - DNA, 22 bp, Homo sapiens
ccaccccagcacagctcctccc

SEQ ID NO: 2928085 - DNA, 23 bp, Homo sapiens
ccaccccatgtcaccggatcctg

SEQ ID NO: 2928086 - DNA, 18 bp, Homo sapiens
ccaccccattttctgtgg

SEQ ID NO: 2928087 - DNA, 16 bp, Homo sapiens
ccacccccaggacccc

SEQ ID NO: 2928088 - DNA, 17 bp, Homo sapiens
ccacccccttcagtgcc

SEQ ID NO: 2928089 - DNA, 20 bp, Homo sapiens
ccacccccttcagtgcccac

SEQ ID NO: 2928090 - DNA, 19 bp, Homo sapiens
ccaccccggccccctgccc

SEQ ID NO: 2928091 - DNA, 16 bp, Homo sapiens
ccacccctcatcagga

SEQ ID NO: 2928092 - DNA, 17 bp, Homo sapiens
ccacccctgccactcac

SEQ ID NO: 2928093 - DNA, 15 bp, Homo sapiens
ccaccctaagggcag

SEQ ID NO: 2928094 - DNA, 19 bp, Homo sapiens
ccaccctccctccactcct

SEQ ID NO: 2928095 - DNA, 17 bp, Homo sapiens
ccaccctcctggcctca

SEQ ID NO: 2928096 - DNA, 20 bp, Homo sapiens
ccaccctctgcgaccggagg

SEQ ID NO: 2928097 - DNA, 14 bp, Homo sapiens
ccaccctgctgctg

SEQ ID NO: 2928098 - DNA, 18 bp, Homo sapiens
ccaccctgctgctggtgc

SEQ ID NO: 2928099 - DNA, 11 bp, Homo sapiens
ccaccctgggt

SEQ ID NO: 2928100 - DNA, 23 bp, Homo sapiens
ccaccctgggtttggcccctgga

SEQ ID NO: 2928101 - DNA, 15 bp, Homo sapiens
ccacccttccctgcc

SEQ ID NO: 2928102 - DNA, 20 bp, Homo sapiens
ccacccttccctgcctccag

SEQ ID NO: 2928103 - DNA, 21 bp, Homo sapiens
ccaccctttcatagagaggcc

SEQ ID NO: 2928104 - DNA, 18 bp, Homo sapiens
ccaccgaagccgcctgtg

SEQ ID NO: 2928105 - DNA, 15 bp, Homo sapiens
ccaccgactgcccag

SEQ ID NO: 2928106 - DNA, 16 bp, Homo sapiens
ccaccgactgcccagc

SEQ ID NO: 2928107 - DNA, 16 bp, Homo sapiens
ccaccgcagctgctgc

SEQ ID NO: 2928108 - DNA, 18 bp, Homo sapiens
ccaccgcagctgctgcca

SEQ ID NO: 2928109 - DNA, 17 bp, Homo sapiens
ccaccgcctcctacagc

SEQ ID NO: 2928110 - DNA, 14 bp, Homo sapiens
ccaccgctgcctaa

SEQ ID NO: 2928111 - DNA, 21 bp, Homo sapiens
ccaccgctgcctaagtggctg

SEQ ID NO: 2928112 - DNA, 16 bp, Homo sapiens
ccaccggatgctgtgc

SEQ ID NO: 2928113 - DNA, 18 bp, Homo sapiens
ccaccggatgctgtgcct

SEQ ID NO: 2928114 - DNA, 19 bp, Homo sapiens
ccaccgggcatgtctgcct

SEQ ID NO: 2928115 - DNA, 19 bp, Homo sapiens
ccaccggggcaagagggaa

SEQ ID NO: 2928116 - DNA, 14 bp, Homo sapiens
ccaccgtgcccggc

SEQ ID NO: 2928117 - DNA, 15 bp, Homo sapiens
ccaccgttcagtcat

SEQ ID NO: 2928118 - DNA, 19 bp, Homo sapiens
ccacctacaatacatctga

SEQ ID NO: 2928119 - DNA, 22 bp, Homo sapiens
ccacctacttagatatttcatg

SEQ ID NO: 2928120 - DNA, 14 bp, Homo sapiens
ccacctagcagcac

SEQ ID NO: 2928121 - DNA, 23 bp, Homo sapiens
ccacctagcagcaccgttctgtg

SEQ ID NO: 2928122 - DNA, 20 bp, Homo sapiens
ccacctaggccactcctcca

SEQ ID NO: 2928123 - DNA, 20 bp, Homo sapiens
ccacctagtgccccagactg

SEQ ID NO: 2928124 - DNA, 16 bp, Homo sapiens
ccacctcacaactcct

SEQ ID NO: 2928125 - DNA, 19 bp, Homo sapiens
ccacctcacctagcctgat

SEQ ID NO: 2928126 - DNA, 19 bp, Homo sapiens
ccacctcacctctttgttc

SEQ ID NO: 2928127 - DNA, 10 bp, Homo sapiens
ccacctcagc

SEQ ID NO: 2928128 - DNA, 13 bp, Homo sapiens
ccacctcagcctc

SEQ ID NO: 2928129 - DNA, 14 bp, Homo sapiens
ccacctcagccttg

SEQ ID NO: 2928130 - DNA, 19 bp, Homo sapiens
ccacctcccctatccaccc

SEQ ID NO: 2928131 - DNA, 13 bp, Homo sapiens
ccacctccctctg

SEQ ID NO: 2928132 - DNA, 14 bp, Homo sapiens
ccacctccctgcct

SEQ ID NO: 2928133 - DNA, 18 bp, Homo sapiens
ccacctcggcctcccaga

SEQ ID NO: 2928134 - DNA, 16 bp, Homo sapiens
ccacctctccctgacc

SEQ ID NO: 2928135 - DNA, 13 bp, Homo sapiens
ccacctctctgtc

SEQ ID NO: 2928136 - DNA, 11 bp, Homo sapiens
ccacctgcctg

SEQ ID NO: 2928137 - DNA, 12 bp, Homo sapiens
ccacctgcctgg

SEQ ID NO: 2928138 - DNA, 13 bp, Homo sapiens
ccacctgcctggc

SEQ ID NO: 2928139 - DNA, 17 bp, Homo sapiens
ccacctgcctggccggc

SEQ ID NO: 2928140 - DNA, 23 bp, Homo sapiens
ccacctgcctggccggccagcca

SEQ ID NO: 2928141 - DNA, 22 bp, Homo sapiens
ccacctgctgagagacccaagg

SEQ ID NO: 2928142 - DNA, 23 bp, Homo sapiens
ccacctgctgagagacccaagga

SEQ ID NO: 2928143 - DNA, 22 bp, Homo sapiens
ccacctggccccatgtctctca

SEQ ID NO: 2928144 - DNA, 17 bp, Homo sapiens
ccacctgggctgggcgc

SEQ ID NO: 2928145 - DNA, 20 bp, Homo sapiens
ccaccttatacatcacttcc

SEQ ID NO: 2928146 - DNA, 11 bp, Homo sapiens
ccaccttccca

SEQ ID NO: 2928147 - DNA, 19 bp, Homo sapiens
ccaccttcccagctctccc

SEQ ID NO: 2928148 - DNA, 21 bp, Homo sapiens
ccaccttcccagctctccctc

SEQ ID NO: 2928149 - DNA, 17 bp, Homo sapiens
ccaccttggagcattta

SEQ ID NO: 2928150 - DNA, 19 bp, Homo sapiens
ccaccttggagcatttatg

SEQ ID NO: 2928151 - DNA, 14 bp, Homo sapiens
ccacgactgtctcc

SEQ ID NO: 2928152 - DNA, 15 bp, Homo sapiens
ccacgactgtctcca

SEQ ID NO: 2928153 - DNA, 16 bp, Homo sapiens
ccacgactgtctccat

SEQ ID NO: 2928154 - DNA, 17 bp, Homo sapiens
ccacgagggctggctgg

SEQ ID NO: 2928155 - DNA, 22 bp, Homo sapiens
ccacgagggctggctggcctca

SEQ ID NO: 2928156 - DNA, 14 bp, Homo sapiens
ccacgcacctccac

SEQ ID NO: 2928157 - DNA, 18 bp, Homo sapiens
ccacgcggccacctcacc

SEQ ID NO: 2928158 - DNA, 12 bp, Homo sapiens
ccacggagccac

SEQ ID NO: 2928159 - DNA, 21 bp, Homo sapiens
ccacggagccactcctctgac

SEQ ID NO: 2928160 - DNA, 14 bp, Homo sapiens
ccacggcccaggga

SEQ ID NO: 2928161 - DNA, 16 bp, Homo sapiens
ccacggcccagggagg

SEQ ID NO: 2928162 - DNA, 20 bp, Homo sapiens
ccacgggacatcacagggtg

SEQ ID NO: 2928163 - DNA, 18 bp, Homo sapiens
ccacggggaccactgggc

SEQ ID NO: 2928164 - DNA, 19 bp, Homo sapiens
ccacggtccgcggcctgca

SEQ ID NO: 2928165 - DNA, 17 bp, Homo sapiens
ccacggtctgttcttga

SEQ ID NO: 2928166 - DNA, 21 bp, Homo sapiens
ccacggtctgttcttgaagca

SEQ ID NO: 2928167 - DNA, 23 bp, Homo sapiens
ccacgtaccaagccaccgcagct

SEQ ID NO: 2928168 - DNA, 15 bp, Homo sapiens
ccacgtattcccctt

SEQ ID NO: 2928169 - DNA, 15 bp, Homo sapiens
ccacgtctctctgcc

SEQ ID NO: 2928170 - DNA, 14 bp, Homo sapiens
ccaggccagggctg

SEQ ID NO: 2928171 - DNA, 16 bp, Homo sapiens
ccaggccagggctggg

SEQ ID NO: 2928172 - DNA, 22 bp, Homo sapiens
ccaggccatgtggcctgcccag

SEQ ID NO: 2928173 - DNA, 24 bp, Homo sapiens
ccaggccatgtggcctgcccagcc

SEQ ID NO: 2928174 - DNA, 14 bp, Homo sapiens
ccaggcccaaggct

SEQ ID NO: 2928175 - DNA, 17 bp, Homo sapiens
ccaggcccaaggctccc

SEQ ID NO: 2928176 - DNA, 14 bp, Homo sapiens
ccaggcccactcag

SEQ ID NO: 2928177 - DNA, 16 bp, Homo sapiens
ccaggcccactcaggg

SEQ ID NO: 2928178 - DNA, 15 bp, Homo sapiens
ccaggcccccaccac

SEQ ID NO: 2928179 - DNA, 19 bp, Homo sapiens
ccaggcccccaccacacat

SEQ ID NO: 2928180 - DNA, 16 bp, Homo sapiens
ccaggcccgcgggcac

SEQ ID NO: 2928181 - DNA, 18 bp, Homo sapiens
ccaggcccgcgggcacag

SEQ ID NO: 2928182 - DNA, 23 bp, Homo sapiens
ccaggcccgcgggcacagccagc

SEQ ID NO: 2928183 - DNA, 21 bp, Homo sapiens
ccaggcccggggctggcggct

SEQ ID NO: 2928184 - DNA, 22 bp, Homo sapiens
ccaggcccgtctgtccatctgc

SEQ ID NO: 2928185 - DNA, 13 bp, Homo sapiens
ccaggccctccca

SEQ ID NO: 2928186 - DNA, 14 bp, Homo sapiens
ccaggccctggagg

SEQ ID NO: 2928187 - DNA, 15 bp, Homo sapiens
ccaggccctgggtct

SEQ ID NO: 2928188 - DNA, 19 bp, Homo sapiens
ccaggccgcgccctttccc

SEQ ID NO: 2928189 - DNA, 16 bp, Homo sapiens
ccaggccggagcccag

SEQ ID NO: 2928190 - DNA, 18 bp, Homo sapiens
ccaggccggcgagccctg

SEQ ID NO: 2928191 - DNA, 19 bp, Homo sapiens
ccaggccgggcctgtacag

SEQ ID NO: 2928192 - DNA, 16 bp, Homo sapiens
ccaggccggggctgga

SEQ ID NO: 2928193 - DNA, 13 bp, Homo sapiens
ccaggcctcactg

SEQ ID NO: 2928194 - DNA, 16 bp, Homo sapiens
ccaggcctcactggct

SEQ ID NO: 2928195 - DNA, 13 bp, Homo sapiens
ccaggcctccagc

SEQ ID NO: 2928196 - DNA, 17 bp, Homo sapiens
ccaggcctccagctcag

SEQ ID NO: 2928197 - DNA, 22 bp, Homo sapiens
ccaggcctcgcacttgcagagg

SEQ ID NO: 2928198 - DNA, 20 bp, Homo sapiens
ccaggcctcgcctgccctcc

SEQ ID NO: 2928199 - DNA, 23 bp, Homo sapiens
ccaggcctcgcctgccctcctct

SEQ ID NO: 2928200 - DNA, 18 bp, Homo sapiens
ccaggcctcttggcagtc

SEQ ID NO: 2928201 - DNA, 19 bp, Homo sapiens
ccaggcctcttggcagtca

SEQ ID NO: 2928202 - DNA, 12 bp, Homo sapiens
ccaggcctgccc

SEQ ID NO: 2928203 - DNA, 13 bp, Homo sapiens
ccaggcctgccct

SEQ ID NO: 2928204 - DNA, 13 bp, Homo sapiens
ccaggcctggagc

SEQ ID NO: 2928205 - DNA, 18 bp, Homo sapiens
ccaggccttatctccaag

SEQ ID NO: 2928206 - DNA, 11 bp, Homo sapiens
ccaggccttgc

SEQ ID NO: 2928207 - DNA, 21 bp, Homo sapiens
ccaggccttgctgactctctg

SEQ ID NO: 2928208 - DNA, 14 bp, Homo sapiens
ccaggcgagcctga

SEQ ID NO: 2928209 - DNA, 15 bp, Homo sapiens
ccaggcgagcctgac

SEQ ID NO: 2928210 - DNA, 16 bp, Homo sapiens
ccaggcgagcctgact

SEQ ID NO: 2928211 - DNA, 20 bp, Homo sapiens
ccaggcgagcctgactctgt

SEQ ID NO: 2928212 - DNA, 15 bp, Homo sapiens
ccaggcgcctgcgct

SEQ ID NO: 2928213 - DNA, 12 bp, Homo sapiens
ccaggcgctgca

SEQ ID NO: 2928214 - DNA, 16 bp, Homo sapiens
ccaggcgctgcagggc

SEQ ID NO: 2928215 - DNA, 20 bp, Homo sapiens
ccaggctagagtgcaatggt

SEQ ID NO: 2928216 - DNA, 14 bp, Homo sapiens
ccaggctcctccct

SEQ ID NO: 2928217 - DNA, 13 bp, Homo sapiens
ccaggctgaagca

SEQ ID NO: 2928218 - DNA, 20 bp, Homo sapiens
ccaggctgaagcaggttccc

SEQ ID NO: 2928219 - DNA, 17 bp, Homo sapiens
ccaggctgaccacagca

SEQ ID NO: 2928220 - DNA, 23 bp, Homo sapiens
ccaggctgaccacagcacagcca

SEQ ID NO: 2928221 - DNA, 16 bp, Homo sapiens
ccaggctggagggcag

SEQ ID NO: 2928222 - DNA, 12 bp, Homo sapiens
ccaggctggcca

SEQ ID NO: 2928223 - DNA, 13 bp, Homo sapiens
ccaggctggccag

SEQ ID NO: 2928224 - DNA, 16 bp, Homo sapiens
ccaggctggccagtgc

SEQ ID NO: 2928225 - DNA, 22 bp, Homo sapiens
ccaggctggccagtgctgccca

SEQ ID NO: 2928226 - DNA, 11 bp, Homo sapiens
ccaggctggga

SEQ ID NO: 2928227 - DNA, 13 bp, Homo sapiens
ccaggctgggcat

SEQ ID NO: 2928228 - DNA, 20 bp, Homo sapiens
ccaggctggtccgagctgag

SEQ ID NO: 2928229 - DNA, 16 bp, Homo sapiens
ccaggctggtctaaaa

SEQ ID NO: 2928230 - DNA, 22 bp, Homo sapiens
ccaggctggtcttgaagtcctg

SEQ ID NO: 2928231 - DNA, 21 bp, Homo sapiens
ccaggctggtttcgaactcct

SEQ ID NO: 2928232 - DNA, 21 bp, Homo sapiens
ccaggcttgcctgggctgggc

SEQ ID NO: 2928233 - DNA, 14 bp, Homo sapiens
ccagggaaaaagac

SEQ ID NO: 2928234 - DNA, 18 bp, Homo sapiens
ccagggacacctgggaga

SEQ ID NO: 2928235 - DNA, 20 bp, Homo sapiens
ccagggacagaggccccagc

SEQ ID NO: 2928236 - DNA, 22 bp, Homo sapiens
ccagggacagaggccccagcct

SEQ ID NO: 2928237 - DNA, 19 bp, Homo sapiens
ccagggacattgcagagtg

SEQ ID NO: 2928238 - DNA, 20 bp, Homo sapiens
ccagggacattgcagagtgg

SEQ ID NO: 2928239 - DNA, 17 bp, Homo sapiens
ccagggacccaaagcag

SEQ ID NO: 2928240 - DNA, 23 bp, Homo sapiens
ccagggacgaagaagagccacag

SEQ ID NO: 2928241 - DNA, 15 bp, Homo sapiens
ccagggagaagctcc

SEQ ID NO: 2928242 - DNA, 21 bp, Homo sapiens
ccagggagacctggacacagg

SEQ ID NO: 2928243 - DNA, 16 bp, Homo sapiens
ccagggagaggctgtg

SEQ ID NO: 2928244 - DNA, 20 bp, Homo sapiens
ccagggagcattttcctcca

SEQ ID NO: 2928245 - DNA, 16 bp, Homo sapiens
ccagggagcctagaag

SEQ ID NO: 2928246 - DNA, 13 bp, Homo sapiens
ccagggagccttt

SEQ ID NO: 2928247 - DNA, 18 bp, Homo sapiens
ccagggagcggaaagcag

SEQ ID NO: 2928248 - DNA, 20 bp, Homo sapiens
ccagggagcggaaagcagct

SEQ ID NO: 2928249 - DNA, 19 bp, Homo sapiens
ccagggaggcagagcggga

SEQ ID NO: 2928250 - DNA, 22 bp, Homo sapiens
ccagggaggcagagcgggaggg

SEQ ID NO: 2928251 - DNA, 14 bp, Homo sapiens
ccagggatgggcag

SEQ ID NO: 2928252 - DNA, 19 bp, Homo sapiens
ccagggccacgctccagct

SEQ ID NO: 2928253 - DNA, 13 bp, Homo sapiens
ccagggccacgtg

SEQ ID NO: 2928254 - DNA, 19 bp, Homo sapiens
ccagggccacgtgccaggc

SEQ ID NO: 2928255 - DNA, 21 bp, Homo sapiens
ccagggccacgtgccaggccc

SEQ ID NO: 2928256 - DNA, 23 bp, Homo sapiens
ccagggcccagagcccagctcca

SEQ ID NO: 2928257 - DNA, 13 bp, Homo sapiens
ccagggcccaggc

SEQ ID NO: 2928258 - DNA, 13 bp, Homo sapiens
ccagggcccccca

SEQ ID NO: 2928259 - DNA, 16 bp, Homo sapiens
ccagggcctgagcctg

SEQ ID NO: 2928260 - DNA, 12 bp, Homo sapiens
ccagggcctttt

SEQ ID NO: 2928261 - DNA, 20 bp, Homo sapiens
ccagggccttttctggcacc

SEQ ID NO: 2928262 - DNA, 14 bp, Homo sapiens
ccagggcggccagg

SEQ ID NO: 2928263 - DNA, 19 bp, Homo sapiens
ccagggctagtgaagtggc

SEQ ID NO: 2928264 - DNA, 15 bp, Homo sapiens
ccagggctcctgtgg

SEQ ID NO: 2928265 - DNA, 16 bp, Homo sapiens
ccagggctcctgtggc

SEQ ID NO: 2928266 - DNA, 21 bp, Homo sapiens
ccagggctcctgtggcagctg

SEQ ID NO: 2928267 - DNA, 12 bp, Homo sapiens
ccagggctctgg

SEQ ID NO: 2928268 - DNA, 17 bp, Homo sapiens
ccagggctgggtcacag

SEQ ID NO: 2928269 - DNA, 18 bp, Homo sapiens
ccaggggacgcgctggaa

SEQ ID NO: 2928270 - DNA, 16 bp, Homo sapiens
ccaggggcagccacac

SEQ ID NO: 2928271 - DNA, 23 bp, Homo sapiens
ccaggggcagccacaccactgcc

SEQ ID NO: 2928272 - DNA, 14 bp, Homo sapiens
ccaggggcgaggcc

SEQ ID NO: 2928273 - DNA, 14 bp, Homo sapiens
ccaggggcgaggtc

SEQ ID NO: 2928274 - DNA, 18 bp, Homo sapiens
ccagggggatgccactcc

SEQ ID NO: 2928275 - DNA, 20 bp, Homo sapiens
ccagggtagagcaaaggaga

SEQ ID NO: 2928276 - DNA, 10 bp, Homo sapiens
ccagggtcag

SEQ ID NO: 2928277 - DNA, 19 bp, Homo sapiens
ccagggtcagaaacaggac

SEQ ID NO: 2928278 - DNA, 16 bp, Homo sapiens
ccagggtcaggcggag

SEQ ID NO: 2928279 - DNA, 16 bp, Homo sapiens
ccagggtcccctgcca

SEQ ID NO: 2928280 - DNA, 18 bp, Homo sapiens
ccagggtcccctgccacc

SEQ ID NO: 2928281 - DNA, 19 bp, Homo sapiens
ccagggtcccctgccaccg

SEQ ID NO: 2928282 - DNA, 20 bp, Homo sapiens
ccagggtctagccgctgccc

SEQ ID NO: 2928283 - DNA, 16 bp, Homo sapiens
ccagggtgcagtgtga

SEQ ID NO: 2928284 - DNA, 22 bp, Homo sapiens
ccagggtggagctgagaagagg

SEQ ID NO: 2928285 - DNA, 14 bp, Homo sapiens
ccagggtgtgtgct

SEQ ID NO: 2928286 - DNA, 12 bp, Homo sapiens
ccaggtaacttt

SEQ ID NO: 2928287 - DNA, 18 bp, Homo sapiens
ccaggtaccttgaccttt

SEQ ID NO: 2928288 - DNA, 15 bp, Homo sapiens
ccaggtacgcacaga

SEQ ID NO: 2928289 - DNA, 21 bp, Homo sapiens
ccaggtactatgcagatgttg

SEQ ID NO: 2928290 - DNA, 14 bp, Homo sapiens
ccaggtagaaactt

SEQ ID NO: 2928291 - DNA, 22 bp, Homo sapiens
ccaggtatagagaaaggtctat

SEQ ID NO: 2928292 - DNA, 13 bp, Homo sapiens
ccaggtcaacaga

SEQ ID NO: 2928293 - DNA, 22 bp, Homo sapiens
ccaggtcaacagaatgaaaaat

SEQ ID NO: 2928294 - DNA, 19 bp, Homo sapiens
ccaggtcccccgactgcct

SEQ ID NO: 2928295 - DNA, 17 bp, Homo sapiens
ccaggtccccctgcagc

SEQ ID NO: 2928296 - DNA, 21 bp, Homo sapiens
ccaggtcctgctccgctgcct

SEQ ID NO: 2928297 - DNA, 22 bp, Homo sapiens
ccaggtcctgctccgctgcctg

SEQ ID NO: 2928298 - DNA, 21 bp, Homo sapiens
ccaggtgagtgtgagggcagc

SEQ ID NO: 2928299 - DNA, 20 bp, Homo sapiens
ccaggtgcagaggtaccctg

SEQ ID NO: 2928300 - DNA, 18 bp, Homo sapiens
ccaggtgcctttcaaatt

SEQ ID NO: 2928301 - DNA, 14 bp, Homo sapiens
ccaggtgcggcctg

SEQ ID NO: 2928302 - DNA, 15 bp, Homo sapiens
ccaggtgcggcctgg

SEQ ID NO: 2928303 - DNA, 16 bp, Homo sapiens
cccagggcctgcagga

SEQ ID NO: 2928304 - DNA, 21 bp, Homo sapiens
cccaggggagaatgcagccca

SEQ ID NO: 2928305 - DNA, 13 bp, Homo sapiens
cccaggggagagg

SEQ ID NO: 2928306 - DNA, 15 bp, Homo sapiens
cccaggggagagggt

SEQ ID NO: 2928307 - DNA, 24 bp, Homo sapiens
cccaggggagagggtctggagaag

SEQ ID NO: 2928308 - DNA, 14 bp, Homo sapiens
cccaggggcagcca

SEQ ID NO: 2928309 - DNA, 19 bp, Homo sapiens
cccagggggcatgaccaga

SEQ ID NO: 2928310 - DNA, 12 bp, Homo sapiens
cccagggggcct

SEQ ID NO: 2928311 - DNA, 14 bp, Homo sapiens
cccagggggcctgg

SEQ ID NO: 2928312 - DNA, 15 bp, Homo sapiens
cccagggggcctgga

SEQ ID NO: 2928313 - DNA, 16 bp, Homo sapiens
cccagggggctgaaac

SEQ ID NO: 2928314 - DNA, 22 bp, Homo sapiens
cccagggggtctcacccatgca

SEQ ID NO: 2928315 - DNA, 19 bp, Homo sapiens
cccagggtctagccgctgc

SEQ ID NO: 2928316 - DNA, 18 bp, Homo sapiens
cccagggtggagtgcagt

SEQ ID NO: 2928317 - DNA, 17 bp, Homo sapiens
cccagggtggcgtccac

SEQ ID NO: 2928318 - DNA, 16 bp, Homo sapiens
cccaggtggctatttt

SEQ ID NO: 2928319 - DNA, 18 bp, Homo sapiens
cccaggtggctgacccag

SEQ ID NO: 2928320 - DNA, 20 bp, Homo sapiens
cccaggtggggtttcctgca

SEQ ID NO: 2928321 - DNA, 21 bp, Homo sapiens
cccaggtgttaacattccaag

SEQ ID NO: 2928322 - DNA, 22 bp, Homo sapiens
cccaggtgttaacattccaaga

SEQ ID NO: 2928323 - DNA, 18 bp, Homo sapiens
cccaggtttttgcccatc

SEQ ID NO: 2928324 - DNA, 21 bp, Homo sapiens
cccaggtttttgcccatcctc

SEQ ID NO: 2928325 - DNA, 22 bp, Homo sapiens
cccagtaattattttcttcctt

SEQ ID NO: 2928326 - DNA, 17 bp, Homo sapiens
cccagtattactgctgc

SEQ ID NO: 2928327 - DNA, 18 bp, Homo sapiens
cccagtattactgctgct

SEQ ID NO: 2928328 - DNA, 19 bp, Homo sapiens
cccagtattactgctgctg

SEQ ID NO: 2928329 - DNA, 18 bp, Homo sapiens
cccagtcagaagttctgg

SEQ ID NO: 2928330 - DNA, 21 bp, Homo sapiens
cccagtcagaagttctgggtg

SEQ ID NO: 2928331 - DNA, 16 bp, Homo sapiens
cccagtccatgctcca

SEQ ID NO: 2928332 - DNA, 18 bp, Homo sapiens
cccagtccatgctccagg

SEQ ID NO: 2928333 - DNA, 19 bp, Homo sapiens
cccagtccatgctccaggg

SEQ ID NO: 2928334 - DNA, 13 bp, Homo sapiens
cccagtccctggg

SEQ ID NO: 2928335 - DNA, 23 bp, Homo sapiens
cccagtccctgggggaagccctg

SEQ ID NO: 2928336 - DNA, 16 bp, Homo sapiens
cccagtctctgctcca

SEQ ID NO: 2928337 - DNA, 20 bp, Homo sapiens
cccagtgcccccactgacca

SEQ ID NO: 2928338 - DNA, 20 bp, Homo sapiens
cccagtgcctcctagcccct

SEQ ID NO: 2928339 - DNA, 15 bp, Homo sapiens
cccagtgccttctgg

SEQ ID NO: 2928340 - DNA, 14 bp, Homo sapiens
cccagtgggctgtg

SEQ ID NO: 2928341 - DNA, 15 bp, Homo sapiens
cccagtgggctgtgt

SEQ ID NO: 2928342 - DNA, 19 bp, Homo sapiens
cccagttcgcctggagccc

SEQ ID NO: 2928343 - DNA, 16 bp, Homo sapiens
cccagtttgcagaaaa

SEQ ID NO: 2928344 - DNA, 23 bp, Homo sapiens
cccagtttgcagaaaagcacctg

SEQ ID NO: 2928345 - DNA, 17 bp, Homo sapiens
cccataggcccacacac

SEQ ID NO: 2928346 - DNA, 20 bp, Homo sapiens
cccataggcccacacacagg

SEQ ID NO: 2928347 - DNA, 17 bp, Homo sapiens
cccatcacctactccag

SEQ ID NO: 2928348 - DNA, 20 bp, Homo sapiens
cccatcacgtgtactggctc

SEQ ID NO: 2928349 - DNA, 20 bp, Homo sapiens
cccatcagtgccagcccctg

SEQ ID NO: 2928350 - DNA, 21 bp, Homo sapiens
cccatcagtgccagcccctgc

SEQ ID NO: 2928351 - DNA, 13 bp, Homo sapiens
cccatcatccttt

SEQ ID NO: 2928352 - DNA, 12 bp, Homo sapiens
cccatcatctct

SEQ ID NO: 2928353 - DNA, 17 bp, Homo sapiens
cccatcatctctgcctt

SEQ ID NO: 2928354 - DNA, 18 bp, Homo sapiens
cccatcatctctgccttt

SEQ ID NO: 2928355 - DNA, 13 bp, Homo sapiens
cccatccctgtct

SEQ ID NO: 2928356 - DNA, 18 bp, Homo sapiens
cccatcctccagccctgc

SEQ ID NO: 2928357 - DNA, 17 bp, Homo sapiens
cccatcgccacaaactc

SEQ ID NO: 2928358 - DNA, 20 bp, Homo sapiens
cccatctcgctccctcccag

SEQ ID NO: 2928359 - DNA, 22 bp, Homo sapiens
cccatctcgctccctcccagga

SEQ ID NO: 2928360 - DNA, 23 bp, Homo sapiens
cccatctcgctccctcccaggac

SEQ ID NO: 2928361 - DNA, 22 bp, Homo sapiens
cccatctgcacccccctgggct

SEQ ID NO: 2928362 - DNA, 15 bp, Homo sapiens
cccatctgtccatcc

SEQ ID NO: 2928363 - DNA, 20 bp, Homo sapiens
cccatctgtccatcctcctc

SEQ ID NO: 2928364 - DNA, 22 bp, Homo sapiens
cccatctgtccatcctcctctc

SEQ ID NO: 2928365 - DNA, 23 bp, Homo sapiens
cccatctgtccatcctcctctcc

SEQ ID NO: 2928366 - DNA, 16 bp, Homo sapiens
cccatctgtcggccta

SEQ ID NO: 2928367 - DNA, 14 bp, Homo sapiens
cccatctgtctaaa

SEQ ID NO: 2928368 - DNA, 12 bp, Homo sapiens
cccatctgtgtt

SEQ ID NO: 2928369 - DNA, 17 bp, Homo sapiens
cccatcttcgggaccag

SEQ ID NO: 2928370 - DNA, 22 bp, Homo sapiens
cccatgaacttaaaatgaaagt

SEQ ID NO: 2928371 - DNA, 20 bp, Homo sapiens
cccatgaccttatccttcct

SEQ ID NO: 2928372 - DNA, 13 bp, Homo sapiens
cccatgagctcct

SEQ ID NO: 2928373 - DNA, 14 bp, Homo sapiens
cccatgagctcctt

SEQ ID NO: 2928374 - DNA, 22 bp, Homo sapiens
cccatgagctccttaaggctct

SEQ ID NO: 2928375 - DNA, 22 bp, Homo sapiens
cccatgcatacgtacattcctg

SEQ ID NO: 2928376 - DNA, 14 bp, Homo sapiens
cccatgcctgtggc

SEQ ID NO: 2928377 - DNA, 21 bp, Homo sapiens
cccatgctgttgattgctaaa

SEQ ID NO: 2928378 - DNA, 22 bp, Homo sapiens
cccatgctgttgattgctaaat

SEQ ID NO: 2928379 - DNA, 13 bp, Homo sapiens
cccatggaatatt

SEQ ID NO: 2928380 - DNA, 24 bp, Homo sapiens
cccatgggacaaattgcacagaag

SEQ ID NO: 2928381 - DNA, 22 bp, Homo sapiens
cccatgtagccccctggcctct

SEQ ID NO: 2928382 - DNA, 12 bp, Homo sapiens
cccattcctgaa

SEQ ID NO: 2928383 - DNA, 14 bp, Homo sapiens
cccattcctgggaa

SEQ ID NO: 2928384 - DNA, 17 bp, Homo sapiens
cccattctctctcctgt

SEQ ID NO: 2928385 - DNA, 21 bp, Homo sapiens
cccattcttttgtaatttaaa

SEQ ID NO: 2928386 - DNA, 15 bp, Homo sapiens
cccattgtccctctg

SEQ ID NO: 2928387 - DNA, 20 bp, Homo sapiens
cccattgtccctctgcccca

SEQ ID NO: 2928388 - DNA, 14 bp, Homo sapiens
cccatttacttagg

SEQ ID NO: 2928389 - DNA, 21 bp, Homo sapiens
cccatttcaggaatttaaaat

SEQ ID NO: 2928390 - DNA, 23 bp, Homo sapiens
cccatttcaggaatttaaaatta

SEQ ID NO: 2928391 - DNA, 20 bp, Homo sapiens
cccatttctagaacatccct

SEQ ID NO: 2928392 - DNA, 17 bp, Homo sapiens
cccatttctccagaacc

SEQ ID NO: 2928393 - DNA, 18 bp, Homo sapiens
cccattttagtcactttt

SEQ ID NO: 2928394 - DNA, 20 bp, Homo sapiens
ccccaaccaaggaaggagcc

SEQ ID NO: 2928395 - DNA, 14 bp, Homo sapiens
ccccaactcctgga

SEQ ID NO: 2928396 - DNA, 23 bp, Homo sapiens
ccccaactgtggtagctccagcg

SEQ ID NO: 2928397 - DNA, 22 bp, Homo sapiens
ccccaatatcctcgctcccggg

SEQ ID NO: 2928398 - DNA, 21 bp, Homo sapiens
ccccacaaggcctggtctggg

SEQ ID NO: 2928399 - DNA, 12 bp, Homo sapiens
ccccacacacac

SEQ ID NO: 2928400 - DNA, 12 bp, Homo sapiens
ccccacacctgc

SEQ ID NO: 2928401 - DNA, 14 bp, Homo sapiens
ccccacacctgcag

SEQ ID NO: 2928402 - DNA, 15 bp, Homo sapiens
ccccacacctgcagt

SEQ ID NO: 2928403 - DNA, 12 bp, Homo sapiens
ccccacagactg

SEQ ID NO: 2928404 - DNA, 22 bp, Homo sapiens
ccccacaggcacattaactgtt

SEQ ID NO: 2928405 - DNA, 12 bp, Homo sapiens
ccccaccaccta

SEQ ID NO: 2928406 - DNA, 17 bp, Homo sapiens
ccccacccaagagagga

SEQ ID NO: 2928407 - DNA, 14 bp, Homo sapiens
ccccaccccagcac

SEQ ID NO: 2928408 - DNA, 18 bp, Homo sapiens
ccccaccccagcacagct

SEQ ID NO: 2928409 - DNA, 19 bp, Homo sapiens
ccccaccccagcacagctc

SEQ ID NO: 2928410 - DNA, 21 bp, Homo sapiens
ccccacccccttcagtgccca

SEQ ID NO: 2928411 - DNA, 12 bp, Homo sapiens
ccccacccctca

SEQ ID NO: 2928412 - DNA, 18 bp, Homo sapiens
ccccaccctagcctccac

SEQ ID NO: 2928413 - DNA, 12 bp, Homo sapiens
ccccaccctggg

SEQ ID NO: 2928414 - DNA, 20 bp, Homo sapiens
ccccaccctggtgggccaac

SEQ ID NO: 2928415 - DNA, 13 bp, Homo sapiens
ccccaccctgttt

SEQ ID NO: 2928416 - DNA, 21 bp, Homo sapiens
ccccaccgggctgcaggtgct

SEQ ID NO: 2928417 - DNA, 20 bp, Homo sapiens
ccccacgtctctctgcctgc

SEQ ID NO: 2928418 - DNA, 21 bp, Homo sapiens
ccccacgtctctctgcctgct

SEQ ID NO: 2928419 - DNA, 16 bp, Homo sapiens
ccccactgcaggcccc

SEQ ID NO: 2928420 - DNA, 18 bp, Homo sapiens
ccccactgcaggccccgc

SEQ ID NO: 2928421 - DNA, 14 bp, Homo sapiens
ccccactgcccttc

SEQ ID NO: 2928422 - DNA, 14 bp, Homo sapiens
ccccactgtatcta

SEQ ID NO: 2928423 - DNA, 13 bp, Homo sapiens
ccccacttttcta

SEQ ID NO: 2928424 - DNA, 17 bp, Homo sapiens
ccccagaagcagagagc

SEQ ID NO: 2928425 - DNA, 13 bp, Homo sapiens
ccccagacactgg

SEQ ID NO: 2928426 - DNA, 16 bp, Homo sapiens
ccccagacagctgctc

SEQ ID NO: 2928427 - DNA, 15 bp, Homo sapiens
ccccagactctgcct

SEQ ID NO: 2928428 - DNA, 17 bp, Homo sapiens
ccccagactgagctctc

SEQ ID NO: 2928429 - DNA, 20 bp, Homo sapiens
ccccagactgagctctccag

SEQ ID NO: 2928430 - DNA, 21 bp, Homo sapiens
ccccagactgggcccaggcag

SEQ ID NO: 2928431 - DNA, 22 bp, Homo sapiens
ccccagactgggcccaggcagg

SEQ ID NO: 2928432 - DNA, 16 bp, Homo sapiens
ccccagacttgcactg

SEQ ID NO: 2928433 - DNA, 13 bp, Homo sapiens
ccccagagcccag

SEQ ID NO: 2928434 - DNA, 14 bp, Homo sapiens
ccccagagcccagc

SEQ ID NO: 2928435 - DNA, 19 bp, Homo sapiens
ccctcctctgaaacagctg

SEQ ID NO: 2928436 - DNA, 12 bp, Homo sapiens
ccctcctctgcc

SEQ ID NO: 2928437 - DNA, 17 bp, Homo sapiens
ccctcctggagcagaaa

SEQ ID NO: 2928438 - DNA, 19 bp, Homo sapiens
ccctcctggagctctgtgg

SEQ ID NO: 2928439 - DNA, 20 bp, Homo sapiens
ccctcctggagctctgtggg

SEQ ID NO: 2928440 - DNA, 14 bp, Homo sapiens
ccctcctggggcca

SEQ ID NO: 2928441 - DNA, 17 bp, Homo sapiens
ccctcctggggccaggc

SEQ ID NO: 2928442 - DNA, 10 bp, Homo sapiens
ccctcctggt

SEQ ID NO: 2928443 - DNA, 12 bp, Homo sapiens
ccctccttcaga

SEQ ID NO: 2928444 - DNA, 16 bp, Homo sapiens
ccctcgaccctgtgca

SEQ ID NO: 2928445 - DNA, 17 bp, Homo sapiens
ccctctcagtgccttct

SEQ ID NO: 2928446 - DNA, 12 bp, Homo sapiens
ccctctcctgcc

SEQ ID NO: 2928447 - DNA, 13 bp, Homo sapiens
ccctctcctgcct

SEQ ID NO: 2928448 - DNA, 16 bp, Homo sapiens
ccctctcctggagggc

SEQ ID NO: 2928449 - DNA, 17 bp, Homo sapiens
ccctctccttcctgtgt

SEQ ID NO: 2928450 - DNA, 22 bp, Homo sapiens
ccctctctcatatcactgaagg

SEQ ID NO: 2928451 - DNA, 13 bp, Homo sapiens
ccctctctgtgca

SEQ ID NO: 2928452 - DNA, 18 bp, Homo sapiens
ccctctcttccgggagct

SEQ ID NO: 2928453 - DNA, 21 bp, Homo sapiens
ccctctcttccgggagctggt

SEQ ID NO: 2928454 - DNA, 19 bp, Homo sapiens
ccctctgaaagttgtacat

SEQ ID NO: 2928455 - DNA, 10 bp, Homo sapiens
ccctctgcct

SEQ ID NO: 2928456 - DNA, 19 bp, Homo sapiens
ccctctgcctcatcctcct

SEQ ID NO: 2928457 - DNA, 14 bp, Homo sapiens
ccctctgcctcctc

SEQ ID NO: 2928458 - DNA, 12 bp, Homo sapiens
ccctctggaagt

SEQ ID NO: 2928459 - DNA, 18 bp, Homo sapiens
ccctctggagtggccact

SEQ ID NO: 2928460 - DNA, 21 bp, Homo sapiens
ccctctggagtggccactaag

SEQ ID NO: 2928461 - DNA, 13 bp, Homo sapiens
ccctctggccctg

SEQ ID NO: 2928462 - DNA, 14 bp, Homo sapiens
ccctctggccctgc

SEQ ID NO: 2928463 - DNA, 17 bp, Homo sapiens
ccctctgtcacccagtc

SEQ ID NO: 2928464 - DNA, 15 bp, Homo sapiens
ccctctgtcatcctc

SEQ ID NO: 2928465 - DNA, 15 bp, Homo sapiens
ccctctgtccccagg

SEQ ID NO: 2928466 - DNA, 13 bp, Homo sapiens
ccctcttctgccc

SEQ ID NO: 2928467 - DNA, 20 bp, Homo sapiens
ccctctttcttgtttgtcag

SEQ ID NO: 2928468 - DNA, 15 bp, Homo sapiens
ccctgaaaacccaga

SEQ ID NO: 2928469 - DNA, 17 bp, Homo sapiens
ccctgaaaacccagaga

SEQ ID NO: 2928470 - DNA, 14 bp, Homo sapiens
ccctgaaagcctca

SEQ ID NO: 2928471 - DNA, 15 bp, Homo sapiens
ccctgaaagcctcac

SEQ ID NO: 2928472 - DNA, 18 bp, Homo sapiens
ccctgaaagcctcacgta

SEQ ID NO: 2928473 - DNA, 13 bp, Homo sapiens
ccctgaagcagag

SEQ ID NO: 2928474 - DNA, 16 bp, Homo sapiens
ccctgaagtcttgcat

SEQ ID NO: 2928475 - DNA, 12 bp, Homo sapiens
ccctgaccctgt

SEQ ID NO: 2928476 - DNA, 20 bp, Homo sapiens
ccctgacctgtgagcccagc

SEQ ID NO: 2928477 - DNA, 15 bp, Homo sapiens
ccctgactcattctg

SEQ ID NO: 2928478 - DNA, 13 bp, Homo sapiens
ccctgactgggag

SEQ ID NO: 2928479 - DNA, 19 bp, Homo sapiens
ccctgactgtcagggaggg

SEQ ID NO: 2928480 - DNA, 21 bp, Homo sapiens
ccctgagagagaatagagctg

SEQ ID NO: 2928481 - DNA, 13 bp, Homo sapiens
ccctgagctgagg

SEQ ID NO: 2928482 - DNA, 14 bp, Homo sapiens
ccctgagctgaggc

SEQ ID NO: 2928483 - DNA, 19 bp, Homo sapiens
ccctgagctgaggcagcag

SEQ ID NO: 2928484 - DNA, 23 bp, Homo sapiens
ccctgaggatcccctgtcccctg

SEQ ID NO: 2928485 - DNA, 19 bp, Homo sapiens
ccctgaggggctggggagg

SEQ ID NO: 2928486 - DNA, 20 bp, Homo sapiens
ccctgaggggctggggaggg

SEQ ID NO: 2928487 - DNA, 17 bp, Homo sapiens
ccctgagtcaccaggaa

SEQ ID NO: 2928488 - DNA, 13 bp, Homo sapiens
ccctgagtccgcc

SEQ ID NO: 2928489 - DNA, 15 bp, Homo sapiens
ccctgagtccgcctg

SEQ ID NO: 2928490 - DNA, 20 bp, Homo sapiens
ccctgagtccgcctgcgcct

SEQ ID NO: 2928491 - DNA, 21 bp, Homo sapiens
ccctgagttgcaccattcttt

SEQ ID NO: 2928492 - DNA, 23 bp, Homo sapiens
ccctgagttgcaccattctttct

SEQ ID NO: 2928493 - DNA, 21 bp, Homo sapiens
ccctgatttaggagaagccag

SEQ ID NO: 2928494 - DNA, 16 bp, Homo sapiens
ccctgcacaggtggct

SEQ ID NO: 2928495 - DNA, 17 bp, Homo sapiens
ccctgcactccctcctg

SEQ ID NO: 2928496 - DNA, 14 bp, Homo sapiens
ccctgcaggagcag

SEQ ID NO: 2928497 - DNA, 13 bp, Homo sapiens
ccctgccaccgac

SEQ ID NO: 2928498 - DNA, 16 bp, Homo sapiens
ccctgccaccgactgc

SEQ ID NO: 2928499 - DNA, 19 bp, Homo sapiens
ccctgccaccgactgccca

SEQ ID NO: 2928500 - DNA, 20 bp, Homo sapiens
ccctgccaccgactgcccag

SEQ ID NO: 2928501 - DNA, 18 bp, Homo sapiens
ccctgccactcaatggga

SEQ ID NO: 2928502 - DNA, 13 bp, Homo sapiens
ccctgccactcac

SEQ ID NO: 2928503 - DNA, 14 bp, Homo sapiens
ccctgccactcacc

SEQ ID NO: 2928504 - DNA, 19 bp, Homo sapiens
ccctgccatccccctctca

SEQ ID NO: 2928505 - DNA, 19 bp, Homo sapiens
ccctgcccaagtgaccagg

SEQ ID NO: 2928506 - DNA, 20 bp, Homo sapiens
ccctgcccaagtgaccaggg

SEQ ID NO: 2928507 - DNA, 10 bp, Homo sapiens
ccctgcccat

SEQ ID NO: 2928508 - DNA, 19 bp, Homo sapiens
ccctgccccctcgggggcc

SEQ ID NO: 2928509 - DNA, 19 bp, Homo sapiens
ccctgccccgcaggcctgc

SEQ ID NO: 2928510 - DNA, 10 bp, Homo sapiens
ccctgcccct

SEQ ID NO: 2928511 - DNA, 11 bp, Homo sapiens
ccctgcccctc

SEQ ID NO: 2928512 - DNA, 16 bp, Homo sapiens
ccctgcccctccccct

SEQ ID NO: 2928513 - DNA, 16 bp, Homo sapiens
ccctgcccgtgtacat

SEQ ID NO: 2928514 - DNA, 14 bp, Homo sapiens
ccctgccctcatgg

SEQ ID NO: 2928515 - DNA, 15 bp, Homo sapiens
ccctgccctcatggg

SEQ ID NO: 2928516 - DNA, 18 bp, Homo sapiens
ccctgccctgctcctaag

SEQ ID NO: 2928517 - DNA, 15 bp, Homo sapiens
ccctgccctgtgccg

SEQ ID NO: 2928518 - DNA, 13 bp, Homo sapiens
ccctgccctgtgg

SEQ ID NO: 2928519 - DNA, 15 bp, Homo sapiens
ccctgccctgtgggg

SEQ ID NO: 2928520 - DNA, 16 bp, Homo sapiens
ccctgcctcgagggcc

SEQ ID NO: 2928521 - DNA, 20 bp, Homo sapiens
ccctgcctcgagggccgcct

SEQ ID NO: 2928522 - DNA, 21 bp, Homo sapiens
ccctgcctcgagggccgcctg

SEQ ID NO: 2928523 - DNA, 13 bp, Homo sapiens
ccctgcctctgtg

SEQ ID NO: 2928524 - DNA, 14 bp, Homo sapiens
ccctgcctctgtgt

SEQ ID NO: 2928525 - DNA, 13 bp, Homo sapiens
ccctgcctgctgt

SEQ ID NO: 2928526 - DNA, 18 bp, Homo sapiens
ccctgcctgctgtggagc

SEQ ID NO: 2928527 - DNA, 17 bp, Homo sapiens
ccctgcgcttcctgagc

SEQ ID NO: 2928528 - DNA, 15 bp, Homo sapiens
ccctgcgctttgaac

SEQ ID NO: 2928529 - DNA, 16 bp, Homo sapiens
ccctgcgggccacagg

SEQ ID NO: 2928530 - DNA, 22 bp, Homo sapiens
ccctgcgggccacagggcaaaa

SEQ ID NO: 2928531 - DNA, 17 bp, Homo sapiens
ccctgcggtagatggga

SEQ ID NO: 2928532 - DNA, 18 bp, Homo sapiens
ccctgctatgaaaggaat

SEQ ID NO: 2928533 - DNA, 23 bp, Homo sapiens
ccctgctatgaaaggaataaaac

SEQ ID NO: 2928534 - DNA, 20 bp, Homo sapiens
ccctgctatttcaggccctc

SEQ ID NO: 2928535 - DNA, 23 bp, Homo sapiens
ccctgctatttcaggccctcagc

SEQ ID NO: 2928536 - DNA, 17 bp, Homo sapiens
ccctgctcccacagaac

SEQ ID NO: 2928537 - DNA, 20 bp, Homo sapiens
ccctgctgcccctccctgcc

SEQ ID NO: 2928538 - DNA, 22 bp, Homo sapiens
ccctgctgcccctccctgcctc

SEQ ID NO: 2928539 - DNA, 13 bp, Homo sapiens
ccctgctgctggt

SEQ ID NO: 2928540 - DNA, 16 bp, Homo sapiens
ccctgctgcttcctaa

SEQ ID NO: 2928541 - DNA, 23 bp, Homo sapiens
ccctgctgcttcctaacttattg

SEQ ID NO: 2928542 - DNA, 14 bp, Homo sapiens
ccctgctgtctctc

SEQ ID NO: 2928543 - DNA, 23 bp, Homo sapiens
ccctgcttcagatgtggagccag

SEQ ID NO: 2928544 - DNA, 13 bp, Homo sapiens
ccctgcttctggc

SEQ ID NO: 2928545 - DNA, 19 bp, Homo sapiens
ccctggaacctttcccttg

SEQ ID NO: 2928546 - DNA, 21 bp, Homo sapiens
ccctggaagagtcctccaccc

SEQ ID NO: 2928547 - DNA, 21 bp, Homo sapiens
ccctggaccagtggtctcaca

SEQ ID NO: 2928548 - DNA, 16 bp, Homo sapiens
ccctggagggcagaga

SEQ ID NO: 2928549 - DNA, 17 bp, Homo sapiens
ccctggagtgtgtcaga

SEQ ID NO: 2928550 - DNA, 23 bp, Homo sapiens
ccctggagtgtgtcagagcccag

SEQ ID NO: 2928551 - DNA, 19 bp, Homo sapiens
ccctggcacctgtgttcca

SEQ ID NO: 2928552 - DNA, 22 bp, Homo sapiens
ccctggcagctgcccctcctgg

SEQ ID NO: 2928553 - DNA, 21 bp, Homo sapiens
ccctggccaccacccaacctg

SEQ ID NO: 2928554 - DNA, 13 bp, Homo sapiens
ccctggccccagg

SEQ ID NO: 2928555 - DNA, 18 bp, Homo sapiens
ccctggcctctgtgcctt

SEQ ID NO: 2928556 - DNA, 21 bp, Homo sapiens
ccctggcctctgtgccttctt

SEQ ID NO: 2928557 - DNA, 13 bp, Homo sapiens
ccctggcctgccg

SEQ ID NO: 2928558 - DNA, 13 bp, Homo sapiens
ccctggcctgctg

SEQ ID NO: 2928559 - DNA, 22 bp, Homo sapiens
ccctggcctgctgggctctcca

SEQ ID NO: 2928560 - DNA, 13 bp, Homo sapiens
ccctggcctggtc

SEQ ID NO: 2928561 - DNA, 14 bp, Homo sapiens
ccctggcctggtcc

SEQ ID NO: 2928562 - DNA, 16 bp, Homo sapiens
ccctggccttgcccgt

SEQ ID NO: 2928563 - DNA, 15 bp, Homo sapiens
ccctggcgggtggct

SEQ ID NO: 2928564 - DNA, 21 bp, Homo sapiens
ccctggcgggtggctgcaagc

SEQ ID NO: 2928565 - DNA, 15 bp, Homo sapiens
ccctggctaagaccc

SEQ ID NO: 2928566 - DNA, 12 bp, Homo sapiens
ccctggctccat

SEQ ID NO: 2928567 - DNA, 21 bp, Homo sapiens
ccctggctgaacagtgctctg

SEQ ID NO: 2928568 - DNA, 23 bp, Homo sapiens
ccctggctgaacagtgctctgcc

SEQ ID NO: 2928569 - DNA, 17 bp, Homo sapiens
cctaccccctcatcccc

SEQ ID NO: 2928570 - DNA, 13 bp, Homo sapiens
cctacccctgccc

SEQ ID NO: 2928571 - DNA, 15 bp, Homo sapiens
cctaccgatggtccc

SEQ ID NO: 2928572 - DNA, 13 bp, Homo sapiens
cctaccgcatggc

SEQ ID NO: 2928573 - DNA, 16 bp, Homo sapiens
cctaccgcatggcagc

SEQ ID NO: 2928574 - DNA, 20 bp, Homo sapiens
cctaccgcatggcagctggg

SEQ ID NO: 2928575 - DNA, 20 bp, Homo sapiens
cctaccgggttctcctgatt

SEQ ID NO: 2928576 - DNA, 13 bp, Homo sapiens
cctacgctgaaga

SEQ ID NO: 2928577 - DNA, 13 bp, Homo sapiens
cctactatttaaa

SEQ ID NO: 2928578 - DNA, 18 bp, Homo sapiens
cctactgagtagctttca

SEQ ID NO: 2928579 - DNA, 20 bp, Homo sapiens
cctactgcccaggcactgca

SEQ ID NO: 2928580 - DNA, 17 bp, Homo sapiens
cctactgcttcctctga

SEQ ID NO: 2928581 - DNA, 19 bp, Homo sapiens
cctactgtctaagcagttt

SEQ ID NO: 2928582 - DNA, 18 bp, Homo sapiens
cctacttagatatttcat

SEQ ID NO: 2928583 - DNA, 19 bp, Homo sapiens
cctacttagatatttcatg

SEQ ID NO: 2928584 - DNA, 22 bp, Homo sapiens
cctacttagatatttcatgtgc

SEQ ID NO: 2928585 - DNA, 22 bp, Homo sapiens
cctacttctctgagtcagctga

SEQ ID NO: 2928586 - DNA, 21 bp, Homo sapiens
cctagaagtaagaagaggagc

SEQ ID NO: 2928587 - DNA, 12 bp, Homo sapiens
cctagactttag

SEQ ID NO: 2928588 - DNA, 19 bp, Homo sapiens
cctagagacagtgatgcct

SEQ ID NO: 2928589 - DNA, 23 bp, Homo sapiens
cctagagacagtgatgcctgccc

SEQ ID NO: 2928590 - DNA, 19 bp, Homo sapiens
cctagagcactctcacccc

SEQ ID NO: 2928591 - DNA, 16 bp, Homo sapiens
cctagagggaggggcc

SEQ ID NO: 2928592 - DNA, 15 bp, Homo sapiens
cctagattatatcaa

SEQ ID NO: 2928593 - DNA, 18 bp, Homo sapiens
cctagcacatgcttcaat

SEQ ID NO: 2928594 - DNA, 23 bp, Homo sapiens
cctagcagcaccgttctgtgcac

SEQ ID NO: 2928595 - DNA, 15 bp, Homo sapiens
cctagcagcccaccc

SEQ ID NO: 2928596 - DNA, 20 bp, Homo sapiens
cctagcagcccaccctgctg

SEQ ID NO: 2928597 - DNA, 15 bp, Homo sapiens
cctagcccagtgctt

SEQ ID NO: 2928598 - DNA, 20 bp, Homo sapiens
cctagcccagtgcttctcca

SEQ ID NO: 2928599 - DNA, 16 bp, Homo sapiens
cctagccctctccctc

SEQ ID NO: 2928600 - DNA, 14 bp, Homo sapiens
cctagcctccacca

SEQ ID NO: 2928601 - DNA, 13 bp, Homo sapiens
cctagctgacgcc

SEQ ID NO: 2928602 - DNA, 15 bp, Homo sapiens
cctagctgctacaaa

SEQ ID NO: 2928603 - DNA, 17 bp, Homo sapiens
cctagctgctacaaaga

SEQ ID NO: 2928604 - DNA, 17 bp, Homo sapiens
cctagcttagtcatggc

SEQ ID NO: 2928605 - DNA, 17 bp, Homo sapiens
cctagcttatctccctg

SEQ ID NO: 2928606 - DNA, 21 bp, Homo sapiens
cctagcttatctccctgcttc

SEQ ID NO: 2928607 - DNA, 11 bp, Homo sapiens
cctaggatttc

SEQ ID NO: 2928608 - DNA, 18 bp, Homo sapiens
cctaggatttcagccatg

SEQ ID NO: 2928609 - DNA, 16 bp, Homo sapiens
cctaggcaatgaagaa

SEQ ID NO: 2928610 - DNA, 16 bp, Homo sapiens
cctaggccactcctcc

SEQ ID NO: 2928611 - DNA, 18 bp, Homo sapiens
cctaggccactcctccaa

SEQ ID NO: 2928612 - DNA, 20 bp, Homo sapiens
cctaggccactcctccaaag

SEQ ID NO: 2928613 - DNA, 18 bp, Homo sapiens
cctaggcctcagccagag

SEQ ID NO: 2928614 - DNA, 20 bp, Homo sapiens
cctaggcctcagccagagaa

SEQ ID NO: 2928615 - DNA, 17 bp, Homo sapiens
cctaggggccagggctt

SEQ ID NO: 2928616 - DNA, 22 bp, Homo sapiens
cctagggtctatttgtgtggca

SEQ ID NO: 2928617 - DNA, 20 bp, Homo sapiens
cctagtagctgggatgacag

SEQ ID NO: 2928618 - DNA, 18 bp, Homo sapiens
cctagtatgaaagctggg

SEQ ID NO: 2928619 - DNA, 23 bp, Homo sapiens
cctagtcccccaaagggcctcct

SEQ ID NO: 2928620 - DNA, 15 bp, Homo sapiens
cctagtctctatcat

SEQ ID NO: 2928621 - DNA, 12 bp, Homo sapiens
cctagtgaacct

SEQ ID NO: 2928622 - DNA, 18 bp, Homo sapiens
cctagtgaacctcacccc

SEQ ID NO: 2928623 - DNA, 22 bp, Homo sapiens
cctagtgaaggcttctctctgt

SEQ ID NO: 2928624 - DNA, 23 bp, Homo sapiens
cctagtgaaggcttctctctgtg

SEQ ID NO: 2928625 - DNA, 13 bp, Homo sapiens
cctagtgccccag

SEQ ID NO: 2928626 - DNA, 14 bp, Homo sapiens
cctagtgccccaga

SEQ ID NO: 2928627 - DNA, 15 bp, Homo sapiens
cctagtgccccagac

SEQ ID NO: 2928628 - DNA, 17 bp, Homo sapiens
cctagtgccccagactg

SEQ ID NO: 2928629 - DNA, 22 bp, Homo sapiens
cctagtgccccagactgagctc

SEQ ID NO: 2928630 - DNA, 13 bp, Homo sapiens
cctagtggcttgt

SEQ ID NO: 2928631 - DNA, 20 bp, Homo sapiens
cctagtggggtctccctctc

SEQ ID NO: 2928632 - DNA, 21 bp, Homo sapiens
cctagtggggtctccctctcc

SEQ ID NO: 2928633 - DNA, 23 bp, Homo sapiens
cctagtggggtctccctctcctg

SEQ ID NO: 2928634 - DNA, 17 bp, Homo sapiens
cctagtggtgtcatttt

SEQ ID NO: 2928635 - DNA, 18 bp, Homo sapiens
cctagttagcatccaggc

SEQ ID NO: 2928636 - DNA, 20 bp, Homo sapiens
cctagttagcatccaggctg

SEQ ID NO: 2928637 - DNA, 21 bp, Homo sapiens
cctagttagcatccaggctgg

SEQ ID NO: 2928638 - DNA, 15 bp, Homo sapiens
cctagttctcttatc

SEQ ID NO: 2928639 - DNA, 22 bp, Homo sapiens
cctagttggtgagaaacctgta

SEQ ID NO: 2928640 - DNA, 23 bp, Homo sapiens
cctagttggtgagaaacctgtat

SEQ ID NO: 2928641 - DNA, 20 bp, Homo sapiens
cctataaaacaggtcaatac

SEQ ID NO: 2928642 - DNA, 22 bp, Homo sapiens
cctataactttttttcaatttt

SEQ ID NO: 2928643 - DNA, 13 bp, Homo sapiens
cctatactgcttg

SEQ ID NO: 2928644 - DNA, 23 bp, Homo sapiens
cctatactgcttggagctgagca

SEQ ID NO: 2928645 - DNA, 19 bp, Homo sapiens
cctatactgtagtattctt

SEQ ID NO: 2928646 - DNA, 15 bp, Homo sapiens
cctatatatttctat

SEQ ID NO: 2928647 - DNA, 15 bp, Homo sapiens
cctatattgatttaa

SEQ ID NO: 2928648 - DNA, 13 bp, Homo sapiens
cctatcctgctgt

SEQ ID NO: 2928649 - DNA, 14 bp, Homo sapiens
cctatctcagccat

SEQ ID NO: 2928650 - DNA, 14 bp, Homo sapiens
cctatgattgaaaa

SEQ ID NO: 2928651 - DNA, 21 bp, Homo sapiens
cctatgattgaaaagtaaaca

SEQ ID NO: 2928652 - DNA, 20 bp, Homo sapiens
cctatgcacatatggactct

SEQ ID NO: 2928653 - DNA, 14 bp, Homo sapiens
cctatggaatttat

SEQ ID NO: 2928654 - DNA, 17 bp, Homo sapiens
cctatgtctcaggagtg

SEQ ID NO: 2928655 - DNA, 20 bp, Homo sapiens
cctatgttgatccatccagc

SEQ ID NO: 2928656 - DNA, 23 bp, Homo sapiens
cctatgtttgtctcacttttcat

SEQ ID NO: 2928657 - DNA, 13 bp, Homo sapiens
cctattagaaaag

SEQ ID NO: 2928658 - DNA, 19 bp, Homo sapiens
cctattgccaggaatgttt

SEQ ID NO: 2928659 - DNA, 20 bp, Homo sapiens
cctattggtgttatgtttat

SEQ ID NO: 2928660 - DNA, 20 bp, Homo sapiens
cctattgtacgctagagcat

SEQ ID NO: 2928661 - DNA, 18 bp, Homo sapiens
cctatttccattcaacaa

SEQ ID NO: 2928662 - DNA, 14 bp, Homo sapiens
cctatttttgtgaa

SEQ ID NO: 2928663 - DNA, 16 bp, Homo sapiens
cctatttttttctccc

SEQ ID NO: 2928664 - DNA, 17 bp, Homo sapiens
cctcaaaaacagtccag

SEQ ID NO: 2928665 - DNA, 17 bp, Homo sapiens
cctcaaattactttgtg

SEQ ID NO: 2928666 - DNA, 15 bp, Homo sapiens
cctcaacctcctggg

SEQ ID NO: 2928667 - DNA, 12 bp, Homo sapiens
cctcaacctctt

SEQ ID NO: 2928668 - DNA, 20 bp, Homo sapiens
cctcaacctcttctggctca

SEQ ID NO: 2928669 - DNA, 18 bp, Homo sapiens
cctcaacgtattgtttcg

SEQ ID NO: 2928670 - DNA, 16 bp, Homo sapiens
cctcaagatcattcag

SEQ ID NO: 2928671 - DNA, 12 bp, Homo sapiens
cctcaaggccta

SEQ ID NO: 2928672 - DNA, 20 bp, Homo sapiens
cctcaaggttttaggttcta

SEQ ID NO: 2928673 - DNA, 16 bp, Homo sapiens
cctcaagtaaaagaaa

SEQ ID NO: 2928674 - DNA, 17 bp, Homo sapiens
cctcaagtgatcctccc

SEQ ID NO: 2928675 - DNA, 17 bp, Homo sapiens
cctcaagttccagtgca

SEQ ID NO: 2928676 - DNA, 12 bp, Homo sapiens
cctcacaactcc

SEQ ID NO: 2928677 - DNA, 18 bp, Homo sapiens
cctcacagactcttccac

SEQ ID NO: 2928678 - DNA, 23 bp, Homo sapiens
cctcacagatgctggcctcttgg

SEQ ID NO: 2928679 - DNA, 14 bp, Homo sapiens
cctcacatctccct

SEQ ID NO: 2928680 - DNA, 12 bp, Homo sapiens
cctcaccacccc

SEQ ID NO: 2928681 - DNA, 19 bp, Homo sapiens
cctcacccacccctgcaca

SEQ ID NO: 2928682 - DNA, 16 bp, Homo sapiens
cctcaccccagctccg

SEQ ID NO: 2928683 - DNA, 19 bp, Homo sapiens
cctcaccccgaggccctgc

SEQ ID NO: 2928684 - DNA, 20 bp, Homo sapiens
cctcaccccgaggccctgca

SEQ ID NO: 2928685 - DNA, 21 bp, Homo sapiens
cctcaccccgaggccctgcat

SEQ ID NO: 2928686 - DNA, 16 bp, Homo sapiens
cctcaccctctccgca

SEQ ID NO: 2928687 - DNA, 16 bp, Homo sapiens
cctcaccctctgtccc

SEQ ID NO: 2928688 - DNA, 14 bp, Homo sapiens
cctcaccctttacc

SEQ ID NO: 2928689 - DNA, 21 bp, Homo sapiens
cctcacgtatttcacagagca

SEQ ID NO: 2928690 - DNA, 22 bp, Homo sapiens
cctcacgtgcaggacagctctt

SEQ ID NO: 2928691 - DNA, 17 bp, Homo sapiens
cctcacgtttcttcccc

SEQ ID NO: 2928692 - DNA, 14 bp, Homo sapiens
cctcactaattttt

SEQ ID NO: 2928693 - DNA, 20 bp, Homo sapiens
cctcactcccttcccataag

SEQ ID NO: 2928694 - DNA, 14 bp, Homo sapiens
cctcactcttgaag

SEQ ID NO: 2928695 - DNA, 21 bp, Homo sapiens
cctcactcttgaagtccagga

SEQ ID NO: 2928696 - DNA, 16 bp, Homo sapiens
cctcactggctcatgc

SEQ ID NO: 2928697 - DNA, 22 bp, Homo sapiens
cctcactgtggtaaatgccaca

SEQ ID NO: 2928698 - DNA, 23 bp, Homo sapiens
cctcacttggtctgccaggcccc

SEQ ID NO: 2928699 - DNA, 18 bp, Homo sapiens
cctcacttttaatgaaca

SEQ ID NO: 2928700 - DNA, 22 bp, Homo sapiens
cctcagaacccttggcttgccc

SEQ ID NO: 2928701 - DNA, 14 bp, Homo sapiens
cctctgaaacagct

SEQ ID NO: 2928702 - DNA, 16 bp, Homo sapiens
cctctgaaacagctgc

SEQ ID NO: 2928703 - DNA, 22 bp, Homo sapiens
cctctgaaacagctgccttagc

SEQ ID NO: 2928704 - DNA, 17 bp, Homo sapiens
cctctgaaagttgtaca

SEQ ID NO: 2928705 - DNA, 16 bp, Homo sapiens
cctctgacagcagcct

SEQ ID NO: 2928706 - DNA, 21 bp, Homo sapiens
cctctgacagcagcctgtgag

SEQ ID NO: 2928707 - DNA, 17 bp, Homo sapiens
cctctgactcagggctc

SEQ ID NO: 2928708 - DNA, 19 bp, Homo sapiens
cctctgactcagggctcct

SEQ ID NO: 2928709 - DNA, 21 bp, Homo sapiens
cctctgactcagggctcctgg

SEQ ID NO: 2928710 - DNA, 17 bp, Homo sapiens
cctctgagccggagggc

SEQ ID NO: 2928711 - DNA, 13 bp, Homo sapiens
cctctgccacctc

SEQ ID NO: 2928712 - DNA, 14 bp, Homo sapiens
cctctgccacctcc

SEQ ID NO: 2928713 - DNA, 20 bp, Homo sapiens
cctctgccacctcccctatc

SEQ ID NO: 2928714 - DNA, 19 bp, Homo sapiens
cctctgccagtcgggagag

SEQ ID NO: 2928715 - DNA, 23 bp, Homo sapiens
cctctgccgctgcttccaggctg

SEQ ID NO: 2928716 - DNA, 12 bp, Homo sapiens
cctctgccggct

SEQ ID NO: 2928717 - DNA, 12 bp, Homo sapiens
cctctgcctcaa

SEQ ID NO: 2928718 - DNA, 15 bp, Homo sapiens
cctctgcctcatcct

SEQ ID NO: 2928719 - DNA, 21 bp, Homo sapiens
cctctgcctcatcctcctcct

SEQ ID NO: 2928720 - DNA, 23 bp, Homo sapiens
cctctgcctcatcctcctcctca

SEQ ID NO: 2928721 - DNA, 15 bp, Homo sapiens
cctctgcctgcactc

SEQ ID NO: 2928722 - DNA, 17 bp, Homo sapiens
cctctgcctgcactccc

SEQ ID NO: 2928723 - DNA, 13 bp, Homo sapiens
cctctgcctggga

SEQ ID NO: 2928724 - DNA, 15 bp, Homo sapiens
cctctgctgctgccc

SEQ ID NO: 2928725 - DNA, 23 bp, Homo sapiens
cctctgctgctgcccggggtggg

SEQ ID NO: 2928726 - DNA, 19 bp, Homo sapiens
cctctgctggtctctggct

SEQ ID NO: 2928727 - DNA, 15 bp, Homo sapiens
cctctggccctgcct

SEQ ID NO: 2928728 - DNA, 16 bp, Homo sapiens
cctctgtaagacaaca

SEQ ID NO: 2928729 - DNA, 14 bp, Homo sapiens
cctctgtcacccag

SEQ ID NO: 2928730 - DNA, 15 bp, Homo sapiens
cctctgtcagtcaca

SEQ ID NO: 2928731 - DNA, 16 bp, Homo sapiens
cctctgtcagtcacag

SEQ ID NO: 2928732 - DNA, 19 bp, Homo sapiens
cctctgtcagtcacagcca

SEQ ID NO: 2928733 - DNA, 21 bp, Homo sapiens
cctctgtcagtcacagccacc

SEQ ID NO: 2928734 - DNA, 19 bp, Homo sapiens
cctctgtccaggcactgag

SEQ ID NO: 2928735 - DNA, 21 bp, Homo sapiens
cctctgtccaggcactgagat

SEQ ID NO: 2928736 - DNA, 21 bp, Homo sapiens
cctctgtccccaggcctggct

SEQ ID NO: 2928737 - DNA, 16 bp, Homo sapiens
cctctgtcctagactc

SEQ ID NO: 2928738 - DNA, 17 bp, Homo sapiens
cctctgtcttcaggctc

SEQ ID NO: 2928739 - DNA, 20 bp, Homo sapiens
cctctgtcttggctttcatg

SEQ ID NO: 2928740 - DNA, 18 bp, Homo sapiens
cctctgtgaccaatgtct

SEQ ID NO: 2928741 - DNA, 22 bp, Homo sapiens
cctctgttcagtgtaaatagtt

SEQ ID NO: 2928742 - DNA, 13 bp, Homo sapiens
cctcttcagaggc

SEQ ID NO: 2928743 - DNA, 20 bp, Homo sapiens
cctcttctagatggacccca

SEQ ID NO: 2928744 - DNA, 16 bp, Homo sapiens
cctcttctgggcctga

SEQ ID NO: 2928745 - DNA, 23 bp, Homo sapiens
cctcttctttcagacttgccatg

SEQ ID NO: 2928746 - DNA, 16 bp, Homo sapiens
cctcttgaaacctgat

SEQ ID NO: 2928747 - DNA, 17 bp, Homo sapiens
cctcttggataccagct

SEQ ID NO: 2928748 - DNA, 13 bp, Homo sapiens
cctcttggcacct

SEQ ID NO: 2928749 - DNA, 17 bp, Homo sapiens
cctcttggcacctgcct

SEQ ID NO: 2928750 - DNA, 18 bp, Homo sapiens
cctcttggcacctgccta

SEQ ID NO: 2928751 - DNA, 17 bp, Homo sapiens
cctcttgtaaataaagc

SEQ ID NO: 2928752 - DNA, 18 bp, Homo sapiens
cctcttgtaaataaagcc

SEQ ID NO: 2928753 - DNA, 21 bp, Homo sapiens
cctctttaatgctgtctttgt

SEQ ID NO: 2928754 - DNA, 22 bp, Homo sapiens
cctctttaatgctgtctttgtg

SEQ ID NO: 2928755 - DNA, 14 bp, Homo sapiens
cctctttcccctcc

SEQ ID NO: 2928756 - DNA, 23 bp, Homo sapiens
cctctttcttgtttgtcagcatc

SEQ ID NO: 2928757 - DNA, 15 bp, Homo sapiens
cctctttgctttgct

SEQ ID NO: 2928758 - DNA, 14 bp, Homo sapiens
cctctttgtctaaa

SEQ ID NO: 2928759 - DNA, 23 bp, Homo sapiens
cctctttttccaacttggctgca

SEQ ID NO: 2928760 - DNA, 17 bp, Homo sapiens
cctctttttctctgtat

SEQ ID NO: 2928761 - DNA, 14 bp, Homo sapiens
cctgaaagcctgtc

SEQ ID NO: 2928762 - DNA, 20 bp, Homo sapiens
cctgaaagcctgtctctttc

SEQ ID NO: 2928763 - DNA, 20 bp, Homo sapiens
cctgaaagttggggcccagt

SEQ ID NO: 2928764 - DNA, 24 bp, Homo sapiens
cctgaaagttggggcccagtcctt

SEQ ID NO: 2928765 - DNA, 18 bp, Homo sapiens
cctgaacagatgtaaatc

SEQ ID NO: 2928766 - DNA, 18 bp, Homo sapiens
cctgaaccccagaggcag

SEQ ID NO: 2928767 - DNA, 17 bp, Homo sapiens
cctgaaccttgagcaaa

SEQ ID NO: 2928768 - DNA, 19 bp, Homo sapiens
cctgaactgaggccttgtg

SEQ ID NO: 2928769 - DNA, 14 bp, Homo sapiens
cctgaagaccccag

SEQ ID NO: 2928770 - DNA, 21 bp, Homo sapiens
cctgaagggaaggcaaaggca

SEQ ID NO: 2928771 - DNA, 16 bp, Homo sapiens
cctgaaggtctgggtc

SEQ ID NO: 2928772 - DNA, 17 bp, Homo sapiens
cctgaagttcaccatta

SEQ ID NO: 2928773 - DNA, 17 bp, Homo sapiens
cctgaataaaccaagac

SEQ ID NO: 2928774 - DNA, 18 bp, Homo sapiens
cctgaataaaccaagaca

SEQ ID NO: 2928775 - DNA, 16 bp, Homo sapiens
cctgaatccagcattg

SEQ ID NO: 2928776 - DNA, 21 bp, Homo sapiens
cctgaatggctttgtcttgaa

SEQ ID NO: 2928777 - DNA, 16 bp, Homo sapiens
cctgacaactcatttt

SEQ ID NO: 2928778 - DNA, 23 bp, Homo sapiens
cctgacaagtgaagttgtaaaca

SEQ ID NO: 2928779 - DNA, 14 bp, Homo sapiens
cctgacacattctg

SEQ ID NO: 2928780 - DNA, 16 bp, Homo sapiens
cctgacagcactcctc

SEQ ID NO: 2928781 - DNA, 21 bp, Homo sapiens
cctgacatgtaccccctttcc

SEQ ID NO: 2928782 - DNA, 22 bp, Homo sapiens
cctgacccggattggccctgcc

SEQ ID NO: 2928783 - DNA, 23 bp, Homo sapiens
cctgacccggattggccctgccc

SEQ ID NO: 2928784 - DNA, 23 bp, Homo sapiens
cctgaccctcccggcctggcttc

SEQ ID NO: 2928785 - DNA, 16 bp, Homo sapiens
cctgaccgctgcccag

SEQ ID NO: 2928786 - DNA, 14 bp, Homo sapiens
cctgacctcaagtg

SEQ ID NO: 2928787 - DNA, 22 bp, Homo sapiens
cctgacctccagtcctgctggc

SEQ ID NO: 2928788 - DNA, 14 bp, Homo sapiens
cctgacctccatat

SEQ ID NO: 2928789 - DNA, 13 bp, Homo sapiens
cctgacctgcggg

SEQ ID NO: 2928790 - DNA, 13 bp, Homo sapiens
cctgacctgtcca

SEQ ID NO: 2928791 - DNA, 21 bp, Homo sapiens
cctgacctgtgagcccagctg

SEQ ID NO: 2928792 - DNA, 23 bp, Homo sapiens
cctgactattatgttgttagaga

SEQ ID NO: 2928793 - DNA, 14 bp, Homo sapiens
cctgactgcccagc

SEQ ID NO: 2928794 - DNA, 22 bp, Homo sapiens
cctgactgcccagcatttgggt

SEQ ID NO: 2928795 - DNA, 20 bp, Homo sapiens
cctgactgtcagggagggcc

SEQ ID NO: 2928796 - DNA, 19 bp, Homo sapiens
cctgacttggggagatgga

SEQ ID NO: 2928797 - DNA, 15 bp, Homo sapiens
cctgagaaagcccac

SEQ ID NO: 2928798 - DNA, 17 bp, Homo sapiens
cctgagaaagcccacct

SEQ ID NO: 2928799 - DNA, 18 bp, Homo sapiens
cctgagaaagcccacctg

SEQ ID NO: 2928800 - DNA, 22 bp, Homo sapiens
cctgagaaagcccacctgggct

SEQ ID NO: 2928801 - DNA, 15 bp, Homo sapiens
cctgagaatttaatt

SEQ ID NO: 2928802 - DNA, 15 bp, Homo sapiens
cctgagacccaggac

SEQ ID NO: 2928803 - DNA, 22 bp, Homo sapiens
cctgagagagaatagagctgcc

SEQ ID NO: 2928804 - DNA, 12 bp, Homo sapiens
cctgagaggttg

SEQ ID NO: 2928805 - DNA, 18 bp, Homo sapiens
cctgagatctctgcagga

SEQ ID NO: 2928806 - DNA, 17 bp, Homo sapiens
cctgagattcagatgtc

SEQ ID NO: 2928807 - DNA, 13 bp, Homo sapiens
cctgagcaactct

SEQ ID NO: 2928808 - DNA, 18 bp, Homo sapiens
cctgagcaactcttgatt

SEQ ID NO: 2928809 - DNA, 14 bp, Homo sapiens
cctgagcagtccct

SEQ ID NO: 2928810 - DNA, 19 bp, Homo sapiens
cctgagcagtccctgctta

SEQ ID NO: 2928811 - DNA, 21 bp, Homo sapiens
cctgagcagtctacttctgtg

SEQ ID NO: 2928812 - DNA, 12 bp, Homo sapiens
cctgagcctggc

SEQ ID NO: 2928813 - DNA, 13 bp, Homo sapiens
cctgagcctggcc

SEQ ID NO: 2928814 - DNA, 12 bp, Homo sapiens
cctgaggaagcg

SEQ ID NO: 2928815 - DNA, 23 bp, Homo sapiens
cctgaggaagcgtgaaggccgag

SEQ ID NO: 2928816 - DNA, 16 bp, Homo sapiens
cctgaggacagctgtc

SEQ ID NO: 2928817 - DNA, 17 bp, Homo sapiens
cctgaggacagctgtcc

SEQ ID NO: 2928818 - DNA, 15 bp, Homo sapiens
cctgaggatcccctg

SEQ ID NO: 2928819 - DNA, 13 bp, Homo sapiens
cctgaggcaggag

SEQ ID NO: 2928820 - DNA, 21 bp, Homo sapiens
cctgaggggctggggaggggg

SEQ ID NO: 2928821 - DNA, 13 bp, Homo sapiens
cctgaggtcagga

SEQ ID NO: 2928822 - DNA, 19 bp, Homo sapiens
cctgagtagctggattaca

SEQ ID NO: 2928823 - DNA, 21 bp, Homo sapiens
cctgagtagctgggattacag

SEQ ID NO: 2928824 - DNA, 18 bp, Homo sapiens
cctgagtccgcctgcgcc

SEQ ID NO: 2928825 - DNA, 17 bp, Homo sapiens
cctgagtctgggcagct

SEQ ID NO: 2928826 - DNA, 20 bp, Homo sapiens
cctgagttcctagccaccgc

SEQ ID NO: 2928827 - DNA, 23 bp, Homo sapiens
cctgagttgcaccattctttctt

SEQ ID NO: 2928828 - DNA, 22 bp, Homo sapiens
cctgagttggcgttgtgggcag

SEQ ID NO: 2928829 - DNA, 23 bp, Homo sapiens
cctgagttggcgttgtgggcagg

SEQ ID NO: 2928830 - DNA, 14 bp, Homo sapiens
cctgatatgattta

SEQ ID NO: 2928831 - DNA, 19 bp, Homo sapiens
cctgatatgatttaaaaca

SEQ ID NO: 2928832 - DNA, 17 bp, Homo sapiens
cctggcctgccggacac

SEQ ID NO: 2928833 - DNA, 12 bp, Homo sapiens
cctggcctgctg

SEQ ID NO: 2928834 - DNA, 13 bp, Homo sapiens
cctggcctgctgg

SEQ ID NO: 2928835 - DNA, 15 bp, Homo sapiens
cctggcctggcacac

SEQ ID NO: 2928836 - DNA, 22 bp, Homo sapiens
cctggccttgtcctcagccagt

SEQ ID NO: 2928837 - DNA, 23 bp, Homo sapiens
cctggcgctgtgctagctttcct

SEQ ID NO: 2928838 - DNA, 19 bp, Homo sapiens
cctggcgggtggctgcaag

SEQ ID NO: 2928839 - DNA, 13 bp, Homo sapiens
cctggctcaggcc

SEQ ID NO: 2928840 - DNA, 14 bp, Homo sapiens
cctggctctgattc

SEQ ID NO: 2928841 - DNA, 20 bp, Homo sapiens
cctggctgaacagtgctctg

SEQ ID NO: 2928842 - DNA, 23 bp, Homo sapiens
cctggctgaacagtgctctgcct

SEQ ID NO: 2928843 - DNA, 20 bp, Homo sapiens
cctggctgctgcttcttgct

SEQ ID NO: 2928844 - DNA, 15 bp, Homo sapiens
cctggctggctggga

SEQ ID NO: 2928845 - DNA, 20 bp, Homo sapiens
cctggctgggacgtggctca

SEQ ID NO: 2928846 - DNA, 24 bp, Homo sapiens
cctggctgggacgtggctcagcca

SEQ ID NO: 2928847 - DNA, 16 bp, Homo sapiens
cctggcttcactctcc

SEQ ID NO: 2928848 - DNA, 14 bp, Homo sapiens
cctggcttcaggca

SEQ ID NO: 2928849 - DNA, 22 bp, Homo sapiens
cctggcttcaggcaattctcct

SEQ ID NO: 2928850 - DNA, 22 bp, Homo sapiens
cctggcttgtaactccaccaac

SEQ ID NO: 2928851 - DNA, 13 bp, Homo sapiens
cctgggaggcaca

SEQ ID NO: 2928852 - DNA, 14 bp, Homo sapiens
cctgggaggctgca

SEQ ID NO: 2928853 - DNA, 16 bp, Homo sapiens
cctgggaggctgcagc

SEQ ID NO: 2928854 - DNA, 17 bp, Homo sapiens
cctgggaggctgcagcc

SEQ ID NO: 2928855 - DNA, 22 bp, Homo sapiens
cctgggaggctgcagccaggcc

SEQ ID NO: 2928856 - DNA, 23 bp, Homo sapiens
cctgggaggctgcagccaggcct

SEQ ID NO: 2928857 - DNA, 15 bp, Homo sapiens
cctgggcattgcttt

SEQ ID NO: 2928858 - DNA, 13 bp, Homo sapiens
cctgggccccacc

SEQ ID NO: 2928859 - DNA, 23 bp, Homo sapiens
cctgggccccaccacctaggcca

SEQ ID NO: 2928860 - DNA, 12 bp, Homo sapiens
cctgggcccctc

SEQ ID NO: 2928861 - DNA, 19 bp, Homo sapiens
cctgggcccctcccctcag

SEQ ID NO: 2928862 - DNA, 15 bp, Homo sapiens
cctgggccctctctg

SEQ ID NO: 2928863 - DNA, 23 bp, Homo sapiens
cctgggccgttacatctgtgcag

SEQ ID NO: 2928864 - DNA, 17 bp, Homo sapiens
cctgggccttctcagct

SEQ ID NO: 2928865 - DNA, 14 bp, Homo sapiens
cctgggctatattc

SEQ ID NO: 2928866 - DNA, 14 bp, Homo sapiens
cctgggctgggtgg

SEQ ID NO: 2928867 - DNA, 19 bp, Homo sapiens
cctgggctgggtggcccct

SEQ ID NO: 2928868 - DNA, 18 bp, Homo sapiens
cctgggcttggcccgcgg

SEQ ID NO: 2928869 - DNA, 17 bp, Homo sapiens
cctggggacccacgtgg

SEQ ID NO: 2928870 - DNA, 20 bp, Homo sapiens
cctggggcactcccccagga

SEQ ID NO: 2928871 - DNA, 15 bp, Homo sapiens
cctggggctggcttt

SEQ ID NO: 2928872 - DNA, 15 bp, Homo sapiens
cctggggctggtgga

SEQ ID NO: 2928873 - DNA, 20 bp, Homo sapiens
cctggggcttgaatttgcat

SEQ ID NO: 2928874 - DNA, 18 bp, Homo sapiens
cctgggggaagccctgga

SEQ ID NO: 2928875 - DNA, 20 bp, Homo sapiens
cctgggggacccctggctct

SEQ ID NO: 2928876 - DNA, 19 bp, Homo sapiens
cctggggggaacggatgct

SEQ ID NO: 2928877 - DNA, 15 bp, Homo sapiens
cctgggggtgccagg

SEQ ID NO: 2928878 - DNA, 13 bp, Homo sapiens
cctggggttgtca

SEQ ID NO: 2928879 - DNA, 16 bp, Homo sapiens
cctgggtaggccccac

SEQ ID NO: 2928880 - DNA, 19 bp, Homo sapiens
cctgggtaggccccacaag

SEQ ID NO: 2928881 - DNA, 23 bp, Homo sapiens
cctgggtaggccccacaaggcct

SEQ ID NO: 2928882 - DNA, 16 bp, Homo sapiens
cctgggtcacagagtg

SEQ ID NO: 2928883 - DNA, 18 bp, Homo sapiens
cctgggtcacagagtgag

SEQ ID NO: 2928884 - DNA, 19 bp, Homo sapiens
cctgggtcacagagtgaga

SEQ ID NO: 2928885 - DNA, 17 bp, Homo sapiens
cctgggtcctgcctgca

SEQ ID NO: 2928886 - DNA, 18 bp, Homo sapiens
cctgggtcctgcctgcag

SEQ ID NO: 2928887 - DNA, 18 bp, Homo sapiens
cctgggtgacagagcgag

SEQ ID NO: 2928888 - DNA, 19 bp, Homo sapiens
cctgggtgacagagcgaga

SEQ ID NO: 2928889 - DNA, 15 bp, Homo sapiens
cctgggtgacagagt

SEQ ID NO: 2928890 - DNA, 15 bp, Homo sapiens
cctgggtggggctgc

SEQ ID NO: 2928891 - DNA, 20 bp, Homo sapiens
cctgggtggggctgctcctc

SEQ ID NO: 2928892 - DNA, 22 bp, Homo sapiens
cctgggtggggctgctcctcca

SEQ ID NO: 2928893 - DNA, 14 bp, Homo sapiens
cctgggtggtctgc

SEQ ID NO: 2928894 - DNA, 18 bp, Homo sapiens
cctgggtggtctgcaggc

SEQ ID NO: 2928895 - DNA, 21 bp, Homo sapiens
cctgggtggtctgcaggcagg

SEQ ID NO: 2928896 - DNA, 22 bp, Homo sapiens
cctgggtggtctgcaggcaggg

SEQ ID NO: 2928897 - DNA, 21 bp, Homo sapiens
cctgggtgtccccgctgctgt

SEQ ID NO: 2928898 - DNA, 16 bp, Homo sapiens
cctgggttgcagacag

SEQ ID NO: 2928899 - DNA, 15 bp, Homo sapiens
cctgggtttggcccc

SEQ ID NO: 2928900 - DNA, 16 bp, Homo sapiens
cctgggtttggcccct

SEQ ID NO: 2928901 - DNA, 22 bp, Homo sapiens
cctgggttttgtattctctgag

SEQ ID NO: 2928902 - DNA, 21 bp, Homo sapiens
cctggtaaagaaaagcctcag

SEQ ID NO: 2928903 - DNA, 18 bp, Homo sapiens
cctggtaagcagaggctt

SEQ ID NO: 2928904 - DNA, 13 bp, Homo sapiens
cctggtacctgga

SEQ ID NO: 2928905 - DNA, 20 bp, Homo sapiens
cctggtactccctctcagga

SEQ ID NO: 2928906 - DNA, 17 bp, Homo sapiens
cctggtccctggtcctt

SEQ ID NO: 2928907 - DNA, 23 bp, Homo sapiens
cctggtccttcactggcgccttc

SEQ ID NO: 2928908 - DNA, 14 bp, Homo sapiens
cctggtgagaactg

SEQ ID NO: 2928909 - DNA, 15 bp, Homo sapiens
cctggtgcacagggc

SEQ ID NO: 2928910 - DNA, 17 bp, Homo sapiens
cctggtggctgggccca

SEQ ID NO: 2928911 - DNA, 20 bp, Homo sapiens
cctggtgggtggtgtcctga

SEQ ID NO: 2928912 - DNA, 21 bp, Homo sapiens
cctggtggtggctcgggaggc

SEQ ID NO: 2928913 - DNA, 22 bp, Homo sapiens
cctggtggttcactcttggagc

SEQ ID NO: 2928914 - DNA, 16 bp, Homo sapiens
cctggtgtcaccccag

SEQ ID NO: 2928915 - DNA, 20 bp, Homo sapiens
cctggttcctgctgtcctgg

SEQ ID NO: 2928916 - DNA, 23 bp, Homo sapiens
cctggttcctgctgtcctggtgg

SEQ ID NO: 2928917 - DNA, 13 bp, Homo sapiens
cctggttctgtct

SEQ ID NO: 2928918 - DNA, 14 bp, Homo sapiens
cctggttgaagaag

SEQ ID NO: 2928919 - DNA, 13 bp, Homo sapiens
cctggttttcgtc

SEQ ID NO: 2928920 - DNA, 16 bp, Homo sapiens
cctgtaaaccaaagtt

SEQ ID NO: 2928921 - DNA, 16 bp, Homo sapiens
cctgtaatcccagcta

SEQ ID NO: 2928922 - DNA, 15 bp, Homo sapiens
cctgtaattcagtgt

SEQ ID NO: 2928923 - DNA, 16 bp, Homo sapiens
cctgtacagtctgtct

SEQ ID NO: 2928924 - DNA, 20 bp, Homo sapiens
cctgtacagtctgtcttctg

SEQ ID NO: 2928925 - DNA, 22 bp, Homo sapiens
cctgtacagtctgtcttctgta

SEQ ID NO: 2928926 - DNA, 12 bp, Homo sapiens
cctgtacttttt

SEQ ID NO: 2928927 - DNA, 13 bp, Homo sapiens
cctgtagagccag

SEQ ID NO: 2928928 - DNA, 18 bp, Homo sapiens
cctgtagatgcagaaaaa

SEQ ID NO: 2928929 - DNA, 22 bp, Homo sapiens
cctgtagatgcagaaaaagaaa

SEQ ID NO: 2928930 - DNA, 22 bp, Homo sapiens
cctgtagcccactctgctcgcc

SEQ ID NO: 2928931 - DNA, 23 bp, Homo sapiens
cctgtagcccactctgctcgcct

SEQ ID NO: 2928932 - DNA, 22 bp, Homo sapiens
cctgtaggatcttatttggaat

SEQ ID NO: 2928933 - DNA, 15 bp, Homo sapiens
cctgtagtcccagct

SEQ ID NO: 2928934 - DNA, 18 bp, Homo sapiens
cctgtagttgcgtggact

SEQ ID NO: 2928935 - DNA, 23 bp, Homo sapiens
cctgtagttgcgtggactctgca

SEQ ID NO: 2928936 - DNA, 18 bp, Homo sapiens
cctgtataagtagatctg

SEQ ID NO: 2928937 - DNA, 16 bp, Homo sapiens
cctgtatatagcccag

SEQ ID NO: 2928938 - DNA, 21 bp, Homo sapiens
cctgtatcctccctggcagac

SEQ ID NO: 2928939 - DNA, 14 bp, Homo sapiens
cctgtatctttcta

SEQ ID NO: 2928940 - DNA, 16 bp, Homo sapiens
cctgtattcagacaga

SEQ ID NO: 2928941 - DNA, 20 bp, Homo sapiens
cctgtatttaaaaatagaaa

SEQ ID NO: 2928942 - DNA, 19 bp, Homo sapiens
cctgtcaaacaaagccaga

SEQ ID NO: 2928943 - DNA, 13 bp, Homo sapiens
cctgtcacaaggc

SEQ ID NO: 2928944 - DNA, 23 bp, Homo sapiens
cctgtcagccaacattgccttgc

SEQ ID NO: 2928945 - DNA, 19 bp, Homo sapiens
cctgtccaacctaacccct

SEQ ID NO: 2928946 - DNA, 18 bp, Homo sapiens
cctgtccacacccagctc

SEQ ID NO: 2928947 - DNA, 16 bp, Homo sapiens
cctgtccagcccccag

SEQ ID NO: 2928948 - DNA, 14 bp, Homo sapiens
cctgtccagctcca

SEQ ID NO: 2928949 - DNA, 12 bp, Homo sapiens
cctgtccccgca

SEQ ID NO: 2928950 - DNA, 14 bp, Homo sapiens
cctgtcccctcaca

SEQ ID NO: 2928951 - DNA, 23 bp, Homo sapiens
cctgtcccctcacagactcttcc

SEQ ID NO: 2928952 - DNA, 16 bp, Homo sapiens
cctgtcccctggggct

SEQ ID NO: 2928953 - DNA, 20 bp, Homo sapiens
cctgtcctagtctcctttga

SEQ ID NO: 2928954 - DNA, 17 bp, Homo sapiens
cctgtcctcaccgtctc

SEQ ID NO: 2928955 - DNA, 17 bp, Homo sapiens
cctgtccttactcagag

SEQ ID NO: 2928956 - DNA, 16 bp, Homo sapiens
cctgtcgattagactg

SEQ ID NO: 2928957 - DNA, 16 bp, Homo sapiens
cctgtcgggctttgtg

SEQ ID NO: 2928958 - DNA, 16 bp, Homo sapiens
cctgtcgtctctccca

SEQ ID NO: 2928959 - DNA, 18 bp, Homo sapiens
cctgtcgtctctcccacc

SEQ ID NO: 2928960 - DNA, 13 bp, Homo sapiens
cctgtctactgac

SEQ ID NO: 2928961 - DNA, 21 bp, Homo sapiens
cctgtctcaaaaaaaaaaaga

SEQ ID NO: 2928962 - DNA, 20 bp, Homo sapiens
cctgtctcggggcttgcccc

SEQ ID NO: 2928963 - DNA, 21 bp, Homo sapiens
cgaggaaaaacaacaaataat

SEQ ID NO: 2928964 - DNA, 17 bp, Homo sapiens
cgaggaactcgcctcag

SEQ ID NO: 2928965 - DNA, 16 bp, Homo sapiens
cgaggaatctgtgggt

SEQ ID NO: 2928966 - DNA, 22 bp, Homo sapiens
cgaggaatctgtgggtctggga

SEQ ID NO: 2928967 - DNA, 21 bp, Homo sapiens
cgaggacatgcatgacacttc

SEQ ID NO: 2928968 - DNA, 21 bp, Homo sapiens
cgaggactgtatttgtgacta

SEQ ID NO: 2928969 - DNA, 12 bp, Homo sapiens
cgaggaggggcc

SEQ ID NO: 2928970 - DNA, 14 bp, Homo sapiens
cgaggattttaatt

SEQ ID NO: 2928971 - DNA, 19 bp, Homo sapiens
cgaggccagtacctttcca

SEQ ID NO: 2928972 - DNA, 12 bp, Homo sapiens
cgaggccctgca

SEQ ID NO: 2928973 - DNA, 22 bp, Homo sapiens
cgaggcctctctcaggagcagg

SEQ ID NO: 2928974 - DNA, 17 bp, Homo sapiens
cgaggctgcagtcagcc

SEQ ID NO: 2928975 - DNA, 17 bp, Homo sapiens
cgaggctgccccaggcc

SEQ ID NO: 2928976 - DNA, 12 bp, Homo sapiens
cgagggccgcct

SEQ ID NO: 2928977 - DNA, 16 bp, Homo sapiens
cgagggccgcctgcct

SEQ ID NO: 2928978 - DNA, 11 bp, Homo sapiens
cgagggctcag

SEQ ID NO: 2928979 - DNA, 16 bp, Homo sapiens
cgagggctcagaagag

SEQ ID NO: 2928980 - DNA, 23 bp, Homo sapiens
cgagggctcagaagagcagcttc

SEQ ID NO: 2928981 - DNA, 11 bp, Homo sapiens
cgagggctggc

SEQ ID NO: 2928982 - DNA, 14 bp, Homo sapiens
cgagggctggctgg

SEQ ID NO: 2928983 - DNA, 19 bp, Homo sapiens
cgagggctggctggcctca

SEQ ID NO: 2928984 - DNA, 22 bp, Homo sapiens
cgaggggcctttgttctggggg

SEQ ID NO: 2928985 - DNA, 16 bp, Homo sapiens
cgaggttgtggggagg

SEQ ID NO: 2928986 - DNA, 19 bp, Homo sapiens
cgaggttgtggggaggctg

SEQ ID NO: 2928987 - DNA, 21 bp, Homo sapiens
cgaggttgtggggaggctgca

SEQ ID NO: 2928988 - DNA, 15 bp, Homo sapiens
cgagtaatatgcctg

SEQ ID NO: 2928989 - DNA, 14 bp, Homo sapiens
cgagtccaagctgg

SEQ ID NO: 2928990 - DNA, 18 bp, Homo sapiens
cgagtggatgctgtgcta

SEQ ID NO: 2928991 - DNA, 15 bp, Homo sapiens
cgatatactctagat

SEQ ID NO: 2928992 - DNA, 19 bp, Homo sapiens
cgatcaggaatcttgctcc

SEQ ID NO: 2928993 - DNA, 13 bp, Homo sapiens
cgatctcagctca

SEQ ID NO: 2928994 - DNA, 20 bp, Homo sapiens
cgatgattcaggtgcagagg

SEQ ID NO: 2928995 - DNA, 21 bp, Homo sapiens
cgatgattcaggtgcagagga

SEQ ID NO: 2928996 - DNA, 15 bp, Homo sapiens
cgatgcctggcctgc

SEQ ID NO: 2928997 - DNA, 16 bp, Homo sapiens
cgatgcgtattctgtg

SEQ ID NO: 2928998 - DNA, 17 bp, Homo sapiens
cgatgctgacctcacct

SEQ ID NO: 2928999 - DNA, 13 bp, Homo sapiens
cgatgctgctggc

SEQ ID NO: 2929000 - DNA, 14 bp, Homo sapiens
cgatgctgctggcc

SEQ ID NO: 2929001 - DNA, 15 bp, Homo sapiens
cgatgctgctggcct

SEQ ID NO: 2929002 - DNA, 19 bp, Homo sapiens
cgatggcggggatctggga

SEQ ID NO: 2929003 - DNA, 21 bp, Homo sapiens
cgatggtgctgcccaggcctc

SEQ ID NO: 2929004 - DNA, 13 bp, Homo sapiens
cgatgtaaattat

SEQ ID NO: 2929005 - DNA, 15 bp, Homo sapiens
cgatgtggccctggc

SEQ ID NO: 2929006 - DNA, 16 bp, Homo sapiens
cgatgtggccctggcc

SEQ ID NO: 2929007 - DNA, 16 bp, Homo sapiens
cgatgtttatgttctt

SEQ ID NO: 2929008 - DNA, 15 bp, Homo sapiens
cgattcatattgaat

SEQ ID NO: 2929009 - DNA, 16 bp, Homo sapiens
cgattctcctgcctca

SEQ ID NO: 2929010 - DNA, 17 bp, Homo sapiens
cgattctcctgcctcag

SEQ ID NO: 2929011 - DNA, 21 bp, Homo sapiens
cgattgacctgtcctctttgt

SEQ ID NO: 2929012 - DNA, 18 bp, Homo sapiens
cgatttaattctcttgaa

SEQ ID NO: 2929013 - DNA, 14 bp, Homo sapiens
cgattttatctgtt

SEQ ID NO: 2929014 - DNA, 18 bp, Homo sapiens
cgcaaaccaacctttctg

SEQ ID NO: 2929015 - DNA, 23 bp, Homo sapiens
cgcaaagggcatgggtcgggaga

SEQ ID NO: 2929016 - DNA, 12 bp, Homo sapiens
cgcaaggaagga

SEQ ID NO: 2929017 - DNA, 13 bp, Homo sapiens
cgcaaggaaggac

SEQ ID NO: 2929018 - DNA, 14 bp, Homo sapiens
cgcaagggcctgga

SEQ ID NO: 2929019 - DNA, 18 bp, Homo sapiens
cgcacatatacacacaca

SEQ ID NO: 2929020 - DNA, 13 bp, Homo sapiens
cgcaccctggcct

SEQ ID NO: 2929021 - DNA, 14 bp, Homo sapiens
cgcaccctggcctg

SEQ ID NO: 2929022 - DNA, 14 bp, Homo sapiens
cgcacctccacgcc

SEQ ID NO: 2929023 - DNA, 19 bp, Homo sapiens
cgcacctccacgccactgc

SEQ ID NO: 2929024 - DNA, 12 bp, Homo sapiens
cgcacctcccat

SEQ ID NO: 2929025 - DNA, 19 bp, Homo sapiens
cgcacctgaccgctgccca

SEQ ID NO: 2929026 - DNA, 20 bp, Homo sapiens
cgcacctgaccgctgcccag

SEQ ID NO: 2929027 - DNA, 15 bp, Homo sapiens
cgcacctgcctcagg

SEQ ID NO: 2929028 - DNA, 17 bp, Homo sapiens
cgcacctgtagtcccag

SEQ ID NO: 2929029 - DNA, 15 bp, Homo sapiens
cgcacctgtgctgga

SEQ ID NO: 2929030 - DNA, 17 bp, Homo sapiens
cgcactgtcccagtagc

SEQ ID NO: 2929031 - DNA, 20 bp, Homo sapiens
cgcacttgcagaggagccca

SEQ ID NO: 2929032 - DNA, 11 bp, Homo sapiens
cgcagaagagg

SEQ ID NO: 2929033 - DNA, 19 bp, Homo sapiens
cgcagacctctggattagg

SEQ ID NO: 2929034 - DNA, 16 bp, Homo sapiens
cgcagccctggcaggg

SEQ ID NO: 2929035 - DNA, 17 bp, Homo sapiens
cgcagccggagggaggc

SEQ ID NO: 2929036 - DNA, 18 bp, Homo sapiens
cgcagccggagggaggca

SEQ ID NO: 2929037 - DNA, 17 bp, Homo sapiens
cgcagcggtgggaagga

SEQ ID NO: 2929038 - DNA, 18 bp, Homo sapiens
cgcagcggtgggaaggaa

SEQ ID NO: 2929039 - DNA, 19 bp, Homo sapiens
cgcagcggtgggaaggaaa

SEQ ID NO: 2929040 - DNA, 21 bp, Homo sapiens
cgcagcggtgggaaggaaagg

SEQ ID NO: 2929041 - DNA, 12 bp, Homo sapiens
cgcagctgctgc

SEQ ID NO: 2929042 - DNA, 16 bp, Homo sapiens
cgcagctgctgccact

SEQ ID NO: 2929043 - DNA, 12 bp, Homo sapiens
cgcaggaagctg

SEQ ID NO: 2929044 - DNA, 19 bp, Homo sapiens
cgcaggaccaagggggcgg

SEQ ID NO: 2929045 - DNA, 10 bp, Homo sapiens
cgcaggcccc

SEQ ID NO: 2929046 - DNA, 13 bp, Homo sapiens
cgcaggccctgtc

SEQ ID NO: 2929047 - DNA, 14 bp, Homo sapiens
cgcaggccctgtcc

SEQ ID NO: 2929048 - DNA, 18 bp, Homo sapiens
cgcaggccctgtccagcc

SEQ ID NO: 2929049 - DNA, 21 bp, Homo sapiens
cgcaggcctccctgcctcagc

SEQ ID NO: 2929050 - DNA, 19 bp, Homo sapiens
cgcaggcctgccttctcag

SEQ ID NO: 2929051 - DNA, 16 bp, Homo sapiens
cgcaggcggccagggc

SEQ ID NO: 2929052 - DNA, 22 bp, Homo sapiens
cgcatatgtgagtgaaagtact

SEQ ID NO: 2929053 - DNA, 14 bp, Homo sapiens
cgcatcaaaagaca

SEQ ID NO: 2929054 - DNA, 22 bp, Homo sapiens
cgcatcaaaagacaattcttta

SEQ ID NO: 2929055 - DNA, 19 bp, Homo sapiens
cgcatcccggctgaccctg

SEQ ID NO: 2929056 - DNA, 18 bp, Homo sapiens
cgcatccctgcttctggc

SEQ ID NO: 2929057 - DNA, 19 bp, Homo sapiens
cgcatcttcccaacccctt

SEQ ID NO: 2929058 - DNA, 14 bp, Homo sapiens
cgcatcttctccat

SEQ ID NO: 2929059 - DNA, 16 bp, Homo sapiens
cgcatcttctccatct

SEQ ID NO: 2929060 - DNA, 21 bp, Homo sapiens
cgcatcttctccatctggcag

SEQ ID NO: 2929061 - DNA, 16 bp, Homo sapiens
cgcatcttgcctccag

SEQ ID NO: 2929062 - DNA, 19 bp, Homo sapiens
cgcatggcagctgggccca

SEQ ID NO: 2929063 - DNA, 22 bp, Homo sapiens
cgcatggcagctgggcccacag

SEQ ID NO: 2929064 - DNA, 24 bp, Homo sapiens
cgcatggcagctgggcccacagcc

SEQ ID NO: 2929065 - DNA, 19 bp, Homo sapiens
cgcatgtttaatgtgaact

SEQ ID NO: 2929066 - DNA, 15 bp, Homo sapiens
cgcattccaggctcc

SEQ ID NO: 2929067 - DNA, 12 bp, Homo sapiens
cgcattccctga

SEQ ID NO: 2929068 - DNA, 13 bp, Homo sapiens
cgcattccctgag

SEQ ID NO: 2929069 - DNA, 23 bp, Homo sapiens
cgccaataataaaaaacaagaaa

SEQ ID NO: 2929070 - DNA, 21 bp, Homo sapiens
cgccacatggtgtggccatca

SEQ ID NO: 2929071 - DNA, 13 bp, Homo sapiens
cgccaccatgccc

SEQ ID NO: 2929072 - DNA, 22 bp, Homo sapiens
cgccactgcctcccccgaatgc

SEQ ID NO: 2929073 - DNA, 17 bp, Homo sapiens
cgccagaggtgcttcac

SEQ ID NO: 2929074 - DNA, 20 bp, Homo sapiens
cgccagccccgctcccacct

SEQ ID NO: 2929075 - DNA, 16 bp, Homo sapiens
cgccaggcagagctga

SEQ ID NO: 2929076 - DNA, 20 bp, Homo sapiens
cgccaggctgaccacagcac

SEQ ID NO: 2929077 - DNA, 21 bp, Homo sapiens
cgccaggctgaccacagcaca

SEQ ID NO: 2929078 - DNA, 18 bp, Homo sapiens
cgccagggagacctggac

SEQ ID NO: 2929079 - DNA, 17 bp, Homo sapiens
cgccagggcccaggcca

SEQ ID NO: 2929080 - DNA, 13 bp, Homo sapiens
cgccataggccaa

SEQ ID NO: 2929081 - DNA, 14 bp, Homo sapiens
cgccataggccaag

SEQ ID NO: 2929082 - DNA, 19 bp, Homo sapiens
cgccattctcctgcctcag

SEQ ID NO: 2929083 - DNA, 13 bp, Homo sapiens
cgccatttcctca

SEQ ID NO: 2929084 - DNA, 14 bp, Homo sapiens
cgccatttcctcac

SEQ ID NO: 2929085 - DNA, 19 bp, Homo sapiens
cgcccagaggagcccagcg

SEQ ID NO: 2929086 - DNA, 13 bp, Homo sapiens
cgcccagcagcct

SEQ ID NO: 2929087 - DNA, 17 bp, Homo sapiens
cgcccagcagcctgcca

SEQ ID NO: 2929088 - DNA, 18 bp, Homo sapiens
cgcccagcagcctgccag

SEQ ID NO: 2929089 - DNA, 19 bp, Homo sapiens
cgcccagcagcctgccagc

SEQ ID NO: 2929090 - DNA, 17 bp, Homo sapiens
cgcccagctctcccaca

SEQ ID NO: 2929091 - DNA, 18 bp, Homo sapiens
cgcccaggaaggcctagg

SEQ ID NO: 2929092 - DNA, 17 bp, Homo sapiens
cgcccaggatcagattg

SEQ ID NO: 2929093 - DNA, 20 bp, Homo sapiens
cgcccatcagtgccagcccc

SEQ ID NO: 2929094 - DNA, 18 bp, Homo sapiens
cgcccatgcactggggac

SEQ ID NO: 2929095 - DNA, 15 bp, Homo sapiens
cgcccccaccgggct

SEQ ID NO: 2929096 - DNA, 14 bp, Homo sapiens
cgtctgactccctc

SEQ ID NO: 2929097 - DNA, 15 bp, Homo sapiens
cgtctggaagtccaa

SEQ ID NO: 2929098 - DNA, 17 bp, Homo sapiens
cgtctggcgagccctta

SEQ ID NO: 2929099 - DNA, 18 bp, Homo sapiens
cgtctggcgagcccttag

SEQ ID NO: 2929100 - DNA, 21 bp, Homo sapiens
cgtctggcgagcccttagcct

SEQ ID NO: 2929101 - DNA, 15 bp, Homo sapiens
cgtctgtccatctgc

SEQ ID NO: 2929102 - DNA, 20 bp, Homo sapiens
cgtctgtccatctgcccgcc

SEQ ID NO: 2929103 - DNA, 13 bp, Homo sapiens
cgtctgtctgtct

SEQ ID NO: 2929104 - DNA, 23 bp, Homo sapiens
cgtctgtgtgtgacccctcctgg

SEQ ID NO: 2929105 - DNA, 16 bp, Homo sapiens
cgtctttaagagactc

SEQ ID NO: 2929106 - DNA, 18 bp, Homo sapiens
cgtgacactctccttgca

SEQ ID NO: 2929107 - DNA, 18 bp, Homo sapiens
cgtgacagactcctgagg

SEQ ID NO: 2929108 - DNA, 13 bp, Homo sapiens
cgtgactcaccca

SEQ ID NO: 2929109 - DNA, 18 bp, Homo sapiens
cgtgactcagcagcctgc

SEQ ID NO: 2929110 - DNA, 20 bp, Homo sapiens
cgtgactgccccaactcctg

SEQ ID NO: 2929111 - DNA, 15 bp, Homo sapiens
cgtgagctgcccggc

SEQ ID NO: 2929112 - DNA, 19 bp, Homo sapiens
cgtgaggatgtcactcaga

SEQ ID NO: 2929113 - DNA, 20 bp, Homo sapiens
cgtgagtgacatagcctcat

SEQ ID NO: 2929114 - DNA, 15 bp, Homo sapiens
cgtgatagaaaaaaa

SEQ ID NO: 2929115 - DNA, 13 bp, Homo sapiens
cgtgatgtgccac

SEQ ID NO: 2929116 - DNA, 15 bp, Homo sapiens
cgtgatgtgccacta

SEQ ID NO: 2929117 - DNA, 15 bp, Homo sapiens
cgtgattctgttcta

SEQ ID NO: 2929118 - DNA, 17 bp, Homo sapiens
cgtgcacggttcaatgg

SEQ ID NO: 2929119 - DNA, 12 bp, Homo sapiens
cgtgcactgtga

SEQ ID NO: 2929120 - DNA, 14 bp, Homo sapiens
cgtgccagcagcct

SEQ ID NO: 2929121 - DNA, 18 bp, Homo sapiens
cgtgccagcagcctcgca

SEQ ID NO: 2929122 - DNA, 19 bp, Homo sapiens
cgtgccagcagcctcgcac

SEQ ID NO: 2929123 - DNA, 21 bp, Homo sapiens
cgtgccagcagcctcgcacag

SEQ ID NO: 2929124 - DNA, 19 bp, Homo sapiens
cgtgccaggcccggggctg

SEQ ID NO: 2929125 - DNA, 19 bp, Homo sapiens
cgtgccattgtactccagc

SEQ ID NO: 2929126 - DNA, 24 bp, Homo sapiens
cgtgccattgtactccagcctggg

SEQ ID NO: 2929127 - DNA, 15 bp, Homo sapiens
cgtgccgggccccca

SEQ ID NO: 2929128 - DNA, 17 bp, Homo sapiens
cgtgccgttactctcca

SEQ ID NO: 2929129 - DNA, 16 bp, Homo sapiens
cgtgcctgggcccctc

SEQ ID NO: 2929130 - DNA, 12 bp, Homo sapiens
cgtgctatgaca

SEQ ID NO: 2929131 - DNA, 22 bp, Homo sapiens
cgtgcttgtttgctcacctggg

SEQ ID NO: 2929132 - DNA, 17 bp, Homo sapiens
cgtggaagtgttcctgt

SEQ ID NO: 2929133 - DNA, 13 bp, Homo sapiens
cgtggacagcgct

SEQ ID NO: 2929134 - DNA, 16 bp, Homo sapiens
cgtggactctgcacat

SEQ ID NO: 2929135 - DNA, 14 bp, Homo sapiens
cgtggactgcagtc

SEQ ID NO: 2929136 - DNA, 15 bp, Homo sapiens
cgtggagactggcag

SEQ ID NO: 2929137 - DNA, 16 bp, Homo sapiens
cgtggagactggcagg

SEQ ID NO: 2929138 - DNA, 17 bp, Homo sapiens
cgtggagactggcaggc

SEQ ID NO: 2929139 - DNA, 15 bp, Homo sapiens
cgtggagggaggccc

SEQ ID NO: 2929140 - DNA, 19 bp, Homo sapiens
cgtggagggaggccccagg

SEQ ID NO: 2929141 - DNA, 18 bp, Homo sapiens
cgtggatgctctttcaat

SEQ ID NO: 2929142 - DNA, 13 bp, Homo sapiens
cgtggattaaact

SEQ ID NO: 2929143 - DNA, 21 bp, Homo sapiens
cgtggcagcacggcccggccc

SEQ ID NO: 2929144 - DNA, 13 bp, Homo sapiens
cgtggcatcacct

SEQ ID NO: 2929145 - DNA, 22 bp, Homo sapiens
cgtggcatttcaattcctggcc

SEQ ID NO: 2929146 - DNA, 20 bp, Homo sapiens
cgtggcctggcatctgtgtg

SEQ ID NO: 2929147 - DNA, 15 bp, Homo sapiens
cgtggctcagccagc

SEQ ID NO: 2929148 - DNA, 22 bp, Homo sapiens
cgtggctccagaatgtgctgcc

SEQ ID NO: 2929149 - DNA, 13 bp, Homo sapiens
cgtggctctgctg

SEQ ID NO: 2929150 - DNA, 20 bp, Homo sapiens
cgtggcttggcatctgtgtg

SEQ ID NO: 2929151 - DNA, 17 bp, Homo sapiens
cgtggcttgggctggtc

SEQ ID NO: 2929152 - DNA, 12 bp, Homo sapiens
cgtgggctcccg

SEQ ID NO: 2929153 - DNA, 22 bp, Homo sapiens
cgtgggctgggcccacaaaggc

SEQ ID NO: 2929154 - DNA, 16 bp, Homo sapiens
cgtggggaaggggtgc

SEQ ID NO: 2929155 - DNA, 18 bp, Homo sapiens
cgtggggaatgggcaggt

SEQ ID NO: 2929156 - DNA, 23 bp, Homo sapiens
cgtggggaatgggcaggtggcct

SEQ ID NO: 2929157 - DNA, 22 bp, Homo sapiens
cgtggggcagggagctgggccc

SEQ ID NO: 2929158 - DNA, 14 bp, Homo sapiens
cgtgggttgctaac

SEQ ID NO: 2929159 - DNA, 14 bp, Homo sapiens
cgtggtggcagctg

SEQ ID NO: 2929160 - DNA, 15 bp, Homo sapiens
cgtggtgtggcccgt

SEQ ID NO: 2929161 - DNA, 22 bp, Homo sapiens
cgtggtgtggcccgtggcctgg

SEQ ID NO: 2929162 - DNA, 16 bp, Homo sapiens
cgtgtaatattctctg

SEQ ID NO: 2929163 - DNA, 10 bp, Homo sapiens
cgtgtacata

SEQ ID NO: 2929164 - DNA, 18 bp, Homo sapiens
cgtgtacatagccctggt

SEQ ID NO: 2929165 - DNA, 20 bp, Homo sapiens
cgtgtacatagtgcattgtt

SEQ ID NO: 2929166 - DNA, 16 bp, Homo sapiens
cgtgtgaaatctgtct

SEQ ID NO: 2929167 - DNA, 18 bp, Homo sapiens
cgtgtgacctccatactg

SEQ ID NO: 2929168 - DNA, 18 bp, Homo sapiens
cgtgtgcatagcgtcctg

SEQ ID NO: 2929169 - DNA, 22 bp, Homo sapiens
cgtgtgcatagcgtcctgccct

SEQ ID NO: 2929170 - DNA, 16 bp, Homo sapiens
cgtgtgctgaagacat

SEQ ID NO: 2929171 - DNA, 14 bp, Homo sapiens
cgtgtggcgtggcc

SEQ ID NO: 2929172 - DNA, 16 bp, Homo sapiens
cgtgtggcgtggcccg

SEQ ID NO: 2929173 - DNA, 17 bp, Homo sapiens
cgtgtggcgtggcccgt

SEQ ID NO: 2929174 - DNA, 22 bp, Homo sapiens
cgtgtgtgtgtgtgtgtgtgca

SEQ ID NO: 2929175 - DNA, 19 bp, Homo sapiens
cgtgttaattataaacagc

SEQ ID NO: 2929176 - DNA, 22 bp, Homo sapiens
cgtgttaattataaacagcagg

SEQ ID NO: 2929177 - DNA, 23 bp, Homo sapiens
cgtgttaattataaacagcaggg

SEQ ID NO: 2929178 - DNA, 17 bp, Homo sapiens
cgtgttcctttgctctt

SEQ ID NO: 2929179 - DNA, 14 bp, Homo sapiens
cgtgttttcaagga

SEQ ID NO: 2929180 - DNA, 23 bp, Homo sapiens
cgttacatctgtgcagggctggt

SEQ ID NO: 2929181 - DNA, 22 bp, Homo sapiens
cgttatagtccatggtccatca

SEQ ID NO: 2929182 - DNA, 16 bp, Homo sapiens
cgttatggtgtttctc

SEQ ID NO: 2929183 - DNA, 17 bp, Homo sapiens
cgttattataaatgtta

SEQ ID NO: 2929184 - DNA, 13 bp, Homo sapiens
cgttcaaaagtgg

SEQ ID NO: 2929185 - DNA, 16 bp, Homo sapiens
cgttcaagaggcgtgt

SEQ ID NO: 2929186 - DNA, 18 bp, Homo sapiens
cgttcaagaggcgtgtgc

SEQ ID NO: 2929187 - DNA, 17 bp, Homo sapiens
cgttcagggaggggccg

SEQ ID NO: 2929188 - DNA, 13 bp, Homo sapiens
cgttccagttccc

SEQ ID NO: 2929189 - DNA, 19 bp, Homo sapiens
cgttcccactgccctgggc

SEQ ID NO: 2929190 - DNA, 13 bp, Homo sapiens
cgttctcctgctt

SEQ ID NO: 2929191 - DNA, 23 bp, Homo sapiens
cgttctgtactgttactgggccc

SEQ ID NO: 2929192 - DNA, 12 bp, Homo sapiens
cgttctgtgcac

SEQ ID NO: 2929193 - DNA, 20 bp, Homo sapiens
cgttcttaggctgctgggat

SEQ ID NO: 2929194 - DNA, 14 bp, Homo sapiens
cgttgatgtaatga

SEQ ID NO: 2929195 - DNA, 20 bp, Homo sapiens
cgttgccctaattcatcttt

SEQ ID NO: 2929196 - DNA, 23 bp, Homo sapiens
cgttgccctaattcatcttttaa

SEQ ID NO: 2929197 - DNA, 22 bp, Homo sapiens
cgttggcctcagggccaggaag

SEQ ID NO: 2929198 - DNA, 23 bp, Homo sapiens
cgttggcctcagggccaggaagg

SEQ ID NO: 2929199 - DNA, 20 bp, Homo sapiens
cgttggtgaccagtttctta

SEQ ID NO: 2929200 - DNA, 16 bp, Homo sapiens
cgttgtgggcaggcta

SEQ ID NO: 2929201 - DNA, 19 bp, Homo sapiens
cgtttaatcccagcacttt

SEQ ID NO: 2929202 - DNA, 14 bp, Homo sapiens
cgtttaatgtttat

SEQ ID NO: 2929203 - DNA, 16 bp, Homo sapiens
cgtttaatgtttatac

SEQ ID NO: 2929204 - DNA, 14 bp, Homo sapiens
cgtttagtgccaat

SEQ ID NO: 2929205 - DNA, 19 bp, Homo sapiens
cgtttattttttattgtat

SEQ ID NO: 2929206 - DNA, 15 bp, Homo sapiens
cgtttcaaaaacaca

SEQ ID NO: 2929207 - DNA, 12 bp, Homo sapiens
cgtttcttcccc

SEQ ID NO: 2929208 - DNA, 17 bp, Homo sapiens
cgtttgaccttttatgt

SEQ ID NO: 2929209 - DNA, 16 bp, Homo sapiens
cgtttgagaagaaaac

SEQ ID NO: 2929210 - DNA, 21 bp, Homo sapiens
cgtttgagaagaaaacatcta

SEQ ID NO: 2929211 - DNA, 15 bp, Homo sapiens
cgtttgcaccgcctg

SEQ ID NO: 2929212 - DNA, 16 bp, Homo sapiens
cgtttgcaccgcctgc

SEQ ID NO: 2929213 - DNA, 14 bp, Homo sapiens
cgtttgtatgtgtg

SEQ ID NO: 2929214 - DNA, 14 bp, Homo sapiens
cgtttgtgcagaat

SEQ ID NO: 2929215 - DNA, 16 bp, Homo sapiens
cgttttccccatgaca

SEQ ID NO: 2929216 - DNA, 16 bp, Homo sapiens
ctaaaaaaaaaaaagt

SEQ ID NO: 2929217 - DNA, 17 bp, Homo sapiens
ctaaaaacaaacccttt

SEQ ID NO: 2929218 - DNA, 23 bp, Homo sapiens
ctaaaaataagaaattagccggg

SEQ ID NO: 2929219 - DNA, 23 bp, Homo sapiens
ctaaaaatacaaaattagctggg

SEQ ID NO: 2929220 - DNA, 12 bp, Homo sapiens
ctaaaaatgaac

SEQ ID NO: 2929221 - DNA, 12 bp, Homo sapiens
ctaaaaatgcat

SEQ ID NO: 2929222 - DNA, 21 bp, Homo sapiens
ctaaaaccagttttgctgcta

SEQ ID NO: 2929223 - DNA, 16 bp, Homo sapiens
ctaaaagaatttaaat

SEQ ID NO: 2929224 - DNA, 19 bp, Homo sapiens
ctaaaagtgggcttgattc

SEQ ID NO: 2929225 - DNA, 20 bp, Homo sapiens
ctaaaagttctcaatgtaga

SEQ ID NO: 2929226 - DNA, 19 bp, Homo sapiens
ctaaaatcttatagttcta

SEQ ID NO: 2929227 - DNA, 16 bp, Homo sapiens
ctaaaatgaattttct

SEQ ID NO: 2929228 - DNA, 19 bp, Homo sapiens
ctaaaatgtgatgttctaa

SEQ ID NO: 2929229 - DNA, 16 bp, Homo sapiens
ctagccctctccctct

SEQ ID NO: 2929230 - DNA, 20 bp, Homo sapiens
ctagcctaggtcataaagag

SEQ ID NO: 2929231 - DNA, 20 bp, Homo sapiens
ctagcctgatgagattttta

SEQ ID NO: 2929232 - DNA, 21 bp, Homo sapiens
ctagcctggggcttgaatttg

SEQ ID NO: 2929233 - DNA, 15 bp, Homo sapiens
ctagctagccagcca

SEQ ID NO: 2929234 - DNA, 17 bp, Homo sapiens
ctagctagccagccaag

SEQ ID NO: 2929235 - DNA, 19 bp, Homo sapiens
ctagctcctcctcctgggc

SEQ ID NO: 2929236 - DNA, 16 bp, Homo sapiens
ctagctcttgggcctg

SEQ ID NO: 2929237 - DNA, 21 bp, Homo sapiens
ctagctcttgggcctgacctc

SEQ ID NO: 2929238 - DNA, 14 bp, Homo sapiens
ctagctgctacaaa

SEQ ID NO: 2929239 - DNA, 15 bp, Homo sapiens
ctagctgctacaaag

SEQ ID NO: 2929240 - DNA, 18 bp, Homo sapiens
ctagctgctacaaagaag

SEQ ID NO: 2929241 - DNA, 23 bp, Homo sapiens
ctagctgctacaaagaagacatg

SEQ ID NO: 2929242 - DNA, 13 bp, Homo sapiens
ctagctggagcct

SEQ ID NO: 2929243 - DNA, 12 bp, Homo sapiens
ctagctgggggt

SEQ ID NO: 2929244 - DNA, 18 bp, Homo sapiens
ctagctgggggtgggcca

SEQ ID NO: 2929245 - DNA, 19 bp, Homo sapiens
ctagctgggggtgggccag

SEQ ID NO: 2929246 - DNA, 21 bp, Homo sapiens
ctagctgggggtgggccaggc

SEQ ID NO: 2929247 - DNA, 20 bp, Homo sapiens
ctagcttatctccctgcttc

SEQ ID NO: 2929248 - DNA, 18 bp, Homo sapiens
ctagctttacgctcatca

SEQ ID NO: 2929249 - DNA, 19 bp, Homo sapiens
ctaggaagaattttaaaaa

SEQ ID NO: 2929250 - DNA, 20 bp, Homo sapiens
ctaggaagaattttaaaaat

SEQ ID NO: 2929251 - DNA, 23 bp, Homo sapiens
ctaggaagagcaggactccaggc

SEQ ID NO: 2929252 - DNA, 23 bp, Homo sapiens
ctaggaagatctctgcagggccg

SEQ ID NO: 2929253 - DNA, 21 bp, Homo sapiens
ctaggaccatggttaagagtc

SEQ ID NO: 2929254 - DNA, 12 bp, Homo sapiens
ctaggactcctt

SEQ ID NO: 2929255 - DNA, 18 bp, Homo sapiens
ctaggattccccctgccc

SEQ ID NO: 2929256 - DNA, 20 bp, Homo sapiens
ctaggattccccctgccctg

SEQ ID NO: 2929257 - DNA, 15 bp, Homo sapiens
ctaggatttcagcca

SEQ ID NO: 2929258 - DNA, 16 bp, Homo sapiens
ctaggatttcagccat

SEQ ID NO: 2929259 - DNA, 19 bp, Homo sapiens
ctaggcactgtagttctaa

SEQ ID NO: 2929260 - DNA, 15 bp, Homo sapiens
ctaggcatcaccccc

SEQ ID NO: 2929261 - DNA, 22 bp, Homo sapiens
ctaggcatcacccccgctttgg

SEQ ID NO: 2929262 - DNA, 16 bp, Homo sapiens
ctaggcccctgtgtag

SEQ ID NO: 2929263 - DNA, 15 bp, Homo sapiens
ctaggcctcagccag

SEQ ID NO: 2929264 - DNA, 18 bp, Homo sapiens
ctaggcctcagccagaga

SEQ ID NO: 2929265 - DNA, 16 bp, Homo sapiens
ctaggctaggacgttg

SEQ ID NO: 2929266 - DNA, 15 bp, Homo sapiens
ctaggctagggtggg

SEQ ID NO: 2929267 - DNA, 15 bp, Homo sapiens
ctaggctctgccttc

SEQ ID NO: 2929268 - DNA, 15 bp, Homo sapiens
ctaggctggagccca

SEQ ID NO: 2929269 - DNA, 17 bp, Homo sapiens
ctaggctggagcccagg

SEQ ID NO: 2929270 - DNA, 20 bp, Homo sapiens
ctaggctggagcccagggag

SEQ ID NO: 2929271 - DNA, 14 bp, Homo sapiens
ctagggagagaccc

SEQ ID NO: 2929272 - DNA, 23 bp, Homo sapiens
ctagggatccctcatctgtccct

SEQ ID NO: 2929273 - DNA, 23 bp, Homo sapiens
ctagggcagggtgggagccggga

SEQ ID NO: 2929274 - DNA, 18 bp, Homo sapiens
ctagggccaagcccagca

SEQ ID NO: 2929275 - DNA, 23 bp, Homo sapiens
ctagggcctcggaggctcctccc

SEQ ID NO: 2929276 - DNA, 14 bp, Homo sapiens
ctagggcggagagg

SEQ ID NO: 2929277 - DNA, 15 bp, Homo sapiens
ctagggctgggaaac

SEQ ID NO: 2929278 - DNA, 17 bp, Homo sapiens
ctaggggaaggactggc

SEQ ID NO: 2929279 - DNA, 22 bp, Homo sapiens
ctaggggaaggactggccgtgg

SEQ ID NO: 2929280 - DNA, 23 bp, Homo sapiens
ctaggggaaggactggccgtggc

SEQ ID NO: 2929281 - DNA, 15 bp, Homo sapiens
ctagggtttcttaaa

SEQ ID NO: 2929282 - DNA, 18 bp, Homo sapiens
ctagggtttcttaaatat

SEQ ID NO: 2929283 - DNA, 15 bp, Homo sapiens
ctagggttttggcct

SEQ ID NO: 2929284 - DNA, 17 bp, Homo sapiens
ctaggtaggaaatgtgg

SEQ ID NO: 2929285 - DNA, 11 bp, Homo sapiens
ctaggtatcat

SEQ ID NO: 2929286 - DNA, 18 bp, Homo sapiens
ctaggtgcccttggaggc

SEQ ID NO: 2929287 - DNA, 23 bp, Homo sapiens
ctaggtgccttttgtttttggct

SEQ ID NO: 2929288 - DNA, 20 bp, Homo sapiens
ctaggttctgtagagccaat

SEQ ID NO: 2929289 - DNA, 14 bp, Homo sapiens
ctaggttgttttta

SEQ ID NO: 2929290 - DNA, 23 bp, Homo sapiens
ctaggttttgagatttagagcaa

SEQ ID NO: 2929291 - DNA, 14 bp, Homo sapiens
ctaggttttttcct

SEQ ID NO: 2929292 - DNA, 16 bp, Homo sapiens
ctagtaaaaatacaaa

SEQ ID NO: 2929293 - DNA, 22 bp, Homo sapiens
ctagtacataattgattaaaat

SEQ ID NO: 2929294 - DNA, 15 bp, Homo sapiens
ctagtactagaaact

SEQ ID NO: 2929295 - DNA, 15 bp, Homo sapiens
ctagtagttctcttg

SEQ ID NO: 2929296 - DNA, 16 bp, Homo sapiens
ctagtagttctcttgg

SEQ ID NO: 2929297 - DNA, 21 bp, Homo sapiens
ctagtatttcatgctgggaat

SEQ ID NO: 2929298 - DNA, 16 bp, Homo sapiens
ctagtcaatcaagtct

SEQ ID NO: 2929299 - DNA, 21 bp, Homo sapiens
ctagtcaatcaagtctgttta

SEQ ID NO: 2929300 - DNA, 18 bp, Homo sapiens
ctagtcaccgacagcggc

SEQ ID NO: 2929301 - DNA, 23 bp, Homo sapiens
ctagtcaccgacagcggccttga

SEQ ID NO: 2929302 - DNA, 14 bp, Homo sapiens
ctagtcactggcag

SEQ ID NO: 2929303 - DNA, 17 bp, Homo sapiens
ctagtcactggcagcct

SEQ ID NO: 2929304 - DNA, 20 bp, Homo sapiens
ctagtcactggcagcctgca

SEQ ID NO: 2929305 - DNA, 12 bp, Homo sapiens
ctagtccttgtt

SEQ ID NO: 2929306 - DNA, 15 bp, Homo sapiens
ctagtcctttactaa

SEQ ID NO: 2929307 - DNA, 22 bp, Homo sapiens
ctagtcctttataagttgcttt

SEQ ID NO: 2929308 - DNA, 16 bp, Homo sapiens
ctagtcttgaatttct

SEQ ID NO: 2929309 - DNA, 17 bp, Homo sapiens
ctagtgaagtggcctct

SEQ ID NO: 2929310 - DNA, 23 bp, Homo sapiens
ctagtgatgtagaaagatacact

SEQ ID NO: 2929311 - DNA, 13 bp, Homo sapiens
ctagtgccccaga

SEQ ID NO: 2929312 - DNA, 21 bp, Homo sapiens
ctagtggagggttggagaagg

SEQ ID NO: 2929313 - DNA, 20 bp, Homo sapiens
ctagtggggtctccctctcc

SEQ ID NO: 2929314 - DNA, 21 bp, Homo sapiens
ctagtgtctgggtttggccca

SEQ ID NO: 2929315 - DNA, 22 bp, Homo sapiens
ctagtgtctgggtttggcccaa

SEQ ID NO: 2929316 - DNA, 23 bp, Homo sapiens
ctagttaaccaatcgcaaagcaa

SEQ ID NO: 2929317 - DNA, 23 bp, Homo sapiens
ctagttaccacattactctgcct

SEQ ID NO: 2929318 - DNA, 22 bp, Homo sapiens
ctagttattggatcagtgaaaa

SEQ ID NO: 2929319 - DNA, 16 bp, Homo sapiens
ctagttctcagcttgc

SEQ ID NO: 2929320 - DNA, 22 bp, Homo sapiens
ctagttctcagcttgcagctgg

SEQ ID NO: 2929321 - DNA, 21 bp, Homo sapiens
ctagtttatggttctgcagtc

SEQ ID NO: 2929322 - DNA, 18 bp, Homo sapiens
ctagtttcctgccttcag

SEQ ID NO: 2929323 - DNA, 13 bp, Homo sapiens
ctagttttgttta

SEQ ID NO: 2929324 - DNA, 13 bp, Homo sapiens
ctagtttttaatt

SEQ ID NO: 2929325 - DNA, 21 bp, Homo sapiens
ctataaatacaaatctgtata

SEQ ID NO: 2929326 - DNA, 22 bp, Homo sapiens
ctataaatacaaatctgtataa

SEQ ID NO: 2929327 - DNA, 17 bp, Homo sapiens
ctataaattcctctttg

SEQ ID NO: 2929328 - DNA, 19 bp, Homo sapiens
ctataaattcctctttgct

SEQ ID NO: 2929329 - DNA, 15 bp, Homo sapiens
ctataaattttttga

SEQ ID NO: 2929330 - DNA, 17 bp, Homo sapiens
ctataactttttttcaa

SEQ ID NO: 2929331 - DNA, 13 bp, Homo sapiens
ctataagaaaaag

SEQ ID NO: 2929332 - DNA, 16 bp, Homo sapiens
ctataagaaaaaggaa

SEQ ID NO: 2929333 - DNA, 12 bp, Homo sapiens
ctataatcatta

SEQ ID NO: 2929334 - DNA, 14 bp, Homo sapiens
ctataatcattagt

SEQ ID NO: 2929335 - DNA, 14 bp, Homo sapiens
ctatacaaatataa

SEQ ID NO: 2929336 - DNA, 21 bp, Homo sapiens
ctatacaaattttcagaaggt

SEQ ID NO: 2929337 - DNA, 15 bp, Homo sapiens
ctatacctgtgcctc

SEQ ID NO: 2929338 - DNA, 12 bp, Homo sapiens
ctatactgcttg

SEQ ID NO: 2929339 - DNA, 23 bp, Homo sapiens
ctatactgcttggagctgagcaa

SEQ ID NO: 2929340 - DNA, 13 bp, Homo sapiens
ctatactggaaat

SEQ ID NO: 2929341 - DNA, 19 bp, Homo sapiens
ctatagacccgaggaaact

SEQ ID NO: 2929342 - DNA, 12 bp, Homo sapiens
ctatagcctggg

SEQ ID NO: 2929343 - DNA, 13 bp, Homo sapiens
ctatagcctgggg

SEQ ID NO: 2929344 - DNA, 14 bp, Homo sapiens
ctatagcctggggt

SEQ ID NO: 2929345 - DNA, 18 bp, Homo sapiens
ctatagcctggggtgggg

SEQ ID NO: 2929346 - DNA, 21 bp, Homo sapiens
ctatagcctggggtggggtca

SEQ ID NO: 2929347 - DNA, 23 bp, Homo sapiens
ctatagtatttgattcaaaatat

SEQ ID NO: 2929348 - DNA, 15 bp, Homo sapiens
ctatagttctagaca

SEQ ID NO: 2929349 - DNA, 14 bp, Homo sapiens
ctatagtttttcta

SEQ ID NO: 2929350 - DNA, 12 bp, Homo sapiens
ctatataaaatg

SEQ ID NO: 2929351 - DNA, 16 bp, Homo sapiens
ctatataagacattaa

SEQ ID NO: 2929352 - DNA, 17 bp, Homo sapiens
ctatataagacattaag

SEQ ID NO: 2929353 - DNA, 14 bp, Homo sapiens
ctatatagacttgg

SEQ ID NO: 2929354 - DNA, 13 bp, Homo sapiens
ctatatatataat

SEQ ID NO: 2929355 - DNA, 20 bp, Homo sapiens
ctatatatcttttgtaagac

SEQ ID NO: 2929356 - DNA, 14 bp, Homo sapiens
ctatatatttctat

SEQ ID NO: 2929357 - DNA, 16 bp, Homo sapiens
ctatatatttctatta

SEQ ID NO: 2929358 - DNA, 21 bp, Homo sapiens
ctatatcattaaaagaacata

SEQ ID NO: 2929359 - DNA, 20 bp, Homo sapiens
ctatattctggccagactcg

SEQ ID NO: 2929360 - DNA, 13 bp, Homo sapiens
ctatattgattta

SEQ ID NO: 2929361 - DNA, 13 bp, Homo sapiens
ctccagctcagca

SEQ ID NO: 2929362 - DNA, 21 bp, Homo sapiens
ctccagctctggcttcctgct

SEQ ID NO: 2929363 - DNA, 11 bp, Homo sapiens
ctccagctgcc

SEQ ID NO: 2929364 - DNA, 14 bp, Homo sapiens
ctccagctggtgcc

SEQ ID NO: 2929365 - DNA, 18 bp, Homo sapiens
ctccagctggtgccccca

SEQ ID NO: 2929366 - DNA, 19 bp, Homo sapiens
ctccagctggtgcccccag

SEQ ID NO: 2929367 - DNA, 14 bp, Homo sapiens
ctccagctgtcagc

SEQ ID NO: 2929368 - DNA, 18 bp, Homo sapiens
ctccagcttttcctcagg

SEQ ID NO: 2929369 - DNA, 18 bp, Homo sapiens
ctccaggaaccacaccac

SEQ ID NO: 2929370 - DNA, 15 bp, Homo sapiens
ctccaggccagctcc

SEQ ID NO: 2929371 - DNA, 14 bp, Homo sapiens
ctccaggcccgtct

SEQ ID NO: 2929372 - DNA, 16 bp, Homo sapiens
ctccaggcccgtctgt

SEQ ID NO: 2929373 - DNA, 23 bp, Homo sapiens
ctccaggcccgtctgtccatctg

SEQ ID NO: 2929374 - DNA, 22 bp, Homo sapiens
ctccaggcgacgcggttttttc

SEQ ID NO: 2929375 - DNA, 15 bp, Homo sapiens
ctccaggctgggctg

SEQ ID NO: 2929376 - DNA, 21 bp, Homo sapiens
ctccaggctgggtgacagagc

SEQ ID NO: 2929377 - DNA, 18 bp, Homo sapiens
ctccagggccacgtgcca

SEQ ID NO: 2929378 - DNA, 14 bp, Homo sapiens
ctccagggtcccct

SEQ ID NO: 2929379 - DNA, 18 bp, Homo sapiens
ctccagggtcccctgcca

SEQ ID NO: 2929380 - DNA, 20 bp, Homo sapiens
ctccagggtcccctgccacc

SEQ ID NO: 2929381 - DNA, 13 bp, Homo sapiens
ctccaggtgcaga

SEQ ID NO: 2929382 - DNA, 16 bp, Homo sapiens
ctccaggtgcagaggt

SEQ ID NO: 2929383 - DNA, 16 bp, Homo sapiens
ctccagtaccttgctt

SEQ ID NO: 2929384 - DNA, 14 bp, Homo sapiens
ctccagtccctggg

SEQ ID NO: 2929385 - DNA, 20 bp, Homo sapiens
ctccagtccctgggagcaag

SEQ ID NO: 2929386 - DNA, 22 bp, Homo sapiens
ctccagtcctgctggcctgctc

SEQ ID NO: 2929387 - DNA, 13 bp, Homo sapiens
ctccagtctgttc

SEQ ID NO: 2929388 - DNA, 15 bp, Homo sapiens
ctccagtctgttctc

SEQ ID NO: 2929389 - DNA, 13 bp, Homo sapiens
ctccagtgcagtc

SEQ ID NO: 2929390 - DNA, 14 bp, Homo sapiens
ctccataagtttaa

SEQ ID NO: 2929391 - DNA, 17 bp, Homo sapiens
ctccatactttggatga

SEQ ID NO: 2929392 - DNA, 14 bp, Homo sapiens
ctccatagagcagt

SEQ ID NO: 2929393 - DNA, 21 bp, Homo sapiens
ctccatccatctgtccgtcca

SEQ ID NO: 2929394 - DNA, 16 bp, Homo sapiens
ctccatccccatcggc

SEQ ID NO: 2929395 - DNA, 23 bp, Homo sapiens
ctccatcctaccccctgtgcctt

SEQ ID NO: 2929396 - DNA, 21 bp, Homo sapiens
ctccatcctgtttgtatgaaa

SEQ ID NO: 2929397 - DNA, 21 bp, Homo sapiens
ctccatctctcatcctccagt

SEQ ID NO: 2929398 - DNA, 16 bp, Homo sapiens
ctccatctggcagggt

SEQ ID NO: 2929399 - DNA, 19 bp, Homo sapiens
ctccatgaagaagctggga

SEQ ID NO: 2929400 - DNA, 13 bp, Homo sapiens
ctccatggtcctg

SEQ ID NO: 2929401 - DNA, 14 bp, Homo sapiens
ctccatggtcctgt

SEQ ID NO: 2929402 - DNA, 22 bp, Homo sapiens
ctccatggtcctgtctgtcctt

SEQ ID NO: 2929403 - DNA, 12 bp, Homo sapiens
ctccatggttct

SEQ ID NO: 2929404 - DNA, 14 bp, Homo sapiens
ctccatggttctca

SEQ ID NO: 2929405 - DNA, 22 bp, Homo sapiens
ctccatggttctcaatttattt

SEQ ID NO: 2929406 - DNA, 21 bp, Homo sapiens
ctccatgttggtcaggctggt

SEQ ID NO: 2929407 - DNA, 23 bp, Homo sapiens
ctccatgtttccaccaaatgaat

SEQ ID NO: 2929408 - DNA, 23 bp, Homo sapiens
ctccattggtcctttttttttct

SEQ ID NO: 2929409 - DNA, 16 bp, Homo sapiens
ctccattttcttgtca

SEQ ID NO: 2929410 - DNA, 15 bp, Homo sapiens
ctcccaaaacatttt

SEQ ID NO: 2929411 - DNA, 18 bp, Homo sapiens
ctcccaaacgccctttcc

SEQ ID NO: 2929412 - DNA, 20 bp, Homo sapiens
ctcccaagagcttccagagc

SEQ ID NO: 2929413 - DNA, 21 bp, Homo sapiens
ctcccaagagcttccagagct

SEQ ID NO: 2929414 - DNA, 22 bp, Homo sapiens
ctcccaatctcaatacagcctg

SEQ ID NO: 2929415 - DNA, 21 bp, Homo sapiens
ctcccaatttcagactcccat

SEQ ID NO: 2929416 - DNA, 18 bp, Homo sapiens
ctcccacacccaaagctg

SEQ ID NO: 2929417 - DNA, 15 bp, Homo sapiens
ctcccacactcgcca

SEQ ID NO: 2929418 - DNA, 18 bp, Homo sapiens
ctcccacatcccactgga

SEQ ID NO: 2929419 - DNA, 15 bp, Homo sapiens
ctcccaccaccccat

SEQ ID NO: 2929420 - DNA, 22 bp, Homo sapiens
ctcccaccccacccccttcagt

SEQ ID NO: 2929421 - DNA, 14 bp, Homo sapiens
ctcccaccctaagg

SEQ ID NO: 2929422 - DNA, 19 bp, Homo sapiens
ctcccacctagtgccccag

SEQ ID NO: 2929423 - DNA, 20 bp, Homo sapiens
ctcccacctagtgccccaga

SEQ ID NO: 2929424 - DNA, 18 bp, Homo sapiens
ctcccacggggaccactg

SEQ ID NO: 2929425 - DNA, 22 bp, Homo sapiens
ctcccacggggaccactgggcc

SEQ ID NO: 2929426 - DNA, 11 bp, Homo sapiens
ctcccactcct

SEQ ID NO: 2929427 - DNA, 12 bp, Homo sapiens
ctcccactccta

SEQ ID NO: 2929428 - DNA, 12 bp, Homo sapiens
ctcccactttgc

SEQ ID NO: 2929429 - DNA, 20 bp, Homo sapiens
ctcccactttgctgttcctt

SEQ ID NO: 2929430 - DNA, 16 bp, Homo sapiens
ctcccagaacacactc

SEQ ID NO: 2929431 - DNA, 15 bp, Homo sapiens
ctcccagacttgttt

SEQ ID NO: 2929432 - DNA, 17 bp, Homo sapiens
ctcccagacttgtttcc

SEQ ID NO: 2929433 - DNA, 17 bp, Homo sapiens
ctcccagagctggtgga

SEQ ID NO: 2929434 - DNA, 22 bp, Homo sapiens
ctcccagagctggtggacccag

SEQ ID NO: 2929435 - DNA, 22 bp, Homo sapiens
ctcccagatcgctcccttggct

SEQ ID NO: 2929436 - DNA, 21 bp, Homo sapiens
ctcccaggccaacagtagcca

SEQ ID NO: 2929437 - DNA, 18 bp, Homo sapiens
ctcccaggtgcagccaga

SEQ ID NO: 2929438 - DNA, 21 bp, Homo sapiens
ctcccaggtgttaacattcca

SEQ ID NO: 2929439 - DNA, 15 bp, Homo sapiens
ctcccatccagggcc

SEQ ID NO: 2929440 - DNA, 13 bp, Homo sapiens
ctcccatcctcca

SEQ ID NO: 2929441 - DNA, 16 bp, Homo sapiens
ctcccatcctccagcc

SEQ ID NO: 2929442 - DNA, 14 bp, Homo sapiens
ctcccatgtatgga

SEQ ID NO: 2929443 - DNA, 14 bp, Homo sapiens
ctcccattcctgaa

SEQ ID NO: 2929444 - DNA, 17 bp, Homo sapiens
ctcccattgtccctctg

SEQ ID NO: 2929445 - DNA, 19 bp, Homo sapiens
ctcccattgtccctctgcc

SEQ ID NO: 2929446 - DNA, 13 bp, Homo sapiens
ctccccaaagcca

SEQ ID NO: 2929447 - DNA, 21 bp, Homo sapiens
ctccccaaagccactggaagg

SEQ ID NO: 2929448 - DNA, 18 bp, Homo sapiens
ctccccaacttgagcctg

SEQ ID NO: 2929449 - DNA, 18 bp, Homo sapiens
ctccccaatgagacttgc

SEQ ID NO: 2929450 - DNA, 23 bp, Homo sapiens
ctccccaatgagacttgccttcc

SEQ ID NO: 2929451 - DNA, 12 bp, Homo sapiens
ctccccaccaga

SEQ ID NO: 2929452 - DNA, 14 bp, Homo sapiens
ctccccaccagagc

SEQ ID NO: 2929453 - DNA, 15 bp, Homo sapiens
ctccccaccagagct

SEQ ID NO: 2929454 - DNA, 17 bp, Homo sapiens
ctccccaccagagctgc

SEQ ID NO: 2929455 - DNA, 16 bp, Homo sapiens
ctccccacccaagaga

SEQ ID NO: 2929456 - DNA, 15 bp, Homo sapiens
ctccccagcccagag

SEQ ID NO: 2929457 - DNA, 17 bp, Homo sapiens
ctccccagcccagagac

SEQ ID NO: 2929458 - DNA, 19 bp, Homo sapiens
ctccccaggaagcccactg

SEQ ID NO: 2929459 - DNA, 21 bp, Homo sapiens
ctccccaggaagcccactgcc

SEQ ID NO: 2929460 - DNA, 22 bp, Homo sapiens
ctccccaggaagcccactgcct

SEQ ID NO: 2929461 - DNA, 21 bp, Homo sapiens
ctccccaggggagagggtctg

SEQ ID NO: 2929462 - DNA, 21 bp, Homo sapiens
ctccccatctcggggctgctg

SEQ ID NO: 2929463 - DNA, 16 bp, Homo sapiens
ctccccatctgtgttc

SEQ ID NO: 2929464 - DNA, 17 bp, Homo sapiens
ctccccatggagccagc

SEQ ID NO: 2929465 - DNA, 16 bp, Homo sapiens
ctccccattagctttc

SEQ ID NO: 2929466 - DNA, 22 bp, Homo sapiens
ctcccccaaccaaggaaggagc

SEQ ID NO: 2929467 - DNA, 16 bp, Homo sapiens
ctcccccacccctgct

SEQ ID NO: 2929468 - DNA, 21 bp, Homo sapiens
ctcccccacgtctctctgcct

SEQ ID NO: 2929469 - DNA, 23 bp, Homo sapiens
ctcccccacgtctctctgcctgc

SEQ ID NO: 2929470 - DNA, 16 bp, Homo sapiens
ctcccccactcctcta

SEQ ID NO: 2929471 - DNA, 12 bp, Homo sapiens
ctcccccagcag

SEQ ID NO: 2929472 - DNA, 17 bp, Homo sapiens
ctcccccatagcaccct

SEQ ID NO: 2929473 - DNA, 19 bp, Homo sapiens
ctcccccatagcaccctgc

SEQ ID NO: 2929474 - DNA, 12 bp, Homo sapiens
ctccccccaatc

SEQ ID NO: 2929475 - DNA, 13 bp, Homo sapiens
ctccccccactgc

SEQ ID NO: 2929476 - DNA, 14 bp, Homo sapiens
ctccccccactgca

SEQ ID NO: 2929477 - DNA, 16 bp, Homo sapiens
ctccccccactgcagg

SEQ ID NO: 2929478 - DNA, 18 bp, Homo sapiens
ctcccccccatgcactgt

SEQ ID NO: 2929479 - DNA, 18 bp, Homo sapiens
ctcccccctcctctgaaa

SEQ ID NO: 2929480 - DNA, 15 bp, Homo sapiens
ctcccccggctctac

SEQ ID NO: 2929481 - DNA, 22 bp, Homo sapiens
ctccccctaccgcatggcagct

SEQ ID NO: 2929482 - DNA, 14 bp, Homo sapiens
ctccccctctgctt

SEQ ID NO: 2929483 - DNA, 17 bp, Homo sapiens
ctccccctgccagtgcc

SEQ ID NO: 2929484 - DNA, 19 bp, Homo sapiens
ctccccctgccagtgcctt

SEQ ID NO: 2929485 - DNA, 14 bp, Homo sapiens
ctccccgaggctgc

SEQ ID NO: 2929486 - DNA, 16 bp, Homo sapiens
ctccccgagggctcag

SEQ ID NO: 2929487 - DNA, 19 bp, Homo sapiens
ctccccgatggcggggatc

SEQ ID NO: 2929488 - DNA, 22 bp, Homo sapiens
ctccccgctccgtctctgtcct

SEQ ID NO: 2929489 - DNA, 23 bp, Homo sapiens
ctcccctatccacccagcccatt

SEQ ID NO: 2929490 - DNA, 12 bp, Homo sapiens
ctcccctccatc

SEQ ID NO: 2929491 - DNA, 14 bp, Homo sapiens
ctcccctccccatc

SEQ ID NO: 2929492 - DNA, 19 bp, Homo sapiens
ctcccctccccatctgtgt

SEQ ID NO: 2929493 - DNA, 15 bp, Homo sapiens
ctctcatagtgtcat

SEQ ID NO: 2929494 - DNA, 16 bp, Homo sapiens
ctctcatcgtctttta

SEQ ID NO: 2929495 - DNA, 11 bp, Homo sapiens
ctctcattccc

SEQ ID NO: 2929496 - DNA, 21 bp, Homo sapiens
ctctcattccccaggtggctg

SEQ ID NO: 2929497 - DNA, 13 bp, Homo sapiens
ctctccaacctgg

SEQ ID NO: 2929498 - DNA, 13 bp, Homo sapiens
ctctccacaggag

SEQ ID NO: 2929499 - DNA, 22 bp, Homo sapiens
ctctccactcatgtgactcttt

SEQ ID NO: 2929500 - DNA, 22 bp, Homo sapiens
ctctccacttctggtcccctgt

SEQ ID NO: 2929501 - DNA, 13 bp, Homo sapiens
ctctccagcctca

SEQ ID NO: 2929502 - DNA, 16 bp, Homo sapiens
ctctccagcctcacag

SEQ ID NO: 2929503 - DNA, 14 bp, Homo sapiens
ctctccagcctgac

SEQ ID NO: 2929504 - DNA, 15 bp, Homo sapiens
ctctccatcttcagc

SEQ ID NO: 2929505 - DNA, 12 bp, Homo sapiens
ctctccatgcaa

SEQ ID NO: 2929506 - DNA, 15 bp, Homo sapiens
ctctccatgcaagtg

SEQ ID NO: 2929507 - DNA, 19 bp, Homo sapiens
ctctcccaacgctgaagcg

SEQ ID NO: 2929508 - DNA, 16 bp, Homo sapiens
ctctcccaccccctcc

SEQ ID NO: 2929509 - DNA, 16 bp, Homo sapiens
ctctcccaccctaagg

SEQ ID NO: 2929510 - DNA, 18 bp, Homo sapiens
ctctcccattgtccctct

SEQ ID NO: 2929511 - DNA, 21 bp, Homo sapiens
ctctcccattgtccctctgcc

SEQ ID NO: 2929512 - DNA, 18 bp, Homo sapiens
ctctccccacgagggctg

SEQ ID NO: 2929513 - DNA, 16 bp, Homo sapiens
ctctccccagcccaga

SEQ ID NO: 2929514 - DNA, 13 bp, Homo sapiens
ctctccccctctg

SEQ ID NO: 2929515 - DNA, 17 bp, Homo sapiens
ctctccccctctgtctt

SEQ ID NO: 2929516 - DNA, 19 bp, Homo sapiens
ctctccccctctgtcttct

SEQ ID NO: 2929517 - DNA, 21 bp, Homo sapiens
ctctcccctcagagtgcaagc

SEQ ID NO: 2929518 - DNA, 12 bp, Homo sapiens
ctctcccctccc

SEQ ID NO: 2929519 - DNA, 14 bp, Homo sapiens
ctctcccctcccca

SEQ ID NO: 2929520 - DNA, 22 bp, Homo sapiens
ctctccctctaggctctgcctt

SEQ ID NO: 2929521 - DNA, 21 bp, Homo sapiens
ctctccctctggccctgcctt

SEQ ID NO: 2929522 - DNA, 13 bp, Homo sapiens
ctctccctgaccc

SEQ ID NO: 2929523 - DNA, 13 bp, Homo sapiens
ctctccctgcact

SEQ ID NO: 2929524 - DNA, 15 bp, Homo sapiens
ctctccctgcctcac

SEQ ID NO: 2929525 - DNA, 15 bp, Homo sapiens
ctctcccttacccat

SEQ ID NO: 2929526 - DNA, 13 bp, Homo sapiens
ctctcccttccct

SEQ ID NO: 2929527 - DNA, 17 bp, Homo sapiens
ctctccgaaagaagaca

SEQ ID NO: 2929528 - DNA, 19 bp, Homo sapiens
ctctccgcacacctctggc

SEQ ID NO: 2929529 - DNA, 20 bp, Homo sapiens
ctctccgcacacctctggct

SEQ ID NO: 2929530 - DNA, 18 bp, Homo sapiens
ctctcctccgtggcacat

SEQ ID NO: 2929531 - DNA, 20 bp, Homo sapiens
ctctcctcctgcccacctgt

SEQ ID NO: 2929532 - DNA, 22 bp, Homo sapiens
ctctcctcggacacccagggtc

SEQ ID NO: 2929533 - DNA, 21 bp, Homo sapiens
ctctcctgacttttaatgtca

SEQ ID NO: 2929534 - DNA, 13 bp, Homo sapiens
ctctcctgcctac

SEQ ID NO: 2929535 - DNA, 16 bp, Homo sapiens
ctctcctgcctcagcc

SEQ ID NO: 2929536 - DNA, 20 bp, Homo sapiens
ctctcctggagggcgcccag

SEQ ID NO: 2929537 - DNA, 21 bp, Homo sapiens
ctctcctggagggcgcccagc

SEQ ID NO: 2929538 - DNA, 18 bp, Homo sapiens
ctctcctgtactttttcc

SEQ ID NO: 2929539 - DNA, 12 bp, Homo sapiens
ctctcctgtcca

SEQ ID NO: 2929540 - DNA, 20 bp, Homo sapiens
ctctccttgctcctggcctt

SEQ ID NO: 2929541 - DNA, 13 bp, Homo sapiens
ctctcctttgtat

SEQ ID NO: 2929542 - DNA, 19 bp, Homo sapiens
ctctcgcacctttccaaag

SEQ ID NO: 2929543 - DNA, 18 bp, Homo sapiens
ctctcgctgccctgtgga

SEQ ID NO: 2929544 - DNA, 19 bp, Homo sapiens
ctctcggtgctccatctcc

SEQ ID NO: 2929545 - DNA, 16 bp, Homo sapiens
ctctcggttgaaacct

SEQ ID NO: 2929546 - DNA, 13 bp, Homo sapiens
ctctctcaggagc

SEQ ID NO: 2929547 - DNA, 14 bp, Homo sapiens
ctctctccagatgt

SEQ ID NO: 2929548 - DNA, 14 bp, Homo sapiens
ctctctcccaggac

SEQ ID NO: 2929549 - DNA, 14 bp, Homo sapiens
ctctctccctgcct

SEQ ID NO: 2929550 - DNA, 17 bp, Homo sapiens
ctctctcctcctgccca

SEQ ID NO: 2929551 - DNA, 14 bp, Homo sapiens
ctctctcctggact

SEQ ID NO: 2929552 - DNA, 15 bp, Homo sapiens
ctctctcctggactg

SEQ ID NO: 2929553 - DNA, 14 bp, Homo sapiens
ctctctcctgtcca

SEQ ID NO: 2929554 - DNA, 19 bp, Homo sapiens
ctctctcctgtccaaccta

SEQ ID NO: 2929555 - DNA, 15 bp, Homo sapiens
ctctctctctttctc

SEQ ID NO: 2929556 - DNA, 14 bp, Homo sapiens
ctctctctgtgggg

SEQ ID NO: 2929557 - DNA, 12 bp, Homo sapiens
ctctctctttct

SEQ ID NO: 2929558 - DNA, 13 bp, Homo sapiens
ctctctctttctc

SEQ ID NO: 2929559 - DNA, 19 bp, Homo sapiens
ctctctgagtcctggccca

SEQ ID NO: 2929560 - DNA, 20 bp, Homo sapiens
ctctctgagtcctggcccaa

SEQ ID NO: 2929561 - DNA, 17 bp, Homo sapiens
ctctctgcagccagccc

SEQ ID NO: 2929562 - DNA, 13 bp, Homo sapiens
ctctctgcctgct

SEQ ID NO: 2929563 - DNA, 17 bp, Homo sapiens
ctctctgcctgctgggc

SEQ ID NO: 2929564 - DNA, 20 bp, Homo sapiens
ctctctgcctgctgggctct

SEQ ID NO: 2929565 - DNA, 15 bp, Homo sapiens
ctctctggagcccct

SEQ ID NO: 2929566 - DNA, 12 bp, Homo sapiens
ctctctgggctg

SEQ ID NO: 2929567 - DNA, 23 bp, Homo sapiens
ctctctgtctgtctctccccctc

SEQ ID NO: 2929568 - DNA, 20 bp, Homo sapiens
ctctctgtcttctctccact

SEQ ID NO: 2929569 - DNA, 20 bp, Homo sapiens
ctctctgtctttttccttcc

SEQ ID NO: 2929570 - DNA, 16 bp, Homo sapiens
ctctctgtgtctgaga

SEQ ID NO: 2929571 - DNA, 12 bp, Homo sapiens
ctctcttcactg

SEQ ID NO: 2929572 - DNA, 23 bp, Homo sapiens
ctctcttcccttttttttctggg

SEQ ID NO: 2929573 - DNA, 13 bp, Homo sapiens
ctctcttggaatt

SEQ ID NO: 2929574 - DNA, 21 bp, Homo sapiens
ctctcttgtgagccatagaga

SEQ ID NO: 2929575 - DNA, 17 bp, Homo sapiens
ctctcttgttgtccagg

SEQ ID NO: 2929576 - DNA, 21 bp, Homo sapiens
ctctcttgttgtccaggctgg

SEQ ID NO: 2929577 - DNA, 19 bp, Homo sapiens
ctctcttttcctctctctc

SEQ ID NO: 2929578 - DNA, 17 bp, Homo sapiens
ctctcttttcctctctg

SEQ ID NO: 2929579 - DNA, 21 bp, Homo sapiens
ctctgaaaagcaaaggatgtg

SEQ ID NO: 2929580 - DNA, 11 bp, Homo sapiens
ctctgaaacag

SEQ ID NO: 2929581 - DNA, 12 bp, Homo sapiens
ctctgaaacagc

SEQ ID NO: 2929582 - DNA, 17 bp, Homo sapiens
ctctgaaacagctgcct

SEQ ID NO: 2929583 - DNA, 18 bp, Homo sapiens
ctctgaaacagctgcctt

SEQ ID NO: 2929584 - DNA, 19 bp, Homo sapiens
ctctgaaagttgtacatga

SEQ ID NO: 2929585 - DNA, 13 bp, Homo sapiens
ctctgaaataatg

SEQ ID NO: 2929586 - DNA, 17 bp, Homo sapiens
ctctgaaataatgggat

SEQ ID NO: 2929587 - DNA, 22 bp, Homo sapiens
ctctgaagagtgggtttcacaa

SEQ ID NO: 2929588 - DNA, 23 bp, Homo sapiens
ctctgaagcaaggcggtggactt

SEQ ID NO: 2929589 - DNA, 18 bp, Homo sapiens
ctctgaagcgtgatttta

SEQ ID NO: 2929590 - DNA, 17 bp, Homo sapiens
ctctgaagggcatcatg

SEQ ID NO: 2929591 - DNA, 21 bp, Homo sapiens
ctctgacagcagcctgtgagg

SEQ ID NO: 2929592 - DNA, 18 bp, Homo sapiens
ctctgacccacagcctcc

SEQ ID NO: 2929593 - DNA, 13 bp, Homo sapiens
ctctgaccctggg

SEQ ID NO: 2929594 - DNA, 17 bp, Homo sapiens
ctctgactcagggctcc

SEQ ID NO: 2929595 - DNA, 20 bp, Homo sapiens
ctctgagacaaaagaaaaaa

SEQ ID NO: 2929596 - DNA, 19 bp, Homo sapiens
ctctgagagtctagattct

SEQ ID NO: 2929597 - DNA, 13 bp, Homo sapiens
ctctgagcagtga

SEQ ID NO: 2929598 - DNA, 16 bp, Homo sapiens
ctctgagctgtgcagg

SEQ ID NO: 2929599 - DNA, 13 bp, Homo sapiens
ctctgagctttgt

SEQ ID NO: 2929600 - DNA, 16 bp, Homo sapiens
ctctgagtatctcctc

SEQ ID NO: 2929601 - DNA, 23 bp, Homo sapiens
ctctgagtcagctgaccccctcc

SEQ ID NO: 2929602 - DNA, 16 bp, Homo sapiens
ctctgagtgtctctgc

SEQ ID NO: 2929603 - DNA, 20 bp, Homo sapiens
ctctgagtgtctctgcctgg

SEQ ID NO: 2929604 - DNA, 14 bp, Homo sapiens
ctctgataagagaa

SEQ ID NO: 2929605 - DNA, 13 bp, Homo sapiens
ctctgatcaaaat

SEQ ID NO: 2929606 - DNA, 12 bp, Homo sapiens
ctctgatccctc

SEQ ID NO: 2929607 - DNA, 17 bp, Homo sapiens
ctctgattagaaaggaa

SEQ ID NO: 2929608 - DNA, 21 bp, Homo sapiens
ctctgattttctccacaacac

SEQ ID NO: 2929609 - DNA, 13 bp, Homo sapiens
ctctgcaactgaa

SEQ ID NO: 2929610 - DNA, 14 bp, Homo sapiens
ctctgcaactgaat

SEQ ID NO: 2929611 - DNA, 21 bp, Homo sapiens
ctctgcaactgaatacttgaa

SEQ ID NO: 2929612 - DNA, 14 bp, Homo sapiens
ctctgcaactgctc

SEQ ID NO: 2929613 - DNA, 20 bp, Homo sapiens
ctctgcaagtgtctggagcg

SEQ ID NO: 2929614 - DNA, 18 bp, Homo sapiens
ctctgcacatgtcttgta

SEQ ID NO: 2929615 - DNA, 15 bp, Homo sapiens
ctctgcacccagaac

SEQ ID NO: 2929616 - DNA, 17 bp, Homo sapiens
ctctgcacccagaacag

SEQ ID NO: 2929617 - DNA, 21 bp, Homo sapiens
ctctgcacctgtaggatattg

SEQ ID NO: 2929618 - DNA, 19 bp, Homo sapiens
ctctgcagacttcccagct

SEQ ID NO: 2929619 - DNA, 22 bp, Homo sapiens
ctctgcagacttcccagctagg

SEQ ID NO: 2929620 - DNA, 13 bp, Homo sapiens
ctctgcagccagc

SEQ ID NO: 2929621 - DNA, 15 bp, Homo sapiens
ctctgcagccagccc

SEQ ID NO: 2929622 - DNA, 19 bp, Homo sapiens
ctctgcagggccgccaggg

SEQ ID NO: 2929623 - DNA, 18 bp, Homo sapiens
ctctgcagtcgcttgcca

SEQ ID NO: 2929624 - DNA, 19 bp, Homo sapiens
ctctgcatttttctgcaga

SEQ ID NO: 2929625 - DNA, 14 bp, Homo sapiens
ctctgccacctccc

SEQ ID NO: 2929626 - DNA, 12 bp, Homo sapiens
ctctgcccacct

SEQ ID NO: 2929627 - DNA, 17 bp, Homo sapiens
ctgactttttgtttctt

SEQ ID NO: 2929628 - DNA, 21 bp, Homo sapiens
ctgagaaacgtccatctctct

SEQ ID NO: 2929629 - DNA, 23 bp, Homo sapiens
ctgagaaagcccacctgggctgg

SEQ ID NO: 2929630 - DNA, 14 bp, Homo sapiens
ctgagaagaggagg

SEQ ID NO: 2929631 - DNA, 18 bp, Homo sapiens
ctgagaatttaattttta

SEQ ID NO: 2929632 - DNA, 17 bp, Homo sapiens
ctgagacagaattaatg

SEQ ID NO: 2929633 - DNA, 14 bp, Homo sapiens
ctgagacccaggac

SEQ ID NO: 2929634 - DNA, 16 bp, Homo sapiens
ctgagaccttgatgag

SEQ ID NO: 2929635 - DNA, 17 bp, Homo sapiens
ctgagagacccaaggag

SEQ ID NO: 2929636 - DNA, 18 bp, Homo sapiens
ctgagagagaatagagct

SEQ ID NO: 2929637 - DNA, 14 bp, Homo sapiens
ctgagagaggccat

SEQ ID NO: 2929638 - DNA, 12 bp, Homo sapiens
ctgagagccagg

SEQ ID NO: 2929639 - DNA, 15 bp, Homo sapiens
ctgagagtctagatt

SEQ ID NO: 2929640 - DNA, 17 bp, Homo sapiens
ctgagagtctagattct

SEQ ID NO: 2929641 - DNA, 22 bp, Homo sapiens
ctgagagtctagattctctggc

SEQ ID NO: 2929642 - DNA, 14 bp, Homo sapiens
ctgagagtttagtt

SEQ ID NO: 2929643 - DNA, 14 bp, Homo sapiens
ctgagatcgtgccg

SEQ ID NO: 2929644 - DNA, 17 bp, Homo sapiens
ctgagatctctgcagga

SEQ ID NO: 2929645 - DNA, 20 bp, Homo sapiens
ctgagcaactcttgattatc

SEQ ID NO: 2929646 - DNA, 13 bp, Homo sapiens
ctgagcaccaggg

SEQ ID NO: 2929647 - DNA, 16 bp, Homo sapiens
ctgagcaggacctctg

SEQ ID NO: 2929648 - DNA, 18 bp, Homo sapiens
ctgagcaggacctctgaa

SEQ ID NO: 2929649 - DNA, 12 bp, Homo sapiens
ctgagcagtccc

SEQ ID NO: 2929650 - DNA, 22 bp, Homo sapiens
ctgagcagtctacttctgtgtc

SEQ ID NO: 2929651 - DNA, 20 bp, Homo sapiens
ctgagcagtgaatgattcag

SEQ ID NO: 2929652 - DNA, 22 bp, Homo sapiens
ctgagcattcgctgtacccttt

SEQ ID NO: 2929653 - DNA, 14 bp, Homo sapiens
ctgagccaaagcca

SEQ ID NO: 2929654 - DNA, 15 bp, Homo sapiens
ctgagccagattggc

SEQ ID NO: 2929655 - DNA, 21 bp, Homo sapiens
ctgagccagattggccaatta

SEQ ID NO: 2929656 - DNA, 11 bp, Homo sapiens
ctgagcccctc

SEQ ID NO: 2929657 - DNA, 15 bp, Homo sapiens
ctgagcccctcagac

SEQ ID NO: 2929658 - DNA, 13 bp, Homo sapiens
ctgagcccctgtc

SEQ ID NO: 2929659 - DNA, 14 bp, Homo sapiens
ctgagcctcacttg

SEQ ID NO: 2929660 - DNA, 14 bp, Homo sapiens
ctgagcctctgctc

SEQ ID NO: 2929661 - DNA, 15 bp, Homo sapiens
ctgagcctctgctcc

SEQ ID NO: 2929662 - DNA, 16 bp, Homo sapiens
ctgagcctctgctccc

SEQ ID NO: 2929663 - DNA, 15 bp, Homo sapiens
ctgagcctgcaggga

SEQ ID NO: 2929664 - DNA, 14 bp, Homo sapiens
ctgagcctggccag

SEQ ID NO: 2929665 - DNA, 15 bp, Homo sapiens
ctgagcctggccagc

SEQ ID NO: 2929666 - DNA, 12 bp, Homo sapiens
ctgagcgaggaa

SEQ ID NO: 2929667 - DNA, 16 bp, Homo sapiens
ctgagcgaggaaaaac

SEQ ID NO: 2929668 - DNA, 17 bp, Homo sapiens
ctgagcgaggaaaaaca

SEQ ID NO: 2929669 - DNA, 21 bp, Homo sapiens
ctgagcgaggaaaaacaacaa

SEQ ID NO: 2929670 - DNA, 22 bp, Homo sapiens
ctgagcgaggaaaaacaacaaa

SEQ ID NO: 2929671 - DNA, 19 bp, Homo sapiens
ctgagcggccgcagagact

SEQ ID NO: 2929672 - DNA, 23 bp, Homo sapiens
ctgagcgtgctttccaaaaccca

SEQ ID NO: 2929673 - DNA, 17 bp, Homo sapiens
ctgagcgtttaaagtac

SEQ ID NO: 2929674 - DNA, 18 bp, Homo sapiens
ctgagcgtttaaagtact

SEQ ID NO: 2929675 - DNA, 16 bp, Homo sapiens
ctgagctcgcagcccc

SEQ ID NO: 2929676 - DNA, 17 bp, Homo sapiens
ctgagctctccaggcca

SEQ ID NO: 2929677 - DNA, 19 bp, Homo sapiens
ctgagctctccaggccagg

SEQ ID NO: 2929678 - DNA, 22 bp, Homo sapiens
ctgagctctccaggccaggtgg

SEQ ID NO: 2929679 - DNA, 14 bp, Homo sapiens
ctgagctctgcctc

SEQ ID NO: 2929680 - DNA, 12 bp, Homo sapiens
ctgagctggctt

SEQ ID NO: 2929681 - DNA, 12 bp, Homo sapiens
ctgagctgggga

SEQ ID NO: 2929682 - DNA, 24 bp, Homo sapiens
ctgagctggggaggtgggaggcca

SEQ ID NO: 2929683 - DNA, 23 bp, Homo sapiens
ctgagctgtgacattgctggtca

SEQ ID NO: 2929684 - DNA, 14 bp, Homo sapiens
ctgagcttggaagc

SEQ ID NO: 2929685 - DNA, 16 bp, Homo sapiens
ctgaggaaaggccagc

SEQ ID NO: 2929686 - DNA, 22 bp, Homo sapiens
ctgaggaaaggccagctggcag

SEQ ID NO: 2929687 - DNA, 17 bp, Homo sapiens
ctgaggacagctgtcct

SEQ ID NO: 2929688 - DNA, 15 bp, Homo sapiens
ctgaggactctgcaa

SEQ ID NO: 2929689 - DNA, 23 bp, Homo sapiens
ctgaggatcccctgtcccctggg

SEQ ID NO: 2929690 - DNA, 15 bp, Homo sapiens
ctgaggcagcagtgt

SEQ ID NO: 2929691 - DNA, 24 bp, Homo sapiens
ctgaggcagcagtgtgaggccagg

SEQ ID NO: 2929692 - DNA, 12 bp, Homo sapiens
ctgaggcaggag

SEQ ID NO: 2929693 - DNA, 12 bp, Homo sapiens
ctgaggccacac

SEQ ID NO: 2929694 - DNA, 12 bp, Homo sapiens
ctgaggcctcac

SEQ ID NO: 2929695 - DNA, 13 bp, Homo sapiens
ctgaggcctccct

SEQ ID NO: 2929696 - DNA, 21 bp, Homo sapiens
ctgaggcctgagacccaggac

SEQ ID NO: 2929697 - DNA, 12 bp, Homo sapiens
ctgaggccttgt

SEQ ID NO: 2929698 - DNA, 16 bp, Homo sapiens
ctgaggctgagaaagc

SEQ ID NO: 2929699 - DNA, 11 bp, Homo sapiens
ctgaggctggc

SEQ ID NO: 2929700 - DNA, 19 bp, Homo sapiens
ctgaggctggcacaggaca

SEQ ID NO: 2929701 - DNA, 15 bp, Homo sapiens
ctgaggctttggatt

SEQ ID NO: 2929702 - DNA, 17 bp, Homo sapiens
ctgaggctttggatttg

SEQ ID NO: 2929703 - DNA, 21 bp, Homo sapiens
ctgaggctttggatttgacat

SEQ ID NO: 2929704 - DNA, 14 bp, Homo sapiens
ctgagggaccgagc

SEQ ID NO: 2929705 - DNA, 16 bp, Homo sapiens
ctgagggaccgagccc

SEQ ID NO: 2929706 - DNA, 17 bp, Homo sapiens
ctgagggagcctggccc

SEQ ID NO: 2929707 - DNA, 18 bp, Homo sapiens
ctgagggagggagccatg

SEQ ID NO: 2929708 - DNA, 19 bp, Homo sapiens
ctgagggagggagccatgg

SEQ ID NO: 2929709 - DNA, 15 bp, Homo sapiens
ctgagggatctttac

SEQ ID NO: 2929710 - DNA, 18 bp, Homo sapiens
ctgagggcatctctgagt

SEQ ID NO: 2929711 - DNA, 18 bp, Homo sapiens
ctgaggggctggggaggg

SEQ ID NO: 2929712 - DNA, 20 bp, Homo sapiens
ctgaggggctggggaggggg

SEQ ID NO: 2929713 - DNA, 19 bp, Homo sapiens
ctgagggtgtttcttcctg

SEQ ID NO: 2929714 - DNA, 20 bp, Homo sapiens
ctgagggtgtttcttcctgc

SEQ ID NO: 2929715 - DNA, 15 bp, Homo sapiens
ctgaggtgtctggcc

SEQ ID NO: 2929716 - DNA, 19 bp, Homo sapiens
ctgagtagctctcctgact

SEQ ID NO: 2929717 - DNA, 19 bp, Homo sapiens
ctgagtagctggattacag

SEQ ID NO: 2929718 - DNA, 20 bp, Homo sapiens
ctgagtagctggattacagg

SEQ ID NO: 2929719 - DNA, 20 bp, Homo sapiens
ctgagtagctgggattacag

SEQ ID NO: 2929720 - DNA, 21 bp, Homo sapiens
ctgagtatctcctcgcaagct

SEQ ID NO: 2929721 - DNA, 22 bp, Homo sapiens
ctgagtatctcctcgcaagctg

SEQ ID NO: 2929722 - DNA, 14 bp, Homo sapiens
ctgagtattactag

SEQ ID NO: 2929723 - DNA, 16 bp, Homo sapiens
ctgagtcaagttgttc

SEQ ID NO: 2929724 - DNA, 15 bp, Homo sapiens
ctgagtcaccaggaa

SEQ ID NO: 2929725 - DNA, 17 bp, Homo sapiens
ctgagtcagctgacccc

SEQ ID NO: 2929726 - DNA, 19 bp, Homo sapiens
ctgagtcatgatctccctg

SEQ ID NO: 2929727 - DNA, 19 bp, Homo sapiens
ctgagtccctccatgcaaa

SEQ ID NO: 2929728 - DNA, 20 bp, Homo sapiens
ctgagtccctggcaagactg

SEQ ID NO: 2929729 - DNA, 13 bp, Homo sapiens
ctgagtcctggcc

SEQ ID NO: 2929730 - DNA, 16 bp, Homo sapiens
ctgagtctccagggcc

SEQ ID NO: 2929731 - DNA, 15 bp, Homo sapiens
ctgagtctggcaaac

SEQ ID NO: 2929732 - DNA, 19 bp, Homo sapiens
ctgagtctggcaaacatgt

SEQ ID NO: 2929733 - DNA, 14 bp, Homo sapiens
ctgagtgacagagc

SEQ ID NO: 2929734 - DNA, 21 bp, Homo sapiens
ctgagtgactctatatagctg

SEQ ID NO: 2929735 - DNA, 17 bp, Homo sapiens
ctgagtgagttcaacta

SEQ ID NO: 2929736 - DNA, 15 bp, Homo sapiens
ctgagtggtgttttt

SEQ ID NO: 2929737 - DNA, 17 bp, Homo sapiens
ctgagtggtgttttttt

SEQ ID NO: 2929738 - DNA, 13 bp, Homo sapiens
ctgagtgtctctg

SEQ ID NO: 2929739 - DNA, 16 bp, Homo sapiens
ctgagttcctagccac

SEQ ID NO: 2929740 - DNA, 21 bp, Homo sapiens
ctgagttggcgttgtgggcag

SEQ ID NO: 2929741 - DNA, 19 bp, Homo sapiens
ctgagtttctatttagaca

SEQ ID NO: 2929742 - DNA, 11 bp, Homo sapiens
ctgagttttcc

SEQ ID NO: 2929743 - DNA, 19 bp, Homo sapiens
ctgagttttccatggcagg

SEQ ID NO: 2929744 - DNA, 20 bp, Homo sapiens
ctgagttttccatggcagga

SEQ ID NO: 2929745 - DNA, 18 bp, Homo sapiens
ctgataccatatgaatga

SEQ ID NO: 2929746 - DNA, 23 bp, Homo sapiens
ctgataccatatgaatgaaacat

SEQ ID NO: 2929747 - DNA, 23 bp, Homo sapiens
ctgatagaaatggtttcctctgg

SEQ ID NO: 2929748 - DNA, 15 bp, Homo sapiens
ctgataggagggggc

SEQ ID NO: 2929749 - DNA, 15 bp, Homo sapiens
ctgatagttactgtt

SEQ ID NO: 2929750 - DNA, 21 bp, Homo sapiens
ctgatagttactgttgtgacc

SEQ ID NO: 2929751 - DNA, 15 bp, Homo sapiens
ctgatatatgtgttt

SEQ ID NO: 2929752 - DNA, 16 bp, Homo sapiens
ctgatcaacaatttgg

SEQ ID NO: 2929753 - DNA, 18 bp, Homo sapiens
ctgatcacccccctgctt

SEQ ID NO: 2929754 - DNA, 19 bp, Homo sapiens
ctgatcaggcttcctggtg

SEQ ID NO: 2929755 - DNA, 18 bp, Homo sapiens
ctgatcccagtttctgct

SEQ ID NO: 2929756 - DNA, 15 bp, Homo sapiens
ctgatccctctacag

SEQ ID NO: 2929757 - DNA, 16 bp, Homo sapiens
ctgatccctggccact

SEQ ID NO: 2929758 - DNA, 12 bp, Homo sapiens
ctgatcctggag

SEQ ID NO: 2929759 - DNA, 17 bp, Homo sapiens
ctgatcctggaggccca

SEQ ID NO: 2929760 - DNA, 20 bp, Homo sapiens
ctgccctgtgccgcactctg

SEQ ID NO: 2929761 - DNA, 17 bp, Homo sapiens
ctgccctgtggacagga

SEQ ID NO: 2929762 - DNA, 20 bp, Homo sapiens
ctgccctgtgggaccccagg

SEQ ID NO: 2929763 - DNA, 16 bp, Homo sapiens
ctgccctgtttctgtt

SEQ ID NO: 2929764 - DNA, 15 bp, Homo sapiens
ctgcccttccgcagt

SEQ ID NO: 2929765 - DNA, 18 bp, Homo sapiens
ctgcccttcttccccttc

SEQ ID NO: 2929766 - DNA, 22 bp, Homo sapiens
ctgcccttttcctgggccttct

SEQ ID NO: 2929767 - DNA, 19 bp, Homo sapiens
ctgccgagacagaccctct

SEQ ID NO: 2929768 - DNA, 14 bp, Homo sapiens
ctgccgcctcccgg

SEQ ID NO: 2929769 - DNA, 13 bp, Homo sapiens
ctgccgctacctc

SEQ ID NO: 2929770 - DNA, 23 bp, Homo sapiens
ctgccggagaggaagagacactc

SEQ ID NO: 2929771 - DNA, 21 bp, Homo sapiens
ctgccggcaggatgcagcgcc

SEQ ID NO: 2929772 - DNA, 16 bp, Homo sapiens
ctgccggccctggggc

SEQ ID NO: 2929773 - DNA, 21 bp, Homo sapiens
ctgccggccctggggctaggc

SEQ ID NO: 2929774 - DNA, 17 bp, Homo sapiens
ctgccggctctggctct

SEQ ID NO: 2929775 - DNA, 18 bp, Homo sapiens
ctgccggtaaacacgcct

SEQ ID NO: 2929776 - DNA, 19 bp, Homo sapiens
ctgccgtcagtgctgtgct

SEQ ID NO: 2929777 - DNA, 22 bp, Homo sapiens
ctgccgtgccgcctgcactcct

SEQ ID NO: 2929778 - DNA, 18 bp, Homo sapiens
ctgcctaagtggctgctg

SEQ ID NO: 2929779 - DNA, 19 bp, Homo sapiens
ctgcctaagtggctgctga

SEQ ID NO: 2929780 - DNA, 14 bp, Homo sapiens
ctgcctactcacga

SEQ ID NO: 2929781 - DNA, 15 bp, Homo sapiens
ctgcctagctcttgg

SEQ ID NO: 2929782 - DNA, 20 bp, Homo sapiens
ctgcctagctcttgggcctg

SEQ ID NO: 2929783 - DNA, 15 bp, Homo sapiens
ctgcctcaactccac

SEQ ID NO: 2929784 - DNA, 21 bp, Homo sapiens
ctgcctcaatgtgaatcagac

SEQ ID NO: 2929785 - DNA, 11 bp, Homo sapiens
ctgcctcagcc

SEQ ID NO: 2929786 - DNA, 18 bp, Homo sapiens
ctgcctcagcctcccaag

SEQ ID NO: 2929787 - DNA, 15 bp, Homo sapiens
ctgcctcatcctcct

SEQ ID NO: 2929788 - DNA, 21 bp, Homo sapiens
ctgcctcatcctcctcctcat

SEQ ID NO: 2929789 - DNA, 12 bp, Homo sapiens
ctgcctcattta

SEQ ID NO: 2929790 - DNA, 15 bp, Homo sapiens
ctgcctccacccaca

SEQ ID NO: 2929791 - DNA, 14 bp, Homo sapiens
ctgcctccagctgt

SEQ ID NO: 2929792 - DNA, 16 bp, Homo sapiens
ctgcctcccactccat

SEQ ID NO: 2929793 - DNA, 13 bp, Homo sapiens
ctgcctcccatgc

SEQ ID NO: 2929794 - DNA, 17 bp, Homo sapiens
ctgcctccccaatccat

SEQ ID NO: 2929795 - DNA, 15 bp, Homo sapiens
ctgcctccctctctt

SEQ ID NO: 2929796 - DNA, 22 bp, Homo sapiens
ctgcctcctcagctttgcttca

SEQ ID NO: 2929797 - DNA, 19 bp, Homo sapiens
ctgcctcctccctggctgc

SEQ ID NO: 2929798 - DNA, 13 bp, Homo sapiens
ctgcctcctggct

SEQ ID NO: 2929799 - DNA, 23 bp, Homo sapiens
ctgcctcgcccccacttttctag

SEQ ID NO: 2929800 - DNA, 21 bp, Homo sapiens
ctgcctctaactccctcctca

SEQ ID NO: 2929801 - DNA, 23 bp, Homo sapiens
ctgcctctaactccctcctcaca

SEQ ID NO: 2929802 - DNA, 14 bp, Homo sapiens
ctgcctctctagga

SEQ ID NO: 2929803 - DNA, 22 bp, Homo sapiens
ctgcctctgacagcagcctgtg

SEQ ID NO: 2929804 - DNA, 14 bp, Homo sapiens
ctgcctctgtgtag

SEQ ID NO: 2929805 - DNA, 21 bp, Homo sapiens
ctgcctctgtgtagccgccct

SEQ ID NO: 2929806 - DNA, 13 bp, Homo sapiens
ctgcctgaataaa

SEQ ID NO: 2929807 - DNA, 23 bp, Homo sapiens
ctgcctgacatttggagtgttcc

SEQ ID NO: 2929808 - DNA, 16 bp, Homo sapiens
ctgcctgcactccctg

SEQ ID NO: 2929809 - DNA, 17 bp, Homo sapiens
ctgcctgcactccctgg

SEQ ID NO: 2929810 - DNA, 18 bp, Homo sapiens
ctgcctgcactccctggc

SEQ ID NO: 2929811 - DNA, 14 bp, Homo sapiens
ctgcctgcagcaca

SEQ ID NO: 2929812 - DNA, 11 bp, Homo sapiens
ctgcctgcagt

SEQ ID NO: 2929813 - DNA, 17 bp, Homo sapiens
ctgcctgccaccctgcc

SEQ ID NO: 2929814 - DNA, 16 bp, Homo sapiens
ctgcctgcccacacag

SEQ ID NO: 2929815 - DNA, 20 bp, Homo sapiens
ctgcctgcgttctccccatg

SEQ ID NO: 2929816 - DNA, 12 bp, Homo sapiens
ctgcctgctggg

SEQ ID NO: 2929817 - DNA, 20 bp, Homo sapiens
ctgcctgctgggctcttaac

SEQ ID NO: 2929818 - DNA, 14 bp, Homo sapiens
ctgcctgctgtgct

SEQ ID NO: 2929819 - DNA, 15 bp, Homo sapiens
ctgcctgctgtgctg

SEQ ID NO: 2929820 - DNA, 13 bp, Homo sapiens
ctgcctgctgtgg

SEQ ID NO: 2929821 - DNA, 16 bp, Homo sapiens
ctgcctgctgtggagc

SEQ ID NO: 2929822 - DNA, 17 bp, Homo sapiens
ctgcctggaccagcctc

SEQ ID NO: 2929823 - DNA, 12 bp, Homo sapiens
ctgcctggagca

SEQ ID NO: 2929824 - DNA, 14 bp, Homo sapiens
ctgcctggagcagg

SEQ ID NO: 2929825 - DNA, 18 bp, Homo sapiens
ctgcctggagcaggggtg

SEQ ID NO: 2929826 - DNA, 16 bp, Homo sapiens
ctgcctggagccccac

SEQ ID NO: 2929827 - DNA, 19 bp, Homo sapiens
ctgcctggagccccactgc

SEQ ID NO: 2929828 - DNA, 12 bp, Homo sapiens
ctgcctggcagg

SEQ ID NO: 2929829 - DNA, 16 bp, Homo sapiens
ctgcctggccaggccc

SEQ ID NO: 2929830 - DNA, 17 bp, Homo sapiens
ctgcctggccaggccct

SEQ ID NO: 2929831 - DNA, 15 bp, Homo sapiens
ctgcctggccatgct

SEQ ID NO: 2929832 - DNA, 16 bp, Homo sapiens
ctgcctggccatgctg

SEQ ID NO: 2929833 - DNA, 19 bp, Homo sapiens
ctgcctggccatgctgtcc

SEQ ID NO: 2929834 - DNA, 21 bp, Homo sapiens
ctgcctggccatgctgtccct

SEQ ID NO: 2929835 - DNA, 12 bp, Homo sapiens
ctgcctggcctt

SEQ ID NO: 2929836 - DNA, 16 bp, Homo sapiens
ctgcctgggtaggccc

SEQ ID NO: 2929837 - DNA, 18 bp, Homo sapiens
ctgcctgggtaggcccca

SEQ ID NO: 2929838 - DNA, 19 bp, Homo sapiens
ctgcctgtaacttgagagt

SEQ ID NO: 2929839 - DNA, 19 bp, Homo sapiens
ctgcctgtagcccactctg

SEQ ID NO: 2929840 - DNA, 21 bp, Homo sapiens
ctgcctgttgcgtgacactct

SEQ ID NO: 2929841 - DNA, 15 bp, Homo sapiens
ctgccttagcttcag

SEQ ID NO: 2929842 - DNA, 16 bp, Homo sapiens
ctgccttagcttcagg

SEQ ID NO: 2929843 - DNA, 18 bp, Homo sapiens
ctgccttagcttcaggaa

SEQ ID NO: 2929844 - DNA, 22 bp, Homo sapiens
ctgccttatctaaatcaccaga

SEQ ID NO: 2929845 - DNA, 11 bp, Homo sapiens
ctgccttccag

SEQ ID NO: 2929846 - DNA, 15 bp, Homo sapiens
ctgccttccagccca

SEQ ID NO: 2929847 - DNA, 16 bp, Homo sapiens
ctgccttccagcccag

SEQ ID NO: 2929848 - DNA, 19 bp, Homo sapiens
ctgccttccagcccagacc

SEQ ID NO: 2929849 - DNA, 16 bp, Homo sapiens
ctgccttcctcctggg

SEQ ID NO: 2929850 - DNA, 20 bp, Homo sapiens
ctgccttcgaggtcagagga

SEQ ID NO: 2929851 - DNA, 18 bp, Homo sapiens
ctgccttcgtttatattt

SEQ ID NO: 2929852 - DNA, 15 bp, Homo sapiens
ctgccttctcaggga

SEQ ID NO: 2929853 - DNA, 21 bp, Homo sapiens
ctgccttgaaatacctgtttc

SEQ ID NO: 2929854 - DNA, 13 bp, Homo sapiens
ctgccttgccttt

SEQ ID NO: 2929855 - DNA, 14 bp, Homo sapiens
ctgccttgccttta

SEQ ID NO: 2929856 - DNA, 14 bp, Homo sapiens
ctgccttgtttgga

SEQ ID NO: 2929857 - DNA, 21 bp, Homo sapiens
ctgcctttgatcacaggagca

SEQ ID NO: 2929858 - DNA, 17 bp, Homo sapiens
ctgcctttgggagcagg

SEQ ID NO: 2929859 - DNA, 19 bp, Homo sapiens
ctgcctttgtggtgggcgc

SEQ ID NO: 2929860 - DNA, 23 bp, Homo sapiens
ctgcctttgtggtgggcgctggg

SEQ ID NO: 2929861 - DNA, 22 bp, Homo sapiens
ctgcgaagtcctatggaaaccc

SEQ ID NO: 2929862 - DNA, 20 bp, Homo sapiens
ctgcgaatgggatcctgatg

SEQ ID NO: 2929863 - DNA, 14 bp, Homo sapiens
ctgcgaccctgggg

SEQ ID NO: 2929864 - DNA, 13 bp, Homo sapiens
ctgcgattttatc

SEQ ID NO: 2929865 - DNA, 12 bp, Homo sapiens
ctgcgccaggca

SEQ ID NO: 2929866 - DNA, 16 bp, Homo sapiens
ctgcgccaggcagagc

SEQ ID NO: 2929867 - DNA, 20 bp, Homo sapiens
ctgcgccaggcagagctgag

SEQ ID NO: 2929868 - DNA, 19 bp, Homo sapiens
ctgcgcccagtccttccac

SEQ ID NO: 2929869 - DNA, 12 bp, Homo sapiens
ctgcgcctcagg

SEQ ID NO: 2929870 - DNA, 14 bp, Homo sapiens
ctgcgcctccatcc

SEQ ID NO: 2929871 - DNA, 19 bp, Homo sapiens
ctgcgcctccatccatctg

SEQ ID NO: 2929872 - DNA, 20 bp, Homo sapiens
ctgcgcctccatccatctgt

SEQ ID NO: 2929873 - DNA, 19 bp, Homo sapiens
ctgcgctgctttttcaaaa

SEQ ID NO: 2929874 - DNA, 15 bp, Homo sapiens
ctgcgcttcctgagc

SEQ ID NO: 2929875 - DNA, 17 bp, Homo sapiens
ctgcgcttcctgagcag

SEQ ID NO: 2929876 - DNA, 20 bp, Homo sapiens
ctgcggagagaggccttgtc

SEQ ID NO: 2929877 - DNA, 17 bp, Homo sapiens
ctgcgggccacagggca

SEQ ID NO: 2929878 - DNA, 14 bp, Homo sapiens
ctgcgggctgaggg

SEQ ID NO: 2929879 - DNA, 22 bp, Homo sapiens
ctgcgggctgggtgtggtctcc

SEQ ID NO: 2929880 - DNA, 16 bp, Homo sapiens
ctgcgggtcctcagct

SEQ ID NO: 2929881 - DNA, 22 bp, Homo sapiens
ctgcgggtgaacaaagcagcca

SEQ ID NO: 2929882 - DNA, 15 bp, Homo sapiens
ctgcggtacaggagt

SEQ ID NO: 2929883 - DNA, 17 bp, Homo sapiens
ctgcggtgggcagccat

SEQ ID NO: 2929884 - DNA, 22 bp, Homo sapiens
ctgcgtaggcgttggtgcgtcc

SEQ ID NO: 2929885 - DNA, 13 bp, Homo sapiens
ctgcgtccaccag

SEQ ID NO: 2929886 - DNA, 14 bp, Homo sapiens
ctgctaaaataaac

SEQ ID NO: 2929887 - DNA, 23 bp, Homo sapiens
ctgctaaataaaatttgttgcat

SEQ ID NO: 2929888 - DNA, 19 bp, Homo sapiens
ctgctaaatgcactgaccc

SEQ ID NO: 2929889 - DNA, 12 bp, Homo sapiens
ctgctacaaaga

SEQ ID NO: 2929890 - DNA, 15 bp, Homo sapiens
ctgctacaaagaaga

SEQ ID NO: 2929891 - DNA, 18 bp, Homo sapiens
ctgctacaaagaagacat

SEQ ID NO: 2929892 - DNA, 16 bp, Homo sapiens
ctgctacacttctgat

SEQ ID NO: 2929893 - DNA, 23 bp, Homo sapiens
ctggctgcagagcagtgggcctg

SEQ ID NO: 2929894 - DNA, 11 bp, Homo sapiens
ctggctgcagc

SEQ ID NO: 2929895 - DNA, 14 bp, Homo sapiens
ctggctgcagcctc

SEQ ID NO: 2929896 - DNA, 17 bp, Homo sapiens
ctggctgcagcctccgg

SEQ ID NO: 2929897 - DNA, 20 bp, Homo sapiens
ctggctgcttgcagccagga

SEQ ID NO: 2929898 - DNA, 19 bp, Homo sapiens
ctggctggagaatgtggag

SEQ ID NO: 2929899 - DNA, 19 bp, Homo sapiens
ctggctggggtggcctgtg

SEQ ID NO: 2929900 - DNA, 20 bp, Homo sapiens
ctggctggggtggcctgtgt

SEQ ID NO: 2929901 - DNA, 21 bp, Homo sapiens
ctggctggggtggcctgtgtg

SEQ ID NO: 2929902 - DNA, 23 bp, Homo sapiens
ctggctggggtggcctgtgtggc

SEQ ID NO: 2929903 - DNA, 16 bp, Homo sapiens
ctggctgtaaggctct

SEQ ID NO: 2929904 - DNA, 17 bp, Homo sapiens
ctggctgtaaggctcta

SEQ ID NO: 2929905 - DNA, 21 bp, Homo sapiens
ctggctgtgaatgccaaagcc

SEQ ID NO: 2929906 - DNA, 18 bp, Homo sapiens
ctggctgtggcctaacct

SEQ ID NO: 2929907 - DNA, 14 bp, Homo sapiens
ctggctgttctgat

SEQ ID NO: 2929908 - DNA, 22 bp, Homo sapiens
ctggcttcaggcaattctcctg

SEQ ID NO: 2929909 - DNA, 20 bp, Homo sapiens
ctggcttgttgtaaagcaat

SEQ ID NO: 2929910 - DNA, 14 bp, Homo sapiens
ctggcttttattaa

SEQ ID NO: 2929911 - DNA, 23 bp, Homo sapiens
ctggcttttattaatgcactttc

SEQ ID NO: 2929912 - DNA, 12 bp, Homo sapiens
ctggcttttctg

SEQ ID NO: 2929913 - DNA, 20 bp, Homo sapiens
ctggcttttctgtttcctgt

SEQ ID NO: 2929914 - DNA, 12 bp, Homo sapiens
ctgggaaacact

SEQ ID NO: 2929915 - DNA, 21 bp, Homo sapiens
ctgggaaacactccttgcatc

SEQ ID NO: 2929916 - DNA, 15 bp, Homo sapiens
ctgggaaacagaggc

SEQ ID NO: 2929917 - DNA, 19 bp, Homo sapiens
ctgggaaagacatccataa

SEQ ID NO: 2929918 - DNA, 18 bp, Homo sapiens
ctgggaaatattccctag

SEQ ID NO: 2929919 - DNA, 16 bp, Homo sapiens
ctgggaaatgagcagg

SEQ ID NO: 2929920 - DNA, 17 bp, Homo sapiens
ctgggaactcatctggt

SEQ ID NO: 2929921 - DNA, 23 bp, Homo sapiens
ctgggaactggttcaagagacac

SEQ ID NO: 2929922 - DNA, 13 bp, Homo sapiens
ctgggaagctgga

SEQ ID NO: 2929923 - DNA, 19 bp, Homo sapiens
ctgggaagctggagtgctg

SEQ ID NO: 2929924 - DNA, 20 bp, Homo sapiens
ctgggaagggagagggcctc

SEQ ID NO: 2929925 - DNA, 15 bp, Homo sapiens
ctgggacagcccagg

SEQ ID NO: 2929926 - DNA, 20 bp, Homo sapiens
ctgggacatcaggagactgg

SEQ ID NO: 2929927 - DNA, 14 bp, Homo sapiens
ctgggaccctttcc

SEQ ID NO: 2929928 - DNA, 19 bp, Homo sapiens
ctgggagaaatctggcttc

SEQ ID NO: 2929929 - DNA, 21 bp, Homo sapiens
ctgggagaaatctggcttctg

SEQ ID NO: 2929930 - DNA, 15 bp, Homo sapiens
ctgggagattcaagg

SEQ ID NO: 2929931 - DNA, 19 bp, Homo sapiens
ctgggagcaagttgcagtc

SEQ ID NO: 2929932 - DNA, 19 bp, Homo sapiens
ctgggaggagggcaggcat

SEQ ID NO: 2929933 - DNA, 14 bp, Homo sapiens
ctgggaggccagtg

SEQ ID NO: 2929934 - DNA, 13 bp, Homo sapiens
ctgggaggctgca

SEQ ID NO: 2929935 - DNA, 21 bp, Homo sapiens
ctgggaggctgcagccaggcc

SEQ ID NO: 2929936 - DNA, 23 bp, Homo sapiens
ctgggaggctgcagccaggcctc

SEQ ID NO: 2929937 - DNA, 13 bp, Homo sapiens
ctgggagggcagc

SEQ ID NO: 2929938 - DNA, 21 bp, Homo sapiens
ctgggaggttggtttaatgca

SEQ ID NO: 2929939 - DNA, 22 bp, Homo sapiens
ctgggagtcacacagtgttgga

SEQ ID NO: 2929940 - DNA, 15 bp, Homo sapiens
ctgggatcccacagc

SEQ ID NO: 2929941 - DNA, 16 bp, Homo sapiens
ctgggatcccacagcc

SEQ ID NO: 2929942 - DNA, 19 bp, Homo sapiens
ctgggatcccacagcccta

SEQ ID NO: 2929943 - DNA, 21 bp, Homo sapiens
ctgggatcccacagccctagt

SEQ ID NO: 2929944 - DNA, 13 bp, Homo sapiens
ctgggatcctaag

SEQ ID NO: 2929945 - DNA, 17 bp, Homo sapiens
ctgggatctgattgagg

SEQ ID NO: 2929946 - DNA, 19 bp, Homo sapiens
ctgggatggtgggcttcag

SEQ ID NO: 2929947 - DNA, 22 bp, Homo sapiens
ctgggatggtgggcttcagggc

SEQ ID NO: 2929948 - DNA, 20 bp, Homo sapiens
ctgggattataggcatgagc

SEQ ID NO: 2929949 - DNA, 22 bp, Homo sapiens
ctgggattttaaactagatgac

SEQ ID NO: 2929950 - DNA, 23 bp, Homo sapiens
ctgggcacacgcctcccactggg

SEQ ID NO: 2929951 - DNA, 13 bp, Homo sapiens
ctgggcacttccc

SEQ ID NO: 2929952 - DNA, 16 bp, Homo sapiens
ctgggcacttccctgc

SEQ ID NO: 2929953 - DNA, 17 bp, Homo sapiens
ctgggcagagcctgtcc

SEQ ID NO: 2929954 - DNA, 12 bp, Homo sapiens
ctgggcagcctt

SEQ ID NO: 2929955 - DNA, 15 bp, Homo sapiens
ctgggcagccttggg

SEQ ID NO: 2929956 - DNA, 13 bp, Homo sapiens
ctgggcaggaggg

SEQ ID NO: 2929957 - DNA, 12 bp, Homo sapiens
ctgggcaggtgg

SEQ ID NO: 2929958 - DNA, 19 bp, Homo sapiens
ctgggcagtgccagccaat

SEQ ID NO: 2929959 - DNA, 13 bp, Homo sapiens
ctgggcagtgccc

SEQ ID NO: 2929960 - DNA, 21 bp, Homo sapiens
ctgggcagtgcccaccatgca

SEQ ID NO: 2929961 - DNA, 13 bp, Homo sapiens
ctgggccatgggt

SEQ ID NO: 2929962 - DNA, 22 bp, Homo sapiens
ctgggccattctccacagcaac

SEQ ID NO: 2929963 - DNA, 17 bp, Homo sapiens
ctgggcccacagccccc

SEQ ID NO: 2929964 - DNA, 21 bp, Homo sapiens
ctgggcccacagcccccaccc

SEQ ID NO: 2929965 - DNA, 22 bp, Homo sapiens
ctgggcccacagcccccacccc

SEQ ID NO: 2929966 - DNA, 16 bp, Homo sapiens
ctgggcccagcagggg

SEQ ID NO: 2929967 - DNA, 23 bp, Homo sapiens
ctgggcccagcaggggccctcac

SEQ ID NO: 2929968 - DNA, 13 bp, Homo sapiens
ctgggcccaggca

SEQ ID NO: 2929969 - DNA, 17 bp, Homo sapiens
ctgggcccaggcaggtc

SEQ ID NO: 2929970 - DNA, 14 bp, Homo sapiens
ctgggcccccagag

SEQ ID NO: 2929971 - DNA, 15 bp, Homo sapiens
ctgggcccccagaga

SEQ ID NO: 2929972 - DNA, 23 bp, Homo sapiens
ctgggcccctcaggggaagctgc

SEQ ID NO: 2929973 - DNA, 12 bp, Homo sapiens
ctgggcccctcc

SEQ ID NO: 2929974 - DNA, 21 bp, Homo sapiens
ctgggcccctcccctcagagc

SEQ ID NO: 2929975 - DNA, 23 bp, Homo sapiens
ctgggcccctcccctcagagccc

SEQ ID NO: 2929976 - DNA, 20 bp, Homo sapiens
ctgggcccgacatggctccg

SEQ ID NO: 2929977 - DNA, 15 bp, Homo sapiens
ctgggccgcaagggc

SEQ ID NO: 2929978 - DNA, 18 bp, Homo sapiens
ctgggccgcgtgccgggc

SEQ ID NO: 2929979 - DNA, 16 bp, Homo sapiens
ctgggccgggcctggg

SEQ ID NO: 2929980 - DNA, 17 bp, Homo sapiens
ctgggccgggcctgggg

SEQ ID NO: 2929981 - DNA, 21 bp, Homo sapiens
ctgggccgttacatctgtgca

SEQ ID NO: 2929982 - DNA, 20 bp, Homo sapiens
ctgggcctcagtgtgcccat

SEQ ID NO: 2929983 - DNA, 19 bp, Homo sapiens
ctgggcctccttcttccac

SEQ ID NO: 2929984 - DNA, 23 bp, Homo sapiens
ctgggccttctcagctctccacc

SEQ ID NO: 2929985 - DNA, 23 bp, Homo sapiens
ctgggcgcttcccttttaagcaa

SEQ ID NO: 2929986 - DNA, 17 bp, Homo sapiens
ctgggcgtctgactccc

SEQ ID NO: 2929987 - DNA, 19 bp, Homo sapiens
ctgggcgtctgactccctc

SEQ ID NO: 2929988 - DNA, 22 bp, Homo sapiens
ctgggctaaggaagtatcagca

SEQ ID NO: 2929989 - DNA, 14 bp, Homo sapiens
ctgggctcctccag

SEQ ID NO: 2929990 - DNA, 12 bp, Homo sapiens
ctgggctctcca

SEQ ID NO: 2929991 - DNA, 13 bp, Homo sapiens
ctgggctctccac

SEQ ID NO: 2929992 - DNA, 14 bp, Homo sapiens
ctgggctctccacc

SEQ ID NO: 2929993 - DNA, 16 bp, Homo sapiens
ctgggctctccacctc

SEQ ID NO: 2929994 - DNA, 18 bp, Homo sapiens
ctgggctctccacctcag

SEQ ID NO: 2929995 - DNA, 19 bp, Homo sapiens
ctgggctctccacctcagc

SEQ ID NO: 2929996 - DNA, 13 bp, Homo sapiens
ctgggctgagaga

SEQ ID NO: 2929997 - DNA, 19 bp, Homo sapiens
ctgggctgagccaaagcca

SEQ ID NO: 2929998 - DNA, 13 bp, Homo sapiens
ctgggctgaggga

SEQ ID NO: 2929999 - DNA, 19 bp, Homo sapiens
ctgggctgagggagcctgg

SEQ ID NO: 2930000 - DNA, 14 bp, Homo sapiens
ctgggctgggcagc

SEQ ID NO: 2930001 - DNA, 16 bp, Homo sapiens
ctgggctgggcagcct

SEQ ID NO: 2930002 - DNA, 17 bp, Homo sapiens
ctgggctgggcagcctt

SEQ ID NO: 2930003 - DNA, 13 bp, Homo sapiens
ctgggctgggttt

SEQ ID NO: 2930004 - DNA, 16 bp, Homo sapiens
ctgggctgggtttgct

SEQ ID NO: 2930005 - DNA, 19 bp, Homo sapiens
ctgggctgggtttgctgtc

SEQ ID NO: 2930006 - DNA, 20 bp, Homo sapiens
ctggggaaaactccaccttc

SEQ ID NO: 2930007 - DNA, 20 bp, Homo sapiens
ctggggaaagacactgcctg

SEQ ID NO: 2930008 - DNA, 22 bp, Homo sapiens
ctggggaaagacactgcctggg

SEQ ID NO: 2930009 - DNA, 22 bp, Homo sapiens
ctggggaaataacagctgtggc

SEQ ID NO: 2930010 - DNA, 13 bp, Homo sapiens
ctggggaaggaag

SEQ ID NO: 2930011 - DNA, 21 bp, Homo sapiens
ctggggaagtacgtcccagcg

SEQ ID NO: 2930012 - DNA, 24 bp, Homo sapiens
ctggggaagtacgtcccagcggcc

SEQ ID NO: 2930013 - DNA, 17 bp, Homo sapiens
ctggggaccggttccca

SEQ ID NO: 2930014 - DNA, 19 bp, Homo sapiens
ctggggaccggttcccaca

SEQ ID NO: 2930015 - DNA, 15 bp, Homo sapiens
ctggggacctggttt

SEQ ID NO: 2930016 - DNA, 19 bp, Homo sapiens
ctggggagaaagaggggcc

SEQ ID NO: 2930017 - DNA, 16 bp, Homo sapiens
ctggggagccaaaggc

SEQ ID NO: 2930018 - DNA, 18 bp, Homo sapiens
ctggggattgggcccctg

SEQ ID NO: 2930019 - DNA, 22 bp, Homo sapiens
ctggggattgggcccctgccag

SEQ ID NO: 2930020 - DNA, 16 bp, Homo sapiens
ctggggccggggctga

SEQ ID NO: 2930021 - DNA, 14 bp, Homo sapiens
ctggggcctgggcc

SEQ ID NO: 2930022 - DNA, 16 bp, Homo sapiens
ctggggctccgaaatt

SEQ ID NO: 2930023 - DNA, 11 bp, Homo sapiens
ctggggctggt

SEQ ID NO: 2930024 - DNA, 17 bp, Homo sapiens
ctggggctggtgaggcc

SEQ ID NO: 2930025 - DNA, 20 bp, Homo sapiens
ctgtgagctcccaggtgcag

SEQ ID NO: 2930026 - DNA, 17 bp, Homo sapiens
ctgtgaggagccccatc

SEQ ID NO: 2930027 - DNA, 15 bp, Homo sapiens
ctgtgaggggcccct

SEQ ID NO: 2930028 - DNA, 22 bp, Homo sapiens
ctgtgaggggcccctggcccag

SEQ ID NO: 2930029 - DNA, 17 bp, Homo sapiens
ctgtgaggtttcccaat

SEQ ID NO: 2930030 - DNA, 21 bp, Homo sapiens
ctgtgagtctttggttctaag

SEQ ID NO: 2930031 - DNA, 21 bp, Homo sapiens
ctgtgatacagaactcttaaa

SEQ ID NO: 2930032 - DNA, 17 bp, Homo sapiens
ctgtgatcttatttttc

SEQ ID NO: 2930033 - DNA, 21 bp, Homo sapiens
ctgtgatgctcccaagcaaag

SEQ ID NO: 2930034 - DNA, 21 bp, Homo sapiens
ctgtgatgttgggaagctatt

SEQ ID NO: 2930035 - DNA, 15 bp, Homo sapiens
ctgtgattactcttt

SEQ ID NO: 2930036 - DNA, 23 bp, Homo sapiens
ctgtgattactctttgctttgta

SEQ ID NO: 2930037 - DNA, 15 bp, Homo sapiens
ctgtgcaaaaaaatt

SEQ ID NO: 2930038 - DNA, 23 bp, Homo sapiens
ctgtgcaattactgcctgcagag

SEQ ID NO: 2930039 - DNA, 18 bp, Homo sapiens
ctgtgcacatctgtgtct

SEQ ID NO: 2930040 - DNA, 19 bp, Homo sapiens
ctgtgcacatctgtgtctt

SEQ ID NO: 2930041 - DNA, 17 bp, Homo sapiens
ctgtgcagggctggttt

SEQ ID NO: 2930042 - DNA, 16 bp, Homo sapiens
ctgtgcatgtatgtct

SEQ ID NO: 2930043 - DNA, 15 bp, Homo sapiens
ctgtgcattgggatt

SEQ ID NO: 2930044 - DNA, 17 bp, Homo sapiens
ctgtgcccaggccagct

SEQ ID NO: 2930045 - DNA, 17 bp, Homo sapiens
ctgtgcccatcatctct

SEQ ID NO: 2930046 - DNA, 22 bp, Homo sapiens
ctgtgcccatcatctctgcctt

SEQ ID NO: 2930047 - DNA, 17 bp, Homo sapiens
ctgtgccccgcgggctt

SEQ ID NO: 2930048 - DNA, 20 bp, Homo sapiens
ctgtgccccttgacaactgg

SEQ ID NO: 2930049 - DNA, 13 bp, Homo sapiens
ctgtgccgcactc

SEQ ID NO: 2930050 - DNA, 18 bp, Homo sapiens
ctgtgcctacatgttctc

SEQ ID NO: 2930051 - DNA, 15 bp, Homo sapiens
ctgtgcctccatcag

SEQ ID NO: 2930052 - DNA, 13 bp, Homo sapiens
ctgtgcctcggct

SEQ ID NO: 2930053 - DNA, 20 bp, Homo sapiens
ctgtgcctctgtcctagact

SEQ ID NO: 2930054 - DNA, 17 bp, Homo sapiens
ctgtgcctgtctgtcca

SEQ ID NO: 2930055 - DNA, 13 bp, Homo sapiens
ctgtgcctttcct

SEQ ID NO: 2930056 - DNA, 19 bp, Homo sapiens
ctgtgcgcgtggcgtggcc

SEQ ID NO: 2930057 - DNA, 14 bp, Homo sapiens
ctgtgcgttccctt

SEQ ID NO: 2930058 - DNA, 17 bp, Homo sapiens
ctgtgctacagagaaaa

SEQ ID NO: 2930059 - DNA, 16 bp, Homo sapiens
ctgtgctacgtgtgaa

SEQ ID NO: 2930060 - DNA, 20 bp, Homo sapiens
ctgtgctacgtgtgaaatct

SEQ ID NO: 2930061 - DNA, 14 bp, Homo sapiens
ctgtgctagctttc

SEQ ID NO: 2930062 - DNA, 15 bp, Homo sapiens
ctgtgctagctttcc

SEQ ID NO: 2930063 - DNA, 15 bp, Homo sapiens
ctgtgctatgaattt

SEQ ID NO: 2930064 - DNA, 21 bp, Homo sapiens
ctgtgctatggtgctctgtct

SEQ ID NO: 2930065 - DNA, 13 bp, Homo sapiens
ctgtgctcagaga

SEQ ID NO: 2930066 - DNA, 12 bp, Homo sapiens
ctgtgctcagga

SEQ ID NO: 2930067 - DNA, 15 bp, Homo sapiens
ctgtgctcaggactc

SEQ ID NO: 2930068 - DNA, 20 bp, Homo sapiens
ctgtgctccaagttgagact

SEQ ID NO: 2930069 - DNA, 22 bp, Homo sapiens
ctgtgctgggtgagctcttcca

SEQ ID NO: 2930070 - DNA, 17 bp, Homo sapiens
ctgtgctgtgtttaatc

SEQ ID NO: 2930071 - DNA, 19 bp, Homo sapiens
ctgtgcttttgatctctgc

SEQ ID NO: 2930072 - DNA, 17 bp, Homo sapiens
ctgtggaaagtgtaaag

SEQ ID NO: 2930073 - DNA, 18 bp, Homo sapiens
ctgtggaaagtgtaaagc

SEQ ID NO: 2930074 - DNA, 20 bp, Homo sapiens
ctgtggaaagtgtaaagcat

SEQ ID NO: 2930075 - DNA, 15 bp, Homo sapiens
ctgtggaagtccctc

SEQ ID NO: 2930076 - DNA, 13 bp, Homo sapiens
ctgtggaatgaag

SEQ ID NO: 2930077 - DNA, 20 bp, Homo sapiens
ctgtggaatgaagcttttta

SEQ ID NO: 2930078 - DNA, 21 bp, Homo sapiens
ctgtggactgaccttgtaaaa

SEQ ID NO: 2930079 - DNA, 14 bp, Homo sapiens
ctgtggagtccagc

SEQ ID NO: 2930080 - DNA, 20 bp, Homo sapiens
ctgtggagtccagctctact

SEQ ID NO: 2930081 - DNA, 19 bp, Homo sapiens
ctgtggagttcctgctccg

SEQ ID NO: 2930082 - DNA, 20 bp, Homo sapiens
ctgtggagttcctgctccgt

SEQ ID NO: 2930083 - DNA, 20 bp, Homo sapiens
ctgtggatgagccctcagaa

SEQ ID NO: 2930084 - DNA, 21 bp, Homo sapiens
ctgtggatgggaggggtcccc

SEQ ID NO: 2930085 - DNA, 20 bp, Homo sapiens
ctgtggattcagcttctgtt

SEQ ID NO: 2930086 - DNA, 21 bp, Homo sapiens
ctgtggattcagcttctgttg

SEQ ID NO: 2930087 - DNA, 21 bp, Homo sapiens
ctgtggcaaacaaaaccaatt

SEQ ID NO: 2930088 - DNA, 15 bp, Homo sapiens
ctgtggcacttgcct

SEQ ID NO: 2930089 - DNA, 16 bp, Homo sapiens
ctgtggcacttgcctg

SEQ ID NO: 2930090 - DNA, 14 bp, Homo sapiens
ctgtggcagctgcc

SEQ ID NO: 2930091 - DNA, 16 bp, Homo sapiens
ctgtggcagctgcccc

SEQ ID NO: 2930092 - DNA, 17 bp, Homo sapiens
ctgtggcagctgcccct

SEQ ID NO: 2930093 - DNA, 22 bp, Homo sapiens
ctgtggcagctgcccctggcac

SEQ ID NO: 2930094 - DNA, 23 bp, Homo sapiens
ctgtggcagctgcccctggcacc

SEQ ID NO: 2930095 - DNA, 22 bp, Homo sapiens
ctgtggcaggaggagctgcctc

SEQ ID NO: 2930096 - DNA, 22 bp, Homo sapiens
ctgtggccacattttcagccaa

SEQ ID NO: 2930097 - DNA, 22 bp, Homo sapiens
ctgtggccatggtccccaagac

SEQ ID NO: 2930098 - DNA, 15 bp, Homo sapiens
ctgtggccgcacgcc

SEQ ID NO: 2930099 - DNA, 21 bp, Homo sapiens
ctgtggccgttatctggaagt

SEQ ID NO: 2930100 - DNA, 15 bp, Homo sapiens
ctgtggcggtgcctg

SEQ ID NO: 2930101 - DNA, 23 bp, Homo sapiens
ctgtggctcacagtggggccagc

SEQ ID NO: 2930102 - DNA, 13 bp, Homo sapiens
ctgtggctccctc

SEQ ID NO: 2930103 - DNA, 14 bp, Homo sapiens
ctgtggctccctct

SEQ ID NO: 2930104 - DNA, 15 bp, Homo sapiens
ctgtggctgtctgga

SEQ ID NO: 2930105 - DNA, 14 bp, Homo sapiens
ctgtgggaaaaaag

SEQ ID NO: 2930106 - DNA, 16 bp, Homo sapiens
ctgtgggaaaaaagaa

SEQ ID NO: 2930107 - DNA, 16 bp, Homo sapiens
ctgtgggaaggccagc

SEQ ID NO: 2930108 - DNA, 20 bp, Homo sapiens
ctgtgggaaggccagctgcc

SEQ ID NO: 2930109 - DNA, 15 bp, Homo sapiens
ctgtgggaccccagg

SEQ ID NO: 2930110 - DNA, 15 bp, Homo sapiens
ctgtgggtctctgga

SEQ ID NO: 2930111 - DNA, 16 bp, Homo sapiens
ctgtgggtgtgtgact

SEQ ID NO: 2930112 - DNA, 23 bp, Homo sapiens
ctgtggtaactttgcaggcggcc

SEQ ID NO: 2930113 - DNA, 17 bp, Homo sapiens
ctgtggtcccacccagg

SEQ ID NO: 2930114 - DNA, 20 bp, Homo sapiens
ctgtggtggcctggtgcaca

SEQ ID NO: 2930115 - DNA, 14 bp, Homo sapiens
ctgtggttgcagtc

SEQ ID NO: 2930116 - DNA, 20 bp, Homo sapiens
ctgtggttgcagtctttccc

SEQ ID NO: 2930117 - DNA, 23 bp, Homo sapiens
ctgtggttgcagtctttccccca

SEQ ID NO: 2930118 - DNA, 13 bp, Homo sapiens
ctgtgtaaagtta

SEQ ID NO: 2930119 - DNA, 23 bp, Homo sapiens
ctgtgtaaatatttttccctccg

SEQ ID NO: 2930120 - DNA, 18 bp, Homo sapiens
ctgtgtaaccttgggtgg

SEQ ID NO: 2930121 - DNA, 15 bp, Homo sapiens
ctgtgtaagctttta

SEQ ID NO: 2930122 - DNA, 15 bp, Homo sapiens
ctgtgtacaaagaaa

SEQ ID NO: 2930123 - DNA, 13 bp, Homo sapiens
ctgtgtagccgcc

SEQ ID NO: 2930124 - DNA, 21 bp, Homo sapiens
ctgtgtagccgccctgagaga

SEQ ID NO: 2930125 - DNA, 17 bp, Homo sapiens
ctgtgtatttatataaa

SEQ ID NO: 2930126 - DNA, 14 bp, Homo sapiens
ctgtgtcacccagg

SEQ ID NO: 2930127 - DNA, 14 bp, Homo sapiens
ctgtgtcagagccc

SEQ ID NO: 2930128 - DNA, 17 bp, Homo sapiens
ctgtgtcagagcccagc

SEQ ID NO: 2930129 - DNA, 19 bp, Homo sapiens
ctgtgtcagcgcctggcct

SEQ ID NO: 2930130 - DNA, 20 bp, Homo sapiens
ctgtgtcattaaccatcttt

SEQ ID NO: 2930131 - DNA, 21 bp, Homo sapiens
ctgtgtccccgatgctgacct

SEQ ID NO: 2930132 - DNA, 22 bp, Homo sapiens
ctgtgtccccgatgctgacctc

SEQ ID NO: 2930133 - DNA, 13 bp, Homo sapiens
ctgtgtcccctga

SEQ ID NO: 2930134 - DNA, 19 bp, Homo sapiens
ctgtgtcccctgacctgtc

SEQ ID NO: 2930135 - DNA, 19 bp, Homo sapiens
ctgtgtccctgctggggtc

SEQ ID NO: 2930136 - DNA, 16 bp, Homo sapiens
ctgtgtccttgcacct

SEQ ID NO: 2930137 - DNA, 17 bp, Homo sapiens
ctgtgtctaagattcta

SEQ ID NO: 2930138 - DNA, 20 bp, Homo sapiens
ctgtgtctaagattctagat

SEQ ID NO: 2930139 - DNA, 12 bp, Homo sapiens
ctgtgtctctgt

SEQ ID NO: 2930140 - DNA, 15 bp, Homo sapiens
ctgtgtctctgtata

SEQ ID NO: 2930141 - DNA, 13 bp, Homo sapiens
ctgtgtctgtcac

SEQ ID NO: 2930142 - DNA, 17 bp, Homo sapiens
ctgtgtgaagaaagcct

SEQ ID NO: 2930143 - DNA, 21 bp, Homo sapiens
ctgtgtgattttcatacaggt

SEQ ID NO: 2930144 - DNA, 22 bp, Homo sapiens
ctgtgtgtccaaaactgcctca

SEQ ID NO: 2930145 - DNA, 18 bp, Homo sapiens
ctgtgtgtcccaggcagg

SEQ ID NO: 2930146 - DNA, 19 bp, Homo sapiens
ctgtgtgtcccaggcaggg

SEQ ID NO: 2930147 - DNA, 23 bp, Homo sapiens
ctgtgtgtcccaggcagggagac

SEQ ID NO: 2930148 - DNA, 17 bp, Homo sapiens
ctgtgtgtgacccctcc

SEQ ID NO: 2930149 - DNA, 21 bp, Homo sapiens
ctgtgtgtgacccctcctggg

SEQ ID NO: 2930150 - DNA, 12 bp, Homo sapiens
ctgtgttacttg

SEQ ID NO: 2930151 - DNA, 13 bp, Homo sapiens
ctgtgttacttga

SEQ ID NO: 2930152 - DNA, 18 bp, Homo sapiens
ctgtgttacttgaagtaa

SEQ ID NO: 2930153 - DNA, 17 bp, Homo sapiens
ctgtgttctcttaagca

SEQ ID NO: 2930154 - DNA, 18 bp, Homo sapiens
ctgtgttgactgctgctc

SEQ ID NO: 2930155 - DNA, 19 bp, Homo sapiens
ctgtgttgactgctgctcc

SEQ ID NO: 2930156 - DNA, 23 bp, Homo sapiens
ctgtgttgttgcttcttgtgaag

SEQ ID NO: 2930157 - DNA, 19 bp, Homo sapiens
cttccagtttctgtaaggt

SEQ ID NO: 2930158 - DNA, 22 bp, Homo sapiens
cttccataatgctactgtctca

SEQ ID NO: 2930159 - DNA, 14 bp, Homo sapiens
cttccatagcctaa

SEQ ID NO: 2930160 - DNA, 16 bp, Homo sapiens
cttccatccaaagaat

SEQ ID NO: 2930161 - DNA, 14 bp, Homo sapiens
cttccatgattcta

SEQ ID NO: 2930162 - DNA, 13 bp, Homo sapiens
cttccatgctccc

SEQ ID NO: 2930163 - DNA, 14 bp, Homo sapiens
cttccatgctccca

SEQ ID NO: 2930164 - DNA, 18 bp, Homo sapiens
cttccatgctcccaactc

SEQ ID NO: 2930165 - DNA, 19 bp, Homo sapiens
cttccatggccctcattaa

SEQ ID NO: 2930166 - DNA, 19 bp, Homo sapiens
cttccatggcttcctgaga

SEQ ID NO: 2930167 - DNA, 15 bp, Homo sapiens
cttccattctttctt

SEQ ID NO: 2930168 - DNA, 17 bp, Homo sapiens
cttccattctttcttcc

SEQ ID NO: 2930169 - DNA, 18 bp, Homo sapiens
cttcccaagaagagagaa

SEQ ID NO: 2930170 - DNA, 18 bp, Homo sapiens
cttcccaaggccttaagc

SEQ ID NO: 2930171 - DNA, 22 bp, Homo sapiens
cttcccaaggttactcagcagc

SEQ ID NO: 2930172 - DNA, 23 bp, Homo sapiens
cttcccaagtaagaggctggagt

SEQ ID NO: 2930173 - DNA, 19 bp, Homo sapiens
cttcccacacctgcctgcg

SEQ ID NO: 2930174 - DNA, 13 bp, Homo sapiens
cttcccaccctgc

SEQ ID NO: 2930175 - DNA, 22 bp, Homo sapiens
cttcccagatttagggtacttt

SEQ ID NO: 2930176 - DNA, 20 bp, Homo sapiens
cttcccagctctccctctgg

SEQ ID NO: 2930177 - DNA, 19 bp, Homo sapiens
cttcccaggatctgctcca

SEQ ID NO: 2930178 - DNA, 18 bp, Homo sapiens
cttcccaggttcaagcga

SEQ ID NO: 2930179 - DNA, 17 bp, Homo sapiens
cttcccatcactggagc

SEQ ID NO: 2930180 - DNA, 19 bp, Homo sapiens
cttccccagacttgcactg

SEQ ID NO: 2930181 - DNA, 18 bp, Homo sapiens
cttccccatcttctaaac

SEQ ID NO: 2930182 - DNA, 16 bp, Homo sapiens
cttcccccaccctggg

SEQ ID NO: 2930183 - DNA, 17 bp, Homo sapiens
cttccccttgtccctgg

SEQ ID NO: 2930184 - DNA, 21 bp, Homo sapiens
cttccccttgtccctggggca

SEQ ID NO: 2930185 - DNA, 16 bp, Homo sapiens
cttccctaacacttac

SEQ ID NO: 2930186 - DNA, 14 bp, Homo sapiens
cttccctgactcat

SEQ ID NO: 2930187 - DNA, 22 bp, Homo sapiens
cttccctgcccctgtgcctctg

SEQ ID NO: 2930188 - DNA, 19 bp, Homo sapiens
cttccctgcctccagctgt

SEQ ID NO: 2930189 - DNA, 17 bp, Homo sapiens
cttccctgtcagcctga

SEQ ID NO: 2930190 - DNA, 13 bp, Homo sapiens
cttcccttccctc

SEQ ID NO: 2930191 - DNA, 14 bp, Homo sapiens
cttccgcagtgtgg

SEQ ID NO: 2930192 - DNA, 17 bp, Homo sapiens
cttccgcatcctagtct

SEQ ID NO: 2930193 - DNA, 18 bp, Homo sapiens
cttccgtcacccttggta

SEQ ID NO: 2930194 - DNA, 23 bp, Homo sapiens
cttccgtcacccttggtagagtt

SEQ ID NO: 2930195 - DNA, 16 bp, Homo sapiens
cttcctaagcctgtgg

SEQ ID NO: 2930196 - DNA, 20 bp, Homo sapiens
cttcctaagcctgtggctgt

SEQ ID NO: 2930197 - DNA, 17 bp, Homo sapiens
cttcctactcctcatag

SEQ ID NO: 2930198 - DNA, 17 bp, Homo sapiens
cttcctagatgtttccc

SEQ ID NO: 2930199 - DNA, 16 bp, Homo sapiens
cttcctagcttatctc

SEQ ID NO: 2930200 - DNA, 18 bp, Homo sapiens
cttcctagcttatctccc

SEQ ID NO: 2930201 - DNA, 21 bp, Homo sapiens
cttcctagcttatctccctgc

SEQ ID NO: 2930202 - DNA, 16 bp, Homo sapiens
cttcctatttctaggg

SEQ ID NO: 2930203 - DNA, 17 bp, Homo sapiens
cttcctatttctagggc

SEQ ID NO: 2930204 - DNA, 16 bp, Homo sapiens
cttcctcaagtcttga

SEQ ID NO: 2930205 - DNA, 13 bp, Homo sapiens
cttcctcactgcc

SEQ ID NO: 2930206 - DNA, 18 bp, Homo sapiens
cttcctcatctgtgcctg

SEQ ID NO: 2930207 - DNA, 11 bp, Homo sapiens
cttcctccaga

SEQ ID NO: 2930208 - DNA, 14 bp, Homo sapiens
cttcctccagagga

SEQ ID NO: 2930209 - DNA, 14 bp, Homo sapiens
cttcctccagtctg

SEQ ID NO: 2930210 - DNA, 21 bp, Homo sapiens
cttcctccagtctgttctcac

SEQ ID NO: 2930211 - DNA, 17 bp, Homo sapiens
cttcctccgaggccagt

SEQ ID NO: 2930212 - DNA, 20 bp, Homo sapiens
cttcctccgaggccagtacc

SEQ ID NO: 2930213 - DNA, 15 bp, Homo sapiens
cttcctcctgggccc

SEQ ID NO: 2930214 - DNA, 15 bp, Homo sapiens
cttcctctcctgtct

SEQ ID NO: 2930215 - DNA, 19 bp, Homo sapiens
cttcctctcctgtctccct

SEQ ID NO: 2930216 - DNA, 15 bp, Homo sapiens
cttcctctccttcct

SEQ ID NO: 2930217 - DNA, 17 bp, Homo sapiens
cttcctctccttccttg

SEQ ID NO: 2930218 - DNA, 15 bp, Homo sapiens
cttcctctctccaga

SEQ ID NO: 2930219 - DNA, 19 bp, Homo sapiens
cttcctgacccggattggc

SEQ ID NO: 2930220 - DNA, 21 bp, Homo sapiens
cttcctgacccggattggccc

SEQ ID NO: 2930221 - DNA, 22 bp, Homo sapiens
cttcctgagaaagcccacctgg

SEQ ID NO: 2930222 - DNA, 18 bp, Homo sapiens
cttcctgcttaaacttga

SEQ ID NO: 2930223 - DNA, 23 bp, Homo sapiens
cttcctgcttaaacttgacccag

SEQ ID NO: 2930224 - DNA, 16 bp, Homo sapiens
cttcctggcccaggcc

SEQ ID NO: 2930225 - DNA, 14 bp, Homo sapiens
cttcctgtccccat

SEQ ID NO: 2930226 - DNA, 10 bp, Homo sapiens
cttcctgtgg

SEQ ID NO: 2930227 - DNA, 13 bp, Homo sapiens
cttcctgtggctc

SEQ ID NO: 2930228 - DNA, 17 bp, Homo sapiens
cttcctgttacctgtct

SEQ ID NO: 2930229 - DNA, 22 bp, Homo sapiens
cttcctgttttaagcagctcta

SEQ ID NO: 2930230 - DNA, 16 bp, Homo sapiens
cttccttcacatctcc

SEQ ID NO: 2930231 - DNA, 14 bp, Homo sapiens
cttccttccctggc

SEQ ID NO: 2930232 - DNA, 17 bp, Homo sapiens
cttccttccctggcttg

SEQ ID NO: 2930233 - DNA, 20 bp, Homo sapiens
cttccttgagacacggagcc

SEQ ID NO: 2930234 - DNA, 12 bp, Homo sapiens
cttccttgcccc

SEQ ID NO: 2930235 - DNA, 13 bp, Homo sapiens
cttccttgctttt

SEQ ID NO: 2930236 - DNA, 13 bp, Homo sapiens
cttccttggcttt

SEQ ID NO: 2930237 - DNA, 17 bp, Homo sapiens
cttccttttatcagtag

SEQ ID NO: 2930238 - DNA, 17 bp, Homo sapiens
cttcctttttttaaatt

SEQ ID NO: 2930239 - DNA, 17 bp, Homo sapiens
cttcgacatgctgccag

SEQ ID NO: 2930240 - DNA, 14 bp, Homo sapiens
cttcgattttaaat

SEQ ID NO: 2930241 - DNA, 16 bp, Homo sapiens
cttcgcatcaaaagac

SEQ ID NO: 2930242 - DNA, 20 bp, Homo sapiens
cttcgcatcaaaagacaatt

SEQ ID NO: 2930243 - DNA, 16 bp, Homo sapiens
cttcggccagagctga

SEQ ID NO: 2930244 - DNA, 14 bp, Homo sapiens
cttcgggaccagga

SEQ ID NO: 2930245 - DNA, 15 bp, Homo sapiens
cttcgggctgtgccc

SEQ ID NO: 2930246 - DNA, 19 bp, Homo sapiens
cttcggggaactcctggaa

SEQ ID NO: 2930247 - DNA, 15 bp, Homo sapiens
cttcgttctttttaa

SEQ ID NO: 2930248 - DNA, 21 bp, Homo sapiens
cttcgtttactatgcctgtgt

SEQ ID NO: 2930249 - DNA, 15 bp, Homo sapiens
cttcgttttctaaag

SEQ ID NO: 2930250 - DNA, 19 bp, Homo sapiens
cttctaaacccaatccaaa

SEQ ID NO: 2930251 - DNA, 20 bp, Homo sapiens
cttctaaactgaagctgctg

SEQ ID NO: 2930252 - DNA, 21 bp, Homo sapiens
cttctaaactgaagctgctgt

SEQ ID NO: 2930253 - DNA, 22 bp, Homo sapiens
cttctaaactgaagctgctgta

SEQ ID NO: 2930254 - DNA, 22 bp, Homo sapiens
cttctaaacttccccatcttct

SEQ ID NO: 2930255 - DNA, 21 bp, Homo sapiens
cttctaaaggtgttgtccctt

SEQ ID NO: 2930256 - DNA, 23 bp, Homo sapiens
cttctaaaggtgttgtcccttct

SEQ ID NO: 2930257 - DNA, 13 bp, Homo sapiens
cttctaaatgagc

SEQ ID NO: 2930258 - DNA, 12 bp, Homo sapiens
cttctaaatgcc

SEQ ID NO: 2930259 - DNA, 18 bp, Homo sapiens
cttctaaatgcccagttc

SEQ ID NO: 2930260 - DNA, 14 bp, Homo sapiens
cttctaatcttaaa

SEQ ID NO: 2930261 - DNA, 16 bp, Homo sapiens
cttctaattttgtgct

SEQ ID NO: 2930262 - DNA, 18 bp, Homo sapiens
cttctaattttgtgctct

SEQ ID NO: 2930263 - DNA, 21 bp, Homo sapiens
cttctaattttgtgctctttc

SEQ ID NO: 2930264 - DNA, 17 bp, Homo sapiens
cttctacggccatgaga

SEQ ID NO: 2930265 - DNA, 21 bp, Homo sapiens
cttctacttctgcccttgcca

SEQ ID NO: 2930266 - DNA, 21 bp, Homo sapiens
cttctagaagataacattttc

SEQ ID NO: 2930267 - DNA, 9 bp, Homo sapiens
cttctagag

SEQ ID NO: 2930268 - DNA, 14 bp, Homo sapiens
cttctagagttcag

SEQ ID NO: 2930269 - DNA, 16 bp, Homo sapiens
cttctagatctcagcc

SEQ ID NO: 2930270 - DNA, 20 bp, Homo sapiens
cttctagatggaccccagca

SEQ ID NO: 2930271 - DNA, 21 bp, Homo sapiens
cttctaggagtcaactggctg

SEQ ID NO: 2930272 - DNA, 18 bp, Homo sapiens
cttctagggtatgggaaa

SEQ ID NO: 2930273 - DNA, 21 bp, Homo sapiens
cttctagggttattgcatttg

SEQ ID NO: 2930274 - DNA, 14 bp, Homo sapiens
cttctaggtaattt

SEQ ID NO: 2930275 - DNA, 20 bp, Homo sapiens
cttctatattttaatagaaa

SEQ ID NO: 2930276 - DNA, 12 bp, Homo sapiens
cttctattttta

SEQ ID NO: 2930277 - DNA, 14 bp, Homo sapiens
cttctcaagttcta

SEQ ID NO: 2930278 - DNA, 17 bp, Homo sapiens
cttctcaagttctaaga

SEQ ID NO: 2930279 - DNA, 21 bp, Homo sapiens
cttctcaagttctaagattct

SEQ ID NO: 2930280 - DNA, 23 bp, Homo sapiens
cttctcaagttctaagattctaa

SEQ ID NO: 2930281 - DNA, 20 bp, Homo sapiens
cttctcacatttatattttt

SEQ ID NO: 2930282 - DNA, 12 bp, Homo sapiens
cttctcaccagc

SEQ ID NO: 2930283 - DNA, 13 bp, Homo sapiens
cttctcaccagct

SEQ ID NO: 2930284 - DNA, 14 bp, Homo sapiens
cttctcaccagctg

SEQ ID NO: 2930285 - DNA, 19 bp, Homo sapiens
cttctcaccagctgcaaag

SEQ ID NO: 2930286 - DNA, 21 bp, Homo sapiens
cttctcaccagctgcaaagtg

SEQ ID NO: 2930287 - DNA, 13 bp, Homo sapiens
cttctcaggctgg

SEQ ID NO: 2930288 - DNA, 16 bp, Homo sapiens
cttctcatcttaaaaa

SEQ ID NO: 2930289 - DNA, 18 bp, Homo sapiens
cttctcatcttaaaaata

SEQ ID NO: 2930290 - DNA, 18 bp, Homo sapiens
cttggcccaggagctctg

SEQ ID NO: 2930291 - DNA, 19 bp, Homo sapiens
cttggcccaggagctctgc

SEQ ID NO: 2930292 - DNA, 22 bp, Homo sapiens
cttggcccaggagctctgcgcc

SEQ ID NO: 2930293 - DNA, 19 bp, Homo sapiens
cttggccggctgtgctcag

SEQ ID NO: 2930294 - DNA, 13 bp, Homo sapiens
cttggcctatctc

SEQ ID NO: 2930295 - DNA, 13 bp, Homo sapiens
cttggctgcagga

SEQ ID NO: 2930296 - DNA, 19 bp, Homo sapiens
cttggcttaatcattttca

SEQ ID NO: 2930297 - DNA, 22 bp, Homo sapiens
cttggctttaaccgtttttcaa

SEQ ID NO: 2930298 - DNA, 17 bp, Homo sapiens
cttggctttcagagttt

SEQ ID NO: 2930299 - DNA, 17 bp, Homo sapiens
cttggctttgaggccga

SEQ ID NO: 2930300 - DNA, 20 bp, Homo sapiens
cttggcttttactgaagcct

SEQ ID NO: 2930301 - DNA, 22 bp, Homo sapiens
cttgggaaaggtggtgtttctg

SEQ ID NO: 2930302 - DNA, 19 bp, Homo sapiens
cttgggaaatatgaatgcc

SEQ ID NO: 2930303 - DNA, 13 bp, Homo sapiens
cttgggagcctga

SEQ ID NO: 2930304 - DNA, 18 bp, Homo sapiens
cttgggagcctgaggcag

SEQ ID NO: 2930305 - DNA, 20 bp, Homo sapiens
cttgggagcctgaggcagga

SEQ ID NO: 2930306 - DNA, 14 bp, Homo sapiens
cttgggcagcatcc

SEQ ID NO: 2930307 - DNA, 13 bp, Homo sapiens
cttgggccacccc

SEQ ID NO: 2930308 - DNA, 17 bp, Homo sapiens
cttgggccacccctcct

SEQ ID NO: 2930309 - DNA, 17 bp, Homo sapiens
cttgggccctggaagag

SEQ ID NO: 2930310 - DNA, 15 bp, Homo sapiens
cttgggcccttccct

SEQ ID NO: 2930311 - DNA, 23 bp, Homo sapiens
cttgggcctgacctccagtcctg

SEQ ID NO: 2930312 - DNA, 12 bp, Homo sapiens
cttgggcctggc

SEQ ID NO: 2930313 - DNA, 15 bp, Homo sapiens
cttgggcctggccag

SEQ ID NO: 2930314 - DNA, 15 bp, Homo sapiens
cttgggctggtcaga

SEQ ID NO: 2930315 - DNA, 16 bp, Homo sapiens
cttgggctggtcagag

SEQ ID NO: 2930316 - DNA, 15 bp, Homo sapiens
cttggggacatctct

SEQ ID NO: 2930317 - DNA, 20 bp, Homo sapiens
cttggggagttaagacctgg

SEQ ID NO: 2930318 - DNA, 23 bp, Homo sapiens
cttggggagttaagacctggcag

SEQ ID NO: 2930319 - DNA, 14 bp, Homo sapiens
cttggggcaggcag

SEQ ID NO: 2930320 - DNA, 18 bp, Homo sapiens
cttggggcatgacccagt

SEQ ID NO: 2930321 - DNA, 15 bp, Homo sapiens
cttggggcccagtgc

SEQ ID NO: 2930322 - DNA, 16 bp, Homo sapiens
cttggggcccagtgca

SEQ ID NO: 2930323 - DNA, 12 bp, Homo sapiens
cttggggtggcg

SEQ ID NO: 2930324 - DNA, 21 bp, Homo sapiens
cttggggtggcgcgcctgcct

SEQ ID NO: 2930325 - DNA, 22 bp, Homo sapiens
cttggggtggcgcgcctgcctt

SEQ ID NO: 2930326 - DNA, 14 bp, Homo sapiens
cttggggtgggggc

SEQ ID NO: 2930327 - DNA, 21 bp, Homo sapiens
cttggggtgggggccaggcct

SEQ ID NO: 2930328 - DNA, 19 bp, Homo sapiens
cttggggttcataggggca

SEQ ID NO: 2930329 - DNA, 14 bp, Homo sapiens
cttgggtcagagaa

SEQ ID NO: 2930330 - DNA, 17 bp, Homo sapiens
cttggtagagtttattt

SEQ ID NO: 2930331 - DNA, 15 bp, Homo sapiens
cttggtatgtgccag

SEQ ID NO: 2930332 - DNA, 16 bp, Homo sapiens
cttggtatgtgccagg

SEQ ID NO: 2930333 - DNA, 14 bp, Homo sapiens
cttggtcacataca

SEQ ID NO: 2930334 - DNA, 17 bp, Homo sapiens
cttggtctctccttcct

SEQ ID NO: 2930335 - DNA, 19 bp, Homo sapiens
cttggtctctccttcctct

SEQ ID NO: 2930336 - DNA, 14 bp, Homo sapiens
cttggtgctgggaa

SEQ ID NO: 2930337 - DNA, 17 bp, Homo sapiens
cttggtgctggtttatt

SEQ ID NO: 2930338 - DNA, 15 bp, Homo sapiens
cttggtgtccacctg

SEQ ID NO: 2930339 - DNA, 17 bp, Homo sapiens
cttggtgttaaaacact

SEQ ID NO: 2930340 - DNA, 19 bp, Homo sapiens
cttggttccagcctgccac

SEQ ID NO: 2930341 - DNA, 20 bp, Homo sapiens
cttggttccagcctgccact

SEQ ID NO: 2930342 - DNA, 13 bp, Homo sapiens
cttggttccccca

SEQ ID NO: 2930343 - DNA, 20 bp, Homo sapiens
cttggttggacctattgcca

SEQ ID NO: 2930344 - DNA, 17 bp, Homo sapiens
cttggtttccaaaggca

SEQ ID NO: 2930345 - DNA, 13 bp, Homo sapiens
cttggtttctggg

SEQ ID NO: 2930346 - DNA, 12 bp, Homo sapiens
cttgtaaataaa

SEQ ID NO: 2930347 - DNA, 16 bp, Homo sapiens
cttgtaaataaagccc

SEQ ID NO: 2930348 - DNA, 17 bp, Homo sapiens
cttgtaaataaagccct

SEQ ID NO: 2930349 - DNA, 19 bp, Homo sapiens
cttgtaaataaagccctgg

SEQ ID NO: 2930350 - DNA, 14 bp, Homo sapiens
cttgtaaataaagt

SEQ ID NO: 2930351 - DNA, 20 bp, Homo sapiens
cttgtaaataaagtctattt

SEQ ID NO: 2930352 - DNA, 22 bp, Homo sapiens
cttgtaaataaagtctattttt

SEQ ID NO: 2930353 - DNA, 15 bp, Homo sapiens
cttgtaaggctttga

SEQ ID NO: 2930354 - DNA, 14 bp, Homo sapiens
cttgtaatatttct

SEQ ID NO: 2930355 - DNA, 15 bp, Homo sapiens
cttgtaatatttctt

SEQ ID NO: 2930356 - DNA, 22 bp, Homo sapiens
cttgtaatttttttaatttaca

SEQ ID NO: 2930357 - DNA, 19 bp, Homo sapiens
cttgtacatgtgtagcctg

SEQ ID NO: 2930358 - DNA, 20 bp, Homo sapiens
cttgtacatgtgtagcctgt

SEQ ID NO: 2930359 - DNA, 24 bp, Homo sapiens
cttgtactaagccaggaggcttta

SEQ ID NO: 2930360 - DNA, 17 bp, Homo sapiens
cttgtaggaatctgcct

SEQ ID NO: 2930361 - DNA, 21 bp, Homo sapiens
cttgtataacatcactgtcaa

SEQ ID NO: 2930362 - DNA, 18 bp, Homo sapiens
cttgtattgctccatttt

SEQ ID NO: 2930363 - DNA, 13 bp, Homo sapiens
cttgtcaaagaag

SEQ ID NO: 2930364 - DNA, 19 bp, Homo sapiens
cttgtcaagcctgtgcaaa

SEQ ID NO: 2930365 - DNA, 18 bp, Homo sapiens
cttgtcacccaaagcctg

SEQ ID NO: 2930366 - DNA, 22 bp, Homo sapiens
cttgtcacgaattccatcttgt

SEQ ID NO: 2930367 - DNA, 23 bp, Homo sapiens
cttgtcacgccagacttcccacg

SEQ ID NO: 2930368 - DNA, 11 bp, Homo sapiens
cttgtcacttg

SEQ ID NO: 2930369 - DNA, 13 bp, Homo sapiens
cttgtcacttgca

SEQ ID NO: 2930370 - DNA, 16 bp, Homo sapiens
cttgtcacttgcatgt

SEQ ID NO: 2930371 - DNA, 23 bp, Homo sapiens
cttgtcatcagtaagtataacaa

SEQ ID NO: 2930372 - DNA, 20 bp, Homo sapiens
cttgtcattttacaagcatt

SEQ ID NO: 2930373 - DNA, 18 bp, Homo sapiens
cttgtccagcgcctagtg

SEQ ID NO: 2930374 - DNA, 22 bp, Homo sapiens
cttgtccagttcaaataagaaa

SEQ ID NO: 2930375 - DNA, 21 bp, Homo sapiens
cttgtcccaaatccgccagtg

SEQ ID NO: 2930376 - DNA, 18 bp, Homo sapiens
cttgtcccactcaagcca

SEQ ID NO: 2930377 - DNA, 21 bp, Homo sapiens
cttgtcccactcaagccaagc

SEQ ID NO: 2930378 - DNA, 15 bp, Homo sapiens
cttgtcccagaggct

SEQ ID NO: 2930379 - DNA, 12 bp, Homo sapiens
cttgtccctggg

SEQ ID NO: 2930380 - DNA, 17 bp, Homo sapiens
cttgtccctggggcact

SEQ ID NO: 2930381 - DNA, 23 bp, Homo sapiens
cttgtccctggggcactccccca

SEQ ID NO: 2930382 - DNA, 16 bp, Homo sapiens
cttgtcttagctctgg

SEQ ID NO: 2930383 - DNA, 17 bp, Homo sapiens
cttgtcttagctctgga

SEQ ID NO: 2930384 - DNA, 15 bp, Homo sapiens
cttgtcttttcccct

SEQ ID NO: 2930385 - DNA, 18 bp, Homo sapiens
cttgtcttttcccctcat

SEQ ID NO: 2930386 - DNA, 14 bp, Homo sapiens
cttgtgaaaatgtg

SEQ ID NO: 2930387 - DNA, 16 bp, Homo sapiens
cttgtgaaaatgtgtt

SEQ ID NO: 2930388 - DNA, 15 bp, Homo sapiens
cttgtgaagttgttt

SEQ ID NO: 2930389 - DNA, 22 bp, Homo sapiens
cttgtgacagctctttttgtga

SEQ ID NO: 2930390 - DNA, 15 bp, Homo sapiens
cttgtgagcatcaga

SEQ ID NO: 2930391 - DNA, 21 bp, Homo sapiens
cttgtgagcatcagagggctg

SEQ ID NO: 2930392 - DNA, 18 bp, Homo sapiens
cttgtgcctcccttccca

SEQ ID NO: 2930393 - DNA, 13 bp, Homo sapiens
cttgtgctcagtc

SEQ ID NO: 2930394 - DNA, 22 bp, Homo sapiens
cttgtggatgttttaattccat

SEQ ID NO: 2930395 - DNA, 15 bp, Homo sapiens
cttgtgggtcctggg

SEQ ID NO: 2930396 - DNA, 16 bp, Homo sapiens
cttgtgggtcctgggg

SEQ ID NO: 2930397 - DNA, 21 bp, Homo sapiens
cttgtggtctcgatgctgctg

SEQ ID NO: 2930398 - DNA, 16 bp, Homo sapiens
cttgtgtaatttatgt

SEQ ID NO: 2930399 - DNA, 14 bp, Homo sapiens
cttgtgtctgtaca

SEQ ID NO: 2930400 - DNA, 18 bp, Homo sapiens
cttgtgtctgtacacgtg

SEQ ID NO: 2930401 - DNA, 14 bp, Homo sapiens
cttgtgtgtcaggc

SEQ ID NO: 2930402 - DNA, 20 bp, Homo sapiens
cttgtgtgtcaggccctctg

SEQ ID NO: 2930403 - DNA, 17 bp, Homo sapiens
cttgtgttacttgccaa

SEQ ID NO: 2930404 - DNA, 12 bp, Homo sapiens
cttgtgttcctt

SEQ ID NO: 2930405 - DNA, 18 bp, Homo sapiens
cttgtgttccttctgtga

SEQ ID NO: 2930406 - DNA, 19 bp, Homo sapiens
cttgtgttccttctgtgaa

SEQ ID NO: 2930407 - DNA, 20 bp, Homo sapiens
cttgtgttccttctgtgaag

SEQ ID NO: 2930408 - DNA, 18 bp, Homo sapiens
cttgttacccatgaaaaa

SEQ ID NO: 2930409 - DNA, 14 bp, Homo sapiens
cttgttattattgt

SEQ ID NO: 2930410 - DNA, 16 bp, Homo sapiens
cttgttattattgtta

SEQ ID NO: 2930411 - DNA, 22 bp, Homo sapiens
cttgttattattgttaataata

SEQ ID NO: 2930412 - DNA, 13 bp, Homo sapiens
cttgttcatttct

SEQ ID NO: 2930413 - DNA, 17 bp, Homo sapiens
cttgttcatttctgtct

SEQ ID NO: 2930414 - DNA, 16 bp, Homo sapiens
cttgttccaaggccag

SEQ ID NO: 2930415 - DNA, 17 bp, Homo sapiens
cttgttctgtcactcag

SEQ ID NO: 2930416 - DNA, 12 bp, Homo sapiens
cttgttgctttg

SEQ ID NO: 2930417 - DNA, 16 bp, Homo sapiens
cttgttgtaaagcaat

SEQ ID NO: 2930418 - DNA, 23 bp, Homo sapiens
cttgttgtacccttgttttgaaa

SEQ ID NO: 2930419 - DNA, 15 bp, Homo sapiens
cttgttgtgctttta

SEQ ID NO: 2930420 - DNA, 18 bp, Homo sapiens
cttgttgtttatatgaaa

SEQ ID NO: 2930421 - DNA, 22 bp, Homo sapiens
cttgttgtttgttgacagcttg

SEQ ID NO: 2930422 - DNA, 11 bp, Homo sapiens
ctttttattgc

SEQ ID NO: 2930423 - DNA, 12 bp, Homo sapiens
ctttttatttat

SEQ ID NO: 2930424 - DNA, 13 bp, Homo sapiens
ctttttatttata

SEQ ID NO: 2930425 - DNA, 13 bp, Homo sapiens
ctttttatttctg

SEQ ID NO: 2930426 - DNA, 17 bp, Homo sapiens
ctttttcaacttggaaa

SEQ ID NO: 2930427 - DNA, 23 bp, Homo sapiens
ctttttcaacttggaaaaagaaa

SEQ ID NO: 2930428 - DNA, 20 bp, Homo sapiens
ctttttcagaggtgaattaa

SEQ ID NO: 2930429 - DNA, 14 bp, Homo sapiens
ctttttcatagtaa

SEQ ID NO: 2930430 - DNA, 13 bp, Homo sapiens
ctttttcctgaaa

SEQ ID NO: 2930431 - DNA, 17 bp, Homo sapiens
ctttttccttatttcaa

SEQ ID NO: 2930432 - DNA, 16 bp, Homo sapiens
ctttttccttcctgag

SEQ ID NO: 2930433 - DNA, 14 bp, Homo sapiens
ctttttctctgtat

SEQ ID NO: 2930434 - DNA, 22 bp, Homo sapiens
ctttttcttcacttacaagaaa

SEQ ID NO: 2930435 - DNA, 22 bp, Homo sapiens
ctttttcttgatcttaaagatc

SEQ ID NO: 2930436 - DNA, 23 bp, Homo sapiens
ctttttcttgtcattaacacatt

SEQ ID NO: 2930437 - DNA, 11 bp, Homo sapiens
ctttttgagta

SEQ ID NO: 2930438 - DNA, 21 bp, Homo sapiens
ctttttgagtaattttctgat

SEQ ID NO: 2930439 - DNA, 22 bp, Homo sapiens
ctttttgcaggggactgggcca

SEQ ID NO: 2930440 - DNA, 23 bp, Homo sapiens
ctttttgcaggggactgggccat

SEQ ID NO: 2930441 - DNA, 19 bp, Homo sapiens
ctttttgtaagtgagtgtg

SEQ ID NO: 2930442 - DNA, 22 bp, Homo sapiens
ctttttgtataaatgacaaagt

SEQ ID NO: 2930443 - DNA, 13 bp, Homo sapiens
ctttttgtgaaga

SEQ ID NO: 2930444 - DNA, 18 bp, Homo sapiens
ctttttgtgaagttaggt

SEQ ID NO: 2930445 - DNA, 20 bp, Homo sapiens
ctttttgttccagagctgct

SEQ ID NO: 2930446 - DNA, 17 bp, Homo sapiens
cttttttaaatattttc

SEQ ID NO: 2930447 - DNA, 21 bp, Homo sapiens
cttttttaaggctctgtgcct

SEQ ID NO: 2930448 - DNA, 15 bp, Homo sapiens
cttttttagaaaact

SEQ ID NO: 2930449 - DNA, 18 bp, Homo sapiens
cttttttcaggatgctat

SEQ ID NO: 2930450 - DNA, 16 bp, Homo sapiens
cttttttcctcctttc

SEQ ID NO: 2930451 - DNA, 21 bp, Homo sapiens
cttttttcctcctttctctgt

SEQ ID NO: 2930452 - DNA, 11 bp, Homo sapiens
cttttttctct

SEQ ID NO: 2930453 - DNA, 16 bp, Homo sapiens
cttttttctcttctgt

SEQ ID NO: 2930454 - DNA, 23 bp, Homo sapiens
cttttttcttaaagcaaagtcac

SEQ ID NO: 2930455 - DNA, 13 bp, Homo sapiens
cttttttgtacag

SEQ ID NO: 2930456 - DNA, 16 bp, Homo sapiens
cttttttgttttttca

SEQ ID NO: 2930457 - DNA, 14 bp, Homo sapiens
ctttttttaaattt

SEQ ID NO: 2930458 - DNA, 20 bp, Homo sapiens
ctttttttaaattttctcca

SEQ ID NO: 2930459 - DNA, 17 bp, Homo sapiens
cttttttttaatgtgct

SEQ ID NO: 2930460 - DNA, 18 bp, Homo sapiens
cttttttttaatgtgctg

SEQ ID NO: 2930461 - DNA, 15 bp, Homo sapiens
cttttttttcatcct

SEQ ID NO: 2930462 - DNA, 15 bp, Homo sapiens
cttttttttgtatgt

SEQ ID NO: 2930463 - DNA, 23 bp, Homo sapiens
ctttttttttttttaaagacaga

SEQ ID NO: 2930464 - DNA, 18 bp, Homo sapiens
gaaaaaaaaaaaagagga

SEQ ID NO: 2930465 - DNA, 15 bp, Homo sapiens
gaaaaaaaaatgcca

SEQ ID NO: 2930466 - DNA, 22 bp, Homo sapiens
gaaaaaaaaatgccataataca

SEQ ID NO: 2930467 - DNA, 17 bp, Homo sapiens
gaaaaaaaatagatgtt

SEQ ID NO: 2930468 - DNA, 19 bp, Homo sapiens
gaaaaaaaatagatgtttt

SEQ ID NO: 2930469 - DNA, 18 bp, Homo sapiens
gaaaaaaacataaaaagc

SEQ ID NO: 2930470 - DNA, 22 bp, Homo sapiens
gaaaaaaagaatgagtaatgtg

SEQ ID NO: 2930471 - DNA, 14 bp, Homo sapiens
gaaaaaaagcatgt

SEQ ID NO: 2930472 - DNA, 18 bp, Homo sapiens
gaaaaaaagtttgccaga

SEQ ID NO: 2930473 - DNA, 17 bp, Homo sapiens
gaaaaaaataaataaaa

SEQ ID NO: 2930474 - DNA, 18 bp, Homo sapiens
gaaaaaaataattttaaa

SEQ ID NO: 2930475 - DNA, 21 bp, Homo sapiens
gaaaaaaatgttgtttcctaa

SEQ ID NO: 2930476 - DNA, 20 bp, Homo sapiens
gaaaaaaccgttcaaattct

SEQ ID NO: 2930477 - DNA, 14 bp, Homo sapiens
gaaaaaagattttt

SEQ ID NO: 2930478 - DNA, 20 bp, Homo sapiens
gaaaaaagggtttatgctta

SEQ ID NO: 2930479 - DNA, 15 bp, Homo sapiens
gaaaaacaacaaata

SEQ ID NO: 2930480 - DNA, 19 bp, Homo sapiens
gaaaaacaacaaataattt

SEQ ID NO: 2930481 - DNA, 17 bp, Homo sapiens
gaaaaacctgctccctt

SEQ ID NO: 2930482 - DNA, 21 bp, Homo sapiens
gaaaaagaacatgcagtttga

SEQ ID NO: 2930483 - DNA, 23 bp, Homo sapiens
gaaaaagaacatgcagtttgaaa

SEQ ID NO: 2930484 - DNA, 22 bp, Homo sapiens
gaaaaagaatcggcagtatttt

SEQ ID NO: 2930485 - DNA, 12 bp, Homo sapiens
gaaaaagcatga

SEQ ID NO: 2930486 - DNA, 19 bp, Homo sapiens
gaaaaagcatgatgggaaa

SEQ ID NO: 2930487 - DNA, 20 bp, Homo sapiens
gaaaaagcatgatgggaaaa

SEQ ID NO: 2930488 - DNA, 15 bp, Homo sapiens
gaaaaagccatatca

SEQ ID NO: 2930489 - DNA, 16 bp, Homo sapiens
gaaaaagtcagctaca

SEQ ID NO: 2930490 - DNA, 20 bp, Homo sapiens
gaaaaagttaatgcttaaga

SEQ ID NO: 2930491 - DNA, 12 bp, Homo sapiens
gaaaaataaata

SEQ ID NO: 2930492 - DNA, 13 bp, Homo sapiens
gaaaaataatcaa

SEQ ID NO: 2930493 - DNA, 18 bp, Homo sapiens
gaaaaatgaaagatgatt

SEQ ID NO: 2930494 - DNA, 20 bp, Homo sapiens
gaaaaatgggagacagcctc

SEQ ID NO: 2930495 - DNA, 12 bp, Homo sapiens
gaaaaattatag

SEQ ID NO: 2930496 - DNA, 14 bp, Homo sapiens
gaaaacaaggaagt

SEQ ID NO: 2930497 - DNA, 22 bp, Homo sapiens
gaaaacaataacgataaaagac

SEQ ID NO: 2930498 - DNA, 17 bp, Homo sapiens
gaaaacactcaaaatga

SEQ ID NO: 2930499 - DNA, 14 bp, Homo sapiens
gaaaacactgtgca

SEQ ID NO: 2930500 - DNA, 12 bp, Homo sapiens
gaaaacagatat

SEQ ID NO: 2930501 - DNA, 19 bp, Homo sapiens
gaaaacatcactgaaatgc

SEQ ID NO: 2930502 - DNA, 13 bp, Homo sapiens
gaaaaccacttta

SEQ ID NO: 2930503 - DNA, 14 bp, Homo sapiens
gaaaaccactttat

SEQ ID NO: 2930504 - DNA, 16 bp, Homo sapiens
gaaaaccatcacatga

SEQ ID NO: 2930505 - DNA, 19 bp, Homo sapiens
gaaaacccaagtttttaat

SEQ ID NO: 2930506 - DNA, 11 bp, Homo sapiens
gaaaacccctg

SEQ ID NO: 2930507 - DNA, 9 bp, Homo sapiens
gaaaactca

SEQ ID NO: 2930508 - DNA, 20 bp, Homo sapiens
gaaaactcaaagaatgtgta

SEQ ID NO: 2930509 - DNA, 16 bp, Homo sapiens
gaaaactgcacaataa

SEQ ID NO: 2930510 - DNA, 15 bp, Homo sapiens
gaaaacttttctcag

SEQ ID NO: 2930511 - DNA, 14 bp, Homo sapiens
gaaaagaaataata

SEQ ID NO: 2930512 - DNA, 13 bp, Homo sapiens
gaaaagagaaaaa

SEQ ID NO: 2930513 - DNA, 18 bp, Homo sapiens
gaaaagagagcagagaat

SEQ ID NO: 2930514 - DNA, 14 bp, Homo sapiens
gaaaagagctggga

SEQ ID NO: 2930515 - DNA, 17 bp, Homo sapiens
gaaaagcacaagaaact

SEQ ID NO: 2930516 - DNA, 16 bp, Homo sapiens
gaaaagcacctgccga

SEQ ID NO: 2930517 - DNA, 17 bp, Homo sapiens
gaaaagcacctgccgac

SEQ ID NO: 2930518 - DNA, 21 bp, Homo sapiens
gaaaagcagatggacttgaaa

SEQ ID NO: 2930519 - DNA, 22 bp, Homo sapiens
gaaaagcagatggacttgaaaa

SEQ ID NO: 2930520 - DNA, 14 bp, Homo sapiens
gaaaagcagctctc

SEQ ID NO: 2930521 - DNA, 17 bp, Homo sapiens
gaaaagcatctgccaca

SEQ ID NO: 2930522 - DNA, 14 bp, Homo sapiens
gaaaagcctcagct

SEQ ID NO: 2930523 - DNA, 20 bp, Homo sapiens
gaaaagcggacatcagctgg

SEQ ID NO: 2930524 - DNA, 17 bp, Homo sapiens
gaaaagcgtctttaaga

SEQ ID NO: 2930525 - DNA, 23 bp, Homo sapiens
gaaaagcgtctttaagagactca

SEQ ID NO: 2930526 - DNA, 21 bp, Homo sapiens
gaaaaggatattatctacctg

SEQ ID NO: 2930527 - DNA, 21 bp, Homo sapiens
gaaaagggtcttgggaaatat

SEQ ID NO: 2930528 - DNA, 12 bp, Homo sapiens
gaaaagttattt

SEQ ID NO: 2930529 - DNA, 14 bp, Homo sapiens
gaaaagttatttat

SEQ ID NO: 2930530 - DNA, 12 bp, Homo sapiens
gaaaataaaaag

SEQ ID NO: 2930531 - DNA, 16 bp, Homo sapiens
gaaaataaaaagttaa

SEQ ID NO: 2930532 - DNA, 17 bp, Homo sapiens
gaaaataaaaagttaaa

SEQ ID NO: 2930533 - DNA, 19 bp, Homo sapiens
gaaaataacaataaaagac

SEQ ID NO: 2930534 - DNA, 19 bp, Homo sapiens
gaaaataacgataaaagac

SEQ ID NO: 2930535 - DNA, 19 bp, Homo sapiens
gaaaataactgaaccaaat

SEQ ID NO: 2930536 - DNA, 20 bp, Homo sapiens
gaaaataactgaaccaaatt

SEQ ID NO: 2930537 - DNA, 23 bp, Homo sapiens
gaaaataactgaaccaaattgca

SEQ ID NO: 2930538 - DNA, 22 bp, Homo sapiens
gaaaataatctggtgttcttgc

SEQ ID NO: 2930539 - DNA, 18 bp, Homo sapiens
gaaaataatgtaattgta

SEQ ID NO: 2930540 - DNA, 13 bp, Homo sapiens
gaaaataattgtt

SEQ ID NO: 2930541 - DNA, 19 bp, Homo sapiens
gaaaataggcaggaagccc

SEQ ID NO: 2930542 - DNA, 14 bp, Homo sapiens
gaaaatatactgta

SEQ ID NO: 2930543 - DNA, 18 bp, Homo sapiens
gaaaatatactgtaaaga

SEQ ID NO: 2930544 - DNA, 21 bp, Homo sapiens
gaaaatatactgtaaagaaag

SEQ ID NO: 2930545 - DNA, 23 bp, Homo sapiens
gaaaatatactgtaaagaaagag

SEQ ID NO: 2930546 - DNA, 17 bp, Homo sapiens
gaaaatatatgtatttt

SEQ ID NO: 2930547 - DNA, 22 bp, Homo sapiens
gaaaatatatgtatttttatat

SEQ ID NO: 2930548 - DNA, 13 bp, Homo sapiens
gaaaatcaaagca

SEQ ID NO: 2930549 - DNA, 19 bp, Homo sapiens
gaaaatcaaatacatactt

SEQ ID NO: 2930550 - DNA, 14 bp, Homo sapiens
gaaaatcacttgaa

SEQ ID NO: 2930551 - DNA, 15 bp, Homo sapiens
gaaaatcctctggct

SEQ ID NO: 2930552 - DNA, 19 bp, Homo sapiens
gaaaatcttataatttaaa

SEQ ID NO: 2930553 - DNA, 15 bp, Homo sapiens
gaaaatgaagaagga

SEQ ID NO: 2930554 - DNA, 17 bp, Homo sapiens
gaaaatgaagaaggaag

SEQ ID NO: 2930555 - DNA, 18 bp, Homo sapiens
gagcccgtgccaccccca

SEQ ID NO: 2930556 - DNA, 15 bp, Homo sapiens
gagccctcagaaccc

SEQ ID NO: 2930557 - DNA, 12 bp, Homo sapiens
gagccctcccca

SEQ ID NO: 2930558 - DNA, 15 bp, Homo sapiens
gagccctccgccttc

SEQ ID NO: 2930559 - DNA, 17 bp, Homo sapiens
gagccctccgccttcac

SEQ ID NO: 2930560 - DNA, 16 bp, Homo sapiens
gagccctctagggcag

SEQ ID NO: 2930561 - DNA, 20 bp, Homo sapiens
gagccctgctatgaaaggaa

SEQ ID NO: 2930562 - DNA, 18 bp, Homo sapiens
gagccctgtggatgagcc

SEQ ID NO: 2930563 - DNA, 18 bp, Homo sapiens
gagccctgttcctccctc

SEQ ID NO: 2930564 - DNA, 12 bp, Homo sapiens
gagcccttagcc

SEQ ID NO: 2930565 - DNA, 23 bp, Homo sapiens
gagcccttagccttgctgtagag

SEQ ID NO: 2930566 - DNA, 14 bp, Homo sapiens
gagccgctggcaga

SEQ ID NO: 2930567 - DNA, 19 bp, Homo sapiens
gagccgctggcagaaggga

SEQ ID NO: 2930568 - DNA, 14 bp, Homo sapiens
gagccggcatcctt

SEQ ID NO: 2930569 - DNA, 19 bp, Homo sapiens
gagccggcatccttgcctg

SEQ ID NO: 2930570 - DNA, 20 bp, Homo sapiens
gagccgggtctgcctcttct

SEQ ID NO: 2930571 - DNA, 13 bp, Homo sapiens
gagccgtggtcct

SEQ ID NO: 2930572 - DNA, 17 bp, Homo sapiens
gagcctacccaccccca

SEQ ID NO: 2930573 - DNA, 15 bp, Homo sapiens
gagcctagaagctgg

SEQ ID NO: 2930574 - DNA, 15 bp, Homo sapiens
gagcctcagaagaaa

SEQ ID NO: 2930575 - DNA, 15 bp, Homo sapiens
gagcctgcagagctg

SEQ ID NO: 2930576 - DNA, 18 bp, Homo sapiens
gagcctgctcccccaccc

SEQ ID NO: 2930577 - DNA, 19 bp, Homo sapiens
gagcctgctcccccacccc

SEQ ID NO: 2930578 - DNA, 15 bp, Homo sapiens
gagcctggccagcct

SEQ ID NO: 2930579 - DNA, 21 bp, Homo sapiens
gagcctgggatttctatgcag

SEQ ID NO: 2930580 - DNA, 11 bp, Homo sapiens
gagcctgtccc

SEQ ID NO: 2930581 - DNA, 20 bp, Homo sapiens
gagcctgtgaccttgggacc

SEQ ID NO: 2930582 - DNA, 16 bp, Homo sapiens
gagccttgctgccaag

SEQ ID NO: 2930583 - DNA, 19 bp, Homo sapiens
gagccttggtgtccacctg

SEQ ID NO: 2930584 - DNA, 22 bp, Homo sapiens
gagccttggtgtccacctggcc

SEQ ID NO: 2930585 - DNA, 18 bp, Homo sapiens
gagcctttggttctggcc

SEQ ID NO: 2930586 - DNA, 13 bp, Homo sapiens
gagcgaaactccg

SEQ ID NO: 2930587 - DNA, 16 bp, Homo sapiens
gagcgaggaaaaacaa

SEQ ID NO: 2930588 - DNA, 21 bp, Homo sapiens
gagcgaggaaaaacaacaaat

SEQ ID NO: 2930589 - DNA, 13 bp, Homo sapiens
gagcgaggaggcg

SEQ ID NO: 2930590 - DNA, 15 bp, Homo sapiens
gagcgcctgcccctc

SEQ ID NO: 2930591 - DNA, 22 bp, Homo sapiens
gagcgcctgcccctcccagaac

SEQ ID NO: 2930592 - DNA, 17 bp, Homo sapiens
gagcgctagtgccttgc

SEQ ID NO: 2930593 - DNA, 19 bp, Homo sapiens
gagcggactcacttgatgt

SEQ ID NO: 2930594 - DNA, 15 bp, Homo sapiens
gagcggcgccctgga

SEQ ID NO: 2930595 - DNA, 13 bp, Homo sapiens
gagctacaaatgc

SEQ ID NO: 2930596 - DNA, 23 bp, Homo sapiens
gagctacactcattgaaatgtaa

SEQ ID NO: 2930597 - DNA, 11 bp, Homo sapiens
gagctactgcc

SEQ ID NO: 2930598 - DNA, 14 bp, Homo sapiens
gagctagccagagg

SEQ ID NO: 2930599 - DNA, 18 bp, Homo sapiens
gagctagccagaggactg

SEQ ID NO: 2930600 - DNA, 17 bp, Homo sapiens
gagctagttctcagctt

SEQ ID NO: 2930601 - DNA, 13 bp, Homo sapiens
gagctattgctgt

SEQ ID NO: 2930602 - DNA, 23 bp, Homo sapiens
gagctcaggagtttgagaccagg

SEQ ID NO: 2930603 - DNA, 12 bp, Homo sapiens
gagctcagggca

SEQ ID NO: 2930604 - DNA, 21 bp, Homo sapiens
gagctcccaggtgcagccaga

SEQ ID NO: 2930605 - DNA, 14 bp, Homo sapiens
gagctctacccagg

SEQ ID NO: 2930606 - DNA, 21 bp, Homo sapiens
gagctctcaaatccctctcca

SEQ ID NO: 2930607 - DNA, 23 bp, Homo sapiens
gagctctcaaatccctctccaac

SEQ ID NO: 2930608 - DNA, 14 bp, Homo sapiens
gagctctgcctcaa

SEQ ID NO: 2930609 - DNA, 14 bp, Homo sapiens
gagctctgcgccag

SEQ ID NO: 2930610 - DNA, 19 bp, Homo sapiens
gagctctgcgccaggcaga

SEQ ID NO: 2930611 - DNA, 20 bp, Homo sapiens
gagctctgcgccaggcagag

SEQ ID NO: 2930612 - DNA, 13 bp, Homo sapiens
gagctctgggggg

SEQ ID NO: 2930613 - DNA, 11 bp, Homo sapiens
gagctctgtgg

SEQ ID NO: 2930614 - DNA, 15 bp, Homo sapiens
gagctcttgggtcag

SEQ ID NO: 2930615 - DNA, 16 bp, Homo sapiens
gagctgagaagaggag

SEQ ID NO: 2930616 - DNA, 17 bp, Homo sapiens
gagctgagaagaggagg

SEQ ID NO: 2930617 - DNA, 18 bp, Homo sapiens
gagctgagaagaggagga

SEQ ID NO: 2930618 - DNA, 23 bp, Homo sapiens
gagctgagaagaggaggaggtgg

SEQ ID NO: 2930619 - DNA, 15 bp, Homo sapiens
gagctgaggactctg

SEQ ID NO: 2930620 - DNA, 16 bp, Homo sapiens
gagctgaggactctgc

SEQ ID NO: 2930621 - DNA, 13 bp, Homo sapiens
gagctgagggagg

SEQ ID NO: 2930622 - DNA, 15 bp, Homo sapiens
gagctgagggaggga

SEQ ID NO: 2930623 - DNA, 20 bp, Homo sapiens
gagctgagggagggagccat

SEQ ID NO: 2930624 - DNA, 21 bp, Homo sapiens
gagctgagggagggagccatg

SEQ ID NO: 2930625 - DNA, 23 bp, Homo sapiens
gagctgagggagggagccatgga

SEQ ID NO: 2930626 - DNA, 17 bp, Homo sapiens
gagctgagggccctgtg

SEQ ID NO: 2930627 - DNA, 15 bp, Homo sapiens
gagctgccactgggc

SEQ ID NO: 2930628 - DNA, 17 bp, Homo sapiens
gagctgccactgggcac

SEQ ID NO: 2930629 - DNA, 19 bp, Homo sapiens
gagctgccactgggcacct

SEQ ID NO: 2930630 - DNA, 13 bp, Homo sapiens
gagctgccagtgg

SEQ ID NO: 2930631 - DNA, 17 bp, Homo sapiens
gagctgcccggcgcctg

SEQ ID NO: 2930632 - DNA, 20 bp, Homo sapiens
gagctgcccggcgcctgccc

SEQ ID NO: 2930633 - DNA, 11 bp, Homo sapiens
gagctgcctcc

SEQ ID NO: 2930634 - DNA, 14 bp, Homo sapiens
gagctgcctcccca

SEQ ID NO: 2930635 - DNA, 20 bp, Homo sapiens
gagctgcctccccaatccat

SEQ ID NO: 2930636 - DNA, 13 bp, Homo sapiens
gagctgcctgcag

SEQ ID NO: 2930637 - DNA, 22 bp, Homo sapiens
gagctgccttggctcagacatg

SEQ ID NO: 2930638 - DNA, 13 bp, Homo sapiens
gagctgcgggctg

SEQ ID NO: 2930639 - DNA, 16 bp, Homo sapiens
gagctgcgggctgagg

SEQ ID NO: 2930640 - DNA, 19 bp, Homo sapiens
gagctgctaaaataaacct

SEQ ID NO: 2930641 - DNA, 23 bp, Homo sapiens
gagctgctaaaataaacctgttt

SEQ ID NO: 2930642 - DNA, 19 bp, Homo sapiens
gagctggccaaagagcctt

SEQ ID NO: 2930643 - DNA, 13 bp, Homo sapiens
gagctggcccagg

SEQ ID NO: 2930644 - DNA, 14 bp, Homo sapiens
gagctgggaggaaa

SEQ ID NO: 2930645 - DNA, 21 bp, Homo sapiens
gagctgggatcccacagccct

SEQ ID NO: 2930646 - DNA, 20 bp, Homo sapiens
gagctgggcccgacatggct

SEQ ID NO: 2930647 - DNA, 21 bp, Homo sapiens
gagctggggaggtgggaggcc

SEQ ID NO: 2930648 - DNA, 18 bp, Homo sapiens
gagctggtgacagccttg

SEQ ID NO: 2930649 - DNA, 18 bp, Homo sapiens
gagctgtcaccaaggaaa

SEQ ID NO: 2930650 - DNA, 22 bp, Homo sapiens
gagctgttcaacatcactgaaa

SEQ ID NO: 2930651 - DNA, 23 bp, Homo sapiens
gagcttacattgaaaacagatat

SEQ ID NO: 2930652 - DNA, 17 bp, Homo sapiens
gagcttcccacacctgc

SEQ ID NO: 2930653 - DNA, 19 bp, Homo sapiens
gagcttcctgtcctcccag

SEQ ID NO: 2930654 - DNA, 21 bp, Homo sapiens
gagcttctggggtccccaggg

SEQ ID NO: 2930655 - DNA, 21 bp, Homo sapiens
gagcttctgtattttcaaaga

SEQ ID NO: 2930656 - DNA, 14 bp, Homo sapiens
gagctttgttactg

SEQ ID NO: 2930657 - DNA, 21 bp, Homo sapiens
gagcttttttgtaccctgaag

SEQ ID NO: 2930658 - DNA, 22 bp, Homo sapiens
gaggaaaaaaatcgtccaggga

SEQ ID NO: 2930659 - DNA, 18 bp, Homo sapiens
gaggaaacaacagcttta

SEQ ID NO: 2930660 - DNA, 16 bp, Homo sapiens
gaggaaagaatgaaag

SEQ ID NO: 2930661 - DNA, 19 bp, Homo sapiens
gaggaaaggccagctggca

SEQ ID NO: 2930662 - DNA, 17 bp, Homo sapiens
gaggaaagggcctggcc

SEQ ID NO: 2930663 - DNA, 18 bp, Homo sapiens
gaggaaagggcctggcca

SEQ ID NO: 2930664 - DNA, 20 bp, Homo sapiens
gaggaaagtcaaatcttggt

SEQ ID NO: 2930665 - DNA, 12 bp, Homo sapiens
gaggaacagtgg

SEQ ID NO: 2930666 - DNA, 22 bp, Homo sapiens
gaggaaccaggagaagggctgg

SEQ ID NO: 2930667 - DNA, 18 bp, Homo sapiens
gaggaactcgcctcagcc

SEQ ID NO: 2930668 - DNA, 17 bp, Homo sapiens
gaggaagagagagactg

SEQ ID NO: 2930669 - DNA, 22 bp, Homo sapiens
gaggaagccaggtccacggtct

SEQ ID NO: 2930670 - DNA, 19 bp, Homo sapiens
gaggaagccctaagacgtc

SEQ ID NO: 2930671 - DNA, 17 bp, Homo sapiens
gaggaagtgagccagca

SEQ ID NO: 2930672 - DNA, 21 bp, Homo sapiens
gaggaatctgtgggtctggga

SEQ ID NO: 2930673 - DNA, 22 bp, Homo sapiens
gaggaatctgtgggtctgggag

SEQ ID NO: 2930674 - DNA, 14 bp, Homo sapiens
gaggaatggacaga

SEQ ID NO: 2930675 - DNA, 19 bp, Homo sapiens
gaggacaattcatgaactt

SEQ ID NO: 2930676 - DNA, 17 bp, Homo sapiens
gaggacagagggcacat

SEQ ID NO: 2930677 - DNA, 20 bp, Homo sapiens
gaggacataatggggtcctg

SEQ ID NO: 2930678 - DNA, 19 bp, Homo sapiens
gaggaccagggcagggcca

SEQ ID NO: 2930679 - DNA, 13 bp, Homo sapiens
gaggaccagggcc

SEQ ID NO: 2930680 - DNA, 14 bp, Homo sapiens
gaggaccagggcct

SEQ ID NO: 2930681 - DNA, 20 bp, Homo sapiens
gaggaccagggtggagctga

SEQ ID NO: 2930682 - DNA, 15 bp, Homo sapiens
gaggaccatgaaaca

SEQ ID NO: 2930683 - DNA, 18 bp, Homo sapiens
gaggaccgggcactcccg

SEQ ID NO: 2930684 - DNA, 19 bp, Homo sapiens
gaggacgtgttacccactg

SEQ ID NO: 2930685 - DNA, 22 bp, Homo sapiens
gaggactctgcaagtgtctgga

SEQ ID NO: 2930686 - DNA, 16 bp, Homo sapiens
gaggactggactgttt

SEQ ID NO: 2930687 - DNA, 20 bp, Homo sapiens
gatcaattatagtttctgag

SEQ ID NO: 2930688 - DNA, 16 bp, Homo sapiens
gatcacaaggtcagga

SEQ ID NO: 2930689 - DNA, 13 bp, Homo sapiens
gatcacagaggct

SEQ ID NO: 2930690 - DNA, 13 bp, Homo sapiens
gatcactgccaga

SEQ ID NO: 2930691 - DNA, 22 bp, Homo sapiens
gatcagaaaaatggagcaaagt

SEQ ID NO: 2930692 - DNA, 16 bp, Homo sapiens
gatcagagccgtggtc

SEQ ID NO: 2930693 - DNA, 13 bp, Homo sapiens
gatcaggcacagg

SEQ ID NO: 2930694 - DNA, 16 bp, Homo sapiens
gatcaggcttcctggt

SEQ ID NO: 2930695 - DNA, 19 bp, Homo sapiens
gatcaggcttcctggtgag

SEQ ID NO: 2930696 - DNA, 17 bp, Homo sapiens
gatcataaggcttcaaa

SEQ ID NO: 2930697 - DNA, 19 bp, Homo sapiens
gatcatatacgtgaaaatt

SEQ ID NO: 2930698 - DNA, 19 bp, Homo sapiens
gatcatatgaattgctgtc

SEQ ID NO: 2930699 - DNA, 22 bp, Homo sapiens
gatcatccgtctgtgtggggtt

SEQ ID NO: 2930700 - DNA, 14 bp, Homo sapiens
gatcatcgccagag

SEQ ID NO: 2930701 - DNA, 21 bp, Homo sapiens
gatcatcgccagaggtgcttc

SEQ ID NO: 2930702 - DNA, 19 bp, Homo sapiens
gatcatgaaagtagacagt

SEQ ID NO: 2930703 - DNA, 18 bp, Homo sapiens
gatcatttggagctcttg

SEQ ID NO: 2930704 - DNA, 13 bp, Homo sapiens
gatccaaaagaag

SEQ ID NO: 2930705 - DNA, 19 bp, Homo sapiens
gatccaaaagaagccccca

SEQ ID NO: 2930706 - DNA, 22 bp, Homo sapiens
gatccaaaagaagcccccagct

SEQ ID NO: 2930707 - DNA, 11 bp, Homo sapiens
gatccaaagac

SEQ ID NO: 2930708 - DNA, 19 bp, Homo sapiens
gatccaaggggctagctgg

SEQ ID NO: 2930709 - DNA, 23 bp, Homo sapiens
gatccagccctgagttcctagcc

SEQ ID NO: 2930710 - DNA, 21 bp, Homo sapiens
gatccagctgtgtgttttcaa

SEQ ID NO: 2930711 - DNA, 18 bp, Homo sapiens
gatccagggacagaggcc

SEQ ID NO: 2930712 - DNA, 18 bp, Homo sapiens
gatccatccagcttgcca

SEQ ID NO: 2930713 - DNA, 14 bp, Homo sapiens
gatcccaaagcaag

SEQ ID NO: 2930714 - DNA, 12 bp, Homo sapiens
gatcccaacact

SEQ ID NO: 2930715 - DNA, 19 bp, Homo sapiens
gatcccaacactgccagca

SEQ ID NO: 2930716 - DNA, 22 bp, Homo sapiens
gatcccatcaaagaaccttgaa

SEQ ID NO: 2930717 - DNA, 13 bp, Homo sapiens
gatcccctttggt

SEQ ID NO: 2930718 - DNA, 13 bp, Homo sapiens
gatccctcccccc

SEQ ID NO: 2930719 - DNA, 19 bp, Homo sapiens
gatccctcccccccatgca

SEQ ID NO: 2930720 - DNA, 13 bp, Homo sapiens
gatccctggccac

SEQ ID NO: 2930721 - DNA, 23 bp, Homo sapiens
gatccggggccctctctgcaccg

SEQ ID NO: 2930722 - DNA, 19 bp, Homo sapiens
gatcctaagcatctaagtt

SEQ ID NO: 2930723 - DNA, 18 bp, Homo sapiens
gatcctacttctctgagt

SEQ ID NO: 2930724 - DNA, 20 bp, Homo sapiens
gatcctacttctctgagtca

SEQ ID NO: 2930725 - DNA, 15 bp, Homo sapiens
gatcctagatcctaa

SEQ ID NO: 2930726 - DNA, 16 bp, Homo sapiens
gatcctctcacctcag

SEQ ID NO: 2930727 - DNA, 11 bp, Homo sapiens
gatcctgcccc

SEQ ID NO: 2930728 - DNA, 15 bp, Homo sapiens
gatcctggaggccca

SEQ ID NO: 2930729 - DNA, 16 bp, Homo sapiens
gatcctggaggcccag

SEQ ID NO: 2930730 - DNA, 12 bp, Homo sapiens
gatcctgtcaca

SEQ ID NO: 2930731 - DNA, 14 bp, Homo sapiens
gatccttcccaagg

SEQ ID NO: 2930732 - DNA, 20 bp, Homo sapiens
gatccttcccaaggtacagc

SEQ ID NO: 2930733 - DNA, 16 bp, Homo sapiens
gatcgaggcatggggc

SEQ ID NO: 2930734 - DNA, 21 bp, Homo sapiens
gatcgcggcggagctggcccc

SEQ ID NO: 2930735 - DNA, 13 bp, Homo sapiens
gatcgttgtccct

SEQ ID NO: 2930736 - DNA, 21 bp, Homo sapiens
gatctacatgaatgcaaaaca

SEQ ID NO: 2930737 - DNA, 19 bp, Homo sapiens
gatctacctgcaacacaac

SEQ ID NO: 2930738 - DNA, 18 bp, Homo sapiens
gatctagaataatcttgc

SEQ ID NO: 2930739 - DNA, 13 bp, Homo sapiens
gatctatttatta

SEQ ID NO: 2930740 - DNA, 14 bp, Homo sapiens
gatctatttattag

SEQ ID NO: 2930741 - DNA, 20 bp, Homo sapiens
gatctcaagtatatgtcatt

SEQ ID NO: 2930742 - DNA, 12 bp, Homo sapiens
gatctcagtttt

SEQ ID NO: 2930743 - DNA, 15 bp, Homo sapiens
gatctcatgtcctct

SEQ ID NO: 2930744 - DNA, 12 bp, Homo sapiens
gatctccctgcc

SEQ ID NO: 2930745 - DNA, 13 bp, Homo sapiens
gatctccctgccg

SEQ ID NO: 2930746 - DNA, 19 bp, Homo sapiens
gatctcgcctggaaacaga

SEQ ID NO: 2930747 - DNA, 14 bp, Homo sapiens
gatctcggtttgcc

SEQ ID NO: 2930748 - DNA, 22 bp, Homo sapiens
gatctctgggatttatgctcat

SEQ ID NO: 2930749 - DNA, 15 bp, Homo sapiens
gatctgaacatctgg

SEQ ID NO: 2930750 - DNA, 15 bp, Homo sapiens
gatctgaacccagct

SEQ ID NO: 2930751 - DNA, 16 bp, Homo sapiens
gatctgcacagtcaga

SEQ ID NO: 2930752 - DNA, 18 bp, Homo sapiens
gatctgcaccaccatgcc

SEQ ID NO: 2930753 - DNA, 20 bp, Homo sapiens
gatctgctttctgttcatct

SEQ ID NO: 2930754 - DNA, 21 bp, Homo sapiens
gatctgctttctgttcatctc

SEQ ID NO: 2930755 - DNA, 22 bp, Homo sapiens
gatctgctttctgttcatctct

SEQ ID NO: 2930756 - DNA, 17 bp, Homo sapiens
gatctggaacccagact

SEQ ID NO: 2930757 - DNA, 18 bp, Homo sapiens
gatctggaacccagactc

SEQ ID NO: 2930758 - DNA, 16 bp, Homo sapiens
gatctggaacctcagc

SEQ ID NO: 2930759 - DNA, 19 bp, Homo sapiens
gatctggaacctcagcctg

SEQ ID NO: 2930760 - DNA, 23 bp, Homo sapiens
gatctggaacctcagcctggcca

SEQ ID NO: 2930761 - DNA, 22 bp, Homo sapiens
gatctgggaccctttccttcct

SEQ ID NO: 2930762 - DNA, 16 bp, Homo sapiens
gatctgtcctcagcct

SEQ ID NO: 2930763 - DNA, 13 bp, Homo sapiens
gatctgttttgaa

SEQ ID NO: 2930764 - DNA, 17 bp, Homo sapiens
gatctgttttgaaggca

SEQ ID NO: 2930765 - DNA, 18 bp, Homo sapiens
gatctgttttgaaggcaa

SEQ ID NO: 2930766 - DNA, 14 bp, Homo sapiens
gatcttagattctc

SEQ ID NO: 2930767 - DNA, 21 bp, Homo sapiens
gatcttatttttctaaacgta

SEQ ID NO: 2930768 - DNA, 19 bp, Homo sapiens
gatcttcaaaagtaatgcc

SEQ ID NO: 2930769 - DNA, 16 bp, Homo sapiens
gatcttggaaaaacag

SEQ ID NO: 2930770 - DNA, 13 bp, Homo sapiens
gatctttggacag

SEQ ID NO: 2930771 - DNA, 18 bp, Homo sapiens
gatgaaaaatatttctga

SEQ ID NO: 2930772 - DNA, 15 bp, Homo sapiens
gatgaaaaattatag

SEQ ID NO: 2930773 - DNA, 14 bp, Homo sapiens
gatgaaaatattta

SEQ ID NO: 2930774 - DNA, 17 bp, Homo sapiens
gatgaaaatatttaaag

SEQ ID NO: 2930775 - DNA, 19 bp, Homo sapiens
gatgaaactaaagcaatag

SEQ ID NO: 2930776 - DNA, 22 bp, Homo sapiens
gatgaaactaaagcaatagaaa

SEQ ID NO: 2930777 - DNA, 14 bp, Homo sapiens
gatgaaacttctca

SEQ ID NO: 2930778 - DNA, 18 bp, Homo sapiens
gatgaagggcgagtgaat

SEQ ID NO: 2930779 - DNA, 13 bp, Homo sapiens
gatgaatcactgt

SEQ ID NO: 2930780 - DNA, 20 bp, Homo sapiens
gatgaatcactgtttttaga

SEQ ID NO: 2930781 - DNA, 20 bp, Homo sapiens
gatgaattaggggacactgt

SEQ ID NO: 2930782 - DNA, 18 bp, Homo sapiens
gatgaattgtcacatcta

SEQ ID NO: 2930783 - DNA, 16 bp, Homo sapiens
gatgacattgctaaga

SEQ ID NO: 2930784 - DNA, 18 bp, Homo sapiens
gatgacccctaccccctc

SEQ ID NO: 2930785 - DNA, 21 bp, Homo sapiens
gatgactatgcagaggcctgg

SEQ ID NO: 2930786 - DNA, 15 bp, Homo sapiens
gatgacttgagccct

SEQ ID NO: 2930787 - DNA, 14 bp, Homo sapiens
gatgactttgcaga

SEQ ID NO: 2930788 - DNA, 23 bp, Homo sapiens
gatgagacagggttttttcattt

SEQ ID NO: 2930789 - DNA, 19 bp, Homo sapiens
gatgagccctcagaaccct

SEQ ID NO: 2930790 - DNA, 19 bp, Homo sapiens
gatgagctctacccagggc

SEQ ID NO: 2930791 - DNA, 16 bp, Homo sapiens
gatgaggacagagggc

SEQ ID NO: 2930792 - DNA, 23 bp, Homo sapiens
gatgagggttcatcatccctccc

SEQ ID NO: 2930793 - DNA, 15 bp, Homo sapiens
gatgatacagtgttt

SEQ ID NO: 2930794 - DNA, 18 bp, Homo sapiens
gatgatacatccaaagca

SEQ ID NO: 2930795 - DNA, 13 bp, Homo sapiens
gatgatcaattat

SEQ ID NO: 2930796 - DNA, 22 bp, Homo sapiens
gatgatcgctgtattttgagtt

SEQ ID NO: 2930797 - DNA, 13 bp, Homo sapiens
gatgatgcatgga

SEQ ID NO: 2930798 - DNA, 16 bp, Homo sapiens
gatgatgcatggagga

SEQ ID NO: 2930799 - DNA, 16 bp, Homo sapiens
gatgatgctttggaag

SEQ ID NO: 2930800 - DNA, 13 bp, Homo sapiens
gatgatgtgtata

SEQ ID NO: 2930801 - DNA, 23 bp, Homo sapiens
gatgattaaataagattctaacg

SEQ ID NO: 2930802 - DNA, 14 bp, Homo sapiens
gatgattgttcttt

SEQ ID NO: 2930803 - DNA, 15 bp, Homo sapiens
gatgattgttctttt

SEQ ID NO: 2930804 - DNA, 19 bp, Homo sapiens
gatgatttcagaaggagaa

SEQ ID NO: 2930805 - DNA, 14 bp, Homo sapiens
gatgcaaagaggca

SEQ ID NO: 2930806 - DNA, 15 bp, Homo sapiens
gatgcaaagaggcaa

SEQ ID NO: 2930807 - DNA, 19 bp, Homo sapiens
gatgcaaggattacagaaa

SEQ ID NO: 2930808 - DNA, 20 bp, Homo sapiens
gatgcaaggattacagaaac

SEQ ID NO: 2930809 - DNA, 22 bp, Homo sapiens
gatgcaaggattacagaaactg

SEQ ID NO: 2930810 - DNA, 13 bp, Homo sapiens
gatgcaatgaaca

SEQ ID NO: 2930811 - DNA, 17 bp, Homo sapiens
gatgcaatgtagagggg

SEQ ID NO: 2930812 - DNA, 18 bp, Homo sapiens
gatgcaattgctcccatc

SEQ ID NO: 2930813 - DNA, 15 bp, Homo sapiens
gatgcacatccctgg

SEQ ID NO: 2930814 - DNA, 19 bp, Homo sapiens
gatgcagagtaagtattat

SEQ ID NO: 2930815 - DNA, 22 bp, Homo sapiens
gatgcaggatttgttctctgtc

SEQ ID NO: 2930816 - DNA, 17 bp, Homo sapiens
gatgcaggctcccctga

SEQ ID NO: 2930817 - DNA, 14 bp, Homo sapiens
gatgcatggaggac

SEQ ID NO: 2930818 - DNA, 20 bp, Homo sapiens
gatgcattctgataggaggg

SEQ ID NO: 2930819 - DNA, 17 bp, Homo sapiens
gatgccagggccgacca

SEQ ID NO: 2930820 - DNA, 21 bp, Homo sapiens
gcaagtgtctggagcggctgc

SEQ ID NO: 2930821 - DNA, 15 bp, Homo sapiens
gcaagttgccatttt

SEQ ID NO: 2930822 - DNA, 21 bp, Homo sapiens
gcaataaatctgacccagtgc

SEQ ID NO: 2930823 - DNA, 12 bp, Homo sapiens
gcaataaatgaa

SEQ ID NO: 2930824 - DNA, 23 bp, Homo sapiens
gcaatatatctaaattgaataat

SEQ ID NO: 2930825 - DNA, 14 bp, Homo sapiens
gcaatcacaggaaa

SEQ ID NO: 2930826 - DNA, 15 bp, Homo sapiens
gcaatcacaggaaaa

SEQ ID NO: 2930827 - DNA, 17 bp, Homo sapiens
gcaatcctctcacctca

SEQ ID NO: 2930828 - DNA, 14 bp, Homo sapiens
gcaatcttctactt

SEQ ID NO: 2930829 - DNA, 13 bp, Homo sapiens
gcaatctttgaaa

SEQ ID NO: 2930830 - DNA, 18 bp, Homo sapiens
gcaatctttgaaagactt

SEQ ID NO: 2930831 - DNA, 20 bp, Homo sapiens
gcaatgcttaacacaggcag

SEQ ID NO: 2930832 - DNA, 20 bp, Homo sapiens
gcaatggatcagccaaggcc

SEQ ID NO: 2930833 - DNA, 20 bp, Homo sapiens
gcaatgggagctgaggccac

SEQ ID NO: 2930834 - DNA, 14 bp, Homo sapiens
gcaattaactctgg

SEQ ID NO: 2930835 - DNA, 17 bp, Homo sapiens
gcaattatttaaagaaa

SEQ ID NO: 2930836 - DNA, 18 bp, Homo sapiens
gcaattgaattaaattag

SEQ ID NO: 2930837 - DNA, 20 bp, Homo sapiens
gcaattttgcatagctttcc

SEQ ID NO: 2930838 - DNA, 18 bp, Homo sapiens
gcaattttgcatttgaat

SEQ ID NO: 2930839 - DNA, 23 bp, Homo sapiens
gcacaactgttgatggtaggctg

SEQ ID NO: 2930840 - DNA, 23 bp, Homo sapiens
gcacaaggccttgcctggcctga

SEQ ID NO: 2930841 - DNA, 17 bp, Homo sapiens
gcacaagttatttaaat

SEQ ID NO: 2930842 - DNA, 12 bp, Homo sapiens
gcacaataaaac

SEQ ID NO: 2930843 - DNA, 22 bp, Homo sapiens
gcacaatctgttctactcttaa

SEQ ID NO: 2930844 - DNA, 23 bp, Homo sapiens
gcacaatctgttctactcttaat

SEQ ID NO: 2930845 - DNA, 16 bp, Homo sapiens
gcacaattctgtttta

SEQ ID NO: 2930846 - DNA, 19 bp, Homo sapiens
gcacacagcggctgcctcc

SEQ ID NO: 2930847 - DNA, 20 bp, Homo sapiens
gcacacagcggctgcctcct

SEQ ID NO: 2930848 - DNA, 16 bp, Homo sapiens
gcacacatcaccaggt

SEQ ID NO: 2930849 - DNA, 15 bp, Homo sapiens
gcacaccacaattct

SEQ ID NO: 2930850 - DNA, 20 bp, Homo sapiens
gcacaccacaattctcccta

SEQ ID NO: 2930851 - DNA, 17 bp, Homo sapiens
gcacacccactcagctc

SEQ ID NO: 2930852 - DNA, 18 bp, Homo sapiens
gcacacccactcagctcc

SEQ ID NO: 2930853 - DNA, 17 bp, Homo sapiens
gcacacgcctcccactg

SEQ ID NO: 2930854 - DNA, 20 bp, Homo sapiens
gcacactcatcccctcactt

SEQ ID NO: 2930855 - DNA, 13 bp, Homo sapiens
gcacactttgcca

SEQ ID NO: 2930856 - DNA, 19 bp, Homo sapiens
gcacagaagtcctgtatgt

SEQ ID NO: 2930857 - DNA, 13 bp, Homo sapiens
gcacagagggcgc

SEQ ID NO: 2930858 - DNA, 15 bp, Homo sapiens
gcacagattcccagg

SEQ ID NO: 2930859 - DNA, 16 bp, Homo sapiens
gcacagattcccaggc

SEQ ID NO: 2930860 - DNA, 15 bp, Homo sapiens
gcacagcagcctggg

SEQ ID NO: 2930861 - DNA, 19 bp, Homo sapiens
gcacagcctggctgtggcc

SEQ ID NO: 2930862 - DNA, 13 bp, Homo sapiens
gcacagctcctcc

SEQ ID NO: 2930863 - DNA, 15 bp, Homo sapiens
gcacagctcctcccc

SEQ ID NO: 2930864 - DNA, 17 bp, Homo sapiens
gcacagctcctcccctg

SEQ ID NO: 2930865 - DNA, 14 bp, Homo sapiens
gcacaggacatgcg

SEQ ID NO: 2930866 - DNA, 20 bp, Homo sapiens
gcacaggaggcaggcatggc

SEQ ID NO: 2930867 - DNA, 20 bp, Homo sapiens
gcacaggagtgtcctcttcc

SEQ ID NO: 2930868 - DNA, 15 bp, Homo sapiens
gcacaggtcaggggt

SEQ ID NO: 2930869 - DNA, 12 bp, Homo sapiens
gcacaggtctct

SEQ ID NO: 2930870 - DNA, 14 bp, Homo sapiens
gcacaggtgggagg

SEQ ID NO: 2930871 - DNA, 15 bp, Homo sapiens
gcacagtcagaagga

SEQ ID NO: 2930872 - DNA, 15 bp, Homo sapiens
gcacagtccacagct

SEQ ID NO: 2930873 - DNA, 22 bp, Homo sapiens
gcacagtggctcacgcctgtaa

SEQ ID NO: 2930874 - DNA, 18 bp, Homo sapiens
gcacagtggtggcagggc

SEQ ID NO: 2930875 - DNA, 12 bp, Homo sapiens
gcacagtttgaa

SEQ ID NO: 2930876 - DNA, 14 bp, Homo sapiens
gcacatagcagact

SEQ ID NO: 2930877 - DNA, 13 bp, Homo sapiens
gcacatatggact

SEQ ID NO: 2930878 - DNA, 19 bp, Homo sapiens
gcacatccgcgtgtgcctg

SEQ ID NO: 2930879 - DNA, 20 bp, Homo sapiens
gcacatcctatgcaatatat

SEQ ID NO: 2930880 - DNA, 23 bp, Homo sapiens
gcacatctaaattgatcattcat

SEQ ID NO: 2930881 - DNA, 17 bp, Homo sapiens
gcacatgcacctaccca

SEQ ID NO: 2930882 - DNA, 16 bp, Homo sapiens
gcacatgccagggaaa

SEQ ID NO: 2930883 - DNA, 13 bp, Homo sapiens
gcacatgcttcaa

SEQ ID NO: 2930884 - DNA, 21 bp, Homo sapiens
gcacatggctgggggagggac

SEQ ID NO: 2930885 - DNA, 23 bp, Homo sapiens
gcacatggctgggggagggactg

SEQ ID NO: 2930886 - DNA, 17 bp, Homo sapiens
gcacattggaaagcaca

SEQ ID NO: 2930887 - DNA, 15 bp, Homo sapiens
gcaccaagcaggaaa

SEQ ID NO: 2930888 - DNA, 23 bp, Homo sapiens
gcaccaaggcaacggcaccattg

SEQ ID NO: 2930889 - DNA, 15 bp, Homo sapiens
gcaccaccaggtctc

SEQ ID NO: 2930890 - DNA, 15 bp, Homo sapiens
gcaccaccatgccca

SEQ ID NO: 2930891 - DNA, 15 bp, Homo sapiens
gcaccacggccagaa

SEQ ID NO: 2930892 - DNA, 18 bp, Homo sapiens
gcaccactgcactccagc

SEQ ID NO: 2930893 - DNA, 19 bp, Homo sapiens
gcaccactgcactccagcc

SEQ ID NO: 2930894 - DNA, 16 bp, Homo sapiens
gcaccagaatgtatat

SEQ ID NO: 2930895 - DNA, 14 bp, Homo sapiens
gcaccagacaccca

SEQ ID NO: 2930896 - DNA, 13 bp, Homo sapiens
gcaccagggactc

SEQ ID NO: 2930897 - DNA, 13 bp, Homo sapiens
gcaccatccgcca

SEQ ID NO: 2930898 - DNA, 14 bp, Homo sapiens
gcaccattgctgct

SEQ ID NO: 2930899 - DNA, 14 bp, Homo sapiens
gcacccagcccaga

SEQ ID NO: 2930900 - DNA, 17 bp, Homo sapiens
gcacccagtcctctgcc

SEQ ID NO: 2930901 - DNA, 19 bp, Homo sapiens
gcacccagtcctctgcctc

SEQ ID NO: 2930902 - DNA, 15 bp, Homo sapiens
gcaccccatgctgtt

SEQ ID NO: 2930903 - DNA, 13 bp, Homo sapiens
gcacccccctggg

SEQ ID NO: 2930904 - DNA, 14 bp, Homo sapiens
gcacccccctgggc

SEQ ID NO: 2930905 - DNA, 21 bp, Homo sapiens
gcaccctgccctcatgggacc

SEQ ID NO: 2930906 - DNA, 12 bp, Homo sapiens
gcaccctggcct

SEQ ID NO: 2930907 - DNA, 15 bp, Homo sapiens
gcaccgcctgccctc

SEQ ID NO: 2930908 - DNA, 20 bp, Homo sapiens
gcaccgcctgccctcccgca

SEQ ID NO: 2930909 - DNA, 22 bp, Homo sapiens
gcaccggacagtcggaaaagcg

SEQ ID NO: 2930910 - DNA, 19 bp, Homo sapiens
gcaccgggctggctgcttg

SEQ ID NO: 2930911 - DNA, 16 bp, Homo sapiens
gcaccggggcctgggc

SEQ ID NO: 2930912 - DNA, 14 bp, Homo sapiens
gcaccgttctgtgc

SEQ ID NO: 2930913 - DNA, 15 bp, Homo sapiens
gcacctaatccaggc

SEQ ID NO: 2930914 - DNA, 17 bp, Homo sapiens
gcacctatctcagccat

SEQ ID NO: 2930915 - DNA, 19 bp, Homo sapiens
gcacctccccccactgcag

SEQ ID NO: 2930916 - DNA, 22 bp, Homo sapiens
gcacctgcatccgtagttccct

SEQ ID NO: 2930917 - DNA, 19 bp, Homo sapiens
gcacctgccgacctcgtcc

SEQ ID NO: 2930918 - DNA, 19 bp, Homo sapiens
gcacctgcctagctcttgg

SEQ ID NO: 2930919 - DNA, 18 bp, Homo sapiens
gcacctgcgcacaggtgg

SEQ ID NO: 2930920 - DNA, 18 bp, Homo sapiens
gcacctggaccccctgcc

SEQ ID NO: 2930921 - DNA, 21 bp, Homo sapiens
gcacctggaccccctgcccgc

SEQ ID NO: 2930922 - DNA, 23 bp, Homo sapiens
gcacctggaccccctgcccgcca

SEQ ID NO: 2930923 - DNA, 22 bp, Homo sapiens
gcacctggtgggtggtgtcctg

SEQ ID NO: 2930924 - DNA, 19 bp, Homo sapiens
gcacctgtcggtggctgcc

SEQ ID NO: 2930925 - DNA, 23 bp, Homo sapiens
gcacctgtcggtggctgcctttg

SEQ ID NO: 2930926 - DNA, 18 bp, Homo sapiens
gcacctgtgttccagccc

SEQ ID NO: 2930927 - DNA, 15 bp, Homo sapiens
gcaccttggcccagg

SEQ ID NO: 2930928 - DNA, 19 bp, Homo sapiens
gcaccttggcccaggagct

SEQ ID NO: 2930929 - DNA, 18 bp, Homo sapiens
gcaccttgtgcctggggt

SEQ ID NO: 2930930 - DNA, 17 bp, Homo sapiens
gcacctttctagttgaa

SEQ ID NO: 2930931 - DNA, 15 bp, Homo sapiens
gcacgaacccacctg

SEQ ID NO: 2930932 - DNA, 19 bp, Homo sapiens
gcacgaacccacctgctga

SEQ ID NO: 2930933 - DNA, 23 bp, Homo sapiens
gcacgaacccacctgctgagaga

SEQ ID NO: 2930934 - DNA, 14 bp, Homo sapiens
gcacgcctgccatc

SEQ ID NO: 2930935 - DNA, 23 bp, Homo sapiens
gcacgcggattaatttgcatctg

SEQ ID NO: 2930936 - DNA, 15 bp, Homo sapiens
gcacgctcccctcca

SEQ ID NO: 2930937 - DNA, 21 bp, Homo sapiens
gcacggaccatgcgacactgg

SEQ ID NO: 2930938 - DNA, 14 bp, Homo sapiens
gcacggcaggcgtg

SEQ ID NO: 2930939 - DNA, 17 bp, Homo sapiens
gcacggcccggcccctc

SEQ ID NO: 2930940 - DNA, 18 bp, Homo sapiens
gcacggcccggcccctca

SEQ ID NO: 2930941 - DNA, 15 bp, Homo sapiens
gcacgggcatgcaca

SEQ ID NO: 2930942 - DNA, 22 bp, Homo sapiens
gcacgttatggtgtttctccct

SEQ ID NO: 2930943 - DNA, 23 bp, Homo sapiens
gcactaaggggcccggccagcca

SEQ ID NO: 2930944 - DNA, 22 bp, Homo sapiens
gcactagtcaccgacagcggcc

SEQ ID NO: 2930945 - DNA, 23 bp, Homo sapiens
gcactagtcaccgacagcggcct

SEQ ID NO: 2930946 - DNA, 18 bp, Homo sapiens
gcactatctttcagctcc

SEQ ID NO: 2930947 - DNA, 16 bp, Homo sapiens
gcactcaagttgttta

SEQ ID NO: 2930948 - DNA, 11 bp, Homo sapiens
gcactccagcc

SEQ ID NO: 2930949 - DNA, 15 bp, Homo sapiens
gcactccagcctgag

SEQ ID NO: 2930950 - DNA, 16 bp, Homo sapiens
gcactccagcctgggt

SEQ ID NO: 2930951 - DNA, 18 bp, Homo sapiens
gcactccctccagcacaa

SEQ ID NO: 2930952 - DNA, 14 bp, Homo sapiens
gcatcacctgcctg

SEQ ID NO: 2930953 - DNA, 20 bp, Homo sapiens
gcatcaccttaggcagggaa

SEQ ID NO: 2930954 - DNA, 22 bp, Homo sapiens
gcatcaccttaggcagggaagt

SEQ ID NO: 2930955 - DNA, 22 bp, Homo sapiens
gcatcaccttcctaatcaccgc

SEQ ID NO: 2930956 - DNA, 18 bp, Homo sapiens
gcatcaggatactcaaag

SEQ ID NO: 2930957 - DNA, 19 bp, Homo sapiens
gcatcagtccctatgtatt

SEQ ID NO: 2930958 - DNA, 16 bp, Homo sapiens
gcatcagttcactgct

SEQ ID NO: 2930959 - DNA, 11 bp, Homo sapiens
gcatcattgca

SEQ ID NO: 2930960 - DNA, 14 bp, Homo sapiens
gcatcattgcagat

SEQ ID NO: 2930961 - DNA, 18 bp, Homo sapiens
gcatccagcagtctctgc

SEQ ID NO: 2930962 - DNA, 20 bp, Homo sapiens
gcatccagcagtctctgcct

SEQ ID NO: 2930963 - DNA, 18 bp, Homo sapiens
gcatccagggctgccagg

SEQ ID NO: 2930964 - DNA, 16 bp, Homo sapiens
gcatccatcttggaag

SEQ ID NO: 2930965 - DNA, 21 bp, Homo sapiens
gcatccattcctcagggacag

SEQ ID NO: 2930966 - DNA, 13 bp, Homo sapiens
gcatccctgcttc

SEQ ID NO: 2930967 - DNA, 19 bp, Homo sapiens
gcatccctgcttctggcgc

SEQ ID NO: 2930968 - DNA, 16 bp, Homo sapiens
gcatccgcaggtgctg

SEQ ID NO: 2930969 - DNA, 17 bp, Homo sapiens
gcatccgtagttccctg

SEQ ID NO: 2930970 - DNA, 12 bp, Homo sapiens
gcatcctcccca

SEQ ID NO: 2930971 - DNA, 21 bp, Homo sapiens
gcatcctccccaccagagctg

SEQ ID NO: 2930972 - DNA, 23 bp, Homo sapiens
gcatcctccccaccagagctgcc

SEQ ID NO: 2930973 - DNA, 19 bp, Homo sapiens
gcatcgaccacaccagcct

SEQ ID NO: 2930974 - DNA, 15 bp, Homo sapiens
gcatcggtcatgtgt

SEQ ID NO: 2930975 - DNA, 22 bp, Homo sapiens
gcatctaagcatctgggttgcc

SEQ ID NO: 2930976 - DNA, 15 bp, Homo sapiens
gcatctaagcccatg

SEQ ID NO: 2930977 - DNA, 16 bp, Homo sapiens
gcatctaattcttatt

SEQ ID NO: 2930978 - DNA, 20 bp, Homo sapiens
gcatctagcatgtcgtcaaa

SEQ ID NO: 2930979 - DNA, 23 bp, Homo sapiens
gcatctatgggagagtgtcaacc

SEQ ID NO: 2930980 - DNA, 20 bp, Homo sapiens
gcatctcagtggtgtgtgaa

SEQ ID NO: 2930981 - DNA, 22 bp, Homo sapiens
gcatctcagtggtgtgtgaagt

SEQ ID NO: 2930982 - DNA, 12 bp, Homo sapiens
gcatctcccaga

SEQ ID NO: 2930983 - DNA, 13 bp, Homo sapiens
gcatctcccagat

SEQ ID NO: 2930984 - DNA, 12 bp, Homo sapiens
gcatctctgagt

SEQ ID NO: 2930985 - DNA, 19 bp, Homo sapiens
gcatctctgagtgtctctg

SEQ ID NO: 2930986 - DNA, 23 bp, Homo sapiens
gcatctctgagtgtctctgcctg

SEQ ID NO: 2930987 - DNA, 24 bp, Homo sapiens
gcatctctgagtgtctctgcctgg

SEQ ID NO: 2930988 - DNA, 20 bp, Homo sapiens
gcatctgaaataggaaacaa

SEQ ID NO: 2930989 - DNA, 21 bp, Homo sapiens
gcatctgaatgaaaataactg

SEQ ID NO: 2930990 - DNA, 15 bp, Homo sapiens
gcatctgaccagcag

SEQ ID NO: 2930991 - DNA, 17 bp, Homo sapiens
gcatctgaccagcagcg

SEQ ID NO: 2930992 - DNA, 16 bp, Homo sapiens
gcatctgaccatctgt

SEQ ID NO: 2930993 - DNA, 21 bp, Homo sapiens
gcatctgaccatctgtgacta

SEQ ID NO: 2930994 - DNA, 15 bp, Homo sapiens
gcatctgataaagtt

SEQ ID NO: 2930995 - DNA, 21 bp, Homo sapiens
gcatctgccacaaaaatgttc

SEQ ID NO: 2930996 - DNA, 16 bp, Homo sapiens
gcatctggattgaaag

SEQ ID NO: 2930997 - DNA, 16 bp, Homo sapiens
gcatcttactgaaggt

SEQ ID NO: 2930998 - DNA, 21 bp, Homo sapiens
gcatcttccagaagtgtgatt

SEQ ID NO: 2930999 - DNA, 20 bp, Homo sapiens
gcatcttcgtcttcactctt

SEQ ID NO: 2931000 - DNA, 23 bp, Homo sapiens
gcatcttcgtcttcactcttagg

SEQ ID NO: 2931001 - DNA, 14 bp, Homo sapiens
gcatcttctccatc

SEQ ID NO: 2931002 - DNA, 15 bp, Homo sapiens
gcatctttgcctctc

SEQ ID NO: 2931003 - DNA, 23 bp, Homo sapiens
gcatctttggggaggtgttcact

SEQ ID NO: 2931004 - DNA, 18 bp, Homo sapiens
gcatctttttttcatttt

SEQ ID NO: 2931005 - DNA, 22 bp, Homo sapiens
gcatgaaaaaagcaagattgaa

SEQ ID NO: 2931006 - DNA, 22 bp, Homo sapiens
gcatgacaaaagtgacagatgt

SEQ ID NO: 2931007 - DNA, 12 bp, Homo sapiens
gcatgacccagt

SEQ ID NO: 2931008 - DNA, 22 bp, Homo sapiens
gcatgacccagtgaagatgcag

SEQ ID NO: 2931009 - DNA, 18 bp, Homo sapiens
gcatgacgtttaaggcca

SEQ ID NO: 2931010 - DNA, 14 bp, Homo sapiens
gcatgagaaataca

SEQ ID NO: 2931011 - DNA, 18 bp, Homo sapiens
gcatgagactcagtgcag

SEQ ID NO: 2931012 - DNA, 22 bp, Homo sapiens
gcatgagtggccttaataaata

SEQ ID NO: 2931013 - DNA, 17 bp, Homo sapiens
gcatgataaacattcat

SEQ ID NO: 2931014 - DNA, 23 bp, Homo sapiens
gcatgatagacacatatgagggg

SEQ ID NO: 2931015 - DNA, 23 bp, Homo sapiens
gcatgatccaagcaagactgagg

SEQ ID NO: 2931016 - DNA, 16 bp, Homo sapiens
gcatgatccagctgtg

SEQ ID NO: 2931017 - DNA, 15 bp, Homo sapiens
gcatgatgggaaaat

SEQ ID NO: 2931018 - DNA, 20 bp, Homo sapiens
gcatgatgggaaaatatttc

SEQ ID NO: 2931019 - DNA, 20 bp, Homo sapiens
gcatgcaaaagaaagcaaat

SEQ ID NO: 2931020 - DNA, 24 bp, Homo sapiens
gcatgcacacggctggtcactctg

SEQ ID NO: 2931021 - DNA, 15 bp, Homo sapiens
gcatgcacgggcatg

SEQ ID NO: 2931022 - DNA, 21 bp, Homo sapiens
gcatgcacgggcatgcacacg

SEQ ID NO: 2931023 - DNA, 16 bp, Homo sapiens
gcatgcactgttcccc

SEQ ID NO: 2931024 - DNA, 17 bp, Homo sapiens
gcatgcactgttccccc

SEQ ID NO: 2931025 - DNA, 21 bp, Homo sapiens
gcatgcactgttccccctgtg

SEQ ID NO: 2931026 - DNA, 23 bp, Homo sapiens
gcatgcactgttccccctgtgca

SEQ ID NO: 2931027 - DNA, 18 bp, Homo sapiens
gcatgccaacaagaatgc

SEQ ID NO: 2931028 - DNA, 23 bp, Homo sapiens
gcatgccaacaagaatgcattga

SEQ ID NO: 2931029 - DNA, 19 bp, Homo sapiens
gcatgccaggacccgccag

SEQ ID NO: 2931030 - DNA, 19 bp, Homo sapiens
gcatgcgattatctaccca

SEQ ID NO: 2931031 - DNA, 21 bp, Homo sapiens
gcatgcgccaccatgccctat

SEQ ID NO: 2931032 - DNA, 13 bp, Homo sapiens
gcatgctctctgc

SEQ ID NO: 2931033 - DNA, 18 bp, Homo sapiens
gcatggaagttggggcac

SEQ ID NO: 2931034 - DNA, 19 bp, Homo sapiens
gcatggacagtgtgggcgc

SEQ ID NO: 2931035 - DNA, 13 bp, Homo sapiens
gcatggcagctgg

SEQ ID NO: 2931036 - DNA, 15 bp, Homo sapiens
gcatggcagctgggc

SEQ ID NO: 2931037 - DNA, 16 bp, Homo sapiens
gcatggcagctgggcc

SEQ ID NO: 2931038 - DNA, 23 bp, Homo sapiens
gcatggcgtagagggtgctgccc

SEQ ID NO: 2931039 - DNA, 14 bp, Homo sapiens
gcatggggcatgtc

SEQ ID NO: 2931040 - DNA, 15 bp, Homo sapiens
gcatggggcatgtcc

SEQ ID NO: 2931041 - DNA, 18 bp, Homo sapiens
gcatggggggtgggggga

SEQ ID NO: 2931042 - DNA, 19 bp, Homo sapiens
gcatgggtcgggagagggg

SEQ ID NO: 2931043 - DNA, 23 bp, Homo sapiens
gcatgggtcgggagaggggacgc

SEQ ID NO: 2931044 - DNA, 21 bp, Homo sapiens
gcatggtgccccaggaccagc

SEQ ID NO: 2931045 - DNA, 18 bp, Homo sapiens
gcatggtgcgggcacctg

SEQ ID NO: 2931046 - DNA, 15 bp, Homo sapiens
gcatggtggcaggcg

SEQ ID NO: 2931047 - DNA, 15 bp, Homo sapiens
gcatggtggccagag

SEQ ID NO: 2931048 - DNA, 19 bp, Homo sapiens
gcatggtggcgcaagcctg

SEQ ID NO: 2931049 - DNA, 21 bp, Homo sapiens
gcatgtaaaatcttcagctgg

SEQ ID NO: 2931050 - DNA, 17 bp, Homo sapiens
gcatgtaaacacgcctg

SEQ ID NO: 2931051 - DNA, 19 bp, Homo sapiens
gcatgtaaacacgcctgca

SEQ ID NO: 2931052 - DNA, 18 bp, Homo sapiens
gcatgtacaaaaattatg

SEQ ID NO: 2931053 - DNA, 14 bp, Homo sapiens
gcatgtagccagtt

SEQ ID NO: 2931054 - DNA, 20 bp, Homo sapiens
gcatgtcaaacatgagatgt

SEQ ID NO: 2931055 - DNA, 16 bp, Homo sapiens
gcatgtcccatcacgt

SEQ ID NO: 2931056 - DNA, 15 bp, Homo sapiens
gcatgtctaattcat

SEQ ID NO: 2931057 - DNA, 18 bp, Homo sapiens
gcatgtctaattcattta

SEQ ID NO: 2931058 - DNA, 12 bp, Homo sapiens
gcatgtgaagaa

SEQ ID NO: 2931059 - DNA, 21 bp, Homo sapiens
gcatgtgactctgaagctgac

SEQ ID NO: 2931060 - DNA, 22 bp, Homo sapiens
gcatgtgcgtggaagtgttcct

SEQ ID NO: 2931061 - DNA, 23 bp, Homo sapiens
gcatgtgcgtggaagtgttcctg

SEQ ID NO: 2931062 - DNA, 16 bp, Homo sapiens
gcatgtggcttctctg

SEQ ID NO: 2931063 - DNA, 16 bp, Homo sapiens
gcatgtgtatatatgt

SEQ ID NO: 2931064 - DNA, 19 bp, Homo sapiens
gcatgtgtatatatgtcaa

SEQ ID NO: 2931065 - DNA, 21 bp, Homo sapiens
gcatgttgttttttcatagtg

SEQ ID NO: 2931066 - DNA, 14 bp, Homo sapiens
gcatgtttaatgtg

SEQ ID NO: 2931067 - DNA, 15 bp, Homo sapiens
gcatgttttctgctt

SEQ ID NO: 2931068 - DNA, 19 bp, Homo sapiens
gcatgttttctgctttaaa

SEQ ID NO: 2931069 - DNA, 15 bp, Homo sapiens
gcatgttttcttcat

SEQ ID NO: 2931070 - DNA, 15 bp, Homo sapiens
gcattaaaataacta

SEQ ID NO: 2931071 - DNA, 22 bp, Homo sapiens
gcattaaaataactatcaggca

SEQ ID NO: 2931072 - DNA, 14 bp, Homo sapiens
gcattaagcccaat

SEQ ID NO: 2931073 - DNA, 14 bp, Homo sapiens
gcattactttatag

SEQ ID NO: 2931074 - DNA, 21 bp, Homo sapiens
gcattagattcctttcctgtg

SEQ ID NO: 2931075 - DNA, 19 bp, Homo sapiens
gcattatgtccactgtgta

SEQ ID NO: 2931076 - DNA, 23 bp, Homo sapiens
gcattatgtccactgtgtataga

SEQ ID NO: 2931077 - DNA, 20 bp, Homo sapiens
gcattattgacgaactggct

SEQ ID NO: 2931078 - DNA, 18 bp, Homo sapiens
gcattcaggcagcactga

SEQ ID NO: 2931079 - DNA, 23 bp, Homo sapiens
gcattcaggcagcactgacaata

SEQ ID NO: 2931080 - DNA, 14 bp, Homo sapiens
gcattccagagtta

SEQ ID NO: 2931081 - DNA, 19 bp, Homo sapiens
gcattccagagttaaaatg

SEQ ID NO: 2931082 - DNA, 14 bp, Homo sapiens
gccccatcctccag

SEQ ID NO: 2931083 - DNA, 16 bp, Homo sapiens
gccccatcctccagca

SEQ ID NO: 2931084 - DNA, 14 bp, Homo sapiens
gccccatgaagcca

SEQ ID NO: 2931085 - DNA, 16 bp, Homo sapiens
gccccatgtctctcag

SEQ ID NO: 2931086 - DNA, 23 bp, Homo sapiens
gccccattcttttgtaatttaaa

SEQ ID NO: 2931087 - DNA, 14 bp, Homo sapiens
gcccccaagcctgc

SEQ ID NO: 2931088 - DNA, 21 bp, Homo sapiens
gcccccacatttgtgccgaca

SEQ ID NO: 2931089 - DNA, 20 bp, Homo sapiens
gcccccaccacacatcccag

SEQ ID NO: 2931090 - DNA, 21 bp, Homo sapiens
gcccccaccacacatcccagc

SEQ ID NO: 2931091 - DNA, 10 bp, Homo sapiens
gcccccaccg

SEQ ID NO: 2931092 - DNA, 17 bp, Homo sapiens
gcccccaccgtgggcag

SEQ ID NO: 2931093 - DNA, 22 bp, Homo sapiens
gcccccaccgtgggcagggagc

SEQ ID NO: 2931094 - DNA, 17 bp, Homo sapiens
gcccccacttttctagt

SEQ ID NO: 2931095 - DNA, 23 bp, Homo sapiens
gcccccagctaagaacctggaac

SEQ ID NO: 2931096 - DNA, 15 bp, Homo sapiens
gcccccaggcctgcc

SEQ ID NO: 2931097 - DNA, 14 bp, Homo sapiens
gccccccagggcta

SEQ ID NO: 2931098 - DNA, 13 bp, Homo sapiens
gcccccccttcca

SEQ ID NO: 2931099 - DNA, 13 bp, Homo sapiens
gcccccctcccag

SEQ ID NO: 2931100 - DNA, 23 bp, Homo sapiens
gcccccgacccccgcagaggcag

SEQ ID NO: 2931101 - DNA, 17 bp, Homo sapiens
gcccccgacggctgtga

SEQ ID NO: 2931102 - DNA, 19 bp, Homo sapiens
gcccccgcgccctccctcc

SEQ ID NO: 2931103 - DNA, 12 bp, Homo sapiens
gccccctaggat

SEQ ID NO: 2931104 - DNA, 15 bp, Homo sapiens
gccccctcaccccag

SEQ ID NO: 2931105 - DNA, 15 bp, Homo sapiens
gccccctcagctctg

SEQ ID NO: 2931106 - DNA, 12 bp, Homo sapiens
gccccctggcag

SEQ ID NO: 2931107 - DNA, 14 bp, Homo sapiens
gccccctggcagct

SEQ ID NO: 2931108 - DNA, 17 bp, Homo sapiens
gccccctggcagctgcc

SEQ ID NO: 2931109 - DNA, 20 bp, Homo sapiens
gccccctggcagctgcccct

SEQ ID NO: 2931110 - DNA, 22 bp, Homo sapiens
gccccctggcagctgcccctcc

SEQ ID NO: 2931111 - DNA, 23 bp, Homo sapiens
gccccctggcagctgcccctcct

SEQ ID NO: 2931112 - DNA, 14 bp, Homo sapiens
gccccctggcctct

SEQ ID NO: 2931113 - DNA, 16 bp, Homo sapiens
gccccctggcctctgt

SEQ ID NO: 2931114 - DNA, 16 bp, Homo sapiens
gccccgaagggccccc

SEQ ID NO: 2931115 - DNA, 18 bp, Homo sapiens
gccccgcctgcctgccac

SEQ ID NO: 2931116 - DNA, 20 bp, Homo sapiens
gccccgcggcccagcaggtg

SEQ ID NO: 2931117 - DNA, 14 bp, Homo sapiens
gccccgctgtgtcc

SEQ ID NO: 2931118 - DNA, 17 bp, Homo sapiens
gccccgctgtgtcctcc

SEQ ID NO: 2931119 - DNA, 20 bp, Homo sapiens
gccccgcttgtccagcgcct

SEQ ID NO: 2931120 - DNA, 18 bp, Homo sapiens
gccccggcaactctggct

SEQ ID NO: 2931121 - DNA, 19 bp, Homo sapiens
gccccggcgcccgcaccca

SEQ ID NO: 2931122 - DNA, 12 bp, Homo sapiens
gccccgggctgg

SEQ ID NO: 2931123 - DNA, 15 bp, Homo sapiens
gccccgggctggccc

SEQ ID NO: 2931124 - DNA, 16 bp, Homo sapiens
gccccgggctggccct

SEQ ID NO: 2931125 - DNA, 13 bp, Homo sapiens
gccccgtgaggca

SEQ ID NO: 2931126 - DNA, 18 bp, Homo sapiens
gcccctaaagatgggagg

SEQ ID NO: 2931127 - DNA, 21 bp, Homo sapiens
gcccctaaagatgggaggaga

SEQ ID NO: 2931128 - DNA, 15 bp, Homo sapiens
gcccctacccctgcc

SEQ ID NO: 2931129 - DNA, 21 bp, Homo sapiens
gcccctacccctgccctgctc

SEQ ID NO: 2931130 - DNA, 20 bp, Homo sapiens
gcccctatgtagtccgtgct

SEQ ID NO: 2931131 - DNA, 14 bp, Homo sapiens
gcccctcaccctct

SEQ ID NO: 2931132 - DNA, 13 bp, Homo sapiens
gcccctcacctgg

SEQ ID NO: 2931133 - DNA, 16 bp, Homo sapiens
gcccctcacctggtac

SEQ ID NO: 2931134 - DNA, 22 bp, Homo sapiens
gcccctccagagacaggaaaga

SEQ ID NO: 2931135 - DNA, 13 bp, Homo sapiens
gcccctcccccag

SEQ ID NO: 2931136 - DNA, 14 bp, Homo sapiens
gcccctcccccagg

SEQ ID NO: 2931137 - DNA, 17 bp, Homo sapiens
gcccctccccctaccgc

SEQ ID NO: 2931138 - DNA, 18 bp, Homo sapiens
gcccctcccctcagagcc

SEQ ID NO: 2931139 - DNA, 19 bp, Homo sapiens
gcccctcccctcagagccc

SEQ ID NO: 2931140 - DNA, 15 bp, Homo sapiens
gcccctccctagatc

SEQ ID NO: 2931141 - DNA, 12 bp, Homo sapiens
gcccctcctccc

SEQ ID NO: 2931142 - DNA, 18 bp, Homo sapiens
gcccctcctctgccacct

SEQ ID NO: 2931143 - DNA, 14 bp, Homo sapiens
gcccctcctggagc

SEQ ID NO: 2931144 - DNA, 19 bp, Homo sapiens
gcccctcggctctggaggc

SEQ ID NO: 2931145 - DNA, 14 bp, Homo sapiens
gcccctctctgggc

SEQ ID NO: 2931146 - DNA, 15 bp, Homo sapiens
gcccctctctgggcc

SEQ ID NO: 2931147 - DNA, 12 bp, Homo sapiens
gcccctgaccct

SEQ ID NO: 2931148 - DNA, 20 bp, Homo sapiens
gcccctgagatctctgcagg

SEQ ID NO: 2931149 - DNA, 11 bp, Homo sapiens
gcccctgccag

SEQ ID NO: 2931150 - DNA, 15 bp, Homo sapiens
gcccctgctgctgtc

SEQ ID NO: 2931151 - DNA, 20 bp, Homo sapiens
gcccctgctgctgtcacctc

SEQ ID NO: 2931152 - DNA, 13 bp, Homo sapiens
gcccctggaacct

SEQ ID NO: 2931153 - DNA, 12 bp, Homo sapiens
gcccctggcact

SEQ ID NO: 2931154 - DNA, 16 bp, Homo sapiens
gcccctggcccaggag

SEQ ID NO: 2931155 - DNA, 13 bp, Homo sapiens
gcccctggcccca

SEQ ID NO: 2931156 - DNA, 16 bp, Homo sapiens
gcccctggctgggacg

SEQ ID NO: 2931157 - DNA, 11 bp, Homo sapiens
gcccctgggtt

SEQ ID NO: 2931158 - DNA, 14 bp, Homo sapiens
gcccctgtgcctct

SEQ ID NO: 2931159 - DNA, 20 bp, Homo sapiens
gcccctgtgcctctgtccta

SEQ ID NO: 2931160 - DNA, 22 bp, Homo sapiens
gccccttcattgatttcctgtg

SEQ ID NO: 2931161 - DNA, 17 bp, Homo sapiens
gccccttctgctcagct

SEQ ID NO: 2931162 - DNA, 19 bp, Homo sapiens
gccccttctgctcagctct

SEQ ID NO: 2931163 - DNA, 20 bp, Homo sapiens
gccccttctgctcagctctg

SEQ ID NO: 2931164 - DNA, 13 bp, Homo sapiens
gccccttgccatc

SEQ ID NO: 2931165 - DNA, 14 bp, Homo sapiens
gccccttggattac

SEQ ID NO: 2931166 - DNA, 15 bp, Homo sapiens
gcccctttacggaca

SEQ ID NO: 2931167 - DNA, 17 bp, Homo sapiens
gcccctttgggccctgc

SEQ ID NO: 2931168 - DNA, 21 bp, Homo sapiens
gcccgagtgcggcgtggagac

SEQ ID NO: 2931169 - DNA, 19 bp, Homo sapiens
gcccgcaccctggcctggt

SEQ ID NO: 2931170 - DNA, 15 bp, Homo sapiens
gcccgcagcccagac

SEQ ID NO: 2931171 - DNA, 20 bp, Homo sapiens
gcccgcccagaggagcccag

SEQ ID NO: 2931172 - DNA, 22 bp, Homo sapiens
gcccgcctgcccacctgcctgg

SEQ ID NO: 2931173 - DNA, 18 bp, Homo sapiens
gcccgcggcctgcaccga

SEQ ID NO: 2931174 - DNA, 13 bp, Homo sapiens
gcccgcggcctgg

SEQ ID NO: 2931175 - DNA, 14 bp, Homo sapiens
gcccgcggcctgga

SEQ ID NO: 2931176 - DNA, 15 bp, Homo sapiens
gcccgcggcctggac

SEQ ID NO: 2931177 - DNA, 20 bp, Homo sapiens
gcccgcgggcacagccagcc

SEQ ID NO: 2931178 - DNA, 17 bp, Homo sapiens
gcccgcgtctgtgccgc

SEQ ID NO: 2931179 - DNA, 13 bp, Homo sapiens
gcccgctggggac

SEQ ID NO: 2931180 - DNA, 18 bp, Homo sapiens
gcccggccagccatgtct

SEQ ID NO: 2931181 - DNA, 22 bp, Homo sapiens
gcccggcccctcaccctctgtc

SEQ ID NO: 2931182 - DNA, 23 bp, Homo sapiens
gcccggcccctcaccctctgtcc

SEQ ID NO: 2931183 - DNA, 18 bp, Homo sapiens
gcccggcgcctggcctcc

SEQ ID NO: 2931184 - DNA, 23 bp, Homo sapiens
gcccggcgcctggcctccaggcc

SEQ ID NO: 2931185 - DNA, 21 bp, Homo sapiens
gcccggcgcggtggctcacgc

SEQ ID NO: 2931186 - DNA, 18 bp, Homo sapiens
gcccggctcggcccagca

SEQ ID NO: 2931187 - DNA, 23 bp, Homo sapiens
gcccgggccgaccctgcggcctc

SEQ ID NO: 2931188 - DNA, 17 bp, Homo sapiens
gcccggtggcggcaggg

SEQ ID NO: 2931189 - DNA, 19 bp, Homo sapiens
gcccggtggcggcagggcc

SEQ ID NO: 2931190 - DNA, 17 bp, Homo sapiens
gcccgtaatcccagcta

SEQ ID NO: 2931191 - DNA, 13 bp, Homo sapiens
gcccgtcggagct

SEQ ID NO: 2931192 - DNA, 18 bp, Homo sapiens
gcccgtcggagctgcctg

SEQ ID NO: 2931193 - DNA, 22 bp, Homo sapiens
gcccgtgccacccccagccctg

SEQ ID NO: 2931194 - DNA, 22 bp, Homo sapiens
gcccgtggcctggcatctgtgt

SEQ ID NO: 2931195 - DNA, 17 bp, Homo sapiens
gcccgtgtacatagtgc

SEQ ID NO: 2931196 - DNA, 15 bp, Homo sapiens
gccctaaaagcacac

SEQ ID NO: 2931197 - DNA, 21 bp, Homo sapiens
gccctaagaggtttttcctct

SEQ ID NO: 2931198 - DNA, 23 bp, Homo sapiens
gccctaaggccttggtgccctga

SEQ ID NO: 2931199 - DNA, 22 bp, Homo sapiens
gccctaagtgatttccacaggt

SEQ ID NO: 2931200 - DNA, 15 bp, Homo sapiens
gccctaattcagcca

SEQ ID NO: 2931201 - DNA, 16 bp, Homo sapiens
gccctaattcagccat

SEQ ID NO: 2931202 - DNA, 22 bp, Homo sapiens
gccctaattcagccatgtacag

SEQ ID NO: 2931203 - DNA, 15 bp, Homo sapiens
gccctaattcatctt

SEQ ID NO: 2931204 - DNA, 20 bp, Homo sapiens
gccctaattcatcttttaat

SEQ ID NO: 2931205 - DNA, 14 bp, Homo sapiens
gccctatgtctcag

SEQ ID NO: 2931206 - DNA, 17 bp, Homo sapiens
gccctatgtctcaggag

SEQ ID NO: 2931207 - DNA, 17 bp, Homo sapiens
gccctcaagtaaaagaa

SEQ ID NO: 2931208 - DNA, 15 bp, Homo sapiens
gccctcactcttgaa

SEQ ID NO: 2931209 - DNA, 18 bp, Homo sapiens
gccctcagaacccttggc

SEQ ID NO: 2931210 - DNA, 13 bp, Homo sapiens
gccctcccaccac

SEQ ID NO: 2931211 - DNA, 15 bp, Homo sapiens
gccctcccaccaccc

SEQ ID NO: 2931212 - DNA, 17 bp, Homo sapiens
gccctcccaccacccca

SEQ ID NO: 2931213 - DNA, 19 bp, Homo sapiens
gccctccccatggagccag

SEQ ID NO: 2931214 - DNA, 20 bp, Homo sapiens
gccctccccgatggcgggga

SEQ ID NO: 2931215 - DNA, 20 bp, Homo sapiens
gccttttacccctgcacagt

SEQ ID NO: 2931216 - DNA, 15 bp, Homo sapiens
gccttttacctggat

SEQ ID NO: 2931217 - DNA, 23 bp, Homo sapiens
gccttttccaaatgcccaaggat

SEQ ID NO: 2931218 - DNA, 16 bp, Homo sapiens
gccttttctggcaccg

SEQ ID NO: 2931219 - DNA, 21 bp, Homo sapiens
gccttttgggggtgggtctgg

SEQ ID NO: 2931220 - DNA, 22 bp, Homo sapiens
gcctttttccttatttcaaggg

SEQ ID NO: 2931221 - DNA, 23 bp, Homo sapiens
gcgaaaggatgtaaacagtgcct

SEQ ID NO: 2931222 - DNA, 14 bp, Homo sapiens
gcgaacatcttcat

SEQ ID NO: 2931223 - DNA, 17 bp, Homo sapiens
gcgaagtcctatggaaa

SEQ ID NO: 2931224 - DNA, 14 bp, Homo sapiens
gcgaattttaaaag

SEQ ID NO: 2931225 - DNA, 13 bp, Homo sapiens
gcgacaaagatga

SEQ ID NO: 2931226 - DNA, 10 bp, Homo sapiens
gcgacctcct

SEQ ID NO: 2931227 - DNA, 20 bp, Homo sapiens
gcgacgcacctcgagggtgt

SEQ ID NO: 2931228 - DNA, 20 bp, Homo sapiens
gcgacttttgttctcttctg

SEQ ID NO: 2931229 - DNA, 22 bp, Homo sapiens
gcgagaccccctgtcctgtgct

SEQ ID NO: 2931230 - DNA, 23 bp, Homo sapiens
gcgagatggggtggggtggagaa

SEQ ID NO: 2931231 - DNA, 21 bp, Homo sapiens
gcgagcccctcggctctggag

SEQ ID NO: 2931232 - DNA, 14 bp, Homo sapiens
gcgagcctgactct

SEQ ID NO: 2931233 - DNA, 14 bp, Homo sapiens
gcgaggaggcgcgg

SEQ ID NO: 2931234 - DNA, 16 bp, Homo sapiens
gcgaggaggcgcggcc

SEQ ID NO: 2931235 - DNA, 22 bp, Homo sapiens
gcgaggaggcgcggcctcccga

SEQ ID NO: 2931236 - DNA, 17 bp, Homo sapiens
gcgaggaggctccagag

SEQ ID NO: 2931237 - DNA, 19 bp, Homo sapiens
gcgaggcccttcctctttg

SEQ ID NO: 2931238 - DNA, 13 bp, Homo sapiens
gcgaggggaaagg

SEQ ID NO: 2931239 - DNA, 17 bp, Homo sapiens
gcgaggggaaaggcctg

SEQ ID NO: 2931240 - DNA, 17 bp, Homo sapiens
gcgaggtcaacagagaa

SEQ ID NO: 2931241 - DNA, 18 bp, Homo sapiens
gcgaggtcaacagagaag

SEQ ID NO: 2931242 - DNA, 22 bp, Homo sapiens
gcgaggtcaacagagaaggcag

SEQ ID NO: 2931243 - DNA, 22 bp, Homo sapiens
gcgagtgaatgccagtgtgctg

SEQ ID NO: 2931244 - DNA, 18 bp, Homo sapiens
gcgagtggatgctgtgct

SEQ ID NO: 2931245 - DNA, 19 bp, Homo sapiens
gcgagtggatgctgtgcta

SEQ ID NO: 2931246 - DNA, 13 bp, Homo sapiens
gcgatagagtctc

SEQ ID NO: 2931247 - DNA, 14 bp, Homo sapiens
gcgattctcctgcc

SEQ ID NO: 2931248 - DNA, 20 bp, Homo sapiens
gcgattctcctgcctcagcc

SEQ ID NO: 2931249 - DNA, 22 bp, Homo sapiens
gcgattctcctgcctcagcctc

SEQ ID NO: 2931250 - DNA, 13 bp, Homo sapiens
gcgattgaatgct

SEQ ID NO: 2931251 - DNA, 15 bp, Homo sapiens
gcgattttattactg

SEQ ID NO: 2931252 - DNA, 14 bp, Homo sapiens
gcgcaagccacagc

SEQ ID NO: 2931253 - DNA, 17 bp, Homo sapiens
gcgcaagccacagcctg

SEQ ID NO: 2931254 - DNA, 23 bp, Homo sapiens
gcgcaagccacagcctgtcttgt

SEQ ID NO: 2931255 - DNA, 12 bp, Homo sapiens
gcgcaagcctgt

SEQ ID NO: 2931256 - DNA, 22 bp, Homo sapiens
gcgcaagcctgtaatcccagct

SEQ ID NO: 2931257 - DNA, 14 bp, Homo sapiens
gcgcacaccgccag

SEQ ID NO: 2931258 - DNA, 11 bp, Homo sapiens
gcgcagacagg

SEQ ID NO: 2931259 - DNA, 14 bp, Homo sapiens
gcgcagccccatct

SEQ ID NO: 2931260 - DNA, 14 bp, Homo sapiens
gcgccaccatgccc

SEQ ID NO: 2931261 - DNA, 15 bp, Homo sapiens
gcgccaccatgccct

SEQ ID NO: 2931262 - DNA, 13 bp, Homo sapiens
gcgccaggcagag

SEQ ID NO: 2931263 - DNA, 15 bp, Homo sapiens
gcgccaggctgacca

SEQ ID NO: 2931264 - DNA, 15 bp, Homo sapiens
gcgccagggcccagg

SEQ ID NO: 2931265 - DNA, 16 bp, Homo sapiens
gcgccagggcccaggc

SEQ ID NO: 2931266 - DNA, 18 bp, Homo sapiens
gcgccagggcccaggcca

SEQ ID NO: 2931267 - DNA, 13 bp, Homo sapiens
gcgcccacccagg

SEQ ID NO: 2931268 - DNA, 16 bp, Homo sapiens
gcgcccacccaggtcc

SEQ ID NO: 2931269 - DNA, 16 bp, Homo sapiens
gcgcccagcagcctgc

SEQ ID NO: 2931270 - DNA, 12 bp, Homo sapiens
gcgccccaccca

SEQ ID NO: 2931271 - DNA, 20 bp, Homo sapiens
gcgcccccaggcctgccctg

SEQ ID NO: 2931272 - DNA, 12 bp, Homo sapiens
gcgccctccctc

SEQ ID NO: 2931273 - DNA, 13 bp, Homo sapiens
gcgccctccctcc

SEQ ID NO: 2931274 - DNA, 14 bp, Homo sapiens
gcgccctggacttg

SEQ ID NO: 2931275 - DNA, 16 bp, Homo sapiens
gcgccctggacttggt

SEQ ID NO: 2931276 - DNA, 12 bp, Homo sapiens
gcgccctttccc

SEQ ID NO: 2931277 - DNA, 17 bp, Homo sapiens
gcgccgcaaaccacact

SEQ ID NO: 2931278 - DNA, 20 bp, Homo sapiens
gcgcctagagcgcggctggc

SEQ ID NO: 2931279 - DNA, 24 bp, Homo sapiens
gcgcctagagcgcggctggctctg

SEQ ID NO: 2931280 - DNA, 21 bp, Homo sapiens
gcgcctagtggggtctccctc

SEQ ID NO: 2931281 - DNA, 12 bp, Homo sapiens
gcgcctccatcc

SEQ ID NO: 2931282 - DNA, 13 bp, Homo sapiens
gcgcctgccctgc

SEQ ID NO: 2931283 - DNA, 14 bp, Homo sapiens
gcgcctgccctgcc

SEQ ID NO: 2931284 - DNA, 16 bp, Homo sapiens
gcgcctggcctccagg

SEQ ID NO: 2931285 - DNA, 22 bp, Homo sapiens
gcgcctggcctccaggcccgtc

SEQ ID NO: 2931286 - DNA, 17 bp, Homo sapiens
gcgcctgtataagtaga

SEQ ID NO: 2931287 - DNA, 16 bp, Homo sapiens
gcgcctgtcccctcac

SEQ ID NO: 2931288 - DNA, 15 bp, Homo sapiens
gcgcctttcccaact

SEQ ID NO: 2931289 - DNA, 13 bp, Homo sapiens
gcgcgctctctct

SEQ ID NO: 2931290 - DNA, 18 bp, Homo sapiens
gcgcggcggctctgccca

SEQ ID NO: 2931291 - DNA, 16 bp, Homo sapiens
gcgcggctggctctgt

SEQ ID NO: 2931292 - DNA, 15 bp, Homo sapiens
gcgctcggcaggaag

SEQ ID NO: 2931293 - DNA, 16 bp, Homo sapiens
gcgctcggcaggaagg

SEQ ID NO: 2931294 - DNA, 20 bp, Homo sapiens
gcgctctccctaccttgcct

SEQ ID NO: 2931295 - DNA, 23 bp, Homo sapiens
gcgctctccctaccttgcctcct

SEQ ID NO: 2931296 - DNA, 12 bp, Homo sapiens
gcgctctcctgg

SEQ ID NO: 2931297 - DNA, 13 bp, Homo sapiens
gcgctctcctgga

SEQ ID NO: 2931298 - DNA, 17 bp, Homo sapiens
gcgctctctctctttct

SEQ ID NO: 2931299 - DNA, 21 bp, Homo sapiens
gcgctgaggtgtctggcctga

SEQ ID NO: 2931300 - DNA, 17 bp, Homo sapiens
gcgctgccgcaccccag

SEQ ID NO: 2931301 - DNA, 16 bp, Homo sapiens
gcgctgggcacttccc

SEQ ID NO: 2931302 - DNA, 20 bp, Homo sapiens
gcgctgggcacttccctgct

SEQ ID NO: 2931303 - DNA, 22 bp, Homo sapiens
gcgctgggcacttccctgctgc

SEQ ID NO: 2931304 - DNA, 16 bp, Homo sapiens
gcgctggttccgccag

SEQ ID NO: 2931305 - DNA, 23 bp, Homo sapiens
gcgcttcctgagcagtccctgct

SEQ ID NO: 2931306 - DNA, 16 bp, Homo sapiens
gcgctttgaacgtgcc

SEQ ID NO: 2931307 - DNA, 17 bp, Homo sapiens
gcgctttgaacgtgcca

SEQ ID NO: 2931308 - DNA, 15 bp, Homo sapiens
gcggaaagcagctca

SEQ ID NO: 2931309 - DNA, 19 bp, Homo sapiens
gcggaagtacttccctcag

SEQ ID NO: 2931310 - DNA, 21 bp, Homo sapiens
gcggaagtacttccctcaggc

SEQ ID NO: 2931311 - DNA, 17 bp, Homo sapiens
gcggacaaaagggccag

SEQ ID NO: 2931312 - DNA, 16 bp, Homo sapiens
gcggacgtgctggcct

SEQ ID NO: 2931313 - DNA, 17 bp, Homo sapiens
gcggacgtgctggcctt

SEQ ID NO: 2931314 - DNA, 22 bp, Homo sapiens
gcggagagaggccttgtcccag

SEQ ID NO: 2931315 - DNA, 16 bp, Homo sapiens
gcggagctgctgagtg

SEQ ID NO: 2931316 - DNA, 17 bp, Homo sapiens
gcggagctggccccgcc

SEQ ID NO: 2931317 - DNA, 22 bp, Homo sapiens
gcggaggcgctcctccctgcct

SEQ ID NO: 2931318 - DNA, 14 bp, Homo sapiens
gcggatcacttgag

SEQ ID NO: 2931319 - DNA, 13 bp, Homo sapiens
gcggatctcactc

SEQ ID NO: 2931320 - DNA, 19 bp, Homo sapiens
gcggattaatttgcatctg

SEQ ID NO: 2931321 - DNA, 18 bp, Homo sapiens
gcggcagctcttctgggc

SEQ ID NO: 2931322 - DNA, 19 bp, Homo sapiens
gcggcaggaccgccatggt

SEQ ID NO: 2931323 - DNA, 22 bp, Homo sapiens
gcggcagggccaggctggtccg

SEQ ID NO: 2931324 - DNA, 15 bp, Homo sapiens
gcggccagggaccca

SEQ ID NO: 2931325 - DNA, 14 bp, Homo sapiens
gcggccagggcggc

SEQ ID NO: 2931326 - DNA, 18 bp, Homo sapiens
gcggccagggcggccagg

SEQ ID NO: 2931327 - DNA, 23 bp, Homo sapiens
gcggccagggcggccagggaccc

SEQ ID NO: 2931328 - DNA, 16 bp, Homo sapiens
gcggcccaagagcccg

SEQ ID NO: 2931329 - DNA, 14 bp, Homo sapiens
gcggcccagaccca

SEQ ID NO: 2931330 - DNA, 15 bp, Homo sapiens
gcggcccagacccac

SEQ ID NO: 2931331 - DNA, 14 bp, Homo sapiens
gcggcccagcaggt

SEQ ID NO: 2931332 - DNA, 15 bp, Homo sapiens
gcggcccagcaggtg

SEQ ID NO: 2931333 - DNA, 14 bp, Homo sapiens
gcggccctcagtgc

SEQ ID NO: 2931334 - DNA, 17 bp, Homo sapiens
gcggccctggggcgggc

SEQ ID NO: 2931335 - DNA, 15 bp, Homo sapiens
gcggccgcattccct

SEQ ID NO: 2931336 - DNA, 16 bp, Homo sapiens
gcggcctcccgaggag

SEQ ID NO: 2931337 - DNA, 12 bp, Homo sapiens
gcggcctggacc

SEQ ID NO: 2931338 - DNA, 18 bp, Homo sapiens
gcggcctggggggaacgg

SEQ ID NO: 2931339 - DNA, 16 bp, Homo sapiens
gcggcggagctggccc

SEQ ID NO: 2931340 - DNA, 20 bp, Homo sapiens
gcggcgtggagactggcagg

SEQ ID NO: 2931341 - DNA, 13 bp, Homo sapiens
gcggctactcagc

SEQ ID NO: 2931342 - DNA, 19 bp, Homo sapiens
gcggctactcagcagccct

SEQ ID NO: 2931343 - DNA, 19 bp, Homo sapiens
gcggctctgcccacctctc

SEQ ID NO: 2931344 - DNA, 22 bp, Homo sapiens
gcggctgagtcatgatctccct

SEQ ID NO: 2931345 - DNA, 23 bp, Homo sapiens
gcggctgagtcatgatctccctg

SEQ ID NO: 2931346 - DNA, 21 bp, Homo sapiens
gcggctgccgactcccccaac

SEQ ID NO: 2931347 - DNA, 20 bp, Homo sapiens
gcggctgctcgcccaggaag

SEQ ID NO: 2931348 - DNA, 22 bp, Homo sapiens
gctctttcctgcccttttcctg

SEQ ID NO: 2931349 - DNA, 20 bp, Homo sapiens
gctgaaaacctaagtccttt

SEQ ID NO: 2931350 - DNA, 14 bp, Homo sapiens
gctgaacagtgctc

SEQ ID NO: 2931351 - DNA, 17 bp, Homo sapiens
gctgaacagtgctctgc

SEQ ID NO: 2931352 - DNA, 19 bp, Homo sapiens
gctgaacagtgctctgcct

SEQ ID NO: 2931353 - DNA, 18 bp, Homo sapiens
gctgaacataacttctca

SEQ ID NO: 2931354 - DNA, 11 bp, Homo sapiens
gctgaagagca

SEQ ID NO: 2931355 - DNA, 15 bp, Homo sapiens
gctgaagagcaaggt

SEQ ID NO: 2931356 - DNA, 15 bp, Homo sapiens
gctgaataaagggaa

SEQ ID NO: 2931357 - DNA, 12 bp, Homo sapiens
gctgaataaatg

SEQ ID NO: 2931358 - DNA, 14 bp, Homo sapiens
gctgaataaatgtc

SEQ ID NO: 2931359 - DNA, 18 bp, Homo sapiens
gctgaataaatgtctttt

SEQ ID NO: 2931360 - DNA, 10 bp, Homo sapiens
gctgaatcca

SEQ ID NO: 2931361 - DNA, 17 bp, Homo sapiens
gctgaatgttgggactg

SEQ ID NO: 2931362 - DNA, 19 bp, Homo sapiens
gctgaatttataaaaatta

SEQ ID NO: 2931363 - DNA, 21 bp, Homo sapiens
gctgacacttcaaggtgacag

SEQ ID NO: 2931364 - DNA, 17 bp, Homo sapiens
gctgacattcacctgcc

SEQ ID NO: 2931365 - DNA, 13 bp, Homo sapiens
gctgaccacagca

SEQ ID NO: 2931366 - DNA, 14 bp, Homo sapiens
gctgaccacagcac

SEQ ID NO: 2931367 - DNA, 21 bp, Homo sapiens
gctgaccagccgtgagcatgt

SEQ ID NO: 2931368 - DNA, 21 bp, Homo sapiens
gctgaccccctccccccaatc

SEQ ID NO: 2931369 - DNA, 14 bp, Homo sapiens
gctgaccctgggcc

SEQ ID NO: 2931370 - DNA, 16 bp, Homo sapiens
gctgaccctgggcctg

SEQ ID NO: 2931371 - DNA, 16 bp, Homo sapiens
gctgacctcaaccctg

SEQ ID NO: 2931372 - DNA, 18 bp, Homo sapiens
gctgacctcacctggtcc

SEQ ID NO: 2931373 - DNA, 17 bp, Homo sapiens
gctgacctccacagctt

SEQ ID NO: 2931374 - DNA, 19 bp, Homo sapiens
gctgacgaacttccatggc

SEQ ID NO: 2931375 - DNA, 21 bp, Homo sapiens
gctgacgccaataataaaaaa

SEQ ID NO: 2931376 - DNA, 20 bp, Homo sapiens
gctgactatttgacccccac

SEQ ID NO: 2931377 - DNA, 22 bp, Homo sapiens
gctgactgccaataacattctt

SEQ ID NO: 2931378 - DNA, 22 bp, Homo sapiens
gctgagagacccaaggaggaaa

SEQ ID NO: 2931379 - DNA, 20 bp, Homo sapiens
gctgagaggctgcctccgca

SEQ ID NO: 2931380 - DNA, 15 bp, Homo sapiens
gctgagcaaacatgt

SEQ ID NO: 2931381 - DNA, 18 bp, Homo sapiens
gctgagcaaatcaccaca

SEQ ID NO: 2931382 - DNA, 17 bp, Homo sapiens
gctgagcaccaggggat

SEQ ID NO: 2931383 - DNA, 14 bp, Homo sapiens
gctgagccaaagcc

SEQ ID NO: 2931384 - DNA, 22 bp, Homo sapiens
gctgagcccctgtctagagagg

SEQ ID NO: 2931385 - DNA, 12 bp, Homo sapiens
gctgagcctgca

SEQ ID NO: 2931386 - DNA, 15 bp, Homo sapiens
gctgagcctgcaggg

SEQ ID NO: 2931387 - DNA, 19 bp, Homo sapiens
gctgagcctgcagggaagc

SEQ ID NO: 2931388 - DNA, 23 bp, Homo sapiens
gctgagcgaggagatgctccttg

SEQ ID NO: 2931389 - DNA, 14 bp, Homo sapiens
gctgagctggggaa

SEQ ID NO: 2931390 - DNA, 12 bp, Homo sapiens
gctgaggaaagg

SEQ ID NO: 2931391 - DNA, 17 bp, Homo sapiens
gctgaggaaaggccagc

SEQ ID NO: 2931392 - DNA, 21 bp, Homo sapiens
gctgaggaaaggccagctggc

SEQ ID NO: 2931393 - DNA, 13 bp, Homo sapiens
gctgaggactctg

SEQ ID NO: 2931394 - DNA, 19 bp, Homo sapiens
gctgaggcacaagaatcac

SEQ ID NO: 2931395 - DNA, 16 bp, Homo sapiens
gctgaggcagaagaat

SEQ ID NO: 2931396 - DNA, 19 bp, Homo sapiens
gctgaggccacactcagca

SEQ ID NO: 2931397 - DNA, 16 bp, Homo sapiens
gctgaggcctcccttg

SEQ ID NO: 2931398 - DNA, 16 bp, Homo sapiens
gctgaggctgagaaag

SEQ ID NO: 2931399 - DNA, 17 bp, Homo sapiens
gctgaggctgagaaagc

SEQ ID NO: 2931400 - DNA, 19 bp, Homo sapiens
gctgaggctgagaaagcta

SEQ ID NO: 2931401 - DNA, 18 bp, Homo sapiens
gctgaggctggcacagga

SEQ ID NO: 2931402 - DNA, 18 bp, Homo sapiens
gctgagggaccgagccca

SEQ ID NO: 2931403 - DNA, 12 bp, Homo sapiens
gctgagggaggg

SEQ ID NO: 2931404 - DNA, 20 bp, Homo sapiens
gctgagggagggagccatgg

SEQ ID NO: 2931405 - DNA, 17 bp, Homo sapiens
gctgagggccctgtgga

SEQ ID NO: 2931406 - DNA, 12 bp, Homo sapiens
gctgaggggacg

SEQ ID NO: 2931407 - DNA, 23 bp, Homo sapiens
gctgaggtggctaagggggacca

SEQ ID NO: 2931408 - DNA, 21 bp, Homo sapiens
gctgagtcatgatctccctgc

SEQ ID NO: 2931409 - DNA, 22 bp, Homo sapiens
gctgagtcatgatctccctgcc

SEQ ID NO: 2931410 - DNA, 22 bp, Homo sapiens
gctgagtccctcacgtttcttc

SEQ ID NO: 2931411 - DNA, 20 bp, Homo sapiens
gctgataccatatgaatgaa

SEQ ID NO: 2931412 - DNA, 17 bp, Homo sapiens
gctgatatatgtgtttt

SEQ ID NO: 2931413 - DNA, 18 bp, Homo sapiens
gctgatatatgtgttttt

SEQ ID NO: 2931414 - DNA, 17 bp, Homo sapiens
gctgatgaatcactgtt

SEQ ID NO: 2931415 - DNA, 16 bp, Homo sapiens
gctgatgcgctgggat

SEQ ID NO: 2931416 - DNA, 20 bp, Homo sapiens
gctgatgttcagtgtaattt

SEQ ID NO: 2931417 - DNA, 21 bp, Homo sapiens
gctgatgttcagtgtaatttc

SEQ ID NO: 2931418 - DNA, 11 bp, Homo sapiens
gctgcaaagtg

SEQ ID NO: 2931419 - DNA, 13 bp, Homo sapiens
gctgcaaagtgtt

SEQ ID NO: 2931420 - DNA, 20 bp, Homo sapiens
gctgcaaggacattcttgta

SEQ ID NO: 2931421 - DNA, 19 bp, Homo sapiens
gctgcaaggtttaggctgg

SEQ ID NO: 2931422 - DNA, 22 bp, Homo sapiens
gctgcacatagcagactagaat

SEQ ID NO: 2931423 - DNA, 18 bp, Homo sapiens
gctgcacgctcccctcca

SEQ ID NO: 2931424 - DNA, 17 bp, Homo sapiens
gctgcactggagccaca

SEQ ID NO: 2931425 - DNA, 20 bp, Homo sapiens
gctgcactggagccacaggc

SEQ ID NO: 2931426 - DNA, 23 bp, Homo sapiens
gctgcagagtcacaagcctcgag

SEQ ID NO: 2931427 - DNA, 23 bp, Homo sapiens
gctgcagataacagaaaggcttt

SEQ ID NO: 2931428 - DNA, 16 bp, Homo sapiens
gctgcagcaccgaggg

SEQ ID NO: 2931429 - DNA, 15 bp, Homo sapiens
gctgcagccaggcct

SEQ ID NO: 2931430 - DNA, 17 bp, Homo sapiens
gctgcagccaggcctcg

SEQ ID NO: 2931431 - DNA, 17 bp, Homo sapiens
gctgcagccctgccagt

SEQ ID NO: 2931432 - DNA, 17 bp, Homo sapiens
gctgcaggaatctttaa

SEQ ID NO: 2931433 - DNA, 17 bp, Homo sapiens
gctgcaggacttgagaa

SEQ ID NO: 2931434 - DNA, 23 bp, Homo sapiens
gctgcagggagcaccacggccag

SEQ ID NO: 2931435 - DNA, 18 bp, Homo sapiens
gctgcagttgaagagcct

SEQ ID NO: 2931436 - DNA, 14 bp, Homo sapiens
gctgccaagcccca

SEQ ID NO: 2931437 - DNA, 21 bp, Homo sapiens
gctgccacccacctccctgcc

SEQ ID NO: 2931438 - DNA, 14 bp, Homo sapiens
gctgccactctgct

SEQ ID NO: 2931439 - DNA, 20 bp, Homo sapiens
gctgccactctgctgcctgt

SEQ ID NO: 2931440 - DNA, 11 bp, Homo sapiens
gctgccactgg

SEQ ID NO: 2931441 - DNA, 14 bp, Homo sapiens
gctgccacttttta

SEQ ID NO: 2931442 - DNA, 18 bp, Homo sapiens
gctgccagctctgtatca

SEQ ID NO: 2931443 - DNA, 13 bp, Homo sapiens
gctgccaggaaac

SEQ ID NO: 2931444 - DNA, 13 bp, Homo sapiens
gctgccagggctt

SEQ ID NO: 2931445 - DNA, 23 bp, Homo sapiens
gctgccagtgtgttactcatctt

SEQ ID NO: 2931446 - DNA, 16 bp, Homo sapiens
gctgcccatttcgtga

SEQ ID NO: 2931447 - DNA, 13 bp, Homo sapiens
gctgccccaggcc

SEQ ID NO: 2931448 - DNA, 23 bp, Homo sapiens
gctgccccaggccggagcccaga

SEQ ID NO: 2931449 - DNA, 22 bp, Homo sapiens
gctgccccggcccctccccctg

SEQ ID NO: 2931450 - DNA, 14 bp, Homo sapiens
gctgcccctccctg

SEQ ID NO: 2931451 - DNA, 13 bp, Homo sapiens
gctgcccctcctg

SEQ ID NO: 2931452 - DNA, 23 bp, Homo sapiens
gctgcccctctctgggcctcaga

SEQ ID NO: 2931453 - DNA, 20 bp, Homo sapiens
gctgcccgctcagcccagct

SEQ ID NO: 2931454 - DNA, 19 bp, Homo sapiens
gctgcccggcgcctgccct

SEQ ID NO: 2931455 - DNA, 21 bp, Homo sapiens
gctgccctaaataacccttca

SEQ ID NO: 2931456 - DNA, 15 bp, Homo sapiens
gctgccctgaggggc

SEQ ID NO: 2931457 - DNA, 19 bp, Homo sapiens
gctgccctgggtcctgcct

SEQ ID NO: 2931458 - DNA, 21 bp, Homo sapiens
gctgccctgggtcctgcctgc

SEQ ID NO: 2931459 - DNA, 20 bp, Homo sapiens
gctgcccttgggccacccct

SEQ ID NO: 2931460 - DNA, 14 bp, Homo sapiens
gctgccgcacccca

SEQ ID NO: 2931461 - DNA, 15 bp, Homo sapiens
gctgccgcaccccag

SEQ ID NO: 2931462 - DNA, 17 bp, Homo sapiens
gctgcctccccaatcca

SEQ ID NO: 2931463 - DNA, 21 bp, Homo sapiens
gctgcctctgacagcagcctg

SEQ ID NO: 2931464 - DNA, 20 bp, Homo sapiens
gctgcctgagtattactagt

SEQ ID NO: 2931465 - DNA, 13 bp, Homo sapiens
gctgcctgcccac

SEQ ID NO: 2931466 - DNA, 17 bp, Homo sapiens
gctgcctgcccacacag

SEQ ID NO: 2931467 - DNA, 18 bp, Homo sapiens
gctgcctgcccacacagg

SEQ ID NO: 2931468 - DNA, 22 bp, Homo sapiens
gctgcctgccggtaaacacgcc

SEQ ID NO: 2931469 - DNA, 16 bp, Homo sapiens
gctgcctggagcccca

SEQ ID NO: 2931470 - DNA, 22 bp, Homo sapiens
gctgcctggagccccactgccc

SEQ ID NO: 2931471 - DNA, 15 bp, Homo sapiens
gctgcctggccatgc

SEQ ID NO: 2931472 - DNA, 19 bp, Homo sapiens
gctgcctgggtaggcccca

SEQ ID NO: 2931473 - DNA, 15 bp, Homo sapiens
gctgcctgtacagaa

SEQ ID NO: 2931474 - DNA, 17 bp, Homo sapiens
gctgccttggctcagac

SEQ ID NO: 2931475 - DNA, 22 bp, Homo sapiens
gctgcctttgatcacaggagca

SEQ ID NO: 2931476 - DNA, 15 bp, Homo sapiens
gctgcctttggactt

SEQ ID NO: 2931477 - DNA, 22 bp, Homo sapiens
gctgcctttgtggtgggcgctg

SEQ ID NO: 2931478 - DNA, 14 bp, Homo sapiens
gctgcgggctgagg

SEQ ID NO: 2931479 - DNA, 15 bp, Homo sapiens
gctgcgggctgaggg

SEQ ID NO: 2931480 - DNA, 21 bp, Homo sapiens
ggaaaatgagtatttggtcca

SEQ ID NO: 2931481 - DNA, 16 bp, Homo sapiens
ggaaaatgcattgtat

SEQ ID NO: 2931482 - DNA, 20 bp, Homo sapiens
ggaaaatgtatccagaggaa

SEQ ID NO: 2931483 - DNA, 22 bp, Homo sapiens
ggaaacaaataatttgaacttt

SEQ ID NO: 2931484 - DNA, 13 bp, Homo sapiens
ggaaacaacagct

SEQ ID NO: 2931485 - DNA, 14 bp, Homo sapiens
ggaaacaagggaag

SEQ ID NO: 2931486 - DNA, 13 bp, Homo sapiens
ggaaacagaggct

SEQ ID NO: 2931487 - DNA, 13 bp, Homo sapiens
ggaaacagaggta

SEQ ID NO: 2931488 - DNA, 20 bp, Homo sapiens
ggaaacatatttaagaaata

SEQ ID NO: 2931489 - DNA, 19 bp, Homo sapiens
ggaaaccacaaccttgcag

SEQ ID NO: 2931490 - DNA, 20 bp, Homo sapiens
ggaaaccagagtctgtattt

SEQ ID NO: 2931491 - DNA, 19 bp, Homo sapiens
ggaaaccccttctctgtga

SEQ ID NO: 2931492 - DNA, 14 bp, Homo sapiens
ggaaacctttgctt

SEQ ID NO: 2931493 - DNA, 23 bp, Homo sapiens
ggaaacgctacctctctgtccct

SEQ ID NO: 2931494 - DNA, 17 bp, Homo sapiens
ggaaacgtgggttcaat

SEQ ID NO: 2931495 - DNA, 13 bp, Homo sapiens
ggaaactggctga

SEQ ID NO: 2931496 - DNA, 16 bp, Homo sapiens
ggaaactgtgaatgct

SEQ ID NO: 2931497 - DNA, 18 bp, Homo sapiens
ggaaagaagagccggagc

SEQ ID NO: 2931498 - DNA, 15 bp, Homo sapiens
ggaaaggccagctgg

SEQ ID NO: 2931499 - DNA, 18 bp, Homo sapiens
ggaaaggccagctggcag

SEQ ID NO: 2931500 - DNA, 15 bp, Homo sapiens
ggaaagggcctggcc

SEQ ID NO: 2931501 - DNA, 16 bp, Homo sapiens
ggaaaggtggtgtttc

SEQ ID NO: 2931502 - DNA, 13 bp, Homo sapiens
ggaaagtgtaaag

SEQ ID NO: 2931503 - DNA, 19 bp, Homo sapiens
ggaaagtgtaaagcattcc

SEQ ID NO: 2931504 - DNA, 20 bp, Homo sapiens
ggaaatatttagcaaataat

SEQ ID NO: 2931505 - DNA, 16 bp, Homo sapiens
ggaaatcaacttgctt

SEQ ID NO: 2931506 - DNA, 19 bp, Homo sapiens
ggaaatctggattttcagc

SEQ ID NO: 2931507 - DNA, 21 bp, Homo sapiens
ggaaatgagtggccagcgcca

SEQ ID NO: 2931508 - DNA, 23 bp, Homo sapiens
ggaaatgagtggccagcgccagg

SEQ ID NO: 2931509 - DNA, 21 bp, Homo sapiens
ggaaatggcatgcaaaagcaa

SEQ ID NO: 2931510 - DNA, 20 bp, Homo sapiens
ggaaatgtaaaattgaaaat

SEQ ID NO: 2931511 - DNA, 21 bp, Homo sapiens
ggaaatgtggtcctatttaag

SEQ ID NO: 2931512 - DNA, 21 bp, Homo sapiens
ggaaattcaaccccagaaatt

SEQ ID NO: 2931513 - DNA, 17 bp, Homo sapiens
ggaaattggaagagcac

SEQ ID NO: 2931514 - DNA, 13 bp, Homo sapiens
ggaacagacagga

SEQ ID NO: 2931515 - DNA, 17 bp, Homo sapiens
ggaacagacaggagaaa

SEQ ID NO: 2931516 - DNA, 18 bp, Homo sapiens
ggaacagtggccttgctt

SEQ ID NO: 2931517 - DNA, 18 bp, Homo sapiens
ggaacagttaccctgctt

SEQ ID NO: 2931518 - DNA, 16 bp, Homo sapiens
ggaacatgcagctctg

SEQ ID NO: 2931519 - DNA, 16 bp, Homo sapiens
ggaacatttattttat

SEQ ID NO: 2931520 - DNA, 18 bp, Homo sapiens
ggaacatttattttatga

SEQ ID NO: 2931521 - DNA, 21 bp, Homo sapiens
ggaacatttattttatgagaa

SEQ ID NO: 2931522 - DNA, 22 bp, Homo sapiens
ggaaccaaagcgaattttaaaa

SEQ ID NO: 2931523 - DNA, 13 bp, Homo sapiens
ggaaccacctgga

SEQ ID NO: 2931524 - DNA, 13 bp, Homo sapiens
ggaacccagactc

SEQ ID NO: 2931525 - DNA, 15 bp, Homo sapiens
ggaacccagactcag

SEQ ID NO: 2931526 - DNA, 24 bp, Homo sapiens
ggaacccttacagtaggagcccag

SEQ ID NO: 2931527 - DNA, 15 bp, Homo sapiens
ggaaccgaggcaggg

SEQ ID NO: 2931528 - DNA, 17 bp, Homo sapiens
ggaaccgcaggaagctg

SEQ ID NO: 2931529 - DNA, 18 bp, Homo sapiens
ggaaccgcaggaagctgc

SEQ ID NO: 2931530 - DNA, 16 bp, Homo sapiens
ggaaccgtaggaccca

SEQ ID NO: 2931531 - DNA, 21 bp, Homo sapiens
ggaaccgtaggacccaagcag

SEQ ID NO: 2931532 - DNA, 19 bp, Homo sapiens
ggaacctcagcctggccag

SEQ ID NO: 2931533 - DNA, 21 bp, Homo sapiens
ggaacctcagcctggccagac

SEQ ID NO: 2931534 - DNA, 15 bp, Homo sapiens
ggaacctgcaaaaaa

SEQ ID NO: 2931535 - DNA, 16 bp, Homo sapiens
ggaacctgcaaaaaat

SEQ ID NO: 2931536 - DNA, 13 bp, Homo sapiens
ggaacctttccct

SEQ ID NO: 2931537 - DNA, 20 bp, Homo sapiens
ggaacggtaaatttctgtgg

SEQ ID NO: 2931538 - DNA, 13 bp, Homo sapiens
ggaactcagatcc

SEQ ID NO: 2931539 - DNA, 15 bp, Homo sapiens
ggaactcagatccag

SEQ ID NO: 2931540 - DNA, 17 bp, Homo sapiens
ggaactcatctggttga

SEQ ID NO: 2931541 - DNA, 15 bp, Homo sapiens
ggaactcctggaaat

SEQ ID NO: 2931542 - DNA, 19 bp, Homo sapiens
ggaactcgcacctgtgctg

SEQ ID NO: 2931543 - DNA, 14 bp, Homo sapiens
ggaactcgcctcag

SEQ ID NO: 2931544 - DNA, 16 bp, Homo sapiens
ggaactcgcctcagcc

SEQ ID NO: 2931545 - DNA, 12 bp, Homo sapiens
ggaactgcagca

SEQ ID NO: 2931546 - DNA, 15 bp, Homo sapiens
ggaactgtcccagct

SEQ ID NO: 2931547 - DNA, 14 bp, Homo sapiens
ggaacttgaactga

SEQ ID NO: 2931548 - DNA, 22 bp, Homo sapiens
ggaactttagggggtgggaggg

SEQ ID NO: 2931549 - DNA, 11 bp, Homo sapiens
ggaagaaaacg

SEQ ID NO: 2931550 - DNA, 16 bp, Homo sapiens
ggaagaaaatggaatt

SEQ ID NO: 2931551 - DNA, 11 bp, Homo sapiens
ggaagaacacc

SEQ ID NO: 2931552 - DNA, 13 bp, Homo sapiens
ggaagaagcagcg

SEQ ID NO: 2931553 - DNA, 16 bp, Homo sapiens
ggaagaccaaggcctc

SEQ ID NO: 2931554 - DNA, 15 bp, Homo sapiens
ggaagacgagacagg

SEQ ID NO: 2931555 - DNA, 20 bp, Homo sapiens
ggaagactggagaaatgctt

SEQ ID NO: 2931556 - DNA, 16 bp, Homo sapiens
ggaagagacatgagaa

SEQ ID NO: 2931557 - DNA, 14 bp, Homo sapiens
ggaagagatccaaa

SEQ ID NO: 2931558 - DNA, 16 bp, Homo sapiens
ggaagagatccaaaga

SEQ ID NO: 2931559 - DNA, 17 bp, Homo sapiens
ggaagagatccaaagac

SEQ ID NO: 2931560 - DNA, 18 bp, Homo sapiens
ggaagagatccaaagact

SEQ ID NO: 2931561 - DNA, 23 bp, Homo sapiens
ggaagagcaggactccaggccca

SEQ ID NO: 2931562 - DNA, 20 bp, Homo sapiens
ggaagagctcaagggacaag

SEQ ID NO: 2931563 - DNA, 23 bp, Homo sapiens
ggaagagctcaagggacaaggac

SEQ ID NO: 2931564 - DNA, 20 bp, Homo sapiens
ggaagatctctgcagggccg

SEQ ID NO: 2931565 - DNA, 21 bp, Homo sapiens
ggaagatgctcatctgagcca

SEQ ID NO: 2931566 - DNA, 13 bp, Homo sapiens
ggaagcaggacag

SEQ ID NO: 2931567 - DNA, 21 bp, Homo sapiens
ggaagcatcctccccaccaga

SEQ ID NO: 2931568 - DNA, 22 bp, Homo sapiens
ggaagccaccctcccagctctg

SEQ ID NO: 2931569 - DNA, 23 bp, Homo sapiens
ggaagccaccctcccagctctga

SEQ ID NO: 2931570 - DNA, 14 bp, Homo sapiens
ggaagcccactgcc

SEQ ID NO: 2931571 - DNA, 17 bp, Homo sapiens
ggaagcccactgcctcc

SEQ ID NO: 2931572 - DNA, 18 bp, Homo sapiens
ggaagcccactgcctcct

SEQ ID NO: 2931573 - DNA, 16 bp, Homo sapiens
ggaagccgtgccctgc

SEQ ID NO: 2931574 - DNA, 20 bp, Homo sapiens
ggaagccgtgctcgccccag

SEQ ID NO: 2931575 - DNA, 13 bp, Homo sapiens
ggaagcctgaact

SEQ ID NO: 2931576 - DNA, 20 bp, Homo sapiens
ggaagcctttactgaccctg

SEQ ID NO: 2931577 - DNA, 21 bp, Homo sapiens
ggaagcgtgaaggccgagaag

SEQ ID NO: 2931578 - DNA, 22 bp, Homo sapiens
ggaagcgtgaaggccgagaagc

SEQ ID NO: 2931579 - DNA, 13 bp, Homo sapiens
ggaagctacaggt

SEQ ID NO: 2931580 - DNA, 13 bp, Homo sapiens
ggaagctgctccg

SEQ ID NO: 2931581 - DNA, 21 bp, Homo sapiens
ggaagctttggtgagaacctg

SEQ ID NO: 2931582 - DNA, 15 bp, Homo sapiens
ggaaggaaaactatg

SEQ ID NO: 2931583 - DNA, 18 bp, Homo sapiens
ggaaggacaatcccagga

SEQ ID NO: 2931584 - DNA, 16 bp, Homo sapiens
ggaaggacagactggc

SEQ ID NO: 2931585 - DNA, 20 bp, Homo sapiens
ggaaggagacacagatgttc

SEQ ID NO: 2931586 - DNA, 20 bp, Homo sapiens
ggaaggagactcacctctgc

SEQ ID NO: 2931587 - DNA, 17 bp, Homo sapiens
ggaaggagcccctgagt

SEQ ID NO: 2931588 - DNA, 21 bp, Homo sapiens
ggaaggagcggcgccctggac

SEQ ID NO: 2931589 - DNA, 22 bp, Homo sapiens
ggaaggatcccatgagctcctt

SEQ ID NO: 2931590 - DNA, 18 bp, Homo sapiens
ggaaggcctaggctagga

SEQ ID NO: 2931591 - DNA, 24 bp, Homo sapiens
ggaaggcctaggctaggacgttgg

SEQ ID NO: 2931592 - DNA, 12 bp, Homo sapiens
ggaaggctctcg

SEQ ID NO: 2931593 - DNA, 19 bp, Homo sapiens
ggaaggcttgttgtgcttt

SEQ ID NO: 2931594 - DNA, 15 bp, Homo sapiens
ggaagggagggagct

SEQ ID NO: 2931595 - DNA, 14 bp, Homo sapiens
ggaagggcaggcac

SEQ ID NO: 2931596 - DNA, 13 bp, Homo sapiens
ggaagggcatgca

SEQ ID NO: 2931597 - DNA, 18 bp, Homo sapiens
ggaagggcatgcacgggc

SEQ ID NO: 2931598 - DNA, 15 bp, Homo sapiens
ggaaggggctaggga

SEQ ID NO: 2931599 - DNA, 21 bp, Homo sapiens
ggaaggggtgcaggtggggtg

SEQ ID NO: 2931600 - DNA, 20 bp, Homo sapiens
ggaaggtctgatttgcagga

SEQ ID NO: 2931601 - DNA, 16 bp, Homo sapiens
ggaaggtgaccgccca

SEQ ID NO: 2931602 - DNA, 17 bp, Homo sapiens
ggaaggtgccagaagga

SEQ ID NO: 2931603 - DNA, 19 bp, Homo sapiens
ggaagtaaaggcattccac

SEQ ID NO: 2931604 - DNA, 17 bp, Homo sapiens
ggaagtacttccctcag

SEQ ID NO: 2931605 - DNA, 15 bp, Homo sapiens
ggaagtagctgtcag

SEQ ID NO: 2931606 - DNA, 17 bp, Homo sapiens
ggaagtccaatgtggca

SEQ ID NO: 2931607 - DNA, 18 bp, Homo sapiens
ggaagtccccaggcccca

SEQ ID NO: 2931608 - DNA, 23 bp, Homo sapiens
ggaagtccccaggccccaggaag

SEQ ID NO: 2931609 - DNA, 20 bp, Homo sapiens
ggaagtcgaggctgcagtca

SEQ ID NO: 2931610 - DNA, 17 bp, Homo sapiens
ggaagtctaggagctgg

SEQ ID NO: 2931611 - DNA, 14 bp, Homo sapiens
ggaagtgttcctgt

SEQ ID NO: 2931612 - DNA, 14 bp, Homo sapiens
ggatagatgctggc

SEQ ID NO: 2931613 - DNA, 18 bp, Homo sapiens
ggatagatgctggcccag

SEQ ID NO: 2931614 - DNA, 15 bp, Homo sapiens
ggatagtctgggtca

SEQ ID NO: 2931615 - DNA, 13 bp, Homo sapiens
ggatattttgaaa

SEQ ID NO: 2931616 - DNA, 21 bp, Homo sapiens
ggatattttgaaatgaacttt

SEQ ID NO: 2931617 - DNA, 12 bp, Homo sapiens
ggatcagaatag

SEQ ID NO: 2931618 - DNA, 23 bp, Homo sapiens
ggatcagatttggtgatggaaaa

SEQ ID NO: 2931619 - DNA, 15 bp, Homo sapiens
ggatcagtgaaaaac

SEQ ID NO: 2931620 - DNA, 17 bp, Homo sapiens
ggatcccatgagctcct

SEQ ID NO: 2931621 - DNA, 18 bp, Homo sapiens
ggatccctcatctgtccc

SEQ ID NO: 2931622 - DNA, 14 bp, Homo sapiens
ggatcctgccccca

SEQ ID NO: 2931623 - DNA, 17 bp, Homo sapiens
ggatcctgcccccaagt

SEQ ID NO: 2931624 - DNA, 22 bp, Homo sapiens
ggatccttcccaaggtacagct

SEQ ID NO: 2931625 - DNA, 14 bp, Homo sapiens
ggatcgacaagaag

SEQ ID NO: 2931626 - DNA, 18 bp, Homo sapiens
ggatctaccagcataaat

SEQ ID NO: 2931627 - DNA, 15 bp, Homo sapiens
ggatctcagttttta

SEQ ID NO: 2931628 - DNA, 17 bp, Homo sapiens
ggatctcattggaccct

SEQ ID NO: 2931629 - DNA, 13 bp, Homo sapiens
ggatctgattgag

SEQ ID NO: 2931630 - DNA, 21 bp, Homo sapiens
ggatctggtagggggaaaatg

SEQ ID NO: 2931631 - DNA, 20 bp, Homo sapiens
ggatctgtaaggaactggaa

SEQ ID NO: 2931632 - DNA, 13 bp, Homo sapiens
ggatcttatttgg

SEQ ID NO: 2931633 - DNA, 22 bp, Homo sapiens
ggatctttggacagaagcagct

SEQ ID NO: 2931634 - DNA, 18 bp, Homo sapiens
ggatgaaaaatatttctg

SEQ ID NO: 2931635 - DNA, 20 bp, Homo sapiens
ggatgaattgtcacatctat

SEQ ID NO: 2931636 - DNA, 14 bp, Homo sapiens
ggatgaccatactc

SEQ ID NO: 2931637 - DNA, 23 bp, Homo sapiens
ggatgagaatttgagtgctctga

SEQ ID NO: 2931638 - DNA, 14 bp, Homo sapiens
ggatgaggacagag

SEQ ID NO: 2931639 - DNA, 12 bp, Homo sapiens
ggatgccctgga

SEQ ID NO: 2931640 - DNA, 13 bp, Homo sapiens
ggatgccctggag

SEQ ID NO: 2931641 - DNA, 18 bp, Homo sapiens
ggatgccctggaggtggc

SEQ ID NO: 2931642 - DNA, 21 bp, Homo sapiens
ggatgccctggaggtggctga

SEQ ID NO: 2931643 - DNA, 11 bp, Homo sapiens
ggatgcctcct

SEQ ID NO: 2931644 - DNA, 17 bp, Homo sapiens
ggatgctccgaggactg

SEQ ID NO: 2931645 - DNA, 19 bp, Homo sapiens
ggatgctctttcccaggac

SEQ ID NO: 2931646 - DNA, 12 bp, Homo sapiens
ggatgctgtgct

SEQ ID NO: 2931647 - DNA, 19 bp, Homo sapiens
ggatggatcttttctaaat

SEQ ID NO: 2931648 - DNA, 22 bp, Homo sapiens
ggatggcaggacgtgggctggg

SEQ ID NO: 2931649 - DNA, 23 bp, Homo sapiens
ggatggcccttcctcctccacca

SEQ ID NO: 2931650 - DNA, 18 bp, Homo sapiens
ggatgggaatttgtcagc

SEQ ID NO: 2931651 - DNA, 23 bp, Homo sapiens
ggatgggcagcccaacagcactt

SEQ ID NO: 2931652 - DNA, 21 bp, Homo sapiens
ggatgggccctatgtctcagg

SEQ ID NO: 2931653 - DNA, 14 bp, Homo sapiens
ggatggggaggaag

SEQ ID NO: 2931654 - DNA, 15 bp, Homo sapiens
ggatggggaggaaga

SEQ ID NO: 2931655 - DNA, 15 bp, Homo sapiens
ggatgggggaactca

SEQ ID NO: 2931656 - DNA, 17 bp, Homo sapiens
ggatgggggaactcaga

SEQ ID NO: 2931657 - DNA, 23 bp, Homo sapiens
ggatgggggaactcagatccagg

SEQ ID NO: 2931658 - DNA, 13 bp, Homo sapiens
ggatggtgacttt

SEQ ID NO: 2931659 - DNA, 15 bp, Homo sapiens
ggatggtgacttttg

SEQ ID NO: 2931660 - DNA, 17 bp, Homo sapiens
ggatgtaaacagtgcct

SEQ ID NO: 2931661 - DNA, 18 bp, Homo sapiens
ggatgtcactcagatgga

SEQ ID NO: 2931662 - DNA, 20 bp, Homo sapiens
ggatgtctgccaatttttgc

SEQ ID NO: 2931663 - DNA, 17 bp, Homo sapiens
ggatgtggttttcttaa

SEQ ID NO: 2931664 - DNA, 23 bp, Homo sapiens
ggatgttttaattccatgaatcg

SEQ ID NO: 2931665 - DNA, 12 bp, Homo sapiens
ggattaaactta

SEQ ID NO: 2931666 - DNA, 19 bp, Homo sapiens
ggattaaacttatgaatgt

SEQ ID NO: 2931667 - DNA, 23 bp, Homo sapiens
ggattaaacttatgaatgtttcc

SEQ ID NO: 2931668 - DNA, 13 bp, Homo sapiens
ggattacagaaac

SEQ ID NO: 2931669 - DNA, 18 bp, Homo sapiens
ggattccccatctcaggc

SEQ ID NO: 2931670 - DNA, 15 bp, Homo sapiens
ggattccccctgccc

SEQ ID NO: 2931671 - DNA, 21 bp, Homo sapiens
ggattccccctgccctgtgcc

SEQ ID NO: 2931672 - DNA, 21 bp, Homo sapiens
ggattctcatgggaaggggag

SEQ ID NO: 2931673 - DNA, 14 bp, Homo sapiens
ggattgctgccact

SEQ ID NO: 2931674 - DNA, 15 bp, Homo sapiens
ggattgctgccactt

SEQ ID NO: 2931675 - DNA, 15 bp, Homo sapiens
ggattggccctgccc

SEQ ID NO: 2931676 - DNA, 17 bp, Homo sapiens
ggattggccctgcccct

SEQ ID NO: 2931677 - DNA, 21 bp, Homo sapiens
ggattggccctgcccctcccc

SEQ ID NO: 2931678 - DNA, 16 bp, Homo sapiens
ggattggggtccctct

SEQ ID NO: 2931679 - DNA, 20 bp, Homo sapiens
ggattgtgctgatgtagtga

SEQ ID NO: 2931680 - DNA, 19 bp, Homo sapiens
ggatttacgactgaagaag

SEQ ID NO: 2931681 - DNA, 17 bp, Homo sapiens
ggatttgatgcttttct

SEQ ID NO: 2931682 - DNA, 15 bp, Homo sapiens
ggatttgttctctgt

SEQ ID NO: 2931683 - DNA, 18 bp, Homo sapiens
ggattttattaattataa

SEQ ID NO: 2931684 - DNA, 15 bp, Homo sapiens
ggatttttttgttct

SEQ ID NO: 2931685 - DNA, 23 bp, Homo sapiens
ggcaaaaggatctttgtggccaa

SEQ ID NO: 2931686 - DNA, 18 bp, Homo sapiens
ggcaaaagtgtaacaacc

SEQ ID NO: 2931687 - DNA, 13 bp, Homo sapiens
ggcaaaattgcaa

SEQ ID NO: 2931688 - DNA, 17 bp, Homo sapiens
ggcaaacggagtacaga

SEQ ID NO: 2931689 - DNA, 14 bp, Homo sapiens
ggcaaattcttttg

SEQ ID NO: 2931690 - DNA, 18 bp, Homo sapiens
ggcaaattcttttgaatt

SEQ ID NO: 2931691 - DNA, 22 bp, Homo sapiens
ggcaaccatttttagaaggaaa

SEQ ID NO: 2931692 - DNA, 19 bp, Homo sapiens
ggcaactggccatttgcca

SEQ ID NO: 2931693 - DNA, 14 bp, Homo sapiens
ggcaacttgaagaa

SEQ ID NO: 2931694 - DNA, 16 bp, Homo sapiens
ggcaacttgaagaaac

SEQ ID NO: 2931695 - DNA, 10 bp, Homo sapiens
ggcaaggaaa

SEQ ID NO: 2931696 - DNA, 16 bp, Homo sapiens
ggcaagtgagagggga

SEQ ID NO: 2931697 - DNA, 20 bp, Homo sapiens
ggcaataatattttctgtgt

SEQ ID NO: 2931698 - DNA, 19 bp, Homo sapiens
ggcaattctcctgcctttg

SEQ ID NO: 2931699 - DNA, 14 bp, Homo sapiens
ggcacacagctact

SEQ ID NO: 2931700 - DNA, 17 bp, Homo sapiens
ggcacacgcctcccact

SEQ ID NO: 2931701 - DNA, 18 bp, Homo sapiens
ggcacacgcctcccactg

SEQ ID NO: 2931702 - DNA, 19 bp, Homo sapiens
ggcacacgcctcccactgg

SEQ ID NO: 2931703 - DNA, 17 bp, Homo sapiens
ggcacagcatctgtagt

SEQ ID NO: 2931704 - DNA, 16 bp, Homo sapiens
ggcacagccagcccaa

SEQ ID NO: 2931705 - DNA, 17 bp, Homo sapiens
ggcacaggaaacagcaa

SEQ ID NO: 2931706 - DNA, 16 bp, Homo sapiens
ggcacaggaggcaggc

SEQ ID NO: 2931707 - DNA, 23 bp, Homo sapiens
ggcacaggaggcaggcatggccc

SEQ ID NO: 2931708 - DNA, 14 bp, Homo sapiens
ggcacaggtcaggg

SEQ ID NO: 2931709 - DNA, 22 bp, Homo sapiens
ggcacaggtcaggggtgacaca

SEQ ID NO: 2931710 - DNA, 13 bp, Homo sapiens
ggcacagtggctc

SEQ ID NO: 2931711 - DNA, 23 bp, Homo sapiens
ggcacatctaaattgatcattca

SEQ ID NO: 2931712 - DNA, 17 bp, Homo sapiens
ggcacatgaacagcttg

SEQ ID NO: 2931713 - DNA, 22 bp, Homo sapiens
ggcacatggctgggggagggac

SEQ ID NO: 2931714 - DNA, 21 bp, Homo sapiens
ggcacattaactgttgcactt

SEQ ID NO: 2931715 - DNA, 17 bp, Homo sapiens
ggcaccagacacccagg

SEQ ID NO: 2931716 - DNA, 19 bp, Homo sapiens
ggcaccagacacccaggac

SEQ ID NO: 2931717 - DNA, 14 bp, Homo sapiens
ggcaccagtccctg

SEQ ID NO: 2931718 - DNA, 17 bp, Homo sapiens
ggcacctataaaacagg

SEQ ID NO: 2931719 - DNA, 23 bp, Homo sapiens
ggcacctcctacgtcaaacatga

SEQ ID NO: 2931720 - DNA, 22 bp, Homo sapiens
ggcacctgccaccctgggcctg

SEQ ID NO: 2931721 - DNA, 17 bp, Homo sapiens
ggcacgaacccacctgc

SEQ ID NO: 2931722 - DNA, 20 bp, Homo sapiens
ggcacgaacccacctgctga

SEQ ID NO: 2931723 - DNA, 14 bp, Homo sapiens
ggcacgcacctgta

SEQ ID NO: 2931724 - DNA, 20 bp, Homo sapiens
ggcacggcaggcgtgtggca

SEQ ID NO: 2931725 - DNA, 14 bp, Homo sapiens
ggcactatttttat

SEQ ID NO: 2931726 - DNA, 22 bp, Homo sapiens
ggcactccaacctaacctgtgt

SEQ ID NO: 2931727 - DNA, 19 bp, Homo sapiens
ggcactgggcgtctgactc

SEQ ID NO: 2931728 - DNA, 18 bp, Homo sapiens
ggcacttccctgctgcct

SEQ ID NO: 2931729 - DNA, 13 bp, Homo sapiens
ggcacttcctccc

SEQ ID NO: 2931730 - DNA, 14 bp, Homo sapiens
ggcacttgcctggg

SEQ ID NO: 2931731 - DNA, 11 bp, Homo sapiens
ggcagaaaatt

SEQ ID NO: 2931732 - DNA, 19 bp, Homo sapiens
ggcagaactctctgtcttc

SEQ ID NO: 2931733 - DNA, 16 bp, Homo sapiens
ggcagaactgctgggg

SEQ ID NO: 2931734 - DNA, 18 bp, Homo sapiens
ggcagaagaatctttctt

SEQ ID NO: 2931735 - DNA, 23 bp, Homo sapiens
ggcagaagaattgaacccaggag

SEQ ID NO: 2931736 - DNA, 17 bp, Homo sapiens
ggcagaatcctgggccc

SEQ ID NO: 2931737 - DNA, 19 bp, Homo sapiens
ggcagaatcctgggccccc

SEQ ID NO: 2931738 - DNA, 18 bp, Homo sapiens
ggcagactctttatgctt

SEQ ID NO: 2931739 - DNA, 20 bp, Homo sapiens
ggcagactctttatgcttgc

SEQ ID NO: 2931740 - DNA, 12 bp, Homo sapiens
ggcagagcccaa

SEQ ID NO: 2931741 - DNA, 13 bp, Homo sapiens
ggcagagcctgtc

SEQ ID NO: 2931742 - DNA, 14 bp, Homo sapiens
ggcagagcctgtcc

SEQ ID NO: 2931743 - DNA, 22 bp, Homo sapiens
ggcagaggctggaggcagggcc

SEQ ID NO: 2931744 - DNA, 23 bp, Homo sapiens
ggcctggaattagcttggggcca

SEQ ID NO: 2931745 - DNA, 15 bp, Homo sapiens
ggcctggacccctgg

SEQ ID NO: 2931746 - DNA, 13 bp, Homo sapiens
ggcctggagcatg

SEQ ID NO: 2931747 - DNA, 15 bp, Homo sapiens
ggcctggaggctcag

SEQ ID NO: 2931748 - DNA, 16 bp, Homo sapiens
ggcctggcatctgtgt

SEQ ID NO: 2931749 - DNA, 18 bp, Homo sapiens
ggcctggcatctgtgtgc

SEQ ID NO: 2931750 - DNA, 18 bp, Homo sapiens
ggcctggcatctgtgtgt

SEQ ID NO: 2931751 - DNA, 16 bp, Homo sapiens
ggcctggccagtcctg

SEQ ID NO: 2931752 - DNA, 21 bp, Homo sapiens
ggcctggccagtcctggtcct

SEQ ID NO: 2931753 - DNA, 20 bp, Homo sapiens
ggcctggccgttcagcctgt

SEQ ID NO: 2931754 - DNA, 21 bp, Homo sapiens
ggcctggccgttcagcctgtc

SEQ ID NO: 2931755 - DNA, 11 bp, Homo sapiens
ggcctggctcc

SEQ ID NO: 2931756 - DNA, 16 bp, Homo sapiens
ggcctggctccccgag

SEQ ID NO: 2931757 - DNA, 24 bp, Homo sapiens
ggcctggctccccgagggctcaga

SEQ ID NO: 2931758 - DNA, 13 bp, Homo sapiens
ggcctggcttcac

SEQ ID NO: 2931759 - DNA, 15 bp, Homo sapiens
ggcctgggcaggagg

SEQ ID NO: 2931760 - DNA, 19 bp, Homo sapiens
ggcctgggcaggagggagg

SEQ ID NO: 2931761 - DNA, 20 bp, Homo sapiens
ggcctgggggacccctggct

SEQ ID NO: 2931762 - DNA, 22 bp, Homo sapiens
ggcctgggggacccctggctct

SEQ ID NO: 2931763 - DNA, 16 bp, Homo sapiens
ggcctggtccctggtc

SEQ ID NO: 2931764 - DNA, 14 bp, Homo sapiens
ggcctggtccctgt

SEQ ID NO: 2931765 - DNA, 14 bp, Homo sapiens
ggcctggtctggga

SEQ ID NO: 2931766 - DNA, 23 bp, Homo sapiens
ggcctgtatcctccctggcagac

SEQ ID NO: 2931767 - DNA, 11 bp, Homo sapiens
ggcctgtctca

SEQ ID NO: 2931768 - DNA, 14 bp, Homo sapiens
ggcctgtctgtgac

SEQ ID NO: 2931769 - DNA, 16 bp, Homo sapiens
ggcctgtggggagccg

SEQ ID NO: 2931770 - DNA, 17 bp, Homo sapiens
ggcctgtggggagccga

SEQ ID NO: 2931771 - DNA, 17 bp, Homo sapiens
ggcctgtggtggctccc

SEQ ID NO: 2931772 - DNA, 23 bp, Homo sapiens
ggcctgtgtggaggcctcaggga

SEQ ID NO: 2931773 - DNA, 15 bp, Homo sapiens
ggccttacccctgcc

SEQ ID NO: 2931774 - DNA, 14 bp, Homo sapiens
ggccttctcagctc

SEQ ID NO: 2931775 - DNA, 18 bp, Homo sapiens
ggccttgaagacagagca

SEQ ID NO: 2931776 - DNA, 18 bp, Homo sapiens
ggccttgaagactccctg

SEQ ID NO: 2931777 - DNA, 13 bp, Homo sapiens
ggccttgcccaga

SEQ ID NO: 2931778 - DNA, 16 bp, Homo sapiens
ggccttgcccagagat

SEQ ID NO: 2931779 - DNA, 14 bp, Homo sapiens
ggccttgcccgtcg

SEQ ID NO: 2931780 - DNA, 20 bp, Homo sapiens
ggccttgctgactctctgag

SEQ ID NO: 2931781 - DNA, 22 bp, Homo sapiens
ggccttgctgactctctgagct

SEQ ID NO: 2931782 - DNA, 21 bp, Homo sapiens
ggccttggggtgggggccagg

SEQ ID NO: 2931783 - DNA, 22 bp, Homo sapiens
ggccttggggtgggggccaggc

SEQ ID NO: 2931784 - DNA, 19 bp, Homo sapiens
ggccttggtatgtgccagg

SEQ ID NO: 2931785 - DNA, 21 bp, Homo sapiens
ggccttggtatgtgccaggct

SEQ ID NO: 2931786 - DNA, 19 bp, Homo sapiens
ggccttgtcctcagccagt

SEQ ID NO: 2931787 - DNA, 17 bp, Homo sapiens
ggcctttgttctggggg

SEQ ID NO: 2931788 - DNA, 15 bp, Homo sapiens
ggcgacactcagggc

SEQ ID NO: 2931789 - DNA, 17 bp, Homo sapiens
ggcgacactcagggcag

SEQ ID NO: 2931790 - DNA, 18 bp, Homo sapiens
ggcgacagttttccttct

SEQ ID NO: 2931791 - DNA, 16 bp, Homo sapiens
ggcgagcccttagcct

SEQ ID NO: 2931792 - DNA, 18 bp, Homo sapiens
ggcgagcccttagccttg

SEQ ID NO: 2931793 - DNA, 18 bp, Homo sapiens
ggcgaggcccttcctctt

SEQ ID NO: 2931794 - DNA, 23 bp, Homo sapiens
ggcgagtgaatgccagtgtgctg

SEQ ID NO: 2931795 - DNA, 15 bp, Homo sapiens
ggcgcaaagggcatg

SEQ ID NO: 2931796 - DNA, 12 bp, Homo sapiens
ggcgcactgtga

SEQ ID NO: 2931797 - DNA, 15 bp, Homo sapiens
ggcgcacttcagaat

SEQ ID NO: 2931798 - DNA, 16 bp, Homo sapiens
ggcgccaccagctctg

SEQ ID NO: 2931799 - DNA, 12 bp, Homo sapiens
ggcgcccagcag

SEQ ID NO: 2931800 - DNA, 17 bp, Homo sapiens
ggcgcccagcagcctgc

SEQ ID NO: 2931801 - DNA, 20 bp, Homo sapiens
ggcgccccgcacctgtacag

SEQ ID NO: 2931802 - DNA, 15 bp, Homo sapiens
ggcgcctagagcgcg

SEQ ID NO: 2931803 - DNA, 22 bp, Homo sapiens
ggcgcctagagcgcggctggct

SEQ ID NO: 2931804 - DNA, 15 bp, Homo sapiens
ggcgcctgccctgcc

SEQ ID NO: 2931805 - DNA, 16 bp, Homo sapiens
ggcgcctgccctgccc

SEQ ID NO: 2931806 - DNA, 17 bp, Homo sapiens
ggcgcctgccctgccca

SEQ ID NO: 2931807 - DNA, 23 bp, Homo sapiens
ggcgcctgccctgcccaagtgac

SEQ ID NO: 2931808 - DNA, 17 bp, Homo sapiens
ggcgcctggagagcgag

SEQ ID NO: 2931809 - DNA, 18 bp, Homo sapiens
ggcgcctggagagcgagg

SEQ ID NO: 2931810 - DNA, 12 bp, Homo sapiens
ggcgcctggcct

SEQ ID NO: 2931811 - DNA, 17 bp, Homo sapiens
ggcgccttctcggagct

SEQ ID NO: 2931812 - DNA, 17 bp, Homo sapiens
ggcgcggcggctctgcc

SEQ ID NO: 2931813 - DNA, 21 bp, Homo sapiens
ggcgctgaggtgtctggcctg

SEQ ID NO: 2931814 - DNA, 20 bp, Homo sapiens
ggcggagctggccccgccgc

SEQ ID NO: 2931815 - DNA, 22 bp, Homo sapiens
ggcggatcacaaggtcaggagt

SEQ ID NO: 2931816 - DNA, 15 bp, Homo sapiens
ggcggcagggccagg

SEQ ID NO: 2931817 - DNA, 21 bp, Homo sapiens
ggcggccagggacccaaagca

SEQ ID NO: 2931818 - DNA, 17 bp, Homo sapiens
ggcggccagggcggcca

SEQ ID NO: 2931819 - DNA, 19 bp, Homo sapiens
ggcggccagggcggccagg

SEQ ID NO: 2931820 - DNA, 20 bp, Homo sapiens
ggcggccagggcggccaggg

SEQ ID NO: 2931821 - DNA, 21 bp, Homo sapiens
ggcggctactcagcagccctc

SEQ ID NO: 2931822 - DNA, 22 bp, Homo sapiens
ggcggctactcagcagccctcc

SEQ ID NO: 2931823 - DNA, 12 bp, Homo sapiens
ggcggctctgcc

SEQ ID NO: 2931824 - DNA, 18 bp, Homo sapiens
ggcgggcagagggctgga

SEQ ID NO: 2931825 - DNA, 21 bp, Homo sapiens
ggcgggggcacgtgtgggccg

SEQ ID NO: 2931826 - DNA, 13 bp, Homo sapiens
ggcggggtggggt

SEQ ID NO: 2931827 - DNA, 22 bp, Homo sapiens
ggcgggtgcctgtaatcccagc

SEQ ID NO: 2931828 - DNA, 14 bp, Homo sapiens
ggcggtcctgcaca

SEQ ID NO: 2931829 - DNA, 14 bp, Homo sapiens
ggcggtggccacag

SEQ ID NO: 2931830 - DNA, 21 bp, Homo sapiens
ggcggtgggcacccaccctgg

SEQ ID NO: 2931831 - DNA, 22 bp, Homo sapiens
ggcggtgggcacccaccctggg

SEQ ID NO: 2931832 - DNA, 17 bp, Homo sapiens
ggcgtacgctggtgctg

SEQ ID NO: 2931833 - DNA, 14 bp, Homo sapiens
ggcgtctgtgtgcg

SEQ ID NO: 2931834 - DNA, 21 bp, Homo sapiens
ggcgtctgttcccccttcaca

SEQ ID NO: 2931835 - DNA, 19 bp, Homo sapiens
ggcgtcttcatctccctgc

SEQ ID NO: 2931836 - DNA, 17 bp, Homo sapiens
ggcgtgactcacccaag

SEQ ID NO: 2931837 - DNA, 19 bp, Homo sapiens
ggcgtgagccactgttccc

SEQ ID NO: 2931838 - DNA, 18 bp, Homo sapiens
ggcgtggagggaggcccc

SEQ ID NO: 2931839 - DNA, 16 bp, Homo sapiens
ggcgtggattaaactt

SEQ ID NO: 2931840 - DNA, 14 bp, Homo sapiens
ggcgtgtgcaggcc

SEQ ID NO: 2931841 - DNA, 14 bp, Homo sapiens
ggcgtgtgcatagc

SEQ ID NO: 2931842 - DNA, 20 bp, Homo sapiens
ggcgtgtgcatagcgtcctg

SEQ ID NO: 2931843 - DNA, 13 bp, Homo sapiens
ggcgtgtggcagc

SEQ ID NO: 2931844 - DNA, 18 bp, Homo sapiens
ggctaacatttaggagaa

SEQ ID NO: 2931845 - DNA, 20 bp, Homo sapiens
ggctaagagctagcgctgcc

SEQ ID NO: 2931846 - DNA, 18 bp, Homo sapiens
ggctaagatactgctgat

SEQ ID NO: 2931847 - DNA, 12 bp, Homo sapiens
ggctacatcagc

SEQ ID NO: 2931848 - DNA, 16 bp, Homo sapiens
ggctacatcagccttc

SEQ ID NO: 2931849 - DNA, 21 bp, Homo sapiens
ggctactcagcagccctcctc

SEQ ID NO: 2931850 - DNA, 17 bp, Homo sapiens
ggctaggacgttggcct

SEQ ID NO: 2931851 - DNA, 16 bp, Homo sapiens
ggctagtcaagctcct

SEQ ID NO: 2931852 - DNA, 19 bp, Homo sapiens
ggctagtcaagctcctcct

SEQ ID NO: 2931853 - DNA, 22 bp, Homo sapiens
ggctagtcaagctcctcctccc

SEQ ID NO: 2931854 - DNA, 17 bp, Homo sapiens
ggctagtgaagtggcct

SEQ ID NO: 2931855 - DNA, 19 bp, Homo sapiens
ggctagtgaagtggcctct

SEQ ID NO: 2931856 - DNA, 19 bp, Homo sapiens
ggctagtggggtgaacagc

SEQ ID NO: 2931857 - DNA, 19 bp, Homo sapiens
ggctcaagcgattctcctg

SEQ ID NO: 2931858 - DNA, 21 bp, Homo sapiens
ggctcaaggcaccgcagcctg

SEQ ID NO: 2931859 - DNA, 16 bp, Homo sapiens
ggctcacgccccgctg

SEQ ID NO: 2931860 - DNA, 19 bp, Homo sapiens
ggctcagagagtacactgt

SEQ ID NO: 2931861 - DNA, 16 bp, Homo sapiens
ggctcaggtcacataa

SEQ ID NO: 2931862 - DNA, 18 bp, Homo sapiens
ggctcagtgcaacctctg

SEQ ID NO: 2931863 - DNA, 13 bp, Homo sapiens
ggctcatcagaac

SEQ ID NO: 2931864 - DNA, 16 bp, Homo sapiens
ggctcatgccccttgg

SEQ ID NO: 2931865 - DNA, 16 bp, Homo sapiens
ggctccagagggcact

SEQ ID NO: 2931866 - DNA, 17 bp, Homo sapiens
ggctccagatgcagggc

SEQ ID NO: 2931867 - DNA, 12 bp, Homo sapiens
ggctccagctca

SEQ ID NO: 2931868 - DNA, 18 bp, Homo sapiens
ggctccaggcagaaggag

SEQ ID NO: 2931869 - DNA, 21 bp, Homo sapiens
ggctccccaggaagcccactg

SEQ ID NO: 2931870 - DNA, 15 bp, Homo sapiens
ggctccccctctgct

SEQ ID NO: 2931871 - DNA, 20 bp, Homo sapiens
ggctccctgtaacctcttca

SEQ ID NO: 2931872 - DNA, 14 bp, Homo sapiens
ggctccggcctctg

SEQ ID NO: 2931873 - DNA, 15 bp, Homo sapiens
ggctcctccctctgc

SEQ ID NO: 2931874 - DNA, 17 bp, Homo sapiens
ggctcctccctctgcct

SEQ ID NO: 2931875 - DNA, 19 bp, Homo sapiens
ggctcctccctctgcctca

SEQ ID NO: 2931876 - DNA, 13 bp, Homo sapiens
gggcgcctagagc

SEQ ID NO: 2931877 - DNA, 22 bp, Homo sapiens
gggcgcctagagcgcggctggc

SEQ ID NO: 2931878 - DNA, 15 bp, Homo sapiens
gggcgcctggagagc

SEQ ID NO: 2931879 - DNA, 20 bp, Homo sapiens
gggcgctcgcttccgcatcc

SEQ ID NO: 2931880 - DNA, 22 bp, Homo sapiens
gggcgctctccctaccttgcct

SEQ ID NO: 2931881 - DNA, 18 bp, Homo sapiens
gggcggacaaaagggcca

SEQ ID NO: 2931882 - DNA, 17 bp, Homo sapiens
gggcgggcagagggctg

SEQ ID NO: 2931883 - DNA, 19 bp, Homo sapiens
gggcggggactgctggctc

SEQ ID NO: 2931884 - DNA, 17 bp, Homo sapiens
gggcggtgtcaggtccc

SEQ ID NO: 2931885 - DNA, 12 bp, Homo sapiens
gggcgtcagaga

SEQ ID NO: 2931886 - DNA, 14 bp, Homo sapiens
gggcgtcagagaga

SEQ ID NO: 2931887 - DNA, 21 bp, Homo sapiens
gggcgtctgactccctcccca

SEQ ID NO: 2931888 - DNA, 15 bp, Homo sapiens
gggcgtggagggagg

SEQ ID NO: 2931889 - DNA, 13 bp, Homo sapiens
gggctaaatgaag

SEQ ID NO: 2931890 - DNA, 20 bp, Homo sapiens
gggctaacatttaggagaag

SEQ ID NO: 2931891 - DNA, 17 bp, Homo sapiens
gggctagggaggaccaa

SEQ ID NO: 2931892 - DNA, 16 bp, Homo sapiens
gggctagtgaagtggc

SEQ ID NO: 2931893 - DNA, 22 bp, Homo sapiens
gggctcaagcaatcctctcacc

SEQ ID NO: 2931894 - DNA, 16 bp, Homo sapiens
gggctcagaagagcag

SEQ ID NO: 2931895 - DNA, 22 bp, Homo sapiens
gggctcaggtcacataaaactt

SEQ ID NO: 2931896 - DNA, 12 bp, Homo sapiens
gggctccccagg

SEQ ID NO: 2931897 - DNA, 20 bp, Homo sapiens
gggctccccttgcccttcct

SEQ ID NO: 2931898 - DNA, 21 bp, Homo sapiens
gggctcctgtggcagctgccc

SEQ ID NO: 2931899 - DNA, 14 bp, Homo sapiens
gggctctccacctc

SEQ ID NO: 2931900 - DNA, 18 bp, Homo sapiens
gggctgagagaacctcac

SEQ ID NO: 2931901 - DNA, 15 bp, Homo sapiens
gggctgagccaaagc

SEQ ID NO: 2931902 - DNA, 16 bp, Homo sapiens
gggctgagggtgccct

SEQ ID NO: 2931903 - DNA, 18 bp, Homo sapiens
gggctgcacgctcccctc

SEQ ID NO: 2931904 - DNA, 16 bp, Homo sapiens
gggctgcaggtgctgc

SEQ ID NO: 2931905 - DNA, 15 bp, Homo sapiens
gggctgctgggggct

SEQ ID NO: 2931906 - DNA, 20 bp, Homo sapiens
gggctgctgggggctcccct

SEQ ID NO: 2931907 - DNA, 11 bp, Homo sapiens
gggctgctgtg

SEQ ID NO: 2931908 - DNA, 14 bp, Homo sapiens
gggctggaggccca

SEQ ID NO: 2931909 - DNA, 15 bp, Homo sapiens
gggctggaggcccag

SEQ ID NO: 2931910 - DNA, 16 bp, Homo sapiens
gggctggaggcccagg

SEQ ID NO: 2931911 - DNA, 14 bp, Homo sapiens
gggctggaggtgct

SEQ ID NO: 2931912 - DNA, 11 bp, Homo sapiens
gggctggctgg

SEQ ID NO: 2931913 - DNA, 14 bp, Homo sapiens
gggctgggcagcct

SEQ ID NO: 2931914 - DNA, 12 bp, Homo sapiens
gggctggggagg

SEQ ID NO: 2931915 - DNA, 13 bp, Homo sapiens
gggctggggaggg

SEQ ID NO: 2931916 - DNA, 18 bp, Homo sapiens
gggctgggtcacaggaag

SEQ ID NO: 2931917 - DNA, 16 bp, Homo sapiens
gggctgggtttgctgt

SEQ ID NO: 2931918 - DNA, 18 bp, Homo sapiens
gggctgtctttgcagggc

SEQ ID NO: 2931919 - DNA, 19 bp, Homo sapiens
gggctgtgactctgggcag

SEQ ID NO: 2931920 - DNA, 13 bp, Homo sapiens
gggctgtgcctgg

SEQ ID NO: 2931921 - DNA, 23 bp, Homo sapiens
gggctgtgttgactgctgctccc

SEQ ID NO: 2931922 - DNA, 15 bp, Homo sapiens
gggctgtttagggga

SEQ ID NO: 2931923 - DNA, 15 bp, Homo sapiens
gggcttcagggcagg

SEQ ID NO: 2931924 - DNA, 17 bp, Homo sapiens
gggcttcagggcaggtg

SEQ ID NO: 2931925 - DNA, 17 bp, Homo sapiens
gggcttcaggtccaggc

SEQ ID NO: 2931926 - DNA, 19 bp, Homo sapiens
gggcttcatacacatgaga

SEQ ID NO: 2931927 - DNA, 21 bp, Homo sapiens
gggcttctgcgtccaccaggc

SEQ ID NO: 2931928 - DNA, 21 bp, Homo sapiens
gggcttggcccgcggcctgca

SEQ ID NO: 2931929 - DNA, 20 bp, Homo sapiens
gggctttcagcgcccccagg

SEQ ID NO: 2931930 - DNA, 18 bp, Homo sapiens
gggctttcggggagggcg

SEQ ID NO: 2931931 - DNA, 19 bp, Homo sapiens
gggctttcggggagggcgc

SEQ ID NO: 2931932 - DNA, 15 bp, Homo sapiens
gggctttgtgtgaag

SEQ ID NO: 2931933 - DNA, 18 bp, Homo sapiens
ggggaaacgtctcccaga

SEQ ID NO: 2931934 - DNA, 21 bp, Homo sapiens
ggggaaaggcctgtggggagc

SEQ ID NO: 2931935 - DNA, 21 bp, Homo sapiens
ggggaactcagatccagggac

SEQ ID NO: 2931936 - DNA, 13 bp, Homo sapiens
ggggaagctgcta

SEQ ID NO: 2931937 - DNA, 20 bp, Homo sapiens
ggggaatgggcaggtggcct

SEQ ID NO: 2931938 - DNA, 20 bp, Homo sapiens
ggggaattctcagtgccaac

SEQ ID NO: 2931939 - DNA, 19 bp, Homo sapiens
ggggaccaaatagccacct

SEQ ID NO: 2931940 - DNA, 21 bp, Homo sapiens
ggggacccaatgtaggagctg

SEQ ID NO: 2931941 - DNA, 15 bp, Homo sapiens
ggggacccagtgcag

SEQ ID NO: 2931942 - DNA, 19 bp, Homo sapiens
ggggacccatgggggctgt

SEQ ID NO: 2931943 - DNA, 13 bp, Homo sapiens
ggggaccccaccc

SEQ ID NO: 2931944 - DNA, 23 bp, Homo sapiens
ggggacctcagcctgcaccctct

SEQ ID NO: 2931945 - DNA, 14 bp, Homo sapiens
ggggacgcaggccc

SEQ ID NO: 2931946 - DNA, 19 bp, Homo sapiens
ggggagaaggcctcccctg

SEQ ID NO: 2931947 - DNA, 11 bp, Homo sapiens
ggggagcccac

SEQ ID NO: 2931948 - DNA, 19 bp, Homo sapiens
ggggagcccactgtcctgg

SEQ ID NO: 2931949 - DNA, 22 bp, Homo sapiens
ggggagcttggctgagggtctg

SEQ ID NO: 2931950 - DNA, 18 bp, Homo sapiens
ggggaggcggcactccaa

SEQ ID NO: 2931951 - DNA, 13 bp, Homo sapiens
ggggaggggcgct

SEQ ID NO: 2931952 - DNA, 14 bp, Homo sapiens
ggggagggtgacag

SEQ ID NO: 2931953 - DNA, 12 bp, Homo sapiens
ggggaggtggga

SEQ ID NO: 2931954 - DNA, 19 bp, Homo sapiens
ggggatgtttacctggtgc

SEQ ID NO: 2931955 - DNA, 13 bp, Homo sapiens
ggggcacaggagg

SEQ ID NO: 2931956 - DNA, 15 bp, Homo sapiens
ggggcacggcaggcg

SEQ ID NO: 2931957 - DNA, 23 bp, Homo sapiens
ggggcacggcaggcgtgtggcag

SEQ ID NO: 2931958 - DNA, 22 bp, Homo sapiens
ggggcagagggcagaggctgga

SEQ ID NO: 2931959 - DNA, 18 bp, Homo sapiens
ggggcagagggctttcag

SEQ ID NO: 2931960 - DNA, 18 bp, Homo sapiens
ggggcagtctgagagagg

SEQ ID NO: 2931961 - DNA, 19 bp, Homo sapiens
ggggcagtctgagagaggc

SEQ ID NO: 2931962 - DNA, 13 bp, Homo sapiens
ggggcatgaaaaa

SEQ ID NO: 2931963 - DNA, 20 bp, Homo sapiens
ggggcatgacccagtgaaga

SEQ ID NO: 2931964 - DNA, 14 bp, Homo sapiens
ggggccacctctgg

SEQ ID NO: 2931965 - DNA, 22 bp, Homo sapiens
ggggccactgtgtttctgtgct

SEQ ID NO: 2931966 - DNA, 23 bp, Homo sapiens
ggggccactgtgtttctgtgctc

SEQ ID NO: 2931967 - DNA, 12 bp, Homo sapiens
ggggccagaggc

SEQ ID NO: 2931968 - DNA, 12 bp, Homo sapiens
ggggccaggcct

SEQ ID NO: 2931969 - DNA, 12 bp, Homo sapiens
ggggcccagtcc

SEQ ID NO: 2931970 - DNA, 12 bp, Homo sapiens
ggggcccagtgc

SEQ ID NO: 2931971 - DNA, 14 bp, Homo sapiens
ggggcccagtgcat

SEQ ID NO: 2931972 - DNA, 19 bp, Homo sapiens
ggggcccatggaggagaca

SEQ ID NO: 2931973 - DNA, 13 bp, Homo sapiens
ggggcccctggcc

SEQ ID NO: 2931974 - DNA, 22 bp, Homo sapiens
ggggccgctgccacccacctcc

SEQ ID NO: 2931975 - DNA, 14 bp, Homo sapiens
ggggccggctggcc

SEQ ID NO: 2931976 - DNA, 19 bp, Homo sapiens
ggggccggctggcctggag

SEQ ID NO: 2931977 - DNA, 17 bp, Homo sapiens
ggggccgggggcagtct

SEQ ID NO: 2931978 - DNA, 23 bp, Homo sapiens
ggggcctacagctttgatccctg

SEQ ID NO: 2931979 - DNA, 13 bp, Homo sapiens
ggggcctgtggtg

SEQ ID NO: 2931980 - DNA, 17 bp, Homo sapiens
ggggccttagggagccc

SEQ ID NO: 2931981 - DNA, 19 bp, Homo sapiens
ggggcctttgctgcccttg

SEQ ID NO: 2931982 - DNA, 13 bp, Homo sapiens
ggggcgcctggag

SEQ ID NO: 2931983 - DNA, 14 bp, Homo sapiens
ggggcgcctggaga

SEQ ID NO: 2931984 - DNA, 15 bp, Homo sapiens
ggggcgcctggagag

SEQ ID NO: 2931985 - DNA, 15 bp, Homo sapiens
ggggcgcggctggga

SEQ ID NO: 2931986 - DNA, 19 bp, Homo sapiens
ggggcgtggagggaggccc

SEQ ID NO: 2931987 - DNA, 18 bp, Homo sapiens
ggggctagggaggaccaa

SEQ ID NO: 2931988 - DNA, 20 bp, Homo sapiens
ggggctccccttgcccttcc

SEQ ID NO: 2931989 - DNA, 18 bp, Homo sapiens
ggggctgagtctccaggg

SEQ ID NO: 2931990 - DNA, 16 bp, Homo sapiens
ggggctgctcctccag

SEQ ID NO: 2931991 - DNA, 20 bp, Homo sapiens
ggggctgctcctccagggcc

SEQ ID NO: 2931992 - DNA, 10 bp, Homo sapiens
ggggctgctg

SEQ ID NO: 2931993 - DNA, 21 bp, Homo sapiens
ggggctgctgacctccacagc

SEQ ID NO: 2931994 - DNA, 13 bp, Homo sapiens
ggggctgctgggg

SEQ ID NO: 2931995 - DNA, 18 bp, Homo sapiens
ggggctttcggggagggc

SEQ ID NO: 2931996 - DNA, 20 bp, Homo sapiens
ggggctttcggggagggcgc

SEQ ID NO: 2931997 - DNA, 21 bp, Homo sapiens
ggggctttcgtccacagcttc

SEQ ID NO: 2931998 - DNA, 11 bp, Homo sapiens
gggggacagag

SEQ ID NO: 2931999 - DNA, 19 bp, Homo sapiens
gggggagaaccactgaccc

SEQ ID NO: 2932000 - DNA, 22 bp, Homo sapiens
gggggagaaggcctcccctgag

SEQ ID NO: 2932001 - DNA, 15 bp, Homo sapiens
gggggagagggctgc

SEQ ID NO: 2932002 - DNA, 22 bp, Homo sapiens
gggggagccccttctgctcagc

SEQ ID NO: 2932003 - DNA, 22 bp, Homo sapiens
gggggagtctgaagcagatgca

SEQ ID NO: 2932004 - DNA, 22 bp, Homo sapiens
gggggcagatcttggactcatg

SEQ ID NO: 2932005 - DNA, 22 bp, Homo sapiens
gggggcagtctgagagaggcca

SEQ ID NO: 2932006 - DNA, 17 bp, Homo sapiens
gggggccactgtgtttc

SEQ ID NO: 2932007 - DNA, 22 bp, Homo sapiens
gggggcctccgcttatcctgct

SEQ ID NO: 2932008 - DNA, 13 bp, Homo sapiens
gggggctcccctt

SEQ ID NO: 2932009 - DNA, 19 bp, Homo sapiens
ggtaggccccacaaggcct

SEQ ID NO: 2932010 - DNA, 16 bp, Homo sapiens
ggtagtaaaacacaga

SEQ ID NO: 2932011 - DNA, 21 bp, Homo sapiens
ggtagtgccgcagtggggtca

SEQ ID NO: 2932012 - DNA, 19 bp, Homo sapiens
ggtagtgggatggtggggt

SEQ ID NO: 2932013 - DNA, 21 bp, Homo sapiens
ggtagttaggatgctcagttg

SEQ ID NO: 2932014 - DNA, 23 bp, Homo sapiens
ggtatagttcatgtctgctatca

SEQ ID NO: 2932015 - DNA, 13 bp, Homo sapiens
ggtatatatacat

SEQ ID NO: 2932016 - DNA, 23 bp, Homo sapiens
ggtatctgcatgtaaaatcttca

SEQ ID NO: 2932017 - DNA, 14 bp, Homo sapiens
ggtatctttatagt

SEQ ID NO: 2932018 - DNA, 21 bp, Homo sapiens
ggtatgaaacaaactactgtg

SEQ ID NO: 2932019 - DNA, 14 bp, Homo sapiens
ggtatgtgccaggc

SEQ ID NO: 2932020 - DNA, 19 bp, Homo sapiens
ggtatgtgccaggcttgcc

SEQ ID NO: 2932021 - DNA, 21 bp, Homo sapiens
ggtatttgtttgtagctttcc

SEQ ID NO: 2932022 - DNA, 20 bp, Homo sapiens
ggtcaacagaatgaaaaatg

SEQ ID NO: 2932023 - DNA, 21 bp, Homo sapiens
ggtcaacagaatgaaaaatga

SEQ ID NO: 2932024 - DNA, 11 bp, Homo sapiens
ggtcaataaac

SEQ ID NO: 2932025 - DNA, 13 bp, Homo sapiens
ggtcaccctgtga

SEQ ID NO: 2932026 - DNA, 23 bp, Homo sapiens
ggtcaccgcggacgtgctggcct

SEQ ID NO: 2932027 - DNA, 13 bp, Homo sapiens
ggtcactctgccc

SEQ ID NO: 2932028 - DNA, 19 bp, Homo sapiens
ggtcactctgccctctgct

SEQ ID NO: 2932029 - DNA, 20 bp, Homo sapiens
ggtcactgaggcctgagacc

SEQ ID NO: 2932030 - DNA, 22 bp, Homo sapiens
ggtcactgaggcctgagaccca

SEQ ID NO: 2932031 - DNA, 21 bp, Homo sapiens
ggtcacttaaaatgtgcagta

SEQ ID NO: 2932032 - DNA, 15 bp, Homo sapiens
ggtcagaaacaggac

SEQ ID NO: 2932033 - DNA, 16 bp, Homo sapiens
ggtcagaaacaggacc

SEQ ID NO: 2932034 - DNA, 18 bp, Homo sapiens
ggtcagaaccggcctgga

SEQ ID NO: 2932035 - DNA, 19 bp, Homo sapiens
ggtcagaaccggcctggag

SEQ ID NO: 2932036 - DNA, 14 bp, Homo sapiens
ggtcagactggagg

SEQ ID NO: 2932037 - DNA, 16 bp, Homo sapiens
ggtcagactggaggtc

SEQ ID NO: 2932038 - DNA, 19 bp, Homo sapiens
ggtcagagtggcgtgagct

SEQ ID NO: 2932039 - DNA, 22 bp, Homo sapiens
ggtcagatttatttgtttgatt

SEQ ID NO: 2932040 - DNA, 12 bp, Homo sapiens
ggtcaggctggt

SEQ ID NO: 2932041 - DNA, 15 bp, Homo sapiens
ggtcaggtgtcaggc

SEQ ID NO: 2932042 - DNA, 18 bp, Homo sapiens
ggtcaggtgtcaggcccg

SEQ ID NO: 2932043 - DNA, 12 bp, Homo sapiens
ggtcatccttgc

SEQ ID NO: 2932044 - DNA, 16 bp, Homo sapiens
ggtcatgtgtgtattt

SEQ ID NO: 2932045 - DNA, 21 bp, Homo sapiens
ggtcattgagggaccaaaaaa

SEQ ID NO: 2932046 - DNA, 22 bp, Homo sapiens
ggtcattgagggaccaaaaaag

SEQ ID NO: 2932047 - DNA, 17 bp, Homo sapiens
ggtccaaaaaaaggaaa

SEQ ID NO: 2932048 - DNA, 18 bp, Homo sapiens
ggtccaaaaaaaggaaaa

SEQ ID NO: 2932049 - DNA, 15 bp, Homo sapiens
ggtccaagattctgg

SEQ ID NO: 2932050 - DNA, 14 bp, Homo sapiens
ggtccacagggcac

SEQ ID NO: 2932051 - DNA, 14 bp, Homo sapiens
ggtccaccccatgt

SEQ ID NO: 2932052 - DNA, 14 bp, Homo sapiens
ggtccacttgccag

SEQ ID NO: 2932053 - DNA, 18 bp, Homo sapiens
ggtccacttgccagggct

SEQ ID NO: 2932054 - DNA, 21 bp, Homo sapiens
ggtccacttgccagggctctg

SEQ ID NO: 2932055 - DNA, 22 bp, Homo sapiens
ggtccacttgccagggctctgg

SEQ ID NO: 2932056 - DNA, 20 bp, Homo sapiens
ggtccagctttactgtggct

SEQ ID NO: 2932057 - DNA, 18 bp, Homo sapiens
ggtccaggccctgtggca

SEQ ID NO: 2932058 - DNA, 13 bp, Homo sapiens
ggtccaggctgtg

SEQ ID NO: 2932059 - DNA, 17 bp, Homo sapiens
ggtccatgggcagagcc

SEQ ID NO: 2932060 - DNA, 18 bp, Homo sapiens
ggtccatgggcagagccc

SEQ ID NO: 2932061 - DNA, 12 bp, Homo sapiens
ggtcccaacagg

SEQ ID NO: 2932062 - DNA, 22 bp, Homo sapiens
ggtcccaacaggaggacaattc

SEQ ID NO: 2932063 - DNA, 23 bp, Homo sapiens
ggtcccaacaggaggacaattca

SEQ ID NO: 2932064 - DNA, 22 bp, Homo sapiens
ggtcccattgttggcgctgagg

SEQ ID NO: 2932065 - DNA, 16 bp, Homo sapiens
ggtcccccgactgcct

SEQ ID NO: 2932066 - DNA, 17 bp, Homo sapiens
ggtcccccgactgcctg

SEQ ID NO: 2932067 - DNA, 21 bp, Homo sapiens
ggtcccccgactgcctgtctc

SEQ ID NO: 2932068 - DNA, 23 bp, Homo sapiens
ggtcccccgactgcctgtctcca

SEQ ID NO: 2932069 - DNA, 13 bp, Homo sapiens
ggtccccctgcag

SEQ ID NO: 2932070 - DNA, 19 bp, Homo sapiens
ggtccccgccctctctcat

SEQ ID NO: 2932071 - DNA, 13 bp, Homo sapiens
ggtcccctgccac

SEQ ID NO: 2932072 - DNA, 22 bp, Homo sapiens
ggtcccctgccaccgactgccc

SEQ ID NO: 2932073 - DNA, 16 bp, Homo sapiens
ggtccccttcccaggg

SEQ ID NO: 2932074 - DNA, 13 bp, Homo sapiens
ggtccctgggagg

SEQ ID NO: 2932075 - DNA, 19 bp, Homo sapiens
ggtcccttgagacctcagc

SEQ ID NO: 2932076 - DNA, 20 bp, Homo sapiens
ggtcccttgagacctcagcc

SEQ ID NO: 2932077 - DNA, 17 bp, Homo sapiens
ggtcctacccatccccg

SEQ ID NO: 2932078 - DNA, 13 bp, Homo sapiens
ggtcctagcccag

SEQ ID NO: 2932079 - DNA, 22 bp, Homo sapiens
ggtcctctctctgtggggctga

SEQ ID NO: 2932080 - DNA, 23 bp, Homo sapiens
ggtcctctgtcagtcacagccac

SEQ ID NO: 2932081 - DNA, 19 bp, Homo sapiens
ggtcctcttctgggcctga

SEQ ID NO: 2932082 - DNA, 22 bp, Homo sapiens
ggtcctgcacagattcccaggc

SEQ ID NO: 2932083 - DNA, 13 bp, Homo sapiens
ggtcctgcctgca

SEQ ID NO: 2932084 - DNA, 16 bp, Homo sapiens
ggtcctgctccgctgc

SEQ ID NO: 2932085 - DNA, 21 bp, Homo sapiens
ggtcctgctccgctgcctgga

SEQ ID NO: 2932086 - DNA, 12 bp, Homo sapiens
ggtcctggccat

SEQ ID NO: 2932087 - DNA, 14 bp, Homo sapiens
ggtcctggccatcc

SEQ ID NO: 2932088 - DNA, 13 bp, Homo sapiens
ggtcctggcctcc

SEQ ID NO: 2932089 - DNA, 16 bp, Homo sapiens
ggtcctggctgcactc

SEQ ID NO: 2932090 - DNA, 19 bp, Homo sapiens
ggtcctgggaggctgcagc

SEQ ID NO: 2932091 - DNA, 20 bp, Homo sapiens
ggtcctgggaggctgcagcc

SEQ ID NO: 2932092 - DNA, 12 bp, Homo sapiens
ggtcctgtcccc

SEQ ID NO: 2932093 - DNA, 19 bp, Homo sapiens
ggtcctgtgatcttatttt

SEQ ID NO: 2932094 - DNA, 15 bp, Homo sapiens
ggtcggaacccaagc

SEQ ID NO: 2932095 - DNA, 21 bp, Homo sapiens
ggtctaaggagcgctagtgcc

SEQ ID NO: 2932096 - DNA, 15 bp, Homo sapiens
ggtctaccaatacaa

SEQ ID NO: 2932097 - DNA, 14 bp, Homo sapiens
ggtctagccgctgc

SEQ ID NO: 2932098 - DNA, 16 bp, Homo sapiens
ggtctagccgctgccc

SEQ ID NO: 2932099 - DNA, 22 bp, Homo sapiens
ggtctagtgacacggtagcacc

SEQ ID NO: 2932100 - DNA, 22 bp, Homo sapiens
ggtctatgtcgagagctggcca

SEQ ID NO: 2932101 - DNA, 14 bp, Homo sapiens
ggtctattccagct

SEQ ID NO: 2932102 - DNA, 15 bp, Homo sapiens
ggtctattccagctc

SEQ ID NO: 2932103 - DNA, 15 bp, Homo sapiens
ggtctcacactcctc

SEQ ID NO: 2932104 - DNA, 13 bp, Homo sapiens
ggtctcacccatg

SEQ ID NO: 2932105 - DNA, 15 bp, Homo sapiens
ggtctcaggtccagc

SEQ ID NO: 2932106 - DNA, 22 bp, Homo sapiens
ggtctccctctcctgcctactc

SEQ ID NO: 2932107 - DNA, 15 bp, Homo sapiens
ggtctcgatgctgct

SEQ ID NO: 2932108 - DNA, 16 bp, Homo sapiens
ggtctcgatgctgctg

SEQ ID NO: 2932109 - DNA, 20 bp, Homo sapiens
ggtctcgggggtccggaagg

SEQ ID NO: 2932110 - DNA, 18 bp, Homo sapiens
ggtctcgtcccagccctc

SEQ ID NO: 2932111 - DNA, 18 bp, Homo sapiens
ggtctctccttcctcttg

SEQ ID NO: 2932112 - DNA, 20 bp, Homo sapiens
ggtctctgcatttttctgca

SEQ ID NO: 2932113 - DNA, 23 bp, Homo sapiens
ggtctctgcatttttctgcagaa

SEQ ID NO: 2932114 - DNA, 19 bp, Homo sapiens
ggtctctgttgactggctg

SEQ ID NO: 2932115 - DNA, 15 bp, Homo sapiens
ggtctcttttctcta

SEQ ID NO: 2932116 - DNA, 17 bp, Homo sapiens
ggtctgatttgcaggat

SEQ ID NO: 2932117 - DNA, 14 bp, Homo sapiens
ggtctgcaggcagg

SEQ ID NO: 2932118 - DNA, 17 bp, Homo sapiens
ggtctgcaggtgagcag

SEQ ID NO: 2932119 - DNA, 13 bp, Homo sapiens
ggtctgccaggcc

SEQ ID NO: 2932120 - DNA, 19 bp, Homo sapiens
ggtctggccgtacttgtga

SEQ ID NO: 2932121 - DNA, 22 bp, Homo sapiens
ggtctggctagagggcccaaag

SEQ ID NO: 2932122 - DNA, 19 bp, Homo sapiens
ggtctgggagtcacacagt

SEQ ID NO: 2932123 - DNA, 13 bp, Homo sapiens
ggtcttcctgtgg

SEQ ID NO: 2932124 - DNA, 13 bp, Homo sapiens
ggtcttgaagtcc

SEQ ID NO: 2932125 - DNA, 18 bp, Homo sapiens
ggtctttcctaaggctgc

SEQ ID NO: 2932126 - DNA, 14 bp, Homo sapiens
ggtctttgtaagaa

SEQ ID NO: 2932127 - DNA, 15 bp, Homo sapiens
ggtctttgtaagaac

SEQ ID NO: 2932128 - DNA, 20 bp, Homo sapiens
ggtcttttcatctgggaaag

SEQ ID NO: 2932129 - DNA, 18 bp, Homo sapiens
ggtctttttctcttctgt

SEQ ID NO: 2932130 - DNA, 15 bp, Homo sapiens
ggtgaaatgaagcaa

SEQ ID NO: 2932131 - DNA, 15 bp, Homo sapiens
ggtgaagtgaggaca

SEQ ID NO: 2932132 - DNA, 12 bp, Homo sapiens
ggtgacacagac

SEQ ID NO: 2932133 - DNA, 14 bp, Homo sapiens
ggtgacacagactc

SEQ ID NO: 2932134 - DNA, 23 bp, Homo sapiens
ggtgacagtgacgtgactcagag

SEQ ID NO: 2932135 - DNA, 19 bp, Homo sapiens
ggtgaccttccaagagcct

SEQ ID NO: 2932136 - DNA, 20 bp, Homo sapiens
ggtgaccttccaagagcctg

SEQ ID NO: 2932137 - DNA, 21 bp, Homo sapiens
ggtgaccttccaagagcctga

SEQ ID NO: 2932138 - DNA, 16 bp, Homo sapiens
ggtgactttctgaaac

SEQ ID NO: 2932139 - DNA, 16 bp, Homo sapiens
ggtgagatgcagctgg

SEQ ID NO: 2932140 - DNA, 17 bp, Homo sapiens
ggtgagctggtgcctgc

SEQ ID NO: 2932141 - DNA, 23 bp, Homo sapiens
gtactttttagtaatttcttttt

SEQ ID NO: 2932142 - DNA, 20 bp, Homo sapiens
gtactttttgttccagagct

SEQ ID NO: 2932143 - DNA, 16 bp, Homo sapiens
gtagaaaactccaggg

SEQ ID NO: 2932144 - DNA, 18 bp, Homo sapiens
gtagaaacatttagattt

SEQ ID NO: 2932145 - DNA, 14 bp, Homo sapiens
gtagaacaaaaaac

SEQ ID NO: 2932146 - DNA, 20 bp, Homo sapiens
gtagaagccacccttccctg

SEQ ID NO: 2932147 - DNA, 21 bp, Homo sapiens
gtagaagccacccttccctgc

SEQ ID NO: 2932148 - DNA, 15 bp, Homo sapiens
gtagaattgcattga

SEQ ID NO: 2932149 - DNA, 13 bp, Homo sapiens
gtagacagttttg

SEQ ID NO: 2932150 - DNA, 16 bp, Homo sapiens
gtagacattgtaaata

SEQ ID NO: 2932151 - DNA, 22 bp, Homo sapiens
gtagacattttaacaagaagat

SEQ ID NO: 2932152 - DNA, 18 bp, Homo sapiens
gtagactatggaatgtca

SEQ ID NO: 2932153 - DNA, 23 bp, Homo sapiens
gtagactatggaatgtcagtgtt

SEQ ID NO: 2932154 - DNA, 18 bp, Homo sapiens
gtagagacggggtttctc

SEQ ID NO: 2932155 - DNA, 13 bp, Homo sapiens
gtagatctgcttt

SEQ ID NO: 2932156 - DNA, 14 bp, Homo sapiens
gtagatctgctttc

SEQ ID NO: 2932157 - DNA, 20 bp, Homo sapiens
gtagatctgctttctgttca

SEQ ID NO: 2932158 - DNA, 15 bp, Homo sapiens
gtagatgcgcagccc

SEQ ID NO: 2932159 - DNA, 15 bp, Homo sapiens
gtagattttctttaa

SEQ ID NO: 2932160 - DNA, 17 bp, Homo sapiens
gtagcaggtaccactga

SEQ ID NO: 2932161 - DNA, 15 bp, Homo sapiens
gtagcatctcagtgg

SEQ ID NO: 2932162 - DNA, 18 bp, Homo sapiens
gtagccacaggagccctg

SEQ ID NO: 2932163 - DNA, 22 bp, Homo sapiens
gtagccacaggagccctgctat

SEQ ID NO: 2932164 - DNA, 15 bp, Homo sapiens
gtagccagcacacag

SEQ ID NO: 2932165 - DNA, 21 bp, Homo sapiens
gtagccagcacacagggcagt

SEQ ID NO: 2932166 - DNA, 20 bp, Homo sapiens
gtagccaggtccccctgcag

SEQ ID NO: 2932167 - DNA, 21 bp, Homo sapiens
gtagccaggtccccctgcagc

SEQ ID NO: 2932168 - DNA, 20 bp, Homo sapiens
gtagccatgttaacatgaca

SEQ ID NO: 2932169 - DNA, 16 bp, Homo sapiens
gtagccccagtgacag

SEQ ID NO: 2932170 - DNA, 18 bp, Homo sapiens
gtagccccctggcctctg

SEQ ID NO: 2932171 - DNA, 14 bp, Homo sapiens
gtagccctcccact

SEQ ID NO: 2932172 - DNA, 17 bp, Homo sapiens
gtagccctcccactttg

SEQ ID NO: 2932173 - DNA, 23 bp, Homo sapiens
gtagccctctcatcgtcttttag

SEQ ID NO: 2932174 - DNA, 19 bp, Homo sapiens
gtagccgagagcctgctcc

SEQ ID NO: 2932175 - DNA, 13 bp, Homo sapiens
gtagccgccctga

SEQ ID NO: 2932176 - DNA, 16 bp, Homo sapiens
gtagctgagctgtgac

SEQ ID NO: 2932177 - DNA, 15 bp, Homo sapiens
gtagctgaggggacg

SEQ ID NO: 2932178 - DNA, 15 bp, Homo sapiens
gtagctgcccctggc

SEQ ID NO: 2932179 - DNA, 16 bp, Homo sapiens
gtagctgcccctggct

SEQ ID NO: 2932180 - DNA, 22 bp, Homo sapiens
gtagctgggattttaaactaga

SEQ ID NO: 2932181 - DNA, 24 bp, Homo sapiens
gtagctgggattttaaactagatg

SEQ ID NO: 2932182 - DNA, 18 bp, Homo sapiens
gtagctgtggtgaggtgg

SEQ ID NO: 2932183 - DNA, 15 bp, Homo sapiens
gtagctttcctggaa

SEQ ID NO: 2932184 - DNA, 16 bp, Homo sapiens
gtagctttcctggaag

SEQ ID NO: 2932185 - DNA, 15 bp, Homo sapiens
gtaggaaaaaaatag

SEQ ID NO: 2932186 - DNA, 14 bp, Homo sapiens
gtaggaaagggcaa

SEQ ID NO: 2932187 - DNA, 18 bp, Homo sapiens
gtaggaacggtaaatttc

SEQ ID NO: 2932188 - DNA, 15 bp, Homo sapiens
gtaggaagtaggaag

SEQ ID NO: 2932189 - DNA, 21 bp, Homo sapiens
gtaggaatctgccttccagcc

SEQ ID NO: 2932190 - DNA, 18 bp, Homo sapiens
gtaggagcccagctctga

SEQ ID NO: 2932191 - DNA, 12 bp, Homo sapiens
gtaggaggaggc

SEQ ID NO: 2932192 - DNA, 17 bp, Homo sapiens
gtaggaggaggcatgga

SEQ ID NO: 2932193 - DNA, 15 bp, Homo sapiens
gtaggatctaaggct

SEQ ID NO: 2932194 - DNA, 17 bp, Homo sapiens
gtaggatctaaggctgt

SEQ ID NO: 2932195 - DNA, 13 bp, Homo sapiens
gtaggattactag

SEQ ID NO: 2932196 - DNA, 15 bp, Homo sapiens
gtaggccccacaagg

SEQ ID NO: 2932197 - DNA, 19 bp, Homo sapiens
gtaggccctggttcctgct

SEQ ID NO: 2932198 - DNA, 17 bp, Homo sapiens
gtagggtaaggtgcctt

SEQ ID NO: 2932199 - DNA, 22 bp, Homo sapiens
gtagggtaattagtaacatgtg

SEQ ID NO: 2932200 - DNA, 13 bp, Homo sapiens
gtaggtaaatcta

SEQ ID NO: 2932201 - DNA, 15 bp, Homo sapiens
gtaggtaattccccc

SEQ ID NO: 2932202 - DNA, 22 bp, Homo sapiens
gtaggtcacaacaactcatttt

SEQ ID NO: 2932203 - DNA, 14 bp, Homo sapiens
gtaggttattttat

SEQ ID NO: 2932204 - DNA, 17 bp, Homo sapiens
gtagtagttctgtgttg

SEQ ID NO: 2932205 - DNA, 23 bp, Homo sapiens
gtagtccgtgctgacagctgctc

SEQ ID NO: 2932206 - DNA, 12 bp, Homo sapiens
gtagtgagcgag

SEQ ID NO: 2932207 - DNA, 17 bp, Homo sapiens
gtagttatataattgtt

SEQ ID NO: 2932208 - DNA, 13 bp, Homo sapiens
gtagttccctgaa

SEQ ID NO: 2932209 - DNA, 13 bp, Homo sapiens
gtagttctaagac

SEQ ID NO: 2932210 - DNA, 19 bp, Homo sapiens
gtagttctttgttcctgct

SEQ ID NO: 2932211 - DNA, 20 bp, Homo sapiens
gtagttctttgttcctgctt

SEQ ID NO: 2932212 - DNA, 17 bp, Homo sapiens
gtagtttgctttgcttt

SEQ ID NO: 2932213 - DNA, 16 bp, Homo sapiens
gtagtttgtattaaac

SEQ ID NO: 2932214 - DNA, 16 bp, Homo sapiens
gtagttttggttttta

SEQ ID NO: 2932215 - DNA, 20 bp, Homo sapiens
gtataaaacttgataaatgg

SEQ ID NO: 2932216 - DNA, 23 bp, Homo sapiens
gtataaatgacaaagtgttgaaa

SEQ ID NO: 2932217 - DNA, 15 bp, Homo sapiens
gtataacaaactatg

SEQ ID NO: 2932218 - DNA, 18 bp, Homo sapiens
gtataacaaactatgtaa

SEQ ID NO: 2932219 - DNA, 20 bp, Homo sapiens
gtataacaactatttacata

SEQ ID NO: 2932220 - DNA, 13 bp, Homo sapiens
gtataacatcact

SEQ ID NO: 2932221 - DNA, 18 bp, Homo sapiens
gtataaccctgttacaaa

SEQ ID NO: 2932222 - DNA, 14 bp, Homo sapiens
gtataagatcctag

SEQ ID NO: 2932223 - DNA, 18 bp, Homo sapiens
gtataagatcctagatcc

SEQ ID NO: 2932224 - DNA, 18 bp, Homo sapiens
gtataattgtatcgtata

SEQ ID NO: 2932225 - DNA, 22 bp, Homo sapiens
gtataattttttaaagttactt

SEQ ID NO: 2932226 - DNA, 19 bp, Homo sapiens
gtataccggaattactttt

SEQ ID NO: 2932227 - DNA, 16 bp, Homo sapiens
gtatacttaatactga

SEQ ID NO: 2932228 - DNA, 23 bp, Homo sapiens
gtatagcctatggcagaaaaaat

SEQ ID NO: 2932229 - DNA, 15 bp, Homo sapiens
gtatagctgtattga

SEQ ID NO: 2932230 - DNA, 21 bp, Homo sapiens
gtatataaatgggaacattta

SEQ ID NO: 2932231 - DNA, 12 bp, Homo sapiens
gtatatactttt

SEQ ID NO: 2932232 - DNA, 20 bp, Homo sapiens
gtatatacttttaaattatg

SEQ ID NO: 2932233 - DNA, 15 bp, Homo sapiens
gtatatagcccagcc

SEQ ID NO: 2932234 - DNA, 15 bp, Homo sapiens
gtatatataagaaag

SEQ ID NO: 2932235 - DNA, 17 bp, Homo sapiens
gtatatataagaaagac

SEQ ID NO: 2932236 - DNA, 23 bp, Homo sapiens
gtatatatatatatatgtacagt

SEQ ID NO: 2932237 - DNA, 17 bp, Homo sapiens
gtatatatgtatttcta

SEQ ID NO: 2932238 - DNA, 13 bp, Homo sapiens
gtatatattccca

SEQ ID NO: 2932239 - DNA, 18 bp, Homo sapiens
gtatatgaaatattttga

SEQ ID NO: 2932240 - DNA, 16 bp, Homo sapiens
gtatatgtcatttact

SEQ ID NO: 2932241 - DNA, 23 bp, Homo sapiens
gtatattatgtatttatattttg

SEQ ID NO: 2932242 - DNA, 14 bp, Homo sapiens
gtatattcttgtaa

SEQ ID NO: 2932243 - DNA, 20 bp, Homo sapiens
gtatattgtgtttgtgtatt

SEQ ID NO: 2932244 - DNA, 17 bp, Homo sapiens
gtatatttgtaaagcta

SEQ ID NO: 2932245 - DNA, 20 bp, Homo sapiens
gtatcaaatattagatgtga

SEQ ID NO: 2932246 - DNA, 21 bp, Homo sapiens
gtatcaaatattagatgtgat

SEQ ID NO: 2932247 - DNA, 16 bp, Homo sapiens
gtatcaatacagttta

SEQ ID NO: 2932248 - DNA, 19 bp, Homo sapiens
gtatcaggaatataaatat

SEQ ID NO: 2932249 - DNA, 17 bp, Homo sapiens
gtatcatgccctgtgca

SEQ ID NO: 2932250 - DNA, 18 bp, Homo sapiens
gtatcatgccctgtgcaa

SEQ ID NO: 2932251 - DNA, 15 bp, Homo sapiens
gtatcatgtatctct

SEQ ID NO: 2932252 - DNA, 17 bp, Homo sapiens
gtatccatgtaatgatc

SEQ ID NO: 2932253 - DNA, 19 bp, Homo sapiens
gtatccattatcatgtgta

SEQ ID NO: 2932254 - DNA, 22 bp, Homo sapiens
gtatccatttaaactaaccttt

SEQ ID NO: 2932255 - DNA, 23 bp, Homo sapiens
gtatcccgggaaggacctgcggt

SEQ ID NO: 2932256 - DNA, 21 bp, Homo sapiens
gtatcctccctggcagacaca

SEQ ID NO: 2932257 - DNA, 16 bp, Homo sapiens
gtatccttgatgaatc

SEQ ID NO: 2932258 - DNA, 15 bp, Homo sapiens
gtatcgtatagctgt

SEQ ID NO: 2932259 - DNA, 16 bp, Homo sapiens
gtatcgtatagctgta

SEQ ID NO: 2932260 - DNA, 19 bp, Homo sapiens
gtatctaaaggatggaaaa

SEQ ID NO: 2932261 - DNA, 21 bp, Homo sapiens
gtatctaaaggatggaaaaat

SEQ ID NO: 2932262 - DNA, 18 bp, Homo sapiens
gtatctaggcaacatagt

SEQ ID NO: 2932263 - DNA, 20 bp, Homo sapiens
gtatctatatatgtgtatgt

SEQ ID NO: 2932264 - DNA, 18 bp, Homo sapiens
gtatctgaagacctacca

SEQ ID NO: 2932265 - DNA, 11 bp, Homo sapiens
gtatctgtcta

SEQ ID NO: 2932266 - DNA, 20 bp, Homo sapiens
gtatctgtctactttctctt

SEQ ID NO: 2932267 - DNA, 14 bp, Homo sapiens
gtatcttctatttt

SEQ ID NO: 2932268 - DNA, 22 bp, Homo sapiens
gtatcttctatttttatcatga

SEQ ID NO: 2932269 - DNA, 23 bp, Homo sapiens
gtatgaaaatctttatagtaaaa

SEQ ID NO: 2932270 - DNA, 23 bp, Homo sapiens
gtatgaatattttatattaaaat

SEQ ID NO: 2932271 - DNA, 23 bp, Homo sapiens
gtatgatttataaacagacaata

SEQ ID NO: 2932272 - DNA, 13 bp, Homo sapiens
gtatgcggtgacg

SEQ ID NO: 2932273 - DNA, 20 bp, Homo sapiens
gtcctttatgtggaaaacag

SEQ ID NO: 2932274 - DNA, 22 bp, Homo sapiens
gtcctttatgtggaaaacagaa

SEQ ID NO: 2932275 - DNA, 21 bp, Homo sapiens
gtcctttccatctgtccacat

SEQ ID NO: 2932276 - DNA, 19 bp, Homo sapiens
gtccttttactacagctat

SEQ ID NO: 2932277 - DNA, 15 bp, Homo sapiens
gtccttttcactaca

SEQ ID NO: 2932278 - DNA, 12 bp, Homo sapiens
gtccttttgtaa

SEQ ID NO: 2932279 - DNA, 14 bp, Homo sapiens
gtcgagagctggcc

SEQ ID NO: 2932280 - DNA, 14 bp, Homo sapiens
gtcgatgaactatt

SEQ ID NO: 2932281 - DNA, 13 bp, Homo sapiens
gtcgattagactg

SEQ ID NO: 2932282 - DNA, 15 bp, Homo sapiens
gtcgccctcccaggc

SEQ ID NO: 2932283 - DNA, 23 bp, Homo sapiens
gtcgccctgttcttgaggtctct

SEQ ID NO: 2932284 - DNA, 14 bp, Homo sapiens
gtcgctgcagggag

SEQ ID NO: 2932285 - DNA, 17 bp, Homo sapiens
gtcgcttgccaaagcag

SEQ ID NO: 2932286 - DNA, 13 bp, Homo sapiens
gtcggagctgcct

SEQ ID NO: 2932287 - DNA, 21 bp, Homo sapiens
gtcggagctgcctgcagcaca

SEQ ID NO: 2932288 - DNA, 17 bp, Homo sapiens
gtcggcatgccaggacc

SEQ ID NO: 2932289 - DNA, 15 bp, Homo sapiens
gtcgggagagccagg

SEQ ID NO: 2932290 - DNA, 13 bp, Homo sapiens
gtcgggcagggcc

SEQ ID NO: 2932291 - DNA, 17 bp, Homo sapiens
gtcggtgaccccatcac

SEQ ID NO: 2932292 - DNA, 13 bp, Homo sapiens
gtctaaaacaata

SEQ ID NO: 2932293 - DNA, 16 bp, Homo sapiens
gtctaaaatcctgctt

SEQ ID NO: 2932294 - DNA, 21 bp, Homo sapiens
gtctaaacaatgctgatttgg

SEQ ID NO: 2932295 - DNA, 13 bp, Homo sapiens
gtctaaactgagc

SEQ ID NO: 2932296 - DNA, 17 bp, Homo sapiens
gtctaaagccttaacta

SEQ ID NO: 2932297 - DNA, 12 bp, Homo sapiens
gtctaagattct

SEQ ID NO: 2932298 - DNA, 13 bp, Homo sapiens
gtctaagattcta

SEQ ID NO: 2932299 - DNA, 18 bp, Homo sapiens
gtctaagattctagatca

SEQ ID NO: 2932300 - DNA, 21 bp, Homo sapiens
gtctaaggagcgctagtgcct

SEQ ID NO: 2932301 - DNA, 18 bp, Homo sapiens
gtctaccaatacaaaatg

SEQ ID NO: 2932302 - DNA, 17 bp, Homo sapiens
gtctactcttaagccat

SEQ ID NO: 2932303 - DNA, 14 bp, Homo sapiens
gtctacttctgtgt

SEQ ID NO: 2932304 - DNA, 21 bp, Homo sapiens
gtctacttctgtgtctgtcac

SEQ ID NO: 2932305 - DNA, 15 bp, Homo sapiens
gtctacttgctcagg

SEQ ID NO: 2932306 - DNA, 13 bp, Homo sapiens
gtctactttctct

SEQ ID NO: 2932307 - DNA, 15 bp, Homo sapiens
gtctagagagggagg

SEQ ID NO: 2932308 - DNA, 15 bp, Homo sapiens
gtctagatggctcct

SEQ ID NO: 2932309 - DNA, 19 bp, Homo sapiens
gtctagatggctcctctca

SEQ ID NO: 2932310 - DNA, 20 bp, Homo sapiens
gtctagatggctcctctcag

SEQ ID NO: 2932311 - DNA, 22 bp, Homo sapiens
gtctagatgtttattcttctag

SEQ ID NO: 2932312 - DNA, 15 bp, Homo sapiens
gtctagattcaaagg

SEQ ID NO: 2932313 - DNA, 21 bp, Homo sapiens
gtctagattcaaaggttctag

SEQ ID NO: 2932314 - DNA, 21 bp, Homo sapiens
gtctagccttagtcaataaac

SEQ ID NO: 2932315 - DNA, 21 bp, Homo sapiens
gtctaggagctgggaggaaaa

SEQ ID NO: 2932316 - DNA, 12 bp, Homo sapiens
gtctagggagag

SEQ ID NO: 2932317 - DNA, 13 bp, Homo sapiens
gtctagtgtctgg

SEQ ID NO: 2932318 - DNA, 18 bp, Homo sapiens
gtctagttattggatcag

SEQ ID NO: 2932319 - DNA, 23 bp, Homo sapiens
gtctatcaaccccagacactggt

SEQ ID NO: 2932320 - DNA, 22 bp, Homo sapiens
gtctatgttccgaattgagcac

SEQ ID NO: 2932321 - DNA, 12 bp, Homo sapiens
gtctattccagc

SEQ ID NO: 2932322 - DNA, 16 bp, Homo sapiens
gtctattccagctcat

SEQ ID NO: 2932323 - DNA, 15 bp, Homo sapiens
gtctcaagactgaaa

SEQ ID NO: 2932324 - DNA, 14 bp, Homo sapiens
gtctcaagggtggc

SEQ ID NO: 2932325 - DNA, 22 bp, Homo sapiens
gtctcaatagctccaagctgtt

SEQ ID NO: 2932326 - DNA, 18 bp, Homo sapiens
gtctcaattttgtattta

SEQ ID NO: 2932327 - DNA, 19 bp, Homo sapiens
gtctcaattttgtatttaa

SEQ ID NO: 2932328 - DNA, 22 bp, Homo sapiens
gtctcacactcctcctgccagc

SEQ ID NO: 2932329 - DNA, 13 bp, Homo sapiens
gtctcacccatgc

SEQ ID NO: 2932330 - DNA, 23 bp, Homo sapiens
gtctcacccatgcaagcagagga

SEQ ID NO: 2932331 - DNA, 21 bp, Homo sapiens
gtctcactgaaacatttaaat

SEQ ID NO: 2932332 - DNA, 13 bp, Homo sapiens
gtctcacttttca

SEQ ID NO: 2932333 - DNA, 14 bp, Homo sapiens
gtctcacttttcat

SEQ ID NO: 2932334 - DNA, 10 bp, Homo sapiens
gtctcaggag

SEQ ID NO: 2932335 - DNA, 23 bp, Homo sapiens
gtctcaggtccagctttactgtg

SEQ ID NO: 2932336 - DNA, 18 bp, Homo sapiens
gtctcattttgtccatgt

SEQ ID NO: 2932337 - DNA, 22 bp, Homo sapiens
gtctccagggccccccaactgt

SEQ ID NO: 2932338 - DNA, 21 bp, Homo sapiens
gtctccatgaggtactggtcc

SEQ ID NO: 2932339 - DNA, 22 bp, Homo sapiens
gtctccatgaggtactggtccc

SEQ ID NO: 2932340 - DNA, 19 bp, Homo sapiens
gtctccctccgactccaga

SEQ ID NO: 2932341 - DNA, 12 bp, Homo sapiens
gtctccctcctc

SEQ ID NO: 2932342 - DNA, 18 bp, Homo sapiens
gtctccctctcctgccta

SEQ ID NO: 2932343 - DNA, 21 bp, Homo sapiens
gtctccctctcctgcctactc

SEQ ID NO: 2932344 - DNA, 16 bp, Homo sapiens
gtctccgcacttggaa

SEQ ID NO: 2932345 - DNA, 17 bp, Homo sapiens
gtctcctctcttggcat

SEQ ID NO: 2932346 - DNA, 23 bp, Homo sapiens
gtctcctggaccttgacagagca

SEQ ID NO: 2932347 - DNA, 13 bp, Homo sapiens
gtctccttctctt

SEQ ID NO: 2932348 - DNA, 17 bp, Homo sapiens
gtctccttctcttctct

SEQ ID NO: 2932349 - DNA, 16 bp, Homo sapiens
gtctcctttaagagct

SEQ ID NO: 2932350 - DNA, 21 bp, Homo sapiens
gtctcgccagaagactcctag

SEQ ID NO: 2932351 - DNA, 13 bp, Homo sapiens
gtctcgctgcatc

SEQ ID NO: 2932352 - DNA, 22 bp, Homo sapiens
gtctcgctgcatcacccaggct

SEQ ID NO: 2932353 - DNA, 16 bp, Homo sapiens
gtctcgtttgtgattc

SEQ ID NO: 2932354 - DNA, 17 bp, Homo sapiens
gtctctacaaaaaataa

SEQ ID NO: 2932355 - DNA, 21 bp, Homo sapiens
gtctctacaaaaaataaaata

SEQ ID NO: 2932356 - DNA, 16 bp, Homo sapiens
gtctctacccctttct

SEQ ID NO: 2932357 - DNA, 18 bp, Homo sapiens
gtctctactaaaaataag

SEQ ID NO: 2932358 - DNA, 15 bp, Homo sapiens
gtctctactgtggca

SEQ ID NO: 2932359 - DNA, 16 bp, Homo sapiens
gtctctatcattaaag

SEQ ID NO: 2932360 - DNA, 15 bp, Homo sapiens
gtctctccagcctca

SEQ ID NO: 2932361 - DNA, 16 bp, Homo sapiens
gtctctccagcctcac

SEQ ID NO: 2932362 - DNA, 14 bp, Homo sapiens
gtctctcccacccc

SEQ ID NO: 2932363 - DNA, 21 bp, Homo sapiens
gtctctccccctctgtcttct

SEQ ID NO: 2932364 - DNA, 15 bp, Homo sapiens
gtctctctgcctgct

SEQ ID NO: 2932365 - DNA, 20 bp, Homo sapiens
gtctctctgcctgctgggct

SEQ ID NO: 2932366 - DNA, 16 bp, Homo sapiens
gtctctcttgtcacat

SEQ ID NO: 2932367 - DNA, 15 bp, Homo sapiens
gtctctgaagcgtga

SEQ ID NO: 2932368 - DNA, 21 bp, Homo sapiens
gtctctgaaggtaagatcatt

SEQ ID NO: 2932369 - DNA, 20 bp, Homo sapiens
gtctctgcctggagcagggg

SEQ ID NO: 2932370 - DNA, 15 bp, Homo sapiens
gtctctgccttgcct

SEQ ID NO: 2932371 - DNA, 16 bp, Homo sapiens
gtctctgccttgcctt

SEQ ID NO: 2932372 - DNA, 15 bp, Homo sapiens
gtctctgctccagca

SEQ ID NO: 2932373 - DNA, 21 bp, Homo sapiens
gtctctggaacccaggacctc

SEQ ID NO: 2932374 - DNA, 15 bp, Homo sapiens
gtctctggctcagct

SEQ ID NO: 2932375 - DNA, 20 bp, Homo sapiens
gtctctggctcagctgtggt

SEQ ID NO: 2932376 - DNA, 12 bp, Homo sapiens
gtctctgtcctc

SEQ ID NO: 2932377 - DNA, 20 bp, Homo sapiens
gtctctgtggaaaagccatc

SEQ ID NO: 2932378 - DNA, 19 bp, Homo sapiens
gtctctgtttagtaaatac

SEQ ID NO: 2932379 - DNA, 23 bp, Homo sapiens
gtctcttgtgactcagcagaggc

SEQ ID NO: 2932380 - DNA, 17 bp, Homo sapiens
gtctctttattcctagt

SEQ ID NO: 2932381 - DNA, 14 bp, Homo sapiens
gtctcttttctcta

SEQ ID NO: 2932382 - DNA, 20 bp, Homo sapiens
gtctgaaaagaggagccaga

SEQ ID NO: 2932383 - DNA, 13 bp, Homo sapiens
gtctgacctggtg

SEQ ID NO: 2932384 - DNA, 22 bp, Homo sapiens
gtctgactccctccccacccaa

SEQ ID NO: 2932385 - DNA, 13 bp, Homo sapiens
gtctgagagaggc

SEQ ID NO: 2932386 - DNA, 15 bp, Homo sapiens
gtctgagagaggcca

SEQ ID NO: 2932387 - DNA, 18 bp, Homo sapiens
gtctgagagaggccattc

SEQ ID NO: 2932388 - DNA, 20 bp, Homo sapiens
gtctgatcgtgacgctgaat

SEQ ID NO: 2932389 - DNA, 21 bp, Homo sapiens
gtctgatcgtgacgctgaata

SEQ ID NO: 2932390 - DNA, 13 bp, Homo sapiens
gtctgatttgcag

SEQ ID NO: 2932391 - DNA, 19 bp, Homo sapiens
gtctgatttgcaggatttt

SEQ ID NO: 2932392 - DNA, 21 bp, Homo sapiens
gtctgcaagggcccagagtga

SEQ ID NO: 2932393 - DNA, 14 bp, Homo sapiens
gtctgcaatggtga

SEQ ID NO: 2932394 - DNA, 16 bp, Homo sapiens
gtctgcaatggtgact

SEQ ID NO: 2932395 - DNA, 11 bp, Homo sapiens
gtctgcagccc

SEQ ID NO: 2932396 - DNA, 13 bp, Homo sapiens
gtctgcagccctg

SEQ ID NO: 2932397 - DNA, 15 bp, Homo sapiens
gtctgcagccctgag

SEQ ID NO: 2932398 - DNA, 19 bp, Homo sapiens
gtctgcaggtgagcagaca

SEQ ID NO: 2932399 - DNA, 22 bp, Homo sapiens
gtctgccaatctgtacaaaatg

SEQ ID NO: 2932400 - DNA, 18 bp, Homo sapiens
gtctgccaatttttgcct

SEQ ID NO: 2932401 - DNA, 17 bp, Homo sapiens
gtctgccccacatgtgg

SEQ ID NO: 2932402 - DNA, 12 bp, Homo sapiens
gtctgcctggag

SEQ ID NO: 2932403 - DNA, 21 bp, Homo sapiens
gtctgcgaagtcctatggaaa

SEQ ID NO: 2932404 - DNA, 17 bp, Homo sapiens
gtctggaagaagcagcg

SEQ ID NO: 2932405 - DNA, 14 bp, Homo sapiens
gtctggaagtccaa

SEQ ID NO: 2932406 - DNA, 13 bp, Homo sapiens
gtgcttcttgtaa

SEQ ID NO: 2932407 - DNA, 21 bp, Homo sapiens
gtgcttgtttgctcacctggg

SEQ ID NO: 2932408 - DNA, 22 bp, Homo sapiens
gtgcttgtttgctcacctgggg

SEQ ID NO: 2932409 - DNA, 23 bp, Homo sapiens
gtgcttgtttgctcacctggggt

SEQ ID NO: 2932410 - DNA, 22 bp, Homo sapiens
gtgcttttaggcttgaaatctc

SEQ ID NO: 2932411 - DNA, 16 bp, Homo sapiens
gtggaaaaaacatttt

SEQ ID NO: 2932412 - DNA, 21 bp, Homo sapiens
gtggaaaaagacgatgtttat

SEQ ID NO: 2932413 - DNA, 13 bp, Homo sapiens
gtggaaaacaggg

SEQ ID NO: 2932414 - DNA, 20 bp, Homo sapiens
gtggaaaagccatctcaggt

SEQ ID NO: 2932415 - DNA, 21 bp, Homo sapiens
gtggaaagtgtaaagcattcc

SEQ ID NO: 2932416 - DNA, 16 bp, Homo sapiens
gtggaagccctccttc

SEQ ID NO: 2932417 - DNA, 20 bp, Homo sapiens
gtggaaggcatcagtcccta

SEQ ID NO: 2932418 - DNA, 14 bp, Homo sapiens
gtggaagtgttcct

SEQ ID NO: 2932419 - DNA, 20 bp, Homo sapiens
gtggaattattttaaaagat

SEQ ID NO: 2932420 - DNA, 16 bp, Homo sapiens
gtggacaagtcatgga

SEQ ID NO: 2932421 - DNA, 22 bp, Homo sapiens
gtggacagtctgctctagatga

SEQ ID NO: 2932422 - DNA, 23 bp, Homo sapiens
gtggaccaaacccttagcagccc

SEQ ID NO: 2932423 - DNA, 12 bp, Homo sapiens
gtggacctggca

SEQ ID NO: 2932424 - DNA, 18 bp, Homo sapiens
gtggaccttaggccttcc

SEQ ID NO: 2932425 - DNA, 13 bp, Homo sapiens
gtggacggcgctg

SEQ ID NO: 2932426 - DNA, 15 bp, Homo sapiens
gtggacgtagagttg

SEQ ID NO: 2932427 - DNA, 16 bp, Homo sapiens
gtggactcagggcagc

SEQ ID NO: 2932428 - DNA, 12 bp, Homo sapiens
gtggactctggt

SEQ ID NO: 2932429 - DNA, 18 bp, Homo sapiens
gtggactgagcgaggaaa

SEQ ID NO: 2932430 - DNA, 22 bp, Homo sapiens
gtggactgagcgaggaaaaaca

SEQ ID NO: 2932431 - DNA, 23 bp, Homo sapiens
gtggactgagcgaggaaaaacaa

SEQ ID NO: 2932432 - DNA, 21 bp, Homo sapiens
gtggactgtggcacttgcctg

SEQ ID NO: 2932433 - DNA, 22 bp, Homo sapiens
gtggactgtggcacttgcctgg

SEQ ID NO: 2932434 - DNA, 13 bp, Homo sapiens
gtggacttctgaa

SEQ ID NO: 2932435 - DNA, 16 bp, Homo sapiens
gtggacttgaactttc

SEQ ID NO: 2932436 - DNA, 18 bp, Homo sapiens
gtggacttgttttaattt

SEQ ID NO: 2932437 - DNA, 22 bp, Homo sapiens
gtggagaaattccttgattcac

SEQ ID NO: 2932438 - DNA, 15 bp, Homo sapiens
gtggagaagccattg

SEQ ID NO: 2932439 - DNA, 19 bp, Homo sapiens
gtggagaagccattgtctt

SEQ ID NO: 2932440 - DNA, 13 bp, Homo sapiens
gtggagactggca

SEQ ID NO: 2932441 - DNA, 12 bp, Homo sapiens
gtggagatgccc

SEQ ID NO: 2932442 - DNA, 11 bp, Homo sapiens
gtggagccagg

SEQ ID NO: 2932443 - DNA, 17 bp, Homo sapiens
gtggagctgagaagagg

SEQ ID NO: 2932444 - DNA, 19 bp, Homo sapiens
gtggaggagctgagggagg

SEQ ID NO: 2932445 - DNA, 23 bp, Homo sapiens
gtggaggagctgagggagggagc

SEQ ID NO: 2932446 - DNA, 16 bp, Homo sapiens
gtggaggcctcaggga

SEQ ID NO: 2932447 - DNA, 12 bp, Homo sapiens
gtggagggccac

SEQ ID NO: 2932448 - DNA, 16 bp, Homo sapiens
gtggaggttgagtgag

SEQ ID NO: 2932449 - DNA, 13 bp, Homo sapiens
gtggagtccagct

SEQ ID NO: 2932450 - DNA, 18 bp, Homo sapiens
gtggagtccagctctact

SEQ ID NO: 2932451 - DNA, 17 bp, Homo sapiens
gtggagtgcagtggtgc

SEQ ID NO: 2932452 - DNA, 14 bp, Homo sapiens
gtggataacaaaga

SEQ ID NO: 2932453 - DNA, 18 bp, Homo sapiens
gtggataacaaagatatc

SEQ ID NO: 2932454 - DNA, 18 bp, Homo sapiens
gtggatctcagtttttaa

SEQ ID NO: 2932455 - DNA, 13 bp, Homo sapiens
gtggatgctgtgc

SEQ ID NO: 2932456 - DNA, 16 bp, Homo sapiens
gtggatggtgactttt

SEQ ID NO: 2932457 - DNA, 13 bp, Homo sapiens
gtggatgtgagca

SEQ ID NO: 2932458 - DNA, 16 bp, Homo sapiens
gtggatgtgagcagaa

SEQ ID NO: 2932459 - DNA, 14 bp, Homo sapiens
gtggattaaactta

SEQ ID NO: 2932460 - DNA, 21 bp, Homo sapiens
gtggattcagcttctgttgga

SEQ ID NO: 2932461 - DNA, 14 bp, Homo sapiens
gtggatttcagttt

SEQ ID NO: 2932462 - DNA, 15 bp, Homo sapiens
gtggcaaatgccaac

SEQ ID NO: 2932463 - DNA, 19 bp, Homo sapiens
gtggcaagtgaatttgcct

SEQ ID NO: 2932464 - DNA, 20 bp, Homo sapiens
gtggcaccagcgaagggagt

SEQ ID NO: 2932465 - DNA, 18 bp, Homo sapiens
gtggcacgatctcagctc

SEQ ID NO: 2932466 - DNA, 14 bp, Homo sapiens
gtggcactggggca

SEQ ID NO: 2932467 - DNA, 17 bp, Homo sapiens
gtggcactggggcaggg

SEQ ID NO: 2932468 - DNA, 13 bp, Homo sapiens
gtggcagccacac

SEQ ID NO: 2932469 - DNA, 15 bp, Homo sapiens
gtggcagctggggct

SEQ ID NO: 2932470 - DNA, 16 bp, Homo sapiens
gtggcaggtcactgtc

SEQ ID NO: 2932471 - DNA, 19 bp, Homo sapiens
gtggcaggtcactgtcact

SEQ ID NO: 2932472 - DNA, 21 bp, Homo sapiens
gtggcaggtcactgtcactgc

SEQ ID NO: 2932473 - DNA, 22 bp, Homo sapiens
gtggcatcaccttaggcaggga

SEQ ID NO: 2932474 - DNA, 23 bp, Homo sapiens
gtggcatgtgggttgtgatattg

SEQ ID NO: 2932475 - DNA, 23 bp, Homo sapiens
gtggcatttcaattcctggccct

SEQ ID NO: 2932476 - DNA, 15 bp, Homo sapiens
gtggccaaggagctg

SEQ ID NO: 2932477 - DNA, 16 bp, Homo sapiens
gtggccaaggagctgc

SEQ ID NO: 2932478 - DNA, 14 bp, Homo sapiens
gtggccacagcgtg

SEQ ID NO: 2932479 - DNA, 22 bp, Homo sapiens
gtggccaccgggggtggctctg

SEQ ID NO: 2932480 - DNA, 15 bp, Homo sapiens
gtggccacggcccag

SEQ ID NO: 2932481 - DNA, 20 bp, Homo sapiens
gtggccacggcccagggagg

SEQ ID NO: 2932482 - DNA, 19 bp, Homo sapiens
gtggccacgttcagggagg

SEQ ID NO: 2932483 - DNA, 20 bp, Homo sapiens
gtggccacgttcagggaggg

SEQ ID NO: 2932484 - DNA, 13 bp, Homo sapiens
gtggccagaggtg

SEQ ID NO: 2932485 - DNA, 19 bp, Homo sapiens
gtggccagaggtgtcaccc

SEQ ID NO: 2932486 - DNA, 13 bp, Homo sapiens
gtggccagcgcca

SEQ ID NO: 2932487 - DNA, 19 bp, Homo sapiens
gtggccagcgccagggccc

SEQ ID NO: 2932488 - DNA, 18 bp, Homo sapiens
gtggccatcactcagccc

SEQ ID NO: 2932489 - DNA, 20 bp, Homo sapiens
gtggcccctgctgtctctct

SEQ ID NO: 2932490 - DNA, 15 bp, Homo sapiens
gtggcccgtggcctg

SEQ ID NO: 2932491 - DNA, 16 bp, Homo sapiens
gtggcccgtggcctgg

SEQ ID NO: 2932492 - DNA, 17 bp, Homo sapiens
gtggcccgtggcctggc

SEQ ID NO: 2932493 - DNA, 17 bp, Homo sapiens
gtggccctggcctgctg

SEQ ID NO: 2932494 - DNA, 19 bp, Homo sapiens
gtggccctggcctgctggg

SEQ ID NO: 2932495 - DNA, 22 bp, Homo sapiens
gtggccgccatctgcgcagggt

SEQ ID NO: 2932496 - DNA, 16 bp, Homo sapiens
gtggccgcccctgagg

SEQ ID NO: 2932497 - DNA, 22 bp, Homo sapiens
gtggcctaacctgccgagagtc

SEQ ID NO: 2932498 - DNA, 18 bp, Homo sapiens
gtggcctagagcactctc

SEQ ID NO: 2932499 - DNA, 17 bp, Homo sapiens
gtggcctctgctggtct

SEQ ID NO: 2932500 - DNA, 15 bp, Homo sapiens
gtggcctgcccagcc

SEQ ID NO: 2932501 - DNA, 16 bp, Homo sapiens
gtggcctggcatctgt

SEQ ID NO: 2932502 - DNA, 13 bp, Homo sapiens
gtggcctggccgt

SEQ ID NO: 2932503 - DNA, 17 bp, Homo sapiens
gtggcctgggcttggcc

SEQ ID NO: 2932504 - DNA, 22 bp, Homo sapiens
gtggcctgtagaatagcctgtg

SEQ ID NO: 2932505 - DNA, 22 bp, Homo sapiens
gtggcctgtgaggggcccctgg

SEQ ID NO: 2932506 - DNA, 13 bp, Homo sapiens
gtggcctgtgctt

SEQ ID NO: 2932507 - DNA, 13 bp, Homo sapiens
gtggcctgtgtgg

SEQ ID NO: 2932508 - DNA, 19 bp, Homo sapiens
gtggccttggccggctgtg

SEQ ID NO: 2932509 - DNA, 21 bp, Homo sapiens
gtggcggcagggccaggctgg

SEQ ID NO: 2932510 - DNA, 13 bp, Homo sapiens
gtggcggggtggg

SEQ ID NO: 2932511 - DNA, 21 bp, Homo sapiens
gtggcggggtggggtgggggt

SEQ ID NO: 2932512 - DNA, 14 bp, Homo sapiens
gtggcggtgcctgg

SEQ ID NO: 2932513 - DNA, 16 bp, Homo sapiens
gtggcgtgagctgccc

SEQ ID NO: 2932514 - DNA, 20 bp, Homo sapiens
gtggctaagggggaccatgg

SEQ ID NO: 2932515 - DNA, 22 bp, Homo sapiens
gtggctagcaaattagaaacac

SEQ ID NO: 2932516 - DNA, 17 bp, Homo sapiens
gtggctagtcagagaga

SEQ ID NO: 2932517 - DNA, 23 bp, Homo sapiens
gtggctagtggggtgaacagctg

SEQ ID NO: 2932518 - DNA, 23 bp, Homo sapiens
gtggctccagaatgtgctgcctt

SEQ ID NO: 2932519 - DNA, 14 bp, Homo sapiens
gtggctccccctct

SEQ ID NO: 2932520 - DNA, 15 bp, Homo sapiens
gtggctccccctctg

SEQ ID NO: 2932521 - DNA, 16 bp, Homo sapiens
gtggctccccctctgc

SEQ ID NO: 2932522 - DNA, 18 bp, Homo sapiens
gtggctccctctctcctg

SEQ ID NO: 2932523 - DNA, 19 bp, Homo sapiens
gtggctccctctctcctgg

SEQ ID NO: 2932524 - DNA, 16 bp, Homo sapiens
gtggctcgggaggcga

SEQ ID NO: 2932525 - DNA, 15 bp, Homo sapiens
gtggctctgctggcc

SEQ ID NO: 2932526 - DNA, 15 bp, Homo sapiens
gtggctgagcccctg

SEQ ID NO: 2932527 - DNA, 14 bp, Homo sapiens
gtggctgcctttga

SEQ ID NO: 2932528 - DNA, 21 bp, Homo sapiens
gtggctgcctttgatcacagg

SEQ ID NO: 2932529 - DNA, 22 bp, Homo sapiens
gtggctgcctttgatcacagga

SEQ ID NO: 2932530 - DNA, 12 bp, Homo sapiens
gtggctgggccc

SEQ ID NO: 2932531 - DNA, 20 bp, Homo sapiens
gtggctgggcccagcagggg

SEQ ID NO: 2932532 - DNA, 21 bp, Homo sapiens
gtggctgggtccaggggatgg

SEQ ID NO: 2932533 - DNA, 15 bp, Homo sapiens
gtggctgtctggaaa

SEQ ID NO: 2932534 - DNA, 19 bp, Homo sapiens
gtggcttcagctccagccc

SEQ ID NO: 2932535 - DNA, 13 bp, Homo sapiens
gtggcttctcttt

SEQ ID NO: 2932536 - DNA, 14 bp, Homo sapiens
gtggcttctttcca

SEQ ID NO: 2932537 - DNA, 22 bp, Homo sapiens
gtggcttgagaaatatggacac

SEQ ID NO: 2932538 - DNA, 16 bp, Homo sapiens
gtggcttggcatctgt

SEQ ID NO: 2932539 - DNA, 18 bp, Homo sapiens
gtggcttgggctggtcag

SEQ ID NO: 2932540 - DNA, 23 bp, Homo sapiens
gtgggaaagattactttttcttt

SEQ ID NO: 2932541 - DNA, 17 bp, Homo sapiens
gtgggaagcgtctgtcc

SEQ ID NO: 2932542 - DNA, 15 bp, Homo sapiens
gtgggaaggaaaggc

SEQ ID NO: 2932543 - DNA, 18 bp, Homo sapiens
gtgggaaggaaaggcaga

SEQ ID NO: 2932544 - DNA, 15 bp, Homo sapiens
gtgggagatgaaaac

SEQ ID NO: 2932545 - DNA, 23 bp, Homo sapiens
gtgggaggaaagggcctggccag

SEQ ID NO: 2932546 - DNA, 14 bp, Homo sapiens
gtgggaggccaggc

SEQ ID NO: 2932547 - DNA, 20 bp, Homo sapiens
gtgggagggtaccagcagaa

SEQ ID NO: 2932548 - DNA, 14 bp, Homo sapiens
gtgggatggaggag

SEQ ID NO: 2932549 - DNA, 20 bp, Homo sapiens
gtgggcacccaccctgggac

SEQ ID NO: 2932550 - DNA, 16 bp, Homo sapiens
gtgggcagcagcatcc

SEQ ID NO: 2932551 - DNA, 18 bp, Homo sapiens
gtgggccaggacaggccc

SEQ ID NO: 2932552 - DNA, 18 bp, Homo sapiens
gtgggccgtggcttgggc

SEQ ID NO: 2932553 - DNA, 21 bp, Homo sapiens
gtgggccgtggcttgggctgg

SEQ ID NO: 2932554 - DNA, 15 bp, Homo sapiens
gtgggctccctgact

SEQ ID NO: 2932555 - DNA, 22 bp, Homo sapiens
gtgggctggtattctctctatg

SEQ ID NO: 2932556 - DNA, 15 bp, Homo sapiens
gtgggcttcagggca

SEQ ID NO: 2932557 - DNA, 17 bp, Homo sapiens
gtggggaatgggcaggt

SEQ ID NO: 2932558 - DNA, 15 bp, Homo sapiens
gtggggaccccaccc

SEQ ID NO: 2932559 - DNA, 15 bp, Homo sapiens
gtggggacctcagcc

SEQ ID NO: 2932560 - DNA, 21 bp, Homo sapiens
gtggggagagacgggccctgg

SEQ ID NO: 2932561 - DNA, 20 bp, Homo sapiens
gtggggagcgggagcaagag

SEQ ID NO: 2932562 - DNA, 13 bp, Homo sapiens
gtggggcagggag

SEQ ID NO: 2932563 - DNA, 18 bp, Homo sapiens
gtggggcccatggaggag

SEQ ID NO: 2932564 - DNA, 20 bp, Homo sapiens
gtggggcccatggaggagac

SEQ ID NO: 2932565 - DNA, 17 bp, Homo sapiens
gtggggctgctcctcca

SEQ ID NO: 2932566 - DNA, 18 bp, Homo sapiens
gtggggctgctcctccag

SEQ ID NO: 2932567 - DNA, 18 bp, Homo sapiens
gtgggggcagagggcaga

SEQ ID NO: 2932568 - DNA, 13 bp, Homo sapiens
gtgggggccaggc

SEQ ID NO: 2932569 - DNA, 16 bp, Homo sapiens
gtggggggcttcatac

SEQ ID NO: 2932570 - DNA, 23 bp, Homo sapiens
gtggggggggggcgcggctggga

SEQ ID NO: 2932571 - DNA, 13 bp, Homo sapiens
gtgggggtgggca

SEQ ID NO: 2932572 - DNA, 15 bp, Homo sapiens
gtggggtcatgccct

SEQ ID NO: 2932573 - DNA, 12 bp, Homo sapiens
gtggggtggggg

SEQ ID NO: 2932574 - DNA, 13 bp, Homo sapiens
gtggggtgggggt

SEQ ID NO: 2932575 - DNA, 20 bp, Homo sapiens
gtggggttgggggacagcct

SEQ ID NO: 2932576 - DNA, 22 bp, Homo sapiens
gtggggttgggggacagccttc

SEQ ID NO: 2932577 - DNA, 15 bp, Homo sapiens
gtggggtttcctgca

SEQ ID NO: 2932578 - DNA, 12 bp, Homo sapiens
gtgggtcctggg

SEQ ID NO: 2932579 - DNA, 17 bp, Homo sapiens
gtgggtctttttctctt

SEQ ID NO: 2932580 - DNA, 20 bp, Homo sapiens
gtgggtctttttctcttctg

SEQ ID NO: 2932581 - DNA, 12 bp, Homo sapiens
gtgggtgtgtga

SEQ ID NO: 2932582 - DNA, 17 bp, Homo sapiens
gtgggttgtgatattga

SEQ ID NO: 2932583 - DNA, 16 bp, Homo sapiens
gtggtaactttgcagg

SEQ ID NO: 2932584 - DNA, 14 bp, Homo sapiens
gtggtagctccagc

SEQ ID NO: 2932585 - DNA, 18 bp, Homo sapiens
gtggtagtaaaacacaga

SEQ ID NO: 2932586 - DNA, 22 bp, Homo sapiens
gtggtatgacattggatagaac

SEQ ID NO: 2932587 - DNA, 14 bp, Homo sapiens
gtggtattctgtca

SEQ ID NO: 2932588 - DNA, 22 bp, Homo sapiens
gtggtcatattattattaattt

SEQ ID NO: 2932589 - DNA, 16 bp, Homo sapiens
gtggtcccacccagga

SEQ ID NO: 2932590 - DNA, 18 bp, Homo sapiens
gtggtcccacccaggaag

SEQ ID NO: 2932591 - DNA, 16 bp, Homo sapiens
gtggtctcctctcagc

SEQ ID NO: 2932592 - DNA, 18 bp, Homo sapiens
gtggtctcctctcagctt

SEQ ID NO: 2932593 - DNA, 20 bp, Homo sapiens
gtggtctcctctcagcttct

SEQ ID NO: 2932594 - DNA, 21 bp, Homo sapiens
gtggtctcgatgctgctggcc

SEQ ID NO: 2932595 - DNA, 21 bp, Homo sapiens
gtggtctcttcttggggccca

SEQ ID NO: 2932596 - DNA, 17 bp, Homo sapiens
gtggtggcctgtgaggg

SEQ ID NO: 2932597 - DNA, 14 bp, Homo sapiens
gtggtggctcggga

SEQ ID NO: 2932598 - DNA, 18 bp, Homo sapiens
gtggtgtcactgtccctc

SEQ ID NO: 2932599 - DNA, 14 bp, Homo sapiens
gtggtgtcctgaag

SEQ ID NO: 2932600 - DNA, 20 bp, Homo sapiens
gtggtgtcctgaagctgctg

SEQ ID NO: 2932601 - DNA, 22 bp, Homo sapiens
gtggtgtgatcccagctcactg

SEQ ID NO: 2932602 - DNA, 13 bp, Homo sapiens
gtggtgtggcccg

SEQ ID NO: 2932603 - DNA, 20 bp, Homo sapiens
gtggttcaatacctgtttag

SEQ ID NO: 2932604 - DNA, 21 bp, Homo sapiens
gtggttcactcttggagcctg

SEQ ID NO: 2932605 - DNA, 18 bp, Homo sapiens
gtggttcattccacagga

SEQ ID NO: 2932606 - DNA, 14 bp, Homo sapiens
gtggttgaagagca

SEQ ID NO: 2932607 - DNA, 17 bp, Homo sapiens
gtggttgcagtctttcc

SEQ ID NO: 2932608 - DNA, 20 bp, Homo sapiens
gtggtttctacggtgacagt

SEQ ID NO: 2932609 - DNA, 15 bp, Homo sapiens
gtggtttgtgagcct

SEQ ID NO: 2932610 - DNA, 23 bp, Homo sapiens
gtggttttagattttctggttct

SEQ ID NO: 2932611 - DNA, 18 bp, Homo sapiens
gtgtaaaaaatggaaaaa

SEQ ID NO: 2932612 - DNA, 20 bp, Homo sapiens
gtgtaaaaaatggaaaaaaa

SEQ ID NO: 2932613 - DNA, 17 bp, Homo sapiens
gtgtaaaatattttgaa

SEQ ID NO: 2932614 - DNA, 18 bp, Homo sapiens
gtgtaaaatattttgaat

SEQ ID NO: 2932615 - DNA, 16 bp, Homo sapiens
gtgtaaagttagtcta

SEQ ID NO: 2932616 - DNA, 19 bp, Homo sapiens
gtgtaaagttagtctactc

SEQ ID NO: 2932617 - DNA, 17 bp, Homo sapiens
gtgtaaatgaagatctt

SEQ ID NO: 2932618 - DNA, 19 bp, Homo sapiens
gtgtaataatgtaacatga

SEQ ID NO: 2932619 - DNA, 13 bp, Homo sapiens
gtgtaatattctc

SEQ ID NO: 2932620 - DNA, 17 bp, Homo sapiens
gtgtaatcaataaacga

SEQ ID NO: 2932621 - DNA, 19 bp, Homo sapiens
gtgtaatcaataaacgatt

SEQ ID NO: 2932622 - DNA, 18 bp, Homo sapiens
gtgtaattgagaaggaaa

SEQ ID NO: 2932623 - DNA, 18 bp, Homo sapiens
gtgtacaagttgctttgt

SEQ ID NO: 2932624 - DNA, 19 bp, Homo sapiens
gtgtacaagttgctttgtt

SEQ ID NO: 2932625 - DNA, 17 bp, Homo sapiens
gtgtacatgtacatagt

SEQ ID NO: 2932626 - DNA, 22 bp, Homo sapiens
gtgtaccacaccctgcctgctg

SEQ ID NO: 2932627 - DNA, 17 bp, Homo sapiens
gtgtagccacaccagga

SEQ ID NO: 2932628 - DNA, 13 bp, Homo sapiens
gtgtagctgagct

SEQ ID NO: 2932629 - DNA, 22 bp, Homo sapiens
gtgtatagaagcgatttaagtt

SEQ ID NO: 2932630 - DNA, 12 bp, Homo sapiens
gtgtatatatat

SEQ ID NO: 2932631 - DNA, 17 bp, Homo sapiens
gtgtatatcatgaagcc

SEQ ID NO: 2932632 - DNA, 16 bp, Homo sapiens
gtgtatccattatcat

SEQ ID NO: 2932633 - DNA, 22 bp, Homo sapiens
gtgtatccattatcatgtgtaa

SEQ ID NO: 2932634 - DNA, 18 bp, Homo sapiens
gtgtatctaaaggatgga

SEQ ID NO: 2932635 - DNA, 21 bp, Homo sapiens
gtgtatgagaagtactttgtg

SEQ ID NO: 2932636 - DNA, 22 bp, Homo sapiens
gtgtatgcaagtgggagatgaa

SEQ ID NO: 2932637 - DNA, 16 bp, Homo sapiens
gtgtatgcactgctca

SEQ ID NO: 2932638 - DNA, 16 bp, Homo sapiens
gtgtatgtagaagcat

SEQ ID NO: 2932639 - DNA, 17 bp, Homo sapiens
gtgtatttacgctttga

SEQ ID NO: 2932640 - DNA, 17 bp, Homo sapiens
gtgtattttaaaataga

SEQ ID NO: 2932641 - DNA, 14 bp, Homo sapiens
gtgtattttattca

SEQ ID NO: 2932642 - DNA, 16 bp, Homo sapiens
gtgtcaaccagacaga

SEQ ID NO: 2932643 - DNA, 19 bp, Homo sapiens
gtgtcacccaaaccggcag

SEQ ID NO: 2932644 - DNA, 14 bp, Homo sapiens
gtgtcaccccagag

SEQ ID NO: 2932645 - DNA, 17 bp, Homo sapiens
gtgtcaccccagagcca

SEQ ID NO: 2932646 - DNA, 17 bp, Homo sapiens
gtgtcaccttttcttgc

SEQ ID NO: 2932647 - DNA, 15 bp, Homo sapiens
gtgtcactcaaggcg

SEQ ID NO: 2932648 - DNA, 15 bp, Homo sapiens
gtgtcagagcccagc

SEQ ID NO: 2932649 - DNA, 16 bp, Homo sapiens
gtgtcagagcccagcc

SEQ ID NO: 2932650 - DNA, 20 bp, Homo sapiens
gtgtcagagcccagcccagg

SEQ ID NO: 2932651 - DNA, 12 bp, Homo sapiens
gtgtcagccatt

SEQ ID NO: 2932652 - DNA, 23 bp, Homo sapiens
gtgtcaggaaacatatttaagaa

SEQ ID NO: 2932653 - DNA, 20 bp, Homo sapiens
gtgtcaggcccgtcggagct

SEQ ID NO: 2932654 - DNA, 23 bp, Homo sapiens
gtgtcaggcccgtcggagctgcc

SEQ ID NO: 2932655 - DNA, 17 bp, Homo sapiens
gtgtcaggccctctgcc

SEQ ID NO: 2932656 - DNA, 23 bp, Homo sapiens
gtgtcaggccctctgcctgcact

SEQ ID NO: 2932657 - DNA, 19 bp, Homo sapiens
gtgtcagtactaaggtgac

SEQ ID NO: 2932658 - DNA, 17 bp, Homo sapiens
gtgtcatcaatttgtaa

SEQ ID NO: 2932659 - DNA, 17 bp, Homo sapiens
gtgtccagcatggatga

SEQ ID NO: 2932660 - DNA, 19 bp, Homo sapiens
gtgtccattttgtgaagcc

SEQ ID NO: 2932661 - DNA, 20 bp, Homo sapiens
gtgtccattttgtgaagccc

SEQ ID NO: 2932662 - DNA, 22 bp, Homo sapiens
gtgtccattttgtgaagccctg

SEQ ID NO: 2932663 - DNA, 18 bp, Homo sapiens
gtgtccccctctgtccag

SEQ ID NO: 2932664 - DNA, 19 bp, Homo sapiens
gtgtccccgatgctgacct

SEQ ID NO: 2932665 - DNA, 21 bp, Homo sapiens
gtgtccccgctgctgtgcaac

SEQ ID NO: 2932666 - DNA, 21 bp, Homo sapiens
gtgtcccctgacctgtccagg

SEQ ID NO: 2932667 - DNA, 14 bp, Homo sapiens
gtgtccctgccttc

SEQ ID NO: 2932668 - DNA, 13 bp, Homo sapiens
gtgtccctgctgg

SEQ ID NO: 2932669 - DNA, 15 bp, Homo sapiens
gtgtccgatgctgga

SEQ ID NO: 2932670 - DNA, 18 bp, Homo sapiens
gttgataattttttaatt

SEQ ID NO: 2932671 - DNA, 12 bp, Homo sapiens
gttgatagttta

SEQ ID NO: 2932672 - DNA, 17 bp, Homo sapiens
gttgatgtactgattga

SEQ ID NO: 2932673 - DNA, 18 bp, Homo sapiens
gttgattaagttaataag

SEQ ID NO: 2932674 - DNA, 12 bp, Homo sapiens
gttgattgctaa

SEQ ID NO: 2932675 - DNA, 13 bp, Homo sapiens
gttgattgctaaa

SEQ ID NO: 2932676 - DNA, 20 bp, Homo sapiens
gttgattgctaaatgtaaca

SEQ ID NO: 2932677 - DNA, 15 bp, Homo sapiens
gttgattgtgcatgg

SEQ ID NO: 2932678 - DNA, 15 bp, Homo sapiens
gttgcaaggccgctg

SEQ ID NO: 2932679 - DNA, 17 bp, Homo sapiens
gttgcaagtactgctgt

SEQ ID NO: 2932680 - DNA, 20 bp, Homo sapiens
gttgcacacccactcagctc

SEQ ID NO: 2932681 - DNA, 21 bp, Homo sapiens
gttgcaggaaggagccagact

SEQ ID NO: 2932682 - DNA, 22 bp, Homo sapiens
gttgcaggaaggagccagactt

SEQ ID NO: 2932683 - DNA, 13 bp, Homo sapiens
gttgcaggcagtg

SEQ ID NO: 2932684 - DNA, 14 bp, Homo sapiens
gttgcagtctttcc

SEQ ID NO: 2932685 - DNA, 18 bp, Homo sapiens
gttgcagtctttccccca

SEQ ID NO: 2932686 - DNA, 19 bp, Homo sapiens
gttgcagtctttcccccag

SEQ ID NO: 2932687 - DNA, 21 bp, Homo sapiens
gttgcagtctttcccccagga

SEQ ID NO: 2932688 - DNA, 17 bp, Homo sapiens
gttgcagtgagctgaga

SEQ ID NO: 2932689 - DNA, 16 bp, Homo sapiens
gttgcataaacaatcc

SEQ ID NO: 2932690 - DNA, 20 bp, Homo sapiens
gttgcataaacaatccaaat

SEQ ID NO: 2932691 - DNA, 15 bp, Homo sapiens
gttgcatgataaaca

SEQ ID NO: 2932692 - DNA, 16 bp, Homo sapiens
gttgccccgtctctgt

SEQ ID NO: 2932693 - DNA, 17 bp, Homo sapiens
gttgccccgtctctgtt

SEQ ID NO: 2932694 - DNA, 20 bp, Homo sapiens
gttgccctgtttcctgctgc

SEQ ID NO: 2932695 - DNA, 21 bp, Homo sapiens
gttgccctgtttcctgctgct

SEQ ID NO: 2932696 - DNA, 22 bp, Homo sapiens
gttgccgcagcggtgggaagga

SEQ ID NO: 2932697 - DNA, 13 bp, Homo sapiens
gttgccgtgctcc

SEQ ID NO: 2932698 - DNA, 21 bp, Homo sapiens
gttgcctcctctctccctgcc

SEQ ID NO: 2932699 - DNA, 23 bp, Homo sapiens
gttgcctcctctctccctgcctc

SEQ ID NO: 2932700 - DNA, 14 bp, Homo sapiens
gttgcctctctaag

SEQ ID NO: 2932701 - DNA, 18 bp, Homo sapiens
gttgcctcttgcaatgcc

SEQ ID NO: 2932702 - DNA, 18 bp, Homo sapiens
gttgcgtgacactctcct

SEQ ID NO: 2932703 - DNA, 23 bp, Homo sapiens
gttgcgtgacactctccttgcag

SEQ ID NO: 2932704 - DNA, 23 bp, Homo sapiens
gttgcgtggactctgcacatgtc

SEQ ID NO: 2932705 - DNA, 17 bp, Homo sapiens
gttgctaactgaacttt

SEQ ID NO: 2932706 - DNA, 21 bp, Homo sapiens
gttgctaactgaactttgaag

SEQ ID NO: 2932707 - DNA, 21 bp, Homo sapiens
gttgctattgtaaggtctttg

SEQ ID NO: 2932708 - DNA, 20 bp, Homo sapiens
gttgctccggcctgcgtctc

SEQ ID NO: 2932709 - DNA, 12 bp, Homo sapiens
gttgctgctgct

SEQ ID NO: 2932710 - DNA, 14 bp, Homo sapiens
gttgctgctgctgc

SEQ ID NO: 2932711 - DNA, 17 bp, Homo sapiens
gttgctgctgctgctca

SEQ ID NO: 2932712 - DNA, 18 bp, Homo sapiens
gttgctggcttgttgtaa

SEQ ID NO: 2932713 - DNA, 19 bp, Homo sapiens
gttgctggcttgttgtaaa

SEQ ID NO: 2932714 - DNA, 22 bp, Homo sapiens
gttgctggcttgttgtaaagca

SEQ ID NO: 2932715 - DNA, 23 bp, Homo sapiens
gttgctggcttgttgtaaagcaa

SEQ ID NO: 2932716 - DNA, 18 bp, Homo sapiens
gttgctgttttcctccct

SEQ ID NO: 2932717 - DNA, 19 bp, Homo sapiens
gttgctgttttcctccctt

SEQ ID NO: 2932718 - DNA, 15 bp, Homo sapiens
gttgcttacaatttt

SEQ ID NO: 2932719 - DNA, 20 bp, Homo sapiens
gttgcttcttgtgaaggcca

SEQ ID NO: 2932720 - DNA, 15 bp, Homo sapiens
gttgctttcactctc

SEQ ID NO: 2932721 - DNA, 22 bp, Homo sapiens
gttgctttgttacaataaaact

SEQ ID NO: 2932722 - DNA, 22 bp, Homo sapiens
gttggaattccacgcccgggag

SEQ ID NO: 2932723 - DNA, 22 bp, Homo sapiens
gttggaggtgattccagtgaag

SEQ ID NO: 2932724 - DNA, 12 bp, Homo sapiens
gttggatttgtt

SEQ ID NO: 2932725 - DNA, 18 bp, Homo sapiens
gttggcagtgtttgtata

SEQ ID NO: 2932726 - DNA, 18 bp, Homo sapiens
gttggccaggctggtcta

SEQ ID NO: 2932727 - DNA, 21 bp, Homo sapiens
gttggcctcagggccaggaag

SEQ ID NO: 2932728 - DNA, 13 bp, Homo sapiens
gttggcgggggca

SEQ ID NO: 2932729 - DNA, 17 bp, Homo sapiens
gttgggaattttgtttt

SEQ ID NO: 2932730 - DNA, 17 bp, Homo sapiens
gttgggctgtgcctggg

SEQ ID NO: 2932731 - DNA, 17 bp, Homo sapiens
gttgggggacagccttc

SEQ ID NO: 2932732 - DNA, 18 bp, Homo sapiens
gttgggggacagccttca

SEQ ID NO: 2932733 - DNA, 13 bp, Homo sapiens
gttgggggcaggt

SEQ ID NO: 2932734 - DNA, 23 bp, Homo sapiens
gttggtctctgcatttttctgca

SEQ ID NO: 2932735 - DNA, 19 bp, Homo sapiens
gttggtgagaaacctgtat

SEQ ID NO: 2932736 - DNA, 18 bp, Homo sapiens
gttggttatttgtgttat

SEQ ID NO: 2932737 - DNA, 12 bp, Homo sapiens
gttggtttttat

SEQ ID NO: 2932738 - DNA, 22 bp, Homo sapiens
gttgtacccttgttttgaaact

SEQ ID NO: 2932739 - DNA, 13 bp, Homo sapiens
gttgtagaatgta

SEQ ID NO: 2932740 - DNA, 18 bp, Homo sapiens
gttgtatataaagttttt

SEQ ID NO: 2932741 - DNA, 22 bp, Homo sapiens
gttgtattctttgatgttaaca

SEQ ID NO: 2932742 - DNA, 16 bp, Homo sapiens
gttgtcactgcttttg

SEQ ID NO: 2932743 - DNA, 13 bp, Homo sapiens
gttgtccaggctg

SEQ ID NO: 2932744 - DNA, 17 bp, Homo sapiens
gttgtccctacaggagg

SEQ ID NO: 2932745 - DNA, 14 bp, Homo sapiens
gttgtctacattaa

SEQ ID NO: 2932746 - DNA, 16 bp, Homo sapiens
gttgtgaaatttaatg

SEQ ID NO: 2932747 - DNA, 13 bp, Homo sapiens
gttgtgacctgaa

SEQ ID NO: 2932748 - DNA, 17 bp, Homo sapiens
gttgtgacctgaagttc

SEQ ID NO: 2932749 - DNA, 19 bp, Homo sapiens
gttgtgagccctctagggc

SEQ ID NO: 2932750 - DNA, 18 bp, Homo sapiens
gttgtgcagcttttggtc

SEQ ID NO: 2932751 - DNA, 12 bp, Homo sapiens
gttgtgccaaac

SEQ ID NO: 2932752 - DNA, 16 bp, Homo sapiens
gttgtggatttcagtt

SEQ ID NO: 2932753 - DNA, 20 bp, Homo sapiens
gttgtggcccccgccccctc

SEQ ID NO: 2932754 - DNA, 21 bp, Homo sapiens
gttgtggcccccgccccctcc

SEQ ID NO: 2932755 - DNA, 15 bp, Homo sapiens
gttgtgggtgggaga

SEQ ID NO: 2932756 - DNA, 18 bp, Homo sapiens
gttgtgggttctatgttt

SEQ ID NO: 2932757 - DNA, 22 bp, Homo sapiens
gttgttaccaaatacacatttc

SEQ ID NO: 2932758 - DNA, 16 bp, Homo sapiens
gttgttcaactatttt

SEQ ID NO: 2932759 - DNA, 18 bp, Homo sapiens
gttgttgcttcttgtgaa

SEQ ID NO: 2932760 - DNA, 20 bp, Homo sapiens
gttgtttacttaaagattta

SEQ ID NO: 2932761 - DNA, 10 bp, Homo sapiens
gttgtttata

SEQ ID NO: 2932762 - DNA, 17 bp, Homo sapiens
gttgtttatatgaaaac

SEQ ID NO: 2932763 - DNA, 19 bp, Homo sapiens
gttgtttatatgaaaacac

SEQ ID NO: 2932764 - DNA, 12 bp, Homo sapiens
gttgtttcagtg

SEQ ID NO: 2932765 - DNA, 17 bp, Homo sapiens
gttgtttccatagctct

SEQ ID NO: 2932766 - DNA, 13 bp, Homo sapiens
gttgtttgtgcct

SEQ ID NO: 2932767 - DNA, 17 bp, Homo sapiens
gttgtttttaaaaagaa

SEQ ID NO: 2932768 - DNA, 22 bp, Homo sapiens
gttgttttttcatagtgccttt

SEQ ID NO: 2932769 - DNA, 15 bp, Homo sapiens
gtttaaaaaaagaaa

SEQ ID NO: 2932770 - DNA, 14 bp, Homo sapiens
gtttaaaattctct

SEQ ID NO: 2932771 - DNA, 16 bp, Homo sapiens
gtttaaactgattcat

SEQ ID NO: 2932772 - DNA, 21 bp, Homo sapiens
gtttaaactgattcataataa

SEQ ID NO: 2932773 - DNA, 17 bp, Homo sapiens
gtttaaagagtctagat

SEQ ID NO: 2932774 - DNA, 18 bp, Homo sapiens
gtttaactttaaaactgt

SEQ ID NO: 2932775 - DNA, 17 bp, Homo sapiens
gtttaagacaccaaata

SEQ ID NO: 2932776 - DNA, 13 bp, Homo sapiens
gtttaagatgaca

SEQ ID NO: 2932777 - DNA, 14 bp, Homo sapiens
gtttaatagatttg

SEQ ID NO: 2932778 - DNA, 15 bp, Homo sapiens
gtttaatattgagaa

SEQ ID NO: 2932779 - DNA, 21 bp, Homo sapiens
gtttaatgtgaactctcccct

SEQ ID NO: 2932780 - DNA, 16 bp, Homo sapiens
gtttacaacaaacact

SEQ ID NO: 2932781 - DNA, 18 bp, Homo sapiens
gtttacaagccccccctt

SEQ ID NO: 2932782 - DNA, 19 bp, Homo sapiens
gtttacagctctgacttta

SEQ ID NO: 2932783 - DNA, 19 bp, Homo sapiens
gtttaccgtagcgtataca

SEQ ID NO: 2932784 - DNA, 12 bp, Homo sapiens
gtttactgtaaa

SEQ ID NO: 2932785 - DNA, 20 bp, Homo sapiens
gtttacttcccctatggaat

SEQ ID NO: 2932786 - DNA, 14 bp, Homo sapiens
gtttactttcaaaa

SEQ ID NO: 2932787 - DNA, 21 bp, Homo sapiens
gtttagataaaggaaacatat

SEQ ID NO: 2932788 - DNA, 15 bp, Homo sapiens
gtttagatttattag

SEQ ID NO: 2932789 - DNA, 18 bp, Homo sapiens
gtttaggctggtggccca

SEQ ID NO: 2932790 - DNA, 22 bp, Homo sapiens
gtttagtgcatctttgcctctc

SEQ ID NO: 2932791 - DNA, 19 bp, Homo sapiens
gtttataaaatataaacaa

SEQ ID NO: 2932792 - DNA, 18 bp, Homo sapiens
gtttataaagccaagaat

SEQ ID NO: 2932793 - DNA, 18 bp, Homo sapiens
gtttatacagtgtacatg

SEQ ID NO: 2932794 - DNA, 20 bp, Homo sapiens
gtttatacagtgtacatgta

SEQ ID NO: 2932795 - DNA, 22 bp, Homo sapiens
gtttatatacagtacacagata

SEQ ID NO: 2932796 - DNA, 16 bp, Homo sapiens
gtttatatgaaaacac

SEQ ID NO: 2932797 - DNA, 18 bp, Homo sapiens
gtttatatgaaaacactc

SEQ ID NO: 2932798 - DNA, 20 bp, Homo sapiens
gtttatatttttttaactgt

SEQ ID NO: 2932799 - DNA, 21 bp, Homo sapiens
gtttatatttttttaactgtg

SEQ ID NO: 2932800 - DNA, 14 bp, Homo sapiens
gtttatcattcaag

SEQ ID NO: 2932801 - DNA, 16 bp, Homo sapiens
gtttatcattcaagtg

SEQ ID NO: 2932802 - DNA, 19 bp, Homo sapiens
taaaactaaatgtgtacac

SEQ ID NO: 2932803 - DNA, 14 bp, Homo sapiens
taaaactcttttga

SEQ ID NO: 2932804 - DNA, 21 bp, Homo sapiens
taaaactgacctagtggacaa

SEQ ID NO: 2932805 - DNA, 20 bp, Homo sapiens
taaaactgggcctgtagctc

SEQ ID NO: 2932806 - DNA, 19 bp, Homo sapiens
taaaagaaagaaagaaaaa

SEQ ID NO: 2932807 - DNA, 23 bp, Homo sapiens
taaaagaaagttaggttataaga

SEQ ID NO: 2932808 - DNA, 20 bp, Homo sapiens
taaaagaatgggcagttaca

SEQ ID NO: 2932809 - DNA, 21 bp, Homo sapiens
taaaagaatgggcagttacat

SEQ ID NO: 2932810 - DNA, 14 bp, Homo sapiens
taaaagaatttaaa

SEQ ID NO: 2932811 - DNA, 23 bp, Homo sapiens
taaaagacagtgtatgtagaagc

SEQ ID NO: 2932812 - DNA, 12 bp, Homo sapiens
taaaagactttg

SEQ ID NO: 2932813 - DNA, 13 bp, Homo sapiens
taaaagatagcaa

SEQ ID NO: 2932814 - DNA, 20 bp, Homo sapiens
taaaagatagcaatatgaga

SEQ ID NO: 2932815 - DNA, 23 bp, Homo sapiens
taaaagatcttcaaaagtaatgc

SEQ ID NO: 2932816 - DNA, 15 bp, Homo sapiens
taaaagatgctttta

SEQ ID NO: 2932817 - DNA, 12 bp, Homo sapiens
taaaagattcat

SEQ ID NO: 2932818 - DNA, 19 bp, Homo sapiens
taaaagattcatttttaat

SEQ ID NO: 2932819 - DNA, 20 bp, Homo sapiens
taaaagattcatttttaatc

SEQ ID NO: 2932820 - DNA, 14 bp, Homo sapiens
taaaaggaagccaa

SEQ ID NO: 2932821 - DNA, 15 bp, Homo sapiens
taaaaggccaaacct

SEQ ID NO: 2932822 - DNA, 20 bp, Homo sapiens
taaaagggattacccaagca

SEQ ID NO: 2932823 - DNA, 16 bp, Homo sapiens
taaaagggtcaaacct

SEQ ID NO: 2932824 - DNA, 19 bp, Homo sapiens
taaaagggtcaaacctgta

SEQ ID NO: 2932825 - DNA, 20 bp, Homo sapiens
taaaaggtactggtactata

SEQ ID NO: 2932826 - DNA, 17 bp, Homo sapiens
taaaaggtgcaggtgtg

SEQ ID NO: 2932827 - DNA, 15 bp, Homo sapiens
taaaagtcacaatgt

SEQ ID NO: 2932828 - DNA, 23 bp, Homo sapiens
taaaagtcacaatgttctttata

SEQ ID NO: 2932829 - DNA, 22 bp, Homo sapiens
taaaagtgggcttgattctgca

SEQ ID NO: 2932830 - DNA, 15 bp, Homo sapiens
taaaagtgtatttta

SEQ ID NO: 2932831 - DNA, 21 bp, Homo sapiens
taaaagttcctctcccttccc

SEQ ID NO: 2932832 - DNA, 15 bp, Homo sapiens
taaaagttctcaatg

SEQ ID NO: 2932833 - DNA, 20 bp, Homo sapiens
taaaagtttgtcctttaact

SEQ ID NO: 2932834 - DNA, 17 bp, Homo sapiens
taaaataaacctgttta

SEQ ID NO: 2932835 - DNA, 15 bp, Homo sapiens
taaaataaattccta

SEQ ID NO: 2932836 - DNA, 18 bp, Homo sapiens
taaaataactatcaggca

SEQ ID NO: 2932837 - DNA, 14 bp, Homo sapiens
taaaataagttaaa

SEQ ID NO: 2932838 - DNA, 14 bp, Homo sapiens
taaaatactttttg

SEQ ID NO: 2932839 - DNA, 19 bp, Homo sapiens
taaaataggggagcctgtg

SEQ ID NO: 2932840 - DNA, 20 bp, Homo sapiens
taaaatattttgaatcaata

SEQ ID NO: 2932841 - DNA, 20 bp, Homo sapiens
taaaatcctgcttaaaactt

SEQ ID NO: 2932842 - DNA, 14 bp, Homo sapiens
taaaatctaattag

SEQ ID NO: 2932843 - DNA, 18 bp, Homo sapiens
taaaatctcttgattata

SEQ ID NO: 2932844 - DNA, 19 bp, Homo sapiens
taaaatctcttgattataa

SEQ ID NO: 2932845 - DNA, 15 bp, Homo sapiens
taaaatcttcagctg

SEQ ID NO: 2932846 - DNA, 14 bp, Homo sapiens
taaaatcttgcatg

SEQ ID NO: 2932847 - DNA, 18 bp, Homo sapiens
taaaatgagctacttctt

SEQ ID NO: 2932848 - DNA, 20 bp, Homo sapiens
taaaatgagctacttcttat

SEQ ID NO: 2932849 - DNA, 13 bp, Homo sapiens
taaaatgaggcag

SEQ ID NO: 2932850 - DNA, 21 bp, Homo sapiens
taaaatgcagtaacattctac

SEQ ID NO: 2932851 - DNA, 20 bp, Homo sapiens
taaaatgcccatttcgaaga

SEQ ID NO: 2932852 - DNA, 17 bp, Homo sapiens
taaaatggcgaacatgt

SEQ ID NO: 2932853 - DNA, 15 bp, Homo sapiens
taaaatgtaaagcca

SEQ ID NO: 2932854 - DNA, 18 bp, Homo sapiens
taaaatgtaaagccatgc

SEQ ID NO: 2932855 - DNA, 19 bp, Homo sapiens
taaaatgtgatgttctaag

SEQ ID NO: 2932856 - DNA, 22 bp, Homo sapiens
taaaatgtgatgttctaaggct

SEQ ID NO: 2932857 - DNA, 13 bp, Homo sapiens
taaaatgtgcagt

SEQ ID NO: 2932858 - DNA, 15 bp, Homo sapiens
taaaatgttcctttt

SEQ ID NO: 2932859 - DNA, 19 bp, Homo sapiens
taaaatgttccttttgaca

SEQ ID NO: 2932860 - DNA, 16 bp, Homo sapiens
taaaatgtttactgta

SEQ ID NO: 2932861 - DNA, 17 bp, Homo sapiens
taaaatgtttactgtaa

SEQ ID NO: 2932862 - DNA, 19 bp, Homo sapiens
taaaatgtttactgtaaat

SEQ ID NO: 2932863 - DNA, 15 bp, Homo sapiens
taaaattaagtagaa

SEQ ID NO: 2932864 - DNA, 14 bp, Homo sapiens
taaaattacaaaag

SEQ ID NO: 2932865 - DNA, 11 bp, Homo sapiens
taaaattagat

SEQ ID NO: 2932866 - DNA, 14 bp, Homo sapiens
taaaattagtgctg

SEQ ID NO: 2932867 - DNA, 12 bp, Homo sapiens
taaaattatata

SEQ ID NO: 2932868 - DNA, 14 bp, Homo sapiens
taaaattcatttct

SEQ ID NO: 2932869 - DNA, 23 bp, Homo sapiens
taaaattgctaacgttttttctt

SEQ ID NO: 2932870 - DNA, 17 bp, Homo sapiens
taaaatttattctactt

SEQ ID NO: 2932871 - DNA, 22 bp, Homo sapiens
taaaatttattctacttttaaa

SEQ ID NO: 2932872 - DNA, 17 bp, Homo sapiens
taaaatttgtagaattg

SEQ ID NO: 2932873 - DNA, 21 bp, Homo sapiens
taaaatttgtagaattgaaaa

SEQ ID NO: 2932874 - DNA, 19 bp, Homo sapiens
taaaattttttttcatgtt

SEQ ID NO: 2932875 - DNA, 16 bp, Homo sapiens
taaacaaagattcatg

SEQ ID NO: 2932876 - DNA, 14 bp, Homo sapiens
taaacactgcgctt

SEQ ID NO: 2932877 - DNA, 14 bp, Homo sapiens
taaacagaaatgct

SEQ ID NO: 2932878 - DNA, 19 bp, Homo sapiens
taaacagactgttttctaa

SEQ ID NO: 2932879 - DNA, 18 bp, Homo sapiens
taaacagatgtccctgaa

SEQ ID NO: 2932880 - DNA, 15 bp, Homo sapiens
taaacagctttttta

SEQ ID NO: 2932881 - DNA, 13 bp, Homo sapiens
taaacagtgcctg

SEQ ID NO: 2932882 - DNA, 18 bp, Homo sapiens
taaacagtgcctgctgaa

SEQ ID NO: 2932883 - DNA, 15 bp, Homo sapiens
taaacagtgtttatg

SEQ ID NO: 2932884 - DNA, 16 bp, Homo sapiens
taaacagtgtttatga

SEQ ID NO: 2932885 - DNA, 13 bp, Homo sapiens
taaaccaagacaa

SEQ ID NO: 2932886 - DNA, 12 bp, Homo sapiens
taaaccattgga

SEQ ID NO: 2932887 - DNA, 17 bp, Homo sapiens
taaacccagatggtttc

SEQ ID NO: 2932888 - DNA, 14 bp, Homo sapiens
taaacccattttag

SEQ ID NO: 2932889 - DNA, 23 bp, Homo sapiens
taaacccattttagtcacttttt

SEQ ID NO: 2932890 - DNA, 16 bp, Homo sapiens
taaacctgtgcctccc

SEQ ID NO: 2932891 - DNA, 13 bp, Homo sapiens
taaaccttatgaa

SEQ ID NO: 2932892 - DNA, 16 bp, Homo sapiens
taaaccttgtttcttt

SEQ ID NO: 2932893 - DNA, 23 bp, Homo sapiens
taaacctttccattttacgtttt

SEQ ID NO: 2932894 - DNA, 14 bp, Homo sapiens
taaacctttttctt

SEQ ID NO: 2932895 - DNA, 20 bp, Homo sapiens
taaacctttttcttgatctt

SEQ ID NO: 2932896 - DNA, 14 bp, Homo sapiens
taaacgattagtga

SEQ ID NO: 2932897 - DNA, 18 bp, Homo sapiens
taaacgatttaattctct

SEQ ID NO: 2932898 - DNA, 15 bp, Homo sapiens
taaacggattccaaa

SEQ ID NO: 2932899 - DNA, 16 bp, Homo sapiens
taaacggttcagtttc

SEQ ID NO: 2932900 - DNA, 21 bp, Homo sapiens
taaacggttcagtttcttctg

SEQ ID NO: 2932901 - DNA, 17 bp, Homo sapiens
taaacgtaagcactgtt

SEQ ID NO: 2932902 - DNA, 15 bp, Homo sapiens
taaactaaagttgta

SEQ ID NO: 2932903 - DNA, 12 bp, Homo sapiens
taaactaacctt

SEQ ID NO: 2932904 - DNA, 18 bp, Homo sapiens
taaactactatttttctt

SEQ ID NO: 2932905 - DNA, 16 bp, Homo sapiens
taaactagatgacctc

SEQ ID NO: 2932906 - DNA, 21 bp, Homo sapiens
taaactccctggctgttctga

SEQ ID NO: 2932907 - DNA, 23 bp, Homo sapiens
taaactcctactgcttcctctga

SEQ ID NO: 2932908 - DNA, 15 bp, Homo sapiens
taaactctcctttga

SEQ ID NO: 2932909 - DNA, 15 bp, Homo sapiens
taaactctgttgcaa

SEQ ID NO: 2932910 - DNA, 12 bp, Homo sapiens
taaactcttcac

SEQ ID NO: 2932911 - DNA, 16 bp, Homo sapiens
taaactgaagctgctg

SEQ ID NO: 2932912 - DNA, 22 bp, Homo sapiens
taaactgattagtattcaggca

SEQ ID NO: 2932913 - DNA, 16 bp, Homo sapiens
taaactggtatgaata

SEQ ID NO: 2932914 - DNA, 16 bp, Homo sapiens
taaacttatgaatgtt

SEQ ID NO: 2932915 - DNA, 18 bp, Homo sapiens
taaacttatgaatgtttc

SEQ ID NO: 2932916 - DNA, 18 bp, Homo sapiens
taaacttccccatcttct

SEQ ID NO: 2932917 - DNA, 21 bp, Homo sapiens
taaacttgtaggacttttaaa

SEQ ID NO: 2932918 - DNA, 16 bp, Homo sapiens
taaactttcaatatct

SEQ ID NO: 2932919 - DNA, 21 bp, Homo sapiens
taaactttcaatatctttatt

SEQ ID NO: 2932920 - DNA, 18 bp, Homo sapiens
taaactttgtgctgatct

SEQ ID NO: 2932921 - DNA, 13 bp, Homo sapiens
taaagaaaatgtg

SEQ ID NO: 2932922 - DNA, 16 bp, Homo sapiens
taaagaaaatgtgtct

SEQ ID NO: 2932923 - DNA, 17 bp, Homo sapiens
taaagaaaatgtgtctg

SEQ ID NO: 2932924 - DNA, 13 bp, Homo sapiens
taaagaaagagag

SEQ ID NO: 2932925 - DNA, 14 bp, Homo sapiens
taaagaagatctgt

SEQ ID NO: 2932926 - DNA, 16 bp, Homo sapiens
taaagaagtgcatgaa

SEQ ID NO: 2932927 - DNA, 17 bp, Homo sapiens
taaagaagtgcatgaaa

SEQ ID NO: 2932928 - DNA, 15 bp, Homo sapiens
taaagaatacttgaa

SEQ ID NO: 2932929 - DNA, 18 bp, Homo sapiens
taaagaatacttgaactt

SEQ ID NO: 2932930 - DNA, 15 bp, Homo sapiens
taaagaatttaagct

SEQ ID NO: 2932931 - DNA, 20 bp, Homo sapiens
taaagacaaagacaaattct

SEQ ID NO: 2932932 - DNA, 20 bp, Homo sapiens
taaagactggcttttattaa

SEQ ID NO: 2932933 - DNA, 15 bp, Homo sapiens
taaagagtctagatt

SEQ ID NO: 2932934 - DNA, 15 bp, Homo sapiens
taaagagttattcaa

SEQ ID NO: 2932935 - DNA, 23 bp, Homo sapiens
taacttttaatccctatgtttgt

SEQ ID NO: 2932936 - DNA, 12 bp, Homo sapiens
taactttttcca

SEQ ID NO: 2932937 - DNA, 15 bp, Homo sapiens
taagaaagtgaagca

SEQ ID NO: 2932938 - DNA, 13 bp, Homo sapiens
taagaacagctca

SEQ ID NO: 2932939 - DNA, 22 bp, Homo sapiens
taagaaccttattttgataaaa

SEQ ID NO: 2932940 - DNA, 16 bp, Homo sapiens
taagaactaaagaaga

SEQ ID NO: 2932941 - DNA, 20 bp, Homo sapiens
taagaagaatgagaaggcca

SEQ ID NO: 2932942 - DNA, 22 bp, Homo sapiens
taagaagaggagcctcagaaga

SEQ ID NO: 2932943 - DNA, 18 bp, Homo sapiens
taagaaggcaaaaatgta

SEQ ID NO: 2932944 - DNA, 18 bp, Homo sapiens
taagaagtggtgttccat

SEQ ID NO: 2932945 - DNA, 15 bp, Homo sapiens
taagaataatttata

SEQ ID NO: 2932946 - DNA, 14 bp, Homo sapiens
taagaatatttgaa

SEQ ID NO: 2932947 - DNA, 17 bp, Homo sapiens
taagaatggaaaagaga

SEQ ID NO: 2932948 - DNA, 13 bp, Homo sapiens
taagaattgttta

SEQ ID NO: 2932949 - DNA, 15 bp, Homo sapiens
taagaatttcactgt

SEQ ID NO: 2932950 - DNA, 17 bp, Homo sapiens
taagaatttcactgtct

SEQ ID NO: 2932951 - DNA, 18 bp, Homo sapiens
taagacagtgccctgaga

SEQ ID NO: 2932952 - DNA, 19 bp, Homo sapiens
taagacatagtctctacct

SEQ ID NO: 2932953 - DNA, 14 bp, Homo sapiens
taagacctactgtt

SEQ ID NO: 2932954 - DNA, 19 bp, Homo sapiens
taagacctactgttctaaa

SEQ ID NO: 2932955 - DNA, 22 bp, Homo sapiens
taagacctactgttctaaagct

SEQ ID NO: 2932956 - DNA, 11 bp, Homo sapiens
taagacctggc

SEQ ID NO: 2932957 - DNA, 18 bp, Homo sapiens
taagacctggcagctctg

SEQ ID NO: 2932958 - DNA, 20 bp, Homo sapiens
taagactaatgctttctgtg

SEQ ID NO: 2932959 - DNA, 19 bp, Homo sapiens
taagactcaaatgttctaa

SEQ ID NO: 2932960 - DNA, 21 bp, Homo sapiens
taagactcaaatgttctaagt

SEQ ID NO: 2932961 - DNA, 22 bp, Homo sapiens
taagactcccgccccgggctgg

SEQ ID NO: 2932962 - DNA, 15 bp, Homo sapiens
taagactgtgtattc

SEQ ID NO: 2932963 - DNA, 15 bp, Homo sapiens
taagacttgtgcatg

SEQ ID NO: 2932964 - DNA, 20 bp, Homo sapiens
taagagaacaaagagtgaaa

SEQ ID NO: 2932965 - DNA, 22 bp, Homo sapiens
taagagaacaaagagtgaaata

SEQ ID NO: 2932966 - DNA, 14 bp, Homo sapiens
taagagactcagcc

SEQ ID NO: 2932967 - DNA, 13 bp, Homo sapiens
taagagattctga

SEQ ID NO: 2932968 - DNA, 18 bp, Homo sapiens
taagaggctttggcccaa

SEQ ID NO: 2932969 - DNA, 18 bp, Homo sapiens
taagagggcatatacagt

SEQ ID NO: 2932970 - DNA, 21 bp, Homo sapiens
taagagtacaagctcttgttt

SEQ ID NO: 2932971 - DNA, 22 bp, Homo sapiens
taagagtatgtgccaggaaact

SEQ ID NO: 2932972 - DNA, 19 bp, Homo sapiens
taagagtctccttctcttc

SEQ ID NO: 2932973 - DNA, 20 bp, Homo sapiens
taagagtctccttctcttct

SEQ ID NO: 2932974 - DNA, 14 bp, Homo sapiens
taagatagacttat

SEQ ID NO: 2932975 - DNA, 20 bp, Homo sapiens
taagatatcccagctttaaa

SEQ ID NO: 2932976 - DNA, 23 bp, Homo sapiens
taagatcctagatcctaagggtc

SEQ ID NO: 2932977 - DNA, 13 bp, Homo sapiens
taagatctcagtg

SEQ ID NO: 2932978 - DNA, 16 bp, Homo sapiens
taagatcttagattct

SEQ ID NO: 2932979 - DNA, 19 bp, Homo sapiens
taagatgtctgtttgctga

SEQ ID NO: 2932980 - DNA, 19 bp, Homo sapiens
taagatgtgatattctaag

SEQ ID NO: 2932981 - DNA, 20 bp, Homo sapiens
taagatgtgatattctaaga

SEQ ID NO: 2932982 - DNA, 21 bp, Homo sapiens
taagatgtgatattctaagac

SEQ ID NO: 2932983 - DNA, 22 bp, Homo sapiens
taagatgtgatattctaagact

SEQ ID NO: 2932984 - DNA, 23 bp, Homo sapiens
taagatgtgatattctaagactt

SEQ ID NO: 2932985 - DNA, 16 bp, Homo sapiens
taagattatagattct

SEQ ID NO: 2932986 - DNA, 17 bp, Homo sapiens
taagattatagattcta

SEQ ID NO: 2932987 - DNA, 23 bp, Homo sapiens
taagattatagattctaaagatt

SEQ ID NO: 2932988 - DNA, 10 bp, Homo sapiens
taagattcta

SEQ ID NO: 2932989 - DNA, 12 bp, Homo sapiens
taagattctaaa

SEQ ID NO: 2932990 - DNA, 14 bp, Homo sapiens
taagattctaaagg

SEQ ID NO: 2932991 - DNA, 15 bp, Homo sapiens
taagattctaatgat

SEQ ID NO: 2932992 - DNA, 14 bp, Homo sapiens
taagattctagatc

SEQ ID NO: 2932993 - DNA, 21 bp, Homo sapiens
taagattctagatcagatgct

SEQ ID NO: 2932994 - DNA, 18 bp, Homo sapiens
taagattgaaattccagt

SEQ ID NO: 2932995 - DNA, 17 bp, Homo sapiens
taagattttatctgggg

SEQ ID NO: 2932996 - DNA, 15 bp, Homo sapiens
taagcaaatgcattc

SEQ ID NO: 2932997 - DNA, 17 bp, Homo sapiens
taagcaacttgcttcta

SEQ ID NO: 2932998 - DNA, 17 bp, Homo sapiens
taagcagaccactgata

SEQ ID NO: 2932999 - DNA, 20 bp, Homo sapiens
taagcagaccactgataaaa

SEQ ID NO: 2933000 - DNA, 13 bp, Homo sapiens
taagcagccagga

SEQ ID NO: 2933001 - DNA, 16 bp, Homo sapiens
taagcagctaaatttt

SEQ ID NO: 2933002 - DNA, 18 bp, Homo sapiens
taagcagctctaaaacat

SEQ ID NO: 2933003 - DNA, 14 bp, Homo sapiens
taagcagttttgta

SEQ ID NO: 2933004 - DNA, 18 bp, Homo sapiens
taagcataagaccaatct

SEQ ID NO: 2933005 - DNA, 14 bp, Homo sapiens
taagcatctaagtt

SEQ ID NO: 2933006 - DNA, 15 bp, Homo sapiens
taagcatctacttca

SEQ ID NO: 2933007 - DNA, 15 bp, Homo sapiens
taagcattgtgagta

SEQ ID NO: 2933008 - DNA, 15 bp, Homo sapiens
taagccaagctgtgt

SEQ ID NO: 2933009 - DNA, 20 bp, Homo sapiens
taagccaagctgtgttcatc

SEQ ID NO: 2933010 - DNA, 15 bp, Homo sapiens
taagccctggccccc

SEQ ID NO: 2933011 - DNA, 16 bp, Homo sapiens
taagcctaaaagtggg

SEQ ID NO: 2933012 - DNA, 13 bp, Homo sapiens
taagcctgtggct

SEQ ID NO: 2933013 - DNA, 23 bp, Homo sapiens
taagcggaataaactagagaagg

SEQ ID NO: 2933014 - DNA, 17 bp, Homo sapiens
taagctagaagaagtga

SEQ ID NO: 2933015 - DNA, 22 bp, Homo sapiens
taagctggctgtacctgttcct

SEQ ID NO: 2933016 - DNA, 15 bp, Homo sapiens
taagcttatgcttaa

SEQ ID NO: 2933017 - DNA, 18 bp, Homo sapiens
taaggaaaactacctgta

SEQ ID NO: 2933018 - DNA, 22 bp, Homo sapiens
taaggaaaactacctgtattta

SEQ ID NO: 2933019 - DNA, 16 bp, Homo sapiens
taaggaaagcaataaa

SEQ ID NO: 2933020 - DNA, 18 bp, Homo sapiens
taaggaaagcaataaatg

SEQ ID NO: 2933021 - DNA, 13 bp, Homo sapiens
taaggaactggaa

SEQ ID NO: 2933022 - DNA, 20 bp, Homo sapiens
taaggaactggaacacacat

SEQ ID NO: 2933023 - DNA, 15 bp, Homo sapiens
taaggaattgaagat

SEQ ID NO: 2933024 - DNA, 20 bp, Homo sapiens
taaggacaaagtgccaaaga

SEQ ID NO: 2933025 - DNA, 19 bp, Homo sapiens
taaggacatgatgctttta

SEQ ID NO: 2933026 - DNA, 22 bp, Homo sapiens
taaggacctgaaattccaaagt

SEQ ID NO: 2933027 - DNA, 14 bp, Homo sapiens
taaggagactggta

SEQ ID NO: 2933028 - DNA, 20 bp, Homo sapiens
taaggagcatgattttaaga

SEQ ID NO: 2933029 - DNA, 19 bp, Homo sapiens
taaggagtaatctgtgtac

SEQ ID NO: 2933030 - DNA, 20 bp, Homo sapiens
taaggagtaatctgtgtaca

SEQ ID NO: 2933031 - DNA, 17 bp, Homo sapiens
taaggagttaaatcttc

SEQ ID NO: 2933032 - DNA, 17 bp, Homo sapiens
taaggataatgaaataa

SEQ ID NO: 2933033 - DNA, 22 bp, Homo sapiens
taaggatgtagcttttcacctt

SEQ ID NO: 2933034 - DNA, 18 bp, Homo sapiens
taaggcatgtgtgaaaca

SEQ ID NO: 2933035 - DNA, 12 bp, Homo sapiens
taaggcatgtta

SEQ ID NO: 2933036 - DNA, 15 bp, Homo sapiens
taaggccactgtttt

SEQ ID NO: 2933037 - DNA, 23 bp, Homo sapiens
taaggccccctctcaggagccat

SEQ ID NO: 2933038 - DNA, 14 bp, Homo sapiens
taaggccttggtgc

SEQ ID NO: 2933039 - DNA, 12 bp, Homo sapiens
taaggctctaga

SEQ ID NO: 2933040 - DNA, 19 bp, Homo sapiens
taaggctctatgagtctag

SEQ ID NO: 2933041 - DNA, 14 bp, Homo sapiens
taaggctctgagag

SEQ ID NO: 2933042 - DNA, 15 bp, Homo sapiens
taaggctctgagagt

SEQ ID NO: 2933043 - DNA, 14 bp, Homo sapiens
taagggaatatgca

SEQ ID NO: 2933044 - DNA, 12 bp, Homo sapiens
taagggagagct

SEQ ID NO: 2933045 - DNA, 16 bp, Homo sapiens
taagggaggaggagct

SEQ ID NO: 2933046 - DNA, 22 bp, Homo sapiens
taagggaggcacttcctcccct

SEQ ID NO: 2933047 - DNA, 17 bp, Homo sapiens
taagggattagtatttt

SEQ ID NO: 2933048 - DNA, 12 bp, Homo sapiens
taagggccgggg

SEQ ID NO: 2933049 - DNA, 17 bp, Homo sapiens
taagggtcgaaagctct

SEQ ID NO: 2933050 - DNA, 22 bp, Homo sapiens
taagggtttcccccaacatata

SEQ ID NO: 2933051 - DNA, 23 bp, Homo sapiens
taaggtaacatttatagaagaaa

SEQ ID NO: 2933052 - DNA, 24 bp, Homo sapiens
taaggtagccctctcatcgtcttt

SEQ ID NO: 2933053 - DNA, 20 bp, Homo sapiens
taaggtccggtgttctaaga

SEQ ID NO: 2933054 - DNA, 16 bp, Homo sapiens
taaggtcctgaaagta

SEQ ID NO: 2933055 - DNA, 18 bp, Homo sapiens
taaggtctttcagtactt

SEQ ID NO: 2933056 - DNA, 23 bp, Homo sapiens
taaggtctttgtaaaatcttgca

SEQ ID NO: 2933057 - DNA, 16 bp, Homo sapiens
taaggtgactttctga

SEQ ID NO: 2933058 - DNA, 18 bp, Homo sapiens
taaggtgactttctgaaa

SEQ ID NO: 2933059 - DNA, 22 bp, Homo sapiens
taaggtgaggcctgtctgtgac

SEQ ID NO: 2933060 - DNA, 19 bp, Homo sapiens
taaggtgtagccacaccag

SEQ ID NO: 2933061 - DNA, 21 bp, Homo sapiens
taaggtgtagccacaccagga

SEQ ID NO: 2933062 - DNA, 16 bp, Homo sapiens
taaggtgttttctgtg

SEQ ID NO: 2933063 - DNA, 19 bp, Homo sapiens
taaggtgttttctgtgtaa

SEQ ID NO: 2933064 - DNA, 23 bp, Homo sapiens
taaggttgaaaagacaatagccc

SEQ ID NO: 2933065 - DNA, 19 bp, Homo sapiens
taaggtttcgtttctgtat

SEQ ID NO: 2933066 - DNA, 15 bp, Homo sapiens
taagtaagtgtctgt

SEQ ID NO: 2933067 - DNA, 20 bp, Homo sapiens
tacatatgtagaaacattta

SEQ ID NO: 2933068 - DNA, 21 bp, Homo sapiens
tacatatgttaataaactgca

SEQ ID NO: 2933069 - DNA, 13 bp, Homo sapiens
tacatcacttcct

SEQ ID NO: 2933070 - DNA, 22 bp, Homo sapiens
tacatcagccttcaagaatcag

SEQ ID NO: 2933071 - DNA, 18 bp, Homo sapiens
tacatcccatgtaacaga

SEQ ID NO: 2933072 - DNA, 19 bp, Homo sapiens
tacatcccatgtaacagaa

SEQ ID NO: 2933073 - DNA, 18 bp, Homo sapiens
tacatctattttggattg

SEQ ID NO: 2933074 - DNA, 23 bp, Homo sapiens
tacatctattttggattgtatat

SEQ ID NO: 2933075 - DNA, 13 bp, Homo sapiens
tacatctgtgcag

SEQ ID NO: 2933076 - DNA, 22 bp, Homo sapiens
tacatctgtgcagggctggttt

SEQ ID NO: 2933077 - DNA, 16 bp, Homo sapiens
tacatgacatttattt

SEQ ID NO: 2933078 - DNA, 17 bp, Homo sapiens
tacatgagaacaaacag

SEQ ID NO: 2933079 - DNA, 12 bp, Homo sapiens
tacatgcataaa

SEQ ID NO: 2933080 - DNA, 19 bp, Homo sapiens
tacatgctgcgcatgtttt

SEQ ID NO: 2933081 - DNA, 17 bp, Homo sapiens
tacatggacagaatttt

SEQ ID NO: 2933082 - DNA, 22 bp, Homo sapiens
tacatgtattatttcattatgt

SEQ ID NO: 2933083 - DNA, 19 bp, Homo sapiens
tacatgtgtagcctgtgca

SEQ ID NO: 2933084 - DNA, 17 bp, Homo sapiens
tacatgtttataaatct

SEQ ID NO: 2933085 - DNA, 15 bp, Homo sapiens
tacattaaaaagcct

SEQ ID NO: 2933086 - DNA, 17 bp, Homo sapiens
tacattaaaaagcctta

SEQ ID NO: 2933087 - DNA, 22 bp, Homo sapiens
tacattaaaaagccttacagtt

SEQ ID NO: 2933088 - DNA, 18 bp, Homo sapiens
tacattaaaataaaccaa

SEQ ID NO: 2933089 - DNA, 13 bp, Homo sapiens
tacattaaatcac

SEQ ID NO: 2933090 - DNA, 19 bp, Homo sapiens
tacattaatgcccagccag

SEQ ID NO: 2933091 - DNA, 22 bp, Homo sapiens
tacattaattattattgctgtt

SEQ ID NO: 2933092 - DNA, 23 bp, Homo sapiens
tacattaattattattgctgttg

SEQ ID NO: 2933093 - DNA, 18 bp, Homo sapiens
tacattagttaagatgtc

SEQ ID NO: 2933094 - DNA, 13 bp, Homo sapiens
tacattcatttag

SEQ ID NO: 2933095 - DNA, 16 bp, Homo sapiens
tacattgaaaacagat

SEQ ID NO: 2933096 - DNA, 18 bp, Homo sapiens
tacattgaaaacagatat

SEQ ID NO: 2933097 - DNA, 19 bp, Homo sapiens
tacattgaaaacagatatt

SEQ ID NO: 2933098 - DNA, 14 bp, Homo sapiens
tacatttaaatcct

SEQ ID NO: 2933099 - DNA, 19 bp, Homo sapiens
tacatttgtattttgtgat

SEQ ID NO: 2933100 - DNA, 13 bp, Homo sapiens
taccaaaaattag

SEQ ID NO: 2933101 - DNA, 15 bp, Homo sapiens
taccaaacagcaaac

SEQ ID NO: 2933102 - DNA, 22 bp, Homo sapiens
taccaaagtgtcttttgacatt

SEQ ID NO: 2933103 - DNA, 18 bp, Homo sapiens
taccaaatacacatttca

SEQ ID NO: 2933104 - DNA, 13 bp, Homo sapiens
taccaacatgtat

SEQ ID NO: 2933105 - DNA, 14 bp, Homo sapiens
taccaagagaaggg

SEQ ID NO: 2933106 - DNA, 20 bp, Homo sapiens
taccaagccaccgcagctgc

SEQ ID NO: 2933107 - DNA, 21 bp, Homo sapiens
taccaagccaccgcagctgct

SEQ ID NO: 2933108 - DNA, 22 bp, Homo sapiens
taccaagccaccgcagctgctg

SEQ ID NO: 2933109 - DNA, 23 bp, Homo sapiens
taccaagccaccgcagctgctgc

SEQ ID NO: 2933110 - DNA, 20 bp, Homo sapiens
taccaagtatagcctatggc

SEQ ID NO: 2933111 - DNA, 18 bp, Homo sapiens
taccaatacaaaatgtat

SEQ ID NO: 2933112 - DNA, 21 bp, Homo sapiens
taccaatattattaaaatctt

SEQ ID NO: 2933113 - DNA, 15 bp, Homo sapiens
taccaatgaaaaaat

SEQ ID NO: 2933114 - DNA, 19 bp, Homo sapiens
taccacaccctgcctgctg

SEQ ID NO: 2933115 - DNA, 19 bp, Homo sapiens
taccagagaaaaagggagg

SEQ ID NO: 2933116 - DNA, 11 bp, Homo sapiens
taccagccact

SEQ ID NO: 2933117 - DNA, 14 bp, Homo sapiens
taccagccactgga

SEQ ID NO: 2933118 - DNA, 13 bp, Homo sapiens
taccagcgaggag

SEQ ID NO: 2933119 - DNA, 21 bp, Homo sapiens
taccagcgtatatataagaaa

SEQ ID NO: 2933120 - DNA, 22 bp, Homo sapiens
taccagcgtatatataagaaag

SEQ ID NO: 2933121 - DNA, 16 bp, Homo sapiens
taccaggaactataaa

SEQ ID NO: 2933122 - DNA, 12 bp, Homo sapiens
taccaggataaa

SEQ ID NO: 2933123 - DNA, 15 bp, Homo sapiens
taccaggcacatggc

SEQ ID NO: 2933124 - DNA, 16 bp, Homo sapiens
taccaggcacatggct

SEQ ID NO: 2933125 - DNA, 19 bp, Homo sapiens
taccagtgaatttttgcaa

SEQ ID NO: 2933126 - DNA, 15 bp, Homo sapiens
taccagtgagtggcc

SEQ ID NO: 2933127 - DNA, 17 bp, Homo sapiens
taccagtgagtggcccc

SEQ ID NO: 2933128 - DNA, 18 bp, Homo sapiens
taccagtgagtggcccca

SEQ ID NO: 2933129 - DNA, 20 bp, Homo sapiens
taccagtgcaggctggccag

SEQ ID NO: 2933130 - DNA, 22 bp, Homo sapiens
taccagtgcaggctggccagcc

SEQ ID NO: 2933131 - DNA, 14 bp, Homo sapiens
taccatatgaatga

SEQ ID NO: 2933132 - DNA, 17 bp, Homo sapiens
taccatcactgagtttt

SEQ ID NO: 2933133 - DNA, 21 bp, Homo sapiens
taccatcccggtgcatgcagg

SEQ ID NO: 2933134 - DNA, 19 bp, Homo sapiens
taccatctactcttttgaa

SEQ ID NO: 2933135 - DNA, 23 bp, Homo sapiens
taccatgtgaaactctaccctga

SEQ ID NO: 2933136 - DNA, 16 bp, Homo sapiens
taccattgctgttcta

SEQ ID NO: 2933137 - DNA, 15 bp, Homo sapiens
taccatttgcctccc

SEQ ID NO: 2933138 - DNA, 21 bp, Homo sapiens
tacccagagatatctatgaaa

SEQ ID NO: 2933139 - DNA, 16 bp, Homo sapiens
tacccagctaaataat

SEQ ID NO: 2933140 - DNA, 20 bp, Homo sapiens
tacccagggtggagtgcagt

SEQ ID NO: 2933141 - DNA, 19 bp, Homo sapiens
tacccagtattactgctgc

SEQ ID NO: 2933142 - DNA, 22 bp, Homo sapiens
tacccagtgccgaggacatgca

SEQ ID NO: 2933143 - DNA, 17 bp, Homo sapiens
tacccatccccgcagtg

SEQ ID NO: 2933144 - DNA, 14 bp, Homo sapiens
tacccatcttgctt

SEQ ID NO: 2933145 - DNA, 22 bp, Homo sapiens
tacccatcttgcttccaagacc

SEQ ID NO: 2933146 - DNA, 18 bp, Homo sapiens
taccccctcatcccccag

SEQ ID NO: 2933147 - DNA, 13 bp, Homo sapiens
taccccctccttc

SEQ ID NO: 2933148 - DNA, 13 bp, Homo sapiens
tacccctgccctg

SEQ ID NO: 2933149 - DNA, 18 bp, Homo sapiens
tacccctttctggctctc

SEQ ID NO: 2933150 - DNA, 17 bp, Homo sapiens
tacccctttctgttcga

SEQ ID NO: 2933151 - DNA, 20 bp, Homo sapiens
taccctgaagaaagggatgg

SEQ ID NO: 2933152 - DNA, 13 bp, Homo sapiens
tacccttcctcat

SEQ ID NO: 2933153 - DNA, 15 bp, Homo sapiens
tacccttcctcatct

SEQ ID NO: 2933154 - DNA, 21 bp, Homo sapiens
tacccttgacttaacttttta

SEQ ID NO: 2933155 - DNA, 16 bp, Homo sapiens
tacccttgttttgaaa

SEQ ID NO: 2933156 - DNA, 15 bp, Homo sapiens
taccgatggtcccag

SEQ ID NO: 2933157 - DNA, 19 bp, Homo sapiens
taccgcatggcagctgggc

SEQ ID NO: 2933158 - DNA, 14 bp, Homo sapiens
taccgccctgcggg

SEQ ID NO: 2933159 - DNA, 19 bp, Homo sapiens
taccggacacacctctgct

SEQ ID NO: 2933160 - DNA, 12 bp, Homo sapiens
tacctaagaatt

SEQ ID NO: 2933161 - DNA, 21 bp, Homo sapiens
tacctaagaatttcactgtct

SEQ ID NO: 2933162 - DNA, 15 bp, Homo sapiens
tacctacaaaatgag

SEQ ID NO: 2933163 - DNA, 19 bp, Homo sapiens
tacctacaataaactggta

SEQ ID NO: 2933164 - DNA, 14 bp, Homo sapiens
tacctccccttttc

SEQ ID NO: 2933165 - DNA, 19 bp, Homo sapiens
tacctcctcccccctcctc

SEQ ID NO: 2933166 - DNA, 13 bp, Homo sapiens
tacctcctctcag

SEQ ID NO: 2933167 - DNA, 14 bp, Homo sapiens
tacctcctctcagt

SEQ ID NO: 2933168 - DNA, 15 bp, Homo sapiens
tacctcctctcagtg

SEQ ID NO: 2933169 - DNA, 17 bp, Homo sapiens
tacctcctctcagtgtt

SEQ ID NO: 2933170 - DNA, 13 bp, Homo sapiens
tacctcctgagaa

SEQ ID NO: 2933171 - DNA, 14 bp, Homo sapiens
tacctcctgagaaa

SEQ ID NO: 2933172 - DNA, 11 bp, Homo sapiens
tacctcctgcc

SEQ ID NO: 2933173 - DNA, 21 bp, Homo sapiens
tacctcctgtctttacaaata

SEQ ID NO: 2933174 - DNA, 21 bp, Homo sapiens
tacctctaaatttccatatcc

SEQ ID NO: 2933175 - DNA, 14 bp, Homo sapiens
tacctctctgtccc

SEQ ID NO: 2933176 - DNA, 12 bp, Homo sapiens
tacctctgtgtg

SEQ ID NO: 2933177 - DNA, 13 bp, Homo sapiens
tacctgaaaacac

SEQ ID NO: 2933178 - DNA, 12 bp, Homo sapiens
tacctgaaagga

SEQ ID NO: 2933179 - DNA, 15 bp, Homo sapiens
tacctgagcattcag

SEQ ID NO: 2933180 - DNA, 19 bp, Homo sapiens
tacctgatcaatgacagag

SEQ ID NO: 2933181 - DNA, 13 bp, Homo sapiens
tacctgcaagcag

SEQ ID NO: 2933182 - DNA, 16 bp, Homo sapiens
tacctggcagcaaact

SEQ ID NO: 2933183 - DNA, 21 bp, Homo sapiens
tacctggtgctcgggaaggga

SEQ ID NO: 2933184 - DNA, 21 bp, Homo sapiens
tacctgtatttaaaaatagaa

SEQ ID NO: 2933185 - DNA, 19 bp, Homo sapiens
tacctgtcttgctcctggg

SEQ ID NO: 2933186 - DNA, 19 bp, Homo sapiens
tacctgtgcaccagtgtga

SEQ ID NO: 2933187 - DNA, 16 bp, Homo sapiens
tacctgtgcctcggct

SEQ ID NO: 2933188 - DNA, 19 bp, Homo sapiens
tacctgtggtttggtttta

SEQ ID NO: 2933189 - DNA, 13 bp, Homo sapiens
tacctgtttagtt

SEQ ID NO: 2933190 - DNA, 23 bp, Homo sapiens
taccttcaatgaattaattcaga

SEQ ID NO: 2933191 - DNA, 14 bp, Homo sapiens
taccttcatttcat

SEQ ID NO: 2933192 - DNA, 19 bp, Homo sapiens
taccttcatttcatcctgt

SEQ ID NO: 2933193 - DNA, 13 bp, Homo sapiens
taccttccccaga

SEQ ID NO: 2933194 - DNA, 15 bp, Homo sapiens
taccttccccagact

SEQ ID NO: 2933195 - DNA, 18 bp, Homo sapiens
taccttgccaattagtaa

SEQ ID NO: 2933196 - DNA, 14 bp, Homo sapiens
taccttgcctcctt

SEQ ID NO: 2933197 - DNA, 22 bp, Homo sapiens
taccttgcctccttttttctta

SEQ ID NO: 2933198 - DNA, 22 bp, Homo sapiens
taccttgttatttaacccattt

SEQ ID NO: 2933199 - DNA, 15 bp, Homo sapiens
tagcatgacatttct

SEQ ID NO: 2933200 - DNA, 20 bp, Homo sapiens
tagcatgatttttcaaggat

SEQ ID NO: 2933201 - DNA, 15 bp, Homo sapiens
tagccacaccaggat

SEQ ID NO: 2933202 - DNA, 18 bp, Homo sapiens
tagccacccaccacactg

SEQ ID NO: 2933203 - DNA, 18 bp, Homo sapiens
tagccagcacacagggca

SEQ ID NO: 2933204 - DNA, 14 bp, Homo sapiens
tagccagctgctcc

SEQ ID NO: 2933205 - DNA, 18 bp, Homo sapiens
tagccagctgctccccag

SEQ ID NO: 2933206 - DNA, 19 bp, Homo sapiens
tagccagttaaggaaagaa

SEQ ID NO: 2933207 - DNA, 17 bp, Homo sapiens
tagccatgttaacatga

SEQ ID NO: 2933208 - DNA, 19 bp, Homo sapiens
tagccatgttaacatgaca

SEQ ID NO: 2933209 - DNA, 13 bp, Homo sapiens
tagcccacccccc

SEQ ID NO: 2933210 - DNA, 16 bp, Homo sapiens
tagccccacaggaggt

SEQ ID NO: 2933211 - DNA, 17 bp, Homo sapiens
tagccccagtgacagct

SEQ ID NO: 2933212 - DNA, 15 bp, Homo sapiens
tagccccctggcctc

SEQ ID NO: 2933213 - DNA, 16 bp, Homo sapiens
tagccccctggcctct

SEQ ID NO: 2933214 - DNA, 17 bp, Homo sapiens
tagccccctggcctctg

SEQ ID NO: 2933215 - DNA, 18 bp, Homo sapiens
tagccccctggcctctgt

SEQ ID NO: 2933216 - DNA, 18 bp, Homo sapiens
tagccgaactccaggctg

SEQ ID NO: 2933217 - DNA, 20 bp, Homo sapiens
tagccgaactccaggctggg

SEQ ID NO: 2933218 - DNA, 14 bp, Homo sapiens
tagccgagagcctg

SEQ ID NO: 2933219 - DNA, 15 bp, Homo sapiens
tagccgagagcctgc

SEQ ID NO: 2933220 - DNA, 19 bp, Homo sapiens
tagccgagagcctgctccc

SEQ ID NO: 2933221 - DNA, 14 bp, Homo sapiens
tagccgctgccctg

SEQ ID NO: 2933222 - DNA, 16 bp, Homo sapiens
tagccgctgccctggg

SEQ ID NO: 2933223 - DNA, 18 bp, Homo sapiens
tagcctcacttttaatga

SEQ ID NO: 2933224 - DNA, 23 bp, Homo sapiens
tagcctcacttttaatgaacaaa

SEQ ID NO: 2933225 - DNA, 12 bp, Homo sapiens
tagcctgtggcc

SEQ ID NO: 2933226 - DNA, 15 bp, Homo sapiens
tagccttgctgtaga

SEQ ID NO: 2933227 - DNA, 14 bp, Homo sapiens
tagcgcctgtataa

SEQ ID NO: 2933228 - DNA, 21 bp, Homo sapiens
tagcgctgccgcaccccagag

SEQ ID NO: 2933229 - DNA, 14 bp, Homo sapiens
tagcgtatacattt

SEQ ID NO: 2933230 - DNA, 17 bp, Homo sapiens
tagcgtcctgccctgcc

SEQ ID NO: 2933231 - DNA, 19 bp, Homo sapiens
tagcgtcctgccctgcccc

SEQ ID NO: 2933232 - DNA, 16 bp, Homo sapiens
tagcgtgctcactgac

SEQ ID NO: 2933233 - DNA, 19 bp, Homo sapiens
tagctaaacggattccaaa

SEQ ID NO: 2933234 - DNA, 14 bp, Homo sapiens
tagctaataagtag

SEQ ID NO: 2933235 - DNA, 19 bp, Homo sapiens
tagctacaatcctaccttt

SEQ ID NO: 2933236 - DNA, 21 bp, Homo sapiens
tagctacaatcctaccttttg

SEQ ID NO: 2933237 - DNA, 12 bp, Homo sapiens
tagctactgcta

SEQ ID NO: 2933238 - DNA, 19 bp, Homo sapiens
tagctagaagtgggccagg

SEQ ID NO: 2933239 - DNA, 13 bp, Homo sapiens
tagctagccagcc

SEQ ID NO: 2933240 - DNA, 15 bp, Homo sapiens
tagctagctatttct

SEQ ID NO: 2933241 - DNA, 16 bp, Homo sapiens
tagctaggatttgaac

SEQ ID NO: 2933242 - DNA, 23 bp, Homo sapiens
tagctataattgggtcatagaaa

SEQ ID NO: 2933243 - DNA, 13 bp, Homo sapiens
tagctccaagctg

SEQ ID NO: 2933244 - DNA, 14 bp, Homo sapiens
tagctccaagctgt

SEQ ID NO: 2933245 - DNA, 11 bp, Homo sapiens
tagctccagcg

SEQ ID NO: 2933246 - DNA, 23 bp, Homo sapiens
tagctccagcgatggtgctgccc

SEQ ID NO: 2933247 - DNA, 16 bp, Homo sapiens
tagctcctcctcctgg

SEQ ID NO: 2933248 - DNA, 21 bp, Homo sapiens
tagctccttgaagacatatca

SEQ ID NO: 2933249 - DNA, 16 bp, Homo sapiens
tagctcttcacttcct

SEQ ID NO: 2933250 - DNA, 14 bp, Homo sapiens
tagctcttgggcct

SEQ ID NO: 2933251 - DNA, 18 bp, Homo sapiens
tagctcttgggcctgacc

SEQ ID NO: 2933252 - DNA, 20 bp, Homo sapiens
tagctcttgggcctgacctc

SEQ ID NO: 2933253 - DNA, 13 bp, Homo sapiens
tagctgaaaaaac

SEQ ID NO: 2933254 - DNA, 21 bp, Homo sapiens
tagctgaaaaaactatatttg

SEQ ID NO: 2933255 - DNA, 16 bp, Homo sapiens
tagctgacacagaaaa

SEQ ID NO: 2933256 - DNA, 21 bp, Homo sapiens
tagctgacgccaataataaaa

SEQ ID NO: 2933257 - DNA, 16 bp, Homo sapiens
tagctgagctgtgaca

SEQ ID NO: 2933258 - DNA, 20 bp, Homo sapiens
tagctgaggctgagaaagct

SEQ ID NO: 2933259 - DNA, 12 bp, Homo sapiens
tagctgagggga

SEQ ID NO: 2933260 - DNA, 16 bp, Homo sapiens
tagctgaggggacggg

SEQ ID NO: 2933261 - DNA, 14 bp, Homo sapiens
tagctgatcagttt

SEQ ID NO: 2933262 - DNA, 11 bp, Homo sapiens
tagctgcagaa

SEQ ID NO: 2933263 - DNA, 12 bp, Homo sapiens
tagctgcagaac

SEQ ID NO: 2933264 - DNA, 20 bp, Homo sapiens
tagctgccatcttgcttttc

SEQ ID NO: 2933265 - DNA, 23 bp, Homo sapiens
tagctgctacaaagaagacatgt

SEQ ID NO: 2933266 - DNA, 15 bp, Homo sapiens
tagctgctaccttct

SEQ ID NO: 2933267 - DNA, 23 bp, Homo sapiens
tagctgctcttttgtctcttaac

SEQ ID NO: 2933268 - DNA, 12 bp, Homo sapiens
tagctggagcct

SEQ ID NO: 2933269 - DNA, 15 bp, Homo sapiens
tagctgggattacag

SEQ ID NO: 2933270 - DNA, 12 bp, Homo sapiens
tagctgtattga

SEQ ID NO: 2933271 - DNA, 17 bp, Homo sapiens
tagctgtctagagtagc

SEQ ID NO: 2933272 - DNA, 21 bp, Homo sapiens
tagcttacaagccagctggag

SEQ ID NO: 2933273 - DNA, 14 bp, Homo sapiens
tagcttatctccct

SEQ ID NO: 2933274 - DNA, 20 bp, Homo sapiens
tagcttatctccctgcttca

SEQ ID NO: 2933275 - DNA, 19 bp, Homo sapiens
tagcttcctccagaggagg

SEQ ID NO: 2933276 - DNA, 12 bp, Homo sapiens
tagctttcctgg

SEQ ID NO: 2933277 - DNA, 13 bp, Homo sapiens
tagcttttcacct

SEQ ID NO: 2933278 - DNA, 15 bp, Homo sapiens
taggaagaattttaa

SEQ ID NO: 2933279 - DNA, 21 bp, Homo sapiens
taggaagttcttttttgtaca

SEQ ID NO: 2933280 - DNA, 22 bp, Homo sapiens
taggaatatcaatataatgttt

SEQ ID NO: 2933281 - DNA, 14 bp, Homo sapiens
taggaatctgcctt

SEQ ID NO: 2933282 - DNA, 21 bp, Homo sapiens
taggaatctgccttccagccc

SEQ ID NO: 2933283 - DNA, 16 bp, Homo sapiens
taggaatgatcataaa

SEQ ID NO: 2933284 - DNA, 14 bp, Homo sapiens
taggacccaagcag

SEQ ID NO: 2933285 - DNA, 14 bp, Homo sapiens
taggactgtggcaa

SEQ ID NO: 2933286 - DNA, 15 bp, Homo sapiens
taggactgtggcaaa

SEQ ID NO: 2933287 - DNA, 17 bp, Homo sapiens
taggactgtggcaaaca

SEQ ID NO: 2933288 - DNA, 21 bp, Homo sapiens
taggactttggtggtttaaaa

SEQ ID NO: 2933289 - DNA, 15 bp, Homo sapiens
taggagaagccagga

SEQ ID NO: 2933290 - DNA, 20 bp, Homo sapiens
taggagacagatcactcctg

SEQ ID NO: 2933291 - DNA, 22 bp, Homo sapiens
taggagacagatcactcctgga

SEQ ID NO: 2933292 - DNA, 14 bp, Homo sapiens
taggagctaaggct

SEQ ID NO: 2933293 - DNA, 14 bp, Homo sapiens
taggagctgggagg

SEQ ID NO: 2933294 - DNA, 18 bp, Homo sapiens
taggagctgggaggaaaa

SEQ ID NO: 2933295 - DNA, 23 bp, Homo sapiens
taggagggggcggcagggctggg

SEQ ID NO: 2933296 - DNA, 19 bp, Homo sapiens
taggatagctaactgtaaa

SEQ ID NO: 2933297 - DNA, 21 bp, Homo sapiens
taggatagctaactgtaaatc

SEQ ID NO: 2933298 - DNA, 15 bp, Homo sapiens
taggatcatatgaat

SEQ ID NO: 2933299 - DNA, 15 bp, Homo sapiens
taggatcctggaggc

SEQ ID NO: 2933300 - DNA, 19 bp, Homo sapiens
taggatcttatttggaatt

SEQ ID NO: 2933301 - DNA, 14 bp, Homo sapiens
taggattctaaaat

SEQ ID NO: 2933302 - DNA, 13 bp, Homo sapiens
taggattgctggg

SEQ ID NO: 2933303 - DNA, 19 bp, Homo sapiens
taggattgcttcaattaaa

SEQ ID NO: 2933304 - DNA, 22 bp, Homo sapiens
taggattgcttcaattaaaatt

SEQ ID NO: 2933305 - DNA, 14 bp, Homo sapiens
taggatttcagcca

SEQ ID NO: 2933306 - DNA, 18 bp, Homo sapiens
taggatttgaacacttgg

SEQ ID NO: 2933307 - DNA, 21 bp, Homo sapiens
taggattttttttaatgttta

SEQ ID NO: 2933308 - DNA, 16 bp, Homo sapiens
taggcaaaagaaaagc

SEQ ID NO: 2933309 - DNA, 20 bp, Homo sapiens
taggcaaatgtttaaacatt

SEQ ID NO: 2933310 - DNA, 17 bp, Homo sapiens
taggcaagtcacactgc

SEQ ID NO: 2933311 - DNA, 22 bp, Homo sapiens
taggcaggaagcccaattgctg

SEQ ID NO: 2933312 - DNA, 15 bp, Homo sapiens
taggccaactgcctc

SEQ ID NO: 2933313 - DNA, 14 bp, Homo sapiens
taggccactcctcc

SEQ ID NO: 2933314 - DNA, 20 bp, Homo sapiens
taggccatgaaaaaaatgat

SEQ ID NO: 2933315 - DNA, 17 bp, Homo sapiens
taggccccacaaggcct

SEQ ID NO: 2933316 - DNA, 19 bp, Homo sapiens
taggcccttggggtggcgc

SEQ ID NO: 2933317 - DNA, 16 bp, Homo sapiens
taggcctcagccagag

SEQ ID NO: 2933318 - DNA, 22 bp, Homo sapiens
taggcctcagccagagaagcta

SEQ ID NO: 2933319 - DNA, 23 bp, Homo sapiens
taggctaggacgttggcctcagg

SEQ ID NO: 2933320 - DNA, 13 bp, Homo sapiens
taggctagggtgg

SEQ ID NO: 2933321 - DNA, 15 bp, Homo sapiens
taggctattcacaac

SEQ ID NO: 2933322 - DNA, 13 bp, Homo sapiens
taggctctgcctt

SEQ ID NO: 2933323 - DNA, 15 bp, Homo sapiens
taggctggtggccca

SEQ ID NO: 2933324 - DNA, 18 bp, Homo sapiens
taggctggtggcccagga

SEQ ID NO: 2933325 - DNA, 20 bp, Homo sapiens
tagggaaaaaaatgcttctt

SEQ ID NO: 2933326 - DNA, 13 bp, Homo sapiens
tagggaaatgaaa

SEQ ID NO: 2933327 - DNA, 13 bp, Homo sapiens
tagggaagtaaaa

SEQ ID NO: 2933328 - DNA, 13 bp, Homo sapiens
tagggagatattt

SEQ ID NO: 2933329 - DNA, 14 bp, Homo sapiens
tagggatgcctcct

SEQ ID NO: 2933330 - DNA, 16 bp, Homo sapiens
tagggccaagcccagc

SEQ ID NO: 2933331 - DNA, 14 bp, Homo sapiens
tagggcctcggagg

SEQ ID NO: 2933332 - DNA, 22 bp, Homo sapiens
tagggcctcggaggctcctccc

SEQ ID NO: 2933333 - DNA, 21 bp, Homo sapiens
tatccaggtcaacagaatgaa

SEQ ID NO: 2933334 - DNA, 20 bp, Homo sapiens
tatccatattacgttgtttc

SEQ ID NO: 2933335 - DNA, 22 bp, Homo sapiens
tatccatattgagtcaaatggt

SEQ ID NO: 2933336 - DNA, 14 bp, Homo sapiens
tatccatgtaatga

SEQ ID NO: 2933337 - DNA, 15 bp, Homo sapiens
tatccattatcatgt

SEQ ID NO: 2933338 - DNA, 18 bp, Homo sapiens
tatccattatcatgtgta

SEQ ID NO: 2933339 - DNA, 14 bp, Homo sapiens
tatccatttaaact

SEQ ID NO: 2933340 - DNA, 20 bp, Homo sapiens
tatccattttttttactgtt

SEQ ID NO: 2933341 - DNA, 14 bp, Homo sapiens
tatcccctgcgctt

SEQ ID NO: 2933342 - DNA, 18 bp, Homo sapiens
tatcccctgcgctttgaa

SEQ ID NO: 2933343 - DNA, 17 bp, Homo sapiens
tatccctaacaggctgt

SEQ ID NO: 2933344 - DNA, 13 bp, Homo sapiens
tatccctgcccat

SEQ ID NO: 2933345 - DNA, 13 bp, Homo sapiens
tatcctaaaaatc

SEQ ID NO: 2933346 - DNA, 13 bp, Homo sapiens
tatcctatttcag

SEQ ID NO: 2933347 - DNA, 22 bp, Homo sapiens
tatcctccgccctttttgtcct

SEQ ID NO: 2933348 - DNA, 22 bp, Homo sapiens
tatcctcctgttctgaaacctt

SEQ ID NO: 2933349 - DNA, 13 bp, Homo sapiens
tatcctgcaaggg

SEQ ID NO: 2933350 - DNA, 22 bp, Homo sapiens
tatcctgggggacccaatgtag

SEQ ID NO: 2933351 - DNA, 15 bp, Homo sapiens
tatcctgtgctacag

SEQ ID NO: 2933352 - DNA, 16 bp, Homo sapiens
tatccttctacttgtc

SEQ ID NO: 2933353 - DNA, 17 bp, Homo sapiens
tatcggcagatgatgct

SEQ ID NO: 2933354 - DNA, 17 bp, Homo sapiens
tatcgttattataaatg

SEQ ID NO: 2933355 - DNA, 13 bp, Homo sapiens
tatctaaaagtgt

SEQ ID NO: 2933356 - DNA, 23 bp, Homo sapiens
tatctaaaagtgtcaccttttct

SEQ ID NO: 2933357 - DNA, 17 bp, Homo sapiens
tatctaaaggatggaaa

SEQ ID NO: 2933358 - DNA, 22 bp, Homo sapiens
tatctaaaggatggaaaaataa

SEQ ID NO: 2933359 - DNA, 22 bp, Homo sapiens
tatctaaagtcatcatgaactg

SEQ ID NO: 2933360 - DNA, 19 bp, Homo sapiens
tatctaaagttatatttca

SEQ ID NO: 2933361 - DNA, 20 bp, Homo sapiens
tatctaaattgaataatggt

SEQ ID NO: 2933362 - DNA, 19 bp, Homo sapiens
tatctaagttaatttaaag

SEQ ID NO: 2933363 - DNA, 15 bp, Homo sapiens
tatctaatacctctg

SEQ ID NO: 2933364 - DNA, 20 bp, Homo sapiens
tatctaatacctctgtgtgc

SEQ ID NO: 2933365 - DNA, 22 bp, Homo sapiens
tatctaatcctttaatgatctg

SEQ ID NO: 2933366 - DNA, 21 bp, Homo sapiens
tatctacccagtcatgtactg

SEQ ID NO: 2933367 - DNA, 19 bp, Homo sapiens
tatctactaagtttccttt

SEQ ID NO: 2933368 - DNA, 22 bp, Homo sapiens
tatctactaagtttccttttaa

SEQ ID NO: 2933369 - DNA, 16 bp, Homo sapiens
tatctagatttctaga

SEQ ID NO: 2933370 - DNA, 16 bp, Homo sapiens
tatctatatatgtgta

SEQ ID NO: 2933371 - DNA, 19 bp, Homo sapiens
tatctatatgtacttgtca

SEQ ID NO: 2933372 - DNA, 16 bp, Homo sapiens
tatctattctgagaaa

SEQ ID NO: 2933373 - DNA, 15 bp, Homo sapiens
tatctcagccatagg

SEQ ID NO: 2933374 - DNA, 15 bp, Homo sapiens
tatctccaagaccag

SEQ ID NO: 2933375 - DNA, 15 bp, Homo sapiens
tatctccctgcttca

SEQ ID NO: 2933376 - DNA, 18 bp, Homo sapiens
tatctctaataaaaacag

SEQ ID NO: 2933377 - DNA, 16 bp, Homo sapiens
tatctctagtccctgt

SEQ ID NO: 2933378 - DNA, 19 bp, Homo sapiens
tatctctagtccctgtgtt

SEQ ID NO: 2933379 - DNA, 22 bp, Homo sapiens
tatctctagtccctgtgttctg

SEQ ID NO: 2933380 - DNA, 16 bp, Homo sapiens
tatctctatttgagaa

SEQ ID NO: 2933381 - DNA, 16 bp, Homo sapiens
tatctctcccttcttt

SEQ ID NO: 2933382 - DNA, 18 bp, Homo sapiens
tatctctcccttctttac

SEQ ID NO: 2933383 - DNA, 13 bp, Homo sapiens
tatctcttgccct

SEQ ID NO: 2933384 - DNA, 17 bp, Homo sapiens
tatctcttgcccttcct

SEQ ID NO: 2933385 - DNA, 16 bp, Homo sapiens
tatctgaaaatacatt

SEQ ID NO: 2933386 - DNA, 16 bp, Homo sapiens
tatctgagctgagcca

SEQ ID NO: 2933387 - DNA, 12 bp, Homo sapiens
tatctgcatgta

SEQ ID NO: 2933388 - DNA, 22 bp, Homo sapiens
tatctgcatgtaaaatcttcag

SEQ ID NO: 2933389 - DNA, 16 bp, Homo sapiens
tatctggtatctgcat

SEQ ID NO: 2933390 - DNA, 14 bp, Homo sapiens
tatctgtctacttt

SEQ ID NO: 2933391 - DNA, 15 bp, Homo sapiens
tatctgttaaccaaa

SEQ ID NO: 2933392 - DNA, 20 bp, Homo sapiens
tatctgtttcctgacattgt

SEQ ID NO: 2933393 - DNA, 22 bp, Homo sapiens
tatctgtttcctgacattgtct

SEQ ID NO: 2933394 - DNA, 18 bp, Homo sapiens
tatcttatactgtacaat

SEQ ID NO: 2933395 - DNA, 15 bp, Homo sapiens
tatcttctcaagttc

SEQ ID NO: 2933396 - DNA, 17 bp, Homo sapiens
tatcttctcaagttcta

SEQ ID NO: 2933397 - DNA, 18 bp, Homo sapiens
tatcttctcaagttctaa

SEQ ID NO: 2933398 - DNA, 17 bp, Homo sapiens
tatcttctgtttcataa

SEQ ID NO: 2933399 - DNA, 23 bp, Homo sapiens
tatcttgtaaataaagacattca

SEQ ID NO: 2933400 - DNA, 17 bp, Homo sapiens
tatcttgttattattgt

SEQ ID NO: 2933401 - DNA, 15 bp, Homo sapiens
tatcttgttccaagg

SEQ ID NO: 2933402 - DNA, 15 bp, Homo sapiens
tatctttaagaaaaa

SEQ ID NO: 2933403 - DNA, 16 bp, Homo sapiens
tatctttagttgaatt

SEQ ID NO: 2933404 - DNA, 22 bp, Homo sapiens
tatctttagttgaattccaagt

SEQ ID NO: 2933405 - DNA, 19 bp, Homo sapiens
tatctttatacttaaacag

SEQ ID NO: 2933406 - DNA, 18 bp, Homo sapiens
tatcttttatttcattca

SEQ ID NO: 2933407 - DNA, 14 bp, Homo sapiens
tatcttttctttag

SEQ ID NO: 2933408 - DNA, 15 bp, Homo sapiens
tatcttttctttaga

SEQ ID NO: 2933409 - DNA, 15 bp, Homo sapiens
tatctttttcattat

SEQ ID NO: 2933410 - DNA, 18 bp, Homo sapiens
tatcttttttagtgttaa

SEQ ID NO: 2933411 - DNA, 22 bp, Homo sapiens
tatgaaactctacatttaaaca

SEQ ID NO: 2933412 - DNA, 16 bp, Homo sapiens
tatgaaatattttgaa

SEQ ID NO: 2933413 - DNA, 22 bp, Homo sapiens
tatgaaatattttgaatacaca

SEQ ID NO: 2933414 - DNA, 17 bp, Homo sapiens
tatgaagcaagctgtgt

SEQ ID NO: 2933415 - DNA, 24 bp, Homo sapiens
tatgaagctcacctgttgcttaca

SEQ ID NO: 2933416 - DNA, 16 bp, Homo sapiens
tatgaagtacttttaa

SEQ ID NO: 2933417 - DNA, 16 bp, Homo sapiens
tatgaagtatctaaaa

SEQ ID NO: 2933418 - DNA, 22 bp, Homo sapiens
tatgaagtgctacagaaagcac

SEQ ID NO: 2933419 - DNA, 21 bp, Homo sapiens
tatgaagttactttcttaatg

SEQ ID NO: 2933420 - DNA, 15 bp, Homo sapiens
tatgaataattgcat

SEQ ID NO: 2933421 - DNA, 16 bp, Homo sapiens
tatgaatgaatgggat

SEQ ID NO: 2933422 - DNA, 22 bp, Homo sapiens
tatgaatgcagcactgctgcct

SEQ ID NO: 2933423 - DNA, 23 bp, Homo sapiens
tatgaatgcagcactgctgcctc

SEQ ID NO: 2933424 - DNA, 20 bp, Homo sapiens
tatgaatgcccccagctggc

SEQ ID NO: 2933425 - DNA, 13 bp, Homo sapiens
tatgaattcaaga

SEQ ID NO: 2933426 - DNA, 21 bp, Homo sapiens
tatgaattcaagaaaggaaat

SEQ ID NO: 2933427 - DNA, 21 bp, Homo sapiens
tatgacaagctgtatcactgc

SEQ ID NO: 2933428 - DNA, 22 bp, Homo sapiens
tatgacaagctgtatcactgcc

SEQ ID NO: 2933429 - DNA, 16 bp, Homo sapiens
tatgacagctgtccct

SEQ ID NO: 2933430 - DNA, 21 bp, Homo sapiens
tatgacattggatagaacatg

SEQ ID NO: 2933431 - DNA, 21 bp, Homo sapiens
tatgaccttccaagtttgact

SEQ ID NO: 2933432 - DNA, 20 bp, Homo sapiens
tatgacttggacctcatttt

SEQ ID NO: 2933433 - DNA, 15 bp, Homo sapiens
tatgagaggcaatga

SEQ ID NO: 2933434 - DNA, 15 bp, Homo sapiens
tatgagctaaaaata

SEQ ID NO: 2933435 - DNA, 22 bp, Homo sapiens
tatgagttgttttcagactcag

SEQ ID NO: 2933436 - DNA, 16 bp, Homo sapiens
tatgataatagattct

SEQ ID NO: 2933437 - DNA, 13 bp, Homo sapiens
tatgatcagtgtt

SEQ ID NO: 2933438 - DNA, 17 bp, Homo sapiens
tatgatcagtgttgttg

SEQ ID NO: 2933439 - DNA, 10 bp, Homo sapiens
tatgatgaca

SEQ ID NO: 2933440 - DNA, 18 bp, Homo sapiens
tatgatgggctccccagg

SEQ ID NO: 2933441 - DNA, 21 bp, Homo sapiens
tatgattgtttgcacagaggg

SEQ ID NO: 2933442 - DNA, 22 bp, Homo sapiens
tatgattttttaagtctatgtt

SEQ ID NO: 2933443 - DNA, 17 bp, Homo sapiens
tatgcaattcagtgttc

SEQ ID NO: 2933444 - DNA, 20 bp, Homo sapiens
tatgcacatatggactctgc

SEQ ID NO: 2933445 - DNA, 12 bp, Homo sapiens
tatgcacccctg

SEQ ID NO: 2933446 - DNA, 20 bp, Homo sapiens
tatgcaccttgtgtctgtac

SEQ ID NO: 2933447 - DNA, 20 bp, Homo sapiens
tatgcacttataattttcct

SEQ ID NO: 2933448 - DNA, 22 bp, Homo sapiens
tatgcacttataattttcctaa

SEQ ID NO: 2933449 - DNA, 18 bp, Homo sapiens
tatgcatggtgccccagg

SEQ ID NO: 2933450 - DNA, 15 bp, Homo sapiens
tatgccatttttagt

SEQ ID NO: 2933451 - DNA, 19 bp, Homo sapiens
tatgcccattcttttcact

SEQ ID NO: 2933452 - DNA, 20 bp, Homo sapiens
tatgcccattcttttcactt

SEQ ID NO: 2933453 - DNA, 14 bp, Homo sapiens
tatgcctctccttt

SEQ ID NO: 2933454 - DNA, 15 bp, Homo sapiens
tatgcctctcctttg

SEQ ID NO: 2933455 - DNA, 20 bp, Homo sapiens
tatgcgtgtccgtctgtctg

SEQ ID NO: 2933456 - DNA, 22 bp, Homo sapiens
tatgctccatcccattcacttc

SEQ ID NO: 2933457 - DNA, 18 bp, Homo sapiens
tatgctctcactgtttgt

SEQ ID NO: 2933458 - DNA, 14 bp, Homo sapiens
tatgctcttttgtt

SEQ ID NO: 2933459 - DNA, 15 bp, Homo sapiens
tatgctgatcatcgc

SEQ ID NO: 2933460 - DNA, 21 bp, Homo sapiens
tatgctgtatgaatattttat

SEQ ID NO: 2933461 - DNA, 14 bp, Homo sapiens
tatgcttcatacag

SEQ ID NO: 2933462 - DNA, 17 bp, Homo sapiens
tatgcttcatacaggga

SEQ ID NO: 2933463 - DNA, 16 bp, Homo sapiens
tatgcttgcaaaaact

SEQ ID NO: 2933464 - DNA, 23 bp, Homo sapiens
tcaatggtagattcgctgtcccc

SEQ ID NO: 2933465 - DNA, 17 bp, Homo sapiens
tcaatgtattaatatct

SEQ ID NO: 2933466 - DNA, 21 bp, Homo sapiens
tcaatgtattaatatctccat

SEQ ID NO: 2933467 - DNA, 15 bp, Homo sapiens
tcaatgtgaatcaga

SEQ ID NO: 2933468 - DNA, 16 bp, Homo sapiens
tcaatgtgacatgttg

SEQ ID NO: 2933469 - DNA, 14 bp, Homo sapiens
tcaattaaaattac

SEQ ID NO: 2933470 - DNA, 22 bp, Homo sapiens
tcaattaaaattacaaaagaga

SEQ ID NO: 2933471 - DNA, 14 bp, Homo sapiens
tcaattatagtttc

SEQ ID NO: 2933472 - DNA, 17 bp, Homo sapiens
tcaattatagtttctga

SEQ ID NO: 2933473 - DNA, 19 bp, Homo sapiens
tcaatttaaacccatttta

SEQ ID NO: 2933474 - DNA, 23 bp, Homo sapiens
tcaatttaaacccattttagtca

SEQ ID NO: 2933475 - DNA, 15 bp, Homo sapiens
tcaatttaaatgttt

SEQ ID NO: 2933476 - DNA, 18 bp, Homo sapiens
tcaatttaaatgtttact

SEQ ID NO: 2933477 - DNA, 12 bp, Homo sapiens
tcaatttcagca

SEQ ID NO: 2933478 - DNA, 15 bp, Homo sapiens
tcaatttctgaacac

SEQ ID NO: 2933479 - DNA, 20 bp, Homo sapiens
tcaatttgccattggtttct

SEQ ID NO: 2933480 - DNA, 13 bp, Homo sapiens
tcaatttgtaatt

SEQ ID NO: 2933481 - DNA, 20 bp, Homo sapiens
tcaatttgtaattttagtat

SEQ ID NO: 2933482 - DNA, 14 bp, Homo sapiens
tcaattttcattaa

SEQ ID NO: 2933483 - DNA, 14 bp, Homo sapiens
tcaattttgtattt

SEQ ID NO: 2933484 - DNA, 15 bp, Homo sapiens
tcaattttgtattta

SEQ ID NO: 2933485 - DNA, 20 bp, Homo sapiens
tcacaaaacatattttacat

SEQ ID NO: 2933486 - DNA, 14 bp, Homo sapiens
tcacaaaacattaa

SEQ ID NO: 2933487 - DNA, 21 bp, Homo sapiens
tcacaaaagctgtgtctctgt

SEQ ID NO: 2933488 - DNA, 15 bp, Homo sapiens
tcacaaacttttata

SEQ ID NO: 2933489 - DNA, 16 bp, Homo sapiens
tcacaaagcccaaggg

SEQ ID NO: 2933490 - DNA, 13 bp, Homo sapiens
tcacaaataatag

SEQ ID NO: 2933491 - DNA, 15 bp, Homo sapiens
tcacaaccagatttg

SEQ ID NO: 2933492 - DNA, 11 bp, Homo sapiens
tcacaactcct

SEQ ID NO: 2933493 - DNA, 19 bp, Homo sapiens
tcacaactccttccatcct

SEQ ID NO: 2933494 - DNA, 23 bp, Homo sapiens
tcacaagctgtagataacagcaa

SEQ ID NO: 2933495 - DNA, 14 bp, Homo sapiens
tcacaaggtcagga

SEQ ID NO: 2933496 - DNA, 16 bp, Homo sapiens
tcacaagtgaaaaaca

SEQ ID NO: 2933497 - DNA, 16 bp, Homo sapiens
tcacaatgttctttat

SEQ ID NO: 2933498 - DNA, 23 bp, Homo sapiens
tcacaattcttagatctggtgtc

SEQ ID NO: 2933499 - DNA, 13 bp, Homo sapiens
tcacacagcccag

SEQ ID NO: 2933500 - DNA, 18 bp, Homo sapiens
tcacacatctgggtgccc

SEQ ID NO: 2933501 - DNA, 20 bp, Homo sapiens
tcacacatctgggtgccctg

SEQ ID NO: 2933502 - DNA, 19 bp, Homo sapiens
tcacaccctaccttcccca

SEQ ID NO: 2933503 - DNA, 21 bp, Homo sapiens
tcacaccctaccttccccaga

SEQ ID NO: 2933504 - DNA, 22 bp, Homo sapiens
tcacaccctaccttccccagac

SEQ ID NO: 2933505 - DNA, 21 bp, Homo sapiens
tcacactcagttgtgactaac

SEQ ID NO: 2933506 - DNA, 20 bp, Homo sapiens
tcacactgcaagagccttgg

SEQ ID NO: 2933507 - DNA, 15 bp, Homo sapiens
tcacactggttctca

SEQ ID NO: 2933508 - DNA, 16 bp, Homo sapiens
tcacactggttctcaa

SEQ ID NO: 2933509 - DNA, 23 bp, Homo sapiens
tcacacttactgtaagacattag

SEQ ID NO: 2933510 - DNA, 24 bp, Homo sapiens
tcacacttgtaatcccagcaattt

SEQ ID NO: 2933511 - DNA, 17 bp, Homo sapiens
tcacacttttcagcaaa

SEQ ID NO: 2933512 - DNA, 19 bp, Homo sapiens
tcacagagcacgcctgcca

SEQ ID NO: 2933513 - DNA, 21 bp, Homo sapiens
tcacagagcacgcctgccatc

SEQ ID NO: 2933514 - DNA, 22 bp, Homo sapiens
tcacagagcacgcctgccatct

SEQ ID NO: 2933515 - DNA, 13 bp, Homo sapiens
tcacagagtgaga

SEQ ID NO: 2933516 - DNA, 13 bp, Homo sapiens
tcacagatgctgg

SEQ ID NO: 2933517 - DNA, 16 bp, Homo sapiens
tcacagatgctggcct

SEQ ID NO: 2933518 - DNA, 19 bp, Homo sapiens
tcacagatgctggcctctt

SEQ ID NO: 2933519 - DNA, 23 bp, Homo sapiens
tcacagatgctggcctcttggca

SEQ ID NO: 2933520 - DNA, 12 bp, Homo sapiens
tcacagcagctt

SEQ ID NO: 2933521 - DNA, 14 bp, Homo sapiens
tcacagcagctttg

SEQ ID NO: 2933522 - DNA, 19 bp, Homo sapiens
tcacaggccccaggaaagg

SEQ ID NO: 2933523 - DNA, 18 bp, Homo sapiens
tcacaggcttctgagcac

SEQ ID NO: 2933524 - DNA, 15 bp, Homo sapiens
tcacagggtgggcct

SEQ ID NO: 2933525 - DNA, 17 bp, Homo sapiens
tcacagggtgggcctcg

SEQ ID NO: 2933526 - DNA, 16 bp, Homo sapiens
tcacagttcaaaattc

SEQ ID NO: 2933527 - DNA, 19 bp, Homo sapiens
tcacagttcctcgccctgg

SEQ ID NO: 2933528 - DNA, 21 bp, Homo sapiens
tcacagttcctcgccctgggt

SEQ ID NO: 2933529 - DNA, 22 bp, Homo sapiens
tcacagttcctcgccctgggtc

SEQ ID NO: 2933530 - DNA, 13 bp, Homo sapiens
tcacataaatgca

SEQ ID NO: 2933531 - DNA, 17 bp, Homo sapiens
tcacataaatgcagccc

SEQ ID NO: 2933532 - DNA, 18 bp, Homo sapiens
tcacataaccccttgaaa

SEQ ID NO: 2933533 - DNA, 19 bp, Homo sapiens
tcacatcctgtgtttctag

SEQ ID NO: 2933534 - DNA, 19 bp, Homo sapiens
tcacatctcccttccacct

SEQ ID NO: 2933535 - DNA, 21 bp, Homo sapiens
tcacatctcccttccacctca

SEQ ID NO: 2933536 - DNA, 20 bp, Homo sapiens
tcacatgaccacatagcatg

SEQ ID NO: 2933537 - DNA, 13 bp, Homo sapiens
tcacatgatgaaa

SEQ ID NO: 2933538 - DNA, 14 bp, Homo sapiens
tcacatgatgaaaa

SEQ ID NO: 2933539 - DNA, 21 bp, Homo sapiens
tcacatgatgaaaaattatag

SEQ ID NO: 2933540 - DNA, 13 bp, Homo sapiens
tcacatgccttgc

SEQ ID NO: 2933541 - DNA, 21 bp, Homo sapiens
tcacatggaatctacatgtgt

SEQ ID NO: 2933542 - DNA, 23 bp, Homo sapiens
tcacatggaatctacatgtgttt

SEQ ID NO: 2933543 - DNA, 16 bp, Homo sapiens
tcacatggcctatgca

SEQ ID NO: 2933544 - DNA, 21 bp, Homo sapiens
tcacatggcctatgcacatat

SEQ ID NO: 2933545 - DNA, 12 bp, Homo sapiens
tcacattagaag

SEQ ID NO: 2933546 - DNA, 17 bp, Homo sapiens
tcacattcccctgggga

SEQ ID NO: 2933547 - DNA, 17 bp, Homo sapiens
tcacattcttataaata

SEQ ID NO: 2933548 - DNA, 21 bp, Homo sapiens
tcacattcttataaatatgaa

SEQ ID NO: 2933549 - DNA, 21 bp, Homo sapiens
tcacattcttggcttaatcat

SEQ ID NO: 2933550 - DNA, 12 bp, Homo sapiens
tcaccaagctca

SEQ ID NO: 2933551 - DNA, 20 bp, Homo sapiens
tcaccaagctcacagttcct

SEQ ID NO: 2933552 - DNA, 21 bp, Homo sapiens
tcaccaagctcacagttcctc

SEQ ID NO: 2933553 - DNA, 12 bp, Homo sapiens
tcaccaaggaaa

SEQ ID NO: 2933554 - DNA, 12 bp, Homo sapiens
tcaccacaaact

SEQ ID NO: 2933555 - DNA, 21 bp, Homo sapiens
tcaccacaagccaccttttgt

SEQ ID NO: 2933556 - DNA, 12 bp, Homo sapiens
tcaccaccccca

SEQ ID NO: 2933557 - DNA, 18 bp, Homo sapiens
tcaccacgactggccagg

SEQ ID NO: 2933558 - DNA, 20 bp, Homo sapiens
tcaccacgactggccagggc

SEQ ID NO: 2933559 - DNA, 17 bp, Homo sapiens
tcaccagctgcaaagtg

SEQ ID NO: 2933560 - DNA, 16 bp, Homo sapiens
tcaccaggtgcatctg

SEQ ID NO: 2933561 - DNA, 22 bp, Homo sapiens
tcaccagtggccttacccctgc

SEQ ID NO: 2933562 - DNA, 23 bp, Homo sapiens
tcaccatatttgaattggcctga

SEQ ID NO: 2933563 - DNA, 21 bp, Homo sapiens
tcaccatgatggccaggctga

SEQ ID NO: 2933564 - DNA, 18 bp, Homo sapiens
tcaccatggatcctggat

SEQ ID NO: 2933565 - DNA, 15 bp, Homo sapiens
tcacccaaaagcaca

SEQ ID NO: 2933566 - DNA, 16 bp, Homo sapiens
tcacccaaaagcacaa

SEQ ID NO: 2933567 - DNA, 16 bp, Homo sapiens
tcacccaaagcctgtc

SEQ ID NO: 2933568 - DNA, 19 bp, Homo sapiens
tcacccaagagattgttgt

SEQ ID NO: 2933569 - DNA, 19 bp, Homo sapiens
tcacccacaaccctctgga

SEQ ID NO: 2933570 - DNA, 14 bp, Homo sapiens
tcacccacagggct

SEQ ID NO: 2933571 - DNA, 15 bp, Homo sapiens
tcacccacagggcta

SEQ ID NO: 2933572 - DNA, 22 bp, Homo sapiens
tcacccacagggctaagagcta

SEQ ID NO: 2933573 - DNA, 13 bp, Homo sapiens
tcacccacccctg

SEQ ID NO: 2933574 - DNA, 16 bp, Homo sapiens
tcacccaggctggagt

SEQ ID NO: 2933575 - DNA, 12 bp, Homo sapiens
tcaccccagagc

SEQ ID NO: 2933576 - DNA, 13 bp, Homo sapiens
tcaccccagagcc

SEQ ID NO: 2933577 - DNA, 13 bp, Homo sapiens
tcaccccagctcc

SEQ ID NO: 2933578 - DNA, 15 bp, Homo sapiens
tcaccccagctccga

SEQ ID NO: 2933579 - DNA, 20 bp, Homo sapiens
tcaccccagctccgacctct

SEQ ID NO: 2933580 - DNA, 12 bp, Homo sapiens
tcaccccagggc

SEQ ID NO: 2933581 - DNA, 15 bp, Homo sapiens
tcaccccagggcctg

SEQ ID NO: 2933582 - DNA, 20 bp, Homo sapiens
tcaccccagggcctgagcct

SEQ ID NO: 2933583 - DNA, 21 bp, Homo sapiens
tcaccccagggcctgagcctg

SEQ ID NO: 2933584 - DNA, 13 bp, Homo sapiens
tcacccccttctc

SEQ ID NO: 2933585 - DNA, 16 bp, Homo sapiens
tcacccccttctccat

SEQ ID NO: 2933586 - DNA, 18 bp, Homo sapiens
tcaccccgaggccctgca

SEQ ID NO: 2933587 - DNA, 14 bp, Homo sapiens
tcacccctccagga

SEQ ID NO: 2933588 - DNA, 19 bp, Homo sapiens
tcacccctgacatgtaccc

SEQ ID NO: 2933589 - DNA, 19 bp, Homo sapiens
tcaccctggccaccaccca

SEQ ID NO: 2933590 - DNA, 23 bp, Homo sapiens
tcaccctggccaccacccaacct

SEQ ID NO: 2933591 - DNA, 16 bp, Homo sapiens
tcacccttcctggccc

SEQ ID NO: 2933592 - DNA, 19 bp, Homo sapiens
tcacccttcctggcccagg

SEQ ID NO: 2933593 - DNA, 21 bp, Homo sapiens
tcaccgcggacgtgctggcct

SEQ ID NO: 2933594 - DNA, 13 bp, Homo sapiens
tcaccgtgggctc

SEQ ID NO: 2933595 - DNA, 15 bp, Homo sapiens
tcaccgtgggctccc

SEQ ID NO: 2933596 - DNA, 20 bp, Homo sapiens
tcagtcctggtctgctcagg

SEQ ID NO: 2933597 - DNA, 12 bp, Homo sapiens
tcagtctagaag

SEQ ID NO: 2933598 - DNA, 16 bp, Homo sapiens
tcagtctagaagaatt

SEQ ID NO: 2933599 - DNA, 17 bp, Homo sapiens
tcagtctgctttctcta

SEQ ID NO: 2933600 - DNA, 12 bp, Homo sapiens
tcagtctgttca

SEQ ID NO: 2933601 - DNA, 18 bp, Homo sapiens
tcagtcttttctctgaaa

SEQ ID NO: 2933602 - DNA, 22 bp, Homo sapiens
tcagtgaactaatttggttttt

SEQ ID NO: 2933603 - DNA, 23 bp, Homo sapiens
tcagtgaactaatttggttttta

SEQ ID NO: 2933604 - DNA, 21 bp, Homo sapiens
tcagtgaatatgcctgtaatt

SEQ ID NO: 2933605 - DNA, 18 bp, Homo sapiens
tcagtgcaaaatgtcttg

SEQ ID NO: 2933606 - DNA, 19 bp, Homo sapiens
tcagtgcaaaatgtcttgt

SEQ ID NO: 2933607 - DNA, 20 bp, Homo sapiens
tcagtgcaaaatgtcttgtg

SEQ ID NO: 2933608 - DNA, 16 bp, Homo sapiens
tcagtgcacctgcctc

SEQ ID NO: 2933609 - DNA, 19 bp, Homo sapiens
tcagtgcacctgcctcagc

SEQ ID NO: 2933610 - DNA, 23 bp, Homo sapiens
tcagtgcacctgcctcagctacc

SEQ ID NO: 2933611 - DNA, 20 bp, Homo sapiens
tcagtgccaactgtggctgg

SEQ ID NO: 2933612 - DNA, 13 bp, Homo sapiens
tcagtgcccacca

SEQ ID NO: 2933613 - DNA, 14 bp, Homo sapiens
tcagtgccttctct

SEQ ID NO: 2933614 - DNA, 15 bp, Homo sapiens
tcagtgccttctctc

SEQ ID NO: 2933615 - DNA, 19 bp, Homo sapiens
tcagtgccttctctcagct

SEQ ID NO: 2933616 - DNA, 21 bp, Homo sapiens
tcagtgccttctctcagctcc

SEQ ID NO: 2933617 - DNA, 19 bp, Homo sapiens
tcagtgctccctcacatgt

SEQ ID NO: 2933618 - DNA, 22 bp, Homo sapiens
tcagtggaacacaaatgaaaat

SEQ ID NO: 2933619 - DNA, 15 bp, Homo sapiens
tcagtgggaacgtga

SEQ ID NO: 2933620 - DNA, 19 bp, Homo sapiens
tcagtgggaacgtgactgc

SEQ ID NO: 2933621 - DNA, 22 bp, Homo sapiens
tcagtgggaacgtgactgcccc

SEQ ID NO: 2933622 - DNA, 16 bp, Homo sapiens
tcagtggggctctctg

SEQ ID NO: 2933623 - DNA, 23 bp, Homo sapiens
tcagtgtaaatagttactccagt

SEQ ID NO: 2933624 - DNA, 16 bp, Homo sapiens
tcagtgtaatgtgact

SEQ ID NO: 2933625 - DNA, 17 bp, Homo sapiens
tcagtgtaatgtgactt

SEQ ID NO: 2933626 - DNA, 14 bp, Homo sapiens
tcagtgtaatttct

SEQ ID NO: 2933627 - DNA, 19 bp, Homo sapiens
tcagtgtaatttctttgcc

SEQ ID NO: 2933628 - DNA, 21 bp, Homo sapiens
tcagtgttcagccaaacagta

SEQ ID NO: 2933629 - DNA, 16 bp, Homo sapiens
tcagtgttttggactc

SEQ ID NO: 2933630 - DNA, 23 bp, Homo sapiens
tcagtgttttggactccatctct

SEQ ID NO: 2933631 - DNA, 16 bp, Homo sapiens
tcagttaacgtcaccc

SEQ ID NO: 2933632 - DNA, 19 bp, Homo sapiens
tcagttactcagccctggg

SEQ ID NO: 2933633 - DNA, 16 bp, Homo sapiens
tcagttactctgaagg

SEQ ID NO: 2933634 - DNA, 15 bp, Homo sapiens
tcagttattggtgga

SEQ ID NO: 2933635 - DNA, 17 bp, Homo sapiens
tcagttattggtggaat

SEQ ID NO: 2933636 - DNA, 17 bp, Homo sapiens
tcagttctcaaatgtgt

SEQ ID NO: 2933637 - DNA, 12 bp, Homo sapiens
tcagttctgcct

SEQ ID NO: 2933638 - DNA, 13 bp, Homo sapiens
tcagttctgcctt

SEQ ID NO: 2933639 - DNA, 17 bp, Homo sapiens
tcagttctgccttatct

SEQ ID NO: 2933640 - DNA, 17 bp, Homo sapiens
tcagttgctaaacactg

SEQ ID NO: 2933641 - DNA, 21 bp, Homo sapiens
tcagttgtagaatgtattgta

SEQ ID NO: 2933642 - DNA, 15 bp, Homo sapiens
tcagttgtgactaac

SEQ ID NO: 2933643 - DNA, 20 bp, Homo sapiens
tcagtttcttctccagactg

SEQ ID NO: 2933644 - DNA, 12 bp, Homo sapiens
tcagttttggtg

SEQ ID NO: 2933645 - DNA, 14 bp, Homo sapiens
tcagtttttaagag

SEQ ID NO: 2933646 - DNA, 23 bp, Homo sapiens
tcataacggttaagaaagcactt

SEQ ID NO: 2933647 - DNA, 22 bp, Homo sapiens
tcataactaggagactgaatta

SEQ ID NO: 2933648 - DNA, 14 bp, Homo sapiens
tcataaggcttcaa

SEQ ID NO: 2933649 - DNA, 19 bp, Homo sapiens
tcataataaatatctgtac

SEQ ID NO: 2933650 - DNA, 13 bp, Homo sapiens
tcataatccttct

SEQ ID NO: 2933651 - DNA, 15 bp, Homo sapiens
tcataatctttgctt

SEQ ID NO: 2933652 - DNA, 12 bp, Homo sapiens
tcataatgtgaa

SEQ ID NO: 2933653 - DNA, 15 bp, Homo sapiens
tcataatgtgaagtg

SEQ ID NO: 2933654 - DNA, 22 bp, Homo sapiens
tcataccgcctcgtgccagcag

SEQ ID NO: 2933655 - DNA, 15 bp, Homo sapiens
tcatacctgctcctc

SEQ ID NO: 2933656 - DNA, 23 bp, Homo sapiens
tcatacctgctcctcatctgcct

SEQ ID NO: 2933657 - DNA, 13 bp, Homo sapiens
tcatactctgttg

SEQ ID NO: 2933658 - DNA, 21 bp, Homo sapiens
tcatactctgttgcctcctct

SEQ ID NO: 2933659 - DNA, 19 bp, Homo sapiens
tcatagaacagaaatatat

SEQ ID NO: 2933660 - DNA, 22 bp, Homo sapiens
tcatagatattggaagagagaa

SEQ ID NO: 2933661 - DNA, 14 bp, Homo sapiens
tcatagtaacttct

SEQ ID NO: 2933662 - DNA, 21 bp, Homo sapiens
tcatagtaacttcttatggaa

SEQ ID NO: 2933663 - DNA, 18 bp, Homo sapiens
tcatagtaagtgcgaaga

SEQ ID NO: 2933664 - DNA, 20 bp, Homo sapiens
tcatagtactctttgtagca

SEQ ID NO: 2933665 - DNA, 16 bp, Homo sapiens
tcatagtgcctttttc

SEQ ID NO: 2933666 - DNA, 19 bp, Homo sapiens
tcatagtgcctttttcctt

SEQ ID NO: 2933667 - DNA, 13 bp, Homo sapiens
tcatagtttaatt

SEQ ID NO: 2933668 - DNA, 17 bp, Homo sapiens
tcatataccagcaatat

SEQ ID NO: 2933669 - DNA, 15 bp, Homo sapiens
tcatatcccgtgaaa

SEQ ID NO: 2933670 - DNA, 16 bp, Homo sapiens
tcatatctctcccttc

SEQ ID NO: 2933671 - DNA, 24 bp, Homo sapiens
tcatatctctcccttctttacctt

SEQ ID NO: 2933672 - DNA, 20 bp, Homo sapiens
tcatatctcttgcccttcct

SEQ ID NO: 2933673 - DNA, 20 bp, Homo sapiens
tcatatgcaaagcatattaa

SEQ ID NO: 2933674 - DNA, 12 bp, Homo sapiens
tcatattgaata

SEQ ID NO: 2933675 - DNA, 13 bp, Homo sapiens
tcatatttgaaaa

SEQ ID NO: 2933676 - DNA, 14 bp, Homo sapiens
tcatatttttcctt

SEQ ID NO: 2933677 - DNA, 22 bp, Homo sapiens
tcatcaaataaaccttgtttct

SEQ ID NO: 2933678 - DNA, 13 bp, Homo sapiens
tcatcaacaatga

SEQ ID NO: 2933679 - DNA, 16 bp, Homo sapiens
tcatcaatgtgacatt

SEQ ID NO: 2933680 - DNA, 20 bp, Homo sapiens
tcatcaatttgtaattttag

SEQ ID NO: 2933681 - DNA, 17 bp, Homo sapiens
tcatcacaattagggaa

SEQ ID NO: 2933682 - DNA, 15 bp, Homo sapiens
tcatcacacacatgg

SEQ ID NO: 2933683 - DNA, 20 bp, Homo sapiens
tcatcacacccttttaacat

SEQ ID NO: 2933684 - DNA, 14 bp, Homo sapiens
tcatcacactgggt

SEQ ID NO: 2933685 - DNA, 15 bp, Homo sapiens
tcatcactgtggctg

SEQ ID NO: 2933686 - DNA, 13 bp, Homo sapiens
tcatcagggaggg

SEQ ID NO: 2933687 - DNA, 20 bp, Homo sapiens
tcatcagtaagtataacaaa

SEQ ID NO: 2933688 - DNA, 21 bp, Homo sapiens
tcatcatctcttgataaagga

SEQ ID NO: 2933689 - DNA, 17 bp, Homo sapiens
tcatcatctttttgtgt

SEQ ID NO: 2933690 - DNA, 20 bp, Homo sapiens
tcatcatctttttgtgtgca

SEQ ID NO: 2933691 - DNA, 21 bp, Homo sapiens
tcatcatgttgaccaggctgg

SEQ ID NO: 2933692 - DNA, 15 bp, Homo sapiens
tcatcattccctctc

SEQ ID NO: 2933693 - DNA, 13 bp, Homo sapiens
tcatcatttcagc

SEQ ID NO: 2933694 - DNA, 15 bp, Homo sapiens
tcatcatttcagcca

SEQ ID NO: 2933695 - DNA, 18 bp, Homo sapiens
tcatcatttcagccaaag

SEQ ID NO: 2933696 - DNA, 16 bp, Homo sapiens
tcatccacattgtttt

SEQ ID NO: 2933697 - DNA, 22 bp, Homo sapiens
tcatccagctacttagctggcc

SEQ ID NO: 2933698 - DNA, 17 bp, Homo sapiens
tcatccatcatctgctg

SEQ ID NO: 2933699 - DNA, 23 bp, Homo sapiens
tcatcccgagcacctccacatcc

SEQ ID NO: 2933700 - DNA, 18 bp, Homo sapiens
tcatcctattacttttca

SEQ ID NO: 2933701 - DNA, 20 bp, Homo sapiens
tcatcctattacttttcatc

SEQ ID NO: 2933702 - DNA, 13 bp, Homo sapiens
tcatcctcaggaa

SEQ ID NO: 2933703 - DNA, 21 bp, Homo sapiens
tcatcctccagtaccttgctt

SEQ ID NO: 2933704 - DNA, 12 bp, Homo sapiens
tcatcctcctcc

SEQ ID NO: 2933705 - DNA, 14 bp, Homo sapiens
tcatcctcctcctc

SEQ ID NO: 2933706 - DNA, 16 bp, Homo sapiens
tcatcctcctcctcat

SEQ ID NO: 2933707 - DNA, 15 bp, Homo sapiens
tcatcctgcttctct

SEQ ID NO: 2933708 - DNA, 21 bp, Homo sapiens
tcatcctgcttctcttttcct

SEQ ID NO: 2933709 - DNA, 11 bp, Homo sapiens
tcatcctgtgt

SEQ ID NO: 2933710 - DNA, 12 bp, Homo sapiens
tcatcctgtgtc

SEQ ID NO: 2933711 - DNA, 16 bp, Homo sapiens
tcatcctttgttctga

SEQ ID NO: 2933712 - DNA, 17 bp, Homo sapiens
tcatccttttttctctt

SEQ ID NO: 2933713 - DNA, 19 bp, Homo sapiens
tcatccttttttctcttct

SEQ ID NO: 2933714 - DNA, 15 bp, Homo sapiens
tcatcggctttcccc

SEQ ID NO: 2933715 - DNA, 16 bp, Homo sapiens
tcatcgggcccaggga

SEQ ID NO: 2933716 - DNA, 13 bp, Homo sapiens
tcatcgtctttta

SEQ ID NO: 2933717 - DNA, 16 bp, Homo sapiens
tcatcgtcttttagtt

SEQ ID NO: 2933718 - DNA, 18 bp, Homo sapiens
tcatcgttccccacccct

SEQ ID NO: 2933719 - DNA, 18 bp, Homo sapiens
tcatctagcgcaattgaa

SEQ ID NO: 2933720 - DNA, 22 bp, Homo sapiens
tcatctatagttgatatgtttt

SEQ ID NO: 2933721 - DNA, 20 bp, Homo sapiens
tcatctcaggcctccctcaa

SEQ ID NO: 2933722 - DNA, 16 bp, Homo sapiens
tcatctcaggtagaag

SEQ ID NO: 2933723 - DNA, 22 bp, Homo sapiens
tcatctccagtatcctgctggt

SEQ ID NO: 2933724 - DNA, 22 bp, Homo sapiens
tcatctcccacctagcagcacc

SEQ ID NO: 2933725 - DNA, 20 bp, Homo sapiens
tcatctccctgccatccccc

SEQ ID NO: 2933726 - DNA, 23 bp, Homo sapiens
tcatctccctgccatccccctct

SEQ ID NO: 2933727 - DNA, 16 bp, Homo sapiens
tcatctctctgcccaa

SEQ ID NO: 2933728 - DNA, 18 bp, Homo sapiens
tcccagacacccaccctc

SEQ ID NO: 2933729 - DNA, 18 bp, Homo sapiens
tcccagagacaggaaaat

SEQ ID NO: 2933730 - DNA, 22 bp, Homo sapiens
tcccagagctggtggacccagg

SEQ ID NO: 2933731 - DNA, 20 bp, Homo sapiens
tcccagagtgctgggattac

SEQ ID NO: 2933732 - DNA, 12 bp, Homo sapiens
tcccagagtttg

SEQ ID NO: 2933733 - DNA, 22 bp, Homo sapiens
tcccagcactttgagaggctga

SEQ ID NO: 2933734 - DNA, 19 bp, Homo sapiens
tcccagcactttgggaggc

SEQ ID NO: 2933735 - DNA, 23 bp, Homo sapiens
tcccagcactttgggaggcaggg

SEQ ID NO: 2933736 - DNA, 11 bp, Homo sapiens
tcccagcccaa

SEQ ID NO: 2933737 - DNA, 17 bp, Homo sapiens
tcccagcgagccacagg

SEQ ID NO: 2933738 - DNA, 20 bp, Homo sapiens
tcccagcggcctcagggtct

SEQ ID NO: 2933739 - DNA, 15 bp, Homo sapiens
tcccagctactcagg

SEQ ID NO: 2933740 - DNA, 22 bp, Homo sapiens
tcccagctactcaggaggctga

SEQ ID NO: 2933741 - DNA, 21 bp, Homo sapiens
tcccagctacttgggagcctg

SEQ ID NO: 2933742 - DNA, 14 bp, Homo sapiens
tcccagctctccct

SEQ ID NO: 2933743 - DNA, 15 bp, Homo sapiens
tcccaggaagcaggg

SEQ ID NO: 2933744 - DNA, 23 bp, Homo sapiens
tcccaggaagcagggagagttgg

SEQ ID NO: 2933745 - DNA, 19 bp, Homo sapiens
tcccaggaccctgaagggg

SEQ ID NO: 2933746 - DNA, 15 bp, Homo sapiens
tcccaggagaccatt

SEQ ID NO: 2933747 - DNA, 16 bp, Homo sapiens
tcccaggccagggctg

SEQ ID NO: 2933748 - DNA, 19 bp, Homo sapiens
tcccaggccagggctgggt

SEQ ID NO: 2933749 - DNA, 16 bp, Homo sapiens
tcccagggacacctgg

SEQ ID NO: 2933750 - DNA, 21 bp, Homo sapiens
tcccaggtagctgggattaca

SEQ ID NO: 2933751 - DNA, 17 bp, Homo sapiens
tcccaggtgcagccaga

SEQ ID NO: 2933752 - DNA, 21 bp, Homo sapiens
tcccaggtgttaacattccaa

SEQ ID NO: 2933753 - DNA, 18 bp, Homo sapiens
tcccagtagtgtttggaa

SEQ ID NO: 2933754 - DNA, 12 bp, Homo sapiens
tcccagtgcctt

SEQ ID NO: 2933755 - DNA, 16 bp, Homo sapiens
tcccagtttctgctgt

SEQ ID NO: 2933756 - DNA, 13 bp, Homo sapiens
tcccatagatttg

SEQ ID NO: 2933757 - DNA, 14 bp, Homo sapiens
tcccatcagggaag

SEQ ID NO: 2933758 - DNA, 15 bp, Homo sapiens
tcccatcatcctttg

SEQ ID NO: 2933759 - DNA, 17 bp, Homo sapiens
tcccatcctccagccct

SEQ ID NO: 2933760 - DNA, 13 bp, Homo sapiens
tcccatgtagccc

SEQ ID NO: 2933761 - DNA, 21 bp, Homo sapiens
tcccatgtagccccctggcct

SEQ ID NO: 2933762 - DNA, 13 bp, Homo sapiens
tcccatgtgcata

SEQ ID NO: 2933763 - DNA, 15 bp, Homo sapiens
tcccattcctgaaga

SEQ ID NO: 2933764 - DNA, 13 bp, Homo sapiens
tcccattgccctg

SEQ ID NO: 2933765 - DNA, 18 bp, Homo sapiens
tcccattgtccctctgcc

SEQ ID NO: 2933766 - DNA, 13 bp, Homo sapiens
tcccatttcagga

SEQ ID NO: 2933767 - DNA, 17 bp, Homo sapiens
tcccatttcgtgtaata

SEQ ID NO: 2933768 - DNA, 15 bp, Homo sapiens
tcccatttgtaattt

SEQ ID NO: 2933769 - DNA, 19 bp, Homo sapiens
tcccatttgttgctgctgc

SEQ ID NO: 2933770 - DNA, 21 bp, Homo sapiens
tcccatttgttgctgctgctg

SEQ ID NO: 2933771 - DNA, 19 bp, Homo sapiens
tccccaaagccactggaag

SEQ ID NO: 2933772 - DNA, 14 bp, Homo sapiens
tccccaaatccgaa

SEQ ID NO: 2933773 - DNA, 14 bp, Homo sapiens
tccccaacagtgtg

SEQ ID NO: 2933774 - DNA, 18 bp, Homo sapiens
tccccaacagtgtgaagt

SEQ ID NO: 2933775 - DNA, 19 bp, Homo sapiens
tccccaacagtgtgaagtt

SEQ ID NO: 2933776 - DNA, 21 bp, Homo sapiens
tccccaacagtgtgaagttag

SEQ ID NO: 2933777 - DNA, 23 bp, Homo sapiens
tccccaacagtgtgaagttagaa

SEQ ID NO: 2933778 - DNA, 13 bp, Homo sapiens
tccccaactccct

SEQ ID NO: 2933779 - DNA, 17 bp, Homo sapiens
tccccaatgagacttgc

SEQ ID NO: 2933780 - DNA, 16 bp, Homo sapiens
tccccacagactgccc

SEQ ID NO: 2933781 - DNA, 18 bp, Homo sapiens
tccccacagactgcccca

SEQ ID NO: 2933782 - DNA, 23 bp, Homo sapiens
tccccacagactgccccagccaa

SEQ ID NO: 2933783 - DNA, 14 bp, Homo sapiens
tccccaccagagct

SEQ ID NO: 2933784 - DNA, 17 bp, Homo sapiens
tccccacccaagagagg

SEQ ID NO: 2933785 - DNA, 18 bp, Homo sapiens
tccccacccaagagagga

SEQ ID NO: 2933786 - DNA, 13 bp, Homo sapiens
tccccaccccttc

SEQ ID NO: 2933787 - DNA, 15 bp, Homo sapiens
tccccaccctcctgg

SEQ ID NO: 2933788 - DNA, 16 bp, Homo sapiens
tccccaccctcctggc

SEQ ID NO: 2933789 - DNA, 14 bp, Homo sapiens
tccccacctccagg

SEQ ID NO: 2933790 - DNA, 15 bp, Homo sapiens
tccccactgtatcta

SEQ ID NO: 2933791 - DNA, 19 bp, Homo sapiens
tccccacttgcagccctgt

SEQ ID NO: 2933792 - DNA, 17 bp, Homo sapiens
tccccagaatggaggca

SEQ ID NO: 2933793 - DNA, 17 bp, Homo sapiens
tccccagactctgccta

SEQ ID NO: 2933794 - DNA, 18 bp, Homo sapiens
tccccagacttgcactgg

SEQ ID NO: 2933795 - DNA, 15 bp, Homo sapiens
tccccagagcccagc

SEQ ID NO: 2933796 - DNA, 16 bp, Homo sapiens
tccccagagcccagct

SEQ ID NO: 2933797 - DNA, 21 bp, Homo sapiens
tccccagagcccagctcttgc

SEQ ID NO: 2933798 - DNA, 22 bp, Homo sapiens
tccccagagcccagctcttgct

SEQ ID NO: 2933799 - DNA, 15 bp, Homo sapiens
tccccagatatttat

SEQ ID NO: 2933800 - DNA, 13 bp, Homo sapiens
tccccagccacag

SEQ ID NO: 2933801 - DNA, 15 bp, Homo sapiens
tccccagcccagaga

SEQ ID NO: 2933802 - DNA, 18 bp, Homo sapiens
tccccagcctctcctcct

SEQ ID NO: 2933803 - DNA, 20 bp, Homo sapiens
tccccaggaagcccactgcc

SEQ ID NO: 2933804 - DNA, 11 bp, Homo sapiens
tccccaggccc

SEQ ID NO: 2933805 - DNA, 18 bp, Homo sapiens
tccccaggcctggctccc

SEQ ID NO: 2933806 - DNA, 15 bp, Homo sapiens
tccccaggtggctga

SEQ ID NO: 2933807 - DNA, 18 bp, Homo sapiens
tccccaggtggctgaccc

SEQ ID NO: 2933808 - DNA, 19 bp, Homo sapiens
tccccaggtggctgaccca

SEQ ID NO: 2933809 - DNA, 22 bp, Homo sapiens
tccccaggtggctgacccagtc

SEQ ID NO: 2933810 - DNA, 15 bp, Homo sapiens
tccccatatttgtgt

SEQ ID NO: 2933811 - DNA, 17 bp, Homo sapiens
tccccatcggccctgtc

SEQ ID NO: 2933812 - DNA, 18 bp, Homo sapiens
tccccatcggccctgtcc

SEQ ID NO: 2933813 - DNA, 13 bp, Homo sapiens
tccccatctcagg

SEQ ID NO: 2933814 - DNA, 17 bp, Homo sapiens
tccccatctgtcggcct

SEQ ID NO: 2933815 - DNA, 13 bp, Homo sapiens
tccccatctgtgt

SEQ ID NO: 2933816 - DNA, 14 bp, Homo sapiens
tccccatctgtgtt

SEQ ID NO: 2933817 - DNA, 14 bp, Homo sapiens
tccccatcttctaa

SEQ ID NO: 2933818 - DNA, 16 bp, Homo sapiens
tccccatgcctgtggc

SEQ ID NO: 2933819 - DNA, 18 bp, Homo sapiens
tccccatgcctgtggctg

SEQ ID NO: 2933820 - DNA, 14 bp, Homo sapiens
tcccccaaccaagg

SEQ ID NO: 2933821 - DNA, 19 bp, Homo sapiens
tcccccaaccaaggaagga

SEQ ID NO: 2933822 - DNA, 21 bp, Homo sapiens
tcccccaaccaaggaaggagc

SEQ ID NO: 2933823 - DNA, 18 bp, Homo sapiens
tcccccaccccctcccca

SEQ ID NO: 2933824 - DNA, 19 bp, Homo sapiens
tcccccaccccctccccag

SEQ ID NO: 2933825 - DNA, 21 bp, Homo sapiens
tcccccaccccctccccaggg

SEQ ID NO: 2933826 - DNA, 12 bp, Homo sapiens
tcccccaccctg

SEQ ID NO: 2933827 - DNA, 14 bp, Homo sapiens
tcccccaccctggg

SEQ ID NO: 2933828 - DNA, 15 bp, Homo sapiens
tcccccaccctgggt

SEQ ID NO: 2933829 - DNA, 21 bp, Homo sapiens
tcccccacgtctctctgcctg

SEQ ID NO: 2933830 - DNA, 22 bp, Homo sapiens
tcccccacgtctctctgcctgc

SEQ ID NO: 2933831 - DNA, 11 bp, Homo sapiens
tcccccactcc

SEQ ID NO: 2933832 - DNA, 17 bp, Homo sapiens
tcccccatagcaccctg

SEQ ID NO: 2933833 - DNA, 17 bp, Homo sapiens
tccccccaatccctcaa

SEQ ID NO: 2933834 - DNA, 12 bp, Homo sapiens
tccccccactgc

SEQ ID NO: 2933835 - DNA, 17 bp, Homo sapiens
tcccccccatgcactgt

SEQ ID NO: 2933836 - DNA, 15 bp, Homo sapiens
tcccccctcctctga

SEQ ID NO: 2933837 - DNA, 17 bp, Homo sapiens
tcccccctcctctgaaa

SEQ ID NO: 2933838 - DNA, 16 bp, Homo sapiens
tcccccgactgcctgt

SEQ ID NO: 2933839 - DNA, 15 bp, Homo sapiens
tcccccggctgggcc

SEQ ID NO: 2933840 - DNA, 19 bp, Homo sapiens
tcccccggctgggcctcct

SEQ ID NO: 2933841 - DNA, 17 bp, Homo sapiens
tccccctaccgcatggc

SEQ ID NO: 2933842 - DNA, 18 bp, Homo sapiens
tccccctaccgcatggca

SEQ ID NO: 2933843 - DNA, 22 bp, Homo sapiens
tccccctaccgcatggcagctg

SEQ ID NO: 2933844 - DNA, 23 bp, Homo sapiens
tccccctaccgcatggcagctgg

SEQ ID NO: 2933845 - DNA, 11 bp, Homo sapiens
tccccctctgc

SEQ ID NO: 2933846 - DNA, 14 bp, Homo sapiens
tccccctctgcttc

SEQ ID NO: 2933847 - DNA, 17 bp, Homo sapiens
tccccctgccagtgcct

SEQ ID NO: 2933848 - DNA, 14 bp, Homo sapiens
tccccctgccctgt

SEQ ID NO: 2933849 - DNA, 20 bp, Homo sapiens
tccccctgccctgtgccgca

SEQ ID NO: 2933850 - DNA, 15 bp, Homo sapiens
tccccgaggctgccc

SEQ ID NO: 2933851 - DNA, 16 bp, Homo sapiens
tccccgaggctgcccc

SEQ ID NO: 2933852 - DNA, 22 bp, Homo sapiens
tccccgaggctgccccaggccg

SEQ ID NO: 2933853 - DNA, 23 bp, Homo sapiens
tccccgaggttgtggggaggctg

SEQ ID NO: 2933854 - DNA, 14 bp, Homo sapiens
tccccgatgctgac

SEQ ID NO: 2933855 - DNA, 18 bp, Homo sapiens
tccccgcattccaggctc

SEQ ID NO: 2933856 - DNA, 22 bp, Homo sapiens
tccccgcgtccgagaaggcgga

SEQ ID NO: 2933857 - DNA, 15 bp, Homo sapiens
tccccgctgctgtgc

SEQ ID NO: 2933858 - DNA, 17 bp, Homo sapiens
tccccgctgctgtgcaa

SEQ ID NO: 2933859 - DNA, 17 bp, Homo sapiens
tccccgggcatctttgg

SEQ ID NO: 2933860 - DNA, 21 bp, Homo sapiens
tccccgggcatctttggggag

SEQ ID NO: 2933861 - DNA, 18 bp, Homo sapiens
tccttaaaaatcacactg

SEQ ID NO: 2933862 - DNA, 19 bp, Homo sapiens
tccttaaaaatcacactgt

SEQ ID NO: 2933863 - DNA, 18 bp, Homo sapiens
tccttaaaatgtaagatt

SEQ ID NO: 2933864 - DNA, 18 bp, Homo sapiens
tccttacccatctgcacc

SEQ ID NO: 2933865 - DNA, 17 bp, Homo sapiens
tccttactcagagctgc

SEQ ID NO: 2933866 - DNA, 19 bp, Homo sapiens
tccttactcagagctgcgg

SEQ ID NO: 2933867 - DNA, 18 bp, Homo sapiens
tccttagacctgagggac

SEQ ID NO: 2933868 - DNA, 23 bp, Homo sapiens
tccttagacctgagggacccttc

SEQ ID NO: 2933869 - DNA, 18 bp, Homo sapiens
tccttagatctggcatgt

SEQ ID NO: 2933870 - DNA, 14 bp, Homo sapiens
tccttagtggtaga

SEQ ID NO: 2933871 - DNA, 14 bp, Homo sapiens
tccttatttcaagg

SEQ ID NO: 2933872 - DNA, 14 bp, Homo sapiens
tccttcaaaacatt

SEQ ID NO: 2933873 - DNA, 23 bp, Homo sapiens
tccttcaaaacattctcctttgc

SEQ ID NO: 2933874 - DNA, 15 bp, Homo sapiens
tccttcaattccata

SEQ ID NO: 2933875 - DNA, 15 bp, Homo sapiens
tccttcacatctccc

SEQ ID NO: 2933876 - DNA, 18 bp, Homo sapiens
tccttcacatctcccatg

SEQ ID NO: 2933877 - DNA, 22 bp, Homo sapiens
tccttcactcctgcctcctcag

SEQ ID NO: 2933878 - DNA, 23 bp, Homo sapiens
tccttcactggcgccttctcgga

SEQ ID NO: 2933879 - DNA, 12 bp, Homo sapiens
tccttcagacac

SEQ ID NO: 2933880 - DNA, 18 bp, Homo sapiens
tccttcagggtgatgcca

SEQ ID NO: 2933881 - DNA, 21 bp, Homo sapiens
tccttccaacaggagctggga

SEQ ID NO: 2933882 - DNA, 15 bp, Homo sapiens
tccttccagaagagt

SEQ ID NO: 2933883 - DNA, 18 bp, Homo sapiens
tccttccatgctcccaac

SEQ ID NO: 2933884 - DNA, 22 bp, Homo sapiens
tccttcccaagtaagaggctgg

SEQ ID NO: 2933885 - DNA, 18 bp, Homo sapiens
tccttccccttgtccctg

SEQ ID NO: 2933886 - DNA, 19 bp, Homo sapiens
tccttccccttgtccctgg

SEQ ID NO: 2933887 - DNA, 20 bp, Homo sapiens
tccttccccttgtccctggg

SEQ ID NO: 2933888 - DNA, 15 bp, Homo sapiens
tccttccttccctgg

SEQ ID NO: 2933889 - DNA, 19 bp, Homo sapiens
tccttctcattgctgcccg

SEQ ID NO: 2933890 - DNA, 21 bp, Homo sapiens
tccttctcttctcttctttgg

SEQ ID NO: 2933891 - DNA, 14 bp, Homo sapiens
tccttctctttaaa

SEQ ID NO: 2933892 - DNA, 22 bp, Homo sapiens
tccttctgcaactgaaattaca

SEQ ID NO: 2933893 - DNA, 15 bp, Homo sapiens
tccttctgtgaagaa

SEQ ID NO: 2933894 - DNA, 19 bp, Homo sapiens
tccttctgtgaagaagccc

SEQ ID NO: 2933895 - DNA, 22 bp, Homo sapiens
tccttctgtgaagaagccctgt

SEQ ID NO: 2933896 - DNA, 23 bp, Homo sapiens
tccttctgtgaagaagccctgtt

SEQ ID NO: 2933897 - DNA, 18 bp, Homo sapiens
tccttcttcctcaagtct

SEQ ID NO: 2933898 - DNA, 23 bp, Homo sapiens
tccttgaagacatatcatgtgtg

SEQ ID NO: 2933899 - DNA, 20 bp, Homo sapiens
tccttgactgaagcgaacat

SEQ ID NO: 2933900 - DNA, 23 bp, Homo sapiens
tccttgactgaagcgaacatctt

SEQ ID NO: 2933901 - DNA, 17 bp, Homo sapiens
tccttgagacacggagc

SEQ ID NO: 2933902 - DNA, 17 bp, Homo sapiens
tccttgagattctgaag

SEQ ID NO: 2933903 - DNA, 16 bp, Homo sapiens
tccttggaggacagtg

SEQ ID NO: 2933904 - DNA, 18 bp, Homo sapiens
tccttggaggacagtggg

SEQ ID NO: 2933905 - DNA, 16 bp, Homo sapiens
tccttggcaactttct

SEQ ID NO: 2933906 - DNA, 23 bp, Homo sapiens
tccttggcaggctgatttctagg

SEQ ID NO: 2933907 - DNA, 18 bp, Homo sapiens
tccttggctgtatccatg

SEQ ID NO: 2933908 - DNA, 20 bp, Homo sapiens
tccttgggaggccccactgg

SEQ ID NO: 2933909 - DNA, 20 bp, Homo sapiens
tccttgggcagggtctctgc

SEQ ID NO: 2933910 - DNA, 22 bp, Homo sapiens
tccttgggcagggtctctgctc

SEQ ID NO: 2933911 - DNA, 15 bp, Homo sapiens
tccttggggcaggca

SEQ ID NO: 2933912 - DNA, 16 bp, Homo sapiens
tccttggggcaggcag

SEQ ID NO: 2933913 - DNA, 18 bp, Homo sapiens
tccttggtgcctggcctg

SEQ ID NO: 2933914 - DNA, 19 bp, Homo sapiens
tccttgttacccatgaaaa

SEQ ID NO: 2933915 - DNA, 13 bp, Homo sapiens
tccttgtttcaaa

SEQ ID NO: 2933916 - DNA, 17 bp, Homo sapiens
tcctttaaatccttcca

SEQ ID NO: 2933917 - DNA, 14 bp, Homo sapiens
tcctttacagctgt

SEQ ID NO: 2933918 - DNA, 15 bp, Homo sapiens
tcctttacagctgtt

SEQ ID NO: 2933919 - DNA, 16 bp, Homo sapiens
tcctttactcctggct

SEQ ID NO: 2933920 - DNA, 15 bp, Homo sapiens
tcctttatactgtga

SEQ ID NO: 2933921 - DNA, 19 bp, Homo sapiens
tcctttatactgtgaagtt

SEQ ID NO: 2933922 - DNA, 20 bp, Homo sapiens
tcctttatactgtgaagtta

SEQ ID NO: 2933923 - DNA, 20 bp, Homo sapiens
tcctttatattttttgtctg

SEQ ID NO: 2933924 - DNA, 16 bp, Homo sapiens
tcctttatttctgata

SEQ ID NO: 2933925 - DNA, 17 bp, Homo sapiens
tcctttcaccccagggc

SEQ ID NO: 2933926 - DNA, 14 bp, Homo sapiens
tcctttcagccaca

SEQ ID NO: 2933927 - DNA, 23 bp, Homo sapiens
tcctttcagccacatgccccagg

SEQ ID NO: 2933928 - DNA, 14 bp, Homo sapiens
tcctttccatctgt

SEQ ID NO: 2933929 - DNA, 13 bp, Homo sapiens
tcctttcccaagc

SEQ ID NO: 2933930 - DNA, 21 bp, Homo sapiens
tcctttcccaagccttcgggc

SEQ ID NO: 2933931 - DNA, 18 bp, Homo sapiens
tcctttctctgtatattg

SEQ ID NO: 2933932 - DNA, 18 bp, Homo sapiens
tcctttctgccccccagg

SEQ ID NO: 2933933 - DNA, 22 bp, Homo sapiens
tcctttgatattatgtggcttt

SEQ ID NO: 2933934 - DNA, 15 bp, Homo sapiens
tcctttggcatgttt

SEQ ID NO: 2933935 - DNA, 19 bp, Homo sapiens
tcctttggcatgtttaatt

SEQ ID NO: 2933936 - DNA, 21 bp, Homo sapiens
tcctttggcatgtttaattgt

SEQ ID NO: 2933937 - DNA, 18 bp, Homo sapiens
tcctttggtatttcactg

SEQ ID NO: 2933938 - DNA, 19 bp, Homo sapiens
tcctttgtatattatttct

SEQ ID NO: 2933939 - DNA, 23 bp, Homo sapiens
tcctttgtatattatttctagga

SEQ ID NO: 2933940 - DNA, 19 bp, Homo sapiens
tcctttgttgtctacatta

SEQ ID NO: 2933941 - DNA, 13 bp, Homo sapiens
tccttttctttct

SEQ ID NO: 2933942 - DNA, 17 bp, Homo sapiens
tccttttgaacttgtca

SEQ ID NO: 2933943 - DNA, 18 bp, Homo sapiens
tccttttgaccttcattt

SEQ ID NO: 2933944 - DNA, 20 bp, Homo sapiens
tccttttgaccttcatttca

SEQ ID NO: 2933945 - DNA, 13 bp, Homo sapiens
tccttttgtaaag

SEQ ID NO: 2933946 - DNA, 14 bp, Homo sapiens
tccttttgtaaagt

SEQ ID NO: 2933947 - DNA, 21 bp, Homo sapiens
tccttttgtaaagtgaagaat

SEQ ID NO: 2933948 - DNA, 17 bp, Homo sapiens
tccttttgtagaatgaa

SEQ ID NO: 2933949 - DNA, 17 bp, Homo sapiens
tcctttttaaatgtgaa

SEQ ID NO: 2933950 - DNA, 21 bp, Homo sapiens
tcctttttaaatgtgaatttt

SEQ ID NO: 2933951 - DNA, 14 bp, Homo sapiens
tcctttttctgcta

SEQ ID NO: 2933952 - DNA, 14 bp, Homo sapiens
tcctttttgttatt

SEQ ID NO: 2933953 - DNA, 17 bp, Homo sapiens
tccttttttctcttctg

SEQ ID NO: 2933954 - DNA, 17 bp, Homo sapiens
tcctttttttaaatttt

SEQ ID NO: 2933955 - DNA, 19 bp, Homo sapiens
tcctttttttaaattttct

SEQ ID NO: 2933956 - DNA, 24 bp, Homo sapiens
tcctttttttaaattttctccagt

SEQ ID NO: 2933957 - DNA, 21 bp, Homo sapiens
tcctttttttccatctttaca

SEQ ID NO: 2933958 - DNA, 19 bp, Homo sapiens
tcgaaacctgggattcagg

SEQ ID NO: 2933959 - DNA, 16 bp, Homo sapiens
tcgaaagtgtcatcaa

SEQ ID NO: 2933960 - DNA, 18 bp, Homo sapiens
tcgaaagtgtcatcaatt

SEQ ID NO: 2933961 - DNA, 14 bp, Homo sapiens
tcgaacatgtttca

SEQ ID NO: 2933962 - DNA, 17 bp, Homo sapiens
tcgaacatgtttcactt

SEQ ID NO: 2933963 - DNA, 18 bp, Homo sapiens
tcgaaccgttttgaagct

SEQ ID NO: 2933964 - DNA, 14 bp, Homo sapiens
tcgaactcctgacc

SEQ ID NO: 2933965 - DNA, 13 bp, Homo sapiens
tcgaactgtgctc

SEQ ID NO: 2933966 - DNA, 15 bp, Homo sapiens
tcgaactgtgctccc

SEQ ID NO: 2933967 - DNA, 17 bp, Homo sapiens
tcgaactgtgctcccac

SEQ ID NO: 2933968 - DNA, 19 bp, Homo sapiens
tcgaagcaatcagcaaaca

SEQ ID NO: 2933969 - DNA, 12 bp, Homo sapiens
tcgaagtcatta

SEQ ID NO: 2933970 - DNA, 17 bp, Homo sapiens
tcgaagtcattaaactg

SEQ ID NO: 2933971 - DNA, 16 bp, Homo sapiens
tcgaagttcattttta

SEQ ID NO: 2933972 - DNA, 20 bp, Homo sapiens
tcgaatctactaattccaca

SEQ ID NO: 2933973 - DNA, 14 bp, Homo sapiens
tcgaatgacactgt

SEQ ID NO: 2933974 - DNA, 14 bp, Homo sapiens
tcgagacagaacct

SEQ ID NO: 2933975 - DNA, 17 bp, Homo sapiens
tcgagaccagcctggcc

SEQ ID NO: 2933976 - DNA, 18 bp, Homo sapiens
tcgagaccagcctgggca

SEQ ID NO: 2933977 - DNA, 19 bp, Homo sapiens
tcgagagctggccaaagag

SEQ ID NO: 2933978 - DNA, 15 bp, Homo sapiens
tcgagctacatgcat

SEQ ID NO: 2933979 - DNA, 20 bp, Homo sapiens
tcgaggctgcagtcagccct

SEQ ID NO: 2933980 - DNA, 19 bp, Homo sapiens
tcgagggccgcctgcctta

SEQ ID NO: 2933981 - DNA, 17 bp, Homo sapiens
tcgaggtgccttcttca

SEQ ID NO: 2933982 - DNA, 23 bp, Homo sapiens
tcgaggtgccttcttcagggcct

SEQ ID NO: 2933983 - DNA, 16 bp, Homo sapiens
tcgagtactgtgggca

SEQ ID NO: 2933984 - DNA, 17 bp, Homo sapiens
tcgagtactgtgggcaa

SEQ ID NO: 2933985 - DNA, 14 bp, Homo sapiens
tcgatgcaatgaac

SEQ ID NO: 2933986 - DNA, 16 bp, Homo sapiens
tcgatgcgtattctgt

SEQ ID NO: 2933987 - DNA, 12 bp, Homo sapiens
tcgatgctgctg

SEQ ID NO: 2933988 - DNA, 14 bp, Homo sapiens
tcgatgctgctggc

SEQ ID NO: 2933989 - DNA, 21 bp, Homo sapiens
tcgattagactggacagcttg

SEQ ID NO: 2933990 - DNA, 17 bp, Homo sapiens
tcgattcatattgaata

SEQ ID NO: 2933991 - DNA, 22 bp, Homo sapiens
tcgcaccactgcactccagcct

SEQ ID NO: 2933992 - DNA, 17 bp, Homo sapiens
tctcatctgtgattccc

SEQ ID NO: 2933993 - DNA, 18 bp, Homo sapiens
tctcatgcccctggctgg

SEQ ID NO: 2933994 - DNA, 21 bp, Homo sapiens
tctcatgcccctggctgggac

SEQ ID NO: 2933995 - DNA, 17 bp, Homo sapiens
tctcatgggaaggggag

SEQ ID NO: 2933996 - DNA, 18 bp, Homo sapiens
tctcatgttttccattgt

SEQ ID NO: 2933997 - DNA, 14 bp, Homo sapiens
tctcattccgttgt

SEQ ID NO: 2933998 - DNA, 18 bp, Homo sapiens
tctcattcctgttctttc

SEQ ID NO: 2933999 - DNA, 23 bp, Homo sapiens
tctcattgaggacaaagaaaact

SEQ ID NO: 2934000 - DNA, 19 bp, Homo sapiens
tctcattttgtccatgtcc

SEQ ID NO: 2934001 - DNA, 17 bp, Homo sapiens
tctcatttttccgtaaa

SEQ ID NO: 2934002 - DNA, 20 bp, Homo sapiens
tctccaagaatggaagcctg

SEQ ID NO: 2934003 - DNA, 13 bp, Homo sapiens
tctccaaggaaat

SEQ ID NO: 2934004 - DNA, 17 bp, Homo sapiens
tctccacaacactgtgt

SEQ ID NO: 2934005 - DNA, 11 bp, Homo sapiens
tctccacctca

SEQ ID NO: 2934006 - DNA, 12 bp, Homo sapiens
tctccacctcag

SEQ ID NO: 2934007 - DNA, 19 bp, Homo sapiens
tctccacttctggtcccct

SEQ ID NO: 2934008 - DNA, 14 bp, Homo sapiens
tctccagatgtttc

SEQ ID NO: 2934009 - DNA, 19 bp, Homo sapiens
tctccagatgtttccagac

SEQ ID NO: 2934010 - DNA, 15 bp, Homo sapiens
tctccagcattctca

SEQ ID NO: 2934011 - DNA, 20 bp, Homo sapiens
tctccagcctcacagatgct

SEQ ID NO: 2934012 - DNA, 19 bp, Homo sapiens
tctccagggccccccaact

SEQ ID NO: 2934013 - DNA, 18 bp, Homo sapiens
tctccagtccctgggagc

SEQ ID NO: 2934014 - DNA, 13 bp, Homo sapiens
tctccatactttg

SEQ ID NO: 2934015 - DNA, 17 bp, Homo sapiens
tctccatgcaagtgctg

SEQ ID NO: 2934016 - DNA, 14 bp, Homo sapiens
tctccatggccctg

SEQ ID NO: 2934017 - DNA, 18 bp, Homo sapiens
tctccatggccctgcaaa

SEQ ID NO: 2934018 - DNA, 23 bp, Homo sapiens
tctccatgtagaataaatgaaga

SEQ ID NO: 2934019 - DNA, 17 bp, Homo sapiens
tctcccacatcccactg

SEQ ID NO: 2934020 - DNA, 17 bp, Homo sapiens
tctcccaccccctcccc

SEQ ID NO: 2934021 - DNA, 21 bp, Homo sapiens
tctcccaccctaagggcagcc

SEQ ID NO: 2934022 - DNA, 22 bp, Homo sapiens
tctcccaccctaagggcagccc

SEQ ID NO: 2934023 - DNA, 18 bp, Homo sapiens
tctcccagataatgtgaa

SEQ ID NO: 2934024 - DNA, 18 bp, Homo sapiens
tctcccattgtccctctg

SEQ ID NO: 2934025 - DNA, 19 bp, Homo sapiens
tctcccattgtccctctgc

SEQ ID NO: 2934026 - DNA, 19 bp, Homo sapiens
tctccccaatgagacttgc

SEQ ID NO: 2934027 - DNA, 19 bp, Homo sapiens
tctccccacgagggctggc

SEQ ID NO: 2934028 - DNA, 20 bp, Homo sapiens
tctccccacgagggctggct

SEQ ID NO: 2934029 - DNA, 17 bp, Homo sapiens
tctccccagcccagaga

SEQ ID NO: 2934030 - DNA, 18 bp, Homo sapiens
tctccccagcccagagac

SEQ ID NO: 2934031 - DNA, 19 bp, Homo sapiens
tctccccagcccagagaca

SEQ ID NO: 2934032 - DNA, 15 bp, Homo sapiens
tctccccctctgtct

SEQ ID NO: 2934033 - DNA, 20 bp, Homo sapiens
tctccccctctgtcttctct

SEQ ID NO: 2934034 - DNA, 22 bp, Homo sapiens
tctccccgaggctgccccaggc

SEQ ID NO: 2934035 - DNA, 16 bp, Homo sapiens
tctcccctccccatct

SEQ ID NO: 2934036 - DNA, 17 bp, Homo sapiens
tctcccgtctcgcctgc

SEQ ID NO: 2934037 - DNA, 20 bp, Homo sapiens
tctccctaccttgcctcctt

SEQ ID NO: 2934038 - DNA, 23 bp, Homo sapiens
tctccctcacagcacagagaaga

SEQ ID NO: 2934039 - DNA, 18 bp, Homo sapiens
tctccctccgactccaga

SEQ ID NO: 2934040 - DNA, 19 bp, Homo sapiens
tctccctccgactccagat

SEQ ID NO: 2934041 - DNA, 21 bp, Homo sapiens
tctccctctaggctctgcctt

SEQ ID NO: 2934042 - DNA, 17 bp, Homo sapiens
tctccctctcactgtct

SEQ ID NO: 2934043 - DNA, 23 bp, Homo sapiens
tctccctctcactgtctgagagt

SEQ ID NO: 2934044 - DNA, 21 bp, Homo sapiens
tctccctctcctgcctactca

SEQ ID NO: 2934045 - DNA, 16 bp, Homo sapiens
tctccctctggccctg

SEQ ID NO: 2934046 - DNA, 18 bp, Homo sapiens
tctccctctggccctgcc

SEQ ID NO: 2934047 - DNA, 13 bp, Homo sapiens
tctccctctttct

SEQ ID NO: 2934048 - DNA, 14 bp, Homo sapiens
tctccctctttcta

SEQ ID NO: 2934049 - DNA, 15 bp, Homo sapiens
tctccctctttctag

SEQ ID NO: 2934050 - DNA, 21 bp, Homo sapiens
tctccctctttctagcctggg

SEQ ID NO: 2934051 - DNA, 13 bp, Homo sapiens
tctccctgccatc

SEQ ID NO: 2934052 - DNA, 17 bp, Homo sapiens
tctccctgccatccccc

SEQ ID NO: 2934053 - DNA, 21 bp, Homo sapiens
tctccctgccatccccctctc

SEQ ID NO: 2934054 - DNA, 22 bp, Homo sapiens
tctccctgccatccccctctca

SEQ ID NO: 2934055 - DNA, 14 bp, Homo sapiens
tctccctgccgcct

SEQ ID NO: 2934056 - DNA, 15 bp, Homo sapiens
tctccctgccgcctc

SEQ ID NO: 2934057 - DNA, 17 bp, Homo sapiens
tctccctgcctcacatc

SEQ ID NO: 2934058 - DNA, 21 bp, Homo sapiens
tctcccttacccatcttgctt

SEQ ID NO: 2934059 - DNA, 19 bp, Homo sapiens
tctcccttcccttccctca

SEQ ID NO: 2934060 - DNA, 19 bp, Homo sapiens
tctcccttctttaccttca

SEQ ID NO: 2934061 - DNA, 21 bp, Homo sapiens
tctcccttctttaccttcatt

SEQ ID NO: 2934062 - DNA, 20 bp, Homo sapiens
tctccgattttgctctgtct

SEQ ID NO: 2934063 - DNA, 16 bp, Homo sapiens
tctccggcgcagacag

SEQ ID NO: 2934064 - DNA, 14 bp, Homo sapiens
tctcctactctgtg

SEQ ID NO: 2934065 - DNA, 15 bp, Homo sapiens
tctcctactctgtgt

SEQ ID NO: 2934066 - DNA, 16 bp, Homo sapiens
tctcctagggctatgg

SEQ ID NO: 2934067 - DNA, 19 bp, Homo sapiens
tctcctaggggcttggtcc

SEQ ID NO: 2934068 - DNA, 18 bp, Homo sapiens
tctcctatatatttctat

SEQ ID NO: 2934069 - DNA, 19 bp, Homo sapiens
tctcctatatatttctatt

SEQ ID NO: 2934070 - DNA, 19 bp, Homo sapiens
tctcctatcttttatttca

SEQ ID NO: 2934071 - DNA, 21 bp, Homo sapiens
tctcctatcttttatttcatt

SEQ ID NO: 2934072 - DNA, 17 bp, Homo sapiens
tctcctccgtggcacat

SEQ ID NO: 2934073 - DNA, 16 bp, Homo sapiens
tctcctcgcaagctgg

SEQ ID NO: 2934074 - DNA, 22 bp, Homo sapiens
tctcctcgtcaatccatcagca

SEQ ID NO: 2934075 - DNA, 21 bp, Homo sapiens
tctcctcgttggttcatgtgt

SEQ ID NO: 2934076 - DNA, 18 bp, Homo sapiens
tctcctctcagcttctaa

SEQ ID NO: 2934077 - DNA, 13 bp, Homo sapiens
tctcctctttgaa

SEQ ID NO: 2934078 - DNA, 12 bp, Homo sapiens
tctcctgccaca

SEQ ID NO: 2934079 - DNA, 11 bp, Homo sapiens
tctcctgccta

SEQ ID NO: 2934080 - DNA, 14 bp, Homo sapiens
tctcctgcctactc

SEQ ID NO: 2934081 - DNA, 17 bp, Homo sapiens
tctcctgcctactcacg

SEQ ID NO: 2934082 - DNA, 13 bp, Homo sapiens
tctcctgcctcag

SEQ ID NO: 2934083 - DNA, 17 bp, Homo sapiens
tctcctgccttcctcct

SEQ ID NO: 2934084 - DNA, 12 bp, Homo sapiens
tctcctgccttt

SEQ ID NO: 2934085 - DNA, 12 bp, Homo sapiens
tctcctggacct

SEQ ID NO: 2934086 - DNA, 17 bp, Homo sapiens
tctcctggaccttgaca

SEQ ID NO: 2934087 - DNA, 23 bp, Homo sapiens
tctcctggaccttgacagagcag

SEQ ID NO: 2934088 - DNA, 15 bp, Homo sapiens
tctcctggactggtt

SEQ ID NO: 2934089 - DNA, 12 bp, Homo sapiens
tctcctggaggg

SEQ ID NO: 2934090 - DNA, 22 bp, Homo sapiens
tctcctggagggcgcccagcag

SEQ ID NO: 2934091 - DNA, 18 bp, Homo sapiens
tctcctgggccgttacat

SEQ ID NO: 2934092 - DNA, 14 bp, Homo sapiens
tctccttcaaaaca

SEQ ID NO: 2934093 - DNA, 13 bp, Homo sapiens
tctccttcctgtg

SEQ ID NO: 2934094 - DNA, 17 bp, Homo sapiens
tctccttctcttctctt

SEQ ID NO: 2934095 - DNA, 14 bp, Homo sapiens
tctccttcttagct

SEQ ID NO: 2934096 - DNA, 12 bp, Homo sapiens
tctccttggagg

SEQ ID NO: 2934097 - DNA, 14 bp, Homo sapiens
tctccttggaggac

SEQ ID NO: 2934098 - DNA, 23 bp, Homo sapiens
tctcctttcaccccagggcctga

SEQ ID NO: 2934099 - DNA, 18 bp, Homo sapiens
tctcctttgatattatgt

SEQ ID NO: 2934100 - DNA, 22 bp, Homo sapiens
tctcctttgtatattatttcta

SEQ ID NO: 2934101 - DNA, 12 bp, Homo sapiens
tctccttttgaa

SEQ ID NO: 2934102 - DNA, 14 bp, Homo sapiens
tctccttttgaact

SEQ ID NO: 2934103 - DNA, 15 bp, Homo sapiens
tctccttttgaactt

SEQ ID NO: 2934104 - DNA, 12 bp, Homo sapiens
tctcgagcttgg

SEQ ID NO: 2934105 - DNA, 16 bp, Homo sapiens
tctcgatgctgctggc

SEQ ID NO: 2934106 - DNA, 16 bp, Homo sapiens
tctcgcctaggatttc

SEQ ID NO: 2934107 - DNA, 15 bp, Homo sapiens
tctcggagctggccc

SEQ ID NO: 2934108 - DNA, 13 bp, Homo sapiens
tctcggccccatc

SEQ ID NO: 2934109 - DNA, 19 bp, Homo sapiens
tctcggccccctcacccca

SEQ ID NO: 2934110 - DNA, 16 bp, Homo sapiens
tctcggtgctccatct

SEQ ID NO: 2934111 - DNA, 20 bp, Homo sapiens
tctcgtcaggctgccagaga

SEQ ID NO: 2934112 - DNA, 12 bp, Homo sapiens
tctcgtctcctg

SEQ ID NO: 2934113 - DNA, 13 bp, Homo sapiens
tctcgttgcccta

SEQ ID NO: 2934114 - DNA, 14 bp, Homo sapiens
tctcgtttcaaaaa

SEQ ID NO: 2934115 - DNA, 21 bp, Homo sapiens
tctctaaagagtttattttaa

SEQ ID NO: 2934116 - DNA, 18 bp, Homo sapiens
tctctaactcagaaacat

SEQ ID NO: 2934117 - DNA, 15 bp, Homo sapiens
tctctaattctatta

SEQ ID NO: 2934118 - DNA, 22 bp, Homo sapiens
tctctacccctttctgttcgaa

SEQ ID NO: 2934119 - DNA, 16 bp, Homo sapiens
tctctacctaagaggg

SEQ ID NO: 2934120 - DNA, 17 bp, Homo sapiens
tctctatcattaaagtt

SEQ ID NO: 2934121 - DNA, 17 bp, Homo sapiens
tctctattgtaattttg

SEQ ID NO: 2934122 - DNA, 12 bp, Homo sapiens
tctctcagcccc

SEQ ID NO: 2934123 - DNA, 13 bp, Homo sapiens
tctctcagcccca

SEQ ID NO: 2934124 - DNA, 15 bp, Homo sapiens
tctctcagccccatc

SEQ ID NO: 2934125 - DNA, 13 bp, Homo sapiens
tctgcttcccagg

SEQ ID NO: 2934126 - DNA, 22 bp, Homo sapiens
tctgcttcccaggttcaagcga

SEQ ID NO: 2934127 - DNA, 20 bp, Homo sapiens
tctgctttaaattaaaattt

SEQ ID NO: 2934128 - DNA, 23 bp, Homo sapiens
tctgctttaaattaaaattttat

SEQ ID NO: 2934129 - DNA, 17 bp, Homo sapiens
tctgctttctgttcatc

SEQ ID NO: 2934130 - DNA, 14 bp, Homo sapiens
tctggaacccagac

SEQ ID NO: 2934131 - DNA, 16 bp, Homo sapiens
tctggaacccagactc

SEQ ID NO: 2934132 - DNA, 18 bp, Homo sapiens
tctggaacccagactcag

SEQ ID NO: 2934133 - DNA, 22 bp, Homo sapiens
tctggaacccagactcagacat

SEQ ID NO: 2934134 - DNA, 23 bp, Homo sapiens
tctggaacccagactcagacatt

SEQ ID NO: 2934135 - DNA, 18 bp, Homo sapiens
tctggaacctcagcctgg

SEQ ID NO: 2934136 - DNA, 21 bp, Homo sapiens
tctggaacctcagcctggcca

SEQ ID NO: 2934137 - DNA, 19 bp, Homo sapiens
tctggaatctggagaccag

SEQ ID NO: 2934138 - DNA, 18 bp, Homo sapiens
tctggacagccccaccct

SEQ ID NO: 2934139 - DNA, 19 bp, Homo sapiens
tctggacagccccaccctg

SEQ ID NO: 2934140 - DNA, 19 bp, Homo sapiens
tctggacaggatgtgtttg

SEQ ID NO: 2934141 - DNA, 17 bp, Homo sapiens
tctggaccaaggagcat

SEQ ID NO: 2934142 - DNA, 16 bp, Homo sapiens
tctggacgtgaaatac

SEQ ID NO: 2934143 - DNA, 16 bp, Homo sapiens
tctggagacagaacca

SEQ ID NO: 2934144 - DNA, 20 bp, Homo sapiens
tctggagacagaaccagcag

SEQ ID NO: 2934145 - DNA, 15 bp, Homo sapiens
tctggagaccaggga

SEQ ID NO: 2934146 - DNA, 19 bp, Homo sapiens
tctggagaccagggagcct

SEQ ID NO: 2934147 - DNA, 21 bp, Homo sapiens
tctggagaccagggagccttt

SEQ ID NO: 2934148 - DNA, 21 bp, Homo sapiens
tctggagcaacctactgtcta

SEQ ID NO: 2934149 - DNA, 13 bp, Homo sapiens
tctggagcccctc

SEQ ID NO: 2934150 - DNA, 16 bp, Homo sapiens
tctggagcccctcctc

SEQ ID NO: 2934151 - DNA, 19 bp, Homo sapiens
tctggaggttgataacttt

SEQ ID NO: 2934152 - DNA, 15 bp, Homo sapiens
tctggagtggccact

SEQ ID NO: 2934153 - DNA, 17 bp, Homo sapiens
tctggagttgatctgga

SEQ ID NO: 2934154 - DNA, 15 bp, Homo sapiens
tctggatccttccca

SEQ ID NO: 2934155 - DNA, 16 bp, Homo sapiens
tctggatccttcccaa

SEQ ID NO: 2934156 - DNA, 17 bp, Homo sapiens
tctggatccttcccaag

SEQ ID NO: 2934157 - DNA, 18 bp, Homo sapiens
tctggatccttcccaagg

SEQ ID NO: 2934158 - DNA, 14 bp, Homo sapiens
tctggatctgggac

SEQ ID NO: 2934159 - DNA, 19 bp, Homo sapiens
tctggcaaacatgtgcaac

SEQ ID NO: 2934160 - DNA, 16 bp, Homo sapiens
tctggcagcctcccat

SEQ ID NO: 2934161 - DNA, 19 bp, Homo sapiens
tctggcagggtgggatgga

SEQ ID NO: 2934162 - DNA, 16 bp, Homo sapiens
tctggcatggctccct

SEQ ID NO: 2934163 - DNA, 23 bp, Homo sapiens
tctggcattctacacctggacca

SEQ ID NO: 2934164 - DNA, 13 bp, Homo sapiens
tctggccctgcct

SEQ ID NO: 2934165 - DNA, 14 bp, Homo sapiens
tctggcctgaggtc

SEQ ID NO: 2934166 - DNA, 21 bp, Homo sapiens
tctggcctgaggtcaatggtg

SEQ ID NO: 2934167 - DNA, 23 bp, Homo sapiens
tctggcggtggccacagcgtgct

SEQ ID NO: 2934168 - DNA, 18 bp, Homo sapiens
tctggctagagggcccaa

SEQ ID NO: 2934169 - DNA, 17 bp, Homo sapiens
tctggctcagctgtggt

SEQ ID NO: 2934170 - DNA, 19 bp, Homo sapiens
tctggctcagctgtggtcc

SEQ ID NO: 2934171 - DNA, 14 bp, Homo sapiens
tctggctgcagagc

SEQ ID NO: 2934172 - DNA, 15 bp, Homo sapiens
tctggctgcagagca

SEQ ID NO: 2934173 - DNA, 16 bp, Homo sapiens
tctggctgtaaggctc

SEQ ID NO: 2934174 - DNA, 18 bp, Homo sapiens
tctggctgtaaggctcta

SEQ ID NO: 2934175 - DNA, 15 bp, Homo sapiens
tctggcttcctgctg

SEQ ID NO: 2934176 - DNA, 16 bp, Homo sapiens
tctgggaccctttcct

SEQ ID NO: 2934177 - DNA, 19 bp, Homo sapiens
tctgggaggaatggacaga

SEQ ID NO: 2934178 - DNA, 17 bp, Homo sapiens
tctgggagtcacacagt

SEQ ID NO: 2934179 - DNA, 14 bp, Homo sapiens
tctgggcagagcct

SEQ ID NO: 2934180 - DNA, 18 bp, Homo sapiens
tctgggcagagcctgtcc

SEQ ID NO: 2934181 - DNA, 18 bp, Homo sapiens
tctgggctaccccaccca

SEQ ID NO: 2934182 - DNA, 13 bp, Homo sapiens
tctgggctccaga

SEQ ID NO: 2934183 - DNA, 21 bp, Homo sapiens
tctggggaaagacactgcctg

SEQ ID NO: 2934184 - DNA, 22 bp, Homo sapiens
tctggggaaagacactgcctgg

SEQ ID NO: 2934185 - DNA, 18 bp, Homo sapiens
tctgggggaaaaagccat

SEQ ID NO: 2934186 - DNA, 21 bp, Homo sapiens
tctgggggcagatttgtgggg

SEQ ID NO: 2934187 - DNA, 18 bp, Homo sapiens
tctggggggacccagtgc

SEQ ID NO: 2934188 - DNA, 20 bp, Homo sapiens
tctggggggacccagtgcag

SEQ ID NO: 2934189 - DNA, 14 bp, Homo sapiens
tctggggggtgggg

SEQ ID NO: 2934190 - DNA, 16 bp, Homo sapiens
tctggggttcagcccc

SEQ ID NO: 2934191 - DNA, 18 bp, Homo sapiens
tctgggtacctgcaagca

SEQ ID NO: 2934192 - DNA, 16 bp, Homo sapiens
tctgggtatctttcca

SEQ ID NO: 2934193 - DNA, 16 bp, Homo sapiens
tctgggtcaatggaat

SEQ ID NO: 2934194 - DNA, 11 bp, Homo sapiens
tctgggtcaga

SEQ ID NO: 2934195 - DNA, 23 bp, Homo sapiens
tctgggtctacaaggactttcca

SEQ ID NO: 2934196 - DNA, 16 bp, Homo sapiens
tctgggtgaaagagtc

SEQ ID NO: 2934197 - DNA, 15 bp, Homo sapiens
tctgggtgatttcta

SEQ ID NO: 2934198 - DNA, 17 bp, Homo sapiens
tctgggtgatttctaga

SEQ ID NO: 2934199 - DNA, 19 bp, Homo sapiens
tctgggtgatttctagaat

SEQ ID NO: 2934200 - DNA, 17 bp, Homo sapiens
tctgggtgccctgaaag

SEQ ID NO: 2934201 - DNA, 18 bp, Homo sapiens
tctgggtgctccctacca

SEQ ID NO: 2934202 - DNA, 15 bp, Homo sapiens
tctgggtggatgtga

SEQ ID NO: 2934203 - DNA, 20 bp, Homo sapiens
tctgggtgttgaccactcca

SEQ ID NO: 2934204 - DNA, 18 bp, Homo sapiens
tctgggtttggcccaaga

SEQ ID NO: 2934205 - DNA, 14 bp, Homo sapiens
tctggtatctgcat

SEQ ID NO: 2934206 - DNA, 14 bp, Homo sapiens
tctggtatgaaaca

SEQ ID NO: 2934207 - DNA, 15 bp, Homo sapiens
tctggtatggtgcta

SEQ ID NO: 2934208 - DNA, 16 bp, Homo sapiens
tctggtcccctgtggt

SEQ ID NO: 2934209 - DNA, 14 bp, Homo sapiens
tctggtcctaccca

SEQ ID NO: 2934210 - DNA, 16 bp, Homo sapiens
tctggtcctgttttct

SEQ ID NO: 2934211 - DNA, 21 bp, Homo sapiens
tctggtctaatttattaatct

SEQ ID NO: 2934212 - DNA, 23 bp, Homo sapiens
tctggtgaccttccaagagcctg

SEQ ID NO: 2934213 - DNA, 14 bp, Homo sapiens
tctggtggttattt

SEQ ID NO: 2934214 - DNA, 16 bp, Homo sapiens
tctggtgtccagcatg

SEQ ID NO: 2934215 - DNA, 13 bp, Homo sapiens
tctggtgtctgct

SEQ ID NO: 2934216 - DNA, 23 bp, Homo sapiens
tctgtaaaaaagaaaaacaagtt

SEQ ID NO: 2934217 - DNA, 22 bp, Homo sapiens
tctgtaaatccagtgttacaat

SEQ ID NO: 2934218 - DNA, 20 bp, Homo sapiens
tctgtaagaaacctactgcc

SEQ ID NO: 2934219 - DNA, 22 bp, Homo sapiens
tctgtaagaaacctactgccca

SEQ ID NO: 2934220 - DNA, 15 bp, Homo sapiens
tctgtaagacaacat

SEQ ID NO: 2934221 - DNA, 17 bp, Homo sapiens
tctgtaagatatcccag

SEQ ID NO: 2934222 - DNA, 14 bp, Homo sapiens
tctgtaaggaactg

SEQ ID NO: 2934223 - DNA, 17 bp, Homo sapiens
tctgtaaggaactggaa

SEQ ID NO: 2934224 - DNA, 16 bp, Homo sapiens
tctgtaatcagcaata

SEQ ID NO: 2934225 - DNA, 12 bp, Homo sapiens
tctgtacaaagg

SEQ ID NO: 2934226 - DNA, 13 bp, Homo sapiens
tctgtacaatgaa

SEQ ID NO: 2934227 - DNA, 13 bp, Homo sapiens
tctgtacattttt

SEQ ID NO: 2934228 - DNA, 18 bp, Homo sapiens
tctgtaccccatgacctt

SEQ ID NO: 2934229 - DNA, 12 bp, Homo sapiens
tctgtacctaaa

SEQ ID NO: 2934230 - DNA, 23 bp, Homo sapiens
tctgtactgttactgggccctga

SEQ ID NO: 2934231 - DNA, 14 bp, Homo sapiens
tctgtacttttcat

SEQ ID NO: 2934232 - DNA, 16 bp, Homo sapiens
tctgtagattctgtgg

SEQ ID NO: 2934233 - DNA, 19 bp, Homo sapiens
tctgtagattctgtggaac

SEQ ID NO: 2934234 - DNA, 23 bp, Homo sapiens
tctgtagattctgtggaacaagc

SEQ ID NO: 2934235 - DNA, 17 bp, Homo sapiens
tctgtagctttctggaa

SEQ ID NO: 2934236 - DNA, 20 bp, Homo sapiens
tctgtagggtaattagtaac

SEQ ID NO: 2934237 - DNA, 16 bp, Homo sapiens
tctgtaggttaaaaaa

SEQ ID NO: 2934238 - DNA, 14 bp, Homo sapiens
tctgtagtgagata

SEQ ID NO: 2934239 - DNA, 14 bp, Homo sapiens
tctgtataaatgtc

SEQ ID NO: 2934240 - DNA, 14 bp, Homo sapiens
tctgtatataaatg

SEQ ID NO: 2934241 - DNA, 16 bp, Homo sapiens
tctgtatataaatggg

SEQ ID NO: 2934242 - DNA, 15 bp, Homo sapiens
tctgtatatactttt

SEQ ID NO: 2934243 - DNA, 15 bp, Homo sapiens
tctgtatatttatga

SEQ ID NO: 2934244 - DNA, 20 bp, Homo sapiens
tctgtatatttatgaccaga

SEQ ID NO: 2934245 - DNA, 13 bp, Homo sapiens
tctgtatgtatta

SEQ ID NO: 2934246 - DNA, 22 bp, Homo sapiens
tctgtatgtattagtgatattt

SEQ ID NO: 2934247 - DNA, 16 bp, Homo sapiens
tctgtatttcactctt

SEQ ID NO: 2934248 - DNA, 21 bp, Homo sapiens
tctgtcaagcatattggaaag

SEQ ID NO: 2934249 - DNA, 21 bp, Homo sapiens
tctgtcaccacatcttgtctt

SEQ ID NO: 2934250 - DNA, 22 bp, Homo sapiens
tctgtcacccagtctgttgctg

SEQ ID NO: 2934251 - DNA, 12 bp, Homo sapiens
tctgtcactcag

SEQ ID NO: 2934252 - DNA, 14 bp, Homo sapiens
tctgtcactcaggc

SEQ ID NO: 2934253 - DNA, 12 bp, Homo sapiens
tctgtcagtgtg

SEQ ID NO: 2934254 - DNA, 21 bp, Homo sapiens
tctgtcataagcattacttta

SEQ ID NO: 2934255 - DNA, 19 bp, Homo sapiens
tctgtcataggactctgga

SEQ ID NO: 2934256 - DNA, 17 bp, Homo sapiens
tctgtcatcctcaggaa

SEQ ID NO: 2934257 - DNA, 15 bp, Homo sapiens
tctttgcttccttgc

SEQ ID NO: 2934258 - DNA, 22 bp, Homo sapiens
tctttgcttccttgcttttatg

SEQ ID NO: 2934259 - DNA, 12 bp, Homo sapiens
tctttgctttgc

SEQ ID NO: 2934260 - DNA, 18 bp, Homo sapiens
tctttgctttgctttctg

SEQ ID NO: 2934261 - DNA, 23 bp, Homo sapiens
tctttgctttgctttctgctcag

SEQ ID NO: 2934262 - DNA, 21 bp, Homo sapiens
tctttgctttgtagtttgctt

SEQ ID NO: 2934263 - DNA, 21 bp, Homo sapiens
tctttggacagaagcagctct

SEQ ID NO: 2934264 - DNA, 14 bp, Homo sapiens
tctttggctctatt

SEQ ID NO: 2934265 - DNA, 15 bp, Homo sapiens
tctttggttctaagg

SEQ ID NO: 2934266 - DNA, 19 bp, Homo sapiens
tctttgtaaaatcttgcag

SEQ ID NO: 2934267 - DNA, 12 bp, Homo sapiens
tctttgtaagaa

SEQ ID NO: 2934268 - DNA, 15 bp, Homo sapiens
tctttgtctaaaaca

SEQ ID NO: 2934269 - DNA, 16 bp, Homo sapiens
tctttgtgctttggct

SEQ ID NO: 2934270 - DNA, 16 bp, Homo sapiens
tctttgttcctgcttt

SEQ ID NO: 2934271 - DNA, 18 bp, Homo sapiens
tctttgttcctgctttct

SEQ ID NO: 2934272 - DNA, 20 bp, Homo sapiens
tctttgttcctgctttctct

SEQ ID NO: 2934273 - DNA, 23 bp, Homo sapiens
tctttgttcctgctttctctttc

SEQ ID NO: 2934274 - DNA, 14 bp, Homo sapiens
tctttgttctccta

SEQ ID NO: 2934275 - DNA, 14 bp, Homo sapiens
tcttttaatcatga

SEQ ID NO: 2934276 - DNA, 20 bp, Homo sapiens
tcttttaatcatgagcctgt

SEQ ID NO: 2934277 - DNA, 23 bp, Homo sapiens
tcttttagttccaacaaagaaag

SEQ ID NO: 2934278 - DNA, 22 bp, Homo sapiens
tcttttataactagtcctttac

SEQ ID NO: 2934279 - DNA, 13 bp, Homo sapiens
tcttttataataa

SEQ ID NO: 2934280 - DNA, 13 bp, Homo sapiens
tcttttatttcat

SEQ ID NO: 2934281 - DNA, 14 bp, Homo sapiens
tcttttcacattct

SEQ ID NO: 2934282 - DNA, 15 bp, Homo sapiens
tcttttcccctcatt

SEQ ID NO: 2934283 - DNA, 18 bp, Homo sapiens
tcttttcccctcattgca

SEQ ID NO: 2934284 - DNA, 17 bp, Homo sapiens
tcttttcctctctgtct

SEQ ID NO: 2934285 - DNA, 18 bp, Homo sapiens
tcttttctagtctgagct

SEQ ID NO: 2934286 - DNA, 12 bp, Homo sapiens
tcttttctctac

SEQ ID NO: 2934287 - DNA, 13 bp, Homo sapiens
tcttttctctgaa

SEQ ID NO: 2934288 - DNA, 13 bp, Homo sapiens
tcttttctttaga

SEQ ID NO: 2934289 - DNA, 17 bp, Homo sapiens
tcttttctttagagaac

SEQ ID NO: 2934290 - DNA, 18 bp, Homo sapiens
tcttttgaattgttacat

SEQ ID NO: 2934291 - DNA, 16 bp, Homo sapiens
tcttttgattatgttt

SEQ ID NO: 2934292 - DNA, 16 bp, Homo sapiens
tcttttggggaagtga

SEQ ID NO: 2934293 - DNA, 20 bp, Homo sapiens
tcttttggggaagtgaggaa

SEQ ID NO: 2934294 - DNA, 17 bp, Homo sapiens
tcttttgggggaaactt

SEQ ID NO: 2934295 - DNA, 19 bp, Homo sapiens
tcttttgtaaggtttttgt

SEQ ID NO: 2934296 - DNA, 13 bp, Homo sapiens
tcttttgtaattg

SEQ ID NO: 2934297 - DNA, 20 bp, Homo sapiens
tcttttgttcgcatggtcac

SEQ ID NO: 2934298 - DNA, 15 bp, Homo sapiens
tctttttaagttaat

SEQ ID NO: 2934299 - DNA, 15 bp, Homo sapiens
tctttttaataaaaa

SEQ ID NO: 2934300 - DNA, 12 bp, Homo sapiens
tctttttattca

SEQ ID NO: 2934301 - DNA, 14 bp, Homo sapiens
tctttttattgaat

SEQ ID NO: 2934302 - DNA, 15 bp, Homo sapiens
tctttttctttttaa

SEQ ID NO: 2934303 - DNA, 19 bp, Homo sapiens
tctttttgactcttgcaat

SEQ ID NO: 2934304 - DNA, 15 bp, Homo sapiens
tctttttgttgtaaa

SEQ ID NO: 2934305 - DNA, 16 bp, Homo sapiens
tctttttgttgtaaaa

SEQ ID NO: 2934306 - DNA, 19 bp, Homo sapiens
tcttttttttaatgtgctg

SEQ ID NO: 2934307 - DNA, 18 bp, Homo sapiens
tgaaaaaaaaaaaccctt

SEQ ID NO: 2934308 - DNA, 19 bp, Homo sapiens
tgaaaaaaagtttctattt

SEQ ID NO: 2934309 - DNA, 23 bp, Homo sapiens
tgaaaaaaagtttctatttagtt

SEQ ID NO: 2934310 - DNA, 18 bp, Homo sapiens
tgaaaaaaataattttaa

SEQ ID NO: 2934311 - DNA, 23 bp, Homo sapiens
tgaaaaaaccgttcaaattctct

SEQ ID NO: 2934312 - DNA, 13 bp, Homo sapiens
tgaaaaaatacta

SEQ ID NO: 2934313 - DNA, 22 bp, Homo sapiens
tgaaaaaatagagcctgaggga

SEQ ID NO: 2934314 - DNA, 11 bp, Homo sapiens
tgaaaaaatta

SEQ ID NO: 2934315 - DNA, 14 bp, Homo sapiens
tgaaaaaattaaaa

SEQ ID NO: 2934316 - DNA, 13 bp, Homo sapiens
tgaaaaatatctt

SEQ ID NO: 2934317 - DNA, 21 bp, Homo sapiens
tgaaaaatcacttgattcata

SEQ ID NO: 2934318 - DNA, 13 bp, Homo sapiens
tgaaaaatgaaag

SEQ ID NO: 2934319 - DNA, 17 bp, Homo sapiens
tgaaaaatgaaagatga

SEQ ID NO: 2934320 - DNA, 15 bp, Homo sapiens
tgaaaacaaacaaat

SEQ ID NO: 2934321 - DNA, 19 bp, Homo sapiens
tgaaaacacttattttaca

SEQ ID NO: 2934322 - DNA, 20 bp, Homo sapiens
tgaaaacattgatgaatgag

SEQ ID NO: 2934323 - DNA, 14 bp, Homo sapiens
tgaaaacccagaga

SEQ ID NO: 2934324 - DNA, 14 bp, Homo sapiens
tgaaaacccctggc

SEQ ID NO: 2934325 - DNA, 13 bp, Homo sapiens
tgaaaacctgcat

SEQ ID NO: 2934326 - DNA, 17 bp, Homo sapiens
tgaaaacttttctcaga

SEQ ID NO: 2934327 - DNA, 14 bp, Homo sapiens
tgaaaagattcttc

SEQ ID NO: 2934328 - DNA, 20 bp, Homo sapiens
tgaaaagctccatttttagt

SEQ ID NO: 2934329 - DNA, 14 bp, Homo sapiens
tgaaaagctttcct

SEQ ID NO: 2934330 - DNA, 13 bp, Homo sapiens
tgaaaagttattt

SEQ ID NO: 2934331 - DNA, 21 bp, Homo sapiens
tgaaaagttatttatgctata

SEQ ID NO: 2934332 - DNA, 20 bp, Homo sapiens
tgaaaataactgaaccaaat

SEQ ID NO: 2934333 - DNA, 16 bp, Homo sapiens
tgaaaataagaataga

SEQ ID NO: 2934334 - DNA, 13 bp, Homo sapiens
tgaaaataattgt

SEQ ID NO: 2934335 - DNA, 19 bp, Homo sapiens
tgaaaatacaacttaaata

SEQ ID NO: 2934336 - DNA, 23 bp, Homo sapiens
tgaaaatacaacttaaataataa

SEQ ID NO: 2934337 - DNA, 23 bp, Homo sapiens
tgaaaatatctgctcaaaacttt

SEQ ID NO: 2934338 - DNA, 11 bp, Homo sapiens
tgaaaatattt

SEQ ID NO: 2934339 - DNA, 21 bp, Homo sapiens
tgaaaatattttttatatata

SEQ ID NO: 2934340 - DNA, 20 bp, Homo sapiens
tgaaaatcttataatttaaa

SEQ ID NO: 2934341 - DNA, 16 bp, Homo sapiens
tgaaaatgaatagctt

SEQ ID NO: 2934342 - DNA, 17 bp, Homo sapiens
tgaaaatgtatttcctg

SEQ ID NO: 2934343 - DNA, 14 bp, Homo sapiens
tgaaaatgtatttg

SEQ ID NO: 2934344 - DNA, 15 bp, Homo sapiens
tgaaacaacttggaa

SEQ ID NO: 2934345 - DNA, 16 bp, Homo sapiens
tgaaacaacttggaaa

SEQ ID NO: 2934346 - DNA, 15 bp, Homo sapiens
tgaaacacttgcttg

SEQ ID NO: 2934347 - DNA, 15 bp, Homo sapiens
tgaaacagaaaaata

SEQ ID NO: 2934348 - DNA, 17 bp, Homo sapiens
tgaaacagaaaaataag

SEQ ID NO: 2934349 - DNA, 23 bp, Homo sapiens
tgaaacagctgccttagcttcag

SEQ ID NO: 2934350 - DNA, 18 bp, Homo sapiens
tgaaacaggtctttgcca

SEQ ID NO: 2934351 - DNA, 20 bp, Homo sapiens
tgaaacatgggctgtgatta

SEQ ID NO: 2934352 - DNA, 20 bp, Homo sapiens
tgaaacatgttcatctggaa

SEQ ID NO: 2934353 - DNA, 16 bp, Homo sapiens
tgaaacattattttaa

SEQ ID NO: 2934354 - DNA, 20 bp, Homo sapiens
tgaaacccagtcactgtgag

SEQ ID NO: 2934355 - DNA, 16 bp, Homo sapiens
tgaaacccccacacac

SEQ ID NO: 2934356 - DNA, 17 bp, Homo sapiens
tgaaacccccacacaca

SEQ ID NO: 2934357 - DNA, 16 bp, Homo sapiens
tgaaacccccatctct

SEQ ID NO: 2934358 - DNA, 15 bp, Homo sapiens
tgaaaccctggacca

SEQ ID NO: 2934359 - DNA, 21 bp, Homo sapiens
tgaaacctacagcatattctt

SEQ ID NO: 2934360 - DNA, 22 bp, Homo sapiens
tgaaacctgatgtcagctgctg

SEQ ID NO: 2934361 - DNA, 19 bp, Homo sapiens
tgaaactaaagcaatagaa

SEQ ID NO: 2934362 - DNA, 18 bp, Homo sapiens
tgaaactatttacaatgt

SEQ ID NO: 2934363 - DNA, 19 bp, Homo sapiens
tgaaactcccttgtgttcc

SEQ ID NO: 2934364 - DNA, 21 bp, Homo sapiens
tgaaactcccttgtgttcctt

SEQ ID NO: 2934365 - DNA, 17 bp, Homo sapiens
tgaaactctacatttaa

SEQ ID NO: 2934366 - DNA, 14 bp, Homo sapiens
tgaaacttctcagt

SEQ ID NO: 2934367 - DNA, 18 bp, Homo sapiens
tgaaagacttccaaagaa

SEQ ID NO: 2934368 - DNA, 21 bp, Homo sapiens
tgaaagattcaggtatgttgc

SEQ ID NO: 2934369 - DNA, 20 bp, Homo sapiens
tgaaagattttattgtataa

SEQ ID NO: 2934370 - DNA, 17 bp, Homo sapiens
tgaaagcaaaaatgcta

SEQ ID NO: 2934371 - DNA, 19 bp, Homo sapiens
tgaaagcaaaaatgctaat

SEQ ID NO: 2934372 - DNA, 12 bp, Homo sapiens
tgaaagcctcac

SEQ ID NO: 2934373 - DNA, 15 bp, Homo sapiens
tgaaagcctgtctct

SEQ ID NO: 2934374 - DNA, 14 bp, Homo sapiens
tgaaaggagccctt

SEQ ID NO: 2934375 - DNA, 20 bp, Homo sapiens
tgaaaggagggaaaagcaga

SEQ ID NO: 2934376 - DNA, 16 bp, Homo sapiens
tgaaaggatgtagaaa

SEQ ID NO: 2934377 - DNA, 19 bp, Homo sapiens
tgaaaggcattctctgaag

SEQ ID NO: 2934378 - DNA, 20 bp, Homo sapiens
tgaaagggaaggacagctgt

SEQ ID NO: 2934379 - DNA, 22 bp, Homo sapiens
tgaaagggaaggacagctgtgc

SEQ ID NO: 2934380 - DNA, 22 bp, Homo sapiens
tgaaaggggaaacgtctcccag

SEQ ID NO: 2934381 - DNA, 18 bp, Homo sapiens
tgaaaggttggccttact

SEQ ID NO: 2934382 - DNA, 18 bp, Homo sapiens
tgaaagtatgttgtatat

SEQ ID NO: 2934383 - DNA, 17 bp, Homo sapiens
tgaaagtcaattcagtg

SEQ ID NO: 2934384 - DNA, 16 bp, Homo sapiens
tgaaagtccagaaact

SEQ ID NO: 2934385 - DNA, 15 bp, Homo sapiens
tgaaagttgtacatg

SEQ ID NO: 2934386 - DNA, 22 bp, Homo sapiens
tgaaataaaactggctttggct

SEQ ID NO: 2934387 - DNA, 19 bp, Homo sapiens
tgaaataaaattacacagt

SEQ ID NO: 2934388 - DNA, 23 bp, Homo sapiens
tgaaataaacagtctaaagaaga

SEQ ID NO: 2934389 - DNA, 17 bp, Homo sapiens
tgaaataaactagggtt

SEQ ID NO: 2934390 - DNA, 21 bp, Homo sapiens
tgaccccctccccccaatccc

SEQ ID NO: 2934391 - DNA, 22 bp, Homo sapiens
tgacccctaccccctcatcccc

SEQ ID NO: 2934392 - DNA, 23 bp, Homo sapiens
tgacccctcctggggccaggccg

SEQ ID NO: 2934393 - DNA, 21 bp, Homo sapiens
tgacccggattggccctgccc

SEQ ID NO: 2934394 - DNA, 21 bp, Homo sapiens
tgaccctcatctttcttccaa

SEQ ID NO: 2934395 - DNA, 21 bp, Homo sapiens
tgaccctcccggcctggcttc

SEQ ID NO: 2934396 - DNA, 14 bp, Homo sapiens
tgaccctctcactt

SEQ ID NO: 2934397 - DNA, 15 bp, Homo sapiens
tgaccctctgtcccc

SEQ ID NO: 2934398 - DNA, 22 bp, Homo sapiens
tgaccctctgtccccaggcctg

SEQ ID NO: 2934399 - DNA, 15 bp, Homo sapiens
tgaccctgggcctgg

SEQ ID NO: 2934400 - DNA, 18 bp, Homo sapiens
tgaccctgggcctggagg

SEQ ID NO: 2934401 - DNA, 16 bp, Homo sapiens
tgaccctgtgccccag

SEQ ID NO: 2934402 - DNA, 13 bp, Homo sapiens
tgaccgcccagct

SEQ ID NO: 2934403 - DNA, 17 bp, Homo sapiens
tgaccgcccagctctcc

SEQ ID NO: 2934404 - DNA, 14 bp, Homo sapiens
tgaccgctgcccag

SEQ ID NO: 2934405 - DNA, 17 bp, Homo sapiens
tgaccgctgcccaggtg

SEQ ID NO: 2934406 - DNA, 21 bp, Homo sapiens
tgaccggctgccgtttgagga

SEQ ID NO: 2934407 - DNA, 17 bp, Homo sapiens
tgacctcaactaaccct

SEQ ID NO: 2934408 - DNA, 20 bp, Homo sapiens
tgacctcagggctatgtgga

SEQ ID NO: 2934409 - DNA, 19 bp, Homo sapiens
tgacctcaggtgatccgcc

SEQ ID NO: 2934410 - DNA, 20 bp, Homo sapiens
tgacctcaggtgatccgcct

SEQ ID NO: 2934411 - DNA, 18 bp, Homo sapiens
tgacctcatgatccaccc

SEQ ID NO: 2934412 - DNA, 22 bp, Homo sapiens
tgacctcattaaccgatgcttt

SEQ ID NO: 2934413 - DNA, 15 bp, Homo sapiens
tgacctccagtcctg

SEQ ID NO: 2934414 - DNA, 22 bp, Homo sapiens
tgacctccagtcctgctggcct

SEQ ID NO: 2934415 - DNA, 19 bp, Homo sapiens
tgacctcctccctgttatt

SEQ ID NO: 2934416 - DNA, 14 bp, Homo sapiens
tgacctgaagttca

SEQ ID NO: 2934417 - DNA, 18 bp, Homo sapiens
tgacctgaagttcaccat

SEQ ID NO: 2934418 - DNA, 15 bp, Homo sapiens
tgacctgcaaaaatg

SEQ ID NO: 2934419 - DNA, 19 bp, Homo sapiens
tgacctgcaaaaatgctgg

SEQ ID NO: 2934420 - DNA, 13 bp, Homo sapiens
tgacctgccagcc

SEQ ID NO: 2934421 - DNA, 22 bp, Homo sapiens
tgacctgcgggtcctcagctgc

SEQ ID NO: 2934422 - DNA, 15 bp, Homo sapiens
tgaccttagtgtttc

SEQ ID NO: 2934423 - DNA, 21 bp, Homo sapiens
tgaccttagtgtttctgtgca

SEQ ID NO: 2934424 - DNA, 20 bp, Homo sapiens
tgaccttcatttcatgtata

SEQ ID NO: 2934425 - DNA, 13 bp, Homo sapiens
tgacgaggctcaa

SEQ ID NO: 2934426 - DNA, 15 bp, Homo sapiens
tgacgctgaataaat

SEQ ID NO: 2934427 - DNA, 22 bp, Homo sapiens
tgacgctgaataaatgtctttt

SEQ ID NO: 2934428 - DNA, 19 bp, Homo sapiens
tgacggccagggagaagct

SEQ ID NO: 2934429 - DNA, 13 bp, Homo sapiens
tgacgggccaggc

SEQ ID NO: 2934430 - DNA, 16 bp, Homo sapiens
tgacgggccaggccct

SEQ ID NO: 2934431 - DNA, 20 bp, Homo sapiens
tgacgggccaggccctggag

SEQ ID NO: 2934432 - DNA, 18 bp, Homo sapiens
tgacgtaagctctatctg

SEQ ID NO: 2934433 - DNA, 20 bp, Homo sapiens
tgacgtaagctctatctgca

SEQ ID NO: 2934434 - DNA, 13 bp, Homo sapiens
tgacgtgactcag

SEQ ID NO: 2934435 - DNA, 15 bp, Homo sapiens
tgacgtgactcagag

SEQ ID NO: 2934436 - DNA, 18 bp, Homo sapiens
tgacgtgactcagagctt

SEQ ID NO: 2934437 - DNA, 15 bp, Homo sapiens
tgacgtgcactgtga

SEQ ID NO: 2934438 - DNA, 15 bp, Homo sapiens
tgactaaaaatgcat

SEQ ID NO: 2934439 - DNA, 22 bp, Homo sapiens
tgactaaagtaccagattataa

SEQ ID NO: 2934440 - DNA, 14 bp, Homo sapiens
tgactaagccaagc

SEQ ID NO: 2934441 - DNA, 22 bp, Homo sapiens
tgactaagccccgcatatgtga

SEQ ID NO: 2934442 - DNA, 14 bp, Homo sapiens
tgactaatggcatg

SEQ ID NO: 2934443 - DNA, 14 bp, Homo sapiens
tgactaattgtata

SEQ ID NO: 2934444 - DNA, 18 bp, Homo sapiens
tgactaattgtataacag

SEQ ID NO: 2934445 - DNA, 20 bp, Homo sapiens
tgactaattgtataacaggt

SEQ ID NO: 2934446 - DNA, 15 bp, Homo sapiens
tgactaattttacat

SEQ ID NO: 2934447 - DNA, 18 bp, Homo sapiens
tgactaattttacatgtt

SEQ ID NO: 2934448 - DNA, 14 bp, Homo sapiens
tgactacatttttt

SEQ ID NO: 2934449 - DNA, 15 bp, Homo sapiens
tgactagagacgcac

SEQ ID NO: 2934450 - DNA, 23 bp, Homo sapiens
tgactagagacgcaccttgctgc

SEQ ID NO: 2934451 - DNA, 21 bp, Homo sapiens
tgactagggagccatgtttca

SEQ ID NO: 2934452 - DNA, 18 bp, Homo sapiens
tgactaggttctgtagag

SEQ ID NO: 2934453 - DNA, 13 bp, Homo sapiens
tgactataaagct

SEQ ID NO: 2934454 - DNA, 16 bp, Homo sapiens
tgactataaagctgtt

SEQ ID NO: 2934455 - DNA, 17 bp, Homo sapiens
tgactataaagctgtta

SEQ ID NO: 2934456 - DNA, 18 bp, Homo sapiens
tgactatttgacccccac

SEQ ID NO: 2934457 - DNA, 18 bp, Homo sapiens
tgactcaagtttttacaa

SEQ ID NO: 2934458 - DNA, 19 bp, Homo sapiens
tgactcaagtttttacaaa

SEQ ID NO: 2934459 - DNA, 21 bp, Homo sapiens
tgactcaagtttttacaaaat

SEQ ID NO: 2934460 - DNA, 11 bp, Homo sapiens
tgactcaccca

SEQ ID NO: 2934461 - DNA, 12 bp, Homo sapiens
tgactcacccaa

SEQ ID NO: 2934462 - DNA, 13 bp, Homo sapiens
tgactcacccaag

SEQ ID NO: 2934463 - DNA, 12 bp, Homo sapiens
tgactcagagct

SEQ ID NO: 2934464 - DNA, 16 bp, Homo sapiens
tgactcagcagaggca

SEQ ID NO: 2934465 - DNA, 15 bp, Homo sapiens
tgactcagggctcct

SEQ ID NO: 2934466 - DNA, 17 bp, Homo sapiens
tgactcagggctcctgg

SEQ ID NO: 2934467 - DNA, 12 bp, Homo sapiens
tgactcatgcct

SEQ ID NO: 2934468 - DNA, 20 bp, Homo sapiens
tgactcattctgaaggagcc

SEQ ID NO: 2934469 - DNA, 18 bp, Homo sapiens
tgactccctccccaccca

SEQ ID NO: 2934470 - DNA, 19 bp, Homo sapiens
tgactccctccccacccaa

SEQ ID NO: 2934471 - DNA, 20 bp, Homo sapiens
tgactccctccccacccaag

SEQ ID NO: 2934472 - DNA, 20 bp, Homo sapiens
tgactcctgaagggaaggca

SEQ ID NO: 2934473 - DNA, 20 bp, Homo sapiens
tgactctctgagctggggag

SEQ ID NO: 2934474 - DNA, 13 bp, Homo sapiens
tgactctgggcag

SEQ ID NO: 2934475 - DNA, 14 bp, Homo sapiens
tgactctttccaac

SEQ ID NO: 2934476 - DNA, 16 bp, Homo sapiens
tgactctttccaaccg

SEQ ID NO: 2934477 - DNA, 23 bp, Homo sapiens
tgactgaactagagcttgcagtg

SEQ ID NO: 2934478 - DNA, 17 bp, Homo sapiens
tgactgaggcaggcatg

SEQ ID NO: 2934479 - DNA, 14 bp, Homo sapiens
tgactgatttcaaa

SEQ ID NO: 2934480 - DNA, 15 bp, Homo sapiens
tgactgccccaactc

SEQ ID NO: 2934481 - DNA, 19 bp, Homo sapiens
tgactgccctgtttctgtt

SEQ ID NO: 2934482 - DNA, 11 bp, Homo sapiens
tgactgctgct

SEQ ID NO: 2934483 - DNA, 23 bp, Homo sapiens
tgactggagggtccatttttctt

SEQ ID NO: 2934484 - DNA, 21 bp, Homo sapiens
tgactggcattttatagacac

SEQ ID NO: 2934485 - DNA, 12 bp, Homo sapiens
tgactgggctgg

SEQ ID NO: 2934486 - DNA, 20 bp, Homo sapiens
tgactgggctgggtttgctg

SEQ ID NO: 2934487 - DNA, 23 bp, Homo sapiens
tgactggtgagagaagaaaacat

SEQ ID NO: 2934488 - DNA, 15 bp, Homo sapiens
tgactggtgctgcag

SEQ ID NO: 2934489 - DNA, 20 bp, Homo sapiens
tgactggttatcacaccatc

SEQ ID NO: 2934490 - DNA, 15 bp, Homo sapiens
tgactgtcagggagg

SEQ ID NO: 2934491 - DNA, 16 bp, Homo sapiens
tgactgtcagggaggg

SEQ ID NO: 2934492 - DNA, 17 bp, Homo sapiens
tgactgtggagttccat

SEQ ID NO: 2934493 - DNA, 21 bp, Homo sapiens
tgactgtggagttccattctt

SEQ ID NO: 2934494 - DNA, 15 bp, Homo sapiens
tgactgttgatgtac

SEQ ID NO: 2934495 - DNA, 20 bp, Homo sapiens
tgactgtttttcggacagtt

SEQ ID NO: 2934496 - DNA, 14 bp, Homo sapiens
tgacttaaggtgaa

SEQ ID NO: 2934497 - DNA, 16 bp, Homo sapiens
tgacttagatattaaa

SEQ ID NO: 2934498 - DNA, 21 bp, Homo sapiens
tgacttaggtttcaggaagtt

SEQ ID NO: 2934499 - DNA, 18 bp, Homo sapiens
tgacttattgtggataac

SEQ ID NO: 2934500 - DNA, 21 bp, Homo sapiens
tgacttcatgctatatatctt

SEQ ID NO: 2934501 - DNA, 23 bp, Homo sapiens
tgacttccccgcattccaggctc

SEQ ID NO: 2934502 - DNA, 19 bp, Homo sapiens
tgacttcttggtgctgttg

SEQ ID NO: 2934503 - DNA, 13 bp, Homo sapiens
tgacttgagccct

SEQ ID NO: 2934504 - DNA, 15 bp, Homo sapiens
tgacttgctttagtt

SEQ ID NO: 2934505 - DNA, 18 bp, Homo sapiens
tgacttggggagatggag

SEQ ID NO: 2934506 - DNA, 12 bp, Homo sapiens
tgacttgtataa

SEQ ID NO: 2934507 - DNA, 19 bp, Homo sapiens
tgacttgtataacatcact

SEQ ID NO: 2934508 - DNA, 16 bp, Homo sapiens
tgactttaatttatgt

SEQ ID NO: 2934509 - DNA, 14 bp, Homo sapiens
tgactttgcagatg

SEQ ID NO: 2934510 - DNA, 11 bp, Homo sapiens
tgactttgtct

SEQ ID NO: 2934511 - DNA, 16 bp, Homo sapiens
tgacttttaaaatttg

SEQ ID NO: 2934512 - DNA, 19 bp, Homo sapiens
tgactttttataaaatggc

SEQ ID NO: 2934513 - DNA, 15 bp, Homo sapiens
tgactttttgtttct

SEQ ID NO: 2934514 - DNA, 13 bp, Homo sapiens
tgagaaaaactaa

SEQ ID NO: 2934515 - DNA, 18 bp, Homo sapiens
tgagaaaaactaacttga

SEQ ID NO: 2934516 - DNA, 20 bp, Homo sapiens
tgagaaacaacaatttctac

SEQ ID NO: 2934517 - DNA, 20 bp, Homo sapiens
tgagaaacctgtatctttct

SEQ ID NO: 2934518 - DNA, 21 bp, Homo sapiens
tgagaaacctgtatctttcta

SEQ ID NO: 2934519 - DNA, 17 bp, Homo sapiens
tgagaaagaaagtaaaa

SEQ ID NO: 2934520 - DNA, 15 bp, Homo sapiens
tgagaaagcccacct

SEQ ID NO: 2934521 - DNA, 20 bp, Homo sapiens
tgagaaagcccacctgggct

SEQ ID NO: 2934522 - DNA, 20 bp, Homo sapiens
tgatgctgggagttctaaca

SEQ ID NO: 2934523 - DNA, 19 bp, Homo sapiens
tgatgcttgatattttcta

SEQ ID NO: 2934524 - DNA, 13 bp, Homo sapiens
tgatgctttggaa

SEQ ID NO: 2934525 - DNA, 19 bp, Homo sapiens
tgatgctttggaagatgca

SEQ ID NO: 2934526 - DNA, 14 bp, Homo sapiens
tgatgcttttctct

SEQ ID NO: 2934527 - DNA, 15 bp, Homo sapiens
tgatgcttttctctc

SEQ ID NO: 2934528 - DNA, 17 bp, Homo sapiens
tgatgcttttctctcag

SEQ ID NO: 2934529 - DNA, 15 bp, Homo sapiens
tgatggagtgtgagc

SEQ ID NO: 2934530 - DNA, 14 bp, Homo sapiens
tgatggccagagga

SEQ ID NO: 2934531 - DNA, 21 bp, Homo sapiens
tgatggctagattctaacata

SEQ ID NO: 2934532 - DNA, 11 bp, Homo sapiens
tgatggctggg

SEQ ID NO: 2934533 - DNA, 16 bp, Homo sapiens
tgatgggaaaatattt

SEQ ID NO: 2934534 - DNA, 17 bp, Homo sapiens
tgatgggaaaatatttc

SEQ ID NO: 2934535 - DNA, 18 bp, Homo sapiens
tgatgggaaaatatttcc

SEQ ID NO: 2934536 - DNA, 16 bp, Homo sapiens
tgatgggctccccagg

SEQ ID NO: 2934537 - DNA, 20 bp, Homo sapiens
tgatggtcacttaaaatgtg

SEQ ID NO: 2934538 - DNA, 23 bp, Homo sapiens
tgatggtcacttaaaatgtgcag

SEQ ID NO: 2934539 - DNA, 16 bp, Homo sapiens
tgatggtcttcagcct

SEQ ID NO: 2934540 - DNA, 21 bp, Homo sapiens
tgatgtaatgaaattccagat

SEQ ID NO: 2934541 - DNA, 14 bp, Homo sapiens
tgatgtagaaagat

SEQ ID NO: 2934542 - DNA, 20 bp, Homo sapiens
tgatgtagggtaaggtgcct

SEQ ID NO: 2934543 - DNA, 22 bp, Homo sapiens
tgatgtgaagccaattcagaca

SEQ ID NO: 2934544 - DNA, 13 bp, Homo sapiens
tgatgtgccacta

SEQ ID NO: 2934545 - DNA, 12 bp, Homo sapiens
tgatgtgcctgt

SEQ ID NO: 2934546 - DNA, 21 bp, Homo sapiens
tgatgtgttcggttttgttgt

SEQ ID NO: 2934547 - DNA, 22 bp, Homo sapiens
tgatgtgttcggttttgttgtt

SEQ ID NO: 2934548 - DNA, 18 bp, Homo sapiens
tgatgttaacacattttg

SEQ ID NO: 2934549 - DNA, 21 bp, Homo sapiens
tgatgttaacacattttgtat

SEQ ID NO: 2934550 - DNA, 22 bp, Homo sapiens
tgatgttaacacattttgtata

SEQ ID NO: 2934551 - DNA, 15 bp, Homo sapiens
tgatgttcagtgtaa

SEQ ID NO: 2934552 - DNA, 16 bp, Homo sapiens
tgatgttcagtgtaat

SEQ ID NO: 2934553 - DNA, 21 bp, Homo sapiens
tgatgttcagtgtaatttctt

SEQ ID NO: 2934554 - DNA, 18 bp, Homo sapiens
tgatgttctaaggctctg

SEQ ID NO: 2934555 - DNA, 17 bp, Homo sapiens
tgatgttgagggaacag

SEQ ID NO: 2934556 - DNA, 18 bp, Homo sapiens
tgatgttgataatttcag

SEQ ID NO: 2934557 - DNA, 17 bp, Homo sapiens
tgatgttgggaagctat

SEQ ID NO: 2934558 - DNA, 22 bp, Homo sapiens
tgatgttgggaagctatttcct

SEQ ID NO: 2934559 - DNA, 11 bp, Homo sapiens
tgatgtttaaa

SEQ ID NO: 2934560 - DNA, 15 bp, Homo sapiens
tgatgtttaaagaga

SEQ ID NO: 2934561 - DNA, 13 bp, Homo sapiens
tgatgtttcattt

SEQ ID NO: 2934562 - DNA, 13 bp, Homo sapiens
tgatgtttgtcct

SEQ ID NO: 2934563 - DNA, 13 bp, Homo sapiens
tgatgttttctaa

SEQ ID NO: 2934564 - DNA, 18 bp, Homo sapiens
tgattaacaatgtatttt

SEQ ID NO: 2934565 - DNA, 19 bp, Homo sapiens
tgattaacaatgtatttta

SEQ ID NO: 2934566 - DNA, 13 bp, Homo sapiens
tgattaacatttg

SEQ ID NO: 2934567 - DNA, 24 bp, Homo sapiens
tgattaactcttagaagtgttgta

SEQ ID NO: 2934568 - DNA, 13 bp, Homo sapiens
tgattaaggcagt

SEQ ID NO: 2934569 - DNA, 15 bp, Homo sapiens
tgattaatcagctgt

SEQ ID NO: 2934570 - DNA, 16 bp, Homo sapiens
tgattacagtgcagtg

SEQ ID NO: 2934571 - DNA, 21 bp, Homo sapiens
tgattactctttgctttgtag

SEQ ID NO: 2934572 - DNA, 17 bp, Homo sapiens
tgattactgcaatcact

SEQ ID NO: 2934573 - DNA, 16 bp, Homo sapiens
tgattagataatcttt

SEQ ID NO: 2934574 - DNA, 22 bp, Homo sapiens
tgattagataatcttttacatt

SEQ ID NO: 2934575 - DNA, 13 bp, Homo sapiens
tgattagcaagtt

SEQ ID NO: 2934576 - DNA, 19 bp, Homo sapiens
tgattatagcaatgtgatt

SEQ ID NO: 2934577 - DNA, 18 bp, Homo sapiens
tgattatggagccttaga

SEQ ID NO: 2934578 - DNA, 23 bp, Homo sapiens
tgattcaaaatatttaaaaatgt

SEQ ID NO: 2934579 - DNA, 14 bp, Homo sapiens
tgattcaactaaaa

SEQ ID NO: 2934580 - DNA, 13 bp, Homo sapiens
tgattcactgcat

SEQ ID NO: 2934581 - DNA, 19 bp, Homo sapiens
tgattcaggcttataacaa

SEQ ID NO: 2934582 - DNA, 18 bp, Homo sapiens
tgattcaggtgcagagga

SEQ ID NO: 2934583 - DNA, 21 bp, Homo sapiens
tgattcaggtgcagaggaagt

SEQ ID NO: 2934584 - DNA, 21 bp, Homo sapiens
tgattcagtgttaaatgtgat

SEQ ID NO: 2934585 - DNA, 16 bp, Homo sapiens
tgattcatagtaactt

SEQ ID NO: 2934586 - DNA, 19 bp, Homo sapiens
tgattcatagtaacttctt

SEQ ID NO: 2934587 - DNA, 16 bp, Homo sapiens
tgattccatcctgtgt

SEQ ID NO: 2934588 - DNA, 16 bp, Homo sapiens
tgattccattttaagt

SEQ ID NO: 2934589 - DNA, 14 bp, Homo sapiens
tgattcccaactcc

SEQ ID NO: 2934590 - DNA, 18 bp, Homo sapiens
tgattccctcctgctact

SEQ ID NO: 2934591 - DNA, 17 bp, Homo sapiens
tgattccttttttcaaa

SEQ ID NO: 2934592 - DNA, 23 bp, Homo sapiens
tgattctagtacataattgatta

SEQ ID NO: 2934593 - DNA, 20 bp, Homo sapiens
tgattctcctgcctcagctt

SEQ ID NO: 2934594 - DNA, 12 bp, Homo sapiens
tgattctctgtg

SEQ ID NO: 2934595 - DNA, 20 bp, Homo sapiens
tgattctgaagcttatgttt

SEQ ID NO: 2934596 - DNA, 21 bp, Homo sapiens
tgattctgataatgctcactt

SEQ ID NO: 2934597 - DNA, 16 bp, Homo sapiens
tgattctgcagtaaat

SEQ ID NO: 2934598 - DNA, 18 bp, Homo sapiens
tgattctgcttgagaata

SEQ ID NO: 2934599 - DNA, 19 bp, Homo sapiens
tgattctgttctacttgat

SEQ ID NO: 2934600 - DNA, 22 bp, Homo sapiens
tgattctgttgtgttcaccaga

SEQ ID NO: 2934601 - DNA, 17 bp, Homo sapiens
tgattgacagctttgct

SEQ ID NO: 2934602 - DNA, 20 bp, Homo sapiens
tgattgagaagttcattgtc

SEQ ID NO: 2934603 - DNA, 12 bp, Homo sapiens
tgattgagagtt

SEQ ID NO: 2934604 - DNA, 14 bp, Homo sapiens
tgattgctaaatgt

SEQ ID NO: 2934605 - DNA, 12 bp, Homo sapiens
tgattgggaata

SEQ ID NO: 2934606 - DNA, 21 bp, Homo sapiens
tgattgggaataaatatgcct

SEQ ID NO: 2934607 - DNA, 19 bp, Homo sapiens
tgattggggaattaaaagt

SEQ ID NO: 2934608 - DNA, 17 bp, Homo sapiens
tgattgtcagccacctc

SEQ ID NO: 2934609 - DNA, 18 bp, Homo sapiens
tgattgtggaatggagat

SEQ ID NO: 2934610 - DNA, 18 bp, Homo sapiens
tgattgttagttaagttt

SEQ ID NO: 2934611 - DNA, 22 bp, Homo sapiens
tgattgtttcttcttcatgctt

SEQ ID NO: 2934612 - DNA, 19 bp, Homo sapiens
tgatttaaaaagtgagaaa

SEQ ID NO: 2934613 - DNA, 15 bp, Homo sapiens
tgatttaaaacatgt

SEQ ID NO: 2934614 - DNA, 15 bp, Homo sapiens
tgatttaaaagtgta

SEQ ID NO: 2934615 - DNA, 20 bp, Homo sapiens
tgatttaactgacttaacaa

SEQ ID NO: 2934616 - DNA, 20 bp, Homo sapiens
tgatttaatagtgttaatca

SEQ ID NO: 2934617 - DNA, 22 bp, Homo sapiens
tgatttagcaatgctgtgaata

SEQ ID NO: 2934618 - DNA, 23 bp, Homo sapiens
tgatttagcaatgctgtgaataa

SEQ ID NO: 2934619 - DNA, 20 bp, Homo sapiens
tgatttaggagaagccagga

SEQ ID NO: 2934620 - DNA, 12 bp, Homo sapiens
tgatttatacca

SEQ ID NO: 2934621 - DNA, 16 bp, Homo sapiens
tgatttattgaaattt

SEQ ID NO: 2934622 - DNA, 22 bp, Homo sapiens
tgatttcagtagcacaagttat

SEQ ID NO: 2934623 - DNA, 18 bp, Homo sapiens
tgatttccaaagagaaaa

SEQ ID NO: 2934624 - DNA, 15 bp, Homo sapiens
tgatttcctgtgtca

SEQ ID NO: 2934625 - DNA, 19 bp, Homo sapiens
tgatttcctgtgtcaatcc

SEQ ID NO: 2934626 - DNA, 16 bp, Homo sapiens
tgatttccttgaatgt

SEQ ID NO: 2934627 - DNA, 17 bp, Homo sapiens
tgatttccttgaatgtg

SEQ ID NO: 2934628 - DNA, 19 bp, Homo sapiens
tgatttccttgaatgtggc

SEQ ID NO: 2934629 - DNA, 15 bp, Homo sapiens
tgatttcgatgtaca

SEQ ID NO: 2934630 - DNA, 19 bp, Homo sapiens
tgatttcgatgtacagtct

SEQ ID NO: 2934631 - DNA, 12 bp, Homo sapiens
tgatttcttcta

SEQ ID NO: 2934632 - DNA, 12 bp, Homo sapiens
tgatttcttgct

SEQ ID NO: 2934633 - DNA, 22 bp, Homo sapiens
tgatttcttgctaagctccagc

SEQ ID NO: 2934634 - DNA, 19 bp, Homo sapiens
tgatttgaagaacatgtga

SEQ ID NO: 2934635 - DNA, 11 bp, Homo sapiens
tgatttgcaat

SEQ ID NO: 2934636 - DNA, 17 bp, Homo sapiens
tgatttgcaataaaaat

SEQ ID NO: 2934637 - DNA, 18 bp, Homo sapiens
tgatttgcaggattttta

SEQ ID NO: 2934638 - DNA, 14 bp, Homo sapiens
tgatttgcattgaa

SEQ ID NO: 2934639 - DNA, 20 bp, Homo sapiens
tgatttgttttgaattttgt

SEQ ID NO: 2934640 - DNA, 19 bp, Homo sapiens
tgattttacaattgaaatg

SEQ ID NO: 2934641 - DNA, 18 bp, Homo sapiens
tgattttatgatcagtgt

SEQ ID NO: 2934642 - DNA, 13 bp, Homo sapiens
tgattttctccac

SEQ ID NO: 2934643 - DNA, 15 bp, Homo sapiens
tgattttctcctaaa

SEQ ID NO: 2934644 - DNA, 16 bp, Homo sapiens
tgattttgaaaagtat

SEQ ID NO: 2934645 - DNA, 13 bp, Homo sapiens
tgatttttactgt

SEQ ID NO: 2934646 - DNA, 18 bp, Homo sapiens
tgatttttatgccacctg

SEQ ID NO: 2934647 - DNA, 20 bp, Homo sapiens
tgatttttattaactgcttt

SEQ ID NO: 2934648 - DNA, 13 bp, Homo sapiens
tgatttttctgga

SEQ ID NO: 2934649 - DNA, 13 bp, Homo sapiens
tgatttttgtgta

SEQ ID NO: 2934650 - DNA, 13 bp, Homo sapiens
tgcaaaaaaagaa

SEQ ID NO: 2934651 - DNA, 17 bp, Homo sapiens
tgcaaaaagaggatccg

SEQ ID NO: 2934652 - DNA, 22 bp, Homo sapiens
tgcaaaagcaatcatagagaaa

SEQ ID NO: 2934653 - DNA, 15 bp, Homo sapiens
tgcaaaagcaggctt

SEQ ID NO: 2934654 - DNA, 20 bp, Homo sapiens
tgcactggagccacaggcag

SEQ ID NO: 2934655 - DNA, 18 bp, Homo sapiens
tgcactgtgaatcctggc

SEQ ID NO: 2934656 - DNA, 19 bp, Homo sapiens
tgcactgttccccctgtgc

SEQ ID NO: 2934657 - DNA, 23 bp, Homo sapiens
tgcactgttccccctgtgcagcc

SEQ ID NO: 2934658 - DNA, 20 bp, Homo sapiens
tgcacttatgatttcatgtg

SEQ ID NO: 2934659 - DNA, 22 bp, Homo sapiens
tgcacttatttatgaacctgcc

SEQ ID NO: 2934660 - DNA, 17 bp, Homo sapiens
tgcacttgtgattattt

SEQ ID NO: 2934661 - DNA, 20 bp, Homo sapiens
tgcacttgtgattatttatt

SEQ ID NO: 2934662 - DNA, 18 bp, Homo sapiens
tgcactttgggtttttaa

SEQ ID NO: 2934663 - DNA, 22 bp, Homo sapiens
tgcactttgggtttttaactca

SEQ ID NO: 2934664 - DNA, 14 bp, Homo sapiens
tgcactttgtaaat

SEQ ID NO: 2934665 - DNA, 14 bp, Homo sapiens
tgcacttttgaatg

SEQ ID NO: 2934666 - DNA, 12 bp, Homo sapiens
tgcagaaaaaaa

SEQ ID NO: 2934667 - DNA, 15 bp, Homo sapiens
tgcagaaaaagaaaa

SEQ ID NO: 2934668 - DNA, 17 bp, Homo sapiens
tgcagaaaaagaaaaaa

SEQ ID NO: 2934669 - DNA, 13 bp, Homo sapiens
tgcagaacacctg

SEQ ID NO: 2934670 - DNA, 14 bp, Homo sapiens
tgcagaacacctgg

SEQ ID NO: 2934671 - DNA, 17 bp, Homo sapiens
tgcagaacacctggccg

SEQ ID NO: 2934672 - DNA, 19 bp, Homo sapiens
tgcagaacacctggccggg

SEQ ID NO: 2934673 - DNA, 19 bp, Homo sapiens
tgcagaacaggcagaaata

SEQ ID NO: 2934674 - DNA, 23 bp, Homo sapiens
tgcagaacaggcagaaatataaa

SEQ ID NO: 2934675 - DNA, 14 bp, Homo sapiens
tgcagaactaaact

SEQ ID NO: 2934676 - DNA, 15 bp, Homo sapiens
tgcagaagcagagat

SEQ ID NO: 2934677 - DNA, 12 bp, Homo sapiens
tgcagaatctct

SEQ ID NO: 2934678 - DNA, 12 bp, Homo sapiens
tgcagaatgtaa

SEQ ID NO: 2934679 - DNA, 20 bp, Homo sapiens
tgcagacaggaatcttaagg

SEQ ID NO: 2934680 - DNA, 16 bp, Homo sapiens
tgcagaccttactcag

SEQ ID NO: 2934681 - DNA, 18 bp, Homo sapiens
tgcagaccttactcaggg

SEQ ID NO: 2934682 - DNA, 15 bp, Homo sapiens
tgcagagaaagaaag

SEQ ID NO: 2934683 - DNA, 20 bp, Homo sapiens
tgcagagaaagaaagggaaa

SEQ ID NO: 2934684 - DNA, 22 bp, Homo sapiens
tgcagagatatttcttcaggag

SEQ ID NO: 2934685 - DNA, 11 bp, Homo sapiens
tgcagagctgc

SEQ ID NO: 2934686 - DNA, 12 bp, Homo sapiens
tgcagaggagcc

SEQ ID NO: 2934687 - DNA, 15 bp, Homo sapiens
tgcagaggagcccag

SEQ ID NO: 2934688 - DNA, 21 bp, Homo sapiens
tgcagaggaggagaaaagtga

SEQ ID NO: 2934689 - DNA, 17 bp, Homo sapiens
tgcagaggcctggggga

SEQ ID NO: 2934690 - DNA, 19 bp, Homo sapiens
tgcagagggtactttaaga

SEQ ID NO: 2934691 - DNA, 15 bp, Homo sapiens
tgcagagtaagtatt

SEQ ID NO: 2934692 - DNA, 15 bp, Homo sapiens
tgcagataaacagaa

SEQ ID NO: 2934693 - DNA, 17 bp, Homo sapiens
tgcagataactttgact

SEQ ID NO: 2934694 - DNA, 16 bp, Homo sapiens
tgcagatagaaagcat

SEQ ID NO: 2934695 - DNA, 22 bp, Homo sapiens
tgcagcaattaaaaattgtctt

SEQ ID NO: 2934696 - DNA, 22 bp, Homo sapiens
tgcagcacatgcgggctcgccc

SEQ ID NO: 2934697 - DNA, 13 bp, Homo sapiens
tgcagcacattga

SEQ ID NO: 2934698 - DNA, 20 bp, Homo sapiens
tgcagcaccgaggggccttt

SEQ ID NO: 2934699 - DNA, 17 bp, Homo sapiens
tgcagcactgctgcctc

SEQ ID NO: 2934700 - DNA, 22 bp, Homo sapiens
tgcagcactgctgcctcagctc

SEQ ID NO: 2934701 - DNA, 23 bp, Homo sapiens
tgcagcactttttccttctgaaa

SEQ ID NO: 2934702 - DNA, 13 bp, Homo sapiens
tgcagcagattgg

SEQ ID NO: 2934703 - DNA, 16 bp, Homo sapiens
tgcagcagattggaag

SEQ ID NO: 2934704 - DNA, 19 bp, Homo sapiens
tgcagcagggatgccctgg

SEQ ID NO: 2934705 - DNA, 13 bp, Homo sapiens
tgcagccagaggc

SEQ ID NO: 2934706 - DNA, 12 bp, Homo sapiens
tgcagccagccc

SEQ ID NO: 2934707 - DNA, 17 bp, Homo sapiens
tgcagccagcccagccc

SEQ ID NO: 2934708 - DNA, 21 bp, Homo sapiens
tgcagccagcccagcccagct

SEQ ID NO: 2934709 - DNA, 22 bp, Homo sapiens
tgcagccagcccagcccagctg

SEQ ID NO: 2934710 - DNA, 15 bp, Homo sapiens
tgcagccaggcctcg

SEQ ID NO: 2934711 - DNA, 18 bp, Homo sapiens
tgcagccaggcctcgcct

SEQ ID NO: 2934712 - DNA, 19 bp, Homo sapiens
tgcagccaggcctcgcctg

SEQ ID NO: 2934713 - DNA, 16 bp, Homo sapiens
tgcagcccaccaggag

SEQ ID NO: 2934714 - DNA, 17 bp, Homo sapiens
tgcagcccaccaggagc

SEQ ID NO: 2934715 - DNA, 23 bp, Homo sapiens
tgcagcccagagaccttcaaatg

SEQ ID NO: 2934716 - DNA, 19 bp, Homo sapiens
tgcagcccatttctccaga

SEQ ID NO: 2934717 - DNA, 15 bp, Homo sapiens
tgcagcctccggggt

SEQ ID NO: 2934718 - DNA, 13 bp, Homo sapiens
tgcagcctggtca

SEQ ID NO: 2934719 - DNA, 14 bp, Homo sapiens
tgcagctaacatga

SEQ ID NO: 2934720 - DNA, 22 bp, Homo sapiens
tgcagctagtcctagtgaacct

SEQ ID NO: 2934721 - DNA, 20 bp, Homo sapiens
tgcagctcaagagatcccaa

SEQ ID NO: 2934722 - DNA, 21 bp, Homo sapiens
tgcagctcaaggaaaggcctg

SEQ ID NO: 2934723 - DNA, 19 bp, Homo sapiens
tgcagctgcttgttgtcaa

SEQ ID NO: 2934724 - DNA, 19 bp, Homo sapiens
tgcagctggaaaagggtct

SEQ ID NO: 2934725 - DNA, 12 bp, Homo sapiens
tgcagctggccc

SEQ ID NO: 2934726 - DNA, 13 bp, Homo sapiens
tgcagctggccca

SEQ ID NO: 2934727 - DNA, 20 bp, Homo sapiens
tgcaggaaggaaaactatgt

SEQ ID NO: 2934728 - DNA, 12 bp, Homo sapiens
tgcaggacagct

SEQ ID NO: 2934729 - DNA, 14 bp, Homo sapiens
tgcaggacagctct

SEQ ID NO: 2934730 - DNA, 18 bp, Homo sapiens
tgcaggacagctcttgat

SEQ ID NO: 2934731 - DNA, 15 bp, Homo sapiens
tgcaggacctgcctg

SEQ ID NO: 2934732 - DNA, 18 bp, Homo sapiens
tgcaggacctgcctgtag

SEQ ID NO: 2934733 - DNA, 15 bp, Homo sapiens
tgcaggacttgagaa

SEQ ID NO: 2934734 - DNA, 16 bp, Homo sapiens
tgcaggagacattttc

SEQ ID NO: 2934735 - DNA, 21 bp, Homo sapiens
tgcaggagcgtgaaggactta

SEQ ID NO: 2934736 - DNA, 15 bp, Homo sapiens
tgcaggagggcactg

SEQ ID NO: 2934737 - DNA, 21 bp, Homo sapiens
tgcaggagggcactggagctg

SEQ ID NO: 2934738 - DNA, 14 bp, Homo sapiens
tgcaggatggtgtc

SEQ ID NO: 2934739 - DNA, 18 bp, Homo sapiens
tgcaggatggtgtctctt

SEQ ID NO: 2934740 - DNA, 23 bp, Homo sapiens
tgcaggatttttagagcattaaa

SEQ ID NO: 2934741 - DNA, 14 bp, Homo sapiens
tgcaggcagtgtct

SEQ ID NO: 2934742 - DNA, 10 bp, Homo sapiens
tgcaggcccc

SEQ ID NO: 2934743 - DNA, 21 bp, Homo sapiens
tgcaggcctaggtgcagctcc

SEQ ID NO: 2934744 - DNA, 22 bp, Homo sapiens
tgcaggcctaggtgcagctcct

SEQ ID NO: 2934745 - DNA, 13 bp, Homo sapiens
tgcaggcggccct

SEQ ID NO: 2934746 - DNA, 15 bp, Homo sapiens
tgcaggctcccctga

SEQ ID NO: 2934747 - DNA, 18 bp, Homo sapiens
tgcaggctcccctgagga

SEQ ID NO: 2934748 - DNA, 15 bp, Homo sapiens
tgcaggctggccagc

SEQ ID NO: 2934749 - DNA, 16 bp, Homo sapiens
tgcaggcttaataaaa

SEQ ID NO: 2934750 - DNA, 15 bp, Homo sapiens
tgcagggaaaattat

SEQ ID NO: 2934751 - DNA, 21 bp, Homo sapiens
tgcagggaaaattatttgcat

SEQ ID NO: 2934752 - DNA, 22 bp, Homo sapiens
tgcagggaaaattatttgcata

SEQ ID NO: 2934753 - DNA, 16 bp, Homo sapiens
tgcagggcacagatga

SEQ ID NO: 2934754 - DNA, 13 bp, Homo sapiens
tgcagggcagtca

SEQ ID NO: 2934755 - DNA, 23 bp, Homo sapiens
tgcagggccgcgagaggccgagc

SEQ ID NO: 2934756 - DNA, 14 bp, Homo sapiens
tgcaggggactggg

SEQ ID NO: 2934757 - DNA, 18 bp, Homo sapiens
tgcaggggatggggtggg

SEQ ID NO: 2934758 - DNA, 19 bp, Homo sapiens
tgcagggtcctcttctggg

SEQ ID NO: 2934759 - DNA, 17 bp, Homo sapiens
tgcaggtcaaaagtcag

SEQ ID NO: 2934760 - DNA, 23 bp, Homo sapiens
tgcaggttggcaaacgggcttga

SEQ ID NO: 2934761 - DNA, 13 bp, Homo sapiens
tgcagtaaatctt

SEQ ID NO: 2934762 - DNA, 14 bp, Homo sapiens
tgcagtaaatcttt

SEQ ID NO: 2934763 - DNA, 14 bp, Homo sapiens
tgcagtagattttc

SEQ ID NO: 2934764 - DNA, 19 bp, Homo sapiens
tgcagtagattttctttaa

SEQ ID NO: 2934765 - DNA, 18 bp, Homo sapiens
tgcagtaggggaggagca

SEQ ID NO: 2934766 - DNA, 16 bp, Homo sapiens
tgcagtatcatgccct

SEQ ID NO: 2934767 - DNA, 21 bp, Homo sapiens
tgcagtatcatgccctgtgca

SEQ ID NO: 2934768 - DNA, 13 bp, Homo sapiens
tgcagtcatcttg

SEQ ID NO: 2934769 - DNA, 22 bp, Homo sapiens
tgcagtcctgatcagagccgtg

SEQ ID NO: 2934770 - DNA, 17 bp, Homo sapiens
tgcagtcgcttgccaaa

SEQ ID NO: 2934771 - DNA, 19 bp, Homo sapiens
tgcagtcgcttgccaaagc

SEQ ID NO: 2934772 - DNA, 22 bp, Homo sapiens
tgcagtcggcatgccaggaccc

SEQ ID NO: 2934773 - DNA, 21 bp, Homo sapiens
tgcagtctttcccccaggaaa

SEQ ID NO: 2934774 - DNA, 15 bp, Homo sapiens
tgcagtgaagtgttc

SEQ ID NO: 2934775 - DNA, 15 bp, Homo sapiens
tgcagtgagctgaga

SEQ ID NO: 2934776 - DNA, 19 bp, Homo sapiens
tgcagtgccagctccctcg

SEQ ID NO: 2934777 - DNA, 14 bp, Homo sapiens
tgcagtgcggctca

SEQ ID NO: 2934778 - DNA, 22 bp, Homo sapiens
tgcagtggccccttaggccagt

SEQ ID NO: 2934779 - DNA, 15 bp, Homo sapiens
tgcagtggcctggcc

SEQ ID NO: 2934780 - DNA, 23 bp, Homo sapiens
tgcagtggtgcgatctcggctca

SEQ ID NO: 2934781 - DNA, 15 bp, Homo sapiens
tgcagtgttttgcat

SEQ ID NO: 2934782 - DNA, 15 bp, Homo sapiens
tgcagtgtttttcct

SEQ ID NO: 2934783 - DNA, 20 bp, Homo sapiens
tgcagttcagtttgtctctt

SEQ ID NO: 2934784 - DNA, 22 bp, Homo sapiens
tgcagttcctcttcatctgtgt

SEQ ID NO: 2934785 - DNA, 20 bp, Homo sapiens
tgcagttctagtttgcattc

SEQ ID NO: 2934786 - DNA, 15 bp, Homo sapiens
tgcccggcgcctgcc

SEQ ID NO: 2934787 - DNA, 22 bp, Homo sapiens
tgcccggctaatttttttgtat

SEQ ID NO: 2934788 - DNA, 13 bp, Homo sapiens
tgccctaagggac

SEQ ID NO: 2934789 - DNA, 12 bp, Homo sapiens
tgccctaagtga

SEQ ID NO: 2934790 - DNA, 16 bp, Homo sapiens
tgccctaattcatctt

SEQ ID NO: 2934791 - DNA, 23 bp, Homo sapiens
tgccctaattcatcttttaatca

SEQ ID NO: 2934792 - DNA, 22 bp, Homo sapiens
tgccctactatagcagttttta

SEQ ID NO: 2934793 - DNA, 15 bp, Homo sapiens
tgccctcaagtaaaa

SEQ ID NO: 2934794 - DNA, 18 bp, Homo sapiens
tgccctcaagtaaaagaa

SEQ ID NO: 2934795 - DNA, 21 bp, Homo sapiens
tgccctcaagtaaaagaaaag

SEQ ID NO: 2934796 - DNA, 14 bp, Homo sapiens
tgccctcccctctc

SEQ ID NO: 2934797 - DNA, 17 bp, Homo sapiens
tgccctcccctctctgc

SEQ ID NO: 2934798 - DNA, 21 bp, Homo sapiens
tgccctcccctctctgcaccg

SEQ ID NO: 2934799 - DNA, 15 bp, Homo sapiens
tgccctcctctccca

SEQ ID NO: 2934800 - DNA, 19 bp, Homo sapiens
tgccctcctctcccgtctc

SEQ ID NO: 2934801 - DNA, 15 bp, Homo sapiens
tgccctctgctgctg

SEQ ID NO: 2934802 - DNA, 19 bp, Homo sapiens
tgccctctgctgctgcccg

SEQ ID NO: 2934803 - DNA, 17 bp, Homo sapiens
tgccctgaacctctgat

SEQ ID NO: 2934804 - DNA, 15 bp, Homo sapiens
tgccctgaggggctg

SEQ ID NO: 2934805 - DNA, 19 bp, Homo sapiens
tgccctgaggggctgggga

SEQ ID NO: 2934806 - DNA, 12 bp, Homo sapiens
tgccctgcccaa

SEQ ID NO: 2934807 - DNA, 15 bp, Homo sapiens
tgccctgcccaagtg

SEQ ID NO: 2934808 - DNA, 21 bp, Homo sapiens
tgccctgccgtggtggcagct

SEQ ID NO: 2934809 - DNA, 20 bp, Homo sapiens
tgccctgctatttcaggccc

SEQ ID NO: 2934810 - DNA, 13 bp, Homo sapiens
tgccctgctccct

SEQ ID NO: 2934811 - DNA, 22 bp, Homo sapiens
tgccctgggtcctgcctgcagt

SEQ ID NO: 2934812 - DNA, 12 bp, Homo sapiens
tgccctgtgccg

SEQ ID NO: 2934813 - DNA, 20 bp, Homo sapiens
tgccctgtgccgcactctgg

SEQ ID NO: 2934814 - DNA, 19 bp, Homo sapiens
tgccctgtggacaggatga

SEQ ID NO: 2934815 - DNA, 14 bp, Homo sapiens
tgccctgtgtggct

SEQ ID NO: 2934816 - DNA, 18 bp, Homo sapiens
tgcccttggcacccaaga

SEQ ID NO: 2934817 - DNA, 13 bp, Homo sapiens
tgcccttgggcca

SEQ ID NO: 2934818 - DNA, 20 bp, Homo sapiens
tgcccttggtttctgggggc

SEQ ID NO: 2934819 - DNA, 21 bp, Homo sapiens
tgcccttttcctgggccttct

SEQ ID NO: 2934820 - DNA, 18 bp, Homo sapiens
tgccgaagtccagctttc

SEQ ID NO: 2934821 - DNA, 14 bp, Homo sapiens
tgccgacctcgtcc

SEQ ID NO: 2934822 - DNA, 15 bp, Homo sapiens
tgccgacctcgtcct

SEQ ID NO: 2934823 - DNA, 22 bp, Homo sapiens
tgccgactcccccaaccaagga

SEQ ID NO: 2934824 - DNA, 16 bp, Homo sapiens
tgccgcacatgaaaca

SEQ ID NO: 2934825 - DNA, 12 bp, Homo sapiens
tgccgcacccca

SEQ ID NO: 2934826 - DNA, 14 bp, Homo sapiens
tgccgcactctggc

SEQ ID NO: 2934827 - DNA, 21 bp, Homo sapiens
tgccgcagtggggtcaagctg

SEQ ID NO: 2934828 - DNA, 23 bp, Homo sapiens
tgccgcagtggggtcaagctgag

SEQ ID NO: 2934829 - DNA, 16 bp, Homo sapiens
tgccgccgcccgctgg

SEQ ID NO: 2934830 - DNA, 20 bp, Homo sapiens
tgccgcctgcactcctcagg

SEQ ID NO: 2934831 - DNA, 20 bp, Homo sapiens
tgccgcgtcgccctcccagg

SEQ ID NO: 2934832 - DNA, 15 bp, Homo sapiens
tgccgctacctccct

SEQ ID NO: 2934833 - DNA, 16 bp, Homo sapiens
tgccgctacctccctc

SEQ ID NO: 2934834 - DNA, 17 bp, Homo sapiens
tgccgctacctccctcc

SEQ ID NO: 2934835 - DNA, 14 bp, Homo sapiens
tgccggagaggaag

SEQ ID NO: 2934836 - DNA, 15 bp, Homo sapiens
tgccggagaggaaga

SEQ ID NO: 2934837 - DNA, 20 bp, Homo sapiens
tgccggtaaacacgcctgca

SEQ ID NO: 2934838 - DNA, 12 bp, Homo sapiens
tgccgtctctgg

SEQ ID NO: 2934839 - DNA, 14 bp, Homo sapiens
tgccgtctctggag

SEQ ID NO: 2934840 - DNA, 16 bp, Homo sapiens
tgccgtcttctgccct

SEQ ID NO: 2934841 - DNA, 14 bp, Homo sapiens
tgcctaaaatgaat

SEQ ID NO: 2934842 - DNA, 13 bp, Homo sapiens
tgcctaagacatg

SEQ ID NO: 2934843 - DNA, 15 bp, Homo sapiens
tgcctaagtggctgc

SEQ ID NO: 2934844 - DNA, 13 bp, Homo sapiens
tgcctaatcactc

SEQ ID NO: 2934845 - DNA, 17 bp, Homo sapiens
tgcctatcctgctgttc

SEQ ID NO: 2934846 - DNA, 23 bp, Homo sapiens
tgcctatcctgctgttctagcac

SEQ ID NO: 2934847 - DNA, 23 bp, Homo sapiens
tgcctcaactccaccctctgcga

SEQ ID NO: 2934848 - DNA, 23 bp, Homo sapiens
tgcctcaatgtgaatcagaccct

SEQ ID NO: 2934849 - DNA, 14 bp, Homo sapiens
tgcctcacatctcc

SEQ ID NO: 2934850 - DNA, 16 bp, Homo sapiens
tgcctcacatctccct

SEQ ID NO: 2934851 - DNA, 19 bp, Homo sapiens
tgcctcagccctgaccctg

SEQ ID NO: 2934852 - DNA, 17 bp, Homo sapiens
tgcctcagcctcccgag

SEQ ID NO: 2934853 - DNA, 13 bp, Homo sapiens
tgcctcagccttc

SEQ ID NO: 2934854 - DNA, 17 bp, Homo sapiens
tgcctcagctgcatctg

SEQ ID NO: 2934855 - DNA, 18 bp, Homo sapiens
tgcctcaggaggcaggac

SEQ ID NO: 2934856 - DNA, 21 bp, Homo sapiens
tgcctcaggaggcaggacctt

SEQ ID NO: 2934857 - DNA, 18 bp, Homo sapiens
tgcctcataaattaatga

SEQ ID NO: 2934858 - DNA, 16 bp, Homo sapiens
tgcctcatcctcctcc

SEQ ID NO: 2934859 - DNA, 19 bp, Homo sapiens
tgcctcatcctcctcctca

SEQ ID NO: 2934860 - DNA, 20 bp, Homo sapiens
tgcctcatctataacatgca

SEQ ID NO: 2934861 - DNA, 17 bp, Homo sapiens
tgcctccagaagcactg

SEQ ID NO: 2934862 - DNA, 17 bp, Homo sapiens
tgcctccctctcctcgg

SEQ ID NO: 2934863 - DNA, 13 bp, Homo sapiens
tgcctccctctct

SEQ ID NO: 2934864 - DNA, 16 bp, Homo sapiens
tgcctccctctcttcc

SEQ ID NO: 2934865 - DNA, 13 bp, Homo sapiens
tgcctcccttccc

SEQ ID NO: 2934866 - DNA, 23 bp, Homo sapiens
tgcctcccttcccagtgggctgt

SEQ ID NO: 2934867 - DNA, 19 bp, Homo sapiens
tgcctcctccctggctgca

SEQ ID NO: 2934868 - DNA, 20 bp, Homo sapiens
tgcctcctccctggctgcag

SEQ ID NO: 2934869 - DNA, 16 bp, Homo sapiens
tgcctcctctctccct

SEQ ID NO: 2934870 - DNA, 19 bp, Homo sapiens
tgcctcctctctccctgcc

SEQ ID NO: 2934871 - DNA, 22 bp, Homo sapiens
tgcctcctctctccctgcctca

SEQ ID NO: 2934872 - DNA, 23 bp, Homo sapiens
tgcctcctctctccctgcctcac

SEQ ID NO: 2934873 - DNA, 12 bp, Homo sapiens
tgcctcctggct

SEQ ID NO: 2934874 - DNA, 16 bp, Homo sapiens
tgcctcctggctcagg

SEQ ID NO: 2934875 - DNA, 19 bp, Homo sapiens
tgcctccttgccagcccca

SEQ ID NO: 2934876 - DNA, 17 bp, Homo sapiens
tgcctccttttttctta

SEQ ID NO: 2934877 - DNA, 16 bp, Homo sapiens
tgcctcgaaagtgtca

SEQ ID NO: 2934878 - DNA, 15 bp, Homo sapiens
tgcctcgagggccgc

SEQ ID NO: 2934879 - DNA, 16 bp, Homo sapiens
tgcctcgccttgtgtt

SEQ ID NO: 2934880 - DNA, 14 bp, Homo sapiens
tgcctctaactccc

SEQ ID NO: 2934881 - DNA, 16 bp, Homo sapiens
tgcctctaactccctc

SEQ ID NO: 2934882 - DNA, 18 bp, Homo sapiens
tgcctctaactccctcct

SEQ ID NO: 2934883 - DNA, 20 bp, Homo sapiens
tgcctctaactccctcctca

SEQ ID NO: 2934884 - DNA, 17 bp, Homo sapiens
tgcctctacctgacact

SEQ ID NO: 2934885 - DNA, 23 bp, Homo sapiens
tgcctctacctgacactcccttg

SEQ ID NO: 2934886 - DNA, 20 bp, Homo sapiens
tgcctctcctttgtatatta

SEQ ID NO: 2934887 - DNA, 19 bp, Homo sapiens
tgcctctgacagcagcctg

SEQ ID NO: 2934888 - DNA, 23 bp, Homo sapiens
tgcctctgacagcagcctgtgag

SEQ ID NO: 2934889 - DNA, 13 bp, Homo sapiens
tgcctctgagctt

SEQ ID NO: 2934890 - DNA, 15 bp, Homo sapiens
tgcctctgagcttct

SEQ ID NO: 2934891 - DNA, 18 bp, Homo sapiens
tgcctctgattttctcca

SEQ ID NO: 2934892 - DNA, 17 bp, Homo sapiens
tgcctctgtcctagact

SEQ ID NO: 2934893 - DNA, 18 bp, Homo sapiens
tgcctctgtcttctggac

SEQ ID NO: 2934894 - DNA, 20 bp, Homo sapiens
tgcctcttctcttgacagtc

SEQ ID NO: 2934895 - DNA, 21 bp, Homo sapiens
tgcctcttctcttgacagtct

SEQ ID NO: 2934896 - DNA, 23 bp, Homo sapiens
tgcctcttctcttgacagtctga

SEQ ID NO: 2934897 - DNA, 16 bp, Homo sapiens
tgcctcttctgggagg

SEQ ID NO: 2934898 - DNA, 20 bp, Homo sapiens
tgcctcttctgggagggcag

SEQ ID NO: 2934899 - DNA, 15 bp, Homo sapiens
tgcctgaaacccatt

SEQ ID NO: 2934900 - DNA, 15 bp, Homo sapiens
tgcctgaagacccca

SEQ ID NO: 2934901 - DNA, 18 bp, Homo sapiens
tgcctgaagaccccagat

SEQ ID NO: 2934902 - DNA, 13 bp, Homo sapiens
tgcctgagcccct

SEQ ID NO: 2934903 - DNA, 14 bp, Homo sapiens
tgcctgagcccctc

SEQ ID NO: 2934904 - DNA, 18 bp, Homo sapiens
tgcctgatcctccaacag

SEQ ID NO: 2934905 - DNA, 15 bp, Homo sapiens
tgcctgcagagtttg

SEQ ID NO: 2934906 - DNA, 12 bp, Homo sapiens
tgcctgcagggc

SEQ ID NO: 2934907 - DNA, 13 bp, Homo sapiens
tgcctgcagggcc

SEQ ID NO: 2934908 - DNA, 22 bp, Homo sapiens
tgcctgcagggccatggctcag

SEQ ID NO: 2934909 - DNA, 15 bp, Homo sapiens
tgcctgccagctgca

SEQ ID NO: 2934910 - DNA, 19 bp, Homo sapiens
tgcctgccagctgcactga

SEQ ID NO: 2934911 - DNA, 22 bp, Homo sapiens
tgcctgccctctgtctgtcttc

SEQ ID NO: 2934912 - DNA, 20 bp, Homo sapiens
tgcctgctttctccaagaca

SEQ ID NO: 2934913 - DNA, 18 bp, Homo sapiens
tgcctggaacaccagcag

SEQ ID NO: 2934914 - DNA, 23 bp, Homo sapiens
tgcctggaagctttgtcccctgc

SEQ ID NO: 2934915 - DNA, 15 bp, Homo sapiens
tgcctggagtgctgt

SEQ ID NO: 2934916 - DNA, 23 bp, Homo sapiens
tgcctggcaggctgtctggccag

SEQ ID NO: 2934917 - DNA, 16 bp, Homo sapiens
tgcctggccatgctgt

SEQ ID NO: 2934918 - DNA, 17 bp, Homo sapiens
tgctgatgttcagtgta

SEQ ID NO: 2934919 - DNA, 20 bp, Homo sapiens
tgctgatgttcagtgtaatt

SEQ ID NO: 2934920 - DNA, 17 bp, Homo sapiens
tgctgcagagttgaggg

SEQ ID NO: 2934921 - DNA, 18 bp, Homo sapiens
tgctgcagtcatctactt

SEQ ID NO: 2934922 - DNA, 14 bp, Homo sapiens
tgctgcatacattc

SEQ ID NO: 2934923 - DNA, 19 bp, Homo sapiens
tgctgccaagtcctgcctt

SEQ ID NO: 2934924 - DNA, 21 bp, Homo sapiens
tgctgccactctgctgcctgt

SEQ ID NO: 2934925 - DNA, 22 bp, Homo sapiens
tgctgccactctgctgcctgta

SEQ ID NO: 2934926 - DNA, 14 bp, Homo sapiens
tgctgccacttttt

SEQ ID NO: 2934927 - DNA, 13 bp, Homo sapiens
tgctgcccaggcc

SEQ ID NO: 2934928 - DNA, 13 bp, Homo sapiens
tgctgcccatgag

SEQ ID NO: 2934929 - DNA, 19 bp, Homo sapiens
tgctgccccatcagtgctc

SEQ ID NO: 2934930 - DNA, 15 bp, Homo sapiens
tgctgcccctccctg

SEQ ID NO: 2934931 - DNA, 23 bp, Homo sapiens
tgctgcccttggtttctgggggc

SEQ ID NO: 2934932 - DNA, 11 bp, Homo sapiens
tgctgcctcag

SEQ ID NO: 2934933 - DNA, 12 bp, Homo sapiens
tgctgcctcagc

SEQ ID NO: 2934934 - DNA, 14 bp, Homo sapiens
tgctgcctcagctc

SEQ ID NO: 2934935 - DNA, 13 bp, Homo sapiens
tgctgcctgggta

SEQ ID NO: 2934936 - DNA, 20 bp, Homo sapiens
tgctgcctgggtaggcccca

SEQ ID NO: 2934937 - DNA, 18 bp, Homo sapiens
tgctgctcattccacact

SEQ ID NO: 2934938 - DNA, 18 bp, Homo sapiens
tgctgctccttagctgcc

SEQ ID NO: 2934939 - DNA, 20 bp, Homo sapiens
tgctgctgaactaatttctg

SEQ ID NO: 2934940 - DNA, 11 bp, Homo sapiens
tgctgctgccc

SEQ ID NO: 2934941 - DNA, 13 bp, Homo sapiens
tgctgctgctgct

SEQ ID NO: 2934942 - DNA, 14 bp, Homo sapiens
tgctgctgctgctc

SEQ ID NO: 2934943 - DNA, 13 bp, Homo sapiens
tgctgctggcctc

SEQ ID NO: 2934944 - DNA, 16 bp, Homo sapiens
tgctgctggtgcacag

SEQ ID NO: 2934945 - DNA, 20 bp, Homo sapiens
tgctgcttcaccagactttt

SEQ ID NO: 2934946 - DNA, 13 bp, Homo sapiens
tgctgcttcctaa

SEQ ID NO: 2934947 - DNA, 15 bp, Homo sapiens
tgctgcttgtgcctc

SEQ ID NO: 2934948 - DNA, 22 bp, Homo sapiens
tgctgcttgtgcctcccttccc

SEQ ID NO: 2934949 - DNA, 19 bp, Homo sapiens
tgctgctttgttgttctgc

SEQ ID NO: 2934950 - DNA, 19 bp, Homo sapiens
tgctgcttttatatctgta

SEQ ID NO: 2934951 - DNA, 22 bp, Homo sapiens
tgctggaaaatctgtaaaaaag

SEQ ID NO: 2934952 - DNA, 17 bp, Homo sapiens
tgctggaacctgcaaaa

SEQ ID NO: 2934953 - DNA, 14 bp, Homo sapiens
tgctggagccctgt

SEQ ID NO: 2934954 - DNA, 14 bp, Homo sapiens
tgctggcccaccca

SEQ ID NO: 2934955 - DNA, 16 bp, Homo sapiens
tgctggcccagcatgg

SEQ ID NO: 2934956 - DNA, 17 bp, Homo sapiens
tgctggcccagggccca

SEQ ID NO: 2934957 - DNA, 20 bp, Homo sapiens
tgctggcccagggcccagag

SEQ ID NO: 2934958 - DNA, 22 bp, Homo sapiens
tgctggcctccctccgtccctc

SEQ ID NO: 2934959 - DNA, 19 bp, Homo sapiens
tgctggcctcttggcacct

SEQ ID NO: 2934960 - DNA, 21 bp, Homo sapiens
tgctggcctcttggcacctgc

SEQ ID NO: 2934961 - DNA, 12 bp, Homo sapiens
tgctggccttgg

SEQ ID NO: 2934962 - DNA, 17 bp, Homo sapiens
tgctggccttggtatgt

SEQ ID NO: 2934963 - DNA, 23 bp, Homo sapiens
tgctggccttggtatgtgccagg

SEQ ID NO: 2934964 - DNA, 20 bp, Homo sapiens
tgctggctcacgccccgctg

SEQ ID NO: 2934965 - DNA, 17 bp, Homo sapiens
tgctggctggtgcctga

SEQ ID NO: 2934966 - DNA, 16 bp, Homo sapiens
tgctgggattacagac

SEQ ID NO: 2934967 - DNA, 15 bp, Homo sapiens
tgctgggctctccac

SEQ ID NO: 2934968 - DNA, 18 bp, Homo sapiens
tgctgggctctccacctc

SEQ ID NO: 2934969 - DNA, 22 bp, Homo sapiens
tgctgggctctccacctcagcc

SEQ ID NO: 2934970 - DNA, 22 bp, Homo sapiens
tgctgggctcttaactgttgct

SEQ ID NO: 2934971 - DNA, 19 bp, Homo sapiens
tgctgggctgacggtgcag

SEQ ID NO: 2934972 - DNA, 15 bp, Homo sapiens
tgctgggggcaactg

SEQ ID NO: 2934973 - DNA, 22 bp, Homo sapiens
tgctgggggctccccttgccct

SEQ ID NO: 2934974 - DNA, 18 bp, Homo sapiens
tgctggggtacacagtga

SEQ ID NO: 2934975 - DNA, 13 bp, Homo sapiens
tgctgggtaataa

SEQ ID NO: 2934976 - DNA, 23 bp, Homo sapiens
tgctggtagctgaggggacgggc

SEQ ID NO: 2934977 - DNA, 16 bp, Homo sapiens
tgctggtctctggctc

SEQ ID NO: 2934978 - DNA, 13 bp, Homo sapiens
tgctggtttattt

SEQ ID NO: 2934979 - DNA, 15 bp, Homo sapiens
tgctgtacatctatt

SEQ ID NO: 2934980 - DNA, 21 bp, Homo sapiens
tgctgtacatctattttggat

SEQ ID NO: 2934981 - DNA, 16 bp, Homo sapiens
tgctgtccctgcactg

SEQ ID NO: 2934982 - DNA, 21 bp, Homo sapiens
tgctgtccctgcactgtgccc

SEQ ID NO: 2934983 - DNA, 14 bp, Homo sapiens
tgctgtcctcaggt

SEQ ID NO: 2934984 - DNA, 21 bp, Homo sapiens
tgctgtcctcaggtggccatg

SEQ ID NO: 2934985 - DNA, 14 bp, Homo sapiens
tgctgtctgcagcc

SEQ ID NO: 2934986 - DNA, 17 bp, Homo sapiens
tgctgtctgcagccttg

SEQ ID NO: 2934987 - DNA, 12 bp, Homo sapiens
tgctgtctttgt

SEQ ID NO: 2934988 - DNA, 19 bp, Homo sapiens
tgctgtgaataaaaagaaa

SEQ ID NO: 2934989 - DNA, 17 bp, Homo sapiens
tgctgtgcaaacagtgt

SEQ ID NO: 2934990 - DNA, 18 bp, Homo sapiens
tgctgtgcaaacagtgta

SEQ ID NO: 2934991 - DNA, 22 bp, Homo sapiens
tgctgtgcaaacagtgtaagct

SEQ ID NO: 2934992 - DNA, 20 bp, Homo sapiens
tgctgtgctacgtgtgaaat

SEQ ID NO: 2934993 - DNA, 21 bp, Homo sapiens
tgctgtgcttttgatctctgc

SEQ ID NO: 2934994 - DNA, 17 bp, Homo sapiens
tgctgtggtgtgtcccc

SEQ ID NO: 2934995 - DNA, 14 bp, Homo sapiens
tgctgtgtaaagtt

SEQ ID NO: 2934996 - DNA, 19 bp, Homo sapiens
tgctgtgtatatggtatat

SEQ ID NO: 2934997 - DNA, 20 bp, Homo sapiens
tgctgtgtgagaccagggga

SEQ ID NO: 2934998 - DNA, 14 bp, Homo sapiens
tgctgttgaaagca

SEQ ID NO: 2934999 - DNA, 17 bp, Homo sapiens
tgctgttgaaagcaaaa

SEQ ID NO: 2935000 - DNA, 21 bp, Homo sapiens
tgctgttgaaagcaaaaatgc

SEQ ID NO: 2935001 - DNA, 18 bp, Homo sapiens
tgctgttgacatatttaa

SEQ ID NO: 2935002 - DNA, 17 bp, Homo sapiens
tgctgttgattgctaaa

SEQ ID NO: 2935003 - DNA, 22 bp, Homo sapiens
tgctgttgattgctaaatgtaa

SEQ ID NO: 2935004 - DNA, 14 bp, Homo sapiens
tgctgtttagattt

SEQ ID NO: 2935005 - DNA, 20 bp, Homo sapiens
tgctgtttagcttcctccag

SEQ ID NO: 2935006 - DNA, 21 bp, Homo sapiens
tgctgtttagcttcctccaga

SEQ ID NO: 2935007 - DNA, 22 bp, Homo sapiens
tgctgtttagcttcctccagag

SEQ ID NO: 2935008 - DNA, 14 bp, Homo sapiens
tgctgtttgggcag

SEQ ID NO: 2935009 - DNA, 13 bp, Homo sapiens
tgctgttttaaat

SEQ ID NO: 2935010 - DNA, 22 bp, Homo sapiens
tgctgttttcctcccttctgct

SEQ ID NO: 2935011 - DNA, 18 bp, Homo sapiens
tgcttaattcaaataata

SEQ ID NO: 2935012 - DNA, 15 bp, Homo sapiens
tgcttaattgctgat

SEQ ID NO: 2935013 - DNA, 22 bp, Homo sapiens
tgcttaattttaattggaggaa

SEQ ID NO: 2935014 - DNA, 15 bp, Homo sapiens
tgcttacaatcttta

SEQ ID NO: 2935015 - DNA, 23 bp, Homo sapiens
tgcttaccttgactgttgatgta

SEQ ID NO: 2935016 - DNA, 12 bp, Homo sapiens
tgcttaccttgt

SEQ ID NO: 2935017 - DNA, 15 bp, Homo sapiens
tgcttactatgacct

SEQ ID NO: 2935018 - DNA, 21 bp, Homo sapiens
tgcttagaacccttctgcttt

SEQ ID NO: 2935019 - DNA, 22 bp, Homo sapiens
tgcttagagggatttctttgct

SEQ ID NO: 2935020 - DNA, 23 bp, Homo sapiens
tgcttagagggatttctttgctg

SEQ ID NO: 2935021 - DNA, 22 bp, Homo sapiens
tgcttaggagacagatcactcc

SEQ ID NO: 2935022 - DNA, 23 bp, Homo sapiens
tgcttaggagacagatcactcct

SEQ ID NO: 2935023 - DNA, 13 bp, Homo sapiens
tgcttagtaatgc

SEQ ID NO: 2935024 - DNA, 15 bp, Homo sapiens
tgcttatctgaaact

SEQ ID NO: 2935025 - DNA, 23 bp, Homo sapiens
tgcttatgatgggctccccagga

SEQ ID NO: 2935026 - DNA, 12 bp, Homo sapiens
tgcttatggaaa

SEQ ID NO: 2935027 - DNA, 13 bp, Homo sapiens
tgcttcaaaaaca

SEQ ID NO: 2935028 - DNA, 21 bp, Homo sapiens
tgcttcaaaaacattcttaca

SEQ ID NO: 2935029 - DNA, 17 bp, Homo sapiens
tgcttcaattaaaatta

SEQ ID NO: 2935030 - DNA, 18 bp, Homo sapiens
tgcttcaattaaaattac

SEQ ID NO: 2935031 - DNA, 16 bp, Homo sapiens
tgcttcaccagacttt

SEQ ID NO: 2935032 - DNA, 21 bp, Homo sapiens
tgcttcaccagacttttctct

SEQ ID NO: 2935033 - DNA, 19 bp, Homo sapiens
tgcttcagatgtggagcca

SEQ ID NO: 2935034 - DNA, 22 bp, Homo sapiens
tgcttcagatgtggagccaggc

SEQ ID NO: 2935035 - DNA, 11 bp, Homo sapiens
tgcttcataca

SEQ ID NO: 2935036 - DNA, 15 bp, Homo sapiens
tgcttcatacaggga

SEQ ID NO: 2935037 - DNA, 20 bp, Homo sapiens
tgcttcatatctctcccttc

SEQ ID NO: 2935038 - DNA, 17 bp, Homo sapiens
tgcttcatcattccctc

SEQ ID NO: 2935039 - DNA, 19 bp, Homo sapiens
tgcttcatcttcccaggta

SEQ ID NO: 2935040 - DNA, 14 bp, Homo sapiens
tgcttcctaactta

SEQ ID NO: 2935041 - DNA, 15 bp, Homo sapiens
tgcttcctcccaaca

SEQ ID NO: 2935042 - DNA, 17 bp, Homo sapiens
tgcttccttgcttttat

SEQ ID NO: 2935043 - DNA, 13 bp, Homo sapiens
tgcttcgggccct

SEQ ID NO: 2935044 - DNA, 18 bp, Homo sapiens
tgcttcgggcccttccca

SEQ ID NO: 2935045 - DNA, 13 bp, Homo sapiens
tgcttctccaaca

SEQ ID NO: 2935046 - DNA, 17 bp, Homo sapiens
tgcttctcggccagccc

SEQ ID NO: 2935047 - DNA, 18 bp, Homo sapiens
tgcttctcggccagcccg

SEQ ID NO: 2935048 - DNA, 17 bp, Homo sapiens
tgcttctcggggtccag

SEQ ID NO: 2935049 - DNA, 21 bp, Homo sapiens
tgcttctcggggtccagtgca

SEQ ID NO: 2935050 - DNA, 22 bp, Homo sapiens
tggcagcacggcccggcccctc

SEQ ID NO: 2935051 - DNA, 14 bp, Homo sapiens
tggcagcagagtgt

SEQ ID NO: 2935052 - DNA, 19 bp, Homo sapiens
tggcagcctcccatccagg

SEQ ID NO: 2935053 - DNA, 20 bp, Homo sapiens
tggcagcctcccatccaggg

SEQ ID NO: 2935054 - DNA, 22 bp, Homo sapiens
tggcagcctcccatccagggcc

SEQ ID NO: 2935055 - DNA, 13 bp, Homo sapiens
tggcagcctgcac

SEQ ID NO: 2935056 - DNA, 11 bp, Homo sapiens
tggcagctctg

SEQ ID NO: 2935057 - DNA, 12 bp, Homo sapiens
tggcagctgccc

SEQ ID NO: 2935058 - DNA, 14 bp, Homo sapiens
tggcagctgcccct

SEQ ID NO: 2935059 - DNA, 22 bp, Homo sapiens
tggcagctgcccctggcacctg

SEQ ID NO: 2935060 - DNA, 16 bp, Homo sapiens
tggcagctgggcccac

SEQ ID NO: 2935061 - DNA, 20 bp, Homo sapiens
tggcagctgggcccacagcc

SEQ ID NO: 2935062 - DNA, 18 bp, Homo sapiens
tggcagctggggctgtgg

SEQ ID NO: 2935063 - DNA, 17 bp, Homo sapiens
tggcaggaaggcttgtt

SEQ ID NO: 2935064 - DNA, 20 bp, Homo sapiens
tggcaggacgtgggctgggc

SEQ ID NO: 2935065 - DNA, 16 bp, Homo sapiens
tggcaggatccaaggg

SEQ ID NO: 2935066 - DNA, 19 bp, Homo sapiens
tggcaggatccaaggggct

SEQ ID NO: 2935067 - DNA, 15 bp, Homo sapiens
tggcagggcctagct

SEQ ID NO: 2935068 - DNA, 15 bp, Homo sapiens
tggcagggctgagga

SEQ ID NO: 2935069 - DNA, 23 bp, Homo sapiens
tggcaggggtggctgcctcattt

SEQ ID NO: 2935070 - DNA, 16 bp, Homo sapiens
tggcagggtgggatgg

SEQ ID NO: 2935071 - DNA, 14 bp, Homo sapiens
tggcaggtcactgt

SEQ ID NO: 2935072 - DNA, 18 bp, Homo sapiens
tggcaggtcactgtcact

SEQ ID NO: 2935073 - DNA, 19 bp, Homo sapiens
tggcaggttgggtaaccct

SEQ ID NO: 2935074 - DNA, 16 bp, Homo sapiens
tggcagtgttttgaga

SEQ ID NO: 2935075 - DNA, 21 bp, Homo sapiens
tggcagtgttttggttcagac

SEQ ID NO: 2935076 - DNA, 18 bp, Homo sapiens
tggcagttttgacatcag

SEQ ID NO: 2935077 - DNA, 16 bp, Homo sapiens
tggcatacctttcaca

SEQ ID NO: 2935078 - DNA, 14 bp, Homo sapiens
tggcatagtttcat

SEQ ID NO: 2935079 - DNA, 23 bp, Homo sapiens
tggcatcaccttaggcagggaag

SEQ ID NO: 2935080 - DNA, 19 bp, Homo sapiens
tggcatccagggctgccag

SEQ ID NO: 2935081 - DNA, 15 bp, Homo sapiens
tggcatcctgtgaag

SEQ ID NO: 2935082 - DNA, 17 bp, Homo sapiens
tggcatcctgtgaagtc

SEQ ID NO: 2935083 - DNA, 21 bp, Homo sapiens
tggcatctaattcttattttt

SEQ ID NO: 2935084 - DNA, 22 bp, Homo sapiens
tggcatctaattcttattttta

SEQ ID NO: 2935085 - DNA, 22 bp, Homo sapiens
tggcatctgaatgaaaataact

SEQ ID NO: 2935086 - DNA, 11 bp, Homo sapiens
tggcatctgtg

SEQ ID NO: 2935087 - DNA, 15 bp, Homo sapiens
tggcatgcaaaagaa

SEQ ID NO: 2935088 - DNA, 16 bp, Homo sapiens
tggcatgcaaaagaaa

SEQ ID NO: 2935089 - DNA, 19 bp, Homo sapiens
tggcatggaaggggcttct

SEQ ID NO: 2935090 - DNA, 20 bp, Homo sapiens
tggcatgtgggttgtgatat

SEQ ID NO: 2935091 - DNA, 13 bp, Homo sapiens
tggcatgtttaat

SEQ ID NO: 2935092 - DNA, 23 bp, Homo sapiens
tggcattaattgttccttgcttt

SEQ ID NO: 2935093 - DNA, 13 bp, Homo sapiens
tggcattatgtcc

SEQ ID NO: 2935094 - DNA, 18 bp, Homo sapiens
tggcattatgtccactgt

SEQ ID NO: 2935095 - DNA, 23 bp, Homo sapiens
tggcattatgtccactgtgtata

SEQ ID NO: 2935096 - DNA, 15 bp, Homo sapiens
tggcattctacacct

SEQ ID NO: 2935097 - DNA, 18 bp, Homo sapiens
tggcattctacacctgga

SEQ ID NO: 2935098 - DNA, 16 bp, Homo sapiens
tggcattctttgcaat

SEQ ID NO: 2935099 - DNA, 20 bp, Homo sapiens
tggcattctttgcaatactg

SEQ ID NO: 2935100 - DNA, 22 bp, Homo sapiens
tggcattctttgcaatactgct

SEQ ID NO: 2935101 - DNA, 15 bp, Homo sapiens
tggcattgatcttaa

SEQ ID NO: 2935102 - DNA, 23 bp, Homo sapiens
tggcatttcaattcctggccctg

SEQ ID NO: 2935103 - DNA, 19 bp, Homo sapiens
tggcatttttgcaggctgg

SEQ ID NO: 2935104 - DNA, 14 bp, Homo sapiens
tggccaagagaagg

SEQ ID NO: 2935105 - DNA, 18 bp, Homo sapiens
tggccaaggagctgctat

SEQ ID NO: 2935106 - DNA, 18 bp, Homo sapiens
tggccaattaaaaacgaa

SEQ ID NO: 2935107 - DNA, 14 bp, Homo sapiens
tggccacactgtga

SEQ ID NO: 2935108 - DNA, 19 bp, Homo sapiens
tggccacagcgtgctggcg

SEQ ID NO: 2935109 - DNA, 12 bp, Homo sapiens
tggccaccaccc

SEQ ID NO: 2935110 - DNA, 13 bp, Homo sapiens
tggccaccaccca

SEQ ID NO: 2935111 - DNA, 22 bp, Homo sapiens
tggccaccaggtgcctttcaaa

SEQ ID NO: 2935112 - DNA, 16 bp, Homo sapiens
tggccaccttttcagc

SEQ ID NO: 2935113 - DNA, 17 bp, Homo sapiens
tggccacggcccaggga

SEQ ID NO: 2935114 - DNA, 18 bp, Homo sapiens
tggccacggcccagggag

SEQ ID NO: 2935115 - DNA, 19 bp, Homo sapiens
tggccacggcccagggagg

SEQ ID NO: 2935116 - DNA, 20 bp, Homo sapiens
tggccacggcccagggaggg

SEQ ID NO: 2935117 - DNA, 22 bp, Homo sapiens
tggccacgttcagggaggggcc

SEQ ID NO: 2935118 - DNA, 12 bp, Homo sapiens
tggccactaagc

SEQ ID NO: 2935119 - DNA, 18 bp, Homo sapiens
tggccactaagcagagga

SEQ ID NO: 2935120 - DNA, 19 bp, Homo sapiens
tggccactaagcagaggag

SEQ ID NO: 2935121 - DNA, 12 bp, Homo sapiens
tggccagactcg

SEQ ID NO: 2935122 - DNA, 17 bp, Homo sapiens
tggccagatgcggggac

SEQ ID NO: 2935123 - DNA, 19 bp, Homo sapiens
tggccagatgcggggacag

SEQ ID NO: 2935124 - DNA, 18 bp, Homo sapiens
tggccagccgctctcctg

SEQ ID NO: 2935125 - DNA, 17 bp, Homo sapiens
tggccagcgccagggcc

SEQ ID NO: 2935126 - DNA, 23 bp, Homo sapiens
tggccagcgccagggcccaggcc

SEQ ID NO: 2935127 - DNA, 23 bp, Homo sapiens
tggccagtcctggtcctggctgc

SEQ ID NO: 2935128 - DNA, 22 bp, Homo sapiens
tggccagttttctgttcagctt

SEQ ID NO: 2935129 - DNA, 14 bp, Homo sapiens
tggccatcactcag

SEQ ID NO: 2935130 - DNA, 17 bp, Homo sapiens
tggccatcactcagccc

SEQ ID NO: 2935131 - DNA, 18 bp, Homo sapiens
tggccatcactcagcccc

SEQ ID NO: 2935132 - DNA, 20 bp, Homo sapiens
tggccatcactcagccccta

SEQ ID NO: 2935133 - DNA, 17 bp, Homo sapiens
tggccatgcctcagccc

SEQ ID NO: 2935134 - DNA, 20 bp, Homo sapiens
tggccatgcctcagccctga

SEQ ID NO: 2935135 - DNA, 21 bp, Homo sapiens
tggccatgctgtccctgcact

SEQ ID NO: 2935136 - DNA, 22 bp, Homo sapiens
tggccatgctgtccctgcactg

SEQ ID NO: 2935137 - DNA, 16 bp, Homo sapiens
tggccatggcctctgc

SEQ ID NO: 2935138 - DNA, 17 bp, Homo sapiens
tggccatggcctctgca

SEQ ID NO: 2935139 - DNA, 22 bp, Homo sapiens
tggccattctttttttcttggc

SEQ ID NO: 2935140 - DNA, 15 bp, Homo sapiens
tggcccaagactggg

SEQ ID NO: 2935141 - DNA, 19 bp, Homo sapiens
tggcccaatgcctataaaa

SEQ ID NO: 2935142 - DNA, 18 bp, Homo sapiens
tggcccactgctggctgc

SEQ ID NO: 2935143 - DNA, 19 bp, Homo sapiens
tggcccactgctggctgca

SEQ ID NO: 2935144 - DNA, 19 bp, Homo sapiens
tggcccaggagctctgcgc

SEQ ID NO: 2935145 - DNA, 20 bp, Homo sapiens
tggcccaggagctctgcgcc

SEQ ID NO: 2935146 - DNA, 12 bp, Homo sapiens
tggcccaggagg

SEQ ID NO: 2935147 - DNA, 11 bp, Homo sapiens
tggcccaggcc

SEQ ID NO: 2935148 - DNA, 21 bp, Homo sapiens
tggcccaggccttgctgactc

SEQ ID NO: 2935149 - DNA, 12 bp, Homo sapiens
tggcccaggggg

SEQ ID NO: 2935150 - DNA, 13 bp, Homo sapiens
tggcccagggggc

SEQ ID NO: 2935151 - DNA, 19 bp, Homo sapiens
tggcccagggggcctggag

SEQ ID NO: 2935152 - DNA, 20 bp, Homo sapiens
tggcccagggggcctggagc

SEQ ID NO: 2935153 - DNA, 21 bp, Homo sapiens
tggccccatgtctctcagaat

SEQ ID NO: 2935154 - DNA, 23 bp, Homo sapiens
tggcccccaaaatctgtcactac

SEQ ID NO: 2935155 - DNA, 17 bp, Homo sapiens
tggccccctcagctctg

SEQ ID NO: 2935156 - DNA, 22 bp, Homo sapiens
tggccccctcagctctgtcctg

SEQ ID NO: 2935157 - DNA, 21 bp, Homo sapiens
tggcccctgctgtctctctgg

SEQ ID NO: 2935158 - DNA, 22 bp, Homo sapiens
tggcccctgctgtctctctggg

SEQ ID NO: 2935159 - DNA, 15 bp, Homo sapiens
tggcccctggaacct

SEQ ID NO: 2935160 - DNA, 21 bp, Homo sapiens
tggcccctttgggccctgcat

SEQ ID NO: 2935161 - DNA, 14 bp, Homo sapiens
tggcccgcggcctg

SEQ ID NO: 2935162 - DNA, 15 bp, Homo sapiens
tggcccgcggcctgc

SEQ ID NO: 2935163 - DNA, 18 bp, Homo sapiens
tggcccgtgacagactcc

SEQ ID NO: 2935164 - DNA, 20 bp, Homo sapiens
tggcccgtgacagactcctg

SEQ ID NO: 2935165 - DNA, 13 bp, Homo sapiens
tggcccgtggcct

SEQ ID NO: 2935166 - DNA, 20 bp, Homo sapiens
tggcccgtggcctggcatct

SEQ ID NO: 2935167 - DNA, 22 bp, Homo sapiens
tggcccgtggcttggcatctgt

SEQ ID NO: 2935168 - DNA, 22 bp, Homo sapiens
tggccctgctgcccctccctgc

SEQ ID NO: 2935169 - DNA, 15 bp, Homo sapiens
tggccctggcctgct

SEQ ID NO: 2935170 - DNA, 19 bp, Homo sapiens
tggccctgttctcctcccc

SEQ ID NO: 2935171 - DNA, 15 bp, Homo sapiens
tggcccttccagtgg

SEQ ID NO: 2935172 - DNA, 23 bp, Homo sapiens
tggcccttggtggggagcacaga

SEQ ID NO: 2935173 - DNA, 20 bp, Homo sapiens
tggccctttaatatttccaa

SEQ ID NO: 2935174 - DNA, 17 bp, Homo sapiens
tggccgccatctgcgca

SEQ ID NO: 2935175 - DNA, 12 bp, Homo sapiens
tggccggccagc

SEQ ID NO: 2935176 - DNA, 21 bp, Homo sapiens
tggccggccagccagccactc

SEQ ID NO: 2935177 - DNA, 15 bp, Homo sapiens
tggccgggaccccga

SEQ ID NO: 2935178 - DNA, 24 bp, Homo sapiens
tggccgggcacagtggctcacgcc

SEQ ID NO: 2935179 - DNA, 13 bp, Homo sapiens
tggccgggcaggc

SEQ ID NO: 2935180 - DNA, 21 bp, Homo sapiens
tggccgggcaggcgtgactca

SEQ ID NO: 2935181 - DNA, 20 bp, Homo sapiens
tgggtctttttctcttctgt

SEQ ID NO: 2935182 - DNA, 19 bp, Homo sapiens
tgggtgaaggctggcatga

SEQ ID NO: 2935183 - DNA, 15 bp, Homo sapiens
tgggtgacagagtga

SEQ ID NO: 2935184 - DNA, 20 bp, Homo sapiens
tgggtgatttctagaatggt

SEQ ID NO: 2935185 - DNA, 23 bp, Homo sapiens
tgggtgcagtttgaggggcctgt

SEQ ID NO: 2935186 - DNA, 12 bp, Homo sapiens
tgggtgccctga

SEQ ID NO: 2935187 - DNA, 13 bp, Homo sapiens
tgggtgctcccta

SEQ ID NO: 2935188 - DNA, 18 bp, Homo sapiens
tgggtggaaaacagggtg

SEQ ID NO: 2935189 - DNA, 15 bp, Homo sapiens
tgggtggagaagcca

SEQ ID NO: 2935190 - DNA, 21 bp, Homo sapiens
tgggtggagaagccattgtct

SEQ ID NO: 2935191 - DNA, 13 bp, Homo sapiens
tgggtggggctgc

SEQ ID NO: 2935192 - DNA, 20 bp, Homo sapiens
tgggtggggggcttcataca

SEQ ID NO: 2935193 - DNA, 24 bp, Homo sapiens
tgggtggtttgtgagccttgctgc

SEQ ID NO: 2935194 - DNA, 12 bp, Homo sapiens
tgggtgttcata

SEQ ID NO: 2935195 - DNA, 17 bp, Homo sapiens
tgggttctatgtttact

SEQ ID NO: 2935196 - DNA, 19 bp, Homo sapiens
tgggttctgcctgccagct

SEQ ID NO: 2935197 - DNA, 21 bp, Homo sapiens
tgggttctgcctgccagctgc

SEQ ID NO: 2935198 - DNA, 21 bp, Homo sapiens
tgggttgcagacaggaatctt

SEQ ID NO: 2935199 - DNA, 16 bp, Homo sapiens
tgggtttacaacaaac

SEQ ID NO: 2935200 - DNA, 18 bp, Homo sapiens
tgggtttacaacaaacac

SEQ ID NO: 2935201 - DNA, 22 bp, Homo sapiens
tgggtttacaacaaacactgtg

SEQ ID NO: 2935202 - DNA, 13 bp, Homo sapiens
tgggtttggccca

SEQ ID NO: 2935203 - DNA, 15 bp, Homo sapiens
tgggtttggcccctg

SEQ ID NO: 2935204 - DNA, 16 bp, Homo sapiens
tgggttttatgagatg

SEQ ID NO: 2935205 - DNA, 22 bp, Homo sapiens
tgggttttcagcataaatggga

SEQ ID NO: 2935206 - DNA, 14 bp, Homo sapiens
tgggttttcttccc

SEQ ID NO: 2935207 - DNA, 19 bp, Homo sapiens
tggtaaacgctgtccctag

SEQ ID NO: 2935208 - DNA, 20 bp, Homo sapiens
tggtaaagaaaagcctcagc

SEQ ID NO: 2935209 - DNA, 22 bp, Homo sapiens
tggtaaagaaaagcctcagctc

SEQ ID NO: 2935210 - DNA, 17 bp, Homo sapiens
tggtaaagtccttttct

SEQ ID NO: 2935211 - DNA, 19 bp, Homo sapiens
tggtaaatgccacacacct

SEQ ID NO: 2935212 - DNA, 19 bp, Homo sapiens
tggtaaatttccccaacag

SEQ ID NO: 2935213 - DNA, 22 bp, Homo sapiens
tggtaaatttccccaacagtgt

SEQ ID NO: 2935214 - DNA, 20 bp, Homo sapiens
tggtaatgatgttgataatt

SEQ ID NO: 2935215 - DNA, 14 bp, Homo sapiens
tggtaattgtacta

SEQ ID NO: 2935216 - DNA, 17 bp, Homo sapiens
tggtacagttgcaggag

SEQ ID NO: 2935217 - DNA, 18 bp, Homo sapiens
tggtacagttgcaggagc

SEQ ID NO: 2935218 - DNA, 14 bp, Homo sapiens
tggtaccagataaa

SEQ ID NO: 2935219 - DNA, 13 bp, Homo sapiens
tggtaccagatgc

SEQ ID NO: 2935220 - DNA, 15 bp, Homo sapiens
tggtactaaggagaa

SEQ ID NO: 2935221 - DNA, 17 bp, Homo sapiens
tggtactcattaaaaaa

SEQ ID NO: 2935222 - DNA, 14 bp, Homo sapiens
tggtagaaaatgca

SEQ ID NO: 2935223 - DNA, 19 bp, Homo sapiens
tggtagaaaatgcaccaaa

SEQ ID NO: 2935224 - DNA, 21 bp, Homo sapiens
tggtagaaaatgcaccaaata

SEQ ID NO: 2935225 - DNA, 13 bp, Homo sapiens
tggtagagatgga

SEQ ID NO: 2935226 - DNA, 11 bp, Homo sapiens
tggtagagttt

SEQ ID NO: 2935227 - DNA, 20 bp, Homo sapiens
tggtagatcttcaatttgga

SEQ ID NO: 2935228 - DNA, 18 bp, Homo sapiens
tggtagattcgctgtccc

SEQ ID NO: 2935229 - DNA, 19 bp, Homo sapiens
tggtagattcgctgtcccc

SEQ ID NO: 2935230 - DNA, 17 bp, Homo sapiens
tggtagatttcctcctc

SEQ ID NO: 2935231 - DNA, 18 bp, Homo sapiens
tggtagccatcaagcact

SEQ ID NO: 2935232 - DNA, 15 bp, Homo sapiens
tggtagctccagcga

SEQ ID NO: 2935233 - DNA, 16 bp, Homo sapiens
tggtagctgaaaaaac

SEQ ID NO: 2935234 - DNA, 18 bp, Homo sapiens
tggtaggaggaggcatgg

SEQ ID NO: 2935235 - DNA, 21 bp, Homo sapiens
tggtaggaggaggcatggaaa

SEQ ID NO: 2935236 - DNA, 14 bp, Homo sapiens
tggtaggtactttt

SEQ ID NO: 2935237 - DNA, 22 bp, Homo sapiens
tggtagtaatcacagttggcct

SEQ ID NO: 2935238 - DNA, 15 bp, Homo sapiens
tggtagtgttcagta

SEQ ID NO: 2935239 - DNA, 19 bp, Homo sapiens
tggtataagtaactttatt

SEQ ID NO: 2935240 - DNA, 18 bp, Homo sapiens
tggtatggtgctaatatt

SEQ ID NO: 2935241 - DNA, 13 bp, Homo sapiens
tggtatgtgccag

SEQ ID NO: 2935242 - DNA, 17 bp, Homo sapiens
tggtatgtgccaggctt

SEQ ID NO: 2935243 - DNA, 20 bp, Homo sapiens
tggtatgtgccaggcttgcc

SEQ ID NO: 2935244 - DNA, 12 bp, Homo sapiens
tggtattctgtc

SEQ ID NO: 2935245 - DNA, 20 bp, Homo sapiens
tggtattgtgagatgatttg

SEQ ID NO: 2935246 - DNA, 21 bp, Homo sapiens
tggtattgtgagatgatttgt

SEQ ID NO: 2935247 - DNA, 15 bp, Homo sapiens
tggtatttgctgtca

SEQ ID NO: 2935248 - DNA, 14 bp, Homo sapiens
tggtcacacactga

SEQ ID NO: 2935249 - DNA, 15 bp, Homo sapiens
tggtcacacactgat

SEQ ID NO: 2935250 - DNA, 14 bp, Homo sapiens
tggtcactctgccc

SEQ ID NO: 2935251 - DNA, 15 bp, Homo sapiens
tggtcactctgccct

SEQ ID NO: 2935252 - DNA, 21 bp, Homo sapiens
tggtcactctgccctctgctg

SEQ ID NO: 2935253 - DNA, 22 bp, Homo sapiens
tggtcacttaaaatgtgcagta

SEQ ID NO: 2935254 - DNA, 23 bp, Homo sapiens
tggtcatccttggtgctcttgct

SEQ ID NO: 2935255 - DNA, 15 bp, Homo sapiens
tggtccaagattccg

SEQ ID NO: 2935256 - DNA, 22 bp, Homo sapiens
tggtccatcactattcaaggat

SEQ ID NO: 2935257 - DNA, 14 bp, Homo sapiens
tggtcccaggaagc

SEQ ID NO: 2935258 - DNA, 21 bp, Homo sapiens
tggtcccaggaagcagggaga

SEQ ID NO: 2935259 - DNA, 12 bp, Homo sapiens
tggtcccctgtg

SEQ ID NO: 2935260 - DNA, 20 bp, Homo sapiens
tggtcccgtggatgctcttt

SEQ ID NO: 2935261 - DNA, 13 bp, Homo sapiens
tggtccctgggag

SEQ ID NO: 2935262 - DNA, 15 bp, Homo sapiens
tggtccctggtcctt

SEQ ID NO: 2935263 - DNA, 22 bp, Homo sapiens
tggtccctgttttcccacgagg

SEQ ID NO: 2935264 - DNA, 15 bp, Homo sapiens
tggtccggtgtcctt

SEQ ID NO: 2935265 - DNA, 12 bp, Homo sapiens
tggtcctaccca

SEQ ID NO: 2935266 - DNA, 21 bp, Homo sapiens
tggtcctatttttgtgaagag

SEQ ID NO: 2935267 - DNA, 16 bp, Homo sapiens
tggtcctccgcctact

SEQ ID NO: 2935268 - DNA, 12 bp, Homo sapiens
tggtcctggcct

SEQ ID NO: 2935269 - DNA, 12 bp, Homo sapiens
tggtcctggctg

SEQ ID NO: 2935270 - DNA, 18 bp, Homo sapiens
tggtcctgttttctaaaa

SEQ ID NO: 2935271 - DNA, 22 bp, Homo sapiens
tggtccttcactggcgccttct

SEQ ID NO: 2935272 - DNA, 23 bp, Homo sapiens
tggtctagtagcggatctcactc

SEQ ID NO: 2935273 - DNA, 18 bp, Homo sapiens
tggtctcaaactcctgac

SEQ ID NO: 2935274 - DNA, 14 bp, Homo sapiens
tggtctccactggg

SEQ ID NO: 2935275 - DNA, 11 bp, Homo sapiens
tggtctcctct

SEQ ID NO: 2935276 - DNA, 12 bp, Homo sapiens
tggtctcctctc

SEQ ID NO: 2935277 - DNA, 17 bp, Homo sapiens
tggtctcctctcagctt

SEQ ID NO: 2935278 - DNA, 16 bp, Homo sapiens
tggtctccttggaaat

SEQ ID NO: 2935279 - DNA, 19 bp, Homo sapiens
tggtctcgatgctgctggc

SEQ ID NO: 2935280 - DNA, 14 bp, Homo sapiens
tggtctgcaggcag

SEQ ID NO: 2935281 - DNA, 20 bp, Homo sapiens
tggtctgccaatctgtacaa

SEQ ID NO: 2935282 - DNA, 21 bp, Homo sapiens
tggtctgggtggatgtgagca

SEQ ID NO: 2935283 - DNA, 13 bp, Homo sapiens
tggtctgttttct

SEQ ID NO: 2935284 - DNA, 16 bp, Homo sapiens
tggtcttaagaaatgt

SEQ ID NO: 2935285 - DNA, 20 bp, Homo sapiens
tggtcttactttgtgcaaaa

SEQ ID NO: 2935286 - DNA, 17 bp, Homo sapiens
tggtcttaggtcttcct

SEQ ID NO: 2935287 - DNA, 24 bp, Homo sapiens
tggtcttaggtcttcctgtggctc

SEQ ID NO: 2935288 - DNA, 15 bp, Homo sapiens
tggtcttgaagtcct

SEQ ID NO: 2935289 - DNA, 20 bp, Homo sapiens
tggtcttggcagcacctgtc

SEQ ID NO: 2935290 - DNA, 14 bp, Homo sapiens
tggtctttttcctg

SEQ ID NO: 2935291 - DNA, 11 bp, Homo sapiens
tggtgaacagt

SEQ ID NO: 2935292 - DNA, 16 bp, Homo sapiens
tggtgaatttcacaag

SEQ ID NO: 2935293 - DNA, 17 bp, Homo sapiens
tggtgaccagtttctta

SEQ ID NO: 2935294 - DNA, 19 bp, Homo sapiens
tggtgaccagtttcttaaa

SEQ ID NO: 2935295 - DNA, 22 bp, Homo sapiens
tggtgaccttccaagagcctga

SEQ ID NO: 2935296 - DNA, 14 bp, Homo sapiens
tggtgacgccccgg

SEQ ID NO: 2935297 - DNA, 16 bp, Homo sapiens
tggtgagatgcagctg

SEQ ID NO: 2935298 - DNA, 15 bp, Homo sapiens
tggtgataaggacat

SEQ ID NO: 2935299 - DNA, 14 bp, Homo sapiens
tggtgatgtgcctg

SEQ ID NO: 2935300 - DNA, 17 bp, Homo sapiens
tggtgcaattaactctg

SEQ ID NO: 2935301 - DNA, 11 bp, Homo sapiens
tggtgcattcg

SEQ ID NO: 2935302 - DNA, 21 bp, Homo sapiens
tggtgccatccccagggggca

SEQ ID NO: 2935303 - DNA, 18 bp, Homo sapiens
tggtgccccaggaccagc

SEQ ID NO: 2935304 - DNA, 13 bp, Homo sapiens
tggtgcctccaga

SEQ ID NO: 2935305 - DNA, 17 bp, Homo sapiens
tggtgcctgaagacccc

SEQ ID NO: 2935306 - DNA, 19 bp, Homo sapiens
tggtgcctgaagaccccag

SEQ ID NO: 2935307 - DNA, 17 bp, Homo sapiens
tggtgcctggcctggca

SEQ ID NO: 2935308 - DNA, 18 bp, Homo sapiens
tggtgcctggcctggcac

SEQ ID NO: 2935309 - DNA, 23 bp, Homo sapiens
tggtgcctggcctggcacacatc

SEQ ID NO: 2935310 - DNA, 21 bp, Homo sapiens
tggtgctaatattttatttga

SEQ ID NO: 2935311 - DNA, 17 bp, Homo sapiens
tggtgctgttgaaaata

SEQ ID NO: 2935312 - DNA, 10 bp, Homo sapiens
tggtggcatg

SEQ ID NO: 2935313 - DNA, 17 bp, Homo sapiens
tggtggcggggtggggt

SEQ ID NO: 2935314 - DNA, 15 bp, Homo sapiens
tgtagtaattgacat

SEQ ID NO: 2935315 - DNA, 16 bp, Homo sapiens
tgtagtaattgacatg

SEQ ID NO: 2935316 - DNA, 18 bp, Homo sapiens
tgtagtaattgacatgtg

SEQ ID NO: 2935317 - DNA, 19 bp, Homo sapiens
tgtagtatcaaatattaga

SEQ ID NO: 2935318 - DNA, 13 bp, Homo sapiens
tgtagtatttagt

SEQ ID NO: 2935319 - DNA, 13 bp, Homo sapiens
tgtagtctcagct

SEQ ID NO: 2935320 - DNA, 13 bp, Homo sapiens
tgtagtgagccaa

SEQ ID NO: 2935321 - DNA, 20 bp, Homo sapiens
tgtagtgatttttatgccac

SEQ ID NO: 2935322 - DNA, 21 bp, Homo sapiens
tgtagtgatttttatgccacc

SEQ ID NO: 2935323 - DNA, 20 bp, Homo sapiens
tgtagtgtccattttgtgaa

SEQ ID NO: 2935324 - DNA, 21 bp, Homo sapiens
tgtagtgtccattttgtgaag

SEQ ID NO: 2935325 - DNA, 14 bp, Homo sapiens
tgtagttactcaag

SEQ ID NO: 2935326 - DNA, 15 bp, Homo sapiens
tgtagttctaagact

SEQ ID NO: 2935327 - DNA, 14 bp, Homo sapiens
tgtagttgaactga

SEQ ID NO: 2935328 - DNA, 17 bp, Homo sapiens
tgtataacatcactgtc

SEQ ID NO: 2935329 - DNA, 18 bp, Homo sapiens
tgtataagctactcactt

SEQ ID NO: 2935330 - DNA, 20 bp, Homo sapiens
tgtataagtagatctgcttt

SEQ ID NO: 2935331 - DNA, 13 bp, Homo sapiens
tgtataattgtat

SEQ ID NO: 2935332 - DNA, 21 bp, Homo sapiens
tgtataccatgatgcatggag

SEQ ID NO: 2935333 - DNA, 14 bp, Homo sapiens
tgtatataaatggg

SEQ ID NO: 2935334 - DNA, 18 bp, Homo sapiens
tgtatataaatgggaaca

SEQ ID NO: 2935335 - DNA, 20 bp, Homo sapiens
tgtatatacacacatgtata

SEQ ID NO: 2935336 - DNA, 15 bp, Homo sapiens
tgtatatacatatat

SEQ ID NO: 2935337 - DNA, 21 bp, Homo sapiens
tgtatatagctctacacaaca

SEQ ID NO: 2935338 - DNA, 19 bp, Homo sapiens
tgtatatgattctctgtgg

SEQ ID NO: 2935339 - DNA, 13 bp, Homo sapiens
tgtatatgtgctt

SEQ ID NO: 2935340 - DNA, 19 bp, Homo sapiens
tgtatattacccaatggaa

SEQ ID NO: 2935341 - DNA, 15 bp, Homo sapiens
tgtatattatttcta

SEQ ID NO: 2935342 - DNA, 21 bp, Homo sapiens
tgtatattatttctaggaaga

SEQ ID NO: 2935343 - DNA, 14 bp, Homo sapiens
tgtatattcctttg

SEQ ID NO: 2935344 - DNA, 15 bp, Homo sapiens
tgtatattgattata

SEQ ID NO: 2935345 - DNA, 19 bp, Homo sapiens
tgtatattgggctcagaga

SEQ ID NO: 2935346 - DNA, 20 bp, Homo sapiens
tgtatatttatgaccagagc

SEQ ID NO: 2935347 - DNA, 16 bp, Homo sapiens
tgtatatttgtaaagc

SEQ ID NO: 2935348 - DNA, 22 bp, Homo sapiens
tgtatatttgtaaagctattta

SEQ ID NO: 2935349 - DNA, 16 bp, Homo sapiens
tgtatccatgtaatga

SEQ ID NO: 2935350 - DNA, 21 bp, Homo sapiens
tgtatccatgtaatgatcttg

SEQ ID NO: 2935351 - DNA, 14 bp, Homo sapiens
tgtatccattatca

SEQ ID NO: 2935352 - DNA, 21 bp, Homo sapiens
tgtatcgcatattagttaatc

SEQ ID NO: 2935353 - DNA, 22 bp, Homo sapiens
tgtatcgcatattagttaatct

SEQ ID NO: 2935354 - DNA, 18 bp, Homo sapiens
tgtatcgtatagctgtat

SEQ ID NO: 2935355 - DNA, 12 bp, Homo sapiens
tgtatctaattc

SEQ ID NO: 2935356 - DNA, 24 bp, Homo sapiens
tgtatctatgttgcatgataaaca

SEQ ID NO: 2935357 - DNA, 14 bp, Homo sapiens
tgtatctcttaaag

SEQ ID NO: 2935358 - DNA, 15 bp, Homo sapiens
tgtatctgtctactt

SEQ ID NO: 2935359 - DNA, 19 bp, Homo sapiens
tgtatctgtctactttctc

SEQ ID NO: 2935360 - DNA, 20 bp, Homo sapiens
tgtatctgtctactttctct

SEQ ID NO: 2935361 - DNA, 22 bp, Homo sapiens
tgtatctgtctactttctcttg

SEQ ID NO: 2935362 - DNA, 21 bp, Homo sapiens
tgtatctttctatgctgcttt

SEQ ID NO: 2935363 - DNA, 16 bp, Homo sapiens
tgtatgaagtactttt

SEQ ID NO: 2935364 - DNA, 21 bp, Homo sapiens
tgtatgagaagtactttgtgc

SEQ ID NO: 2935365 - DNA, 12 bp, Homo sapiens
tgtatgatgtat

SEQ ID NO: 2935366 - DNA, 17 bp, Homo sapiens
tgtatgcagctatctgg

SEQ ID NO: 2935367 - DNA, 23 bp, Homo sapiens
tgtatgcggtgacggcggggtgt

SEQ ID NO: 2935368 - DNA, 13 bp, Homo sapiens
tgtatgcttcata

SEQ ID NO: 2935369 - DNA, 14 bp, Homo sapiens
tgtatgcttcatac

SEQ ID NO: 2935370 - DNA, 22 bp, Homo sapiens
tgtatgggggagattgaacttt

SEQ ID NO: 2935371 - DNA, 17 bp, Homo sapiens
tgtatgtattagtgata

SEQ ID NO: 2935372 - DNA, 20 bp, Homo sapiens
tgtatgtggatacagtcatt

SEQ ID NO: 2935373 - DNA, 18 bp, Homo sapiens
tgtattaagggatttagt

SEQ ID NO: 2935374 - DNA, 17 bp, Homo sapiens
tgtattaataaatagag

SEQ ID NO: 2935375 - DNA, 20 bp, Homo sapiens
tgtattaataaatagagcaa

SEQ ID NO: 2935376 - DNA, 18 bp, Homo sapiens
tgtattaatatctccata

SEQ ID NO: 2935377 - DNA, 10 bp, Homo sapiens
tgtattaatg

SEQ ID NO: 2935378 - DNA, 16 bp, Homo sapiens
tgtattaccattactt

SEQ ID NO: 2935379 - DNA, 18 bp, Homo sapiens
tgtattcagacagatgag

SEQ ID NO: 2935380 - DNA, 17 bp, Homo sapiens
tgtattcatactgacat

SEQ ID NO: 2935381 - DNA, 12 bp, Homo sapiens
tgtattcatgtt

SEQ ID NO: 2935382 - DNA, 16 bp, Homo sapiens
tgtattcatgttcatg

SEQ ID NO: 2935383 - DNA, 19 bp, Homo sapiens
tgtattcatgttcatgtga

SEQ ID NO: 2935384 - DNA, 22 bp, Homo sapiens
tgtattcatgttcatgtgatta

SEQ ID NO: 2935385 - DNA, 17 bp, Homo sapiens
tgtattcgtgcattttt

SEQ ID NO: 2935386 - DNA, 13 bp, Homo sapiens
tgtattctctgag

SEQ ID NO: 2935387 - DNA, 19 bp, Homo sapiens
tgtattctctgagctgtgc

SEQ ID NO: 2935388 - DNA, 22 bp, Homo sapiens
tgtattctttgatgttaacaca

SEQ ID NO: 2935389 - DNA, 16 bp, Homo sapiens
tgtattgctgctgtgc

SEQ ID NO: 2935390 - DNA, 18 bp, Homo sapiens
tgtattgctgctgtgcgt

SEQ ID NO: 2935391 - DNA, 22 bp, Homo sapiens
tgtattggcacagtgcttacat

SEQ ID NO: 2935392 - DNA, 19 bp, Homo sapiens
tgtattgttttctgacagt

SEQ ID NO: 2935393 - DNA, 20 bp, Homo sapiens
tgtatttaaaaatagaaaca

SEQ ID NO: 2935394 - DNA, 18 bp, Homo sapiens
tgtatttaacagggaggg

SEQ ID NO: 2935395 - DNA, 14 bp, Homo sapiens
tgtatttaatgatt

SEQ ID NO: 2935396 - DNA, 21 bp, Homo sapiens
tgtatttacgctttgattcat

SEQ ID NO: 2935397 - DNA, 21 bp, Homo sapiens
tgtatttatattttgtgctat

SEQ ID NO: 2935398 - DNA, 13 bp, Homo sapiens
tgtatttcattgc

SEQ ID NO: 2935399 - DNA, 21 bp, Homo sapiens
tgtatttcctgaaataaatgt

SEQ ID NO: 2935400 - DNA, 22 bp, Homo sapiens
tgtatttcctgaaataaatgtt

SEQ ID NO: 2935401 - DNA, 13 bp, Homo sapiens
tgtatttctctgt

SEQ ID NO: 2935402 - DNA, 15 bp, Homo sapiens
tgtatttctctgtga

SEQ ID NO: 2935403 - DNA, 12 bp, Homo sapiens
tgtatttgtgac

SEQ ID NO: 2935404 - DNA, 15 bp, Homo sapiens
tgtatttgtgactaa

SEQ ID NO: 2935405 - DNA, 16 bp, Homo sapiens
tgtattttaataacat

SEQ ID NO: 2935406 - DNA, 16 bp, Homo sapiens
tgtattttattcagta

SEQ ID NO: 2935407 - DNA, 18 bp, Homo sapiens
tgtattttcaaagactgc

SEQ ID NO: 2935408 - DNA, 20 bp, Homo sapiens
tgtattttccaagtgtgcat

SEQ ID NO: 2935409 - DNA, 23 bp, Homo sapiens
tgtattttccaagtgtgcatatt

SEQ ID NO: 2935410 - DNA, 19 bp, Homo sapiens
tgtattttgtaaataataa

SEQ ID NO: 2935411 - DNA, 15 bp, Homo sapiens
tgtattttgtccaag

SEQ ID NO: 2935412 - DNA, 19 bp, Homo sapiens
tgtattttgtccaagttca

SEQ ID NO: 2935413 - DNA, 23 bp, Homo sapiens
tgtattttgtgatgaatctacat

SEQ ID NO: 2935414 - DNA, 23 bp, Homo sapiens
tgtatttttatataatatctaaa

SEQ ID NO: 2935415 - DNA, 18 bp, Homo sapiens
tgtcaaactgtagaaatg

SEQ ID NO: 2935416 - DNA, 15 bp, Homo sapiens
tgtcaaagtgaaaga

SEQ ID NO: 2935417 - DNA, 19 bp, Homo sapiens
tgtcaaagtgaaagacatt

SEQ ID NO: 2935418 - DNA, 17 bp, Homo sapiens
tgtcaacatgaaacacc

SEQ ID NO: 2935419 - DNA, 13 bp, Homo sapiens
tgtcaacattgtg

SEQ ID NO: 2935420 - DNA, 20 bp, Homo sapiens
tgtcaaccagacagagggtc

SEQ ID NO: 2935421 - DNA, 22 bp, Homo sapiens
tgtcaaccagacagagggtcac

SEQ ID NO: 2935422 - DNA, 15 bp, Homo sapiens
tgtcaacttcaacat

SEQ ID NO: 2935423 - DNA, 22 bp, Homo sapiens
tgtcaactttcatttgaaagtg

SEQ ID NO: 2935424 - DNA, 14 bp, Homo sapiens
tgtcaagaaattct

SEQ ID NO: 2935425 - DNA, 19 bp, Homo sapiens
tgtcaagaaattctgctgt

SEQ ID NO: 2935426 - DNA, 23 bp, Homo sapiens
tgtcaagcatattggaaagtgat

SEQ ID NO: 2935427 - DNA, 17 bp, Homo sapiens
tgtcaagcctgtgcaaa

SEQ ID NO: 2935428 - DNA, 13 bp, Homo sapiens
tgtcaagtcctga

SEQ ID NO: 2935429 - DNA, 14 bp, Homo sapiens
tgtcaataaaaata

SEQ ID NO: 2935430 - DNA, 20 bp, Homo sapiens
tgtcaataaaaataaatcta

SEQ ID NO: 2935431 - DNA, 17 bp, Homo sapiens
tgtcaatccagatggtg

SEQ ID NO: 2935432 - DNA, 19 bp, Homo sapiens
tgtcaatttatgaatataa

SEQ ID NO: 2935433 - DNA, 12 bp, Homo sapiens
tgtcacagctct

SEQ ID NO: 2935434 - DNA, 14 bp, Homo sapiens
tgtcacagctcttg

SEQ ID NO: 2935435 - DNA, 17 bp, Homo sapiens
tgtcacagggactgaaa

SEQ ID NO: 2935436 - DNA, 19 bp, Homo sapiens
tgtcacatagtttttcctg

SEQ ID NO: 2935437 - DNA, 16 bp, Homo sapiens
tgtcacatcaagcatc

SEQ ID NO: 2935438 - DNA, 18 bp, Homo sapiens
tgtcacatcaagcatcat

SEQ ID NO: 2935439 - DNA, 23 bp, Homo sapiens
tgtcacatcaagcatcattgtcc

SEQ ID NO: 2935440 - DNA, 15 bp, Homo sapiens
tgtcaccccagagcc

SEQ ID NO: 2935441 - DNA, 20 bp, Homo sapiens
tgtcaccccagagccacaca

SEQ ID NO: 2935442 - DNA, 22 bp, Homo sapiens
tgtcaccccagagccacacatg

SEQ ID NO: 2935443 - DNA, 18 bp, Homo sapiens
tgtcaccctggccaccac

SEQ ID NO: 2935444 - DNA, 18 bp, Homo sapiens
tgtcaccggatcctgggt

SEQ ID NO: 2935445 - DNA, 19 bp, Homo sapiens
tgtcaccggatcctgggtg

SEQ ID NO: 2935446 - DNA, 18 bp, Homo sapiens
tgtggccgttatctggaa

SEQ ID NO: 2935447 - DNA, 22 bp, Homo sapiens
tgtggcctaccttgtgagggag

SEQ ID NO: 2935448 - DNA, 12 bp, Homo sapiens
tgtggcctgccc

SEQ ID NO: 2935449 - DNA, 14 bp, Homo sapiens
tgtggcctgcccag

SEQ ID NO: 2935450 - DNA, 23 bp, Homo sapiens
tgtggctcacagtggggccagca

SEQ ID NO: 2935451 - DNA, 21 bp, Homo sapiens
tgtggcttttatttcagtgcc

SEQ ID NO: 2935452 - DNA, 18 bp, Homo sapiens
tgtgggagtgcagagaaa

SEQ ID NO: 2935453 - DNA, 21 bp, Homo sapiens
tgtgggcatttcttgcgagcc

SEQ ID NO: 2935454 - DNA, 13 bp, Homo sapiens
tgtggggaggctg

SEQ ID NO: 2935455 - DNA, 16 bp, Homo sapiens
tgtggggaggctgcac

SEQ ID NO: 2935456 - DNA, 17 bp, Homo sapiens
tgtggggaggctgcact

SEQ ID NO: 2935457 - DNA, 18 bp, Homo sapiens
tgtgggttgtgatattga

SEQ ID NO: 2935458 - DNA, 15 bp, Homo sapiens
tgtggtagctccagc

SEQ ID NO: 2935459 - DNA, 16 bp, Homo sapiens
tgtggtagctccagcg

SEQ ID NO: 2935460 - DNA, 16 bp, Homo sapiens
tgtggtcagcggtatg

SEQ ID NO: 2935461 - DNA, 20 bp, Homo sapiens
tgtggtcagcggtatgtgcg

SEQ ID NO: 2935462 - DNA, 16 bp, Homo sapiens
tgtggtcccaacagga

SEQ ID NO: 2935463 - DNA, 13 bp, Homo sapiens
tgtggtctccact

SEQ ID NO: 2935464 - DNA, 17 bp, Homo sapiens
tgtggtctccttggaaa

SEQ ID NO: 2935465 - DNA, 18 bp, Homo sapiens
tgtggtctcgatgctgct

SEQ ID NO: 2935466 - DNA, 15 bp, Homo sapiens
tgtggtgatgatgtg

SEQ ID NO: 2935467 - DNA, 19 bp, Homo sapiens
tgtggtgatgatgtgtata

SEQ ID NO: 2935468 - DNA, 18 bp, Homo sapiens
tgtggtggattctccctg

SEQ ID NO: 2935469 - DNA, 16 bp, Homo sapiens
tgtggtgggcgctggg

SEQ ID NO: 2935470 - DNA, 18 bp, Homo sapiens
tgtggtggttcattccac

SEQ ID NO: 2935471 - DNA, 23 bp, Homo sapiens
tgtggtgtgtccccctctgtcca

SEQ ID NO: 2935472 - DNA, 18 bp, Homo sapiens
tgtggtgttagggtgcag

SEQ ID NO: 2935473 - DNA, 22 bp, Homo sapiens
tgtggtttaaatacataaatag

SEQ ID NO: 2935474 - DNA, 14 bp, Homo sapiens
tgtgtaaagttagt

SEQ ID NO: 2935475 - DNA, 13 bp, Homo sapiens
tgtgtaacagaac

SEQ ID NO: 2935476 - DNA, 20 bp, Homo sapiens
tgtgtaaccagctcagtgtt

SEQ ID NO: 2935477 - DNA, 19 bp, Homo sapiens
tgtgtaataatgtaacatg

SEQ ID NO: 2935478 - DNA, 15 bp, Homo sapiens
tgtgtaatcaataaa

SEQ ID NO: 2935479 - DNA, 19 bp, Homo sapiens
tgtgtaatcaataaacgat

SEQ ID NO: 2935480 - DNA, 20 bp, Homo sapiens
tgtgtaatcaataaacgatt

SEQ ID NO: 2935481 - DNA, 20 bp, Homo sapiens
tgtgtacatcccatgtaaca

SEQ ID NO: 2935482 - DNA, 19 bp, Homo sapiens
tgtgtacatggcagagttt

SEQ ID NO: 2935483 - DNA, 21 bp, Homo sapiens
tgtgtaccacaccctgcctgc

SEQ ID NO: 2935484 - DNA, 17 bp, Homo sapiens
tgtgtagccgccctgag

SEQ ID NO: 2935485 - DNA, 15 bp, Homo sapiens
tgtgtagcctgtgca

SEQ ID NO: 2935486 - DNA, 16 bp, Homo sapiens
tgtgtagcctgtgcat

SEQ ID NO: 2935487 - DNA, 23 bp, Homo sapiens
tgtgtagcctgtgcatgtatgtc

SEQ ID NO: 2935488 - DNA, 19 bp, Homo sapiens
tgtgtatagtgccaccaca

SEQ ID NO: 2935489 - DNA, 20 bp, Homo sapiens
tgtgtatatatatgtgagga

SEQ ID NO: 2935490 - DNA, 17 bp, Homo sapiens
tgtgtatatatttaaaa

SEQ ID NO: 2935491 - DNA, 13 bp, Homo sapiens
tgtgtatatggta

SEQ ID NO: 2935492 - DNA, 16 bp, Homo sapiens
tgtgtatccattatca

SEQ ID NO: 2935493 - DNA, 21 bp, Homo sapiens
tgtgtatccattatcatgtgt

SEQ ID NO: 2935494 - DNA, 23 bp, Homo sapiens
tgtgtatccattatcatgtgtaa

SEQ ID NO: 2935495 - DNA, 13 bp, Homo sapiens
tgtgtatttaaca

SEQ ID NO: 2935496 - DNA, 22 bp, Homo sapiens
tgtgtatttaacagggagggga

SEQ ID NO: 2935497 - DNA, 15 bp, Homo sapiens
tgtgtatttctctgt

SEQ ID NO: 2935498 - DNA, 16 bp, Homo sapiens
tgtgtatttctctgtg

SEQ ID NO: 2935499 - DNA, 16 bp, Homo sapiens
tgtgtatttcttatac

SEQ ID NO: 2935500 - DNA, 15 bp, Homo sapiens
tgtgtcactgtacag

SEQ ID NO: 2935501 - DNA, 21 bp, Homo sapiens
tgtgtcagagcccagcccagg

SEQ ID NO: 2935502 - DNA, 16 bp, Homo sapiens
tgtgtcaggccctctg

SEQ ID NO: 2935503 - DNA, 19 bp, Homo sapiens
tgtgtcaggccctctgcct

SEQ ID NO: 2935504 - DNA, 17 bp, Homo sapiens
tgtgtccacgactgtct

SEQ ID NO: 2935505 - DNA, 13 bp, Homo sapiens
tgtgtcccaggca

SEQ ID NO: 2935506 - DNA, 15 bp, Homo sapiens
tgtgtcccagtgaac

SEQ ID NO: 2935507 - DNA, 21 bp, Homo sapiens
tgtgtcccctgacctgtccag

SEQ ID NO: 2935508 - DNA, 16 bp, Homo sapiens
tgtgtccgatgctgga

SEQ ID NO: 2935509 - DNA, 19 bp, Homo sapiens
tgtgtcctgtgtaaattag

SEQ ID NO: 2935510 - DNA, 14 bp, Homo sapiens
tgtgtccttgcacc

SEQ ID NO: 2935511 - DNA, 18 bp, Homo sapiens
tgtgtccttgcacctgca

SEQ ID NO: 2935512 - DNA, 20 bp, Homo sapiens
tgtgtccttgcacctgcatc

SEQ ID NO: 2935513 - DNA, 15 bp, Homo sapiens
tgtgtctaagattct

SEQ ID NO: 2935514 - DNA, 22 bp, Homo sapiens
tgtgtctctatgtgaatatgga

SEQ ID NO: 2935515 - DNA, 12 bp, Homo sapiens
tgtgtctctgta

SEQ ID NO: 2935516 - DNA, 15 bp, Homo sapiens
tgtgtctggaagaag

SEQ ID NO: 2935517 - DNA, 20 bp, Homo sapiens
tgtgtctggaagaagcagcg

SEQ ID NO: 2935518 - DNA, 23 bp, Homo sapiens
tgtgtctggtccaggagaagtat

SEQ ID NO: 2935519 - DNA, 15 bp, Homo sapiens
tgtgtctgttttact

SEQ ID NO: 2935520 - DNA, 12 bp, Homo sapiens
tgtgtgaagaaa

SEQ ID NO: 2935521 - DNA, 15 bp, Homo sapiens
tgtgtgaaggcagag

SEQ ID NO: 2935522 - DNA, 23 bp, Homo sapiens
tgtgtgacccctcctggggccag

SEQ ID NO: 2935523 - DNA, 21 bp, Homo sapiens
tgtgtgagaccaggggaccag

SEQ ID NO: 2935524 - DNA, 20 bp, Homo sapiens
tgtgtgagataacttccttc

SEQ ID NO: 2935525 - DNA, 15 bp, Homo sapiens
tgtgtgattgacagc

SEQ ID NO: 2935526 - DNA, 19 bp, Homo sapiens
tgtgtgattgacagctttg

SEQ ID NO: 2935527 - DNA, 21 bp, Homo sapiens
tgtgtgattgacagctttgct

SEQ ID NO: 2935528 - DNA, 14 bp, Homo sapiens
tgtgtgccttgttc

SEQ ID NO: 2935529 - DNA, 14 bp, Homo sapiens
tgtgtgcgctgcct

SEQ ID NO: 2935530 - DNA, 18 bp, Homo sapiens
tgtgtgcgctgcctggcc

SEQ ID NO: 2935531 - DNA, 15 bp, Homo sapiens
tgtgtgcgtgtatat

SEQ ID NO: 2935532 - DNA, 19 bp, Homo sapiens
tgtgtggacggcgctgcct

SEQ ID NO: 2935533 - DNA, 16 bp, Homo sapiens
tgtgtggactgtggca

SEQ ID NO: 2935534 - DNA, 23 bp, Homo sapiens
tgtgtggactgtggcacttgcct

SEQ ID NO: 2935535 - DNA, 18 bp, Homo sapiens
tgtgtgtaccacaccctg

SEQ ID NO: 2935536 - DNA, 18 bp, Homo sapiens
tgtgtgtcatgccagtga

SEQ ID NO: 2935537 - DNA, 12 bp, Homo sapiens
tgtgtgtctctg

SEQ ID NO: 2935538 - DNA, 18 bp, Homo sapiens
tgtgtgtcttttataaaa

SEQ ID NO: 2935539 - DNA, 16 bp, Homo sapiens
tgtgtgtgaatgaaca

SEQ ID NO: 2935540 - DNA, 23 bp, Homo sapiens
tgtgtgtgacccctcctggggcc

SEQ ID NO: 2935541 - DNA, 13 bp, Homo sapiens
tgtgtgtgtgaat

SEQ ID NO: 2935542 - DNA, 12 bp, Homo sapiens
tgtgtgtgtgca

SEQ ID NO: 2935543 - DNA, 14 bp, Homo sapiens
tgtgtgtgtgcgtg

SEQ ID NO: 2935544 - DNA, 16 bp, Homo sapiens
tgtgtgtgtgtgtgca

SEQ ID NO: 2935545 - DNA, 22 bp, Homo sapiens
tgtgtgttgcaaatcactctgc

SEQ ID NO: 2935546 - DNA, 19 bp, Homo sapiens
tgtgttacttgaagtaact

SEQ ID NO: 2935547 - DNA, 20 bp, Homo sapiens
tgtgttacttgaagtaacta

SEQ ID NO: 2935548 - DNA, 20 bp, Homo sapiens
tgtgttatttccccagccac

SEQ ID NO: 2935549 - DNA, 13 bp, Homo sapiens
tgtgttcagttcc

SEQ ID NO: 2935550 - DNA, 15 bp, Homo sapiens
tgtgttccttctgtg

SEQ ID NO: 2935551 - DNA, 17 bp, Homo sapiens
tgtgttccttctgtgaa

SEQ ID NO: 2935552 - DNA, 16 bp, Homo sapiens
tgtgttctaacttatt

SEQ ID NO: 2935553 - DNA, 18 bp, Homo sapiens
tgtgttctcacagtgaca

SEQ ID NO: 2935554 - DNA, 18 bp, Homo sapiens
tgtgttctcggagtgtgt

SEQ ID NO: 2935555 - DNA, 23 bp, Homo sapiens
tgtgttgactgctgctccccacc

SEQ ID NO: 2935556 - DNA, 23 bp, Homo sapiens
tgtgttgcaaatcactctgcaat

SEQ ID NO: 2935557 - DNA, 23 bp, Homo sapiens
tgtgttgcataaacaatccaaat

SEQ ID NO: 2935558 - DNA, 15 bp, Homo sapiens
tgtgttggacagaga

SEQ ID NO: 2935559 - DNA, 19 bp, Homo sapiens
tgtgttggacagagaaggg

SEQ ID NO: 2935560 - DNA, 22 bp, Homo sapiens
tgtgttgggattgagtctgtgc

SEQ ID NO: 2935561 - DNA, 21 bp, Homo sapiens
tgtgtttaagcaccatggcct

SEQ ID NO: 2935562 - DNA, 12 bp, Homo sapiens
tgtgtttgcttg

SEQ ID NO: 2935563 - DNA, 15 bp, Homo sapiens
tgtgtttgtgtattt

SEQ ID NO: 2935564 - DNA, 10 bp, Homo sapiens
tgtgtttgtt

SEQ ID NO: 2935565 - DNA, 14 bp, Homo sapiens
tgtgttttcagtct

SEQ ID NO: 2935566 - DNA, 15 bp, Homo sapiens
tgtgtttttaataaa

SEQ ID NO: 2935567 - DNA, 13 bp, Homo sapiens
tgtgtttttgaaa

SEQ ID NO: 2935568 - DNA, 15 bp, Homo sapiens
tgtgtttttgcactg

SEQ ID NO: 2935569 - DNA, 13 bp, Homo sapiens
tgttaaaaataaa

SEQ ID NO: 2935570 - DNA, 13 bp, Homo sapiens
tgttaaagatatt

SEQ ID NO: 2935571 - DNA, 13 bp, Homo sapiens
tgttaacacattt

SEQ ID NO: 2935572 - DNA, 13 bp, Homo sapiens
tgttaacagagca

SEQ ID NO: 2935573 - DNA, 15 bp, Homo sapiens
tgttaacattccaag

SEQ ID NO: 2935574 - DNA, 19 bp, Homo sapiens
tgttaaccaaataaaacat

SEQ ID NO: 2935575 - DNA, 19 bp, Homo sapiens
tgttaacgtgatgtgccac

SEQ ID NO: 2935576 - DNA, 21 bp, Homo sapiens
tgttaactgaagatattccaa

SEQ ID NO: 2935577 - DNA, 22 bp, Homo sapiens
tgttaactgtactgaaggtgtg

SEQ ID NO: 2935578 - DNA, 13 bp, Homo sapiens
ttaaagagataaa

SEQ ID NO: 2935579 - DNA, 22 bp, Homo sapiens
ttaaagatatttttattcaaac

SEQ ID NO: 2935580 - DNA, 18 bp, Homo sapiens
ttaaagatgattgttctt

SEQ ID NO: 2935581 - DNA, 17 bp, Homo sapiens
ttaaagatttatcaaat

SEQ ID NO: 2935582 - DNA, 21 bp, Homo sapiens
ttaaagccagtcatcatctct

SEQ ID NO: 2935583 - DNA, 19 bp, Homo sapiens
ttaaagctaaagtatctgt

SEQ ID NO: 2935584 - DNA, 20 bp, Homo sapiens
ttaaagcttatttttctgtg

SEQ ID NO: 2935585 - DNA, 21 bp, Homo sapiens
ttaaagcttatttttctgtga

SEQ ID NO: 2935586 - DNA, 17 bp, Homo sapiens
ttaaaggaaaagcacaa

SEQ ID NO: 2935587 - DNA, 14 bp, Homo sapiens
ttaaaggacaaaca

SEQ ID NO: 2935588 - DNA, 16 bp, Homo sapiens
ttaaaggacaaacagt

SEQ ID NO: 2935589 - DNA, 19 bp, Homo sapiens
ttaaaggacaaacagtgaa

SEQ ID NO: 2935590 - DNA, 19 bp, Homo sapiens
ttaaaggcagtccagagct

SEQ ID NO: 2935591 - DNA, 22 bp, Homo sapiens
ttaaaggcagtccagagctttt

SEQ ID NO: 2935592 - DNA, 17 bp, Homo sapiens
ttaaaggtgtgctattt

SEQ ID NO: 2935593 - DNA, 20 bp, Homo sapiens
ttaaagtcacacatttctat

SEQ ID NO: 2935594 - DNA, 18 bp, Homo sapiens
ttaaagtcaggtccaatt

SEQ ID NO: 2935595 - DNA, 21 bp, Homo sapiens
ttaaagtgactaatggcatga

SEQ ID NO: 2935596 - DNA, 14 bp, Homo sapiens
ttaaagtgctgttt

SEQ ID NO: 2935597 - DNA, 19 bp, Homo sapiens
ttaaataaagacctatgta

SEQ ID NO: 2935598 - DNA, 22 bp, Homo sapiens
ttaaataataatagttaatgaa

SEQ ID NO: 2935599 - DNA, 15 bp, Homo sapiens
ttaaataatttccta

SEQ ID NO: 2935600 - DNA, 15 bp, Homo sapiens
ttaaatataatatgc

SEQ ID NO: 2935601 - DNA, 18 bp, Homo sapiens
ttaaatattctgtacatt

SEQ ID NO: 2935602 - DNA, 15 bp, Homo sapiens
ttaaatatttcttaa

SEQ ID NO: 2935603 - DNA, 15 bp, Homo sapiens
ttaaatcagaataaa

SEQ ID NO: 2935604 - DNA, 22 bp, Homo sapiens
ttaaatcagtttattaaatctg

SEQ ID NO: 2935605 - DNA, 19 bp, Homo sapiens
ttaaatcgtttaatgttta

SEQ ID NO: 2935606 - DNA, 17 bp, Homo sapiens
ttaaatctgaattttaa

SEQ ID NO: 2935607 - DNA, 18 bp, Homo sapiens
ttaaatctgtttttctaa

SEQ ID NO: 2935608 - DNA, 15 bp, Homo sapiens
ttaaatctttcttca

SEQ ID NO: 2935609 - DNA, 18 bp, Homo sapiens
ttaaatgcttttaaatct

SEQ ID NO: 2935610 - DNA, 23 bp, Homo sapiens
ttaaatgggctactttgtccttt

SEQ ID NO: 2935611 - DNA, 11 bp, Homo sapiens
ttaaatgtgaa

SEQ ID NO: 2935612 - DNA, 12 bp, Homo sapiens
ttaaatgtgaat

SEQ ID NO: 2935613 - DNA, 14 bp, Homo sapiens
ttaaatgtttacta

SEQ ID NO: 2935614 - DNA, 16 bp, Homo sapiens
ttaaattacaatttta

SEQ ID NO: 2935615 - DNA, 18 bp, Homo sapiens
ttaaattacaattttatc

SEQ ID NO: 2935616 - DNA, 16 bp, Homo sapiens
ttaaattatgttttta

SEQ ID NO: 2935617 - DNA, 21 bp, Homo sapiens
ttaaattattatcttcttaac

SEQ ID NO: 2935618 - DNA, 18 bp, Homo sapiens
ttaaattctcaaagtttt

SEQ ID NO: 2935619 - DNA, 17 bp, Homo sapiens
ttaaattctctctaaca

SEQ ID NO: 2935620 - DNA, 20 bp, Homo sapiens
ttaaattttaccctttagac

SEQ ID NO: 2935621 - DNA, 14 bp, Homo sapiens
ttaaattttgtaat

SEQ ID NO: 2935622 - DNA, 20 bp, Homo sapiens
ttaacaaatgctattaaagt

SEQ ID NO: 2935623 - DNA, 20 bp, Homo sapiens
ttaacaagaagatgaatggc

SEQ ID NO: 2935624 - DNA, 21 bp, Homo sapiens
ttaacaatgtattttaataac

SEQ ID NO: 2935625 - DNA, 12 bp, Homo sapiens
ttaacacatttt

SEQ ID NO: 2935626 - DNA, 17 bp, Homo sapiens
ttaacagaaatgtttct

SEQ ID NO: 2935627 - DNA, 19 bp, Homo sapiens
ttaacagaaatgtttctgt

SEQ ID NO: 2935628 - DNA, 13 bp, Homo sapiens
ttaacagagtctg

SEQ ID NO: 2935629 - DNA, 18 bp, Homo sapiens
ttaacagagttttctgtt

SEQ ID NO: 2935630 - DNA, 18 bp, Homo sapiens
ttaacaggttttcttcta

SEQ ID NO: 2935631 - DNA, 13 bp, Homo sapiens
ttaacattccaag

SEQ ID NO: 2935632 - DNA, 14 bp, Homo sapiens
ttaacattccaaga

SEQ ID NO: 2935633 - DNA, 14 bp, Homo sapiens
ttaacatttcaagg

SEQ ID NO: 2935634 - DNA, 16 bp, Homo sapiens
ttaaccaaataaaaca

SEQ ID NO: 2935635 - DNA, 15 bp, Homo sapiens
ttaaccgtttttcaa

SEQ ID NO: 2935636 - DNA, 22 bp, Homo sapiens
ttaaccgtttttcaagaaaact

SEQ ID NO: 2935637 - DNA, 20 bp, Homo sapiens
ttaacgtgggattcagagaa

SEQ ID NO: 2935638 - DNA, 18 bp, Homo sapiens
ttaactactatattgatt

SEQ ID NO: 2935639 - DNA, 14 bp, Homo sapiens
ttaactactgtaga

SEQ ID NO: 2935640 - DNA, 18 bp, Homo sapiens
ttaactactgtagaactg

SEQ ID NO: 2935641 - DNA, 20 bp, Homo sapiens
ttaactactgtagaactgat

SEQ ID NO: 2935642 - DNA, 22 bp, Homo sapiens
ttaactactgtagaactgattt

SEQ ID NO: 2935643 - DNA, 19 bp, Homo sapiens
ttaactacttatctctaaa

SEQ ID NO: 2935644 - DNA, 21 bp, Homo sapiens
ttaactctgtaaaagtgtctg

SEQ ID NO: 2935645 - DNA, 23 bp, Homo sapiens
ttaactctgtaaaagtgtctgta

SEQ ID NO: 2935646 - DNA, 15 bp, Homo sapiens
ttaactgaagaaaga

SEQ ID NO: 2935647 - DNA, 18 bp, Homo sapiens
ttaactgaagatattcca

SEQ ID NO: 2935648 - DNA, 19 bp, Homo sapiens
ttaactgaagatgttgaga

SEQ ID NO: 2935649 - DNA, 21 bp, Homo sapiens
ttaactgaagatgttgagaaa

SEQ ID NO: 2935650 - DNA, 21 bp, Homo sapiens
ttaactgccaatccttaaata

SEQ ID NO: 2935651 - DNA, 14 bp, Homo sapiens
ttaactgcttttgc

SEQ ID NO: 2935652 - DNA, 20 bp, Homo sapiens
ttaactggtgcactttgtaa

SEQ ID NO: 2935653 - DNA, 21 bp, Homo sapiens
ttaactggtgcactttgtaaa

SEQ ID NO: 2935654 - DNA, 23 bp, Homo sapiens
ttaactggtgcactttgtaaatt

SEQ ID NO: 2935655 - DNA, 12 bp, Homo sapiens
ttaactgtactg

SEQ ID NO: 2935656 - DNA, 22 bp, Homo sapiens
ttaacttatttatatgaagcaa

SEQ ID NO: 2935657 - DNA, 14 bp, Homo sapiens
ttaacttgaatttg

SEQ ID NO: 2935658 - DNA, 19 bp, Homo sapiens
ttaactttaaaactgtatt

SEQ ID NO: 2935659 - DNA, 14 bp, Homo sapiens
ttaactttttaacc

SEQ ID NO: 2935660 - DNA, 17 bp, Homo sapiens
ttaagaaccttattttg

SEQ ID NO: 2935661 - DNA, 14 bp, Homo sapiens
ttaagaaggcaaaa

SEQ ID NO: 2935662 - DNA, 23 bp, Homo sapiens
ttaagaataatttttaattgctt

SEQ ID NO: 2935663 - DNA, 17 bp, Homo sapiens
ttaagaatagtctctgg

SEQ ID NO: 2935664 - DNA, 11 bp, Homo sapiens
ttaagaatgaa

SEQ ID NO: 2935665 - DNA, 16 bp, Homo sapiens
ttaagacatgatttcc

SEQ ID NO: 2935666 - DNA, 11 bp, Homo sapiens
ttaagacctgg

SEQ ID NO: 2935667 - DNA, 14 bp, Homo sapiens
ttaagacctggcag

SEQ ID NO: 2935668 - DNA, 14 bp, Homo sapiens
ttaagactgatttt

SEQ ID NO: 2935669 - DNA, 18 bp, Homo sapiens
ttaagactgattttaata

SEQ ID NO: 2935670 - DNA, 18 bp, Homo sapiens
ttaagacttagttatttc

SEQ ID NO: 2935671 - DNA, 13 bp, Homo sapiens
ttaagacttgaca

SEQ ID NO: 2935672 - DNA, 22 bp, Homo sapiens
ttaagagccatataagtttgaa

SEQ ID NO: 2935673 - DNA, 12 bp, Homo sapiens
ttaagaggcttt

SEQ ID NO: 2935674 - DNA, 22 bp, Homo sapiens
ttaagagtacaagctcttgttt

SEQ ID NO: 2935675 - DNA, 17 bp, Homo sapiens
ttaagatgtctgagaga

SEQ ID NO: 2935676 - DNA, 14 bp, Homo sapiens
ttaagattcagttt

SEQ ID NO: 2935677 - DNA, 14 bp, Homo sapiens
ttaagcaacatctt

SEQ ID NO: 2935678 - DNA, 21 bp, Homo sapiens
ttaagcaaggtgtccctgcct

SEQ ID NO: 2935679 - DNA, 15 bp, Homo sapiens
ttaagcatgcttcta

SEQ ID NO: 2935680 - DNA, 13 bp, Homo sapiens
ttaagctccagct

SEQ ID NO: 2935681 - DNA, 14 bp, Homo sapiens
ttaagctccagctt

SEQ ID NO: 2935682 - DNA, 18 bp, Homo sapiens
ttaaggaaaaaagatttt

SEQ ID NO: 2935683 - DNA, 21 bp, Homo sapiens
ttaaggagactggtaggagga

SEQ ID NO: 2935684 - DNA, 18 bp, Homo sapiens
ttaaggagggagaaagga

SEQ ID NO: 2935685 - DNA, 23 bp, Homo sapiens
ttaaggctgaggaaaggccagct

SEQ ID NO: 2935686 - DNA, 14 bp, Homo sapiens
ttaagggaatatgc

SEQ ID NO: 2935687 - DNA, 21 bp, Homo sapiens
ttaagggccggggatggatct

SEQ ID NO: 2935688 - DNA, 22 bp, Homo sapiens
ttaagggccggggatggatctt

SEQ ID NO: 2935689 - DNA, 20 bp, Homo sapiens
ttaaggtgaggcctgtctgt

SEQ ID NO: 2935690 - DNA, 19 bp, Homo sapiens
ttaagtagaacaaaaaacc

SEQ ID NO: 2935691 - DNA, 15 bp, Homo sapiens
ttaagtgtgcagcca

SEQ ID NO: 2935692 - DNA, 17 bp, Homo sapiens
ttaagtgtgcagccata

SEQ ID NO: 2935693 - DNA, 13 bp, Homo sapiens
ttaagtgttgaaa

SEQ ID NO: 2935694 - DNA, 22 bp, Homo sapiens
ttaagttggctagagcttctgt

SEQ ID NO: 2935695 - DNA, 18 bp, Homo sapiens
ttaagttttatttaactt

SEQ ID NO: 2935696 - DNA, 11 bp, Homo sapiens
ttaataaaaag

SEQ ID NO: 2935697 - DNA, 14 bp, Homo sapiens
ttaataaaataatt

SEQ ID NO: 2935698 - DNA, 22 bp, Homo sapiens
ttaataaacgaagataaatcat

SEQ ID NO: 2935699 - DNA, 20 bp, Homo sapiens
ttaataactttgctggaaaa

SEQ ID NO: 2935700 - DNA, 17 bp, Homo sapiens
ttaataagttgatgttt

SEQ ID NO: 2935701 - DNA, 21 bp, Homo sapiens
ttaataagttgatgttttcta

SEQ ID NO: 2935702 - DNA, 18 bp, Homo sapiens
ttaataataattgaagaa

SEQ ID NO: 2935703 - DNA, 16 bp, Homo sapiens
ttaatacacaatgcat

SEQ ID NO: 2935704 - DNA, 17 bp, Homo sapiens
ttaatactaccttgaaa

SEQ ID NO: 2935705 - DNA, 23 bp, Homo sapiens
ttaatagagaaggaaagctttgg

SEQ ID NO: 2935706 - DNA, 18 bp, Homo sapiens
ttaatagcttttgattag

SEQ ID NO: 2935707 - DNA, 13 bp, Homo sapiens
ttaataggatttt

SEQ ID NO: 2935708 - DNA, 16 bp, Homo sapiens
ttaatagtgttaatca

SEQ ID NO: 2935709 - DNA, 16 bp, Homo sapiens
ttaatataagtttctt

SEQ ID NO: 2935710 - DNA, 14 bp, Homo sapiens
ttatctgatactta

SEQ ID NO: 2935711 - DNA, 22 bp, Homo sapiens
ttatctggtatggtgctaatat

SEQ ID NO: 2935712 - DNA, 21 bp, Homo sapiens
ttatctgtggagttcctgctc

SEQ ID NO: 2935713 - DNA, 14 bp, Homo sapiens
ttatcttaacactg

SEQ ID NO: 2935714 - DNA, 19 bp, Homo sapiens
ttatcttaacactgaaatt

SEQ ID NO: 2935715 - DNA, 18 bp, Homo sapiens
ttatcttctcaagttcta

SEQ ID NO: 2935716 - DNA, 19 bp, Homo sapiens
ttatctttagttgaattcc

SEQ ID NO: 2935717 - DNA, 24 bp, Homo sapiens
ttatctttcgtgataaactttgct

SEQ ID NO: 2935718 - DNA, 15 bp, Homo sapiens
ttatgaaacagaaaa

SEQ ID NO: 2935719 - DNA, 22 bp, Homo sapiens
ttatgacaagctgtatcactgc

SEQ ID NO: 2935720 - DNA, 23 bp, Homo sapiens
ttatgaccagagcaaaaatgtaa

SEQ ID NO: 2935721 - DNA, 13 bp, Homo sapiens
ttatgagaaactg

SEQ ID NO: 2935722 - DNA, 11 bp, Homo sapiens
ttatgagaaat

SEQ ID NO: 2935723 - DNA, 18 bp, Homo sapiens
ttatgagaaatgtaatgc

SEQ ID NO: 2935724 - DNA, 21 bp, Homo sapiens
ttatgagaaatgtaatgcgat

SEQ ID NO: 2935725 - DNA, 14 bp, Homo sapiens
ttatgagaacatgg

SEQ ID NO: 2935726 - DNA, 15 bp, Homo sapiens
ttatgagaacatggt

SEQ ID NO: 2935727 - DNA, 19 bp, Homo sapiens
ttatgagttattcatattc

SEQ ID NO: 2935728 - DNA, 18 bp, Homo sapiens
ttatgataatagattctc

SEQ ID NO: 2935729 - DNA, 12 bp, Homo sapiens
ttatgatagatt

SEQ ID NO: 2935730 - DNA, 18 bp, Homo sapiens
ttatgatagtgcaaggaa

SEQ ID NO: 2935731 - DNA, 14 bp, Homo sapiens
ttatgatatttctt

SEQ ID NO: 2935732 - DNA, 15 bp, Homo sapiens
ttatgatcagtgttg

SEQ ID NO: 2935733 - DNA, 13 bp, Homo sapiens
ttatgatctatgt

SEQ ID NO: 2935734 - DNA, 23 bp, Homo sapiens
ttatgatggaagacaggaaagtt

SEQ ID NO: 2935735 - DNA, 21 bp, Homo sapiens
ttatgcaattcagtgttccaa

SEQ ID NO: 2935736 - DNA, 11 bp, Homo sapiens
ttatgcatctg

SEQ ID NO: 2935737 - DNA, 13 bp, Homo sapiens
ttatgccacctga

SEQ ID NO: 2935738 - DNA, 22 bp, Homo sapiens
ttatgctataaattttttgaaa

SEQ ID NO: 2935739 - DNA, 23 bp, Homo sapiens
ttatgctccatcccattcacttc

SEQ ID NO: 2935740 - DNA, 17 bp, Homo sapiens
ttatgctctcactgttt

SEQ ID NO: 2935741 - DNA, 18 bp, Homo sapiens
ttatgctgtagtcttacc

SEQ ID NO: 2935742 - DNA, 14 bp, Homo sapiens
ttatggaattgatt

SEQ ID NO: 2935743 - DNA, 11 bp, Homo sapiens
ttatggacatc

SEQ ID NO: 2935744 - DNA, 22 bp, Homo sapiens
ttatggacatcgatatgaaaaa

SEQ ID NO: 2935745 - DNA, 21 bp, Homo sapiens
ttatggatacgtgttttgaat

SEQ ID NO: 2935746 - DNA, 17 bp, Homo sapiens
ttatgggaatcaagatt

SEQ ID NO: 2935747 - DNA, 13 bp, Homo sapiens
ttatggtgtttct

SEQ ID NO: 2935748 - DNA, 20 bp, Homo sapiens
ttatggtgtttctccctctc

SEQ ID NO: 2935749 - DNA, 17 bp, Homo sapiens
ttatggttttgtgatgt

SEQ ID NO: 2935750 - DNA, 22 bp, Homo sapiens
ttatgtaaaaggccaaacctct

SEQ ID NO: 2935751 - DNA, 16 bp, Homo sapiens
ttatgtaaataactct

SEQ ID NO: 2935752 - DNA, 20 bp, Homo sapiens
ttatgtaaatgtttgttaaa

SEQ ID NO: 2935753 - DNA, 16 bp, Homo sapiens
ttatgtacaacattta

SEQ ID NO: 2935754 - DNA, 20 bp, Homo sapiens
ttatgtatttcctggatgtt

SEQ ID NO: 2935755 - DNA, 17 bp, Homo sapiens
ttatgtccactgtgtat

SEQ ID NO: 2935756 - DNA, 21 bp, Homo sapiens
ttatgtcttttgatgaataga

SEQ ID NO: 2935757 - DNA, 15 bp, Homo sapiens
ttatgtggcttttat

SEQ ID NO: 2935758 - DNA, 19 bp, Homo sapiens
ttatgtggttttagatttt

SEQ ID NO: 2935759 - DNA, 15 bp, Homo sapiens
ttatgtgtctggaag

SEQ ID NO: 2935760 - DNA, 13 bp, Homo sapiens
ttatgttcttata

SEQ ID NO: 2935761 - DNA, 19 bp, Homo sapiens
ttatgttcttatagaataa

SEQ ID NO: 2935762 - DNA, 12 bp, Homo sapiens
ttatgtttctta

SEQ ID NO: 2935763 - DNA, 20 bp, Homo sapiens
ttatgttttatttggcttgt

SEQ ID NO: 2935764 - DNA, 18 bp, Homo sapiens
ttattaaacgtatgcatg

SEQ ID NO: 2935765 - DNA, 15 bp, Homo sapiens
ttattaaatcgttta

SEQ ID NO: 2935766 - DNA, 20 bp, Homo sapiens
ttattaaatcgtttaatgtt

SEQ ID NO: 2935767 - DNA, 21 bp, Homo sapiens
ttattaaatcgtttaatgttt

SEQ ID NO: 2935768 - DNA, 23 bp, Homo sapiens
ttattaaatcgtttaatgtttat

SEQ ID NO: 2935769 - DNA, 17 bp, Homo sapiens
ttattaaatttatttga

SEQ ID NO: 2935770 - DNA, 20 bp, Homo sapiens
ttattaaatttatttgaaaa

SEQ ID NO: 2935771 - DNA, 19 bp, Homo sapiens
ttattaacaattaggcaga

SEQ ID NO: 2935772 - DNA, 15 bp, Homo sapiens
ttattaacctcttaa

SEQ ID NO: 2935773 - DNA, 20 bp, Homo sapiens
ttattaagccaggaaacatg

SEQ ID NO: 2935774 - DNA, 23 bp, Homo sapiens
ttattaagccaggaaacatgaag

SEQ ID NO: 2935775 - DNA, 11 bp, Homo sapiens
ttattaatgca

SEQ ID NO: 2935776 - DNA, 13 bp, Homo sapiens
ttattaatgcact

SEQ ID NO: 2935777 - DNA, 19 bp, Homo sapiens
ttattacaaattttcactg

SEQ ID NO: 2935778 - DNA, 20 bp, Homo sapiens
ttattacataactgatctat

SEQ ID NO: 2935779 - DNA, 22 bp, Homo sapiens
ttattacataactgatctattt

SEQ ID NO: 2935780 - DNA, 12 bp, Homo sapiens
ttattacatctt

SEQ ID NO: 2935781 - DNA, 13 bp, Homo sapiens
ttattacatgtaa

SEQ ID NO: 2935782 - DNA, 18 bp, Homo sapiens
ttattacattagttaaga

SEQ ID NO: 2935783 - DNA, 19 bp, Homo sapiens
ttattacatttaaatcctt

SEQ ID NO: 2935784 - DNA, 21 bp, Homo sapiens
ttattactgttgtatctatgt

SEQ ID NO: 2935785 - DNA, 16 bp, Homo sapiens
ttattagccagtgaaa

SEQ ID NO: 2935786 - DNA, 14 bp, Homo sapiens
ttattagtttacat

SEQ ID NO: 2935787 - DNA, 12 bp, Homo sapiens
ttattataaatg

SEQ ID NO: 2935788 - DNA, 19 bp, Homo sapiens
ttattatcctcctgttctg

SEQ ID NO: 2935789 - DNA, 16 bp, Homo sapiens
ttattatcgcatacag

SEQ ID NO: 2935790 - DNA, 13 bp, Homo sapiens
ttattatgaagaa

SEQ ID NO: 2935791 - DNA, 15 bp, Homo sapiens
ttattatttaactct

SEQ ID NO: 2935792 - DNA, 19 bp, Homo sapiens
ttattcaaactacctatat

SEQ ID NO: 2935793 - DNA, 16 bp, Homo sapiens
ttattccatcttctcc

SEQ ID NO: 2935794 - DNA, 15 bp, Homo sapiens
ttattccgtattaca

SEQ ID NO: 2935795 - DNA, 17 bp, Homo sapiens
ttattcctgtatgttgt

SEQ ID NO: 2935796 - DNA, 19 bp, Homo sapiens
ttattctaaacagactcat

SEQ ID NO: 2935797 - DNA, 13 bp, Homo sapiens
ttattctctgttt

SEQ ID NO: 2935798 - DNA, 18 bp, Homo sapiens
ttattcttgaaagaagaa

SEQ ID NO: 2935799 - DNA, 12 bp, Homo sapiens
ttattcttggtt

SEQ ID NO: 2935800 - DNA, 18 bp, Homo sapiens
ttattgaatctatttaag

SEQ ID NO: 2935801 - DNA, 23 bp, Homo sapiens
ttattgacgaactggctacagta

SEQ ID NO: 2935802 - DNA, 23 bp, Homo sapiens
ttattgagattgtcctcatttct

SEQ ID NO: 2935803 - DNA, 14 bp, Homo sapiens
ttattgatctttgc

SEQ ID NO: 2935804 - DNA, 14 bp, Homo sapiens
ttattgatggatat

SEQ ID NO: 2935805 - DNA, 14 bp, Homo sapiens
ttattgcagtttat

SEQ ID NO: 2935806 - DNA, 18 bp, Homo sapiens
ttattgccctaacaattt

SEQ ID NO: 2935807 - DNA, 17 bp, Homo sapiens
ttattgccttctcacca

SEQ ID NO: 2935808 - DNA, 20 bp, Homo sapiens
ttattgccttctcaccagct

SEQ ID NO: 2935809 - DNA, 23 bp, Homo sapiens
ttattgccttctcaccagctgca

SEQ ID NO: 2935810 - DNA, 13 bp, Homo sapiens
ttattggatcagt

SEQ ID NO: 2935811 - DNA, 16 bp, Homo sapiens
ttattgtataaaaagt

SEQ ID NO: 2935812 - DNA, 20 bp, Homo sapiens
ttattgtcttggttgccagt

SEQ ID NO: 2935813 - DNA, 21 bp, Homo sapiens
ttattgtggataacaaagata

SEQ ID NO: 2935814 - DNA, 21 bp, Homo sapiens
ttattgtgtgcgctgcctggc

SEQ ID NO: 2935815 - DNA, 14 bp, Homo sapiens
ttatttaaaaatat

SEQ ID NO: 2935816 - DNA, 20 bp, Homo sapiens
ttatttaaactctgttgcaa

SEQ ID NO: 2935817 - DNA, 14 bp, Homo sapiens
ttatttaaagaaag

SEQ ID NO: 2935818 - DNA, 19 bp, Homo sapiens
ttatttaaagcacatgcca

SEQ ID NO: 2935819 - DNA, 14 bp, Homo sapiens
ttatttaaatctgt

SEQ ID NO: 2935820 - DNA, 15 bp, Homo sapiens
ttatttaaatgtact

SEQ ID NO: 2935821 - DNA, 18 bp, Homo sapiens
ttatttaaatgtacttat

SEQ ID NO: 2935822 - DNA, 11 bp, Homo sapiens
ttatttaactc

SEQ ID NO: 2935823 - DNA, 12 bp, Homo sapiens
ttatttaacttt

SEQ ID NO: 2935824 - DNA, 20 bp, Homo sapiens
ttatttacagatgaatgtat

SEQ ID NO: 2935825 - DNA, 15 bp, Homo sapiens
ttatttatatgtact

SEQ ID NO: 2935826 - DNA, 23 bp, Homo sapiens
ttatttcaaaatatacattcaaa

SEQ ID NO: 2935827 - DNA, 14 bp, Homo sapiens
ttatttccccagcc

SEQ ID NO: 2935828 - DNA, 13 bp, Homo sapiens
ttatttctgcata

SEQ ID NO: 2935829 - DNA, 21 bp, Homo sapiens
ttatttctgcctataaattta

SEQ ID NO: 2935830 - DNA, 12 bp, Homo sapiens
ttatttgaaaat

SEQ ID NO: 2935831 - DNA, 13 bp, Homo sapiens
ttatttgaatgaa

SEQ ID NO: 2935832 - DNA, 15 bp, Homo sapiens
ttatttgactttaat

SEQ ID NO: 2935833 - DNA, 11 bp, Homo sapiens
ttatttgcata

SEQ ID NO: 2935834 - DNA, 16 bp, Homo sapiens
ttatttgtttgatttt

SEQ ID NO: 2935835 - DNA, 18 bp, Homo sapiens
ttatttgtttgattttca

SEQ ID NO: 2935836 - DNA, 19 bp, Homo sapiens
ttattttacacagaaacac

SEQ ID NO: 2935837 - DNA, 12 bp, Homo sapiens
ttattttacatt

SEQ ID NO: 2935838 - DNA, 16 bp, Homo sapiens
ttattttagtttctgt

SEQ ID NO: 2935839 - DNA, 22 bp, Homo sapiens
ttattttatgacatgaaaagtt

SEQ ID NO: 2935840 - DNA, 23 bp, Homo sapiens
ttattttatgagaaatgtaatgc

SEQ ID NO: 2935841 - DNA, 16 bp, Homo sapiens
ttattttcaagtagct

SEQ ID NO: 2935842 - DNA, 14 bp, Homo sapiens
ttattttcagtgat

SEQ ID NO: 2935843 - DNA, 24 bp, Homo sapiens
ttcagcgatgtatgcagctatctg

SEQ ID NO: 2935844 - DNA, 15 bp, Homo sapiens
ttcagcgcccccagg

SEQ ID NO: 2935845 - DNA, 19 bp, Homo sapiens
ttcagcgcccccaggcctg

SEQ ID NO: 2935846 - DNA, 22 bp, Homo sapiens
ttcagcggcagtgtgtccatca

SEQ ID NO: 2935847 - DNA, 20 bp, Homo sapiens
ttcagctatttagtgatata

SEQ ID NO: 2935848 - DNA, 14 bp, Homo sapiens
ttcagctcacgctt

SEQ ID NO: 2935849 - DNA, 16 bp, Homo sapiens
ttcagctcacgcttca

SEQ ID NO: 2935850 - DNA, 14 bp, Homo sapiens
ttcagctgcagttg

SEQ ID NO: 2935851 - DNA, 18 bp, Homo sapiens
ttcagctgcagttgaaga

SEQ ID NO: 2935852 - DNA, 22 bp, Homo sapiens
ttcagctggtggatggtgactt

SEQ ID NO: 2935853 - DNA, 20 bp, Homo sapiens
ttcaggaacctcgagtactg

SEQ ID NO: 2935854 - DNA, 17 bp, Homo sapiens
ttcaggaagggatgcag

SEQ ID NO: 2935855 - DNA, 22 bp, Homo sapiens
ttcaggaagggatgcaggctcc

SEQ ID NO: 2935856 - DNA, 20 bp, Homo sapiens
ttcaggatgcacggtttctg

SEQ ID NO: 2935857 - DNA, 15 bp, Homo sapiens
ttcaggcagcactga

SEQ ID NO: 2935858 - DNA, 14 bp, Homo sapiens
ttcaggctctgccc

SEQ ID NO: 2935859 - DNA, 18 bp, Homo sapiens
ttcagggcagcccctgca

SEQ ID NO: 2935860 - DNA, 21 bp, Homo sapiens
ttcagggtaggtttgtgtctt

SEQ ID NO: 2935861 - DNA, 16 bp, Homo sapiens
ttcaggtatgttgcct

SEQ ID NO: 2935862 - DNA, 14 bp, Homo sapiens
ttcaggtccaggct

SEQ ID NO: 2935863 - DNA, 21 bp, Homo sapiens
ttcaggtggagagcactagaa

SEQ ID NO: 2935864 - DNA, 21 bp, Homo sapiens
ttcaggtgtagtagttctgtg

SEQ ID NO: 2935865 - DNA, 21 bp, Homo sapiens
ttcagtaacccccactggact

SEQ ID NO: 2935866 - DNA, 17 bp, Homo sapiens
ttcagtaatgtcttcag

SEQ ID NO: 2935867 - DNA, 20 bp, Homo sapiens
ttcagtatgttttacactgt

SEQ ID NO: 2935868 - DNA, 21 bp, Homo sapiens
ttcagtcatataaaagctatg

SEQ ID NO: 2935869 - DNA, 23 bp, Homo sapiens
ttcagtcctggtctgctcaggaa

SEQ ID NO: 2935870 - DNA, 16 bp, Homo sapiens
ttcagtctagaagaat

SEQ ID NO: 2935871 - DNA, 16 bp, Homo sapiens
ttcagtgaactaattt

SEQ ID NO: 2935872 - DNA, 20 bp, Homo sapiens
ttcagtgcacctgcctcagc

SEQ ID NO: 2935873 - DNA, 19 bp, Homo sapiens
ttcagtggaacacaaatga

SEQ ID NO: 2935874 - DNA, 14 bp, Homo sapiens
ttcagtggggcagt

SEQ ID NO: 2935875 - DNA, 12 bp, Homo sapiens
ttcagtgtaatt

SEQ ID NO: 2935876 - DNA, 19 bp, Homo sapiens
ttcagtgtaatttctttgc

SEQ ID NO: 2935877 - DNA, 13 bp, Homo sapiens
ttcagttccagct

SEQ ID NO: 2935878 - DNA, 15 bp, Homo sapiens
ttcagttccagcttt

SEQ ID NO: 2935879 - DNA, 16 bp, Homo sapiens
ttcagttgattttaca

SEQ ID NO: 2935880 - DNA, 21 bp, Homo sapiens
ttcagtttgaaaatattttgt

SEQ ID NO: 2935881 - DNA, 13 bp, Homo sapiens
ttcagttttggtg

SEQ ID NO: 2935882 - DNA, 24 bp, Homo sapiens
ttcagttttggtgataatcgtctt

SEQ ID NO: 2935883 - DNA, 22 bp, Homo sapiens
ttcataaagattcacctaagag

SEQ ID NO: 2935884 - DNA, 22 bp, Homo sapiens
ttcataaatttgttgtcatgtg

SEQ ID NO: 2935885 - DNA, 23 bp, Homo sapiens
ttcataaatttgttgtcatgtgt

SEQ ID NO: 2935886 - DNA, 16 bp, Homo sapiens
ttcataacttcctgta

SEQ ID NO: 2935887 - DNA, 14 bp, Homo sapiens
ttcataatctttgc

SEQ ID NO: 2935888 - DNA, 22 bp, Homo sapiens
ttcataatgcagaagtattctt

SEQ ID NO: 2935889 - DNA, 23 bp, Homo sapiens
ttcatactctgttgcctcctctc

SEQ ID NO: 2935890 - DNA, 17 bp, Homo sapiens
ttcatagatattggaag

SEQ ID NO: 2935891 - DNA, 15 bp, Homo sapiens
ttcataggggcaggt

SEQ ID NO: 2935892 - DNA, 19 bp, Homo sapiens
ttcatagtaagtgcgaaga

SEQ ID NO: 2935893 - DNA, 18 bp, Homo sapiens
ttcatagtgcctttttcc

SEQ ID NO: 2935894 - DNA, 16 bp, Homo sapiens
ttcatatcccgtgaaa

SEQ ID NO: 2935895 - DNA, 16 bp, Homo sapiens
ttcatatctctccctt

SEQ ID NO: 2935896 - DNA, 22 bp, Homo sapiens
ttcatattaatataagtttctt

SEQ ID NO: 2935897 - DNA, 23 bp, Homo sapiens
ttcatattaatataagtttcttt

SEQ ID NO: 2935898 - DNA, 14 bp, Homo sapiens
ttcatattgaatat

SEQ ID NO: 2935899 - DNA, 18 bp, Homo sapiens
ttcatatttgtagttgca

SEQ ID NO: 2935900 - DNA, 19 bp, Homo sapiens
ttcatcatccctccctgcc

SEQ ID NO: 2935901 - DNA, 17 bp, Homo sapiens
ttcatcattccctctca

SEQ ID NO: 2935902 - DNA, 19 bp, Homo sapiens
ttcatcattccctctcatc

SEQ ID NO: 2935903 - DNA, 15 bp, Homo sapiens
ttcatcatttcagcc

SEQ ID NO: 2935904 - DNA, 18 bp, Homo sapiens
ttcatcatttcagccaaa

SEQ ID NO: 2935905 - DNA, 23 bp, Homo sapiens
ttcatcatttcagccaaagtcct

SEQ ID NO: 2935906 - DNA, 22 bp, Homo sapiens
ttcatccagctacttagctggc

SEQ ID NO: 2935907 - DNA, 18 bp, Homo sapiens
ttcatccatcatctgctg

SEQ ID NO: 2935908 - DNA, 11 bp, Homo sapiens
ttcatcctggc

SEQ ID NO: 2935909 - DNA, 20 bp, Homo sapiens
ttcatcgaatctactaattc

SEQ ID NO: 2935910 - DNA, 23 bp, Homo sapiens
ttcatcgaatctactaattccac

SEQ ID NO: 2935911 - DNA, 14 bp, Homo sapiens
ttcatctccctgcc

SEQ ID NO: 2935912 - DNA, 15 bp, Homo sapiens
ttcatctccctgcca

SEQ ID NO: 2935913 - DNA, 18 bp, Homo sapiens
ttcatctctaacatatga

SEQ ID NO: 2935914 - DNA, 12 bp, Homo sapiens
ttcatctgccca

SEQ ID NO: 2935915 - DNA, 13 bp, Homo sapiens
ttcatctgggaaa

SEQ ID NO: 2935916 - DNA, 22 bp, Homo sapiens
ttcatcttggtcacatacaatt

SEQ ID NO: 2935917 - DNA, 17 bp, Homo sapiens
ttcatggcagaaggcaa

SEQ ID NO: 2935918 - DNA, 14 bp, Homo sapiens
ttcatgtaaactgt

SEQ ID NO: 2935919 - DNA, 13 bp, Homo sapiens
ttcatgtacattt

SEQ ID NO: 2935920 - DNA, 16 bp, Homo sapiens
ttcatgtctgctatca

SEQ ID NO: 2935921 - DNA, 18 bp, Homo sapiens
ttcatgttttaacaaaaa

SEQ ID NO: 2935922 - DNA, 12 bp, Homo sapiens
ttcattaaactt

SEQ ID NO: 2935923 - DNA, 23 bp, Homo sapiens
ttcattaaatgtttgttgaataa

SEQ ID NO: 2935924 - DNA, 16 bp, Homo sapiens
ttcattaattctataa

SEQ ID NO: 2935925 - DNA, 22 bp, Homo sapiens
ttcattattagtactgctcttg

SEQ ID NO: 2935926 - DNA, 15 bp, Homo sapiens
ttcattattctcata

SEQ ID NO: 2935927 - DNA, 23 bp, Homo sapiens
ttcattcaatcaacctgcacttc

SEQ ID NO: 2935928 - DNA, 9 bp, Homo sapiens
ttcattcag

SEQ ID NO: 2935929 - DNA, 14 bp, Homo sapiens
ttcattcattcact

SEQ ID NO: 2935930 - DNA, 12 bp, Homo sapiens
ttcattcatttt

SEQ ID NO: 2935931 - DNA, 16 bp, Homo sapiens
ttcattctcctcctcc

SEQ ID NO: 2935932 - DNA, 19 bp, Homo sapiens
ttcattgagagttttgtct

SEQ ID NO: 2935933 - DNA, 15 bp, Homo sapiens
ttcatttctaattaa

SEQ ID NO: 2935934 - DNA, 22 bp, Homo sapiens
ttcatttgcttcaggagtttca

SEQ ID NO: 2935935 - DNA, 22 bp, Homo sapiens
ttcatttggttcattaattcta

SEQ ID NO: 2935936 - DNA, 22 bp, Homo sapiens
ttcatttgtggtgatatagaat

SEQ ID NO: 2935937 - DNA, 15 bp, Homo sapiens
ttcattttatgaaga

SEQ ID NO: 2935938 - DNA, 14 bp, Homo sapiens
ttcatttttaatca

SEQ ID NO: 2935939 - DNA, 18 bp, Homo sapiens
ttcatttttaatcatgaa

SEQ ID NO: 2935940 - DNA, 23 bp, Homo sapiens
ttcatttttgtgagcctctttgt

SEQ ID NO: 2935941 - DNA, 24 bp, Homo sapiens
ttcatttttgtgagcctctttgta

SEQ ID NO: 2935942 - DNA, 19 bp, Homo sapiens
ttcatttttttctctctgg

SEQ ID NO: 2935943 - DNA, 21 bp, Homo sapiens
ttcatttttttctctctggag

SEQ ID NO: 2935944 - DNA, 22 bp, Homo sapiens
ttccaaagagtagaattgcatt

SEQ ID NO: 2935945 - DNA, 18 bp, Homo sapiens
ttccaaagagtgtggaat

SEQ ID NO: 2935946 - DNA, 17 bp, Homo sapiens
ttccaacaggcgtggga

SEQ ID NO: 2935947 - DNA, 16 bp, Homo sapiens
ttccaaccttcctttt

SEQ ID NO: 2935948 - DNA, 18 bp, Homo sapiens
ttccaaccttcctttttt

SEQ ID NO: 2935949 - DNA, 19 bp, Homo sapiens
ttccaactcgtatagcatg

SEQ ID NO: 2935950 - DNA, 22 bp, Homo sapiens
ttccaacttggctgcaggaatc

SEQ ID NO: 2935951 - DNA, 16 bp, Homo sapiens
ttccaagactctagag

SEQ ID NO: 2935952 - DNA, 12 bp, Homo sapiens
ttccaagagtct

SEQ ID NO: 2935953 - DNA, 13 bp, Homo sapiens
ttccaagagtcta

SEQ ID NO: 2935954 - DNA, 15 bp, Homo sapiens
ttccaagtagctggg

SEQ ID NO: 2935955 - DNA, 14 bp, Homo sapiens
ttccaagtgtgcat

SEQ ID NO: 2935956 - DNA, 17 bp, Homo sapiens
ttccaatgtgaaagatt

SEQ ID NO: 2935957 - DNA, 15 bp, Homo sapiens
ttccaattaaattta

SEQ ID NO: 2935958 - DNA, 19 bp, Homo sapiens
ttccacaagattcccagag

SEQ ID NO: 2935959 - DNA, 14 bp, Homo sapiens
ttccacactgttga

SEQ ID NO: 2935960 - DNA, 12 bp, Homo sapiens
ttccacagattg

SEQ ID NO: 2935961 - DNA, 15 bp, Homo sapiens
ttccacaggatcatc

SEQ ID NO: 2935962 - DNA, 11 bp, Homo sapiens
ttccacatttt

SEQ ID NO: 2935963 - DNA, 15 bp, Homo sapiens
ttccaccagagcagg

SEQ ID NO: 2935964 - DNA, 23 bp, Homo sapiens
ttccaccagagcaggggctgctg

SEQ ID NO: 2935965 - DNA, 19 bp, Homo sapiens
ttccacctcacctctttgt

SEQ ID NO: 2935966 - DNA, 24 bp, Homo sapiens
ttccacgcccgggagtggggtaga

SEQ ID NO: 2935967 - DNA, 15 bp, Homo sapiens
ttccacggagccact

SEQ ID NO: 2935968 - DNA, 14 bp, Homo sapiens
ttccacgtgtatgc

SEQ ID NO: 2935969 - DNA, 19 bp, Homo sapiens
ttccacgtgttttattcct

SEQ ID NO: 2935970 - DNA, 15 bp, Homo sapiens
ttccactgagggcag

SEQ ID NO: 2935971 - DNA, 13 bp, Homo sapiens
ttccactgtgcta

SEQ ID NO: 2935972 - DNA, 12 bp, Homo sapiens
ttccacttctgg

SEQ ID NO: 2935973 - DNA, 15 bp, Homo sapiens
ttccagaagtgtgat

SEQ ID NO: 2935974 - DNA, 16 bp, Homo sapiens
ttccagagctctgacc

SEQ ID NO: 2935975 - DNA, 19 bp, Homo sapiens
ttctcttgtataagatcct

SEQ ID NO: 2935976 - DNA, 23 bp, Homo sapiens
ttctcttgtataagatcctagat

SEQ ID NO: 2935977 - DNA, 21 bp, Homo sapiens
ttctcttgtttaaaaaaagaa

SEQ ID NO: 2935978 - DNA, 17 bp, Homo sapiens
ttctcttttcctcgcag

SEQ ID NO: 2935979 - DNA, 15 bp, Homo sapiens
ttctcttttctaaaa

SEQ ID NO: 2935980 - DNA, 16 bp, Homo sapiens
ttctctttttgaaaaa

SEQ ID NO: 2935981 - DNA, 13 bp, Homo sapiens
ttctgaaaaatga

SEQ ID NO: 2935982 - DNA, 13 bp, Homo sapiens
ttctgaaaagaaa

SEQ ID NO: 2935983 - DNA, 19 bp, Homo sapiens
ttctgaagcttatgtttct

SEQ ID NO: 2935984 - DNA, 20 bp, Homo sapiens
ttctgaagttttattttaaa

SEQ ID NO: 2935985 - DNA, 14 bp, Homo sapiens
ttctgaatgtttgt

SEQ ID NO: 2935986 - DNA, 18 bp, Homo sapiens
ttctgaatttgcaaagta

SEQ ID NO: 2935987 - DNA, 15 bp, Homo sapiens
ttctgacatcagcac

SEQ ID NO: 2935988 - DNA, 12 bp, Homo sapiens
ttctgagaaaac

SEQ ID NO: 2935989 - DNA, 21 bp, Homo sapiens
ttctgagaaaacaagcaagtt

SEQ ID NO: 2935990 - DNA, 15 bp, Homo sapiens
ttctgataatgtatt

SEQ ID NO: 2935991 - DNA, 15 bp, Homo sapiens
ttctgataggagggg

SEQ ID NO: 2935992 - DNA, 14 bp, Homo sapiens
ttctgatcaaggcc

SEQ ID NO: 2935993 - DNA, 22 bp, Homo sapiens
ttctgatcaaggccttattgga

SEQ ID NO: 2935994 - DNA, 14 bp, Homo sapiens
ttctgattggtctg

SEQ ID NO: 2935995 - DNA, 23 bp, Homo sapiens
ttctgatttgccactgatattca

SEQ ID NO: 2935996 - DNA, 23 bp, Homo sapiens
ttctgattttaggagctaaggct

SEQ ID NO: 2935997 - DNA, 15 bp, Homo sapiens
ttctgcacaggtctc

SEQ ID NO: 2935998 - DNA, 15 bp, Homo sapiens
ttctgcagaagagga

SEQ ID NO: 2935999 - DNA, 22 bp, Homo sapiens
ttctgcatatgttgaatacttt

SEQ ID NO: 2936000 - DNA, 13 bp, Homo sapiens
ttctgccaggaga

SEQ ID NO: 2936001 - DNA, 20 bp, Homo sapiens
ttctgcccggctacatcagc

SEQ ID NO: 2936002 - DNA, 17 bp, Homo sapiens
ttctgcctataaattta

SEQ ID NO: 2936003 - DNA, 12 bp, Homo sapiens
ttctgcctgcca

SEQ ID NO: 2936004 - DNA, 21 bp, Homo sapiens
ttctgcctgtcctagtctcct

SEQ ID NO: 2936005 - DNA, 12 bp, Homo sapiens
ttctgctcagct

SEQ ID NO: 2936006 - DNA, 13 bp, Homo sapiens
ttctgctcatcat

SEQ ID NO: 2936007 - DNA, 14 bp, Homo sapiens
ttctgctcatcatt

SEQ ID NO: 2936008 - DNA, 14 bp, Homo sapiens
ttctgctttaaatt

SEQ ID NO: 2936009 - DNA, 13 bp, Homo sapiens
ttctgctttctat

SEQ ID NO: 2936010 - DNA, 14 bp, Homo sapiens
ttctgctttgctct

SEQ ID NO: 2936011 - DNA, 17 bp, Homo sapiens
ttctgcttttaagtttt

SEQ ID NO: 2936012 - DNA, 19 bp, Homo sapiens
ttctggacagtcagctctt

SEQ ID NO: 2936013 - DNA, 22 bp, Homo sapiens
ttctggacagtcagctcttcat

SEQ ID NO: 2936014 - DNA, 10 bp, Homo sapiens
ttctggctca

SEQ ID NO: 2936015 - DNA, 14 bp, Homo sapiens
ttctggctccctct

SEQ ID NO: 2936016 - DNA, 16 bp, Homo sapiens
ttctggctctcccatt

SEQ ID NO: 2936017 - DNA, 14 bp, Homo sapiens
ttctggggaaagac

SEQ ID NO: 2936018 - DNA, 15 bp, Homo sapiens
ttctgggggaaaaag

SEQ ID NO: 2936019 - DNA, 16 bp, Homo sapiens
ttctgggggaaaaagc

SEQ ID NO: 2936020 - DNA, 22 bp, Homo sapiens
ttctggggggacccagtgcaga

SEQ ID NO: 2936021 - DNA, 17 bp, Homo sapiens
ttctgggtagaagccac

SEQ ID NO: 2936022 - DNA, 17 bp, Homo sapiens
ttctgggtgttgaccac

SEQ ID NO: 2936023 - DNA, 14 bp, Homo sapiens
ttctggtataaagc

SEQ ID NO: 2936024 - DNA, 20 bp, Homo sapiens
ttctgtaaggtcttacattg

SEQ ID NO: 2936025 - DNA, 22 bp, Homo sapiens
ttctgtacatgcattgagctct

SEQ ID NO: 2936026 - DNA, 16 bp, Homo sapiens
ttctgtaggttaaaaa

SEQ ID NO: 2936027 - DNA, 21 bp, Homo sapiens
ttctgtatacaaccctggcat

SEQ ID NO: 2936028 - DNA, 16 bp, Homo sapiens
ttctgtatatactttt

SEQ ID NO: 2936029 - DNA, 18 bp, Homo sapiens
ttctgtatttcactcttt

SEQ ID NO: 2936030 - DNA, 20 bp, Homo sapiens
ttctgtattttcaaagactg

SEQ ID NO: 2936031 - DNA, 17 bp, Homo sapiens
ttctgtcatttacacac

SEQ ID NO: 2936032 - DNA, 12 bp, Homo sapiens
ttctgtccatca

SEQ ID NO: 2936033 - DNA, 17 bp, Homo sapiens
ttctgtccatcagtgca

SEQ ID NO: 2936034 - DNA, 19 bp, Homo sapiens
ttctgtccatcagtgcatg

SEQ ID NO: 2936035 - DNA, 15 bp, Homo sapiens
ttctgtccctcacag

SEQ ID NO: 2936036 - DNA, 18 bp, Homo sapiens
ttctgtctagactggcct

SEQ ID NO: 2936037 - DNA, 19 bp, Homo sapiens
ttctgtctcccctaccagg

SEQ ID NO: 2936038 - DNA, 13 bp, Homo sapiens
ttctgtgaagaag

SEQ ID NO: 2936039 - DNA, 15 bp, Homo sapiens
ttctgtgcactgtag

SEQ ID NO: 2936040 - DNA, 13 bp, Homo sapiens
ttctgtggaaagt

SEQ ID NO: 2936041 - DNA, 23 bp, Homo sapiens
ttctgtggaaagtgtaaagcatt

SEQ ID NO: 2936042 - DNA, 21 bp, Homo sapiens
ttctgtggccgccatctgcgc

SEQ ID NO: 2936043 - DNA, 18 bp, Homo sapiens
ttctgtgtaaccatttta

SEQ ID NO: 2936044 - DNA, 12 bp, Homo sapiens
ttctgtgtttat

SEQ ID NO: 2936045 - DNA, 18 bp, Homo sapiens
ttctgtgtttataaaata

SEQ ID NO: 2936046 - DNA, 11 bp, Homo sapiens
ttctgttcagc

SEQ ID NO: 2936047 - DNA, 13 bp, Homo sapiens
ttctgttcatctc

SEQ ID NO: 2936048 - DNA, 17 bp, Homo sapiens
ttctgttcatctctttg

SEQ ID NO: 2936049 - DNA, 21 bp, Homo sapiens
ttctgttctgtggaaagtgta

SEQ ID NO: 2936050 - DNA, 13 bp, Homo sapiens
ttctgtttcctgt

SEQ ID NO: 2936051 - DNA, 23 bp, Homo sapiens
ttctgttttcgtaccttcccact

SEQ ID NO: 2936052 - DNA, 22 bp, Homo sapiens
ttctgttttcttctcagtcttt

SEQ ID NO: 2936053 - DNA, 15 bp, Homo sapiens
ttctgtttttatgtt

SEQ ID NO: 2936054 - DNA, 17 bp, Homo sapiens
ttcttaaacacttgcaa

SEQ ID NO: 2936055 - DNA, 19 bp, Homo sapiens
ttcttaaactgaaagcttt

SEQ ID NO: 2936056 - DNA, 19 bp, Homo sapiens
ttcttaaatatatgattta

SEQ ID NO: 2936057 - DNA, 21 bp, Homo sapiens
ttcttaaatctttcttcaaat

SEQ ID NO: 2936058 - DNA, 19 bp, Homo sapiens
ttcttaacctttgctatgt

SEQ ID NO: 2936059 - DNA, 20 bp, Homo sapiens
ttcttaagccgatggtcact

SEQ ID NO: 2936060 - DNA, 17 bp, Homo sapiens
ttcttaagtataaacct

SEQ ID NO: 2936061 - DNA, 19 bp, Homo sapiens
ttcttaagtataaacctta

SEQ ID NO: 2936062 - DNA, 21 bp, Homo sapiens
ttcttaatttggataataaaa

SEQ ID NO: 2936063 - DNA, 21 bp, Homo sapiens
ttcttaatttggatctattta

SEQ ID NO: 2936064 - DNA, 14 bp, Homo sapiens
ttcttacatgtttt

SEQ ID NO: 2936065 - DNA, 18 bp, Homo sapiens
ttcttaccctagttctct

SEQ ID NO: 2936066 - DNA, 19 bp, Homo sapiens
ttcttaccctagttctctt

SEQ ID NO: 2936067 - DNA, 16 bp, Homo sapiens
ttcttactgataattt

SEQ ID NO: 2936068 - DNA, 20 bp, Homo sapiens
ttcttactgataattttgct

SEQ ID NO: 2936069 - DNA, 21 bp, Homo sapiens
ttcttagactacatttagaga

SEQ ID NO: 2936070 - DNA, 20 bp, Homo sapiens
ttcttagtgtggtatttgct

SEQ ID NO: 2936071 - DNA, 15 bp, Homo sapiens
ttcttatagaataaa

SEQ ID NO: 2936072 - DNA, 16 bp, Homo sapiens
ttcttatatctgaaga

SEQ ID NO: 2936073 - DNA, 14 bp, Homo sapiens
ttcttattcaaaga

SEQ ID NO: 2936074 - DNA, 23 bp, Homo sapiens
ttcttcaaatctcccacaagtat

SEQ ID NO: 2936075 - DNA, 22 bp, Homo sapiens
ttcttcactgtcctccaagcca

SEQ ID NO: 2936076 - DNA, 18 bp, Homo sapiens
ttcttcacttacaagaaa

SEQ ID NO: 2936077 - DNA, 18 bp, Homo sapiens
ttcttcacttttgcaagg

SEQ ID NO: 2936078 - DNA, 23 bp, Homo sapiens
ttcttcagccacctctctttttc

SEQ ID NO: 2936079 - DNA, 24 bp, Homo sapiens
ttcttcaggctgcctaagacatgt

SEQ ID NO: 2936080 - DNA, 17 bp, Homo sapiens
ttcttccaaacttttgc

SEQ ID NO: 2936081 - DNA, 23 bp, Homo sapiens
ttcttccaaacttttgcagaaaa

SEQ ID NO: 2936082 - DNA, 20 bp, Homo sapiens
ttcttccagcagaacagaga

SEQ ID NO: 2936083 - DNA, 11 bp, Homo sapiens
ttcttccagga

SEQ ID NO: 2936084 - DNA, 20 bp, Homo sapiens
ttcttccaggtgcccagcta

SEQ ID NO: 2936085 - DNA, 21 bp, Homo sapiens
ttcttccattcccatttcctg

SEQ ID NO: 2936086 - DNA, 22 bp, Homo sapiens
ttcttcccttttacatactgct

SEQ ID NO: 2936087 - DNA, 21 bp, Homo sapiens
ttcttcctccagtctgttctc

SEQ ID NO: 2936088 - DNA, 20 bp, Homo sapiens
ttcttcggggaactcctgga

SEQ ID NO: 2936089 - DNA, 17 bp, Homo sapiens
ttcttcgtatatacaca

SEQ ID NO: 2936090 - DNA, 18 bp, Homo sapiens
ttcttcgttctttttaag

SEQ ID NO: 2936091 - DNA, 13 bp, Homo sapiens
ttcttctaaatga

SEQ ID NO: 2936092 - DNA, 11 bp, Homo sapiens
ttcttctagag

SEQ ID NO: 2936093 - DNA, 23 bp, Homo sapiens
ttcttctatgtaggaaaaaaata

SEQ ID NO: 2936094 - DNA, 20 bp, Homo sapiens
ttcttctgtcctgagaagca

SEQ ID NO: 2936095 - DNA, 14 bp, Homo sapiens
ttcttcttcctgaa

SEQ ID NO: 2936096 - DNA, 13 bp, Homo sapiens
ttcttcttttaaa

SEQ ID NO: 2936097 - DNA, 16 bp, Homo sapiens
ttcttgaaagaagaat

SEQ ID NO: 2936098 - DNA, 16 bp, Homo sapiens
ttcttgcattgacatt

SEQ ID NO: 2936099 - DNA, 14 bp, Homo sapiens
ttcttgcttctggc

SEQ ID NO: 2936100 - DNA, 20 bp, Homo sapiens
ttcttggaactgtcccagct

SEQ ID NO: 2936101 - DNA, 21 bp, Homo sapiens
ttcttggaactgtcccagcta

SEQ ID NO: 2936102 - DNA, 21 bp, Homo sapiens
ttcttggtaaagtccttttct

SEQ ID NO: 2936103 - DNA, 15 bp, Homo sapiens
ttcttggtgcattcg

SEQ ID NO: 2936104 - DNA, 23 bp, Homo sapiens
ttcttggttattctgccataaca

SEQ ID NO: 2936105 - DNA, 22 bp, Homo sapiens
ttcttggttgaggaaacaaaca

SEQ ID NO: 2936106 - DNA, 16 bp, Homo sapiens
ttcttgtaaatgtgtt

SEQ ID NO: 2936107 - DNA, 12 bp, Homo sapiens
ttgcttaaggca

SEQ ID NO: 2936108 - DNA, 14 bp, Homo sapiens
ttgcttacaatttt

SEQ ID NO: 2936109 - DNA, 19 bp, Homo sapiens
ttgcttatcaacttcctaa

SEQ ID NO: 2936110 - DNA, 14 bp, Homo sapiens
ttgcttcctcctcc

SEQ ID NO: 2936111 - DNA, 15 bp, Homo sapiens
ttgcttcctcctccc

SEQ ID NO: 2936112 - DNA, 17 bp, Homo sapiens
ttgcttctacatgatgc

SEQ ID NO: 2936113 - DNA, 15 bp, Homo sapiens
ttgcttcttactgat

SEQ ID NO: 2936114 - DNA, 18 bp, Homo sapiens
ttgcttcttactgataat

SEQ ID NO: 2936115 - DNA, 15 bp, Homo sapiens
ttgcttgagctcagg

SEQ ID NO: 2936116 - DNA, 19 bp, Homo sapiens
ttgcttgcctgcagggcca

SEQ ID NO: 2936117 - DNA, 19 bp, Homo sapiens
ttgctttaacctgaacctt

SEQ ID NO: 2936118 - DNA, 13 bp, Homo sapiens
ttgctttcctctt

SEQ ID NO: 2936119 - DNA, 14 bp, Homo sapiens
ttgctttctgaaat

SEQ ID NO: 2936120 - DNA, 14 bp, Homo sapiens
ttgctttgaaaaag

SEQ ID NO: 2936121 - DNA, 11 bp, Homo sapiens
ttgctttgagc

SEQ ID NO: 2936122 - DNA, 18 bp, Homo sapiens
ttggaaaactaattaatt

SEQ ID NO: 2936123 - DNA, 14 bp, Homo sapiens
ttggaaaagaaatc

SEQ ID NO: 2936124 - DNA, 20 bp, Homo sapiens
ttggaaaagaaatcaatttt

SEQ ID NO: 2936125 - DNA, 22 bp, Homo sapiens
ttggaaacattttttaaaacaa

SEQ ID NO: 2936126 - DNA, 14 bp, Homo sapiens
ttggaagagagaat

SEQ ID NO: 2936127 - DNA, 21 bp, Homo sapiens
ttggaagatcctgtgaggagc

SEQ ID NO: 2936128 - DNA, 16 bp, Homo sapiens
ttggaagatgcagaag

SEQ ID NO: 2936129 - DNA, 23 bp, Homo sapiens
ttggaagatgcagaagcaataat

SEQ ID NO: 2936130 - DNA, 16 bp, Homo sapiens
ttggaagcaacgtgtt

SEQ ID NO: 2936131 - DNA, 21 bp, Homo sapiens
ttggaaggagacacagatgtt

SEQ ID NO: 2936132 - DNA, 23 bp, Homo sapiens
ttggaatattgtccattgtccaa

SEQ ID NO: 2936133 - DNA, 15 bp, Homo sapiens
ttggaattagatgtt

SEQ ID NO: 2936134 - DNA, 17 bp, Homo sapiens
ttggaattggtgtatat

SEQ ID NO: 2936135 - DNA, 22 bp, Homo sapiens
ttggacaaatgtgaagatgcat

SEQ ID NO: 2936136 - DNA, 14 bp, Homo sapiens
ttggacccttccat

SEQ ID NO: 2936137 - DNA, 14 bp, Homo sapiens
ttggactccatctc

SEQ ID NO: 2936138 - DNA, 18 bp, Homo sapiens
ttggactgagatttctta

SEQ ID NO: 2936139 - DNA, 16 bp, Homo sapiens
ttggacttgtcccggg

SEQ ID NO: 2936140 - DNA, 20 bp, Homo sapiens
ttggagaacaacaaggacaa

SEQ ID NO: 2936141 - DNA, 15 bp, Homo sapiens
ttggagaatatcaaa

SEQ ID NO: 2936142 - DNA, 22 bp, Homo sapiens
ttggagacccgcctggctaaca

SEQ ID NO: 2936143 - DNA, 16 bp, Homo sapiens
ttggagactttcttta

SEQ ID NO: 2936144 - DNA, 20 bp, Homo sapiens
ttggagatctttgcttcctt

SEQ ID NO: 2936145 - DNA, 14 bp, Homo sapiens
ttggagcaatcaga

SEQ ID NO: 2936146 - DNA, 19 bp, Homo sapiens
ttggagcatttatgtagac

SEQ ID NO: 2936147 - DNA, 18 bp, Homo sapiens
ttggagcctgcagagctg

SEQ ID NO: 2936148 - DNA, 14 bp, Homo sapiens
ttggagcttcatgg

SEQ ID NO: 2936149 - DNA, 13 bp, Homo sapiens
ttggaggacagtg

SEQ ID NO: 2936150 - DNA, 15 bp, Homo sapiens
ttggaggacagtggg

SEQ ID NO: 2936151 - DNA, 15 bp, Homo sapiens
ttggaggccagccag

SEQ ID NO: 2936152 - DNA, 17 bp, Homo sapiens
ttggaggcctttcatcc

SEQ ID NO: 2936153 - DNA, 15 bp, Homo sapiens
ttggagggatcattt

SEQ ID NO: 2936154 - DNA, 23 bp, Homo sapiens
ttggagtcccaggggcagccaca

SEQ ID NO: 2936155 - DNA, 16 bp, Homo sapiens
ttggagtgttatgtat

SEQ ID NO: 2936156 - DNA, 22 bp, Homo sapiens
ttggataatgctgttgcctcat

SEQ ID NO: 2936157 - DNA, 23 bp, Homo sapiens
ttggatcagtgaaaaacattagt

SEQ ID NO: 2936158 - DNA, 18 bp, Homo sapiens
ttggatcataaactggaa

SEQ ID NO: 2936159 - DNA, 19 bp, Homo sapiens
ttggatctccaattgcctc

SEQ ID NO: 2936160 - DNA, 20 bp, Homo sapiens
ttggatgacttgttcatttt

SEQ ID NO: 2936161 - DNA, 18 bp, Homo sapiens
ttggatgatacagtgttt

SEQ ID NO: 2936162 - DNA, 20 bp, Homo sapiens
ttggatgatacagtgttttt

SEQ ID NO: 2936163 - DNA, 20 bp, Homo sapiens
ttggatgtgggtctttttct

SEQ ID NO: 2936164 - DNA, 22 bp, Homo sapiens
ttggattcctaaatattttcaa

SEQ ID NO: 2936165 - DNA, 17 bp, Homo sapiens
ttggattctgagagctg

SEQ ID NO: 2936166 - DNA, 14 bp, Homo sapiens
ttggatttgacatt

SEQ ID NO: 2936167 - DNA, 22 bp, Homo sapiens
ttggatttgacattgcgtttga

SEQ ID NO: 2936168 - DNA, 22 bp, Homo sapiens
ttggatttgtccaaacaggtgc

SEQ ID NO: 2936169 - DNA, 21 bp, Homo sapiens
ttggatttttaattaaaaact

SEQ ID NO: 2936170 - DNA, 16 bp, Homo sapiens
ttggcaaactctccac

SEQ ID NO: 2936171 - DNA, 13 bp, Homo sapiens
ttggcaactttct

SEQ ID NO: 2936172 - DNA, 14 bp, Homo sapiens
ttggcaactttctt

SEQ ID NO: 2936173 - DNA, 21 bp, Homo sapiens
ttggcaccagacacccaggac

SEQ ID NO: 2936174 - DNA, 23 bp, Homo sapiens
ttggcaccagacacccaggactt

SEQ ID NO: 2936175 - DNA, 21 bp, Homo sapiens
ttggcacctaatccaggcaga

SEQ ID NO: 2936176 - DNA, 17 bp, Homo sapiens
ttggcagaactgctggg

SEQ ID NO: 2936177 - DNA, 12 bp, Homo sapiens
ttggcagtgttt

SEQ ID NO: 2936178 - DNA, 19 bp, Homo sapiens
ttggcagtgttttgagaac

SEQ ID NO: 2936179 - DNA, 15 bp, Homo sapiens
ttggcatcgaccaca

SEQ ID NO: 2936180 - DNA, 16 bp, Homo sapiens
ttggcatctgcaaagg

SEQ ID NO: 2936181 - DNA, 13 bp, Homo sapiens
ttggcatgtttaa

SEQ ID NO: 2936182 - DNA, 15 bp, Homo sapiens
ttggcattctttgca

SEQ ID NO: 2936183 - DNA, 20 bp, Homo sapiens
ttggcattctttgcaatact

SEQ ID NO: 2936184 - DNA, 12 bp, Homo sapiens
ttggcatttgca

SEQ ID NO: 2936185 - DNA, 15 bp, Homo sapiens
ttggccaagagaagg

SEQ ID NO: 2936186 - DNA, 18 bp, Homo sapiens
ttggccaagagaagggct

SEQ ID NO: 2936187 - DNA, 16 bp, Homo sapiens
ttggccagtgacgtgg

SEQ ID NO: 2936188 - DNA, 16 bp, Homo sapiens
ttggcccaggagctct

SEQ ID NO: 2936189 - DNA, 23 bp, Homo sapiens
ttggcccaggagctctgcgccag

SEQ ID NO: 2936190 - DNA, 13 bp, Homo sapiens
ttggccctgcccc

SEQ ID NO: 2936191 - DNA, 19 bp, Homo sapiens
ttggccctgcccctccccc

SEQ ID NO: 2936192 - DNA, 14 bp, Homo sapiens
ttggcccttccagt

SEQ ID NO: 2936193 - DNA, 15 bp, Homo sapiens
ttggcccttccagtg

SEQ ID NO: 2936194 - DNA, 20 bp, Homo sapiens
ttggcctatctcctagggct

SEQ ID NO: 2936195 - DNA, 18 bp, Homo sapiens
ttggcctcagggccagga

SEQ ID NO: 2936196 - DNA, 19 bp, Homo sapiens
ttggcctcagggccaggaa

SEQ ID NO: 2936197 - DNA, 22 bp, Homo sapiens
ttggcctcagggccaggaagga

SEQ ID NO: 2936198 - DNA, 16 bp, Homo sapiens
ttggcctcctgcaaag

SEQ ID NO: 2936199 - DNA, 18 bp, Homo sapiens
ttggcctcctgcaaagtc

SEQ ID NO: 2936200 - DNA, 17 bp, Homo sapiens
ttggcctgaacagatgt

SEQ ID NO: 2936201 - DNA, 11 bp, Homo sapiens
ttggcctgagt

SEQ ID NO: 2936202 - DNA, 14 bp, Homo sapiens
ttggcctggagttt

SEQ ID NO: 2936203 - DNA, 22 bp, Homo sapiens
ttggccttcagaaccatccata

SEQ ID NO: 2936204 - DNA, 17 bp, Homo sapiens
ttggccttgcagctggc

SEQ ID NO: 2936205 - DNA, 13 bp, Homo sapiens
ttggcctttttac

SEQ ID NO: 2936206 - DNA, 14 bp, Homo sapiens
ttggctagagcttc

SEQ ID NO: 2936207 - DNA, 17 bp, Homo sapiens
ttggctatttaaaactt

SEQ ID NO: 2936208 - DNA, 19 bp, Homo sapiens
ttggctgatttaaaaagtg

SEQ ID NO: 2936209 - DNA, 13 bp, Homo sapiens
ttggctgctgcca

SEQ ID NO: 2936210 - DNA, 14 bp, Homo sapiens
ttggctgctgccac

SEQ ID NO: 2936211 - DNA, 16 bp, Homo sapiens
ttggcttaatcatttt

SEQ ID NO: 2936212 - DNA, 13 bp, Homo sapiens
ttggcttgtttta

SEQ ID NO: 2936213 - DNA, 13 bp, Homo sapiens
ttggcttttttcc

SEQ ID NO: 2936214 - DNA, 17 bp, Homo sapiens
ttgggaaacttgtcact

SEQ ID NO: 2936215 - DNA, 18 bp, Homo sapiens
ttgggaactgaactcact

SEQ ID NO: 2936216 - DNA, 14 bp, Homo sapiens
ttgggaataaatat

SEQ ID NO: 2936217 - DNA, 11 bp, Homo sapiens
ttgggagcctg

SEQ ID NO: 2936218 - DNA, 18 bp, Homo sapiens
ttgggaggccgaggcagg

SEQ ID NO: 2936219 - DNA, 19 bp, Homo sapiens
ttgggcagaatgaattcga

SEQ ID NO: 2936220 - DNA, 14 bp, Homo sapiens
ttgggccagacatg

SEQ ID NO: 2936221 - DNA, 11 bp, Homo sapiens
ttgggccctgc

SEQ ID NO: 2936222 - DNA, 13 bp, Homo sapiens
ttgggccctgcat

SEQ ID NO: 2936223 - DNA, 16 bp, Homo sapiens
ttgggcctgctccaga

SEQ ID NO: 2936224 - DNA, 19 bp, Homo sapiens
ttgggcctgctccagacct

SEQ ID NO: 2936225 - DNA, 20 bp, Homo sapiens
ttgggcctgctccagacctg

SEQ ID NO: 2936226 - DNA, 14 bp, Homo sapiens
ttgggctgtgcctg

SEQ ID NO: 2936227 - DNA, 20 bp, Homo sapiens
ttggggaaaaattcttggtt

SEQ ID NO: 2936228 - DNA, 16 bp, Homo sapiens
ttggggagatttgcca

SEQ ID NO: 2936229 - DNA, 15 bp, Homo sapiens
ttggggaggtgttca

SEQ ID NO: 2936230 - DNA, 17 bp, Homo sapiens
ttggggagttaagacct

SEQ ID NO: 2936231 - DNA, 22 bp, Homo sapiens
ttggggcaacattgttcacctt

SEQ ID NO: 2936232 - DNA, 17 bp, Homo sapiens
ttgggggacagccttca

SEQ ID NO: 2936233 - DNA, 15 bp, Homo sapiens
ttgggggcaggtcag

SEQ ID NO: 2936234 - DNA, 16 bp, Homo sapiens
ttgggggtaaaaaata

SEQ ID NO: 2936235 - DNA, 19 bp, Homo sapiens
ttgggggttaccaaaaata

SEQ ID NO: 2936236 - DNA, 16 bp, Homo sapiens
ttggggtgagaggtga

SEQ ID NO: 2936237 - DNA, 14 bp, Homo sapiens
ttggggtgggggcc

SEQ ID NO: 2936238 - DNA, 18 bp, Homo sapiens
ttggggtgggggccaggc

SEQ ID NO: 2936239 - DNA, 23 bp, Homo sapiens
ttgggtagaaagagatacagagg

SEQ ID NO: 2936240 - DNA, 18 bp, Homo sapiens
tttacactcggctttgga

SEQ ID NO: 2936241 - DNA, 17 bp, Homo sapiens
tttacagatgaatgtat

SEQ ID NO: 2936242 - DNA, 12 bp, Homo sapiens
tttacagctgtt

SEQ ID NO: 2936243 - DNA, 20 bp, Homo sapiens
tttacagctgtttacagaca

SEQ ID NO: 2936244 - DNA, 21 bp, Homo sapiens
tttacagttagggttttgcaa

SEQ ID NO: 2936245 - DNA, 18 bp, Homo sapiens
tttacataagagaaagag

SEQ ID NO: 2936246 - DNA, 15 bp, Homo sapiens
tttacatactgctgt

SEQ ID NO: 2936247 - DNA, 16 bp, Homo sapiens
tttacattaaagaaat

SEQ ID NO: 2936248 - DNA, 15 bp, Homo sapiens
tttaccaacatgtat

SEQ ID NO: 2936249 - DNA, 16 bp, Homo sapiens
tttaccaacatgtatc

SEQ ID NO: 2936250 - DNA, 15 bp, Homo sapiens
tttacccctgcacag

SEQ ID NO: 2936251 - DNA, 21 bp, Homo sapiens
tttaccctcctctatttcttt

SEQ ID NO: 2936252 - DNA, 15 bp, Homo sapiens
tttacctatgtaaca

SEQ ID NO: 2936253 - DNA, 18 bp, Homo sapiens
tttacctccccttttcta

SEQ ID NO: 2936254 - DNA, 15 bp, Homo sapiens
tttacctgtgaaata

SEQ ID NO: 2936255 - DNA, 16 bp, Homo sapiens
tttacctgtgaaatag

SEQ ID NO: 2936256 - DNA, 20 bp, Homo sapiens
tttaccttcatttcatcctg

SEQ ID NO: 2936257 - DNA, 20 bp, Homo sapiens
tttacgatctgtttccaaat

SEQ ID NO: 2936258 - DNA, 15 bp, Homo sapiens
tttacgctagattaa

SEQ ID NO: 2936259 - DNA, 18 bp, Homo sapiens
tttacgctagattaaaat

SEQ ID NO: 2936260 - DNA, 14 bp, Homo sapiens
tttactaagacata

SEQ ID NO: 2936261 - DNA, 16 bp, Homo sapiens
tttactaagatgacat

SEQ ID NO: 2936262 - DNA, 21 bp, Homo sapiens
tttactacccaaatctaaata

SEQ ID NO: 2936263 - DNA, 16 bp, Homo sapiens
tttactcaaaatctgt

SEQ ID NO: 2936264 - DNA, 16 bp, Homo sapiens
tttactcctcacactt

SEQ ID NO: 2936265 - DNA, 22 bp, Homo sapiens
tttactgcctgaataaagagcc

SEQ ID NO: 2936266 - DNA, 12 bp, Homo sapiens
tttactgtaaat

SEQ ID NO: 2936267 - DNA, 18 bp, Homo sapiens
tttactgtggctgtctgg

SEQ ID NO: 2936268 - DNA, 21 bp, Homo sapiens
tttactgttatttaattgaaa

SEQ ID NO: 2936269 - DNA, 22 bp, Homo sapiens
tttacttaaagatttatcaaat

SEQ ID NO: 2936270 - DNA, 23 bp, Homo sapiens
tttacttaaagatttatcaaatc

SEQ ID NO: 2936271 - DNA, 21 bp, Homo sapiens
tttacttactgctatctacta

SEQ ID NO: 2936272 - DNA, 13 bp, Homo sapiens
tttagaacagagg

SEQ ID NO: 2936273 - DNA, 14 bp, Homo sapiens
tttagaagtgtcat

SEQ ID NO: 2936274 - DNA, 23 bp, Homo sapiens
tttagaatggttgagttacatta

SEQ ID NO: 2936275 - DNA, 18 bp, Homo sapiens
tttagacaaatactcatg

SEQ ID NO: 2936276 - DNA, 16 bp, Homo sapiens
tttagacaccttcatt

SEQ ID NO: 2936277 - DNA, 13 bp, Homo sapiens
tttagactttaaa

SEQ ID NO: 2936278 - DNA, 18 bp, Homo sapiens
tttagagaactgaaaaga

SEQ ID NO: 2936279 - DNA, 22 bp, Homo sapiens
tttagagtaagaaatttcaggt

SEQ ID NO: 2936280 - DNA, 16 bp, Homo sapiens
tttagattattttatc

SEQ ID NO: 2936281 - DNA, 21 bp, Homo sapiens
tttagattattttatctggta

SEQ ID NO: 2936282 - DNA, 17 bp, Homo sapiens
tttagattggttctgtt

SEQ ID NO: 2936283 - DNA, 21 bp, Homo sapiens
tttagctaggatttgaacact

SEQ ID NO: 2936284 - DNA, 13 bp, Homo sapiens
tttagcttcctcc

SEQ ID NO: 2936285 - DNA, 13 bp, Homo sapiens
tttagctttgaca

SEQ ID NO: 2936286 - DNA, 13 bp, Homo sapiens
tttaggaaaagca

SEQ ID NO: 2936287 - DNA, 11 bp, Homo sapiens
tttaggagaag

SEQ ID NO: 2936288 - DNA, 22 bp, Homo sapiens
tttaggcacccctttccccagc

SEQ ID NO: 2936289 - DNA, 16 bp, Homo sapiens
tttaggcttgaaatct

SEQ ID NO: 2936290 - DNA, 17 bp, Homo sapiens
tttaggtctttgtaaga

SEQ ID NO: 2936291 - DNA, 12 bp, Homo sapiens
tttaggttctaa

SEQ ID NO: 2936292 - DNA, 23 bp, Homo sapiens
tttaggttctttgctgcattctg

SEQ ID NO: 2936293 - DNA, 15 bp, Homo sapiens
tttagtaaaaacatt

SEQ ID NO: 2936294 - DNA, 22 bp, Homo sapiens
tttagtaaatacatcactgtat

SEQ ID NO: 2936295 - DNA, 12 bp, Homo sapiens
tttagtaaatgt

SEQ ID NO: 2936296 - DNA, 13 bp, Homo sapiens
tttagtaatttct

SEQ ID NO: 2936297 - DNA, 17 bp, Homo sapiens
tttagtatatgaaatat

SEQ ID NO: 2936298 - DNA, 14 bp, Homo sapiens
tttagtctctttat

SEQ ID NO: 2936299 - DNA, 23 bp, Homo sapiens
tttagtgccaatgttgtgtgttg

SEQ ID NO: 2936300 - DNA, 18 bp, Homo sapiens
tttagttatttaagaaga

SEQ ID NO: 2936301 - DNA, 18 bp, Homo sapiens
tttagttgctcaaagagc

SEQ ID NO: 2936302 - DNA, 22 bp, Homo sapiens
tttagtttctgttctgtggaaa

SEQ ID NO: 2936303 - DNA, 18 bp, Homo sapiens
tttataaacagacaatat

SEQ ID NO: 2936304 - DNA, 13 bp, Homo sapiens
tttataaacagtt

SEQ ID NO: 2936305 - DNA, 13 bp, Homo sapiens
tttataaagccaa

SEQ ID NO: 2936306 - DNA, 19 bp, Homo sapiens
tttataaagccaagaattg

SEQ ID NO: 2936307 - DNA, 18 bp, Homo sapiens
tttataacctgatgccat

SEQ ID NO: 2936308 - DNA, 19 bp, Homo sapiens
tttataactagtcctttac

SEQ ID NO: 2936309 - DNA, 14 bp, Homo sapiens
tttataattcagta

SEQ ID NO: 2936310 - DNA, 16 bp, Homo sapiens
tttatacagtgtacat

SEQ ID NO: 2936311 - DNA, 21 bp, Homo sapiens
tttatacatacagagattgta

SEQ ID NO: 2936312 - DNA, 22 bp, Homo sapiens
tttatacccttgacttaacttt

SEQ ID NO: 2936313 - DNA, 21 bp, Homo sapiens
tttatactgtgaagttacatg

SEQ ID NO: 2936314 - DNA, 22 bp, Homo sapiens
tttatacttaaacagctttttt

SEQ ID NO: 2936315 - DNA, 12 bp, Homo sapiens
tttatagaagaa

SEQ ID NO: 2936316 - DNA, 23 bp, Homo sapiens
tttatataaggtcatagattctt

SEQ ID NO: 2936317 - DNA, 17 bp, Homo sapiens
tttatataatatctaaa

SEQ ID NO: 2936318 - DNA, 22 bp, Homo sapiens
tttatataatatctaaagttat

SEQ ID NO: 2936319 - DNA, 14 bp, Homo sapiens
tttatatacgttta

SEQ ID NO: 2936320 - DNA, 20 bp, Homo sapiens
tttatatattgtctgtaaaa

SEQ ID NO: 2936321 - DNA, 13 bp, Homo sapiens
tttatatgaaaac

SEQ ID NO: 2936322 - DNA, 19 bp, Homo sapiens
tttatatgaagcaagctgt

SEQ ID NO: 2936323 - DNA, 23 bp, Homo sapiens
tttatatgaagcaagctgtgtta

SEQ ID NO: 2936324 - DNA, 17 bp, Homo sapiens
tttatatgtacatgaga

SEQ ID NO: 2936325 - DNA, 14 bp, Homo sapiens
tttatatgtactgt

SEQ ID NO: 2936326 - DNA, 16 bp, Homo sapiens
tttatatgtattaaat

SEQ ID NO: 2936327 - DNA, 19 bp, Homo sapiens
tttatattaaataacatgt

SEQ ID NO: 2936328 - DNA, 14 bp, Homo sapiens
tttatattgaaaaa

SEQ ID NO: 2936329 - DNA, 19 bp, Homo sapiens
tttatattgtaaatattgt

SEQ ID NO: 2936330 - DNA, 16 bp, Homo sapiens
tttatatttcaataaa

SEQ ID NO: 2936331 - DNA, 18 bp, Homo sapiens
tttatatttcaataaatg

SEQ ID NO: 2936332 - DNA, 20 bp, Homo sapiens
tttatatttcaataaatgat

SEQ ID NO: 2936333 - DNA, 17 bp, Homo sapiens
tttatatttgaaaaaat

SEQ ID NO: 2936334 - DNA, 23 bp, Homo sapiens
tttatatttgagttgtgattgaa

SEQ ID NO: 2936335 - DNA, 20 bp, Homo sapiens
tttatattttagaaataata

SEQ ID NO: 2936336 - DNA, 13 bp, Homo sapiens
tttatattttccc

SEQ ID NO: 2936337 - DNA, 19 bp, Homo sapiens
tttatatttttttaactgt

SEQ ID NO: 2936338 - DNA, 17 bp, Homo sapiens
tttatcattcaagtgta

SEQ ID NO: 2936339 - DNA, 22 bp, Homo sapiens
tttatccaaaatgtgtatttct

SEQ ID NO: 2936340 - DNA, 22 bp, Homo sapiens
tttatccctgcttatctgaaac

SEQ ID NO: 2936341 - DNA, 19 bp, Homo sapiens
tttatcccttcctgtctga

SEQ ID NO: 2936342 - DNA, 23 bp, Homo sapiens
tttatcctaaaaatctggaatca

SEQ ID NO: 2936343 - DNA, 20 bp, Homo sapiens
tttatctaatacctctgtgt

SEQ ID NO: 2936344 - DNA, 20 bp, Homo sapiens
tttatctacccagtcatgta

SEQ ID NO: 2936345 - DNA, 20 bp, Homo sapiens
tttatctattctgagaaaac

SEQ ID NO: 2936346 - DNA, 17 bp, Homo sapiens
tttatctggccccaggt

SEQ ID NO: 2936347 - DNA, 16 bp, Homo sapiens
tttatctgtagtaaac

SEQ ID NO: 2936348 - DNA, 19 bp, Homo sapiens
tttatctgtagtaaactat

SEQ ID NO: 2936349 - DNA, 15 bp, Homo sapiens
tttatctgtggagtt

SEQ ID NO: 2936350 - DNA, 12 bp, Homo sapiens
tttatctgttaa

SEQ ID NO: 2936351 - DNA, 14 bp, Homo sapiens
tttatctgtttcct

SEQ ID NO: 2936352 - DNA, 19 bp, Homo sapiens
tttatgaaacagaaaagta

SEQ ID NO: 2936353 - DNA, 23 bp, Homo sapiens
tttatgacatgaaaagttattta

SEQ ID NO: 2936354 - DNA, 20 bp, Homo sapiens
tttatgaccagagcaaaaat

SEQ ID NO: 2936355 - DNA, 14 bp, Homo sapiens
tttatgagatggat

SEQ ID NO: 2936356 - DNA, 17 bp, Homo sapiens
tttatgagctaaaaata

SEQ ID NO: 2936357 - DNA, 14 bp, Homo sapiens
tttatgatcagtgt

SEQ ID NO: 2936358 - DNA, 15 bp, Homo sapiens
tttatgatttcaaca

SEQ ID NO: 2936359 - DNA, 16 bp, Homo sapiens
tttatgatttcaacat

SEQ ID NO: 2936360 - DNA, 16 bp, Homo sapiens
tttatgcaaaaggttt

SEQ ID NO: 2936361 - DNA, 13 bp, Homo sapiens
tttatgcttgcaa

SEQ ID NO: 2936362 - DNA, 17 bp, Homo sapiens
tttatggccttaatata

SEQ ID NO: 2936363 - DNA, 18 bp, Homo sapiens
tttatgggcccctggcac

SEQ ID NO: 2936364 - DNA, 19 bp, Homo sapiens
tttatgtagtaattgacat

SEQ ID NO: 2936365 - DNA, 17 bp, Homo sapiens
tttatgttagattttgc

SEQ ID NO: 2936366 - DNA, 11 bp, Homo sapiens
tttatgttctt

SEQ ID NO: 2936367 - DNA, 14 bp, Homo sapiens
tttatgttcttata

SEQ ID NO: 2936368 - DNA, 13 bp, Homo sapiens
tttattaaaaact

SEQ ID NO: 2936369 - DNA, 12 bp, Homo sapiens
tttattaaataa

SEQ ID NO: 2936370 - DNA, 19 bp, Homo sapiens
tttattaaatagttaatat

SEQ ID NO: 2936371 - DNA, 14 bp, Homo sapiens
tttattaagattat

SEQ ID NO: 2936372 - DNA, 18 bp, Homo sapiens
ttttaaattttgtaatga

SEQ ID NO: 2936373 - DNA, 13 bp, Homo sapiens
ttttaacaagaag

SEQ ID NO: 2936374 - DNA, 17 bp, Homo sapiens
ttttaacaagaagatga

SEQ ID NO: 2936375 - DNA, 23 bp, Homo sapiens
ttttaacatttatctaaaagaat

SEQ ID NO: 2936376 - DNA, 23 bp, Homo sapiens
ttttaaccaagttgtttattcca

SEQ ID NO: 2936377 - DNA, 18 bp, Homo sapiens
ttttaaccatggcagggt

SEQ ID NO: 2936378 - DNA, 18 bp, Homo sapiens
ttttaacctctttaagta

SEQ ID NO: 2936379 - DNA, 19 bp, Homo sapiens
ttttaactgccaatcctta

SEQ ID NO: 2936380 - DNA, 12 bp, Homo sapiens
ttttaactgtga

SEQ ID NO: 2936381 - DNA, 23 bp, Homo sapiens
ttttaacttatttatatgaagca

SEQ ID NO: 2936382 - DNA, 15 bp, Homo sapiens
ttttaagatttgtgt

SEQ ID NO: 2936383 - DNA, 16 bp, Homo sapiens
ttttaagcagctctaa

SEQ ID NO: 2936384 - DNA, 18 bp, Homo sapiens
ttttaagcattgtgagta

SEQ ID NO: 2936385 - DNA, 13 bp, Homo sapiens
ttttaaggtcttt

SEQ ID NO: 2936386 - DNA, 18 bp, Homo sapiens
ttttaaggtctttcagta

SEQ ID NO: 2936387 - DNA, 21 bp, Homo sapiens
ttttaagtgaaagtgaggaaa

SEQ ID NO: 2936388 - DNA, 16 bp, Homo sapiens
ttttaagttgtttgca

SEQ ID NO: 2936389 - DNA, 23 bp, Homo sapiens
ttttaataattatttttaattta

SEQ ID NO: 2936390 - DNA, 20 bp, Homo sapiens
ttttaatcatgaaattactt

SEQ ID NO: 2936391 - DNA, 18 bp, Homo sapiens
ttttaatcatgagcctgt

SEQ ID NO: 2936392 - DNA, 21 bp, Homo sapiens
ttttaatcatgagcctgttta

SEQ ID NO: 2936393 - DNA, 23 bp, Homo sapiens
ttttaatccctatgtttgtctca

SEQ ID NO: 2936394 - DNA, 22 bp, Homo sapiens
ttttaatcgtttttgttttaag

SEQ ID NO: 2936395 - DNA, 15 bp, Homo sapiens
ttttaatgatgacaa

SEQ ID NO: 2936396 - DNA, 19 bp, Homo sapiens
ttttaatgtgaagacattt

SEQ ID NO: 2936397 - DNA, 20 bp, Homo sapiens
ttttaatgtgaagacatttt

SEQ ID NO: 2936398 - DNA, 12 bp, Homo sapiens
ttttaatgtgct

SEQ ID NO: 2936399 - DNA, 15 bp, Homo sapiens
ttttaatgtgctgtg

SEQ ID NO: 2936400 - DNA, 21 bp, Homo sapiens
ttttaatgtgctgtgtaaagt

SEQ ID NO: 2936401 - DNA, 20 bp, Homo sapiens
ttttaattatttaaatgtac

SEQ ID NO: 2936402 - DNA, 18 bp, Homo sapiens
ttttaattattttaaaat

SEQ ID NO: 2936403 - DNA, 15 bp, Homo sapiens
ttttaattccatgaa

SEQ ID NO: 2936404 - DNA, 12 bp, Homo sapiens
ttttaatttagt

SEQ ID NO: 2936405 - DNA, 14 bp, Homo sapiens
ttttaatttgtttt

SEQ ID NO: 2936406 - DNA, 11 bp, Homo sapiens
ttttacaaagg

SEQ ID NO: 2936407 - DNA, 15 bp, Homo sapiens
ttttacaagatgtat

SEQ ID NO: 2936408 - DNA, 17 bp, Homo sapiens
ttttacacagaaacact

SEQ ID NO: 2936409 - DNA, 22 bp, Homo sapiens
ttttacagttagggttttgcaa

SEQ ID NO: 2936410 - DNA, 23 bp, Homo sapiens
ttttacagttagggttttgcaat

SEQ ID NO: 2936411 - DNA, 15 bp, Homo sapiens
ttttacatactgctg

SEQ ID NO: 2936412 - DNA, 18 bp, Homo sapiens
ttttacatgtttataaat

SEQ ID NO: 2936413 - DNA, 17 bp, Homo sapiens
ttttacattctgtgtgt

SEQ ID NO: 2936414 - DNA, 21 bp, Homo sapiens
ttttacgctagattaaaatat

SEQ ID NO: 2936415 - DNA, 13 bp, Homo sapiens
ttttactaagaca

SEQ ID NO: 2936416 - DNA, 15 bp, Homo sapiens
ttttacttacaaaaa

SEQ ID NO: 2936417 - DNA, 18 bp, Homo sapiens
ttttacttgttcatttct

SEQ ID NO: 2936418 - DNA, 22 bp, Homo sapiens
ttttacttgttcatttctgtct

SEQ ID NO: 2936419 - DNA, 19 bp, Homo sapiens
ttttagaaataataaaaag

SEQ ID NO: 2936420 - DNA, 14 bp, Homo sapiens
ttttagaattaaaa

SEQ ID NO: 2936421 - DNA, 16 bp, Homo sapiens
ttttagagcattaaaa

SEQ ID NO: 2936422 - DNA, 19 bp, Homo sapiens
ttttagattggttctgttt

SEQ ID NO: 2936423 - DNA, 20 bp, Homo sapiens
ttttagattggttctgtttt

SEQ ID NO: 2936424 - DNA, 22 bp, Homo sapiens
ttttagattttctggttctaac

SEQ ID NO: 2936425 - DNA, 20 bp, Homo sapiens
ttttaggagctaaggctcta

SEQ ID NO: 2936426 - DNA, 13 bp, Homo sapiens
ttttaggttctaa

SEQ ID NO: 2936427 - DNA, 15 bp, Homo sapiens
ttttaggttctaaag

SEQ ID NO: 2936428 - DNA, 16 bp, Homo sapiens
ttttaggttctaaagt

SEQ ID NO: 2936429 - DNA, 18 bp, Homo sapiens
ttttaggttctaaagttc

SEQ ID NO: 2936430 - DNA, 14 bp, Homo sapiens
ttttagtaatttct

SEQ ID NO: 2936431 - DNA, 18 bp, Homo sapiens
ttttagttgcatgaaatt

SEQ ID NO: 2936432 - DNA, 13 bp, Homo sapiens
ttttataaagtgc

SEQ ID NO: 2936433 - DNA, 13 bp, Homo sapiens
ttttatactcttt

SEQ ID NO: 2936434 - DNA, 15 bp, Homo sapiens
ttttatatatacagt

SEQ ID NO: 2936435 - DNA, 18 bp, Homo sapiens
ttttatatctgtatgtat

SEQ ID NO: 2936436 - DNA, 16 bp, Homo sapiens
ttttatatgttgctat

SEQ ID NO: 2936437 - DNA, 18 bp, Homo sapiens
ttttatatttgaaaaaat

SEQ ID NO: 2936438 - DNA, 13 bp, Homo sapiens
ttttatatttgta

SEQ ID NO: 2936439 - DNA, 14 bp, Homo sapiens
ttttatatttgtag

SEQ ID NO: 2936440 - DNA, 12 bp, Homo sapiens
ttttatcagtag

SEQ ID NO: 2936441 - DNA, 13 bp, Homo sapiens
ttttatcatgaat

SEQ ID NO: 2936442 - DNA, 14 bp, Homo sapiens
ttttatcatgaatt

SEQ ID NO: 2936443 - DNA, 21 bp, Homo sapiens
ttttatcccttcctgtctgaa

SEQ ID NO: 2936444 - DNA, 13 bp, Homo sapiens
ttttatctgtgga

SEQ ID NO: 2936445 - DNA, 13 bp, Homo sapiens
ttttatgatcagt

SEQ ID NO: 2936446 - DNA, 19 bp, Homo sapiens
ttttattgaatctatttaa

SEQ ID NO: 2936447 - DNA, 23 bp, Homo sapiens
ttttattgccttctcaccagctg

SEQ ID NO: 2936448 - DNA, 14 bp, Homo sapiens
ttttatttatatgt

SEQ ID NO: 2936449 - DNA, 16 bp, Homo sapiens
ttttatttattttaat

SEQ ID NO: 2936450 - DNA, 22 bp, Homo sapiens
ttttatttcattggttaatttt

SEQ ID NO: 2936451 - DNA, 20 bp, Homo sapiens
ttttcaaaatagaaaagtta

SEQ ID NO: 2936452 - DNA, 19 bp, Homo sapiens
ttttcaaagggacttttgt

SEQ ID NO: 2936453 - DNA, 13 bp, Homo sapiens
ttttcaaatcatt

SEQ ID NO: 2936454 - DNA, 22 bp, Homo sapiens
ttttcaaatcatttttgagact

SEQ ID NO: 2936455 - DNA, 22 bp, Homo sapiens
ttttcaacagtgaagacagaag

SEQ ID NO: 2936456 - DNA, 24 bp, Homo sapiens
ttttcaactttgaataaagaatac

SEQ ID NO: 2936457 - DNA, 18 bp, Homo sapiens
ttttcaagaaaactggaa

SEQ ID NO: 2936458 - DNA, 17 bp, Homo sapiens
ttttcaaggaagaaaac

SEQ ID NO: 2936459 - DNA, 23 bp, Homo sapiens
ttttcacattcttataaatatga

SEQ ID NO: 2936460 - DNA, 23 bp, Homo sapiens
ttttcacctggaagcatttgttt

SEQ ID NO: 2936461 - DNA, 21 bp, Homo sapiens
ttttcagaaggttattttctt

SEQ ID NO: 2936462 - DNA, 19 bp, Homo sapiens
ttttcagaggtgaattaat

SEQ ID NO: 2936463 - DNA, 13 bp, Homo sapiens
ttttcagatataa

SEQ ID NO: 2936464 - DNA, 17 bp, Homo sapiens
ttttcagatgtgaacca

SEQ ID NO: 2936465 - DNA, 18 bp, Homo sapiens
ttttcagcaaattccaga

SEQ ID NO: 2936466 - DNA, 21 bp, Homo sapiens
ttttcagcatcaaacatgaaa

SEQ ID NO: 2936467 - DNA, 22 bp, Homo sapiens
ttttcagcatcaaacatgaaaa

SEQ ID NO: 2936468 - DNA, 18 bp, Homo sapiens
ttttcagccaatttgtct

SEQ ID NO: 2936469 - DNA, 20 bp, Homo sapiens
ttttcagccaatttgtctcc

SEQ ID NO: 2936470 - DNA, 18 bp, Homo sapiens
ttttcagcgatgtatgca

SEQ ID NO: 2936471 - DNA, 14 bp, Homo sapiens
ttttcagtttaatt

SEQ ID NO: 2936472 - DNA, 16 bp, Homo sapiens
ttttcatctgggaaag

SEQ ID NO: 2936473 - DNA, 21 bp, Homo sapiens
ttttcatggaaaagccttctt

SEQ ID NO: 2936474 - DNA, 13 bp, Homo sapiens
ttttcattaaact

SEQ ID NO: 2936475 - DNA, 17 bp, Homo sapiens
ttttcattaaacttgaa

SEQ ID NO: 2936476 - DNA, 17 bp, Homo sapiens
ttttcattcctaaagaa

SEQ ID NO: 2936477 - DNA, 17 bp, Homo sapiens
ttttcattctcctcctc

SEQ ID NO: 2936478 - DNA, 15 bp, Homo sapiens
ttttcattgcaaagt

SEQ ID NO: 2936479 - DNA, 17 bp, Homo sapiens
ttttcatttttccatga

SEQ ID NO: 2936480 - DNA, 13 bp, Homo sapiens
ttttcatttttgt

SEQ ID NO: 2936481 - DNA, 16 bp, Homo sapiens
ttttccaaaagtaaag

SEQ ID NO: 2936482 - DNA, 23 bp, Homo sapiens
ttttccaaaagtggcctctttgt

SEQ ID NO: 2936483 - DNA, 18 bp, Homo sapiens
ttttccaaatgcccaagg

SEQ ID NO: 2936484 - DNA, 17 bp, Homo sapiens
ttttccacactatgtgt

SEQ ID NO: 2936485 - DNA, 17 bp, Homo sapiens
ttttccagaaagaaaat

SEQ ID NO: 2936486 - DNA, 15 bp, Homo sapiens
ttttccagtctcttg

SEQ ID NO: 2936487 - DNA, 15 bp, Homo sapiens
ttttccatgacattt

SEQ ID NO: 2936488 - DNA, 17 bp, Homo sapiens
ttttccattgtttgaaa

SEQ ID NO: 2936489 - DNA, 18 bp, Homo sapiens
ttttcccagctacacctt

SEQ ID NO: 2936490 - DNA, 20 bp, Homo sapiens
ttttcccatcatcctttgtt

SEQ ID NO: 2936491 - DNA, 23 bp, Homo sapiens
ttttccccggtcccttgagacct

SEQ ID NO: 2936492 - DNA, 15 bp, Homo sapiens
ttttcctccaaagta

SEQ ID NO: 2936493 - DNA, 20 bp, Homo sapiens
ttttcctcccttctgctact

SEQ ID NO: 2936494 - DNA, 21 bp, Homo sapiens
ttttcctcccttctgctactg

SEQ ID NO: 2936495 - DNA, 18 bp, Homo sapiens
ttttcctcctttctctgt

SEQ ID NO: 2936496 - DNA, 22 bp, Homo sapiens
ttttcctcctttctctgtatat

SEQ ID NO: 2936497 - DNA, 14 bp, Homo sapiens
ttttcctgaaagtt

SEQ ID NO: 2936498 - DNA, 22 bp, Homo sapiens
ttttcctgggccttctcagctc

SEQ ID NO: 2936499 - DNA, 18 bp, Homo sapiens
ttttcctgtttctgaaaa

SEQ ID NO: 2936500 - DNA, 11 bp, Homo sapiens
ttttccttcca

SEQ ID NO: 2936501 - DNA, 12 bp, Homo sapiens
ttttccttccat

SEQ ID NO: 2936502 - DNA, 15 bp, Homo sapiens
ttttccttccatgct

SEQ ID NO: 2936503 - DNA, 18 bp, Homo sapiens
ttttccttcctctgtaag

SEQ ID NO: 2936504 - DNA, 13 bp, Homo sapiens
aaacgtctcccag

SEQ ID NO: 2936505 - DNA, 12 bp, Homo sapiens
aaactaaccttt

SEQ ID NO: 2936506 - DNA, 21 bp, Homo sapiens
aaactacaaccaatggaatgt

SEQ ID NO: 2936507 - DNA, 19 bp, Homo sapiens
aaactaccagtgggcatgt

SEQ ID NO: 2936508 - DNA, 17 bp, Homo sapiens
aaactacctatattcct

SEQ ID NO: 2936509 - DNA, 17 bp, Homo sapiens
aaactacctgtgagcat

SEQ ID NO: 2936510 - DNA, 18 bp, Homo sapiens
aaactacctgtgagcatg

SEQ ID NO: 2936511 - DNA, 13 bp, Homo sapiens
aaactagaaatct

SEQ ID NO: 2936512 - DNA, 22 bp, Homo sapiens
aaactagaaatctgtcctgtgg

SEQ ID NO: 2936513 - DNA, 13 bp, Homo sapiens
aaactagatgacc

SEQ ID NO: 2936514 - DNA, 18 bp, Homo sapiens
aaactagggccaagccca

SEQ ID NO: 2936515 - DNA, 18 bp, Homo sapiens
aaactagggttttggcct

SEQ ID NO: 2936516 - DNA, 16 bp, Homo sapiens
aaactataaatacaaa

SEQ ID NO: 2936517 - DNA, 18 bp, Homo sapiens
aaactatcgccatggctt

SEQ ID NO: 2936518 - DNA, 15 bp, Homo sapiens
aaactcatttataaa

SEQ ID NO: 2936519 - DNA, 15 bp, Homo sapiens
aaactcatttcctat

SEQ ID NO: 2936520 - DNA, 15 bp, Homo sapiens
aaactccaccttccc

SEQ ID NO: 2936521 - DNA, 19 bp, Homo sapiens
aaactcccttgtgttcctt

SEQ ID NO: 2936522 - DNA, 16 bp, Homo sapiens
aaactcctactgcttc

SEQ ID NO: 2936523 - DNA, 17 bp, Homo sapiens
aaactcgaggactgtat

SEQ ID NO: 2936524 - DNA, 20 bp, Homo sapiens
aaactcgaggactgtatttg

SEQ ID NO: 2936525 - DNA, 22 bp, Homo sapiens
aaactcgaggactgtatttgtg

SEQ ID NO: 2936526 - DNA, 24 bp, Homo sapiens
aaactcgaggactgtatttgtgac

SEQ ID NO: 2936527 - DNA, 14 bp, Homo sapiens
aaactctaccctga

SEQ ID NO: 2936528 - DNA, 22 bp, Homo sapiens
aaactctatcggagaacatgaa

SEQ ID NO: 2936529 - DNA, 16 bp, Homo sapiens
aaactctctcccagga

SEQ ID NO: 2936530 - DNA, 17 bp, Homo sapiens
aaactctctcccaggac

SEQ ID NO: 2936531 - DNA, 12 bp, Homo sapiens
aaactctcttct

SEQ ID NO: 2936532 - DNA, 11 bp, Homo sapiens
aaactctgctg

SEQ ID NO: 2936533 - DNA, 21 bp, Homo sapiens
aaactcttcagttaattctta

SEQ ID NO: 2936534 - DNA, 13 bp, Homo sapiens
aaactgagtgact

SEQ ID NO: 2936535 - DNA, 16 bp, Homo sapiens
aaactgcacaataaaa

SEQ ID NO: 2936536 - DNA, 23 bp, Homo sapiens
aaactgcagtcatcaacaatgat

SEQ ID NO: 2936537 - DNA, 14 bp, Homo sapiens
aacactgaaaaaat

SEQ ID NO: 2936538 - DNA, 21 bp, Homo sapiens
aacactgccctcgcacggccc

SEQ ID NO: 2936539 - DNA, 21 bp, Homo sapiens
aacactgcttctcggccagcc

SEQ ID NO: 2936540 - DNA, 18 bp, Homo sapiens
aacactgtgattactctt

SEQ ID NO: 2936541 - DNA, 15 bp, Homo sapiens
aacacttcaataatt

SEQ ID NO: 2936542 - DNA, 19 bp, Homo sapiens
aacacttctgtcctgtgag

SEQ ID NO: 2936543 - DNA, 15 bp, Homo sapiens
aacactttcctggat

SEQ ID NO: 2936544 - DNA, 20 bp, Homo sapiens
aacactttctcacttacagg

SEQ ID NO: 2936545 - DNA, 19 bp, Homo sapiens
aacactttctcttcttgtt

SEQ ID NO: 2936546 - DNA, 15 bp, Homo sapiens
aacagaaaaataagt

SEQ ID NO: 2936547 - DNA, 16 bp, Homo sapiens
aacagaaaaataagtc

SEQ ID NO: 2936548 - DNA, 23 bp, Homo sapiens
aacagaaaaatatgtaccaagaa

SEQ ID NO: 2936549 - DNA, 19 bp, Homo sapiens
aacagaaaacattctgatt

SEQ ID NO: 2936550 - DNA, 21 bp, Homo sapiens
aacagaaatatataaaaatat

SEQ ID NO: 2936551 - DNA, 15 bp, Homo sapiens
aacagaaatgctctg

SEQ ID NO: 2936552 - DNA, 16 bp, Homo sapiens
aacagaaatgctctga

SEQ ID NO: 2936553 - DNA, 12 bp, Homo sapiens
aacagaatgaaa

SEQ ID NO: 2936554 - DNA, 16 bp, Homo sapiens
aacagaatgaaaaatg

SEQ ID NO: 2936555 - DNA, 17 bp, Homo sapiens
aacagaatgaaaaatga

SEQ ID NO: 2936556 - DNA, 18 bp, Homo sapiens
aacagaatgaaaaatgaa

SEQ ID NO: 2936557 - DNA, 18 bp, Homo sapiens
aacagacaaaaacagcct

SEQ ID NO: 2936558 - DNA, 14 bp, Homo sapiens
aacagacaggagaa

SEQ ID NO: 2936559 - DNA, 15 bp, Homo sapiens
aacagagagaaaaag

SEQ ID NO: 2936560 - DNA, 18 bp, Homo sapiens
aacagagaggaccaacat

SEQ ID NO: 2936561 - DNA, 15 bp, Homo sapiens
aacagaggcatttaa

SEQ ID NO: 2936562 - DNA, 20 bp, Homo sapiens
aacagaggcgtctcacattt

SEQ ID NO: 2936563 - DNA, 21 bp, Homo sapiens
aacagagggaggaatgtgtgc

SEQ ID NO: 2936564 - DNA, 14 bp, Homo sapiens
aacagaggtaaaaa

SEQ ID NO: 2936565 - DNA, 16 bp, Homo sapiens
aacagaggtaaaaaaa

SEQ ID NO: 2936566 - DNA, 20 bp, Homo sapiens
aacagaggtaaaaaaaagaa

SEQ ID NO: 2936567 - DNA, 21 bp, Homo sapiens
aacagaggtaaaaaaaagaag

SEQ ID NO: 2936568 - DNA, 20 bp, Homo sapiens
aacagagtagttttggtttt

SEQ ID NO: 2936569 - DNA, 21 bp, Homo sapiens
aacagatattacagcttattt

SEQ ID NO: 2936570 - DNA, 15 bp, Homo sapiens
aacagatgtccctga

SEQ ID NO: 2936571 - DNA, 20 bp, Homo sapiens
aacagattattttggaaagt

SEQ ID NO: 2936572 - DNA, 15 bp, Homo sapiens
aacagattgtttgca

SEQ ID NO: 2936573 - DNA, 14 bp, Homo sapiens
aacagatttgtgaa

SEQ ID NO: 2936574 - DNA, 15 bp, Homo sapiens
aacagatttgtgaac

SEQ ID NO: 2936575 - DNA, 18 bp, Homo sapiens
aacagatttgtgaactca

SEQ ID NO: 2936576 - DNA, 21 bp, Homo sapiens
aacagatttgtgaactcagcc

SEQ ID NO: 2936577 - DNA, 18 bp, Homo sapiens
aacagcaaaccaagagat

SEQ ID NO: 2936578 - DNA, 20 bp, Homo sapiens
aacagcagactcagctctga

SEQ ID NO: 2936579 - DNA, 22 bp, Homo sapiens
aacagcagggtacctgaaagag

SEQ ID NO: 2936580 - DNA, 15 bp, Homo sapiens
aacagcagggtttga

SEQ ID NO: 2936581 - DNA, 18 bp, Homo sapiens
aacagccactacattact

SEQ ID NO: 2936582 - DNA, 18 bp, Homo sapiens
aacagccactcccctcca

SEQ ID NO: 2936583 - DNA, 12 bp, Homo sapiens
aacagccatttt

SEQ ID NO: 2936584 - DNA, 13 bp, Homo sapiens
aacagcctcactt

SEQ ID NO: 2936585 - DNA, 16 bp, Homo sapiens
aacagcctctttttga

SEQ ID NO: 2936586 - DNA, 17 bp, Homo sapiens
aacagcgtcttccttct

SEQ ID NO: 2936587 - DNA, 18 bp, Homo sapiens
aacagctgccttagcttc

SEQ ID NO: 2936588 - DNA, 20 bp, Homo sapiens
aacagctgccttagcttcag

SEQ ID NO: 2936589 - DNA, 23 bp, Homo sapiens
aacagctgccttagcttcaggaa

SEQ ID NO: 2936590 - DNA, 18 bp, Homo sapiens
aacagctgttcctgtgtt

SEQ ID NO: 2936591 - DNA, 14 bp, Homo sapiens
aacaggaggacaat

SEQ ID NO: 2936592 - DNA, 17 bp, Homo sapiens
aacaggaggacaattca

SEQ ID NO: 2936593 - DNA, 19 bp, Homo sapiens
aacaggaggacaattcatg

SEQ ID NO: 2936594 - DNA, 14 bp, Homo sapiens
aacaggcagaaata

SEQ ID NO: 2936595 - DNA, 17 bp, Homo sapiens
aacaggcgtgggatcag

SEQ ID NO: 2936596 - DNA, 14 bp, Homo sapiens
aacaggctcagagg

SEQ ID NO: 2936597 - DNA, 20 bp, Homo sapiens
aacagggcgggggggggggc

SEQ ID NO: 2936598 - DNA, 18 bp, Homo sapiens
aacaggtaatataaaaag

SEQ ID NO: 2936599 - DNA, 13 bp, Homo sapiens
aacaggtgctggc

SEQ ID NO: 2936600 - DNA, 21 bp, Homo sapiens
aacaggtgctggcccagcatg

SEQ ID NO: 2936601 - DNA, 22 bp, Homo sapiens
aacaggtgctggcccagcatgg

SEQ ID NO: 2936602 - DNA, 14 bp, Homo sapiens
aacaggtggagaaa

SEQ ID NO: 2936603 - DNA, 21 bp, Homo sapiens
aacaggttattttagtttctg

SEQ ID NO: 2936604 - DNA, 22 bp, Homo sapiens
aacaggttattttagtttctgt

SEQ ID NO: 2936605 - DNA, 22 bp, Homo sapiens
aacagtaccagtgtaaattcag

SEQ ID NO: 2936606 - DNA, 16 bp, Homo sapiens
aacagtacctgtgcct

SEQ ID NO: 2936607 - DNA, 23 bp, Homo sapiens
aacagtataacaactatttacat

SEQ ID NO: 2936608 - DNA, 14 bp, Homo sapiens
aacagtatgatgga

SEQ ID NO: 2936609 - DNA, 17 bp, Homo sapiens
aacagtattaaatgact

SEQ ID NO: 2936610 - DNA, 20 bp, Homo sapiens
aacagtcatgaggcagcttt

SEQ ID NO: 2936611 - DNA, 14 bp, Homo sapiens
aacagtgaaagtca

SEQ ID NO: 2936612 - DNA, 12 bp, Homo sapiens
aacagtgaattt

SEQ ID NO: 2936613 - DNA, 12 bp, Homo sapiens
aacagtgcctgc

SEQ ID NO: 2936614 - DNA, 13 bp, Homo sapiens
aacagtgcctgct

SEQ ID NO: 2936615 - DNA, 15 bp, Homo sapiens
aacagtgctaaaaat

SEQ ID NO: 2936616 - DNA, 16 bp, Homo sapiens
aacagtgctaaaaatg

SEQ ID NO: 2936617 - DNA, 15 bp, Homo sapiens
aacagtggaatataa

SEQ ID NO: 2936618 - DNA, 21 bp, Homo sapiens
aacagtggccttgcttcttag

SEQ ID NO: 2936619 - DNA, 13 bp, Homo sapiens
aacagtgtgaagt

SEQ ID NO: 2936620 - DNA, 17 bp, Homo sapiens
aacagtgtgaagttaga

SEQ ID NO: 2936621 - DNA, 20 bp, Homo sapiens
aacagtgtgaagttagaatt

SEQ ID NO: 2936622 - DNA, 17 bp, Homo sapiens
aacagtgtttatgacga

SEQ ID NO: 2936623 - DNA, 20 bp, Homo sapiens
aacagttacttaagattcag

SEQ ID NO: 2936624 - DNA, 19 bp, Homo sapiens
aacagttagtaatggtgct

SEQ ID NO: 2936625 - DNA, 12 bp, Homo sapiens
aacagttttcct

SEQ ID NO: 2936626 - DNA, 20 bp, Homo sapiens
aacagttttcctatgctttg

SEQ ID NO: 2936627 - DNA, 13 bp, Homo sapiens
aacataaaaagca

SEQ ID NO: 2936628 - DNA, 16 bp, Homo sapiens
aacataaaatgaggca

SEQ ID NO: 2936629 - DNA, 21 bp, Homo sapiens
aacataaccattacagggagc

SEQ ID NO: 2936630 - DNA, 23 bp, Homo sapiens
aacataatagaatttcctaatga

SEQ ID NO: 2936631 - DNA, 14 bp, Homo sapiens
aacatacttcaaaa

SEQ ID NO: 2936632 - DNA, 12 bp, Homo sapiens
aacatagaaaaa

SEQ ID NO: 2936633 - DNA, 21 bp, Homo sapiens
aacatagaaaaatgatgtctt

SEQ ID NO: 2936634 - DNA, 22 bp, Homo sapiens
aacatagaaaaatgatgtcttt

SEQ ID NO: 2936635 - DNA, 19 bp, Homo sapiens
aacatagactgaagattta

SEQ ID NO: 2936636 - DNA, 17 bp, Homo sapiens
aacatagtccagagaac

SEQ ID NO: 2936637 - DNA, 14 bp, Homo sapiens
aacatatcaaaata

SEQ ID NO: 2936638 - DNA, 17 bp, Homo sapiens
aacatatctaaagtcat

SEQ ID NO: 2936639 - DNA, 15 bp, Homo sapiens
aacatatttaagaaa

SEQ ID NO: 2936640 - DNA, 16 bp, Homo sapiens
aacatatttaaggaac

SEQ ID NO: 2936641 - DNA, 14 bp, Homo sapiens
aacatattttacat

SEQ ID NO: 2936642 - DNA, 17 bp, Homo sapiens
aacatcactgaaatgct

SEQ ID NO: 2936643 - DNA, 18 bp, Homo sapiens
aacatcagttactctgaa

SEQ ID NO: 2936644 - DNA, 21 bp, Homo sapiens
aacatcagttactctgaaggg

SEQ ID NO: 2936645 - DNA, 19 bp, Homo sapiens
aacatcattactataagaa

SEQ ID NO: 2936646 - DNA, 14 bp, Homo sapiens
aacatcattagaac

SEQ ID NO: 2936647 - DNA, 15 bp, Homo sapiens
aacatcattagaaca

SEQ ID NO: 2936648 - DNA, 17 bp, Homo sapiens
aacatcattttgttttc

SEQ ID NO: 2936649 - DNA, 17 bp, Homo sapiens
aacatccaaccttccca

SEQ ID NO: 2936650 - DNA, 16 bp, Homo sapiens
aacatcgttgttttgc

SEQ ID NO: 2936651 - DNA, 16 bp, Homo sapiens
aacatctagaaattgc

SEQ ID NO: 2936652 - DNA, 15 bp, Homo sapiens
aacatcttcaacatg

SEQ ID NO: 2936653 - DNA, 12 bp, Homo sapiens
aacatcttcata

SEQ ID NO: 2936654 - DNA, 13 bp, Homo sapiens
aacatcttcatat

SEQ ID NO: 2936655 - DNA, 17 bp, Homo sapiens
aacatcttcatataaac

SEQ ID NO: 2936656 - DNA, 15 bp, Homo sapiens
aacatctttgcgaaa

SEQ ID NO: 2936657 - DNA, 19 bp, Homo sapiens
aacatctttgcgaaaagat

SEQ ID NO: 2936658 - DNA, 20 bp, Homo sapiens
aacatctttgcgaaaagata

SEQ ID NO: 2936659 - DNA, 21 bp, Homo sapiens
aacatctttttaacctgcaaa

SEQ ID NO: 2936660 - DNA, 15 bp, Homo sapiens
aacatgaagcataat

SEQ ID NO: 2936661 - DNA, 16 bp, Homo sapiens
aacatgaagcataatt

SEQ ID NO: 2936662 - DNA, 19 bp, Homo sapiens
aacatgacatttaccagca

SEQ ID NO: 2936663 - DNA, 21 bp, Homo sapiens
aacatgcagtttgaaattctg

SEQ ID NO: 2936664 - DNA, 20 bp, Homo sapiens
aacatggagaaaccctgtct

SEQ ID NO: 2936665 - DNA, 17 bp, Homo sapiens
aacatggattccaaagc

SEQ ID NO: 2936666 - DNA, 16 bp, Homo sapiens
aacatggcttctcctt

SEQ ID NO: 2936667 - DNA, 17 bp, Homo sapiens
aacatggcttctccttt

SEQ ID NO: 2936668 - DNA, 19 bp, Homo sapiens
aacatgggctgtgattact

SEQ ID NO: 2936669 - DNA, 22 bp, Homo sapiens
aacatggtaaacgctgtcccta

SEQ ID NO: 2936670 - DNA, 17 bp, Homo sapiens
aacatggtgtgtgtctc

SEQ ID NO: 2936671 - DNA, 21 bp, Homo sapiens
aacatggtgtgtgtctctgac

SEQ ID NO: 2936672 - DNA, 22 bp, Homo sapiens
aacatgtaatataaagatgtta

SEQ ID NO: 2936673 - DNA, 17 bp, Homo sapiens
aacatgtatctgtctac

SEQ ID NO: 2936674 - DNA, 23 bp, Homo sapiens
aaatcgtttaatgtttatacaga

SEQ ID NO: 2936675 - DNA, 16 bp, Homo sapiens
aaatctatgattccag

SEQ ID NO: 2936676 - DNA, 18 bp, Homo sapiens
aaatctcccacaagtata

SEQ ID NO: 2936677 - DNA, 18 bp, Homo sapiens
aaatctgacccagtgccc

SEQ ID NO: 2936678 - DNA, 14 bp, Homo sapiens
aaatctggcttctg

SEQ ID NO: 2936679 - DNA, 18 bp, Homo sapiens
aaatctggcttctggcca

SEQ ID NO: 2936680 - DNA, 16 bp, Homo sapiens
aaatctgtataaatgt

SEQ ID NO: 2936681 - DNA, 18 bp, Homo sapiens
aaatctgtataaatgtct

SEQ ID NO: 2936682 - DNA, 19 bp, Homo sapiens
aaatctgtataaatgtcta

SEQ ID NO: 2936683 - DNA, 16 bp, Homo sapiens
aaatctgtcaagagta

SEQ ID NO: 2936684 - DNA, 12 bp, Homo sapiens
aaatctgtcctc

SEQ ID NO: 2936685 - DNA, 16 bp, Homo sapiens
aaatctgtcctctgta

SEQ ID NO: 2936686 - DNA, 17 bp, Homo sapiens
aaatctgtcctctgtag

SEQ ID NO: 2936687 - DNA, 15 bp, Homo sapiens
aaatctgtcctgtgg

SEQ ID NO: 2936688 - DNA, 14 bp, Homo sapiens
aaatctgtctttgc

SEQ ID NO: 2936689 - DNA, 19 bp, Homo sapiens
aaatctgtgcctgagaaca

SEQ ID NO: 2936690 - DNA, 14 bp, Homo sapiens
aaatcttaaaaagt

SEQ ID NO: 2936691 - DNA, 17 bp, Homo sapiens
aaatcttaaaaagttgt

SEQ ID NO: 2936692 - DNA, 13 bp, Homo sapiens
aaatcttacaaaa

SEQ ID NO: 2936693 - DNA, 13 bp, Homo sapiens
aaatcttacaaca

SEQ ID NO: 2936694 - DNA, 11 bp, Homo sapiens
aaatcttcagc

SEQ ID NO: 2936695 - DNA, 12 bp, Homo sapiens
aaatcttcagct

SEQ ID NO: 2936696 - DNA, 21 bp, Homo sapiens
aaatcttcagctggtggatgg

SEQ ID NO: 2936697 - DNA, 20 bp, Homo sapiens
aaatcttgcatggcattaat

SEQ ID NO: 2936698 - DNA, 18 bp, Homo sapiens
aaatctttctgtaaacag

SEQ ID NO: 2936699 - DNA, 15 bp, Homo sapiens
aaatctttcttcaaa

SEQ ID NO: 2936700 - DNA, 16 bp, Homo sapiens
aaatctttcttcaaat

SEQ ID NO: 2936701 - DNA, 11 bp, Homo sapiens
aaatcttttac

SEQ ID NO: 2936702 - DNA, 14 bp, Homo sapiens
aaatgaaagatgat

SEQ ID NO: 2936703 - DNA, 12 bp, Homo sapiens
aaatgaaaggag

SEQ ID NO: 2936704 - DNA, 11 bp, Homo sapiens
aaatgaacttt

SEQ ID NO: 2936705 - DNA, 14 bp, Homo sapiens
aaatgaagaaggaa

SEQ ID NO: 2936706 - DNA, 18 bp, Homo sapiens
aaatgaagatctttatat

SEQ ID NO: 2936707 - DNA, 11 bp, Homo sapiens
aaatgaagtgc

SEQ ID NO: 2936708 - DNA, 13 bp, Homo sapiens
aaatgaatggttc

SEQ ID NO: 2936709 - DNA, 16 bp, Homo sapiens
aaatgaatttgactgg

SEQ ID NO: 2936710 - DNA, 16 bp, Homo sapiens
aaatgacaaagtgttg

SEQ ID NO: 2936711 - DNA, 19 bp, Homo sapiens
aaatgactaaaaaacaaag

SEQ ID NO: 2936712 - DNA, 14 bp, Homo sapiens
aaatgacttagaaa

SEQ ID NO: 2936713 - DNA, 19 bp, Homo sapiens
aaatgagcatctcaaatgt

SEQ ID NO: 2936714 - DNA, 23 bp, Homo sapiens
aaatgagctcgcatttgtcaatg

SEQ ID NO: 2936715 - DNA, 22 bp, Homo sapiens
aaatgaggaggatgctaaaaat

SEQ ID NO: 2936716 - DNA, 15 bp, Homo sapiens
aaatgagtgtgaagg

SEQ ID NO: 2936717 - DNA, 18 bp, Homo sapiens
aaatgatagaactgtact

SEQ ID NO: 2936718 - DNA, 13 bp, Homo sapiens
aaatgatagattt

SEQ ID NO: 2936719 - DNA, 15 bp, Homo sapiens
aaatgatagatttga

SEQ ID NO: 2936720 - DNA, 21 bp, Homo sapiens
aaatgatagatttgacctcct

SEQ ID NO: 2936721 - DNA, 15 bp, Homo sapiens
aaatgatcctcagtg

SEQ ID NO: 2936722 - DNA, 12 bp, Homo sapiens
aaatgatgttat

SEQ ID NO: 2936723 - DNA, 23 bp, Homo sapiens
aaatgatgttcatttagattgaa

SEQ ID NO: 2936724 - DNA, 23 bp, Homo sapiens
aaatgatgttgtcactggtggct

SEQ ID NO: 2936725 - DNA, 21 bp, Homo sapiens
aaatgcaaatcctatgtgatt

SEQ ID NO: 2936726 - DNA, 19 bp, Homo sapiens
aaatgcaatcaatttaaat

SEQ ID NO: 2936727 - DNA, 12 bp, Homo sapiens
aaatgcagccca

SEQ ID NO: 2936728 - DNA, 13 bp, Homo sapiens
aaatgcagcccat

SEQ ID NO: 2936729 - DNA, 21 bp, Homo sapiens
aaatgcagcccatttctccag

SEQ ID NO: 2936730 - DNA, 19 bp, Homo sapiens
aaatgcagtaacattctac

SEQ ID NO: 2936731 - DNA, 20 bp, Homo sapiens
aaatgcatccattcctcagg

SEQ ID NO: 2936732 - DNA, 22 bp, Homo sapiens
aaatgcatccattcctcaggga

SEQ ID NO: 2936733 - DNA, 15 bp, Homo sapiens
aaatgcattattgac

SEQ ID NO: 2936734 - DNA, 11 bp, Homo sapiens
aaatgcattca

SEQ ID NO: 2936735 - DNA, 15 bp, Homo sapiens
aaatgcattcatgtt

SEQ ID NO: 2936736 - DNA, 22 bp, Homo sapiens
aaatgcattctatcgttattat

SEQ ID NO: 2936737 - DNA, 23 bp, Homo sapiens
aaatgcattctatcgttattata

SEQ ID NO: 2936738 - DNA, 20 bp, Homo sapiens
aaatgccaactgttggaatt

SEQ ID NO: 2936739 - DNA, 18 bp, Homo sapiens
aaatgccaagtgcctgct

SEQ ID NO: 2936740 - DNA, 14 bp, Homo sapiens
aaatgccacttttt

SEQ ID NO: 2936741 - DNA, 18 bp, Homo sapiens
aaatgcccaaggatgcct

SEQ ID NO: 2936742 - DNA, 15 bp, Homo sapiens
aaatgcccatttcga

SEQ ID NO: 2936743 - DNA, 18 bp, Homo sapiens
aaatgcctttttgtttac

SEQ ID NO: 2936744 - DNA, 16 bp, Homo sapiens
aaatgcgtatttgcat

SEQ ID NO: 2936745 - DNA, 15 bp, Homo sapiens
aaatgctaatattaa

SEQ ID NO: 2936746 - DNA, 23 bp, Homo sapiens
aaatgctcccacctgaatttgta

SEQ ID NO: 2936747 - DNA, 14 bp, Homo sapiens
aaatgctgatattt

SEQ ID NO: 2936748 - DNA, 18 bp, Homo sapiens
aaatgctgatatttactg

SEQ ID NO: 2936749 - DNA, 14 bp, Homo sapiens
aaatgctgtgcaaa

SEQ ID NO: 2936750 - DNA, 13 bp, Homo sapiens
aaatggaattact

SEQ ID NO: 2936751 - DNA, 14 bp, Homo sapiens
aaatggacaaagaa

SEQ ID NO: 2936752 - DNA, 23 bp, Homo sapiens
aaatggagtcatttgagtctctt

SEQ ID NO: 2936753 - DNA, 21 bp, Homo sapiens
aaatggatgccttgaataata

SEQ ID NO: 2936754 - DNA, 16 bp, Homo sapiens
aaatggcagtgatgaa

SEQ ID NO: 2936755 - DNA, 19 bp, Homo sapiens
aaatggctgtaatcatttg

SEQ ID NO: 2936756 - DNA, 13 bp, Homo sapiens
aaatgggaacatt

SEQ ID NO: 2936757 - DNA, 21 bp, Homo sapiens
aaatgggacttcttttcacat

SEQ ID NO: 2936758 - DNA, 22 bp, Homo sapiens
aaatggggccagatccagcctg

SEQ ID NO: 2936759 - DNA, 15 bp, Homo sapiens
aacaaaaagtaaagt

SEQ ID NO: 2936760 - DNA, 21 bp, Homo sapiens
aacaaaaatgatcctcagtgc

SEQ ID NO: 2936761 - DNA, 17 bp, Homo sapiens
aacaaaactgcatttca

SEQ ID NO: 2936762 - DNA, 20 bp, Homo sapiens
aacaaaatctcctcttttag

SEQ ID NO: 2936763 - DNA, 17 bp, Homo sapiens
aacaaaatggcttcagt

SEQ ID NO: 2936764 - DNA, 18 bp, Homo sapiens
aacaaaattagccgggca

SEQ ID NO: 2936765 - DNA, 20 bp, Homo sapiens
aacaaaatttgactaatttt

SEQ ID NO: 2936766 - DNA, 12 bp, Homo sapiens
aacaaacaaaaa

SEQ ID NO: 2936767 - DNA, 15 bp, Homo sapiens
aacaaacaaaactct

SEQ ID NO: 2936768 - DNA, 17 bp, Homo sapiens
aacaaacaaatcaaaca

SEQ ID NO: 2936769 - DNA, 16 bp, Homo sapiens
aacaaaccagaatccc

SEQ ID NO: 2936770 - DNA, 14 bp, Homo sapiens
aacaaagagtgaaa

SEQ ID NO: 2936771 - DNA, 16 bp, Homo sapiens
aacaaagagtgaaata

SEQ ID NO: 2936772 - DNA, 14 bp, Homo sapiens
aacaaagcagccac

SEQ ID NO: 2936773 - DNA, 12 bp, Homo sapiens
aacaaagccaga

SEQ ID NO: 2936774 - DNA, 15 bp, Homo sapiens
aacaaagttaattgt

SEQ ID NO: 2936775 - DNA, 15 bp, Homo sapiens
aacaaattatttttg

SEQ ID NO: 2936776 - DNA, 13 bp, Homo sapiens
aacaacaaaaaaa

SEQ ID NO: 2936777 - DNA, 18 bp, Homo sapiens
aacaaccttcagctttat

SEQ ID NO: 2936778 - DNA, 13 bp, Homo sapiens
aacaagaagatga

SEQ ID NO: 2936779 - DNA, 14 bp, Homo sapiens
aacaagacagcctt

SEQ ID NO: 2936780 - DNA, 22 bp, Homo sapiens
aacaagaccaccacttcgaaac

SEQ ID NO: 2936781 - DNA, 19 bp, Homo sapiens
aacaagagcgaaactccgt

SEQ ID NO: 2936782 - DNA, 16 bp, Homo sapiens
aacaagcccaaattta

SEQ ID NO: 2936783 - DNA, 22 bp, Homo sapiens
aacaagcttcaaagccatatgg

SEQ ID NO: 2936784 - DNA, 14 bp, Homo sapiens
aacaataaaatttt

SEQ ID NO: 2936785 - DNA, 20 bp, Homo sapiens
aacaatactcataatgtgaa

SEQ ID NO: 2936786 - DNA, 20 bp, Homo sapiens
aacaatcacaaaagctgtgt

SEQ ID NO: 2936787 - DNA, 22 bp, Homo sapiens
aacaatcctagtgctttccttt

SEQ ID NO: 2936788 - DNA, 22 bp, Homo sapiens
aacaatgagtggacaagtcatg

SEQ ID NO: 2936789 - DNA, 14 bp, Homo sapiens
aacaatgattaatc

SEQ ID NO: 2936790 - DNA, 15 bp, Homo sapiens
aacaatgattaatca

SEQ ID NO: 2936791 - DNA, 18 bp, Homo sapiens
aacaatggtgtggtgaat

SEQ ID NO: 2936792 - DNA, 13 bp, Homo sapiens
aacacaaatgcag

SEQ ID NO: 2936793 - DNA, 17 bp, Homo sapiens
aacacaacacaagaaaa

SEQ ID NO: 2936794 - DNA, 14 bp, Homo sapiens
aacacaataagagt

SEQ ID NO: 2936795 - DNA, 19 bp, Homo sapiens
aacacagacattctgccag

SEQ ID NO: 2936796 - DNA, 20 bp, Homo sapiens
aacacagacattctgccagg

SEQ ID NO: 2936797 - DNA, 22 bp, Homo sapiens
aacacagagtgtgtttttgcac

SEQ ID NO: 2936798 - DNA, 18 bp, Homo sapiens
aacacagcaattcctcag

SEQ ID NO: 2936799 - DNA, 16 bp, Homo sapiens
aacacagtgtttttgt

SEQ ID NO: 2936800 - DNA, 20 bp, Homo sapiens
aacacagtgtttttgtaaag

SEQ ID NO: 2936801 - DNA, 19 bp, Homo sapiens
aacacatacaaaagaatta

SEQ ID NO: 2936802 - DNA, 17 bp, Homo sapiens
aacacattaaaagacaa

SEQ ID NO: 2936803 - DNA, 19 bp, Homo sapiens
aacacattgttattttcag

SEQ ID NO: 2936804 - DNA, 14 bp, Homo sapiens
aacacatttcccta

SEQ ID NO: 2936805 - DNA, 22 bp, Homo sapiens
aacacattttgtataattgtat

SEQ ID NO: 2936806 - DNA, 17 bp, Homo sapiens
aacaccaagcacagcag

SEQ ID NO: 2936807 - DNA, 21 bp, Homo sapiens
aacaccagtcccgaaatttgg

SEQ ID NO: 2936808 - DNA, 21 bp, Homo sapiens
aacaccccgcctgcctcctgg

SEQ ID NO: 2936809 - DNA, 13 bp, Homo sapiens
aacacctgatgtg

SEQ ID NO: 2936810 - DNA, 15 bp, Homo sapiens
aacacgcacctgcct

SEQ ID NO: 2936811 - DNA, 22 bp, Homo sapiens
aacactatttgtgactttttaa

SEQ ID NO: 2936812 - DNA, 12 bp, Homo sapiens
aacactcttttg

SEQ ID NO: 2936813 - DNA, 16 bp, Homo sapiens
aacactcttttgcttt

SEQ ID NO: 2936814 - DNA, 19 bp, Homo sapiens
aacactcttttgctttatt

SEQ ID NO: 2936815 - DNA, 11 bp, Homo sapiens
aaaaatagatg

SEQ ID NO: 2936816 - DNA, 14 bp, Homo sapiens
aaaaatagatgttt

SEQ ID NO: 2936817 - DNA, 17 bp, Homo sapiens
aaaaatagcaacttgtg

SEQ ID NO: 2936818 - DNA, 16 bp, Homo sapiens
aaaaataggattgctt

SEQ ID NO: 2936819 - DNA, 22 bp, Homo sapiens
aaaaatattttctctgtacttt

SEQ ID NO: 2936820 - DNA, 15 bp, Homo sapiens
aaaaatctttttgat

SEQ ID NO: 2936821 - DNA, 14 bp, Homo sapiens
aaaaatgaaagatg

SEQ ID NO: 2936822 - DNA, 14 bp, Homo sapiens
aaaaatgacagact

SEQ ID NO: 2936823 - DNA, 14 bp, Homo sapiens
aaaaatgatgtctt

SEQ ID NO: 2936824 - DNA, 18 bp, Homo sapiens
aaaaatgcaaatcctatg

SEQ ID NO: 2936825 - DNA, 23 bp, Homo sapiens
aaaaatgcaaatcctatgtgatt

SEQ ID NO: 2936826 - DNA, 15 bp, Homo sapiens
aaaaatgccataata

SEQ ID NO: 2936827 - DNA, 12 bp, Homo sapiens
aaaaatgctaat

SEQ ID NO: 2936828 - DNA, 17 bp, Homo sapiens
aaaaatgctaatattaa

SEQ ID NO: 2936829 - DNA, 12 bp, Homo sapiens
aaaaatgcttct

SEQ ID NO: 2936830 - DNA, 17 bp, Homo sapiens
aaaaatggaaaaaaaca

SEQ ID NO: 2936831 - DNA, 17 bp, Homo sapiens
aaaaatgggacttcttt

SEQ ID NO: 2936832 - DNA, 18 bp, Homo sapiens
aaaaatggtggcttcagc

SEQ ID NO: 2936833 - DNA, 19 bp, Homo sapiens
aaaaatggtggcttcagct

SEQ ID NO: 2936834 - DNA, 20 bp, Homo sapiens
aaaaatggtggcttcagctc

SEQ ID NO: 2936835 - DNA, 21 bp, Homo sapiens
aaaaatggttttgaatagatc

SEQ ID NO: 2936836 - DNA, 16 bp, Homo sapiens
aaaaatgtatatgcac

SEQ ID NO: 2936837 - DNA, 22 bp, Homo sapiens
aaaaatgtatgctatcctctta

SEQ ID NO: 2936838 - DNA, 18 bp, Homo sapiens
aaaaatgtcctgcctttt

SEQ ID NO: 2936839 - DNA, 13 bp, Homo sapiens
aaaaattaaaatg

SEQ ID NO: 2936840 - DNA, 19 bp, Homo sapiens
aaaaattaaattctctcta

SEQ ID NO: 2936841 - DNA, 14 bp, Homo sapiens
aaaaattacaaaga

SEQ ID NO: 2936842 - DNA, 18 bp, Homo sapiens
aaaaattggttctttatt

SEQ ID NO: 2936843 - DNA, 14 bp, Homo sapiens
aaaaattgtcttca

SEQ ID NO: 2936844 - DNA, 15 bp, Homo sapiens
aaaaattgtctttat

SEQ ID NO: 2936845 - DNA, 14 bp, Homo sapiens
aaaacaacaaataa

SEQ ID NO: 2936846 - DNA, 22 bp, Homo sapiens
aaaacaatggtgtggtgaatgt

SEQ ID NO: 2936847 - DNA, 21 bp, Homo sapiens
aaaacacagtgtttttgtaaa

SEQ ID NO: 2936848 - DNA, 15 bp, Homo sapiens
aaaacactgccctct

SEQ ID NO: 2936849 - DNA, 17 bp, Homo sapiens
aaaacacttctgtcctg

SEQ ID NO: 2936850 - DNA, 19 bp, Homo sapiens
aaaacacttctgtcctgtg

SEQ ID NO: 2936851 - DNA, 18 bp, Homo sapiens
aaaacagaacatcattag

SEQ ID NO: 2936852 - DNA, 20 bp, Homo sapiens
aaaacagcattgctttctga

SEQ ID NO: 2936853 - DNA, 18 bp, Homo sapiens
aaaacaggtcaatacagt

SEQ ID NO: 2936854 - DNA, 21 bp, Homo sapiens
aaaacataatagaatttccta

SEQ ID NO: 2936855 - DNA, 23 bp, Homo sapiens
aaaacatagaaatggaaattttg

SEQ ID NO: 2936856 - DNA, 18 bp, Homo sapiens
aaaacatagactgaagat

SEQ ID NO: 2936857 - DNA, 13 bp, Homo sapiens
aaaacatctattc

SEQ ID NO: 2936858 - DNA, 13 bp, Homo sapiens
aaaacatgctgtt

SEQ ID NO: 2936859 - DNA, 19 bp, Homo sapiens
aaaacatgtaatataaaga

SEQ ID NO: 2936860 - DNA, 13 bp, Homo sapiens
aaaacatgtatgt

SEQ ID NO: 2936861 - DNA, 22 bp, Homo sapiens
aaaacattgcctttgaatgtta

SEQ ID NO: 2936862 - DNA, 18 bp, Homo sapiens
aaaacattttaaatgaaa

SEQ ID NO: 2936863 - DNA, 20 bp, Homo sapiens
aaaacattttaagttttact

SEQ ID NO: 2936864 - DNA, 12 bp, Homo sapiens
aaaaccaaatta

SEQ ID NO: 2936865 - DNA, 19 bp, Homo sapiens
aaaaccaatgttttgcagt

SEQ ID NO: 2936866 - DNA, 18 bp, Homo sapiens
aaaaccactatgcaaaga

SEQ ID NO: 2936867 - DNA, 14 bp, Homo sapiens
aaaaccagcctcat

SEQ ID NO: 2936868 - DNA, 15 bp, Homo sapiens
aaaaccatattttat

SEQ ID NO: 2936869 - DNA, 15 bp, Homo sapiens
aaaacccagagagga

SEQ ID NO: 2936870 - DNA, 22 bp, Homo sapiens
aaaaccccactacacagtctgc

SEQ ID NO: 2936871 - DNA, 20 bp, Homo sapiens
aaaaccgttcaaattctctt

SEQ ID NO: 2936872 - DNA, 21 bp, Homo sapiens
aaaacgcgcagatgtgcagca

SEQ ID NO: 2936873 - DNA, 19 bp, Homo sapiens
aaaactaaatgtgtacaca

SEQ ID NO: 2936874 - DNA, 17 bp, Homo sapiens
aaaactctctcccagga

SEQ ID NO: 2936875 - DNA, 12 bp, Homo sapiens
aaaactgtattt

SEQ ID NO: 2936876 - DNA, 9 bp, Homo sapiens
aaaacttcc

SEQ ID NO: 2936877 - DNA, 16 bp, Homo sapiens
aaaacttttaaaactt

SEQ ID NO: 2936878 - DNA, 15 bp, Homo sapiens
aaaagaaaaacaagt

SEQ ID NO: 2936879 - DNA, 13 bp, Homo sapiens
aaaagaaaacatt

SEQ ID NO: 2936880 - DNA, 13 bp, Homo sapiens
aaaagaaataata

SEQ ID NO: 2936881 - DNA, 20 bp, Homo sapiens
aaaagaaattcgcatgttta

SEQ ID NO: 2936882 - DNA, 19 bp, Homo sapiens
aaaagaagcactttgattg

SEQ ID NO: 2936883 - DNA, 13 bp, Homo sapiens
aaaagaagtgtgc

SEQ ID NO: 2936884 - DNA, 17 bp, Homo sapiens
aaaagaatcggcagtat

SEQ ID NO: 2936885 - DNA, 22 bp, Homo sapiens
aaaagaatcggcagtattttct

SEQ ID NO: 2936886 - DNA, 16 bp, Homo sapiens
aaaagaatgggcagtt

SEQ ID NO: 2936887 - DNA, 17 bp, Homo sapiens
aaaagaatttaaattct

SEQ ID NO: 2936888 - DNA, 20 bp, Homo sapiens
aaaagacaaggaaaaaataa

SEQ ID NO: 2936889 - DNA, 19 bp, Homo sapiens
aaaagacaattctttatac

SEQ ID NO: 2936890 - DNA, 19 bp, Homo sapiens
aaaagacagtgtatgtaga

SEQ ID NO: 2936891 - DNA, 20 bp, Homo sapiens
aaaagacgatgtttatgttc

SEQ ID NO: 2936892 - DNA, 18 bp, Homo sapiens
aaaagacggatggcagga

SEQ ID NO: 2936893 - DNA, 15 bp, Homo sapiens
aaaagagattgagat

SEQ ID NO: 2936894 - DNA, 13 bp, Homo sapiens
aaaagagctactc

SEQ ID NO: 2936895 - DNA, 12 bp, Homo sapiens
aaaagaggaaaa

SEQ ID NO: 2936896 - DNA, 22 bp, Homo sapiens
aaaagaggaaagaatgaaagag

SEQ ID NO: 2936897 - DNA, 20 bp, Homo sapiens
aaaagaggatgatttcagaa

SEQ ID NO: 2936898 - DNA, 15 bp, Homo sapiens
aaaagaggcctgttc

SEQ ID NO: 2936899 - DNA, 14 bp, Homo sapiens
aaaagataaatatt

SEQ ID NO: 2936900 - DNA, 20 bp, Homo sapiens
aaaagatgatcgctgtattt

SEQ ID NO: 2936901 - DNA, 19 bp, Homo sapiens
aaaagatgcttttaacaga

SEQ ID NO: 2936902 - DNA, 15 bp, Homo sapiens
aaaagattaaactgc

SEQ ID NO: 2936903 - DNA, 23 bp, Homo sapiens
aaaagattgtattactttaatga

SEQ ID NO: 2936904 - DNA, 15 bp, Homo sapiens
aaaagatttttattt

SEQ ID NO: 2936905 - DNA, 10 bp, Homo sapiens
aaaagcacaa

SEQ ID NO: 2936906 - DNA, 13 bp, Homo sapiens
aaaagcacaaaat

SEQ ID NO: 2936907 - DNA, 21 bp, Homo sapiens
aaaagcacactcatcccctca

SEQ ID NO: 2936908 - DNA, 20 bp, Homo sapiens
aaaagcagaattttaatgtg

SEQ ID NO: 2936909 - DNA, 20 bp, Homo sapiens
aaaagcagatggacttgaaa

SEQ ID NO: 2936910 - DNA, 16 bp, Homo sapiens
aaaagcagctctcccc

SEQ ID NO: 2936911 - DNA, 21 bp, Homo sapiens
aaaagcatctgccacaaaaat

SEQ ID NO: 2936912 - DNA, 18 bp, Homo sapiens
aaaagcatggccctgctg

SEQ ID NO: 2936913 - DNA, 10 bp, Homo sapiens
aaaagcccac

SEQ ID NO: 2936914 - DNA, 13 bp, Homo sapiens
aaaagccttctta

SEQ ID NO: 2936915 - DNA, 15 bp, Homo sapiens
aaaagcgctgtttcc

SEQ ID NO: 2936916 - DNA, 16 bp, Homo sapiens
aaaagcgtctttaaga

SEQ ID NO: 2936917 - DNA, 21 bp, Homo sapiens
aaaagcgtctttaagagactc

SEQ ID NO: 2936918 - DNA, 21 bp, Homo sapiens
aaaagctagtgtacctcctct

SEQ ID NO: 2936919 - DNA, 13 bp, Homo sapiens
aaaagctgctcag

SEQ ID NO: 2936920 - DNA, 14 bp, Homo sapiens
aaaagctttttgat

SEQ ID NO: 2936921 - DNA, 15 bp, Homo sapiens
aaaaggaacaaaaat

SEQ ID NO: 2936922 - DNA, 16 bp, Homo sapiens
aaaaggaactgcagca

SEQ ID NO: 2936923 - DNA, 13 bp, Homo sapiens
aaaaggaagactg

SEQ ID NO: 2936924 - DNA, 13 bp, Homo sapiens
aaaaggaaggaga

SEQ ID NO: 2936925 - DNA, 14 bp, Homo sapiens
aaaaggactggaaa

SEQ ID NO: 2936926 - DNA, 16 bp, Homo sapiens
aaaaggcaaatgtgta

SEQ ID NO: 2936927 - DNA, 17 bp, Homo sapiens
aaaaggcattgtttgag

SEQ ID NO: 2936928 - DNA, 14 bp, Homo sapiens
aaaaggccaaacct

SEQ ID NO: 2936929 - DNA, 16 bp, Homo sapiens
aaaaggctgtgctgcc

SEQ ID NO: 2936930 - DNA, 20 bp, Homo sapiens
aaaaggctgtgctgccctga

SEQ ID NO: 2936931 - DNA, 14 bp, Homo sapiens
aaaagggaagtcta

SEQ ID NO: 2936932 - DNA, 14 bp, Homo sapiens
aaaagggaggggga

SEQ ID NO: 2936933 - DNA, 18 bp, Homo sapiens
aaaagggattacccaagc

SEQ ID NO: 2936934 - DNA, 15 bp, Homo sapiens
aaaagggcagccctc

SEQ ID NO: 2936935 - DNA, 18 bp, Homo sapiens
aaaagggcagccctcctt

SEQ ID NO: 2936936 - DNA, 13 bp, Homo sapiens
aaaagggccaggt

SEQ ID NO: 2936937 - DNA, 19 bp, Homo sapiens
aaaagggtcttgggaaata

SEQ ID NO: 2936938 - DNA, 21 bp, Homo sapiens
aaaagggtcttgggaaatatg

SEQ ID NO: 2936939 - DNA, 19 bp, Homo sapiens
aaaaggttgactcaagttt

SEQ ID NO: 2936940 - DNA, 13 bp, Homo sapiens
aaaaggtttacag

SEQ ID NO: 2936941 - DNA, 14 bp, Homo sapiens
aaaaggtttacaga

SEQ ID NO: 2936942 - DNA, 12 bp, Homo sapiens
aaaagtaacttg

SEQ ID NO: 2936943 - DNA, 22 bp, Homo sapiens
aaaagtaagaacagctcatctt

SEQ ID NO: 2936944 - DNA, 23 bp, Homo sapiens
aaaagtaagaacagctcatcttc

SEQ ID NO: 2936945 - DNA, 14 bp, Homo sapiens
aaaagtattatttt

SEQ ID NO: 2936946 - DNA, 20 bp, Homo sapiens
aaaagtattattttccaaaa

SEQ ID NO: 2936947 - DNA, 14 bp, Homo sapiens
aaaagtattttcct

SEQ ID NO: 2936948 - DNA, 16 bp, Homo sapiens
aaaagtggcgttgttc

SEQ ID NO: 2936949 - DNA, 20 bp, Homo sapiens
aaaagtgtattttattcagt

SEQ ID NO: 2936950 - DNA, 18 bp, Homo sapiens
aaaagtgtcaccttttct

SEQ ID NO: 2936951 - DNA, 12 bp, Homo sapiens
aaaagtgttccc

SEQ ID NO: 2936952 - DNA, 16 bp, Homo sapiens
aaaagttaatgcttaa

SEQ ID NO: 2936953 - DNA, 15 bp, Homo sapiens
acagccacacacaca

SEQ ID NO: 2936954 - DNA, 18 bp, Homo sapiens
acagccacacacacagaa

SEQ ID NO: 2936955 - DNA, 21 bp, Homo sapiens
acagccacttttagctactgc

SEQ ID NO: 2936956 - DNA, 13 bp, Homo sapiens
acagcccaggcct

SEQ ID NO: 2936957 - DNA, 13 bp, Homo sapiens
acagccccaccct

SEQ ID NO: 2936958 - DNA, 14 bp, Homo sapiens
acagccccaccctg

SEQ ID NO: 2936959 - DNA, 15 bp, Homo sapiens
acagcccccacccca

SEQ ID NO: 2936960 - DNA, 19 bp, Homo sapiens
acagcccccaccccagcac

SEQ ID NO: 2936961 - DNA, 23 bp, Homo sapiens
acagccccttaagcatgcttcta

SEQ ID NO: 2936962 - DNA, 15 bp, Homo sapiens
acagccgccggaagt

SEQ ID NO: 2936963 - DNA, 17 bp, Homo sapiens
acagcctattcctgaac

SEQ ID NO: 2936964 - DNA, 22 bp, Homo sapiens
acagcctcacttggtctgccag

SEQ ID NO: 2936965 - DNA, 12 bp, Homo sapiens
acagcctccaag

SEQ ID NO: 2936966 - DNA, 15 bp, Homo sapiens
acagcctccaagtca

SEQ ID NO: 2936967 - DNA, 19 bp, Homo sapiens
acagcctcccctgccaggg

SEQ ID NO: 2936968 - DNA, 14 bp, Homo sapiens
acagcctcttactt

SEQ ID NO: 2936969 - DNA, 18 bp, Homo sapiens
acagcctgaataaaccaa

SEQ ID NO: 2936970 - DNA, 22 bp, Homo sapiens
acagcctgaataaaccaagaca

SEQ ID NO: 2936971 - DNA, 12 bp, Homo sapiens
acagcctggctg

SEQ ID NO: 2936972 - DNA, 18 bp, Homo sapiens
acagcctgggccccagct

SEQ ID NO: 2936973 - DNA, 12 bp, Homo sapiens
acagccttcact

SEQ ID NO: 2936974 - DNA, 19 bp, Homo sapiens
acagccttgggcctttcag

SEQ ID NO: 2936975 - DNA, 12 bp, Homo sapiens
acagcggccttg

SEQ ID NO: 2936976 - DNA, 19 bp, Homo sapiens
acagcggctggacttggag

SEQ ID NO: 2936977 - DNA, 13 bp, Homo sapiens
acagcgtgctggc

SEQ ID NO: 2936978 - DNA, 19 bp, Homo sapiens
acagcgtgctggcgacact

SEQ ID NO: 2936979 - DNA, 16 bp, Homo sapiens
acagctacaacagcct

SEQ ID NO: 2936980 - DNA, 14 bp, Homo sapiens
acagctatgaagaa

SEQ ID NO: 2936981 - DNA, 22 bp, Homo sapiens
acagctcactgcagcctcaacc

SEQ ID NO: 2936982 - DNA, 14 bp, Homo sapiens
acagctcccacccc

SEQ ID NO: 2936983 - DNA, 15 bp, Homo sapiens
acagctcccacccca

SEQ ID NO: 2936984 - DNA, 22 bp, Homo sapiens
acagctcccaccccaccccctt

SEQ ID NO: 2936985 - DNA, 12 bp, Homo sapiens
acagctcctccc

SEQ ID NO: 2936986 - DNA, 17 bp, Homo sapiens
acagctgaagagcaagg

SEQ ID NO: 2936987 - DNA, 11 bp, Homo sapiens
acagctgcctt

SEQ ID NO: 2936988 - DNA, 19 bp, Homo sapiens
acagctgccttagcttcag

SEQ ID NO: 2936989 - DNA, 20 bp, Homo sapiens
acagctgccttagcttcagg

SEQ ID NO: 2936990 - DNA, 13 bp, Homo sapiens
acagctgctcaga

SEQ ID NO: 2936991 - DNA, 20 bp, Homo sapiens
acagctgctcctagagggag

SEQ ID NO: 2936992 - DNA, 12 bp, Homo sapiens
acagctgttcct

SEQ ID NO: 2936993 - DNA, 23 bp, Homo sapiens
acagctgttcctgtgttcttcgt

SEQ ID NO: 2936994 - DNA, 20 bp, Homo sapiens
acagcttcccctctctcctc

SEQ ID NO: 2936995 - DNA, 16 bp, Homo sapiens
acagcttgccagggat

SEQ ID NO: 2936996 - DNA, 12 bp, Homo sapiens
acagctttctga

SEQ ID NO: 2936997 - DNA, 17 bp, Homo sapiens
acagctttctgaccttc

SEQ ID NO: 2936998 - DNA, 17 bp, Homo sapiens
acagcttttcccaggag

SEQ ID NO: 2936999 - DNA, 18 bp, Homo sapiens
acagcttttcccaggaga

SEQ ID NO: 2937000 - DNA, 23 bp, Homo sapiens
acagcttttttagaggtgagttt

SEQ ID NO: 2937001 - DNA, 16 bp, Homo sapiens
acaggaaaatgtatcc

SEQ ID NO: 2937002 - DNA, 22 bp, Homo sapiens
acaggaaaatgtatccagagga

SEQ ID NO: 2937003 - DNA, 16 bp, Homo sapiens
acaggaacggccctgc

SEQ ID NO: 2937004 - DNA, 17 bp, Homo sapiens
acaggaacggccctgca

SEQ ID NO: 2937005 - DNA, 21 bp, Homo sapiens
acaggaacggccctgcaggag

SEQ ID NO: 2937006 - DNA, 16 bp, Homo sapiens
acaggaagcctcaagt

SEQ ID NO: 2937007 - DNA, 23 bp, Homo sapiens
acaggaaggtctgatttgcagga

SEQ ID NO: 2937008 - DNA, 22 bp, Homo sapiens
acaggacatgcggtagccagca

SEQ ID NO: 2937009 - DNA, 15 bp, Homo sapiens
acaggacgaatgcat

SEQ ID NO: 2937010 - DNA, 18 bp, Homo sapiens
acaggagcaatcacagga

SEQ ID NO: 2937011 - DNA, 19 bp, Homo sapiens
acaggagcaatcacaggaa

SEQ ID NO: 2937012 - DNA, 13 bp, Homo sapiens
acaggagccctgc

SEQ ID NO: 2937013 - DNA, 14 bp, Homo sapiens
acaggagccctgct

SEQ ID NO: 2937014 - DNA, 14 bp, Homo sapiens
acaggagctgggat

SEQ ID NO: 2937015 - DNA, 21 bp, Homo sapiens
acaggaggcaggcatggccct

SEQ ID NO: 2937016 - DNA, 15 bp, Homo sapiens
acaggatgaggacag

SEQ ID NO: 2937017 - DNA, 16 bp, Homo sapiens
acaggatgaggacaga

SEQ ID NO: 2937018 - DNA, 16 bp, Homo sapiens
acaggatgtgtttgct

SEQ ID NO: 2937019 - DNA, 18 bp, Homo sapiens
acaggatgtgtttgcttt

SEQ ID NO: 2937020 - DNA, 18 bp, Homo sapiens
acaggcacattaactgtt

SEQ ID NO: 2937021 - DNA, 16 bp, Homo sapiens
acaggcaggggtgaga

SEQ ID NO: 2937022 - DNA, 21 bp, Homo sapiens
acaggcggggcccagcgctct

SEQ ID NO: 2937023 - DNA, 22 bp, Homo sapiens
acaggcgtgagccactgttccc

SEQ ID NO: 2937024 - DNA, 17 bp, Homo sapiens
acaggcgtgggatcaga

SEQ ID NO: 2937025 - DNA, 13 bp, Homo sapiens
acagggaagctac

SEQ ID NO: 2937026 - DNA, 18 bp, Homo sapiens
acagggaagctacaggtt

SEQ ID NO: 2937027 - DNA, 23 bp, Homo sapiens
acagggaagctacaggttacaac

SEQ ID NO: 2937028 - DNA, 15 bp, Homo sapiens
acagggacaaagaaa

SEQ ID NO: 2937029 - DNA, 20 bp, Homo sapiens
acagggacatgccctgtgtg

SEQ ID NO: 2937030 - DNA, 12 bp, Homo sapiens
acagggagggga

SEQ ID NO: 2937031 - DNA, 17 bp, Homo sapiens
acagggatggcgaggcc

SEQ ID NO: 2937032 - DNA, 21 bp, Homo sapiens
acagggatggcgaggcctctc

SEQ ID NO: 2937033 - DNA, 23 bp, Homo sapiens
acagggcaaaatcgccataggcc

SEQ ID NO: 2937034 - DNA, 15 bp, Homo sapiens
acaggggcaggagga

SEQ ID NO: 2937035 - DNA, 20 bp, Homo sapiens
acaggggggtcggaagcctg

SEQ ID NO: 2937036 - DNA, 9 bp, Homo sapiens
acagggtgc

SEQ ID NO: 2937037 - DNA, 16 bp, Homo sapiens
acagggtggcccaggt

SEQ ID NO: 2937038 - DNA, 14 bp, Homo sapiens
acaggtacttggag

SEQ ID NO: 2937039 - DNA, 23 bp, Homo sapiens
acaggtcaatacagtacaggcag

SEQ ID NO: 2937040 - DNA, 22 bp, Homo sapiens
acaggtcaggggtgacacagac

SEQ ID NO: 2937041 - DNA, 13 bp, Homo sapiens
acaggtccctccc

SEQ ID NO: 2937042 - DNA, 16 bp, Homo sapiens
acaggtcttcatcgaa

SEQ ID NO: 2937043 - DNA, 21 bp, Homo sapiens
acaggtctttcctaaggctgc

SEQ ID NO: 2937044 - DNA, 17 bp, Homo sapiens
acaggtgcgggaccatc

SEQ ID NO: 2937045 - DNA, 18 bp, Homo sapiens
acaggtgctggcccagca

SEQ ID NO: 2937046 - DNA, 13 bp, Homo sapiens
acaggtggctgtt

SEQ ID NO: 2937047 - DNA, 23 bp, Homo sapiens
acaggtggctgtttcttgtctgt

SEQ ID NO: 2937048 - DNA, 23 bp, Homo sapiens
acaggtgggatatgctagaaaag

SEQ ID NO: 2937049 - DNA, 17 bp, Homo sapiens
acaggtggtgtcactgt

SEQ ID NO: 2937050 - DNA, 13 bp, Homo sapiens
acaggtgtgcacc

SEQ ID NO: 2937051 - DNA, 14 bp, Homo sapiens
acaggtgtttatac

SEQ ID NO: 2937052 - DNA, 19 bp, Homo sapiens
acaggttacaacagatttg

SEQ ID NO: 2937053 - DNA, 21 bp, Homo sapiens
acaggttacaacagatttgtg

SEQ ID NO: 2937054 - DNA, 21 bp, Homo sapiens
acaggttactaccctcaccct

SEQ ID NO: 2937055 - DNA, 21 bp, Homo sapiens
acaggttattttagtttctgt

SEQ ID NO: 2937056 - DNA, 23 bp, Homo sapiens
acaggttattttagtttctgttc

SEQ ID NO: 2937057 - DNA, 21 bp, Homo sapiens
acaggttttccaaaagtaaag

SEQ ID NO: 2937058 - DNA, 18 bp, Homo sapiens
acagtaactttatgtgta

SEQ ID NO: 2937059 - DNA, 19 bp, Homo sapiens
acagtaactttatgtgtaa

SEQ ID NO: 2937060 - DNA, 12 bp, Homo sapiens
acagtacaggca

SEQ ID NO: 2937061 - DNA, 13 bp, Homo sapiens
acagtacctgtgc

SEQ ID NO: 2937062 - DNA, 14 bp, Homo sapiens
acagtaggagccca

SEQ ID NO: 2937063 - DNA, 14 bp, Homo sapiens
acagtagtcttgat

SEQ ID NO: 2937064 - DNA, 14 bp, Homo sapiens
acagtatattcttg

SEQ ID NO: 2937065 - DNA, 20 bp, Homo sapiens
acagtatgatggaacagtga

SEQ ID NO: 2937066 - DNA, 12 bp, Homo sapiens
acagtattctgt

SEQ ID NO: 2937067 - DNA, 15 bp, Homo sapiens
acagtcaacaagcct

SEQ ID NO: 2937068 - DNA, 18 bp, Homo sapiens
acagtcattatttaaagc

SEQ ID NO: 2937069 - DNA, 19 bp, Homo sapiens
acagtccacagctgaagag

SEQ ID NO: 2937070 - DNA, 21 bp, Homo sapiens
acagtccacagctgaagagca

SEQ ID NO: 2937071 - DNA, 16 bp, Homo sapiens
acagtcggaaaagcgt

SEQ ID NO: 2937072 - DNA, 19 bp, Homo sapiens
acagtcggtgaccccatca

SEQ ID NO: 2937073 - DNA, 14 bp, Homo sapiens
acagtctagtgcaa

SEQ ID NO: 2937074 - DNA, 14 bp, Homo sapiens
acagtctcaatttt

SEQ ID NO: 2937075 - DNA, 22 bp, Homo sapiens
acagtctgatcgtgacgctgaa

SEQ ID NO: 2937076 - DNA, 15 bp, Homo sapiens
acagtctgtcttctg

SEQ ID NO: 2937077 - DNA, 15 bp, Homo sapiens
acagtgaaagtcaat

SEQ ID NO: 2937078 - DNA, 19 bp, Homo sapiens
acagtgaagacagaagttt

SEQ ID NO: 2937079 - DNA, 21 bp, Homo sapiens
acagtgaagacagaagtttgc

SEQ ID NO: 2937080 - DNA, 14 bp, Homo sapiens
acagtgcacatgaa

SEQ ID NO: 2937081 - DNA, 15 bp, Homo sapiens
acagtgccctgagac

SEQ ID NO: 2937082 - DNA, 14 bp, Homo sapiens
acagtgctaaaaat

SEQ ID NO: 2937083 - DNA, 15 bp, Homo sapiens
acagtgctctgcctc

SEQ ID NO: 2937084 - DNA, 12 bp, Homo sapiens
acagtggccttg

SEQ ID NO: 2937085 - DNA, 21 bp, Homo sapiens
acagtggtggcaacattcatt

SEQ ID NO: 2937086 - DNA, 23 bp, Homo sapiens
acagtggtggcaacattcattgc

SEQ ID NO: 2937087 - DNA, 23 bp, Homo sapiens
acagtggtggcagggcctagctg

SEQ ID NO: 2937088 - DNA, 16 bp, Homo sapiens
acagtgtacatgtaca

SEQ ID NO: 2937089 - DNA, 12 bp, Homo sapiens
acagtgtatgta

SEQ ID NO: 2937090 - DNA, 14 bp, Homo sapiens
aatttggctgcttc

SEQ ID NO: 2937091 - DNA, 17 bp, Homo sapiens
aatttgggaccctgctt

SEQ ID NO: 2937092 - DNA, 21 bp, Homo sapiens
aatttgggaccctgctttaga

SEQ ID NO: 2937093 - DNA, 20 bp, Homo sapiens
aatttgggcttcctgtttgt

SEQ ID NO: 2937094 - DNA, 19 bp, Homo sapiens
aatttgggggacatgctaa

SEQ ID NO: 2937095 - DNA, 23 bp, Homo sapiens
aatttgggtttgttggtcacatg

SEQ ID NO: 2937096 - DNA, 19 bp, Homo sapiens
aatttggtttttactcaac

SEQ ID NO: 2937097 - DNA, 24 bp, Homo sapiens
aatttgtaaaaacagcattgcttt

SEQ ID NO: 2937098 - DNA, 16 bp, Homo sapiens
aatttgtaattttagt

SEQ ID NO: 2937099 - DNA, 21 bp, Homo sapiens
aatttgtactattagcaagaa

SEQ ID NO: 2937100 - DNA, 14 bp, Homo sapiens
aatttgtatatgac

SEQ ID NO: 2937101 - DNA, 21 bp, Homo sapiens
aatttgtatatgactgcattt

SEQ ID NO: 2937102 - DNA, 10 bp, Homo sapiens
aatttgtcag

SEQ ID NO: 2937103 - DNA, 13 bp, Homo sapiens
aatttgtctccta

SEQ ID NO: 2937104 - DNA, 18 bp, Homo sapiens
aatttgtctttttgtata

SEQ ID NO: 2937105 - DNA, 18 bp, Homo sapiens
aatttgttaattaaatat

SEQ ID NO: 2937106 - DNA, 21 bp, Homo sapiens
aatttgttggagatgcagcct

SEQ ID NO: 2937107 - DNA, 18 bp, Homo sapiens
aatttgttgtcatgtgta

SEQ ID NO: 2937108 - DNA, 19 bp, Homo sapiens
aatttgttgtcatgtgtat

SEQ ID NO: 2937109 - DNA, 21 bp, Homo sapiens
aatttgttgtcatgtgtatga

SEQ ID NO: 2937110 - DNA, 17 bp, Homo sapiens
aattttaaaaatgaatc

SEQ ID NO: 2937111 - DNA, 14 bp, Homo sapiens
aattttaaaaatgg

SEQ ID NO: 2937112 - DNA, 22 bp, Homo sapiens
aattttaacttttaaggttgaa

SEQ ID NO: 2937113 - DNA, 13 bp, Homo sapiens
aattttaatgtga

SEQ ID NO: 2937114 - DNA, 14 bp, Homo sapiens
aattttaatgtgaa

SEQ ID NO: 2937115 - DNA, 16 bp, Homo sapiens
aattttaatgtgaaga

SEQ ID NO: 2937116 - DNA, 12 bp, Homo sapiens
aattttaattta

SEQ ID NO: 2937117 - DNA, 16 bp, Homo sapiens
aattttagagaaactt

SEQ ID NO: 2937118 - DNA, 22 bp, Homo sapiens
aattttagtattaactctgtaa

SEQ ID NO: 2937119 - DNA, 19 bp, Homo sapiens
aattttatctgtttcctga

SEQ ID NO: 2937120 - DNA, 15 bp, Homo sapiens
aattttcaagtaatt

SEQ ID NO: 2937121 - DNA, 17 bp, Homo sapiens
aattttcagaccccagc

SEQ ID NO: 2937122 - DNA, 21 bp, Homo sapiens
aattttcattaaacttgaagc

SEQ ID NO: 2937123 - DNA, 16 bp, Homo sapiens
aattttcctttgtcat

SEQ ID NO: 2937124 - DNA, 14 bp, Homo sapiens
aattttctccagtc

SEQ ID NO: 2937125 - DNA, 13 bp, Homo sapiens
aattttctgttca

SEQ ID NO: 2937126 - DNA, 21 bp, Homo sapiens
aattttctttttaataaaaag

SEQ ID NO: 2937127 - DNA, 14 bp, Homo sapiens
aattttctttttgt

SEQ ID NO: 2937128 - DNA, 17 bp, Homo sapiens
aattttgaggtctttta

SEQ ID NO: 2937129 - DNA, 12 bp, Homo sapiens
aattttgcaatg

SEQ ID NO: 2937130 - DNA, 20 bp, Homo sapiens
aattttgctggaattcctaa

SEQ ID NO: 2937131 - DNA, 22 bp, Homo sapiens
aattttgctggaattcctaact

SEQ ID NO: 2937132 - DNA, 16 bp, Homo sapiens
aattttggtttttcaa

SEQ ID NO: 2937133 - DNA, 18 bp, Homo sapiens
aattttgtatccatttaa

SEQ ID NO: 2937134 - DNA, 17 bp, Homo sapiens
aattttgtatttaatga

SEQ ID NO: 2937135 - DNA, 14 bp, Homo sapiens
aattttgtattttc

SEQ ID NO: 2937136 - DNA, 21 bp, Homo sapiens
aattttgtattttccaagtgt

SEQ ID NO: 2937137 - DNA, 14 bp, Homo sapiens
aattttgtttttat

SEQ ID NO: 2937138 - DNA, 17 bp, Homo sapiens
aatttttaaaaagattt

SEQ ID NO: 2937139 - DNA, 15 bp, Homo sapiens
aatttttaaaagact

SEQ ID NO: 2937140 - DNA, 15 bp, Homo sapiens
aatttttcagatgct

SEQ ID NO: 2937141 - DNA, 16 bp, Homo sapiens
aatttttctctttaaa

SEQ ID NO: 2937142 - DNA, 14 bp, Homo sapiens
aatttttgcaataa

SEQ ID NO: 2937143 - DNA, 18 bp, Homo sapiens
aatttttgcaataatgca

SEQ ID NO: 2937144 - DNA, 14 bp, Homo sapiens
aatttttgtaaatc

SEQ ID NO: 2937145 - DNA, 14 bp, Homo sapiens
aatttttgtaattt

SEQ ID NO: 2937146 - DNA, 15 bp, Homo sapiens
aattttttggtacaa

SEQ ID NO: 2937147 - DNA, 20 bp, Homo sapiens
aattttttgttcttcagaga

SEQ ID NO: 2937148 - DNA, 17 bp, Homo sapiens
aatttttttaaggaaaa

SEQ ID NO: 2937149 - DNA, 19 bp, Homo sapiens
aatttttttaatttacaaa

SEQ ID NO: 2937150 - DNA, 18 bp, Homo sapiens
aatttttttaattttgta

SEQ ID NO: 2937151 - DNA, 20 bp, Homo sapiens
aatttttttaattttgtatt

SEQ ID NO: 2937152 - DNA, 21 bp, Homo sapiens
aatttttttcatcttctctgg

SEQ ID NO: 2937153 - DNA, 23 bp, Homo sapiens
aattttttttcatgttttaacaa

SEQ ID NO: 2937154 - DNA, 22 bp, Homo sapiens
aattttttttgttgtttcagtg

SEQ ID NO: 2937155 - DNA, 23 bp, Homo sapiens
aattttttttgttgtttcagtga

SEQ ID NO: 2937156 - DNA, 16 bp, Homo sapiens
acaaaaaaaacaacaa

SEQ ID NO: 2937157 - DNA, 11 bp, Homo sapiens
acaaaaaagtg

SEQ ID NO: 2937158 - DNA, 16 bp, Homo sapiens
acaaaaagtaaagtaa

SEQ ID NO: 2937159 - DNA, 10 bp, Homo sapiens
acaaaaataa

SEQ ID NO: 2937160 - DNA, 15 bp, Homo sapiens
acaaaaatcagccag

SEQ ID NO: 2937161 - DNA, 14 bp, Homo sapiens
acaaaaattgtctt

SEQ ID NO: 2937162 - DNA, 23 bp, Homo sapiens
acaaaactacatgagaacaaaca

SEQ ID NO: 2937163 - DNA, 18 bp, Homo sapiens
acaaaagaaaaaatatta

SEQ ID NO: 2937164 - DNA, 18 bp, Homo sapiens
acaaaagcagccctctgc

SEQ ID NO: 2937165 - DNA, 18 bp, Homo sapiens
acaaaaggataatgaata

SEQ ID NO: 2937166 - DNA, 19 bp, Homo sapiens
acaaaaggctccatatata

SEQ ID NO: 2937167 - DNA, 15 bp, Homo sapiens
acaaaagtgacagat

SEQ ID NO: 2937168 - DNA, 16 bp, Homo sapiens
acaaaatggcttcagt

SEQ ID NO: 2937169 - DNA, 15 bp, Homo sapiens
acaaacaaaaaatta

SEQ ID NO: 2937170 - DNA, 15 bp, Homo sapiens
acaaacaaaactctt

SEQ ID NO: 2937171 - DNA, 23 bp, Homo sapiens
acaaacactacagacaataaata

SEQ ID NO: 2937172 - DNA, 12 bp, Homo sapiens
acaaacagtgaa

SEQ ID NO: 2937173 - DNA, 13 bp, Homo sapiens
acaaacagtgaat

SEQ ID NO: 2937174 - DNA, 14 bp, Homo sapiens
acaaacatgaccct

SEQ ID NO: 2937175 - DNA, 17 bp, Homo sapiens
acaaaccaacatctttg

SEQ ID NO: 2937176 - DNA, 22 bp, Homo sapiens
acaaaccaacatctttgcgaaa

SEQ ID NO: 2937177 - DNA, 16 bp, Homo sapiens
acaaactgtaatacaa

SEQ ID NO: 2937178 - DNA, 17 bp, Homo sapiens
acaaactgtaatacaat

SEQ ID NO: 2937179 - DNA, 19 bp, Homo sapiens
acaaactgtaatacaatga

SEQ ID NO: 2937180 - DNA, 13 bp, Homo sapiens
acaaacttttata

SEQ ID NO: 2937181 - DNA, 23 bp, Homo sapiens
acaaagaaaggtgccatgtcttt

SEQ ID NO: 2937182 - DNA, 20 bp, Homo sapiens
acaaagaaccatgcaggaag

SEQ ID NO: 2937183 - DNA, 18 bp, Homo sapiens
acaaagaagacaacatta

SEQ ID NO: 2937184 - DNA, 16 bp, Homo sapiens
acaaagaagacatgtt

SEQ ID NO: 2937185 - DNA, 19 bp, Homo sapiens
acaaagaagacatgtttta

SEQ ID NO: 2937186 - DNA, 19 bp, Homo sapiens
acaaagacaaattctgttt

SEQ ID NO: 2937187 - DNA, 12 bp, Homo sapiens
acaaagacagcc

SEQ ID NO: 2937188 - DNA, 13 bp, Homo sapiens
acaaagagtgaaa

SEQ ID NO: 2937189 - DNA, 14 bp, Homo sapiens
acaaagatatcttt

SEQ ID NO: 2937190 - DNA, 17 bp, Homo sapiens
acaaagatatcttttct

SEQ ID NO: 2937191 - DNA, 21 bp, Homo sapiens
acaaagatatcttttctttag

SEQ ID NO: 2937192 - DNA, 13 bp, Homo sapiens
acaaagcaaaggc

SEQ ID NO: 2937193 - DNA, 19 bp, Homo sapiens
acaaagcacagtttgaaca

SEQ ID NO: 2937194 - DNA, 13 bp, Homo sapiens
acaaagcaggagt

SEQ ID NO: 2937195 - DNA, 15 bp, Homo sapiens
acaaagcaggagtgg

SEQ ID NO: 2937196 - DNA, 11 bp, Homo sapiens
acaaagcccaa

SEQ ID NO: 2937197 - DNA, 20 bp, Homo sapiens
acaaagcccaagggatctgg

SEQ ID NO: 2937198 - DNA, 15 bp, Homo sapiens
acaaagctcaaaaca

SEQ ID NO: 2937199 - DNA, 23 bp, Homo sapiens
acaaaggaggacaagaccctctc

SEQ ID NO: 2937200 - DNA, 18 bp, Homo sapiens
acaaaggatttgatgctt

SEQ ID NO: 2937201 - DNA, 17 bp, Homo sapiens
acaaagggttttaatgt

SEQ ID NO: 2937202 - DNA, 19 bp, Homo sapiens
acacggctggtcactctgc

SEQ ID NO: 2937203 - DNA, 21 bp, Homo sapiens
acacggctggtcactctgccc

SEQ ID NO: 2937204 - DNA, 17 bp, Homo sapiens
acacgtgacacaaacac

SEQ ID NO: 2937205 - DNA, 22 bp, Homo sapiens
acacgtttaatcccagcacttt

SEQ ID NO: 2937206 - DNA, 18 bp, Homo sapiens
acactacaagtttataag

SEQ ID NO: 2937207 - DNA, 14 bp, Homo sapiens
acactacaccacac

SEQ ID NO: 2937208 - DNA, 16 bp, Homo sapiens
acactacaccacacac

SEQ ID NO: 2937209 - DNA, 16 bp, Homo sapiens
acactagacaagccag

SEQ ID NO: 2937210 - DNA, 19 bp, Homo sapiens
acactatgcactgctgtaa

SEQ ID NO: 2937211 - DNA, 13 bp, Homo sapiens
acactatgtgtgt

SEQ ID NO: 2937212 - DNA, 15 bp, Homo sapiens
acactatttgtgact

SEQ ID NO: 2937213 - DNA, 21 bp, Homo sapiens
acactatttgtgactttttaa

SEQ ID NO: 2937214 - DNA, 16 bp, Homo sapiens
acactcagcacaaggc

SEQ ID NO: 2937215 - DNA, 16 bp, Homo sapiens
acactcagggcagctg

SEQ ID NO: 2937216 - DNA, 20 bp, Homo sapiens
acactcagggcagctgcctg

SEQ ID NO: 2937217 - DNA, 18 bp, Homo sapiens
acactcattgaaatgtaa

SEQ ID NO: 2937218 - DNA, 16 bp, Homo sapiens
acactccatcagctta

SEQ ID NO: 2937219 - DNA, 16 bp, Homo sapiens
acactcccacccagtc

SEQ ID NO: 2937220 - DNA, 22 bp, Homo sapiens
acactcttctatgacccagcat

SEQ ID NO: 2937221 - DNA, 18 bp, Homo sapiens
acactgaagtgcttgcag

SEQ ID NO: 2937222 - DNA, 18 bp, Homo sapiens
acactgatctgaacatct

SEQ ID NO: 2937223 - DNA, 19 bp, Homo sapiens
acactgatctgaacatctg

SEQ ID NO: 2937224 - DNA, 14 bp, Homo sapiens
acactgatgcaagg

SEQ ID NO: 2937225 - DNA, 15 bp, Homo sapiens
acactgatgcaagga

SEQ ID NO: 2937226 - DNA, 18 bp, Homo sapiens
acactgcaagagccttgg

SEQ ID NO: 2937227 - DNA, 12 bp, Homo sapiens
acactgcctggg

SEQ ID NO: 2937228 - DNA, 13 bp, Homo sapiens
acactgcctgggc

SEQ ID NO: 2937229 - DNA, 14 bp, Homo sapiens
acactgcctgggct

SEQ ID NO: 2937230 - DNA, 20 bp, Homo sapiens
acactgcctttttatttata

SEQ ID NO: 2937231 - DNA, 15 bp, Homo sapiens
acactgcgccccgcc

SEQ ID NO: 2937232 - DNA, 23 bp, Homo sapiens
acactgcgccccgcctgacctgg

SEQ ID NO: 2937233 - DNA, 18 bp, Homo sapiens
acactggaggagagaaga

SEQ ID NO: 2937234 - DNA, 15 bp, Homo sapiens
acactggcagactgt

SEQ ID NO: 2937235 - DNA, 14 bp, Homo sapiens
acactgggaggcca

SEQ ID NO: 2937236 - DNA, 20 bp, Homo sapiens
acactgggtggtggcctggt

SEQ ID NO: 2937237 - DNA, 14 bp, Homo sapiens
acactggtgtatct

SEQ ID NO: 2937238 - DNA, 18 bp, Homo sapiens
aatttctttgcctgttca

SEQ ID NO: 2937239 - DNA, 18 bp, Homo sapiens
aatttgaaaataattgtt

SEQ ID NO: 2937240 - DNA, 16 bp, Homo sapiens
aatttgaactttggaa

SEQ ID NO: 2937241 - DNA, 13 bp, Homo sapiens
aatttgagtgctc

SEQ ID NO: 2937242 - DNA, 15 bp, Homo sapiens
aatttgagtttgctg

SEQ ID NO: 2937243 - DNA, 20 bp, Homo sapiens
aatttgatacatatgtgaat

SEQ ID NO: 2937244 - DNA, 16 bp, Homo sapiens
aatttgatagatgttt

SEQ ID NO: 2937245 - DNA, 18 bp, Homo sapiens
aatttgatagatgtttga

SEQ ID NO: 2937246 - DNA, 23 bp, Homo sapiens
aatttgatagatgtttgacttta

SEQ ID NO: 2937247 - DNA, 18 bp, Homo sapiens
aatttgatcgttccagtt

SEQ ID NO: 2937248 - DNA, 15 bp, Homo sapiens
aatttgattgatttg

SEQ ID NO: 2937249 - DNA, 14 bp, Homo sapiens
aatttgccattggt

SEQ ID NO: 2937250 - DNA, 22 bp, Homo sapiens
aatttgcctgtaacaagccaga

SEQ ID NO: 2937251 - DNA, 23 bp, Homo sapiens
aatttggataataaaaattgtag

SEQ ID NO: 2937252 - DNA, 14 bp, Homo sapiens
aatttggatctatt

SEQ ID NO: 2937253 - DNA, 17 bp, Homo sapiens
aatttggatctatttat

SEQ ID NO: 2937254 - DNA, 22 bp, Homo sapiens
aatttggatttacgactgaaga

SEQ ID NO: 2937255 - DNA, 23 bp, Homo sapiens
aatttggatttacgactgaagaa

SEQ ID NO: 2937256 - DNA, 14 bp, Homo sapiens
aatttggcattgat

SEQ ID NO: 2937257 - DNA, 11 bp, Homo sapiens
aaagtgtaaag

SEQ ID NO: 2937258 - DNA, 16 bp, Homo sapiens
aaagtgtaaagcattc

SEQ ID NO: 2937259 - DNA, 20 bp, Homo sapiens
aaagtgtcaccttttcttgc

SEQ ID NO: 2937260 - DNA, 21 bp, Homo sapiens
aaagtgtcaccttttcttgcc

SEQ ID NO: 2937261 - DNA, 22 bp, Homo sapiens
aaagtgtctgtaggtacgtttt

SEQ ID NO: 2937262 - DNA, 17 bp, Homo sapiens
aaagtgtcttttgacat

SEQ ID NO: 2937263 - DNA, 22 bp, Homo sapiens
aaagtgtcttttgacattttat

SEQ ID NO: 2937264 - DNA, 14 bp, Homo sapiens
aaagtgttcaaatt

SEQ ID NO: 2937265 - DNA, 15 bp, Homo sapiens
aaagtgttttgtacc

SEQ ID NO: 2937266 - DNA, 12 bp, Homo sapiens
aaagttaaatgt

SEQ ID NO: 2937267 - DNA, 16 bp, Homo sapiens
aaagttaacagatttt

SEQ ID NO: 2937268 - DNA, 17 bp, Homo sapiens
aaagttactgcaactta

SEQ ID NO: 2937269 - DNA, 18 bp, Homo sapiens
aaagttaggttataagaa

SEQ ID NO: 2937270 - DNA, 23 bp, Homo sapiens
aaagttagtctactcttaagcca

SEQ ID NO: 2937271 - DNA, 16 bp, Homo sapiens
aaagttatataggttt

SEQ ID NO: 2937272 - DNA, 22 bp, Homo sapiens
aaagttatttatgctataaatt

SEQ ID NO: 2937273 - DNA, 20 bp, Homo sapiens
aaagttcagagttttctggg

SEQ ID NO: 2937274 - DNA, 18 bp, Homo sapiens
aaagttcctctcccttcc

SEQ ID NO: 2937275 - DNA, 19 bp, Homo sapiens
aaagttctaataatttcta

SEQ ID NO: 2937276 - DNA, 22 bp, Homo sapiens
aaagttctgctttctccccaat

SEQ ID NO: 2937277 - DNA, 19 bp, Homo sapiens
aaagttggggcccagtcct

SEQ ID NO: 2937278 - DNA, 19 bp, Homo sapiens
aaagttgttttacagctgt

SEQ ID NO: 2937279 - DNA, 12 bp, Homo sapiens
aaagtttctcag

SEQ ID NO: 2937280 - DNA, 13 bp, Homo sapiens
aaagtttctcaga

SEQ ID NO: 2937281 - DNA, 17 bp, Homo sapiens
aaagtttctcagatcct

SEQ ID NO: 2937282 - DNA, 15 bp, Homo sapiens
aaagtttgccagaag

SEQ ID NO: 2937283 - DNA, 17 bp, Homo sapiens
aaagtttgttactttga

SEQ ID NO: 2937284 - DNA, 23 bp, Homo sapiens
aaagtttgttactttgaatagtc

SEQ ID NO: 2937285 - DNA, 19 bp, Homo sapiens
aaagttttattataaattc

SEQ ID NO: 2937286 - DNA, 18 bp, Homo sapiens
aaagtttttttatttctt

SEQ ID NO: 2937287 - DNA, 10 bp, Homo sapiens
aaataaaaag

SEQ ID NO: 2937288 - DNA, 13 bp, Homo sapiens
aaataaaaagaaa

SEQ ID NO: 2937289 - DNA, 12 bp, Homo sapiens
aaataaaaagtt

SEQ ID NO: 2937290 - DNA, 15 bp, Homo sapiens
aaataaaaagttaaa

SEQ ID NO: 2937291 - DNA, 13 bp, Homo sapiens
aaataaaacaaag

SEQ ID NO: 2937292 - DNA, 20 bp, Homo sapiens
aaataaaacaaagggcacag

SEQ ID NO: 2937293 - DNA, 17 bp, Homo sapiens
aaataaaaggaagccaa

SEQ ID NO: 2937294 - DNA, 17 bp, Homo sapiens
aaataaaagttttacaa

SEQ ID NO: 2937295 - DNA, 19 bp, Homo sapiens
aaataaaatttgttgcata

SEQ ID NO: 2937296 - DNA, 19 bp, Homo sapiens
aaataaaccattggacaga

SEQ ID NO: 2937297 - DNA, 11 bp, Homo sapiens
aaataaactag

SEQ ID NO: 2937298 - DNA, 21 bp, Homo sapiens
aaataaactagggttttggcc

SEQ ID NO: 2937299 - DNA, 23 bp, Homo sapiens
aaataaagagaactccagtgttg

SEQ ID NO: 2937300 - DNA, 17 bp, Homo sapiens
aatgcatattcaacaca

SEQ ID NO: 2937301 - DNA, 17 bp, Homo sapiens
aatgcatcacatgatga

SEQ ID NO: 2937302 - DNA, 12 bp, Homo sapiens
aatgcattcatg

SEQ ID NO: 2937303 - DNA, 14 bp, Homo sapiens
aatgcattcatgtt

SEQ ID NO: 2937304 - DNA, 19 bp, Homo sapiens
aatgcattgatattgtgaa

SEQ ID NO: 2937305 - DNA, 22 bp, Homo sapiens
aatgcattttctgggtgaaaga

SEQ ID NO: 2937306 - DNA, 14 bp, Homo sapiens
aatgccaagcactt

SEQ ID NO: 2937307 - DNA, 13 bp, Homo sapiens
aatgccagtgtgc

SEQ ID NO: 2937308 - DNA, 14 bp, Homo sapiens
aatgccataataca

SEQ ID NO: 2937309 - DNA, 15 bp, Homo sapiens
aatgccatcatctcc

SEQ ID NO: 2937310 - DNA, 20 bp, Homo sapiens
aatgccatttatttattgat

SEQ ID NO: 2937311 - DNA, 13 bp, Homo sapiens
aatgcccaaggat

SEQ ID NO: 2937312 - DNA, 17 bp, Homo sapiens
aatgcccccagctggcc

SEQ ID NO: 2937313 - DNA, 15 bp, Homo sapiens
aatgcccctgttcat

SEQ ID NO: 2937314 - DNA, 14 bp, Homo sapiens
aatgcgattttatt

SEQ ID NO: 2937315 - DNA, 20 bp, Homo sapiens
aatgcggccgcattccctga

SEQ ID NO: 2937316 - DNA, 14 bp, Homo sapiens
aatgctaatattaa

SEQ ID NO: 2937317 - DNA, 16 bp, Homo sapiens
aatgctacgtgtgatt

SEQ ID NO: 2937318 - DNA, 18 bp, Homo sapiens
aatgctattatactgtta

SEQ ID NO: 2937319 - DNA, 16 bp, Homo sapiens
aatgctatttgaacaa

SEQ ID NO: 2937320 - DNA, 18 bp, Homo sapiens
aatgctcaatttcagcac

SEQ ID NO: 2937321 - DNA, 15 bp, Homo sapiens
aatgctcagaccagc

SEQ ID NO: 2937322 - DNA, 11 bp, Homo sapiens
aatgctctagt

SEQ ID NO: 2937323 - DNA, 12 bp, Homo sapiens
aatgctgtacat

SEQ ID NO: 2937324 - DNA, 14 bp, Homo sapiens
aatgctgtctttgt

SEQ ID NO: 2937325 - DNA, 20 bp, Homo sapiens
aatgctgtctttgtggactg

SEQ ID NO: 2937326 - DNA, 22 bp, Homo sapiens
aatgctgtgcaaacagtgtaag

SEQ ID NO: 2937327 - DNA, 18 bp, Homo sapiens
aatgctgttcgttcaaaa

SEQ ID NO: 2937328 - DNA, 23 bp, Homo sapiens
aatgctgttcgttcaaaagtgga

SEQ ID NO: 2937329 - DNA, 22 bp, Homo sapiens
aatgcttaataataattgaaga

SEQ ID NO: 2937330 - DNA, 23 bp, Homo sapiens
aatgcttaataataattgaagaa

SEQ ID NO: 2937331 - DNA, 21 bp, Homo sapiens
aatgcttcgttttctaaagga

SEQ ID NO: 2937332 - DNA, 14 bp, Homo sapiens
aatgcttctgattt

SEQ ID NO: 2937333 - DNA, 12 bp, Homo sapiens
aatgctttgata

SEQ ID NO: 2937334 - DNA, 20 bp, Homo sapiens
aatgctttttatttctgcat

SEQ ID NO: 2937335 - DNA, 20 bp, Homo sapiens
aatggaaaaaaaaaaaagag

SEQ ID NO: 2937336 - DNA, 21 bp, Homo sapiens
aatggaaaaaaaaaaaagagg

SEQ ID NO: 2937337 - DNA, 16 bp, Homo sapiens
aatggaaaaaaacata

SEQ ID NO: 2937338 - DNA, 15 bp, Homo sapiens
aatggaaaagagaga

SEQ ID NO: 2937339 - DNA, 14 bp, Homo sapiens
aatggaaaatgtat

SEQ ID NO: 2937340 - DNA, 13 bp, Homo sapiens
aatggaataataa

SEQ ID NO: 2937341 - DNA, 14 bp, Homo sapiens
aatggatagctcat

SEQ ID NO: 2937342 - DNA, 22 bp, Homo sapiens
aatggatatttgtactgtttaa

SEQ ID NO: 2937343 - DNA, 21 bp, Homo sapiens
aatggatttgatgctgtttga

SEQ ID NO: 2937344 - DNA, 20 bp, Homo sapiens
aatggcatccagggctgcca

SEQ ID NO: 2937345 - DNA, 16 bp, Homo sapiens
aatggccggctggaaa

SEQ ID NO: 2937346 - DNA, 23 bp, Homo sapiens
aatggcgtccgtgggttgctaac

SEQ ID NO: 2937347 - DNA, 20 bp, Homo sapiens
aatggcgtctggaagtccaa

SEQ ID NO: 2937348 - DNA, 14 bp, Homo sapiens
aatggctctgtgaa

SEQ ID NO: 2937349 - DNA, 13 bp, Homo sapiens
aatggcttcagtg

SEQ ID NO: 2937350 - DNA, 17 bp, Homo sapiens
aatggctttgtcttgaa

SEQ ID NO: 2937351 - DNA, 21 bp, Homo sapiens
aatgggacttcttttcacatt

SEQ ID NO: 2937352 - DNA, 17 bp, Homo sapiens
aatgggagaatcagcag

SEQ ID NO: 2937353 - DNA, 15 bp, Homo sapiens
aatgggcaggtggcc

SEQ ID NO: 2937354 - DNA, 17 bp, Homo sapiens
aatgggcagttacatgc

SEQ ID NO: 2937355 - DNA, 22 bp, Homo sapiens
aatgggcagttacatgcatact

SEQ ID NO: 2937356 - DNA, 20 bp, Homo sapiens
aatgggccactgaaatctgt

SEQ ID NO: 2937357 - DNA, 12 bp, Homo sapiens
aatggggccaga

SEQ ID NO: 2937358 - DNA, 22 bp, Homo sapiens
aatggggccagatccagcctgg

SEQ ID NO: 2937359 - DNA, 21 bp, Homo sapiens
aatgggggctttcggggaggg

SEQ ID NO: 2937360 - DNA, 15 bp, Homo sapiens
aatggtaccagataa

SEQ ID NO: 2937361 - DNA, 17 bp, Homo sapiens
aatggtagattcgctgt

SEQ ID NO: 2937362 - DNA, 16 bp, Homo sapiens
aatggtagctgaaaaa

SEQ ID NO: 2937363 - DNA, 17 bp, Homo sapiens
aatggtaggcatttcct

SEQ ID NO: 2937364 - DNA, 18 bp, Homo sapiens
aatggtaggcatttccta

SEQ ID NO: 2937365 - DNA, 22 bp, Homo sapiens
aatggtatttgaattaaatgtt

SEQ ID NO: 2937366 - DNA, 14 bp, Homo sapiens
aatggtccaggaga

SEQ ID NO: 2937367 - DNA, 20 bp, Homo sapiens
aatggtctagaaacatttct

SEQ ID NO: 2937368 - DNA, 22 bp, Homo sapiens
aatggtgcgtggcttccctgtc

SEQ ID NO: 2937369 - DNA, 20 bp, Homo sapiens
aatggtggcttcagctccag

SEQ ID NO: 2937370 - DNA, 21 bp, Homo sapiens
aatggtggcttcagctccagc

SEQ ID NO: 2937371 - DNA, 16 bp, Homo sapiens
aatggtgtgtttccct

SEQ ID NO: 2937372 - DNA, 16 bp, Homo sapiens
aatggttataaaagtg

SEQ ID NO: 2937373 - DNA, 19 bp, Homo sapiens
aatggttataaaagtgatt

SEQ ID NO: 2937374 - DNA, 14 bp, Homo sapiens
aatggtttcctctg

SEQ ID NO: 2937375 - DNA, 23 bp, Homo sapiens
aatgtaaaaatttaatttctgaa

SEQ ID NO: 2937376 - DNA, 14 bp, Homo sapiens
aatgtaaaacacat

SEQ ID NO: 2937377 - DNA, 21 bp, Homo sapiens
aatgtaaaagacactggtgta

SEQ ID NO: 2937378 - DNA, 14 bp, Homo sapiens
aatgtaaagccatg

SEQ ID NO: 2937379 - DNA, 21 bp, Homo sapiens
aatgtaaaggagtcaaaacta

SEQ ID NO: 2937380 - DNA, 16 bp, Homo sapiens
aatgtaacatgatttc

SEQ ID NO: 2937381 - DNA, 19 bp, Homo sapiens
aatgtaagattatagattc

SEQ ID NO: 2937382 - DNA, 21 bp, Homo sapiens
aatgtaagattatagattcta

SEQ ID NO: 2937383 - DNA, 22 bp, Homo sapiens
aatgtaagattatagattctaa

SEQ ID NO: 2937384 - DNA, 23 bp, Homo sapiens
aatgtaagattatagattctaaa

SEQ ID NO: 2937385 - DNA, 20 bp, Homo sapiens
aatgtaatcggcttgaattt

SEQ ID NO: 2937386 - DNA, 13 bp, Homo sapiens
aatgtaattgtaa

SEQ ID NO: 2937387 - DNA, 13 bp, Homo sapiens
aatgtaatttcag

SEQ ID NO: 2937388 - DNA, 21 bp, Homo sapiens
aatgtacagacatatttaact

SEQ ID NO: 2937389 - DNA, 14 bp, Homo sapiens
aatgtactggtaat

SEQ ID NO: 2937390 - DNA, 22 bp, Homo sapiens
aatgtactggtaattgtacaat

SEQ ID NO: 2937391 - DNA, 23 bp, Homo sapiens
aatgtacttatattaagaaaaat

SEQ ID NO: 2937392 - DNA, 12 bp, Homo sapiens
aatgtagatttt

SEQ ID NO: 2937393 - DNA, 12 bp, Homo sapiens
aatgtagcagca

SEQ ID NO: 2937394 - DNA, 22 bp, Homo sapiens
aatgtagcagcagcctactgag

SEQ ID NO: 2937395 - DNA, 13 bp, Homo sapiens
aatgtatatgcac

SEQ ID NO: 2937396 - DNA, 14 bp, Homo sapiens
aatgtatatgcact

SEQ ID NO: 2937397 - DNA, 17 bp, Homo sapiens
aatgtatattttgatga

SEQ ID NO: 2937398 - DNA, 16 bp, Homo sapiens
aatgtatccagaggaa

SEQ ID NO: 2937399 - DNA, 16 bp, Homo sapiens
aatgtatgcttcatac

SEQ ID NO: 2937400 - DNA, 18 bp, Homo sapiens
aatgtatgcttcatacag

SEQ ID NO: 2937401 - DNA, 13 bp, Homo sapiens
aatgtattgtacc

SEQ ID NO: 2937402 - DNA, 21 bp, Homo sapiens
aatgtatttatttaaaagatt

SEQ ID NO: 2937403 - DNA, 15 bp, Homo sapiens
aatgtatttcctgaa

SEQ ID NO: 2937404 - DNA, 23 bp, Homo sapiens
aatgtattttggaagacatatat

SEQ ID NO: 2937405 - DNA, 16 bp, Homo sapiens
aatgtatttttcaaaa

SEQ ID NO: 2937406 - DNA, 13 bp, Homo sapiens
aatgtcaagaaat

SEQ ID NO: 2937407 - DNA, 14 bp, Homo sapiens
aatgtcaagaaatt

SEQ ID NO: 2937408 - DNA, 21 bp, Homo sapiens
aatgtcaagaaattctgctgt

SEQ ID NO: 2937409 - DNA, 16 bp, Homo sapiens
aatgtcaccaccttcc

SEQ ID NO: 2937410 - DNA, 16 bp, Homo sapiens
aatgtcagatacaatg

SEQ ID NO: 2937411 - DNA, 21 bp, Homo sapiens
aatgtcctgaatccagcattg

SEQ ID NO: 2937412 - DNA, 17 bp, Homo sapiens
aatgtcgaactcttctt

SEQ ID NO: 2937413 - DNA, 21 bp, Homo sapiens
aatgtctgcagccctgagaaa

SEQ ID NO: 2937414 - DNA, 23 bp, Homo sapiens
aatgtcttcagtggaacacaaat

SEQ ID NO: 2937415 - DNA, 12 bp, Homo sapiens
aatgtcttcctt

SEQ ID NO: 2937416 - DNA, 22 bp, Homo sapiens
aatgtcttgctgttgacatatt

SEQ ID NO: 2937417 - DNA, 17 bp, Homo sapiens
aatgtcttgtgtatttc

SEQ ID NO: 2937418 - DNA, 20 bp, Homo sapiens
aatgtcttttttcaaacttt

SEQ ID NO: 2937419 - DNA, 22 bp, Homo sapiens
aatgtgaaaatggtccaggaga

SEQ ID NO: 2937420 - DNA, 13 bp, Homo sapiens
aatgtgaaagatt

SEQ ID NO: 2937421 - DNA, 14 bp, Homo sapiens
aatgtgaaattttt

SEQ ID NO: 2937422 - DNA, 16 bp, Homo sapiens
aatgtgaactctcccc

SEQ ID NO: 2937423 - DNA, 20 bp, Homo sapiens
aatgtgaactctcccctccc

SEQ ID NO: 2937424 - DNA, 15 bp, Homo sapiens
aatgtgaagacattt

SEQ ID NO: 2937425 - DNA, 15 bp, Homo sapiens
aatgtgaagatgcat

SEQ ID NO: 2937426 - DNA, 14 bp, Homo sapiens
aatgtgaagtgtta

SEQ ID NO: 2937427 - DNA, 17 bp, Homo sapiens
aatgtgaagtgttaata

SEQ ID NO: 2937428 - DNA, 20 bp, Homo sapiens
aattccacaccttttattga

SEQ ID NO: 2937429 - DNA, 15 bp, Homo sapiens
aattccagatttgtt

SEQ ID NO: 2937430 - DNA, 22 bp, Homo sapiens
aattcctcatcctcagatgctc

SEQ ID NO: 2937431 - DNA, 18 bp, Homo sapiens
aattcctctttgctttgc

SEQ ID NO: 2937432 - DNA, 13 bp, Homo sapiens
aattccttaaagt

SEQ ID NO: 2937433 - DNA, 20 bp, Homo sapiens
aattcgatgcgtattctgtg

SEQ ID NO: 2937434 - DNA, 15 bp, Homo sapiens
aattcggtgtgcacc

SEQ ID NO: 2937435 - DNA, 14 bp, Homo sapiens
aattctactaagtt

SEQ ID NO: 2937436 - DNA, 17 bp, Homo sapiens
aattctactaagttatt

SEQ ID NO: 2937437 - DNA, 23 bp, Homo sapiens
aattctagcttttttcctccttt

SEQ ID NO: 2937438 - DNA, 16 bp, Homo sapiens
aattctataaggccat

SEQ ID NO: 2937439 - DNA, 22 bp, Homo sapiens
aattctataaggccataaaaca

SEQ ID NO: 2937440 - DNA, 15 bp, Homo sapiens
aattctcaaagtttt

SEQ ID NO: 2937441 - DNA, 18 bp, Homo sapiens
aattctccctatcttgtg

SEQ ID NO: 2937442 - DNA, 17 bp, Homo sapiens
aatctgtcctctgtagt

SEQ ID NO: 2937443 - DNA, 18 bp, Homo sapiens
aatctgtcctctgtagta

SEQ ID NO: 2937444 - DNA, 13 bp, Homo sapiens
aatctgtcctgtg

SEQ ID NO: 2937445 - DNA, 21 bp, Homo sapiens
aatctgtctagaatcctgctt

SEQ ID NO: 2937446 - DNA, 17 bp, Homo sapiens
aatctgtgggtctggga

SEQ ID NO: 2937447 - DNA, 19 bp, Homo sapiens
aatctgtgggtctgggagt

SEQ ID NO: 2937448 - DNA, 16 bp, Homo sapiens
aatctgtttttctaac

SEQ ID NO: 2937449 - DNA, 16 bp, Homo sapiens
aatcttaaatcagaat

SEQ ID NO: 2937450 - DNA, 17 bp, Homo sapiens
aatcttaaattttgacg

SEQ ID NO: 2937451 - DNA, 13 bp, Homo sapiens
aatcttacaaaag

SEQ ID NO: 2937452 - DNA, 22 bp, Homo sapiens
aatcttacaaaatcctggaaga

SEQ ID NO: 2937453 - DNA, 14 bp, Homo sapiens
aatcttactctaga

SEQ ID NO: 2937454 - DNA, 14 bp, Homo sapiens
aatcttatagttct

SEQ ID NO: 2937455 - DNA, 14 bp, Homo sapiens
aatcttcagctggt

SEQ ID NO: 2937456 - DNA, 15 bp, Homo sapiens
aatcttcagctggtg

SEQ ID NO: 2937457 - DNA, 14 bp, Homo sapiens
aatcttgaaattaa

SEQ ID NO: 2937458 - DNA, 21 bp, Homo sapiens
aatcttgagagtgttcctgag

SEQ ID NO: 2937459 - DNA, 19 bp, Homo sapiens
aatcttgcagttttgtaag

SEQ ID NO: 2937460 - DNA, 19 bp, Homo sapiens
aatcttgcatggcattaat

SEQ ID NO: 2937461 - DNA, 13 bp, Homo sapiens
aatcttggtttgc

SEQ ID NO: 2937462 - DNA, 17 bp, Homo sapiens
aatcttgtaagtattta

SEQ ID NO: 2937463 - DNA, 13 bp, Homo sapiens
aatcttgttttaa

SEQ ID NO: 2937464 - DNA, 17 bp, Homo sapiens
aatctttaaaagatgct

SEQ ID NO: 2937465 - DNA, 20 bp, Homo sapiens
aatctttatagtaaaatttt

SEQ ID NO: 2937466 - DNA, 17 bp, Homo sapiens
aatctttattatgcatt

SEQ ID NO: 2937467 - DNA, 21 bp, Homo sapiens
aatctttattcaaacttttat

SEQ ID NO: 2937468 - DNA, 22 bp, Homo sapiens
aatctttattcaaacttttatt

SEQ ID NO: 2937469 - DNA, 16 bp, Homo sapiens
aatctttcacttgaaa

SEQ ID NO: 2937470 - DNA, 22 bp, Homo sapiens
aatctttgtttcaggttcagta

SEQ ID NO: 2937471 - DNA, 18 bp, Homo sapiens
aatcttttgggggaaact

SEQ ID NO: 2937472 - DNA, 17 bp, Homo sapiens
aatctttttctccaccc

SEQ ID NO: 2937473 - DNA, 22 bp, Homo sapiens
aatcttttttctaaacctgtgc

SEQ ID NO: 2937474 - DNA, 14 bp, Homo sapiens
aatgaaaataactg

SEQ ID NO: 2937475 - DNA, 19 bp, Homo sapiens
aatgaaaataactgaacca

SEQ ID NO: 2937476 - DNA, 14 bp, Homo sapiens
aatgaaaatgaata

SEQ ID NO: 2937477 - DNA, 15 bp, Homo sapiens
aatgaaaatgtcttg

SEQ ID NO: 2937478 - DNA, 21 bp, Homo sapiens
aatgaaacatgggctgtgatt

SEQ ID NO: 2937479 - DNA, 14 bp, Homo sapiens
aatgaaacccccac

SEQ ID NO: 2937480 - DNA, 19 bp, Homo sapiens
aatgaaagagtaaaggaaa

SEQ ID NO: 2937481 - DNA, 21 bp, Homo sapiens
aatgaaaggagtttaaaaaca

SEQ ID NO: 2937482 - DNA, 15 bp, Homo sapiens
aatgaaagtattggc

SEQ ID NO: 2937483 - DNA, 15 bp, Homo sapiens
aatgaaataatcagt

SEQ ID NO: 2937484 - DNA, 18 bp, Homo sapiens
aatgaaatatgtgaagcc

SEQ ID NO: 2937485 - DNA, 19 bp, Homo sapiens
aatgaaatgctctcctttc

SEQ ID NO: 2937486 - DNA, 14 bp, Homo sapiens
aatgaactgatttt

SEQ ID NO: 2937487 - DNA, 19 bp, Homo sapiens
aatgaactgtattattgca

SEQ ID NO: 2937488 - DNA, 20 bp, Homo sapiens
aatgaactgtattattgcaa

SEQ ID NO: 2937489 - DNA, 20 bp, Homo sapiens
aatgaactttgtcagtgttg

SEQ ID NO: 2937490 - DNA, 23 bp, Homo sapiens
aatgaactttgtcagtgttgcct

SEQ ID NO: 2937491 - DNA, 11 bp, Homo sapiens
aatgaagaaag

SEQ ID NO: 2937492 - DNA, 12 bp, Homo sapiens
aatgaagaagga

SEQ ID NO: 2937493 - DNA, 12 bp, Homo sapiens
aatgaagcttgt

SEQ ID NO: 2937494 - DNA, 15 bp, Homo sapiens
aatgaagcttgtgta

SEQ ID NO: 2937495 - DNA, 19 bp, Homo sapiens
aatgaagcttgtgtatcca

SEQ ID NO: 2937496 - DNA, 15 bp, Homo sapiens
aatgaagctttttaa

SEQ ID NO: 2937497 - DNA, 18 bp, Homo sapiens
aatgaagggtcatttctc

SEQ ID NO: 2937498 - DNA, 18 bp, Homo sapiens
aatgaaggtgtgctacag

SEQ ID NO: 2937499 - DNA, 17 bp, Homo sapiens
aatgaaggttttcattt

SEQ ID NO: 2937500 - DNA, 14 bp, Homo sapiens
aatgaagttggggt

SEQ ID NO: 2937501 - DNA, 14 bp, Homo sapiens
aatgaatgggatat

SEQ ID NO: 2937502 - DNA, 17 bp, Homo sapiens
aatgaatgtaaaagaca

SEQ ID NO: 2937503 - DNA, 13 bp, Homo sapiens
aatgaatgtcttt

SEQ ID NO: 2937504 - DNA, 17 bp, Homo sapiens
aatgaattcctagaatt

SEQ ID NO: 2937505 - DNA, 18 bp, Homo sapiens
aatgaattgaaattttat

SEQ ID NO: 2937506 - DNA, 16 bp, Homo sapiens
aatgaatttgactggt

SEQ ID NO: 2937507 - DNA, 17 bp, Homo sapiens
aatgaatttttatgata

SEQ ID NO: 2937508 - DNA, 18 bp, Homo sapiens
aatgacaaagtgttgaaa

SEQ ID NO: 2937509 - DNA, 22 bp, Homo sapiens
aatgacaggtttgggacccctg

SEQ ID NO: 2937510 - DNA, 14 bp, Homo sapiens
aatgacagtagcat

SEQ ID NO: 2937511 - DNA, 22 bp, Homo sapiens
aatgacagtccgtcaaaacaga

SEQ ID NO: 2937512 - DNA, 17 bp, Homo sapiens
aatgactaaaaaacaaa

SEQ ID NO: 2937513 - DNA, 16 bp, Homo sapiens
aatgactaagccaagc

SEQ ID NO: 2937514 - DNA, 17 bp, Homo sapiens
aatgactaagccaagct

SEQ ID NO: 2937515 - DNA, 20 bp, Homo sapiens
aatgactaagccaagctgtg

SEQ ID NO: 2937516 - DNA, 20 bp, Homo sapiens
aatgactcatgcctctgagc

SEQ ID NO: 2937517 - DNA, 17 bp, Homo sapiens
aatgacttagaaacaat

SEQ ID NO: 2937518 - DNA, 18 bp, Homo sapiens
aatgacttatattcttag

SEQ ID NO: 2937519 - DNA, 14 bp, Homo sapiens
aatgacttattgtg

SEQ ID NO: 2937520 - DNA, 22 bp, Homo sapiens
aatgacttattgtggataacaa

SEQ ID NO: 2937521 - DNA, 23 bp, Homo sapiens
aatgacttattgtggataacaaa

SEQ ID NO: 2937522 - DNA, 13 bp, Homo sapiens
aatgacttttaaa

SEQ ID NO: 2937523 - DNA, 18 bp, Homo sapiens
aatgacttttaaaatttg

SEQ ID NO: 2937524 - DNA, 17 bp, Homo sapiens
aatgagaaaggacagag

SEQ ID NO: 2937525 - DNA, 22 bp, Homo sapiens
aatgagaagaaaatggaaccag

SEQ ID NO: 2937526 - DNA, 22 bp, Homo sapiens
aatgagaaggccaatagtttta

SEQ ID NO: 2937527 - DNA, 22 bp, Homo sapiens
aatgagacttgagtctattttt

SEQ ID NO: 2937528 - DNA, 15 bp, Homo sapiens
aatgagacttgcctt

SEQ ID NO: 2937529 - DNA, 23 bp, Homo sapiens
aatgagcatctcaaatgttttct

SEQ ID NO: 2937530 - DNA, 22 bp, Homo sapiens
aatgagctcgcatttgtcaatg

SEQ ID NO: 2937531 - DNA, 19 bp, Homo sapiens
aatgaggaacaatcacaaa

SEQ ID NO: 2937532 - DNA, 19 bp, Homo sapiens
aatgaggagagaaaatata

SEQ ID NO: 2937533 - DNA, 11 bp, Homo sapiens
aatgagggagg

SEQ ID NO: 2937534 - DNA, 19 bp, Homo sapiens
aatgaggtgcacacaataa

SEQ ID NO: 2937535 - DNA, 19 bp, Homo sapiens
aatgagtctgttgtgtgtc

SEQ ID NO: 2937536 - DNA, 14 bp, Homo sapiens
aatgagtttaaaaa

SEQ ID NO: 2937537 - DNA, 17 bp, Homo sapiens
aatgagtttaaaaatca

SEQ ID NO: 2937538 - DNA, 19 bp, Homo sapiens
aatgatagaactgtactgt

SEQ ID NO: 2937539 - DNA, 21 bp, Homo sapiens
aatgatatataatttaaagtt

SEQ ID NO: 2937540 - DNA, 13 bp, Homo sapiens
aatgatcctgcca

SEQ ID NO: 2937541 - DNA, 19 bp, Homo sapiens
aatgatcctgtattcagac

SEQ ID NO: 2937542 - DNA, 22 bp, Homo sapiens
aatgatcctgtctctaaaaaga

SEQ ID NO: 2937543 - DNA, 16 bp, Homo sapiens
aatgatctcttctttt

SEQ ID NO: 2937544 - DNA, 16 bp, Homo sapiens
aatgatgcaaccaaaa

SEQ ID NO: 2937545 - DNA, 15 bp, Homo sapiens
aatgatgtctttaag

SEQ ID NO: 2937546 - DNA, 14 bp, Homo sapiens
aatgatgttataca

SEQ ID NO: 2937547 - DNA, 19 bp, Homo sapiens
aatgatgttatacatcaat

SEQ ID NO: 2937548 - DNA, 14 bp, Homo sapiens
aatgattataatca

SEQ ID NO: 2937549 - DNA, 16 bp, Homo sapiens
aatgattataatcata

SEQ ID NO: 2937550 - DNA, 13 bp, Homo sapiens
aatgattcagtgt

SEQ ID NO: 2937551 - DNA, 22 bp, Homo sapiens
aatgattcagtgttaaatgtga

SEQ ID NO: 2937552 - DNA, 23 bp, Homo sapiens
aatgattcagtgttaaatgtgat

SEQ ID NO: 2937553 - DNA, 20 bp, Homo sapiens
aatgatttccaaagagaaaa

SEQ ID NO: 2937554 - DNA, 13 bp, Homo sapiens
aatgcaaagaatc

SEQ ID NO: 2937555 - DNA, 17 bp, Homo sapiens
aatgcaaagaatcccta

SEQ ID NO: 2937556 - DNA, 16 bp, Homo sapiens
aatgcaaatcctatgt

SEQ ID NO: 2937557 - DNA, 20 bp, Homo sapiens
aatgcaactacccaaaacaa

SEQ ID NO: 2937558 - DNA, 17 bp, Homo sapiens
aatgcaatagaagtgct

SEQ ID NO: 2937559 - DNA, 22 bp, Homo sapiens
aatgcaatagaagtgctcccct

SEQ ID NO: 2937560 - DNA, 23 bp, Homo sapiens
aatgcaatagaagtgctcccctc

SEQ ID NO: 2937561 - DNA, 13 bp, Homo sapiens
aatgcaatcaatt

SEQ ID NO: 2937562 - DNA, 12 bp, Homo sapiens
aatgcacaattt

SEQ ID NO: 2937563 - DNA, 15 bp, Homo sapiens
aatgcactttctatc

SEQ ID NO: 2937564 - DNA, 15 bp, Homo sapiens
aatgcagaagtattc

SEQ ID NO: 2937565 - DNA, 18 bp, Homo sapiens
aatgcagaggaggagaaa

SEQ ID NO: 2937566 - DNA, 17 bp, Homo sapiens
aatgcagcacccttgcc

SEQ ID NO: 2937567 - DNA, 16 bp, Homo sapiens
aatgcagcactgctgc

SEQ ID NO: 2937568 - DNA, 19 bp, Homo sapiens
aatgcagcactgctgcctc

SEQ ID NO: 2937569 - DNA, 15 bp, Homo sapiens
aatgcagcccaccag

SEQ ID NO: 2937570 - DNA, 18 bp, Homo sapiens
aatgcagcccatttctcc

SEQ ID NO: 2937571 - DNA, 17 bp, Homo sapiens
aatgcagggcacatgat

SEQ ID NO: 2937572 - DNA, 17 bp, Homo sapiens
aatgcagtatggtacat

SEQ ID NO: 2937573 - DNA, 23 bp, Homo sapiens
aatgcagtatggtacatttttca

SEQ ID NO: 2937574 - DNA, 13 bp, Homo sapiens
aatcaagatttta

SEQ ID NO: 2937575 - DNA, 16 bp, Homo sapiens
aatcaagcaggttaga

SEQ ID NO: 2937576 - DNA, 19 bp, Homo sapiens
aatcaatgtgacatgttgc

SEQ ID NO: 2937577 - DNA, 12 bp, Homo sapiens
aatcaatttaaa

SEQ ID NO: 2937578 - DNA, 15 bp, Homo sapiens
aatcaatttaaatgt

SEQ ID NO: 2937579 - DNA, 19 bp, Homo sapiens
aatcaatttaaatgtttac

SEQ ID NO: 2937580 - DNA, 20 bp, Homo sapiens
aatcaatttaaatgtttact

SEQ ID NO: 2937581 - DNA, 14 bp, Homo sapiens
aatcaattttttaa

SEQ ID NO: 2937582 - DNA, 13 bp, Homo sapiens
aatcacaaaagct

SEQ ID NO: 2937583 - DNA, 22 bp, Homo sapiens
aatcacaaaagctgtgtctctg

SEQ ID NO: 2937584 - DNA, 18 bp, Homo sapiens
aatcacaacaaactgaat

SEQ ID NO: 2937585 - DNA, 13 bp, Homo sapiens
aatcacaggaaaa

SEQ ID NO: 2937586 - DNA, 20 bp, Homo sapiens
aatcacctgaaccccagagg

SEQ ID NO: 2937587 - DNA, 14 bp, Homo sapiens
aatcactgtgctat

SEQ ID NO: 2937588 - DNA, 11 bp, Homo sapiens
aatcactgttt

SEQ ID NO: 2937589 - DNA, 22 bp, Homo sapiens
aatcactgtttttagacacctt

SEQ ID NO: 2937590 - DNA, 23 bp, Homo sapiens
aatcacttgaacccgggggacag

SEQ ID NO: 2937591 - DNA, 18 bp, Homo sapiens
aatcacttgattcataaa

SEQ ID NO: 2937592 - DNA, 21 bp, Homo sapiens
aatcacttgattcataaagat

SEQ ID NO: 2937593 - DNA, 12 bp, Homo sapiens
aatcagaactca

SEQ ID NO: 2937594 - DNA, 15 bp, Homo sapiens
aatcagaagtgcaaa

SEQ ID NO: 2937595 - DNA, 17 bp, Homo sapiens
aatcagaagtgcaaagg

SEQ ID NO: 2937596 - DNA, 15 bp, Homo sapiens
aatcagagatttttg

SEQ ID NO: 2937597 - DNA, 14 bp, Homo sapiens
aatcagatcatttc

SEQ ID NO: 2937598 - DNA, 20 bp, Homo sapiens
aatcagcaaacacaataaga

SEQ ID NO: 2937599 - DNA, 20 bp, Homo sapiens
aatcagctccttcctggaga

SEQ ID NO: 2937600 - DNA, 17 bp, Homo sapiens
aatcagctgttgcaggc

SEQ ID NO: 2937601 - DNA, 18 bp, Homo sapiens
aatcagctgttgcaggca

SEQ ID NO: 2937602 - DNA, 19 bp, Homo sapiens
aatcagctgttgcaggcag

SEQ ID NO: 2937603 - DNA, 14 bp, Homo sapiens
aatcagtgttgatt

SEQ ID NO: 2937604 - DNA, 21 bp, Homo sapiens
aatcagtgtttaaataaagac

SEQ ID NO: 2937605 - DNA, 22 bp, Homo sapiens
aatcagtgtttaaataaagacc

SEQ ID NO: 2937606 - DNA, 18 bp, Homo sapiens
aatcagtttattaaatct

SEQ ID NO: 2937607 - DNA, 19 bp, Homo sapiens
aatcagtttattaaatctg

SEQ ID NO: 2937608 - DNA, 19 bp, Homo sapiens
aatcataacatagttgaaa

SEQ ID NO: 2937609 - DNA, 13 bp, Homo sapiens
aatcatagagaaa

SEQ ID NO: 2937610 - DNA, 15 bp, Homo sapiens
aatcatccaatgctc

SEQ ID NO: 2937611 - DNA, 17 bp, Homo sapiens
aatcatgagcctgttta

SEQ ID NO: 2937612 - DNA, 21 bp, Homo sapiens
aatcatgagcctgtttattgc

SEQ ID NO: 2937613 - DNA, 21 bp, Homo sapiens
aatcatggaatggttataaaa

SEQ ID NO: 2937614 - DNA, 18 bp, Homo sapiens
aatcatgttttttctgca

SEQ ID NO: 2937615 - DNA, 15 bp, Homo sapiens
aatcattagttttag

SEQ ID NO: 2937616 - DNA, 20 bp, Homo sapiens
aatcattagttttagaggca

SEQ ID NO: 2937617 - DNA, 13 bp, Homo sapiens
aatcattttagaa

SEQ ID NO: 2937618 - DNA, 18 bp, Homo sapiens
aatcattttagaattaaa

SEQ ID NO: 2937619 - DNA, 18 bp, Homo sapiens
aatcattttcattcctaa

SEQ ID NO: 2937620 - DNA, 14 bp, Homo sapiens
aatccaaactgctg

SEQ ID NO: 2937621 - DNA, 18 bp, Homo sapiens
aatccaaactgctgtctc

SEQ ID NO: 2937622 - DNA, 17 bp, Homo sapiens
aatccaaatctgtcctc

SEQ ID NO: 2937623 - DNA, 19 bp, Homo sapiens
aatccaaatctgtcctctg

SEQ ID NO: 2937624 - DNA, 22 bp, Homo sapiens
aatccaaatctgtcctctgtag

SEQ ID NO: 2937625 - DNA, 16 bp, Homo sapiens
aatccaaatgcattca

SEQ ID NO: 2937626 - DNA, 13 bp, Homo sapiens
aatccaaatggcg

SEQ ID NO: 2937627 - DNA, 17 bp, Homo sapiens
aatccaacccatgatga

SEQ ID NO: 2937628 - DNA, 18 bp, Homo sapiens
aatccacaatctgacatt

SEQ ID NO: 2937629 - DNA, 15 bp, Homo sapiens
aatccacatttctaa

SEQ ID NO: 2937630 - DNA, 19 bp, Homo sapiens
aatccacctgcctcggcct

SEQ ID NO: 2937631 - DNA, 21 bp, Homo sapiens
aatccagatggtgggatgtgg

SEQ ID NO: 2937632 - DNA, 17 bp, Homo sapiens
aatccaggcagatccag

SEQ ID NO: 2937633 - DNA, 20 bp, Homo sapiens
aatccaggtacgcacagaca

SEQ ID NO: 2937634 - DNA, 22 bp, Homo sapiens
aatccaggtacgcacagacagg

SEQ ID NO: 2937635 - DNA, 13 bp, Homo sapiens
aatccatcagcaa

SEQ ID NO: 2937636 - DNA, 18 bp, Homo sapiens
aatccatcagcaatgctt

SEQ ID NO: 2937637 - DNA, 23 bp, Homo sapiens
aatccattttcactaaaagtgtg

SEQ ID NO: 2937638 - DNA, 12 bp, Homo sapiens
aatcccaccaga

SEQ ID NO: 2937639 - DNA, 18 bp, Homo sapiens
aatcccacccacatgtga

SEQ ID NO: 2937640 - DNA, 14 bp, Homo sapiens
aatcccactgtatg

SEQ ID NO: 2937641 - DNA, 15 bp, Homo sapiens
aatcccagcaatttg

SEQ ID NO: 2937642 - DNA, 20 bp, Homo sapiens
aatccccagatatttatgta

SEQ ID NO: 2937643 - DNA, 23 bp, Homo sapiens
aatccccagttcgcctggagccc

SEQ ID NO: 2937644 - DNA, 22 bp, Homo sapiens
aatccccatgcctgtggctgcg

SEQ ID NO: 2937645 - DNA, 19 bp, Homo sapiens
aatcccctcattcaggaaa

SEQ ID NO: 2937646 - DNA, 19 bp, Homo sapiens
aatccctttattaccccct

SEQ ID NO: 2937647 - DNA, 19 bp, Homo sapiens
aatccgaacctcctctgtg

SEQ ID NO: 2937648 - DNA, 19 bp, Homo sapiens
aatccgccagtgtttctga

SEQ ID NO: 2937649 - DNA, 14 bp, Homo sapiens
aatcctaccttttg

SEQ ID NO: 2937650 - DNA, 17 bp, Homo sapiens
aatcctaccttttgata

SEQ ID NO: 2937651 - DNA, 23 bp, Homo sapiens
aatcctaccttttgataaaatgt

SEQ ID NO: 2937652 - DNA, 21 bp, Homo sapiens
aatcctatgtgattttaactc

SEQ ID NO: 2937653 - DNA, 20 bp, Homo sapiens
aatcctccaaccaggctcct

SEQ ID NO: 2937654 - DNA, 16 bp, Homo sapiens
aatcctccccgctctg

SEQ ID NO: 2937655 - DNA, 19 bp, Homo sapiens
aatcctcctacctcagcct

SEQ ID NO: 2937656 - DNA, 11 bp, Homo sapiens
aatcctcctcc

SEQ ID NO: 2937657 - DNA, 15 bp, Homo sapiens
aatcctggaagattt

SEQ ID NO: 2937658 - DNA, 22 bp, Homo sapiens
aatcctggcaagaaagcttgag

SEQ ID NO: 2937659 - DNA, 19 bp, Homo sapiens
aatcctgggcccccagaga

SEQ ID NO: 2937660 - DNA, 18 bp, Homo sapiens
aatcctgtatataaaata

SEQ ID NO: 2937661 - DNA, 19 bp, Homo sapiens
aatcctgtcgattagactg

SEQ ID NO: 2937662 - DNA, 12 bp, Homo sapiens
aatcctgtcttt

SEQ ID NO: 2937663 - DNA, 15 bp, Homo sapiens
aatccttacttccag

SEQ ID NO: 2937664 - DNA, 17 bp, Homo sapiens
aatccttacttccagca

SEQ ID NO: 2937665 - DNA, 15 bp, Homo sapiens
aatcctttctgcccc

SEQ ID NO: 2937666 - DNA, 22 bp, Homo sapiens
aatcctttctgccccccagggc

SEQ ID NO: 2937667 - DNA, 23 bp, Homo sapiens
aatcctttctgccccccagggct

SEQ ID NO: 2937668 - DNA, 13 bp, Homo sapiens
aatccttttgtag

SEQ ID NO: 2937669 - DNA, 17 bp, Homo sapiens
aatcgactcaaaaataa

SEQ ID NO: 2937670 - DNA, 13 bp, Homo sapiens
aatcgatggggga

SEQ ID NO: 2937671 - DNA, 17 bp, Homo sapiens
aatcgccataggccaag

SEQ ID NO: 2937672 - DNA, 16 bp, Homo sapiens
aatcgccttatgagaa

SEQ ID NO: 2937673 - DNA, 18 bp, Homo sapiens
aatcggcccacagctccc

SEQ ID NO: 2937674 - DNA, 15 bp, Homo sapiens
aatcgggaaggatgg

SEQ ID NO: 2937675 - DNA, 14 bp, Homo sapiens
aatcgtttaatgtt

SEQ ID NO: 2937676 - DNA, 17 bp, Homo sapiens
aatcgtttaatgtttat

SEQ ID NO: 2937677 - DNA, 18 bp, Homo sapiens
aatcgtttaatgtttata

SEQ ID NO: 2937678 - DNA, 19 bp, Homo sapiens
aatcgtttttgttttaagg

SEQ ID NO: 2937679 - DNA, 12 bp, Homo sapiens
aatctacagtgt

SEQ ID NO: 2937680 - DNA, 13 bp, Homo sapiens
aatctacatttgt

SEQ ID NO: 2937681 - DNA, 21 bp, Homo sapiens
aatctacatttgtttgtattc

SEQ ID NO: 2937682 - DNA, 19 bp, Homo sapiens
aatctagtatttcatgctg

SEQ ID NO: 2937683 - DNA, 22 bp, Homo sapiens
aatctatgaacctgaaaagggt

SEQ ID NO: 2937684 - DNA, 19 bp, Homo sapiens
aatctatgtcgtgttttca

SEQ ID NO: 2937685 - DNA, 15 bp, Homo sapiens
aatctatgtttataa

SEQ ID NO: 2937686 - DNA, 20 bp, Homo sapiens
aatctcccagacttgtttcc

SEQ ID NO: 2937687 - DNA, 16 bp, Homo sapiens
aatctcccatgtgcat

SEQ ID NO: 2937688 - DNA, 18 bp, Homo sapiens
aatctcgtcaggctgcca

SEQ ID NO: 2937689 - DNA, 19 bp, Homo sapiens
aatctcgtttcaaaaacac

SEQ ID NO: 2937690 - DNA, 13 bp, Homo sapiens
aatctctatactg

SEQ ID NO: 2937691 - DNA, 22 bp, Homo sapiens
aatctctgcctagaatctttat

SEQ ID NO: 2937692 - DNA, 17 bp, Homo sapiens
aatctcttaaactctct

SEQ ID NO: 2937693 - DNA, 23 bp, Homo sapiens
aatctcttgattataaatgtttg

SEQ ID NO: 2937694 - DNA, 15 bp, Homo sapiens
aatctctttttgact

SEQ ID NO: 2937695 - DNA, 12 bp, Homo sapiens
aatctgacccag

SEQ ID NO: 2937696 - DNA, 15 bp, Homo sapiens
aatctgacccagtgc

SEQ ID NO: 2937697 - DNA, 13 bp, Homo sapiens
aatctgatgaaaa

SEQ ID NO: 2937698 - DNA, 15 bp, Homo sapiens
aatctgcaattcaaa

SEQ ID NO: 2937699 - DNA, 19 bp, Homo sapiens
aatctgcaatttctactac

SEQ ID NO: 2937700 - DNA, 11 bp, Homo sapiens
aatctgccttc

SEQ ID NO: 2937701 - DNA, 20 bp, Homo sapiens
aatctgctcactttaaacct

SEQ ID NO: 2937702 - DNA, 18 bp, Homo sapiens
aatctgtacaaaatggtc

SEQ ID NO: 2937703 - DNA, 14 bp, Homo sapiens
aatctgtataaatg

SEQ ID NO: 2937704 - DNA, 19 bp, Homo sapiens
aagtttccttttaattcta

SEQ ID NO: 2937705 - DNA, 17 bp, Homo sapiens
aagtttcgaggggtcct

SEQ ID NO: 2937706 - DNA, 13 bp, Homo sapiens
aagtttctaagat

SEQ ID NO: 2937707 - DNA, 16 bp, Homo sapiens
aagtttctaagattct

SEQ ID NO: 2937708 - DNA, 23 bp, Homo sapiens
aagtttctcagatccttgtttca

SEQ ID NO: 2937709 - DNA, 17 bp, Homo sapiens
aagtttgaaggaaacag

SEQ ID NO: 2937710 - DNA, 19 bp, Homo sapiens
aagtttgcactatctttca

SEQ ID NO: 2937711 - DNA, 21 bp, Homo sapiens
aagtttgcactatctttcagc

SEQ ID NO: 2937712 - DNA, 14 bp, Homo sapiens
aagtttgctagtga

SEQ ID NO: 2937713 - DNA, 16 bp, Homo sapiens
aagtttgcttagaaaa

SEQ ID NO: 2937714 - DNA, 15 bp, Homo sapiens
aagtttgcttgtttc

SEQ ID NO: 2937715 - DNA, 18 bp, Homo sapiens
aagtttgggctaacattt

SEQ ID NO: 2937716 - DNA, 16 bp, Homo sapiens
aagtttgtaaaaatat

SEQ ID NO: 2937717 - DNA, 14 bp, Homo sapiens
aagtttgttacttt

SEQ ID NO: 2937718 - DNA, 16 bp, Homo sapiens
aagtttgttactttga

SEQ ID NO: 2937719 - DNA, 17 bp, Homo sapiens
aagttttactgataatt

SEQ ID NO: 2937720 - DNA, 13 bp, Homo sapiens
aagtttttacaaa

SEQ ID NO: 2937721 - DNA, 19 bp, Homo sapiens
aagtttttacaaaatacta

SEQ ID NO: 2937722 - DNA, 14 bp, Homo sapiens
aatagaaaagttat

SEQ ID NO: 2937723 - DNA, 15 bp, Homo sapiens
aatagaaaagttatt

SEQ ID NO: 2937724 - DNA, 19 bp, Homo sapiens
aatagaaaagttattagtg

SEQ ID NO: 2937725 - DNA, 15 bp, Homo sapiens
aatagaatttcctaa

SEQ ID NO: 2937726 - DNA, 17 bp, Homo sapiens
aatagaatttcctaatg

SEQ ID NO: 2937727 - DNA, 23 bp, Homo sapiens
aatagacactccccgaagtcttt

SEQ ID NO: 2937728 - DNA, 16 bp, Homo sapiens
aatagagcaagaaggc

SEQ ID NO: 2937729 - DNA, 14 bp, Homo sapiens
aatagagcctgagg

SEQ ID NO: 2937730 - DNA, 18 bp, Homo sapiens
aatagagctgccactggg

SEQ ID NO: 2937731 - DNA, 19 bp, Homo sapiens
aatagagctgttcaacatc

SEQ ID NO: 2937732 - DNA, 23 bp, Homo sapiens
aatagagtgtagtttacagaaaa

SEQ ID NO: 2937733 - DNA, 11 bp, Homo sapiens
aatagatgttt

SEQ ID NO: 2937734 - DNA, 21 bp, Homo sapiens
aatagatttgggtcatttaga

SEQ ID NO: 2937735 - DNA, 12 bp, Homo sapiens
aatagcatctgt

SEQ ID NO: 2937736 - DNA, 19 bp, Homo sapiens
aatagcatctgtacaaagg

SEQ ID NO: 2937737 - DNA, 23 bp, Homo sapiens
aatagccacatttggaatacttt

SEQ ID NO: 2937738 - DNA, 19 bp, Homo sapiens
aatagccaccttgattttc

SEQ ID NO: 2937739 - DNA, 23 bp, Homo sapiens
aatagccactgcataccaacctg

SEQ ID NO: 2937740 - DNA, 20 bp, Homo sapiens
aatagccgaactccaggctg

SEQ ID NO: 2937741 - DNA, 18 bp, Homo sapiens
aatagctccaagctgtta

SEQ ID NO: 2937742 - DNA, 20 bp, Homo sapiens
aatagctccaagctgttaaa

SEQ ID NO: 2937743 - DNA, 14 bp, Homo sapiens
aatagcttgtttct

SEQ ID NO: 2937744 - DNA, 14 bp, Homo sapiens
aatagctttagtga

SEQ ID NO: 2937745 - DNA, 22 bp, Homo sapiens
aataggattgcttcaattaaaa

SEQ ID NO: 2937746 - DNA, 21 bp, Homo sapiens
aatagggaagtaaaaaaacaa

SEQ ID NO: 2937747 - DNA, 19 bp, Homo sapiens
aataggtgcagtctttgag

SEQ ID NO: 2937748 - DNA, 13 bp, Homo sapiens
aatagtaatgttt

SEQ ID NO: 2937749 - DNA, 14 bp, Homo sapiens
aatagtcattaaaa

SEQ ID NO: 2937750 - DNA, 14 bp, Homo sapiens
aatagtctagatgg

SEQ ID NO: 2937751 - DNA, 21 bp, Homo sapiens
aatagtggatctcagttttta

SEQ ID NO: 2937752 - DNA, 17 bp, Homo sapiens
aatagtgttaatcaatt

SEQ ID NO: 2937753 - DNA, 22 bp, Homo sapiens
aatagttaagacatgatttcct

SEQ ID NO: 2937754 - DNA, 17 bp, Homo sapiens
aatagttttagattatt

SEQ ID NO: 2937755 - DNA, 14 bp, Homo sapiens
aatagttttttctt

SEQ ID NO: 2937756 - DNA, 23 bp, Homo sapiens
aatataaaatatgaagacataaa

SEQ ID NO: 2937757 - DNA, 22 bp, Homo sapiens
aatataaacaaagattcatgat

SEQ ID NO: 2937758 - DNA, 20 bp, Homo sapiens
aatataaatatccccaggga

SEQ ID NO: 2937759 - DNA, 19 bp, Homo sapiens
aatataacaagtataatta

SEQ ID NO: 2937760 - DNA, 16 bp, Homo sapiens
aatataacatgaaatg

SEQ ID NO: 2937761 - DNA, 19 bp, Homo sapiens
aatataacatgaaatgata

SEQ ID NO: 2937762 - DNA, 18 bp, Homo sapiens
aatataaggaaagcaata

SEQ ID NO: 2937763 - DNA, 19 bp, Homo sapiens
aatatacattcaaacttaa

SEQ ID NO: 2937764 - DNA, 11 bp, Homo sapiens
aatatactgta

SEQ ID NO: 2937765 - DNA, 17 bp, Homo sapiens
aatatactgtaaagaaa

SEQ ID NO: 2937766 - DNA, 21 bp, Homo sapiens
aatatactgtaaagaaagaga

SEQ ID NO: 2937767 - DNA, 22 bp, Homo sapiens
aatatactgtaaagaaagagag

SEQ ID NO: 2937768 - DNA, 21 bp, Homo sapiens
aatatacttttacattaaaga

SEQ ID NO: 2937769 - DNA, 13 bp, Homo sapiens
aatatagttgtct

SEQ ID NO: 2937770 - DNA, 13 bp, Homo sapiens
aatatatatattt

SEQ ID NO: 2937771 - DNA, 19 bp, Homo sapiens
aatatatcctgaaagcatt

SEQ ID NO: 2937772 - DNA, 22 bp, Homo sapiens
aatatatgtatttttatataat

SEQ ID NO: 2937773 - DNA, 23 bp, Homo sapiens
aatatatgtattttttgaatcta

SEQ ID NO: 2937774 - DNA, 14 bp, Homo sapiens
aatatatttgtgta

SEQ ID NO: 2937775 - DNA, 24 bp, Homo sapiens
aatatatttgtgtatttaacaggg

SEQ ID NO: 2937776 - DNA, 17 bp, Homo sapiens
aatatattttctttcta

SEQ ID NO: 2937777 - DNA, 18 bp, Homo sapiens
aatatcaagtactacatt

SEQ ID NO: 2937778 - DNA, 15 bp, Homo sapiens
aatatcaatataatg

SEQ ID NO: 2937779 - DNA, 19 bp, Homo sapiens
aatatcagttactcagccc

SEQ ID NO: 2937780 - DNA, 22 bp, Homo sapiens
aatatcagttactcagccctgg

SEQ ID NO: 2937781 - DNA, 20 bp, Homo sapiens
aatatccaggtcaacagaat

SEQ ID NO: 2937782 - DNA, 15 bp, Homo sapiens
aatatctaaagttat

SEQ ID NO: 2937783 - DNA, 14 bp, Homo sapiens
aatatctttgcatc

SEQ ID NO: 2937784 - DNA, 18 bp, Homo sapiens
aatatgaagctcacctgt

SEQ ID NO: 2937785 - DNA, 13 bp, Homo sapiens
aatatgaatgaat

SEQ ID NO: 2937786 - DNA, 22 bp, Homo sapiens
aatatgacagctgtccctgtca

SEQ ID NO: 2937787 - DNA, 20 bp, Homo sapiens
aatatgactttttataaaat

SEQ ID NO: 2937788 - DNA, 17 bp, Homo sapiens
aatatgcagaatctctg

SEQ ID NO: 2937789 - DNA, 19 bp, Homo sapiens
aatatgcattgtctgcaat

SEQ ID NO: 2937790 - DNA, 17 bp, Homo sapiens
aatatgcctttttgaag

SEQ ID NO: 2937791 - DNA, 17 bp, Homo sapiens
aatatggaagtaaaggc

SEQ ID NO: 2937792 - DNA, 17 bp, Homo sapiens
aatatggacacttaata

SEQ ID NO: 2937793 - DNA, 21 bp, Homo sapiens
aatatggacacttaatactac

SEQ ID NO: 2937794 - DNA, 16 bp, Homo sapiens
aatatggttgatagtt

SEQ ID NO: 2937795 - DNA, 11 bp, Homo sapiens
aatatgtctgc

SEQ ID NO: 2937796 - DNA, 17 bp, Homo sapiens
aatatgttaaagtttaa

SEQ ID NO: 2937797 - DNA, 11 bp, Homo sapiens
aatatgttgac

SEQ ID NO: 2937798 - DNA, 19 bp, Homo sapiens
aatattaaaagtcacaatg

SEQ ID NO: 2937799 - DNA, 22 bp, Homo sapiens
aatattaaagcctcatgtgtga

SEQ ID NO: 2937800 - DNA, 15 bp, Homo sapiens
aatattaactactgt

SEQ ID NO: 2937801 - DNA, 16 bp, Homo sapiens
aatattaactactgta

SEQ ID NO: 2937802 - DNA, 14 bp, Homo sapiens
aatattaagaaaca

SEQ ID NO: 2937803 - DNA, 15 bp, Homo sapiens
aatattaagaaacaa

SEQ ID NO: 2937804 - DNA, 12 bp, Homo sapiens
aatattagatgt

SEQ ID NO: 2937805 - DNA, 14 bp, Homo sapiens
aatattagatgtga

SEQ ID NO: 2937806 - DNA, 17 bp, Homo sapiens
aatattagatgtgattt

SEQ ID NO: 2937807 - DNA, 18 bp, Homo sapiens
aatattagctttactgtt

SEQ ID NO: 2937808 - DNA, 21 bp, Homo sapiens
aatattagctttactgtttgt

SEQ ID NO: 2937809 - DNA, 16 bp, Homo sapiens
aatattatgagatgct

SEQ ID NO: 2937810 - DNA, 18 bp, Homo sapiens
aatattatgagatgctgg

SEQ ID NO: 2937811 - DNA, 18 bp, Homo sapiens
aatattattaaaatctta

SEQ ID NO: 2937812 - DNA, 15 bp, Homo sapiens
aatattcagaatctt

SEQ ID NO: 2937813 - DNA, 17 bp, Homo sapiens
aatattctctgatgttt

SEQ ID NO: 2937814 - DNA, 18 bp, Homo sapiens
aatattctgataatgtat

SEQ ID NO: 2937815 - DNA, 14 bp, Homo sapiens
aatattgactttgt

SEQ ID NO: 2937816 - DNA, 20 bp, Homo sapiens
aatattgagaaagaaactaa

SEQ ID NO: 2937817 - DNA, 13 bp, Homo sapiens
aatattggtttgt

SEQ ID NO: 2937818 - DNA, 17 bp, Homo sapiens
aatattgtattgctgct

SEQ ID NO: 2937819 - DNA, 19 bp, Homo sapiens
aatattgtattgctgctgt

SEQ ID NO: 2937820 - DNA, 13 bp, Homo sapiens
aatattgtccatt

SEQ ID NO: 2937821 - DNA, 13 bp, Homo sapiens
aatattgttctct

SEQ ID NO: 2937822 - DNA, 19 bp, Homo sapiens
aatattgtttctttatcac

SEQ ID NO: 2937823 - DNA, 14 bp, Homo sapiens
aatatttaaaaatg

SEQ ID NO: 2937824 - DNA, 17 bp, Homo sapiens
aatatttaaaaatgtct

SEQ ID NO: 2937825 - DNA, 15 bp, Homo sapiens
aatatttaaaccttt

SEQ ID NO: 2937826 - DNA, 20 bp, Homo sapiens
aatatttaaacctttttctt

SEQ ID NO: 2937827 - DNA, 12 bp, Homo sapiens
aatatttcctga

SEQ ID NO: 2937828 - DNA, 19 bp, Homo sapiens
aatatttcctgacttgagt

SEQ ID NO: 2937829 - DNA, 22 bp, Homo sapiens
aatatttcctgacttgagtgtt

SEQ ID NO: 2937830 - DNA, 12 bp, Homo sapiens
aatatttcttaa

SEQ ID NO: 2937831 - DNA, 17 bp, Homo sapiens
aatattttatctttcct

SEQ ID NO: 2937832 - DNA, 16 bp, Homo sapiens
aatattttatttgaaa

SEQ ID NO: 2937833 - DNA, 18 bp, Homo sapiens
aatattttatttgaaaaa

SEQ ID NO: 2937834 - DNA, 13 bp, Homo sapiens
aatattttcaaga

SEQ ID NO: 2937835 - DNA, 13 bp, Homo sapiens
aatattttctatt

SEQ ID NO: 2937836 - DNA, 18 bp, Homo sapiens
aatattttgaatacacat

SEQ ID NO: 2937837 - DNA, 22 bp, Homo sapiens
aatattttgaatcaataatata

SEQ ID NO: 2937838 - DNA, 23 bp, Homo sapiens
aatatttttccctccgggcaggg

SEQ ID NO: 2937839 - DNA, 14 bp, Homo sapiens
aatatttttctaaa

SEQ ID NO: 2937840 - DNA, 17 bp, Homo sapiens
aatattttttatatata

SEQ ID NO: 2937841 - DNA, 19 bp, Homo sapiens
aatattttttatatataca

SEQ ID NO: 2937842 - DNA, 20 bp, Homo sapiens
aatcaaacaaccttcagctt

SEQ ID NO: 2937843 - DNA, 16 bp, Homo sapiens
aatcaaacctttttat

SEQ ID NO: 2937844 - DNA, 22 bp, Homo sapiens
aatcaaagccggcctgagaaac

SEQ ID NO: 2937845 - DNA, 21 bp, Homo sapiens
aatcaaatcttacaaaatcct

SEQ ID NO: 2937846 - DNA, 15 bp, Homo sapiens
aatcaacctatcaaa

SEQ ID NO: 2937847 - DNA, 14 bp, Homo sapiens
cagttgcaggagcg

SEQ ID NO: 2937848 - DNA, 22 bp, Homo sapiens
cagttgcatttttatggagttc

SEQ ID NO: 2937849 - DNA, 23 bp, Homo sapiens
cagttggggcaggggcaggaggg

SEQ ID NO: 2937850 - DNA, 18 bp, Homo sapiens
cagttgtagaatgtattg

SEQ ID NO: 2937851 - DNA, 17 bp, Homo sapiens
cagttgtggtgtgagta

SEQ ID NO: 2937852 - DNA, 21 bp, Homo sapiens
cagttgtggtgtgagtatcag

SEQ ID NO: 2937853 - DNA, 16 bp, Homo sapiens
cagtttagaacagagg

SEQ ID NO: 2937854 - DNA, 20 bp, Homo sapiens
cagtttataaagccaagaat

SEQ ID NO: 2937855 - DNA, 14 bp, Homo sapiens
cagtttatcattca

SEQ ID NO: 2937856 - DNA, 19 bp, Homo sapiens
cagtttatcattcaagtgt

SEQ ID NO: 2937857 - DNA, 16 bp, Homo sapiens
cagtttattaaatctg

SEQ ID NO: 2937858 - DNA, 15 bp, Homo sapiens
cagtttcattattct

SEQ ID NO: 2937859 - DNA, 12 bp, Homo sapiens
cagtttccagtc

SEQ ID NO: 2937860 - DNA, 22 bp, Homo sapiens
cagtttcttctgcgcctcaggc

SEQ ID NO: 2937861 - DNA, 17 bp, Homo sapiens
cagtttcttctgtaaat

SEQ ID NO: 2937862 - DNA, 16 bp, Homo sapiens
cagtttgaaattctga

SEQ ID NO: 2937863 - DNA, 23 bp, Homo sapiens
cagtttgcagaaaagcacctgcc

SEQ ID NO: 2937864 - DNA, 13 bp, Homo sapiens
cagtttgtttcct

SEQ ID NO: 2937865 - DNA, 15 bp, Homo sapiens
cagtttgtttcctgt

SEQ ID NO: 2937866 - DNA, 16 bp, Homo sapiens
cagttttcccactttt

SEQ ID NO: 2937867 - DNA, 11 bp, Homo sapiens
cagttttcctt

SEQ ID NO: 2937868 - DNA, 13 bp, Homo sapiens
cagttttccttct

SEQ ID NO: 2937869 - DNA, 22 bp, Homo sapiens
cagttttccttctcatctgtga

SEQ ID NO: 2937870 - DNA, 16 bp, Homo sapiens
cagttttcggaaacac

SEQ ID NO: 2937871 - DNA, 20 bp, Homo sapiens
cagttttgacatcagccagc

SEQ ID NO: 2937872 - DNA, 23 bp, Homo sapiens
cagttttgacatcagccagctgc

SEQ ID NO: 2937873 - DNA, 12 bp, Homo sapiens
cagttttgctgc

SEQ ID NO: 2937874 - DNA, 12 bp, Homo sapiens
cagttttgtaaa

SEQ ID NO: 2937875 - DNA, 15 bp, Homo sapiens
cagttttgtaaatgt

SEQ ID NO: 2937876 - DNA, 19 bp, Homo sapiens
cagttttgtaagccctctt

SEQ ID NO: 2937877 - DNA, 18 bp, Homo sapiens
cagttttgtggactgagc

SEQ ID NO: 2937878 - DNA, 17 bp, Homo sapiens
cataaaaaagaagcact

SEQ ID NO: 2937879 - DNA, 23 bp, Homo sapiens
cataaaaagaggatgatttcaga

SEQ ID NO: 2937880 - DNA, 12 bp, Homo sapiens
cataaaaagcag

SEQ ID NO: 2937881 - DNA, 17 bp, Homo sapiens
cataaaaagcagaattt

SEQ ID NO: 2937882 - DNA, 21 bp, Homo sapiens
cataaaaagcagaattttaat

SEQ ID NO: 2937883 - DNA, 12 bp, Homo sapiens
cataaaacaggt

SEQ ID NO: 2937884 - DNA, 13 bp, Homo sapiens
cataaaatttaca

SEQ ID NO: 2937885 - DNA, 16 bp, Homo sapiens
cataaaatttacattt

SEQ ID NO: 2937886 - DNA, 17 bp, Homo sapiens
cataaacctgtgctgaa

SEQ ID NO: 2937887 - DNA, 22 bp, Homo sapiens
cataaagaggcgttgctttcac

SEQ ID NO: 2937888 - DNA, 14 bp, Homo sapiens
cataaagtcttgcc

SEQ ID NO: 2937889 - DNA, 15 bp, Homo sapiens
cataaatagagtgtt

SEQ ID NO: 2937890 - DNA, 17 bp, Homo sapiens
cataaatagtagaaaaa

SEQ ID NO: 2937891 - DNA, 22 bp, Homo sapiens
cataaatctgaagtggttcagt

SEQ ID NO: 2937892 - DNA, 15 bp, Homo sapiens
cataaatgcagccca

SEQ ID NO: 2937893 - DNA, 16 bp, Homo sapiens
cataaatgcagcccat

SEQ ID NO: 2937894 - DNA, 14 bp, Homo sapiens
cataaatttaatgt

SEQ ID NO: 2937895 - DNA, 22 bp, Homo sapiens
cataaatttctctttttgaaaa

SEQ ID NO: 2937896 - DNA, 16 bp, Homo sapiens
cataaatttgttgtca

SEQ ID NO: 2937897 - DNA, 14 bp, Homo sapiens
cataacaattcctc

SEQ ID NO: 2937898 - DNA, 15 bp, Homo sapiens
cataacaattcctct

SEQ ID NO: 2937899 - DNA, 22 bp, Homo sapiens
cataacatagttgaaaaaagaa

SEQ ID NO: 2937900 - DNA, 23 bp, Homo sapiens
cataacggttaagaaagcactta

SEQ ID NO: 2937901 - DNA, 20 bp, Homo sapiens
cataactaatgaattgaaat

SEQ ID NO: 2937902 - DNA, 19 bp, Homo sapiens
cataactgctacttgctct

SEQ ID NO: 2937903 - DNA, 22 bp, Homo sapiens
cataactgctacttgctctgct

SEQ ID NO: 2937904 - DNA, 16 bp, Homo sapiens
cataacttctcatgta

SEQ ID NO: 2937905 - DNA, 19 bp, Homo sapiens
cataacttctcatgtatat

SEQ ID NO: 2937906 - DNA, 14 bp, Homo sapiens
cataactttatgaa

SEQ ID NO: 2937907 - DNA, 15 bp, Homo sapiens
cataactttatgaag

SEQ ID NO: 2937908 - DNA, 18 bp, Homo sapiens
cataactttatgaagtgc

SEQ ID NO: 2937909 - DNA, 14 bp, Homo sapiens
cataagaccaatct

SEQ ID NO: 2937910 - DNA, 15 bp, Homo sapiens
cataagaccaatctc

SEQ ID NO: 2937911 - DNA, 12 bp, Homo sapiens
cataagataaaa

SEQ ID NO: 2937912 - DNA, 19 bp, Homo sapiens
cataagcggcgtaagttta

SEQ ID NO: 2937913 - DNA, 18 bp, Homo sapiens
cataagtacctcagcatt

SEQ ID NO: 2937914 - DNA, 18 bp, Homo sapiens
cataagtgacagtttaac

SEQ ID NO: 2937915 - DNA, 21 bp, Homo sapiens
cataagtggagaaatgaaaag

SEQ ID NO: 2937916 - DNA, 18 bp, Homo sapiens
cataataaaaggctttga

SEQ ID NO: 2937917 - DNA, 21 bp, Homo sapiens
cataatacacttgccctgctc

SEQ ID NO: 2937918 - DNA, 16 bp, Homo sapiens
cataatgctactgtct

SEQ ID NO: 2937919 - DNA, 22 bp, Homo sapiens
cataatggggtcctggccatcc

SEQ ID NO: 2937920 - DNA, 12 bp, Homo sapiens
cataatgtgaag

SEQ ID NO: 2937921 - DNA, 23 bp, Homo sapiens
cataattcactctgagtgtttta

SEQ ID NO: 2937922 - DNA, 16 bp, Homo sapiens
cataattgattaaaat

SEQ ID NO: 2937923 - DNA, 17 bp, Homo sapiens
cataattgattaaaatc

SEQ ID NO: 2937924 - DNA, 21 bp, Homo sapiens
cataattgttgtggtttaaat

SEQ ID NO: 2937925 - DNA, 19 bp, Homo sapiens
cataatttgtttaaaattc

SEQ ID NO: 2937926 - DNA, 15 bp, Homo sapiens
catacacacacacac

SEQ ID NO: 2937927 - DNA, 16 bp, Homo sapiens
catacacacacacaca

SEQ ID NO: 2937928 - DNA, 20 bp, Homo sapiens
catacacacacacacacagc

SEQ ID NO: 2937929 - DNA, 13 bp, Homo sapiens
catacaccagcat

SEQ ID NO: 2937930 - DNA, 16 bp, Homo sapiens
caggttggcttttttc

SEQ ID NO: 2937931 - DNA, 19 bp, Homo sapiens
caggtttcactattcctat

SEQ ID NO: 2937932 - DNA, 16 bp, Homo sapiens
caggtttgtttcttga

SEQ ID NO: 2937933 - DNA, 20 bp, Homo sapiens
caggtttgtttcttgatagt

SEQ ID NO: 2937934 - DNA, 24 bp, Homo sapiens
caggttttcttctaatcataacat

SEQ ID NO: 2937935 - DNA, 18 bp, Homo sapiens
caggtttttgcccatcct

SEQ ID NO: 2937936 - DNA, 20 bp, Homo sapiens
caggtttttgcccatcctcc

SEQ ID NO: 2937937 - DNA, 13 bp, Homo sapiens
cagtaacacaatt

SEQ ID NO: 2937938 - DNA, 14 bp, Homo sapiens
cagtaacacaatta

SEQ ID NO: 2937939 - DNA, 21 bp, Homo sapiens
cagtaacgggtcgtaatgact

SEQ ID NO: 2937940 - DNA, 20 bp, Homo sapiens
cagtaatgctaaatgtgtaa

SEQ ID NO: 2937941 - DNA, 19 bp, Homo sapiens
cagtaattattatttaact

SEQ ID NO: 2937942 - DNA, 14 bp, Homo sapiens
cagtacaggcagca

SEQ ID NO: 2937943 - DNA, 16 bp, Homo sapiens
cagtacttcagcaaga

SEQ ID NO: 2937944 - DNA, 16 bp, Homo sapiens
cagtactttggaggcc

SEQ ID NO: 2937945 - DNA, 20 bp, Homo sapiens
cagtactttggaggccccta

SEQ ID NO: 2937946 - DNA, 16 bp, Homo sapiens
cagtagacattttaac

SEQ ID NO: 2937947 - DNA, 22 bp, Homo sapiens
cagtagacattttaacaagaag

SEQ ID NO: 2937948 - DNA, 23 bp, Homo sapiens
cagtagagtagggtagaaggaaa

SEQ ID NO: 2937949 - DNA, 13 bp, Homo sapiens
cagtagattttct

SEQ ID NO: 2937950 - DNA, 14 bp, Homo sapiens
cagtagattttctt

SEQ ID NO: 2937951 - DNA, 19 bp, Homo sapiens
cagtagattttctttaaaa

SEQ ID NO: 2937952 - DNA, 21 bp, Homo sapiens
cagtagcacaagttatttaaa

SEQ ID NO: 2937953 - DNA, 16 bp, Homo sapiens
cagtagccaaggcccg

SEQ ID NO: 2937954 - DNA, 20 bp, Homo sapiens
cagtagccatttttttgcag

SEQ ID NO: 2937955 - DNA, 22 bp, Homo sapiens
cagtagcccctaatcacatgtg

SEQ ID NO: 2937956 - DNA, 15 bp, Homo sapiens
cagtaggagcccagc

SEQ ID NO: 2937957 - DNA, 20 bp, Homo sapiens
cagtaggttatttagcttgg

SEQ ID NO: 2937958 - DNA, 12 bp, Homo sapiens
cagtagtgtttg

SEQ ID NO: 2937959 - DNA, 16 bp, Homo sapiens
cagtagtgtttggaat

SEQ ID NO: 2937960 - DNA, 17 bp, Homo sapiens
cagtagtgtttggaatt

SEQ ID NO: 2937961 - DNA, 14 bp, Homo sapiens
cagtatacagtcct

SEQ ID NO: 2937962 - DNA, 14 bp, Homo sapiens
cagtatattcttgt

SEQ ID NO: 2937963 - DNA, 20 bp, Homo sapiens
cagtatattcttgtaaatac

SEQ ID NO: 2937964 - DNA, 15 bp, Homo sapiens
cagtatcatattatt

SEQ ID NO: 2937965 - DNA, 24 bp, Homo sapiens
cagtatccatgctcttgaccttgt

SEQ ID NO: 2937966 - DNA, 15 bp, Homo sapiens
cagtatggtacattt

SEQ ID NO: 2937967 - DNA, 15 bp, Homo sapiens
cagtatgttttacac

SEQ ID NO: 2937968 - DNA, 22 bp, Homo sapiens
cagtattaaactctcctttgat

SEQ ID NO: 2937969 - DNA, 18 bp, Homo sapiens
cagtatttttcagatata

SEQ ID NO: 2937970 - DNA, 17 bp, Homo sapiens
cagtcaaatctgggctc

SEQ ID NO: 2937971 - DNA, 14 bp, Homo sapiens
cagtcaacctgggc

SEQ ID NO: 2937972 - DNA, 16 bp, Homo sapiens
cagtcacagccacccc

SEQ ID NO: 2937973 - DNA, 23 bp, Homo sapiens
cagtcacttcggccagagctgaa

SEQ ID NO: 2937974 - DNA, 13 bp, Homo sapiens
cagtcagaaggac

SEQ ID NO: 2937975 - DNA, 16 bp, Homo sapiens
cagtcagaaggacggc

SEQ ID NO: 2937976 - DNA, 18 bp, Homo sapiens
cagtcagaaggacggcag

SEQ ID NO: 2937977 - DNA, 21 bp, Homo sapiens
cagtcaggtagttgcaattga

SEQ ID NO: 2937978 - DNA, 17 bp, Homo sapiens
cagtcagtgcaaatgtc

SEQ ID NO: 2937979 - DNA, 18 bp, Homo sapiens
cagtcagtgcaaatgtca

SEQ ID NO: 2937980 - DNA, 21 bp, Homo sapiens
cagtcatcttgaccaagcagg

SEQ ID NO: 2937981 - DNA, 22 bp, Homo sapiens
cagtcatgttttaaatgtacag

SEQ ID NO: 2937982 - DNA, 13 bp, Homo sapiens
cagtcattatgag

SEQ ID NO: 2937983 - DNA, 22 bp, Homo sapiens
cagtcattcagcagcaaatttt

SEQ ID NO: 2937984 - DNA, 17 bp, Homo sapiens
cagtcattggctgtctc

SEQ ID NO: 2937985 - DNA, 21 bp, Homo sapiens
cagtcattggctgtctcctag

SEQ ID NO: 2937986 - DNA, 13 bp, Homo sapiens
cagtccacagctg

SEQ ID NO: 2937987 - DNA, 14 bp, Homo sapiens
cagtccacagctga

SEQ ID NO: 2937988 - DNA, 11 bp, Homo sapiens
cagtccagagc

SEQ ID NO: 2937989 - DNA, 13 bp, Homo sapiens
cagtccagagctt

SEQ ID NO: 2937990 - DNA, 19 bp, Homo sapiens
cagtccatgctccagggtc

SEQ ID NO: 2937991 - DNA, 19 bp, Homo sapiens
cagtcccaaatccttccca

SEQ ID NO: 2937992 - DNA, 17 bp, Homo sapiens
cagtccctgagcagtct

SEQ ID NO: 2937993 - DNA, 19 bp, Homo sapiens
cagtccctgagcagtctac

SEQ ID NO: 2937994 - DNA, 13 bp, Homo sapiens
cagggagggccag

SEQ ID NO: 2937995 - DNA, 16 bp, Homo sapiens
cagggagggccaggga

SEQ ID NO: 2937996 - DNA, 20 bp, Homo sapiens
cagggagggccagggaggca

SEQ ID NO: 2937997 - DNA, 16 bp, Homo sapiens
cagggaggggaagagg

SEQ ID NO: 2937998 - DNA, 22 bp, Homo sapiens
cagggaggggccggccctgtgt

SEQ ID NO: 2937999 - DNA, 14 bp, Homo sapiens
cagggatgccctgg

SEQ ID NO: 2938000 - DNA, 14 bp, Homo sapiens
cagggatgggcagc

SEQ ID NO: 2938001 - DNA, 17 bp, Homo sapiens
cagggatgggcagccca

SEQ ID NO: 2938002 - DNA, 21 bp, Homo sapiens
cagggatgggcagcccaacag

SEQ ID NO: 2938003 - DNA, 21 bp, Homo sapiens
cagggcaaaatcgccataggc

SEQ ID NO: 2938004 - DNA, 15 bp, Homo sapiens
cagggcaaggccatt

SEQ ID NO: 2938005 - DNA, 18 bp, Homo sapiens
cagggcaatgatgaatga

SEQ ID NO: 2938006 - DNA, 13 bp, Homo sapiens
cagggcagagtga

SEQ ID NO: 2938007 - DNA, 13 bp, Homo sapiens
cagggcagcccct

SEQ ID NO: 2938008 - DNA, 16 bp, Homo sapiens
cagggcagcccctgca

SEQ ID NO: 2938009 - DNA, 18 bp, Homo sapiens
cagggcagcccctgcaga

SEQ ID NO: 2938010 - DNA, 15 bp, Homo sapiens
cagggcagcgccagg

SEQ ID NO: 2938011 - DNA, 19 bp, Homo sapiens
cagggcagcgccaggctga

SEQ ID NO: 2938012 - DNA, 18 bp, Homo sapiens
cagggccaacccttctcc

SEQ ID NO: 2938013 - DNA, 17 bp, Homo sapiens
cagggccacgctccagc

SEQ ID NO: 2938014 - DNA, 17 bp, Homo sapiens
cagggccacgtgccagg

SEQ ID NO: 2938015 - DNA, 21 bp, Homo sapiens
cagggccacgtgccaggcccg

SEQ ID NO: 2938016 - DNA, 16 bp, Homo sapiens
cagggccagcaggcag

SEQ ID NO: 2938017 - DNA, 18 bp, Homo sapiens
cagggccagcaggcagcg

SEQ ID NO: 2938018 - DNA, 19 bp, Homo sapiens
cagggccagcaggcagcgc

SEQ ID NO: 2938019 - DNA, 22 bp, Homo sapiens
cagggccagcaggcagcgcctg

SEQ ID NO: 2938020 - DNA, 11 bp, Homo sapiens
cagggccagga

SEQ ID NO: 2938021 - DNA, 14 bp, Homo sapiens
cagggccaggaagg

SEQ ID NO: 2938022 - DNA, 20 bp, Homo sapiens
cagggccaggaaggacagac

SEQ ID NO: 2938023 - DNA, 24 bp, Homo sapiens
cagggccaggaaggacagactggc

SEQ ID NO: 2938024 - DNA, 17 bp, Homo sapiens
cagggccatggctcagg

SEQ ID NO: 2938025 - DNA, 17 bp, Homo sapiens
cagggcccacaccccct

SEQ ID NO: 2938026 - DNA, 21 bp, Homo sapiens
cagggcccagagcccagctcc

SEQ ID NO: 2938027 - DNA, 23 bp, Homo sapiens
cagggcccaggccatgtggcctg

SEQ ID NO: 2938028 - DNA, 15 bp, Homo sapiens
cagggcccaggcctg

SEQ ID NO: 2938029 - DNA, 14 bp, Homo sapiens
cagggccgaccaga

SEQ ID NO: 2938030 - DNA, 23 bp, Homo sapiens
cagggccgaccagaggagccttt

SEQ ID NO: 2938031 - DNA, 16 bp, Homo sapiens
cagggccgcgagaggc

SEQ ID NO: 2938032 - DNA, 17 bp, Homo sapiens
cagggccgcgagaggcc

SEQ ID NO: 2938033 - DNA, 20 bp, Homo sapiens
cagggccgcgagaggccgag

SEQ ID NO: 2938034 - DNA, 19 bp, Homo sapiens
cagggccgtcaaggaaagg

SEQ ID NO: 2938035 - DNA, 23 bp, Homo sapiens
cagggcctagctgctacaaagaa

SEQ ID NO: 2938036 - DNA, 19 bp, Homo sapiens
cagggcctgagcctggcca

SEQ ID NO: 2938037 - DNA, 13 bp, Homo sapiens
cagggcctggttg

SEQ ID NO: 2938038 - DNA, 18 bp, Homo sapiens
cagggcctggttgaagaa

SEQ ID NO: 2938039 - DNA, 13 bp, Homo sapiens
cagggccttgccc

SEQ ID NO: 2938040 - DNA, 14 bp, Homo sapiens
cagggccttgccca

SEQ ID NO: 2938041 - DNA, 15 bp, Homo sapiens
cagggccttgcccag

SEQ ID NO: 2938042 - DNA, 17 bp, Homo sapiens
cagggccttgcccagag

SEQ ID NO: 2938043 - DNA, 20 bp, Homo sapiens
cagggccttttctggcaccg

SEQ ID NO: 2938044 - DNA, 14 bp, Homo sapiens
cagggcggccaggg

SEQ ID NO: 2938045 - DNA, 17 bp, Homo sapiens
cagggcggccagggacc

SEQ ID NO: 2938046 - DNA, 14 bp, Homo sapiens
cagggcggctgccg

SEQ ID NO: 2938047 - DNA, 21 bp, Homo sapiens
cagggcggctgccgactcccc

SEQ ID NO: 2938048 - DNA, 22 bp, Homo sapiens
cagggcgggcagagggctggag

SEQ ID NO: 2938049 - DNA, 20 bp, Homo sapiens
cagggctagtgaagtggcct

SEQ ID NO: 2938050 - DNA, 21 bp, Homo sapiens
cagggctagtgaagtggcctc

SEQ ID NO: 2938051 - DNA, 22 bp, Homo sapiens
cagggctcctgtggcagctgcc

SEQ ID NO: 2938052 - DNA, 16 bp, Homo sapiens
cagggctctgggggca

SEQ ID NO: 2938053 - DNA, 19 bp, Homo sapiens
cagggctctgggggcagat

SEQ ID NO: 2938054 - DNA, 12 bp, Homo sapiens
cagggctgggtc

SEQ ID NO: 2938055 - DNA, 17 bp, Homo sapiens
cagggctgggtcacagg

SEQ ID NO: 2938056 - DNA, 21 bp, Homo sapiens
cagggctgggtcacaggaagg

SEQ ID NO: 2938057 - DNA, 13 bp, Homo sapiens
caggggaagggca

SEQ ID NO: 2938058 - DNA, 18 bp, Homo sapiens
caggggaagggcaggcac

SEQ ID NO: 2938059 - DNA, 18 bp, Homo sapiens
caggggacaaaccagggg

SEQ ID NO: 2938060 - DNA, 17 bp, Homo sapiens
caggggacactggcccc

SEQ ID NO: 2938061 - DNA, 14 bp, Homo sapiens
caggggaccagagg

SEQ ID NO: 2938062 - DNA, 20 bp, Homo sapiens
caggggaccagagggatggg

SEQ ID NO: 2938063 - DNA, 21 bp, Homo sapiens
caggggaccagagggatggga

SEQ ID NO: 2938064 - DNA, 14 bp, Homo sapiens
caggggactgggcc

SEQ ID NO: 2938065 - DNA, 15 bp, Homo sapiens
caggggactgggcca

SEQ ID NO: 2938066 - DNA, 16 bp, Homo sapiens
caggggactgggccat

SEQ ID NO: 2938067 - DNA, 18 bp, Homo sapiens
caggggagaatgcagccc

SEQ ID NO: 2938068 - DNA, 20 bp, Homo sapiens
caggggagagggtctggaga

SEQ ID NO: 2938069 - DNA, 17 bp, Homo sapiens
caggggagccagggtag

SEQ ID NO: 2938070 - DNA, 18 bp, Homo sapiens
caggggagccagggtaga

SEQ ID NO: 2938071 - DNA, 19 bp, Homo sapiens
caggggagccagggtagag

SEQ ID NO: 2938072 - DNA, 17 bp, Homo sapiens
caggggcagccacacca

SEQ ID NO: 2938073 - DNA, 19 bp, Homo sapiens
caggggctgacacttcaag

SEQ ID NO: 2938074 - DNA, 15 bp, Homo sapiens
caggggctgctgggg

SEQ ID NO: 2938075 - DNA, 18 bp, Homo sapiens
caggggctgctgggggct

SEQ ID NO: 2938076 - DNA, 23 bp, Homo sapiens
caggggctgctgggggctcccct

SEQ ID NO: 2938077 - DNA, 22 bp, Homo sapiens
cagggggatgccactcctccct

SEQ ID NO: 2938078 - DNA, 17 bp, Homo sapiens
cagggggcatgaccaga

SEQ ID NO: 2938079 - DNA, 20 bp, Homo sapiens
caggggggtcggaagcctgt

SEQ ID NO: 2938080 - DNA, 21 bp, Homo sapiens
caggggggtcggaagcctgtc

SEQ ID NO: 2938081 - DNA, 19 bp, Homo sapiens
cagggggtgaaggcaggag

SEQ ID NO: 2938082 - DNA, 20 bp, Homo sapiens
caggggtaccaggcacatgg

SEQ ID NO: 2938083 - DNA, 22 bp, Homo sapiens
caggggtaccaggcacatggct

SEQ ID NO: 2938084 - DNA, 23 bp, Homo sapiens
caggggtaccaggcacatggctg

SEQ ID NO: 2938085 - DNA, 23 bp, Homo sapiens
caggggtcactgaggcctgagac

SEQ ID NO: 2938086 - DNA, 19 bp, Homo sapiens
caggggtcaggtgtcaggc

SEQ ID NO: 2938087 - DNA, 20 bp, Homo sapiens
caggggtcaggtgtcaggcc

SEQ ID NO: 2938088 - DNA, 17 bp, Homo sapiens
caggggtgacacagact

SEQ ID NO: 2938089 - DNA, 18 bp, Homo sapiens
caggggtgagagcaccca

SEQ ID NO: 2938090 - DNA, 19 bp, Homo sapiens
caggggtgagagcacccac

SEQ ID NO: 2938091 - DNA, 21 bp, Homo sapiens
caggggtgagagcacccactg

SEQ ID NO: 2938092 - DNA, 22 bp, Homo sapiens
caggggtggctgcctcatttag

SEQ ID NO: 2938093 - DNA, 19 bp, Homo sapiens
cagggtagagcaaaggaga

SEQ ID NO: 2938094 - DNA, 10 bp, Homo sapiens
cagggtcaga

SEQ ID NO: 2938095 - DNA, 18 bp, Homo sapiens
cagggtcagaaacaggac

SEQ ID NO: 2938096 - DNA, 17 bp, Homo sapiens
cagggtctagccgctgc

SEQ ID NO: 2938097 - DNA, 21 bp, Homo sapiens
cagggtctagccgctgccctg

SEQ ID NO: 2938098 - DNA, 22 bp, Homo sapiens
cagggtctagccgctgccctgg

SEQ ID NO: 2938099 - DNA, 13 bp, Homo sapiens
cagggtctctgct

SEQ ID NO: 2938100 - DNA, 21 bp, Homo sapiens
cagggtcttttcatctgggaa

SEQ ID NO: 2938101 - DNA, 22 bp, Homo sapiens
cagggtcttttcatctgggaaa

SEQ ID NO: 2938102 - DNA, 18 bp, Homo sapiens
cagggtgatgccaggttc

SEQ ID NO: 2938103 - DNA, 20 bp, Homo sapiens
cagggtgcagtatcatgccc

SEQ ID NO: 2938104 - DNA, 15 bp, Homo sapiens
cagggtggagctgag

SEQ ID NO: 2938105 - DNA, 18 bp, Homo sapiens
cagggtggagtgcagtgg

SEQ ID NO: 2938106 - DNA, 17 bp, Homo sapiens
cagggtggcccaggtgg

SEQ ID NO: 2938107 - DNA, 14 bp, Homo sapiens
cagggtgggagccg

SEQ ID NO: 2938108 - DNA, 17 bp, Homo sapiens
cagggtgggatggagga

SEQ ID NO: 2938109 - DNA, 18 bp, Homo sapiens
cagggtgggatggaggag

SEQ ID NO: 2938110 - DNA, 23 bp, Homo sapiens
cagggtgggcctcggcccctccc

SEQ ID NO: 2938111 - DNA, 22 bp, Homo sapiens
cagggtggtctcttcttggggc

SEQ ID NO: 2938112 - DNA, 17 bp, Homo sapiens
cagggtggtggcacatt

SEQ ID NO: 2938113 - DNA, 20 bp, Homo sapiens
cagggttgaccccagaggat

SEQ ID NO: 2938114 - DNA, 19 bp, Homo sapiens
cagggtttcaccatgttgc

SEQ ID NO: 2938115 - DNA, 13 bp, Homo sapiens
cagggtttgagca

SEQ ID NO: 2938116 - DNA, 16 bp, Homo sapiens
cagggttttttcattt

SEQ ID NO: 2938117 - DNA, 18 bp, Homo sapiens
cagggttttttcattttt

SEQ ID NO: 2938118 - DNA, 19 bp, Homo sapiens
caggtaatgtgaataaatt

SEQ ID NO: 2938119 - DNA, 22 bp, Homo sapiens
caggtaccttgacctttgtaca

SEQ ID NO: 2938120 - DNA, 23 bp, Homo sapiens
caggtaccttgacctttgtacag

SEQ ID NO: 2938121 - DNA, 16 bp, Homo sapiens
caggtacgcacagaca

SEQ ID NO: 2938122 - DNA, 17 bp, Homo sapiens
caggtacgcacagacag

SEQ ID NO: 2938123 - DNA, 22 bp, Homo sapiens
caggtacgcacagacaggtttt

SEQ ID NO: 2938124 - DNA, 20 bp, Homo sapiens
caggtacttggagggctcag

SEQ ID NO: 2938125 - DNA, 15 bp, Homo sapiens
caggtagcagcaaat

SEQ ID NO: 2938126 - DNA, 16 bp, Homo sapiens
caggtagctgcccctg

SEQ ID NO: 2938127 - DNA, 18 bp, Homo sapiens
caggtagctgcccctggc

SEQ ID NO: 2938128 - DNA, 19 bp, Homo sapiens
caggtagctgcccctggct

SEQ ID NO: 2938129 - DNA, 19 bp, Homo sapiens
caggcccccaagcctgcag

SEQ ID NO: 2938130 - DNA, 20 bp, Homo sapiens
caggcccccaccacacatcc

SEQ ID NO: 2938131 - DNA, 22 bp, Homo sapiens
caggccccgcttgtccagcgcc

SEQ ID NO: 2938132 - DNA, 23 bp, Homo sapiens
caggccccgcttgtccagcgcct

SEQ ID NO: 2938133 - DNA, 13 bp, Homo sapiens
caggcccctctcc

SEQ ID NO: 2938134 - DNA, 15 bp, Homo sapiens
caggcccgcgggcac

SEQ ID NO: 2938135 - DNA, 21 bp, Homo sapiens
caggcccgcgggcacagccag

SEQ ID NO: 2938136 - DNA, 22 bp, Homo sapiens
caggcccgcgggcacagccagc

SEQ ID NO: 2938137 - DNA, 16 bp, Homo sapiens
caggcccggcagggcg

SEQ ID NO: 2938138 - DNA, 24 bp, Homo sapiens
caggcccgtcggagctgcctgcag

SEQ ID NO: 2938139 - DNA, 15 bp, Homo sapiens
caggcccgtctgtcc

SEQ ID NO: 2938140 - DNA, 17 bp, Homo sapiens
caggcccgtctgtccat

SEQ ID NO: 2938141 - DNA, 20 bp, Homo sapiens
caggcccgtctgtccatctg

SEQ ID NO: 2938142 - DNA, 14 bp, Homo sapiens
caggccctcagctg

SEQ ID NO: 2938143 - DNA, 14 bp, Homo sapiens
caggccctctgcct

SEQ ID NO: 2938144 - DNA, 15 bp, Homo sapiens
caggccctctgcctg

SEQ ID NO: 2938145 - DNA, 17 bp, Homo sapiens
caggccctctgcctgca

SEQ ID NO: 2938146 - DNA, 18 bp, Homo sapiens
caggccctctgcctgcac

SEQ ID NO: 2938147 - DNA, 20 bp, Homo sapiens
caggccctctgcctgcactc

SEQ ID NO: 2938148 - DNA, 21 bp, Homo sapiens
caggccctctgcctgcactcc

SEQ ID NO: 2938149 - DNA, 23 bp, Homo sapiens
caggccctctgcctgcactccct

SEQ ID NO: 2938150 - DNA, 16 bp, Homo sapiens
caggccctggagggca

SEQ ID NO: 2938151 - DNA, 12 bp, Homo sapiens
caggccctgggt

SEQ ID NO: 2938152 - DNA, 14 bp, Homo sapiens
caggccctgggtct

SEQ ID NO: 2938153 - DNA, 13 bp, Homo sapiens
caggccctgtcca

SEQ ID NO: 2938154 - DNA, 20 bp, Homo sapiens
caggccctgtccagccccca

SEQ ID NO: 2938155 - DNA, 14 bp, Homo sapiens
caggccgccctgcg

SEQ ID NO: 2938156 - DNA, 18 bp, Homo sapiens
caggccgcgccctttccc

SEQ ID NO: 2938157 - DNA, 13 bp, Homo sapiens
caggccggagccc

SEQ ID NO: 2938158 - DNA, 14 bp, Homo sapiens
caggccggagccca

SEQ ID NO: 2938159 - DNA, 15 bp, Homo sapiens
caggccggagcccag

SEQ ID NO: 2938160 - DNA, 19 bp, Homo sapiens
caggcctaggtgcagctcc

SEQ ID NO: 2938161 - DNA, 22 bp, Homo sapiens
caggcctaggtgcagctcctca

SEQ ID NO: 2938162 - DNA, 22 bp, Homo sapiens
caggcctatgttgatccatcca

SEQ ID NO: 2938163 - DNA, 16 bp, Homo sapiens
caggcctcactggctc

SEQ ID NO: 2938164 - DNA, 19 bp, Homo sapiens
caggcctccagctcagcag

SEQ ID NO: 2938165 - DNA, 15 bp, Homo sapiens
caggcctccctgaaa

SEQ ID NO: 2938166 - DNA, 14 bp, Homo sapiens
caggcctcgcctgc

SEQ ID NO: 2938167 - DNA, 17 bp, Homo sapiens
caggcctcgcctgccct

SEQ ID NO: 2938168 - DNA, 19 bp, Homo sapiens
caggcctcgcctgccctcc

SEQ ID NO: 2938169 - DNA, 20 bp, Homo sapiens
caggcctcgcctgccctcct

SEQ ID NO: 2938170 - DNA, 22 bp, Homo sapiens
caggcctcgcctgccctcctct

SEQ ID NO: 2938171 - DNA, 15 bp, Homo sapiens
caggcctcttggcag

SEQ ID NO: 2938172 - DNA, 19 bp, Homo sapiens
caggcctcttggcagtcac

SEQ ID NO: 2938173 - DNA, 13 bp, Homo sapiens
caggcctgccctg

SEQ ID NO: 2938174 - DNA, 13 bp, Homo sapiens
caggcctttccta

SEQ ID NO: 2938175 - DNA, 17 bp, Homo sapiens
caggcgagcctgactct

SEQ ID NO: 2938176 - DNA, 19 bp, Homo sapiens
caggcgcctataatcccag

SEQ ID NO: 2938177 - DNA, 20 bp, Homo sapiens
caggcgcctataatcccagc

SEQ ID NO: 2938178 - DNA, 15 bp, Homo sapiens
caggcgcctgccatc

SEQ ID NO: 2938179 - DNA, 16 bp, Homo sapiens
caggcgcggcggctct

SEQ ID NO: 2938180 - DNA, 22 bp, Homo sapiens
caggcggagctgctgagtgaca

SEQ ID NO: 2938181 - DNA, 15 bp, Homo sapiens
caggcggccagggcg

SEQ ID NO: 2938182 - DNA, 17 bp, Homo sapiens
caggcggccctcagtgc

SEQ ID NO: 2938183 - DNA, 21 bp, Homo sapiens
caggcggggcccagcgctctc

SEQ ID NO: 2938184 - DNA, 24 bp, Homo sapiens
caggcggggcccagcgctctcctg

SEQ ID NO: 2938185 - DNA, 21 bp, Homo sapiens
caggcgtgactcagcagcctg

SEQ ID NO: 2938186 - DNA, 15 bp, Homo sapiens
caggcgtgagccact

SEQ ID NO: 2938187 - DNA, 17 bp, Homo sapiens
caggcgtgtggcagcca

SEQ ID NO: 2938188 - DNA, 23 bp, Homo sapiens
caggcgtgtggcagccacacgca

SEQ ID NO: 2938189 - DNA, 16 bp, Homo sapiens
caggctacaagagaac

SEQ ID NO: 2938190 - DNA, 15 bp, Homo sapiens
caggctcagagggtg

SEQ ID NO: 2938191 - DNA, 14 bp, Homo sapiens
caggctcccctgag

SEQ ID NO: 2938192 - DNA, 16 bp, Homo sapiens
caggctcccctgagga

SEQ ID NO: 2938193 - DNA, 14 bp, Homo sapiens
caggctcctccctc

SEQ ID NO: 2938194 - DNA, 15 bp, Homo sapiens
caggctcctgtgata

SEQ ID NO: 2938195 - DNA, 14 bp, Homo sapiens
caggctctcaacag

SEQ ID NO: 2938196 - DNA, 15 bp, Homo sapiens
caggctctgttcctc

SEQ ID NO: 2938197 - DNA, 16 bp, Homo sapiens
caggctctgttcctca

SEQ ID NO: 2938198 - DNA, 21 bp, Homo sapiens
caggctctgttcctcaatggc

SEQ ID NO: 2938199 - DNA, 20 bp, Homo sapiens
caggctgaccacagcacagc

SEQ ID NO: 2938200 - DNA, 21 bp, Homo sapiens
caggctgaccacagcacagcc

SEQ ID NO: 2938201 - DNA, 15 bp, Homo sapiens
caggctgcaggaggg

SEQ ID NO: 2938202 - DNA, 16 bp, Homo sapiens
caggctgcaggagggc

SEQ ID NO: 2938203 - DNA, 15 bp, Homo sapiens
caggctgccagagaa

SEQ ID NO: 2938204 - DNA, 18 bp, Homo sapiens
caggctggaatgagggag

SEQ ID NO: 2938205 - DNA, 15 bp, Homo sapiens
caggctggccagccg

SEQ ID NO: 2938206 - DNA, 19 bp, Homo sapiens
caggctggccagccgctct

SEQ ID NO: 2938207 - DNA, 16 bp, Homo sapiens
caggctggctccagat

SEQ ID NO: 2938208 - DNA, 12 bp, Homo sapiens
caggctggctcg

SEQ ID NO: 2938209 - DNA, 20 bp, Homo sapiens
caggctggctcgtaggcctg

SEQ ID NO: 2938210 - DNA, 23 bp, Homo sapiens
caggctgggccgcaagggcctgg

SEQ ID NO: 2938211 - DNA, 12 bp, Homo sapiens
caggctgggctg

SEQ ID NO: 2938212 - DNA, 14 bp, Homo sapiens
caggctgggctgag

SEQ ID NO: 2938213 - DNA, 23 bp, Homo sapiens
caggctggtctcaaactcctgac

SEQ ID NO: 2938214 - DNA, 20 bp, Homo sapiens
caggctggtctcgaactcct

SEQ ID NO: 2938215 - DNA, 13 bp, Homo sapiens
caggctgtcccaa

SEQ ID NO: 2938216 - DNA, 16 bp, Homo sapiens
caggctgtcccaagct

SEQ ID NO: 2938217 - DNA, 21 bp, Homo sapiens
caggctgtcccaagctcccaa

SEQ ID NO: 2938218 - DNA, 17 bp, Homo sapiens
caggctgtctggccagg

SEQ ID NO: 2938219 - DNA, 20 bp, Homo sapiens
caggcttaataaaaatgaca

SEQ ID NO: 2938220 - DNA, 21 bp, Homo sapiens
caggcttaataaaaatgacag

SEQ ID NO: 2938221 - DNA, 20 bp, Homo sapiens
caggcttccctgacttgctt

SEQ ID NO: 2938222 - DNA, 18 bp, Homo sapiens
caggacactaccctgaga

SEQ ID NO: 2938223 - DNA, 14 bp, Homo sapiens
caggacagctcttg

SEQ ID NO: 2938224 - DNA, 12 bp, Homo sapiens
caggacaggccc

SEQ ID NO: 2938225 - DNA, 13 bp, Homo sapiens
caggacaggcccg

SEQ ID NO: 2938226 - DNA, 20 bp, Homo sapiens
caggacatgcggtagccagc

SEQ ID NO: 2938227 - DNA, 15 bp, Homo sapiens
caggaccaagggggc

SEQ ID NO: 2938228 - DNA, 18 bp, Homo sapiens
caggaccaagggggcggg

SEQ ID NO: 2938229 - DNA, 12 bp, Homo sapiens
caggaccagctc

SEQ ID NO: 2938230 - DNA, 15 bp, Homo sapiens
caggaccagctcagg

SEQ ID NO: 2938231 - DNA, 20 bp, Homo sapiens
caggaccaggacccagggag

SEQ ID NO: 2938232 - DNA, 14 bp, Homo sapiens
caggacccagagga

SEQ ID NO: 2938233 - DNA, 16 bp, Homo sapiens
caggacccagaggaag

SEQ ID NO: 2938234 - DNA, 15 bp, Homo sapiens
caggacccagggaga

SEQ ID NO: 2938235 - DNA, 12 bp, Homo sapiens
caggacccctga

SEQ ID NO: 2938236 - DNA, 14 bp, Homo sapiens
caggacccgccagc

SEQ ID NO: 2938237 - DNA, 14 bp, Homo sapiens
caggaccctgaagg

SEQ ID NO: 2938238 - DNA, 17 bp, Homo sapiens
caggaccctgaaggggc

SEQ ID NO: 2938239 - DNA, 19 bp, Homo sapiens
caggacctccaagccactg

SEQ ID NO: 2938240 - DNA, 23 bp, Homo sapiens
caggacctccaagccactgagca

SEQ ID NO: 2938241 - DNA, 15 bp, Homo sapiens
caggacctgcctgta

SEQ ID NO: 2938242 - DNA, 14 bp, Homo sapiens
caggacctggctgc

SEQ ID NO: 2938243 - DNA, 17 bp, Homo sapiens
caggacctggctgccat

SEQ ID NO: 2938244 - DNA, 13 bp, Homo sapiens
caggacctggctt

SEQ ID NO: 2938245 - DNA, 14 bp, Homo sapiens
caggacctggcttg

SEQ ID NO: 2938246 - DNA, 20 bp, Homo sapiens
caggaccttcgggctgtgcc

SEQ ID NO: 2938247 - DNA, 22 bp, Homo sapiens
caggacgaatgcatattcaaca

SEQ ID NO: 2938248 - DNA, 16 bp, Homo sapiens
caggacgtgggctggg

SEQ ID NO: 2938249 - DNA, 17 bp, Homo sapiens
caggacgtgggctgggc

SEQ ID NO: 2938250 - DNA, 18 bp, Homo sapiens
caggactcagaagcctct

SEQ ID NO: 2938251 - DNA, 20 bp, Homo sapiens
caggactcagaagcctctgg

SEQ ID NO: 2938252 - DNA, 14 bp, Homo sapiens
caggactctgaccc

SEQ ID NO: 2938253 - DNA, 20 bp, Homo sapiens
caggactgaattgtccccag

SEQ ID NO: 2938254 - DNA, 21 bp, Homo sapiens
caggactgaattgtccccagt

SEQ ID NO: 2938255 - DNA, 21 bp, Homo sapiens
caggactgggtctgacctggt

SEQ ID NO: 2938256 - DNA, 21 bp, Homo sapiens
caggagaaggccaattcctat

SEQ ID NO: 2938257 - DNA, 16 bp, Homo sapiens
caggagaatcgcttga

SEQ ID NO: 2938258 - DNA, 21 bp, Homo sapiens
caggagaatcgcttgaacctg

SEQ ID NO: 2938259 - DNA, 22 bp, Homo sapiens
caggagaatcgcttgaacctgg

SEQ ID NO: 2938260 - DNA, 23 bp, Homo sapiens
caggagacaggttagctgctccc

SEQ ID NO: 2938261 - DNA, 18 bp, Homo sapiens
caggagacccaacaatga

SEQ ID NO: 2938262 - DNA, 13 bp, Homo sapiens
caggagagccagc

SEQ ID NO: 2938263 - DNA, 19 bp, Homo sapiens
caggagagccagccctccc

SEQ ID NO: 2938264 - DNA, 15 bp, Homo sapiens
caggagaggagagcc

SEQ ID NO: 2938265 - DNA, 17 bp, Homo sapiens
caggagaggagagccag

SEQ ID NO: 2938266 - DNA, 16 bp, Homo sapiens
caggagcaatcacagg

SEQ ID NO: 2938267 - DNA, 17 bp, Homo sapiens
caggagcaatcacagga

SEQ ID NO: 2938268 - DNA, 19 bp, Homo sapiens
caggagcacacccagcccc

SEQ ID NO: 2938269 - DNA, 14 bp, Homo sapiens
caggagcagggcgg

SEQ ID NO: 2938270 - DNA, 15 bp, Homo sapiens
caggagcagggcggc

SEQ ID NO: 2938271 - DNA, 19 bp, Homo sapiens
caggagcagggcggctgcc

SEQ ID NO: 2938272 - DNA, 15 bp, Homo sapiens
caggagccctgctat

SEQ ID NO: 2938273 - DNA, 20 bp, Homo sapiens
caggagccggacacttctca

SEQ ID NO: 2938274 - DNA, 22 bp, Homo sapiens
caggagccggacacttctcagg

SEQ ID NO: 2938275 - DNA, 21 bp, Homo sapiens
caggagctagttctcagcttg

SEQ ID NO: 2938276 - DNA, 12 bp, Homo sapiens
caggagctctgc

SEQ ID NO: 2938277 - DNA, 17 bp, Homo sapiens
caggagctctgcgccag

SEQ ID NO: 2938278 - DNA, 14 bp, Homo sapiens
caggagctgggatc

SEQ ID NO: 2938279 - DNA, 22 bp, Homo sapiens
caggagctgggatcctaagggc

SEQ ID NO: 2938280 - DNA, 21 bp, Homo sapiens
caggagctgtcaccaaggaaa

SEQ ID NO: 2938281 - DNA, 16 bp, Homo sapiens
caggaggacaattcat

SEQ ID NO: 2938282 - DNA, 23 bp, Homo sapiens
caggaggagctgcctcttctctt

SEQ ID NO: 2938283 - DNA, 17 bp, Homo sapiens
caggaggaggctgccct

SEQ ID NO: 2938284 - DNA, 23 bp, Homo sapiens
caggaggcaggcatggccctggg

SEQ ID NO: 2938285 - DNA, 21 bp, Homo sapiens
caggaggccctggtcctggcc

SEQ ID NO: 2938286 - DNA, 22 bp, Homo sapiens
caggaggccctggtcctggcct

SEQ ID NO: 2938287 - DNA, 13 bp, Homo sapiens
caggaggcggcag

SEQ ID NO: 2938288 - DNA, 21 bp, Homo sapiens
caggaggcggcagctcttctg

SEQ ID NO: 2938289 - DNA, 13 bp, Homo sapiens
caggaggctgagg

SEQ ID NO: 2938290 - DNA, 16 bp, Homo sapiens
caggaggctgaggcag

SEQ ID NO: 2938291 - DNA, 21 bp, Homo sapiens
caggaggctgaggcagaagaa

SEQ ID NO: 2938292 - DNA, 13 bp, Homo sapiens
caggagggagggt

SEQ ID NO: 2938293 - DNA, 14 bp, Homo sapiens
caggagggagggtt

SEQ ID NO: 2938294 - DNA, 12 bp, Homo sapiens
caggagggcact

SEQ ID NO: 2938295 - DNA, 14 bp, Homo sapiens
caggagggcactgg

SEQ ID NO: 2938296 - DNA, 19 bp, Homo sapiens
caggaggggaacactgccc

SEQ ID NO: 2938297 - DNA, 24 bp, Homo sapiens
caggaggggaacactgccctcgca

SEQ ID NO: 2938298 - DNA, 20 bp, Homo sapiens
caggagtcaccatgcaaggg

SEQ ID NO: 2938299 - DNA, 19 bp, Homo sapiens
caggagtccaagaccagac

SEQ ID NO: 2938300 - DNA, 21 bp, Homo sapiens
caggagtgtcctcttccctct

SEQ ID NO: 2938301 - DNA, 18 bp, Homo sapiens
caggagttcaagaccagc

SEQ ID NO: 2938302 - DNA, 19 bp, Homo sapiens
caggagttcaagaccagcc

SEQ ID NO: 2938303 - DNA, 17 bp, Homo sapiens
caggagttcaagactag

SEQ ID NO: 2938304 - DNA, 21 bp, Homo sapiens
caggagttcaagactagcctg

SEQ ID NO: 2938305 - DNA, 20 bp, Homo sapiens
caggagttgtgagccctcta

SEQ ID NO: 2938306 - DNA, 16 bp, Homo sapiens
caggagtttgagacca

SEQ ID NO: 2938307 - DNA, 19 bp, Homo sapiens
caggatagagactggaaca

SEQ ID NO: 2938308 - DNA, 16 bp, Homo sapiens
caggataggactccat

SEQ ID NO: 2938309 - DNA, 18 bp, Homo sapiens
caggatcaagcatgaaag

SEQ ID NO: 2938310 - DNA, 21 bp, Homo sapiens
caggatcatcatttaaaaaaa

SEQ ID NO: 2938311 - DNA, 17 bp, Homo sapiens
caggatccaagctaagc

SEQ ID NO: 2938312 - DNA, 23 bp, Homo sapiens
caggatgcacggtttctgttctg

SEQ ID NO: 2938313 - DNA, 20 bp, Homo sapiens
caggatgtgtttgctttctg

SEQ ID NO: 2938314 - DNA, 13 bp, Homo sapiens
caggatttataca

SEQ ID NO: 2938315 - DNA, 18 bp, Homo sapiens
caggatttatacatacag

SEQ ID NO: 2938316 - DNA, 20 bp, Homo sapiens
caggatttgttctctgtcca

SEQ ID NO: 2938317 - DNA, 14 bp, Homo sapiens
caggattttgtatt

SEQ ID NO: 2938318 - DNA, 22 bp, Homo sapiens
caggatttttagagcattaaaa

SEQ ID NO: 2938319 - DNA, 12 bp, Homo sapiens
caggcacacagc

SEQ ID NO: 2938320 - DNA, 18 bp, Homo sapiens
caggcacatggctggggg

SEQ ID NO: 2938321 - DNA, 16 bp, Homo sapiens
caggcaccagtccctg

SEQ ID NO: 2938322 - DNA, 18 bp, Homo sapiens
caggcaccagtccctgtc

SEQ ID NO: 2938323 - DNA, 15 bp, Homo sapiens
caggcaccgggctgg

SEQ ID NO: 2938324 - DNA, 18 bp, Homo sapiens
caggcaccgggctggctg

SEQ ID NO: 2938325 - DNA, 20 bp, Homo sapiens
cagctcaggggacactggcc

SEQ ID NO: 2938326 - DNA, 13 bp, Homo sapiens
cagctcagtgttt

SEQ ID NO: 2938327 - DNA, 19 bp, Homo sapiens
cagctcatagtgaacacag

SEQ ID NO: 2938328 - DNA, 19 bp, Homo sapiens
cagctcattcattttatat

SEQ ID NO: 2938329 - DNA, 20 bp, Homo sapiens
cagctcattcattttatatt

SEQ ID NO: 2938330 - DNA, 16 bp, Homo sapiens
cagctccagttggagt

SEQ ID NO: 2938331 - DNA, 12 bp, Homo sapiens
cagctcccaccc

SEQ ID NO: 2938332 - DNA, 14 bp, Homo sapiens
cagctcccacccca

SEQ ID NO: 2938333 - DNA, 13 bp, Homo sapiens
cagctccgacctc

SEQ ID NO: 2938334 - DNA, 21 bp, Homo sapiens
cagctccggcctgtcctccaa

SEQ ID NO: 2938335 - DNA, 12 bp, Homo sapiens
cagctcctcagc

SEQ ID NO: 2938336 - DNA, 17 bp, Homo sapiens
cagctcctcccctgccg

SEQ ID NO: 2938337 - DNA, 14 bp, Homo sapiens
cagctccttcctgg

SEQ ID NO: 2938338 - DNA, 16 bp, Homo sapiens
cagctccttttctgtg

SEQ ID NO: 2938339 - DNA, 16 bp, Homo sapiens
cagctcggggagcctt

SEQ ID NO: 2938340 - DNA, 18 bp, Homo sapiens
cagctctaaaacagattg

SEQ ID NO: 2938341 - DNA, 22 bp, Homo sapiens
cagctctaaaacatagactgaa

SEQ ID NO: 2938342 - DNA, 21 bp, Homo sapiens
cagctctaagcagccaggagg

SEQ ID NO: 2938343 - DNA, 14 bp, Homo sapiens
cagctctccctctg

SEQ ID NO: 2938344 - DNA, 16 bp, Homo sapiens
cagctctccctctggc

SEQ ID NO: 2938345 - DNA, 21 bp, Homo sapiens
cagctctccctctggccctgc

SEQ ID NO: 2938346 - DNA, 18 bp, Homo sapiens
cagctctgaaaccagtgt

SEQ ID NO: 2938347 - DNA, 20 bp, Homo sapiens
cagctctgacattctgattc

SEQ ID NO: 2938348 - DNA, 18 bp, Homo sapiens
cagctctgactttacact

SEQ ID NO: 2938349 - DNA, 19 bp, Homo sapiens
cagctctgcagcaatattc

SEQ ID NO: 2938350 - DNA, 22 bp, Homo sapiens
cagctctgccgtctctggagcg

SEQ ID NO: 2938351 - DNA, 17 bp, Homo sapiens
cagctctgggaactgaa

SEQ ID NO: 2938352 - DNA, 22 bp, Homo sapiens
cagctctgggccattctccaca

SEQ ID NO: 2938353 - DNA, 14 bp, Homo sapiens
cagctctgtctgct

SEQ ID NO: 2938354 - DNA, 14 bp, Homo sapiens
cagctcttcatctg

SEQ ID NO: 2938355 - DNA, 18 bp, Homo sapiens
cagctcttcatctgccca

SEQ ID NO: 2938356 - DNA, 22 bp, Homo sapiens
cagctcttctgccggccctggg

SEQ ID NO: 2938357 - DNA, 18 bp, Homo sapiens
cagctcttctgggcagag

SEQ ID NO: 2938358 - DNA, 22 bp, Homo sapiens
cagctcttctgggcagagcctg

SEQ ID NO: 2938359 - DNA, 20 bp, Homo sapiens
cagctcttgatttgggtgga

SEQ ID NO: 2938360 - DNA, 19 bp, Homo sapiens
cagctcttgctctcttgtg

SEQ ID NO: 2938361 - DNA, 16 bp, Homo sapiens
cagctcttggctccac

SEQ ID NO: 2938362 - DNA, 11 bp, Homo sapiens
cagctcttgtt

SEQ ID NO: 2938363 - DNA, 22 bp, Homo sapiens
cagctgaaatatgctggctgga

SEQ ID NO: 2938364 - DNA, 15 bp, Homo sapiens
cagctgaccccctcc

SEQ ID NO: 2938365 - DNA, 14 bp, Homo sapiens
cagctgaccgggct

SEQ ID NO: 2938366 - DNA, 18 bp, Homo sapiens
cagctgagcgccaggatg

SEQ ID NO: 2938367 - DNA, 13 bp, Homo sapiens
cagctgcaaagtg

SEQ ID NO: 2938368 - DNA, 15 bp, Homo sapiens
cagctgcaaagtgtt

SEQ ID NO: 2938369 - DNA, 20 bp, Homo sapiens
cagctgcatttcacatgcct

SEQ ID NO: 2938370 - DNA, 17 bp, Homo sapiens
cagctgccccggcccct

SEQ ID NO: 2938371 - DNA, 13 bp, Homo sapiens
cagctgccccggg

SEQ ID NO: 2938372 - DNA, 14 bp, Homo sapiens
cagctgcccctcct

SEQ ID NO: 2938373 - DNA, 13 bp, Homo sapiens
cagctgcccctgg

SEQ ID NO: 2938374 - DNA, 17 bp, Homo sapiens
cagctgcccctggcacc

SEQ ID NO: 2938375 - DNA, 14 bp, Homo sapiens
cagctgcctggcca

SEQ ID NO: 2938376 - DNA, 21 bp, Homo sapiens
cagctgcctggccatgctgtc

SEQ ID NO: 2938377 - DNA, 20 bp, Homo sapiens
cagctgccttagcttcagga

SEQ ID NO: 2938378 - DNA, 22 bp, Homo sapiens
cagctgccttagcttcaggaac

SEQ ID NO: 2938379 - DNA, 17 bp, Homo sapiens
cagctgcgttctgaggg

SEQ ID NO: 2938380 - DNA, 16 bp, Homo sapiens
cagctgctcagagcca

SEQ ID NO: 2938381 - DNA, 16 bp, Homo sapiens
cagctgctcccacact

SEQ ID NO: 2938382 - DNA, 18 bp, Homo sapiens
cagctgctcctagaggga

SEQ ID NO: 2938383 - DNA, 16 bp, Homo sapiens
cagctgctgccactct

SEQ ID NO: 2938384 - DNA, 17 bp, Homo sapiens
cagctgctgttgaactt

SEQ ID NO: 2938385 - DNA, 12 bp, Homo sapiens
cagctggaaact

SEQ ID NO: 2938386 - DNA, 20 bp, Homo sapiens
cagctggaaacttctgtaag

SEQ ID NO: 2938387 - DNA, 15 bp, Homo sapiens
cagctggacttattt

SEQ ID NO: 2938388 - DNA, 15 bp, Homo sapiens
cagctggcagcagag

SEQ ID NO: 2938389 - DNA, 18 bp, Homo sapiens
cagctggcagcagagtgt

SEQ ID NO: 2938390 - DNA, 19 bp, Homo sapiens
cagctggccagatttcctc

SEQ ID NO: 2938391 - DNA, 13 bp, Homo sapiens
cagctggcccact

SEQ ID NO: 2938392 - DNA, 18 bp, Homo sapiens
cagctgggcccacagccc

SEQ ID NO: 2938393 - DNA, 20 bp, Homo sapiens
cagctgggcccacagccccc

SEQ ID NO: 2938394 - DNA, 14 bp, Homo sapiens
cagctggtgccccc

SEQ ID NO: 2938395 - DNA, 17 bp, Homo sapiens
cagctggtgcccccaga

SEQ ID NO: 2938396 - DNA, 22 bp, Homo sapiens
cagctggtggatggtgactttt

SEQ ID NO: 2938397 - DNA, 15 bp, Homo sapiens
cagctgtcagcctgg

SEQ ID NO: 2938398 - DNA, 17 bp, Homo sapiens
cagctgtccctgtcacc

SEQ ID NO: 2938399 - DNA, 19 bp, Homo sapiens
cagctgtctgtcatctgct

SEQ ID NO: 2938400 - DNA, 15 bp, Homo sapiens
cagctgtgcccctcc

SEQ ID NO: 2938401 - DNA, 16 bp, Homo sapiens
cagctgtgcccctccc

SEQ ID NO: 2938402 - DNA, 17 bp, Homo sapiens
cagctgtggtcccaccc

SEQ ID NO: 2938403 - DNA, 18 bp, Homo sapiens
cagctgtggtcccaccca

SEQ ID NO: 2938404 - DNA, 16 bp, Homo sapiens
cagctgttcctgtgtt

SEQ ID NO: 2938405 - DNA, 17 bp, Homo sapiens
cagctgttgcaggcagt

SEQ ID NO: 2938406 - DNA, 18 bp, Homo sapiens
cagcttacacaaatctat

SEQ ID NO: 2938407 - DNA, 21 bp, Homo sapiens
cagcttatctcttttatattt

SEQ ID NO: 2938408 - DNA, 23 bp, Homo sapiens
cagcttattgtgtgcgctgcctg

SEQ ID NO: 2938409 - DNA, 22 bp, Homo sapiens
cagcttcccctctctcctcctg

SEQ ID NO: 2938410 - DNA, 21 bp, Homo sapiens
cagcttcctgtccccatctgt

SEQ ID NO: 2938411 - DNA, 17 bp, Homo sapiens
cagcttcggtgtgcaga

SEQ ID NO: 2938412 - DNA, 19 bp, Homo sapiens
cagcttgatcaaaggcaca

SEQ ID NO: 2938413 - DNA, 20 bp, Homo sapiens
cagcttgccagatgctgcag

SEQ ID NO: 2938414 - DNA, 13 bp, Homo sapiens
cagcttgccaggg

SEQ ID NO: 2938415 - DNA, 15 bp, Homo sapiens
cagcttgctcttcag

SEQ ID NO: 2938416 - DNA, 14 bp, Homo sapiens
cagctttactgtgg

SEQ ID NO: 2938417 - DNA, 20 bp, Homo sapiens
cagctttatttttctttaaa

SEQ ID NO: 2938418 - DNA, 17 bp, Homo sapiens
cagctttcatgattagc

SEQ ID NO: 2938419 - DNA, 20 bp, Homo sapiens
cagctttcctcaaaaagcag

SEQ ID NO: 2938420 - DNA, 21 bp, Homo sapiens
cagctttctgaccttcagctc

SEQ ID NO: 2938421 - DNA, 17 bp, Homo sapiens
cagctttgatccctgac

SEQ ID NO: 2938422 - DNA, 12 bp, Homo sapiens
cagctttgctgc

SEQ ID NO: 2938423 - DNA, 21 bp, Homo sapiens
cagcttttgtagatggcactt

SEQ ID NO: 2938424 - DNA, 23 bp, Homo sapiens
caggaaaactgacagaggagggc

SEQ ID NO: 2938425 - DNA, 13 bp, Homo sapiens
caggaaaagcaca

SEQ ID NO: 2938426 - DNA, 16 bp, Homo sapiens
caggaaaatcctctgg

SEQ ID NO: 2938427 - DNA, 13 bp, Homo sapiens
caggaaacagcaa

SEQ ID NO: 2938428 - DNA, 16 bp, Homo sapiens
caggaaagttcagagt

SEQ ID NO: 2938429 - DNA, 13 bp, Homo sapiens
caggaaataaagt

SEQ ID NO: 2938430 - DNA, 13 bp, Homo sapiens
caggaaatgaaaa

SEQ ID NO: 2938431 - DNA, 20 bp, Homo sapiens
caggaaatgaaaatgtcttg

SEQ ID NO: 2938432 - DNA, 16 bp, Homo sapiens
caggaaccacaccaca

SEQ ID NO: 2938433 - DNA, 18 bp, Homo sapiens
caggaaccgaggcaggga

SEQ ID NO: 2938434 - DNA, 23 bp, Homo sapiens
caggaacctcgagtactgtgggc

SEQ ID NO: 2938435 - DNA, 22 bp, Homo sapiens
caggaacggccctgcaggagca

SEQ ID NO: 2938436 - DNA, 17 bp, Homo sapiens
caggaactataaaaaca

SEQ ID NO: 2938437 - DNA, 22 bp, Homo sapiens
caggaactcgcacctgtgctgg

SEQ ID NO: 2938438 - DNA, 20 bp, Homo sapiens
cagacaggccccgtgaggca

SEQ ID NO: 2938439 - DNA, 16 bp, Homo sapiens
cagacaggttttcaca

SEQ ID NO: 2938440 - DNA, 18 bp, Homo sapiens
cagacaggttttcacata

SEQ ID NO: 2938441 - DNA, 22 bp, Homo sapiens
cagacaggttttcacataaatg

SEQ ID NO: 2938442 - DNA, 14 bp, Homo sapiens
cagacatacataga

SEQ ID NO: 2938443 - DNA, 14 bp, Homo sapiens
cagacatatttaac

SEQ ID NO: 2938444 - DNA, 15 bp, Homo sapiens
cagacatatttaact

SEQ ID NO: 2938445 - DNA, 17 bp, Homo sapiens
cagacatccttgcagtt

SEQ ID NO: 2938446 - DNA, 12 bp, Homo sapiens
cagacatgtttt

SEQ ID NO: 2938447 - DNA, 18 bp, Homo sapiens
cagacatgttttccgtga

SEQ ID NO: 2938448 - DNA, 22 bp, Homo sapiens
cagacatgttttccgtgaaaac

SEQ ID NO: 2938449 - DNA, 13 bp, Homo sapiens
cagacatttatgt

SEQ ID NO: 2938450 - DNA, 13 bp, Homo sapiens
cagaccagctctt

SEQ ID NO: 2938451 - DNA, 12 bp, Homo sapiens
cagacccactct

SEQ ID NO: 2938452 - DNA, 20 bp, Homo sapiens
cagacccagcccgcggcctg

SEQ ID NO: 2938453 - DNA, 13 bp, Homo sapiens
cagacccccactc

SEQ ID NO: 2938454 - DNA, 14 bp, Homo sapiens
cagacccccactct

SEQ ID NO: 2938455 - DNA, 16 bp, Homo sapiens
cagacccccactctca

SEQ ID NO: 2938456 - DNA, 19 bp, Homo sapiens
cagacctagaaatgtagca

SEQ ID NO: 2938457 - DNA, 24 bp, Homo sapiens
cagacctagaaatgtagcagcagc

SEQ ID NO: 2938458 - DNA, 13 bp, Homo sapiens
cagacctctggat

SEQ ID NO: 2938459 - DNA, 13 bp, Homo sapiens
cagacctgatcct

SEQ ID NO: 2938460 - DNA, 23 bp, Homo sapiens
cagacctgatcctggaggcccag

SEQ ID NO: 2938461 - DNA, 18 bp, Homo sapiens
cagacctgtcgtctctcc

SEQ ID NO: 2938462 - DNA, 22 bp, Homo sapiens
cagacctgtcgtctctcccacc

SEQ ID NO: 2938463 - DNA, 14 bp, Homo sapiens
cagaccttgaaagt

SEQ ID NO: 2938464 - DNA, 18 bp, Homo sapiens
cagacgtctggccctggc

SEQ ID NO: 2938465 - DNA, 21 bp, Homo sapiens
cagacgtctggccctggcggg

SEQ ID NO: 2938466 - DNA, 23 bp, Homo sapiens
cagactacctgccctcagcttgg

SEQ ID NO: 2938467 - DNA, 18 bp, Homo sapiens
cagactagacaccttctg

SEQ ID NO: 2938468 - DNA, 20 bp, Homo sapiens
cagactagacaccttctgtg

SEQ ID NO: 2938469 - DNA, 21 bp, Homo sapiens
cagactaggataatgtccaac

SEQ ID NO: 2938470 - DNA, 22 bp, Homo sapiens
cagactcaaatgctcagaccag

SEQ ID NO: 2938471 - DNA, 18 bp, Homo sapiens
cagactcccattcctgaa

SEQ ID NO: 2938472 - DNA, 21 bp, Homo sapiens
cagactcctgaggacagctgt

SEQ ID NO: 2938473 - DNA, 20 bp, Homo sapiens
cagactctgcctagaaacag

SEQ ID NO: 2938474 - DNA, 16 bp, Homo sapiens
cagactcttccaccag

SEQ ID NO: 2938475 - DNA, 19 bp, Homo sapiens
cagactcttccaccagagc

SEQ ID NO: 2938476 - DNA, 20 bp, Homo sapiens
cagactcttccaccagagca

SEQ ID NO: 2938477 - DNA, 15 bp, Homo sapiens
cagactctttatgct

SEQ ID NO: 2938478 - DNA, 20 bp, Homo sapiens
cagactgaacttaccgtgag

SEQ ID NO: 2938479 - DNA, 19 bp, Homo sapiens
cagactgagctctccaggc

SEQ ID NO: 2938480 - DNA, 23 bp, Homo sapiens
cagactgagctctccaggccagg

SEQ ID NO: 2938481 - DNA, 17 bp, Homo sapiens
cagactgatcaggacct

SEQ ID NO: 2938482 - DNA, 14 bp, Homo sapiens
cagactgcacccag

SEQ ID NO: 2938483 - DNA, 16 bp, Homo sapiens
cagactgccccagcca

SEQ ID NO: 2938484 - DNA, 15 bp, Homo sapiens
cagactgcttggcca

SEQ ID NO: 2938485 - DNA, 17 bp, Homo sapiens
cagactgcttggccaga

SEQ ID NO: 2938486 - DNA, 17 bp, Homo sapiens
cagactggccgggcagg

SEQ ID NO: 2938487 - DNA, 19 bp, Homo sapiens
cagactggccgggcaggcg

SEQ ID NO: 2938488 - DNA, 20 bp, Homo sapiens
cagactgggcccaggcaggt

SEQ ID NO: 2938489 - DNA, 23 bp, Homo sapiens
cagactgggcccaggcaggtctg

SEQ ID NO: 2938490 - DNA, 23 bp, Homo sapiens
cagactggttgagttcaggtagc

SEQ ID NO: 2938491 - DNA, 24 bp, Homo sapiens
cagacttccttgagacacggagcc

SEQ ID NO: 2938492 - DNA, 14 bp, Homo sapiens
cagacttgcactgg

SEQ ID NO: 2938493 - DNA, 13 bp, Homo sapiens
cagacttgtttcc

SEQ ID NO: 2938494 - DNA, 18 bp, Homo sapiens
cagacttgtttcctgtgc

SEQ ID NO: 2938495 - DNA, 22 bp, Homo sapiens
cagactttggaaaatgcattgt

SEQ ID NO: 2938496 - DNA, 12 bp, Homo sapiens
cagagaaaaagg

SEQ ID NO: 2938497 - DNA, 17 bp, Homo sapiens
cagagaaaaagggaggg

SEQ ID NO: 2938498 - DNA, 18 bp, Homo sapiens
cagagaaaaagggagggg

SEQ ID NO: 2938499 - DNA, 14 bp, Homo sapiens
cagagaaaacactt

SEQ ID NO: 2938500 - DNA, 23 bp, Homo sapiens
cagagaaaacactttcctggata

SEQ ID NO: 2938501 - DNA, 24 bp, Homo sapiens
cagagaaaacactttcctggataa

SEQ ID NO: 2938502 - DNA, 18 bp, Homo sapiens
cagagaaaatcaaagcag

SEQ ID NO: 2938503 - DNA, 22 bp, Homo sapiens
cagagaaagaaagggaaactgg

SEQ ID NO: 2938504 - DNA, 19 bp, Homo sapiens
cagagaaaggggagcccac

SEQ ID NO: 2938505 - DNA, 20 bp, Homo sapiens
cagagaactgacatgcaggt

SEQ ID NO: 2938506 - DNA, 21 bp, Homo sapiens
cagagaagctataaattcctc

SEQ ID NO: 2938507 - DNA, 16 bp, Homo sapiens
cagagaagtgacaggg

SEQ ID NO: 2938508 - DNA, 23 bp, Homo sapiens
cagagaagtgacagggaagctac

SEQ ID NO: 2938509 - DNA, 17 bp, Homo sapiens
cagagacaatcacgggc

SEQ ID NO: 2938510 - DNA, 14 bp, Homo sapiens
cagagacacctgca

SEQ ID NO: 2938511 - DNA, 16 bp, Homo sapiens
cagagacacctgcacc

SEQ ID NO: 2938512 - DNA, 20 bp, Homo sapiens
cagagacacctgcacctccc

SEQ ID NO: 2938513 - DNA, 21 bp, Homo sapiens
cagagacaggaaaatcctctg

SEQ ID NO: 2938514 - DNA, 16 bp, Homo sapiens
cagagacaggaaagaa

SEQ ID NO: 2938515 - DNA, 17 bp, Homo sapiens
cagagacaggaaagaat

SEQ ID NO: 2938516 - DNA, 19 bp, Homo sapiens
cagagacatacttgaaggg

SEQ ID NO: 2938517 - DNA, 17 bp, Homo sapiens
cagagaccaaacaagga

SEQ ID NO: 2938518 - DNA, 16 bp, Homo sapiens
cagagaccaggccctg

SEQ ID NO: 2938519 - DNA, 22 bp, Homo sapiens
cagagaccaggccctggctaag

SEQ ID NO: 2938520 - DNA, 15 bp, Homo sapiens
cagagacctgaagtg

SEQ ID NO: 2938521 - DNA, 18 bp, Homo sapiens
cagagagacccgggaagg

SEQ ID NO: 2938522 - DNA, 15 bp, Homo sapiens
cagagaggaatcaga

SEQ ID NO: 2938523 - DNA, 17 bp, Homo sapiens
cagagaggaccaacatc

SEQ ID NO: 2938524 - DNA, 15 bp, Homo sapiens
cagagaggtggccac

SEQ ID NO: 2938525 - DNA, 18 bp, Homo sapiens
cagagagtacactgtgtc

SEQ ID NO: 2938526 - DNA, 19 bp, Homo sapiens
cagagagtacactgtgtct

SEQ ID NO: 2938527 - DNA, 23 bp, Homo sapiens
cagagagtacactgtgtctctat

SEQ ID NO: 2938528 - DNA, 17 bp, Homo sapiens
cagagagtccaatttat

SEQ ID NO: 2938529 - DNA, 23 bp, Homo sapiens
cagagagtgagagacattaactc

SEQ ID NO: 2938530 - DNA, 20 bp, Homo sapiens
cagagataaaccaataaatc

SEQ ID NO: 2938531 - DNA, 16 bp, Homo sapiens
cagagataaagacctt

SEQ ID NO: 2938532 - DNA, 19 bp, Homo sapiens
cagagatccaaaagaagcc

SEQ ID NO: 2938533 - DNA, 21 bp, Homo sapiens
cagagatcctacttctctgag

SEQ ID NO: 2938534 - DNA, 22 bp, Homo sapiens
cagagatcctacttctctgagt

SEQ ID NO: 2938535 - DNA, 14 bp, Homo sapiens
cagagatgcctcca

SEQ ID NO: 2938536 - DNA, 19 bp, Homo sapiens
cagagatgcctccaccgct

SEQ ID NO: 2938537 - DNA, 19 bp, Homo sapiens
cagagattttcatctatta

SEQ ID NO: 2938538 - DNA, 14 bp, Homo sapiens
cagagcaaaaatgt

SEQ ID NO: 2938539 - DNA, 16 bp, Homo sapiens
cagagcaaaaatgtaa

SEQ ID NO: 2938540 - DNA, 20 bp, Homo sapiens
caccctccacaaagcaaagg

SEQ ID NO: 2938541 - DNA, 16 bp, Homo sapiens
caccctcccagctctg

SEQ ID NO: 2938542 - DNA, 16 bp, Homo sapiens
caccctctaaatggga

SEQ ID NO: 2938543 - DNA, 13 bp, Homo sapiens
caccctctgtacc

SEQ ID NO: 2938544 - DNA, 22 bp, Homo sapiens
caccctgatttaggagaagcca

SEQ ID NO: 2938545 - DNA, 15 bp, Homo sapiens
caccctgcccacccc

SEQ ID NO: 2938546 - DNA, 17 bp, Homo sapiens
caccctgcccctcagag

SEQ ID NO: 2938547 - DNA, 14 bp, Homo sapiens
caccctgcctgctg

SEQ ID NO: 2938548 - DNA, 15 bp, Homo sapiens
caccctgcctgctgt

SEQ ID NO: 2938549 - DNA, 17 bp, Homo sapiens
caccctgcctgctgtgg

SEQ ID NO: 2938550 - DNA, 22 bp, Homo sapiens
caccctggccgagtccaagctg

SEQ ID NO: 2938551 - DNA, 21 bp, Homo sapiens
caccctgggtttggcccctgg

SEQ ID NO: 2938552 - DNA, 15 bp, Homo sapiens
caccctggtgggcca

SEQ ID NO: 2938553 - DNA, 16 bp, Homo sapiens
caccctggtgggccaa

SEQ ID NO: 2938554 - DNA, 19 bp, Homo sapiens
caccctgtgaccctctcac

SEQ ID NO: 2938555 - DNA, 14 bp, Homo sapiens
caccctgtggctca

SEQ ID NO: 2938556 - DNA, 17 bp, Homo sapiens
caccctgtggctcacag

SEQ ID NO: 2938557 - DNA, 12 bp, Homo sapiens
cacccttccctg

SEQ ID NO: 2938558 - DNA, 13 bp, Homo sapiens
cacccttccctgc

SEQ ID NO: 2938559 - DNA, 16 bp, Homo sapiens
cacccttccctgcctc

SEQ ID NO: 2938560 - DNA, 17 bp, Homo sapiens
cacccttccctgcctcc

SEQ ID NO: 2938561 - DNA, 23 bp, Homo sapiens
cacccttccctgcctccagctgt

SEQ ID NO: 2938562 - DNA, 17 bp, Homo sapiens
cacccttcctggcccag

SEQ ID NO: 2938563 - DNA, 18 bp, Homo sapiens
cacccttcctggcccagg

SEQ ID NO: 2938564 - DNA, 22 bp, Homo sapiens
cacccttcctggcccaggcctt

SEQ ID NO: 2938565 - DNA, 17 bp, Homo sapiens
cacccttttccagctgg

SEQ ID NO: 2938566 - DNA, 14 bp, Homo sapiens
caccgacagcggcc

SEQ ID NO: 2938567 - DNA, 19 bp, Homo sapiens
caccgacccgaggcccaga

SEQ ID NO: 2938568 - DNA, 12 bp, Homo sapiens
caccgactgccc

SEQ ID NO: 2938569 - DNA, 15 bp, Homo sapiens
caccgactgcccagc

SEQ ID NO: 2938570 - DNA, 21 bp, Homo sapiens
caccgactgcccagccactcc

SEQ ID NO: 2938571 - DNA, 18 bp, Homo sapiens
caccgagagtagccgaga

SEQ ID NO: 2938572 - DNA, 14 bp, Homo sapiens
caccgagctctgtg

SEQ ID NO: 2938573 - DNA, 16 bp, Homo sapiens
caccgagctctgtggg

SEQ ID NO: 2938574 - DNA, 19 bp, Homo sapiens
caccgagctctgtgggaaa

SEQ ID NO: 2938575 - DNA, 20 bp, Homo sapiens
caccgagctctgtgggaaaa

SEQ ID NO: 2938576 - DNA, 13 bp, Homo sapiens
caccgaggggcct

SEQ ID NO: 2938577 - DNA, 14 bp, Homo sapiens
caccgaggggcctt

SEQ ID NO: 2938578 - DNA, 15 bp, Homo sapiens
caccgcagcctgtca

SEQ ID NO: 2938579 - DNA, 15 bp, Homo sapiens
caccgcagctgctgc

SEQ ID NO: 2938580 - DNA, 20 bp, Homo sapiens
caccgcagctgctgccactc

SEQ ID NO: 2938581 - DNA, 22 bp, Homo sapiens
caccgcagctgctgccactctg

SEQ ID NO: 2938582 - DNA, 22 bp, Homo sapiens
caccgccggggtcctgggaggc

SEQ ID NO: 2938583 - DNA, 17 bp, Homo sapiens
caccgcctcctacagcc

SEQ ID NO: 2938584 - DNA, 14 bp, Homo sapiens
caccgcctgccctc

SEQ ID NO: 2938585 - DNA, 13 bp, Homo sapiens
caccgctgcctaa

SEQ ID NO: 2938586 - DNA, 22 bp, Homo sapiens
caccggatcctgggtggtctgc

SEQ ID NO: 2938587 - DNA, 20 bp, Homo sapiens
caccggatgctgtgcctggc

SEQ ID NO: 2938588 - DNA, 16 bp, Homo sapiens
cactggaaaggaaaga

SEQ ID NO: 2938589 - DNA, 17 bp, Homo sapiens
cactggaaggagcacat

SEQ ID NO: 2938590 - DNA, 14 bp, Homo sapiens
cactggaccaggtc

SEQ ID NO: 2938591 - DNA, 15 bp, Homo sapiens
cactggaccaggtcc

SEQ ID NO: 2938592 - DNA, 15 bp, Homo sapiens
cactggactccggcc

SEQ ID NO: 2938593 - DNA, 16 bp, Homo sapiens
cactggactgacctgg

SEQ ID NO: 2938594 - DNA, 16 bp, Homo sapiens
cactggagccacaggc

SEQ ID NO: 2938595 - DNA, 20 bp, Homo sapiens
cactggagccacaggcaggg

SEQ ID NO: 2938596 - DNA, 22 bp, Homo sapiens
cactggaggagagaagaatgag

SEQ ID NO: 2938597 - DNA, 19 bp, Homo sapiens
cactggagtggctcgccag

SEQ ID NO: 2938598 - DNA, 17 bp, Homo sapiens
cactggattggtcattt

SEQ ID NO: 2938599 - DNA, 15 bp, Homo sapiens
cactggcagccccag

SEQ ID NO: 2938600 - DNA, 17 bp, Homo sapiens
cactggcagccccagca

SEQ ID NO: 2938601 - DNA, 14 bp, Homo sapiens
cactggcagcctgc

SEQ ID NO: 2938602 - DNA, 12 bp, Homo sapiens
cactggccccac

SEQ ID NO: 2938603 - DNA, 13 bp, Homo sapiens
cactggcgccttc

SEQ ID NO: 2938604 - DNA, 14 bp, Homo sapiens
cactggcgccttct

SEQ ID NO: 2938605 - DNA, 16 bp, Homo sapiens
cactggcgccttctcg

SEQ ID NO: 2938606 - DNA, 17 bp, Homo sapiens
cactggctcatgcccct

SEQ ID NO: 2938607 - DNA, 18 bp, Homo sapiens
cactggctcatgcccctt

SEQ ID NO: 2938608 - DNA, 13 bp, Homo sapiens
cactgggaaacag

SEQ ID NO: 2938609 - DNA, 14 bp, Homo sapiens
cactgggaggccag

SEQ ID NO: 2938610 - DNA, 20 bp, Homo sapiens
cactgggcacctgcgcacag

SEQ ID NO: 2938611 - DNA, 21 bp, Homo sapiens
cactgggcacctgcgcacagg

SEQ ID NO: 2938612 - DNA, 13 bp, Homo sapiens
cactgggcccctc

SEQ ID NO: 2938613 - DNA, 16 bp, Homo sapiens
cactggggaaaactcc

SEQ ID NO: 2938614 - DNA, 13 bp, Homo sapiens
cactggggcaggg

SEQ ID NO: 2938615 - DNA, 19 bp, Homo sapiens
cactggggcaggggccggg

SEQ ID NO: 2938616 - DNA, 18 bp, Homo sapiens
cactgggtggtggcctgg

SEQ ID NO: 2938617 - DNA, 22 bp, Homo sapiens
cactgggtggtggcctggtccc

SEQ ID NO: 2938618 - DNA, 12 bp, Homo sapiens
cactggtgagac

SEQ ID NO: 2938619 - DNA, 14 bp, Homo sapiens
cactggtgagacag

SEQ ID NO: 2938620 - DNA, 15 bp, Homo sapiens
cactggttgcactta

SEQ ID NO: 2938621 - DNA, 14 bp, Homo sapiens
cactgtagttctaa

SEQ ID NO: 2938622 - DNA, 17 bp, Homo sapiens
cactgtagttctaagac

SEQ ID NO: 2938623 - DNA, 22 bp, Homo sapiens
cactgtcaaactttgtcaccct

SEQ ID NO: 2938624 - DNA, 15 bp, Homo sapiens
cactgtcaagtgttt

SEQ ID NO: 2938625 - DNA, 13 bp, Homo sapiens
cactgtcactgcc

SEQ ID NO: 2938626 - DNA, 14 bp, Homo sapiens
cactgtcactgccg

SEQ ID NO: 2938627 - DNA, 21 bp, Homo sapiens
cactgtcactgccgacatccc

SEQ ID NO: 2938628 - DNA, 15 bp, Homo sapiens
cactgtccctcctgg

SEQ ID NO: 2938629 - DNA, 14 bp, Homo sapiens
cactgtctgaagca

SEQ ID NO: 2938630 - DNA, 11 bp, Homo sapiens
cactgtctgag

SEQ ID NO: 2938631 - DNA, 15 bp, Homo sapiens
cactgtctgtaccta

SEQ ID NO: 2938632 - DNA, 21 bp, Homo sapiens
cactgtcttatggattcattt

SEQ ID NO: 2938633 - DNA, 14 bp, Homo sapiens
cactgtgaaggacc

SEQ ID NO: 2938634 - DNA, 17 bp, Homo sapiens
cactgtgaatcctggca

SEQ ID NO: 2938635 - DNA, 22 bp, Homo sapiens
cactgtgacaatgactaagcca

SEQ ID NO: 2938636 - DNA, 19 bp, Homo sapiens
cactgtgacccccagctcc

SEQ ID NO: 2938637 - DNA, 22 bp, Homo sapiens
cactgtgattactctttgcttt

SEQ ID NO: 2938638 - DNA, 20 bp, Homo sapiens
cactgtgcacatctgtgtct

SEQ ID NO: 2938639 - DNA, 19 bp, Homo sapiens
cactgtgccccgcgggctt

SEQ ID NO: 2938640 - DNA, 18 bp, Homo sapiens
cactgtggaagtccctca

SEQ ID NO: 2938641 - DNA, 14 bp, Homo sapiens
cactgtgggaaggc

SEQ ID NO: 2938642 - DNA, 21 bp, Homo sapiens
cactgtgggaaggccagctgc

SEQ ID NO: 2938643 - DNA, 20 bp, Homo sapiens
cactgtgggtgtgtgactct

SEQ ID NO: 2938644 - DNA, 20 bp, Homo sapiens
cactgtggtaaatgccacac

SEQ ID NO: 2938645 - DNA, 15 bp, Homo sapiens
cactgtgtcacatca

SEQ ID NO: 2938646 - DNA, 13 bp, Homo sapiens
cactgtgtctcta

SEQ ID NO: 2938647 - DNA, 14 bp, Homo sapiens
cactgtgtctctat

SEQ ID NO: 2938648 - DNA, 21 bp, Homo sapiens
cactgtgtctctatgtgaata

SEQ ID NO: 2938649 - DNA, 15 bp, Homo sapiens
cactgtgtgctattt

SEQ ID NO: 2938650 - DNA, 14 bp, Homo sapiens
cactgtgtttctgt

SEQ ID NO: 2938651 - DNA, 15 bp, Homo sapiens
cactgtgtttctgtg

SEQ ID NO: 2938652 - DNA, 18 bp, Homo sapiens
cactgtgtttctgtgctc

SEQ ID NO: 2938653 - DNA, 20 bp, Homo sapiens
cactgtgtttctgtgctcca

SEQ ID NO: 2938654 - DNA, 14 bp, Homo sapiens
cactgttcatgctg

SEQ ID NO: 2938655 - DNA, 17 bp, Homo sapiens
cactgttccccctgtgc

SEQ ID NO: 2938656 - DNA, 17 bp, Homo sapiens
cactgttgcttaattgt

SEQ ID NO: 2938657 - DNA, 18 bp, Homo sapiens
cactgtttgtttttattt

SEQ ID NO: 2938658 - DNA, 14 bp, Homo sapiens
cactgtttttagac

SEQ ID NO: 2938659 - DNA, 13 bp, Homo sapiens
cactgtttttcca

SEQ ID NO: 2938660 - DNA, 19 bp, Homo sapiens
cactgtttttccatagttt

SEQ ID NO: 2938661 - DNA, 17 bp, Homo sapiens
cacttaaacagaagcag

SEQ ID NO: 2938662 - DNA, 13 bp, Homo sapiens
cacttaagactgt

SEQ ID NO: 2938663 - DNA, 19 bp, Homo sapiens
cacttactgtaagacatta

SEQ ID NO: 2938664 - DNA, 16 bp, Homo sapiens
cacttattttacacag

SEQ ID NO: 2938665 - DNA, 22 bp, Homo sapiens
cacttattttacacagcaattt

SEQ ID NO: 2938666 - DNA, 22 bp, Homo sapiens
cacttcaaggtgacagaaggac

SEQ ID NO: 2938667 - DNA, 18 bp, Homo sapiens
cacttcaggtcaggagtt

SEQ ID NO: 2938668 - DNA, 16 bp, Homo sapiens
cacttcccaccctgcc

SEQ ID NO: 2938669 - DNA, 12 bp, Homo sapiens
cacttcccagga

SEQ ID NO: 2938670 - DNA, 13 bp, Homo sapiens
cacttcccaggat

SEQ ID NO: 2938671 - DNA, 16 bp, Homo sapiens
cacttccctgctgcct

SEQ ID NO: 2938672 - DNA, 12 bp, Homo sapiens
cacttcctcccc

SEQ ID NO: 2938673 - DNA, 13 bp, Homo sapiens
cacttcctcccct

SEQ ID NO: 2938674 - DNA, 20 bp, Homo sapiens
cacagccgattcacctgagc

SEQ ID NO: 2938675 - DNA, 21 bp, Homo sapiens
cacagccgattcacctgagca

SEQ ID NO: 2938676 - DNA, 21 bp, Homo sapiens
cacagcctgggccccagctcg

SEQ ID NO: 2938677 - DNA, 22 bp, Homo sapiens
cacagcgctggccgggaccccg

SEQ ID NO: 2938678 - DNA, 15 bp, Homo sapiens
cacagcggctgcctc

SEQ ID NO: 2938679 - DNA, 19 bp, Homo sapiens
cacagcgtcctgtccacac

SEQ ID NO: 2938680 - DNA, 21 bp, Homo sapiens
cacagctcaagcattctgttt

SEQ ID NO: 2938681 - DNA, 19 bp, Homo sapiens
cacagctcccaccccaccc

SEQ ID NO: 2938682 - DNA, 11 bp, Homo sapiens
cacagctcctc

SEQ ID NO: 2938683 - DNA, 14 bp, Homo sapiens
cacagctcctcccc

SEQ ID NO: 2938684 - DNA, 18 bp, Homo sapiens
cacagctcctcccctgcc

SEQ ID NO: 2938685 - DNA, 20 bp, Homo sapiens
cacagctcctcccctgccgc

SEQ ID NO: 2938686 - DNA, 21 bp, Homo sapiens
cacagctcctcccctgccgcc

SEQ ID NO: 2938687 - DNA, 18 bp, Homo sapiens
cacagcttatggcatctc

SEQ ID NO: 2938688 - DNA, 15 bp, Homo sapiens
cacagcttcccctct

SEQ ID NO: 2938689 - DNA, 12 bp, Homo sapiens
cacagcttcctg

SEQ ID NO: 2938690 - DNA, 15 bp, Homo sapiens
cacagcttcctgtcc

SEQ ID NO: 2938691 - DNA, 15 bp, Homo sapiens
cacaggaacggccct

SEQ ID NO: 2938692 - DNA, 16 bp, Homo sapiens
cacaggaacggccctg

SEQ ID NO: 2938693 - DNA, 14 bp, Homo sapiens
cacaggaaggaaac

SEQ ID NO: 2938694 - DNA, 23 bp, Homo sapiens
cacaggacatgcggtagccagca

SEQ ID NO: 2938695 - DNA, 15 bp, Homo sapiens
cacaggacatttctc

SEQ ID NO: 2938696 - DNA, 19 bp, Homo sapiens
cacaggacgaatgcatatt

SEQ ID NO: 2938697 - DNA, 18 bp, Homo sapiens
cacaggagcaatcacagg

SEQ ID NO: 2938698 - DNA, 14 bp, Homo sapiens
cacaggaggcaggc

SEQ ID NO: 2938699 - DNA, 18 bp, Homo sapiens
cacaggagtgggaaaaca

SEQ ID NO: 2938700 - DNA, 16 bp, Homo sapiens
cacaggagtgtcctct

SEQ ID NO: 2938701 - DNA, 22 bp, Homo sapiens
cacaggagtgtcctcttccctc

SEQ ID NO: 2938702 - DNA, 19 bp, Homo sapiens
cacaaggtcatggccacac

SEQ ID NO: 2938703 - DNA, 21 bp, Homo sapiens
cacaaggtcatggccacactg

SEQ ID NO: 2938704 - DNA, 14 bp, Homo sapiens
cacaagtaagagac

SEQ ID NO: 2938705 - DNA, 16 bp, Homo sapiens
cacaagttatttaaat

SEQ ID NO: 2938706 - DNA, 22 bp, Homo sapiens
cacaataagagtctccttctct

SEQ ID NO: 2938707 - DNA, 21 bp, Homo sapiens
cacaatctgttctactcttaa

SEQ ID NO: 2938708 - DNA, 22 bp, Homo sapiens
cacaatggtttttaaattttgt

SEQ ID NO: 2938709 - DNA, 15 bp, Homo sapiens
cacaatgttctttat

SEQ ID NO: 2938710 - DNA, 16 bp, Homo sapiens
cacaatgttctttata

SEQ ID NO: 2938711 - DNA, 17 bp, Homo sapiens
cacaatgttgcactgaa

SEQ ID NO: 2938712 - DNA, 13 bp, Homo sapiens
cacaattagggaa

SEQ ID NO: 2938713 - DNA, 16 bp, Homo sapiens
cacaatttaaaacaat

SEQ ID NO: 2938714 - DNA, 14 bp, Homo sapiens
cacaatttctttaa

SEQ ID NO: 2938715 - DNA, 16 bp, Homo sapiens
cacaatttctttaaaa

SEQ ID NO: 2938716 - DNA, 17 bp, Homo sapiens
cacaatttctttaaaaa

SEQ ID NO: 2938717 - DNA, 10 bp, Homo sapiens
cacacaaaaa

SEQ ID NO: 2938718 - DNA, 15 bp, Homo sapiens
cacacaacagccaac

SEQ ID NO: 2938719 - DNA, 23 bp, Homo sapiens
cacacaagtaagagactcagcct

SEQ ID NO: 2938720 - DNA, 13 bp, Homo sapiens
caagcacttccca

SEQ ID NO: 2938721 - DNA, 16 bp, Homo sapiens
caagcacttcccagga

SEQ ID NO: 2938722 - DNA, 17 bp, Homo sapiens
caagcacttcccaggat

SEQ ID NO: 2938723 - DNA, 18 bp, Homo sapiens
caagcagaggaccagggc

SEQ ID NO: 2938724 - DNA, 20 bp, Homo sapiens
caagcagaggaccagggcct

SEQ ID NO: 2938725 - DNA, 16 bp, Homo sapiens
caagcagatactgctg

SEQ ID NO: 2938726 - DNA, 15 bp, Homo sapiens
caaatgcccaaggat

SEQ ID NO: 2938727 - DNA, 18 bp, Homo sapiens
caaatgcccaaggatgcc

SEQ ID NO: 2938728 - DNA, 16 bp, Homo sapiens
caaatggggccagatc

SEQ ID NO: 2938729 - DNA, 17 bp, Homo sapiens
caaatggggccagatcc

SEQ ID NO: 2938730 - DNA, 20 bp, Homo sapiens
caaatggggccagatccagc

SEQ ID NO: 2938731 - DNA, 23 bp, Homo sapiens
caaatggggccagatccagcctg

SEQ ID NO: 2938732 - DNA, 20 bp, Homo sapiens
caaatggtaggcatttccta

SEQ ID NO: 2938733 - DNA, 16 bp, Homo sapiens
caaatgtcagatacaa

SEQ ID NO: 2938734 - DNA, 17 bp, Homo sapiens
caaatgtgaagatgcat

SEQ ID NO: 2938735 - DNA, 20 bp, Homo sapiens
caaatgtgaccatgtgaatc

SEQ ID NO: 2938736 - DNA, 23 bp, Homo sapiens
caaatgtgtacatggcagagttt

SEQ ID NO: 2938737 - DNA, 12 bp, Homo sapiens
caaatgttctaa

SEQ ID NO: 2938738 - DNA, 19 bp, Homo sapiens
caaatgttctaagtttcta

SEQ ID NO: 2938739 - DNA, 16 bp, Homo sapiens
caaatgtttaaacatt

SEQ ID NO: 2938740 - DNA, 15 bp, Homo sapiens
caaatgttttctgca

SEQ ID NO: 2938741 - DNA, 18 bp, Homo sapiens
caaattaaagtgctgttt

SEQ ID NO: 2938742 - DNA, 15 bp, Homo sapiens
caaattaatatttgt

SEQ ID NO: 2938743 - DNA, 16 bp, Homo sapiens
caaattaatatttgtg

SEQ ID NO: 2938744 - DNA, 15 bp, Homo sapiens
caaattactgataaa

SEQ ID NO: 2938745 - DNA, 21 bp, Homo sapiens
caaattagaaacaccattcat

SEQ ID NO: 2938746 - DNA, 16 bp, Homo sapiens
caaattagttggtttg

SEQ ID NO: 2938747 - DNA, 21 bp, Homo sapiens
caaattatttttaaaagaaaa

SEQ ID NO: 2938748 - DNA, 18 bp, Homo sapiens
caaattcaaaagagagag

SEQ ID NO: 2938749 - DNA, 17 bp, Homo sapiens
caaattcatattctttt

SEQ ID NO: 2938750 - DNA, 15 bp, Homo sapiens
caaattccatcacat

SEQ ID NO: 2938751 - DNA, 20 bp, Homo sapiens
caaattcctatttttaaata

SEQ ID NO: 2938752 - DNA, 21 bp, Homo sapiens
caaagaaggcatttgcagggt

SEQ ID NO: 2938753 - DNA, 20 bp, Homo sapiens
caaagaatgttagagcacag

SEQ ID NO: 2938754 - DNA, 20 bp, Homo sapiens
caaagacaaattctgtttct

SEQ ID NO: 2938755 - DNA, 21 bp, Homo sapiens
caaagacaaattctgtttctt

SEQ ID NO: 2938756 - DNA, 22 bp, Homo sapiens
caaagagaaagagtttgaaact

SEQ ID NO: 2938757 - DNA, 15 bp, Homo sapiens
caaagagaatgtatt

SEQ ID NO: 2938758 - DNA, 21 bp, Homo sapiens
caaagagagttaaaagcagca

SEQ ID NO: 2938759 - DNA, 19 bp, Homo sapiens
caaagagcctttccaaaga

SEQ ID NO: 2938760 - DNA, 14 bp, Homo sapiens
caaagagtagaatt

SEQ ID NO: 2938761 - DNA, 14 bp, Homo sapiens
caaagagtctctgg

SEQ ID NO: 2938762 - DNA, 15 bp, Homo sapiens
caaagagtctctggc

SEQ ID NO: 2938763 - DNA, 15 bp, Homo sapiens
caaagagtgaaatat

SEQ ID NO: 2938764 - DNA, 17 bp, Homo sapiens
caaagagtgaaatattg

SEQ ID NO: 2938765 - DNA, 20 bp, Homo sapiens
caaagagtgaaatattgtaa

SEQ ID NO: 2938766 - DNA, 21 bp, Homo sapiens
caaagagtgaaatattgtaaa

SEQ ID NO: 2938767 - DNA, 13 bp, Homo sapiens
caaagatatatat

SEQ ID NO: 2938768 - DNA, 17 bp, Homo sapiens
caaagatatcttttctt

SEQ ID NO: 2938769 - DNA, 21 bp, Homo sapiens
caaagatatcttttctttaga

SEQ ID NO: 2938770 - DNA, 16 bp, Homo sapiens
caaagatgctgtgagt

SEQ ID NO: 2938771 - DNA, 13 bp, Homo sapiens
caaagattcatga

SEQ ID NO: 2938772 - DNA, 19 bp, Homo sapiens
caaagattgaacactgcgt

SEQ ID NO: 2938773 - DNA, 15 bp, Homo sapiens
caaagcaaaggcagt

SEQ ID NO: 2938774 - DNA, 14 bp, Homo sapiens
caaagcaacatggc

SEQ ID NO: 2938775 - DNA, 15 bp, Homo sapiens
caaagcaaggaaact

SEQ ID NO: 2938776 - DNA, 13 bp, Homo sapiens
caaagcagacagc

SEQ ID NO: 2938777 - DNA, 19 bp, Homo sapiens
caaagcagacagctccacc

SEQ ID NO: 2938778 - DNA, 19 bp, Homo sapiens
caaagcagagagtccaatt

SEQ ID NO: 2938779 - DNA, 16 bp, Homo sapiens
caaagcagattttcct

SEQ ID NO: 2938780 - DNA, 17 bp, Homo sapiens
caaagcagattttccta

SEQ ID NO: 2938781 - DNA, 18 bp, Homo sapiens
caaagcagattttcctaa

SEQ ID NO: 2938782 - DNA, 22 bp, Homo sapiens
caaagcagattttcctaaggcc

SEQ ID NO: 2938783 - DNA, 13 bp, Homo sapiens
caaagcagccacg

SEQ ID NO: 2938784 - DNA, 12 bp, Homo sapiens
caaagcaggatg

SEQ ID NO: 2938785 - DNA, 24 bp, Homo sapiens
caaagcagtggcttagctgccatc

SEQ ID NO: 2938786 - DNA, 15 bp, Homo sapiens
caaagccactggaag

SEQ ID NO: 2938787 - DNA, 19 bp, Homo sapiens
caaagccactggaaggagc

SEQ ID NO: 2938788 - DNA, 14 bp, Homo sapiens
atgtcaaacaaata

SEQ ID NO: 2938789 - DNA, 21 bp, Homo sapiens
atgtcaactgtgtctctgaat

SEQ ID NO: 2938790 - DNA, 12 bp, Homo sapiens
atgtcaagaaat

SEQ ID NO: 2938791 - DNA, 21 bp, Homo sapiens
atgtcaagaaattctgctgtt

SEQ ID NO: 2938792 - DNA, 16 bp, Homo sapiens
atgtcaccaccttccc

SEQ ID NO: 2938793 - DNA, 18 bp, Homo sapiens
atgtcaccaccttcccag

SEQ ID NO: 2938794 - DNA, 19 bp, Homo sapiens
atgtcaccggatcctgggt

SEQ ID NO: 2938795 - DNA, 18 bp, Homo sapiens
atgtcagatacaatgtat

SEQ ID NO: 2938796 - DNA, 17 bp, Homo sapiens
atgtcagtaccttcaaa

SEQ ID NO: 2938797 - DNA, 13 bp, Homo sapiens
atgtcagtgttca

SEQ ID NO: 2938798 - DNA, 21 bp, Homo sapiens
atgtcatattggcagttggag

SEQ ID NO: 2938799 - DNA, 16 bp, Homo sapiens
atgtcattatttgata

SEQ ID NO: 2938800 - DNA, 16 bp, Homo sapiens
atgtccccactggcat

SEQ ID NO: 2938801 - DNA, 14 bp, Homo sapiens
atgtcccctcccag

SEQ ID NO: 2938802 - DNA, 17 bp, Homo sapiens
cggagcaaactctgctg

SEQ ID NO: 2938803 - DNA, 18 bp, Homo sapiens
cggagcccctgaaagcct

SEQ ID NO: 2938804 - DNA, 22 bp, Homo sapiens
cggagctgcccctctctgggcc

SEQ ID NO: 2938805 - DNA, 23 bp, Homo sapiens
cggagctgcccctctctgggcct

SEQ ID NO: 2938806 - DNA, 15 bp, Homo sapiens
cggagctggcccagg

SEQ ID NO: 2938807 - DNA, 13 bp, Homo sapiens
cggagctggcccc

SEQ ID NO: 2938808 - DNA, 22 bp, Homo sapiens
cggagctggttcctctctccca

SEQ ID NO: 2938809 - DNA, 18 bp, Homo sapiens
cggaggaaagacaacaca

SEQ ID NO: 2938810 - DNA, 16 bp, Homo sapiens
cggaggcaaagctggc

SEQ ID NO: 2938811 - DNA, 19 bp, Homo sapiens
cggaggcaaagctggctca

SEQ ID NO: 2938812 - DNA, 18 bp, Homo sapiens
cggaggcctgcgaccctg

SEQ ID NO: 2938813 - DNA, 12 bp, Homo sapiens
cggaggctcctc

SEQ ID NO: 2938814 - DNA, 15 bp, Homo sapiens
cggaggctcctccct

SEQ ID NO: 2938815 - DNA, 16 bp, Homo sapiens
cggaggctcctccctc

SEQ ID NO: 2938816 - DNA, 22 bp, Homo sapiens
cggaggctcctccctctgcctc

SEQ ID NO: 2938817 - DNA, 20 bp, Homo sapiens
cggaggggactggtcccggt

SEQ ID NO: 2938818 - DNA, 18 bp, Homo sapiens
cggagtacagacgtctca

SEQ ID NO: 2938819 - DNA, 19 bp, Homo sapiens
cggagtcagccaggagctg

SEQ ID NO: 2938820 - DNA, 19 bp, Homo sapiens
cggatcacaaggtcaggag

SEQ ID NO: 2938821 - DNA, 18 bp, Homo sapiens
cggatcaccgagagtagc

SEQ ID NO: 2938822 - DNA, 19 bp, Homo sapiens
cggatcctaagcatctaag

SEQ ID NO: 2938823 - DNA, 14 bp, Homo sapiens
cggatcctgggtgg

SEQ ID NO: 2938824 - DNA, 18 bp, Homo sapiens
cggatgaccatactcaga

SEQ ID NO: 2938825 - DNA, 14 bp, Homo sapiens
cggattggccctgc

SEQ ID NO: 2938826 - DNA, 16 bp, Homo sapiens
cggattggccctgccc

SEQ ID NO: 2938827 - DNA, 12 bp, Homo sapiens
cggcaacatcaa

SEQ ID NO: 2938828 - DNA, 20 bp, Homo sapiens
cggcagatgatgctttggaa

SEQ ID NO: 2938829 - DNA, 14 bp, Homo sapiens
cggcagctcttctg

SEQ ID NO: 2938830 - DNA, 16 bp, Homo sapiens
cggcagctcttctggg

SEQ ID NO: 2938831 - DNA, 22 bp, Homo sapiens
cggcagctcttctgggcagagc

SEQ ID NO: 2938832 - DNA, 16 bp, Homo sapiens
cggcaggaaggagcgg

SEQ ID NO: 2938833 - DNA, 18 bp, Homo sapiens
cggcaggaaggagcggcg

SEQ ID NO: 2938834 - DNA, 19 bp, Homo sapiens
cggcaggaaggagcggcgc

SEQ ID NO: 2938835 - DNA, 17 bp, Homo sapiens
cggcaggcgtgtggcag

SEQ ID NO: 2938836 - DNA, 20 bp, Homo sapiens
cggcaggcgtgtggcagcca

SEQ ID NO: 2938837 - DNA, 22 bp, Homo sapiens
cggcaggcgtgtggcagccaca

SEQ ID NO: 2938838 - DNA, 20 bp, Homo sapiens
cggcatgagactcagtgcag

SEQ ID NO: 2938839 - DNA, 13 bp, Homo sapiens
cggcatgccagga

SEQ ID NO: 2938840 - DNA, 14 bp, Homo sapiens
cggccaagaatgta

SEQ ID NO: 2938841 - DNA, 13 bp, Homo sapiens
cggccagggcggc

SEQ ID NO: 2938842 - DNA, 18 bp, Homo sapiens
cggccagggcggccaggg

SEQ ID NO: 2938843 - DNA, 12 bp, Homo sapiens
cggcccacagct

SEQ ID NO: 2938844 - DNA, 23 bp, Homo sapiens
cggcccagacccactctgcggcc

SEQ ID NO: 2938845 - DNA, 13 bp, Homo sapiens
cggcccagggagg

SEQ ID NO: 2938846 - DNA, 14 bp, Homo sapiens
cggcccagggaggg

SEQ ID NO: 2938847 - DNA, 19 bp, Homo sapiens
cggcccagggagggtgagc

SEQ ID NO: 2938848 - DNA, 22 bp, Homo sapiens
cggcccagggagggtgagctgg

SEQ ID NO: 2938849 - DNA, 15 bp, Homo sapiens
cggcccatctgtcca

SEQ ID NO: 2938850 - DNA, 17 bp, Homo sapiens
cggccccctcaccccag

SEQ ID NO: 2938851 - DNA, 12 bp, Homo sapiens
cggccccctgcc

SEQ ID NO: 2938852 - DNA, 14 bp, Homo sapiens
cggcccctcaccct

SEQ ID NO: 2938853 - DNA, 14 bp, Homo sapiens
cggcccctccccct

SEQ ID NO: 2938854 - DNA, 15 bp, Homo sapiens
cggcccgcagcctgg

SEQ ID NO: 2938855 - DNA, 12 bp, Homo sapiens
cggcccggcccc

SEQ ID NO: 2938856 - DNA, 22 bp, Homo sapiens
cggccctcctaccctgcgccca

SEQ ID NO: 2938857 - DNA, 20 bp, Homo sapiens
cggccctgcaggagcagggc

SEQ ID NO: 2938858 - DNA, 14 bp, Homo sapiens
cggccctgcccctc

SEQ ID NO: 2938859 - DNA, 16 bp, Homo sapiens
cggccctgcccctccc

SEQ ID NO: 2938860 - DNA, 21 bp, Homo sapiens
cggccctgctgaagctgctgc

SEQ ID NO: 2938861 - DNA, 22 bp, Homo sapiens
cggccctgctgaagctgctgca

SEQ ID NO: 2938862 - DNA, 11 bp, Homo sapiens
cggccctgggg

SEQ ID NO: 2938863 - DNA, 15 bp, Homo sapiens
cggccgagctggttt

SEQ ID NO: 2938864 - DNA, 20 bp, Homo sapiens
cggccgatgggagtctccct

SEQ ID NO: 2938865 - DNA, 15 bp, Homo sapiens
cggccgcagagactg

SEQ ID NO: 2938866 - DNA, 21 bp, Homo sapiens
cggcctcccagagtgctggga

SEQ ID NO: 2938867 - DNA, 17 bp, Homo sapiens
cggcctcccgaggaggg

SEQ ID NO: 2938868 - DNA, 23 bp, Homo sapiens
cggcctgcaccgaccccgggccg

SEQ ID NO: 2938869 - DNA, 22 bp, Homo sapiens
cggcctgcaccgacccgaggcc

SEQ ID NO: 2938870 - DNA, 18 bp, Homo sapiens
cggccttttccaaatgcc

SEQ ID NO: 2938871 - DNA, 16 bp, Homo sapiens
cggcgcagacaggcgg

SEQ ID NO: 2938872 - DNA, 12 bp, Homo sapiens
cggcgccctgga

SEQ ID NO: 2938873 - DNA, 14 bp, Homo sapiens
cggcgccctggact

SEQ ID NO: 2938874 - DNA, 15 bp, Homo sapiens
cggcgccctggactt

SEQ ID NO: 2938875 - DNA, 22 bp, Homo sapiens
cggcgcctgccctgcccaagtg

SEQ ID NO: 2938876 - DNA, 15 bp, Homo sapiens
cggcgctgcctcagg

SEQ ID NO: 2938877 - DNA, 18 bp, Homo sapiens
cggcggctctgcccacct

SEQ ID NO: 2938878 - DNA, 18 bp, Homo sapiens
cggcgggtgctctgaggc

SEQ ID NO: 2938879 - DNA, 18 bp, Homo sapiens
cggcgtggagactggcag

SEQ ID NO: 2938880 - DNA, 13 bp, Homo sapiens
cggctacatcagc

SEQ ID NO: 2938881 - DNA, 14 bp, Homo sapiens
cggctactcagcag

SEQ ID NO: 2938882 - DNA, 20 bp, Homo sapiens
cggctcagtgcaacctctgc

SEQ ID NO: 2938883 - DNA, 15 bp, Homo sapiens
cggctccactaggac

SEQ ID NO: 2938884 - DNA, 23 bp, Homo sapiens
cggctcctcgagatcccaacact

SEQ ID NO: 2938885 - DNA, 20 bp, Homo sapiens
cggctcggaggaagccccca

SEQ ID NO: 2938886 - DNA, 13 bp, Homo sapiens
cggctcggcccag

SEQ ID NO: 2938887 - DNA, 18 bp, Homo sapiens
cggctcggcccagcaccc

SEQ ID NO: 2938888 - DNA, 11 bp, Homo sapiens
cggctctgccc

SEQ ID NO: 2938889 - DNA, 22 bp, Homo sapiens
cggctgagtcatgatctccctg

SEQ ID NO: 2938890 - DNA, 14 bp, Homo sapiens
cggctgcctcctga

SEQ ID NO: 2938891 - DNA, 17 bp, Homo sapiens
cggctgctcgcccagga

SEQ ID NO: 2938892 - DNA, 18 bp, Homo sapiens
cggctgctcgcccaggaa

SEQ ID NO: 2938893 - DNA, 18 bp, Homo sapiens
cggctggaaatgctgggc

SEQ ID NO: 2938894 - DNA, 20 bp, Homo sapiens
cggctggaaatgctgggctg

SEQ ID NO: 2938895 - DNA, 15 bp, Homo sapiens
cggctggacttggag

SEQ ID NO: 2938896 - DNA, 14 bp, Homo sapiens
cggctggcctggag

SEQ ID NO: 2938897 - DNA, 22 bp, Homo sapiens
cggctggcctggaggctcagcc

SEQ ID NO: 2938898 - DNA, 18 bp, Homo sapiens
cggctgggaggagggcag

SEQ ID NO: 2938899 - DNA, 20 bp, Homo sapiens
cggctgggcacacgcctccc

SEQ ID NO: 2938900 - DNA, 11 bp, Homo sapiens
cggctgggcct

SEQ ID NO: 2938901 - DNA, 22 bp, Homo sapiens
cggctgggcctccttcttccac

SEQ ID NO: 2938902 - DNA, 16 bp, Homo sapiens
cggctggtcactctgc

SEQ ID NO: 2938903 - DNA, 18 bp, Homo sapiens
cggctgtgacgcagccgg

SEQ ID NO: 2938904 - DNA, 14 bp, Homo sapiens
cggctttcagggca

SEQ ID NO: 2938905 - DNA, 18 bp, Homo sapiens
cgggaagcatcctcccca

SEQ ID NO: 2938906 - DNA, 14 bp, Homo sapiens
cgggaagggagggg

SEQ ID NO: 2938907 - DNA, 14 bp, Homo sapiens
cgggaatcacaggt

SEQ ID NO: 2938908 - DNA, 17 bp, Homo sapiens
cgggacaccgtggggaa

SEQ ID NO: 2938909 - DNA, 19 bp, Homo sapiens
cgggacacctaggctaggg

SEQ ID NO: 2938910 - DNA, 23 bp, Homo sapiens
cgggacatcacagggtgggcctc

SEQ ID NO: 2938911 - DNA, 13 bp, Homo sapiens
cgggaccagaaac

SEQ ID NO: 2938912 - DNA, 23 bp, Homo sapiens
cgggaccagaaacctgggagaga

SEQ ID NO: 2938913 - DNA, 23 bp, Homo sapiens
cgggaccccgagcctggctccaa

SEQ ID NO: 2938914 - DNA, 14 bp, Homo sapiens
cgggaccctcaggt

SEQ ID NO: 2938915 - DNA, 23 bp, Homo sapiens
cgggactcactggcagccccagc

SEQ ID NO: 2938916 - DNA, 20 bp, Homo sapiens
cgggagaaaagacggatggc

SEQ ID NO: 2938917 - DNA, 18 bp, Homo sapiens
cgggagccgctggcagaa

SEQ ID NO: 2938918 - DNA, 16 bp, Homo sapiens
cgggagctcaggaacc

SEQ ID NO: 2938919 - DNA, 20 bp, Homo sapiens
cgggagctggtgacagcctt

SEQ ID NO: 2938920 - DNA, 11 bp, Homo sapiens
cgggagggagt

SEQ ID NO: 2938921 - DNA, 19 bp, Homo sapiens
cgggcaagtgagaggggag

SEQ ID NO: 2938922 - DNA, 14 bp, Homo sapiens
cgggcacagccagc

SEQ ID NO: 2938923 - DNA, 14 bp, Homo sapiens
cgggcacagtggct

SEQ ID NO: 2938924 - DNA, 14 bp, Homo sapiens
cgggcagagggctg

SEQ ID NO: 2938925 - DNA, 14 bp, Homo sapiens
cgggcagccaggct

SEQ ID NO: 2938926 - DNA, 14 bp, Homo sapiens
cgggcatctttggg

SEQ ID NO: 2938927 - DNA, 16 bp, Homo sapiens
cgggcatgatggtgca

SEQ ID NO: 2938928 - DNA, 21 bp, Homo sapiens
cgggcatggtggcgcaagcct

SEQ ID NO: 2938929 - DNA, 15 bp, Homo sapiens
cgggccacagggcaa

SEQ ID NO: 2938930 - DNA, 14 bp, Homo sapiens
cgggccaggccctg

SEQ ID NO: 2938931 - DNA, 17 bp, Homo sapiens
cgggcccagaccggctt

SEQ ID NO: 2938932 - DNA, 14 bp, Homo sapiens
cgggcccagggaca

SEQ ID NO: 2938933 - DNA, 15 bp, Homo sapiens
cgggcccagggacat

SEQ ID NO: 2938934 - DNA, 22 bp, Homo sapiens
cgggcccccaccgccggggtcc

SEQ ID NO: 2938935 - DNA, 17 bp, Homo sapiens
cgggcccctcacctggt

SEQ ID NO: 2938936 - DNA, 21 bp, Homo sapiens
cgggcccttcccacaggacat

SEQ ID NO: 2938937 - DNA, 16 bp, Homo sapiens
cgggccggacctgagc

SEQ ID NO: 2938938 - DNA, 21 bp, Homo sapiens
cgggccggacctgagcccgca

SEQ ID NO: 2938939 - DNA, 13 bp, Homo sapiens
cgccatttaaaag

SEQ ID NO: 2938940 - DNA, 12 bp, Homo sapiens
cgcccaaggccc

SEQ ID NO: 2938941 - DNA, 14 bp, Homo sapiens
cgcccagcagcctg

SEQ ID NO: 2938942 - DNA, 20 bp, Homo sapiens
cgcccagcagcctgccagca

SEQ ID NO: 2938943 - DNA, 15 bp, Homo sapiens
cgcccagtccttcca

SEQ ID NO: 2938944 - DNA, 21 bp, Homo sapiens
cgcccatcagtgccagcccct

SEQ ID NO: 2938945 - DNA, 11 bp, Homo sapiens
cgcccccaccg

SEQ ID NO: 2938946 - DNA, 14 bp, Homo sapiens
cgccccctgccctc

SEQ ID NO: 2938947 - DNA, 19 bp, Homo sapiens
cgccccgctgtgtcctccc

SEQ ID NO: 2938948 - DNA, 14 bp, Homo sapiens
cgccccgggctggc

SEQ ID NO: 2938949 - DNA, 23 bp, Homo sapiens
cgcccgtctgtgtgtgacccctc

SEQ ID NO: 2938950 - DNA, 13 bp, Homo sapiens
cgccctcccaggc

SEQ ID NO: 2938951 - DNA, 19 bp, Homo sapiens
cgccctccgacctctctcg

SEQ ID NO: 2938952 - DNA, 15 bp, Homo sapiens
cgccctgcgggccac

SEQ ID NO: 2938953 - DNA, 16 bp, Homo sapiens
cgccctgcgggccaca

SEQ ID NO: 2938954 - DNA, 14 bp, Homo sapiens
cgccctggacttgg

SEQ ID NO: 2938955 - DNA, 17 bp, Homo sapiens
cgccctttcctcctcag

SEQ ID NO: 2938956 - DNA, 20 bp, Homo sapiens
cgccctttcctcctcaggca

SEQ ID NO: 2938957 - DNA, 15 bp, Homo sapiens
cgccctttttgtcct

SEQ ID NO: 2938958 - DNA, 19 bp, Homo sapiens
cgccgcaaaccacactgga

SEQ ID NO: 2938959 - DNA, 20 bp, Homo sapiens
cgccgcaaaccacactggac

SEQ ID NO: 2938960 - DNA, 15 bp, Homo sapiens
cgccgcctggtactc

SEQ ID NO: 2938961 - DNA, 20 bp, Homo sapiens
cgccgcctggtactcaagcc

SEQ ID NO: 2938962 - DNA, 20 bp, Homo sapiens
cgccgccttggccttgcagc

SEQ ID NO: 2938963 - DNA, 12 bp, Homo sapiens
cgccgctgaccc

SEQ ID NO: 2938964 - DNA, 22 bp, Homo sapiens
cgccggggtcctgggaggctgc

SEQ ID NO: 2938965 - DNA, 14 bp, Homo sapiens
cgccgtgggctgcg

SEQ ID NO: 2938966 - DNA, 21 bp, Homo sapiens
cgcctagtggggtctccctct

SEQ ID NO: 2938967 - DNA, 18 bp, Homo sapiens
cgcctataatcccagcta

SEQ ID NO: 2938968 - DNA, 13 bp, Homo sapiens
cgcctcagcctga

SEQ ID NO: 2938969 - DNA, 21 bp, Homo sapiens
cgcctcagcctgatcaggctt

SEQ ID NO: 2938970 - DNA, 16 bp, Homo sapiens
cgcctcccactggggt

SEQ ID NO: 2938971 - DNA, 18 bp, Homo sapiens
cgcctccccacctccagg

SEQ ID NO: 2938972 - DNA, 19 bp, Homo sapiens
cgcctccccacctccaggc

SEQ ID NO: 2938973 - DNA, 16 bp, Homo sapiens
cgcctcccccctcact

SEQ ID NO: 2938974 - DNA, 16 bp, Homo sapiens
cgcctcccctgcccca

SEQ ID NO: 2938975 - DNA, 21 bp, Homo sapiens
cgcctccgggcgcgcgggcct

SEQ ID NO: 2938976 - DNA, 14 bp, Homo sapiens
cgcctcctgagttc

SEQ ID NO: 2938977 - DNA, 14 bp, Homo sapiens
cgcctcctgctctg

SEQ ID NO: 2938978 - DNA, 15 bp, Homo sapiens
cgcctcgtgccagca

SEQ ID NO: 2938979 - DNA, 19 bp, Homo sapiens
cgcctgcaaacgctgcctg

SEQ ID NO: 2938980 - DNA, 21 bp, Homo sapiens
cgcctgcaaacgctgcctgcc

SEQ ID NO: 2938981 - DNA, 22 bp, Homo sapiens
cgcctgcaaacgctgcctgccc

SEQ ID NO: 2938982 - DNA, 22 bp, Homo sapiens
cgcctgcactcctcagggcagc

SEQ ID NO: 2938983 - DNA, 17 bp, Homo sapiens
cgcctgcatgtaaacac

SEQ ID NO: 2938984 - DNA, 22 bp, Homo sapiens
cgcctgcatgtaaacacgcctg

SEQ ID NO: 2938985 - DNA, 20 bp, Homo sapiens
cgcctgcccacctgcctggc

SEQ ID NO: 2938986 - DNA, 15 bp, Homo sapiens
cgcctgcccctccca

SEQ ID NO: 2938987 - DNA, 17 bp, Homo sapiens
cgcctgccctcctctcc

SEQ ID NO: 2938988 - DNA, 13 bp, Homo sapiens
cgcctgccctgcc

SEQ ID NO: 2938989 - DNA, 16 bp, Homo sapiens
cgcctggaaacagagg

SEQ ID NO: 2938990 - DNA, 16 bp, Homo sapiens
cgcctggagagcgagg

SEQ ID NO: 2938991 - DNA, 11 bp, Homo sapiens
cgcctggccta

SEQ ID NO: 2938992 - DNA, 11 bp, Homo sapiens
cgcctggcctc

SEQ ID NO: 2938993 - DNA, 12 bp, Homo sapiens
cgcctggcctcc

SEQ ID NO: 2938994 - DNA, 13 bp, Homo sapiens
cgcctggcctcca

SEQ ID NO: 2938995 - DNA, 17 bp, Homo sapiens
cgcctggcctccaggcc

SEQ ID NO: 2938996 - DNA, 16 bp, Homo sapiens
cgcctggctgctgctt

SEQ ID NO: 2938997 - DNA, 16 bp, Homo sapiens
cgcctgtaatcccagc

SEQ ID NO: 2938998 - DNA, 16 bp, Homo sapiens
cgcctgtcccctcaca

SEQ ID NO: 2938999 - DNA, 18 bp, Homo sapiens
cgcctgtcccctcacaga

SEQ ID NO: 2939000 - DNA, 14 bp, Homo sapiens
cgccttccctcact

SEQ ID NO: 2939001 - DNA, 14 bp, Homo sapiens
cgcctttcccaact

SEQ ID NO: 2939002 - DNA, 20 bp, Homo sapiens
cgaagtcctatggaaacccg

SEQ ID NO: 2939003 - DNA, 14 bp, Homo sapiens
cgaagttcattttt

SEQ ID NO: 2939004 - DNA, 19 bp, Homo sapiens
cgaatacttttgccctttg

SEQ ID NO: 2939005 - DNA, 23 bp, Homo sapiens
cgaatagggaagtaaaaaaacaa

SEQ ID NO: 2939006 - DNA, 16 bp, Homo sapiens
cgaatgcatattcaac

SEQ ID NO: 2939007 - DNA, 22 bp, Homo sapiens
cgaatgcatattcaacacactg

SEQ ID NO: 2939008 - DNA, 13 bp, Homo sapiens
cgaattatactcc

SEQ ID NO: 2939009 - DNA, 21 bp, Homo sapiens
cgacaaaaacaagactgcctc

SEQ ID NO: 2939010 - DNA, 22 bp, Homo sapiens
cgacaaaaacaagactgcctcc

SEQ ID NO: 2939011 - DNA, 17 bp, Homo sapiens
cgacaccactcctgcca

SEQ ID NO: 2939012 - DNA, 22 bp, Homo sapiens
cgacaccactcctgccagcccg

SEQ ID NO: 2939013 - DNA, 14 bp, Homo sapiens
cgacactcagggca

SEQ ID NO: 2939014 - DNA, 15 bp, Homo sapiens
cgacactcagggcag

SEQ ID NO: 2939015 - DNA, 20 bp, Homo sapiens
cgacactcagggcagctgcc

SEQ ID NO: 2939016 - DNA, 13 bp, Homo sapiens
cgacatcactgtt

SEQ ID NO: 2939017 - DNA, 20 bp, Homo sapiens
cgacatccctcccccagcag

SEQ ID NO: 2939018 - DNA, 21 bp, Homo sapiens
cgacatccctcccccagcaga

SEQ ID NO: 2939019 - DNA, 17 bp, Homo sapiens
cgaccagaggagccttt

SEQ ID NO: 2939020 - DNA, 20 bp, Homo sapiens
cgacccccaagggacccgca

SEQ ID NO: 2939021 - DNA, 16 bp, Homo sapiens
cgaccccccgtgggct

SEQ ID NO: 2939022 - DNA, 18 bp, Homo sapiens
cgaccccccgtgggctcc

SEQ ID NO: 2939023 - DNA, 19 bp, Homo sapiens
cgacccctgcctcgagggc

SEQ ID NO: 2939024 - DNA, 21 bp, Homo sapiens
cgacccctgcctcgagggccg

SEQ ID NO: 2939025 - DNA, 16 bp, Homo sapiens
cgacccgaggcccaga

SEQ ID NO: 2939026 - DNA, 19 bp, Homo sapiens
cgacccgaggcccagatcc

SEQ ID NO: 2939027 - DNA, 17 bp, Homo sapiens
cgaccctgggggcacag

SEQ ID NO: 2939028 - DNA, 23 bp, Homo sapiens
cgacctcgtcctccccctgccag

SEQ ID NO: 2939029 - DNA, 16 bp, Homo sapiens
cgacctctctcagccc

SEQ ID NO: 2939030 - DNA, 14 bp, Homo sapiens
cgacgcccacccaa

SEQ ID NO: 2939031 - DNA, 17 bp, Homo sapiens
cgacgccccgaacctca

SEQ ID NO: 2939032 - DNA, 14 bp, Homo sapiens
cgacggctgtgacg

SEQ ID NO: 2939033 - DNA, 23 bp, Homo sapiens
cgactcccccaaccaaggaagga

SEQ ID NO: 2939034 - DNA, 23 bp, Homo sapiens
cgactgcccagccactccaagcc

SEQ ID NO: 2939035 - DNA, 11 bp, Homo sapiens
cgactgcctgt

SEQ ID NO: 2939036 - DNA, 17 bp, Homo sapiens
cgactggccagggccac

SEQ ID NO: 2939037 - DNA, 20 bp, Homo sapiens
cgacttttgttctcttctgc

SEQ ID NO: 2939038 - DNA, 14 bp, Homo sapiens
cgagagcagtgggc

SEQ ID NO: 2939039 - DNA, 15 bp, Homo sapiens
cgagagcctgctccc

SEQ ID NO: 2939040 - DNA, 14 bp, Homo sapiens
cgagagggagaccc

SEQ ID NO: 2939041 - DNA, 21 bp, Homo sapiens
cgagatagggtggcacatctg

SEQ ID NO: 2939042 - DNA, 15 bp, Homo sapiens
cgagatcccaacact

SEQ ID NO: 2939043 - DNA, 23 bp, Homo sapiens
cgagatggcagattcccactgcc

SEQ ID NO: 2939044 - DNA, 16 bp, Homo sapiens
cgagattgctggaaac

SEQ ID NO: 2939045 - DNA, 13 bp, Homo sapiens
cgagcacctccac

SEQ ID NO: 2939046 - DNA, 20 bp, Homo sapiens
cgagcatgcggagccagcag

SEQ ID NO: 2939047 - DNA, 19 bp, Homo sapiens
cgagcatgttgttttttca

SEQ ID NO: 2939048 - DNA, 14 bp, Homo sapiens
cgagcccctcggct

SEQ ID NO: 2939049 - DNA, 20 bp, Homo sapiens
cgagcccctcggctctggag

SEQ ID NO: 2939050 - DNA, 13 bp, Homo sapiens
cgagcctggaagc

SEQ ID NO: 2939051 - DNA, 17 bp, Homo sapiens
cgagcggtggccccgag

SEQ ID NO: 2939052 - DNA, 23 bp, Homo sapiens
cgagctctgtgggaaaaaagaaa

SEQ ID NO: 2939053 - DNA, 16 bp, Homo sapiens
cgagctgaggactctg

SEQ ID NO: 2939054 - DNA, 17 bp, Homo sapiens
cgagctgaggactctgc

SEQ ID NO: 2939055 - DNA, 19 bp, Homo sapiens
ccttccccagacttgcact

SEQ ID NO: 2939056 - DNA, 12 bp, Homo sapiens
ccttccccttgt

SEQ ID NO: 2939057 - DNA, 21 bp, Homo sapiens
ccttccccttgtccctggggc

SEQ ID NO: 2939058 - DNA, 16 bp, Homo sapiens
ccttccctgcctccag

SEQ ID NO: 2939059 - DNA, 20 bp, Homo sapiens
ccttccctgcctccagctgt

SEQ ID NO: 2939060 - DNA, 18 bp, Homo sapiens
ccttccctgtctgccagg

SEQ ID NO: 2939061 - DNA, 18 bp, Homo sapiens
ccttccgcagtgtggcca

SEQ ID NO: 2939062 - DNA, 18 bp, Homo sapiens
ccttccgggttcaagtga

SEQ ID NO: 2939063 - DNA, 14 bp, Homo sapiens
ccttcctcactgcc

SEQ ID NO: 2939064 - DNA, 22 bp, Homo sapiens
ccttcctcatctgtgcctgtct

SEQ ID NO: 2939065 - DNA, 21 bp, Homo sapiens
ccttcctcctccaccaccgcc

SEQ ID NO: 2939066 - DNA, 12 bp, Homo sapiens
ccttcctcctgg

SEQ ID NO: 2939067 - DNA, 13 bp, Homo sapiens
ccttcctcctggg

SEQ ID NO: 2939068 - DNA, 23 bp, Homo sapiens
ccttcctgagaaacgtccatctc

SEQ ID NO: 2939069 - DNA, 12 bp, Homo sapiens
ccttcctgcagt

SEQ ID NO: 2939070 - DNA, 12 bp, Homo sapiens
ccttcctggccc

SEQ ID NO: 2939071 - DNA, 22 bp, Homo sapiens
ccttcctggcccaggccttgct

SEQ ID NO: 2939072 - DNA, 15 bp, Homo sapiens
ccttccttccctggc

SEQ ID NO: 2939073 - DNA, 13 bp, Homo sapiens
ccttcgacatgct

SEQ ID NO: 2939074 - DNA, 19 bp, Homo sapiens
ccttcgacatgctgccagg

SEQ ID NO: 2939075 - DNA, 20 bp, Homo sapiens
ccttcggacaactcagtccc

SEQ ID NO: 2939076 - DNA, 18 bp, Homo sapiens
ccttcgggcgtctgtgtg

SEQ ID NO: 2939077 - DNA, 19 bp, Homo sapiens
ccttcggtggaagagctca

SEQ ID NO: 2939078 - DNA, 23 bp, Homo sapiens
ccttcgtttactatgcctgtgtc

SEQ ID NO: 2939079 - DNA, 11 bp, Homo sapiens
ccttctcacca

SEQ ID NO: 2939080 - DNA, 12 bp, Homo sapiens
ccttctcagctc

SEQ ID NO: 2939081 - DNA, 17 bp, Homo sapiens
ccttctcattgctgccc

SEQ ID NO: 2939082 - DNA, 13 bp, Homo sapiens
ccttctccaaagg

SEQ ID NO: 2939083 - DNA, 11 bp, Homo sapiens
ccttctccatc

SEQ ID NO: 2939084 - DNA, 16 bp, Homo sapiens
ccttctccatccacat

SEQ ID NO: 2939085 - DNA, 18 bp, Homo sapiens
ccttctcggagctggccc

SEQ ID NO: 2939086 - DNA, 22 bp, Homo sapiens
ccttctctcagctcccaggcca

SEQ ID NO: 2939087 - DNA, 14 bp, Homo sapiens
ccttctcttctctt

SEQ ID NO: 2939088 - DNA, 20 bp, Homo sapiens
ccttctgagccttctactta

SEQ ID NO: 2939089 - DNA, 18 bp, Homo sapiens
ccttctgaggacattcca

SEQ ID NO: 2939090 - DNA, 15 bp, Homo sapiens
ccttctgctttctat

SEQ ID NO: 2939091 - DNA, 17 bp, Homo sapiens
ccttctggcctcccaca

SEQ ID NO: 2939092 - DNA, 21 bp, Homo sapiens
ccttctggctgtagataaata

SEQ ID NO: 2939093 - DNA, 19 bp, Homo sapiens
ccttcttattctcactcca

SEQ ID NO: 2939094 - DNA, 22 bp, Homo sapiens
ccttcttattctcactccacca

SEQ ID NO: 2939095 - DNA, 13 bp, Homo sapiens
ccttcttcagggc

SEQ ID NO: 2939096 - DNA, 16 bp, Homo sapiens
ccttcttcagggcctg

SEQ ID NO: 2939097 - DNA, 13 bp, Homo sapiens
ccttcttccaagg

SEQ ID NO: 2939098 - DNA, 21 bp, Homo sapiens
ccttcttcggggaactcctgg

SEQ ID NO: 2939099 - DNA, 16 bp, Homo sapiens
ccttctttaccttcat

SEQ ID NO: 2939100 - DNA, 19 bp, Homo sapiens
ccttctttaccttcatttc

SEQ ID NO: 2939101 - DNA, 15 bp, Homo sapiens
ccttgaaaatatttt

SEQ ID NO: 2939102 - DNA, 12 bp, Homo sapiens
ccttgaaggtct

SEQ ID NO: 2939103 - DNA, 21 bp, Homo sapiens
ccttgacaaagtcaagccaca

SEQ ID NO: 2939104 - DNA, 15 bp, Homo sapiens
ccttgacaactggca

SEQ ID NO: 2939105 - DNA, 14 bp, Homo sapiens
ccttgacagagcag

SEQ ID NO: 2939106 - DNA, 15 bp, Homo sapiens
ccttgacagagcagc

SEQ ID NO: 2939107 - DNA, 22 bp, Homo sapiens
ccttgacagagcagctaactcc

SEQ ID NO: 2939108 - DNA, 15 bp, Homo sapiens
ccttgacctttgtac

SEQ ID NO: 2939109 - DNA, 22 bp, Homo sapiens
ccttgactgaagcgaacatctt

SEQ ID NO: 2939110 - DNA, 14 bp, Homo sapiens
ccttgagacctcag

SEQ ID NO: 2939111 - DNA, 16 bp, Homo sapiens
ccttgagacctcagcc

SEQ ID NO: 2939112 - DNA, 17 bp, Homo sapiens
ccttgagacctcagcca

SEQ ID NO: 2939113 - DNA, 22 bp, Homo sapiens
ccttgagatgcttcactttcct

SEQ ID NO: 2939114 - DNA, 20 bp, Homo sapiens
ccttgagattctgaagtatg

SEQ ID NO: 2939115 - DNA, 11 bp, Homo sapiens
ccttgagccct

SEQ ID NO: 2939116 - DNA, 13 bp, Homo sapiens
ccttgattttctt

SEQ ID NO: 2939117 - DNA, 21 bp, Homo sapiens
ccttgcaatggatcagccaag

SEQ ID NO: 2939118 - DNA, 14 bp, Homo sapiens
ccttgcacctgcat

SEQ ID NO: 2939119 - DNA, 15 bp, Homo sapiens
ccttgcagtttaaga

SEQ ID NO: 2939120 - DNA, 13 bp, Homo sapiens
ccttgccagagat

SEQ ID NO: 2939121 - DNA, 16 bp, Homo sapiens
ccttgcccacaggtgc

SEQ ID NO: 2939122 - DNA, 19 bp, Homo sapiens
ccttgcccagagatgcctc

SEQ ID NO: 2939123 - DNA, 23 bp, Homo sapiens
ccttgcccagagatgcctccacc

SEQ ID NO: 2939124 - DNA, 20 bp, Homo sapiens
ccttgcccgtcgtgtgctga

SEQ ID NO: 2939125 - DNA, 17 bp, Homo sapiens
ccttgcccttcctgacc

SEQ ID NO: 2939126 - DNA, 12 bp, Homo sapiens
ccttgcctggcc

SEQ ID NO: 2939127 - DNA, 19 bp, Homo sapiens
ccttgctagctagccagcc

SEQ ID NO: 2939128 - DNA, 13 bp, Homo sapiens
ccttgctgactct

SEQ ID NO: 2939129 - DNA, 18 bp, Homo sapiens
ccttgctgactctctgag

SEQ ID NO: 2939130 - DNA, 19 bp, Homo sapiens
ccttgctgactctctgagc

SEQ ID NO: 2939131 - DNA, 21 bp, Homo sapiens
ccttgctgccaagtcctgcct

SEQ ID NO: 2939132 - DNA, 20 bp, Homo sapiens
ccttgctgtagagacttccg

SEQ ID NO: 2939133 - DNA, 22 bp, Homo sapiens
ccttggagcatttatgtagaca

SEQ ID NO: 2939134 - DNA, 15 bp, Homo sapiens
ccttggaggacagtg

SEQ ID NO: 2939135 - DNA, 18 bp, Homo sapiens
ccttggaggacagtggga

SEQ ID NO: 2939136 - DNA, 15 bp, Homo sapiens
ccttggagtcccagg

SEQ ID NO: 2939137 - DNA, 18 bp, Homo sapiens
ccttggataatgctgttg

SEQ ID NO: 2939138 - DNA, 23 bp, Homo sapiens
ccttggataatgctgttgcctca

SEQ ID NO: 2939139 - DNA, 15 bp, Homo sapiens
ccttggcaactttct

SEQ ID NO: 2939140 - DNA, 20 bp, Homo sapiens
ccttggcaccagacacccag

SEQ ID NO: 2939141 - DNA, 13 bp, Homo sapiens
ccttggcccagag

SEQ ID NO: 2939142 - DNA, 16 bp, Homo sapiens
ccttggcccaggagct

SEQ ID NO: 2939143 - DNA, 17 bp, Homo sapiens
ccttggcccaggagctc

SEQ ID NO: 2939144 - DNA, 19 bp, Homo sapiens
ccttggcccaggagctctg

SEQ ID NO: 2939145 - DNA, 20 bp, Homo sapiens
ccttggcccaggagctctgc

SEQ ID NO: 2939146 - DNA, 20 bp, Homo sapiens
ccttggccggctgtgctcag

SEQ ID NO: 2939147 - DNA, 13 bp, Homo sapiens
ccttggccttgca

SEQ ID NO: 2939148 - DNA, 22 bp, Homo sapiens
ccttggccttgcagctggccca

SEQ ID NO: 2939149 - DNA, 12 bp, Homo sapiens
ccttggctcaga

SEQ ID NO: 2939150 - DNA, 18 bp, Homo sapiens
ccttggcttgcccacgtg

SEQ ID NO: 2939151 - DNA, 17 bp, Homo sapiens
ccttggctttgaggccg

SEQ ID NO: 2939152 - DNA, 14 bp, Homo sapiens
ccttgggcagggtc

SEQ ID NO: 2939153 - DNA, 14 bp, Homo sapiens
ccttgggccctgga

SEQ ID NO: 2939154 - DNA, 21 bp, Homo sapiens
ccttgggcctggccagtcttc

SEQ ID NO: 2939155 - DNA, 16 bp, Homo sapiens
ccttgggcctttcagt

SEQ ID NO: 2939156 - DNA, 14 bp, Homo sapiens
ccttggggcaggca

SEQ ID NO: 2939157 - DNA, 17 bp, Homo sapiens
ccttgggggggctgcct

SEQ ID NO: 2939158 - DNA, 22 bp, Homo sapiens
ccttgggggggctgcctttgtg

SEQ ID NO: 2939159 - DNA, 19 bp, Homo sapiens
ccttggggtggcgcgcctg

SEQ ID NO: 2939160 - DNA, 23 bp, Homo sapiens
ccttggggtggcgcgcctgcctt

SEQ ID NO: 2939161 - DNA, 19 bp, Homo sapiens
ccttggggtgggggccagg

SEQ ID NO: 2939162 - DNA, 20 bp, Homo sapiens
ccttggggtgggggccaggc

SEQ ID NO: 2939163 - DNA, 21 bp, Homo sapiens
ccttggggtgggggccaggcc

SEQ ID NO: 2939164 - DNA, 16 bp, Homo sapiens
ccttggtatgtgccag

SEQ ID NO: 2939165 - DNA, 12 bp, Homo sapiens
ccttggtgggga

SEQ ID NO: 2939166 - DNA, 16 bp, Homo sapiens
ccttggtgtccacctg

SEQ ID NO: 2939167 - DNA, 16 bp, Homo sapiens
ccttggttcccccact

SEQ ID NO: 2939168 - DNA, 15 bp, Homo sapiens
ccttgtccctggggc

SEQ ID NO: 2939169 - DNA, 13 bp, Homo sapiens
ccttgtgcctggg

SEQ ID NO: 2939170 - DNA, 15 bp, Homo sapiens
ccttgtgcctggggt

SEQ ID NO: 2939171 - DNA, 21 bp, Homo sapiens
ccttgtggtctcgatgctgct

SEQ ID NO: 2939172 - DNA, 16 bp, Homo sapiens
ccttgtgtgtaccaca

SEQ ID NO: 2939173 - DNA, 23 bp, Homo sapiens
ccttgtgtgtaccacaccctgcc

SEQ ID NO: 2939174 - DNA, 15 bp, Homo sapiens
ccttgtgtgtcaggc

SEQ ID NO: 2939175 - DNA, 18 bp, Homo sapiens
ccttgtgtgtcaggccct

SEQ ID NO: 2939176 - DNA, 20 bp, Homo sapiens
ccttgtgttccttctgtgaa

SEQ ID NO: 2939177 - DNA, 18 bp, Homo sapiens
ccttgttacccatgaaaa

SEQ ID NO: 2939178 - DNA, 22 bp, Homo sapiens
ccttgtttcaaacacaaatgca

SEQ ID NO: 2939179 - DNA, 14 bp, Homo sapiens
ccttgtttctttct

SEQ ID NO: 2939180 - DNA, 18 bp, Homo sapiens
ccttgtttgttttattca

SEQ ID NO: 2939181 - DNA, 14 bp, Homo sapiens
ccttgttttgccat

SEQ ID NO: 2939182 - DNA, 20 bp, Homo sapiens
cctttaaaaatgtataatga

SEQ ID NO: 2939183 - DNA, 23 bp, Homo sapiens
cctttaaagtgagtactgttaag

SEQ ID NO: 2939184 - DNA, 16 bp, Homo sapiens
cctttaactcatgagg

SEQ ID NO: 2939185 - DNA, 14 bp, Homo sapiens
cctttaactcgttg

SEQ ID NO: 2939186 - DNA, 20 bp, Homo sapiens
cctttaagatatccatcttt

SEQ ID NO: 2939187 - DNA, 23 bp, Homo sapiens
cctttaagatatccatctttttc

SEQ ID NO: 2939188 - DNA, 21 bp, Homo sapiens
cctttaagcctgcattcttaa

SEQ ID NO: 2939189 - DNA, 19 bp, Homo sapiens
cctttaagtagataagcag

SEQ ID NO: 2939190 - DNA, 22 bp, Homo sapiens
cctttacagtttgtgctctact

SEQ ID NO: 2939191 - DNA, 20 bp, Homo sapiens
cctttagaaactcaaaaact

SEQ ID NO: 2939192 - DNA, 21 bp, Homo sapiens
cctgcaaacgctgcctgcccg

SEQ ID NO: 2939193 - DNA, 17 bp, Homo sapiens
cctgcacagattcccag

SEQ ID NO: 2939194 - DNA, 12 bp, Homo sapiens
cctgcacagttt

SEQ ID NO: 2939195 - DNA, 20 bp, Homo sapiens
cctgcaccctcttctcctct

SEQ ID NO: 2939196 - DNA, 22 bp, Homo sapiens
cctgcaccgaccccgggccgga

SEQ ID NO: 2939197 - DNA, 18 bp, Homo sapiens
cctgcaccgacccgaggc

SEQ ID NO: 2939198 - DNA, 18 bp, Homo sapiens
cctgcacctccccccact

SEQ ID NO: 2939199 - DNA, 21 bp, Homo sapiens
cctgcactccctcctggagct

SEQ ID NO: 2939200 - DNA, 21 bp, Homo sapiens
cctgcactccctggccttgcc

SEQ ID NO: 2939201 - DNA, 12 bp, Homo sapiens
cctgcactcctc

SEQ ID NO: 2939202 - DNA, 23 bp, Homo sapiens
cctgcactcctcagggcagcctc

SEQ ID NO: 2939203 - DNA, 16 bp, Homo sapiens
cctgcacttcatatct

SEQ ID NO: 2939204 - DNA, 23 bp, Homo sapiens
cctgcactttgggtttttaactc

SEQ ID NO: 2939205 - DNA, 16 bp, Homo sapiens
cctgcagaatttgggt

SEQ ID NO: 2939206 - DNA, 17 bp, Homo sapiens
cccttaagccctggccc

SEQ ID NO: 2939207 - DNA, 17 bp, Homo sapiens
cccttacagcctctgac

SEQ ID NO: 2939208 - DNA, 14 bp, Homo sapiens
cccttacagtagga

SEQ ID NO: 2939209 - DNA, 17 bp, Homo sapiens
cccttacccatcttgct

SEQ ID NO: 2939210 - DNA, 13 bp, Homo sapiens
cccttagcagccc

SEQ ID NO: 2939211 - DNA, 14 bp, Homo sapiens
cccttagcagccca

SEQ ID NO: 2939212 - DNA, 17 bp, Homo sapiens
cccttagcagcccagca

SEQ ID NO: 2939213 - DNA, 20 bp, Homo sapiens
cccttagccttgctgtagag

SEQ ID NO: 2939214 - DNA, 22 bp, Homo sapiens
cccttatagtttgggcttcagc

SEQ ID NO: 2939215 - DNA, 20 bp, Homo sapiens
cccttatctgtgctcaggac

SEQ ID NO: 2939216 - DNA, 16 bp, Homo sapiens
cccttcaacaaacagt

SEQ ID NO: 2939217 - DNA, 22 bp, Homo sapiens
cccttcaacgtttcttcacttt

SEQ ID NO: 2939218 - DNA, 21 bp, Homo sapiens
cccttcattgatttcctgtgt

SEQ ID NO: 2939219 - DNA, 21 bp, Homo sapiens
cccttccacctcacaactcct

SEQ ID NO: 2939220 - DNA, 23 bp, Homo sapiens
cccttcccacaggacatttctct

SEQ ID NO: 2939221 - DNA, 11 bp, Homo sapiens
cccttccctgc

SEQ ID NO: 2939222 - DNA, 12 bp, Homo sapiens
cccttccctgcc

SEQ ID NO: 2939223 - DNA, 15 bp, Homo sapiens
cccttccggtgcgtg

SEQ ID NO: 2939224 - DNA, 17 bp, Homo sapiens
cccttcctcatctgtgc

SEQ ID NO: 2939225 - DNA, 13 bp, Homo sapiens
cccttcctcctcc

SEQ ID NO: 2939226 - DNA, 14 bp, Homo sapiens
cccttcctctttgg

SEQ ID NO: 2939227 - DNA, 13 bp, Homo sapiens
cccttcctggccc

SEQ ID NO: 2939228 - DNA, 16 bp, Homo sapiens
cccttcctggcccagg

SEQ ID NO: 2939229 - DNA, 17 bp, Homo sapiens
cccttcctggcccaggc

SEQ ID NO: 2939230 - DNA, 19 bp, Homo sapiens
cccttccttgggcagaatg

SEQ ID NO: 2939231 - DNA, 17 bp, Homo sapiens
cccttcgacatgctgcc

SEQ ID NO: 2939232 - DNA, 16 bp, Homo sapiens
cccttcgctctgctgg

SEQ ID NO: 2939233 - DNA, 23 bp, Homo sapiens
cccttctccatccacatgggagc

SEQ ID NO: 2939234 - DNA, 21 bp, Homo sapiens
cccttctctgtgacccacttc

SEQ ID NO: 2939235 - DNA, 14 bp, Homo sapiens
cccttctgctcagc

SEQ ID NO: 2939236 - DNA, 19 bp, Homo sapiens
cccttcttccaaggagcag

SEQ ID NO: 2939237 - DNA, 18 bp, Homo sapiens
cccttgagacctcagcca

SEQ ID NO: 2939238 - DNA, 13 bp, Homo sapiens
cccttgagccctc

SEQ ID NO: 2939239 - DNA, 15 bp, Homo sapiens
cccttgcccttcctg

SEQ ID NO: 2939240 - DNA, 22 bp, Homo sapiens
cccttgctggagtcatgtgcct

SEQ ID NO: 2939241 - DNA, 21 bp, Homo sapiens
cccttgctgtatgctgatcat

SEQ ID NO: 2939242 - DNA, 22 bp, Homo sapiens
cccttgcttgcctgcagggcca

SEQ ID NO: 2939243 - DNA, 23 bp, Homo sapiens
cccttgcttgcctgcagggccat

SEQ ID NO: 2939244 - DNA, 12 bp, Homo sapiens
cccttgggccac

SEQ ID NO: 2939245 - DNA, 23 bp, Homo sapiens
cccttggggtggcgcgcctgcct

SEQ ID NO: 2939246 - DNA, 15 bp, Homo sapiens
cccttggtagagttt

SEQ ID NO: 2939247 - DNA, 17 bp, Homo sapiens
cccttggtttctggggg

SEQ ID NO: 2939248 - DNA, 15 bp, Homo sapiens
cccttgtcccactca

SEQ ID NO: 2939249 - DNA, 14 bp, Homo sapiens
cccttgtccctggg

SEQ ID NO: 2939250 - DNA, 15 bp, Homo sapiens
cccttgtccctgggg

SEQ ID NO: 2939251 - DNA, 19 bp, Homo sapiens
cccttgtgttccttctgtg

SEQ ID NO: 2939252 - DNA, 15 bp, Homo sapiens
cccttgttttgaaac

SEQ ID NO: 2939253 - DNA, 13 bp, Homo sapiens
ccctttaatattt

SEQ ID NO: 2939254 - DNA, 21 bp, Homo sapiens
ccctttattgaaaaaataaaa

SEQ ID NO: 2939255 - DNA, 14 bp, Homo sapiens
ccctttcctttgga

SEQ ID NO: 2939256 - DNA, 14 bp, Homo sapiens
ccctttctggctct

SEQ ID NO: 2939257 - DNA, 13 bp, Homo sapiens
ccctttctgttcg

SEQ ID NO: 2939258 - DNA, 22 bp, Homo sapiens
ccctttgggccctgcatgtagt

SEQ ID NO: 2939259 - DNA, 17 bp, Homo sapiens
cccttttacattctgtg

SEQ ID NO: 2939260 - DNA, 11 bp, Homo sapiens
cccttttcctg

SEQ ID NO: 2939261 - DNA, 12 bp, Homo sapiens
cccttttcctgg

SEQ ID NO: 2939262 - DNA, 23 bp, Homo sapiens
ccctttttgcaggggactgggcc

SEQ ID NO: 2939263 - DNA, 15 bp, Homo sapiens
ccgaaagaagacaca

SEQ ID NO: 2939264 - DNA, 14 bp, Homo sapiens
ccgaactccaggct

SEQ ID NO: 2939265 - DNA, 18 bp, Homo sapiens
ccgaactccaggctgggc

SEQ ID NO: 2939266 - DNA, 15 bp, Homo sapiens
cctcgtcctccccct

SEQ ID NO: 2939267 - DNA, 19 bp, Homo sapiens
cctcgtcctccccctgcca

SEQ ID NO: 2939268 - DNA, 18 bp, Homo sapiens
cctcgtgccagcagcctc

SEQ ID NO: 2939269 - DNA, 17 bp, Homo sapiens
cctcgtgcctgggggag

SEQ ID NO: 2939270 - DNA, 20 bp, Homo sapiens
cctcgtgcctgggggagaga

SEQ ID NO: 2939271 - DNA, 15 bp, Homo sapiens
cctctaactccctcc

SEQ ID NO: 2939272 - DNA, 16 bp, Homo sapiens
cctctaactccctcct

SEQ ID NO: 2939273 - DNA, 19 bp, Homo sapiens
cctctaactccctcctcac

SEQ ID NO: 2939274 - DNA, 18 bp, Homo sapiens
cctctacagagcttccct

SEQ ID NO: 2939275 - DNA, 20 bp, Homo sapiens
cctctacagagcttccctga

SEQ ID NO: 2939276 - DNA, 21 bp, Homo sapiens
cctctacatggactcagagaa

SEQ ID NO: 2939277 - DNA, 16 bp, Homo sapiens
cctctaccagaactaa

SEQ ID NO: 2939278 - DNA, 18 bp, Homo sapiens
cctctacctctctcctct

SEQ ID NO: 2939279 - DNA, 17 bp, Homo sapiens
cctctagaaatttttca

SEQ ID NO: 2939280 - DNA, 17 bp, Homo sapiens
cctctaggctctgcctt

SEQ ID NO: 2939281 - DNA, 19 bp, Homo sapiens
cctctaggctctgccttcg

SEQ ID NO: 2939282 - DNA, 13 bp, Homo sapiens
cctctagggcagg

SEQ ID NO: 2939283 - DNA, 16 bp, Homo sapiens
cctctaggtaaccagt

SEQ ID NO: 2939284 - DNA, 15 bp, Homo sapiens
cctctcaactgcctc

SEQ ID NO: 2939285 - DNA, 18 bp, Homo sapiens
cctctcaactgcctcagc

SEQ ID NO: 2939286 - DNA, 14 bp, Homo sapiens
cctctcacctctgt

SEQ ID NO: 2939287 - DNA, 15 bp, Homo sapiens
cctctcacctctgtg

SEQ ID NO: 2939288 - DNA, 13 bp, Homo sapiens
cctctcacgccac

SEQ ID NO: 2939289 - DNA, 15 bp, Homo sapiens
cctctcactgtctga

SEQ ID NO: 2939290 - DNA, 16 bp, Homo sapiens
cctctcaggctgtccc

SEQ ID NO: 2939291 - DNA, 14 bp, Homo sapiens
cctctcagtgcctt

SEQ ID NO: 2939292 - DNA, 23 bp, Homo sapiens
cctctcatatatagacagctttg

SEQ ID NO: 2939293 - DNA, 15 bp, Homo sapiens
cctctcatctcaggt

SEQ ID NO: 2939294 - DNA, 18 bp, Homo sapiens
cctctccactcatgtgac

SEQ ID NO: 2939295 - DNA, 18 bp, Homo sapiens
cctctccatgcaagtgct

SEQ ID NO: 2939296 - DNA, 20 bp, Homo sapiens
cctctccatgcaagtgctgt

SEQ ID NO: 2939297 - DNA, 12 bp, Homo sapiens
cctctccccagc

SEQ ID NO: 2939298 - DNA, 16 bp, Homo sapiens
cctctccccagcccag

SEQ ID NO: 2939299 - DNA, 17 bp, Homo sapiens
cctctccccagcccaga

SEQ ID NO: 2939300 - DNA, 11 bp, Homo sapiens
cctctcccgtc

SEQ ID NO: 2939301 - DNA, 18 bp, Homo sapiens
cctctcccgtctcgcctg

SEQ ID NO: 2939302 - DNA, 12 bp, Homo sapiens
cctctccctgac

SEQ ID NO: 2939303 - DNA, 21 bp, Homo sapiens
cctctccctgaccctgtatat

SEQ ID NO: 2939304 - DNA, 12 bp, Homo sapiens
cctctcccttcc

SEQ ID NO: 2939305 - DNA, 20 bp, Homo sapiens
cctctccgcacacctctggc

SEQ ID NO: 2939306 - DNA, 22 bp, Homo sapiens
cctctccgcacacctctggctg

SEQ ID NO: 2939307 - DNA, 11 bp, Homo sapiens
cctctcctgcc

SEQ ID NO: 2939308 - DNA, 15 bp, Homo sapiens
cctctccttcctgtg

SEQ ID NO: 2939309 - DNA, 18 bp, Homo sapiens
cctctcggtgctccatct

SEQ ID NO: 2939310 - DNA, 22 bp, Homo sapiens
cctctctcatatcactgaagga

SEQ ID NO: 2939311 - DNA, 21 bp, Homo sapiens
cctctctcccaccctaagggc

SEQ ID NO: 2939312 - DNA, 16 bp, Homo sapiens
cctctctcccatttca

SEQ ID NO: 2939313 - DNA, 16 bp, Homo sapiens
cctctctccctgcctc

SEQ ID NO: 2939314 - DNA, 18 bp, Homo sapiens
cctctctccctgcctcac

SEQ ID NO: 2939315 - DNA, 21 bp, Homo sapiens
cctctctccctgcctcacatc

SEQ ID NO: 2939316 - DNA, 13 bp, Homo sapiens
cctctctcctctc

SEQ ID NO: 2939317 - DNA, 21 bp, Homo sapiens
cctctctcctggactggttat

SEQ ID NO: 2939318 - DNA, 23 bp, Homo sapiens
cctctctctccctctttctagcc

SEQ ID NO: 2939319 - DNA, 17 bp, Homo sapiens
cctctctctgtggggct

SEQ ID NO: 2939320 - DNA, 12 bp, Homo sapiens
cctctctgcacc

SEQ ID NO: 2939321 - DNA, 23 bp, Homo sapiens
cctctctgcagacttcccagcta

SEQ ID NO: 2939322 - DNA, 16 bp, Homo sapiens
cctctctgctctgcgt

SEQ ID NO: 2939323 - DNA, 13 bp, Homo sapiens
cctctctgggcct

SEQ ID NO: 2939324 - DNA, 24 bp, Homo sapiens
cctctctgtctttttccttcctga

SEQ ID NO: 2939325 - DNA, 19 bp, Homo sapiens
cctctctgtgtccctgctg

SEQ ID NO: 2939326 - DNA, 21 bp, Homo sapiens
cctctcttaagatgtccaggg

SEQ ID NO: 2939327 - DNA, 22 bp, Homo sapiens
cctctcttaagatgtccagggc

SEQ ID NO: 2939328 - DNA, 22 bp, Homo sapiens
cctctcttgtgagccatagaga

SEQ ID NO: 2939329 - DNA, 20 bp, Homo sapiens
cctctcttttcctctctgtc

SEQ ID NO: 2939330 - DNA, 21 bp, Homo sapiens
cctctcttttcctctctgtct

SEQ ID NO: 2939331 - DNA, 23 bp, Homo sapiens
cctctcttttcctctctgtctgt

SEQ ID NO: 2939332 - DNA, 20 bp, Homo sapiens
cctctgaaacagctgcctta

SEQ ID NO: 2939333 - DNA, 23 bp, Homo sapiens
cctctgaaacagctgccttagct

SEQ ID NO: 2939334 - DNA, 19 bp, Homo sapiens
cctctgaaaccctggacca

SEQ ID NO: 2939335 - DNA, 18 bp, Homo sapiens
cctctgaaagttgtacat

SEQ ID NO: 2939336 - DNA, 20 bp, Homo sapiens
cctctgaatgaaccttctgg

SEQ ID NO: 2939337 - DNA, 22 bp, Homo sapiens
cctctgactcagggctcctggg

SEQ ID NO: 2939338 - DNA, 16 bp, Homo sapiens
cctctgcaactgctca

SEQ ID NO: 2939339 - DNA, 16 bp, Homo sapiens
cctctgcacccagaac

SEQ ID NO: 2939340 - DNA, 19 bp, Homo sapiens
cctctgcagtcgcttgcca

SEQ ID NO: 2939341 - DNA, 12 bp, Homo sapiens
cctctgccacct

SEQ ID NO: 2939342 - DNA, 16 bp, Homo sapiens
cctctgccacctcccc

SEQ ID NO: 2939343 - DNA, 21 bp, Homo sapiens
cctctgcccgggagctcagga

SEQ ID NO: 2939344 - DNA, 11 bp, Homo sapiens
cctctgcctca

SEQ ID NO: 2939345 - DNA, 14 bp, Homo sapiens
cctctgcctcaatg

SEQ ID NO: 2939346 - DNA, 17 bp, Homo sapiens
cctctgcctcatcctcc

SEQ ID NO: 2939347 - DNA, 21 bp, Homo sapiens
cctctgcctcctccccaggga

SEQ ID NO: 2939348 - DNA, 14 bp, Homo sapiens
cctctgcctgcact

SEQ ID NO: 2939349 - DNA, 16 bp, Homo sapiens
cctctgcctgcactcc

SEQ ID NO: 2939350 - DNA, 18 bp, Homo sapiens
cctctgcctgcactccct

SEQ ID NO: 2939351 - DNA, 20 bp, Homo sapiens
cctctgcctgcactccctgg

SEQ ID NO: 2939352 - DNA, 21 bp, Homo sapiens
cctctgcctgcactccctggc

SEQ ID NO: 2939353 - DNA, 23 bp, Homo sapiens
cctctgcctgcactccctggcct

SEQ ID NO: 2939354 - DNA, 23 bp, Homo sapiens
cctctgcctttgcaccacgggac

SEQ ID NO: 2939355 - DNA, 14 bp, Homo sapiens
cctctgctccccag

SEQ ID NO: 2939356 - DNA, 20 bp, Homo sapiens
cctctgctgaagacttgccc

SEQ ID NO: 2939357 - DNA, 17 bp, Homo sapiens
cctctgctgctgcccgg

SEQ ID NO: 2939358 - DNA, 21 bp, Homo sapiens
cctctgctggtctctggctct

SEQ ID NO: 2939359 - DNA, 15 bp, Homo sapiens
cctctgcttcccagg

SEQ ID NO: 2939360 - DNA, 15 bp, Homo sapiens
cctctgcttctcacg

SEQ ID NO: 2939361 - DNA, 23 bp, Homo sapiens
cctctggagtgcccccagcccag

SEQ ID NO: 2939362 - DNA, 13 bp, Homo sapiens
cctctggagtggc

SEQ ID NO: 2939363 - DNA, 15 bp, Homo sapiens
cctctggagtggcca

SEQ ID NO: 2939364 - DNA, 16 bp, Homo sapiens
cctctggagtggccac

SEQ ID NO: 2939365 - DNA, 12 bp, Homo sapiens
cctctggatcta

SEQ ID NO: 2939366 - DNA, 12 bp, Homo sapiens
cctctggccctg

SEQ ID NO: 2939367 - DNA, 17 bp, Homo sapiens
cctctggccctgccttc

SEQ ID NO: 2939368 - DNA, 22 bp, Homo sapiens
cctgtgatcttatttttctaaa

SEQ ID NO: 2939369 - DNA, 22 bp, Homo sapiens
cctgtgcaattcagtctgctct

SEQ ID NO: 2939370 - DNA, 19 bp, Homo sapiens
cctgtgcagaccttactca

SEQ ID NO: 2939371 - DNA, 23 bp, Homo sapiens
cctgtgcccatcatctctgcctt

SEQ ID NO: 2939372 - DNA, 11 bp, Homo sapiens
cctgtgcctcc

SEQ ID NO: 2939373 - DNA, 16 bp, Homo sapiens
cctgtgcctccatcag

SEQ ID NO: 2939374 - DNA, 15 bp, Homo sapiens
cctgtgcgttccctt

SEQ ID NO: 2939375 - DNA, 12 bp, Homo sapiens
cctgtgctacag

SEQ ID NO: 2939376 - DNA, 19 bp, Homo sapiens
cctgtgctacagagaaaat

SEQ ID NO: 2939377 - DNA, 23 bp, Homo sapiens
cctgtgctgaacataacttctca

SEQ ID NO: 2939378 - DNA, 23 bp, Homo sapiens
cctgtggacaggatgaggacaga

SEQ ID NO: 2939379 - DNA, 18 bp, Homo sapiens
cctgtggagtccagctct

SEQ ID NO: 2939380 - DNA, 19 bp, Homo sapiens
cctgtggagtccagctcta

SEQ ID NO: 2939381 - DNA, 17 bp, Homo sapiens
cctgtggcagctgcccc

SEQ ID NO: 2939382 - DNA, 23 bp, Homo sapiens
cctgtggcagctgcccctggcac

SEQ ID NO: 2939383 - DNA, 22 bp, Homo sapiens
cctgtggcatgcaaaagaaagc

SEQ ID NO: 2939384 - DNA, 13 bp, Homo sapiens
cctgtggccctgt

SEQ ID NO: 2939385 - DNA, 16 bp, Homo sapiens
cctgtggcggtgcctg

SEQ ID NO: 2939386 - DNA, 17 bp, Homo sapiens
cctgtggcggtgcctgg

SEQ ID NO: 2939387 - DNA, 18 bp, Homo sapiens
cctgtggcggtgcctggg

SEQ ID NO: 2939388 - DNA, 14 bp, Homo sapiens
cctgtggctccctc

SEQ ID NO: 2939389 - DNA, 15 bp, Homo sapiens
cctgtggctccctct

SEQ ID NO: 2939390 - DNA, 12 bp, Homo sapiens
cctgtggctgcg

SEQ ID NO: 2939391 - DNA, 16 bp, Homo sapiens
cctgtggctgtggaga

SEQ ID NO: 2939392 - DNA, 18 bp, Homo sapiens
cctgtggtaactttgcag

SEQ ID NO: 2939393 - DNA, 21 bp, Homo sapiens
cctgtggtggctccccctctg

SEQ ID NO: 2939394 - DNA, 17 bp, Homo sapiens
cctgtgtattaaacctt

SEQ ID NO: 2939395 - DNA, 16 bp, Homo sapiens
cctgtgtcaatccaga

SEQ ID NO: 2939396 - DNA, 21 bp, Homo sapiens
cctgtgtcccctgacctgtcc

SEQ ID NO: 2939397 - DNA, 18 bp, Homo sapiens
cctgtgtccgatgctgga

SEQ ID NO: 2939398 - DNA, 14 bp, Homo sapiens
cctgtgtgattgac

SEQ ID NO: 2939399 - DNA, 13 bp, Homo sapiens
cctgtgtgcaggt

SEQ ID NO: 2939400 - DNA, 21 bp, Homo sapiens
cctgtgtgtccaaaactgcct

SEQ ID NO: 2939401 - DNA, 14 bp, Homo sapiens
cctgtgtgtgtgta

SEQ ID NO: 2939402 - DNA, 21 bp, Homo sapiens
cctgttacctgtcttgctcct

SEQ ID NO: 2939403 - DNA, 19 bp, Homo sapiens
cctgttaggccaactgcct

SEQ ID NO: 2939404 - DNA, 20 bp, Homo sapiens
cctgttaggccaactgcctc

SEQ ID NO: 2939405 - DNA, 13 bp, Homo sapiens
cctgttattttca

SEQ ID NO: 2939406 - DNA, 11 bp, Homo sapiens
cctgttcagtt

SEQ ID NO: 2939407 - DNA, 15 bp, Homo sapiens
cctgttcagttacag

SEQ ID NO: 2939408 - DNA, 13 bp, Homo sapiens
cctgttccccaga

SEQ ID NO: 2939409 - DNA, 18 bp, Homo sapiens
cctgttcctccctcccac

SEQ ID NO: 2939410 - DNA, 16 bp, Homo sapiens
cctgttctgaaacctt

SEQ ID NO: 2939411 - DNA, 14 bp, Homo sapiens
cctgttcttgaggt

SEQ ID NO: 2939412 - DNA, 17 bp, Homo sapiens
cctgttggatttgttta

SEQ ID NO: 2939413 - DNA, 15 bp, Homo sapiens
cctgttgtgccacag

SEQ ID NO: 2939414 - DNA, 19 bp, Homo sapiens
cctgttgttttggctcaat

SEQ ID NO: 2939415 - DNA, 17 bp, Homo sapiens
cctgtttattgccatta

SEQ ID NO: 2939416 - DNA, 22 bp, Homo sapiens
cctgtttatttttaaattttct

SEQ ID NO: 2939417 - DNA, 16 bp, Homo sapiens
cctgtttcaatcactg

SEQ ID NO: 2939418 - DNA, 13 bp, Homo sapiens
cctgtttctctgc

SEQ ID NO: 2939419 - DNA, 23 bp, Homo sapiens
cctgttttcccacgaggaatctg

SEQ ID NO: 2939420 - DNA, 17 bp, Homo sapiens
cctgttttttttctttt

SEQ ID NO: 2939421 - DNA, 16 bp, Homo sapiens
cctgtttttttttcat

SEQ ID NO: 2939422 - DNA, 13 bp, Homo sapiens
ccttaaaaatcac

SEQ ID NO: 2939423 - DNA, 19 bp, Homo sapiens
ccttaactaagactcccgc

SEQ ID NO: 2939424 - DNA, 22 bp, Homo sapiens
ccttaagacctactgttctaaa

SEQ ID NO: 2939425 - DNA, 23 bp, Homo sapiens
ccttaagacctactgttctaaag

SEQ ID NO: 2939426 - DNA, 13 bp, Homo sapiens
ccttaaggctctt

SEQ ID NO: 2939427 - DNA, 12 bp, Homo sapiens
ccttaagtcaga

SEQ ID NO: 2939428 - DNA, 14 bp, Homo sapiens
ccttaatttaactt

SEQ ID NO: 2939429 - DNA, 19 bp, Homo sapiens
ccttacagatatttttctc

SEQ ID NO: 2939430 - DNA, 21 bp, Homo sapiens
ccttacagtaggagcccagct

SEQ ID NO: 2939431 - DNA, 20 bp, Homo sapiens
ccttacagttatcctgcaag

SEQ ID NO: 2939432 - DNA, 22 bp, Homo sapiens
ccttacagttatcctgcaaggg

SEQ ID NO: 2939433 - DNA, 21 bp, Homo sapiens
ccttacattaaaaagccttac

SEQ ID NO: 2939434 - DNA, 21 bp, Homo sapiens
ccttaccaacagcttttccca

SEQ ID NO: 2939435 - DNA, 13 bp, Homo sapiens
ccttaccactgtg

SEQ ID NO: 2939436 - DNA, 16 bp, Homo sapiens
ccttacctcctgccca

SEQ ID NO: 2939437 - DNA, 20 bp, Homo sapiens
ccttacctcctgcccaggag

SEQ ID NO: 2939438 - DNA, 18 bp, Homo sapiens
ccttacgatcaggcacag

SEQ ID NO: 2939439 - DNA, 21 bp, Homo sapiens
ccttacgatcaggcacaggtc

SEQ ID NO: 2939440 - DNA, 23 bp, Homo sapiens
ccttacgatcaggcacaggtcag

SEQ ID NO: 2939441 - DNA, 14 bp, Homo sapiens
ccttactcagagct

SEQ ID NO: 2939442 - DNA, 17 bp, Homo sapiens
ccttactcagagctgcg

SEQ ID NO: 2939443 - DNA, 19 bp, Homo sapiens
ccttactgagcgcaagcca

SEQ ID NO: 2939444 - DNA, 23 bp, Homo sapiens
ccttactgagcgcaagccacagc

SEQ ID NO: 2939445 - DNA, 16 bp, Homo sapiens
ccttactgtctctctt

SEQ ID NO: 2939446 - DNA, 13 bp, Homo sapiens
ccttacttccagc

SEQ ID NO: 2939447 - DNA, 14 bp, Homo sapiens
ccttagatctggca

SEQ ID NO: 2939448 - DNA, 23 bp, Homo sapiens
ccttagattgaagtaaactgcag

SEQ ID NO: 2939449 - DNA, 12 bp, Homo sapiens
ccttagcagccc

SEQ ID NO: 2939450 - DNA, 14 bp, Homo sapiens
ccttagcagcccag

SEQ ID NO: 2939451 - DNA, 13 bp, Homo sapiens
ccttagctgccaa

SEQ ID NO: 2939452 - DNA, 15 bp, Homo sapiens
ccttagctgccaagc

SEQ ID NO: 2939453 - DNA, 16 bp, Homo sapiens
ccttaggaatactgtt

SEQ ID NO: 2939454 - DNA, 20 bp, Homo sapiens
ccttaggaatactgttttat

SEQ ID NO: 2939455 - DNA, 23 bp, Homo sapiens
ccttaggccttcctctctccaga

SEQ ID NO: 2939456 - DNA, 21 bp, Homo sapiens
ccttagtcaataaacttgtag

SEQ ID NO: 2939457 - DNA, 18 bp, Homo sapiens
ccttagtgtcacctttct

SEQ ID NO: 2939458 - DNA, 12 bp, Homo sapiens
ccttagtgtttc

SEQ ID NO: 2939459 - DNA, 20 bp, Homo sapiens
ccttagtgtttctgtgcatg

SEQ ID NO: 2939460 - DNA, 18 bp, Homo sapiens
ccttatacatcacttcct

SEQ ID NO: 2939461 - DNA, 19 bp, Homo sapiens
ccttatacatcacttcctg

SEQ ID NO: 2939462 - DNA, 21 bp, Homo sapiens
ccttatacatcacttcctgtt

SEQ ID NO: 2939463 - DNA, 22 bp, Homo sapiens
ccttatagtttgggcttcagcc

SEQ ID NO: 2939464 - DNA, 21 bp, Homo sapiens
ccttattgagcgtgattctgt

SEQ ID NO: 2939465 - DNA, 16 bp, Homo sapiens
ccttattgatctttgc

SEQ ID NO: 2939466 - DNA, 17 bp, Homo sapiens
ccttcaacgtttcttca

SEQ ID NO: 2939467 - DNA, 21 bp, Homo sapiens
ccttcaacgtttcttcacttt

SEQ ID NO: 2939468 - DNA, 22 bp, Homo sapiens
ccttcaagaatcagaagaaagg

SEQ ID NO: 2939469 - DNA, 10 bp, Homo sapiens
ccttcaatct

SEQ ID NO: 2939470 - DNA, 14 bp, Homo sapiens
cctgggccccagct

SEQ ID NO: 2939471 - DNA, 16 bp, Homo sapiens
cctgggcccccagaga

SEQ ID NO: 2939472 - DNA, 23 bp, Homo sapiens
cctgggcccccagagacctttgc

SEQ ID NO: 2939473 - DNA, 14 bp, Homo sapiens
cctgggcccctccc

SEQ ID NO: 2939474 - DNA, 14 bp, Homo sapiens
cctgggccctctct

SEQ ID NO: 2939475 - DNA, 18 bp, Homo sapiens
cctgggccctctctgctc

SEQ ID NO: 2939476 - DNA, 12 bp, Homo sapiens
cctgggcctgga

SEQ ID NO: 2939477 - DNA, 19 bp, Homo sapiens
cctgggccttctcagctct

SEQ ID NO: 2939478 - DNA, 14 bp, Homo sapiens
cctgggctgggcag

SEQ ID NO: 2939479 - DNA, 15 bp, Homo sapiens
cctgggctgggcagc

SEQ ID NO: 2939480 - DNA, 21 bp, Homo sapiens
cctgggctgggcagccttggg

SEQ ID NO: 2939481 - DNA, 12 bp, Homo sapiens
cctgggctttca

SEQ ID NO: 2939482 - DNA, 19 bp, Homo sapiens
cctggggagaaagaggggc

SEQ ID NO: 2939483 - DNA, 21 bp, Homo sapiens
cctggggcactcccccaggat

SEQ ID NO: 2939484 - DNA, 12 bp, Homo sapiens
cctggggccagg

SEQ ID NO: 2939485 - DNA, 13 bp, Homo sapiens
cctggggccaggc

SEQ ID NO: 2939486 - DNA, 16 bp, Homo sapiens
cctggggccaggccgg

SEQ ID NO: 2939487 - DNA, 20 bp, Homo sapiens
cctggggctaggctggagcc

SEQ ID NO: 2939488 - DNA, 19 bp, Homo sapiens
cctggggctgagtctccag

SEQ ID NO: 2939489 - DNA, 23 bp, Homo sapiens
cctggggctgagtctccagggcc

SEQ ID NO: 2939490 - DNA, 16 bp, Homo sapiens
cctggggctggcctcc

SEQ ID NO: 2939491 - DNA, 19 bp, Homo sapiens
cctggggctggcctcccaa

SEQ ID NO: 2939492 - DNA, 12 bp, Homo sapiens
cctggggctggt

SEQ ID NO: 2939493 - DNA, 18 bp, Homo sapiens
cctggggcttgaatttgc

SEQ ID NO: 2939494 - DNA, 16 bp, Homo sapiens
cctgggggaagccctg

SEQ ID NO: 2939495 - DNA, 15 bp, Homo sapiens
cctgggggcacagga

SEQ ID NO: 2939496 - DNA, 18 bp, Homo sapiens
cctgggggcacaggaggc

SEQ ID NO: 2939497 - DNA, 15 bp, Homo sapiens
cctgggggccgtgct

SEQ ID NO: 2939498 - DNA, 12 bp, Homo sapiens
cctgggggctct

SEQ ID NO: 2939499 - DNA, 14 bp, Homo sapiens
cctggggggaacgg

SEQ ID NO: 2939500 - DNA, 18 bp, Homo sapiens
cctggggtgttagtggca

SEQ ID NO: 2939501 - DNA, 20 bp, Homo sapiens
cctggggtgttagtggcacc

SEQ ID NO: 2939502 - DNA, 23 bp, Homo sapiens
cctgggtagctagcaccatggca

SEQ ID NO: 2939503 - DNA, 13 bp, Homo sapiens
cctgggtaggccc

SEQ ID NO: 2939504 - DNA, 23 bp, Homo sapiens
cctgggtccaggggaggccttcc

SEQ ID NO: 2939505 - DNA, 18 bp, Homo sapiens
cctgggtctaaggggttg

SEQ ID NO: 2939506 - DNA, 18 bp, Homo sapiens
cctgggtggagggagacg

SEQ ID NO: 2939507 - DNA, 16 bp, Homo sapiens
cctgggtggggctgct

SEQ ID NO: 2939508 - DNA, 17 bp, Homo sapiens
cctgggtggggctgctc

SEQ ID NO: 2939509 - DNA, 19 bp, Homo sapiens
cctgggtggggctgctcct

SEQ ID NO: 2939510 - DNA, 21 bp, Homo sapiens
cctgggtttcttttttctttc

SEQ ID NO: 2939511 - DNA, 18 bp, Homo sapiens
cctgggtttggcccctgg

SEQ ID NO: 2939512 - DNA, 19 bp, Homo sapiens
cctgggtttggcccctgga

SEQ ID NO: 2939513 - DNA, 22 bp, Homo sapiens
cctgggtttggcccctggaacc

SEQ ID NO: 2939514 - DNA, 22 bp, Homo sapiens
cctggtaaagaaaagcctcagc

SEQ ID NO: 2939515 - DNA, 20 bp, Homo sapiens
cctggtacaaacgtatggaa

SEQ ID NO: 2939516 - DNA, 15 bp, Homo sapiens
cctggtacctggacg

SEQ ID NO: 2939517 - DNA, 19 bp, Homo sapiens
cctggtcctccgcctactg

SEQ ID NO: 2939518 - DNA, 20 bp, Homo sapiens
cctggtcctccgcctactgt

SEQ ID NO: 2939519 - DNA, 13 bp, Homo sapiens
cctggtcctggct

SEQ ID NO: 2939520 - DNA, 18 bp, Homo sapiens
cctggtcctggctgcact

SEQ ID NO: 2939521 - DNA, 20 bp, Homo sapiens
cctggtccttcactggcgcc

SEQ ID NO: 2939522 - DNA, 22 bp, Homo sapiens
cctggtccttcactggcgcctt

SEQ ID NO: 2939523 - DNA, 16 bp, Homo sapiens
cctggtctgctcagga

SEQ ID NO: 2939524 - DNA, 15 bp, Homo sapiens
cctggtgagaactga

SEQ ID NO: 2939525 - DNA, 20 bp, Homo sapiens
cctggtggctgggcccagca

SEQ ID NO: 2939526 - DNA, 23 bp, Homo sapiens
cctggtggctgggcccagcaggg

SEQ ID NO: 2939527 - DNA, 13 bp, Homo sapiens
cctggtgggagca

SEQ ID NO: 2939528 - DNA, 14 bp, Homo sapiens
cctggtgggccaac

SEQ ID NO: 2939529 - DNA, 18 bp, Homo sapiens
cctggtggtggctcggga

SEQ ID NO: 2939530 - DNA, 13 bp, Homo sapiens
cctggtggttcac

SEQ ID NO: 2939531 - DNA, 21 bp, Homo sapiens
cctggtggttgctgttttcct

SEQ ID NO: 2939532 - DNA, 13 bp, Homo sapiens
cctggtgtcaccc

SEQ ID NO: 2939533 - DNA, 17 bp, Homo sapiens
cctggtgtcaccccaga

SEQ ID NO: 2939534 - DNA, 20 bp, Homo sapiens
cctggtgtcaccccagagcc

SEQ ID NO: 2939535 - DNA, 23 bp, Homo sapiens
cctggtgtcaccccagagccaca

SEQ ID NO: 2939536 - DNA, 13 bp, Homo sapiens
cctggttcctgct

SEQ ID NO: 2939537 - DNA, 18 bp, Homo sapiens
cctggttcctgctgtcct

SEQ ID NO: 2939538 - DNA, 22 bp, Homo sapiens
cctggttctgtctagactggcc

SEQ ID NO: 2939539 - DNA, 21 bp, Homo sapiens
cctggtttcataacttcctgt

SEQ ID NO: 2939540 - DNA, 22 bp, Homo sapiens
cctggttttcgtcatcttccct

SEQ ID NO: 2939541 - DNA, 14 bp, Homo sapiens
cctggtttttgcct

SEQ ID NO: 2939542 - DNA, 16 bp, Homo sapiens
cctgtaacctcttcag

SEQ ID NO: 2939543 - DNA, 21 bp, Homo sapiens
cctgtaacctcttcagaggcc

SEQ ID NO: 2939544 - DNA, 14 bp, Homo sapiens
cctgtaatcccagc

SEQ ID NO: 2939545 - DNA, 15 bp, Homo sapiens
cctgtaatcccagca

SEQ ID NO: 2939546 - DNA, 19 bp, Homo sapiens
cctgtaatcccagcacact

SEQ ID NO: 2939547 - DNA, 19 bp, Homo sapiens
cctgtaatcccagcacttt

SEQ ID NO: 2939548 - DNA, 16 bp, Homo sapiens
cctgtaatcccagcag

SEQ ID NO: 2939549 - DNA, 21 bp, Homo sapiens
cctgtagaatagcctgtggcc

SEQ ID NO: 2939550 - DNA, 15 bp, Homo sapiens
cctgtagatgcagaa

SEQ ID NO: 2939551 - DNA, 23 bp, Homo sapiens
cctgtagatgcagaaaaagaaaa

SEQ ID NO: 2939552 - DNA, 19 bp, Homo sapiens
cctgtagcccactctgctc

SEQ ID NO: 2939553 - DNA, 20 bp, Homo sapiens
cctgtaggcagaggctgccg

SEQ ID NO: 2939554 - DNA, 14 bp, Homo sapiens
cctgtagtcccagc

SEQ ID NO: 2939555 - DNA, 16 bp, Homo sapiens
cctgtagtcccagcta

SEQ ID NO: 2939556 - DNA, 16 bp, Homo sapiens
cctgtagtctcagcta

SEQ ID NO: 2939557 - DNA, 21 bp, Homo sapiens
cctgtataagtagatctgctt

SEQ ID NO: 2939558 - DNA, 20 bp, Homo sapiens
cctgtatatttgtaaagcta

SEQ ID NO: 2939559 - DNA, 15 bp, Homo sapiens
cctgtatgtctgtca

SEQ ID NO: 2939560 - DNA, 16 bp, Homo sapiens
cctgtatgtctgtcat

SEQ ID NO: 2939561 - DNA, 19 bp, Homo sapiens
cctgtatgtctgtcattgt

SEQ ID NO: 2939562 - DNA, 13 bp, Homo sapiens
cctgtatgttgtc

SEQ ID NO: 2939563 - DNA, 20 bp, Homo sapiens
cctgtcaaacaaagccagaa

SEQ ID NO: 2939564 - DNA, 14 bp, Homo sapiens
cctgtcagccaaca

SEQ ID NO: 2939565 - DNA, 19 bp, Homo sapiens
cctgtcagccaacattgcc

SEQ ID NO: 2939566 - DNA, 13 bp, Homo sapiens
cctgtcagcctga

SEQ ID NO: 2939567 - DNA, 21 bp, Homo sapiens
cctgtcagcctgactcttccc

SEQ ID NO: 2939568 - DNA, 15 bp, Homo sapiens
cctgtcatgattggc

SEQ ID NO: 2939569 - DNA, 12 bp, Homo sapiens
cctgtccaacct

SEQ ID NO: 2939570 - DNA, 23 bp, Homo sapiens
cctgtccaacctaacccctttcc

SEQ ID NO: 2939571 - DNA, 21 bp, Homo sapiens
cctgtccccatctgtcggcct

SEQ ID NO: 2939572 - DNA, 14 bp, Homo sapiens
cctgtccccgcagc

SEQ ID NO: 2939573 - DNA, 14 bp, Homo sapiens
cctgtccccgcctt

SEQ ID NO: 2939574 - DNA, 20 bp, Homo sapiens
cctgtcccctcacagactct

SEQ ID NO: 2939575 - DNA, 16 bp, Homo sapiens
cctgtcctagtctcct

SEQ ID NO: 2939576 - DNA, 10 bp, Homo sapiens
cctgtcctca

SEQ ID NO: 2939577 - DNA, 13 bp, Homo sapiens
cctgtcctcctcg

SEQ ID NO: 2939578 - DNA, 14 bp, Homo sapiens
cctgtcctcctcgg

SEQ ID NO: 2939579 - DNA, 15 bp, Homo sapiens
cctgtcctcctcgga

SEQ ID NO: 2939580 - DNA, 23 bp, Homo sapiens
cctgtcctcctcggatcaccgag

SEQ ID NO: 2939581 - DNA, 22 bp, Homo sapiens
cctgtccttactcagagctgcg

SEQ ID NO: 2939582 - DNA, 17 bp, Homo sapiens
ccctaggattccccctg

SEQ ID NO: 2939583 - DNA, 15 bp, Homo sapiens
ccctagtaaaaatac

SEQ ID NO: 2939584 - DNA, 19 bp, Homo sapiens
ccctagttagcatccaggc

SEQ ID NO: 2939585 - DNA, 23 bp, Homo sapiens
ccctatactgcttggagctgagc

SEQ ID NO: 2939586 - DNA, 14 bp, Homo sapiens
ccctatctgtgatt

SEQ ID NO: 2939587 - DNA, 14 bp, Homo sapiens
ccctatcttgtgaa

SEQ ID NO: 2939588 - DNA, 15 bp, Homo sapiens
ccctatttaaatgaa

SEQ ID NO: 2939589 - DNA, 19 bp, Homo sapiens
ccctcacagactcttccac

SEQ ID NO: 2939590 - DNA, 15 bp, Homo sapiens
ccctcaccccagctc

SEQ ID NO: 2939591 - DNA, 21 bp, Homo sapiens
ccctcaccttggcaccagaca

SEQ ID NO: 2939592 - DNA, 23 bp, Homo sapiens
ccctcaccttggcaccagacacc

SEQ ID NO: 2939593 - DNA, 20 bp, Homo sapiens
ccctcacgtttcttccccaa

SEQ ID NO: 2939594 - DNA, 22 bp, Homo sapiens
ccctcagaacccttggcttgcc

SEQ ID NO: 2939595 - DNA, 13 bp, Homo sapiens
ccctcagagccca

SEQ ID NO: 2939596 - DNA, 15 bp, Homo sapiens
ccctcagagtgcaag

SEQ ID NO: 2939597 - DNA, 22 bp, Homo sapiens
ccctcagatgcgttcgcctctg

SEQ ID NO: 2939598 - DNA, 21 bp, Homo sapiens
ccctcagattttatattttct

SEQ ID NO: 2939599 - DNA, 19 bp, Homo sapiens
ccctcagccgtcagccatc

SEQ ID NO: 2939600 - DNA, 23 bp, Homo sapiens
ccctcagctctgtcctgttaggc

SEQ ID NO: 2939601 - DNA, 22 bp, Homo sapiens
ccctcaggggaagctgctaggg

SEQ ID NO: 2939602 - DNA, 19 bp, Homo sapiens
ccctcaggtgtagctgagc

SEQ ID NO: 2939603 - DNA, 22 bp, Homo sapiens
ccctcaggtgtagctgagctgt

SEQ ID NO: 2939604 - DNA, 14 bp, Homo sapiens
ccctcagtgcatcc

SEQ ID NO: 2939605 - DNA, 14 bp, Homo sapiens
ccctcagttgtgca

SEQ ID NO: 2939606 - DNA, 16 bp, Homo sapiens
ccctcagttgtgcagc

SEQ ID NO: 2939607 - DNA, 14 bp, Homo sapiens
ccctcatcccccag

SEQ ID NO: 2939608 - DNA, 17 bp, Homo sapiens
ccctcatcccgagcacc

SEQ ID NO: 2939609 - DNA, 13 bp, Homo sapiens
ccctcatctgtcc

SEQ ID NO: 2939610 - DNA, 14 bp, Homo sapiens
ccctcatctttctt

SEQ ID NO: 2939611 - DNA, 17 bp, Homo sapiens
ccctcattcaggaaaac

SEQ ID NO: 2939612 - DNA, 20 bp, Homo sapiens
ccctccaatcctccccgctc

SEQ ID NO: 2939613 - DNA, 21 bp, Homo sapiens
ccctccaatcctccccgctct

SEQ ID NO: 2939614 - DNA, 15 bp, Homo sapiens
ccctccacggtccgc

SEQ ID NO: 2939615 - DNA, 12 bp, Homo sapiens
ccctccactctc

SEQ ID NO: 2939616 - DNA, 23 bp, Homo sapiens
ccctccagagaaagcacaattta

SEQ ID NO: 2939617 - DNA, 21 bp, Homo sapiens
ccctccagagacaggaaagaa

SEQ ID NO: 2939618 - DNA, 18 bp, Homo sapiens
ccctccagcacaaacaca

SEQ ID NO: 2939619 - DNA, 22 bp, Homo sapiens
ccctccatctgtacttggtcca

SEQ ID NO: 2939620 - DNA, 15 bp, Homo sapiens
ccctcccaagctggc

SEQ ID NO: 2939621 - DNA, 14 bp, Homo sapiens
ccctcccaggactc

SEQ ID NO: 2939622 - DNA, 14 bp, Homo sapiens
ccctcccatcctcc

SEQ ID NO: 2939623 - DNA, 17 bp, Homo sapiens
ccctcccatcctccagc

SEQ ID NO: 2939624 - DNA, 19 bp, Homo sapiens
ccctcccatcctccagccc

SEQ ID NO: 2939625 - DNA, 14 bp, Homo sapiens
ccctccccagggga

SEQ ID NO: 2939626 - DNA, 18 bp, Homo sapiens
ccctccccatctgtgttc

SEQ ID NO: 2939627 - DNA, 23 bp, Homo sapiens
ccctcccccacgtctctctgcct

SEQ ID NO: 2939628 - DNA, 15 bp, Homo sapiens
ccctcccccccatgc

SEQ ID NO: 2939629 - DNA, 13 bp, Homo sapiens
ccctccccctgag

SEQ ID NO: 2939630 - DNA, 19 bp, Homo sapiens
ccctcccgcaccttcctcc

SEQ ID NO: 2939631 - DNA, 23 bp, Homo sapiens
ccctccctcagccgtcagccatc

SEQ ID NO: 2939632 - DNA, 23 bp, Homo sapiens
ccctccctctactgggagcctac

SEQ ID NO: 2939633 - DNA, 14 bp, Homo sapiens
ccctccctgcgctt

SEQ ID NO: 2939634 - DNA, 13 bp, Homo sapiens
ccctccctgtcct

SEQ ID NO: 2939635 - DNA, 20 bp, Homo sapiens
ccctccctgttccccagaga

SEQ ID NO: 2939636 - DNA, 19 bp, Homo sapiens
ccctcccttccttgggcag

SEQ ID NO: 2939637 - DNA, 13 bp, Homo sapiens
ccctccgacctct

SEQ ID NO: 2939638 - DNA, 17 bp, Homo sapiens
ccctccgcctcccatcc

SEQ ID NO: 2939639 - DNA, 17 bp, Homo sapiens
ccctcctaccctgcgcc

SEQ ID NO: 2939640 - DNA, 13 bp, Homo sapiens
ccctcctcacact

SEQ ID NO: 2939641 - DNA, 14 bp, Homo sapiens
ccctcctcacactc

SEQ ID NO: 2939642 - DNA, 15 bp, Homo sapiens
ccctcctcactccct

SEQ ID NO: 2939643 - DNA, 20 bp, Homo sapiens
ccctcctctgaaacagctgc

SEQ ID NO: 2939644 - DNA, 11 bp, Homo sapiens
ccctcctctgc

SEQ ID NO: 2939645 - DNA, 13 bp, Homo sapiens
ccctcctctgcca

SEQ ID NO: 2939646 - DNA, 13 bp, Homo sapiens
ccctcctggggcc

SEQ ID NO: 2939647 - DNA, 16 bp, Homo sapiens
ccctcctggggccagg

SEQ ID NO: 2939648 - DNA, 18 bp, Homo sapiens
ccctcctggggccaggcc

SEQ ID NO: 2939649 - DNA, 13 bp, Homo sapiens
ccctcctttgtct

SEQ ID NO: 2939650 - DNA, 14 bp, Homo sapiens
ccctcctttgtctt

SEQ ID NO: 2939651 - DNA, 15 bp, Homo sapiens
ccctcgaccctgtgc

SEQ ID NO: 2939652 - DNA, 23 bp, Homo sapiens
ccctcgaggcggatctttggaca

SEQ ID NO: 2939653 - DNA, 14 bp, Homo sapiens
ccctcgctgccagc

SEQ ID NO: 2939654 - DNA, 16 bp, Homo sapiens
ccctcgggggcctgtg

SEQ ID NO: 2939655 - DNA, 15 bp, Homo sapiens
ccctctacagagctt

SEQ ID NO: 2939656 - DNA, 21 bp, Homo sapiens
ccctctacagagcttccctga

SEQ ID NO: 2939657 - DNA, 17 bp, Homo sapiens
ccctctactgggagcct

SEQ ID NO: 2939658 - DNA, 15 bp, Homo sapiens
ccctctaggctctgc

SEQ ID NO: 2939659 - DNA, 18 bp, Homo sapiens
ccccacccggtggttctt

SEQ ID NO: 2939660 - DNA, 22 bp, Homo sapiens
ccccacccggtggttcttcctg

SEQ ID NO: 2939661 - DNA, 13 bp, Homo sapiens
ccccaccctgggt

SEQ ID NO: 2939662 - DNA, 16 bp, Homo sapiens
ccccaccgccggggtc

SEQ ID NO: 2939663 - DNA, 19 bp, Homo sapiens
ccccaccgccggggtcctg

SEQ ID NO: 2939664 - DNA, 23 bp, Homo sapiens
ccccaccgccggggtcctgggag

SEQ ID NO: 2939665 - DNA, 12 bp, Homo sapiens
ccccaccgggct

SEQ ID NO: 2939666 - DNA, 15 bp, Homo sapiens
ccccacgagggctgg

SEQ ID NO: 2939667 - DNA, 15 bp, Homo sapiens
ccccacgtctctctg

SEQ ID NO: 2939668 - DNA, 18 bp, Homo sapiens
ccccacgtctctctgcct

SEQ ID NO: 2939669 - DNA, 19 bp, Homo sapiens
ccccacgtctctctgcctg

SEQ ID NO: 2939670 - DNA, 13 bp, Homo sapiens
ccccactccagct

SEQ ID NO: 2939671 - DNA, 15 bp, Homo sapiens
ccccactctcattcc

SEQ ID NO: 2939672 - DNA, 14 bp, Homo sapiens
ccccactctgcctg

SEQ ID NO: 2939673 - DNA, 12 bp, Homo sapiens
ccccactgcagg

SEQ ID NO: 2939674 - DNA, 14 bp, Homo sapiens
ccccactggggaaa

SEQ ID NO: 2939675 - DNA, 22 bp, Homo sapiens
ccccactggggaaataacagct

SEQ ID NO: 2939676 - DNA, 13 bp, Homo sapiens
ccccacttctgtg

SEQ ID NO: 2939677 - DNA, 20 bp, Homo sapiens
ccccagacagttcttttcta

SEQ ID NO: 2939678 - DNA, 21 bp, Homo sapiens
ccccagacagttcttttctac

SEQ ID NO: 2939679 - DNA, 16 bp, Homo sapiens
ccccagactgggccca

SEQ ID NO: 2939680 - DNA, 20 bp, Homo sapiens
ccccagactgggcccaggca

SEQ ID NO: 2939681 - DNA, 23 bp, Homo sapiens
ccccagactgggcccaggcaggt

SEQ ID NO: 2939682 - DNA, 17 bp, Homo sapiens
ccccagagccacacatg

SEQ ID NO: 2939683 - DNA, 17 bp, Homo sapiens
ccccagagcccagctct

SEQ ID NO: 2939684 - DNA, 18 bp, Homo sapiens
ccccagcacctcagcctg

SEQ ID NO: 2939685 - DNA, 20 bp, Homo sapiens
ccccagcattctcaggcacc

SEQ ID NO: 2939686 - DNA, 21 bp, Homo sapiens
ccccagcattctcaggcacca

SEQ ID NO: 2939687 - DNA, 18 bp, Homo sapiens
ccccagcccacagagcct

SEQ ID NO: 2939688 - DNA, 13 bp, Homo sapiens
ccccagcccagag

SEQ ID NO: 2939689 - DNA, 14 bp, Homo sapiens
ccccagcccccacc

SEQ ID NO: 2939690 - DNA, 17 bp, Homo sapiens
ccccagctaagaacctg

SEQ ID NO: 2939691 - DNA, 19 bp, Homo sapiens
ccccagctaagaacctgga

SEQ ID NO: 2939692 - DNA, 11 bp, Homo sapiens
ccccagctccg

SEQ ID NO: 2939693 - DNA, 13 bp, Homo sapiens
ccccagctggccc

SEQ ID NO: 2939694 - DNA, 18 bp, Homo sapiens
ccccaggaccagctcagg

SEQ ID NO: 2939695 - DNA, 15 bp, Homo sapiens
ccccaggacctggct

SEQ ID NO: 2939696 - DNA, 20 bp, Homo sapiens
ccccaggacctggctgccat

SEQ ID NO: 2939697 - DNA, 16 bp, Homo sapiens
ccccaggcccactcag

SEQ ID NO: 2939698 - DNA, 21 bp, Homo sapiens
ccccaggcccactcaggggtc

SEQ ID NO: 2939699 - DNA, 18 bp, Homo sapiens
ccccaggccggagcccag

SEQ ID NO: 2939700 - DNA, 13 bp, Homo sapiens
ccccaggcctggc

SEQ ID NO: 2939701 - DNA, 15 bp, Homo sapiens
ccccagggcctgagc

SEQ ID NO: 2939702 - DNA, 18 bp, Homo sapiens
ccccagtgtattttgtcc

SEQ ID NO: 2939703 - DNA, 16 bp, Homo sapiens
ccccagttcagaaatt

SEQ ID NO: 2939704 - DNA, 20 bp, Homo sapiens
ccccatcagtgctccctcac

SEQ ID NO: 2939705 - DNA, 15 bp, Homo sapiens
ccccatcggccctgt

SEQ ID NO: 2939706 - DNA, 19 bp, Homo sapiens
ccccatcggccctgtcccc

SEQ ID NO: 2939707 - DNA, 22 bp, Homo sapiens
ccccatcggccctgtcccctgg

SEQ ID NO: 2939708 - DNA, 13 bp, Homo sapiens
ccccatctcaggc

SEQ ID NO: 2939709 - DNA, 14 bp, Homo sapiens
ccccatctcaggcc

SEQ ID NO: 2939710 - DNA, 23 bp, Homo sapiens
ccccatctcatgcccctggctgg

SEQ ID NO: 2939711 - DNA, 22 bp, Homo sapiens
ccccatctcgctccctcccagg

SEQ ID NO: 2939712 - DNA, 13 bp, Homo sapiens
ccccatctgtgca

SEQ ID NO: 2939713 - DNA, 15 bp, Homo sapiens
ccccatgatgtaagt

SEQ ID NO: 2939714 - DNA, 14 bp, Homo sapiens
ccccatgctgttga

SEQ ID NO: 2939715 - DNA, 19 bp, Homo sapiens
ccccatggtcagccctagg

SEQ ID NO: 2939716 - DNA, 15 bp, Homo sapiens
ccccatgtctctcag

SEQ ID NO: 2939717 - DNA, 17 bp, Homo sapiens
ccccattagctttcaat

SEQ ID NO: 2939718 - DNA, 22 bp, Homo sapiens
cccccaacaccccgcctgcctc

SEQ ID NO: 2939719 - DNA, 14 bp, Homo sapiens
cccccaagcctgca

SEQ ID NO: 2939720 - DNA, 12 bp, Homo sapiens
cccccaccccct

SEQ ID NO: 2939721 - DNA, 20 bp, Homo sapiens
cccccaccctagcctccacc

SEQ ID NO: 2939722 - DNA, 18 bp, Homo sapiens
cccccacgtctctctgcc

SEQ ID NO: 2939723 - DNA, 17 bp, Homo sapiens
cccccagacagctgctc

SEQ ID NO: 2939724 - DNA, 11 bp, Homo sapiens
cccccagcact

SEQ ID NO: 2939725 - DNA, 15 bp, Homo sapiens
cccccagctccggcc

SEQ ID NO: 2939726 - DNA, 23 bp, Homo sapiens
cccccagctctaagcagccagga

SEQ ID NO: 2939727 - DNA, 13 bp, Homo sapiens
cccccaggccctc

SEQ ID NO: 2939728 - DNA, 20 bp, Homo sapiens
cccccaggccctcccaccac

SEQ ID NO: 2939729 - DNA, 14 bp, Homo sapiens
cccccaggcctgcc

SEQ ID NO: 2939730 - DNA, 21 bp, Homo sapiens
cccccatcttcgggaccagga

SEQ ID NO: 2939731 - DNA, 12 bp, Homo sapiens
ccccccccaggc

SEQ ID NO: 2939732 - DNA, 12 bp, Homo sapiens
cccccccttcca

SEQ ID NO: 2939733 - DNA, 12 bp, Homo sapiens
cccccctcccag

SEQ ID NO: 2939734 - DNA, 16 bp, Homo sapiens
cccccgccccctgccc

SEQ ID NO: 2939735 - DNA, 22 bp, Homo sapiens
cccccgcgccctccctccgcct

SEQ ID NO: 2939736 - DNA, 21 bp, Homo sapiens
cccccggctgggcctccttct

SEQ ID NO: 2939737 - DNA, 16 bp, Homo sapiens
cccccgggatcctgcc

SEQ ID NO: 2939738 - DNA, 18 bp, Homo sapiens
cccccgggccgacggagc

SEQ ID NO: 2939739 - DNA, 16 bp, Homo sapiens
ccccctccccaaagcc

SEQ ID NO: 2939740 - DNA, 17 bp, Homo sapiens
ccccctctcaggagcca

SEQ ID NO: 2939741 - DNA, 11 bp, Homo sapiens
ccccctctgct

SEQ ID NO: 2939742 - DNA, 12 bp, Homo sapiens
ccccctctgctt

SEQ ID NO: 2939743 - DNA, 12 bp, Homo sapiens
ccccctgcagct

SEQ ID NO: 2939744 - DNA, 13 bp, Homo sapiens
ccccctgcagcta

SEQ ID NO: 2939745 - DNA, 16 bp, Homo sapiens
ccccctgccagtgcct

SEQ ID NO: 2939746 - DNA, 16 bp, Homo sapiens
ccccctggcagctgcc

SEQ ID NO: 2939747 - DNA, 22 bp, Homo sapiens
ccccgaagaaggaccagtgaag

SEQ ID NO: 2939748 - DNA, 15 bp, Homo sapiens
ccccgacggctgtga

SEQ ID NO: 2939749 - DNA, 14 bp, Homo sapiens
ccccgaggctgccc

SEQ ID NO: 2939750 - DNA, 16 bp, Homo sapiens
ccccgatgctgacctc

SEQ ID NO: 2939751 - DNA, 13 bp, Homo sapiens
ccccgccccctgc

SEQ ID NO: 2939752 - DNA, 19 bp, Homo sapiens
ccccgccttccctcactct

SEQ ID NO: 2939753 - DNA, 13 bp, Homo sapiens
ccccgcgccctcc

SEQ ID NO: 2939754 - DNA, 13 bp, Homo sapiens
ccccgcgggcttt

SEQ ID NO: 2939755 - DNA, 21 bp, Homo sapiens
ccccgcgtggaactcgtgtct

SEQ ID NO: 2939756 - DNA, 13 bp, Homo sapiens
ccccgctcccacc

SEQ ID NO: 2939757 - DNA, 21 bp, Homo sapiens
ccccggcatgagactcagtgc

SEQ ID NO: 2939758 - DNA, 12 bp, Homo sapiens
cccaggctggga

SEQ ID NO: 2939759 - DNA, 23 bp, Homo sapiens
cccaggctggtcttgaagtcctg

SEQ ID NO: 2939760 - DNA, 21 bp, Homo sapiens
cccagggacattgcagagtgg

SEQ ID NO: 2939761 - DNA, 16 bp, Homo sapiens
cccagggagaggctgt

SEQ ID NO: 2939762 - DNA, 20 bp, Homo sapiens
cccagggagcggaaagcagc

SEQ ID NO: 2939763 - DNA, 14 bp, Homo sapiens
cccagggagggtga

SEQ ID NO: 2939764 - DNA, 18 bp, Homo sapiens
cccagggagggtgagctg

SEQ ID NO: 2939765 - DNA, 19 bp, Homo sapiens
cccagggagggtgagctgg

SEQ ID NO: 2939766 - DNA, 20 bp, Homo sapiens
cccagggagggtgagctggt

SEQ ID NO: 2939767 - DNA, 14 bp, Homo sapiens
cccagggcccagag

SEQ ID NO: 2939768 - DNA, 19 bp, Homo sapiens
cccagggcccagagcccag

SEQ ID NO: 2939769 - DNA, 22 bp, Homo sapiens
cccagggcccagagcccagctc

SEQ ID NO: 2939770 - DNA, 19 bp, Homo sapiens
cccagggcctgcaggacct

SEQ ID NO: 2939771 - DNA, 21 bp, Homo sapiens
cccagggctagtgaagtggcc

SEQ ID NO: 2939772 - DNA, 21 bp, Homo sapiens
cccaggggagagggtctggag

SEQ ID NO: 2939773 - DNA, 23 bp, Homo sapiens
cccaggggagagggtctggagaa

SEQ ID NO: 2939774 - DNA, 15 bp, Homo sapiens
cccaggggcagccac

SEQ ID NO: 2939775 - DNA, 18 bp, Homo sapiens
cccagggggcctggagca

SEQ ID NO: 2939776 - DNA, 23 bp, Homo sapiens
cccagggtctagccgctgccctg

SEQ ID NO: 2939777 - DNA, 14 bp, Homo sapiens
cccagggtgcagtg

SEQ ID NO: 2939778 - DNA, 19 bp, Homo sapiens
cccagggtggagtgcagtg

SEQ ID NO: 2939779 - DNA, 19 bp, Homo sapiens
cccagggttaatagggcct

SEQ ID NO: 2939780 - DNA, 15 bp, Homo sapiens
cccaggtagctggga

SEQ ID NO: 2939781 - DNA, 16 bp, Homo sapiens
cccaggtagctgggat

SEQ ID NO: 2939782 - DNA, 20 bp, Homo sapiens
cccaggtcccccgactgcct

SEQ ID NO: 2939783 - DNA, 22 bp, Homo sapiens
cccaggtcccccgactgcctgt

SEQ ID NO: 2939784 - DNA, 15 bp, Homo sapiens
cccaggtgcagccag

SEQ ID NO: 2939785 - DNA, 21 bp, Homo sapiens
cccaggtgcagccagaggcac

SEQ ID NO: 2939786 - DNA, 16 bp, Homo sapiens
cccaggtggctgaccc

SEQ ID NO: 2939787 - DNA, 19 bp, Homo sapiens
cccaggtggctgacccagt

SEQ ID NO: 2939788 - DNA, 22 bp, Homo sapiens
cccaggtggctgacccagtccc

SEQ ID NO: 2939789 - DNA, 19 bp, Homo sapiens
cccaggtgttaacattcca

SEQ ID NO: 2939790 - DNA, 17 bp, Homo sapiens
cccaggtttttgcccat

SEQ ID NO: 2939791 - DNA, 22 bp, Homo sapiens
cccaggtttttgcccatcctcc

SEQ ID NO: 2939792 - DNA, 19 bp, Homo sapiens
cccagtagctgggattaca

SEQ ID NO: 2939793 - DNA, 23 bp, Homo sapiens
cccagtattactgctgctgtgct

SEQ ID NO: 2939794 - DNA, 13 bp, Homo sapiens
cccagtccatgct

SEQ ID NO: 2939795 - DNA, 22 bp, Homo sapiens
cccagtccatgctccagggtca

SEQ ID NO: 2939796 - DNA, 12 bp, Homo sapiens
cccagtccctgg

SEQ ID NO: 2939797 - DNA, 14 bp, Homo sapiens
cccagtccctgggg

SEQ ID NO: 2939798 - DNA, 16 bp, Homo sapiens
cccagtccctggggga

SEQ ID NO: 2939799 - DNA, 16 bp, Homo sapiens
cccagtcctctgcctc

SEQ ID NO: 2939800 - DNA, 17 bp, Homo sapiens
cccagtcctctgcctcc

SEQ ID NO: 2939801 - DNA, 13 bp, Homo sapiens
cccagtcgccctt

SEQ ID NO: 2939802 - DNA, 20 bp, Homo sapiens
cccagtctgttgctgctcca

SEQ ID NO: 2939803 - DNA, 15 bp, Homo sapiens
cccagtgaagatgca

SEQ ID NO: 2939804 - DNA, 14 bp, Homo sapiens
cccagtgacagcta

SEQ ID NO: 2939805 - DNA, 15 bp, Homo sapiens
cccagtgacagctag

SEQ ID NO: 2939806 - DNA, 10 bp, Homo sapiens
cccagtgcag

SEQ ID NO: 2939807 - DNA, 15 bp, Homo sapiens
cccagtgcagaatgt

SEQ ID NO: 2939808 - DNA, 12 bp, Homo sapiens
cccagtgcatgg

SEQ ID NO: 2939809 - DNA, 19 bp, Homo sapiens
cccagtgcatggtggccag

SEQ ID NO: 2939810 - DNA, 21 bp, Homo sapiens
cccagtgcatggtggccagag

SEQ ID NO: 2939811 - DNA, 22 bp, Homo sapiens
cccagtgcccccactgaccaga

SEQ ID NO: 2939812 - DNA, 13 bp, Homo sapiens
cccagtgcttctc

SEQ ID NO: 2939813 - DNA, 13 bp, Homo sapiens
cccagtgggctgt

SEQ ID NO: 2939814 - DNA, 21 bp, Homo sapiens
cccagttttttgaacatggaa

SEQ ID NO: 2939815 - DNA, 15 bp, Homo sapiens
cccataggcccacac

SEQ ID NO: 2939816 - DNA, 22 bp, Homo sapiens
cccataggcccacacacaggtg

SEQ ID NO: 2939817 - DNA, 11 bp, Homo sapiens
cccatataaaa

SEQ ID NO: 2939818 - DNA, 19 bp, Homo sapiens
cccatatttacttactgct

SEQ ID NO: 2939819 - DNA, 17 bp, Homo sapiens
cccatcactcgcaggac

SEQ ID NO: 2939820 - DNA, 19 bp, Homo sapiens
cccatcactcgcaggacca

SEQ ID NO: 2939821 - DNA, 19 bp, Homo sapiens
cccatcagtgccagcccct

SEQ ID NO: 2939822 - DNA, 22 bp, Homo sapiens
cccatcagtgctccctcacatg

SEQ ID NO: 2939823 - DNA, 13 bp, Homo sapiens
cccatccagggcc

SEQ ID NO: 2939824 - DNA, 18 bp, Homo sapiens
cccatcctccagcaggga

SEQ ID NO: 2939825 - DNA, 15 bp, Homo sapiens
cccatcctccagccc

SEQ ID NO: 2939826 - DNA, 12 bp, Homo sapiens
cccatcctccca

SEQ ID NO: 2939827 - DNA, 13 bp, Homo sapiens
cccatcgccccac

SEQ ID NO: 2939828 - DNA, 23 bp, Homo sapiens
cccatcgccccaccgcagctact

SEQ ID NO: 2939829 - DNA, 13 bp, Homo sapiens
cccatcggaagtt

SEQ ID NO: 2939830 - DNA, 12 bp, Homo sapiens
cccatcggccct

SEQ ID NO: 2939831 - DNA, 19 bp, Homo sapiens
cccatcggccctgtcccct

SEQ ID NO: 2939832 - DNA, 21 bp, Homo sapiens
cccatcggccctgtcccctgg

SEQ ID NO: 2939833 - DNA, 16 bp, Homo sapiens
cccatctcaggccaga

SEQ ID NO: 2939834 - DNA, 11 bp, Homo sapiens
cccatctgtcc

SEQ ID NO: 2939835 - DNA, 13 bp, Homo sapiens
cccatctgtccat

SEQ ID NO: 2939836 - DNA, 24 bp, Homo sapiens
cccatctgtccatcctcctctcca

SEQ ID NO: 2939837 - DNA, 16 bp, Homo sapiens
cccatctgtgcattct

SEQ ID NO: 2939838 - DNA, 18 bp, Homo sapiens
cccatcttcgggaccagg

SEQ ID NO: 2939839 - DNA, 16 bp, Homo sapiens
cccatgaagccacagc

SEQ ID NO: 2939840 - DNA, 18 bp, Homo sapiens
cccatgacaatgttgtag

SEQ ID NO: 2939841 - DNA, 18 bp, Homo sapiens
cccatgcaagcagaggac

SEQ ID NO: 2939842 - DNA, 18 bp, Homo sapiens
cccatgcactgtgaagga

SEQ ID NO: 2939843 - DNA, 19 bp, Homo sapiens
cccatgcactgtgaaggac

SEQ ID NO: 2939844 - DNA, 20 bp, Homo sapiens
cccatgcactgtgaaggacc

SEQ ID NO: 2939845 - DNA, 17 bp, Homo sapiens
cccatgcctgtggctgc

SEQ ID NO: 2939846 - DNA, 19 bp, Homo sapiens
cccatgctgttgattgcta

SEQ ID NO: 2939847 - DNA, 22 bp, Homo sapiens
cccatggacaggctggctccag

SEQ ID NO: 2939848 - DNA, 16 bp, Homo sapiens
cccatggaggagacag

SEQ ID NO: 2939849 - DNA, 14 bp, Homo sapiens
cccatggtccctag

SEQ ID NO: 2939850 - DNA, 15 bp, Homo sapiens
cccatgtagccccct

SEQ ID NO: 2939851 - DNA, 16 bp, Homo sapiens
cccatgtctctcagaa

SEQ ID NO: 2939852 - DNA, 23 bp, Homo sapiens
cccatgtggtgatgatgtgtata

SEQ ID NO: 2939853 - DNA, 22 bp, Homo sapiens
cccattcacttctgcattcctg

SEQ ID NO: 2939854 - DNA, 18 bp, Homo sapiens
cccattctctctcctgtc

SEQ ID NO: 2939855 - DNA, 19 bp, Homo sapiens
cccattctctctcctgtcc

SEQ ID NO: 2939856 - DNA, 20 bp, Homo sapiens
cccattctctctcctgtcca

SEQ ID NO: 2939857 - DNA, 18 bp, Homo sapiens
cccattctgccctgtggg

SEQ ID NO: 2939858 - DNA, 19 bp, Homo sapiens
cccattcttttcacttcct

SEQ ID NO: 2939859 - DNA, 14 bp, Homo sapiens
cccattcttttgta

SEQ ID NO: 2939860 - DNA, 17 bp, Homo sapiens
cccattcttttgtaatt

SEQ ID NO: 2939861 - DNA, 18 bp, Homo sapiens
cccattgtccctctgccc

SEQ ID NO: 2939862 - DNA, 15 bp, Homo sapiens
cccatttctccagaa

SEQ ID NO: 2939863 - DNA, 16 bp, Homo sapiens
cccatttgttgctgct

SEQ ID NO: 2939864 - DNA, 20 bp, Homo sapiens
cccatttgttgctgctgctg

SEQ ID NO: 2939865 - DNA, 18 bp, Homo sapiens
ccagacagttcttttcta

SEQ ID NO: 2939866 - DNA, 14 bp, Homo sapiens
ccagacatgccaca

SEQ ID NO: 2939867 - DNA, 20 bp, Homo sapiens
ccagacatggtgtctcacac

SEQ ID NO: 2939868 - DNA, 13 bp, Homo sapiens
ccagacccactct

SEQ ID NO: 2939869 - DNA, 21 bp, Homo sapiens
ccagacccagcccgcggcctg

SEQ ID NO: 2939870 - DNA, 22 bp, Homo sapiens
ccagacccagcccgcggcctgg

SEQ ID NO: 2939871 - DNA, 16 bp, Homo sapiens
ccagaccccctggaga

SEQ ID NO: 2939872 - DNA, 18 bp, Homo sapiens
ccagaccccctggagact

SEQ ID NO: 2939873 - DNA, 20 bp, Homo sapiens
ccagacctgttagcagacag

SEQ ID NO: 2939874 - DNA, 21 bp, Homo sapiens
ccagacctgttagcagacagg

SEQ ID NO: 2939875 - DNA, 14 bp, Homo sapiens
ccagaccttttatc

SEQ ID NO: 2939876 - DNA, 21 bp, Homo sapiens
ccagactcctgactgtctccc

SEQ ID NO: 2939877 - DNA, 12 bp, Homo sapiens
ccagactctgcc

SEQ ID NO: 2939878 - DNA, 14 bp, Homo sapiens
ccagactctgccta

SEQ ID NO: 2939879 - DNA, 13 bp, Homo sapiens
ccagactgagctc

SEQ ID NO: 2939880 - DNA, 14 bp, Homo sapiens
ccagactgagctct

SEQ ID NO: 2939881 - DNA, 17 bp, Homo sapiens
ccagactgagctctcca

SEQ ID NO: 2939882 - DNA, 21 bp, Homo sapiens
ccagactgagctctccaggcc

SEQ ID NO: 2939883 - DNA, 13 bp, Homo sapiens
ccagactgggccc

SEQ ID NO: 2939884 - DNA, 14 bp, Homo sapiens
ccagacttccttga

SEQ ID NO: 2939885 - DNA, 16 bp, Homo sapiens
ccagacttgtttcctg

SEQ ID NO: 2939886 - DNA, 14 bp, Homo sapiens
ccagacttttctct

SEQ ID NO: 2939887 - DNA, 19 bp, Homo sapiens
ccagagaaaggggagccca

SEQ ID NO: 2939888 - DNA, 22 bp, Homo sapiens
ccagagaaagttggtgctgctc

SEQ ID NO: 2939889 - DNA, 18 bp, Homo sapiens
ccagagaacattggaaga

SEQ ID NO: 2939890 - DNA, 15 bp, Homo sapiens
ccagagaagtgacag

SEQ ID NO: 2939891 - DNA, 12 bp, Homo sapiens
ccagagacagga

SEQ ID NO: 2939892 - DNA, 15 bp, Homo sapiens
ccagagacaggaaaa

SEQ ID NO: 2939893 - DNA, 23 bp, Homo sapiens
ccagagacaggaaaatcctctgg

SEQ ID NO: 2939894 - DNA, 16 bp, Homo sapiens
ccagagacaggaaaga

SEQ ID NO: 2939895 - DNA, 18 bp, Homo sapiens
ccagagacaggaaagaat

SEQ ID NO: 2939896 - DNA, 17 bp, Homo sapiens
ccagagacatacttgaa

SEQ ID NO: 2939897 - DNA, 23 bp, Homo sapiens
ccagagacatgtggcagcaggca

SEQ ID NO: 2939898 - DNA, 18 bp, Homo sapiens
ccagagatgcctccaccg

SEQ ID NO: 2939899 - DNA, 23 bp, Homo sapiens
ccagagatgcctccaccgctgcc

SEQ ID NO: 2939900 - DNA, 18 bp, Homo sapiens
ccagagcaggggctgctg

SEQ ID NO: 2939901 - DNA, 15 bp, Homo sapiens
ccagagccacacatg

SEQ ID NO: 2939902 - DNA, 11 bp, Homo sapiens
ccagagccagg

SEQ ID NO: 2939903 - DNA, 22 bp, Homo sapiens
ccagagccaggggggtgaggag

SEQ ID NO: 2939904 - DNA, 11 bp, Homo sapiens
ccagagcccag

SEQ ID NO: 2939905 - DNA, 12 bp, Homo sapiens
ccagagcccagc

SEQ ID NO: 2939906 - DNA, 15 bp, Homo sapiens
ccagagcccagctcc

SEQ ID NO: 2939907 - DNA, 17 bp, Homo sapiens
ccagagcccagctccaa

SEQ ID NO: 2939908 - DNA, 15 bp, Homo sapiens
ccagagcccagctct

SEQ ID NO: 2939909 - DNA, 21 bp, Homo sapiens
ccagagcccagctcttgctct

SEQ ID NO: 2939910 - DNA, 18 bp, Homo sapiens
ccagagctctgacccaca

SEQ ID NO: 2939911 - DNA, 17 bp, Homo sapiens
ccagagctgcctcccca

SEQ ID NO: 2939912 - DNA, 18 bp, Homo sapiens
ccagagctggtggaccca

SEQ ID NO: 2939913 - DNA, 14 bp, Homo sapiens
ccagagcttttcag

SEQ ID NO: 2939914 - DNA, 22 bp, Homo sapiens
ccagaggaaggggccagaggct

SEQ ID NO: 2939915 - DNA, 23 bp, Homo sapiens
ccagaggaatgatgggcttttgt

SEQ ID NO: 2939916 - DNA, 21 bp, Homo sapiens
ccagaggaattgattgtcagc

SEQ ID NO: 2939917 - DNA, 20 bp, Homo sapiens
ccagaggactgtgatgccct

SEQ ID NO: 2939918 - DNA, 15 bp, Homo sapiens
ccagaggagcctttt

SEQ ID NO: 2939919 - DNA, 17 bp, Homo sapiens
ccagaggagccttttta

SEQ ID NO: 2939920 - DNA, 20 bp, Homo sapiens
ccagaggaggggacttgtag

SEQ ID NO: 2939921 - DNA, 23 bp, Homo sapiens
ccagaggatgctctttcccagga

SEQ ID NO: 2939922 - DNA, 21 bp, Homo sapiens
ccagaggattgctgccccatc

SEQ ID NO: 2939923 - DNA, 22 bp, Homo sapiens
ccagaggcacctcaagaagaag

SEQ ID NO: 2939924 - DNA, 11 bp, Homo sapiens
ccagaggcaga

SEQ ID NO: 2939925 - DNA, 12 bp, Homo sapiens
ccagaggcagag

SEQ ID NO: 2939926 - DNA, 13 bp, Homo sapiens
ccagaggcagagg

SEQ ID NO: 2939927 - DNA, 15 bp, Homo sapiens
ccagaggctgcccca

SEQ ID NO: 2939928 - DNA, 12 bp, Homo sapiens
ccagaggtgctt

SEQ ID NO: 2939929 - DNA, 16 bp, Homo sapiens
ccagagtccctgcctg

SEQ ID NO: 2939930 - DNA, 12 bp, Homo sapiens
ccagagtggcca

SEQ ID NO: 2939931 - DNA, 15 bp, Homo sapiens
ccagagtggccacgg

SEQ ID NO: 2939932 - DNA, 20 bp, Homo sapiens
ccagagtggccacggcccag

SEQ ID NO: 2939933 - DNA, 21 bp, Homo sapiens
ccagagtggccacggcccagg

SEQ ID NO: 2939934 - DNA, 21 bp, Homo sapiens
ccagagtggggatgacatgca

SEQ ID NO: 2939935 - DNA, 21 bp, Homo sapiens
ccagagtgtgggaagggagag

SEQ ID NO: 2939936 - DNA, 21 bp, Homo sapiens
ccagagttaaaatgtttactg

SEQ ID NO: 2939937 - DNA, 22 bp, Homo sapiens
ccagataaaattatagatggga

SEQ ID NO: 2939938 - DNA, 16 bp, Homo sapiens
ccagataactgaggag

SEQ ID NO: 2939939 - DNA, 17 bp, Homo sapiens
ccagatcatgttttggt

SEQ ID NO: 2939940 - DNA, 20 bp, Homo sapiens
ccagatcatgttttggtgaa

SEQ ID NO: 2939941 - DNA, 13 bp, Homo sapiens
ccagatccagcct

SEQ ID NO: 2939942 - DNA, 20 bp, Homo sapiens
ccagatcgctcccttggctt

SEQ ID NO: 2939943 - DNA, 23 bp, Homo sapiens
ccagatctacttggttgtcaagt

SEQ ID NO: 2939944 - DNA, 22 bp, Homo sapiens
ccagatgcggggacaggctgga

SEQ ID NO: 2939945 - DNA, 17 bp, Homo sapiens
ccagatgcgtcccaaga

SEQ ID NO: 2939946 - DNA, 22 bp, Homo sapiens
ccagatgctgatgttcagtgta

SEQ ID NO: 2939947 - DNA, 23 bp, Homo sapiens
ccagatgtttccagacttccttg

SEQ ID NO: 2939948 - DNA, 21 bp, Homo sapiens
ccagatgttttacgtctggga

SEQ ID NO: 2939949 - DNA, 23 bp, Homo sapiens
ccagatttgtctttttgttgtaa

SEQ ID NO: 2939950 - DNA, 16 bp, Homo sapiens
ccagatttgtttcctt

SEQ ID NO: 2939951 - DNA, 12 bp, Homo sapiens
ccagcaaaatcc

SEQ ID NO: 2939952 - DNA, 20 bp, Homo sapiens
ccagcaaaatccaaactgct

SEQ ID NO: 2939953 - DNA, 16 bp, Homo sapiens
ccagcaaagagaatgt

SEQ ID NO: 2939954 - DNA, 19 bp, Homo sapiens
ccagcaacacagcctgggc

SEQ ID NO: 2939955 - DNA, 20 bp, Homo sapiens
ccagcaacacagcctgggcc

SEQ ID NO: 2939956 - DNA, 22 bp, Homo sapiens
ccagcaatcgcatcccggctga

SEQ ID NO: 2939957 - DNA, 20 bp, Homo sapiens
ccagcacactgggaggccga

SEQ ID NO: 2939958 - DNA, 15 bp, Homo sapiens
ccagcacagctcctc

SEQ ID NO: 2939959 - DNA, 17 bp, Homo sapiens
ccagcacagctcctccc

SEQ ID NO: 2939960 - DNA, 19 bp, Homo sapiens
ccagcaccaccaggtctcc

SEQ ID NO: 2939961 - DNA, 23 bp, Homo sapiens
ccagcaccaccaggtctcccggg

SEQ ID NO: 2939962 - DNA, 22 bp, Homo sapiens
ccagcaccatccgccagggccc

SEQ ID NO: 2939963 - DNA, 20 bp, Homo sapiens
ccagcacccagtcctctgcc

SEQ ID NO: 2939964 - DNA, 22 bp, Homo sapiens
ccagcacccagtcctctgcctc

SEQ ID NO: 2939965 - DNA, 22 bp, Homo sapiens
ccagcaccccctctcctggagg

SEQ ID NO: 2939966 - DNA, 14 bp, Homo sapiens
ccagcaccttgtgc

SEQ ID NO: 2939967 - DNA, 15 bp, Homo sapiens
ccagcaccttgtgcc

SEQ ID NO: 2939968 - DNA, 16 bp, Homo sapiens
ccagcaccttgtgcct

SEQ ID NO: 2939969 - DNA, 15 bp, Homo sapiens
ccagcacttgtatat

SEQ ID NO: 2939970 - DNA, 20 bp, Homo sapiens
ccagcacttgtccagctgag

SEQ ID NO: 2939971 - DNA, 19 bp, Homo sapiens
ccagcactttgggaggcag

SEQ ID NO: 2939972 - DNA, 20 bp, Homo sapiens
ccagcactttgggaggcagg

SEQ ID NO: 2939973 - DNA, 22 bp, Homo sapiens
ccagcactttgggaggccaagg

SEQ ID NO: 2939974 - DNA, 12 bp, Homo sapiens
ccagcagaacag

SEQ ID NO: 2939975 - DNA, 17 bp, Homo sapiens
ccagcagaagccagagg

SEQ ID NO: 2939976 - DNA, 17 bp, Homo sapiens
ccagcagaatggaggca

SEQ ID NO: 2939977 - DNA, 14 bp, Homo sapiens
ccagcagcctcgca

SEQ ID NO: 2939978 - DNA, 14 bp, Homo sapiens
ccagcagcctgcca

SEQ ID NO: 2939979 - DNA, 18 bp, Homo sapiens
ccagcagcgcctttccca

SEQ ID NO: 2939980 - DNA, 22 bp, Homo sapiens
ccagcagcgcgcaggcctgcgt

SEQ ID NO: 2939981 - DNA, 17 bp, Homo sapiens
ccagcaggcagcgcctg

SEQ ID NO: 2939982 - DNA, 19 bp, Homo sapiens
ccagcaggcagcgcctgtc

SEQ ID NO: 2939983 - DNA, 16 bp, Homo sapiens
ccagcaggcctccctg

SEQ ID NO: 2939984 - DNA, 18 bp, Homo sapiens
ccagcaggggccctcact

SEQ ID NO: 2939985 - DNA, 21 bp, Homo sapiens
ccagcagggtcttttcatctg

SEQ ID NO: 2939986 - DNA, 22 bp, Homo sapiens
ccagcagggtcttttcatctgg

SEQ ID NO: 2939987 - DNA, 23 bp, Homo sapiens
ccagcagggtcttttcatctggg

SEQ ID NO: 2939988 - DNA, 17 bp, Homo sapiens
ccagcagtctctgcctt

SEQ ID NO: 2939989 - DNA, 22 bp, Homo sapiens
ccagcagtctctgccttgcctt

SEQ ID NO: 2939990 - DNA, 23 bp, Homo sapiens
ccagcagtctctgccttgccttt

SEQ ID NO: 2939991 - DNA, 15 bp, Homo sapiens
ccagcagtttgggag

SEQ ID NO: 2939992 - DNA, 14 bp, Homo sapiens
ccagcatcacctgc

SEQ ID NO: 2939993 - DNA, 16 bp, Homo sapiens
ccagcatcacctgcct

SEQ ID NO: 2939994 - DNA, 18 bp, Homo sapiens
ccagcatggatgaaacct

SEQ ID NO: 2939995 - DNA, 19 bp, Homo sapiens
ccagcatggatgaaacctt

SEQ ID NO: 2939996 - DNA, 13 bp, Homo sapiens
ccagcattccttt

SEQ ID NO: 2939997 - DNA, 14 bp, Homo sapiens
ccagcattcctttt

SEQ ID NO: 2939998 - DNA, 18 bp, Homo sapiens
ccagcattctcagccaca

SEQ ID NO: 2939999 - DNA, 16 bp, Homo sapiens
ccagcattctcaggca

SEQ ID NO: 2940000 - DNA, 12 bp, Homo sapiens
ccacctcagcct

SEQ ID NO: 2940001 - DNA, 21 bp, Homo sapiens
ccacctccaggctttcccact

SEQ ID NO: 2940002 - DNA, 17 bp, Homo sapiens
ccacctcccctatccac

SEQ ID NO: 2940003 - DNA, 13 bp, Homo sapiens
ccacctcggccct

SEQ ID NO: 2940004 - DNA, 18 bp, Homo sapiens
ccacctcggccctccctg

SEQ ID NO: 2940005 - DNA, 17 bp, Homo sapiens
ccacctctccctgaccc

SEQ ID NO: 2940006 - DNA, 13 bp, Homo sapiens
ccacctctctttt

SEQ ID NO: 2940007 - DNA, 15 bp, Homo sapiens
ccacctctctttttc

SEQ ID NO: 2940008 - DNA, 17 bp, Homo sapiens
ccacctgaaagcctgtc

SEQ ID NO: 2940009 - DNA, 14 bp, Homo sapiens
ccacctgcctggcc

SEQ ID NO: 2940010 - DNA, 16 bp, Homo sapiens
ccacctgcctggccgg

SEQ ID NO: 2940011 - DNA, 22 bp, Homo sapiens
ccacctgcctggccggccagcc

SEQ ID NO: 2940012 - DNA, 19 bp, Homo sapiens
ccacctggacgaagagcag

SEQ ID NO: 2940013 - DNA, 23 bp, Homo sapiens
ccacctggtactccctctcagga

SEQ ID NO: 2940014 - DNA, 17 bp, Homo sapiens
ccaccttatacatcact

SEQ ID NO: 2940015 - DNA, 13 bp, Homo sapiens
ccaccttcccagc

SEQ ID NO: 2940016 - DNA, 15 bp, Homo sapiens
ccaccttcccagctc

SEQ ID NO: 2940017 - DNA, 15 bp, Homo sapiens
ccaccttgattttct

SEQ ID NO: 2940018 - DNA, 23 bp, Homo sapiens
ccaccttttgtttttccagttcc

SEQ ID NO: 2940019 - DNA, 22 bp, Homo sapiens
ccacgaacagcccgccagaggc

SEQ ID NO: 2940020 - DNA, 16 bp, Homo sapiens
ccacgacccctgcctc

SEQ ID NO: 2940021 - DNA, 21 bp, Homo sapiens
ccacgacccctgcctcgaggg

SEQ ID NO: 2940022 - DNA, 22 bp, Homo sapiens
ccacgacccctgcctcgagggc

SEQ ID NO: 2940023 - DNA, 15 bp, Homo sapiens
ccacgactggccagg

SEQ ID NO: 2940024 - DNA, 18 bp, Homo sapiens
ccacgactggccagggcc

SEQ ID NO: 2940025 - DNA, 15 bp, Homo sapiens
ccacgagggctggct

SEQ ID NO: 2940026 - DNA, 19 bp, Homo sapiens
ccacgagggctggctggcc

SEQ ID NO: 2940027 - DNA, 18 bp, Homo sapiens
ccacgaggggacccatgg

SEQ ID NO: 2940028 - DNA, 20 bp, Homo sapiens
ccacgaggggacccatgggg

SEQ ID NO: 2940029 - DNA, 18 bp, Homo sapiens
ccacgatgtggccctggc

SEQ ID NO: 2940030 - DNA, 16 bp, Homo sapiens
ccacgccactgcctcc

SEQ ID NO: 2940031 - DNA, 17 bp, Homo sapiens
ccacgcccgggagtggg

SEQ ID NO: 2940032 - DNA, 24 bp, Homo sapiens
ccacgcggccacctcaccctctcc

SEQ ID NO: 2940033 - DNA, 13 bp, Homo sapiens
ccacgctccagct

SEQ ID NO: 2940034 - DNA, 22 bp, Homo sapiens
ccacgctttttgactgctcacc

SEQ ID NO: 2940035 - DNA, 20 bp, Homo sapiens
ccacggagccactcctctga

SEQ ID NO: 2940036 - DNA, 15 bp, Homo sapiens
ccacggcccagggag

SEQ ID NO: 2940037 - DNA, 16 bp, Homo sapiens
ccacggggaccactgg

SEQ ID NO: 2940038 - DNA, 20 bp, Homo sapiens
ccacggggaccactgggccc

SEQ ID NO: 2940039 - DNA, 18 bp, Homo sapiens
ccacggtccgcggcctgc

SEQ ID NO: 2940040 - DNA, 22 bp, Homo sapiens
ccacgtaccaagccaccgcagc

SEQ ID NO: 2940041 - DNA, 16 bp, Homo sapiens
ccacgtctctctgcct

SEQ ID NO: 2940042 - DNA, 18 bp, Homo sapiens
ccacgtctctctgcctgc

SEQ ID NO: 2940043 - DNA, 14 bp, Homo sapiens
ccacgtggagacag

SEQ ID NO: 2940044 - DNA, 18 bp, Homo sapiens
ccacgtggctgcgtgccc

SEQ ID NO: 2940045 - DNA, 15 bp, Homo sapiens
ccacgttccttactg

SEQ ID NO: 2940046 - DNA, 23 bp, Homo sapiens
ccacgttctgctcatcattctct

SEQ ID NO: 2940047 - DNA, 20 bp, Homo sapiens
ccactaagagattgcacagt

SEQ ID NO: 2940048 - DNA, 13 bp, Homo sapiens
ccactaagcagag

SEQ ID NO: 2940049 - DNA, 21 bp, Homo sapiens
ccactaagcagaggaggggcc

SEQ ID NO: 2940050 - DNA, 22 bp, Homo sapiens
ccactatatcatgggctctgca

SEQ ID NO: 2940051 - DNA, 14 bp, Homo sapiens
ccactatgcaaaga

SEQ ID NO: 2940052 - DNA, 18 bp, Homo sapiens
ccactcaagccaagcagc

SEQ ID NO: 2940053 - DNA, 14 bp, Homo sapiens
ccactcacccttcc

SEQ ID NO: 2940054 - DNA, 22 bp, Homo sapiens
ccactcacccttcctggcccag

SEQ ID NO: 2940055 - DNA, 15 bp, Homo sapiens
ccactcagctccgtg

SEQ ID NO: 2940056 - DNA, 14 bp, Homo sapiens
ccactcaggggtca

SEQ ID NO: 2940057 - DNA, 22 bp, Homo sapiens
ccactcctaatcaagagtctct

SEQ ID NO: 2940058 - DNA, 21 bp, Homo sapiens
ccactcctctcaactgcctca

SEQ ID NO: 2940059 - DNA, 14 bp, Homo sapiens
ccactcctgccagc

SEQ ID NO: 2940060 - DNA, 15 bp, Homo sapiens
ccactcctgccagcc

SEQ ID NO: 2940061 - DNA, 18 bp, Homo sapiens
ccactcctgccagcccgg

SEQ ID NO: 2940062 - DNA, 20 bp, Homo sapiens
ccactctaccagtgcaggct

SEQ ID NO: 2940063 - DNA, 17 bp, Homo sapiens
ccactctcattccccag

SEQ ID NO: 2940064 - DNA, 13 bp, Homo sapiens
ccactctgcggcc

SEQ ID NO: 2940065 - DNA, 21 bp, Homo sapiens
ccactctgctcgccttagcac

SEQ ID NO: 2940066 - DNA, 14 bp, Homo sapiens
ccactctgctgcct

SEQ ID NO: 2940067 - DNA, 20 bp, Homo sapiens
ccactgaaaagctttcctga

SEQ ID NO: 2940068 - DNA, 14 bp, Homo sapiens
ccaatcttgtttta

SEQ ID NO: 2940069 - DNA, 17 bp, Homo sapiens
ccaatgagacttgcctt

SEQ ID NO: 2940070 - DNA, 13 bp, Homo sapiens
ccaatgcactgag

SEQ ID NO: 2940071 - DNA, 20 bp, Homo sapiens
ccaatggaatgtgatgttca

SEQ ID NO: 2940072 - DNA, 20 bp, Homo sapiens
ccaatgtaggagctgccttg

SEQ ID NO: 2940073 - DNA, 15 bp, Homo sapiens
ccaatgtcagcatca

SEQ ID NO: 2940074 - DNA, 18 bp, Homo sapiens
ccaatgttgtgtgttgca

SEQ ID NO: 2940075 - DNA, 18 bp, Homo sapiens
ccaattaaaaacgaaaac

SEQ ID NO: 2940076 - DNA, 12 bp, Homo sapiens
ccaattatggaa

SEQ ID NO: 2940077 - DNA, 22 bp, Homo sapiens
ccaattgcctcttgcaggctga

SEQ ID NO: 2940078 - DNA, 20 bp, Homo sapiens
ccaattgttgacagttctga

SEQ ID NO: 2940079 - DNA, 21 bp, Homo sapiens
ccaattgttgacagttctgaa

SEQ ID NO: 2940080 - DNA, 12 bp, Homo sapiens
ccaatttgtctc

SEQ ID NO: 2940081 - DNA, 16 bp, Homo sapiens
ccaattttaatttagt

SEQ ID NO: 2940082 - DNA, 21 bp, Homo sapiens
ccaattttaatttagtaaatg

SEQ ID NO: 2940083 - DNA, 22 bp, Homo sapiens
ccaattttaatttagtaaatgt

SEQ ID NO: 2940084 - DNA, 15 bp, Homo sapiens
ccacaaaaaatactt

SEQ ID NO: 2940085 - DNA, 22 bp, Homo sapiens
ccacaaacggagcccctgaaag

SEQ ID NO: 2940086 - DNA, 20 bp, Homo sapiens
ccacaaagcacagtttgaac

SEQ ID NO: 2940087 - DNA, 20 bp, Homo sapiens
ccacaaaggcaaagggtcca

SEQ ID NO: 2940088 - DNA, 22 bp, Homo sapiens
ccacaaatgggaaaaccagact

SEQ ID NO: 2940089 - DNA, 14 bp, Homo sapiens
ccacaaccttgcag

SEQ ID NO: 2940090 - DNA, 16 bp, Homo sapiens
ccacaacgtgcaactg

SEQ ID NO: 2940091 - DNA, 20 bp, Homo sapiens
ccacaacttgtcacccaaag

SEQ ID NO: 2940092 - DNA, 14 bp, Homo sapiens
ccacaacttttaac

SEQ ID NO: 2940093 - DNA, 15 bp, Homo sapiens
ccacaagattcccag

SEQ ID NO: 2940094 - DNA, 17 bp, Homo sapiens
ccacaagattcccagag

SEQ ID NO: 2940095 - DNA, 19 bp, Homo sapiens
ccacaagattcccagagac

SEQ ID NO: 2940096 - DNA, 12 bp, Homo sapiens
ccacaagcctgc

SEQ ID NO: 2940097 - DNA, 12 bp, Homo sapiens
ccacaaggcctg

SEQ ID NO: 2940098 - DNA, 16 bp, Homo sapiens
ccacaaggcctggtct

SEQ ID NO: 2940099 - DNA, 17 bp, Homo sapiens
ccacaaggcctggtctg

SEQ ID NO: 2940100 - DNA, 17 bp, Homo sapiens
ccacaaggctgttgcat

SEQ ID NO: 2940101 - DNA, 20 bp, Homo sapiens
ccacaagtgccgcaaattgt

SEQ ID NO: 2940102 - DNA, 15 bp, Homo sapiens
ccacaagtggtggta

SEQ ID NO: 2940103 - DNA, 22 bp, Homo sapiens
ccacaagtggtggtaaccctgg

SEQ ID NO: 2940104 - DNA, 20 bp, Homo sapiens
ccacaatttctttaaaaaag

SEQ ID NO: 2940105 - DNA, 22 bp, Homo sapiens
ccacaatttctttaaaaaagaa

SEQ ID NO: 2940106 - DNA, 20 bp, Homo sapiens
ccacacaaggatagatgctg

SEQ ID NO: 2940107 - DNA, 21 bp, Homo sapiens
ccacacacaacagccaacagc

SEQ ID NO: 2940108 - DNA, 11 bp, Homo sapiens
ccacacacaca

SEQ ID NO: 2940109 - DNA, 17 bp, Homo sapiens
ccacacacacacacatg

SEQ ID NO: 2940110 - DNA, 12 bp, Homo sapiens
ccacacacacag

SEQ ID NO: 2940111 - DNA, 14 bp, Homo sapiens
ccacacacacagaa

SEQ ID NO: 2940112 - DNA, 16 bp, Homo sapiens
ccacacacacagaaaa

SEQ ID NO: 2940113 - DNA, 22 bp, Homo sapiens
ccacacacacagaaaatatact

SEQ ID NO: 2940114 - DNA, 12 bp, Homo sapiens
ccacacacactc

SEQ ID NO: 2940115 - DNA, 14 bp, Homo sapiens
ccacacacactcct

SEQ ID NO: 2940116 - DNA, 15 bp, Homo sapiens
ccacacatcccagcc

SEQ ID NO: 2940117 - DNA, 21 bp, Homo sapiens
agactgtcttacctggcagca

SEQ ID NO: 2940118 - DNA, 20 bp, Homo sapiens
agactgtgcggcacaggaaa

SEQ ID NO: 2940119 - DNA, 15 bp, Homo sapiens
agacttaatttcaaa

SEQ ID NO: 2940120 - DNA, 18 bp, Homo sapiens
agacttactctaagatct

SEQ ID NO: 2940121 - DNA, 14 bp, Homo sapiens
agacttagttattt

SEQ ID NO: 2940122 - DNA, 14 bp, Homo sapiens
agacttcccagcta

SEQ ID NO: 2940123 - DNA, 14 bp, Homo sapiens
agacttgacagtgg

SEQ ID NO: 2940124 - DNA, 16 bp, Homo sapiens
agacttgccagagccg

SEQ ID NO: 2940125 - DNA, 15 bp, Homo sapiens
agacttgccatgtga

SEQ ID NO: 2940126 - DNA, 17 bp, Homo sapiens
agacttgccatgtgact

SEQ ID NO: 2940127 - DNA, 11 bp, Homo sapiens
agacttgcctt

SEQ ID NO: 2940128 - DNA, 13 bp, Homo sapiens
agacttgccttcc

SEQ ID NO: 2940129 - DNA, 16 bp, Homo sapiens
agacttgccttcctaa

SEQ ID NO: 2940130 - DNA, 14 bp, Homo sapiens
agacttggatgagg

SEQ ID NO: 2940131 - DNA, 21 bp, Homo sapiens
agacttggccataaagataat

SEQ ID NO: 2940132 - DNA, 18 bp, Homo sapiens
atgggcgtacgctggtgc

SEQ ID NO: 2940133 - DNA, 14 bp, Homo sapiens
atgggctccccagg

SEQ ID NO: 2940134 - DNA, 17 bp, Homo sapiens
atgggcttttgttctga

SEQ ID NO: 2940135 - DNA, 20 bp, Homo sapiens
atgggcttttgttctgaggg

SEQ ID NO: 2940136 - DNA, 15 bp, Homo sapiens
atggggaggaagaga

SEQ ID NO: 2940137 - DNA, 14 bp, Homo sapiens
atggggccagatcc

SEQ ID NO: 2940138 - DNA, 22 bp, Homo sapiens
atggggccagatccagcctggg

SEQ ID NO: 2940139 - DNA, 18 bp, Homo sapiens
atgggggagattgaactt

SEQ ID NO: 2940140 - DNA, 23 bp, Homo sapiens
atggggggatttttttgttcttg

SEQ ID NO: 2940141 - DNA, 18 bp, Homo sapiens
atgggtaatataaagtgt

SEQ ID NO: 2940142 - DNA, 15 bp, Homo sapiens
atgggtctggctaga

SEQ ID NO: 2940143 - DNA, 15 bp, Homo sapiens
atgggtgaaggctgg

SEQ ID NO: 2940144 - DNA, 17 bp, Homo sapiens
atgggtgaaggctggca

SEQ ID NO: 2940145 - DNA, 20 bp, Homo sapiens
atgggtgcagtttgaggggc

SEQ ID NO: 2940146 - DNA, 14 bp, Homo sapiens
atggtacaaccttt

SEQ ID NO: 2940147 - DNA, 16 bp, Homo sapiens
atggtactaaggagaa

SEQ ID NO: 2940148 - DNA, 17 bp, Homo sapiens
atggtactaaggagaat

SEQ ID NO: 2940149 - DNA, 13 bp, Homo sapiens
atggtagaccttt

SEQ ID NO: 2940150 - DNA, 14 bp, Homo sapiens
atggtatatataca

SEQ ID NO: 2940151 - DNA, 17 bp, Homo sapiens
atggtatatatacatat

SEQ ID NO: 2940152 - DNA, 14 bp, Homo sapiens
atggtattgagaag

SEQ ID NO: 2940153 - DNA, 14 bp, Homo sapiens
atggtcacacactg

SEQ ID NO: 2940154 - DNA, 15 bp, Homo sapiens
atggtcacacactga

SEQ ID NO: 2940155 - DNA, 16 bp, Homo sapiens
atggtcacacactgat

SEQ ID NO: 2940156 - DNA, 17 bp, Homo sapiens
atgctgtgctatgaatt

SEQ ID NO: 2940157 - DNA, 12 bp, Homo sapiens
atgctgttgatt

SEQ ID NO: 2940158 - DNA, 17 bp, Homo sapiens
atgctgttgattgctaa

SEQ ID NO: 2940159 - DNA, 19 bp, Homo sapiens
atgctgttgattgctaaat

SEQ ID NO: 2940160 - DNA, 22 bp, Homo sapiens
atgctgttgattgctaaatgta

SEQ ID NO: 2940161 - DNA, 17 bp, Homo sapiens
atgctgttgcctcatct

SEQ ID NO: 2940162 - DNA, 18 bp, Homo sapiens
atgctgttgcctcatcta

SEQ ID NO: 2940163 - DNA, 23 bp, Homo sapiens
atgcttaattttaattggaggaa

SEQ ID NO: 2940164 - DNA, 13 bp, Homo sapiens
atgcttacgtctc

SEQ ID NO: 2940165 - DNA, 17 bp, Homo sapiens
atgcttagatgttccag

SEQ ID NO: 2940166 - DNA, 15 bp, Homo sapiens
atgcttagtaatgct

SEQ ID NO: 2940167 - DNA, 16 bp, Homo sapiens
atgcttcatacaggga

SEQ ID NO: 2940168 - DNA, 16 bp, Homo sapiens
atgcttctagagtttt

SEQ ID NO: 2940169 - DNA, 22 bp, Homo sapiens
atgcttctctcatagtgtcata

SEQ ID NO: 2940170 - DNA, 23 bp, Homo sapiens
atgcttctttctactttgtttat

SEQ ID NO: 2940171 - DNA, 17 bp, Homo sapiens
atgcttgaatggagctg

SEQ ID NO: 2940172 - DNA, 19 bp, Homo sapiens
atgcttgtgaaaatgtgtt

SEQ ID NO: 2940173 - DNA, 22 bp, Homo sapiens
atgctttgaaaaatcacttgat

SEQ ID NO: 2940174 - DNA, 12 bp, Homo sapiens
atgcttttctct

SEQ ID NO: 2940175 - DNA, 15 bp, Homo sapiens
atgcttttctctcag

SEQ ID NO: 2940176 - DNA, 23 bp, Homo sapiens
atgctttttatttctgcatatgt

SEQ ID NO: 2940177 - DNA, 19 bp, Homo sapiens
atggaaaaaaaaaaaagag

SEQ ID NO: 2940178 - DNA, 23 bp, Homo sapiens
atggaaaaaaaaaaaagaggaaa

SEQ ID NO: 2940179 - DNA, 20 bp, Homo sapiens
atggaaaaaaacataaaaag

SEQ ID NO: 2940180 - DNA, 19 bp, Homo sapiens
atggaaaaaaataaacttt

SEQ ID NO: 2940181 - DNA, 21 bp, Homo sapiens
atggaaaaacttgtgctataa

SEQ ID NO: 2940182 - DNA, 14 bp, Homo sapiens
atggaaaagagata

SEQ ID NO: 2940183 - DNA, 15 bp, Homo sapiens
atggaaacacatact

SEQ ID NO: 2940184 - DNA, 22 bp, Homo sapiens
atggaaacccataggcccacac

SEQ ID NO: 2940185 - DNA, 21 bp, Homo sapiens
atggaaagactgggacagccc

SEQ ID NO: 2940186 - DNA, 12 bp, Homo sapiens
atggaacagtga

SEQ ID NO: 2940187 - DNA, 17 bp, Homo sapiens
atggaaccaggcttgga

SEQ ID NO: 2940188 - DNA, 18 bp, Homo sapiens
atggaaccgcaggaagct

SEQ ID NO: 2940189 - DNA, 17 bp, Homo sapiens
atgcatccattcctcag

SEQ ID NO: 2940190 - DNA, 18 bp, Homo sapiens
atgcatccattcctcagg

SEQ ID NO: 2940191 - DNA, 22 bp, Homo sapiens
atgcatccattcctcagggaca

SEQ ID NO: 2940192 - DNA, 13 bp, Homo sapiens
atgcatctctgct

SEQ ID NO: 2940193 - DNA, 17 bp, Homo sapiens
atgcatctctgcttagt

SEQ ID NO: 2940194 - DNA, 16 bp, Homo sapiens
atgcatcttactgaag

SEQ ID NO: 2940195 - DNA, 18 bp, Homo sapiens
atgcatcttactgaaggt

SEQ ID NO: 2940196 - DNA, 17 bp, Homo sapiens
atgcatgcactgttccc

SEQ ID NO: 2940197 - DNA, 18 bp, Homo sapiens
atgcatggtgccccagga

SEQ ID NO: 2940198 - DNA, 16 bp, Homo sapiens
atgcatgtcaaacatg

SEQ ID NO: 2940199 - DNA, 22 bp, Homo sapiens
atgcatgtcaaacatgagatgt

SEQ ID NO: 2940200 - DNA, 13 bp, Homo sapiens
atgcatgtgaaga

SEQ ID NO: 2940201 - DNA, 18 bp, Homo sapiens
atgcatgttgaccatgtc

SEQ ID NO: 2940202 - DNA, 16 bp, Homo sapiens
atgcattgtagtttaa

SEQ ID NO: 2940203 - DNA, 12 bp, Homo sapiens
atgcatttgact

SEQ ID NO: 2940204 - DNA, 21 bp, Homo sapiens
atgcatttggaaccaaagtct

SEQ ID NO: 2940205 - DNA, 15 bp, Homo sapiens
atgccaacaagaatg

SEQ ID NO: 2940206 - DNA, 19 bp, Homo sapiens
atgccaacaagaatgcatt

SEQ ID NO: 2940207 - DNA, 16 bp, Homo sapiens
atgccaagtgcctgct

SEQ ID NO: 2940208 - DNA, 21 bp, Homo sapiens
atgccaattacggtgtacagt

SEQ ID NO: 2940209 - DNA, 16 bp, Homo sapiens
atgccacaaggacttc

SEQ ID NO: 2940210 - DNA, 19 bp, Homo sapiens
atgccacaaggacttcctg

SEQ ID NO: 2940211 - DNA, 14 bp, Homo sapiens
atgccactcctccc

SEQ ID NO: 2940212 - DNA, 16 bp, Homo sapiens
atgccactcctccctc

SEQ ID NO: 2940213 - DNA, 19 bp, Homo sapiens
atgccaggacccgccagcc

SEQ ID NO: 2940214 - DNA, 20 bp, Homo sapiens
atgccaggacccgccagccc

SEQ ID NO: 2940215 - DNA, 22 bp, Homo sapiens
atgccaggacccgccagccccg

SEQ ID NO: 2940216 - DNA, 18 bp, Homo sapiens
atgccagggccgaccaga

SEQ ID NO: 2940217 - DNA, 23 bp, Homo sapiens
atgccaggttaggaaggcagcat

SEQ ID NO: 2940218 - DNA, 18 bp, Homo sapiens
atgccaggttctatttgg

SEQ ID NO: 2940219 - DNA, 20 bp, Homo sapiens
atgccaggttctatttggaa

SEQ ID NO: 2940220 - DNA, 16 bp, Homo sapiens
atgccataaatacaag

SEQ ID NO: 2940221 - DNA, 14 bp, Homo sapiens
atgccatcatctcc

SEQ ID NO: 2940222 - DNA, 15 bp, Homo sapiens
atgcccagccagcca

SEQ ID NO: 2940223 - DNA, 20 bp, Homo sapiens
atgcccagccagccacccct

SEQ ID NO: 2940224 - DNA, 22 bp, Homo sapiens
atgcccccgacccccgcagagg

SEQ ID NO: 2940225 - DNA, 21 bp, Homo sapiens
atgcccctagtaactgctgtc

SEQ ID NO: 2940226 - DNA, 16 bp, Homo sapiens
atgccctcaagtaaaa

SEQ ID NO: 2940227 - DNA, 23 bp, Homo sapiens
atgccctcctctcccattgtccc

SEQ ID NO: 2940228 - DNA, 15 bp, Homo sapiens
atgccctggaggtgg

SEQ ID NO: 2940229 - DNA, 12 bp, Homo sapiens
atgccctgtgca

SEQ ID NO: 2940230 - DNA, 13 bp, Homo sapiens
atgccctgtgcaa

SEQ ID NO: 2940231 - DNA, 17 bp, Homo sapiens
atgccgtcttctgccct

SEQ ID NO: 2940232 - DNA, 14 bp, Homo sapiens
atgaggggaaaaaa

SEQ ID NO: 2940233 - DNA, 22 bp, Homo sapiens
atgagggttcatcatccctccc

SEQ ID NO: 2940234 - DNA, 15 bp, Homo sapiens
atgaggtagctgaca

SEQ ID NO: 2940235 - DNA, 19 bp, Homo sapiens
atgaggtagctgacacaga

SEQ ID NO: 2940236 - DNA, 19 bp, Homo sapiens
atgagtataatgaacactc

SEQ ID NO: 2940237 - DNA, 21 bp, Homo sapiens
atgagtattataggactttct

SEQ ID NO: 2940238 - DNA, 22 bp, Homo sapiens
atgagtctacctgagcattcag

SEQ ID NO: 2940239 - DNA, 17 bp, Homo sapiens
atgagtctagatgttta

SEQ ID NO: 2940240 - DNA, 20 bp, Homo sapiens
atgagtggccagcgccaggg

SEQ ID NO: 2940241 - DNA, 22 bp, Homo sapiens
atgagtggccagcgccagggcc

SEQ ID NO: 2940242 - DNA, 13 bp, Homo sapiens
atgagtgtgaagg

SEQ ID NO: 2940243 - DNA, 12 bp, Homo sapiens
atgataaaagga

SEQ ID NO: 2940244 - DNA, 12 bp, Homo sapiens
atgataagattg

SEQ ID NO: 2940245 - DNA, 15 bp, Homo sapiens
atgataagattgaaa

SEQ ID NO: 2940246 - DNA, 16 bp, Homo sapiens
atgataagattgaaat

SEQ ID NO: 2940247 - DNA, 13 bp, Homo sapiens
atgataataataa

SEQ ID NO: 2940248 - DNA, 15 bp, Homo sapiens
atgatacatccaaag

SEQ ID NO: 2940249 - DNA, 16 bp, Homo sapiens
atgatagaactgtact

SEQ ID NO: 2940250 - DNA, 14 bp, Homo sapiens
atgatagatttgac

SEQ ID NO: 2940251 - DNA, 18 bp, Homo sapiens
atgatagatttgacctcc

SEQ ID NO: 2940252 - DNA, 20 bp, Homo sapiens
atgatagatttgacctcctc

SEQ ID NO: 2940253 - DNA, 12 bp, Homo sapiens
atgatatgcatt

SEQ ID NO: 2940254 - DNA, 15 bp, Homo sapiens
atgatatttcttgct

SEQ ID NO: 2940255 - DNA, 18 bp, Homo sapiens
atgatcaacataatggac

SEQ ID NO: 2940256 - DNA, 20 bp, Homo sapiens
atgatcagtggacagtctgc

SEQ ID NO: 2940257 - DNA, 17 bp, Homo sapiens
atgatcataaaagtgat

SEQ ID NO: 2940258 - DNA, 22 bp, Homo sapiens
atgatcataaaagtgattcttt

SEQ ID NO: 2940259 - DNA, 20 bp, Homo sapiens
atgatccacccacctcagcc

SEQ ID NO: 2940260 - DNA, 17 bp, Homo sapiens
atgatccagctgtgtgt

SEQ ID NO: 2940261 - DNA, 20 bp, Homo sapiens
atgatcctgtattcagacag

SEQ ID NO: 2940262 - DNA, 18 bp, Homo sapiens
atgatcgctgtattttga

SEQ ID NO: 2940263 - DNA, 16 bp, Homo sapiens
atgatctccgtatgat

SEQ ID NO: 2940264 - DNA, 21 bp, Homo sapiens
atgatcttcatgggcccacag

SEQ ID NO: 2940265 - DNA, 15 bp, Homo sapiens
atgatgaatgagaat

SEQ ID NO: 2940266 - DNA, 12 bp, Homo sapiens
atgatgacaatc

SEQ ID NO: 2940267 - DNA, 16 bp, Homo sapiens
atgatgacaatcaaag

SEQ ID NO: 2940268 - DNA, 15 bp, Homo sapiens
atgatgagattcact

SEQ ID NO: 2940269 - DNA, 13 bp, Homo sapiens
atgatgatgatga

SEQ ID NO: 2940270 - DNA, 20 bp, Homo sapiens
atgatgcatggagtgtttga

SEQ ID NO: 2940271 - DNA, 13 bp, Homo sapiens
atgatgctcagtt

SEQ ID NO: 2940272 - DNA, 14 bp, Homo sapiens
atgatgctttggaa

SEQ ID NO: 2940273 - DNA, 15 bp, Homo sapiens
atgatgctttggaag

SEQ ID NO: 2940274 - DNA, 16 bp, Homo sapiens
atgatgctttggaaga

SEQ ID NO: 2940275 - DNA, 16 bp, Homo sapiens
atgatgcttttactga

SEQ ID NO: 2940276 - DNA, 21 bp, Homo sapiens
atgatgcttttactgaacttt

SEQ ID NO: 2940277 - DNA, 15 bp, Homo sapiens
atgatggaatttcat

SEQ ID NO: 2940278 - DNA, 20 bp, Homo sapiens
atgatgggcttttgttctga

SEQ ID NO: 2940279 - DNA, 23 bp, Homo sapiens
atgatggggccctaattcagcca

SEQ ID NO: 2940280 - DNA, 14 bp, Homo sapiens
atgatgtggttttt

SEQ ID NO: 2940281 - DNA, 17 bp, Homo sapiens
atgatgttatacatcaa

SEQ ID NO: 2940282 - DNA, 22 bp, Homo sapiens
atgatgttatcttaacactgaa

SEQ ID NO: 2940283 - DNA, 23 bp, Homo sapiens
atgatgttatcttaacactgaaa

SEQ ID NO: 2940284 - DNA, 20 bp, Homo sapiens
atgatgttgataatttcagg

SEQ ID NO: 2940285 - DNA, 17 bp, Homo sapiens
atcttttttcacaaatt

SEQ ID NO: 2940286 - DNA, 13 bp, Homo sapiens
atgaaaacattga

SEQ ID NO: 2940287 - DNA, 14 bp, Homo sapiens
atgaaaacattgat

SEQ ID NO: 2940288 - DNA, 20 bp, Homo sapiens
atgaaaacattgatgaatga

SEQ ID NO: 2940289 - DNA, 14 bp, Homo sapiens
atgaaaacctgcat

SEQ ID NO: 2940290 - DNA, 13 bp, Homo sapiens
atgaaaagttatt

SEQ ID NO: 2940291 - DNA, 13 bp, Homo sapiens
atgaaaatacaac

SEQ ID NO: 2940292 - DNA, 16 bp, Homo sapiens
atgaaaatatttaaag

SEQ ID NO: 2940293 - DNA, 14 bp, Homo sapiens
atgaaaatgtcttg

SEQ ID NO: 2940294 - DNA, 16 bp, Homo sapiens
atgaaaatgtcttgtg

SEQ ID NO: 2940295 - DNA, 15 bp, Homo sapiens
atgaaacccccacac

SEQ ID NO: 2940296 - DNA, 23 bp, Homo sapiens
atgaaactaaagcaatagaaaca

SEQ ID NO: 2940297 - DNA, 16 bp, Homo sapiens
atgaaactctacattt

SEQ ID NO: 2940298 - DNA, 13 bp, Homo sapiens
atgaaacttggat

SEQ ID NO: 2940299 - DNA, 12 bp, Homo sapiens
atgaaagatgat

SEQ ID NO: 2940300 - DNA, 17 bp, Homo sapiens
atgaaatattgctgtat

SEQ ID NO: 2940301 - DNA, 15 bp, Homo sapiens
atgaaatattttgaa

SEQ ID NO: 2940302 - DNA, 21 bp, Homo sapiens
atgaaatggagtcatttgagt

SEQ ID NO: 2940303 - DNA, 16 bp, Homo sapiens
atgaaattacttatca

SEQ ID NO: 2940304 - DNA, 14 bp, Homo sapiens
atgaaatttttgta

SEQ ID NO: 2940305 - DNA, 16 bp, Homo sapiens
atgaaatttttgtaaa

SEQ ID NO: 2940306 - DNA, 12 bp, Homo sapiens
atgaacaaatgg

SEQ ID NO: 2940307 - DNA, 15 bp, Homo sapiens
atgaacacaatcacg

SEQ ID NO: 2940308 - DNA, 23 bp, Homo sapiens
atgaacactatgcactgctgtaa

SEQ ID NO: 2940309 - DNA, 16 bp, Homo sapiens
atgaacagggcccagg

SEQ ID NO: 2940310 - DNA, 15 bp, Homo sapiens
atgaacctgaaaagg

SEQ ID NO: 2940311 - DNA, 14 bp, Homo sapiens
atgaaccttctggc

SEQ ID NO: 2940312 - DNA, 17 bp, Homo sapiens
atgaaccttctggcctc

SEQ ID NO: 2940313 - DNA, 24 bp, Homo sapiens
atgaaccttctggcctcccacaga

SEQ ID NO: 2940314 - DNA, 15 bp, Homo sapiens
atgaactgattttta

SEQ ID NO: 2940315 - DNA, 16 bp, Homo sapiens
atgaacttattctgta

SEQ ID NO: 2940316 - DNA, 17 bp, Homo sapiens
atgaacttattctgtag

SEQ ID NO: 2940317 - DNA, 18 bp, Homo sapiens
atgaacttattctgtaga

SEQ ID NO: 2940318 - DNA, 20 bp, Homo sapiens
atgaactttgtcagtgttgc

SEQ ID NO: 2940319 - DNA, 19 bp, Homo sapiens
atgaagaaagggaggccca

SEQ ID NO: 2940320 - DNA, 17 bp, Homo sapiens
atgaagaaggaagctgt

SEQ ID NO: 2940321 - DNA, 19 bp, Homo sapiens
atgaagaattgccaatctt

SEQ ID NO: 2940322 - DNA, 13 bp, Homo sapiens
atgaagcaagctg

SEQ ID NO: 2940323 - DNA, 15 bp, Homo sapiens
atgaagcaagctgtg

SEQ ID NO: 2940324 - DNA, 18 bp, Homo sapiens
atgaagcaagctgtgtta

SEQ ID NO: 2940325 - DNA, 19 bp, Homo sapiens
atgaagcaagctgtgttac

SEQ ID NO: 2940326 - DNA, 17 bp, Homo sapiens
atgaagccttgctgaac

SEQ ID NO: 2940327 - DNA, 23 bp, Homo sapiens
atgaagctcacctgttgcttaca

SEQ ID NO: 2940328 - DNA, 17 bp, Homo sapiens
atgaagggtcatttctc

SEQ ID NO: 2940329 - DNA, 17 bp, Homo sapiens
atgaaggtttgagagca

SEQ ID NO: 2940330 - DNA, 13 bp, Homo sapiens
atgaagtaaagaa

SEQ ID NO: 2940331 - DNA, 21 bp, Homo sapiens
atgaagtaaagaactgcacat

SEQ ID NO: 2940332 - DNA, 19 bp, Homo sapiens
atgaagtgtgtttccttca

SEQ ID NO: 2940333 - DNA, 17 bp, Homo sapiens
atgaagttactttctta

SEQ ID NO: 2940334 - DNA, 16 bp, Homo sapiens
atgaatagcttgtttc

SEQ ID NO: 2940335 - DNA, 17 bp, Homo sapiens
atgaatagcttgtttct

SEQ ID NO: 2940336 - DNA, 13 bp, Homo sapiens
atgaatcactgtt

SEQ ID NO: 2940337 - DNA, 14 bp, Homo sapiens
atgaatcagaacag

SEQ ID NO: 2940338 - DNA, 17 bp, Homo sapiens
atgaatcgttcaactcc

SEQ ID NO: 2940339 - DNA, 21 bp, Homo sapiens
atgaatctacatttgtttgta

SEQ ID NO: 2940340 - DNA, 16 bp, Homo sapiens
atgaatctgctcactt

SEQ ID NO: 2940341 - DNA, 17 bp, Homo sapiens
atgaatctgctcacttt

SEQ ID NO: 2940342 - DNA, 18 bp, Homo sapiens
atgaatctgctcacttta

SEQ ID NO: 2940343 - DNA, 16 bp, Homo sapiens
atgaatcttatgcaaa

SEQ ID NO: 2940344 - DNA, 18 bp, Homo sapiens
atgaatgcagcactgctg

SEQ ID NO: 2940345 - DNA, 19 bp, Homo sapiens
atgaatgggatattttgaa

SEQ ID NO: 2940346 - DNA, 20 bp, Homo sapiens
atgaatgggatattttgaaa

SEQ ID NO: 2940347 - DNA, 21 bp, Homo sapiens
atgaatgggctgagctgcctg

SEQ ID NO: 2940348 - DNA, 15 bp, Homo sapiens
atctgctttctgttc

SEQ ID NO: 2940349 - DNA, 20 bp, Homo sapiens
atctgctttctgttcatctc

SEQ ID NO: 2940350 - DNA, 14 bp, Homo sapiens
atctggaacccaga

SEQ ID NO: 2940351 - DNA, 15 bp, Homo sapiens
atctggaacccagac

SEQ ID NO: 2940352 - DNA, 18 bp, Homo sapiens
atctggaacccagactca

SEQ ID NO: 2940353 - DNA, 18 bp, Homo sapiens
atctggaacctcagcctg

SEQ ID NO: 2940354 - DNA, 21 bp, Homo sapiens
atctggaatctggagaccagg

SEQ ID NO: 2940355 - DNA, 13 bp, Homo sapiens
atctggacacttc

SEQ ID NO: 2940356 - DNA, 16 bp, Homo sapiens
atctggacacttcttt

SEQ ID NO: 2940357 - DNA, 22 bp, Homo sapiens
atctggagaccagggagccttt

SEQ ID NO: 2940358 - DNA, 19 bp, Homo sapiens
atctggcattctacacctg

SEQ ID NO: 2940359 - DNA, 21 bp, Homo sapiens
atctggccccaggtagaaact

SEQ ID NO: 2940360 - DNA, 12 bp, Homo sapiens
atctggcttctg

SEQ ID NO: 2940361 - DNA, 11 bp, Homo sapiens
atctgggaaag

SEQ ID NO: 2940362 - DNA, 17 bp, Homo sapiens
atctggggcatgaaaaa

SEQ ID NO: 2940363 - DNA, 18 bp, Homo sapiens
atctgggtgcatgatctt

SEQ ID NO: 2940364 - DNA, 21 bp, Homo sapiens
atctgggtgcatgatcttgag

SEQ ID NO: 2940365 - DNA, 22 bp, Homo sapiens
atctgggtgcatgatcttgagc

SEQ ID NO: 2940366 - DNA, 13 bp, Homo sapiens
atctgggtgccct

SEQ ID NO: 2940367 - DNA, 15 bp, Homo sapiens
atctgggtgccctga

SEQ ID NO: 2940368 - DNA, 23 bp, Homo sapiens
atctgggtgggataatggactca

SEQ ID NO: 2940369 - DNA, 17 bp, Homo sapiens
atctggtcctacccatc

SEQ ID NO: 2940370 - DNA, 19 bp, Homo sapiens
atctgtaaaaaagaaaaac

SEQ ID NO: 2940371 - DNA, 16 bp, Homo sapiens
atctgtacaaaatggt

SEQ ID NO: 2940372 - DNA, 15 bp, Homo sapiens
atctgtacaatgaac

SEQ ID NO: 2940373 - DNA, 17 bp, Homo sapiens
atctgtacttcttcgat

SEQ ID NO: 2940374 - DNA, 23 bp, Homo sapiens
atctgtacttggtccaactgcaa

SEQ ID NO: 2940375 - DNA, 23 bp, Homo sapiens
atctgtatgtattagtgatattt

SEQ ID NO: 2940376 - DNA, 23 bp, Homo sapiens
atctgtccacatccccagagccc

SEQ ID NO: 2940377 - DNA, 20 bp, Homo sapiens
atctgtccatcctcctctcc

SEQ ID NO: 2940378 - DNA, 22 bp, Homo sapiens
atctgtccatcctcctctccat

SEQ ID NO: 2940379 - DNA, 15 bp, Homo sapiens
atctgtcctcagcct

SEQ ID NO: 2940380 - DNA, 17 bp, Homo sapiens
atctgtctaaagataga

SEQ ID NO: 2940381 - DNA, 20 bp, Homo sapiens
atctgtctagaatcctgctt

SEQ ID NO: 2940382 - DNA, 23 bp, Homo sapiens
atctgtctttgcggggcctgtct

SEQ ID NO: 2940383 - DNA, 19 bp, Homo sapiens
atctgtgactataaagctg

SEQ ID NO: 2940384 - DNA, 16 bp, Homo sapiens
atctgtgcactgccca

SEQ ID NO: 2940385 - DNA, 17 bp, Homo sapiens
atctgtgtacaaagaaa

SEQ ID NO: 2940386 - DNA, 12 bp, Homo sapiens
atctgtgtcttg

SEQ ID NO: 2940387 - DNA, 14 bp, Homo sapiens
atctgtgtcttgtt

SEQ ID NO: 2940388 - DNA, 16 bp, Homo sapiens
atctgtgttctaactt

SEQ ID NO: 2940389 - DNA, 21 bp, Homo sapiens
atctgtgtttttgaaatatta

SEQ ID NO: 2940390 - DNA, 14 bp, Homo sapiens
atctgttgtttgaa

SEQ ID NO: 2940391 - DNA, 12 bp, Homo sapiens
atcttaaaaagt

SEQ ID NO: 2940392 - DNA, 17 bp, Homo sapiens
atcttaaaaagttgttc

SEQ ID NO: 2940393 - DNA, 15 bp, Homo sapiens
atcttaaaaatattg

SEQ ID NO: 2940394 - DNA, 17 bp, Homo sapiens
atcttaaagatcgtgta

SEQ ID NO: 2940395 - DNA, 19 bp, Homo sapiens
atcttaaagtgtgtttcta

SEQ ID NO: 2940396 - DNA, 19 bp, Homo sapiens
atcttaaagtttcatgtga

SEQ ID NO: 2940397 - DNA, 20 bp, Homo sapiens
atcttaaatcagaataaatt

SEQ ID NO: 2940398 - DNA, 18 bp, Homo sapiens
atcttaagcagagataaa

SEQ ID NO: 2940399 - DNA, 21 bp, Homo sapiens
atcttaatgaatgagtctgtt

SEQ ID NO: 2940400 - DNA, 15 bp, Homo sapiens
atcttacaaaatcct

SEQ ID NO: 2940401 - DNA, 21 bp, Homo sapiens
atcttacaacaggcttatgaa

SEQ ID NO: 2940402 - DNA, 22 bp, Homo sapiens
atcttacaacaggcttatgaat

SEQ ID NO: 2940403 - DNA, 15 bp, Homo sapiens
atcttactgaaggta

SEQ ID NO: 2940404 - DNA, 22 bp, Homo sapiens
atcttagattctctgtgtctaa

SEQ ID NO: 2940405 - DNA, 22 bp, Homo sapiens
atcttagtttggattcttatgt

SEQ ID NO: 2940406 - DNA, 15 bp, Homo sapiens
atcttataatttaaa

SEQ ID NO: 2940407 - DNA, 16 bp, Homo sapiens
atcttataatttaaaa

SEQ ID NO: 2940408 - DNA, 22 bp, Homo sapiens
atcttataatttaaaatatgct

SEQ ID NO: 2940409 - DNA, 19 bp, Homo sapiens
atcttatcttgctttggag

SEQ ID NO: 2940410 - DNA, 23 bp, Homo sapiens
atcttatgagtataatgaacact

SEQ ID NO: 2940411 - DNA, 13 bp, Homo sapiens
atcttatttggaa

SEQ ID NO: 2940412 - DNA, 15 bp, Homo sapiens
atcttatttggaatt

SEQ ID NO: 2940413 - DNA, 19 bp, Homo sapiens
atcttatttggaattgaca

SEQ ID NO: 2940414 - DNA, 19 bp, Homo sapiens
atcttcagctggtggatgg

SEQ ID NO: 2940415 - DNA, 13 bp, Homo sapiens
atcttcagcttct

SEQ ID NO: 2940416 - DNA, 17 bp, Homo sapiens
atcttcccgcctcagcc

SEQ ID NO: 2940417 - DNA, 19 bp, Homo sapiens
atcttcccgcctcagcctc

SEQ ID NO: 2940418 - DNA, 11 bp, Homo sapiens
atcttccctgc

SEQ ID NO: 2940419 - DNA, 16 bp, Homo sapiens
atcgccataggccaag

SEQ ID NO: 2940420 - DNA, 15 bp, Homo sapiens
atcgccccaactcca

SEQ ID NO: 2940421 - DNA, 12 bp, Homo sapiens
atcgcctttccc

SEQ ID NO: 2940422 - DNA, 16 bp, Homo sapiens
atcgctgtgatgctgg

SEQ ID NO: 2940423 - DNA, 20 bp, Homo sapiens
atcggagaacatgaatcaaa

SEQ ID NO: 2940424 - DNA, 20 bp, Homo sapiens
atcggccctgtcccctggag

SEQ ID NO: 2940425 - DNA, 15 bp, Homo sapiens
atcgggaaggatggg

SEQ ID NO: 2940426 - DNA, 18 bp, Homo sapiens
atcgggaaggatgggaaa

SEQ ID NO: 2940427 - DNA, 16 bp, Homo sapiens
atcggggagccgggag

SEQ ID NO: 2940428 - DNA, 15 bp, Homo sapiens
atcgtatagctgtat

SEQ ID NO: 2940429 - DNA, 16 bp, Homo sapiens
atcgtatagctgtatt

SEQ ID NO: 2940430 - DNA, 20 bp, Homo sapiens
atcgtgacgctgaataaatg

SEQ ID NO: 2940431 - DNA, 21 bp, Homo sapiens
atcgtgacgctgaataaatgt

SEQ ID NO: 2940432 - DNA, 15 bp, Homo sapiens
atcgttattataaat

SEQ ID NO: 2940433 - DNA, 17 bp, Homo sapiens
atcgttattataaatgt

SEQ ID NO: 2940434 - DNA, 18 bp, Homo sapiens
atcgttattataaatgtt

SEQ ID NO: 2940435 - DNA, 19 bp, Homo sapiens
atcgttattataaatgtta

SEQ ID NO: 2940436 - DNA, 15 bp, Homo sapiens
atcgttccagttccc

SEQ ID NO: 2940437 - DNA, 21 bp, Homo sapiens
atcgttgttttgctggaggga

SEQ ID NO: 2940438 - DNA, 23 bp, Homo sapiens
atcgtttaatgtttatacagagt

SEQ ID NO: 2940439 - DNA, 21 bp, Homo sapiens
atctaaaagaatttaaattct

SEQ ID NO: 2940440 - DNA, 18 bp, Homo sapiens
atctaaaggatggaaaaa

SEQ ID NO: 2940441 - DNA, 13 bp, Homo sapiens
atctaaagttata

SEQ ID NO: 2940442 - DNA, 16 bp, Homo sapiens
atctaaagttatattt

SEQ ID NO: 2940443 - DNA, 16 bp, Homo sapiens
atctaaattgaataat

SEQ ID NO: 2940444 - DNA, 19 bp, Homo sapiens
atctaagttataagactct

SEQ ID NO: 2940445 - DNA, 23 bp, Homo sapiens
atctaatgcttgtttatgatatt

SEQ ID NO: 2940446 - DNA, 17 bp, Homo sapiens
atctacatcttttttca

SEQ ID NO: 2940447 - DNA, 17 bp, Homo sapiens
atctacatttgtttgta

SEQ ID NO: 2940448 - DNA, 20 bp, Homo sapiens
atctacctgcaacacaacat

SEQ ID NO: 2940449 - DNA, 16 bp, Homo sapiens
atctacctgttctgta

SEQ ID NO: 2940450 - DNA, 21 bp, Homo sapiens
atctactcttttgaagtgttt

SEQ ID NO: 2940451 - DNA, 15 bp, Homo sapiens
atctagaacattcag

SEQ ID NO: 2940452 - DNA, 15 bp, Homo sapiens
atctagaagggacca

SEQ ID NO: 2940453 - DNA, 14 bp, Homo sapiens
atctagaattttta

SEQ ID NO: 2940454 - DNA, 16 bp, Homo sapiens
atctagagtttataca

SEQ ID NO: 2940455 - DNA, 13 bp, Homo sapiens
atctagatttcta

SEQ ID NO: 2940456 - DNA, 18 bp, Homo sapiens
atctagcaaatgttatgc

SEQ ID NO: 2940457 - DNA, 16 bp, Homo sapiens
atctatagaactgaat

SEQ ID NO: 2940458 - DNA, 18 bp, Homo sapiens
atctatatatgtgtatgt

SEQ ID NO: 2940459 - DNA, 21 bp, Homo sapiens
atctatatgtacttgtcaaag

SEQ ID NO: 2940460 - DNA, 20 bp, Homo sapiens
atctatgaaaaccagtggct

SEQ ID NO: 2940461 - DNA, 11 bp, Homo sapiens
atctatgaacc

SEQ ID NO: 2940462 - DNA, 14 bp, Homo sapiens
atctatgaacctga

SEQ ID NO: 2940463 - DNA, 15 bp, Homo sapiens
atctatgaacctgaa

SEQ ID NO: 2940464 - DNA, 13 bp, Homo sapiens
atctatgtgaata

SEQ ID NO: 2940465 - DNA, 19 bp, Homo sapiens
atctatgttgcatgataaa

SEQ ID NO: 2940466 - DNA, 15 bp, Homo sapiens
atctattaaaaccac

SEQ ID NO: 2940467 - DNA, 23 bp, Homo sapiens
atctattctctccaaaaatgcac

SEQ ID NO: 2940468 - DNA, 18 bp, Homo sapiens
atctattctgagaaaaca

SEQ ID NO: 2940469 - DNA, 14 bp, Homo sapiens
atctattttggatt

SEQ ID NO: 2940470 - DNA, 22 bp, Homo sapiens
atctattttggattgtatattg

SEQ ID NO: 2940471 - DNA, 14 bp, Homo sapiens
atctcaaatgtttt

SEQ ID NO: 2940472 - DNA, 12 bp, Homo sapiens
atctcaagtata

SEQ ID NO: 2940473 - DNA, 16 bp, Homo sapiens
atctcaatacagcctg

SEQ ID NO: 2940474 - DNA, 22 bp, Homo sapiens
atctcacaaaacatattttaca

SEQ ID NO: 2940475 - DNA, 23 bp, Homo sapiens
atctcacaaaacatattttacat

SEQ ID NO: 2940476 - DNA, 19 bp, Homo sapiens
atctcagatcactgcaacc

SEQ ID NO: 2940477 - DNA, 11 bp, Homo sapiens
atctcagctca

SEQ ID NO: 2940478 - DNA, 18 bp, Homo sapiens
atctcaggccagagccaa

SEQ ID NO: 2940479 - DNA, 16 bp, Homo sapiens
atctcaggttggcggc

SEQ ID NO: 2940480 - DNA, 16 bp, Homo sapiens
atctcagtaataaaaa

SEQ ID NO: 2940481 - DNA, 23 bp, Homo sapiens
atctcagtggttaagattcctaa

SEQ ID NO: 2940482 - DNA, 22 bp, Homo sapiens
atctcatcctattacttttcat

SEQ ID NO: 2940483 - DNA, 19 bp, Homo sapiens
atctcattggacccttcca

SEQ ID NO: 2940484 - DNA, 13 bp, Homo sapiens
atctcatttggtt

SEQ ID NO: 2940485 - DNA, 23 bp, Homo sapiens
atctcatttttccgtaaaaatga

SEQ ID NO: 2940486 - DNA, 15 bp, Homo sapiens
atctccaattgcctc

SEQ ID NO: 2940487 - DNA, 13 bp, Homo sapiens
atctccatacttt

SEQ ID NO: 2940488 - DNA, 17 bp, Homo sapiens
atctccatactttggat

SEQ ID NO: 2940489 - DNA, 19 bp, Homo sapiens
atctcccacctagcagcac

SEQ ID NO: 2940490 - DNA, 13 bp, Homo sapiens
atctcccagactt

SEQ ID NO: 2940491 - DNA, 17 bp, Homo sapiens
atctcccagacttgttt

SEQ ID NO: 2940492 - DNA, 19 bp, Homo sapiens
atctcccagacttgtttcc

SEQ ID NO: 2940493 - DNA, 22 bp, Homo sapiens
atctcccagacttgtttcctgt

SEQ ID NO: 2940494 - DNA, 19 bp, Homo sapiens
atctcccccatagcaccct

SEQ ID NO: 2940495 - DNA, 21 bp, Homo sapiens
atctcccccatagcaccctgc

SEQ ID NO: 2940496 - DNA, 16 bp, Homo sapiens
atctccctgccatccc

SEQ ID NO: 2940497 - DNA, 21 bp, Homo sapiens
atctccctgccatccccctct

SEQ ID NO: 2940498 - DNA, 12 bp, Homo sapiens
atctccctgccg

SEQ ID NO: 2940499 - DNA, 15 bp, Homo sapiens
atctccctgccgcct

SEQ ID NO: 2940500 - DNA, 14 bp, Homo sapiens
atctccctgcttca

SEQ ID NO: 2940501 - DNA, 21 bp, Homo sapiens
atccatattacgttgtttctt

SEQ ID NO: 2940502 - DNA, 18 bp, Homo sapiens
atccatattgagtcaaat

SEQ ID NO: 2940503 - DNA, 20 bp, Homo sapiens
atccatattgagtcaaatgg

SEQ ID NO: 2940504 - DNA, 14 bp, Homo sapiens
atccatcagcaatg

SEQ ID NO: 2940505 - DNA, 17 bp, Homo sapiens
atccatccagcttgcca

SEQ ID NO: 2940506 - DNA, 16 bp, Homo sapiens
atccatccatgtactt

SEQ ID NO: 2940507 - DNA, 23 bp, Homo sapiens
atccatgcggagtccattatttg

SEQ ID NO: 2940508 - DNA, 16 bp, Homo sapiens
atccatgggtctggct

SEQ ID NO: 2940509 - DNA, 14 bp, Homo sapiens
atccattatcatgt

SEQ ID NO: 2940510 - DNA, 15 bp, Homo sapiens
atccattatcatgtg

SEQ ID NO: 2940511 - DNA, 18 bp, Homo sapiens
atccattatcatgtgtaa

SEQ ID NO: 2940512 - DNA, 18 bp, Homo sapiens
atccattcctcagggaca

SEQ ID NO: 2940513 - DNA, 14 bp, Homo sapiens
atccattgtgttct

SEQ ID NO: 2940514 - DNA, 20 bp, Homo sapiens
atccatttggcagaactgct

SEQ ID NO: 2940515 - DNA, 20 bp, Homo sapiens
atcccaaagcaaggagatca

SEQ ID NO: 2940516 - DNA, 17 bp, Homo sapiens
atcccaacactgccagc

SEQ ID NO: 2940517 - DNA, 17 bp, Homo sapiens
atcccaagtagaatctc

SEQ ID NO: 2940518 - DNA, 14 bp, Homo sapiens
atcccacagcccta

SEQ ID NO: 2940519 - DNA, 20 bp, Homo sapiens
atcccacatcgtataaatat

SEQ ID NO: 2940520 - DNA, 20 bp, Homo sapiens
atcccacccacatgtgacac

SEQ ID NO: 2940521 - DNA, 23 bp, Homo sapiens
atcccacccacatgtgacacata

SEQ ID NO: 2940522 - DNA, 18 bp, Homo sapiens
atcccactggatctggct

SEQ ID NO: 2940523 - DNA, 11 bp, Homo sapiens
atcccagcact

SEQ ID NO: 2940524 - DNA, 13 bp, Homo sapiens
atcccagcacttt

SEQ ID NO: 2940525 - DNA, 22 bp, Homo sapiens
atcccagctttaaaaagaaaaa

SEQ ID NO: 2940526 - DNA, 19 bp, Homo sapiens
atcccagtagtgtttggaa

SEQ ID NO: 2940527 - DNA, 15 bp, Homo sapiens
atcccagtttctgct

SEQ ID NO: 2940528 - DNA, 18 bp, Homo sapiens
atcccatgtaacagaaag

SEQ ID NO: 2940529 - DNA, 23 bp, Homo sapiens
atcccatgtaacagaaagggcaa

SEQ ID NO: 2940530 - DNA, 22 bp, Homo sapiens
atccccaataattgcagaacta

SEQ ID NO: 2940531 - DNA, 16 bp, Homo sapiens
atccccacgacccctg

SEQ ID NO: 2940532 - DNA, 16 bp, Homo sapiens
atccccagagcccagc

SEQ ID NO: 2940533 - DNA, 19 bp, Homo sapiens
atccccagagcccagctct

SEQ ID NO: 2940534 - DNA, 20 bp, Homo sapiens
atccccagagcccagctctt

SEQ ID NO: 2940535 - DNA, 15 bp, Homo sapiens
atccccatcggccct

SEQ ID NO: 2940536 - DNA, 17 bp, Homo sapiens
atccccatcggccctgt

SEQ ID NO: 2940537 - DNA, 15 bp, Homo sapiens
atccccgcacaaagc

SEQ ID NO: 2940538 - DNA, 18 bp, Homo sapiens
atccccgcagtgtgcact

SEQ ID NO: 2940539 - DNA, 17 bp, Homo sapiens
atcccctgtcccctggg

SEQ ID NO: 2940540 - DNA, 18 bp, Homo sapiens
atcccctgtcccctgggg

SEQ ID NO: 2940541 - DNA, 22 bp, Homo sapiens
atcccctgtcccctggggctgg

SEQ ID NO: 2940542 - DNA, 23 bp, Homo sapiens
atccccttacccttagaatccac

SEQ ID NO: 2940543 - DNA, 14 bp, Homo sapiens
atcccgagcacctc

SEQ ID NO: 2940544 - DNA, 23 bp, Homo sapiens
atcccggcggaaagcctctgtcc

SEQ ID NO: 2940545 - DNA, 15 bp, Homo sapiens
atcccggctgaccct

SEQ ID NO: 2940546 - DNA, 21 bp, Homo sapiens
atcccggtgcatgcaggtctc

SEQ ID NO: 2940547 - DNA, 23 bp, Homo sapiens
atcccgttcagaaaaccacttta

SEQ ID NO: 2940548 - DNA, 20 bp, Homo sapiens
atcccgttttccccatgaca

SEQ ID NO: 2940549 - DNA, 22 bp, Homo sapiens
atccctagactttaggctttca

SEQ ID NO: 2940550 - DNA, 22 bp, Homo sapiens
atccctatgtttgtctcacttt

SEQ ID NO: 2940551 - DNA, 17 bp, Homo sapiens
atccctcatctgtccct

SEQ ID NO: 2940552 - DNA, 15 bp, Homo sapiens
atccctcccccagca

SEQ ID NO: 2940553 - DNA, 22 bp, Homo sapiens
atccctcccccccatgcactgt

SEQ ID NO: 2940554 - DNA, 20 bp, Homo sapiens
atccctctacagagcttccc

SEQ ID NO: 2940555 - DNA, 23 bp, Homo sapiens
atccctctacagagcttccctga

SEQ ID NO: 2940556 - DNA, 16 bp, Homo sapiens
atccctgtctttccta

SEQ ID NO: 2940557 - DNA, 13 bp, Homo sapiens
atccctttattac

SEQ ID NO: 2940558 - DNA, 22 bp, Homo sapiens
atccctttattaccccctcctt

SEQ ID NO: 2940559 - DNA, 22 bp, Homo sapiens
atccctttcatgtctttccact

SEQ ID NO: 2940560 - DNA, 19 bp, Homo sapiens
atccgaacctcctctgtga

SEQ ID NO: 2940561 - DNA, 14 bp, Homo sapiens
atccgccagggccc

SEQ ID NO: 2940562 - DNA, 15 bp, Homo sapiens
atccgccagggccca

SEQ ID NO: 2940563 - DNA, 17 bp, Homo sapiens
atccgccagtgtttctg

SEQ ID NO: 2940564 - DNA, 16 bp, Homo sapiens
atccgtagttccctga

SEQ ID NO: 2940565 - DNA, 18 bp, Homo sapiens
atcctaagcatctaagtt

SEQ ID NO: 2940566 - DNA, 23 bp, Homo sapiens
atcctaagggtcgaaagctctag

SEQ ID NO: 2940567 - DNA, 16 bp, Homo sapiens
atcctacaatatttta

SEQ ID NO: 2940568 - DNA, 14 bp, Homo sapiens
atcctaccttttga

SEQ ID NO: 2940569 - DNA, 17 bp, Homo sapiens
atcctaccttttgataa

SEQ ID NO: 2940570 - DNA, 15 bp, Homo sapiens
atcctagatcctaag

SEQ ID NO: 2940571 - DNA, 13 bp, Homo sapiens
atcctagattata

SEQ ID NO: 2940572 - DNA, 17 bp, Homo sapiens
atcctagattatatcaa

SEQ ID NO: 2940573 - DNA, 23 bp, Homo sapiens
atcctagattatatcaaagtatt

SEQ ID NO: 2940574 - DNA, 20 bp, Homo sapiens
atcctagtctctatcattaa

SEQ ID NO: 2940575 - DNA, 16 bp, Homo sapiens
atcctatgtgatttta

SEQ ID NO: 2940576 - DNA, 17 bp, Homo sapiens
atcctatgtgattttaa

SEQ ID NO: 2940577 - DNA, 23 bp, Homo sapiens
atcctatgtgattttaactctgt

SEQ ID NO: 2940578 - DNA, 11 bp, Homo sapiens
atcctcagtgc

SEQ ID NO: 2940579 - DNA, 19 bp, Homo sapiens
atcctcagtgcaaaatgtc

SEQ ID NO: 2940580 - DNA, 22 bp, Homo sapiens
atcctcagtgcaaaatgtcttg

SEQ ID NO: 2940581 - DNA, 19 bp, Homo sapiens
atcctcagtttttgtgaaa

SEQ ID NO: 2940582 - DNA, 19 bp, Homo sapiens
atcctccaaccaggctcct

SEQ ID NO: 2940583 - DNA, 13 bp, Homo sapiens
atcctccagccct

SEQ ID NO: 2940584 - DNA, 23 bp, Homo sapiens
atcctcccaatctcaatacagcc

SEQ ID NO: 2940585 - DNA, 17 bp, Homo sapiens
atcctccccaccagagc

SEQ ID NO: 2940586 - DNA, 13 bp, Homo sapiens
atcctcctcctca

SEQ ID NO: 2940587 - DNA, 16 bp, Homo sapiens
atcctcctcctcattc

SEQ ID NO: 2940588 - DNA, 12 bp, Homo sapiens
atcctcctctcc

SEQ ID NO: 2940589 - DNA, 18 bp, Homo sapiens
atcctcctctccatgcaa

SEQ ID NO: 2940590 - DNA, 20 bp, Homo sapiens
atcctctgtaaactttttgt

SEQ ID NO: 2940591 - DNA, 14 bp, Homo sapiens
atcctctttttcca

SEQ ID NO: 2940592 - DNA, 11 bp, Homo sapiens
atcctgcaagg

SEQ ID NO: 2940593 - DNA, 15 bp, Homo sapiens
atcagaactgaaata

SEQ ID NO: 2940594 - DNA, 14 bp, Homo sapiens
atcagaagaaaggc

SEQ ID NO: 2940595 - DNA, 17 bp, Homo sapiens
atcagaagtaactccca

SEQ ID NO: 2940596 - DNA, 22 bp, Homo sapiens
atcagaagtaactcccactcct

SEQ ID NO: 2940597 - DNA, 11 bp, Homo sapiens
atcagaataaa

SEQ ID NO: 2940598 - DNA, 12 bp, Homo sapiens
atcagaataaat

SEQ ID NO: 2940599 - DNA, 17 bp, Homo sapiens
atcagaattgaaacact

SEQ ID NO: 2940600 - DNA, 10 bp, Homo sapiens
atcagacagc

SEQ ID NO: 2940601 - DNA, 18 bp, Homo sapiens
atcagaccctaccccacc

SEQ ID NO: 2940602 - DNA, 14 bp, Homo sapiens
atcagagggctgat

SEQ ID NO: 2940603 - DNA, 22 bp, Homo sapiens
atcagatgcaattgctcccatc

SEQ ID NO: 2940604 - DNA, 22 bp, Homo sapiens
atcagatgctccaagattctag

SEQ ID NO: 2940605 - DNA, 14 bp, Homo sapiens
atcagattgcatgt

SEQ ID NO: 2940606 - DNA, 15 bp, Homo sapiens
atcagattgcatgtg

SEQ ID NO: 2940607 - DNA, 19 bp, Homo sapiens
atcagatttgtaatggctc

SEQ ID NO: 2940608 - DNA, 16 bp, Homo sapiens
atcagcaaacacaata

SEQ ID NO: 2940609 - DNA, 17 bp, Homo sapiens
atcagcagaacctgtag

SEQ ID NO: 2940610 - DNA, 13 bp, Homo sapiens
atcagccagctgc

SEQ ID NO: 2940611 - DNA, 15 bp, Homo sapiens
atcagctccttcctg

SEQ ID NO: 2940612 - DNA, 17 bp, Homo sapiens
atcagctccttcctgga

SEQ ID NO: 2940613 - DNA, 22 bp, Homo sapiens
atcagctggtcaaacaaactct

SEQ ID NO: 2940614 - DNA, 18 bp, Homo sapiens
atcagctgttgcaggcag

SEQ ID NO: 2940615 - DNA, 19 bp, Homo sapiens
atcagctgttgcaggcagt

SEQ ID NO: 2940616 - DNA, 14 bp, Homo sapiens
atcaggaagcctgt

SEQ ID NO: 2940617 - DNA, 18 bp, Homo sapiens
atcaggagttccagtgct

SEQ ID NO: 2940618 - DNA, 15 bp, Homo sapiens
atcaggcacaggtca

SEQ ID NO: 2940619 - DNA, 13 bp, Homo sapiens
atcaggtggggag

SEQ ID NO: 2940620 - DNA, 20 bp, Homo sapiens
atcagtacatgagccaaaaa

SEQ ID NO: 2940621 - DNA, 21 bp, Homo sapiens
atcagtccctatgtatttgca

SEQ ID NO: 2940622 - DNA, 13 bp, Homo sapiens
atcagtgactgaa

SEQ ID NO: 2940623 - DNA, 12 bp, Homo sapiens
atcagtgccagc

SEQ ID NO: 2940624 - DNA, 19 bp, Homo sapiens
atcagtgccagcccctgct

SEQ ID NO: 2940625 - DNA, 15 bp, Homo sapiens
atcagtgctccctca

SEQ ID NO: 2940626 - DNA, 16 bp, Homo sapiens
atcagtggacagtctg

SEQ ID NO: 2940627 - DNA, 13 bp, Homo sapiens
atcagtgtttaca

SEQ ID NO: 2940628 - DNA, 15 bp, Homo sapiens
atcagttactcagcc

SEQ ID NO: 2940629 - DNA, 19 bp, Homo sapiens
atcagttactcagccctgg

SEQ ID NO: 2940630 - DNA, 21 bp, Homo sapiens
atcagttactcagccctgggc

SEQ ID NO: 2940631 - DNA, 18 bp, Homo sapiens
atcagttactctgaaggg

SEQ ID NO: 2940632 - DNA, 17 bp, Homo sapiens
atcagttcactgctgca

SEQ ID NO: 2940633 - DNA, 13 bp, Homo sapiens
atcataaggcttc

SEQ ID NO: 2940634 - DNA, 18 bp, Homo sapiens
atcataattaccaagtga

SEQ ID NO: 2940635 - DNA, 21 bp, Homo sapiens
atcatagcaagacctcatctc

SEQ ID NO: 2940636 - DNA, 18 bp, Homo sapiens
atcatatgaattgctgtc

SEQ ID NO: 2940637 - DNA, 17 bp, Homo sapiens
atcatatttgaaaacca

SEQ ID NO: 2940638 - DNA, 20 bp, Homo sapiens
atcatcatttaaaaaaaaag

SEQ ID NO: 2940639 - DNA, 15 bp, Homo sapiens
atcatccacgccaag

SEQ ID NO: 2940640 - DNA, 12 bp, Homo sapiens
atcatccctccc

SEQ ID NO: 2940641 - DNA, 20 bp, Homo sapiens
atcatcctcccttttttgta

SEQ ID NO: 2940642 - DNA, 22 bp, Homo sapiens
atcatcctttgttctgagcatt

SEQ ID NO: 2940643 - DNA, 13 bp, Homo sapiens
atcatcgccagag

SEQ ID NO: 2940644 - DNA, 20 bp, Homo sapiens
atcatcgccagaggtgcttc

SEQ ID NO: 2940645 - DNA, 19 bp, Homo sapiens
atcatctaattctctgtgg

SEQ ID NO: 2940646 - DNA, 23 bp, Homo sapiens
atcatctgaaggggcaaattctt

SEQ ID NO: 2940647 - DNA, 22 bp, Homo sapiens
atcatctgctgcacatagcaga

SEQ ID NO: 2940648 - DNA, 13 bp, Homo sapiens
atcatctgctgtg

SEQ ID NO: 2940649 - DNA, 12 bp, Homo sapiens
atcatctttgct

SEQ ID NO: 2940650 - DNA, 22 bp, Homo sapiens
atcatctttgctgaatgtcatt

SEQ ID NO: 2940651 - DNA, 12 bp, Homo sapiens
atcatctttttg

SEQ ID NO: 2940652 - DNA, 16 bp, Homo sapiens
atcatgaaattactta

SEQ ID NO: 2940653 - DNA, 15 bp, Homo sapiens
atcatgaactggctt

SEQ ID NO: 2940654 - DNA, 20 bp, Homo sapiens
atcatgaactggcttgtaca

SEQ ID NO: 2940655 - DNA, 19 bp, Homo sapiens
atcatgaatctttgtttca

SEQ ID NO: 2940656 - DNA, 23 bp, Homo sapiens
atcatgaattcccttttaatcaa

SEQ ID NO: 2940657 - DNA, 15 bp, Homo sapiens
atcatgagcctgttt

SEQ ID NO: 2940658 - DNA, 16 bp, Homo sapiens
atcatgagcctgttta

SEQ ID NO: 2940659 - DNA, 24 bp, Homo sapiens
atcatgagcctgtttattgccatt

SEQ ID NO: 2940660 - DNA, 20 bp, Homo sapiens
atcatgaggccggatgaaac

SEQ ID NO: 2940661 - DNA, 16 bp, Homo sapiens
atcatgctaaaattct

SEQ ID NO: 2940662 - DNA, 17 bp, Homo sapiens
atcatgctaaaattcta

SEQ ID NO: 2940663 - DNA, 19 bp, Homo sapiens
atcatggaatggttataaa

SEQ ID NO: 2940664 - DNA, 14 bp, Homo sapiens
atcatgtaaatgta

SEQ ID NO: 2940665 - DNA, 22 bp, Homo sapiens
atcatgtaaatgtattggcaca

SEQ ID NO: 2940666 - DNA, 17 bp, Homo sapiens
atcatgtagtatcaaat

SEQ ID NO: 2940667 - DNA, 19 bp, Homo sapiens
atcatgtagtatcaaatat

SEQ ID NO: 2940668 - DNA, 21 bp, Homo sapiens
atcatgtagtatcaaatatta

SEQ ID NO: 2940669 - DNA, 22 bp, Homo sapiens
atcatgttttttctgcaatgac

SEQ ID NO: 2940670 - DNA, 21 bp, Homo sapiens
atcattaaaagaacataagtt

SEQ ID NO: 2940671 - DNA, 11 bp, Homo sapiens
atcattaaagt

SEQ ID NO: 2940672 - DNA, 14 bp, Homo sapiens
atcattagttttag

SEQ ID NO: 2940673 - DNA, 21 bp, Homo sapiens
atcattcataaaagtttgcat

SEQ ID NO: 2940674 - DNA, 13 bp, Homo sapiens
atcattccctctc

SEQ ID NO: 2940675 - DNA, 16 bp, Homo sapiens
atcattgctgtctgca

SEQ ID NO: 2940676 - DNA, 21 bp, Homo sapiens
atcattgctgtctgcagcctt

SEQ ID NO: 2940677 - DNA, 22 bp, Homo sapiens
atcattgctgtctgcagccttg

SEQ ID NO: 2940678 - DNA, 19 bp, Homo sapiens
atcattgcttcctcctccc

SEQ ID NO: 2940679 - DNA, 17 bp, Homo sapiens
atcatttaaaaaaaaag

SEQ ID NO: 2940680 - DNA, 13 bp, Homo sapiens
atcatttcagcca

SEQ ID NO: 2940681 - DNA, 16 bp, Homo sapiens
atcatttcagccaaag

SEQ ID NO: 2940682 - DNA, 16 bp, Homo sapiens
atcattttgttttcca

SEQ ID NO: 2940683 - DNA, 18 bp, Homo sapiens
atccaaaagaagccccca

SEQ ID NO: 2940684 - DNA, 14 bp, Homo sapiens
atccaaaatgtgta

SEQ ID NO: 2940685 - DNA, 15 bp, Homo sapiens
atccaaaggaatcag

SEQ ID NO: 2940686 - DNA, 19 bp, Homo sapiens
atccaaatctgtcctctgt

SEQ ID NO: 2940687 - DNA, 14 bp, Homo sapiens
atccaaatgctgtg

SEQ ID NO: 2940688 - DNA, 22 bp, Homo sapiens
atccaaatgctgtgcaaacagt

SEQ ID NO: 2940689 - DNA, 14 bp, Homo sapiens
atccaacagacctg

SEQ ID NO: 2940690 - DNA, 19 bp, Homo sapiens
atccaaggggctagctgga

SEQ ID NO: 2940691 - DNA, 19 bp, Homo sapiens
atccaatatgactcagaga

SEQ ID NO: 2940692 - DNA, 16 bp, Homo sapiens
atccaatcagagacca

SEQ ID NO: 2940693 - DNA, 22 bp, Homo sapiens
atccaatggactgcataaataa

SEQ ID NO: 2940694 - DNA, 16 bp, Homo sapiens
atccacatgaaaataa

SEQ ID NO: 2940695 - DNA, 17 bp, Homo sapiens
atccacattgttttaaa

SEQ ID NO: 2940696 - DNA, 16 bp, Homo sapiens
atccacattttaacag

SEQ ID NO: 2940697 - DNA, 14 bp, Homo sapiens
atccacccagccca

SEQ ID NO: 2940698 - DNA, 20 bp, Homo sapiens
atccacccgccttcagcctc

SEQ ID NO: 2940699 - DNA, 21 bp, Homo sapiens
atccacgtattccccttccca

SEQ ID NO: 2940700 - DNA, 22 bp, Homo sapiens
atccacttctttcagcagactg

SEQ ID NO: 2940701 - DNA, 19 bp, Homo sapiens
atccagagtccctgcctgg

SEQ ID NO: 2940702 - DNA, 21 bp, Homo sapiens
atccagagtccctgcctggac

SEQ ID NO: 2940703 - DNA, 20 bp, Homo sapiens
atccagatacacccaaagta

SEQ ID NO: 2940704 - DNA, 20 bp, Homo sapiens
atccagatggtgggatgtgg

SEQ ID NO: 2940705 - DNA, 18 bp, Homo sapiens
atccagcagtctctgcct

SEQ ID NO: 2940706 - DNA, 22 bp, Homo sapiens
atccagcattgttgagctgtca

SEQ ID NO: 2940707 - DNA, 19 bp, Homo sapiens
atccagccggaggccagag

SEQ ID NO: 2940708 - DNA, 22 bp, Homo sapiens
atccagctacttagctggccaa

SEQ ID NO: 2940709 - DNA, 15 bp, Homo sapiens
atccagctgtgtgtt

SEQ ID NO: 2940710 - DNA, 20 bp, Homo sapiens
atccagcttgccagatgctg

SEQ ID NO: 2940711 - DNA, 23 bp, Homo sapiens
atccaggactatatttgggcctg

SEQ ID NO: 2940712 - DNA, 14 bp, Homo sapiens
atccaggcagatcc

SEQ ID NO: 2940713 - DNA, 15 bp, Homo sapiens
atccaggcagatcca

SEQ ID NO: 2940714 - DNA, 24 bp, Homo sapiens
atccaggctggccagtgctgccca

SEQ ID NO: 2940715 - DNA, 13 bp, Homo sapiens
atccaggcttctc

SEQ ID NO: 2940716 - DNA, 22 bp, Homo sapiens
atccaggcttctcccggacctg

SEQ ID NO: 2940717 - DNA, 23 bp, Homo sapiens
atccaggcttctcccggacctgg

SEQ ID NO: 2940718 - DNA, 16 bp, Homo sapiens
atccagggacagaggc

SEQ ID NO: 2940719 - DNA, 21 bp, Homo sapiens
atccagggacagaggccccag

SEQ ID NO: 2940720 - DNA, 14 bp, Homo sapiens
atccaggtaatcca

SEQ ID NO: 2940721 - DNA, 20 bp, Homo sapiens
atccaggtacgcacagacag

SEQ ID NO: 2940722 - DNA, 14 bp, Homo sapiens
atccaggtcaacag

SEQ ID NO: 2940723 - DNA, 20 bp, Homo sapiens
atccaggtcaacagaatgaa

SEQ ID NO: 2940724 - DNA, 23 bp, Homo sapiens
atccaggtcaacagaatgaaaaa

SEQ ID NO: 2940725 - DNA, 17 bp, Homo sapiens
atccagtagggaaaata

SEQ ID NO: 2940726 - DNA, 17 bp, Homo sapiens
atccataaagaagcaat

SEQ ID NO: 2940727 - DNA, 21 bp, Homo sapiens
atccataaagaagcaataaag

SEQ ID NO: 2940728 - DNA, 18 bp, Homo sapiens
atccatagtaactgacat

SEQ ID NO: 2940729 - DNA, 13 bp, Homo sapiens
atattgtctgtaa

SEQ ID NO: 2940730 - DNA, 17 bp, Homo sapiens
atattgtgtttgtgtat

SEQ ID NO: 2940731 - DNA, 21 bp, Homo sapiens
atattgtgtttgtgtatttac

SEQ ID NO: 2940732 - DNA, 20 bp, Homo sapiens
atatttaaaaaaaaaatcag

SEQ ID NO: 2940733 - DNA, 21 bp, Homo sapiens
atatttaaaaaaaaaatcagt

SEQ ID NO: 2940734 - DNA, 15 bp, Homo sapiens
atatttaaaagacaa

SEQ ID NO: 2940735 - DNA, 22 bp, Homo sapiens
atatttaaaggccctatctgtt

SEQ ID NO: 2940736 - DNA, 16 bp, Homo sapiens
atatttaactggtgca

SEQ ID NO: 2940737 - DNA, 18 bp, Homo sapiens
atatttaagcaacatctt

SEQ ID NO: 2940738 - DNA, 14 bp, Homo sapiens
atatttaatgtttt

SEQ ID NO: 2940739 - DNA, 20 bp, Homo sapiens
atatttaatgttttaaatgt

SEQ ID NO: 2940740 - DNA, 19 bp, Homo sapiens
atatttagcaaataatttc

SEQ ID NO: 2940741 - DNA, 14 bp, Homo sapiens
atatttatgaccag

SEQ ID NO: 2940742 - DNA, 19 bp, Homo sapiens
atatttatgaccagagcaa

SEQ ID NO: 2940743 - DNA, 21 bp, Homo sapiens
atatttcaataaatgatatat

SEQ ID NO: 2940744 - DNA, 20 bp, Homo sapiens
atatttcagtgatttttagt

SEQ ID NO: 2940745 - DNA, 22 bp, Homo sapiens
atatttcagtgatttttagtaa

SEQ ID NO: 2940746 - DNA, 17 bp, Homo sapiens
atatttccaatgtgaaa

SEQ ID NO: 2940747 - DNA, 19 bp, Homo sapiens
atatttccctgaaggaacc

SEQ ID NO: 2940748 - DNA, 21 bp, Homo sapiens
atatttccctgaaggaaccaa

SEQ ID NO: 2940749 - DNA, 12 bp, Homo sapiens
atatttcttaag

SEQ ID NO: 2940750 - DNA, 16 bp, Homo sapiens
atatttcttcaagtga

SEQ ID NO: 2940751 - DNA, 14 bp, Homo sapiens
atatttcttgcttt

SEQ ID NO: 2940752 - DNA, 18 bp, Homo sapiens
atatttgaaaaccatatt

SEQ ID NO: 2940753 - DNA, 15 bp, Homo sapiens
atatttgaagcagct

SEQ ID NO: 2940754 - DNA, 22 bp, Homo sapiens
atatttgaagcagctctgcctt

SEQ ID NO: 2940755 - DNA, 18 bp, Homo sapiens
atatttgaattggcctga

SEQ ID NO: 2940756 - DNA, 14 bp, Homo sapiens
atatttgacagaca

SEQ ID NO: 2940757 - DNA, 17 bp, Homo sapiens
atatttgatcacttaaa

SEQ ID NO: 2940758 - DNA, 15 bp, Homo sapiens
atatttgctgtgaag

SEQ ID NO: 2940759 - DNA, 13 bp, Homo sapiens
atattttaataga

SEQ ID NO: 2940760 - DNA, 17 bp, Homo sapiens
atattttaatagaaata

SEQ ID NO: 2940761 - DNA, 14 bp, Homo sapiens
atattttatactgc

SEQ ID NO: 2940762 - DNA, 15 bp, Homo sapiens
atattttatgtgaga

SEQ ID NO: 2940763 - DNA, 20 bp, Homo sapiens
atattttatgtgagagaaag

SEQ ID NO: 2940764 - DNA, 14 bp, Homo sapiens
atattttatttgaa

SEQ ID NO: 2940765 - DNA, 21 bp, Homo sapiens
atattttcaccatttgattat

SEQ ID NO: 2940766 - DNA, 14 bp, Homo sapiens
atattttcagcaaa

SEQ ID NO: 2940767 - DNA, 16 bp, Homo sapiens
atattttccctaccta

SEQ ID NO: 2940768 - DNA, 18 bp, Homo sapiens
atattttccctacctaag

SEQ ID NO: 2940769 - DNA, 14 bp, Homo sapiens
atattttcctctta

SEQ ID NO: 2940770 - DNA, 13 bp, Homo sapiens
atattttctctgt

SEQ ID NO: 2940771 - DNA, 12 bp, Homo sapiens
atattttctgtt

SEQ ID NO: 2940772 - DNA, 14 bp, Homo sapiens
atattttctttcta

SEQ ID NO: 2940773 - DNA, 20 bp, Homo sapiens
atattttctttctagtttgt

SEQ ID NO: 2940774 - DNA, 12 bp, Homo sapiens
atattttgaatc

SEQ ID NO: 2940775 - DNA, 13 bp, Homo sapiens
atattttgaatca

SEQ ID NO: 2940776 - DNA, 17 bp, Homo sapiens
atatttttattcaaact

SEQ ID NO: 2940777 - DNA, 20 bp, Homo sapiens
atattttttatatatacagt

SEQ ID NO: 2940778 - DNA, 13 bp, Homo sapiens
atcaaaagacaat

SEQ ID NO: 2940779 - DNA, 17 bp, Homo sapiens
atcaaaagacaattctt

SEQ ID NO: 2940780 - DNA, 18 bp, Homo sapiens
atcaaaagtgatcagcaa

SEQ ID NO: 2940781 - DNA, 13 bp, Homo sapiens
atcaaaagtgcct

SEQ ID NO: 2940782 - DNA, 20 bp, Homo sapiens
atcaaaataggatttcttaa

SEQ ID NO: 2940783 - DNA, 21 bp, Homo sapiens
atcaaaataggatttcttaaa

SEQ ID NO: 2940784 - DNA, 22 bp, Homo sapiens
atcaaaatgctttttatttctg

SEQ ID NO: 2940785 - DNA, 11 bp, Homo sapiens
atcaaacaacc

SEQ ID NO: 2940786 - DNA, 16 bp, Homo sapiens
atcaaacaaccttcag

SEQ ID NO: 2940787 - DNA, 12 bp, Homo sapiens
atcaaacacaac

SEQ ID NO: 2940788 - DNA, 15 bp, Homo sapiens
atcaaacatgaaaac

SEQ ID NO: 2940789 - DNA, 16 bp, Homo sapiens
atcaaacatgaaaaca

SEQ ID NO: 2940790 - DNA, 18 bp, Homo sapiens
atcaaacatgggtttagt

SEQ ID NO: 2940791 - DNA, 22 bp, Homo sapiens
atcaaacccggcggtcccctcc

SEQ ID NO: 2940792 - DNA, 11 bp, Homo sapiens
atcaaagcagt

SEQ ID NO: 2940793 - DNA, 23 bp, Homo sapiens
atcaaagccggcctgagaaacac

SEQ ID NO: 2940794 - DNA, 18 bp, Homo sapiens
atcaaagcttcaaaaact

SEQ ID NO: 2940795 - DNA, 21 bp, Homo sapiens
atcaaatagaaccactatgaa

SEQ ID NO: 2940796 - DNA, 14 bp, Homo sapiens
atcaaatattagat

SEQ ID NO: 2940797 - DNA, 17 bp, Homo sapiens
atcaaatgcagtatatt

SEQ ID NO: 2940798 - DNA, 22 bp, Homo sapiens
atcaacaataaaatttttttaa

SEQ ID NO: 2940799 - DNA, 18 bp, Homo sapiens
atcaacaatgattaatca

SEQ ID NO: 2940800 - DNA, 12 bp, Homo sapiens
atcaacattctt

SEQ ID NO: 2940801 - DNA, 14 bp, Homo sapiens
atcaactcaagaat

SEQ ID NO: 2940802 - DNA, 20 bp, Homo sapiens
atcaactggggggaccaaat

SEQ ID NO: 2940803 - DNA, 19 bp, Homo sapiens
atcaactttttattgcctt

SEQ ID NO: 2940804 - DNA, 18 bp, Homo sapiens
atcaagagactcctgaag

SEQ ID NO: 2940805 - DNA, 18 bp, Homo sapiens
atcaagagtctctccagc

SEQ ID NO: 2940806 - DNA, 19 bp, Homo sapiens
atcaagagtctctccagcc

SEQ ID NO: 2940807 - DNA, 19 bp, Homo sapiens
atcaaggggtcacttacag

SEQ ID NO: 2940808 - DNA, 18 bp, Homo sapiens
atcaagtacctatattga

SEQ ID NO: 2940809 - DNA, 21 bp, Homo sapiens
atcaagtacctatattgattt

SEQ ID NO: 2940810 - DNA, 19 bp, Homo sapiens
atcaagtactacattttct

SEQ ID NO: 2940811 - DNA, 19 bp, Homo sapiens
atcaagtagaacaaaaact

SEQ ID NO: 2940812 - DNA, 20 bp, Homo sapiens
atcaagtatttgggaagtga

SEQ ID NO: 2940813 - DNA, 23 bp, Homo sapiens
atcaagtctgtttactgcaaggt

SEQ ID NO: 2940814 - DNA, 23 bp, Homo sapiens
atcaagtgttctaaaatgaaata

SEQ ID NO: 2940815 - DNA, 19 bp, Homo sapiens
atcaagtttgaccagtgca

SEQ ID NO: 2940816 - DNA, 11 bp, Homo sapiens
atcaagtttta

SEQ ID NO: 2940817 - DNA, 15 bp, Homo sapiens
atcaataaacgattt

SEQ ID NO: 2940818 - DNA, 19 bp, Homo sapiens
atcaataaacgatttaatt

SEQ ID NO: 2940819 - DNA, 14 bp, Homo sapiens
atcaataaagcact

SEQ ID NO: 2940820 - DNA, 13 bp, Homo sapiens
atcaataagaagg

SEQ ID NO: 2940821 - DNA, 21 bp, Homo sapiens
atcaataatatattttctgtt

SEQ ID NO: 2940822 - DNA, 16 bp, Homo sapiens
atcaatacagtttata

SEQ ID NO: 2940823 - DNA, 14 bp, Homo sapiens
atcaatttaaatgt

SEQ ID NO: 2940824 - DNA, 15 bp, Homo sapiens
atcaatttaaatgtt

SEQ ID NO: 2940825 - DNA, 20 bp, Homo sapiens
atcaatttaaatgtttacta

SEQ ID NO: 2940826 - DNA, 14 bp, Homo sapiens
atcaattttttaaa

SEQ ID NO: 2940827 - DNA, 19 bp, Homo sapiens
atcaattttttaaaccact

SEQ ID NO: 2940828 - DNA, 15 bp, Homo sapiens
atcacaaaagctgtg

SEQ ID NO: 2940829 - DNA, 19 bp, Homo sapiens
atcacaaaagctgtgtctc

SEQ ID NO: 2940830 - DNA, 22 bp, Homo sapiens
atcacaagagtccccagactct

SEQ ID NO: 2940831 - DNA, 19 bp, Homo sapiens
atcacacactttctcttca

SEQ ID NO: 2940832 - DNA, 21 bp, Homo sapiens
atcacaccatcgctggcccct

SEQ ID NO: 2940833 - DNA, 21 bp, Homo sapiens
atcacagctcactgcagcctc

SEQ ID NO: 2940834 - DNA, 17 bp, Homo sapiens
atcacagggtgggcctc

SEQ ID NO: 2940835 - DNA, 21 bp, Homo sapiens
atcacagggtgggcctcggcc

SEQ ID NO: 2940836 - DNA, 15 bp, Homo sapiens
atcacctcattctga

SEQ ID NO: 2940837 - DNA, 19 bp, Homo sapiens
atcacctgaaccccagagg

SEQ ID NO: 2940838 - DNA, 16 bp, Homo sapiens
atcacctgaggtcagg

SEQ ID NO: 2940839 - DNA, 22 bp, Homo sapiens
atcacctgctggggtcctttgt

SEQ ID NO: 2940840 - DNA, 23 bp, Homo sapiens
atcaccttaagaaagtgtctctg

SEQ ID NO: 2940841 - DNA, 18 bp, Homo sapiens
atcaccttaggcagggaa

SEQ ID NO: 2940842 - DNA, 20 bp, Homo sapiens
atcaccttaggcagggaagt

SEQ ID NO: 2940843 - DNA, 15 bp, Homo sapiens
atcacgatgtaaatt

SEQ ID NO: 2940844 - DNA, 20 bp, Homo sapiens
atcacgggcggtcctgcaca

SEQ ID NO: 2940845 - DNA, 13 bp, Homo sapiens
atcacgtgtactg

SEQ ID NO: 2940846 - DNA, 16 bp, Homo sapiens
atcacgtgtactggct

SEQ ID NO: 2940847 - DNA, 17 bp, Homo sapiens
atcactagagtgctctg

SEQ ID NO: 2940848 - DNA, 12 bp, Homo sapiens
atcactcagccc

SEQ ID NO: 2940849 - DNA, 13 bp, Homo sapiens
atcactcgcagga

SEQ ID NO: 2940850 - DNA, 14 bp, Homo sapiens
atcactcgcaggac

SEQ ID NO: 2940851 - DNA, 16 bp, Homo sapiens
atcactcttgtggatg

SEQ ID NO: 2940852 - DNA, 19 bp, Homo sapiens
atcactgaaacaaaaattg

SEQ ID NO: 2940853 - DNA, 19 bp, Homo sapiens
atcactgacacatcagcat

SEQ ID NO: 2940854 - DNA, 16 bp, Homo sapiens
atcactgagttttcca

SEQ ID NO: 2940855 - DNA, 17 bp, Homo sapiens
atcactgccttcgttta

SEQ ID NO: 2940856 - DNA, 20 bp, Homo sapiens
atcactgccttcgtttatat

SEQ ID NO: 2940857 - DNA, 19 bp, Homo sapiens
atcactggagcaccaggca

SEQ ID NO: 2940858 - DNA, 23 bp, Homo sapiens
atcactggagcaccaggcacgaa

SEQ ID NO: 2940859 - DNA, 22 bp, Homo sapiens
atcactggttgcacttatgatt

SEQ ID NO: 2940860 - DNA, 15 bp, Homo sapiens
atcactgtggctgtc

SEQ ID NO: 2940861 - DNA, 16 bp, Homo sapiens
atcactgtggctgtct

SEQ ID NO: 2940862 - DNA, 17 bp, Homo sapiens
atcactgtggctgtctg

SEQ ID NO: 2940863 - DNA, 14 bp, Homo sapiens
atcacttaaaactt

SEQ ID NO: 2940864 - DNA, 22 bp, Homo sapiens
atcacttaaaacttttaaaact

SEQ ID NO: 2940865 - DNA, 23 bp, Homo sapiens
atcacttgaatccattgaaagtg

SEQ ID NO: 2940866 - DNA, 13 bp, Homo sapiens
atatatgtacagt

SEQ ID NO: 2940867 - DNA, 14 bp, Homo sapiens
atatatgtacagtt

SEQ ID NO: 2940868 - DNA, 15 bp, Homo sapiens
atatatgtgtttttc

SEQ ID NO: 2940869 - DNA, 17 bp, Homo sapiens
atatattacaagggata

SEQ ID NO: 2940870 - DNA, 14 bp, Homo sapiens
atatattcactttc

SEQ ID NO: 2940871 - DNA, 14 bp, Homo sapiens
atatattcttataa

SEQ ID NO: 2940872 - DNA, 13 bp, Homo sapiens
atatattgtatta

SEQ ID NO: 2940873 - DNA, 21 bp, Homo sapiens
atatatttgtgtatttaacag

SEQ ID NO: 2940874 - DNA, 15 bp, Homo sapiens
atatattttctgttt

SEQ ID NO: 2940875 - DNA, 16 bp, Homo sapiens
atatattttctttcta

SEQ ID NO: 2940876 - DNA, 15 bp, Homo sapiens
atatcaaaattctag

SEQ ID NO: 2940877 - DNA, 13 bp, Homo sapiens
atatcaaagtatt

SEQ ID NO: 2940878 - DNA, 14 bp, Homo sapiens
atatcaaagtattt

SEQ ID NO: 2940879 - DNA, 21 bp, Homo sapiens
atatcaagaagtcagagaaaa

SEQ ID NO: 2940880 - DNA, 18 bp, Homo sapiens
atatcagtgttgtctcat

SEQ ID NO: 2940881 - DNA, 23 bp, Homo sapiens
atatcattataactgaaggagaa

SEQ ID NO: 2940882 - DNA, 18 bp, Homo sapiens
atatccaggtcaacagaa

SEQ ID NO: 2940883 - DNA, 19 bp, Homo sapiens
atatccaggtcaacagaat

SEQ ID NO: 2940884 - DNA, 16 bp, Homo sapiens
atatcccagctttaaa

SEQ ID NO: 2940885 - DNA, 21 bp, Homo sapiens
atatcccagctttaaaaagaa

SEQ ID NO: 2940886 - DNA, 13 bp, Homo sapiens
atatcctgcttga

SEQ ID NO: 2940887 - DNA, 14 bp, Homo sapiens
atatcctttgcctc

SEQ ID NO: 2940888 - DNA, 14 bp, Homo sapiens
atatctaaagttat

SEQ ID NO: 2940889 - DNA, 15 bp, Homo sapiens
atatctaaagttata

SEQ ID NO: 2940890 - DNA, 16 bp, Homo sapiens
atatctaaagttatat

SEQ ID NO: 2940891 - DNA, 13 bp, Homo sapiens
atatctaaattga

SEQ ID NO: 2940892 - DNA, 22 bp, Homo sapiens
atatctaaattgaataatggta

SEQ ID NO: 2940893 - DNA, 17 bp, Homo sapiens
atatctagatttctaga

SEQ ID NO: 2940894 - DNA, 17 bp, Homo sapiens
atatctatatatataat

SEQ ID NO: 2940895 - DNA, 17 bp, Homo sapiens
atatctatatgtacttg

SEQ ID NO: 2940896 - DNA, 15 bp, Homo sapiens
atatctctagtccct

SEQ ID NO: 2940897 - DNA, 22 bp, Homo sapiens
atatctctagtccctgtgttct

SEQ ID NO: 2940898 - DNA, 12 bp, Homo sapiens
atatctctccct

SEQ ID NO: 2940899 - DNA, 16 bp, Homo sapiens
atatctgaagattgaa

SEQ ID NO: 2940900 - DNA, 14 bp, Homo sapiens
atatctgagcaagg

SEQ ID NO: 2940901 - DNA, 12 bp, Homo sapiens
atatctgtatgt

SEQ ID NO: 2940902 - DNA, 15 bp, Homo sapiens
atatctgtatgtatt

SEQ ID NO: 2940903 - DNA, 20 bp, Homo sapiens
atatcttttgtaagacattt

SEQ ID NO: 2940904 - DNA, 17 bp, Homo sapiens
atatctttttcattatt

SEQ ID NO: 2940905 - DNA, 23 bp, Homo sapiens
atatgaaaatacaacttaaataa

SEQ ID NO: 2940906 - DNA, 13 bp, Homo sapiens
atatgaaatattt

SEQ ID NO: 2940907 - DNA, 17 bp, Homo sapiens
atatgaacagggcccag

SEQ ID NO: 2940908 - DNA, 13 bp, Homo sapiens
atatgaagcaagc

SEQ ID NO: 2940909 - DNA, 17 bp, Homo sapiens
atatgaagctcacctgt

SEQ ID NO: 2940910 - DNA, 19 bp, Homo sapiens
atatgaaggtttgagagca

SEQ ID NO: 2940911 - DNA, 23 bp, Homo sapiens
atatgaagtatctaaaagtgtca

SEQ ID NO: 2940912 - DNA, 13 bp, Homo sapiens
atatgaatctgct

SEQ ID NO: 2940913 - DNA, 14 bp, Homo sapiens
atatgaatgcagca

SEQ ID NO: 2940914 - DNA, 23 bp, Homo sapiens
atatgaattgctgtctagcctta

SEQ ID NO: 2940915 - DNA, 22 bp, Homo sapiens
atatgactgtttttcggacagt

SEQ ID NO: 2940916 - DNA, 19 bp, Homo sapiens
atatgagacacaggtggac

SEQ ID NO: 2940917 - DNA, 13 bp, Homo sapiens
atatgagactttc

SEQ ID NO: 2940918 - DNA, 15 bp, Homo sapiens
atatgattaaagaaa

SEQ ID NO: 2940919 - DNA, 15 bp, Homo sapiens
atatgattgtttgca

SEQ ID NO: 2940920 - DNA, 13 bp, Homo sapiens
atatgatttaaaa

SEQ ID NO: 2940921 - DNA, 17 bp, Homo sapiens
atatgcacccctggaac

SEQ ID NO: 2940922 - DNA, 20 bp, Homo sapiens
atatgcaccttgtgtctgta

SEQ ID NO: 2940923 - DNA, 14 bp, Homo sapiens
atatgcacttataa

SEQ ID NO: 2940924 - DNA, 20 bp, Homo sapiens
atatgcattgtctgcaatgg

SEQ ID NO: 2940925 - DNA, 21 bp, Homo sapiens
atatgcctgtaattcagtgta

SEQ ID NO: 2940926 - DNA, 13 bp, Homo sapiens
atatgcttagtaa

SEQ ID NO: 2940927 - DNA, 20 bp, Homo sapiens
atatggacacttaatactac

SEQ ID NO: 2940928 - DNA, 13 bp, Homo sapiens
atatggacagtta

SEQ ID NO: 2940929 - DNA, 15 bp, Homo sapiens
atatggactctgcac

SEQ ID NO: 2940930 - DNA, 16 bp, Homo sapiens
atatggactctgcaca

SEQ ID NO: 2940931 - DNA, 15 bp, Homo sapiens
atatggcctcaagat

SEQ ID NO: 2940932 - DNA, 22 bp, Homo sapiens
atatggtactaaggagaattaa

SEQ ID NO: 2940933 - DNA, 15 bp, Homo sapiens
atatggtatatatac

SEQ ID NO: 2940934 - DNA, 18 bp, Homo sapiens
atatggtatatatacata

SEQ ID NO: 2940935 - DNA, 17 bp, Homo sapiens
atatgtacttgtcaaag

SEQ ID NO: 2940936 - DNA, 19 bp, Homo sapiens
atatgtacttgtcaaagaa

SEQ ID NO: 2940937 - DNA, 20 bp, Homo sapiens
atatgtacttgtcaaagaag

SEQ ID NO: 2940938 - DNA, 19 bp, Homo sapiens
atatgtagtaaactctcat

SEQ ID NO: 2940939 - DNA, 22 bp, Homo sapiens
atatgtatacacaaatatatac

SEQ ID NO: 2940940 - DNA, 23 bp, Homo sapiens
atatgtattaataaatagagcaa

SEQ ID NO: 2940941 - DNA, 13 bp, Homo sapiens
atatgtcaaattg

SEQ ID NO: 2940942 - DNA, 23 bp, Homo sapiens
atatgtgcttgtgctcatgtgtg

SEQ ID NO: 2940943 - DNA, 14 bp, Homo sapiens
atatgtgtatgtac

SEQ ID NO: 2940944 - DNA, 22 bp, Homo sapiens
atatgtgtatgtacgtttgtat

SEQ ID NO: 2940945 - DNA, 19 bp, Homo sapiens
atatgtgtttttcacattt

SEQ ID NO: 2940946 - DNA, 18 bp, Homo sapiens
atatgttaataaactgca

SEQ ID NO: 2940947 - DNA, 18 bp, Homo sapiens
atatgttgaatacttttt

SEQ ID NO: 2940948 - DNA, 21 bp, Homo sapiens
atatgttgactttatttctga

SEQ ID NO: 2940949 - DNA, 15 bp, Homo sapiens
atatgttttatttca

SEQ ID NO: 2940950 - DNA, 20 bp, Homo sapiens
atatgttttccttttattca

SEQ ID NO: 2940951 - DNA, 15 bp, Homo sapiens
atattaaaagtcaca

SEQ ID NO: 2940952 - DNA, 15 bp, Homo sapiens
atattaaaatttggt

SEQ ID NO: 2940953 - DNA, 19 bp, Homo sapiens
atattaaaatttggtgctt

SEQ ID NO: 2940954 - DNA, 19 bp, Homo sapiens
atattaaaggtgaaaattg

SEQ ID NO: 2940955 - DNA, 20 bp, Homo sapiens
atattaaaggtgaaaattgt

SEQ ID NO: 2940956 - DNA, 14 bp, Homo sapiens
atattaaataacat

SEQ ID NO: 2940957 - DNA, 22 bp, Homo sapiens
atattaaataacatgtttctct

SEQ ID NO: 2940958 - DNA, 13 bp, Homo sapiens
atattaaatctgc

SEQ ID NO: 2940959 - DNA, 16 bp, Homo sapiens
atattaaatgttgctt

SEQ ID NO: 2940960 - DNA, 19 bp, Homo sapiens
atattaaattctcaaagtt

SEQ ID NO: 2940961 - DNA, 22 bp, Homo sapiens
atattaactactgtagaactga

SEQ ID NO: 2940962 - DNA, 22 bp, Homo sapiens
atattaagaaaaatatcaagta

SEQ ID NO: 2940963 - DNA, 18 bp, Homo sapiens
atattaagaaacaattta

SEQ ID NO: 2940964 - DNA, 21 bp, Homo sapiens
atattactgtcttttctatta

SEQ ID NO: 2940965 - DNA, 14 bp, Homo sapiens
atattagatgtgat

SEQ ID NO: 2940966 - DNA, 16 bp, Homo sapiens
atattagatgtgattt

SEQ ID NO: 2940967 - DNA, 17 bp, Homo sapiens
atattagatgtgattta

SEQ ID NO: 2940968 - DNA, 20 bp, Homo sapiens
atattagctttactgtttgt

SEQ ID NO: 2940969 - DNA, 13 bp, Homo sapiens
atattatatatac

SEQ ID NO: 2940970 - DNA, 21 bp, Homo sapiens
atattatcatgcaaatgctgt

SEQ ID NO: 2940971 - DNA, 14 bp, Homo sapiens
atattatctacctg

SEQ ID NO: 2940972 - DNA, 22 bp, Homo sapiens
atattatctacctgttctgtag

SEQ ID NO: 2940973 - DNA, 23 bp, Homo sapiens
atattatctacctgttctgtagc

SEQ ID NO: 2940974 - DNA, 16 bp, Homo sapiens
atattatgagatgctg

SEQ ID NO: 2940975 - DNA, 21 bp, Homo sapiens
atattatgtatttatattttg

SEQ ID NO: 2940976 - DNA, 22 bp, Homo sapiens
atattattagttttgatttaat

SEQ ID NO: 2940977 - DNA, 13 bp, Homo sapiens
atattatttctag

SEQ ID NO: 2940978 - DNA, 18 bp, Homo sapiens
atattcaccaatgttgta

SEQ ID NO: 2940979 - DNA, 19 bp, Homo sapiens
atattcagaatctttgtta

SEQ ID NO: 2940980 - DNA, 12 bp, Homo sapiens
atattcagaatt

SEQ ID NO: 2940981 - DNA, 17 bp, Homo sapiens
atattcagaattatgat

SEQ ID NO: 2940982 - DNA, 21 bp, Homo sapiens
atattcatttaaaacattgca

SEQ ID NO: 2940983 - DNA, 23 bp, Homo sapiens
atattccctagaaacttccaaat

SEQ ID NO: 2940984 - DNA, 14 bp, Homo sapiens
atattctgtacatt

SEQ ID NO: 2940985 - DNA, 13 bp, Homo sapiens
atattcttataaa

SEQ ID NO: 2940986 - DNA, 22 bp, Homo sapiens
atattcttccttgattgtgtag

SEQ ID NO: 2940987 - DNA, 18 bp, Homo sapiens
atattcttctcttgcttt

SEQ ID NO: 2940988 - DNA, 13 bp, Homo sapiens
atattcttgtaaa

SEQ ID NO: 2940989 - DNA, 16 bp, Homo sapiens
atattgaaaaaaataa

SEQ ID NO: 2940990 - DNA, 20 bp, Homo sapiens
atattgattatagcaatgtg

SEQ ID NO: 2940991 - DNA, 17 bp, Homo sapiens
atattgatttaaaagtg

SEQ ID NO: 2940992 - DNA, 17 bp, Homo sapiens
atattgcaggagacatt

SEQ ID NO: 2940993 - DNA, 13 bp, Homo sapiens
atattggaagaga

SEQ ID NO: 2940994 - DNA, 19 bp, Homo sapiens
atattggtgcgtttttaca

SEQ ID NO: 2940995 - DNA, 22 bp, Homo sapiens
atattggtgcgtttttacagtt

SEQ ID NO: 2940996 - DNA, 12 bp, Homo sapiens
atattgtaaatg

SEQ ID NO: 2940997 - DNA, 18 bp, Homo sapiens
atattgtaaatgctatta

SEQ ID NO: 2940998 - DNA, 18 bp, Homo sapiens
atattgtaatctatgttt

SEQ ID NO: 2940999 - DNA, 19 bp, Homo sapiens
atattgtaatctatgttta

SEQ ID NO: 2941000 - DNA, 23 bp, Homo sapiens
atattgtaatctatgtttataat

SEQ ID NO: 2941001 - DNA, 13 bp, Homo sapiens
atattgtacactt

SEQ ID NO: 2941002 - DNA, 17 bp, Homo sapiens
atattgtattgctgctg

SEQ ID NO: 2941003 - DNA, 23 bp, Homo sapiens
ataagaaaaccaccccttagatt

SEQ ID NO: 2941004 - DNA, 11 bp, Homo sapiens
ataagacatga

SEQ ID NO: 2941005 - DNA, 20 bp, Homo sapiens
ataagagacctgttttaaaa

SEQ ID NO: 2941006 - DNA, 15 bp, Homo sapiens
ataagagtctccttc

SEQ ID NO: 2941007 - DNA, 16 bp, Homo sapiens
ataagagtctccttct

SEQ ID NO: 2941008 - DNA, 17 bp, Homo sapiens
ataagagtctccttctc

SEQ ID NO: 2941009 - DNA, 21 bp, Homo sapiens
ataagagtctccttctcttct

SEQ ID NO: 2941010 - DNA, 17 bp, Homo sapiens
ataagattctaacggtc

SEQ ID NO: 2941011 - DNA, 14 bp, Homo sapiens
ataagcattacttt

SEQ ID NO: 2941012 - DNA, 15 bp, Homo sapiens
ataagcattacttta

SEQ ID NO: 2941013 - DNA, 16 bp, Homo sapiens
ataagccatttctact

SEQ ID NO: 2941014 - DNA, 21 bp, Homo sapiens
ataagcccaaatggctctgtg

SEQ ID NO: 2941015 - DNA, 18 bp, Homo sapiens
ataagcggcgtaagttta

SEQ ID NO: 2941016 - DNA, 21 bp, Homo sapiens
ataagctaacaccagacagac

SEQ ID NO: 2941017 - DNA, 18 bp, Homo sapiens
ataaggaaagcaataaat

SEQ ID NO: 2941018 - DNA, 22 bp, Homo sapiens
ataaggaaatcaacttgcttat

SEQ ID NO: 2941019 - DNA, 11 bp, Homo sapiens
ataaggcttca

SEQ ID NO: 2941020 - DNA, 18 bp, Homo sapiens
ataaggtaaaatgccatg

SEQ ID NO: 2941021 - DNA, 20 bp, Homo sapiens
ataaggtgttttctgtgtaa

SEQ ID NO: 2941022 - DNA, 21 bp, Homo sapiens
ataaggtgttttctgtgtaac

SEQ ID NO: 2941023 - DNA, 15 bp, Homo sapiens
atacatacaccagca

SEQ ID NO: 2941024 - DNA, 14 bp, Homo sapiens
atacatagacattt

SEQ ID NO: 2941025 - DNA, 18 bp, Homo sapiens
atacatagacatttcaaa

SEQ ID NO: 2941026 - DNA, 20 bp, Homo sapiens
atacatagacatttcaaaat

SEQ ID NO: 2941027 - DNA, 14 bp, Homo sapiens
atacatatgtagaa

SEQ ID NO: 2941028 - DNA, 17 bp, Homo sapiens
atacatcaatatgtata

SEQ ID NO: 2941029 - DNA, 13 bp, Homo sapiens
atacatcactgta

SEQ ID NO: 2941030 - DNA, 13 bp, Homo sapiens
atacatcacttcc

SEQ ID NO: 2941031 - DNA, 20 bp, Homo sapiens
atacatcacttcctgtttta

SEQ ID NO: 2941032 - DNA, 22 bp, Homo sapiens
atacatcctttttctgctaacc

SEQ ID NO: 2941033 - DNA, 19 bp, Homo sapiens
atagcatgacatttctttg

SEQ ID NO: 2941034 - DNA, 13 bp, Homo sapiens
atagcatgcatct

SEQ ID NO: 2941035 - DNA, 16 bp, Homo sapiens
atagccacatttggaa

SEQ ID NO: 2941036 - DNA, 23 bp, Homo sapiens
atagccacatttggaatactttt

SEQ ID NO: 2941037 - DNA, 11 bp, Homo sapiens
atagccacctt

SEQ ID NO: 2941038 - DNA, 23 bp, Homo sapiens
atagccatgtatcataattacca

SEQ ID NO: 2941039 - DNA, 24 bp, Homo sapiens
atagccccagactgggcccaggca

SEQ ID NO: 2941040 - DNA, 21 bp, Homo sapiens
atagccctggtgctcctgccc

SEQ ID NO: 2941041 - DNA, 23 bp, Homo sapiens
atagccctggtgctcctgcccag

SEQ ID NO: 2941042 - DNA, 19 bp, Homo sapiens
atagccgaactccaggctg

SEQ ID NO: 2941043 - DNA, 11 bp, Homo sapiens
atagcctggac

SEQ ID NO: 2941044 - DNA, 18 bp, Homo sapiens
atagcctggactgctacc

SEQ ID NO: 2941045 - DNA, 11 bp, Homo sapiens
atagcctgtgg

SEQ ID NO: 2941046 - DNA, 16 bp, Homo sapiens
atagccttgaaaacaa

SEQ ID NO: 2941047 - DNA, 22 bp, Homo sapiens
atagccttgaaaacaaacaaat

SEQ ID NO: 2941048 - DNA, 18 bp, Homo sapiens
atagcgtcctgccctgcc

SEQ ID NO: 2941049 - DNA, 14 bp, Homo sapiens
atagctaactgtaa

SEQ ID NO: 2941050 - DNA, 17 bp, Homo sapiens
atagctactaattttaa

SEQ ID NO: 2941051 - DNA, 18 bp, Homo sapiens
atagctactaattttaaa

SEQ ID NO: 2941052 - DNA, 16 bp, Homo sapiens
atagctagagcttttc

SEQ ID NO: 2941053 - DNA, 17 bp, Homo sapiens
atagctcaatactctct

SEQ ID NO: 2941054 - DNA, 15 bp, Homo sapiens
atagctccaagctgt

SEQ ID NO: 2941055 - DNA, 19 bp, Homo sapiens
atagctccaagctgttaaa

SEQ ID NO: 2941056 - DNA, 21 bp, Homo sapiens
atagctcgagccggtccaatt

SEQ ID NO: 2941057 - DNA, 19 bp, Homo sapiens
atagctctacacaacatgt

SEQ ID NO: 2941058 - DNA, 22 bp, Homo sapiens
atagctctacacaacatgtatg

SEQ ID NO: 2941059 - DNA, 20 bp, Homo sapiens
atagctcttcacttcctcca

SEQ ID NO: 2941060 - DNA, 21 bp, Homo sapiens
atagctcttcacttcctccag

SEQ ID NO: 2941061 - DNA, 14 bp, Homo sapiens
atagctgatcagtt

SEQ ID NO: 2941062 - DNA, 15 bp, Homo sapiens
atagctgtattgaat

SEQ ID NO: 2941063 - DNA, 16 bp, Homo sapiens
atagctgtattgaatc

SEQ ID NO: 2941064 - DNA, 18 bp, Homo sapiens
atagctgtattgaatcat

SEQ ID NO: 2941065 - DNA, 14 bp, Homo sapiens
atagctttagtgaa

SEQ ID NO: 2941066 - DNA, 16 bp, Homo sapiens
ataggaacatatgaaa

SEQ ID NO: 2941067 - DNA, 23 bp, Homo sapiens
ataggaagttcttttttgtacag

SEQ ID NO: 2941068 - DNA, 15 bp, Homo sapiens
ataggacaaatgata

SEQ ID NO: 2941069 - DNA, 14 bp, Homo sapiens
ataggactgtggca

SEQ ID NO: 2941070 - DNA, 21 bp, Homo sapiens
ataggagggggcggcagggct

SEQ ID NO: 2941071 - DNA, 17 bp, Homo sapiens
ataggcaagtcacactg

SEQ ID NO: 2941072 - DNA, 18 bp, Homo sapiens
ataggcaagtcacactgc

SEQ ID NO: 2941073 - DNA, 20 bp, Homo sapiens
ataggcaggaagcccaattg

SEQ ID NO: 2941074 - DNA, 23 bp, Homo sapiens
ataggctctcagtaagaagtctg

SEQ ID NO: 2941075 - DNA, 20 bp, Homo sapiens
atagggtccttgaaacagaa

SEQ ID NO: 2941076 - DNA, 23 bp, Homo sapiens
atagggtctaccaatacaaaatg

SEQ ID NO: 2941077 - DNA, 18 bp, Homo sapiens
ataggtagaatgtaaagc

SEQ ID NO: 2941078 - DNA, 19 bp, Homo sapiens
ataggtaggtatctttata

SEQ ID NO: 2941079 - DNA, 13 bp, Homo sapiens
ataggtatgctta

SEQ ID NO: 2941080 - DNA, 21 bp, Homo sapiens
ataggttttgtttgctatctt

SEQ ID NO: 2941081 - DNA, 18 bp, Homo sapiens
atagtaacatcaaagatt

SEQ ID NO: 2941082 - DNA, 16 bp, Homo sapiens
atagtaactgacatga

SEQ ID NO: 2941083 - DNA, 22 bp, Homo sapiens
atagtaataggatacaatgtat

SEQ ID NO: 2941084 - DNA, 15 bp, Homo sapiens
atagtactaagcatt

SEQ ID NO: 2941085 - DNA, 21 bp, Homo sapiens
atagtagccaaagttaaatgt

SEQ ID NO: 2941086 - DNA, 15 bp, Homo sapiens
atagtaggcatgtta

SEQ ID NO: 2941087 - DNA, 19 bp, Homo sapiens
atagtatgagtaatgctta

SEQ ID NO: 2941088 - DNA, 21 bp, Homo sapiens
atagtatggaagtatttgaga

SEQ ID NO: 2941089 - DNA, 12 bp, Homo sapiens
atagtatttgat

SEQ ID NO: 2941090 - DNA, 21 bp, Homo sapiens
atagtatttgattcaaaatat

SEQ ID NO: 2941091 - DNA, 19 bp, Homo sapiens
atagtcaatgtttctttta

SEQ ID NO: 2941092 - DNA, 17 bp, Homo sapiens
atagtcagagtgtccct

SEQ ID NO: 2941093 - DNA, 13 bp, Homo sapiens
atagtccagagaa

SEQ ID NO: 2941094 - DNA, 22 bp, Homo sapiens
atagtcccaccttggagcattt

SEQ ID NO: 2941095 - DNA, 17 bp, Homo sapiens
atagtctagtgtagtat

SEQ ID NO: 2941096 - DNA, 12 bp, Homo sapiens
atagtctgggtc

SEQ ID NO: 2941097 - DNA, 15 bp, Homo sapiens
atagtgaacacagca

SEQ ID NO: 2941098 - DNA, 17 bp, Homo sapiens
atagtgagatttaagtt

SEQ ID NO: 2941099 - DNA, 10 bp, Homo sapiens
atagtgcaag

SEQ ID NO: 2941100 - DNA, 19 bp, Homo sapiens
atagtggaccacttggaaa

SEQ ID NO: 2941101 - DNA, 22 bp, Homo sapiens
atagtgggccttcattaaatgt

SEQ ID NO: 2941102 - DNA, 12 bp, Homo sapiens
atagtgttaatc

SEQ ID NO: 2941103 - DNA, 15 bp, Homo sapiens
atagtgttaatcaat

SEQ ID NO: 2941104 - DNA, 18 bp, Homo sapiens
atagtgttaatcaattta

SEQ ID NO: 2941105 - DNA, 15 bp, Homo sapiens
atagttagaacctgg

SEQ ID NO: 2941106 - DNA, 15 bp, Homo sapiens
atagttcaaggaact

SEQ ID NO: 2941107 - DNA, 23 bp, Homo sapiens
atagttctagacatggaggttct

SEQ ID NO: 2941108 - DNA, 13 bp, Homo sapiens
atagttgtatttt

SEQ ID NO: 2941109 - DNA, 15 bp, Homo sapiens
atagttgtattttgt

SEQ ID NO: 2941110 - DNA, 15 bp, Homo sapiens
atagttgtctttctt

SEQ ID NO: 2941111 - DNA, 19 bp, Homo sapiens
atagttgtctttctttgct

SEQ ID NO: 2941112 - DNA, 19 bp, Homo sapiens
atagtttcaaatctgtaat

SEQ ID NO: 2941113 - DNA, 17 bp, Homo sapiens
atagtttggcatttgca

SEQ ID NO: 2941114 - DNA, 21 bp, Homo sapiens
atataaaaggcaaatgtgtac

SEQ ID NO: 2941115 - DNA, 24 bp, Homo sapiens
atataaacacattaaaagacaaat

SEQ ID NO: 2941116 - DNA, 23 bp, Homo sapiens
atataaagtttttttatttcttt

SEQ ID NO: 2941117 - DNA, 15 bp, Homo sapiens
atataaatactgaca

SEQ ID NO: 2941118 - DNA, 22 bp, Homo sapiens
atataaatatattttctttcta

SEQ ID NO: 2941119 - DNA, 22 bp, Homo sapiens
atataaatatttggtaattctg

SEQ ID NO: 2941120 - DNA, 18 bp, Homo sapiens
atataaatgggaacattt

SEQ ID NO: 2941121 - DNA, 21 bp, Homo sapiens
atataaatgggaacatttatt

SEQ ID NO: 2941122 - DNA, 13 bp, Homo sapiens
atataacatgaaa

SEQ ID NO: 2941123 - DNA, 15 bp, Homo sapiens
atataagaaagacat

SEQ ID NO: 2941124 - DNA, 13 bp, Homo sapiens
atataagacatta

SEQ ID NO: 2941125 - DNA, 18 bp, Homo sapiens
atataagtttctttagaa

SEQ ID NO: 2941126 - DNA, 19 bp, Homo sapiens
atataagtttgaaggaaac

SEQ ID NO: 2941127 - DNA, 21 bp, Homo sapiens
atataagtttgaaggaaacag

SEQ ID NO: 2941128 - DNA, 13 bp, Homo sapiens
atataatttaaag

SEQ ID NO: 2941129 - DNA, 18 bp, Homo sapiens
atatacaactgtaaagca

SEQ ID NO: 2941130 - DNA, 18 bp, Homo sapiens
atatacaagctacagttg

SEQ ID NO: 2941131 - DNA, 16 bp, Homo sapiens
atatacagtaacttta

SEQ ID NO: 2941132 - DNA, 18 bp, Homo sapiens
atatacattcaaacttaa

SEQ ID NO: 2941133 - DNA, 22 bp, Homo sapiens
atatacgtttatataaatatat

SEQ ID NO: 2941134 - DNA, 17 bp, Homo sapiens
atatactgcttgtcatc

SEQ ID NO: 2941135 - DNA, 15 bp, Homo sapiens
atatactgtaaagaa

SEQ ID NO: 2941136 - DNA, 20 bp, Homo sapiens
atatacttttacattaaaga

SEQ ID NO: 2941137 - DNA, 21 bp, Homo sapiens
atatacttttacattaaagaa

SEQ ID NO: 2941138 - DNA, 11 bp, Homo sapiens
atatacttttt

SEQ ID NO: 2941139 - DNA, 12 bp, Homo sapiens
atatagacttgg

SEQ ID NO: 2941140 - DNA, 22 bp, Homo sapiens
atatagacttggagaatactgc

SEQ ID NO: 2941141 - DNA, 19 bp, Homo sapiens
atatagcaaaacttttaaa

SEQ ID NO: 2941142 - DNA, 12 bp, Homo sapiens
atatagcaaaga

SEQ ID NO: 2941143 - DNA, 16 bp, Homo sapiens
atatagcaaagatata

SEQ ID NO: 2941144 - DNA, 22 bp, Homo sapiens
atatagcaaagatatatattca

SEQ ID NO: 2941145 - DNA, 16 bp, Homo sapiens
atatagcccagccagg

SEQ ID NO: 2941146 - DNA, 21 bp, Homo sapiens
atatagctctacacaacatgt

SEQ ID NO: 2941147 - DNA, 18 bp, Homo sapiens
atataggttttgtttgct

SEQ ID NO: 2941148 - DNA, 19 bp, Homo sapiens
atataggttttgtttgcta

SEQ ID NO: 2941149 - DNA, 20 bp, Homo sapiens
atataggttttgtttgctat

SEQ ID NO: 2941150 - DNA, 21 bp, Homo sapiens
atatagttgtctttctttgct

SEQ ID NO: 2941151 - DNA, 15 bp, Homo sapiens
atatataaaaagaaa

SEQ ID NO: 2941152 - DNA, 20 bp, Homo sapiens
atatatacagtaactttatg

SEQ ID NO: 2941153 - DNA, 23 bp, Homo sapiens
atatatacagtaactttatgtgt

SEQ ID NO: 2941154 - DNA, 14 bp, Homo sapiens
atatatactattaa

SEQ ID NO: 2941155 - DNA, 13 bp, Homo sapiens
atatatatacaca

SEQ ID NO: 2941156 - DNA, 15 bp, Homo sapiens
atatatatatgtaca

SEQ ID NO: 2941157 - DNA, 12 bp, Homo sapiens
atatatatattt

SEQ ID NO: 2941158 - DNA, 15 bp, Homo sapiens
atatatatctatata

SEQ ID NO: 2941159 - DNA, 16 bp, Homo sapiens
atatatatgtacagtt

SEQ ID NO: 2941160 - DNA, 22 bp, Homo sapiens
atatatcctgaaagcattattt

SEQ ID NO: 2941161 - DNA, 19 bp, Homo sapiens
atatatctaaattgaataa

SEQ ID NO: 2941162 - DNA, 16 bp, Homo sapiens
atatatctctatttga

SEQ ID NO: 2941163 - DNA, 16 bp, Homo sapiens
atatatctttatactt

SEQ ID NO: 2941164 - DNA, 13 bp, Homo sapiens
atatatcttttgt

SEQ ID NO: 2941165 - DNA, 22 bp, Homo sapiens
agggccacctacaatacatctg

SEQ ID NO: 2941166 - DNA, 23 bp, Homo sapiens
agggccacctacaatacatctga

SEQ ID NO: 2941167 - DNA, 15 bp, Homo sapiens
agggccacgctccag

SEQ ID NO: 2941168 - DNA, 18 bp, Homo sapiens
agggccacgtgccaggcc

SEQ ID NO: 2941169 - DNA, 20 bp, Homo sapiens
agggccacgtgccaggcccg

SEQ ID NO: 2941170 - DNA, 12 bp, Homo sapiens
agggccagagcc

SEQ ID NO: 2941171 - DNA, 17 bp, Homo sapiens
agggccagcaggcagcg

SEQ ID NO: 2941172 - DNA, 14 bp, Homo sapiens
agggccaggaagga

SEQ ID NO: 2941173 - DNA, 15 bp, Homo sapiens
agggccaggaaggac

SEQ ID NO: 2941174 - DNA, 20 bp, Homo sapiens
agggccaggtgcggcctggg

SEQ ID NO: 2941175 - DNA, 17 bp, Homo sapiens
agggcccagagcccagc

SEQ ID NO: 2941176 - DNA, 18 bp, Homo sapiens
agggcccagagcccagct

SEQ ID NO: 2941177 - DNA, 14 bp, Homo sapiens
agggcccaggccat

SEQ ID NO: 2941178 - DNA, 18 bp, Homo sapiens
agggcccaggcctggagc

SEQ ID NO: 2941179 - DNA, 15 bp, Homo sapiens
agggcccctgaccct

SEQ ID NO: 2941180 - DNA, 19 bp, Homo sapiens
agggccctgtggagtccag

SEQ ID NO: 2941181 - DNA, 17 bp, Homo sapiens
agggcccttcccctccc

SEQ ID NO: 2941182 - DNA, 23 bp, Homo sapiens
agggcccttcccctcccccactc

SEQ ID NO: 2941183 - DNA, 20 bp, Homo sapiens
agggccgccagggagacctg

SEQ ID NO: 2941184 - DNA, 23 bp, Homo sapiens
agggccgccagggagacctggac

SEQ ID NO: 2941185 - DNA, 14 bp, Homo sapiens
agggccgcctgcct

SEQ ID NO: 2941186 - DNA, 23 bp, Homo sapiens
agggccgctcgatgcctttgctg

SEQ ID NO: 2941187 - DNA, 19 bp, Homo sapiens
agggccggggatggatctt

SEQ ID NO: 2941188 - DNA, 18 bp, Homo sapiens
agggcctagctgctacaa

SEQ ID NO: 2941189 - DNA, 22 bp, Homo sapiens
agggcctcggaggctcctccct

SEQ ID NO: 2941190 - DNA, 14 bp, Homo sapiens
agggcctctgcctg

SEQ ID NO: 2941191 - DNA, 18 bp, Homo sapiens
agggcctctgcctgggac

SEQ ID NO: 2941192 - DNA, 13 bp, Homo sapiens
agggcctggccag

SEQ ID NO: 2941193 - DNA, 20 bp, Homo sapiens
agggcctggccagtcctggt

SEQ ID NO: 2941194 - DNA, 21 bp, Homo sapiens
agggcctggtccctgggagga

SEQ ID NO: 2941195 - DNA, 12 bp, Homo sapiens
agggcctggttg

SEQ ID NO: 2941196 - DNA, 14 bp, Homo sapiens
agggccttgcccag

SEQ ID NO: 2941197 - DNA, 15 bp, Homo sapiens
agggccttgcccaga

SEQ ID NO: 2941198 - DNA, 18 bp, Homo sapiens
agggccttgcccagagat

SEQ ID NO: 2941199 - DNA, 23 bp, Homo sapiens
agggccttgcccagagatgcctc

SEQ ID NO: 2941200 - DNA, 14 bp, Homo sapiens
agggcgcaaagggc

SEQ ID NO: 2941201 - DNA, 16 bp, Homo sapiens
agggcgcccagcagcc

SEQ ID NO: 2941202 - DNA, 13 bp, Homo sapiens
agggcgcctcacc

SEQ ID NO: 2941203 - DNA, 12 bp, Homo sapiens
agggcggccagg

SEQ ID NO: 2941204 - DNA, 18 bp, Homo sapiens
agggcgggcagagggctg

SEQ ID NO: 2941205 - DNA, 19 bp, Homo sapiens
agggcgggcagagggctgg

SEQ ID NO: 2941206 - DNA, 20 bp, Homo sapiens
agggcgggcagagggctgga

SEQ ID NO: 2941207 - DNA, 19 bp, Homo sapiens
agggcgtggaaaggggcag

SEQ ID NO: 2941208 - DNA, 14 bp, Homo sapiens
agggctaagagcta

SEQ ID NO: 2941209 - DNA, 19 bp, Homo sapiens
agggctacaaaggaggaca

SEQ ID NO: 2941210 - DNA, 22 bp, Homo sapiens
agggctacccaaaacagttcta

SEQ ID NO: 2941211 - DNA, 15 bp, Homo sapiens
agggctcagaagagc

SEQ ID NO: 2941212 - DNA, 16 bp, Homo sapiens
agggctcagaagagca

SEQ ID NO: 2941213 - DNA, 18 bp, Homo sapiens
agggctcagaagagcagc

SEQ ID NO: 2941214 - DNA, 17 bp, Homo sapiens
agggctcagctagacat

SEQ ID NO: 2941215 - DNA, 13 bp, Homo sapiens
agggctcagggca

SEQ ID NO: 2941216 - DNA, 19 bp, Homo sapiens
agggctcagggcagtggct

SEQ ID NO: 2941217 - DNA, 12 bp, Homo sapiens
agggctcctggg

SEQ ID NO: 2941218 - DNA, 17 bp, Homo sapiens
agggctctgggggcaga

SEQ ID NO: 2941219 - DNA, 14 bp, Homo sapiens
agggctgccaggag

SEQ ID NO: 2941220 - DNA, 16 bp, Homo sapiens
agggctggaggcccag

SEQ ID NO: 2941221 - DNA, 21 bp, Homo sapiens
agggctggaggcccaggctgg

SEQ ID NO: 2941222 - DNA, 13 bp, Homo sapiens
agggctggctggc

SEQ ID NO: 2941223 - DNA, 20 bp, Homo sapiens
agggctggctggcctcaccc

SEQ ID NO: 2941224 - DNA, 13 bp, Homo sapiens
agggctggtttgt

SEQ ID NO: 2941225 - DNA, 16 bp, Homo sapiens
agggctggtttgttct

SEQ ID NO: 2941226 - DNA, 14 bp, Homo sapiens
agggctgtcatctg

SEQ ID NO: 2941227 - DNA, 15 bp, Homo sapiens
aggggaaaaaaatgt

SEQ ID NO: 2941228 - DNA, 16 bp, Homo sapiens
aggggaaaaaaatgtt

SEQ ID NO: 2941229 - DNA, 16 bp, Homo sapiens
aggggaaaaaactcgg

SEQ ID NO: 2941230 - DNA, 14 bp, Homo sapiens
aggggaaaggcctg

SEQ ID NO: 2941231 - DNA, 11 bp, Homo sapiens
aggggaagggc

SEQ ID NO: 2941232 - DNA, 12 bp, Homo sapiens
aggggaagggca

SEQ ID NO: 2941233 - DNA, 15 bp, Homo sapiens
aggggaaggggccgg

SEQ ID NO: 2941234 - DNA, 16 bp, Homo sapiens
aggggaaggggccggg

SEQ ID NO: 2941235 - DNA, 19 bp, Homo sapiens
aggggaaggggccggggag

SEQ ID NO: 2941236 - DNA, 15 bp, Homo sapiens
aggggaatcagaact

SEQ ID NO: 2941237 - DNA, 16 bp, Homo sapiens
aggggaatcagaactc

SEQ ID NO: 2941238 - DNA, 20 bp, Homo sapiens
aggggacactggccccacag

SEQ ID NO: 2941239 - DNA, 14 bp, Homo sapiens
aggggaccagaggg

SEQ ID NO: 2941240 - DNA, 19 bp, Homo sapiens
aggggacccccgccccctg

SEQ ID NO: 2941241 - DNA, 22 bp, Homo sapiens
aggggacccccgccccctgccc

SEQ ID NO: 2941242 - DNA, 20 bp, Homo sapiens
aggggacgcaggcccctctc

SEQ ID NO: 2941243 - DNA, 21 bp, Homo sapiens
aggggacgggcaagtgagagg

SEQ ID NO: 2941244 - DNA, 18 bp, Homo sapiens
aggggacgtgggccctgc

SEQ ID NO: 2941245 - DNA, 13 bp, Homo sapiens
aggggactggtcc

SEQ ID NO: 2941246 - DNA, 20 bp, Homo sapiens
aggggaggatagcgagaaga

SEQ ID NO: 2941247 - DNA, 18 bp, Homo sapiens
aggggagggagggaagtc

SEQ ID NO: 2941248 - DNA, 17 bp, Homo sapiens
aggggatggtagacctt

SEQ ID NO: 2941249 - DNA, 21 bp, Homo sapiens
aggggatgtttacctggtgct

SEQ ID NO: 2941250 - DNA, 17 bp, Homo sapiens
aggggcaaattcttttg

SEQ ID NO: 2941251 - DNA, 19 bp, Homo sapiens
aggggcacttcattgagag

SEQ ID NO: 2941252 - DNA, 19 bp, Homo sapiens
aggggcagccacaccactg

SEQ ID NO: 2941253 - DNA, 18 bp, Homo sapiens
aggggcaggaggaagggg

SEQ ID NO: 2941254 - DNA, 15 bp, Homo sapiens
aggggccagaggctc

SEQ ID NO: 2941255 - DNA, 17 bp, Homo sapiens
aggggccagaggctcgt

SEQ ID NO: 2941256 - DNA, 21 bp, Homo sapiens
aggggcccccctgccctgtgg

SEQ ID NO: 2941257 - DNA, 22 bp, Homo sapiens
aggggcccccctgccctgtggg

SEQ ID NO: 2941258 - DNA, 17 bp, Homo sapiens
aggggcccctggcccag

SEQ ID NO: 2941259 - DNA, 17 bp, Homo sapiens
aggggcccggccagcca

SEQ ID NO: 2941260 - DNA, 14 bp, Homo sapiens
aggggcccgtggga

SEQ ID NO: 2941261 - DNA, 15 bp, Homo sapiens
aggggccgctgccac

SEQ ID NO: 2941262 - DNA, 17 bp, Homo sapiens
aggggccgctgccaccc

SEQ ID NO: 2941263 - DNA, 14 bp, Homo sapiens
aggggccggccctg

SEQ ID NO: 2941264 - DNA, 15 bp, Homo sapiens
aggggccggctggcc

SEQ ID NO: 2941265 - DNA, 21 bp, Homo sapiens
aggggccggctggcctggagg

SEQ ID NO: 2941266 - DNA, 21 bp, Homo sapiens
aggggccggggagggggcacg

SEQ ID NO: 2941267 - DNA, 22 bp, Homo sapiens
aggggccggggagggggcacgg

SEQ ID NO: 2941268 - DNA, 17 bp, Homo sapiens
aggggccgggggcagtc

SEQ ID NO: 2941269 - DNA, 19 bp, Homo sapiens
aggggcctaggcctcagcc

SEQ ID NO: 2941270 - DNA, 23 bp, Homo sapiens
aggggcctaggcctcagccagag

SEQ ID NO: 2941271 - DNA, 12 bp, Homo sapiens
aggggcctgcct

SEQ ID NO: 2941272 - DNA, 14 bp, Homo sapiens
aggggcctgtgtgg

SEQ ID NO: 2941273 - DNA, 18 bp, Homo sapiens
aggggccttagggagccc

SEQ ID NO: 2941274 - DNA, 23 bp, Homo sapiens
aggggcgccgcaaaccacactgg

SEQ ID NO: 2941275 - DNA, 22 bp, Homo sapiens
aggggcgggtggatcacctgag

SEQ ID NO: 2941276 - DNA, 15 bp, Homo sapiens
aggggctcagttctg

SEQ ID NO: 2941277 - DNA, 13 bp, Homo sapiens
aggggctgacact

SEQ ID NO: 2941278 - DNA, 13 bp, Homo sapiens
aggggctgctggg

SEQ ID NO: 2941279 - DNA, 17 bp, Homo sapiens
aggggctgctgggggct

SEQ ID NO: 2941280 - DNA, 20 bp, Homo sapiens
aggggctgctgggggctccc

SEQ ID NO: 2941281 - DNA, 12 bp, Homo sapiens
aggggcttcagg

SEQ ID NO: 2941282 - DNA, 22 bp, Homo sapiens
aggggcttggtcctagggtggg

SEQ ID NO: 2941283 - DNA, 17 bp, Homo sapiens
agggggaccatggggag

SEQ ID NO: 2941284 - DNA, 22 bp, Homo sapiens
agggggaccatggggaggtggc

SEQ ID NO: 2941285 - DNA, 22 bp, Homo sapiens
agggggagccccttctgctcag

SEQ ID NO: 2941286 - DNA, 21 bp, Homo sapiens
agggggcacggcaggcgtgtg

SEQ ID NO: 2941287 - DNA, 16 bp, Homo sapiens
agggggcggcagggct

SEQ ID NO: 2941288 - DNA, 20 bp, Homo sapiens
agggggcggggactgctggc

SEQ ID NO: 2941289 - DNA, 20 bp, Homo sapiens
aggggggtcggaagcctgtc

SEQ ID NO: 2941290 - DNA, 16 bp, Homo sapiens
agggggtacctcatga

SEQ ID NO: 2941291 - DNA, 15 bp, Homo sapiens
aggggtaccaggcac

SEQ ID NO: 2941292 - DNA, 17 bp, Homo sapiens
aggggtcaggtgtcagg

SEQ ID NO: 2941293 - DNA, 16 bp, Homo sapiens
aggggtcctgggggca

SEQ ID NO: 2941294 - DNA, 15 bp, Homo sapiens
aggggtgacacagac

SEQ ID NO: 2941295 - DNA, 21 bp, Homo sapiens
aggggtggccgggcacagtgg

SEQ ID NO: 2941296 - DNA, 17 bp, Homo sapiens
aggggtgtccgagaggc

SEQ ID NO: 2941297 - DNA, 19 bp, Homo sapiens
aggggttggttgaggtgga

SEQ ID NO: 2941298 - DNA, 20 bp, Homo sapiens
aggggttggttgaggtggaa

SEQ ID NO: 2941299 - DNA, 23 bp, Homo sapiens
aggggtttcagaattttgcattg

SEQ ID NO: 2941300 - DNA, 14 bp, Homo sapiens
agggtaaggtgcct

SEQ ID NO: 2941301 - DNA, 15 bp, Homo sapiens
aggcagatccaggac

SEQ ID NO: 2941302 - DNA, 21 bp, Homo sapiens
aggcagatggccactgctctt

SEQ ID NO: 2941303 - DNA, 19 bp, Homo sapiens
aggcagcagtgtgaggcca

SEQ ID NO: 2941304 - DNA, 15 bp, Homo sapiens
aggcagccctgccat

SEQ ID NO: 2941305 - DNA, 22 bp, Homo sapiens
aggcaggaccttcgggctgtgc

SEQ ID NO: 2941306 - DNA, 21 bp, Homo sapiens
aggcaggagttgggggcaggt

SEQ ID NO: 2941307 - DNA, 14 bp, Homo sapiens
aggcaggcatggcc

SEQ ID NO: 2941308 - DNA, 20 bp, Homo sapiens
aggcaggcatggccctgggc

SEQ ID NO: 2941309 - DNA, 12 bp, Homo sapiens
aggcaggcctga

SEQ ID NO: 2941310 - DNA, 15 bp, Homo sapiens
aggcaggctcccagg

SEQ ID NO: 2941311 - DNA, 12 bp, Homo sapiens
aggcagggaagt

SEQ ID NO: 2941312 - DNA, 21 bp, Homo sapiens
aggcagggaagtgtaagaaac

SEQ ID NO: 2941313 - DNA, 13 bp, Homo sapiens
aggcaggggcgga

SEQ ID NO: 2941314 - DNA, 14 bp, Homo sapiens
aggcaggggtgaga

SEQ ID NO: 2941315 - DNA, 14 bp, Homo sapiens
aggcagggtgcagt

SEQ ID NO: 2941316 - DNA, 13 bp, Homo sapiens
aggcaggtctgca

SEQ ID NO: 2941317 - DNA, 17 bp, Homo sapiens
aggcaggtctgcaaggg

SEQ ID NO: 2941318 - DNA, 23 bp, Homo sapiens
aggcaggtctgcaagggcccaga

SEQ ID NO: 2941319 - DNA, 13 bp, Homo sapiens
aggcagtccagag

SEQ ID NO: 2941320 - DNA, 14 bp, Homo sapiens
aggcagtccagagc

SEQ ID NO: 2941321 - DNA, 14 bp, Homo sapiens
aggcagtcccggga

SEQ ID NO: 2941322 - DNA, 21 bp, Homo sapiens
aggcagtcccgggagaaaaga

SEQ ID NO: 2941323 - DNA, 14 bp, Homo sapiens
aggcagtgtcttaa

SEQ ID NO: 2941324 - DNA, 14 bp, Homo sapiens
aggcataaacctgt

SEQ ID NO: 2941325 - DNA, 13 bp, Homo sapiens
aggcatactttta

SEQ ID NO: 2941326 - DNA, 20 bp, Homo sapiens
aggcatcagtccctatgtat

SEQ ID NO: 2941327 - DNA, 20 bp, Homo sapiens
aggcatccagcagtctctgc

SEQ ID NO: 2941328 - DNA, 20 bp, Homo sapiens
aggcatccaggccagggctc

SEQ ID NO: 2941329 - DNA, 19 bp, Homo sapiens
aggcatcggggagccggga

SEQ ID NO: 2941330 - DNA, 15 bp, Homo sapiens
aggcatggaaaccaa

SEQ ID NO: 2941331 - DNA, 20 bp, Homo sapiens
aggcatggctggtgcctgaa

SEQ ID NO: 2941332 - DNA, 22 bp, Homo sapiens
aggcatggggcatgtcctttcc

SEQ ID NO: 2941333 - DNA, 16 bp, Homo sapiens
aggcatgtacaaaaat

SEQ ID NO: 2941334 - DNA, 18 bp, Homo sapiens
aggcatgtacaaaaatta

SEQ ID NO: 2941335 - DNA, 22 bp, Homo sapiens
aggcatgtgccacccacccaac

SEQ ID NO: 2941336 - DNA, 17 bp, Homo sapiens
aggcatgtgtgaaacat

SEQ ID NO: 2941337 - DNA, 13 bp, Homo sapiens
aggcattccacag

SEQ ID NO: 2941338 - DNA, 15 bp, Homo sapiens
aggcattccacagga

SEQ ID NO: 2941339 - DNA, 16 bp, Homo sapiens
aggcattgccaagggc

SEQ ID NO: 2941340 - DNA, 20 bp, Homo sapiens
aggcattgttagtttagtgt

SEQ ID NO: 2941341 - DNA, 21 bp, Homo sapiens
aggcattgttagtttagtgtg

SEQ ID NO: 2941342 - DNA, 12 bp, Homo sapiens
aggcatttccta

SEQ ID NO: 2941343 - DNA, 13 bp, Homo sapiens
aggccaaaaaaat

SEQ ID NO: 2941344 - DNA, 14 bp, Homo sapiens
aggccaaacctctg

SEQ ID NO: 2941345 - DNA, 17 bp, Homo sapiens
aggccaaacctctgttc

SEQ ID NO: 2941346 - DNA, 17 bp, Homo sapiens
aggccaacactgtgggt

SEQ ID NO: 2941347 - DNA, 15 bp, Homo sapiens
aggccaacagtagcc

SEQ ID NO: 2941348 - DNA, 15 bp, Homo sapiens
aggccaactgcctcc

SEQ ID NO: 2941349 - DNA, 17 bp, Homo sapiens
aggccaagaaacgtctt

SEQ ID NO: 2941350 - DNA, 21 bp, Homo sapiens
aggccaagcagtgcctgccta

SEQ ID NO: 2941351 - DNA, 14 bp, Homo sapiens
aggccaaggtgcat

SEQ ID NO: 2941352 - DNA, 13 bp, Homo sapiens
aggccaaggtgct

SEQ ID NO: 2941353 - DNA, 16 bp, Homo sapiens
aggccaaggtgggcgg

SEQ ID NO: 2941354 - DNA, 17 bp, Homo sapiens
aggccaaggtgggcgga

SEQ ID NO: 2941355 - DNA, 22 bp, Homo sapiens
aggccacagaaggtgaactttg

SEQ ID NO: 2941356 - DNA, 23 bp, Homo sapiens
aggccacagaaggtgaactttgt

SEQ ID NO: 2941357 - DNA, 20 bp, Homo sapiens
aggccacgtatagtcctagc

SEQ ID NO: 2941358 - DNA, 22 bp, Homo sapiens
aggccacgtatagtcctagctg

SEQ ID NO: 2941359 - DNA, 13 bp, Homo sapiens
aggccactcctcc

SEQ ID NO: 2941360 - DNA, 14 bp, Homo sapiens
aggccactcctcca

SEQ ID NO: 2941361 - DNA, 22 bp, Homo sapiens
aggccagacatggtgtctcaca

SEQ ID NO: 2941362 - DNA, 14 bp, Homo sapiens
aggccagagccaag

SEQ ID NO: 2941363 - DNA, 13 bp, Homo sapiens
aggccagccagtg

SEQ ID NO: 2941364 - DNA, 22 bp, Homo sapiens
aggccagccagtgacctgagga

SEQ ID NO: 2941365 - DNA, 21 bp, Homo sapiens
aggccagcccggacctctgga

SEQ ID NO: 2941366 - DNA, 20 bp, Homo sapiens
aggccagctccttttctgtg

SEQ ID NO: 2941367 - DNA, 19 bp, Homo sapiens
aggccagctgccccagcca

SEQ ID NO: 2941368 - DNA, 15 bp, Homo sapiens
aggccagctggcagc

SEQ ID NO: 2941369 - DNA, 12 bp, Homo sapiens
aggccaggccgg

SEQ ID NO: 2941370 - DNA, 20 bp, Homo sapiens
aggccaggcgagcctgactc

SEQ ID NO: 2941371 - DNA, 13 bp, Homo sapiens
aggccagggcaga

SEQ ID NO: 2941372 - DNA, 13 bp, Homo sapiens
aggccagggcagt

SEQ ID NO: 2941373 - DNA, 11 bp, Homo sapiens
aggccagggct

SEQ ID NO: 2941374 - DNA, 17 bp, Homo sapiens
aggccagggctcctgtg

SEQ ID NO: 2941375 - DNA, 20 bp, Homo sapiens
aggccagggctcctgtggca

SEQ ID NO: 2941376 - DNA, 12 bp, Homo sapiens
aggccagggctg

SEQ ID NO: 2941377 - DNA, 14 bp, Homo sapiens
aggccagggctggg

SEQ ID NO: 2941378 - DNA, 14 bp, Homo sapiens
aggccagtgagcca

SEQ ID NO: 2941379 - DNA, 21 bp, Homo sapiens
aggccatccttccctgtctgc

SEQ ID NO: 2941380 - DNA, 13 bp, Homo sapiens
aggccatgaaaaa

SEQ ID NO: 2941381 - DNA, 19 bp, Homo sapiens
aggccatgaaaaaaatgat

SEQ ID NO: 2941382 - DNA, 18 bp, Homo sapiens
aggccatgtggcctgccc

SEQ ID NO: 2941383 - DNA, 19 bp, Homo sapiens
aggccatgtggcctgccca

SEQ ID NO: 2941384 - DNA, 23 bp, Homo sapiens
aggccatgtggcctgcccagcct

SEQ ID NO: 2941385 - DNA, 13 bp, Homo sapiens
aggccattattgt

SEQ ID NO: 2941386 - DNA, 17 bp, Homo sapiens
aggccattctttcccaa

SEQ ID NO: 2941387 - DNA, 15 bp, Homo sapiens
aggcccaagtctcct

SEQ ID NO: 2941388 - DNA, 11 bp, Homo sapiens
aggcccacaca

SEQ ID NO: 2941389 - DNA, 12 bp, Homo sapiens
aggcccacacac

SEQ ID NO: 2941390 - DNA, 13 bp, Homo sapiens
aggcccactcagg

SEQ ID NO: 2941391 - DNA, 23 bp, Homo sapiens
aggcccagccgcaggaaggcaga

SEQ ID NO: 2941392 - DNA, 15 bp, Homo sapiens
aggcccaggctggga

SEQ ID NO: 2941393 - DNA, 16 bp, Homo sapiens
aggcccaggctgggaa

SEQ ID NO: 2941394 - DNA, 17 bp, Homo sapiens
aggcccaggctgggaac

SEQ ID NO: 2941395 - DNA, 15 bp, Homo sapiens
aggccccactgggga

SEQ ID NO: 2941396 - DNA, 12 bp, Homo sapiens
aggccccaggaa

SEQ ID NO: 2941397 - DNA, 13 bp, Homo sapiens
aggccccaggaag

SEQ ID NO: 2941398 - DNA, 15 bp, Homo sapiens
aggccccaggaagcc

SEQ ID NO: 2941399 - DNA, 16 bp, Homo sapiens
aggccccaggaagccg

SEQ ID NO: 2941400 - DNA, 14 bp, Homo sapiens
aggcccccaccaca

SEQ ID NO: 2941401 - DNA, 15 bp, Homo sapiens
aggcccccaccacac

SEQ ID NO: 2941402 - DNA, 17 bp, Homo sapiens
aggcccccaccacacat

SEQ ID NO: 2941403 - DNA, 18 bp, Homo sapiens
aggcccccaccacacatc

SEQ ID NO: 2941404 - DNA, 21 bp, Homo sapiens
aggcccccaccacacatccca

SEQ ID NO: 2941405 - DNA, 21 bp, Homo sapiens
aggcccccccagaagcaagat

SEQ ID NO: 2941406 - DNA, 15 bp, Homo sapiens
aggccccgcttgtcc

SEQ ID NO: 2941407 - DNA, 18 bp, Homo sapiens
aggccccgcttgtccagc

SEQ ID NO: 2941408 - DNA, 16 bp, Homo sapiens
aggcccctgggtttct

SEQ ID NO: 2941409 - DNA, 15 bp, Homo sapiens
aggcccgcgggcaca

SEQ ID NO: 2941410 - DNA, 16 bp, Homo sapiens
aggcccgcgggcacag

SEQ ID NO: 2941411 - DNA, 20 bp, Homo sapiens
aggcccgcgggcacagccag

SEQ ID NO: 2941412 - DNA, 15 bp, Homo sapiens
aggcccgtcggagct

SEQ ID NO: 2941413 - DNA, 16 bp, Homo sapiens
aggcccgtcggagctg

SEQ ID NO: 2941414 - DNA, 22 bp, Homo sapiens
aggcccgtcggagctgcctgca

SEQ ID NO: 2941415 - DNA, 15 bp, Homo sapiens
aggcccgtctgtcca

SEQ ID NO: 2941416 - DNA, 21 bp, Homo sapiens
aggcccgtctgtccatctgcc

SEQ ID NO: 2941417 - DNA, 22 bp, Homo sapiens
aggccctccctgttccccagag

SEQ ID NO: 2941418 - DNA, 23 bp, Homo sapiens
aggccctccctgttccccagaga

SEQ ID NO: 2941419 - DNA, 18 bp, Homo sapiens
aggccctctgcctgcact

SEQ ID NO: 2941420 - DNA, 13 bp, Homo sapiens
aggccctctggag

SEQ ID NO: 2941421 - DNA, 20 bp, Homo sapiens
aggccctctggagtggccac

SEQ ID NO: 2941422 - DNA, 16 bp, Homo sapiens
aggccctggagggcag

SEQ ID NO: 2941423 - DNA, 17 bp, Homo sapiens
aggccctggagggcaga

SEQ ID NO: 2941424 - DNA, 18 bp, Homo sapiens
aggccctggagggcagag

SEQ ID NO: 2941425 - DNA, 18 bp, Homo sapiens
aggccctggtcctggcct

SEQ ID NO: 2941426 - DNA, 12 bp, Homo sapiens
aggccctggttc

SEQ ID NO: 2941427 - DNA, 14 bp, Homo sapiens
aggccctgtccagc

SEQ ID NO: 2941428 - DNA, 17 bp, Homo sapiens
aggcccttggggtggcg

SEQ ID NO: 2941429 - DNA, 20 bp, Homo sapiens
aggccgacaccactcctgcc

SEQ ID NO: 2941430 - DNA, 21 bp, Homo sapiens
aggccgacaccactcctgcca

SEQ ID NO: 2941431 - DNA, 23 bp, Homo sapiens
aggccgacaccactcctgccagc

SEQ ID NO: 2941432 - DNA, 19 bp, Homo sapiens
aggccgagaagcaagaaag

SEQ ID NO: 2941433 - DNA, 16 bp, Homo sapiens
aggccgagcggtggcc

SEQ ID NO: 2941434 - DNA, 16 bp, Homo sapiens
aggccgcgccctttcc

SEQ ID NO: 2941435 - DNA, 18 bp, Homo sapiens
aggccgcgcgtccagctg

SEQ ID NO: 2941436 - DNA, 19 bp, Homo sapiens
aggccgcgcgtccagctgc

SEQ ID NO: 2941437 - DNA, 13 bp, Homo sapiens
aggccgcggccca

SEQ ID NO: 2941438 - DNA, 16 bp, Homo sapiens
aggccgcggcctcccc

SEQ ID NO: 2941439 - DNA, 14 bp, Homo sapiens
agggtacagtttgg

SEQ ID NO: 2941440 - DNA, 15 bp, Homo sapiens
agggtaccagcagaa

SEQ ID NO: 2941441 - DNA, 18 bp, Homo sapiens
agggtaccaggataaagc

SEQ ID NO: 2941442 - DNA, 17 bp, Homo sapiens
agggtaggtttgtgtct

SEQ ID NO: 2941443 - DNA, 15 bp, Homo sapiens
agggtcagaaacagg

SEQ ID NO: 2941444 - DNA, 19 bp, Homo sapiens
agggtcagaaacaggaccg

SEQ ID NO: 2941445 - DNA, 12 bp, Homo sapiens
agggtcatttct

SEQ ID NO: 2941446 - DNA, 14 bp, Homo sapiens
agggtcccctgcca

SEQ ID NO: 2941447 - DNA, 16 bp, Homo sapiens
agggtcccctgccacc

SEQ ID NO: 2941448 - DNA, 16 bp, Homo sapiens
agggtcgaaagctcta

SEQ ID NO: 2941449 - DNA, 17 bp, Homo sapiens
agggtcggaacccaagc

SEQ ID NO: 2941450 - DNA, 19 bp, Homo sapiens
agggtctagccgctgccct

SEQ ID NO: 2941451 - DNA, 23 bp, Homo sapiens
agggtctagggagagacccttgt

SEQ ID NO: 2941452 - DNA, 12 bp, Homo sapiens
agggtctctgct

SEQ ID NO: 2941453 - DNA, 15 bp, Homo sapiens
agggtctctgctcca

SEQ ID NO: 2941454 - DNA, 16 bp, Homo sapiens
agggtctctgctccag

SEQ ID NO: 2941455 - DNA, 19 bp, Homo sapiens
agggtctggagaagcagtg

SEQ ID NO: 2941456 - DNA, 22 bp, Homo sapiens
agggtctgggaaatgagcaggg

SEQ ID NO: 2941457 - DNA, 19 bp, Homo sapiens
agggtctgtttggactgca

SEQ ID NO: 2941458 - DNA, 16 bp, Homo sapiens
agggtcttgggaaata

SEQ ID NO: 2941459 - DNA, 21 bp, Homo sapiens
agggtcttggttccagcctgc

SEQ ID NO: 2941460 - DNA, 18 bp, Homo sapiens
agggtctttggtgttttt

SEQ ID NO: 2941461 - DNA, 13 bp, Homo sapiens
agggtcttttcat

SEQ ID NO: 2941462 - DNA, 16 bp, Homo sapiens
agggtgagctggtgcc

SEQ ID NO: 2941463 - DNA, 17 bp, Homo sapiens
agggtgagctggtgcct

SEQ ID NO: 2941464 - DNA, 15 bp, Homo sapiens
agggtgatgccaggt

SEQ ID NO: 2941465 - DNA, 20 bp, Homo sapiens
agggtgcagtatcatgccct

SEQ ID NO: 2941466 - DNA, 16 bp, Homo sapiens
agggtgcccgagtgcg

SEQ ID NO: 2941467 - DNA, 24 bp, Homo sapiens
agggtgcccttttccagcctcagc

SEQ ID NO: 2941468 - DNA, 11 bp, Homo sapiens
agggtggcagg

SEQ ID NO: 2941469 - DNA, 17 bp, Homo sapiens
agggtggcaggtcactg

SEQ ID NO: 2941470 - DNA, 22 bp, Homo sapiens
agggtggcaggtcactgtcact

SEQ ID NO: 2941471 - DNA, 23 bp, Homo sapiens
agggtggtctcttcttggggccc

SEQ ID NO: 2941472 - DNA, 14 bp, Homo sapiens
agggtgtcctgagg

SEQ ID NO: 2941473 - DNA, 16 bp, Homo sapiens
agggtgtggcatttgg

SEQ ID NO: 2941474 - DNA, 17 bp, Homo sapiens
agggtgtggcatttgga

SEQ ID NO: 2941475 - DNA, 18 bp, Homo sapiens
agggtgtggcatttggaa

SEQ ID NO: 2941476 - DNA, 18 bp, Homo sapiens
agggttctgcttttaagt

SEQ ID NO: 2941477 - DNA, 16 bp, Homo sapiens
agggttgaccccagag

SEQ ID NO: 2941478 - DNA, 17 bp, Homo sapiens
agggttgaccccagagg

SEQ ID NO: 2941479 - DNA, 18 bp, Homo sapiens
agggttgaccccagagga

SEQ ID NO: 2941480 - DNA, 18 bp, Homo sapiens
agggttgattaaggcagt

SEQ ID NO: 2941481 - DNA, 12 bp, Homo sapiens
agggtttctctc

SEQ ID NO: 2941482 - DNA, 14 bp, Homo sapiens
agggtttctctccc

SEQ ID NO: 2941483 - DNA, 15 bp, Homo sapiens
agggtttctctccca

SEQ ID NO: 2941484 - DNA, 14 bp, Homo sapiens
agggtttgagcaca

SEQ ID NO: 2941485 - DNA, 15 bp, Homo sapiens
agggtttggcccaag

SEQ ID NO: 2941486 - DNA, 16 bp, Homo sapiens
agggtttgtgcccagt

SEQ ID NO: 2941487 - DNA, 15 bp, Homo sapiens
agggttttgcaataa

SEQ ID NO: 2941488 - DNA, 15 bp, Homo sapiens
agggttttggcctgc

SEQ ID NO: 2941489 - DNA, 14 bp, Homo sapiens
aggtaaaaaaaaga

SEQ ID NO: 2941490 - DNA, 15 bp, Homo sapiens
aggtaaaaaaaagaa

SEQ ID NO: 2941491 - DNA, 14 bp, Homo sapiens
aggtaaaacaaaac

SEQ ID NO: 2941492 - DNA, 22 bp, Homo sapiens
aggtaaaacaaaacaaaacaac

SEQ ID NO: 2941493 - DNA, 20 bp, Homo sapiens
aggtaaaagcatcacatgaa

SEQ ID NO: 2941494 - DNA, 13 bp, Homo sapiens
aggtaaaatgcca

SEQ ID NO: 2941495 - DNA, 23 bp, Homo sapiens
aggtaaatctagagtttatacag

SEQ ID NO: 2941496 - DNA, 17 bp, Homo sapiens
aggtaagagctgatgtg

SEQ ID NO: 2941497 - DNA, 18 bp, Homo sapiens
aggtacagagacctccct

SEQ ID NO: 2941498 - DNA, 20 bp, Homo sapiens
aggtacccaatagctgccca

SEQ ID NO: 2941499 - DNA, 13 bp, Homo sapiens
aggtaccctgggt

SEQ ID NO: 2941500 - DNA, 16 bp, Homo sapiens
aggtactggtcccttc

SEQ ID NO: 2941501 - DNA, 19 bp, Homo sapiens
aggtactggtcccttcctt

SEQ ID NO: 2941502 - DNA, 14 bp, Homo sapiens
aggtagaatgtaaa

SEQ ID NO: 2941503 - DNA, 19 bp, Homo sapiens
aggtagaatgtaaagcttg

SEQ ID NO: 2941504 - DNA, 14 bp, Homo sapiens
aggtagctgcccct

SEQ ID NO: 2941505 - DNA, 20 bp, Homo sapiens
aggtatgttgcctttatggt

SEQ ID NO: 2941506 - DNA, 20 bp, Homo sapiens
aggtattcaatatcctttgc

SEQ ID NO: 2941507 - DNA, 14 bp, Homo sapiens
aggtcaacagagaa

SEQ ID NO: 2941508 - DNA, 19 bp, Homo sapiens
aggtcaacagagaaggcag

SEQ ID NO: 2941509 - DNA, 21 bp, Homo sapiens
aggtcaatacagtacaggcag

SEQ ID NO: 2941510 - DNA, 22 bp, Homo sapiens
aggtcaatacagtacaggcagc

SEQ ID NO: 2941511 - DNA, 15 bp, Homo sapiens
aggtcacataaaact

SEQ ID NO: 2941512 - DNA, 16 bp, Homo sapiens
aggtcactgtcactgc

SEQ ID NO: 2941513 - DNA, 17 bp, Homo sapiens
aggtcagcgagaaggag

SEQ ID NO: 2941514 - DNA, 22 bp, Homo sapiens
aggtcaggagttcaagaccagc

SEQ ID NO: 2941515 - DNA, 15 bp, Homo sapiens
aggtcaggagttcga

SEQ ID NO: 2941516 - DNA, 19 bp, Homo sapiens
aggtcaggggtgacacaga

SEQ ID NO: 2941517 - DNA, 22 bp, Homo sapiens
aggtcaggggtgacacagactc

SEQ ID NO: 2941518 - DNA, 21 bp, Homo sapiens
aggtcatggccacactgtgac

SEQ ID NO: 2941519 - DNA, 18 bp, Homo sapiens
aggtcattttcagtgact

SEQ ID NO: 2941520 - DNA, 14 bp, Homo sapiens
aggtccaattctcg

SEQ ID NO: 2941521 - DNA, 20 bp, Homo sapiens
aggtccacaggtctagacta

SEQ ID NO: 2941522 - DNA, 22 bp, Homo sapiens
aggtccacggtctgttcttgaa

SEQ ID NO: 2941523 - DNA, 18 bp, Homo sapiens
aggtcccagcgagccaca

SEQ ID NO: 2941524 - DNA, 15 bp, Homo sapiens
aggtcccccgactgc

SEQ ID NO: 2941525 - DNA, 17 bp, Homo sapiens
aggtcccccgactgcct

SEQ ID NO: 2941526 - DNA, 21 bp, Homo sapiens
aggtcccctggcagtgctgag

SEQ ID NO: 2941527 - DNA, 19 bp, Homo sapiens
aggtcctgctccgctgcct

SEQ ID NO: 2941528 - DNA, 20 bp, Homo sapiens
aggtcctgctccgctgcctg

SEQ ID NO: 2941529 - DNA, 22 bp, Homo sapiens
aggtcctgctccgctgcctgga

SEQ ID NO: 2941530 - DNA, 17 bp, Homo sapiens
aggtcgtataatttagt

SEQ ID NO: 2941531 - DNA, 18 bp, Homo sapiens
aggtctaagcaagtgagt

SEQ ID NO: 2941532 - DNA, 17 bp, Homo sapiens
aggtctcacactcctcc

SEQ ID NO: 2941533 - DNA, 19 bp, Homo sapiens
aggtctcacactcctcctg

SEQ ID NO: 2941534 - DNA, 15 bp, Homo sapiens
aggtctccatgaaga

SEQ ID NO: 2941535 - DNA, 16 bp, Homo sapiens
aggtctcccgggaagc

SEQ ID NO: 2941536 - DNA, 14 bp, Homo sapiens
aggtctcttttctc

SEQ ID NO: 2941537 - DNA, 16 bp, Homo sapiens
aggtctcttttctcta

SEQ ID NO: 2941538 - DNA, 22 bp, Homo sapiens
aggtctgagcactggagtggct

SEQ ID NO: 2941539 - DNA, 17 bp, Homo sapiens
aggtctgatttgcagga

SEQ ID NO: 2941540 - DNA, 18 bp, Homo sapiens
aggtctgatttgcaggat

SEQ ID NO: 2941541 - DNA, 21 bp, Homo sapiens
aggtctgatttgcaggatttt

SEQ ID NO: 2941542 - DNA, 19 bp, Homo sapiens
aggtctgcaagggcccaga

SEQ ID NO: 2941543 - DNA, 20 bp, Homo sapiens
aggtcttcatcgaatctact

SEQ ID NO: 2941544 - DNA, 16 bp, Homo sapiens
aggtcttcctgtggct

SEQ ID NO: 2941545 - DNA, 16 bp, Homo sapiens
aggtcttgacctgaac

SEQ ID NO: 2941546 - DNA, 11 bp, Homo sapiens
aggtctttcct

SEQ ID NO: 2941547 - DNA, 17 bp, Homo sapiens
aggtctttgtaaaatct

SEQ ID NO: 2941548 - DNA, 16 bp, Homo sapiens
aggtttcccaatggtg

SEQ ID NO: 2941549 - DNA, 18 bp, Homo sapiens
aggtttcccaatggtgtt

SEQ ID NO: 2941550 - DNA, 14 bp, Homo sapiens
aggtttcttgcttc

SEQ ID NO: 2941551 - DNA, 14 bp, Homo sapiens
aggttttaagttgt

SEQ ID NO: 2941552 - DNA, 17 bp, Homo sapiens
aggttttaggttctaaa

SEQ ID NO: 2941553 - DNA, 23 bp, Homo sapiens
aggttttaggttctaaagttcta

SEQ ID NO: 2941554 - DNA, 22 bp, Homo sapiens
aggttttccaaaagtaaagatg

SEQ ID NO: 2941555 - DNA, 16 bp, Homo sapiens
aggttttgagatttag

SEQ ID NO: 2941556 - DNA, 18 bp, Homo sapiens
aggttttgtttgctatct

SEQ ID NO: 2941557 - DNA, 22 bp, Homo sapiens
aggttttgtttgctatcttaat

SEQ ID NO: 2941558 - DNA, 23 bp, Homo sapiens
aggttttgtttgctatcttaatt

SEQ ID NO: 2941559 - DNA, 22 bp, Homo sapiens
aggtttttttgtcaacattgtg

SEQ ID NO: 2941560 - DNA, 12 bp, Homo sapiens
agtaaaaacatt

SEQ ID NO: 2941561 - DNA, 13 bp, Homo sapiens
agtaaaaatacaa

SEQ ID NO: 2941562 - DNA, 15 bp, Homo sapiens
agtaaaacacagagg

SEQ ID NO: 2941563 - DNA, 11 bp, Homo sapiens
agtaaaagaaa

SEQ ID NO: 2941564 - DNA, 13 bp, Homo sapiens
agtaaaagaaacc

SEQ ID NO: 2941565 - DNA, 20 bp, Homo sapiens
agtaaaagaaaccacttctg

SEQ ID NO: 2941566 - DNA, 13 bp, Homo sapiens
agtaaaatccaca

SEQ ID NO: 2941567 - DNA, 12 bp, Homo sapiens
agtaaagaactg

SEQ ID NO: 2941568 - DNA, 21 bp, Homo sapiens
agtaaatccacaggctcctgt

SEQ ID NO: 2941569 - DNA, 20 bp, Homo sapiens
agtaaatctctttttaagat

SEQ ID NO: 2941570 - DNA, 15 bp, Homo sapiens
agtaaatcttttaca

SEQ ID NO: 2941571 - DNA, 22 bp, Homo sapiens
agtaaatgttatcttatactgt

SEQ ID NO: 2941572 - DNA, 23 bp, Homo sapiens
agtaaatgttatcttatactgta

SEQ ID NO: 2941573 - DNA, 22 bp, Homo sapiens
agtaacatcagccatttttaga

SEQ ID NO: 2941574 - DNA, 16 bp, Homo sapiens
agtaacctttaaaaat

SEQ ID NO: 2941575 - DNA, 22 bp, Homo sapiens
agtaactcataatctataaaca

SEQ ID NO: 2941576 - DNA, 14 bp, Homo sapiens
agtaactgacaact

SEQ ID NO: 2941577 - DNA, 14 bp, Homo sapiens
agtaactgacatga

SEQ ID NO: 2941578 - DNA, 13 bp, Homo sapiens
agtaactgctgtc

SEQ ID NO: 2941579 - DNA, 14 bp, Homo sapiens
agtaacttattttg

SEQ ID NO: 2941580 - DNA, 14 bp, Homo sapiens
agtaacttggcttt

SEQ ID NO: 2941581 - DNA, 14 bp, Homo sapiens
agtaactttatgtg

SEQ ID NO: 2941582 - DNA, 19 bp, Homo sapiens
agtaactttatgtgtaaat

SEQ ID NO: 2941583 - DNA, 18 bp, Homo sapiens
agtaagcagagttctttg

SEQ ID NO: 2941584 - DNA, 22 bp, Homo sapiens
agtaagcagagttctttgcaag

SEQ ID NO: 2941585 - DNA, 18 bp, Homo sapiens
agtatctatatatgtgta

SEQ ID NO: 2941586 - DNA, 19 bp, Homo sapiens
agtatctatatatgtgtat

SEQ ID NO: 2941587 - DNA, 16 bp, Homo sapiens
agtatgaaagctgggg

SEQ ID NO: 2941588 - DNA, 18 bp, Homo sapiens
agtatgaaagctgggggt

SEQ ID NO: 2941589 - DNA, 22 bp, Homo sapiens
agtatgatggaacagtgaaagt

SEQ ID NO: 2941590 - DNA, 16 bp, Homo sapiens
agtatgcttgctctaa

SEQ ID NO: 2941591 - DNA, 19 bp, Homo sapiens
agtatggtacatttttcaa

SEQ ID NO: 2941592 - DNA, 22 bp, Homo sapiens
agtatggtacatttttcaactt

SEQ ID NO: 2941593 - DNA, 17 bp, Homo sapiens
agtattaaactctcctt

SEQ ID NO: 2941594 - DNA, 16 bp, Homo sapiens
agtattactagtggac

SEQ ID NO: 2941595 - DNA, 14 bp, Homo sapiens
agtattactgctgc

SEQ ID NO: 2941596 - DNA, 14 bp, Homo sapiens
agtattattttcca

SEQ ID NO: 2941597 - DNA, 15 bp, Homo sapiens
agtattattttccaa

SEQ ID NO: 2941598 - DNA, 18 bp, Homo sapiens
agtattcaggcactgaga

SEQ ID NO: 2941599 - DNA, 12 bp, Homo sapiens
agtattcttctc

SEQ ID NO: 2941600 - DNA, 16 bp, Homo sapiens
agtattcttttcaatt

SEQ ID NO: 2941601 - DNA, 12 bp, Homo sapiens
agtattgtaaat

SEQ ID NO: 2941602 - DNA, 22 bp, Homo sapiens
agtattgtaaattatatttgtg

SEQ ID NO: 2941603 - DNA, 16 bp, Homo sapiens
agtatttaattgtttc

SEQ ID NO: 2941604 - DNA, 14 bp, Homo sapiens
agtatttggaagca

SEQ ID NO: 2941605 - DNA, 17 bp, Homo sapiens
agtatttgggaagtgaa

SEQ ID NO: 2941606 - DNA, 18 bp, Homo sapiens
agtatttggtccaaaaaa

SEQ ID NO: 2941607 - DNA, 21 bp, Homo sapiens
agtatttgtcgtgtgtagaaa

SEQ ID NO: 2941608 - DNA, 19 bp, Homo sapiens
agtattttaagtctacaaa

SEQ ID NO: 2941609 - DNA, 20 bp, Homo sapiens
agtattttagtgaacttgaa

SEQ ID NO: 2941610 - DNA, 12 bp, Homo sapiens
agtattttctgt

SEQ ID NO: 2941611 - DNA, 14 bp, Homo sapiens
agtatttttcagat

SEQ ID NO: 2941612 - DNA, 15 bp, Homo sapiens
agtatttttcagata

SEQ ID NO: 2941613 - DNA, 18 bp, Homo sapiens
agtatttttcctttttaa

SEQ ID NO: 2941614 - DNA, 23 bp, Homo sapiens
agtatttttctgtgaccatcaat

SEQ ID NO: 2941615 - DNA, 19 bp, Homo sapiens
agtcaaataaatgtttccc

SEQ ID NO: 2941616 - DNA, 17 bp, Homo sapiens
agtcaaatctgggctca

SEQ ID NO: 2941617 - DNA, 14 bp, Homo sapiens
agtcaacaagcctg

SEQ ID NO: 2941618 - DNA, 17 bp, Homo sapiens
agtcaactggctggcca

SEQ ID NO: 2941619 - DNA, 14 bp, Homo sapiens
agtcaagctcctcc

SEQ ID NO: 2941620 - DNA, 15 bp, Homo sapiens
agtcaagctcctcct

SEQ ID NO: 2941621 - DNA, 16 bp, Homo sapiens
agtcaagctcctcctc

SEQ ID NO: 2941622 - DNA, 20 bp, Homo sapiens
agtcaagctcctcctccctg

SEQ ID NO: 2941623 - DNA, 22 bp, Homo sapiens
agtcaagctcctcctccctgca

SEQ ID NO: 2941624 - DNA, 12 bp, Homo sapiens
agtcaataaact

SEQ ID NO: 2941625 - DNA, 17 bp, Homo sapiens
agtcaataaacttgtag

SEQ ID NO: 2941626 - DNA, 16 bp, Homo sapiens
agtcaatttgcctctg

SEQ ID NO: 2941627 - DNA, 22 bp, Homo sapiens
agtcaatttgggggacatgcta

SEQ ID NO: 2941628 - DNA, 20 bp, Homo sapiens
agtcacaacaaaaggaagac

SEQ ID NO: 2941629 - DNA, 16 bp, Homo sapiens
agtcacaatgttcttt

SEQ ID NO: 2941630 - DNA, 18 bp, Homo sapiens
agtcacaatgttctttat

SEQ ID NO: 2941631 - DNA, 11 bp, Homo sapiens
agtcacacagt

SEQ ID NO: 2941632 - DNA, 19 bp, Homo sapiens
agtcacactgctagcaaat

SEQ ID NO: 2941633 - DNA, 20 bp, Homo sapiens
agcctgcgctcggcaggaag

SEQ ID NO: 2941634 - DNA, 14 bp, Homo sapiens
agcctgctttttaa

SEQ ID NO: 2941635 - DNA, 14 bp, Homo sapiens
agcctggaagcact

SEQ ID NO: 2941636 - DNA, 17 bp, Homo sapiens
agcctggaagcactaca

SEQ ID NO: 2941637 - DNA, 23 bp, Homo sapiens
agcctggatcctcagttctcaaa

SEQ ID NO: 2941638 - DNA, 20 bp, Homo sapiens
agcctggccaacatggcgaa

SEQ ID NO: 2941639 - DNA, 19 bp, Homo sapiens
agcctggccaacatggtga

SEQ ID NO: 2941640 - DNA, 16 bp, Homo sapiens
agcctggccagacaca

SEQ ID NO: 2941641 - DNA, 15 bp, Homo sapiens
agcctgggaaataag

SEQ ID NO: 2941642 - DNA, 21 bp, Homo sapiens
agcctgggaaataagccccct

SEQ ID NO: 2941643 - DNA, 18 bp, Homo sapiens
agcctgggaggcacagca

SEQ ID NO: 2941644 - DNA, 22 bp, Homo sapiens
agcctgggaggcacagcaaact

SEQ ID NO: 2941645 - DNA, 14 bp, Homo sapiens
agcctggggctggc

SEQ ID NO: 2941646 - DNA, 23 bp, Homo sapiens
agcctggggcttgaatttgcatg

SEQ ID NO: 2941647 - DNA, 23 bp, Homo sapiens
agcctggggtggggtcatgccct

SEQ ID NO: 2941648 - DNA, 15 bp, Homo sapiens
agcctgggtcacaga

SEQ ID NO: 2941649 - DNA, 21 bp, Homo sapiens
agcctgggtcacagagtgaga

SEQ ID NO: 2941650 - DNA, 20 bp, Homo sapiens
agcctgggtgacagagcgag

SEQ ID NO: 2941651 - DNA, 15 bp, Homo sapiens
agcctgtaatcccag

SEQ ID NO: 2941652 - DNA, 16 bp, Homo sapiens
agcctgtaatcccagc

SEQ ID NO: 2941653 - DNA, 15 bp, Homo sapiens
agcctgtcagccaac

SEQ ID NO: 2941654 - DNA, 18 bp, Homo sapiens
agcctgtccaacatggtg

SEQ ID NO: 2941655 - DNA, 19 bp, Homo sapiens
agcctgtccaacatggtga

SEQ ID NO: 2941656 - DNA, 13 bp, Homo sapiens
agcctgtcccagg

SEQ ID NO: 2941657 - DNA, 19 bp, Homo sapiens
agcctgtccccgccttccc

SEQ ID NO: 2941658 - DNA, 20 bp, Homo sapiens
agcctgtccccgccttccct

SEQ ID NO: 2941659 - DNA, 21 bp, Homo sapiens
agcctgtccccgccttccctc

SEQ ID NO: 2941660 - DNA, 23 bp, Homo sapiens
agcctgtccccgccttccctcac

SEQ ID NO: 2941661 - DNA, 11 bp, Homo sapiens
agcctgtcctc

SEQ ID NO: 2941662 - DNA, 13 bp, Homo sapiens
agcctgtcctcac

SEQ ID NO: 2941663 - DNA, 15 bp, Homo sapiens
agcctgtctctttcc

SEQ ID NO: 2941664 - DNA, 13 bp, Homo sapiens
agcctgtggccct

SEQ ID NO: 2941665 - DNA, 13 bp, Homo sapiens
agcctgtggcctt

SEQ ID NO: 2941666 - DNA, 17 bp, Homo sapiens
agcctgtggcctttgca

SEQ ID NO: 2941667 - DNA, 14 bp, Homo sapiens
agcctgtggctgtg

SEQ ID NO: 2941668 - DNA, 18 bp, Homo sapiens
agcctgtggctgtggaga

SEQ ID NO: 2941669 - DNA, 22 bp, Homo sapiens
agcctgtggctgtggagacaat

SEQ ID NO: 2941670 - DNA, 11 bp, Homo sapiens
agcctgtttat

SEQ ID NO: 2941671 - DNA, 15 bp, Homo sapiens
agccttaactaagac

SEQ ID NO: 2941672 - DNA, 20 bp, Homo sapiens
agccttaactaagactcccg

SEQ ID NO: 2941673 - DNA, 22 bp, Homo sapiens
agccttcaccatggatcctgga

SEQ ID NO: 2941674 - DNA, 13 bp, Homo sapiens
agccttcagcagc

SEQ ID NO: 2941675 - DNA, 18 bp, Homo sapiens
agccttcagcagcagctc

SEQ ID NO: 2941676 - DNA, 19 bp, Homo sapiens
agccttcagcagcagctca

SEQ ID NO: 2941677 - DNA, 22 bp, Homo sapiens
agccttctaaatgagtcactga

SEQ ID NO: 2941678 - DNA, 20 bp, Homo sapiens
agccttcttatatctgaaga

SEQ ID NO: 2941679 - DNA, 15 bp, Homo sapiens
agccttgccagagat

SEQ ID NO: 2941680 - DNA, 17 bp, Homo sapiens
agccttgccagagatcc

SEQ ID NO: 2941681 - DNA, 14 bp, Homo sapiens
agccttgctgtaga

SEQ ID NO: 2941682 - DNA, 15 bp, Homo sapiens
agccttgctgtagag

SEQ ID NO: 2941683 - DNA, 17 bp, Homo sapiens
agccttgctgtagagac

SEQ ID NO: 2941684 - DNA, 16 bp, Homo sapiens
agccttgggcctttca

SEQ ID NO: 2941685 - DNA, 22 bp, Homo sapiens
agccttgggcctttcagtccca

SEQ ID NO: 2941686 - DNA, 19 bp, Homo sapiens
agccttgggggggctgcct

SEQ ID NO: 2941687 - DNA, 20 bp, Homo sapiens
agccttgggggggctgcctt

SEQ ID NO: 2941688 - DNA, 22 bp, Homo sapiens
agccttggttggacctattgcc

SEQ ID NO: 2941689 - DNA, 23 bp, Homo sapiens
agcctttaccctcctctatttct

SEQ ID NO: 2941690 - DNA, 19 bp, Homo sapiens
agcctttaccttttatgca

SEQ ID NO: 2941691 - DNA, 12 bp, Homo sapiens
agcctttcttcc

SEQ ID NO: 2941692 - DNA, 15 bp, Homo sapiens
agcctttcttttgga

SEQ ID NO: 2941693 - DNA, 18 bp, Homo sapiens
agcctttgggtcctgggc

SEQ ID NO: 2941694 - DNA, 19 bp, Homo sapiens
agcctttttaaaacacatg

SEQ ID NO: 2941695 - DNA, 20 bp, Homo sapiens
agcctttttaaaacacatgt

SEQ ID NO: 2941696 - DNA, 13 bp, Homo sapiens
agcgaacatcttc

SEQ ID NO: 2941697 - DNA, 16 bp, Homo sapiens
agcgaacatcttcata

SEQ ID NO: 2941698 - DNA, 12 bp, Homo sapiens
agcgaagggagt

SEQ ID NO: 2941699 - DNA, 14 bp, Homo sapiens
agcgacaaagatga

SEQ ID NO: 2941700 - DNA, 20 bp, Homo sapiens
agcgacaccctttctgtttg

SEQ ID NO: 2941701 - DNA, 20 bp, Homo sapiens
agcgacttttgttctcttct

SEQ ID NO: 2941702 - DNA, 17 bp, Homo sapiens
agcgagactccatctct

SEQ ID NO: 2941703 - DNA, 14 bp, Homo sapiens
agcgagccacagga

SEQ ID NO: 2941704 - DNA, 17 bp, Homo sapiens
agcgaggaaaaacaaca

SEQ ID NO: 2941705 - DNA, 22 bp, Homo sapiens
agccccctggcagctgcccctc

SEQ ID NO: 2941706 - DNA, 13 bp, Homo sapiens
agccccgctccca

SEQ ID NO: 2941707 - DNA, 14 bp, Homo sapiens
agcccctacccctg

SEQ ID NO: 2941708 - DNA, 17 bp, Homo sapiens
agcccctacccctgccc

SEQ ID NO: 2941709 - DNA, 21 bp, Homo sapiens
agcccctacccctgccctgct

SEQ ID NO: 2941710 - DNA, 20 bp, Homo sapiens
agcccctcagacagccccct

SEQ ID NO: 2941711 - DNA, 13 bp, Homo sapiens
agcccctccatct

SEQ ID NO: 2941712 - DNA, 13 bp, Homo sapiens
agcccctcccaag

SEQ ID NO: 2941713 - DNA, 19 bp, Homo sapiens
agcccctcccaagctggct

SEQ ID NO: 2941714 - DNA, 11 bp, Homo sapiens
agcccctcctc

SEQ ID NO: 2941715 - DNA, 15 bp, Homo sapiens
agcccctcctccccc

SEQ ID NO: 2941716 - DNA, 12 bp, Homo sapiens
agcccctcctct

SEQ ID NO: 2941717 - DNA, 23 bp, Homo sapiens
agcccctcctctgccacctcccc

SEQ ID NO: 2941718 - DNA, 18 bp, Homo sapiens
agcccctgaaagcctcac

SEQ ID NO: 2941719 - DNA, 21 bp, Homo sapiens
agcccctggggtggccaccag

SEQ ID NO: 2941720 - DNA, 22 bp, Homo sapiens
agcccctgtctagagagggagg

SEQ ID NO: 2941721 - DNA, 16 bp, Homo sapiens
agcccgcactgtccca

SEQ ID NO: 2941722 - DNA, 13 bp, Homo sapiens
agcccgcagccca

SEQ ID NO: 2941723 - DNA, 14 bp, Homo sapiens
agcccgcggcctgg

SEQ ID NO: 2941724 - DNA, 15 bp, Homo sapiens
agcccgcggcctgga

SEQ ID NO: 2941725 - DNA, 16 bp, Homo sapiens
agcccgcggcctggac

SEQ ID NO: 2941726 - DNA, 20 bp, Homo sapiens
agcccggcggggaccttggt

SEQ ID NO: 2941727 - DNA, 21 bp, Homo sapiens
agcccggcggggaccttggtc

SEQ ID NO: 2941728 - DNA, 17 bp, Homo sapiens
agcccggctcggcccag

SEQ ID NO: 2941729 - DNA, 16 bp, Homo sapiens
agcccgtgccaccccc

SEQ ID NO: 2941730 - DNA, 18 bp, Homo sapiens
agcccgtgccacccccag

SEQ ID NO: 2941731 - DNA, 17 bp, Homo sapiens
agcccgtgccctaccac

SEQ ID NO: 2941732 - DNA, 17 bp, Homo sapiens
agccctagggtggagag

SEQ ID NO: 2941733 - DNA, 15 bp, Homo sapiens
agccctcagaaccct

SEQ ID NO: 2941734 - DNA, 18 bp, Homo sapiens
agccctcagaacccttgg

SEQ ID NO: 2941735 - DNA, 13 bp, Homo sapiens
agccctccatggt

SEQ ID NO: 2941736 - DNA, 20 bp, Homo sapiens
agccctccatggtcctgtct

SEQ ID NO: 2941737 - DNA, 21 bp, Homo sapiens
agccctccatggtcctgtctg

SEQ ID NO: 2941738 - DNA, 12 bp, Homo sapiens
agccctcccact

SEQ ID NO: 2941739 - DNA, 13 bp, Homo sapiens
agccctcccactt

SEQ ID NO: 2941740 - DNA, 11 bp, Homo sapiens
agccctcccca

SEQ ID NO: 2941741 - DNA, 15 bp, Homo sapiens
agccctccctgtcct

SEQ ID NO: 2941742 - DNA, 19 bp, Homo sapiens
agccctccctgtcctcctc

SEQ ID NO: 2941743 - DNA, 20 bp, Homo sapiens
agccctccctgtcctcctcg

SEQ ID NO: 2941744 - DNA, 22 bp, Homo sapiens
agccctccctgtcctcctcgga

SEQ ID NO: 2941745 - DNA, 15 bp, Homo sapiens
agccctccgccttca

SEQ ID NO: 2941746 - DNA, 16 bp, Homo sapiens
agccctccgccttcac

SEQ ID NO: 2941747 - DNA, 13 bp, Homo sapiens
agccctcctcacc

SEQ ID NO: 2941748 - DNA, 17 bp, Homo sapiens
agccctccttaccactg

SEQ ID NO: 2941749 - DNA, 17 bp, Homo sapiens
agccctccttccacgga

SEQ ID NO: 2941750 - DNA, 16 bp, Homo sapiens
agccctctagggcagg

SEQ ID NO: 2941751 - DNA, 19 bp, Homo sapiens
agccctctagggcagggtg

SEQ ID NO: 2941752 - DNA, 13 bp, Homo sapiens
agccctctccctc

SEQ ID NO: 2941753 - DNA, 21 bp, Homo sapiens
agccctctttaatgctgtctt

SEQ ID NO: 2941754 - DNA, 22 bp, Homo sapiens
agccctctttaatgctgtcttt

SEQ ID NO: 2941755 - DNA, 16 bp, Homo sapiens
agccctgaatttcttc

SEQ ID NO: 2941756 - DNA, 18 bp, Homo sapiens
agccctgaatttcttctt

SEQ ID NO: 2941757 - DNA, 19 bp, Homo sapiens
agccctgagaaagccctgt

SEQ ID NO: 2941758 - DNA, 17 bp, Homo sapiens
agccctgattgtgccag

SEQ ID NO: 2941759 - DNA, 13 bp, Homo sapiens
agccctgccactc

SEQ ID NO: 2941760 - DNA, 16 bp, Homo sapiens
agccctggcccctcca

SEQ ID NO: 2941761 - DNA, 16 bp, Homo sapiens
agccctgggccccacc

SEQ ID NO: 2941762 - DNA, 17 bp, Homo sapiens
agccctgggccccacca

SEQ ID NO: 2941763 - DNA, 19 bp, Homo sapiens
agccctgggccccaccacc

SEQ ID NO: 2941764 - DNA, 21 bp, Homo sapiens
agccctgggccccaccaccta

SEQ ID NO: 2941765 - DNA, 23 bp, Homo sapiens
agccctgggccccaccacctagg

SEQ ID NO: 2941766 - DNA, 18 bp, Homo sapiens
agccctgtggatgagccc

SEQ ID NO: 2941767 - DNA, 19 bp, Homo sapiens
agccctgtggatgagccct

SEQ ID NO: 2941768 - DNA, 23 bp, Homo sapiens
agccctgtggatgagccctcaga

SEQ ID NO: 2941769 - DNA, 20 bp, Homo sapiens
agccctgttgacacaggtct

SEQ ID NO: 2941770 - DNA, 21 bp, Homo sapiens
agccctgttgacacaggtctt

SEQ ID NO: 2941771 - DNA, 21 bp, Homo sapiens
agccctgttgtgccacagagt

SEQ ID NO: 2941772 - DNA, 10 bp, Homo sapiens
agcccttagc

SEQ ID NO: 2941773 - DNA, 22 bp, Homo sapiens
agcccttagccttgctgtagag

SEQ ID NO: 2941774 - DNA, 12 bp, Homo sapiens
agccctttgcct

SEQ ID NO: 2941775 - DNA, 21 bp, Homo sapiens
agccgagggcgtcagagagac

SEQ ID NO: 2941776 - DNA, 18 bp, Homo sapiens
agccgattcacctgagca

SEQ ID NO: 2941777 - DNA, 21 bp, Homo sapiens
agccgcatcttctccatctgg

SEQ ID NO: 2941778 - DNA, 13 bp, Homo sapiens
agccgccctgaga

SEQ ID NO: 2941779 - DNA, 15 bp, Homo sapiens
agccgctctcctgcc

SEQ ID NO: 2941780 - DNA, 17 bp, Homo sapiens
agccgctctcctgccac

SEQ ID NO: 2941781 - DNA, 15 bp, Homo sapiens
agccgctgagcgagg

SEQ ID NO: 2941782 - DNA, 12 bp, Homo sapiens
agccgctgccct

SEQ ID NO: 2941783 - DNA, 15 bp, Homo sapiens
agccgctgccctggg

SEQ ID NO: 2941784 - DNA, 14 bp, Homo sapiens
agccggaaggccga

SEQ ID NO: 2941785 - DNA, 19 bp, Homo sapiens
agccggacacttctcagga

SEQ ID NO: 2941786 - DNA, 17 bp, Homo sapiens
agcattccaacaaaggg

SEQ ID NO: 2941787 - DNA, 17 bp, Homo sapiens
agcattctggcagtttt

SEQ ID NO: 2941788 - DNA, 17 bp, Homo sapiens
agcattggatacagcag

SEQ ID NO: 2941789 - DNA, 13 bp, Homo sapiens
agcattgtaatta

SEQ ID NO: 2941790 - DNA, 16 bp, Homo sapiens
agcattgtaattatgt

SEQ ID NO: 2941791 - DNA, 16 bp, Homo sapiens
agcattgttgagctgt

SEQ ID NO: 2941792 - DNA, 21 bp, Homo sapiens
agcatttaccaacatgtatct

SEQ ID NO: 2941793 - DNA, 16 bp, Homo sapiens
agcatttatgtagaca

SEQ ID NO: 2941794 - DNA, 20 bp, Homo sapiens
agcatttatgtagacattgt

SEQ ID NO: 2941795 - DNA, 19 bp, Homo sapiens
agcatttgattaacatttg

SEQ ID NO: 2941796 - DNA, 14 bp, Homo sapiens
agcatttgtttcta

SEQ ID NO: 2941797 - DNA, 21 bp, Homo sapiens
agcattttcagcatcaaacat

SEQ ID NO: 2941798 - DNA, 20 bp, Homo sapiens
agcattttccagcactttgc

SEQ ID NO: 2941799 - DNA, 13 bp, Homo sapiens
agcattttgctaa

SEQ ID NO: 2941800 - DNA, 21 bp, Homo sapiens
agccaaacatatatatactat

SEQ ID NO: 2941801 - DNA, 22 bp, Homo sapiens
agccaacacgcacctgcctcag

SEQ ID NO: 2941802 - DNA, 12 bp, Homo sapiens
agccaacagcta

SEQ ID NO: 2941803 - DNA, 19 bp, Homo sapiens
agccaactctcccaaaggg

SEQ ID NO: 2941804 - DNA, 16 bp, Homo sapiens
agccaagaaagatgta

SEQ ID NO: 2941805 - DNA, 17 bp, Homo sapiens
agccaagaaagatgtat

SEQ ID NO: 2941806 - DNA, 14 bp, Homo sapiens
agccaagatcgcac

SEQ ID NO: 2941807 - DNA, 22 bp, Homo sapiens
agccaagatcgcaccactgcac

SEQ ID NO: 2941808 - DNA, 17 bp, Homo sapiens
agccaagctccttggga

SEQ ID NO: 2941809 - DNA, 15 bp, Homo sapiens
agccaagctgtgttc

SEQ ID NO: 2941810 - DNA, 16 bp, Homo sapiens
agccaagctgtgttca

SEQ ID NO: 2941811 - DNA, 18 bp, Homo sapiens
agccaagctgtgttcatc

SEQ ID NO: 2941812 - DNA, 23 bp, Homo sapiens
agccaatccctcaccttctgagt

SEQ ID NO: 2941813 - DNA, 16 bp, Homo sapiens
agccaatctggacact

SEQ ID NO: 2941814 - DNA, 23 bp, Homo sapiens
agccaatctggacacttctttat

SEQ ID NO: 2941815 - DNA, 14 bp, Homo sapiens
agccaattagactt

SEQ ID NO: 2941816 - DNA, 17 bp, Homo sapiens
agccaattcagacaggc

SEQ ID NO: 2941817 - DNA, 18 bp, Homo sapiens
agccaattcagacaggca

SEQ ID NO: 2941818 - DNA, 17 bp, Homo sapiens
agccacacacacagaaa

SEQ ID NO: 2941819 - DNA, 18 bp, Homo sapiens
agccacacacacagaaaa

SEQ ID NO: 2941820 - DNA, 14 bp, Homo sapiens
agccacaccaggat

SEQ ID NO: 2941821 - DNA, 12 bp, Homo sapiens
agccacacgcag

SEQ ID NO: 2941822 - DNA, 12 bp, Homo sapiens
agccacagccca

SEQ ID NO: 2941823 - DNA, 13 bp, Homo sapiens
agccacagcccag

SEQ ID NO: 2941824 - DNA, 15 bp, Homo sapiens
agccacaggaacggc

SEQ ID NO: 2941825 - DNA, 18 bp, Homo sapiens
agccacaggaacggccct

SEQ ID NO: 2941826 - DNA, 17 bp, Homo sapiens
agccacaggagccctgc

SEQ ID NO: 2941827 - DNA, 18 bp, Homo sapiens
agccacatgccccaggct

SEQ ID NO: 2941828 - DNA, 20 bp, Homo sapiens
agccacatgccccaggctct

SEQ ID NO: 2941829 - DNA, 22 bp, Homo sapiens
agccacatgccccaggctctcg

SEQ ID NO: 2941830 - DNA, 18 bp, Homo sapiens
agataatgtgaaaatggt

SEQ ID NO: 2941831 - DNA, 23 bp, Homo sapiens
agatacaatgtatttatttaaaa

SEQ ID NO: 2941832 - DNA, 14 bp, Homo sapiens
agataccagcgagg

SEQ ID NO: 2941833 - DNA, 19 bp, Homo sapiens
agataccagcgaggaggct

SEQ ID NO: 2941834 - DNA, 22 bp, Homo sapiens
agatacgggggctgtgactctg

SEQ ID NO: 2941835 - DNA, 14 bp, Homo sapiens
agatactattttca

SEQ ID NO: 2941836 - DNA, 22 bp, Homo sapiens
agatactgcatgtttgctgttc

SEQ ID NO: 2941837 - DNA, 22 bp, Homo sapiens
agatactgctgatgctgaaata

SEQ ID NO: 2941838 - DNA, 16 bp, Homo sapiens
agatactgctgtgtaa

SEQ ID NO: 2941839 - DNA, 16 bp, Homo sapiens
agatacttacatgttc

SEQ ID NO: 2941840 - DNA, 12 bp, Homo sapiens
agatacttcagc

SEQ ID NO: 2941841 - DNA, 22 bp, Homo sapiens
agatagagagttgttgtgtaca

SEQ ID NO: 2941842 - DNA, 22 bp, Homo sapiens
agatagcattgtgaactgacag

SEQ ID NO: 2941843 - DNA, 21 bp, Homo sapiens
agatagctcaatactctctga

SEQ ID NO: 2941844 - DNA, 12 bp, Homo sapiens
agatataaatac

SEQ ID NO: 2941845 - DNA, 13 bp, Homo sapiens
agatatatattca

SEQ ID NO: 2941846 - DNA, 19 bp, Homo sapiens
agatatatattcaccaatg

SEQ ID NO: 2941847 - DNA, 14 bp, Homo sapiens
agatatatgccttc

SEQ ID NO: 2941848 - DNA, 14 bp, Homo sapiens
agatatcttttctt

SEQ ID NO: 2941849 - DNA, 17 bp, Homo sapiens
agatatgaacagggccc

SEQ ID NO: 2941850 - DNA, 15 bp, Homo sapiens
agatatgagttgttt

SEQ ID NO: 2941851 - DNA, 19 bp, Homo sapiens
agatattaaaatttggtgc

SEQ ID NO: 2941852 - DNA, 19 bp, Homo sapiens
agatattataagggagagc

SEQ ID NO: 2941853 - DNA, 13 bp, Homo sapiens
agatattctgctc

SEQ ID NO: 2941854 - DNA, 16 bp, Homo sapiens
agatattggacaaaga

SEQ ID NO: 2941855 - DNA, 20 bp, Homo sapiens
agatatttaaaagacaaaca

SEQ ID NO: 2941856 - DNA, 21 bp, Homo sapiens
agatatttaaaagacaaacac

SEQ ID NO: 2941857 - DNA, 23 bp, Homo sapiens
agatatttaagtataaaatacaa

SEQ ID NO: 2941858 - DNA, 12 bp, Homo sapiens
agatatttcatg

SEQ ID NO: 2941859 - DNA, 17 bp, Homo sapiens
agatatttcttcaggag

SEQ ID NO: 2941860 - DNA, 14 bp, Homo sapiens
agatcaaatttcac

SEQ ID NO: 2941861 - DNA, 14 bp, Homo sapiens
agatcaagctgtga

SEQ ID NO: 2941862 - DNA, 12 bp, Homo sapiens
agatcactcctg

SEQ ID NO: 2941863 - DNA, 22 bp, Homo sapiens
agatcactgcaacctctgcctc

SEQ ID NO: 2941864 - DNA, 16 bp, Homo sapiens
agatcactttttaaac

SEQ ID NO: 2941865 - DNA, 18 bp, Homo sapiens
agatcagatgctccaaga

SEQ ID NO: 2941866 - DNA, 15 bp, Homo sapiens
agatcagtgtaccat

SEQ ID NO: 2941867 - DNA, 18 bp, Homo sapiens
agatcagtgtaccatttg

SEQ ID NO: 2941868 - DNA, 13 bp, Homo sapiens
agatcataaggct

SEQ ID NO: 2941869 - DNA, 22 bp, Homo sapiens
agatcatctggggacctggttt

SEQ ID NO: 2941870 - DNA, 20 bp, Homo sapiens
agatcattgaagaccagctt

SEQ ID NO: 2941871 - DNA, 23 bp, Homo sapiens
agatccaaaagaagcccccagct

SEQ ID NO: 2941872 - DNA, 14 bp, Homo sapiens
agatccaaagactc

SEQ ID NO: 2941873 - DNA, 21 bp, Homo sapiens
agatccaagctcctattagaa

SEQ ID NO: 2941874 - DNA, 12 bp, Homo sapiens
agatccaggact

SEQ ID NO: 2941875 - DNA, 14 bp, Homo sapiens
agatccaggcttct

SEQ ID NO: 2941876 - DNA, 16 bp, Homo sapiens
agatccaggcttctcc

SEQ ID NO: 2941877 - DNA, 19 bp, Homo sapiens
agatccagggacagaggcc

SEQ ID NO: 2941878 - DNA, 19 bp, Homo sapiens
agatcccaacactgccagc

SEQ ID NO: 2941879 - DNA, 21 bp, Homo sapiens
agatcctacttctctgagtca

SEQ ID NO: 2941880 - DNA, 16 bp, Homo sapiens
agatcctagatcctaa

SEQ ID NO: 2941881 - DNA, 15 bp, Homo sapiens
agatcctgtgaggag

SEQ ID NO: 2941882 - DNA, 18 bp, Homo sapiens
agatccttgtttcaaaca

SEQ ID NO: 2941883 - DNA, 22 bp, Homo sapiens
agatcgcaccactgcactccag

SEQ ID NO: 2941884 - DNA, 18 bp, Homo sapiens
agatcgctcccttggctt

SEQ ID NO: 2941885 - DNA, 21 bp, Homo sapiens
agatcggatccagtttcccat

SEQ ID NO: 2941886 - DNA, 21 bp, Homo sapiens
agatcgtgccgttactctcca

SEQ ID NO: 2941887 - DNA, 22 bp, Homo sapiens
agatcgtgccgttactctccaa

SEQ ID NO: 2941888 - DNA, 19 bp, Homo sapiens
agatctacctgcaacacaa

SEQ ID NO: 2941889 - DNA, 16 bp, Homo sapiens
agatctcatgtcctct

SEQ ID NO: 2941890 - DNA, 14 bp, Homo sapiens
agatctctcctgca

SEQ ID NO: 2941891 - DNA, 14 bp, Homo sapiens
agatctgatttata

SEQ ID NO: 2941892 - DNA, 14 bp, Homo sapiens
agatctgcacagtc

SEQ ID NO: 2941893 - DNA, 17 bp, Homo sapiens
agatctgcacagtcaga

SEQ ID NO: 2941894 - DNA, 20 bp, Homo sapiens
agatctgcaccaccatgccc

SEQ ID NO: 2941895 - DNA, 15 bp, Homo sapiens
agatctgctttctgt

SEQ ID NO: 2941896 - DNA, 18 bp, Homo sapiens
agatctgctttctgttca

SEQ ID NO: 2941897 - DNA, 21 bp, Homo sapiens
agatctgctttctgttcatct

SEQ ID NO: 2941898 - DNA, 22 bp, Homo sapiens
agatctgctttctgttcatctc

SEQ ID NO: 2941899 - DNA, 17 bp, Homo sapiens
agatctgtcctcagcct

SEQ ID NO: 2941900 - DNA, 18 bp, Homo sapiens
agatctgtcctcagcctt

SEQ ID NO: 2941901 - DNA, 18 bp, Homo sapiens
agatctgttttgaaggca

SEQ ID NO: 2941902 - DNA, 15 bp, Homo sapiens
agatcttagattctc

SEQ ID NO: 2941903 - DNA, 15 bp, Homo sapiens
agatctttatatttc

SEQ ID NO: 2941904 - DNA, 23 bp, Homo sapiens
agatctttcgttggttgtttctc

SEQ ID NO: 2941905 - DNA, 23 bp, Homo sapiens
agatgaaaacctgcatttttaaa

SEQ ID NO: 2941906 - DNA, 18 bp, Homo sapiens
agatgaaaccgtccctga

SEQ ID NO: 2941907 - DNA, 18 bp, Homo sapiens
agatgacataaaatttac

SEQ ID NO: 2941908 - DNA, 22 bp, Homo sapiens
agatgacattgctaagatgctc

SEQ ID NO: 2941909 - DNA, 20 bp, Homo sapiens
agatgagaaatgatgaaaag

SEQ ID NO: 2941910 - DNA, 15 bp, Homo sapiens
agatgagcagtgagt

SEQ ID NO: 2941911 - DNA, 17 bp, Homo sapiens
agatgagttatctaaga

SEQ ID NO: 2941912 - DNA, 16 bp, Homo sapiens
agatgatacatccaaa

SEQ ID NO: 2941913 - DNA, 20 bp, Homo sapiens
agatgatacatccaaagcag

SEQ ID NO: 2941914 - DNA, 17 bp, Homo sapiens
agatgatcgctgtattt

SEQ ID NO: 2941915 - DNA, 16 bp, Homo sapiens
agatgatgctttggaa

SEQ ID NO: 2941916 - DNA, 17 bp, Homo sapiens
agatgatgctttggaag

SEQ ID NO: 2941917 - DNA, 19 bp, Homo sapiens
agatgattaaataagattc

SEQ ID NO: 2941918 - DNA, 22 bp, Homo sapiens
agatgattaaataagattctaa

SEQ ID NO: 2941919 - DNA, 21 bp, Homo sapiens
agatgattgttcttttgtttc

SEQ ID NO: 2941920 - DNA, 22 bp, Homo sapiens
agatgattgttcttttgtttca

SEQ ID NO: 2941921 - DNA, 19 bp, Homo sapiens
agatgatttaaaagggaag

SEQ ID NO: 2941922 - DNA, 16 bp, Homo sapiens
agatgcaaagaggcaa

SEQ ID NO: 2941923 - DNA, 18 bp, Homo sapiens
agatgcaaagaggcaaga

SEQ ID NO: 2941924 - DNA, 15 bp, Homo sapiens
agatgcaagtctctt

SEQ ID NO: 2941925 - DNA, 15 bp, Homo sapiens
agatgcagaaaaaga

SEQ ID NO: 2941926 - DNA, 16 bp, Homo sapiens
agatgcagaaaaagaa

SEQ ID NO: 2941927 - DNA, 19 bp, Homo sapiens
agatgcagagtaagtatta

SEQ ID NO: 2941928 - DNA, 13 bp, Homo sapiens
agatgcagctgga

SEQ ID NO: 2941929 - DNA, 22 bp, Homo sapiens
agatgcaggtttgaccaggaaa

SEQ ID NO: 2941930 - DNA, 23 bp, Homo sapiens
agatgcaggtttgaccaggaaag

SEQ ID NO: 2941931 - DNA, 19 bp, Homo sapiens
agatgcattttgtgtacag

SEQ ID NO: 2941932 - DNA, 15 bp, Homo sapiens
agatgcctgaagcca

SEQ ID NO: 2941933 - DNA, 20 bp, Homo sapiens
agatgcgcagccccatctgt

SEQ ID NO: 2941934 - DNA, 14 bp, Homo sapiens
agatgcggggacag

SEQ ID NO: 2941935 - DNA, 20 bp, Homo sapiens
agatgcgtcccaagatgttg

SEQ ID NO: 2941936 - DNA, 21 bp, Homo sapiens
agatgctagcgcgttgcctgt

SEQ ID NO: 2941937 - DNA, 20 bp, Homo sapiens
agatgctcaaagttgttttt

SEQ ID NO: 2941938 - DNA, 19 bp, Homo sapiens
agatgctccaagattctag

SEQ ID NO: 2941939 - DNA, 20 bp, Homo sapiens
agatgctccttgggcccttt

SEQ ID NO: 2941940 - DNA, 18 bp, Homo sapiens
agatgctctatcttgctc

SEQ ID NO: 2941941 - DNA, 15 bp, Homo sapiens
agatgctcttctgtg

SEQ ID NO: 2941942 - DNA, 11 bp, Homo sapiens
agatgctgatg

SEQ ID NO: 2941943 - DNA, 16 bp, Homo sapiens
agatgctgatgttcag

SEQ ID NO: 2941944 - DNA, 18 bp, Homo sapiens
agatgctgatgttcagtg

SEQ ID NO: 2941945 - DNA, 22 bp, Homo sapiens
agatgctgatgttcagtgtaat

SEQ ID NO: 2941946 - DNA, 19 bp, Homo sapiens
agatgctgcagagtcacaa

SEQ ID NO: 2941947 - DNA, 14 bp, Homo sapiens
agatgctggcccag

SEQ ID NO: 2941948 - DNA, 17 bp, Homo sapiens
agatgctggcccagggc

SEQ ID NO: 2941949 - DNA, 15 bp, Homo sapiens
agatgctggcctctt

SEQ ID NO: 2941950 - DNA, 17 bp, Homo sapiens
agatgctggcttgggca

SEQ ID NO: 2941951 - DNA, 19 bp, Homo sapiens
agatgctggcttgggcagc

SEQ ID NO: 2941952 - DNA, 16 bp, Homo sapiens
agatgctgtgagtctt

SEQ ID NO: 2941953 - DNA, 16 bp, Homo sapiens
agatgctgtgtatatg

SEQ ID NO: 2941954 - DNA, 19 bp, Homo sapiens
agatgctgtgtatatggta

SEQ ID NO: 2941955 - DNA, 15 bp, Homo sapiens
agatgcttctgggag

SEQ ID NO: 2941956 - DNA, 20 bp, Homo sapiens
agatgcttggagcaatcaga

SEQ ID NO: 2941957 - DNA, 17 bp, Homo sapiens
agatggaaaaacttgtg

SEQ ID NO: 2941958 - DNA, 17 bp, Homo sapiens
agatggaaccgcaggaa

SEQ ID NO: 2941959 - DNA, 11 bp, Homo sapiens
agatggagtcc

SEQ ID NO: 2941960 - DNA, 13 bp, Homo sapiens
agatggagtttct

SEQ ID NO: 2941961 - DNA, 14 bp, Homo sapiens
agatggagtttcta

SEQ ID NO: 2941962 - DNA, 18 bp, Homo sapiens
agatggagtttctaaggt

SEQ ID NO: 2941963 - DNA, 20 bp, Homo sapiens
agatggataaactgagcctc

SEQ ID NO: 2941964 - DNA, 20 bp, Homo sapiens
agatggcaatagtcattaaa

SEQ ID NO: 2941965 - DNA, 17 bp, Homo sapiens
agatggcatcctgtgaa

SEQ ID NO: 2941966 - DNA, 16 bp, Homo sapiens
agagcttttaaaaatg

SEQ ID NO: 2941967 - DNA, 12 bp, Homo sapiens
agaggaaaaccc

SEQ ID NO: 2941968 - DNA, 18 bp, Homo sapiens
agaggaaaaccctcaagg

SEQ ID NO: 2941969 - DNA, 22 bp, Homo sapiens
agaggaaaagctgtaagaaaat

SEQ ID NO: 2941970 - DNA, 14 bp, Homo sapiens
agaggaaccaaccc

SEQ ID NO: 2941971 - DNA, 12 bp, Homo sapiens
agaggaagagaa

SEQ ID NO: 2941972 - DNA, 16 bp, Homo sapiens
agaggaagagaagccc

SEQ ID NO: 2941973 - DNA, 19 bp, Homo sapiens
agaggaaggacccctcacc

SEQ ID NO: 2941974 - DNA, 18 bp, Homo sapiens
agaggaaggggccagagg

SEQ ID NO: 2941975 - DNA, 17 bp, Homo sapiens
agaggaatattatgact

SEQ ID NO: 2941976 - DNA, 20 bp, Homo sapiens
agaggaatttaaagaggaaa

SEQ ID NO: 2941977 - DNA, 16 bp, Homo sapiens
agaggacaagggaaat

SEQ ID NO: 2941978 - DNA, 15 bp, Homo sapiens
agaggaccggcggct

SEQ ID NO: 2941979 - DNA, 12 bp, Homo sapiens
agaggagacagc

SEQ ID NO: 2941980 - DNA, 13 bp, Homo sapiens
agaggagacagcc

SEQ ID NO: 2941981 - DNA, 14 bp, Homo sapiens
agaggagagccaga

SEQ ID NO: 2941982 - DNA, 21 bp, Homo sapiens
agaggagagccagagaagtga

SEQ ID NO: 2941983 - DNA, 16 bp, Homo sapiens
agaggagcatcagctg

SEQ ID NO: 2941984 - DNA, 23 bp, Homo sapiens
agaggagcatcagctgtctgtca

SEQ ID NO: 2941985 - DNA, 21 bp, Homo sapiens
agaggagcccagtgggctgca

SEQ ID NO: 2941986 - DNA, 13 bp, Homo sapiens
agaggagcctcag

SEQ ID NO: 2941987 - DNA, 19 bp, Homo sapiens
agaggagcctcagaagaaa

SEQ ID NO: 2941988 - DNA, 11 bp, Homo sapiens
agaggagcctt

SEQ ID NO: 2941989 - DNA, 22 bp, Homo sapiens
agaggagcctttttaaaacaca

SEQ ID NO: 2941990 - DNA, 12 bp, Homo sapiens
agaggaggggcc

SEQ ID NO: 2941991 - DNA, 18 bp, Homo sapiens
agaggatgatttcagaag

SEQ ID NO: 2941992 - DNA, 12 bp, Homo sapiens
agaggcagaggt

SEQ ID NO: 2941993 - DNA, 16 bp, Homo sapiens
agaggcagcccgcaca

SEQ ID NO: 2941994 - DNA, 17 bp, Homo sapiens
agaggcatttaaaatgg

SEQ ID NO: 2941995 - DNA, 19 bp, Homo sapiens
agaggcatttaaaatggaa

SEQ ID NO: 2941996 - DNA, 19 bp, Homo sapiens
agaggccaacactgtgggt

SEQ ID NO: 2941997 - DNA, 18 bp, Homo sapiens
agaggccagacatggtgt

SEQ ID NO: 2941998 - DNA, 21 bp, Homo sapiens
agaggccattctttcccaaca

SEQ ID NO: 2941999 - DNA, 15 bp, Homo sapiens
agaggccccagcctc

SEQ ID NO: 2942000 - DNA, 14 bp, Homo sapiens
agaggccctcgctg

SEQ ID NO: 2942001 - DNA, 21 bp, Homo sapiens
agaggccctctggagtggcca

SEQ ID NO: 2942002 - DNA, 21 bp, Homo sapiens
agaggccgagcggtggccccg

SEQ ID NO: 2942003 - DNA, 18 bp, Homo sapiens
agaggcctgaagctgagc

SEQ ID NO: 2942004 - DNA, 21 bp, Homo sapiens
agaggcctgggggacccctgg

SEQ ID NO: 2942005 - DNA, 14 bp, Homo sapiens
agaggcctgttcat

SEQ ID NO: 2942006 - DNA, 22 bp, Homo sapiens
agaggcgtgtgcaggccgacag

SEQ ID NO: 2942007 - DNA, 14 bp, Homo sapiens
agaggctgcacttg

SEQ ID NO: 2942008 - DNA, 13 bp, Homo sapiens
agaggctgcattg

SEQ ID NO: 2942009 - DNA, 21 bp, Homo sapiens
agaggctgcctccgcacctga

SEQ ID NO: 2942010 - DNA, 17 bp, Homo sapiens
agaggctgtgtccctgc

SEQ ID NO: 2942011 - DNA, 22 bp, Homo sapiens
agaggctgtgtccctgctgggg

SEQ ID NO: 2942012 - DNA, 14 bp, Homo sapiens
agaggcttcttcag

SEQ ID NO: 2942013 - DNA, 21 bp, Homo sapiens
agaggcttcttcagatcagtg

SEQ ID NO: 2942014 - DNA, 16 bp, Homo sapiens
agaggctttggcccaa

SEQ ID NO: 2942015 - DNA, 23 bp, Homo sapiens
agagggaagaaaagagctttctt

SEQ ID NO: 2942016 - DNA, 12 bp, Homo sapiens
agagggaagcca

SEQ ID NO: 2942017 - DNA, 23 bp, Homo sapiens
agagggacataagataaaatgat

SEQ ID NO: 2942018 - DNA, 22 bp, Homo sapiens
agagggaccaaattgcttctag

SEQ ID NO: 2942019 - DNA, 16 bp, Homo sapiens
agagggacctctccca

SEQ ID NO: 2942020 - DNA, 15 bp, Homo sapiens
agagggacgcctggg

SEQ ID NO: 2942021 - DNA, 13 bp, Homo sapiens
agagggagaagaa

SEQ ID NO: 2942022 - DNA, 15 bp, Homo sapiens
agagggagaagactg

SEQ ID NO: 2942023 - DNA, 22 bp, Homo sapiens
agagggaggaatgtgtgccttg

SEQ ID NO: 2942024 - DNA, 17 bp, Homo sapiens
agagggatgcatggaga

SEQ ID NO: 2942025 - DNA, 14 bp, Homo sapiens
agagggcgctcctg

SEQ ID NO: 2942026 - DNA, 11 bp, Homo sapiens
agagggctgga

SEQ ID NO: 2942027 - DNA, 16 bp, Homo sapiens
agaggggaaaagagat

SEQ ID NO: 2942028 - DNA, 14 bp, Homo sapiens
agaggggagggagg

SEQ ID NO: 2942029 - DNA, 16 bp, Homo sapiens
agaggggcctgatgag

SEQ ID NO: 2942030 - DNA, 17 bp, Homo sapiens
agagggggaggggaagc

SEQ ID NO: 2942031 - DNA, 15 bp, Homo sapiens
agagggtcacagtgt

SEQ ID NO: 2942032 - DNA, 22 bp, Homo sapiens
agagggtctggagaagcagtga

SEQ ID NO: 2942033 - DNA, 15 bp, Homo sapiens
agagggtgtcatcta

SEQ ID NO: 2942034 - DNA, 16 bp, Homo sapiens
agagggtgtcctgcac

SEQ ID NO: 2942035 - DNA, 15 bp, Homo sapiens
agaggtaaaaaaaag

SEQ ID NO: 2942036 - DNA, 20 bp, Homo sapiens
agaggtgggtggtgggcttc

SEQ ID NO: 2942037 - DNA, 21 bp, Homo sapiens
agaggtgggtggtgggcttct

SEQ ID NO: 2942038 - DNA, 22 bp, Homo sapiens
agaggtttgactagatgatgga

SEQ ID NO: 2942039 - DNA, 18 bp, Homo sapiens
agagtaaaggaaatgatt

SEQ ID NO: 2942040 - DNA, 14 bp, Homo sapiens
agagtaagacattg

SEQ ID NO: 2942041 - DNA, 15 bp, Homo sapiens
agagtacactgtgtc

SEQ ID NO: 2942042 - DNA, 16 bp, Homo sapiens
agagtacactgtgtct

SEQ ID NO: 2942043 - DNA, 17 bp, Homo sapiens
agagtactattaataga

SEQ ID NO: 2942044 - DNA, 13 bp, Homo sapiens
agagtagaaagct

SEQ ID NO: 2942045 - DNA, 15 bp, Homo sapiens
agagtagaattgcat

SEQ ID NO: 2942046 - DNA, 18 bp, Homo sapiens
agagtagaattgcattga

SEQ ID NO: 2942047 - DNA, 22 bp, Homo sapiens
agagtagccgagagcctgctcc

SEQ ID NO: 2942048 - DNA, 18 bp, Homo sapiens
agagtagggtagaaggaa

SEQ ID NO: 2942049 - DNA, 21 bp, Homo sapiens
agagtatttggaaaaagaaaa

SEQ ID NO: 2942050 - DNA, 14 bp, Homo sapiens
agagtcacaagcct

SEQ ID NO: 2942051 - DNA, 17 bp, Homo sapiens
agagtccatttcccaca

SEQ ID NO: 2942052 - DNA, 23 bp, Homo sapiens
agagtccatttcccacatctttc

SEQ ID NO: 2942053 - DNA, 17 bp, Homo sapiens
agagtctaaagatggag

SEQ ID NO: 2942054 - DNA, 23 bp, Homo sapiens
agagtctagattcaaaggttcta

SEQ ID NO: 2942055 - DNA, 15 bp, Homo sapiens
agagtctccttctct

SEQ ID NO: 2942056 - DNA, 19 bp, Homo sapiens
agagtctccttctcttctc

SEQ ID NO: 2942057 - DNA, 21 bp, Homo sapiens
agagtctctacccctttctgt

SEQ ID NO: 2942058 - DNA, 12 bp, Homo sapiens
agagtctctggc

SEQ ID NO: 2942059 - DNA, 13 bp, Homo sapiens
agagtctctggct

SEQ ID NO: 2942060 - DNA, 17 bp, Homo sapiens
agagtctctggctcagc

SEQ ID NO: 2942061 - DNA, 16 bp, Homo sapiens
agagtctgaacctatt

SEQ ID NO: 2942062 - DNA, 19 bp, Homo sapiens
agagtgaaatattgtaaat

SEQ ID NO: 2942063 - DNA, 23 bp, Homo sapiens
agagtgacacccaagagggctgc

SEQ ID NO: 2942064 - DNA, 16 bp, Homo sapiens
agagtgctctgaccct

SEQ ID NO: 2942065 - DNA, 19 bp, Homo sapiens
agagtgctctgaccctggg

SEQ ID NO: 2942066 - DNA, 18 bp, Homo sapiens
agagtggcgtgagctgcc

SEQ ID NO: 2942067 - DNA, 20 bp, Homo sapiens
agagtggcgtgagctgcccg

SEQ ID NO: 2942068 - DNA, 15 bp, Homo sapiens
agagtgtcaaccaga

SEQ ID NO: 2942069 - DNA, 22 bp, Homo sapiens
agagtgtccctttttgcagggg

SEQ ID NO: 2942070 - DNA, 23 bp, Homo sapiens
agagtgtccctttttgcagggga

SEQ ID NO: 2942071 - DNA, 20 bp, Homo sapiens
agagtgtcttcacggcagga

SEQ ID NO: 2942072 - DNA, 22 bp, Homo sapiens
agagtgtcttcacggcaggaca

SEQ ID NO: 2942073 - DNA, 16 bp, Homo sapiens
agagtgtgtttttgca

SEQ ID NO: 2942074 - DNA, 18 bp, Homo sapiens
agagtgttcctgagacag

SEQ ID NO: 2942075 - DNA, 16 bp, Homo sapiens
agagttaaaagcagca

SEQ ID NO: 2942076 - DNA, 22 bp, Homo sapiens
agagttaaaatgtttactgtaa

SEQ ID NO: 2942077 - DNA, 16 bp, Homo sapiens
agagttattcaaatga

SEQ ID NO: 2942078 - DNA, 19 bp, Homo sapiens
agagttattcaaatgaagg

SEQ ID NO: 2942079 - DNA, 21 bp, Homo sapiens
agagtttatacagtgtacatg

SEQ ID NO: 2942080 - DNA, 21 bp, Homo sapiens
agagtttatttttttgatggc

SEQ ID NO: 2942081 - DNA, 23 bp, Homo sapiens
agagtttatttttttgatggcta

SEQ ID NO: 2942082 - DNA, 17 bp, Homo sapiens
agagtttctgcagttcc

SEQ ID NO: 2942083 - DNA, 14 bp, Homo sapiens
agagtttgaaactc

SEQ ID NO: 2942084 - DNA, 22 bp, Homo sapiens
agagtttgaaactcgagaccat

SEQ ID NO: 2942085 - DNA, 16 bp, Homo sapiens
agagtttggtttggtc

SEQ ID NO: 2942086 - DNA, 13 bp, Homo sapiens
agagtttgtgtgt

SEQ ID NO: 2942087 - DNA, 19 bp, Homo sapiens
agagtttgtgtgttgtctt

SEQ ID NO: 2942088 - DNA, 15 bp, Homo sapiens
agataaaatgatgtt

SEQ ID NO: 2942089 - DNA, 23 bp, Homo sapiens
agataaacagaaatgctctgatt

SEQ ID NO: 2942090 - DNA, 16 bp, Homo sapiens
agataaagaataataa

SEQ ID NO: 2942091 - DNA, 17 bp, Homo sapiens
agataaagatttcttga

SEQ ID NO: 2942092 - DNA, 18 bp, Homo sapiens
agataaagatttcttgag

SEQ ID NO: 2942093 - DNA, 22 bp, Homo sapiens
agataaaggaaacatataacta

SEQ ID NO: 2942094 - DNA, 12 bp, Homo sapiens
agataaatatta

SEQ ID NO: 2942095 - DNA, 13 bp, Homo sapiens
agataacattttc

SEQ ID NO: 2942096 - DNA, 14 bp, Homo sapiens
agataactgctgta

SEQ ID NO: 2942097 - DNA, 18 bp, Homo sapiens
agataaggtaaaatgcca

SEQ ID NO: 2942098 - DNA, 21 bp, Homo sapiens
agataagtgttcttcagtgta

SEQ ID NO: 2942099 - DNA, 13 bp, Homo sapiens
agataatccctgt

SEQ ID NO: 2942100 - DNA, 16 bp, Homo sapiens
agataatcttttacat

SEQ ID NO: 2942101 - DNA, 17 bp, Homo sapiens
agataatcttttacatt

SEQ ID NO: 2942102 - DNA, 12 bp, Homo sapiens
agacttgtttcc

SEQ ID NO: 2942103 - DNA, 13 bp, Homo sapiens
agacttgtttcct

SEQ ID NO: 2942104 - DNA, 14 bp, Homo sapiens
agacttgtttcctg

SEQ ID NO: 2942105 - DNA, 20 bp, Homo sapiens
agactttaggctttcagctt

SEQ ID NO: 2942106 - DNA, 22 bp, Homo sapiens
agactttaggctttcagcttac

SEQ ID NO: 2942107 - DNA, 16 bp, Homo sapiens
agactttctgttacta

SEQ ID NO: 2942108 - DNA, 14 bp, Homo sapiens
agactttctttaaa

SEQ ID NO: 2942109 - DNA, 14 bp, Homo sapiens
agactttggaaaat

SEQ ID NO: 2942110 - DNA, 22 bp, Homo sapiens
agactttggaaaatgcattgta

SEQ ID NO: 2942111 - DNA, 16 bp, Homo sapiens
agagaaaaaaaaacac

SEQ ID NO: 2942112 - DNA, 22 bp, Homo sapiens
agagaaaaaaaaacacacaaaa

SEQ ID NO: 2942113 - DNA, 14 bp, Homo sapiens
agagaaaaagaaag

SEQ ID NO: 2942114 - DNA, 12 bp, Homo sapiens
agagaaaaagag

SEQ ID NO: 2942115 - DNA, 13 bp, Homo sapiens
agagaaaacactt

SEQ ID NO: 2942116 - DNA, 14 bp, Homo sapiens
agagaaaacacttt

SEQ ID NO: 2942117 - DNA, 12 bp, Homo sapiens
agagaaaataaa

SEQ ID NO: 2942118 - DNA, 14 bp, Homo sapiens
agagaaaataaaaa

SEQ ID NO: 2942119 - DNA, 19 bp, Homo sapiens
agagaaaataaaaagttaa

SEQ ID NO: 2942120 - DNA, 18 bp, Homo sapiens
agagaaaatgagaaagga

SEQ ID NO: 2942121 - DNA, 16 bp, Homo sapiens
agagaaagaaagggaa

SEQ ID NO: 2942122 - DNA, 23 bp, Homo sapiens
agagaaagaaagggaaactggct

SEQ ID NO: 2942123 - DNA, 16 bp, Homo sapiens
agagaaagaaatagaa

SEQ ID NO: 2942124 - DNA, 15 bp, Homo sapiens
agagaaagcacaatt

SEQ ID NO: 2942125 - DNA, 19 bp, Homo sapiens
agagaaagttggtgctgct

SEQ ID NO: 2942126 - DNA, 21 bp, Homo sapiens
agagaaagttggtgctgctca

SEQ ID NO: 2942127 - DNA, 17 bp, Homo sapiens
agagaaccagtgcagac

SEQ ID NO: 2942128 - DNA, 22 bp, Homo sapiens
agagaacctcacgcacctccca

SEQ ID NO: 2942129 - DNA, 17 bp, Homo sapiens
agagaacctttccactc

SEQ ID NO: 2942130 - DNA, 14 bp, Homo sapiens
agagaactgaaaag

SEQ ID NO: 2942131 - DNA, 13 bp, Homo sapiens
agagaactgagca

SEQ ID NO: 2942132 - DNA, 23 bp, Homo sapiens
agagaaggaaaagactgaatcta

SEQ ID NO: 2942133 - DNA, 20 bp, Homo sapiens
agagaaggcaggaatgtgtg

SEQ ID NO: 2942134 - DNA, 15 bp, Homo sapiens
agagaagtaagcaga

SEQ ID NO: 2942135 - DNA, 21 bp, Homo sapiens
agagaagtcacaacaaaagga

SEQ ID NO: 2942136 - DNA, 17 bp, Homo sapiens
agagaagtgacagggaa

SEQ ID NO: 2942137 - DNA, 18 bp, Homo sapiens
agagaagtgacagggaag

SEQ ID NO: 2942138 - DNA, 20 bp, Homo sapiens
agagaagtgacagggaagct

SEQ ID NO: 2942139 - DNA, 17 bp, Homo sapiens
agagaatagagctgcca

SEQ ID NO: 2942140 - DNA, 13 bp, Homo sapiens
agagaatataaca

SEQ ID NO: 2942141 - DNA, 18 bp, Homo sapiens
agagaatataacatgaaa

SEQ ID NO: 2942142 - DNA, 22 bp, Homo sapiens
agagaatataacatgaaatgat

SEQ ID NO: 2942143 - DNA, 12 bp, Homo sapiens
agagaatcaaca

SEQ ID NO: 2942144 - DNA, 19 bp, Homo sapiens
agagaatgtatttcctttt

SEQ ID NO: 2942145 - DNA, 17 bp, Homo sapiens
agagacaatcacgggcg

SEQ ID NO: 2942146 - DNA, 16 bp, Homo sapiens
agagacacctgcacct

SEQ ID NO: 2942147 - DNA, 21 bp, Homo sapiens
agagacaggaaaatcctctgg

SEQ ID NO: 2942148 - DNA, 18 bp, Homo sapiens
agagacagtaacacaatt

SEQ ID NO: 2942149 - DNA, 22 bp, Homo sapiens
agagacatacttgaagggccag

SEQ ID NO: 2942150 - DNA, 23 bp, Homo sapiens
agagacatgagaaagggagagga

SEQ ID NO: 2942151 - DNA, 17 bp, Homo sapiens
agagacatgtggcagca

SEQ ID NO: 2942152 - DNA, 14 bp, Homo sapiens
agagaccagccttt

SEQ ID NO: 2942153 - DNA, 14 bp, Homo sapiens
agagaccatctcct

SEQ ID NO: 2942154 - DNA, 14 bp, Homo sapiens
agagacccaaggag

SEQ ID NO: 2942155 - DNA, 19 bp, Homo sapiens
agagacccttcaaacttgg

SEQ ID NO: 2942156 - DNA, 17 bp, Homo sapiens
agagacctttgcccaca

SEQ ID NO: 2942157 - DNA, 16 bp, Homo sapiens
agagacggtgtcttgt

SEQ ID NO: 2942158 - DNA, 14 bp, Homo sapiens
agagactcagcctg

SEQ ID NO: 2942159 - DNA, 18 bp, Homo sapiens
agagactcagcctgcagt

SEQ ID NO: 2942160 - DNA, 14 bp, Homo sapiens
agagactgaaatta

SEQ ID NO: 2942161 - DNA, 12 bp, Homo sapiens
agagagaaagaa

SEQ ID NO: 2942162 - DNA, 21 bp, Homo sapiens
agagagaatagagctgccact

SEQ ID NO: 2942163 - DNA, 13 bp, Homo sapiens
agagagagagaaa

SEQ ID NO: 2942164 - DNA, 18 bp, Homo sapiens
agagaggaaggacccctc

SEQ ID NO: 2942165 - DNA, 13 bp, Homo sapiens
agagaggcctgct

SEQ ID NO: 2942166 - DNA, 17 bp, Homo sapiens
agagagggaggcaagcc

SEQ ID NO: 2942167 - DNA, 21 bp, Homo sapiens
agagataaaccaataaatcca

SEQ ID NO: 2942168 - DNA, 16 bp, Homo sapiens
agagatagcctgtggc

SEQ ID NO: 2942169 - DNA, 17 bp, Homo sapiens
agagatagcctgtggcc

SEQ ID NO: 2942170 - DNA, 23 bp, Homo sapiens
agagatattttgggcatgtgggc

SEQ ID NO: 2942171 - DNA, 13 bp, Homo sapiens
agagatcatggaa

SEQ ID NO: 2942172 - DNA, 20 bp, Homo sapiens
agagatcctacttctctgag

SEQ ID NO: 2942173 - DNA, 15 bp, Homo sapiens
agagatgagaaatga

SEQ ID NO: 2942174 - DNA, 14 bp, Homo sapiens
agagatgcctccac

SEQ ID NO: 2942175 - DNA, 16 bp, Homo sapiens
agagattacctcctga

SEQ ID NO: 2942176 - DNA, 19 bp, Homo sapiens
agagattacctcctgagaa

SEQ ID NO: 2942177 - DNA, 14 bp, Homo sapiens
agagattgctaatt

SEQ ID NO: 2942178 - DNA, 17 bp, Homo sapiens
agagattgtagtattta

SEQ ID NO: 2942179 - DNA, 16 bp, Homo sapiens
agagcaaaaatgtaaa

SEQ ID NO: 2942180 - DNA, 19 bp, Homo sapiens
agagcaaaaatgtaaaaaa

SEQ ID NO: 2942181 - DNA, 23 bp, Homo sapiens
agagcaaaatgctcttgtccctg

SEQ ID NO: 2942182 - DNA, 21 bp, Homo sapiens
agagcaaaggagacaaagcag

SEQ ID NO: 2942183 - DNA, 22 bp, Homo sapiens
agagcaaaggagacaaagcagg

SEQ ID NO: 2942184 - DNA, 14 bp, Homo sapiens
agagcaagtctgga

SEQ ID NO: 2942185 - DNA, 15 bp, Homo sapiens
agagcactagaagtg

SEQ ID NO: 2942186 - DNA, 17 bp, Homo sapiens
agagcactctcacccca

SEQ ID NO: 2942187 - DNA, 15 bp, Homo sapiens
agagcactgccacca

SEQ ID NO: 2942188 - DNA, 12 bp, Homo sapiens
agagcagacagg

SEQ ID NO: 2942189 - DNA, 14 bp, Homo sapiens
agagcagagaatat

SEQ ID NO: 2942190 - DNA, 20 bp, Homo sapiens
agagcagcttcggtgtgcag

SEQ ID NO: 2942191 - DNA, 21 bp, Homo sapiens
agagcagcttcggtgtgcaga

SEQ ID NO: 2942192 - DNA, 23 bp, Homo sapiens
agagcaggggctgctgggggctc

SEQ ID NO: 2942193 - DNA, 14 bp, Homo sapiens
agagcagtgggcag

SEQ ID NO: 2942194 - DNA, 15 bp, Homo sapiens
agagcagtgggcagg

SEQ ID NO: 2942195 - DNA, 18 bp, Homo sapiens
agagcagtgggcaggtgg

SEQ ID NO: 2942196 - DNA, 16 bp, Homo sapiens
agagcagtgggcctgg

SEQ ID NO: 2942197 - DNA, 15 bp, Homo sapiens
agagcatacaaaata

SEQ ID NO: 2942198 - DNA, 23 bp, Homo sapiens
agagcatcctgcttctaccatgt

SEQ ID NO: 2942199 - DNA, 14 bp, Homo sapiens
agagcatgctgcct

SEQ ID NO: 2942200 - DNA, 13 bp, Homo sapiens
agagcattaaaat

SEQ ID NO: 2942201 - DNA, 18 bp, Homo sapiens
agagcattaaaataacta

SEQ ID NO: 2942202 - DNA, 19 bp, Homo sapiens
agagcattgaattggagag

SEQ ID NO: 2942203 - DNA, 18 bp, Homo sapiens
agagccagagaagtgaca

SEQ ID NO: 2942204 - DNA, 17 bp, Homo sapiens
agagccagccctccctg

SEQ ID NO: 2942205 - DNA, 21 bp, Homo sapiens
agagccagcggctccaactcc

SEQ ID NO: 2942206 - DNA, 23 bp, Homo sapiens
agagccaggggggtgaggagctg

SEQ ID NO: 2942207 - DNA, 19 bp, Homo sapiens
agagccatataagtttgaa

SEQ ID NO: 2942208 - DNA, 10 bp, Homo sapiens
agagcccagc

SEQ ID NO: 2942209 - DNA, 13 bp, Homo sapiens
agagcccagccca

SEQ ID NO: 2942210 - DNA, 22 bp, Homo sapiens
agagcccagctcttgctctctt

SEQ ID NO: 2942211 - DNA, 14 bp, Homo sapiens
agagcccaggggag

SEQ ID NO: 2942212 - DNA, 20 bp, Homo sapiens
agagcccgtgccacccccag

SEQ ID NO: 2942213 - DNA, 14 bp, Homo sapiens
agagcctgagggat

SEQ ID NO: 2942214 - DNA, 15 bp, Homo sapiens
agagcctgctccccc

SEQ ID NO: 2942215 - DNA, 13 bp, Homo sapiens
agagcctgtcccc

SEQ ID NO: 2942216 - DNA, 17 bp, Homo sapiens
agagccttggtgtccac

SEQ ID NO: 2942217 - DNA, 21 bp, Homo sapiens
agagccttggtgtccacctgg

SEQ ID NO: 2942218 - DNA, 22 bp, Homo sapiens
agagccttggtgtccacctggc

SEQ ID NO: 2942219 - DNA, 23 bp, Homo sapiens
agagccttggtgtccacctggcc

SEQ ID NO: 2942220 - DNA, 23 bp, Homo sapiens
agagcgcctgcccctcccagaac

SEQ ID NO: 2942221 - DNA, 14 bp, Homo sapiens
agagcggaggagga

SEQ ID NO: 2942222 - DNA, 17 bp, Homo sapiens
agagctactcagaaatg

SEQ ID NO: 2942223 - DNA, 13 bp, Homo sapiens
agagctagcgctg

SEQ ID NO: 2942224 - DNA, 14 bp, Homo sapiens
agagctgagccagt

SEQ ID NO: 2942225 - DNA, 16 bp, Homo sapiens
agagctgccactgggc

SEQ ID NO: 2942226 - DNA, 17 bp, Homo sapiens
agagctgccactgggca

SEQ ID NO: 2942227 - DNA, 11 bp, Homo sapiens
agagctgcctc

SEQ ID NO: 2942228 - DNA, 17 bp, Homo sapiens
agagctgcgggctgagg

SEQ ID NO: 2942229 - DNA, 20 bp, Homo sapiens
agagctgggatcccacagcc

SEQ ID NO: 2942230 - DNA, 23 bp, Homo sapiens
agagctgggatcccacagcccta

SEQ ID NO: 2942231 - DNA, 17 bp, Homo sapiens
agagctgtattaagcca

SEQ ID NO: 2942232 - DNA, 21 bp, Homo sapiens
agagcttccagagctctgacc

SEQ ID NO: 2942233 - DNA, 16 bp, Homo sapiens
agagcttccctgactc

SEQ ID NO: 2942234 - DNA, 17 bp, Homo sapiens
agagcttccctgactca

SEQ ID NO: 2942235 - DNA, 17 bp, Homo sapiens
agagcttctgtattttc

SEQ ID NO: 2942236 - DNA, 19 bp, Homo sapiens
agagctttctgccttagcc

SEQ ID NO: 2942237 - DNA, 20 bp, Homo sapiens
agagctttctgccttagcct

SEQ ID NO: 2942238 - DNA, 15 bp, Homo sapiens
agagcttttaaaaat

SEQ ID NO: 2942239 - DNA, 21 bp, Homo sapiens
agacaggaaaatcctctggct

SEQ ID NO: 2942240 - DNA, 14 bp, Homo sapiens
agacaggaaagaat

SEQ ID NO: 2942241 - DNA, 14 bp, Homo sapiens
agacagggtcttgc

SEQ ID NO: 2942242 - DNA, 19 bp, Homo sapiens
agacagtcgctcagtctgt

SEQ ID NO: 2942243 - DNA, 16 bp, Homo sapiens
agacagtgatgcctgc

SEQ ID NO: 2942244 - DNA, 17 bp, Homo sapiens
agacagtgatgcctgcc

SEQ ID NO: 2942245 - DNA, 16 bp, Homo sapiens
agacagtgcacatgaa

SEQ ID NO: 2942246 - DNA, 11 bp, Homo sapiens
agacagtgccc

SEQ ID NO: 2942247 - DNA, 16 bp, Homo sapiens
agacagtgccctgaga

SEQ ID NO: 2942248 - DNA, 13 bp, Homo sapiens
agacagtgggaaa

SEQ ID NO: 2942249 - DNA, 21 bp, Homo sapiens
agacagtgtatgtagaagcat

SEQ ID NO: 2942250 - DNA, 22 bp, Homo sapiens
agaataatttatagtaatgagt

SEQ ID NO: 2942251 - DNA, 15 bp, Homo sapiens
agaatacaatgggaa

SEQ ID NO: 2942252 - DNA, 14 bp, Homo sapiens
agaatacagctttc

SEQ ID NO: 2942253 - DNA, 16 bp, Homo sapiens
agaatacagctttctg

SEQ ID NO: 2942254 - DNA, 17 bp, Homo sapiens
agaatacagctttctga

SEQ ID NO: 2942255 - DNA, 23 bp, Homo sapiens
agaatacgggtccctctaaccca

SEQ ID NO: 2942256 - DNA, 15 bp, Homo sapiens
agaaaaaaattcatg

SEQ ID NO: 2942257 - DNA, 14 bp, Homo sapiens
agaaaaaacaaaaa

SEQ ID NO: 2942258 - DNA, 19 bp, Homo sapiens
agaaaaacctgctcccttc

SEQ ID NO: 2942259 - DNA, 13 bp, Homo sapiens
agaaaaactaact

SEQ ID NO: 2942260 - DNA, 16 bp, Homo sapiens
acatcacgaaggaaaa

SEQ ID NO: 2942261 - DNA, 23 bp, Homo sapiens
acatcactgaaacctttaagaaa

SEQ ID NO: 2942262 - DNA, 13 bp, Homo sapiens
acatcacttcctg

SEQ ID NO: 2942263 - DNA, 18 bp, Homo sapiens
acatcacttcctgtttta

SEQ ID NO: 2942264 - DNA, 22 bp, Homo sapiens
acatcacttcctgttttaagca

SEQ ID NO: 2942265 - DNA, 13 bp, Homo sapiens
acatcagcacttt

SEQ ID NO: 2942266 - DNA, 14 bp, Homo sapiens
acatcagcatgttt

SEQ ID NO: 2942267 - DNA, 11 bp, Homo sapiens
acatcagccag

SEQ ID NO: 2942268 - DNA, 15 bp, Homo sapiens
acatcaggagactgg

SEQ ID NO: 2942269 - DNA, 14 bp, Homo sapiens
acatcaggagttca

SEQ ID NO: 2942270 - DNA, 15 bp, Homo sapiens
acatcattactataa

SEQ ID NO: 2942271 - DNA, 21 bp, Homo sapiens
acatcattactataagaactt

SEQ ID NO: 2942272 - DNA, 19 bp, Homo sapiens
acatcattggataaatttg

SEQ ID NO: 2942273 - DNA, 12 bp, Homo sapiens
acatcattttgt

SEQ ID NO: 2942274 - DNA, 21 bp, Homo sapiens
acatccaaaatagttaagaca

SEQ ID NO: 2942275 - DNA, 15 bp, Homo sapiens
acatccaaagcagac

SEQ ID NO: 2942276 - DNA, 13 bp, Homo sapiens
acatccactgttt

SEQ ID NO: 2942277 - DNA, 15 bp, Homo sapiens
acatccactgtttgc

SEQ ID NO: 2942278 - DNA, 22 bp, Homo sapiens
acatcccactggatctggctta

SEQ ID NO: 2942279 - DNA, 18 bp, Homo sapiens
acatcccatgtaacagaa

SEQ ID NO: 2942280 - DNA, 14 bp, Homo sapiens
acatccccagagcc

SEQ ID NO: 2942281 - DNA, 19 bp, Homo sapiens
acatccccagagcccagct

SEQ ID NO: 2942282 - DNA, 22 bp, Homo sapiens
acatccccagagcccagctctt

SEQ ID NO: 2942283 - DNA, 15 bp, Homo sapiens
acatccctgccagct

SEQ ID NO: 2942284 - DNA, 22 bp, Homo sapiens
acatccgcgtgtgcctgtgtgc

SEQ ID NO: 2942285 - DNA, 20 bp, Homo sapiens
acatcgttgccgcagcggtg

SEQ ID NO: 2942286 - DNA, 20 bp, Homo sapiens
acatctaaattgatcattca

SEQ ID NO: 2942287 - DNA, 17 bp, Homo sapiens
acatctaacctcatctt

SEQ ID NO: 2942288 - DNA, 21 bp, Homo sapiens
acatctaagcctgaaggggcg

SEQ ID NO: 2942289 - DNA, 19 bp, Homo sapiens
acatctattttggattgta

SEQ ID NO: 2942290 - DNA, 12 bp, Homo sapiens
acatctcatttt

SEQ ID NO: 2942291 - DNA, 14 bp, Homo sapiens
acatctctgtcagt

SEQ ID NO: 2942292 - DNA, 23 bp, Homo sapiens
acatctcttcctccgaggccagt

SEQ ID NO: 2942293 - DNA, 14 bp, Homo sapiens
acatctctttgaat

SEQ ID NO: 2942294 - DNA, 20 bp, Homo sapiens
acatctctttgatgtcatat

SEQ ID NO: 2942295 - DNA, 13 bp, Homo sapiens
acatctgaaagcc

SEQ ID NO: 2942296 - DNA, 19 bp, Homo sapiens
acatctggatgccttcccc

SEQ ID NO: 2942297 - DNA, 14 bp, Homo sapiens
acatctggcatggc

SEQ ID NO: 2942298 - DNA, 15 bp, Homo sapiens
acatctgggtgccct

SEQ ID NO: 2942299 - DNA, 16 bp, Homo sapiens
acatctgggtgccctg

SEQ ID NO: 2942300 - DNA, 17 bp, Homo sapiens
acatctgggtgccctga

SEQ ID NO: 2942301 - DNA, 13 bp, Homo sapiens
acatctgtcctga

SEQ ID NO: 2942302 - DNA, 15 bp, Homo sapiens
acatctgtgtcttgt

SEQ ID NO: 2942303 - DNA, 15 bp, Homo sapiens
acatctttcacattg

SEQ ID NO: 2942304 - DNA, 20 bp, Homo sapiens
acatctttcctcaagtatct

SEQ ID NO: 2942305 - DNA, 18 bp, Homo sapiens
acatctttctcttttcta

SEQ ID NO: 2942306 - DNA, 17 bp, Homo sapiens
acatgaaatttttgtaa

SEQ ID NO: 2942307 - DNA, 19 bp, Homo sapiens
acatgaaatttttgtaaat

SEQ ID NO: 2942308 - DNA, 15 bp, Homo sapiens
acatgaacagcttgc

SEQ ID NO: 2942309 - DNA, 14 bp, Homo sapiens
acagatagagagtt

SEQ ID NO: 2942310 - DNA, 15 bp, Homo sapiens
acagatcactcctgg

SEQ ID NO: 2942311 - DNA, 15 bp, Homo sapiens
acagatcctccattt

SEQ ID NO: 2942312 - DNA, 23 bp, Homo sapiens
acagatcgaaccgttttgaagct

SEQ ID NO: 2942313 - DNA, 22 bp, Homo sapiens
acagatctgcaccaccatgccc

SEQ ID NO: 2942314 - DNA, 17 bp, Homo sapiens
acagatgaatgtattta

SEQ ID NO: 2942315 - DNA, 17 bp, Homo sapiens
acagatgctgagccata

SEQ ID NO: 2942316 - DNA, 18 bp, Homo sapiens
acagatgctgagccatag

SEQ ID NO: 2942317 - DNA, 16 bp, Homo sapiens
acagatgctggcctct

SEQ ID NO: 2942318 - DNA, 23 bp, Homo sapiens
acagatgctggcctcttggcacc

SEQ ID NO: 2942319 - DNA, 21 bp, Homo sapiens
acagatggacgcaggccctgt

SEQ ID NO: 2942320 - DNA, 12 bp, Homo sapiens
acagatgtaaat

SEQ ID NO: 2942321 - DNA, 13 bp, Homo sapiens
acagatgtaaatc

SEQ ID NO: 2942322 - DNA, 14 bp, Homo sapiens
acagatgtccctga

SEQ ID NO: 2942323 - DNA, 14 bp, Homo sapiens
acagatgttatttt

SEQ ID NO: 2942324 - DNA, 15 bp, Homo sapiens
acagatgttattttt

SEQ ID NO: 2942325 - DNA, 15 bp, Homo sapiens
acagattatgtatta

SEQ ID NO: 2942326 - DNA, 15 bp, Homo sapiens
acagattcccaggcc

SEQ ID NO: 2942327 - DNA, 19 bp, Homo sapiens
acagattcccaggccaggg

SEQ ID NO: 2942328 - DNA, 13 bp, Homo sapiens
acagattgtttct

SEQ ID NO: 2942329 - DNA, 15 bp, Homo sapiens
acagattgtttctat

SEQ ID NO: 2942330 - DNA, 14 bp, Homo sapiens
acagatttgtgaac

SEQ ID NO: 2942331 - DNA, 15 bp, Homo sapiens
acagatttgtgaact

SEQ ID NO: 2942332 - DNA, 22 bp, Homo sapiens
acagatttgtgaactcagccaa

SEQ ID NO: 2942333 - DNA, 17 bp, Homo sapiens
acagattttcggaacac

SEQ ID NO: 2942334 - DNA, 17 bp, Homo sapiens
acagcaaaccaagagat

SEQ ID NO: 2942335 - DNA, 16 bp, Homo sapiens
acagcaagtcagggtt

SEQ ID NO: 2942336 - DNA, 15 bp, Homo sapiens
acagcacagagaaga

SEQ ID NO: 2942337 - DNA, 19 bp, Homo sapiens
acagcacttttcctcttct

SEQ ID NO: 2942338 - DNA, 14 bp, Homo sapiens
acagcagcaagaaa

SEQ ID NO: 2942339 - DNA, 15 bp, Homo sapiens
acagcagcaagaaaa

SEQ ID NO: 2942340 - DNA, 21 bp, Homo sapiens
acagcagcaagaaaaaaaaat

SEQ ID NO: 2942341 - DNA, 22 bp, Homo sapiens
acagcagcaagaaaaaaaaatg

SEQ ID NO: 2942342 - DNA, 14 bp, Homo sapiens
acagcagcctgtga

SEQ ID NO: 2942343 - DNA, 16 bp, Homo sapiens
acagcagggtttgagc

SEQ ID NO: 2942344 - DNA, 13 bp, Homo sapiens
acagcattgcttt

SEQ ID NO: 2942345 - DNA, 22 bp, Homo sapiens
acagccaacacgcacctgcctc

SEQ ID NO: 2942346 - DNA, 23 bp, Homo sapiens
acagccaacagctacaacagcct

SEQ ID NO: 2942347 - DNA, 18 bp, Homo sapiens
acagccaactagcccctg

SEQ ID NO: 2942348 - DNA, 20 bp, Homo sapiens
acagccaactagcccctggg

SEQ ID NO: 2942349 - DNA, 18 bp, Homo sapiens
aatttgcattaaattcac

SEQ ID NO: 2942350 - DNA, 12 bp, Homo sapiens
aatttgccattg

SEQ ID NO: 2942351 - DNA, 16 bp, Homo sapiens
aatttgcctgtaacaa

SEQ ID NO: 2942352 - DNA, 21 bp, Homo sapiens
aatttggataataaaaattgt

SEQ ID NO: 2942353 - DNA, 16 bp, Homo sapiens
aatttggatctattta

SEQ ID NO: 2942354 - DNA, 12 bp, Homo sapiens
aatttggctgct

SEQ ID NO: 2942355 - DNA, 18 bp, Homo sapiens
aatttgggaccctgcttt

SEQ ID NO: 2942356 - DNA, 19 bp, Homo sapiens
aatttggtgcttataagag

SEQ ID NO: 2942357 - DNA, 20 bp, Homo sapiens
aatttgtaaaatgttctctt

SEQ ID NO: 2942358 - DNA, 20 bp, Homo sapiens
aatttgtaagcaacttgctt

SEQ ID NO: 2942359 - DNA, 15 bp, Homo sapiens
aatttgtaattttag

SEQ ID NO: 2942360 - DNA, 13 bp, Homo sapiens
aatttgtagaatt

SEQ ID NO: 2942361 - DNA, 17 bp, Homo sapiens
aatttgtatatgactgc

SEQ ID NO: 2942362 - DNA, 16 bp, Homo sapiens
aatttgtcagcgttct

SEQ ID NO: 2942363 - DNA, 16 bp, Homo sapiens
aatttgtctcctactc

SEQ ID NO: 2942364 - DNA, 17 bp, Homo sapiens
aatttgttaacagagca

SEQ ID NO: 2942365 - DNA, 20 bp, Homo sapiens
aatttgtttaaaattctctt

SEQ ID NO: 2942366 - DNA, 17 bp, Homo sapiens
aatttgttttgttttaa

SEQ ID NO: 2942367 - DNA, 20 bp, Homo sapiens
aattttaaaaatggtggctt

SEQ ID NO: 2942368 - DNA, 21 bp, Homo sapiens
aattttaaaacatgctgttta

SEQ ID NO: 2942369 - DNA, 16 bp, Homo sapiens
aattttaatgaagaaa

SEQ ID NO: 2942370 - DNA, 18 bp, Homo sapiens
aattttaccctttagact

SEQ ID NO: 2942371 - DNA, 18 bp, Homo sapiens
aattttcctttgtcattt

SEQ ID NO: 2942372 - DNA, 13 bp, Homo sapiens
aattttctatgtg

SEQ ID NO: 2942373 - DNA, 15 bp, Homo sapiens
aattttctatgtgtt

SEQ ID NO: 2942374 - DNA, 13 bp, Homo sapiens
aattttctccagt

SEQ ID NO: 2942375 - DNA, 18 bp, Homo sapiens
aattttctccagtccctg

SEQ ID NO: 2942376 - DNA, 16 bp, Homo sapiens
aattttgagattaaga

SEQ ID NO: 2942377 - DNA, 15 bp, Homo sapiens
aattttggttgtatt

SEQ ID NO: 2942378 - DNA, 16 bp, Homo sapiens
aattttggttgtattc

SEQ ID NO: 2942379 - DNA, 20 bp, Homo sapiens
aattttggttgtattctttg

SEQ ID NO: 2942380 - DNA, 23 bp, Homo sapiens
aattttggttgtattctttgatg

SEQ ID NO: 2942381 - DNA, 14 bp, Homo sapiens
aattttgtacaaat

SEQ ID NO: 2942382 - DNA, 15 bp, Homo sapiens
aattttgtattttcc

SEQ ID NO: 2942383 - DNA, 16 bp, Homo sapiens
aattttgtattttcca

SEQ ID NO: 2942384 - DNA, 11 bp, Homo sapiens
aattttgtcac

SEQ ID NO: 2942385 - DNA, 17 bp, Homo sapiens
aattttgtcacagctct

SEQ ID NO: 2942386 - DNA, 13 bp, Homo sapiens
aattttgtctttc

SEQ ID NO: 2942387 - DNA, 13 bp, Homo sapiens
aattttgttcctg

SEQ ID NO: 2942388 - DNA, 21 bp, Homo sapiens
aattttgtttttattttcaag

SEQ ID NO: 2942389 - DNA, 13 bp, Homo sapiens
aatttttaactgt

SEQ ID NO: 2942390 - DNA, 14 bp, Homo sapiens
aatttttaatgatg

SEQ ID NO: 2942391 - DNA, 12 bp, Homo sapiens
aatttttccaca

SEQ ID NO: 2942392 - DNA, 22 bp, Homo sapiens
aatttttccacactatgtgtgt

SEQ ID NO: 2942393 - DNA, 14 bp, Homo sapiens
aatttttccttcct

SEQ ID NO: 2942394 - DNA, 22 bp, Homo sapiens
aatttttctctaactcagaaac

SEQ ID NO: 2942395 - DNA, 11 bp, Homo sapiens
aatttttgcaa

SEQ ID NO: 2942396 - DNA, 19 bp, Homo sapiens
aatttttgcaataatgcag

SEQ ID NO: 2942397 - DNA, 17 bp, Homo sapiens
aatttttgccttcatta

SEQ ID NO: 2942398 - DNA, 19 bp, Homo sapiens
aattttttgttcttcagag

SEQ ID NO: 2942399 - DNA, 18 bp, Homo sapiens
acaaaaaaaacaacaaaa

SEQ ID NO: 2942400 - DNA, 12 bp, Homo sapiens
acaaaaaaagtt

SEQ ID NO: 2942401 - DNA, 21 bp, Homo sapiens
acaaaaaaagtttgttacttt

SEQ ID NO: 2942402 - DNA, 22 bp, Homo sapiens
acaaaaaaagtttgttactttg

SEQ ID NO: 2942403 - DNA, 12 bp, Homo sapiens
acaaaaaagcaa

SEQ ID NO: 2942404 - DNA, 12 bp, Homo sapiens
acaaaaaatact

SEQ ID NO: 2942405 - DNA, 14 bp, Homo sapiens
acaaaaaatgtttt

SEQ ID NO: 2942406 - DNA, 17 bp, Homo sapiens
acaaaaaggagcgggca

SEQ ID NO: 2942407 - DNA, 22 bp, Homo sapiens
acaaaaagtaaagtaatgcatt

SEQ ID NO: 2942408 - DNA, 15 bp, Homo sapiens
acaaaaagttttttt

SEQ ID NO: 2942409 - DNA, 14 bp, Homo sapiens
acaaaaataaattt

SEQ ID NO: 2942410 - DNA, 13 bp, Homo sapiens
acaaaaatataaa

SEQ ID NO: 2942411 - DNA, 18 bp, Homo sapiens
acaaaaatcagccagaca

SEQ ID NO: 2942412 - DNA, 17 bp, Homo sapiens
acaaaacgcgcagatgt

SEQ ID NO: 2942413 - DNA, 17 bp, Homo sapiens
acaaaactacatgagaa

SEQ ID NO: 2942414 - DNA, 16 bp, Homo sapiens
acaaaactgcatttca

SEQ ID NO: 2942415 - DNA, 12 bp, Homo sapiens
acaaaaggcttt

SEQ ID NO: 2942416 - DNA, 22 bp, Homo sapiens
acaaaaggctttggcaacagaa

SEQ ID NO: 2942417 - DNA, 15 bp, Homo sapiens
acaaaagggccaggt

SEQ ID NO: 2942418 - DNA, 19 bp, Homo sapiens
acaaaagtgacagatgtta

SEQ ID NO: 2942419 - DNA, 20 bp, Homo sapiens
acaaaagtgacagatgttat

SEQ ID NO: 2942420 - DNA, 22 bp, Homo sapiens
acaaaagtgtacctgtaaatgt

SEQ ID NO: 2942421 - DNA, 15 bp, Homo sapiens
acaaaataaagctgt

SEQ ID NO: 2942422 - DNA, 23 bp, Homo sapiens
acaaaatcttgtaggtcattgca

SEQ ID NO: 2942423 - DNA, 23 bp, Homo sapiens
acaaaatggtcctatttttgtga

SEQ ID NO: 2942424 - DNA, 17 bp, Homo sapiens
acaaacacattgttatt

SEQ ID NO: 2942425 - DNA, 21 bp, Homo sapiens
acaaacagtgaatttaagcat

SEQ ID NO: 2942426 - DNA, 16 bp, Homo sapiens
acaaaccaacatcttt

SEQ ID NO: 2942427 - DNA, 23 bp, Homo sapiens
acaaacccaggagtttgtgtgtc

SEQ ID NO: 2942428 - DNA, 14 bp, Homo sapiens
acaaacggagcccc

SEQ ID NO: 2942429 - DNA, 21 bp, Homo sapiens
acaaacggagcccctgaaagc

SEQ ID NO: 2942430 - DNA, 19 bp, Homo sapiens
acaaacgtatggaatgctt

SEQ ID NO: 2942431 - DNA, 23 bp, Homo sapiens
acaaactacttgattttattgta

SEQ ID NO: 2942432 - DNA, 20 bp, Homo sapiens
acaaactcttcagttaattc

SEQ ID NO: 2942433 - DNA, 13 bp, Homo sapiens
acaaactgtaaat

SEQ ID NO: 2942434 - DNA, 13 bp, Homo sapiens
acaaagaaaataa

SEQ ID NO: 2942435 - DNA, 22 bp, Homo sapiens
acaaagaaatccccccttcaga

SEQ ID NO: 2942436 - DNA, 23 bp, Homo sapiens
acaaagaaccatgcaggaaggaa

SEQ ID NO: 2942437 - DNA, 22 bp, Homo sapiens
acaaagaagacatgttttagac

SEQ ID NO: 2942438 - DNA, 18 bp, Homo sapiens
acaaagacaaattctgtt

SEQ ID NO: 2942439 - DNA, 14 bp, Homo sapiens
acaaagagtgaaat

SEQ ID NO: 2942440 - DNA, 17 bp, Homo sapiens
acaaagagtgaaatatt

SEQ ID NO: 2942441 - DNA, 19 bp, Homo sapiens
acaaagagtgaaatattgt

SEQ ID NO: 2942442 - DNA, 15 bp, Homo sapiens
acaaagcaaaggcag

SEQ ID NO: 2942443 - DNA, 16 bp, Homo sapiens
acaaagcaaaggcagt

SEQ ID NO: 2942444 - DNA, 18 bp, Homo sapiens
acaaagcacagtttgaac

SEQ ID NO: 2942445 - DNA, 12 bp, Homo sapiens
acaaagcagcca

SEQ ID NO: 2942446 - DNA, 18 bp, Homo sapiens
acaaagcaggagtggaag

SEQ ID NO: 2942447 - DNA, 11 bp, Homo sapiens
acaaagccaga

SEQ ID NO: 2942448 - DNA, 16 bp, Homo sapiens
acaaagcttagcagga

SEQ ID NO: 2942449 - DNA, 20 bp, Homo sapiens
acaaaggagcattaagccca

SEQ ID NO: 2942450 - DNA, 11 bp, Homo sapiens
acaaaggcaag

SEQ ID NO: 2942451 - DNA, 14 bp, Homo sapiens
acaaagggcccaga

SEQ ID NO: 2942452 - DNA, 13 bp, Homo sapiens
acaaagtgttgaa

SEQ ID NO: 2942453 - DNA, 14 bp, Homo sapiens
acaaataatttaag

SEQ ID NO: 2942454 - DNA, 19 bp, Homo sapiens
acaaataatttaagttggc

SEQ ID NO: 2942455 - DNA, 16 bp, Homo sapiens
acaaatactcatgtgt

SEQ ID NO: 2942456 - DNA, 17 bp, Homo sapiens
acaaatactcatgtgta

SEQ ID NO: 2942457 - DNA, 21 bp, Homo sapiens
acaaatatgtagaatgtaata

SEQ ID NO: 2942458 - DNA, 15 bp, Homo sapiens
acaaatctgtataaa

SEQ ID NO: 2942459 - DNA, 18 bp, Homo sapiens
acaaatctgtataaatgt

SEQ ID NO: 2942460 - DNA, 18 bp, Homo sapiens
acaaatgaaaatgaatag

SEQ ID NO: 2942461 - DNA, 15 bp, Homo sapiens
acaaatggacatagg

SEQ ID NO: 2942462 - DNA, 20 bp, Homo sapiens
acaaatggagctttctgtat

SEQ ID NO: 2942463 - DNA, 17 bp, Homo sapiens
acaaatgtgaagatgca

SEQ ID NO: 2942464 - DNA, 21 bp, Homo sapiens
acaaattctgaatattttttg

SEQ ID NO: 2942465 - DNA, 14 bp, Homo sapiens
acaaattgcacaga

SEQ ID NO: 2942466 - DNA, 17 bp, Homo sapiens
acaaattttcagaaggt

SEQ ID NO: 2942467 - DNA, 13 bp, Homo sapiens
acaacaaaaggaa

SEQ ID NO: 2942468 - DNA, 14 bp, Homo sapiens
acaacaaaaggaag

SEQ ID NO: 2942469 - DNA, 23 bp, Homo sapiens
acaacaaactgaattaaacatga

SEQ ID NO: 2942470 - DNA, 15 bp, Homo sapiens
acaacaaataattta

SEQ ID NO: 2942471 - DNA, 21 bp, Homo sapiens
acaacaaataatttaagttgg

SEQ ID NO: 2942472 - DNA, 21 bp, Homo sapiens
acaacaaggacaactttatgt

SEQ ID NO: 2942473 - DNA, 13 bp, Homo sapiens
acaacaataataa

SEQ ID NO: 2942474 - DNA, 23 bp, Homo sapiens
acaacaataataaagatgtgaaa

SEQ ID NO: 2942475 - DNA, 14 bp, Homo sapiens
acaacacaagaaaa

SEQ ID NO: 2942476 - DNA, 17 bp, Homo sapiens
acaacacctaaaaccag

SEQ ID NO: 2942477 - DNA, 13 bp, Homo sapiens
acaacagatttgt

SEQ ID NO: 2942478 - DNA, 23 bp, Homo sapiens
acaacagtgctaaaaatgggact

SEQ ID NO: 2942479 - DNA, 23 bp, Homo sapiens
acaacagttacataattcactct

SEQ ID NO: 2942480 - DNA, 13 bp, Homo sapiens
acaacatgtatgt

SEQ ID NO: 2942481 - DNA, 14 bp, Homo sapiens
acaacatgtatgtg

SEQ ID NO: 2942482 - DNA, 14 bp, Homo sapiens
acaacattttcttg

SEQ ID NO: 2942483 - DNA, 15 bp, Homo sapiens
acaacattttgagaa

SEQ ID NO: 2942484 - DNA, 14 bp, Homo sapiens
acaaccaggtcttg

SEQ ID NO: 2942485 - DNA, 14 bp, Homo sapiens
acaaccctctggaa

SEQ ID NO: 2942486 - DNA, 16 bp, Homo sapiens
acaaccctctggaagt

SEQ ID NO: 2942487 - DNA, 21 bp, Homo sapiens
acaatacctacaataaactgg

SEQ ID NO: 2942488 - DNA, 22 bp, Homo sapiens
acaatacctacaataaactggt

SEQ ID NO: 2942489 - DNA, 18 bp, Homo sapiens
acaatactcataatgtga

SEQ ID NO: 2942490 - DNA, 19 bp, Homo sapiens
acaatactcataatgtgaa

SEQ ID NO: 2942491 - DNA, 22 bp, Homo sapiens
acaatagggctgataatgtaat

SEQ ID NO: 2942492 - DNA, 16 bp, Homo sapiens
acaataggtaaagcta

SEQ ID NO: 2942493 - DNA, 21 bp, Homo sapiens
acaatataaccacaaagcaca

SEQ ID NO: 2942494 - DNA, 14 bp, Homo sapiens
acaatatagtattc

SEQ ID NO: 2942495 - DNA, 15 bp, Homo sapiens
acaatatgaaaagga

SEQ ID NO: 2942496 - DNA, 24 bp, Homo sapiens
acaatatgaaaaggatattatcta

SEQ ID NO: 2942497 - DNA, 14 bp, Homo sapiens
acaatatgtgagtg

SEQ ID NO: 2942498 - DNA, 18 bp, Homo sapiens
acaatattgactttgtct

SEQ ID NO: 2942499 - DNA, 14 bp, Homo sapiens
acaatattgtttct

SEQ ID NO: 2942500 - DNA, 19 bp, Homo sapiens
acaatcaaaggaaaatagt

SEQ ID NO: 2942501 - DNA, 22 bp, Homo sapiens
acaatcacgggcggtcctgcac

SEQ ID NO: 2942502 - DNA, 15 bp, Homo sapiens
acaatcactgaaaca

SEQ ID NO: 2942503 - DNA, 17 bp, Homo sapiens
acaatcctagtgctttc

SEQ ID NO: 2942504 - DNA, 15 bp, Homo sapiens
acaatctgttctact

SEQ ID NO: 2942505 - DNA, 20 bp, Homo sapiens
acaatctgttctactcttaa

SEQ ID NO: 2942506 - DNA, 19 bp, Homo sapiens
acaatctttattatgcatt

SEQ ID NO: 2942507 - DNA, 13 bp, Homo sapiens
acaatgaatcaga

SEQ ID NO: 2942508 - DNA, 16 bp, Homo sapiens
acaatgactaagccaa

SEQ ID NO: 2942509 - DNA, 20 bp, Homo sapiens
acaatgatcctgtattcaga

SEQ ID NO: 2942510 - DNA, 23 bp, Homo sapiens
acaatgattaatcagctgttgca

SEQ ID NO: 2942511 - DNA, 20 bp, Homo sapiens
acaatgcgtggcacatctaa

SEQ ID NO: 2942512 - DNA, 13 bp, Homo sapiens
acaatgggaaaag

SEQ ID NO: 2942513 - DNA, 13 bp, Homo sapiens
acaatgtatttta

SEQ ID NO: 2942514 - DNA, 16 bp, Homo sapiens
acaatgtattttggaa

SEQ ID NO: 2942515 - DNA, 22 bp, Homo sapiens
acaatgtattttggaagacata

SEQ ID NO: 2942516 - DNA, 11 bp, Homo sapiens
acaatgtctgc

SEQ ID NO: 2942517 - DNA, 19 bp, Homo sapiens
acaatgtctgcagccctga

SEQ ID NO: 2942518 - DNA, 12 bp, Homo sapiens
acaatgttcttt

SEQ ID NO: 2942519 - DNA, 14 bp, Homo sapiens
acaatgttctttat

SEQ ID NO: 2942520 - DNA, 20 bp, Homo sapiens
acaatgttgcactgaaaacc

SEQ ID NO: 2942521 - DNA, 12 bp, Homo sapiens
acaattaactgc

SEQ ID NO: 2942522 - DNA, 15 bp, Homo sapiens
acaattaactgccct

SEQ ID NO: 2942523 - DNA, 19 bp, Homo sapiens
acaattagaggaatttaaa

SEQ ID NO: 2942524 - DNA, 21 bp, Homo sapiens
acaattaggcagactctttat

SEQ ID NO: 2942525 - DNA, 18 bp, Homo sapiens
acaattatatcagtcctc

SEQ ID NO: 2942526 - DNA, 21 bp, Homo sapiens
acaattatttttacagttctc

SEQ ID NO: 2942527 - DNA, 14 bp, Homo sapiens
acaattcatgaact

SEQ ID NO: 2942528 - DNA, 20 bp, Homo sapiens
acaattcatgaacttcgcat

SEQ ID NO: 2942529 - DNA, 20 bp, Homo sapiens
acaattcattgttttgcaaa

SEQ ID NO: 2942530 - DNA, 21 bp, Homo sapiens
acaattcattgttttgcaaaa

SEQ ID NO: 2942531 - DNA, 19 bp, Homo sapiens
acaattcccgggcccttca

SEQ ID NO: 2942532 - DNA, 22 bp, Homo sapiens
acaattcctctactaacaatca

SEQ ID NO: 2942533 - DNA, 23 bp, Homo sapiens
acaattcctctactaacaatcag

SEQ ID NO: 2942534 - DNA, 20 bp, Homo sapiens
acaattctccctatcttgtg

SEQ ID NO: 2942535 - DNA, 22 bp, Homo sapiens
acaattctgttttaggttaaaa

SEQ ID NO: 2942536 - DNA, 16 bp, Homo sapiens
acaattctttatacaa

SEQ ID NO: 2942537 - DNA, 17 bp, Homo sapiens
acaattctttatacaac

SEQ ID NO: 2942538 - DNA, 21 bp, Homo sapiens
acaattctttatacaacagtg

SEQ ID NO: 2942539 - DNA, 16 bp, Homo sapiens
acaattctttcaactg

SEQ ID NO: 2942540 - DNA, 12 bp, Homo sapiens
acaattgaaatg

SEQ ID NO: 2942541 - DNA, 21 bp, Homo sapiens
acaattgcaaatcagagcata

SEQ ID NO: 2942542 - DNA, 17 bp, Homo sapiens
acaattggttgtatata

SEQ ID NO: 2942543 - DNA, 14 bp, Homo sapiens
acaatttatactgc

SEQ ID NO: 2942544 - DNA, 16 bp, Homo sapiens
acaatttatactgcga

SEQ ID NO: 2942545 - DNA, 20 bp, Homo sapiens
acaatttctttaaaaaagaa

SEQ ID NO: 2942546 - DNA, 18 bp, Homo sapiens
acaattttcttgtgacag

SEQ ID NO: 2942547 - DNA, 19 bp, Homo sapiens
acaatttttttaattttgt

SEQ ID NO: 2942548 - DNA, 16 bp, Homo sapiens
acacaaaaaggagcgg

SEQ ID NO: 2942549 - DNA, 14 bp, Homo sapiens
acacaaactgtaaa

SEQ ID NO: 2942550 - DNA, 16 bp, Homo sapiens
acacaaactgtaaata

SEQ ID NO: 2942551 - DNA, 22 bp, Homo sapiens
acacaaaggatttgatgctttt

SEQ ID NO: 2942552 - DNA, 12 bp, Homo sapiens
acacaacacaag

SEQ ID NO: 2942553 - DNA, 14 bp, Homo sapiens
acacaacacaagaa

SEQ ID NO: 2942554 - DNA, 16 bp, Homo sapiens
acacaacacaagaaaa

SEQ ID NO: 2942555 - DNA, 13 bp, Homo sapiens
acacaacatgtat

SEQ ID NO: 2942556 - DNA, 15 bp, Homo sapiens
acacaacatttgtgt

SEQ ID NO: 2942557 - DNA, 13 bp, Homo sapiens
acacaagagtata

SEQ ID NO: 2942558 - DNA, 17 bp, Homo sapiens
acacaaggagctttctt

SEQ ID NO: 2942559 - DNA, 21 bp, Homo sapiens
acacaataagagtctccttct

SEQ ID NO: 2942560 - DNA, 18 bp, Homo sapiens
acccttctggaaactgtg

SEQ ID NO: 2942561 - DNA, 17 bp, Homo sapiens
acccttggcttgcccac

SEQ ID NO: 2942562 - DNA, 21 bp, Homo sapiens
acccttggtagagtttatttt

SEQ ID NO: 2942563 - DNA, 21 bp, Homo sapiens
accctttaagatatccatctt

SEQ ID NO: 2942564 - DNA, 21 bp, Homo sapiens
accctttcatagagaggcctg

SEQ ID NO: 2942565 - DNA, 15 bp, Homo sapiens
accctttccttcctt

SEQ ID NO: 2942566 - DNA, 19 bp, Homo sapiens
accctttccttccttccct

SEQ ID NO: 2942567 - DNA, 12 bp, Homo sapiens
acccttttccag

SEQ ID NO: 2942568 - DNA, 12 bp, Homo sapiens
accgaaacagcg

SEQ ID NO: 2942569 - DNA, 15 bp, Homo sapiens
accgactgcccagcc

SEQ ID NO: 2942570 - DNA, 17 bp, Homo sapiens
accgagagtagccgaga

SEQ ID NO: 2942571 - DNA, 18 bp, Homo sapiens
accgagcccagcagatct

SEQ ID NO: 2942572 - DNA, 14 bp, Homo sapiens
accgagctctgtgg

SEQ ID NO: 2942573 - DNA, 19 bp, Homo sapiens
accgagctctgtgggaaaa

SEQ ID NO: 2942574 - DNA, 18 bp, Homo sapiens
accgaggaacaacttgga

SEQ ID NO: 2942575 - DNA, 15 bp, Homo sapiens
accgaggggcctttg

SEQ ID NO: 2942576 - DNA, 21 bp, Homo sapiens
accgaggggcctttgttctgg

SEQ ID NO: 2942577 - DNA, 21 bp, Homo sapiens
accgatggtcccaggaagcag

SEQ ID NO: 2942578 - DNA, 23 bp, Homo sapiens
accgatggtcccaggaagcaggg

SEQ ID NO: 2942579 - DNA, 12 bp, Homo sapiens
accgcagctact

SEQ ID NO: 2942580 - DNA, 12 bp, Homo sapiens
accgcagctgct

SEQ ID NO: 2942581 - DNA, 19 bp, Homo sapiens
accgcaggaagctgctccg

SEQ ID NO: 2942582 - DNA, 13 bp, Homo sapiens
accgcatggcagc

SEQ ID NO: 2942583 - DNA, 15 bp, Homo sapiens
accgcatggcagctg

SEQ ID NO: 2942584 - DNA, 16 bp, Homo sapiens
accgcatggcagctgg

SEQ ID NO: 2942585 - DNA, 23 bp, Homo sapiens
accgcatggcagctgggcccaca

SEQ ID NO: 2942586 - DNA, 12 bp, Homo sapiens
accgccagcagc

SEQ ID NO: 2942587 - DNA, 15 bp, Homo sapiens
accgcccagctctcc

SEQ ID NO: 2942588 - DNA, 19 bp, Homo sapiens
accgccctgcgggccacag

SEQ ID NO: 2942589 - DNA, 16 bp, Homo sapiens
accgcccttttcccct

SEQ ID NO: 2942590 - DNA, 18 bp, Homo sapiens
accgccgccccctgcccc

SEQ ID NO: 2942591 - DNA, 12 bp, Homo sapiens
accgccggggtc

SEQ ID NO: 2942592 - DNA, 20 bp, Homo sapiens
accgccggggtcctgggagg

SEQ ID NO: 2942593 - DNA, 16 bp, Homo sapiens
accgcctcgtgccagc

SEQ ID NO: 2942594 - DNA, 19 bp, Homo sapiens
accgcctcgtgccagcagc

SEQ ID NO: 2942595 - DNA, 23 bp, Homo sapiens
accgcctcgtgccagcagcctcg

SEQ ID NO: 2942596 - DNA, 13 bp, Homo sapiens
accgcctgccctc

SEQ ID NO: 2942597 - DNA, 15 bp, Homo sapiens
accgcctgccctccc

SEQ ID NO: 2942598 - DNA, 19 bp, Homo sapiens
accgcggacgtgctggcct

SEQ ID NO: 2942599 - DNA, 15 bp, Homo sapiens
accgcttctgccttt

SEQ ID NO: 2942600 - DNA, 13 bp, Homo sapiens
accgctttggcct

SEQ ID NO: 2942601 - DNA, 16 bp, Homo sapiens
accgctttggcctgag

SEQ ID NO: 2942602 - DNA, 13 bp, Homo sapiens
accggatcctggg

SEQ ID NO: 2942603 - DNA, 18 bp, Homo sapiens
accgggcatgtctgcctg

SEQ ID NO: 2942604 - DNA, 21 bp, Homo sapiens
accgggcatgtctgcctggag

SEQ ID NO: 2942605 - DNA, 11 bp, Homo sapiens
accgggctgca

SEQ ID NO: 2942606 - DNA, 15 bp, Homo sapiens
accgggctggctgct

SEQ ID NO: 2942607 - DNA, 22 bp, Homo sapiens
accgggctggctgcttgcagcc

SEQ ID NO: 2942608 - DNA, 15 bp, Homo sapiens
accggggcaagaggg

SEQ ID NO: 2942609 - DNA, 13 bp, Homo sapiens
accggggcctggg

SEQ ID NO: 2942610 - DNA, 19 bp, Homo sapiens
accgtagcgtatacatttg

SEQ ID NO: 2942611 - DNA, 21 bp, Homo sapiens
accgtgccaaccccacccagc

SEQ ID NO: 2942612 - DNA, 18 bp, Homo sapiens
accgtgccactttccacc

SEQ ID NO: 2942613 - DNA, 15 bp, Homo sapiens
accgtggcctgggct

SEQ ID NO: 2942614 - DNA, 17 bp, Homo sapiens
accgtggcctgggcttg

SEQ ID NO: 2942615 - DNA, 15 bp, Homo sapiens
accgtggggaagggg

SEQ ID NO: 2942616 - DNA, 15 bp, Homo sapiens
accgttcagtcattt

SEQ ID NO: 2942617 - DNA, 13 bp, Homo sapiens
accgtttttcaag

SEQ ID NO: 2942618 - DNA, 23 bp, Homo sapiens
accgtttttcaagaaaactggaa

SEQ ID NO: 2942619 - DNA, 19 bp, Homo sapiens
acctaaacggttcagtttc

SEQ ID NO: 2942620 - DNA, 14 bp, Homo sapiens
acctaacctgtgtc

SEQ ID NO: 2942621 - DNA, 15 bp, Homo sapiens
acctaacctgtgtct

SEQ ID NO: 2942622 - DNA, 20 bp, Homo sapiens
acctaagaatttcactgtct

SEQ ID NO: 2942623 - DNA, 18 bp, Homo sapiens
acctaagtcctttatgtg

SEQ ID NO: 2942624 - DNA, 20 bp, Homo sapiens
acctaagtttcagttgattt

SEQ ID NO: 2942625 - DNA, 15 bp, Homo sapiens
acctacaataaactg

SEQ ID NO: 2942626 - DNA, 23 bp, Homo sapiens
acctacacactgtcatgcttcat

SEQ ID NO: 2942627 - DNA, 19 bp, Homo sapiens
acctactgcccaggcactg

SEQ ID NO: 2942628 - DNA, 15 bp, Homo sapiens
acctactgtctaagc

SEQ ID NO: 2942629 - DNA, 17 bp, Homo sapiens
acctactgttctaaagc

SEQ ID NO: 2942630 - DNA, 21 bp, Homo sapiens
acctactgttctaaagctctg

SEQ ID NO: 2942631 - DNA, 21 bp, Homo sapiens
acctacttagatatttcatgt

SEQ ID NO: 2942632 - DNA, 23 bp, Homo sapiens
acctacttagatatttcatgtgc

SEQ ID NO: 2942633 - DNA, 15 bp, Homo sapiens
acctagaagtaagaa

SEQ ID NO: 2942634 - DNA, 18 bp, Homo sapiens
acctagaagtaagaagag

SEQ ID NO: 2942635 - DNA, 17 bp, Homo sapiens
acctaggcaatgaagaa

SEQ ID NO: 2942636 - DNA, 16 bp, Homo sapiens
acctagtgccccagac

SEQ ID NO: 2942637 - DNA, 17 bp, Homo sapiens
acctagtgccccagact

SEQ ID NO: 2942638 - DNA, 18 bp, Homo sapiens
acctataggaaagtctgt

SEQ ID NO: 2942639 - DNA, 13 bp, Homo sapiens
acctatattgatt

SEQ ID NO: 2942640 - DNA, 16 bp, Homo sapiens
acctatattgatttaa

SEQ ID NO: 2942641 - DNA, 18 bp, Homo sapiens
acctatattgatttaaaa

SEQ ID NO: 2942642 - DNA, 14 bp, Homo sapiens
acctatcccacctc

SEQ ID NO: 2942643 - DNA, 17 bp, Homo sapiens
acctatctcagccatag

SEQ ID NO: 2942644 - DNA, 23 bp, Homo sapiens
acctcaaacttccagtcaggtag

SEQ ID NO: 2942645 - DNA, 20 bp, Homo sapiens
acctcaagtgatcctcccac

SEQ ID NO: 2942646 - DNA, 17 bp, Homo sapiens
acctcacaactccttcc

SEQ ID NO: 2942647 - DNA, 23 bp, Homo sapiens
acctcaccccgaggccctgcatg

SEQ ID NO: 2942648 - DNA, 15 bp, Homo sapiens
acctcacctagaaat

SEQ ID NO: 2942649 - DNA, 15 bp, Homo sapiens
acctcacgcacctcc

SEQ ID NO: 2942650 - DNA, 19 bp, Homo sapiens
acctcacgcacctcccatc

SEQ ID NO: 2942651 - DNA, 20 bp, Homo sapiens
acctcactgaaaacatctgg

SEQ ID NO: 2942652 - DNA, 13 bp, Homo sapiens
acctcagcctgca

SEQ ID NO: 2942653 - DNA, 13 bp, Homo sapiens
acctcagcctggc

SEQ ID NO: 2942654 - DNA, 14 bp, Homo sapiens
acctcagcctggcc

SEQ ID NO: 2942655 - DNA, 15 bp, Homo sapiens
acctcagcctggcca

SEQ ID NO: 2942656 - DNA, 21 bp, Homo sapiens
acctcagcctggccagacaca

SEQ ID NO: 2942657 - DNA, 14 bp, Homo sapiens
acctcagccttgga

SEQ ID NO: 2942658 - DNA, 18 bp, Homo sapiens
acctcagggctatgtgga

SEQ ID NO: 2942659 - DNA, 19 bp, Homo sapiens
acctcagggtattgcttgc

SEQ ID NO: 2942660 - DNA, 14 bp, Homo sapiens
acctcatccaaaca

SEQ ID NO: 2942661 - DNA, 15 bp, Homo sapiens
acctcatgtcatttc

SEQ ID NO: 2942662 - DNA, 16 bp, Homo sapiens
acctcatgtcatttct

SEQ ID NO: 2942663 - DNA, 22 bp, Homo sapiens
acctcattaaatggtgatttct

SEQ ID NO: 2942664 - DNA, 23 bp, Homo sapiens
acctcattaaatggtgatttctt

SEQ ID NO: 2942665 - DNA, 11 bp, Homo sapiens
acctccacagc

SEQ ID NO: 2942666 - DNA, 14 bp, Homo sapiens
acctccacagcttc

SEQ ID NO: 2942667 - DNA, 20 bp, Homo sapiens
acctccacgccactgcctcc

SEQ ID NO: 2942668 - DNA, 14 bp, Homo sapiens
acctccaggctttc

SEQ ID NO: 2942669 - DNA, 11 bp, Homo sapiens
acctccagtcc

SEQ ID NO: 2942670 - DNA, 12 bp, Homo sapiens
acctccagtcct

SEQ ID NO: 2942671 - DNA, 15 bp, Homo sapiens
acctccagtcctgct

SEQ ID NO: 2942672 - DNA, 18 bp, Homo sapiens
acctccagtcctgctggc

SEQ ID NO: 2942673 - DNA, 19 bp, Homo sapiens
acctccagtcctgctggcc

SEQ ID NO: 2942674 - DNA, 15 bp, Homo sapiens
acctccatatgctgt

SEQ ID NO: 2942675 - DNA, 13 bp, Homo sapiens
acctcccaactct

SEQ ID NO: 2942676 - DNA, 15 bp, Homo sapiens
acctcccatcctaat

SEQ ID NO: 2942677 - DNA, 17 bp, Homo sapiens
acctcccctatccaccc

SEQ ID NO: 2942678 - DNA, 21 bp, Homo sapiens
acctcccctatccacccagcc

SEQ ID NO: 2942679 - DNA, 14 bp, Homo sapiens
acctccctgcctcc

SEQ ID NO: 2942680 - DNA, 20 bp, Homo sapiens
acctcccttaagcagcaaca

SEQ ID NO: 2942681 - DNA, 23 bp, Homo sapiens
acctcctacgtcaaacatgaagt

SEQ ID NO: 2942682 - DNA, 14 bp, Homo sapiens
acctcctccctgtt

SEQ ID NO: 2942683 - DNA, 17 bp, Homo sapiens
acctcctctcagtgttt

SEQ ID NO: 2942684 - DNA, 11 bp, Homo sapiens
acctcctctgt

SEQ ID NO: 2942685 - DNA, 12 bp, Homo sapiens
acctcctgccca

SEQ ID NO: 2942686 - DNA, 17 bp, Homo sapiens
acctcctgcccaggaga

SEQ ID NO: 2942687 - DNA, 21 bp, Homo sapiens
acctcctgcccaggagagcca

SEQ ID NO: 2942688 - DNA, 22 bp, Homo sapiens
acctcgagaagtaattatcagt

SEQ ID NO: 2942689 - DNA, 18 bp, Homo sapiens
acctcgagtactgtgggc

SEQ ID NO: 2942690 - DNA, 22 bp, Homo sapiens
acctcgagtactgtgggcaatt

SEQ ID NO: 2942691 - DNA, 13 bp, Homo sapiens
acctcggggtggg

SEQ ID NO: 2942692 - DNA, 22 bp, Homo sapiens
acctcgtcctccccctgccagt

SEQ ID NO: 2942693 - DNA, 23 bp, Homo sapiens
acctcgtgtctagtagaacaatg

SEQ ID NO: 2942694 - DNA, 20 bp, Homo sapiens
acctctaaatttccatatcc

SEQ ID NO: 2942695 - DNA, 22 bp, Homo sapiens
acctctccctgaccctgtatat

SEQ ID NO: 2942696 - DNA, 22 bp, Homo sapiens
acctctcggccccatcgcccca

SEQ ID NO: 2942697 - DNA, 14 bp, Homo sapiens
acctctctcagccc

SEQ ID NO: 2942698 - DNA, 19 bp, Homo sapiens
acctctctgtagtttatgg

SEQ ID NO: 2942699 - DNA, 12 bp, Homo sapiens
acctctctgtcc

SEQ ID NO: 2942700 - DNA, 14 bp, Homo sapiens
acctctctgtccct

SEQ ID NO: 2942701 - DNA, 16 bp, Homo sapiens
acctctctgtcccttg

SEQ ID NO: 2942702 - DNA, 20 bp, Homo sapiens
acctctctgtctttttcctt

SEQ ID NO: 2942703 - DNA, 12 bp, Homo sapiens
acctctcttgtg

SEQ ID NO: 2942704 - DNA, 19 bp, Homo sapiens
acctctcttgtgagccata

SEQ ID NO: 2942705 - DNA, 12 bp, Homo sapiens
acctctgcctca

SEQ ID NO: 2942706 - DNA, 18 bp, Homo sapiens
acctctgcctcccaggtt

SEQ ID NO: 2942707 - DNA, 20 bp, Homo sapiens
acctctgctttctgatgttg

SEQ ID NO: 2942708 - DNA, 17 bp, Homo sapiens
acctctggagtgccccc

SEQ ID NO: 2942709 - DNA, 19 bp, Homo sapiens
acctctgtcttggctttca

SEQ ID NO: 2942710 - DNA, 15 bp, Homo sapiens
acctctgttcagtgt

SEQ ID NO: 2942711 - DNA, 19 bp, Homo sapiens
acctctgttcagtgtaaat

SEQ ID NO: 2942712 - DNA, 22 bp, Homo sapiens
acctctgttcagtgtaaatagt

SEQ ID NO: 2942713 - DNA, 20 bp, Homo sapiens
acctgaaaacactgtgcaca

SEQ ID NO: 2942714 - DNA, 16 bp, Homo sapiens
acctgaaagcctgtct

SEQ ID NO: 2942715 - DNA, 17 bp, Homo sapiens
acctgaaagcctgtctc

SEQ ID NO: 2942716 - DNA, 18 bp, Homo sapiens
acctgaaagcctgtctct

SEQ ID NO: 2942717 - DNA, 22 bp, Homo sapiens
acctgaaattccaaagtctcta

SEQ ID NO: 2942718 - DNA, 15 bp, Homo sapiens
acctgaaccccagag

SEQ ID NO: 2942719 - DNA, 19 bp, Homo sapiens
acctgaagatgggagcctt

SEQ ID NO: 2942720 - DNA, 21 bp, Homo sapiens
acctgaaggtcccctggcagt

SEQ ID NO: 2942721 - DNA, 14 bp, Homo sapiens
acctgaatttgtat

SEQ ID NO: 2942722 - DNA, 16 bp, Homo sapiens
acctgacactcccttg

SEQ ID NO: 2942723 - DNA, 17 bp, Homo sapiens
acctgacactcccttgg

SEQ ID NO: 2942724 - DNA, 19 bp, Homo sapiens
acctgaccaacatggagaa

SEQ ID NO: 2942725 - DNA, 18 bp, Homo sapiens
acctgagcaggacctctg

SEQ ID NO: 2942726 - DNA, 17 bp, Homo sapiens
acctgatcaatgacaga

SEQ ID NO: 2942727 - DNA, 20 bp, Homo sapiens
acctgatcaatgacagagcc

SEQ ID NO: 2942728 - DNA, 20 bp, Homo sapiens
acctgatgtcagctgctgtt

SEQ ID NO: 2942729 - DNA, 15 bp, Homo sapiens
acctgatgtgtacat

SEQ ID NO: 2942730 - DNA, 17 bp, Homo sapiens
acctgattaactgaggc

SEQ ID NO: 2942731 - DNA, 16 bp, Homo sapiens
acctgatttattgaaa

SEQ ID NO: 2942732 - DNA, 16 bp, Homo sapiens
acctgcaaagatctgt

SEQ ID NO: 2942733 - DNA, 18 bp, Homo sapiens
acctgcacctccccccac

SEQ ID NO: 2942734 - DNA, 19 bp, Homo sapiens
acctgcacctccccccact

SEQ ID NO: 2942735 - DNA, 20 bp, Homo sapiens
acctgcacctccccccactg

SEQ ID NO: 2942736 - DNA, 21 bp, Homo sapiens
acctgcacctccccccactgc

SEQ ID NO: 2942737 - DNA, 23 bp, Homo sapiens
acctgcatatctctagtccctgt

SEQ ID NO: 2942738 - DNA, 21 bp, Homo sapiens
acctgcatctaagcatctggg

SEQ ID NO: 2942739 - DNA, 15 bp, Homo sapiens
acctgccctccctca

SEQ ID NO: 2942740 - DNA, 12 bp, Homo sapiens
acctgccgacct

SEQ ID NO: 2942741 - DNA, 12 bp, Homo sapiens
acctgcctagct

SEQ ID NO: 2942742 - DNA, 17 bp, Homo sapiens
acctgcctagctcttgg

SEQ ID NO: 2942743 - DNA, 20 bp, Homo sapiens
acctgcctagctcttgggcc

SEQ ID NO: 2942744 - DNA, 13 bp, Homo sapiens
acctgcctcagga

SEQ ID NO: 2942745 - DNA, 21 bp, Homo sapiens
acctgcctgacatttggagtg

SEQ ID NO: 2942746 - DNA, 13 bp, Homo sapiens
acctgcctggccg

SEQ ID NO: 2942747 - DNA, 15 bp, Homo sapiens
acctgcctggccggc

SEQ ID NO: 2942748 - DNA, 17 bp, Homo sapiens
acctgcctggccggcca

SEQ ID NO: 2942749 - DNA, 20 bp, Homo sapiens
acctgcctggccggccagcc

SEQ ID NO: 2942750 - DNA, 19 bp, Homo sapiens
acctgcgggtcctcagctg

SEQ ID NO: 2942751 - DNA, 22 bp, Homo sapiens
acctgcttgggtggagaagcca

SEQ ID NO: 2942752 - DNA, 18 bp, Homo sapiens
acctggaagcatttgttt

SEQ ID NO: 2942753 - DNA, 22 bp, Homo sapiens
acctggacaaagtccaagtctg

SEQ ID NO: 2942754 - DNA, 15 bp, Homo sapiens
acctggactagggcc

SEQ ID NO: 2942755 - DNA, 21 bp, Homo sapiens
acctggatataaattaattgt

SEQ ID NO: 2942756 - DNA, 23 bp, Homo sapiens
acctggccgggtcaccctgtgac

SEQ ID NO: 2942757 - DNA, 20 bp, Homo sapiens
acctggcttgtttattttgt

SEQ ID NO: 2942758 - DNA, 20 bp, Homo sapiens
acctggcttttctttctacc

SEQ ID NO: 2942759 - DNA, 23 bp, Homo sapiens
acctgggcgccaactgctgatca

SEQ ID NO: 2942760 - DNA, 12 bp, Homo sapiens
acctgggctggg

SEQ ID NO: 2942761 - DNA, 14 bp, Homo sapiens
acctgggctgggcg

SEQ ID NO: 2942762 - DNA, 18 bp, Homo sapiens
acctggggtgtgggaggc

SEQ ID NO: 2942763 - DNA, 21 bp, Homo sapiens
acctggggtgtgggaggcccg

SEQ ID NO: 2942764 - DNA, 19 bp, Homo sapiens
acctgggtatgtgtaggca

SEQ ID NO: 2942765 - DNA, 16 bp, Homo sapiens
acctgggttgcagaca

SEQ ID NO: 2942766 - DNA, 18 bp, Homo sapiens
acctgggttgcagacagg

SEQ ID NO: 2942767 - DNA, 17 bp, Homo sapiens
acctggtactccctctc

SEQ ID NO: 2942768 - DNA, 18 bp, Homo sapiens
acctggtccacagggcac

SEQ ID NO: 2942769 - DNA, 22 bp, Homo sapiens
acctggtcctccgcctactgtc

SEQ ID NO: 2942770 - DNA, 18 bp, Homo sapiens
acctggtctgttttctgt

SEQ ID NO: 2942771 - DNA, 17 bp, Homo sapiens
acctgtaaatgtcctga

SEQ ID NO: 2942772 - DNA, 16 bp, Homo sapiens
acctgtaatcccagca

SEQ ID NO: 2942773 - DNA, 11 bp, Homo sapiens
acctgtacagt

SEQ ID NO: 2942774 - DNA, 18 bp, Homo sapiens
acctgtagatagtgatat

SEQ ID NO: 2942775 - DNA, 20 bp, Homo sapiens
acctgtagatgcagaaaaag

SEQ ID NO: 2942776 - DNA, 16 bp, Homo sapiens
acctgtagtcccagct

SEQ ID NO: 2942777 - DNA, 20 bp, Homo sapiens
acctgtagtcccagctactt

SEQ ID NO: 2942778 - DNA, 12 bp, Homo sapiens
acctgtatcttt

SEQ ID NO: 2942779 - DNA, 23 bp, Homo sapiens
acctgtatctttctatgctgctt

SEQ ID NO: 2942780 - DNA, 21 bp, Homo sapiens
acctgtatttaaaaatagaaa

SEQ ID NO: 2942781 - DNA, 20 bp, Homo sapiens
acctgtcaaacaaagccaga

SEQ ID NO: 2942782 - DNA, 15 bp, Homo sapiens
acctgtcctctttgt

SEQ ID NO: 2942783 - DNA, 22 bp, Homo sapiens
acctgtccttactcagagctgc

SEQ ID NO: 2942784 - DNA, 19 bp, Homo sapiens
acctgtcggtggctgcctt

SEQ ID NO: 2942785 - DNA, 18 bp, Homo sapiens
acctgtctgaactgttaa

SEQ ID NO: 2942786 - DNA, 12 bp, Homo sapiens
acctgtgcctcc

SEQ ID NO: 2942787 - DNA, 13 bp, Homo sapiens
acctgtgcctccc

SEQ ID NO: 2942788 - DNA, 13 bp, Homo sapiens
acctgtgtccccg

SEQ ID NO: 2942789 - DNA, 23 bp, Homo sapiens
acctgtgtccccgatgctgacct

SEQ ID NO: 2942790 - DNA, 14 bp, Homo sapiens
acctgtgtctgcga

SEQ ID NO: 2942791 - DNA, 13 bp, Homo sapiens
acctgttcctccc

SEQ ID NO: 2942792 - DNA, 19 bp, Homo sapiens
acctgttgagcatcacaga

SEQ ID NO: 2942793 - DNA, 21 bp, Homo sapiens
acctgttgagcatcacagaat

SEQ ID NO: 2942794 - DNA, 22 bp, Homo sapiens
acctgttgagcatcacagaatg

SEQ ID NO: 2942795 - DNA, 16 bp, Homo sapiens
acctgttgcttacaat

SEQ ID NO: 2942796 - DNA, 20 bp, Homo sapiens
acctgttgcttacaattttt

SEQ ID NO: 2942797 - DNA, 21 bp, Homo sapiens
acctgttgcttacaatttttt

SEQ ID NO: 2942798 - DNA, 13 bp, Homo sapiens
accttaaaaatgc

SEQ ID NO: 2942799 - DNA, 22 bp, Homo sapiens
accttaaacacccctcagttgt

SEQ ID NO: 2942800 - DNA, 13 bp, Homo sapiens
accttaaatgcta

SEQ ID NO: 2942801 - DNA, 22 bp, Homo sapiens
accttaagacctactgttctaa

SEQ ID NO: 2942802 - DNA, 22 bp, Homo sapiens
accttaatttaactttccagtc

SEQ ID NO: 2942803 - DNA, 17 bp, Homo sapiens
accttacgatcaggcac

SEQ ID NO: 2942804 - DNA, 21 bp, Homo sapiens
accttacgatcaggcacaggt

SEQ ID NO: 2942805 - DNA, 19 bp, Homo sapiens
accttactcaggggatgtt

SEQ ID NO: 2942806 - DNA, 16 bp, Homo sapiens
accttaggcagggaag

SEQ ID NO: 2942807 - DNA, 14 bp, Homo sapiens
accttaggccttcc

SEQ ID NO: 2942808 - DNA, 18 bp, Homo sapiens
accttaggccttcctctc

SEQ ID NO: 2942809 - DNA, 20 bp, Homo sapiens
accttaggccttcctctctc

SEQ ID NO: 2942810 - DNA, 20 bp, Homo sapiens
accttagtgtttctgtgcat

SEQ ID NO: 2942811 - DNA, 19 bp, Homo sapiens
accttagtttcaagagtct

SEQ ID NO: 2942812 - DNA, 23 bp, Homo sapiens
accttatctggaagatctgcaaa

SEQ ID NO: 2942813 - DNA, 18 bp, Homo sapiens
accttatgagaaactgca

SEQ ID NO: 2942814 - DNA, 22 bp, Homo sapiens
accttattgagcgtgattctgt

SEQ ID NO: 2942815 - DNA, 12 bp, Homo sapiens
accttcagcttt

SEQ ID NO: 2942816 - DNA, 16 bp, Homo sapiens
accttcagctttattt

SEQ ID NO: 2942817 - DNA, 19 bp, Homo sapiens
accttcagctttatttttc

SEQ ID NO: 2942818 - DNA, 22 bp, Homo sapiens
accttcagtaacccccactgga

SEQ ID NO: 2942819 - DNA, 22 bp, Homo sapiens
accttcatttcatgtatagttt

SEQ ID NO: 2942820 - DNA, 15 bp, Homo sapiens
accttccaagagcct

SEQ ID NO: 2942821 - DNA, 18 bp, Homo sapiens
accttcccaccccttcat

SEQ ID NO: 2942822 - DNA, 12 bp, Homo sapiens
accttcccagct

SEQ ID NO: 2942823 - DNA, 19 bp, Homo sapiens
accttcccagctctccctc

SEQ ID NO: 2942824 - DNA, 12 bp, Homo sapiens
accttccccaga

SEQ ID NO: 2942825 - DNA, 15 bp, Homo sapiens
accttccccagactt

SEQ ID NO: 2942826 - DNA, 16 bp, Homo sapiens
accttccccagacttg

SEQ ID NO: 2942827 - DNA, 23 bp, Homo sapiens
acggcccagggagggtgagctgg

SEQ ID NO: 2942828 - DNA, 22 bp, Homo sapiens
acggccccgaagggcccccaca

SEQ ID NO: 2942829 - DNA, 19 bp, Homo sapiens
acggcccggcccctcaccc

SEQ ID NO: 2942830 - DNA, 21 bp, Homo sapiens
acggcccggcccctcaccctc

SEQ ID NO: 2942831 - DNA, 17 bp, Homo sapiens
acggcgctgcctcaggc

SEQ ID NO: 2942832 - DNA, 16 bp, Homo sapiens
acggctgatgtggact

SEQ ID NO: 2942833 - DNA, 22 bp, Homo sapiens
acggctgggtgtttcagtttga

SEQ ID NO: 2942834 - DNA, 17 bp, Homo sapiens
acggctggtcactctgc

SEQ ID NO: 2942835 - DNA, 19 bp, Homo sapiens
acggctggtcactctgccc

SEQ ID NO: 2942836 - DNA, 20 bp, Homo sapiens
acggctggtcactctgccct

SEQ ID NO: 2942837 - DNA, 21 bp, Homo sapiens
acggctggtcactctgccctc

SEQ ID NO: 2942838 - DNA, 15 bp, Homo sapiens
acactccccgaagtc

SEQ ID NO: 2942839 - DNA, 14 bp, Homo sapiens
acactcctcctgcc

SEQ ID NO: 2942840 - DNA, 15 bp, Homo sapiens
acactcctcctgcca

SEQ ID NO: 2942841 - DNA, 16 bp, Homo sapiens
acactcctcctgccag

SEQ ID NO: 2942842 - DNA, 20 bp, Homo sapiens
acactcctcctgccagctct

SEQ ID NO: 2942843 - DNA, 21 bp, Homo sapiens
acactcctcctgccagctctg

SEQ ID NO: 2942844 - DNA, 22 bp, Homo sapiens
acactcctcctgccagctctgt

SEQ ID NO: 2942845 - DNA, 13 bp, Homo sapiens
acactccttcccc

SEQ ID NO: 2942846 - DNA, 18 bp, Homo sapiens
acactccttccccttgtc

SEQ ID NO: 2942847 - DNA, 21 bp, Homo sapiens
acactccttccccttgtccct

SEQ ID NO: 2942848 - DNA, 13 bp, Homo sapiens
acactccttgcat

SEQ ID NO: 2942849 - DNA, 14 bp, Homo sapiens
acactccttgcatc

SEQ ID NO: 2942850 - DNA, 14 bp, Homo sapiens
acactctgtgtttt

SEQ ID NO: 2942851 - DNA, 14 bp, Homo sapiens
acactgaggcaggg

SEQ ID NO: 2942852 - DNA, 14 bp, Homo sapiens
acactgagtttcta

SEQ ID NO: 2942853 - DNA, 20 bp, Homo sapiens
acactgatctgaacatctgg

SEQ ID NO: 2942854 - DNA, 22 bp, Homo sapiens
acactgatgcaaggattacaga

SEQ ID NO: 2942855 - DNA, 22 bp, Homo sapiens
acactgatgcttagatgttcca

SEQ ID NO: 2942856 - DNA, 22 bp, Homo sapiens
acactgccatcttagtttggat

SEQ ID NO: 2942857 - DNA, 15 bp, Homo sapiens
acactgccctcttgt

SEQ ID NO: 2942858 - DNA, 19 bp, Homo sapiens
acactgcctttttatttat

SEQ ID NO: 2942859 - DNA, 13 bp, Homo sapiens
acactgcgccccg

SEQ ID NO: 2942860 - DNA, 18 bp, Homo sapiens
acactgcgctttattttc

SEQ ID NO: 2942861 - DNA, 21 bp, Homo sapiens
acactgcgctttattttctta

SEQ ID NO: 2942862 - DNA, 21 bp, Homo sapiens
acactggaggagagaagaatg

SEQ ID NO: 2942863 - DNA, 18 bp, Homo sapiens
acactggcagactgtgta

SEQ ID NO: 2942864 - DNA, 14 bp, Homo sapiens
acactgggaaacag

SEQ ID NO: 2942865 - DNA, 15 bp, Homo sapiens
acactgggaggccag

SEQ ID NO: 2942866 - DNA, 13 bp, Homo sapiens
acactgggtggtg

SEQ ID NO: 2942867 - DNA, 19 bp, Homo sapiens
acactgggtggtggcctgg

SEQ ID NO: 2942868 - DNA, 23 bp, Homo sapiens
acactgggtggtggcctggtccc

SEQ ID NO: 2942869 - DNA, 14 bp, Homo sapiens
acactggttctcaa

SEQ ID NO: 2942870 - DNA, 21 bp, Homo sapiens
acactgtcatgcttcatcatt

SEQ ID NO: 2942871 - DNA, 20 bp, Homo sapiens
acactgtgacaatgactaag

SEQ ID NO: 2942872 - DNA, 18 bp, Homo sapiens
acactgtgacacactaca

SEQ ID NO: 2942873 - DNA, 23 bp, Homo sapiens
acactgtgattactctttgcttt

SEQ ID NO: 2942874 - DNA, 18 bp, Homo sapiens
acactgtgcacatctgtg

SEQ ID NO: 2942875 - DNA, 19 bp, Homo sapiens
acactgtgggtgtgtgact

SEQ ID NO: 2942876 - DNA, 13 bp, Homo sapiens
acactgtgtctct

SEQ ID NO: 2942877 - DNA, 17 bp, Homo sapiens
acactgtgtctctatgt

SEQ ID NO: 2942878 - DNA, 19 bp, Homo sapiens
acactgtgtctctatgtga

SEQ ID NO: 2942879 - DNA, 14 bp, Homo sapiens
acacttaaattatg

SEQ ID NO: 2942880 - DNA, 11 bp, Homo sapiens
acacttaacag

SEQ ID NO: 2942881 - DNA, 14 bp, Homo sapiens
acacttaacagatg

SEQ ID NO: 2942882 - DNA, 16 bp, Homo sapiens
acacttaacagatgca

SEQ ID NO: 2942883 - DNA, 18 bp, Homo sapiens
acacttaccccatggctg

SEQ ID NO: 2942884 - DNA, 19 bp, Homo sapiens
acacttactgtaagacatt

SEQ ID NO: 2942885 - DNA, 23 bp, Homo sapiens
acacttattttacacagcaattt

SEQ ID NO: 2942886 - DNA, 18 bp, Homo sapiens
acacttcaaggtgacaga

SEQ ID NO: 2942887 - DNA, 14 bp, Homo sapiens
acacttctgtcctg

SEQ ID NO: 2942888 - DNA, 21 bp, Homo sapiens
acacttctttatactctcttc

SEQ ID NO: 2942889 - DNA, 22 bp, Homo sapiens
acacttgaacctgggaggtgga

SEQ ID NO: 2942890 - DNA, 20 bp, Homo sapiens
acacttgccctgctccctct

SEQ ID NO: 2942891 - DNA, 15 bp, Homo sapiens
acacttggtgctggg

SEQ ID NO: 2942892 - DNA, 17 bp, Homo sapiens
acacttggtgctgggaa

SEQ ID NO: 2942893 - DNA, 13 bp, Homo sapiens
acacttgtgccag

SEQ ID NO: 2942894 - DNA, 16 bp, Homo sapiens
acacttgtgccagccc

SEQ ID NO: 2942895 - DNA, 19 bp, Homo sapiens
acactttgccatattttca

SEQ ID NO: 2942896 - DNA, 15 bp, Homo sapiens
acactttggacctta

SEQ ID NO: 2942897 - DNA, 23 bp, Homo sapiens
acacttttaaaataaattctctc

SEQ ID NO: 2942898 - DNA, 22 bp, Homo sapiens
acacttttatatttgaaaaaat

SEQ ID NO: 2942899 - DNA, 15 bp, Homo sapiens
acacttttcagcaaa

SEQ ID NO: 2942900 - DNA, 23 bp, Homo sapiens
acacttttttggggatatgctta

SEQ ID NO: 2942901 - DNA, 16 bp, Homo sapiens
acagaaaaagcatgat

SEQ ID NO: 2942902 - DNA, 17 bp, Homo sapiens
acagaaaaagcatgatg

SEQ ID NO: 2942903 - DNA, 22 bp, Homo sapiens
acagaaaacattctgatttgga

SEQ ID NO: 2942904 - DNA, 22 bp, Homo sapiens
acagaaaataatctggtgttct

SEQ ID NO: 2942905 - DNA, 14 bp, Homo sapiens
acagaaacactgcc

SEQ ID NO: 2942906 - DNA, 15 bp, Homo sapiens
acagaaacactgcct

SEQ ID NO: 2942907 - DNA, 19 bp, Homo sapiens
acagaaacactgccttttt

SEQ ID NO: 2942908 - DNA, 20 bp, Homo sapiens
acagaaagaaaaatgcatta

SEQ ID NO: 2942909 - DNA, 15 bp, Homo sapiens
acagaaagagggaca

SEQ ID NO: 2942910 - DNA, 13 bp, Homo sapiens
acagaaagcacaa

SEQ ID NO: 2942911 - DNA, 23 bp, Homo sapiens
acagaaagcacaaagaattgatt

SEQ ID NO: 2942912 - DNA, 24 bp, Homo sapiens
acagaaagggcaacaataaaatag

SEQ ID NO: 2942913 - DNA, 17 bp, Homo sapiens
acagaaagtggtgctca

SEQ ID NO: 2942914 - DNA, 15 bp, Homo sapiens
acagaaatatataaa

SEQ ID NO: 2942915 - DNA, 15 bp, Homo sapiens
acagaaccagcagaa

SEQ ID NO: 2942916 - DNA, 18 bp, Homo sapiens
acagaactctttcaaaac

SEQ ID NO: 2942917 - DNA, 14 bp, Homo sapiens
acagaagcagctct

SEQ ID NO: 2942918 - DNA, 15 bp, Homo sapiens
acagaagcagctctt

SEQ ID NO: 2942919 - DNA, 13 bp, Homo sapiens
acagaataaaagt

SEQ ID NO: 2942920 - DNA, 15 bp, Homo sapiens
acagaatgaaaaatg

SEQ ID NO: 2942921 - DNA, 24 bp, Homo sapiens
acagaatgaaaaatgaaagatgat

SEQ ID NO: 2942922 - DNA, 18 bp, Homo sapiens
acagaattttatggtgca

SEQ ID NO: 2942923 - DNA, 18 bp, Homo sapiens
acagacaaaaacagcctc

SEQ ID NO: 2942924 - DNA, 19 bp, Homo sapiens
acagacaaaaacagcctca

SEQ ID NO: 2942925 - DNA, 13 bp, Homo sapiens
acagacatacata

SEQ ID NO: 2942926 - DNA, 16 bp, Homo sapiens
acagacatacatagac

SEQ ID NO: 2942927 - DNA, 14 bp, Homo sapiens
acagacatatttaa

SEQ ID NO: 2942928 - DNA, 17 bp, Homo sapiens
acagacctggtgctcta

SEQ ID NO: 2942929 - DNA, 17 bp, Homo sapiens
acagacgtctcaagact

SEQ ID NO: 2942930 - DNA, 20 bp, Homo sapiens
acagactcaaatgctcagac

SEQ ID NO: 2942931 - DNA, 18 bp, Homo sapiens
acagactcatcctgaaca

SEQ ID NO: 2942932 - DNA, 23 bp, Homo sapiens
acagactcatcctgaacagcatg

SEQ ID NO: 2942933 - DNA, 17 bp, Homo sapiens
acagactcctgaggaca

SEQ ID NO: 2942934 - DNA, 23 bp, Homo sapiens
acagactcctgaggacagctgtc

SEQ ID NO: 2942935 - DNA, 15 bp, Homo sapiens
acagactcttccacc

SEQ ID NO: 2942936 - DNA, 16 bp, Homo sapiens
acagactcttccacca

SEQ ID NO: 2942937 - DNA, 21 bp, Homo sapiens
acagactcttccaccagagca

SEQ ID NO: 2942938 - DNA, 13 bp, Homo sapiens
acagactgcccca

SEQ ID NO: 2942939 - DNA, 14 bp, Homo sapiens
acagactgccccag

SEQ ID NO: 2942940 - DNA, 15 bp, Homo sapiens
acagactgccccagc

SEQ ID NO: 2942941 - DNA, 16 bp, Homo sapiens
acagactgccccagcc

SEQ ID NO: 2942942 - DNA, 19 bp, Homo sapiens
acagactgccccagccaac

SEQ ID NO: 2942943 - DNA, 16 bp, Homo sapiens
acagagaaggcaggaa

SEQ ID NO: 2942944 - DNA, 15 bp, Homo sapiens
acagagacacctgca

SEQ ID NO: 2942945 - DNA, 16 bp, Homo sapiens
acagagacacctgcac

SEQ ID NO: 2942946 - DNA, 17 bp, Homo sapiens
acagagcacgcctgcca

SEQ ID NO: 2942947 - DNA, 23 bp, Homo sapiens
acagagcagctaactccgagagc

SEQ ID NO: 2942948 - DNA, 22 bp, Homo sapiens
acagagcctgaatttgtaagca

SEQ ID NO: 2942949 - DNA, 23 bp, Homo sapiens
acagagccttctgaggacattcc

SEQ ID NO: 2942950 - DNA, 20 bp, Homo sapiens
acagagcgagactccatctc

SEQ ID NO: 2942951 - DNA, 16 bp, Homo sapiens
acagagcttccctgac

SEQ ID NO: 2942952 - DNA, 16 bp, Homo sapiens
acagaggccccagcct

SEQ ID NO: 2942953 - DNA, 18 bp, Homo sapiens
acagaggccccagcctcc

SEQ ID NO: 2942954 - DNA, 22 bp, Homo sapiens
acagaggccccagcctccctga

SEQ ID NO: 2942955 - DNA, 15 bp, Homo sapiens
acagagggaagaaaa

SEQ ID NO: 2942956 - DNA, 23 bp, Homo sapiens
acagagggaccaaattgcttcta

SEQ ID NO: 2942957 - DNA, 23 bp, Homo sapiens
acagaggtaaaaaaaagaagtgt

SEQ ID NO: 2942958 - DNA, 13 bp, Homo sapiens
acagagtaagaca

SEQ ID NO: 2942959 - DNA, 21 bp, Homo sapiens
acagagtagttttggttttta

SEQ ID NO: 2942960 - DNA, 19 bp, Homo sapiens
acagagtctcgctctgtcg

SEQ ID NO: 2942961 - DNA, 20 bp, Homo sapiens
acagagtgagactccatctc

SEQ ID NO: 2942962 - DNA, 22 bp, Homo sapiens
acagagtggactgttccctgag

SEQ ID NO: 2942963 - DNA, 20 bp, Homo sapiens
acagagtgtagccaggtccc

SEQ ID NO: 2942964 - DNA, 16 bp, Homo sapiens
acagagtgtgtttttg

SEQ ID NO: 2942965 - DNA, 17 bp, Homo sapiens
acagagtgtgtttttgc

SEQ ID NO: 2942966 - DNA, 12 bp, Homo sapiens
acagagttttct

SEQ ID NO: 2942967 - DNA, 13 bp, Homo sapiens
acagagtttttta

SEQ ID NO: 2942968 - DNA, 23 bp, Homo sapiens
acagagttttttaaacaaatgag

SEQ ID NO: 2942969 - DNA, 16 bp, Homo sapiens
acagatactgtgagct

SEQ ID NO: 2942970 - DNA, 22 bp, Homo sapiens
acagatattacagcttattttt

SEQ ID NO: 2942971 - DNA, 16 bp, Homo sapiens
acagatcaagctgtga

SEQ ID NO: 2942972 - DNA, 12 bp, Homo sapiens
acagatctggaa

SEQ ID NO: 2942973 - DNA, 14 bp, Homo sapiens
acagatctggaacc

SEQ ID NO: 2942974 - DNA, 17 bp, Homo sapiens
agaattgaaacactttt

SEQ ID NO: 2942975 - DNA, 18 bp, Homo sapiens
agaattgaacccaggagg

SEQ ID NO: 2942976 - DNA, 15 bp, Homo sapiens
agaattgccaatctt

SEQ ID NO: 2942977 - DNA, 19 bp, Homo sapiens
agaattgcttgagcttggg

SEQ ID NO: 2942978 - DNA, 13 bp, Homo sapiens
agaatttcactgt

SEQ ID NO: 2942979 - DNA, 17 bp, Homo sapiens
agaatttgctttatctg

SEQ ID NO: 2942980 - DNA, 12 bp, Homo sapiens
agaattttaaaa

SEQ ID NO: 2942981 - DNA, 17 bp, Homo sapiens
agaattttaaaaatgaa

SEQ ID NO: 2942982 - DNA, 16 bp, Homo sapiens
agaattttaatgtgaa

SEQ ID NO: 2942983 - DNA, 19 bp, Homo sapiens
agaattttaatgtgaagac

SEQ ID NO: 2942984 - DNA, 21 bp, Homo sapiens
agaattttcagaccccagcgg

SEQ ID NO: 2942985 - DNA, 15 bp, Homo sapiens
agaattttttttgtt

SEQ ID NO: 2942986 - DNA, 12 bp, Homo sapiens
agacaaaagaaa

SEQ ID NO: 2942987 - DNA, 14 bp, Homo sapiens
agacaaaatgaaag

SEQ ID NO: 2942988 - DNA, 16 bp, Homo sapiens
agacaaagacattatt

SEQ ID NO: 2942989 - DNA, 20 bp, Homo sapiens
agacaaatactcatgtgtat

SEQ ID NO: 2942990 - DNA, 20 bp, Homo sapiens
agacaacagaaagagggaca

SEQ ID NO: 2942991 - DNA, 17 bp, Homo sapiens
agacaagcctggcctac

SEQ ID NO: 2942992 - DNA, 16 bp, Homo sapiens
agacaaggcaggcctg

SEQ ID NO: 2942993 - DNA, 17 bp, Homo sapiens
agacaaggcaggcctga

SEQ ID NO: 2942994 - DNA, 23 bp, Homo sapiens
agacaagtgctcaagcagcaaaa

SEQ ID NO: 2942995 - DNA, 18 bp, Homo sapiens
agacaatatgtgagtgcc

SEQ ID NO: 2942996 - DNA, 20 bp, Homo sapiens
agacaatatgtgagtgcctt

SEQ ID NO: 2942997 - DNA, 21 bp, Homo sapiens
agacaatatgtgagtgccttt

SEQ ID NO: 2942998 - DNA, 18 bp, Homo sapiens
agacaatcactgaaacaa

SEQ ID NO: 2942999 - DNA, 21 bp, Homo sapiens
agacaatgtctgcagccctga

SEQ ID NO: 2943000 - DNA, 14 bp, Homo sapiens
agacaattctttat

SEQ ID NO: 2943001 - DNA, 16 bp, Homo sapiens
agacaattgacaacag

SEQ ID NO: 2943002 - DNA, 19 bp, Homo sapiens
agacaattgacaacagtta

SEQ ID NO: 2943003 - DNA, 12 bp, Homo sapiens
agacacaggccc

SEQ ID NO: 2943004 - DNA, 16 bp, Homo sapiens
agacacatatgagggg

SEQ ID NO: 2943005 - DNA, 12 bp, Homo sapiens
agacaccaaagt

SEQ ID NO: 2943006 - DNA, 13 bp, Homo sapiens
agacaccaaagtt

SEQ ID NO: 2943007 - DNA, 17 bp, Homo sapiens
agacaccaaagttctaa

SEQ ID NO: 2943008 - DNA, 14 bp, Homo sapiens
agacacccaggact

SEQ ID NO: 2943009 - DNA, 16 bp, Homo sapiens
agacaccttctgtgct

SEQ ID NO: 2943010 - DNA, 19 bp, Homo sapiens
agacaccttctgtgctcat

SEQ ID NO: 2943011 - DNA, 16 bp, Homo sapiens
agacactacaacatat

SEQ ID NO: 2943012 - DNA, 11 bp, Homo sapiens
agacactgcct

SEQ ID NO: 2943013 - DNA, 15 bp, Homo sapiens
agacactgcctgggc

SEQ ID NO: 2943014 - DNA, 13 bp, Homo sapiens
agacactgcttgg

SEQ ID NO: 2943015 - DNA, 12 bp, Homo sapiens
agacactggtgt

SEQ ID NO: 2943016 - DNA, 15 bp, Homo sapiens
agacagacatacata

SEQ ID NO: 2943017 - DNA, 23 bp, Homo sapiens
agacagagaatatgtctgctcct

SEQ ID NO: 2943018 - DNA, 19 bp, Homo sapiens
agacagagggtcacagtgt

SEQ ID NO: 2943019 - DNA, 17 bp, Homo sapiens
agacagatcactcctgg

SEQ ID NO: 2943020 - DNA, 14 bp, Homo sapiens
agacagccccctgc

SEQ ID NO: 2943021 - DNA, 18 bp, Homo sapiens
agacaggaaaatcctctg

SEQ ID NO: 2943022 - DNA, 20 bp, Homo sapiens
agacaggaaaatcctctggc

SEQ ID NO: 2943023 - DNA, 14 bp, Homo sapiens
agacaggaagcctc

SEQ ID NO: 2943024 - DNA, 16 bp, Homo sapiens
agacaggcggggccca

SEQ ID NO: 2943025 - DNA, 17 bp, Homo sapiens
agacaggcggggcccag

SEQ ID NO: 2943026 - DNA, 21 bp, Homo sapiens
agacaggcggggcccagcgct

SEQ ID NO: 2943027 - DNA, 23 bp, Homo sapiens
agacagggtttcaccatgttgcc

SEQ ID NO: 2943028 - DNA, 22 bp, Homo sapiens
agacaggtccctccccttctct

SEQ ID NO: 2943029 - DNA, 18 bp, Homo sapiens
agacaggttttcacataa

SEQ ID NO: 2943030 - DNA, 22 bp, Homo sapiens
agacaggttttcacataaatgc

SEQ ID NO: 2943031 - DNA, 17 bp, Homo sapiens
agacagtaacacaatta

SEQ ID NO: 2943032 - DNA, 18 bp, Homo sapiens
agacagtcgctcagtctg

SEQ ID NO: 2943033 - DNA, 22 bp, Homo sapiens
agacagtcgctcagtctgttca

SEQ ID NO: 2943034 - DNA, 12 bp, Homo sapiens
agacagtcttgc

SEQ ID NO: 2943035 - DNA, 17 bp, Homo sapiens
agacagtgcacatgaac

SEQ ID NO: 2943036 - DNA, 17 bp, Homo sapiens
agacagttcttttctac

SEQ ID NO: 2943037 - DNA, 16 bp, Homo sapiens
agacagttttgagaac

SEQ ID NO: 2943038 - DNA, 16 bp, Homo sapiens
agacatacttgaaggg

SEQ ID NO: 2943039 - DNA, 19 bp, Homo sapiens
agacatacttgaagggcca

SEQ ID NO: 2943040 - DNA, 18 bp, Homo sapiens
agacataggccatgaaaa

SEQ ID NO: 2943041 - DNA, 19 bp, Homo sapiens
agacataggccatgaaaaa

SEQ ID NO: 2943042 - DNA, 14 bp, Homo sapiens
agacatatttaact

SEQ ID NO: 2943043 - DNA, 16 bp, Homo sapiens
agacatatttaactgg

SEQ ID NO: 2943044 - DNA, 17 bp, Homo sapiens
actgctacacttctgat

SEQ ID NO: 2943045 - DNA, 19 bp, Homo sapiens
actgctacctttcaaagct

SEQ ID NO: 2943046 - DNA, 16 bp, Homo sapiens
actgctacttgctctg

SEQ ID NO: 2943047 - DNA, 19 bp, Homo sapiens
actgctatctactaagttt

SEQ ID NO: 2943048 - DNA, 23 bp, Homo sapiens
actgctatctactaagtttcctt

SEQ ID NO: 2943049 - DNA, 15 bp, Homo sapiens
actgctcttgtttct

SEQ ID NO: 2943050 - DNA, 18 bp, Homo sapiens
actgctcttgtttctttt

SEQ ID NO: 2943051 - DNA, 15 bp, Homo sapiens
actgctcttttacta

SEQ ID NO: 2943052 - DNA, 19 bp, Homo sapiens
actgctcttttactaagac

SEQ ID NO: 2943053 - DNA, 18 bp, Homo sapiens
actgctgacccaccaagg

SEQ ID NO: 2943054 - DNA, 15 bp, Homo sapiens
actgctgatgctgaa

SEQ ID NO: 2943055 - DNA, 18 bp, Homo sapiens
actgctgatgctgaaata

SEQ ID NO: 2943056 - DNA, 11 bp, Homo sapiens
actgctgcctc

SEQ ID NO: 2943057 - DNA, 15 bp, Homo sapiens
actgctgctccccac

SEQ ID NO: 2943058 - DNA, 17 bp, Homo sapiens
actgctgctccccaccc

SEQ ID NO: 2943059 - DNA, 11 bp, Homo sapiens
actgctgctgt

SEQ ID NO: 2943060 - DNA, 14 bp, Homo sapiens
actgctgcttctcc

SEQ ID NO: 2943061 - DNA, 15 bp, Homo sapiens
actgctggctgcagc

SEQ ID NO: 2943062 - DNA, 14 bp, Homo sapiens
actgctggggctgg

SEQ ID NO: 2943063 - DNA, 20 bp, Homo sapiens
actgcttctcggccagcccg

SEQ ID NO: 2943064 - DNA, 13 bp, Homo sapiens
actgcttgcccag

SEQ ID NO: 2943065 - DNA, 17 bp, Homo sapiens
actgcttgcccagggtg

SEQ ID NO: 2943066 - DNA, 14 bp, Homo sapiens
actgcttttggcct

SEQ ID NO: 2943067 - DNA, 13 bp, Homo sapiens
actggaaaaatga

SEQ ID NO: 2943068 - DNA, 19 bp, Homo sapiens
actggaagcatgtaggaga

SEQ ID NO: 2943069 - DNA, 19 bp, Homo sapiens
actggaagctaatttgcat

SEQ ID NO: 2943070 - DNA, 16 bp, Homo sapiens
actggaaggagcacat

SEQ ID NO: 2943071 - DNA, 19 bp, Homo sapiens
actggaaggagcacatact

SEQ ID NO: 2943072 - DNA, 14 bp, Homo sapiens
actggaccaggtcc

SEQ ID NO: 2943073 - DNA, 15 bp, Homo sapiens
actggagaaatgctt

SEQ ID NO: 2943074 - DNA, 15 bp, Homo sapiens
actggagcaccaggc

SEQ ID NO: 2943075 - DNA, 15 bp, Homo sapiens
actggagccatgggc

SEQ ID NO: 2943076 - DNA, 16 bp, Homo sapiens
actggagctgggaggt

SEQ ID NO: 2943077 - DNA, 16 bp, Homo sapiens
actggaggtcgaagca

SEQ ID NO: 2943078 - DNA, 18 bp, Homo sapiens
actggaggtcgaagcaat

SEQ ID NO: 2943079 - DNA, 16 bp, Homo sapiens
actggcagccccagca

SEQ ID NO: 2943080 - DNA, 12 bp, Homo sapiens
actggcagcctg

SEQ ID NO: 2943081 - DNA, 20 bp, Homo sapiens
actggcagcctgcacctggt

SEQ ID NO: 2943082 - DNA, 22 bp, Homo sapiens
actggcagttttccattggttt

SEQ ID NO: 2943083 - DNA, 18 bp, Homo sapiens
actggcataaatctgaag

SEQ ID NO: 2943084 - DNA, 18 bp, Homo sapiens
actggcattttatagaca

SEQ ID NO: 2943085 - DNA, 16 bp, Homo sapiens
actggccccacaggag

SEQ ID NO: 2943086 - DNA, 15 bp, Homo sapiens
actggccgggcaggc

SEQ ID NO: 2943087 - DNA, 16 bp, Homo sapiens
actggccgggcaggcg

SEQ ID NO: 2943088 - DNA, 21 bp, Homo sapiens
actggcctaggggccagggct

SEQ ID NO: 2943089 - DNA, 19 bp, Homo sapiens
actggcgacacgtagcagc

SEQ ID NO: 2943090 - DNA, 13 bp, Homo sapiens
actggctacagta

SEQ ID NO: 2943091 - DNA, 13 bp, Homo sapiens
actggctcatgcc

SEQ ID NO: 2943092 - DNA, 21 bp, Homo sapiens
actggctggccagtctgggtc

SEQ ID NO: 2943093 - DNA, 16 bp, Homo sapiens
actggcttgtacattt

SEQ ID NO: 2943094 - DNA, 13 bp, Homo sapiens
actggctttggct

SEQ ID NO: 2943095 - DNA, 21 bp, Homo sapiens
actggcttttattaatgcact

SEQ ID NO: 2943096 - DNA, 16 bp, Homo sapiens
actgggacagcccagg

SEQ ID NO: 2943097 - DNA, 20 bp, Homo sapiens
actgggaggccgaggcaggg

SEQ ID NO: 2943098 - DNA, 14 bp, Homo sapiens
actgggaggggaga

SEQ ID NO: 2943099 - DNA, 22 bp, Homo sapiens
actgggatgggaggagaggaca

SEQ ID NO: 2943100 - DNA, 21 bp, Homo sapiens
actgggcacctgcgcacaggt

SEQ ID NO: 2943101 - DNA, 22 bp, Homo sapiens
actgggccatgggtcctcggcc

SEQ ID NO: 2943102 - DNA, 17 bp, Homo sapiens
actgggcgtctgactcc

SEQ ID NO: 2943103 - DNA, 19 bp, Homo sapiens
actgggctcaagtgatcct

SEQ ID NO: 2943104 - DNA, 13 bp, Homo sapiens
actgggctgaggg

SEQ ID NO: 2943105 - DNA, 13 bp, Homo sapiens
actgggctgggtt

SEQ ID NO: 2943106 - DNA, 18 bp, Homo sapiens
actgggctgggtttgctg

SEQ ID NO: 2943107 - DNA, 21 bp, Homo sapiens
actggggaggctgaggcagga

SEQ ID NO: 2943108 - DNA, 13 bp, Homo sapiens
actggggcctcca

SEQ ID NO: 2943109 - DNA, 17 bp, Homo sapiens
actggggcctccagaac

SEQ ID NO: 2943110 - DNA, 21 bp, Homo sapiens
actggggctggggaaggaagc

SEQ ID NO: 2943111 - DNA, 15 bp, Homo sapiens
actgggggaaaagat

SEQ ID NO: 2943112 - DNA, 17 bp, Homo sapiens
actggggggaccaaata

SEQ ID NO: 2943113 - DNA, 18 bp, Homo sapiens
actggggggaccaaatag

SEQ ID NO: 2943114 - DNA, 16 bp, Homo sapiens
actgggttcccatgct

SEQ ID NO: 2943115 - DNA, 18 bp, Homo sapiens
actgggttggaagaaata

SEQ ID NO: 2943116 - DNA, 17 bp, Homo sapiens
actggtaattgtacaat

SEQ ID NO: 2943117 - DNA, 20 bp, Homo sapiens
actggtaattgtacaatact

SEQ ID NO: 2943118 - DNA, 12 bp, Homo sapiens
actggtagtgtt

SEQ ID NO: 2943119 - DNA, 13 bp, Homo sapiens
actggtcccggtc

SEQ ID NO: 2943120 - DNA, 13 bp, Homo sapiens
actggtcccttcc

SEQ ID NO: 2943121 - DNA, 22 bp, Homo sapiens
actggtgcactttgtaaattcc

SEQ ID NO: 2943122 - DNA, 13 bp, Homo sapiens
actggtgtaatct

SEQ ID NO: 2943123 - DNA, 21 bp, Homo sapiens
actggtgtaatctcaatgcaa

SEQ ID NO: 2943124 - DNA, 22 bp, Homo sapiens
actggtgttatcaccgtgggct

SEQ ID NO: 2943125 - DNA, 18 bp, Homo sapiens
actggttatcacaccatc

SEQ ID NO: 2943126 - DNA, 14 bp, Homo sapiens
actggttatcctgt

SEQ ID NO: 2943127 - DNA, 15 bp, Homo sapiens
actggttatcctgtg

SEQ ID NO: 2943128 - DNA, 20 bp, Homo sapiens
actggttatcctgtgctaca

SEQ ID NO: 2943129 - DNA, 13 bp, Homo sapiens
actggttatcttg

SEQ ID NO: 2943130 - DNA, 16 bp, Homo sapiens
actggttatcttgtta

SEQ ID NO: 2943131 - DNA, 20 bp, Homo sapiens
actggttatcttgttattat

SEQ ID NO: 2943132 - DNA, 18 bp, Homo sapiens
actggttcaagagacact

SEQ ID NO: 2943133 - DNA, 18 bp, Homo sapiens
actggttctcaatgaaaa

SEQ ID NO: 2943134 - DNA, 17 bp, Homo sapiens
actggtttgaagaatgt

SEQ ID NO: 2943135 - DNA, 22 bp, Homo sapiens
actggtttgtatgatgtattag

SEQ ID NO: 2943136 - DNA, 15 bp, Homo sapiens
actggttttacttac

SEQ ID NO: 2943137 - DNA, 14 bp, Homo sapiens
actggttttcacat

SEQ ID NO: 2943138 - DNA, 19 bp, Homo sapiens
actgtaaagaaagagagaa

SEQ ID NO: 2943139 - DNA, 20 bp, Homo sapiens
acttcatcttccccaagtgc

SEQ ID NO: 2943140 - DNA, 16 bp, Homo sapiens
acttcatgcaggtgaa

SEQ ID NO: 2943141 - DNA, 20 bp, Homo sapiens
acttcatgtttttcacctat

SEQ ID NO: 2943142 - DNA, 21 bp, Homo sapiens
acttcattgagagttttgtct

SEQ ID NO: 2943143 - DNA, 15 bp, Homo sapiens
acttcattttcagag

SEQ ID NO: 2943144 - DNA, 17 bp, Homo sapiens
acttcattttcagagtg

SEQ ID NO: 2943145 - DNA, 19 bp, Homo sapiens
acttccaaatcccctaagc

SEQ ID NO: 2943146 - DNA, 23 bp, Homo sapiens
acttccagcaaaatccaaactgc

SEQ ID NO: 2943147 - DNA, 20 bp, Homo sapiens
acttccaggtgttactgtaa

SEQ ID NO: 2943148 - DNA, 13 bp, Homo sapiens
acttccagtctgg

SEQ ID NO: 2943149 - DNA, 10 bp, Homo sapiens
acttccattc

SEQ ID NO: 2943150 - DNA, 20 bp, Homo sapiens
acttccattctttcttcctc

SEQ ID NO: 2943151 - DNA, 14 bp, Homo sapiens
acttcccaccctgc

SEQ ID NO: 2943152 - DNA, 15 bp, Homo sapiens
acttcccactgtatg

SEQ ID NO: 2943153 - DNA, 13 bp, Homo sapiens
acttccctcaggc

SEQ ID NO: 2943154 - DNA, 16 bp, Homo sapiens
acttccctgctgcctg

SEQ ID NO: 2943155 - DNA, 13 bp, Homo sapiens
acttccctgttct

SEQ ID NO: 2943156 - DNA, 16 bp, Homo sapiens
acttccgtcacccttg

SEQ ID NO: 2943157 - DNA, 18 bp, Homo sapiens
acttcctccagaagcctc

SEQ ID NO: 2943158 - DNA, 13 bp, Homo sapiens
acttcctctccac

SEQ ID NO: 2943159 - DNA, 19 bp, Homo sapiens
acttcctctccacaggagc

SEQ ID NO: 2943160 - DNA, 18 bp, Homo sapiens
acttcctgtccagctcca

SEQ ID NO: 2943161 - DNA, 23 bp, Homo sapiens
acttcctgtccagctccaacctg

SEQ ID NO: 2943162 - DNA, 22 bp, Homo sapiens
acttccttgagacacggagccc

SEQ ID NO: 2943163 - DNA, 16 bp, Homo sapiens
acttcgcatcaaaaga

SEQ ID NO: 2943164 - DNA, 24 bp, Homo sapiens
acttcgcatcaaaagacaattctt

SEQ ID NO: 2943165 - DNA, 15 bp, Homo sapiens
acttctagagggaga

SEQ ID NO: 2943166 - DNA, 19 bp, Homo sapiens
acttctatattttaataga

SEQ ID NO: 2943167 - DNA, 19 bp, Homo sapiens
acttctctgagtcagctga

SEQ ID NO: 2943168 - DNA, 17 bp, Homo sapiens
acttctctgatcaaaat

SEQ ID NO: 2943169 - DNA, 13 bp, Homo sapiens
acttctcttccag

SEQ ID NO: 2943170 - DNA, 17 bp, Homo sapiens
acttctggggccacctc

SEQ ID NO: 2943171 - DNA, 15 bp, Homo sapiens
acttctggtcccctg

SEQ ID NO: 2943172 - DNA, 14 bp, Homo sapiens
acttctgtgtctgt

SEQ ID NO: 2943173 - DNA, 16 bp, Homo sapiens
acttcttatggaattg

SEQ ID NO: 2943174 - DNA, 23 bp, Homo sapiens
acttcttatggaattgatttgca

SEQ ID NO: 2943175 - DNA, 20 bp, Homo sapiens
acttcttgaaggtgctgacg

SEQ ID NO: 2943176 - DNA, 22 bp, Homo sapiens
acttcttggcttggtgaggaaa

SEQ ID NO: 2943177 - DNA, 20 bp, Homo sapiens
acttcttggtgctgttgaaa

SEQ ID NO: 2943178 - DNA, 23 bp, Homo sapiens
acttcttggtgctgttgaaaata

SEQ ID NO: 2943179 - DNA, 19 bp, Homo sapiens
acttctttatactctcttc

SEQ ID NO: 2943180 - DNA, 21 bp, Homo sapiens
acttctttatactctcttccc

SEQ ID NO: 2943181 - DNA, 19 bp, Homo sapiens
acttcttttcacattctta

SEQ ID NO: 2943182 - DNA, 14 bp, Homo sapiens
acttgaaagatttt

SEQ ID NO: 2943183 - DNA, 20 bp, Homo sapiens
acttgaacctatgaagcaat

SEQ ID NO: 2943184 - DNA, 16 bp, Homo sapiens
acttgaactttcctgg

SEQ ID NO: 2943185 - DNA, 23 bp, Homo sapiens
actttccaccaactttttccaag

SEQ ID NO: 2943186 - DNA, 21 bp, Homo sapiens
actttccgaaaaataaagaca

SEQ ID NO: 2943187 - DNA, 17 bp, Homo sapiens
actttccttctctgtaa

SEQ ID NO: 2943188 - DNA, 20 bp, Homo sapiens
actttcggagaaattctctt

SEQ ID NO: 2943189 - DNA, 21 bp, Homo sapiens
actttcggagaaattctcttt

SEQ ID NO: 2943190 - DNA, 12 bp, Homo sapiens
actttctatttt

SEQ ID NO: 2943191 - DNA, 18 bp, Homo sapiens
actttctatttttatgat

SEQ ID NO: 2943192 - DNA, 22 bp, Homo sapiens
actttctatttttatgatgaca

SEQ ID NO: 2943193 - DNA, 15 bp, Homo sapiens
actttctcacttaca

SEQ ID NO: 2943194 - DNA, 12 bp, Homo sapiens
actttctcttca

SEQ ID NO: 2943195 - DNA, 13 bp, Homo sapiens
actttctcttgtt

SEQ ID NO: 2943196 - DNA, 20 bp, Homo sapiens
actttctgaaactcccttgt

SEQ ID NO: 2943197 - DNA, 15 bp, Homo sapiens
actttgaataaagaa

SEQ ID NO: 2943198 - DNA, 22 bp, Homo sapiens
actttgaataaagaatacttga

SEQ ID NO: 2943199 - DNA, 17 bp, Homo sapiens
actttgaatagtcctaa

SEQ ID NO: 2943200 - DNA, 21 bp, Homo sapiens
actttgaatagtcctaaaaag

SEQ ID NO: 2943201 - DNA, 15 bp, Homo sapiens
actttgagaggctga

SEQ ID NO: 2943202 - DNA, 18 bp, Homo sapiens
actttgagaggctgaggt

SEQ ID NO: 2943203 - DNA, 18 bp, Homo sapiens
actttgagcctgggaaat

SEQ ID NO: 2943204 - DNA, 20 bp, Homo sapiens
actttgatgtgtttttgtat

SEQ ID NO: 2943205 - DNA, 17 bp, Homo sapiens
actttgcaggcggccct

SEQ ID NO: 2943206 - DNA, 17 bp, Homo sapiens
actttgcatagcagctg

SEQ ID NO: 2943207 - DNA, 20 bp, Homo sapiens
actttgcctttccataatca

SEQ ID NO: 2943208 - DNA, 17 bp, Homo sapiens
actttgctctttcttga

SEQ ID NO: 2943209 - DNA, 15 bp, Homo sapiens
actttggaaaatgca

SEQ ID NO: 2943210 - DNA, 18 bp, Homo sapiens
actttggaaaatgcattg

SEQ ID NO: 2943211 - DNA, 13 bp, Homo sapiens
actttggaagcac

SEQ ID NO: 2943212 - DNA, 20 bp, Homo sapiens
actttgggataggaaaaatg

SEQ ID NO: 2943213 - DNA, 16 bp, Homo sapiens
actttgggtttttaac

SEQ ID NO: 2943214 - DNA, 17 bp, Homo sapiens
actttgggtttttaact

SEQ ID NO: 2943215 - DNA, 20 bp, Homo sapiens
actttgggtttttaactcat

SEQ ID NO: 2943216 - DNA, 18 bp, Homo sapiens
actttggtcacccagact

SEQ ID NO: 2943217 - DNA, 15 bp, Homo sapiens
actttgtctgaaaaa

SEQ ID NO: 2943218 - DNA, 14 bp, Homo sapiens
actttgtgaataga

SEQ ID NO: 2943219 - DNA, 12 bp, Homo sapiens
actttgtgcaaa

SEQ ID NO: 2943220 - DNA, 17 bp, Homo sapiens
actttgtgcaaaagcag

SEQ ID NO: 2943221 - DNA, 17 bp, Homo sapiens
actttgttggcccttcc

SEQ ID NO: 2943222 - DNA, 12 bp, Homo sapiens
actttgtttatt

SEQ ID NO: 2943223 - DNA, 23 bp, Homo sapiens
acttttaaaataaattctctcct

SEQ ID NO: 2943224 - DNA, 18 bp, Homo sapiens
acttttaaaatttgtaga

SEQ ID NO: 2943225 - DNA, 14 bp, Homo sapiens
acttttaaacaaaa

SEQ ID NO: 2943226 - DNA, 15 bp, Homo sapiens
acttttaaacaaaag

SEQ ID NO: 2943227 - DNA, 20 bp, Homo sapiens
acttttctagttaacttttt

SEQ ID NO: 2943228 - DNA, 22 bp, Homo sapiens
acttttctcctgcatgtgtata

SEQ ID NO: 2943229 - DNA, 23 bp, Homo sapiens
acttttgaagaacaaaaggcttt

SEQ ID NO: 2943230 - DNA, 15 bp, Homo sapiens
acttttgttctcttc

SEQ ID NO: 2943231 - DNA, 18 bp, Homo sapiens
actttttaaaatgttggt

SEQ ID NO: 2943232 - DNA, 22 bp, Homo sapiens
actttttaaacagtgtttatga

SEQ ID NO: 2943233 - DNA, 19 bp, Homo sapiens
actttttaactattaagag

SEQ ID NO: 2943234 - DNA, 15 bp, Homo sapiens
actttttagtaattt

SEQ ID NO: 2943235 - DNA, 12 bp, Homo sapiens
actttttataaa

SEQ ID NO: 2943236 - DNA, 19 bp, Homo sapiens
actttttatgtaatacttt

SEQ ID NO: 2943237 - DNA, 12 bp, Homo sapiens
actttttattgc

SEQ ID NO: 2943238 - DNA, 21 bp, Homo sapiens
actttttcatagtaagtgcga

SEQ ID NO: 2943239 - DNA, 11 bp, Homo sapiens
actttttccag

SEQ ID NO: 2943240 - DNA, 14 bp, Homo sapiens
actttttccttctg

SEQ ID NO: 2943241 - DNA, 15 bp, Homo sapiens
actttttctttatgt

SEQ ID NO: 2943242 - DNA, 19 bp, Homo sapiens
actttttggtaatatatat

SEQ ID NO: 2943243 - DNA, 23 bp, Homo sapiens
actttttgtgaagacggcacggt

SEQ ID NO: 2943244 - DNA, 13 bp, Homo sapiens
actttttgtttct

SEQ ID NO: 2943245 - DNA, 15 bp, Homo sapiens
acttttttacactga

SEQ ID NO: 2943246 - DNA, 22 bp, Homo sapiens
acttttttgagtggatgatgtt

SEQ ID NO: 2943247 - DNA, 22 bp, Homo sapiens
acttttttggggatatgcttag

SEQ ID NO: 2943248 - DNA, 23 bp, Homo sapiens
acttttttggggatatgcttagt

SEQ ID NO: 2943249 - DNA, 17 bp, Homo sapiens
acttttttttgtatgtt

SEQ ID NO: 2943250 - DNA, 14 bp, Homo sapiens
agaaaaaaaaacac

SEQ ID NO: 2943251 - DNA, 16 bp, Homo sapiens
agaaaaaaaaatgcca

SEQ ID NO: 2943252 - DNA, 23 bp, Homo sapiens
agaaaaaaaaatgccataataca

SEQ ID NO: 2943253 - DNA, 21 bp, Homo sapiens
agaaaaaaagtttgccagaag

SEQ ID NO: 2943254 - DNA, 13 bp, Homo sapiens
agaaaaaaattca

SEQ ID NO: 2943255 - DNA, 13 bp, Homo sapiens
agaaaaaagggtt

SEQ ID NO: 2943256 - DNA, 20 bp, Homo sapiens
agaaaaaagggtttatgctt

SEQ ID NO: 2943257 - DNA, 17 bp, Homo sapiens
agaaaaaatcactgttt

SEQ ID NO: 2943258 - DNA, 14 bp, Homo sapiens
agaaaaactaactt

SEQ ID NO: 2943259 - DNA, 21 bp, Homo sapiens
agaaaaatgagcatacatctt

SEQ ID NO: 2943260 - DNA, 13 bp, Homo sapiens
agaaaaatgttct

SEQ ID NO: 2943261 - DNA, 23 bp, Homo sapiens
agaaaacaaaggagcattaagcc

SEQ ID NO: 2943262 - DNA, 13 bp, Homo sapiens
agaaaacatgttt

SEQ ID NO: 2943263 - DNA, 17 bp, Homo sapiens
agaaaaccaaaatgata

SEQ ID NO: 2943264 - DNA, 15 bp, Homo sapiens
agaaaaccacccctt

SEQ ID NO: 2943265 - DNA, 17 bp, Homo sapiens
agaaaacgccagtgtgt

SEQ ID NO: 2943266 - DNA, 15 bp, Homo sapiens
agaaaactggaaatc

SEQ ID NO: 2943267 - DNA, 16 bp, Homo sapiens
agaaaagcacctgccg

SEQ ID NO: 2943268 - DNA, 19 bp, Homo sapiens
agaaaagccgaaagggtta

SEQ ID NO: 2943269 - DNA, 14 bp, Homo sapiens
agaaaagcttccta

SEQ ID NO: 2943270 - DNA, 11 bp, Homo sapiens
agaaaagttat

SEQ ID NO: 2943271 - DNA, 22 bp, Homo sapiens
agaaaagttgacacctgagaaa

SEQ ID NO: 2943272 - DNA, 14 bp, Homo sapiens
agaaaataaaaagt

SEQ ID NO: 2943273 - DNA, 15 bp, Homo sapiens
agaaaataaaaagtt

SEQ ID NO: 2943274 - DNA, 18 bp, Homo sapiens
agaaaataaaaagttaaa

SEQ ID NO: 2943275 - DNA, 15 bp, Homo sapiens
agaaaatatactgta

SEQ ID NO: 2943276 - DNA, 17 bp, Homo sapiens
agaaaatatactgtaaa

SEQ ID NO: 2943277 - DNA, 19 bp, Homo sapiens
agaaaatatactgtaaaga

SEQ ID NO: 2943278 - DNA, 23 bp, Homo sapiens
agaaaatatactgtaaagaaaga

SEQ ID NO: 2943279 - DNA, 16 bp, Homo sapiens
agaaaatcaaagcagt

SEQ ID NO: 2943280 - DNA, 23 bp, Homo sapiens
agaaaatcaagcaggttagagaa

SEQ ID NO: 2943281 - DNA, 22 bp, Homo sapiens
agaaaatcagttgattaagtta

SEQ ID NO: 2943282 - DNA, 11 bp, Homo sapiens
agaaaatgaag

SEQ ID NO: 2943283 - DNA, 16 bp, Homo sapiens
agaaaatgcaccaaat

SEQ ID NO: 2943284 - DNA, 16 bp, Homo sapiens
agaaaatgctagaaga

SEQ ID NO: 2943285 - DNA, 19 bp, Homo sapiens
agaaaatggaattactcca

SEQ ID NO: 2943286 - DNA, 23 bp, Homo sapiens
agaaaatgtgtctgcaacatgga

SEQ ID NO: 2943287 - DNA, 17 bp, Homo sapiens
agaaaatgttgagaatc

SEQ ID NO: 2943288 - DNA, 20 bp, Homo sapiens
agaaaattgcctttaaaact

SEQ ID NO: 2943289 - DNA, 15 bp, Homo sapiens
agaaacaaacaaaac

SEQ ID NO: 2943290 - DNA, 19 bp, Homo sapiens
agaaacacactgaggcagg

SEQ ID NO: 2943291 - DNA, 22 bp, Homo sapiens
agaaacacactgaggcagggaa

SEQ ID NO: 2943292 - DNA, 18 bp, Homo sapiens
agaaacacataaattatg

SEQ ID NO: 2943293 - DNA, 21 bp, Homo sapiens
agaaacacataaattatgaga

SEQ ID NO: 2943294 - DNA, 14 bp, Homo sapiens
agaaacactcaaca

SEQ ID NO: 2943295 - DNA, 19 bp, Homo sapiens
agaaacagggacaaagaaa

SEQ ID NO: 2943296 - DNA, 12 bp, Homo sapiens
agaaacatttag

SEQ ID NO: 2943297 - DNA, 16 bp, Homo sapiens
agaaacccgacagagg

SEQ ID NO: 2943298 - DNA, 16 bp, Homo sapiens
agaaacctactgccca

SEQ ID NO: 2943299 - DNA, 23 bp, Homo sapiens
agaaacctactgcccaggcactg

SEQ ID NO: 2943300 - DNA, 15 bp, Homo sapiens
agaaaccttgtttgt

SEQ ID NO: 2943301 - DNA, 18 bp, Homo sapiens
agaaacctttttaaaaat

SEQ ID NO: 2943302 - DNA, 23 bp, Homo sapiens
agaaacgtccatctctctccctt

SEQ ID NO: 2943303 - DNA, 20 bp, Homo sapiens
agaaacgtctacgtatgcat

SEQ ID NO: 2943304 - DNA, 18 bp, Homo sapiens
agaaacgtcttctaaact

SEQ ID NO: 2943305 - DNA, 19 bp, Homo sapiens
agaaactcaatgcacaaca

SEQ ID NO: 2943306 - DNA, 22 bp, Homo sapiens
agaaactgttcccacctgctgg

SEQ ID NO: 2943307 - DNA, 14 bp, Homo sapiens
agaaactttggaag

SEQ ID NO: 2943308 - DNA, 16 bp, Homo sapiens
agaaagaagtcagtta

SEQ ID NO: 2943309 - DNA, 16 bp, Homo sapiens
agaaagagaagtcaca

SEQ ID NO: 2943310 - DNA, 18 bp, Homo sapiens
agaaagagacagagactg

SEQ ID NO: 2943311 - DNA, 12 bp, Homo sapiens
agaaagagagaa

SEQ ID NO: 2943312 - DNA, 14 bp, Homo sapiens
agaaagagagaaaa

SEQ ID NO: 2943313 - DNA, 16 bp, Homo sapiens
agaaagagagaaaata

SEQ ID NO: 2943314 - DNA, 15 bp, Homo sapiens
agaaagagctacctg

SEQ ID NO: 2943315 - DNA, 14 bp, Homo sapiens
agaaagagggacaa

SEQ ID NO: 2943316 - DNA, 19 bp, Homo sapiens
agaaagagtattgttatgt

SEQ ID NO: 2943317 - DNA, 16 bp, Homo sapiens
agaagataacattttc

SEQ ID NO: 2943318 - DNA, 17 bp, Homo sapiens
agaagataacattttca

SEQ ID NO: 2943319 - DNA, 14 bp, Homo sapiens
agaagatagtgaga

SEQ ID NO: 2943320 - DNA, 20 bp, Homo sapiens
agaagcaataaagaagagtg

SEQ ID NO: 2943321 - DNA, 12 bp, Homo sapiens
agaagcaatggg

SEQ ID NO: 2943322 - DNA, 13 bp, Homo sapiens
agaagcagtgagc

SEQ ID NO: 2943323 - DNA, 12 bp, Homo sapiens
agaagccacaga

SEQ ID NO: 2943324 - DNA, 15 bp, Homo sapiens
agaagccacccttcc

SEQ ID NO: 2943325 - DNA, 16 bp, Homo sapiens
agaagccacccttccc

SEQ ID NO: 2943326 - DNA, 12 bp, Homo sapiens
agaagccattgt

SEQ ID NO: 2943327 - DNA, 12 bp, Homo sapiens
agaagcccccag

SEQ ID NO: 2943328 - DNA, 14 bp, Homo sapiens
agaagcccccagct

SEQ ID NO: 2943329 - DNA, 17 bp, Homo sapiens
agaagcccccagctaag

SEQ ID NO: 2943330 - DNA, 14 bp, Homo sapiens
agaagccctgttct

SEQ ID NO: 2943331 - DNA, 14 bp, Homo sapiens
agaagcctccttac

SEQ ID NO: 2943332 - DNA, 22 bp, Homo sapiens
agaagcctccttacattaaaaa

SEQ ID NO: 2943333 - DNA, 14 bp, Homo sapiens
agaagctcctctcc

SEQ ID NO: 2943334 - DNA, 17 bp, Homo sapiens
agaagctcctctcccca

SEQ ID NO: 2943335 - DNA, 23 bp, Homo sapiens
agaagctcctctccccagcccag

SEQ ID NO: 2943336 - DNA, 15 bp, Homo sapiens
agaagctgagcacca

SEQ ID NO: 2943337 - DNA, 17 bp, Homo sapiens
agaagctgttgggagaa

SEQ ID NO: 2943338 - DNA, 14 bp, Homo sapiens
agaaggaaaaagaa

SEQ ID NO: 2943339 - DNA, 21 bp, Homo sapiens
agaaggaaaattttagcgtgc

SEQ ID NO: 2943340 - DNA, 19 bp, Homo sapiens
agaaggaaggttggcgggg

SEQ ID NO: 2943341 - DNA, 21 bp, Homo sapiens
agaaggaatggtgcgtggctt

SEQ ID NO: 2943342 - DNA, 15 bp, Homo sapiens
agaaggatggcatct

SEQ ID NO: 2943343 - DNA, 17 bp, Homo sapiens
agaaggcaacttgaaga

SEQ ID NO: 2943344 - DNA, 19 bp, Homo sapiens
agaaggcaacttgaagaaa

SEQ ID NO: 2943345 - DNA, 20 bp, Homo sapiens
agaaggcctcccctgaggat

SEQ ID NO: 2943346 - DNA, 22 bp, Homo sapiens
agaagggcttacaggcatggac

SEQ ID NO: 2943347 - DNA, 19 bp, Homo sapiens
agaaggggacttctcttcc

SEQ ID NO: 2943348 - DNA, 24 bp, Homo sapiens
agaaggggcgggaatattgtttct

SEQ ID NO: 2943349 - DNA, 19 bp, Homo sapiens
agaaggtcagcgagaagga

SEQ ID NO: 2943350 - DNA, 18 bp, Homo sapiens
agaagtaacttattttgt

SEQ ID NO: 2943351 - DNA, 16 bp, Homo sapiens
agaagtaagaagagga

SEQ ID NO: 2943352 - DNA, 22 bp, Homo sapiens
agaagtaagaagaggagcctca

SEQ ID NO: 2943353 - DNA, 19 bp, Homo sapiens
agaagtattgtttacatta

SEQ ID NO: 2943354 - DNA, 22 bp, Homo sapiens
agaagtcacaacaaaaggaaga

SEQ ID NO: 2943355 - DNA, 21 bp, Homo sapiens
agaagtcagagaaaacacttt

SEQ ID NO: 2943356 - DNA, 20 bp, Homo sapiens
agaagtctcttaattctgat

SEQ ID NO: 2943357 - DNA, 21 bp, Homo sapiens
agaagtctggccattttggaa

SEQ ID NO: 2943358 - DNA, 19 bp, Homo sapiens
agaagtctttcaagaatga

SEQ ID NO: 2943359 - DNA, 13 bp, Homo sapiens
agaagtgacaggg

SEQ ID NO: 2943360 - DNA, 17 bp, Homo sapiens
agaagtgcaaaggtgtg

SEQ ID NO: 2943361 - DNA, 15 bp, Homo sapiens
agaagtgccaataat

SEQ ID NO: 2943362 - DNA, 15 bp, Homo sapiens
agaagtggaccagga

SEQ ID NO: 2943363 - DNA, 17 bp, Homo sapiens
agaagtggaccaggaca

SEQ ID NO: 2943364 - DNA, 23 bp, Homo sapiens
agaagtggaccaggacaggacca

SEQ ID NO: 2943365 - DNA, 23 bp, Homo sapiens
agaagtgggccaggacaggcccg

SEQ ID NO: 2943366 - DNA, 18 bp, Homo sapiens
agaagtggggaccccacc

SEQ ID NO: 2943367 - DNA, 22 bp, Homo sapiens
agaagtggggaccccacccctc

SEQ ID NO: 2943368 - DNA, 23 bp, Homo sapiens
agaagtggggaccccacccctca

SEQ ID NO: 2943369 - DNA, 15 bp, Homo sapiens
agaagtggtgttcca

SEQ ID NO: 2943370 - DNA, 24 bp, Homo sapiens
agaagtggtgttccatgacttcag

SEQ ID NO: 2943371 - DNA, 12 bp, Homo sapiens
agaagtgtgatt

SEQ ID NO: 2943372 - DNA, 15 bp, Homo sapiens
agaagttaagcaaca

SEQ ID NO: 2943373 - DNA, 21 bp, Homo sapiens
agaagttggtcttactttgtg

SEQ ID NO: 2943374 - DNA, 23 bp, Homo sapiens
agaagtttgcactatctttcagc

SEQ ID NO: 2943375 - DNA, 19 bp, Homo sapiens
agaagtttgggctaacatt

SEQ ID NO: 2943376 - DNA, 21 bp, Homo sapiens
agaagtttgggctaacattta

SEQ ID NO: 2943377 - DNA, 15 bp, Homo sapiens
agaagtttgtcaagt

SEQ ID NO: 2943378 - DNA, 17 bp, Homo sapiens
agaagttttaaattttg

SEQ ID NO: 2943379 - DNA, 12 bp, Homo sapiens
accaattcatga

SEQ ID NO: 2943380 - DNA, 16 bp, Homo sapiens
accaattttttgttct

SEQ ID NO: 2943381 - DNA, 18 bp, Homo sapiens
accaattttttgttcttc

SEQ ID NO: 2943382 - DNA, 19 bp, Homo sapiens
accacaaacggagcccctg

SEQ ID NO: 2943383 - DNA, 20 bp, Homo sapiens
accacaaacggagcccctga

SEQ ID NO: 2943384 - DNA, 20 bp, Homo sapiens
accacaaagcacagtttgaa

SEQ ID NO: 2943385 - DNA, 13 bp, Homo sapiens
accacacacaaca

SEQ ID NO: 2943386 - DNA, 18 bp, Homo sapiens
accacacacaacagccaa

SEQ ID NO: 2943387 - DNA, 13 bp, Homo sapiens
accacacatccca

SEQ ID NO: 2943388 - DNA, 18 bp, Homo sapiens
accacacatcccagccca

SEQ ID NO: 2943389 - DNA, 16 bp, Homo sapiens
accacacatctgtgga

SEQ ID NO: 2943390 - DNA, 13 bp, Homo sapiens
accacaccctgcc

SEQ ID NO: 2943391 - DNA, 14 bp, Homo sapiens
accacaccctgcct

SEQ ID NO: 2943392 - DNA, 17 bp, Homo sapiens
accacaccctgcctgct

SEQ ID NO: 2943393 - DNA, 19 bp, Homo sapiens
accacaccctgcctgctgt

SEQ ID NO: 2943394 - DNA, 15 bp, Homo sapiens
accacagcacagcca

SEQ ID NO: 2943395 - DNA, 16 bp, Homo sapiens
accacagcacagccaa

SEQ ID NO: 2943396 - DNA, 16 bp, Homo sapiens
accacaggtgtgagcc

SEQ ID NO: 2943397 - DNA, 16 bp, Homo sapiens
accacatctaagcctg

SEQ ID NO: 2943398 - DNA, 20 bp, Homo sapiens
accacatctaagcctgaagg

SEQ ID NO: 2943399 - DNA, 14 bp, Homo sapiens
accaccaaaattat

SEQ ID NO: 2943400 - DNA, 15 bp, Homo sapiens
accaccaaaattata

SEQ ID NO: 2943401 - DNA, 21 bp, Homo sapiens
accatctgtgactataaagct

SEQ ID NO: 2943402 - DNA, 20 bp, Homo sapiens
accatctttaatcaatgtga

SEQ ID NO: 2943403 - DNA, 18 bp, Homo sapiens
accatgatggccaggctg

SEQ ID NO: 2943404 - DNA, 20 bp, Homo sapiens
accatgcccgactaattttt

SEQ ID NO: 2943405 - DNA, 23 bp, Homo sapiens
accatgcgacactgggaggccag

SEQ ID NO: 2943406 - DNA, 16 bp, Homo sapiens
accatggggaggtggc

SEQ ID NO: 2943407 - DNA, 17 bp, Homo sapiens
accatggttaagagtcc

SEQ ID NO: 2943408 - DNA, 19 bp, Homo sapiens
accatggttaagagtccaa

SEQ ID NO: 2943409 - DNA, 21 bp, Homo sapiens
accatggttaagagtccaaga

SEQ ID NO: 2943410 - DNA, 22 bp, Homo sapiens
accatgtgaaactctaccctga

SEQ ID NO: 2943411 - DNA, 19 bp, Homo sapiens
accatgtgcggagcagcct

SEQ ID NO: 2943412 - DNA, 20 bp, Homo sapiens
accatgtgcggagcagcctt

SEQ ID NO: 2943413 - DNA, 12 bp, Homo sapiens
accatgtttgag

SEQ ID NO: 2943414 - DNA, 19 bp, Homo sapiens
accatgtttgagctcagac

SEQ ID NO: 2943415 - DNA, 13 bp, Homo sapiens
accattaaccaga

SEQ ID NO: 2943416 - DNA, 15 bp, Homo sapiens
accattataccagca

SEQ ID NO: 2943417 - DNA, 20 bp, Homo sapiens
accattcctatagtacttta

SEQ ID NO: 2943418 - DNA, 15 bp, Homo sapiens
accattggacagatt

SEQ ID NO: 2943419 - DNA, 20 bp, Homo sapiens
accattggacagatttcagt

SEQ ID NO: 2943420 - DNA, 18 bp, Homo sapiens
accattggtctctgggta

SEQ ID NO: 2943421 - DNA, 22 bp, Homo sapiens
accatttcctcagcttatctct

SEQ ID NO: 2943422 - DNA, 23 bp, Homo sapiens
accatttcttgaggtaaaagcat

SEQ ID NO: 2943423 - DNA, 17 bp, Homo sapiens
accattttcccatcatc

SEQ ID NO: 2943424 - DNA, 22 bp, Homo sapiens
accattttttaaggaaacaata

SEQ ID NO: 2943425 - DNA, 23 bp, Homo sapiens
acccaaaagtcaaaaggtgcctg

SEQ ID NO: 2943426 - DNA, 16 bp, Homo sapiens
acccaaaccccttccc

SEQ ID NO: 2943427 - DNA, 15 bp, Homo sapiens
acccaaagcctgtcc

SEQ ID NO: 2943428 - DNA, 20 bp, Homo sapiens
acccaaagcctgtcccagga

SEQ ID NO: 2943429 - DNA, 18 bp, Homo sapiens
acccaaagctgagcctgc

SEQ ID NO: 2943430 - DNA, 23 bp, Homo sapiens
acccaaccagtaggatatttcta

SEQ ID NO: 2943431 - DNA, 13 bp, Homo sapiens
acccaacctgtcc

SEQ ID NO: 2943432 - DNA, 14 bp, Homo sapiens
acccaacctgtcct

SEQ ID NO: 2943433 - DNA, 23 bp, Homo sapiens
acccaacctgtccttactcagag

SEQ ID NO: 2943434 - DNA, 19 bp, Homo sapiens
acccaagacctcagggcac

SEQ ID NO: 2943435 - DNA, 19 bp, Homo sapiens
acccaagtagctgctacct

SEQ ID NO: 2943436 - DNA, 17 bp, Homo sapiens
acccaatagctgcccat

SEQ ID NO: 2943437 - DNA, 21 bp, Homo sapiens
acccaatagctgcccatttcg

SEQ ID NO: 2943438 - DNA, 13 bp, Homo sapiens
acccaatccaaat

SEQ ID NO: 2943439 - DNA, 14 bp, Homo sapiens
acccaatccaaatg

SEQ ID NO: 2943440 - DNA, 17 bp, Homo sapiens
acccacaagctgcctct

SEQ ID NO: 2943441 - DNA, 15 bp, Homo sapiens
acccacatgtgacac

SEQ ID NO: 2943442 - DNA, 22 bp, Homo sapiens
acccaccccacacctgcagtgc

SEQ ID NO: 2943443 - DNA, 11 bp, Homo sapiens
acccacctgct

SEQ ID NO: 2943444 - DNA, 22 bp, Homo sapiens
acccacctgctgagagacccaa

SEQ ID NO: 2943445 - DNA, 22 bp, Homo sapiens
acccacgtccacgcggccacct

SEQ ID NO: 2943446 - DNA, 21 bp, Homo sapiens
acccactctgcggcccgggcc

SEQ ID NO: 2943447 - DNA, 22 bp, Homo sapiens
acccactgaattgacatgaccc

SEQ ID NO: 2943448 - DNA, 18 bp, Homo sapiens
acccacttctcatcacac

SEQ ID NO: 2943449 - DNA, 19 bp, Homo sapiens
acccacttctcatcacaca

SEQ ID NO: 2943450 - DNA, 21 bp, Homo sapiens
acccacttctcatcacacaca

SEQ ID NO: 2943451 - DNA, 22 bp, Homo sapiens
acccacttctcatcacacacat

SEQ ID NO: 2943452 - DNA, 23 bp, Homo sapiens
acccacttctcatcacacacatg

SEQ ID NO: 2943453 - DNA, 21 bp, Homo sapiens
acccagacggctccactagga

SEQ ID NO: 2943454 - DNA, 14 bp, Homo sapiens
acccagctaaataa

SEQ ID NO: 2943455 - DNA, 22 bp, Homo sapiens
acccagctactgaaccagccac

SEQ ID NO: 2943456 - DNA, 21 bp, Homo sapiens
acccaggaagggagggagctg

SEQ ID NO: 2943457 - DNA, 20 bp, Homo sapiens
acccaggaggggaacactgc

SEQ ID NO: 2943458 - DNA, 21 bp, Homo sapiens
acccaggaggtggaggttgca

SEQ ID NO: 2943459 - DNA, 20 bp, Homo sapiens
acccaggatttgctgggaga

SEQ ID NO: 2943460 - DNA, 17 bp, Homo sapiens
acccagggcctgcagga

SEQ ID NO: 2943461 - DNA, 17 bp, Homo sapiens
acccagggggctgaaac

SEQ ID NO: 2943462 - DNA, 20 bp, Homo sapiens
acccagggggctgaaacttg

SEQ ID NO: 2943463 - DNA, 19 bp, Homo sapiens
acccagggtctagccgctg

SEQ ID NO: 2943464 - DNA, 22 bp, Homo sapiens
acccagggtctagccgctgccc

SEQ ID NO: 2943465 - DNA, 19 bp, Homo sapiens
acccagggtggagtgcagt

SEQ ID NO: 2943466 - DNA, 20 bp, Homo sapiens
acccagggtggagtgcagtg

SEQ ID NO: 2943467 - DNA, 21 bp, Homo sapiens
acccagggtggagtgcagtgg

SEQ ID NO: 2943468 - DNA, 23 bp, Homo sapiens
acccaggtcccccgactgcctgt

SEQ ID NO: 2943469 - DNA, 18 bp, Homo sapiens
acccagtcacctctgtct

SEQ ID NO: 2943470 - DNA, 16 bp, Homo sapiens
acccagtccacaaaat

SEQ ID NO: 2943471 - DNA, 18 bp, Homo sapiens
acccagtcctctgcctcc

SEQ ID NO: 2943472 - DNA, 19 bp, Homo sapiens
acccagtcctctgcctcca

SEQ ID NO: 2943473 - DNA, 19 bp, Homo sapiens
acccagtcgcccttacttc

SEQ ID NO: 2943474 - DNA, 21 bp, Homo sapiens
acccagtctgttgctgctcca

SEQ ID NO: 2943475 - DNA, 18 bp, Homo sapiens
acccagtgcagaatgtaa

SEQ ID NO: 2943476 - DNA, 18 bp, Homo sapiens
acccagtgcccccactga

SEQ ID NO: 2943477 - DNA, 14 bp, Homo sapiens
acccatacaccccc

SEQ ID NO: 2943478 - DNA, 14 bp, Homo sapiens
acccataggcccac

SEQ ID NO: 2943479 - DNA, 17 bp, Homo sapiens
acccataggcccacaca

SEQ ID NO: 2943480 - DNA, 21 bp, Homo sapiens
acccataggcccacacacagg

SEQ ID NO: 2943481 - DNA, 22 bp, Homo sapiens
acccataggcccacacacaggt

SEQ ID NO: 2943482 - DNA, 23 bp, Homo sapiens
acccatatccttaccctccttgg

SEQ ID NO: 2943483 - DNA, 19 bp, Homo sapiens
acccatcagaaggagaagg

SEQ ID NO: 2943484 - DNA, 17 bp, Homo sapiens
acccatccccgcagtgt

SEQ ID NO: 2943485 - DNA, 13 bp, Homo sapiens
acccatctctccc

SEQ ID NO: 2943486 - DNA, 22 bp, Homo sapiens
acccatcttccacctcacctct

SEQ ID NO: 2943487 - DNA, 17 bp, Homo sapiens
acccattcctatttctt

SEQ ID NO: 2943488 - DNA, 14 bp, Homo sapiens
acccatttacttag

SEQ ID NO: 2943489 - DNA, 14 bp, Homo sapiens
accccaaagagaaa

SEQ ID NO: 2943490 - DNA, 16 bp, Homo sapiens
accccaaagagaaaga

SEQ ID NO: 2943491 - DNA, 19 bp, Homo sapiens
accccaagatttcagatat

SEQ ID NO: 2943492 - DNA, 18 bp, Homo sapiens
accccaatatatgtattt

SEQ ID NO: 2943493 - DNA, 16 bp, Homo sapiens
accccacaatttcttt

SEQ ID NO: 2943494 - DNA, 13 bp, Homo sapiens
accccacacctgc

SEQ ID NO: 2943495 - DNA, 12 bp, Homo sapiens
accccacccagc

SEQ ID NO: 2943496 - DNA, 15 bp, Homo sapiens
accccacccagctcc

SEQ ID NO: 2943497 - DNA, 21 bp, Homo sapiens
accccacccccttcagtgccc

SEQ ID NO: 2943498 - DNA, 20 bp, Homo sapiens
accccacccctcatcaggag

SEQ ID NO: 2943499 - DNA, 16 bp, Homo sapiens
accccaccctgtttgg

SEQ ID NO: 2943500 - DNA, 16 bp, Homo sapiens
accccacgccttatcc

SEQ ID NO: 2943501 - DNA, 14 bp, Homo sapiens
accccagacactgg

SEQ ID NO: 2943502 - DNA, 15 bp, Homo sapiens
accccagagccacac

SEQ ID NO: 2943503 - DNA, 14 bp, Homo sapiens
accccagaggcaga

SEQ ID NO: 2943504 - DNA, 16 bp, Homo sapiens
accccagaggcagagg

SEQ ID NO: 2943505 - DNA, 17 bp, Homo sapiens
accccagaggcagaggt

SEQ ID NO: 2943506 - DNA, 13 bp, Homo sapiens
accccagagtgtg

SEQ ID NO: 2943507 - DNA, 17 bp, Homo sapiens
accccagattcttcagc

SEQ ID NO: 2943508 - DNA, 14 bp, Homo sapiens
accccagcacagct

SEQ ID NO: 2943509 - DNA, 19 bp, Homo sapiens
accccagcacagctcctcc

SEQ ID NO: 2943510 - DNA, 20 bp, Homo sapiens
accccagcacagctcctccc

SEQ ID NO: 2943511 - DNA, 12 bp, Homo sapiens
accccagctccg

SEQ ID NO: 2943512 - DNA, 19 bp, Homo sapiens
accccaggcccactcaggg

SEQ ID NO: 2943513 - DNA, 23 bp, Homo sapiens
accccatgaccttatccttcctc

SEQ ID NO: 2943514 - DNA, 12 bp, Homo sapiens
accccatgctgt

SEQ ID NO: 2943515 - DNA, 17 bp, Homo sapiens
accccatgctgttgatt

SEQ ID NO: 2943516 - DNA, 23 bp, Homo sapiens
accccatgctgttgattgctaaa

SEQ ID NO: 2943517 - DNA, 13 bp, Homo sapiens
acccccacacaca

SEQ ID NO: 2943518 - DNA, 14 bp, Homo sapiens
acccccacacacac

SEQ ID NO: 2943519 - DNA, 21 bp, Homo sapiens
acccccacacacacacacatg

SEQ ID NO: 2943520 - DNA, 19 bp, Homo sapiens
acccccaccactcttgact

SEQ ID NO: 2943521 - DNA, 13 bp, Homo sapiens
acccccactctca

SEQ ID NO: 2943522 - DNA, 22 bp, Homo sapiens
acccccactctcattccccagg

SEQ ID NO: 2943523 - DNA, 17 bp, Homo sapiens
acccccactggactgac

SEQ ID NO: 2943524 - DNA, 13 bp, Homo sapiens
acccccagcccac

SEQ ID NO: 2943525 - DNA, 17 bp, Homo sapiens
acccccagcccacagag

SEQ ID NO: 2943526 - DNA, 18 bp, Homo sapiens
acccccagcccacagagc

SEQ ID NO: 2943527 - DNA, 20 bp, Homo sapiens
acccccagcccacagagcct

SEQ ID NO: 2943528 - DNA, 16 bp, Homo sapiens
acccccaggacccctg

SEQ ID NO: 2943529 - DNA, 17 bp, Homo sapiens
acccccagtgtattttg

SEQ ID NO: 2943530 - DNA, 14 bp, Homo sapiens
accccccgtgggct

SEQ ID NO: 2943531 - DNA, 14 bp, Homo sapiens
acccccctccccaa

SEQ ID NO: 2943532 - DNA, 18 bp, Homo sapiens
agcctctcctccttgggc

SEQ ID NO: 2943533 - DNA, 20 bp, Homo sapiens
agcctctcctccttgggcag

SEQ ID NO: 2943534 - DNA, 21 bp, Homo sapiens
agcctctgacttaagctgcct

SEQ ID NO: 2943535 - DNA, 22 bp, Homo sapiens
agcctctgcagtcgcttgccaa

SEQ ID NO: 2943536 - DNA, 23 bp, Homo sapiens
agcctctgcagtcgcttgccaaa

SEQ ID NO: 2943537 - DNA, 16 bp, Homo sapiens
agcctctgctccccag

SEQ ID NO: 2943538 - DNA, 14 bp, Homo sapiens
agcctctggatcta

SEQ ID NO: 2943539 - DNA, 21 bp, Homo sapiens
agcctctttctgtcccttctg

SEQ ID NO: 2943540 - DNA, 16 bp, Homo sapiens
agcctgaactgaggcc

SEQ ID NO: 2943541 - DNA, 18 bp, Homo sapiens
agcctgaactgaggcctt

SEQ ID NO: 2943542 - DNA, 20 bp, Homo sapiens
agcctgaataaaccaagaca

SEQ ID NO: 2943543 - DNA, 18 bp, Homo sapiens
agcctgaccctcatcttt

SEQ ID NO: 2943544 - DNA, 16 bp, Homo sapiens
agcctgagcaactctt

SEQ ID NO: 2943545 - DNA, 14 bp, Homo sapiens
agcctgaggcagga

SEQ ID NO: 2943546 - DNA, 16 bp, Homo sapiens
agcctgaggcaggaga

SEQ ID NO: 2943547 - DNA, 22 bp, Homo sapiens
agcctgcaccctcttctcctct

SEQ ID NO: 2943548 - DNA, 21 bp, Homo sapiens
agcctgcactttgggttttta

SEQ ID NO: 2943549 - DNA, 22 bp, Homo sapiens
agcctgcactttgggtttttaa

SEQ ID NO: 2943550 - DNA, 14 bp, Homo sapiens
agcctgcagagctg

SEQ ID NO: 2943551 - DNA, 14 bp, Homo sapiens
agcctgcattctta

SEQ ID NO: 2943552 - DNA, 11 bp, Homo sapiens
agcctgccagc

SEQ ID NO: 2943553 - DNA, 18 bp, Homo sapiens
agcctgcgctcggcagga

SEQ ID NO: 2943554 - DNA, 15 bp, Homo sapiens
agcctgctcccccac

SEQ ID NO: 2943555 - DNA, 16 bp, Homo sapiens
agcctggatagccttg

SEQ ID NO: 2943556 - DNA, 22 bp, Homo sapiens
agcctggatagccttgaaaaca

SEQ ID NO: 2943557 - DNA, 17 bp, Homo sapiens
agcctggcatctgtgcg

SEQ ID NO: 2943558 - DNA, 12 bp, Homo sapiens
agcctggccaga

SEQ ID NO: 2943559 - DNA, 14 bp, Homo sapiens
agcctggccagaca

SEQ ID NO: 2943560 - DNA, 21 bp, Homo sapiens
agcctggccagacacaggccc

SEQ ID NO: 2943561 - DNA, 22 bp, Homo sapiens
agcctggccagacacaggccct

SEQ ID NO: 2943562 - DNA, 17 bp, Homo sapiens
agcctggccagcctaca

SEQ ID NO: 2943563 - DNA, 16 bp, Homo sapiens
agcctggccccatggt

SEQ ID NO: 2943564 - DNA, 22 bp, Homo sapiens
agcctggctccaaaccctcgag

SEQ ID NO: 2943565 - DNA, 15 bp, Homo sapiens
agcctggcttgggtt

SEQ ID NO: 2943566 - DNA, 14 bp, Homo sapiens
agcctgggaggcac

SEQ ID NO: 2943567 - DNA, 11 bp, Homo sapiens
agcctgggccc

SEQ ID NO: 2943568 - DNA, 16 bp, Homo sapiens
agcctgggccccagct

SEQ ID NO: 2943569 - DNA, 14 bp, Homo sapiens
agcctgggtcacag

SEQ ID NO: 2943570 - DNA, 14 bp, Homo sapiens
agcctgggtgacaa

SEQ ID NO: 2943571 - DNA, 18 bp, Homo sapiens
agcctgggtgacagagcg

SEQ ID NO: 2943572 - DNA, 21 bp, Homo sapiens
agcctgggtgacagagcgaga

SEQ ID NO: 2943573 - DNA, 20 bp, Homo sapiens
agcctggtaggaaagggcaa

SEQ ID NO: 2943574 - DNA, 21 bp, Homo sapiens
agcctggtaggaaagggcaag

SEQ ID NO: 2943575 - DNA, 22 bp, Homo sapiens
agcctggttttcgtcatcttcc

SEQ ID NO: 2943576 - DNA, 18 bp, Homo sapiens
agcctgtaatcccagcta

SEQ ID NO: 2943577 - DNA, 22 bp, Homo sapiens
agcctgtcagccaacattgcct

SEQ ID NO: 2943578 - DNA, 18 bp, Homo sapiens
agcctgtcccaggactca

SEQ ID NO: 2943579 - DNA, 15 bp, Homo sapiens
agcctgtccccgcct

SEQ ID NO: 2943580 - DNA, 14 bp, Homo sapiens
agcctgtcctcacc

SEQ ID NO: 2943581 - DNA, 15 bp, Homo sapiens
agcctgtcctcaccg

SEQ ID NO: 2943582 - DNA, 21 bp, Homo sapiens
agcctgtctctccttgttgcc

SEQ ID NO: 2943583 - DNA, 20 bp, Homo sapiens
agcctgtctctttccacttt

SEQ ID NO: 2943584 - DNA, 16 bp, Homo sapiens
agcctgtgaccttggg

SEQ ID NO: 2943585 - DNA, 13 bp, Homo sapiens
agcctgtgaggga

SEQ ID NO: 2943586 - DNA, 14 bp, Homo sapiens
agcctgtgagggag

SEQ ID NO: 2943587 - DNA, 16 bp, Homo sapiens
agcctgtgcaaaaaaa

SEQ ID NO: 2943588 - DNA, 21 bp, Homo sapiens
agcctgtgcaaaaaaattaaa

SEQ ID NO: 2943589 - DNA, 18 bp, Homo sapiens
agcctgtggcggtgcctg

SEQ ID NO: 2943590 - DNA, 19 bp, Homo sapiens
agcctgtggcggtgcctgg

SEQ ID NO: 2943591 - DNA, 22 bp, Homo sapiens
agcctgtggcggtgcctgggtg

SEQ ID NO: 2943592 - DNA, 11 bp, Homo sapiens
agcctgtggct

SEQ ID NO: 2943593 - DNA, 15 bp, Homo sapiens
agcctgtggctgtgg

SEQ ID NO: 2943594 - DNA, 16 bp, Homo sapiens
agcctgtggctgtgga

SEQ ID NO: 2943595 - DNA, 23 bp, Homo sapiens
agcctgtggctgtggagacaatg

SEQ ID NO: 2943596 - DNA, 17 bp, Homo sapiens
agcctgtttattgccat

SEQ ID NO: 2943597 - DNA, 14 bp, Homo sapiens
agccttaactaaga

SEQ ID NO: 2943598 - DNA, 19 bp, Homo sapiens
agccttaactaagactccc

SEQ ID NO: 2943599 - DNA, 10 bp, Homo sapiens
agccttacag

SEQ ID NO: 2943600 - DNA, 12 bp, Homo sapiens
agccttagatgc

SEQ ID NO: 2943601 - DNA, 23 bp, Homo sapiens
agccttagtgtcacctttcttct

SEQ ID NO: 2943602 - DNA, 18 bp, Homo sapiens
agccttcaagaatcagaa

SEQ ID NO: 2943603 - DNA, 15 bp, Homo sapiens
agccttctgtaggaa

SEQ ID NO: 2943604 - DNA, 13 bp, Homo sapiens
agccttgaaaaca

SEQ ID NO: 2943605 - DNA, 16 bp, Homo sapiens
agccttgaaaacaaac

SEQ ID NO: 2943606 - DNA, 21 bp, Homo sapiens
agccttgaaaacaaacaaatc

SEQ ID NO: 2943607 - DNA, 18 bp, Homo sapiens
agccttgaactctgggct

SEQ ID NO: 2943608 - DNA, 13 bp, Homo sapiens
agccttgccagag

SEQ ID NO: 2943609 - DNA, 13 bp, Homo sapiens
agccttgctgcca

SEQ ID NO: 2943610 - DNA, 14 bp, Homo sapiens
agccttgctgccaa

SEQ ID NO: 2943611 - DNA, 20 bp, Homo sapiens
agccttggataatgctgttg

SEQ ID NO: 2943612 - DNA, 22 bp, Homo sapiens
agccttggataatgctgttgcc

SEQ ID NO: 2943613 - DNA, 23 bp, Homo sapiens
agccttggataatgctgttgcct

SEQ ID NO: 2943614 - DNA, 22 bp, Homo sapiens
agccttgggggggctgcctttg

SEQ ID NO: 2943615 - DNA, 16 bp, Homo sapiens
agccttggtgtccacc

SEQ ID NO: 2943616 - DNA, 19 bp, Homo sapiens
agccttggtgtccacctgg

SEQ ID NO: 2943617 - DNA, 21 bp, Homo sapiens
agccttggtgtccacctggcc

SEQ ID NO: 2943618 - DNA, 23 bp, Homo sapiens
agccttggttggacctattgcca

SEQ ID NO: 2943619 - DNA, 22 bp, Homo sapiens
agcctttactgaccctggggct

SEQ ID NO: 2943620 - DNA, 15 bp, Homo sapiens
agccttttaactgtg

SEQ ID NO: 2943621 - DNA, 17 bp, Homo sapiens
agcctttttaaaacaca

SEQ ID NO: 2943622 - DNA, 18 bp, Homo sapiens
agcctttttaaaacacat

SEQ ID NO: 2943623 - DNA, 12 bp, Homo sapiens
agcgaaactccg

SEQ ID NO: 2943624 - DNA, 22 bp, Homo sapiens
agcgaacatgcctgattttaaa

SEQ ID NO: 2943625 - DNA, 15 bp, Homo sapiens
agcgaattttaaaag

SEQ ID NO: 2943626 - DNA, 16 bp, Homo sapiens
agcgaattttaaaaga

SEQ ID NO: 2943627 - DNA, 21 bp, Homo sapiens
agcgacatcccagtagtgttt

SEQ ID NO: 2943628 - DNA, 15 bp, Homo sapiens
agcgagactccatct

SEQ ID NO: 2943629 - DNA, 16 bp, Homo sapiens
agcgagccacaggaac

SEQ ID NO: 2943630 - DNA, 12 bp, Homo sapiens
agcgaggaaaaa

SEQ ID NO: 2943631 - DNA, 20 bp, Homo sapiens
agcgaggaaaaacaacaaat

SEQ ID NO: 2943632 - DNA, 18 bp, Homo sapiens
agcgaggaggcgcggcct

SEQ ID NO: 2943633 - DNA, 20 bp, Homo sapiens
agcgaggaggcgcggcctcc

SEQ ID NO: 2943634 - DNA, 21 bp, Homo sapiens
agcgaggaggcgcggcctccc

SEQ ID NO: 2943635 - DNA, 19 bp, Homo sapiens
agcgaggtcaacagagaag

SEQ ID NO: 2943636 - DNA, 14 bp, Homo sapiens
agcgattctcctgc

SEQ ID NO: 2943637 - DNA, 18 bp, Homo sapiens
agcggtccaacgccgcct

SEQ ID NO: 2943638 - DNA, 15 bp, Homo sapiens
agcggtgggaaggaa

SEQ ID NO: 2943639 - DNA, 18 bp, Homo sapiens
agcggtgggaaggaaagg

SEQ ID NO: 2943640 - DNA, 18 bp, Homo sapiens
agcggtgtggaccgagga

SEQ ID NO: 2943641 - DNA, 15 bp, Homo sapiens
agcgtcctcctctgt

SEQ ID NO: 2943642 - DNA, 17 bp, Homo sapiens
agcgtcctcctctgtga

SEQ ID NO: 2943643 - DNA, 13 bp, Homo sapiens
agcgtcctgccct

SEQ ID NO: 2943644 - DNA, 15 bp, Homo sapiens
agcgtcctgccctgc

SEQ ID NO: 2943645 - DNA, 23 bp, Homo sapiens
agcgtgaaggccgagaagcaaga

SEQ ID NO: 2943646 - DNA, 19 bp, Homo sapiens
agcgtttaaagtactgagc

SEQ ID NO: 2943647 - DNA, 20 bp, Homo sapiens
agcgtttaaagtactgagca

SEQ ID NO: 2943648 - DNA, 16 bp, Homo sapiens
agcgtttgctgtgcca

SEQ ID NO: 2943649 - DNA, 14 bp, Homo sapiens
agctaaaaatgaac

SEQ ID NO: 2943650 - DNA, 20 bp, Homo sapiens
agctaaaagcatggccctgc

SEQ ID NO: 2943651 - DNA, 17 bp, Homo sapiens
agctaaacggattccaa

SEQ ID NO: 2943652 - DNA, 21 bp, Homo sapiens
agctaaagtgcaagactgaat

SEQ ID NO: 2943653 - DNA, 19 bp, Homo sapiens
agctaacccaggtcccctc

SEQ ID NO: 2943654 - DNA, 17 bp, Homo sapiens
agctaactccgagagca

SEQ ID NO: 2943655 - DNA, 12 bp, Homo sapiens
agctaagaacct

SEQ ID NO: 2943656 - DNA, 23 bp, Homo sapiens
agctaaggaggggaaaaaaatgt

SEQ ID NO: 2943657 - DNA, 14 bp, Homo sapiens
agctaatttgcatt

SEQ ID NO: 2943658 - DNA, 20 bp, Homo sapiens
agctaatttgcattaaattc

SEQ ID NO: 2943659 - DNA, 22 bp, Homo sapiens
agctacacctttctcctttgta

SEQ ID NO: 2943660 - DNA, 12 bp, Homo sapiens
agctacaggtta

SEQ ID NO: 2943661 - DNA, 13 bp, Homo sapiens
agctacaggttac

SEQ ID NO: 2943662 - DNA, 21 bp, Homo sapiens
agctacaggttacaacagatt

SEQ ID NO: 2943663 - DNA, 17 bp, Homo sapiens
agctacccgcagagttc

SEQ ID NO: 2943664 - DNA, 14 bp, Homo sapiens
agctacctcaacca

SEQ ID NO: 2943665 - DNA, 23 bp, Homo sapiens
agctacctcaaccaatgccaaaa

SEQ ID NO: 2943666 - DNA, 18 bp, Homo sapiens
agctactcccctttcttc

SEQ ID NO: 2943667 - DNA, 22 bp, Homo sapiens
agctactcccctttcttccaaa

SEQ ID NO: 2943668 - DNA, 23 bp, Homo sapiens
agctactcgggaggctgaggcac

SEQ ID NO: 2943669 - DNA, 17 bp, Homo sapiens
agctactgaaccagcca

SEQ ID NO: 2943670 - DNA, 16 bp, Homo sapiens
agctactgtatgcaaa

SEQ ID NO: 2943671 - DNA, 16 bp, Homo sapiens
agctacttagctggcc

SEQ ID NO: 2943672 - DNA, 17 bp, Homo sapiens
agctacttagctggcca

SEQ ID NO: 2943673 - DNA, 20 bp, Homo sapiens
agctacttagctggccaagg

SEQ ID NO: 2943674 - DNA, 21 bp, Homo sapiens
agctacttcttattcactttt

SEQ ID NO: 2943675 - DNA, 16 bp, Homo sapiens
agctagagagaaaaag

SEQ ID NO: 2943676 - DNA, 20 bp, Homo sapiens
agctagcgctgccgcacccc

SEQ ID NO: 2943677 - DNA, 23 bp, Homo sapiens
agctagctatttctatgtatgtg

SEQ ID NO: 2943678 - DNA, 20 bp, Homo sapiens
agctaggatttgaacacttg

SEQ ID NO: 2943679 - DNA, 21 bp, Homo sapiens
agctatcatcaacacaatgat

SEQ ID NO: 2943680 - DNA, 20 bp, Homo sapiens
agctatcattgcttcctcct

SEQ ID NO: 2943681 - DNA, 21 bp, Homo sapiens
agctatgataagattgaaatt

SEQ ID NO: 2943682 - DNA, 20 bp, Homo sapiens
agctatggtgagatgcagct

SEQ ID NO: 2943683 - DNA, 19 bp, Homo sapiens
agctatggtgtcataggct

SEQ ID NO: 2943684 - DNA, 20 bp, Homo sapiens
agctatgttatattgaaaaa

SEQ ID NO: 2943685 - DNA, 22 bp, Homo sapiens
agctatgttatattgaaaaaat

SEQ ID NO: 2943686 - DNA, 17 bp, Homo sapiens
agctatttagtgatata

SEQ ID NO: 2943687 - DNA, 15 bp, Homo sapiens
agctatttatgggcc

SEQ ID NO: 2943688 - DNA, 18 bp, Homo sapiens
agctatttcctttgcgca

SEQ ID NO: 2943689 - DNA, 19 bp, Homo sapiens
agctcaagggacaaggaca

SEQ ID NO: 2943690 - DNA, 17 bp, Homo sapiens
agctcacaccctacctt

SEQ ID NO: 2943691 - DNA, 17 bp, Homo sapiens
agctcacctgttgctta

SEQ ID NO: 2943692 - DNA, 18 bp, Homo sapiens
agctcacctgttgcttac

SEQ ID NO: 2943693 - DNA, 22 bp, Homo sapiens
agctcacctgttgcttacaatt

SEQ ID NO: 2943694 - DNA, 15 bp, Homo sapiens
agctcacgcttcaca

SEQ ID NO: 2943695 - DNA, 15 bp, Homo sapiens
agctcagacccccac

SEQ ID NO: 2943696 - DNA, 18 bp, Homo sapiens
agctcagacccccactct

SEQ ID NO: 2943697 - DNA, 22 bp, Homo sapiens
agctcagaggcgcactgtgacc

SEQ ID NO: 2943698 - DNA, 22 bp, Homo sapiens
agctcagctttttgtcttttct

SEQ ID NO: 2943699 - DNA, 21 bp, Homo sapiens
agctcaggaaccgaggcaggg

SEQ ID NO: 2943700 - DNA, 22 bp, Homo sapiens
agctcaggaaccgaggcaggga

SEQ ID NO: 2943701 - DNA, 18 bp, Homo sapiens
agctcaggacagatgcca

SEQ ID NO: 2943702 - DNA, 20 bp, Homo sapiens
agctcagggcagctgtgctg

SEQ ID NO: 2943703 - DNA, 16 bp, Homo sapiens
agctcagttgggtttc

SEQ ID NO: 2943704 - DNA, 20 bp, Homo sapiens
agctcatagtgaacacagca

SEQ ID NO: 2943705 - DNA, 20 bp, Homo sapiens
agctcatatgctgacagctc

SEQ ID NO: 2943706 - DNA, 12 bp, Homo sapiens
agctcatcttca

SEQ ID NO: 2943707 - DNA, 15 bp, Homo sapiens
agctcatcttcaaag

SEQ ID NO: 2943708 - DNA, 14 bp, Homo sapiens
agctcattcatttt

SEQ ID NO: 2943709 - DNA, 17 bp, Homo sapiens
agctcattcattttata

SEQ ID NO: 2943710 - DNA, 22 bp, Homo sapiens
agctcattcattttatattgaa

SEQ ID NO: 2943711 - DNA, 16 bp, Homo sapiens
agctccaacctgcaaa

SEQ ID NO: 2943712 - DNA, 11 bp, Homo sapiens
agctctttctc

SEQ ID NO: 2943713 - DNA, 20 bp, Homo sapiens
agctgaaagggaaggacagc

SEQ ID NO: 2943714 - DNA, 22 bp, Homo sapiens
agctgaacaataggctgttccc

SEQ ID NO: 2943715 - DNA, 19 bp, Homo sapiens
agctgacgaacttccatgg

SEQ ID NO: 2943716 - DNA, 18 bp, Homo sapiens
agctgagaagaggaggag

SEQ ID NO: 2943717 - DNA, 19 bp, Homo sapiens
agctgagactacaagtgtg

SEQ ID NO: 2943718 - DNA, 20 bp, Homo sapiens
agctgagatcgtgccactgc

SEQ ID NO: 2943719 - DNA, 20 bp, Homo sapiens
agctgagcaaatcaccacaa

SEQ ID NO: 2943720 - DNA, 14 bp, Homo sapiens
agctgagccaggct

SEQ ID NO: 2943721 - DNA, 17 bp, Homo sapiens
agctgagcctgcaggga

SEQ ID NO: 2943722 - DNA, 21 bp, Homo sapiens
agctgagcctgcagggaagcc

SEQ ID NO: 2943723 - DNA, 13 bp, Homo sapiens
agctgagctggct

SEQ ID NO: 2943724 - DNA, 17 bp, Homo sapiens
agctgaggccacactca

SEQ ID NO: 2943725 - DNA, 12 bp, Homo sapiens
agctgaggcctc

SEQ ID NO: 2943726 - DNA, 14 bp, Homo sapiens
agctgaggcctccc

SEQ ID NO: 2943727 - DNA, 12 bp, Homo sapiens
agctgagggagg

SEQ ID NO: 2943728 - DNA, 13 bp, Homo sapiens
agctgagggaggg

SEQ ID NO: 2943729 - DNA, 16 bp, Homo sapiens
agctgagggagggagc

SEQ ID NO: 2943730 - DNA, 20 bp, Homo sapiens
agctgagggagggagccatg

SEQ ID NO: 2943731 - DNA, 14 bp, Homo sapiens
agctgaggggacgg

SEQ ID NO: 2943732 - DNA, 20 bp, Homo sapiens
agctgagtctccctaaggca

SEQ ID NO: 2943733 - DNA, 16 bp, Homo sapiens
agctgagttgttgtgg

SEQ ID NO: 2943734 - DNA, 22 bp, Homo sapiens
agctgatgaacttattctgtag

SEQ ID NO: 2943735 - DNA, 15 bp, Homo sapiens
agctgcaaagtgttt

SEQ ID NO: 2943736 - DNA, 20 bp, Homo sapiens
agctgcaaagtgttttgtac

SEQ ID NO: 2943737 - DNA, 15 bp, Homo sapiens
agctgcaagtgacat

SEQ ID NO: 2943738 - DNA, 11 bp, Homo sapiens
agctgcactga

SEQ ID NO: 2943739 - DNA, 20 bp, Homo sapiens
agctgcactgatgctgcccc

SEQ ID NO: 2943740 - DNA, 17 bp, Homo sapiens
agctgcatctgttactt

SEQ ID NO: 2943741 - DNA, 22 bp, Homo sapiens
agctgcatttcacatgccttgc

SEQ ID NO: 2943742 - DNA, 10 bp, Homo sapiens
agctgccact

SEQ ID NO: 2943743 - DNA, 14 bp, Homo sapiens
agctgccactgggc

SEQ ID NO: 2943744 - DNA, 24 bp, Homo sapiens
agctgccactgggcacctgcgcac

SEQ ID NO: 2943745 - DNA, 23 bp, Homo sapiens
agctgccagtgtgttactcatct

SEQ ID NO: 2943746 - DNA, 19 bp, Homo sapiens
agctgccatcgctgtgatg

SEQ ID NO: 2943747 - DNA, 20 bp, Homo sapiens
agctgccatcttgcttttct

SEQ ID NO: 2943748 - DNA, 20 bp, Homo sapiens
agctgccccggggaggggcg

SEQ ID NO: 2943749 - DNA, 12 bp, Homo sapiens
agctgcccctcc

SEQ ID NO: 2943750 - DNA, 16 bp, Homo sapiens
agctgcccctcctgga

SEQ ID NO: 2943751 - DNA, 14 bp, Homo sapiens
agctgcccctctct

SEQ ID NO: 2943752 - DNA, 14 bp, Homo sapiens
agctgcccctggct

SEQ ID NO: 2943753 - DNA, 15 bp, Homo sapiens
agctgcccggcgcct

SEQ ID NO: 2943754 - DNA, 20 bp, Homo sapiens
agctgcccggcgcctgccct

SEQ ID NO: 2943755 - DNA, 21 bp, Homo sapiens
agctgcccggcgcctgccctg

SEQ ID NO: 2943756 - DNA, 16 bp, Homo sapiens
agctgcctccccaatc

SEQ ID NO: 2943757 - DNA, 12 bp, Homo sapiens
agctgcctgcag

SEQ ID NO: 2943758 - DNA, 14 bp, Homo sapiens
agctgcctgcagca

SEQ ID NO: 2943759 - DNA, 12 bp, Homo sapiens
agctgcctggcc

SEQ ID NO: 2943760 - DNA, 16 bp, Homo sapiens
agctgcctggccatgc

SEQ ID NO: 2943761 - DNA, 18 bp, Homo sapiens
agctgcctggccatgctg

SEQ ID NO: 2943762 - DNA, 22 bp, Homo sapiens
agctgccttagcttcaggaacc

SEQ ID NO: 2943763 - DNA, 14 bp, Homo sapiens
agctgcgggctgag

SEQ ID NO: 2943764 - DNA, 17 bp, Homo sapiens
agctgcgggctgagggc

SEQ ID NO: 2943765 - DNA, 18 bp, Homo sapiens
agctgcgggctgagggca

SEQ ID NO: 2943766 - DNA, 14 bp, Homo sapiens
agctgctacaaaga

SEQ ID NO: 2943767 - DNA, 17 bp, Homo sapiens
agctgctacaaagaaga

SEQ ID NO: 2943768 - DNA, 15 bp, Homo sapiens
agctgctatagcctg

SEQ ID NO: 2943769 - DNA, 20 bp, Homo sapiens
agctgctccccagcagcgga

SEQ ID NO: 2943770 - DNA, 17 bp, Homo sapiens
agctgctcctagaggga

SEQ ID NO: 2943771 - DNA, 15 bp, Homo sapiens
agctgctgagtgaca

SEQ ID NO: 2943772 - DNA, 13 bp, Homo sapiens
agctgctgccact

SEQ ID NO: 2943773 - DNA, 21 bp, Homo sapiens
agctgctgccactctgctgcc

SEQ ID NO: 2943774 - DNA, 13 bp, Homo sapiens
agctgctggagcc

SEQ ID NO: 2943775 - DNA, 15 bp, Homo sapiens
agctgctgttgaact

SEQ ID NO: 2943776 - DNA, 20 bp, Homo sapiens
agctgctgttgaacttttta

SEQ ID NO: 2943777 - DNA, 22 bp, Homo sapiens
agctggagatctgaacccagct

SEQ ID NO: 2943778 - DNA, 14 bp, Homo sapiens
agctggagtgctgc

SEQ ID NO: 2943779 - DNA, 20 bp, Homo sapiens
agctggagtgctgcttgtgc

SEQ ID NO: 2943780 - DNA, 19 bp, Homo sapiens
agctggccagatttcctca

SEQ ID NO: 2943781 - DNA, 12 bp, Homo sapiens
agctggcccagg

SEQ ID NO: 2943782 - DNA, 13 bp, Homo sapiens
agctggcccaggg

SEQ ID NO: 2943783 - DNA, 23 bp, Homo sapiens
agctggctggggtggcctgtgtg

SEQ ID NO: 2943784 - DNA, 21 bp, Homo sapiens
agctggctgtacctgttcctc

SEQ ID NO: 2943785 - DNA, 11 bp, Homo sapiens
agctggctttc

SEQ ID NO: 2943786 - DNA, 20 bp, Homo sapiens
agctgggaaattcatgtgga

SEQ ID NO: 2943787 - DNA, 17 bp, Homo sapiens
agctgggactacaggtg

SEQ ID NO: 2943788 - DNA, 13 bp, Homo sapiens
agctgggaggaaa

SEQ ID NO: 2943789 - DNA, 15 bp, Homo sapiens
agctgggaggaaaag

SEQ ID NO: 2943790 - DNA, 18 bp, Homo sapiens
agctgggaggaaaagaaa

SEQ ID NO: 2943791 - DNA, 13 bp, Homo sapiens
agctgggaggtct

SEQ ID NO: 2943792 - DNA, 19 bp, Homo sapiens
agctgggatcccacagccc

SEQ ID NO: 2943793 - DNA, 17 bp, Homo sapiens
agctgggcagtgccagc

SEQ ID NO: 2943794 - DNA, 15 bp, Homo sapiens
agctgggcccacagc

SEQ ID NO: 2943795 - DNA, 19 bp, Homo sapiens
agctgggcccacagccccc

SEQ ID NO: 2943796 - DNA, 16 bp, Homo sapiens
agctgggcccgacatg

SEQ ID NO: 2943797 - DNA, 21 bp, Homo sapiens
agctgggcccgacatggctcc

SEQ ID NO: 2943798 - DNA, 11 bp, Homo sapiens
agctggggagg

SEQ ID NO: 2943799 - DNA, 22 bp, Homo sapiens
agctggggatccctccccccca

SEQ ID NO: 2943800 - DNA, 17 bp, Homo sapiens
agctgggggtgggccag

SEQ ID NO: 2943801 - DNA, 20 bp, Homo sapiens
agctgggggtgggccaggct

SEQ ID NO: 2943802 - DNA, 14 bp, Homo sapiens
agctgggtcaggca

SEQ ID NO: 2943803 - DNA, 16 bp, Homo sapiens
agctgggtcaggcagg

SEQ ID NO: 2943804 - DNA, 18 bp, Homo sapiens
agctggtgacagccttgg

SEQ ID NO: 2943805 - DNA, 21 bp, Homo sapiens
agctggtgcccccagacagct

SEQ ID NO: 2943806 - DNA, 14 bp, Homo sapiens
agctggtgcctgct

SEQ ID NO: 2943807 - DNA, 17 bp, Homo sapiens
agctggtggaacatatg

SEQ ID NO: 2943808 - DNA, 15 bp, Homo sapiens
agctggtgggaagcg

SEQ ID NO: 2943809 - DNA, 10 bp, Homo sapiens
agctggtttc

SEQ ID NO: 2943810 - DNA, 13 bp, Homo sapiens
agctggtttcctg

SEQ ID NO: 2943811 - DNA, 22 bp, Homo sapiens
agctggtttcctgcccagcctg

SEQ ID NO: 2943812 - DNA, 17 bp, Homo sapiens
agctgtaagaaaatgct

SEQ ID NO: 2943813 - DNA, 15 bp, Homo sapiens
agctgtacttttacc

SEQ ID NO: 2943814 - DNA, 14 bp, Homo sapiens
agctgtatataaac

SEQ ID NO: 2943815 - DNA, 15 bp, Homo sapiens
agctgtatgatttgt

SEQ ID NO: 2943816 - DNA, 18 bp, Homo sapiens
agctgtcaccaaggaaac

SEQ ID NO: 2943817 - DNA, 18 bp, Homo sapiens
agctgtcagatgtcacat

SEQ ID NO: 2943818 - DNA, 13 bp, Homo sapiens
agctgtcagcctg

SEQ ID NO: 2943819 - DNA, 14 bp, Homo sapiens
agctgtcagcctgg

SEQ ID NO: 2943820 - DNA, 17 bp, Homo sapiens
agctgtcatcaacattc

SEQ ID NO: 2943821 - DNA, 13 bp, Homo sapiens
agctgtcccaagt

SEQ ID NO: 2943822 - DNA, 19 bp, Homo sapiens
agctgtcgggggccactgt

SEQ ID NO: 2943823 - DNA, 19 bp, Homo sapiens
agctgtctgtcatctgctg

SEQ ID NO: 2943824 - DNA, 18 bp, Homo sapiens
agctgtgagacagtggga

SEQ ID NO: 2943825 - DNA, 19 bp, Homo sapiens
agctgtgagacagtgggaa

SEQ ID NO: 2943826 - DNA, 22 bp, Homo sapiens
agctgtgcaattactgcctgca

SEQ ID NO: 2943827 - DNA, 19 bp, Homo sapiens
agctgtgcttatggtacca

SEQ ID NO: 2943828 - DNA, 16 bp, Homo sapiens
agctgtggtcccaccc

SEQ ID NO: 2943829 - DNA, 21 bp, Homo sapiens
agctgtggtcccacccaggaa

SEQ ID NO: 2943830 - DNA, 18 bp, Homo sapiens
agctgtgtccttgcacct

SEQ ID NO: 2943831 - DNA, 20 bp, Homo sapiens
agctgtgtccttgcacctgc

SEQ ID NO: 2943832 - DNA, 13 bp, Homo sapiens
agctgtgtctctg

SEQ ID NO: 2943833 - DNA, 14 bp, Homo sapiens
agctgtgtctctgt

SEQ ID NO: 2943834 - DNA, 20 bp, Homo sapiens
agctgtgtgctctccaagcc

SEQ ID NO: 2943835 - DNA, 16 bp, Homo sapiens
agctgtgttaccgtta

SEQ ID NO: 2943836 - DNA, 13 bp, Homo sapiens
agctgtgttactt

SEQ ID NO: 2943837 - DNA, 21 bp, Homo sapiens
agctgtgttacttgaagtaac

SEQ ID NO: 2943838 - DNA, 18 bp, Homo sapiens
agctgtgttgaaacagaa

SEQ ID NO: 2943839 - DNA, 19 bp, Homo sapiens
agctgtgttgaaacagaaa

SEQ ID NO: 2943840 - DNA, 16 bp, Homo sapiens
agctgttaaagatatt

SEQ ID NO: 2943841 - DNA, 12 bp, Homo sapiens
agctgttattct

SEQ ID NO: 2943842 - DNA, 13 bp, Homo sapiens
agctgttattctt

SEQ ID NO: 2943843 - DNA, 17 bp, Homo sapiens
agctgttattcttgtta

SEQ ID NO: 2943844 - DNA, 13 bp, Homo sapiens
agctgttgcaggc

SEQ ID NO: 2943845 - DNA, 16 bp, Homo sapiens
agctgttgcaggcagt

SEQ ID NO: 2943846 - DNA, 20 bp, Homo sapiens
agctgttgcaggcagtgtct

SEQ ID NO: 2943847 - DNA, 22 bp, Homo sapiens
agctgtttactagggatccctc

SEQ ID NO: 2943848 - DNA, 21 bp, Homo sapiens
agcttaagggaatatgcattg

SEQ ID NO: 2943849 - DNA, 20 bp, Homo sapiens
agcttaccagaagcttccat

SEQ ID NO: 2943850 - DNA, 10 bp, Homo sapiens
agcttagaac

SEQ ID NO: 2943851 - DNA, 22 bp, Homo sapiens
agcttagattttctgtaaatga

SEQ ID NO: 2943852 - DNA, 20 bp, Homo sapiens
agcttataagagggcatata

SEQ ID NO: 2943853 - DNA, 17 bp, Homo sapiens
agcttatctccctgctt

SEQ ID NO: 2943854 - DNA, 19 bp, Homo sapiens
agcttatctcttttatatt

SEQ ID NO: 2943855 - DNA, 22 bp, Homo sapiens
agcttatctcttttatatttgt

SEQ ID NO: 2943856 - DNA, 13 bp, Homo sapiens
agcttatgtttct

SEQ ID NO: 2943857 - DNA, 21 bp, Homo sapiens
agcttattgtgtgcgctgcct

SEQ ID NO: 2943858 - DNA, 21 bp, Homo sapiens
agcttatttagcacattttga

SEQ ID NO: 2943859 - DNA, 16 bp, Homo sapiens
agcttatttttctgtg

SEQ ID NO: 2943860 - DNA, 17 bp, Homo sapiens
agcttatttttctgtga

SEQ ID NO: 2943861 - DNA, 20 bp, Homo sapiens
agcttatttttttctacata

SEQ ID NO: 2943862 - DNA, 17 bp, Homo sapiens
agcttcaatatttttct

SEQ ID NO: 2943863 - DNA, 19 bp, Homo sapiens
agcttcaatatttttctaa

SEQ ID NO: 2943864 - DNA, 13 bp, Homo sapiens
agcttcaggaacc

SEQ ID NO: 2943865 - DNA, 23 bp, Homo sapiens
agcttcaggaacctcgagtactg

SEQ ID NO: 2943866 - DNA, 17 bp, Homo sapiens
agcttcatataccagca

SEQ ID NO: 2943867 - DNA, 13 bp, Homo sapiens
agcttccagagct

SEQ ID NO: 2943868 - DNA, 22 bp, Homo sapiens
agcttccccaacacgcaggagc

SEQ ID NO: 2943869 - DNA, 16 bp, Homo sapiens
agcttcggtgtgcaga

SEQ ID NO: 2943870 - DNA, 17 bp, Homo sapiens
agcttcggtgtgcagat

SEQ ID NO: 2943871 - DNA, 17 bp, Homo sapiens
agcttctaccatgaaca

SEQ ID NO: 2943872 - DNA, 21 bp, Homo sapiens
agcttctcctgtgtgattgac

SEQ ID NO: 2943873 - DNA, 18 bp, Homo sapiens
agcttctgtattttcaaa

SEQ ID NO: 2943874 - DNA, 12 bp, Homo sapiens
agcttcttccag

SEQ ID NO: 2943875 - DNA, 22 bp, Homo sapiens
agcttcttccaggtgcccagct

SEQ ID NO: 2943876 - DNA, 16 bp, Homo sapiens
agcttgagagttttct

SEQ ID NO: 2943877 - DNA, 16 bp, Homo sapiens
agcttgagttctgcac

SEQ ID NO: 2943878 - DNA, 14 bp, Homo sapiens
agcttgcagctgga

SEQ ID NO: 2943879 - DNA, 20 bp, Homo sapiens
agcttgcagtgaagtgttct

SEQ ID NO: 2943880 - DNA, 15 bp, Homo sapiens
agcttgccagatgct

SEQ ID NO: 2943881 - DNA, 15 bp, Homo sapiens
agcttgccagggatg

SEQ ID NO: 2943882 - DNA, 22 bp, Homo sapiens
agcttgctcttcagtgggagaa

SEQ ID NO: 2943883 - DNA, 12 bp, Homo sapiens
agcttgcttctt

SEQ ID NO: 2943884 - DNA, 20 bp, Homo sapiens
agcttgggaaaggtggtgtt

SEQ ID NO: 2943885 - DNA, 17 bp, Homo sapiens
agcttggggcaacattg

SEQ ID NO: 2943886 - DNA, 14 bp, Homo sapiens
agcttggggccagg

SEQ ID NO: 2943887 - DNA, 16 bp, Homo sapiens
agcttggggccaggga

SEQ ID NO: 2943888 - DNA, 12 bp, Homo sapiens
agcttgtgtatc

SEQ ID NO: 2943889 - DNA, 22 bp, Homo sapiens
agcttgtttctgtcaagcatat

SEQ ID NO: 2943890 - DNA, 17 bp, Homo sapiens
agcttgttttattttgt

SEQ ID NO: 2943891 - DNA, 15 bp, Homo sapiens
agctttaaaagaaaa

SEQ ID NO: 2943892 - DNA, 21 bp, Homo sapiens
agctttactggggctggggaa

SEQ ID NO: 2943893 - DNA, 18 bp, Homo sapiens
agctttagtgaattaaat

SEQ ID NO: 2943894 - DNA, 21 bp, Homo sapiens
agctttagtgaattaaattta

SEQ ID NO: 2943895 - DNA, 14 bp, Homo sapiens
agctttatttcaaa

SEQ ID NO: 2943896 - DNA, 18 bp, Homo sapiens
agctttatttttctttaa

SEQ ID NO: 2943897 - DNA, 15 bp, Homo sapiens
agctttcaaagcatt

SEQ ID NO: 2943898 - DNA, 16 bp, Homo sapiens
agctttcaaagcattt

SEQ ID NO: 2943899 - DNA, 15 bp, Homo sapiens
agctttcaattccgt

SEQ ID NO: 2943900 - DNA, 22 bp, Homo sapiens
agctttcatcacacccttttaa

SEQ ID NO: 2943901 - DNA, 22 bp, Homo sapiens
agctttcatgtaaactgtgcac

SEQ ID NO: 2943902 - DNA, 21 bp, Homo sapiens
agctttcccctctgaataaat

SEQ ID NO: 2943903 - DNA, 13 bp, Homo sapiens
agctttcctgaca

SEQ ID NO: 2943904 - DNA, 20 bp, Homo sapiens
agctttcctttacagctgtt

SEQ ID NO: 2943905 - DNA, 20 bp, Homo sapiens
agctttctgaccttcagctc

SEQ ID NO: 2943906 - DNA, 13 bp, Homo sapiens
aggatcttttgaa

SEQ ID NO: 2943907 - DNA, 22 bp, Homo sapiens
aggatgacctcagggctatgtg

SEQ ID NO: 2943908 - DNA, 19 bp, Homo sapiens
aggatgagctctacccagg

SEQ ID NO: 2943909 - DNA, 23 bp, Homo sapiens
aggatgaggacagagggcacatg

SEQ ID NO: 2943910 - DNA, 22 bp, Homo sapiens
aggatgagggttcatcatccct

SEQ ID NO: 2943911 - DNA, 18 bp, Homo sapiens
aggatgcacggtttctgt

SEQ ID NO: 2943912 - DNA, 17 bp, Homo sapiens
aggatgcattctgatag

SEQ ID NO: 2943913 - DNA, 22 bp, Homo sapiens
aggatgcattctgataggaggg

SEQ ID NO: 2943914 - DNA, 14 bp, Homo sapiens
aggatgctcagttg

SEQ ID NO: 2943915 - DNA, 19 bp, Homo sapiens
aggatgctctttcccagga

SEQ ID NO: 2943916 - DNA, 21 bp, Homo sapiens
aggatgctgctgttgaagctt

SEQ ID NO: 2943917 - DNA, 18 bp, Homo sapiens
aggatgtaaacagtgcct

SEQ ID NO: 2943918 - DNA, 17 bp, Homo sapiens
aggatgtgtttgctttc

SEQ ID NO: 2943919 - DNA, 16 bp, Homo sapiens
aggattacagaaactg

SEQ ID NO: 2943920 - DNA, 17 bp, Homo sapiens
aggattacagaaactga

SEQ ID NO: 2943921 - DNA, 17 bp, Homo sapiens
aggattccccctgccct

SEQ ID NO: 2943922 - DNA, 13 bp, Homo sapiens
aggatttagaagt

SEQ ID NO: 2943923 - DNA, 14 bp, Homo sapiens
aggatttatacata

SEQ ID NO: 2943924 - DNA, 19 bp, Homo sapiens
aggatttatacatacagag

SEQ ID NO: 2943925 - DNA, 21 bp, Homo sapiens
aggatttatacatacagagat

SEQ ID NO: 2943926 - DNA, 16 bp, Homo sapiens
aggatttcagccatgc

SEQ ID NO: 2943927 - DNA, 15 bp, Homo sapiens
aggatttcttaaatt

SEQ ID NO: 2943928 - DNA, 21 bp, Homo sapiens
aggatttgatgcttttctctc

SEQ ID NO: 2943929 - DNA, 18 bp, Homo sapiens
aggatttttagagcatta

SEQ ID NO: 2943930 - DNA, 21 bp, Homo sapiens
aggattttttttaatgtttaa

SEQ ID NO: 2943931 - DNA, 21 bp, Homo sapiens
aggattttttttttttcttca

SEQ ID NO: 2943932 - DNA, 13 bp, Homo sapiens
aggcaaaaataat

SEQ ID NO: 2943933 - DNA, 19 bp, Homo sapiens
aggcaaaaatctacagtgt

SEQ ID NO: 2943934 - DNA, 16 bp, Homo sapiens
aggcaaaagtgtaaca

SEQ ID NO: 2943935 - DNA, 12 bp, Homo sapiens
aggcaaaggcag

SEQ ID NO: 2943936 - DNA, 13 bp, Homo sapiens
aggcaaatgtgta

SEQ ID NO: 2943937 - DNA, 19 bp, Homo sapiens
aggcaaatgtttaaacatt

SEQ ID NO: 2943938 - DNA, 15 bp, Homo sapiens
aggcaacttgaagaa

SEQ ID NO: 2943939 - DNA, 20 bp, Homo sapiens
aggcaagattggaaagacag

SEQ ID NO: 2943940 - DNA, 15 bp, Homo sapiens
aggcaagtcacactg

SEQ ID NO: 2943941 - DNA, 20 bp, Homo sapiens
aggcaataatattttctgtg

SEQ ID NO: 2943942 - DNA, 14 bp, Homo sapiens
aggcaatgaagaat

SEQ ID NO: 2943943 - DNA, 14 bp, Homo sapiens
aggcaattctcctg

SEQ ID NO: 2943944 - DNA, 14 bp, Homo sapiens
aggcaattgattgt

SEQ ID NO: 2943945 - DNA, 15 bp, Homo sapiens
aggcacacagctact

SEQ ID NO: 2943946 - DNA, 16 bp, Homo sapiens
aggcacagcaaactgt

SEQ ID NO: 2943947 - DNA, 16 bp, Homo sapiens
aggcacattaactgtt

SEQ ID NO: 2943948 - DNA, 22 bp, Homo sapiens
aggcaccaacaactcagaatgg

SEQ ID NO: 2943949 - DNA, 15 bp, Homo sapiens
aggcaccagtccctg

SEQ ID NO: 2943950 - DNA, 16 bp, Homo sapiens
aggcaccagtccctgt

SEQ ID NO: 2943951 - DNA, 19 bp, Homo sapiens
aggcacccctttccccagc

SEQ ID NO: 2943952 - DNA, 21 bp, Homo sapiens
aggcacccctttccccagcct

SEQ ID NO: 2943953 - DNA, 22 bp, Homo sapiens
aggcacccctttccccagcctc

SEQ ID NO: 2943954 - DNA, 23 bp, Homo sapiens
aggcacccctttccccagcctct

SEQ ID NO: 2943955 - DNA, 20 bp, Homo sapiens
aggcaccgcagcctgtcagc

SEQ ID NO: 2943956 - DNA, 21 bp, Homo sapiens
aggcacctataaaacaggtca

SEQ ID NO: 2943957 - DNA, 20 bp, Homo sapiens
aggcacgaacccacctgctg

SEQ ID NO: 2943958 - DNA, 15 bp, Homo sapiens
aggcactctcctgtc

SEQ ID NO: 2943959 - DNA, 16 bp, Homo sapiens
aggcactctgttattt

SEQ ID NO: 2943960 - DNA, 19 bp, Homo sapiens
aggcactctgttatttaga

SEQ ID NO: 2943961 - DNA, 11 bp, Homo sapiens
aggcactgaag

SEQ ID NO: 2943962 - DNA, 15 bp, Homo sapiens
aggcactgaagcccg

SEQ ID NO: 2943963 - DNA, 15 bp, Homo sapiens
aggcacttcctcccc

SEQ ID NO: 2943964 - DNA, 22 bp, Homo sapiens
aggcacttcctcccctcgccca

SEQ ID NO: 2943965 - DNA, 16 bp, Homo sapiens
aggcagaaaattgcac

SEQ ID NO: 2943966 - DNA, 20 bp, Homo sapiens
aggcagaagaatctttcttc

SEQ ID NO: 2943967 - DNA, 15 bp, Homo sapiens
aggcagaagaattga

SEQ ID NO: 2943968 - DNA, 23 bp, Homo sapiens
aggcagaagaattgaacccagga

SEQ ID NO: 2943969 - DNA, 20 bp, Homo sapiens
aggcagactctttatgcttg

SEQ ID NO: 2943970 - DNA, 11 bp, Homo sapiens
aggcagagctg

SEQ ID NO: 2943971 - DNA, 22 bp, Homo sapiens
aggcagagctgagggccctgtg

SEQ ID NO: 2943972 - DNA, 12 bp, Homo sapiens
aggcagaggaat

SEQ ID NO: 2943973 - DNA, 18 bp, Homo sapiens
aggcagagggcctttgct

SEQ ID NO: 2943974 - DNA, 17 bp, Homo sapiens
aggcagataactgctgt

SEQ ID NO: 2943975 - DNA, 17 bp, Homo sapiens
aggcagatccaggacta

SEQ ID NO: 2943976 - DNA, 18 bp, Homo sapiens
aggcagatgtggggctga

SEQ ID NO: 2943977 - DNA, 23 bp, Homo sapiens
aggcagatgtggggctgagctgg

SEQ ID NO: 2943978 - DNA, 20 bp, Homo sapiens
aggcagcagtgtgaggccag

SEQ ID NO: 2943979 - DNA, 13 bp, Homo sapiens
aggcaggaagccc

SEQ ID NO: 2943980 - DNA, 15 bp, Homo sapiens
aggcaggcatggccc

SEQ ID NO: 2943981 - DNA, 19 bp, Homo sapiens
aggcaggcatggccctggg

SEQ ID NO: 2943982 - DNA, 16 bp, Homo sapiens
aggcaggcctgaggca

SEQ ID NO: 2943983 - DNA, 13 bp, Homo sapiens
aggcaggcctttc

SEQ ID NO: 2943984 - DNA, 23 bp, Homo sapiens
aggcagggaagtccccaggcccc

SEQ ID NO: 2943985 - DNA, 20 bp, Homo sapiens
aggcagggccttgcccagag

SEQ ID NO: 2943986 - DNA, 23 bp, Homo sapiens
aggcagggccttgcccagagatg

SEQ ID NO: 2943987 - DNA, 17 bp, Homo sapiens
aggcaggggtgagagca

SEQ ID NO: 2943988 - DNA, 23 bp, Homo sapiens
aggcaggggtgagagcacccact

SEQ ID NO: 2943989 - DNA, 20 bp, Homo sapiens
aggcagtcccgggagaaaag

SEQ ID NO: 2943990 - DNA, 22 bp, Homo sapiens
aggcagtcccgggagaaaagac

SEQ ID NO: 2943991 - DNA, 14 bp, Homo sapiens
aggcagtgtcattt

SEQ ID NO: 2943992 - DNA, 15 bp, Homo sapiens
aggcagtgtcatttg

SEQ ID NO: 2943993 - DNA, 19 bp, Homo sapiens
aggcagtgtcatttgctct

SEQ ID NO: 2943994 - DNA, 21 bp, Homo sapiens
aggcagtgtcatttgctctgc

SEQ ID NO: 2943995 - DNA, 13 bp, Homo sapiens
aggcagtgtctta

SEQ ID NO: 2943996 - DNA, 23 bp, Homo sapiens
aggcagtgtcttaaggagactgg

SEQ ID NO: 2943997 - DNA, 19 bp, Homo sapiens
aggcagtttagtgcatctt

SEQ ID NO: 2943998 - DNA, 18 bp, Homo sapiens
aggcataaacctgtgctg

SEQ ID NO: 2943999 - DNA, 18 bp, Homo sapiens
aggcatatcatgctttga

SEQ ID NO: 2944000 - DNA, 16 bp, Homo sapiens
aggcatcatgcagagt

SEQ ID NO: 2944001 - DNA, 21 bp, Homo sapiens
aggcatcatggaaagactggg

SEQ ID NO: 2944002 - DNA, 13 bp, Homo sapiens
aggcatgagccac

SEQ ID NO: 2944003 - DNA, 20 bp, Homo sapiens
aggcatgagttactgtgcat

SEQ ID NO: 2944004 - DNA, 21 bp, Homo sapiens
aggcatggggggtggggggag

SEQ ID NO: 2944005 - DNA, 14 bp, Homo sapiens
aggcattccacagg

SEQ ID NO: 2944006 - DNA, 16 bp, Homo sapiens
aggcattccacaggat

SEQ ID NO: 2944007 - DNA, 13 bp, Homo sapiens
aggcattctctga

SEQ ID NO: 2944008 - DNA, 13 bp, Homo sapiens
aggcattgccaag

SEQ ID NO: 2944009 - DNA, 18 bp, Homo sapiens
aggcattgccaagggctt

SEQ ID NO: 2944010 - DNA, 17 bp, Homo sapiens
aggcatttaaaatggaa

SEQ ID NO: 2944011 - DNA, 23 bp, Homo sapiens
aggccaacactgtgggtgtgtga

SEQ ID NO: 2944012 - DNA, 14 bp, Homo sapiens
aggccaagaaacgt

SEQ ID NO: 2944013 - DNA, 21 bp, Homo sapiens
aggccaagaaacgtcttctaa

SEQ ID NO: 2944014 - DNA, 12 bp, Homo sapiens
aggccaaggtgc

SEQ ID NO: 2944015 - DNA, 15 bp, Homo sapiens
aggccaatagtttta

SEQ ID NO: 2944016 - DNA, 17 bp, Homo sapiens
aggccacactcagcaca

SEQ ID NO: 2944017 - DNA, 19 bp, Homo sapiens
aggccacgtatagtcctag

SEQ ID NO: 2944018 - DNA, 15 bp, Homo sapiens
aggccagacatggtg

SEQ ID NO: 2944019 - DNA, 13 bp, Homo sapiens
aggccagctgcct

SEQ ID NO: 2944020 - DNA, 14 bp, Homo sapiens
aggccagctggcag

SEQ ID NO: 2944021 - DNA, 18 bp, Homo sapiens
aggccagctggcagcaga

SEQ ID NO: 2944022 - DNA, 19 bp, Homo sapiens
aggccagctggcagcagag

SEQ ID NO: 2944023 - DNA, 23 bp, Homo sapiens
aggccaggtgggaacggctgatg

SEQ ID NO: 2944024 - DNA, 13 bp, Homo sapiens
aggccaggtgggc

SEQ ID NO: 2944025 - DNA, 17 bp, Homo sapiens
aggccaggtgggcggac

SEQ ID NO: 2944026 - DNA, 22 bp, Homo sapiens
aggccatctgggctcctccagg

SEQ ID NO: 2944027 - DNA, 15 bp, Homo sapiens
aggccatgtggcctg

SEQ ID NO: 2944028 - DNA, 20 bp, Homo sapiens
aggccatgtggcctgcccag

SEQ ID NO: 2944029 - DNA, 15 bp, Homo sapiens
aggccattctttccc

SEQ ID NO: 2944030 - DNA, 18 bp, Homo sapiens
aggccattctttcccaac

SEQ ID NO: 2944031 - DNA, 12 bp, Homo sapiens
aggcccaaagcc

SEQ ID NO: 2944032 - DNA, 15 bp, Homo sapiens
aggcccaaggctccc

SEQ ID NO: 2944033 - DNA, 11 bp, Homo sapiens
aggcccaagtc

SEQ ID NO: 2944034 - DNA, 15 bp, Homo sapiens
aggcccactcagggg

SEQ ID NO: 2944035 - DNA, 16 bp, Homo sapiens
aggcccagccgcagga

SEQ ID NO: 2944036 - DNA, 13 bp, Homo sapiens
aggcccaggctgg

SEQ ID NO: 2944037 - DNA, 14 bp, Homo sapiens
aggctgcactggag

SEQ ID NO: 2944038 - DNA, 17 bp, Homo sapiens
aggctgcactggagcca

SEQ ID NO: 2944039 - DNA, 18 bp, Homo sapiens
aggctgcactggagccac

SEQ ID NO: 2944040 - DNA, 20 bp, Homo sapiens
aggctgcactggagccacag

SEQ ID NO: 2944041 - DNA, 12 bp, Homo sapiens
aggctgcagcca

SEQ ID NO: 2944042 - DNA, 16 bp, Homo sapiens
aggctgcagccaggcc

SEQ ID NO: 2944043 - DNA, 16 bp, Homo sapiens
aggctgcaggagggca

SEQ ID NO: 2944044 - DNA, 14 bp, Homo sapiens
aggctgcagtcagc

SEQ ID NO: 2944045 - DNA, 14 bp, Homo sapiens
aggctgccagagaa

SEQ ID NO: 2944046 - DNA, 15 bp, Homo sapiens
aggctgccccaggcc

SEQ ID NO: 2944047 - DNA, 16 bp, Homo sapiens
aggctgccctgagggg

SEQ ID NO: 2944048 - DNA, 18 bp, Homo sapiens
aggctgccctgaggggct

SEQ ID NO: 2944049 - DNA, 19 bp, Homo sapiens
aggctgcctccgcacctga

SEQ ID NO: 2944050 - DNA, 18 bp, Homo sapiens
aggctgcctgctgtgctg

SEQ ID NO: 2944051 - DNA, 11 bp, Homo sapiens
aggctgctgcc

SEQ ID NO: 2944052 - DNA, 17 bp, Homo sapiens
aggctgctttccaaagc

SEQ ID NO: 2944053 - DNA, 18 bp, Homo sapiens
aggctgctttccaaagcc

SEQ ID NO: 2944054 - DNA, 14 bp, Homo sapiens
aggctggaaatggt

SEQ ID NO: 2944055 - DNA, 18 bp, Homo sapiens
aggctggaatgagggagg

SEQ ID NO: 2944056 - DNA, 15 bp, Homo sapiens
aggctggagcccagg

SEQ ID NO: 2944057 - DNA, 13 bp, Homo sapiens
aggctggaggcag

SEQ ID NO: 2944058 - DNA, 14 bp, Homo sapiens
aggctggaggcagg

SEQ ID NO: 2944059 - DNA, 18 bp, Homo sapiens
aggctggaggcagggcct

SEQ ID NO: 2944060 - DNA, 23 bp, Homo sapiens
aggctggagttgtcactgctttt

SEQ ID NO: 2944061 - DNA, 22 bp, Homo sapiens
aggctggatgtgcattagcctg

SEQ ID NO: 2944062 - DNA, 14 bp, Homo sapiens
aggctggcacagga

SEQ ID NO: 2944063 - DNA, 17 bp, Homo sapiens
aggctggcacaggacat

SEQ ID NO: 2944064 - DNA, 14 bp, Homo sapiens
aggctggccagccg

SEQ ID NO: 2944065 - DNA, 19 bp, Homo sapiens
aggctggctccagatgcag

SEQ ID NO: 2944066 - DNA, 20 bp, Homo sapiens
aggctggcttgtcccctcct

SEQ ID NO: 2944067 - DNA, 21 bp, Homo sapiens
aggctgggccgcaagggcctg

SEQ ID NO: 2944068 - DNA, 22 bp, Homo sapiens
aggctgggccgcaagggcctgg

SEQ ID NO: 2944069 - DNA, 14 bp, Homo sapiens
aggctgggctgagc

SEQ ID NO: 2944070 - DNA, 22 bp, Homo sapiens
aggctggtctcaaactcctgac

SEQ ID NO: 2944071 - DNA, 22 bp, Homo sapiens
aggctggtctcgaactcctgac

SEQ ID NO: 2944072 - DNA, 23 bp, Homo sapiens
aggctggtcttgaactgggctca

SEQ ID NO: 2944073 - DNA, 19 bp, Homo sapiens
aggctggtcttgaagtcct

SEQ ID NO: 2944074 - DNA, 14 bp, Homo sapiens
aggctggtggccca

SEQ ID NO: 2944075 - DNA, 16 bp, Homo sapiens
aggctggtggcccagg

SEQ ID NO: 2944076 - DNA, 20 bp, Homo sapiens
aggctggtgtatgcactgct

SEQ ID NO: 2944077 - DNA, 20 bp, Homo sapiens
aggctggttttgatggctgg

SEQ ID NO: 2944078 - DNA, 19 bp, Homo sapiens
aggctgtaaatgagggcag

SEQ ID NO: 2944079 - DNA, 13 bp, Homo sapiens
aggctgtgtccct

SEQ ID NO: 2944080 - DNA, 22 bp, Homo sapiens
aggctgtgtccctgctggggtc

SEQ ID NO: 2944081 - DNA, 21 bp, Homo sapiens
aggctgtgtttggctttcagg

SEQ ID NO: 2944082 - DNA, 22 bp, Homo sapiens
aggctgtgtttggctttcaggg

SEQ ID NO: 2944083 - DNA, 20 bp, Homo sapiens
aggctgttcccatgtagccc

SEQ ID NO: 2944084 - DNA, 14 bp, Homo sapiens
aggctgtttgcttc

SEQ ID NO: 2944085 - DNA, 16 bp, Homo sapiens
aggcttcctggtgaga

SEQ ID NO: 2944086 - DNA, 20 bp, Homo sapiens
aggcttcctggtgagaactg

SEQ ID NO: 2944087 - DNA, 22 bp, Homo sapiens
aggcttctccaattctgcccaa

SEQ ID NO: 2944088 - DNA, 16 bp, Homo sapiens
aggcttcttcagatca

SEQ ID NO: 2944089 - DNA, 23 bp, Homo sapiens
aggcttcttcagatcagtgcttg

SEQ ID NO: 2944090 - DNA, 15 bp, Homo sapiens
aggcttgaaatctcc

SEQ ID NO: 2944091 - DNA, 15 bp, Homo sapiens
aggcttgattccaac

SEQ ID NO: 2944092 - DNA, 20 bp, Homo sapiens
aggcttgccgcacatgaaac

SEQ ID NO: 2944093 - DNA, 16 bp, Homo sapiens
aggcttgcctgggctg

SEQ ID NO: 2944094 - DNA, 17 bp, Homo sapiens
aggctttaagctccagc

SEQ ID NO: 2944095 - DNA, 23 bp, Homo sapiens
aggctttatgataatagattctc

SEQ ID NO: 2944096 - DNA, 19 bp, Homo sapiens
aggctttggatttgacatt

SEQ ID NO: 2944097 - DNA, 22 bp, Homo sapiens
aggctttggcaacagaaaacaa

SEQ ID NO: 2944098 - DNA, 13 bp, Homo sapiens
aggctttggccca

SEQ ID NO: 2944099 - DNA, 22 bp, Homo sapiens
aggctttggggtcctagcccag

SEQ ID NO: 2944100 - DNA, 19 bp, Homo sapiens
agggaaaaaaatgcttctt

SEQ ID NO: 2944101 - DNA, 14 bp, Homo sapiens
agggaaaaaataaa

SEQ ID NO: 2944102 - DNA, 20 bp, Homo sapiens
agggaaaataggcaggaagc

SEQ ID NO: 2944103 - DNA, 19 bp, Homo sapiens
agggaaagatgtagaaaga

SEQ ID NO: 2944104 - DNA, 14 bp, Homo sapiens
agggaaatgaaaga

SEQ ID NO: 2944105 - DNA, 13 bp, Homo sapiens
agggaaatttcag

SEQ ID NO: 2944106 - DNA, 17 bp, Homo sapiens
agggaacagacaggaga

SEQ ID NO: 2944107 - DNA, 16 bp, Homo sapiens
agggaacatgcagctc

SEQ ID NO: 2944108 - DNA, 23 bp, Homo sapiens
agggaacccagctctaatacatt

SEQ ID NO: 2944109 - DNA, 19 bp, Homo sapiens
agggaaccccagggggcaa

SEQ ID NO: 2944110 - DNA, 15 bp, Homo sapiens
agggaactgcttgcc

SEQ ID NO: 2944111 - DNA, 22 bp, Homo sapiens
agggaactgcttgcccagggtg

SEQ ID NO: 2944112 - DNA, 16 bp, Homo sapiens
agggaagaaaagagct

SEQ ID NO: 2944113 - DNA, 18 bp, Homo sapiens
agggaagatcttgatggt

SEQ ID NO: 2944114 - DNA, 19 bp, Homo sapiens
agggaagcactgcctccct

SEQ ID NO: 2944115 - DNA, 19 bp, Homo sapiens
agggaagctacaggttaca

SEQ ID NO: 2944116 - DNA, 18 bp, Homo sapiens
agggaagctcatcaaagc

SEQ ID NO: 2944117 - DNA, 16 bp, Homo sapiens
agggaaggacagctgt

SEQ ID NO: 2944118 - DNA, 22 bp, Homo sapiens
agggaaggcaaaggcagaggaa

SEQ ID NO: 2944119 - DNA, 18 bp, Homo sapiens
agggaagggcctgccaca

SEQ ID NO: 2944120 - DNA, 15 bp, Homo sapiens
agggaagtcctggga

SEQ ID NO: 2944121 - DNA, 22 bp, Homo sapiens
agggaagtgtgtgtgtgtccat

SEQ ID NO: 2944122 - DNA, 21 bp, Homo sapiens
agggaataataggccacagaa

SEQ ID NO: 2944123 - DNA, 18 bp, Homo sapiens
agggaatcctcctccagg

SEQ ID NO: 2944124 - DNA, 20 bp, Homo sapiens
agggacaaagaaatcccccc

SEQ ID NO: 2944125 - DNA, 19 bp, Homo sapiens
agggacaagtggactcagg

SEQ ID NO: 2944126 - DNA, 10 bp, Homo sapiens
agggacagag

SEQ ID NO: 2944127 - DNA, 19 bp, Homo sapiens
agggacagagacacctgca

SEQ ID NO: 2944128 - DNA, 13 bp, Homo sapiens
agggacaggaagg

SEQ ID NO: 2944129 - DNA, 19 bp, Homo sapiens
agggacatgccctgtgtgg

SEQ ID NO: 2944130 - DNA, 20 bp, Homo sapiens
agggacatgccctgtgtggc

SEQ ID NO: 2944131 - DNA, 22 bp, Homo sapiens
agggacatgccctgtgtggctg

SEQ ID NO: 2944132 - DNA, 19 bp, Homo sapiens
agggacatgttttgataaa

SEQ ID NO: 2944133 - DNA, 20 bp, Homo sapiens
agggacatgttttgataaag

SEQ ID NO: 2944134 - DNA, 22 bp, Homo sapiens
agggacatgttttgataaagta

SEQ ID NO: 2944135 - DNA, 19 bp, Homo sapiens
agggaccaaattgcttcta

SEQ ID NO: 2944136 - DNA, 15 bp, Homo sapiens
agggacccaaagcag

SEQ ID NO: 2944137 - DNA, 20 bp, Homo sapiens
agggacccggggtctcctgg

SEQ ID NO: 2944138 - DNA, 17 bp, Homo sapiens
agggacgaagaagagcc

SEQ ID NO: 2944139 - DNA, 18 bp, Homo sapiens
agggacgcctgggggtgc

SEQ ID NO: 2944140 - DNA, 20 bp, Homo sapiens
agggacggccaagaatgtac

SEQ ID NO: 2944141 - DNA, 19 bp, Homo sapiens
agggactagtgagtcagca

SEQ ID NO: 2944142 - DNA, 16 bp, Homo sapiens
agggactgctgaccca

SEQ ID NO: 2944143 - DNA, 13 bp, Homo sapiens
agggagctgggac

SEQ ID NO: 2944144 - DNA, 15 bp, Homo sapiens
agggagctgtattcc

SEQ ID NO: 2944145 - DNA, 13 bp, Homo sapiens
agggaggcaagcc

SEQ ID NO: 2944146 - DNA, 13 bp, Homo sapiens
agggaggcactag

SEQ ID NO: 2944147 - DNA, 20 bp, Homo sapiens
agggaggcacttcctcccct

SEQ ID NO: 2944148 - DNA, 13 bp, Homo sapiens
agggaggcagtgg

SEQ ID NO: 2944149 - DNA, 16 bp, Homo sapiens
agggaggccccagggg

SEQ ID NO: 2944150 - DNA, 20 bp, Homo sapiens
agggaggcgggggctgccct

SEQ ID NO: 2944151 - DNA, 14 bp, Homo sapiens
agggagggagccat

SEQ ID NO: 2944152 - DNA, 14 bp, Homo sapiens
agggagggagctga

SEQ ID NO: 2944153 - DNA, 15 bp, Homo sapiens
agggagggctgtcat

SEQ ID NO: 2944154 - DNA, 13 bp, Homo sapiens
agggaggggaagg

SEQ ID NO: 2944155 - DNA, 19 bp, Homo sapiens
agggaggggccggccctgt

SEQ ID NO: 2944156 - DNA, 23 bp, Homo sapiens
agggaggggccggccctgtgtgc

SEQ ID NO: 2944157 - DNA, 12 bp, Homo sapiens
agggaggggcct

SEQ ID NO: 2944158 - DNA, 13 bp, Homo sapiens
agggaggggctgt

SEQ ID NO: 2944159 - DNA, 16 bp, Homo sapiens
agggagggtttctctc

SEQ ID NO: 2944160 - DNA, 18 bp, Homo sapiens
agggagggtttctctccc

SEQ ID NO: 2944161 - DNA, 19 bp, Homo sapiens
agggagggtttctctccca

SEQ ID NO: 2944162 - DNA, 19 bp, Homo sapiens
agggagtctcaggaggagg

SEQ ID NO: 2944163 - DNA, 14 bp, Homo sapiens
agggagtgcagaac

SEQ ID NO: 2944164 - DNA, 20 bp, Homo sapiens
agggagtgcagaacacctgg

SEQ ID NO: 2944165 - DNA, 19 bp, Homo sapiens
agggatagtactaagcatt

SEQ ID NO: 2944166 - DNA, 16 bp, Homo sapiens
agggatccctcatctg

SEQ ID NO: 2944167 - DNA, 19 bp, Homo sapiens
agggatccctcatctgtcc

SEQ ID NO: 2944168 - DNA, 22 bp, Homo sapiens
agggatccctcatctgtccctc

SEQ ID NO: 2944169 - DNA, 17 bp, Homo sapiens
agggatgaagggcgagt

SEQ ID NO: 2944170 - DNA, 15 bp, Homo sapiens
agggatgccctggag

SEQ ID NO: 2944171 - DNA, 17 bp, Homo sapiens
agggatgccctggaggt

SEQ ID NO: 2944172 - DNA, 19 bp, Homo sapiens
agggattacccaagcaaaa

SEQ ID NO: 2944173 - DNA, 13 bp, Homo sapiens
agggatttctttg

SEQ ID NO: 2944174 - DNA, 12 bp, Homo sapiens
agggcaaaatcg

SEQ ID NO: 2944175 - DNA, 20 bp, Homo sapiens
agggcaacaataaaatagca

SEQ ID NO: 2944176 - DNA, 19 bp, Homo sapiens
agggcacagcatctgtagt

SEQ ID NO: 2944177 - DNA, 19 bp, Homo sapiens
agggcacatgatctggccc

SEQ ID NO: 2944178 - DNA, 14 bp, Homo sapiens
agggcaccagggac

SEQ ID NO: 2944179 - DNA, 16 bp, Homo sapiens
agggcacttggccagt

SEQ ID NO: 2944180 - DNA, 15 bp, Homo sapiens
agggcagaggctgga

SEQ ID NO: 2944181 - DNA, 17 bp, Homo sapiens
agggcagaggctggagg

SEQ ID NO: 2944182 - DNA, 19 bp, Homo sapiens
agggcagagtgagacccag

SEQ ID NO: 2944183 - DNA, 21 bp, Homo sapiens
agggcagcactgggaagctgg

SEQ ID NO: 2944184 - DNA, 14 bp, Homo sapiens
agggcagcccctgc

SEQ ID NO: 2944185 - DNA, 17 bp, Homo sapiens
agggcagcccctgcaga

SEQ ID NO: 2944186 - DNA, 13 bp, Homo sapiens
agggcagccctcc

SEQ ID NO: 2944187 - DNA, 16 bp, Homo sapiens
agggcagccctccatg

SEQ ID NO: 2944188 - DNA, 15 bp, Homo sapiens
agggcaggtggggtg

SEQ ID NO: 2944189 - DNA, 23 bp, Homo sapiens
agggcagtggcacgatctcagct

SEQ ID NO: 2944190 - DNA, 16 bp, Homo sapiens
agggcatatacagtga

SEQ ID NO: 2944191 - DNA, 20 bp, Homo sapiens
agggcatgcacgggcatgca

SEQ ID NO: 2944192 - DNA, 14 bp, Homo sapiens
agggcatgggtcgg

SEQ ID NO: 2944193 - DNA, 17 bp, Homo sapiens
agggccaacccttctcc

SEQ ID NO: 2944194 - DNA, 21 bp, Homo sapiens
agggccaacccttctcctctt

SEQ ID NO: 2944195 - DNA, 20 bp, Homo sapiens
agggccacatgggaggctca

SEQ ID NO: 2944196 - DNA, 21 bp, Homo sapiens
agggccacatgggaggctcac

SEQ ID NO: 2944197 - DNA, 20 bp, Homo sapiens
agggccacgctccagctgcc

SEQ ID NO: 2944198 - DNA, 16 bp, Homo sapiens
agggccacgtgccagg

SEQ ID NO: 2944199 - DNA, 19 bp, Homo sapiens
agggccacgtgccaggccc

SEQ ID NO: 2944200 - DNA, 21 bp, Homo sapiens
agggccactcaacagagagga

SEQ ID NO: 2944201 - DNA, 13 bp, Homo sapiens
agggccagagcca

SEQ ID NO: 2944202 - DNA, 15 bp, Homo sapiens
agggccagagccagg

SEQ ID NO: 2944203 - DNA, 16 bp, Homo sapiens
agggccagagccaggg

SEQ ID NO: 2944204 - DNA, 23 bp, Homo sapiens
agggccaggaaggacagactggc

SEQ ID NO: 2944205 - DNA, 11 bp, Homo sapiens
agggccaggct

SEQ ID NO: 2944206 - DNA, 16 bp, Homo sapiens
agggccagggaggcag

SEQ ID NO: 2944207 - DNA, 17 bp, Homo sapiens
agggccaggtgcggcct

SEQ ID NO: 2944208 - DNA, 21 bp, Homo sapiens
agggcccaaagcttgtaaata

SEQ ID NO: 2944209 - DNA, 12 bp, Homo sapiens
agggcccagagc

SEQ ID NO: 2944210 - DNA, 13 bp, Homo sapiens
agggcccagagcc

SEQ ID NO: 2944211 - DNA, 14 bp, Homo sapiens
agggcccagagccc

SEQ ID NO: 2944212 - DNA, 16 bp, Homo sapiens
agggcccagagcccag

SEQ ID NO: 2944213 - DNA, 19 bp, Homo sapiens
agggcccagagcccagctc

SEQ ID NO: 2944214 - DNA, 21 bp, Homo sapiens
agggcccagagcccagctcca

SEQ ID NO: 2944215 - DNA, 23 bp, Homo sapiens
agggccccaggcccgcgggcaca

SEQ ID NO: 2944216 - DNA, 15 bp, Homo sapiens
agggccctgtggagt

SEQ ID NO: 2944217 - DNA, 22 bp, Homo sapiens
agggccctgtggagtccagctc

SEQ ID NO: 2944218 - DNA, 14 bp, Homo sapiens
agggcccttcccct

SEQ ID NO: 2944219 - DNA, 15 bp, Homo sapiens
agggcctagctgcta

SEQ ID NO: 2944220 - DNA, 16 bp, Homo sapiens
agggcctagctgctac

SEQ ID NO: 2944221 - DNA, 19 bp, Homo sapiens
agggcctagctgctacaaa

SEQ ID NO: 2944222 - DNA, 20 bp, Homo sapiens
agggcctagctgctacaaag

SEQ ID NO: 2944223 - DNA, 20 bp, Homo sapiens
agggcctcggaggctcctcc

SEQ ID NO: 2944224 - DNA, 16 bp, Homo sapiens
agggcctctgcctggg

SEQ ID NO: 2944225 - DNA, 20 bp, Homo sapiens
agggcctgagcctggccagc

SEQ ID NO: 2944226 - DNA, 12 bp, Homo sapiens
agggcctggacg

SEQ ID NO: 2944227 - DNA, 21 bp, Homo sapiens
agggcctggccagtcctggtc

SEQ ID NO: 2944228 - DNA, 17 bp, Homo sapiens
agggccttgcccagaga

SEQ ID NO: 2944229 - DNA, 19 bp, Homo sapiens
agggccttgcccagagatg

SEQ ID NO: 2944230 - DNA, 18 bp, Homo sapiens
agggcgcaaagggcatgg

SEQ ID NO: 2944231 - DNA, 13 bp, Homo sapiens
agggcgcccagca

SEQ ID NO: 2944232 - DNA, 15 bp, Homo sapiens
agggcgcccagcagc

SEQ ID NO: 2944233 - DNA, 18 bp, Homo sapiens
agggcgcccagcagcctg

SEQ ID NO: 2944234 - DNA, 13 bp, Homo sapiens
agggcgctcctgt

SEQ ID NO: 2944235 - DNA, 14 bp, Homo sapiens
agggcgctcctgtt

SEQ ID NO: 2944236 - DNA, 12 bp, Homo sapiens
agggcggctgcc

SEQ ID NO: 2944237 - DNA, 15 bp, Homo sapiens
agggcgtgactcacc

SEQ ID NO: 2944238 - DNA, 20 bp, Homo sapiens
agggcgttcttaggctgctg

SEQ ID NO: 2944239 - DNA, 13 bp, Homo sapiens
agggctaagagct

SEQ ID NO: 2944240 - DNA, 21 bp, Homo sapiens
agggctaagagctagcgctgc

SEQ ID NO: 2944241 - DNA, 22 bp, Homo sapiens
agggctaagagctagcgctgcc

SEQ ID NO: 2944242 - DNA, 23 bp, Homo sapiens
agggctaagagctagcgctgccg

SEQ ID NO: 2944243 - DNA, 17 bp, Homo sapiens
agggctaccctgagctg

SEQ ID NO: 2944244 - DNA, 21 bp, Homo sapiens
agggctaccctgagctgaggc

SEQ ID NO: 2944245 - DNA, 22 bp, Homo sapiens
agggctaccctgagctgaggca

SEQ ID NO: 2944246 - DNA, 23 bp, Homo sapiens
agggctaccctgagctgaggcag

SEQ ID NO: 2944247 - DNA, 11 bp, Homo sapiens
agggctagtga

SEQ ID NO: 2944248 - DNA, 18 bp, Homo sapiens
agggctagtgaagtggcc

SEQ ID NO: 2944249 - DNA, 23 bp, Homo sapiens
agggctagtgaagtggcctcttg

SEQ ID NO: 2944250 - DNA, 19 bp, Homo sapiens
agggctatggtgtggactg

SEQ ID NO: 2944251 - DNA, 14 bp, Homo sapiens
agggctcagaagag

SEQ ID NO: 2944252 - DNA, 15 bp, Homo sapiens
agggctcctgtggca

SEQ ID NO: 2944253 - DNA, 21 bp, Homo sapiens
agggctcctgtggcagctgcc

SEQ ID NO: 2944254 - DNA, 18 bp, Homo sapiens
agggctctgggggcagat

SEQ ID NO: 2944255 - DNA, 12 bp, Homo sapiens
agggctctttct

SEQ ID NO: 2944256 - DNA, 18 bp, Homo sapiens
agggctgaataaagggaa

SEQ ID NO: 2944257 - DNA, 23 bp, Homo sapiens
agggctgctgggggcaactggcc

SEQ ID NO: 2944258 - DNA, 18 bp, Homo sapiens
agggctggaggcccaggc

SEQ ID NO: 2944259 - DNA, 14 bp, Homo sapiens
acattaactcatta

SEQ ID NO: 2944260 - DNA, 15 bp, Homo sapiens
acattaactcattag

SEQ ID NO: 2944261 - DNA, 14 bp, Homo sapiens
acattaatgcccag

SEQ ID NO: 2944262 - DNA, 16 bp, Homo sapiens
acattaatgcccagcc

SEQ ID NO: 2944263 - DNA, 18 bp, Homo sapiens
acattaatgcccagccag

SEQ ID NO: 2944264 - DNA, 19 bp, Homo sapiens
acattaatgcccagccagc

SEQ ID NO: 2944265 - DNA, 23 bp, Homo sapiens
acattaatgcccagccagccacc

SEQ ID NO: 2944266 - DNA, 15 bp, Homo sapiens
acattagaagacaat

SEQ ID NO: 2944267 - DNA, 14 bp, Homo sapiens
acattataagtact

SEQ ID NO: 2944268 - DNA, 15 bp, Homo sapiens
acattatccctctgg

SEQ ID NO: 2944269 - DNA, 23 bp, Homo sapiens
acattattgtcccacaatattac

SEQ ID NO: 2944270 - DNA, 15 bp, Homo sapiens
acattattttaattg

SEQ ID NO: 2944271 - DNA, 15 bp, Homo sapiens
acattcaaaacagtt

SEQ ID NO: 2944272 - DNA, 15 bp, Homo sapiens
acattccaactcgta

SEQ ID NO: 2944273 - DNA, 22 bp, Homo sapiens
acattccgaggggctcagttct

SEQ ID NO: 2944274 - DNA, 16 bp, Homo sapiens
acattccgtcctgatg

SEQ ID NO: 2944275 - DNA, 23 bp, Homo sapiens
acattctacttgcttattacatt

SEQ ID NO: 2944276 - DNA, 22 bp, Homo sapiens
acattctagatgcaagtctctt

SEQ ID NO: 2944277 - DNA, 22 bp, Homo sapiens
acattctctattgtaattttgt

SEQ ID NO: 2944278 - DNA, 23 bp, Homo sapiens
acattctgattcgaatgacactg

SEQ ID NO: 2944279 - DNA, 16 bp, Homo sapiens
acattctgatttggaa

SEQ ID NO: 2944280 - DNA, 16 bp, Homo sapiens
acattctgccaggccc

SEQ ID NO: 2944281 - DNA, 11 bp, Homo sapiens
acattctgtgt

SEQ ID NO: 2944282 - DNA, 19 bp, Homo sapiens
acattcttgtgtctgtttt

SEQ ID NO: 2944283 - DNA, 20 bp, Homo sapiens
acattgaagtaatgaatttt

SEQ ID NO: 2944284 - DNA, 23 bp, Homo sapiens
acattgcagagtggcctagagca

SEQ ID NO: 2944285 - DNA, 17 bp, Homo sapiens
acattgccttgcatttg

SEQ ID NO: 2944286 - DNA, 22 bp, Homo sapiens
agacatgatttccttgaatgtg

SEQ ID NO: 2944287 - DNA, 15 bp, Homo sapiens
agacatggaggttct

SEQ ID NO: 2944288 - DNA, 18 bp, Homo sapiens
agacatggtgtctcacac

SEQ ID NO: 2944289 - DNA, 19 bp, Homo sapiens
agacatgttttagacaaat

SEQ ID NO: 2944290 - DNA, 20 bp, Homo sapiens
agacattaactcattagact

SEQ ID NO: 2944291 - DNA, 22 bp, Homo sapiens
agacattagagagatttttcat

SEQ ID NO: 2944292 - DNA, 15 bp, Homo sapiens
agacattatcttttg

SEQ ID NO: 2944293 - DNA, 20 bp, Homo sapiens
agacattatcttttggctct

SEQ ID NO: 2944294 - DNA, 19 bp, Homo sapiens
agacattctgccaggcccc

SEQ ID NO: 2944295 - DNA, 15 bp, Homo sapiens
agacattggcaccta

SEQ ID NO: 2944296 - DNA, 19 bp, Homo sapiens
agacattgggtctattcca

SEQ ID NO: 2944297 - DNA, 13 bp, Homo sapiens
agacattgtaaat

SEQ ID NO: 2944298 - DNA, 14 bp, Homo sapiens
agacattgtaaata

SEQ ID NO: 2944299 - DNA, 20 bp, Homo sapiens
agacattgtaaataaatttt

SEQ ID NO: 2944300 - DNA, 21 bp, Homo sapiens
agacattgtaaataaattttg

SEQ ID NO: 2944301 - DNA, 21 bp, Homo sapiens
agacattgtttggatttcctt

SEQ ID NO: 2944302 - DNA, 16 bp, Homo sapiens
agacatttcaaaatta

SEQ ID NO: 2944303 - DNA, 22 bp, Homo sapiens
agacattttaacaagaagatga

SEQ ID NO: 2944304 - DNA, 23 bp, Homo sapiens
agacattttaacaagaagatgaa

SEQ ID NO: 2944305 - DNA, 13 bp, Homo sapiens
agacattttcata

SEQ ID NO: 2944306 - DNA, 22 bp, Homo sapiens
agacattttttgctataatcat

SEQ ID NO: 2944307 - DNA, 23 bp, Homo sapiens
agacattttttgctataatcatt

SEQ ID NO: 2944308 - DNA, 21 bp, Homo sapiens
agaccaaaaggagagattatt

SEQ ID NO: 2944309 - DNA, 23 bp, Homo sapiens
agaccaaattttgaggtctttta

SEQ ID NO: 2944310 - DNA, 14 bp, Homo sapiens
agaccaacctgacc

SEQ ID NO: 2944311 - DNA, 18 bp, Homo sapiens
agaccaaggcctcggcag

SEQ ID NO: 2944312 - DNA, 15 bp, Homo sapiens
agaccagcctgtcca

SEQ ID NO: 2944313 - DNA, 17 bp, Homo sapiens
agaccagcctttcttcc

SEQ ID NO: 2944314 - DNA, 12 bp, Homo sapiens
agaccagctctt

SEQ ID NO: 2944315 - DNA, 13 bp, Homo sapiens
agaccaggccctg

SEQ ID NO: 2944316 - DNA, 19 bp, Homo sapiens
agaccataaagatattctt

SEQ ID NO: 2944317 - DNA, 12 bp, Homo sapiens
agaccatctcct

SEQ ID NO: 2944318 - DNA, 20 bp, Homo sapiens
agaccatgtggagacttcat

SEQ ID NO: 2944319 - DNA, 17 bp, Homo sapiens
agaccattaactagttt

SEQ ID NO: 2944320 - DNA, 14 bp, Homo sapiens
agacccaacaatga

SEQ ID NO: 2944321 - DNA, 15 bp, Homo sapiens
agacccattcctatt

SEQ ID NO: 2944322 - DNA, 13 bp, Homo sapiens
agacccccactct

SEQ ID NO: 2944323 - DNA, 13 bp, Homo sapiens
agaccccctggag

SEQ ID NO: 2944324 - DNA, 15 bp, Homo sapiens
agaccccctggagac

SEQ ID NO: 2944325 - DNA, 19 bp, Homo sapiens
agaccccctggagactaac

SEQ ID NO: 2944326 - DNA, 14 bp, Homo sapiens
agacccgggaagga

SEQ ID NO: 2944327 - DNA, 13 bp, Homo sapiens
agaccctctcagg

SEQ ID NO: 2944328 - DNA, 20 bp, Homo sapiens
agaccctctcaggctgtccc

SEQ ID NO: 2944329 - DNA, 18 bp, Homo sapiens
agaccctctttcttgttt

SEQ ID NO: 2944330 - DNA, 15 bp, Homo sapiens
agacctactgttcta

SEQ ID NO: 2944331 - DNA, 17 bp, Homo sapiens
agacctactgttctaaa

SEQ ID NO: 2944332 - DNA, 19 bp, Homo sapiens
agacctgacacctttcata

SEQ ID NO: 2944333 - DNA, 16 bp, Homo sapiens
agacctgatcctggag

SEQ ID NO: 2944334 - DNA, 21 bp, Homo sapiens
agacctgatcctggaggccca

SEQ ID NO: 2944335 - DNA, 13 bp, Homo sapiens
agacctgctctcc

SEQ ID NO: 2944336 - DNA, 17 bp, Homo sapiens
agacctgtcgtctctcc

SEQ ID NO: 2944337 - DNA, 23 bp, Homo sapiens
agaccttcaaatgcgaacactat

SEQ ID NO: 2944338 - DNA, 19 bp, Homo sapiens
agacgcactgatctttgca

SEQ ID NO: 2944339 - DNA, 14 bp, Homo sapiens
agacgccagtagca

SEQ ID NO: 2944340 - DNA, 15 bp, Homo sapiens
agacgcctgaggaac

SEQ ID NO: 2944341 - DNA, 13 bp, Homo sapiens
agacgctcctgaa

SEQ ID NO: 2944342 - DNA, 13 bp, Homo sapiens
agacgctcttttc

SEQ ID NO: 2944343 - DNA, 14 bp, Homo sapiens
agacggatggcagg

SEQ ID NO: 2944344 - DNA, 16 bp, Homo sapiens
agacggtgttttgcca

SEQ ID NO: 2944345 - DNA, 21 bp, Homo sapiens
agacggtgttttgccatgttg

SEQ ID NO: 2944346 - DNA, 19 bp, Homo sapiens
agacggtttccagggaggg

SEQ ID NO: 2944347 - DNA, 14 bp, Homo sapiens
agacgtcaggggca

SEQ ID NO: 2944348 - DNA, 19 bp, Homo sapiens
agacgtctggccctggcgg

SEQ ID NO: 2944349 - DNA, 14 bp, Homo sapiens
agactacctgccct

SEQ ID NO: 2944350 - DNA, 14 bp, Homo sapiens
agactactaagagg

SEQ ID NO: 2944351 - DNA, 23 bp, Homo sapiens
agactagacaccttctgtgctca

SEQ ID NO: 2944352 - DNA, 20 bp, Homo sapiens
agactatggaatgtcagtgt

SEQ ID NO: 2944353 - DNA, 20 bp, Homo sapiens
agactattccttttctgtat

SEQ ID NO: 2944354 - DNA, 17 bp, Homo sapiens
agactcaaatgttctaa

SEQ ID NO: 2944355 - DNA, 15 bp, Homo sapiens
agactcacctctgcc

SEQ ID NO: 2944356 - DNA, 17 bp, Homo sapiens
agactcacctctgcctc

SEQ ID NO: 2944357 - DNA, 23 bp, Homo sapiens
agactcagcctgcagttaattag

SEQ ID NO: 2944358 - DNA, 20 bp, Homo sapiens
agactcaggccaagaaacgt

SEQ ID NO: 2944359 - DNA, 20 bp, Homo sapiens
agactcatcctgaacagcat

SEQ ID NO: 2944360 - DNA, 16 bp, Homo sapiens
agactcatcttactgt

SEQ ID NO: 2944361 - DNA, 17 bp, Homo sapiens
agactcatcttactgta

SEQ ID NO: 2944362 - DNA, 17 bp, Homo sapiens
agactcccattcctgaa

SEQ ID NO: 2944363 - DNA, 21 bp, Homo sapiens
agactcccgccccgggctggc

SEQ ID NO: 2944364 - DNA, 23 bp, Homo sapiens
agactcccgccccgggctggccc

SEQ ID NO: 2944365 - DNA, 14 bp, Homo sapiens
agactccctccata

SEQ ID NO: 2944366 - DNA, 11 bp, Homo sapiens
agactccctga

SEQ ID NO: 2944367 - DNA, 22 bp, Homo sapiens
agactccctgatcccagacctg

SEQ ID NO: 2944368 - DNA, 15 bp, Homo sapiens
agactcctgaggaca

SEQ ID NO: 2944369 - DNA, 23 bp, Homo sapiens
agactcgattcatattgaatata

SEQ ID NO: 2944370 - DNA, 17 bp, Homo sapiens
agactctagagtccaag

SEQ ID NO: 2944371 - DNA, 19 bp, Homo sapiens
agactctcgcatcttccca

SEQ ID NO: 2944372 - DNA, 22 bp, Homo sapiens
agactcttccaccagagcaggg

SEQ ID NO: 2944373 - DNA, 14 bp, Homo sapiens
agactctttatgct

SEQ ID NO: 2944374 - DNA, 16 bp, Homo sapiens
agactgaagatttatt

SEQ ID NO: 2944375 - DNA, 15 bp, Homo sapiens
agactgagctctcca

SEQ ID NO: 2944376 - DNA, 22 bp, Homo sapiens
agactgagctctccaggccagg

SEQ ID NO: 2944377 - DNA, 17 bp, Homo sapiens
agactgatcaggacctc

SEQ ID NO: 2944378 - DNA, 15 bp, Homo sapiens
agactgatccctggc

SEQ ID NO: 2944379 - DNA, 20 bp, Homo sapiens
agactgatccctggccactg

SEQ ID NO: 2944380 - DNA, 11 bp, Homo sapiens
agactgcctcc

SEQ ID NO: 2944381 - DNA, 19 bp, Homo sapiens
agactgcttggccagatgc

SEQ ID NO: 2944382 - DNA, 20 bp, Homo sapiens
agactgcttggccagatgcg

SEQ ID NO: 2944383 - DNA, 18 bp, Homo sapiens
agactggaacactagaca

SEQ ID NO: 2944384 - DNA, 13 bp, Homo sapiens
agactggaacttg

SEQ ID NO: 2944385 - DNA, 19 bp, Homo sapiens
agactggaagctaatttgc

SEQ ID NO: 2944386 - DNA, 11 bp, Homo sapiens
agactggacag

SEQ ID NO: 2944387 - DNA, 15 bp, Homo sapiens
agactggacagcttg

SEQ ID NO: 2944388 - DNA, 17 bp, Homo sapiens
agactggagaaatgctt

SEQ ID NO: 2944389 - DNA, 21 bp, Homo sapiens
agactggatttgcagaagttt

SEQ ID NO: 2944390 - DNA, 13 bp, Homo sapiens
agactggcaggcg

SEQ ID NO: 2944391 - DNA, 19 bp, Homo sapiens
agactggccgggcaggcgt

SEQ ID NO: 2944392 - DNA, 22 bp, Homo sapiens
agactggcctaggggccagggc

SEQ ID NO: 2944393 - DNA, 11 bp, Homo sapiens
agactggcttt

SEQ ID NO: 2944394 - DNA, 17 bp, Homo sapiens
agactgggcccaggcag

SEQ ID NO: 2944395 - DNA, 18 bp, Homo sapiens
agactgggcccaggcagg

SEQ ID NO: 2944396 - DNA, 15 bp, Homo sapiens
agactgggctgaggg

SEQ ID NO: 2944397 - DNA, 17 bp, Homo sapiens
agacttaaacttcctta

SEQ ID NO: 2944398 - DNA, 16 bp, Homo sapiens
agacttaatttcaaat

SEQ ID NO: 2944399 - DNA, 20 bp, Homo sapiens
agacttaatttcaaatctgt

SEQ ID NO: 2944400 - DNA, 14 bp, Homo sapiens
agacttaattttgt

SEQ ID NO: 2944401 - DNA, 15 bp, Homo sapiens
agacttactctaaga

SEQ ID NO: 2944402 - DNA, 16 bp, Homo sapiens
agacttactctaagat

SEQ ID NO: 2944403 - DNA, 16 bp, Homo sapiens
agacttcagtcctggt

SEQ ID NO: 2944404 - DNA, 18 bp, Homo sapiens
agacttcagtcctggtct

SEQ ID NO: 2944405 - DNA, 19 bp, Homo sapiens
agacttcagtcctggtctg

SEQ ID NO: 2944406 - DNA, 13 bp, Homo sapiens
agacttccaaaga

SEQ ID NO: 2944407 - DNA, 15 bp, Homo sapiens
agacttccaaagaat

SEQ ID NO: 2944408 - DNA, 17 bp, Homo sapiens
agacttccaaagaatgt

SEQ ID NO: 2944409 - DNA, 16 bp, Homo sapiens
agacttccctaacact

SEQ ID NO: 2944410 - DNA, 16 bp, Homo sapiens
agacttccttgagaca

SEQ ID NO: 2944411 - DNA, 19 bp, Homo sapiens
agacttggtggtctgagct

SEQ ID NO: 2944412 - DNA, 22 bp, Homo sapiens
agacttgtcaagcctgtgcaaa

SEQ ID NO: 2944413 - DNA, 17 bp, Homo sapiens
agacttgttctcagagc

SEQ ID NO: 2944414 - DNA, 16 bp, Homo sapiens
agacttgtttcctgtg

SEQ ID NO: 2944415 - DNA, 17 bp, Homo sapiens
agacttgtttcctgtgc

SEQ ID NO: 2944416 - DNA, 19 bp, Homo sapiens
agacttgtttcctgtgccc

SEQ ID NO: 2944417 - DNA, 16 bp, Homo sapiens
agactttaggctttca

SEQ ID NO: 2944418 - DNA, 17 bp, Homo sapiens
agactttaggctttcag

SEQ ID NO: 2944419 - DNA, 21 bp, Homo sapiens
agactttggaaaatgcattgt

SEQ ID NO: 2944420 - DNA, 19 bp, Homo sapiens
agactttgtttttaaaatg

SEQ ID NO: 2944421 - DNA, 11 bp, Homo sapiens
agagaaaaaaa

SEQ ID NO: 2944422 - DNA, 21 bp, Homo sapiens
agagaaaaaaagtttgccaga

SEQ ID NO: 2944423 - DNA, 21 bp, Homo sapiens
agagaaaaatgctttgctttg

SEQ ID NO: 2944424 - DNA, 16 bp, Homo sapiens
agagaaaatatatgta

SEQ ID NO: 2944425 - DNA, 19 bp, Homo sapiens
agagaaaatatatgtattt

SEQ ID NO: 2944426 - DNA, 17 bp, Homo sapiens
agagaaaattaattcct

SEQ ID NO: 2944427 - DNA, 14 bp, Homo sapiens
agagaaagaggcca

SEQ ID NO: 2944428 - DNA, 18 bp, Homo sapiens
agagaaaggggagcccac

SEQ ID NO: 2944429 - DNA, 19 bp, Homo sapiens
agagaaaggggagcccact

SEQ ID NO: 2944430 - DNA, 21 bp, Homo sapiens
agagaaaggggagcccactgt

SEQ ID NO: 2944431 - DNA, 22 bp, Homo sapiens
agagaaagttggtgctgctcat

SEQ ID NO: 2944432 - DNA, 20 bp, Homo sapiens
agagaacctcacgcacctcc

SEQ ID NO: 2944433 - DNA, 16 bp, Homo sapiens
agagaacgggcgtcag

SEQ ID NO: 2944434 - DNA, 15 bp, Homo sapiens
agagaactgaaaaga

SEQ ID NO: 2944435 - DNA, 13 bp, Homo sapiens
agagaactgacat

SEQ ID NO: 2944436 - DNA, 16 bp, Homo sapiens
agagaactgagcatct

SEQ ID NO: 2944437 - DNA, 15 bp, Homo sapiens
agagaagaatgagcc

SEQ ID NO: 2944438 - DNA, 16 bp, Homo sapiens
agagaagacccttctc

SEQ ID NO: 2944439 - DNA, 13 bp, Homo sapiens
agagaaggcagga

SEQ ID NO: 2944440 - DNA, 22 bp, Homo sapiens
agagaaggtggacctggcagtg

SEQ ID NO: 2944441 - DNA, 22 bp, Homo sapiens
agagaagtcacaacaaaaggaa

SEQ ID NO: 2944442 - DNA, 19 bp, Homo sapiens
agagaatagagctgccact

SEQ ID NO: 2944443 - DNA, 16 bp, Homo sapiens
agagaatataacatga

SEQ ID NO: 2944444 - DNA, 23 bp, Homo sapiens
agagaatataacatgaaatgata

SEQ ID NO: 2944445 - DNA, 15 bp, Homo sapiens
agagaatatgtctgc

SEQ ID NO: 2944446 - DNA, 16 bp, Homo sapiens
agagaatgctgacctg

SEQ ID NO: 2944447 - DNA, 14 bp, Homo sapiens
agagaattctgttc

SEQ ID NO: 2944448 - DNA, 14 bp, Homo sapiens
agagacacctgcac

SEQ ID NO: 2944449 - DNA, 18 bp, Homo sapiens
agagacacctgcacctcc

SEQ ID NO: 2944450 - DNA, 19 bp, Homo sapiens
agagacacctgcacctccc

SEQ ID NO: 2944451 - DNA, 13 bp, Homo sapiens
agagacaggaaaa

SEQ ID NO: 2944452 - DNA, 16 bp, Homo sapiens
agagacagtgatgcct

SEQ ID NO: 2944453 - DNA, 17 bp, Homo sapiens
agagacatacttgaagg

SEQ ID NO: 2944454 - DNA, 23 bp, Homo sapiens
agagacatacttgaagggccaga

SEQ ID NO: 2944455 - DNA, 12 bp, Homo sapiens
agagacccaagg

SEQ ID NO: 2944456 - DNA, 13 bp, Homo sapiens
agagacccaagga

SEQ ID NO: 2944457 - DNA, 21 bp, Homo sapiens
agagacccaaggaggaaaaac

SEQ ID NO: 2944458 - DNA, 17 bp, Homo sapiens
agagacccttgtttgat

SEQ ID NO: 2944459 - DNA, 22 bp, Homo sapiens
agagacctgttttaaaaaggaa

SEQ ID NO: 2944460 - DNA, 18 bp, Homo sapiens
agagaccttcaaatgcga

SEQ ID NO: 2944461 - DNA, 14 bp, Homo sapiens
agagacctttgccc

SEQ ID NO: 2944462 - DNA, 16 bp, Homo sapiens
agagacctttgcccac

SEQ ID NO: 2944463 - DNA, 17 bp, Homo sapiens
agagacgggccctggtg

SEQ ID NO: 2944464 - DNA, 21 bp, Homo sapiens
agagacggtgtcttgttctgt

SEQ ID NO: 2944465 - DNA, 15 bp, Homo sapiens
agagacggtgttttg

SEQ ID NO: 2944466 - DNA, 13 bp, Homo sapiens
agagactcagcct

SEQ ID NO: 2944467 - DNA, 16 bp, Homo sapiens
agagactcagcctgca

SEQ ID NO: 2944468 - DNA, 23 bp, Homo sapiens
agagactcctgaaggtctgggtc

SEQ ID NO: 2944469 - DNA, 15 bp, Homo sapiens
agagacttggatgag

SEQ ID NO: 2944470 - DNA, 18 bp, Homo sapiens
agagacttggatgaggag

SEQ ID NO: 2944471 - DNA, 14 bp, Homo sapiens
agagagaaaaagat

SEQ ID NO: 2944472 - DNA, 11 bp, Homo sapiens
agagagaaaat

SEQ ID NO: 2944473 - DNA, 17 bp, Homo sapiens
agagagaaaataaaaag

SEQ ID NO: 2944474 - DNA, 18 bp, Homo sapiens
agagagaacctaactgta

SEQ ID NO: 2944475 - DNA, 19 bp, Homo sapiens
agagagaacctaactgtat

SEQ ID NO: 2944476 - DNA, 18 bp, Homo sapiens
agagagctgccatcgctg

SEQ ID NO: 2944477 - DNA, 12 bp, Homo sapiens
agagaggaagga

SEQ ID NO: 2944478 - DNA, 17 bp, Homo sapiens
agagaggaatcagactt

SEQ ID NO: 2944479 - DNA, 16 bp, Homo sapiens
agagaggccttgtccc

SEQ ID NO: 2944480 - DNA, 16 bp, Homo sapiens
agagagtacactgtgt

SEQ ID NO: 2944481 - DNA, 18 bp, Homo sapiens
agagagtacactgtgtct

SEQ ID NO: 2944482 - DNA, 18 bp, Homo sapiens
agagagttgttgtgtaca

SEQ ID NO: 2944483 - DNA, 16 bp, Homo sapiens
agagataccttgaaaa

SEQ ID NO: 2944484 - DNA, 14 bp, Homo sapiens
agagatagcctgtg

SEQ ID NO: 2944485 - DNA, 18 bp, Homo sapiens
agagatatctatgaaaac

SEQ ID NO: 2944486 - DNA, 15 bp, Homo sapiens
agagatccaaagact

SEQ ID NO: 2944487 - DNA, 23 bp, Homo sapiens
agagatcctacttctctgagtca

SEQ ID NO: 2944488 - DNA, 16 bp, Homo sapiens
agagatcttgagagag

SEQ ID NO: 2944489 - DNA, 15 bp, Homo sapiens
agagatgacccctac

SEQ ID NO: 2944490 - DNA, 18 bp, Homo sapiens
agagatgacccctacccc

SEQ ID NO: 2944491 - DNA, 14 bp, Homo sapiens
agagatgagcagtg

SEQ ID NO: 2944492 - DNA, 18 bp, Homo sapiens
agagatggagtcttgcta

SEQ ID NO: 2944493 - DNA, 21 bp, Homo sapiens
agagatgtgcaattgatttct

SEQ ID NO: 2944494 - DNA, 20 bp, Homo sapiens
agagattacctcctgagaaa

SEQ ID NO: 2944495 - DNA, 12 bp, Homo sapiens
agagattattaa

SEQ ID NO: 2944496 - DNA, 15 bp, Homo sapiens
agagattattaaatc

SEQ ID NO: 2944497 - DNA, 12 bp, Homo sapiens
agagattctgat

SEQ ID NO: 2944498 - DNA, 22 bp, Homo sapiens
agagattgcacagtcaaaacga

SEQ ID NO: 2944499 - DNA, 13 bp, Homo sapiens
agagattgctaat

SEQ ID NO: 2944500 - DNA, 13 bp, Homo sapiens
agagatttttgtt

SEQ ID NO: 2944501 - DNA, 13 bp, Homo sapiens
agagcaaaaatgt

SEQ ID NO: 2944502 - DNA, 23 bp, Homo sapiens
agagcaaaaatgtaaaaaacaaa

SEQ ID NO: 2944503 - DNA, 19 bp, Homo sapiens
agagcaaaactccgtctca

SEQ ID NO: 2944504 - DNA, 15 bp, Homo sapiens
agagcaaagcgccca

SEQ ID NO: 2944505 - DNA, 22 bp, Homo sapiens
agagcaaggtttcgtggcagca

SEQ ID NO: 2944506 - DNA, 12 bp, Homo sapiens
agagcacccact

SEQ ID NO: 2944507 - DNA, 14 bp, Homo sapiens
agagcacgcctgcc

SEQ ID NO: 2944508 - DNA, 15 bp, Homo sapiens
agagcactctcaccc

SEQ ID NO: 2944509 - DNA, 13 bp, Homo sapiens
agagcactgccac

SEQ ID NO: 2944510 - DNA, 18 bp, Homo sapiens
agagcactgccaccagta

SEQ ID NO: 2944511 - DNA, 20 bp, Homo sapiens
agagcagaacagatctttta

SEQ ID NO: 2944512 - DNA, 12 bp, Homo sapiens
agagcagaggtc

SEQ ID NO: 2944513 - DNA, 18 bp, Homo sapiens
agagcagctaactccgag

SEQ ID NO: 2944514 - DNA, 18 bp, Homo sapiens
agagcaggccagcccgga

SEQ ID NO: 2944515 - DNA, 17 bp, Homo sapiens
agagcaggggctgctgg

SEQ ID NO: 2944516 - DNA, 15 bp, Homo sapiens
agagcagtgcacatc

SEQ ID NO: 2944517 - DNA, 23 bp, Homo sapiens
agagcataattccgaaacaaaac

SEQ ID NO: 2944518 - DNA, 23 bp, Homo sapiens
agagcatgtgaggggtagtggga

SEQ ID NO: 2944519 - DNA, 17 bp, Homo sapiens
agagcattaaaataact

SEQ ID NO: 2944520 - DNA, 12 bp, Homo sapiens
agagccacacat

SEQ ID NO: 2944521 - DNA, 15 bp, Homo sapiens
agagccaccaagagg

SEQ ID NO: 2944522 - DNA, 15 bp, Homo sapiens
agagccagagaagtg

SEQ ID NO: 2944523 - DNA, 16 bp, Homo sapiens
agagccagagaagtga

SEQ ID NO: 2944524 - DNA, 17 bp, Homo sapiens
agagccagagaagtgac

SEQ ID NO: 2944525 - DNA, 20 bp, Homo sapiens
agagccagagaagtgacagg

SEQ ID NO: 2944526 - DNA, 21 bp, Homo sapiens
agagccagagaagtgacaggg

SEQ ID NO: 2944527 - DNA, 14 bp, Homo sapiens
agagcccagcccag

SEQ ID NO: 2944528 - DNA, 14 bp, Homo sapiens
agagcccagctcca

SEQ ID NO: 2944529 - DNA, 15 bp, Homo sapiens
agagcccagctccaa

SEQ ID NO: 2944530 - DNA, 19 bp, Homo sapiens
agagcccagctcttgctct

SEQ ID NO: 2944531 - DNA, 20 bp, Homo sapiens
agagcccagctcttgctctc

SEQ ID NO: 2944532 - DNA, 19 bp, Homo sapiens
agagccctgggtgacttca

SEQ ID NO: 2944533 - DNA, 16 bp, Homo sapiens
agagcctgaatttgta

SEQ ID NO: 2944534 - DNA, 15 bp, Homo sapiens
agagcctgagagtga

SEQ ID NO: 2944535 - DNA, 11 bp, Homo sapiens
agagcctgagg

SEQ ID NO: 2944536 - DNA, 19 bp, Homo sapiens
agagcctgctcccccaccc

SEQ ID NO: 2944537 - DNA, 20 bp, Homo sapiens
agagcctgctcccccacccc

SEQ ID NO: 2944538 - DNA, 19 bp, Homo sapiens
agagcctgtccccgccttc

SEQ ID NO: 2944539 - DNA, 23 bp, Homo sapiens
agagcctgtccccgccttccctc

SEQ ID NO: 2944540 - DNA, 15 bp, Homo sapiens
agagcctttccaaag

SEQ ID NO: 2944541 - DNA, 18 bp, Homo sapiens
agagcctttgatcttcag

SEQ ID NO: 2944542 - DNA, 20 bp, Homo sapiens
agagcgaggaggcgcggcct

SEQ ID NO: 2944543 - DNA, 15 bp, Homo sapiens
agagcgcctgcccct

SEQ ID NO: 2944544 - DNA, 21 bp, Homo sapiens
agagcgcctgcccctcccaga

SEQ ID NO: 2944545 - DNA, 15 bp, Homo sapiens
agagcgcggctggct

SEQ ID NO: 2944546 - DNA, 16 bp, Homo sapiens
agagcgcggctggctc

SEQ ID NO: 2944547 - DNA, 23 bp, Homo sapiens
agagcgcggctggctctgtggag

SEQ ID NO: 2944548 - DNA, 21 bp, Homo sapiens
agagctaacccttatctgtaa

SEQ ID NO: 2944549 - DNA, 20 bp, Homo sapiens
agagctaataaatctcttct

SEQ ID NO: 2944550 - DNA, 14 bp, Homo sapiens
agagctagcgctgc

SEQ ID NO: 2944551 - DNA, 21 bp, Homo sapiens
agagctagcgctgccgcaccc

SEQ ID NO: 2944552 - DNA, 23 bp, Homo sapiens
agagctatttaatggccggctgg

SEQ ID NO: 2944553 - DNA, 17 bp, Homo sapiens
agagctgagccagttgt

SEQ ID NO: 2944554 - DNA, 18 bp, Homo sapiens
agagctgagccagttgtc

SEQ ID NO: 2944555 - DNA, 22 bp, Homo sapiens
agagctgatgtgagtgtgtgtg

SEQ ID NO: 2944556 - DNA, 12 bp, Homo sapiens
agagctgcctcc

SEQ ID NO: 2944557 - DNA, 13 bp, Homo sapiens
agagctgcctccc

SEQ ID NO: 2944558 - DNA, 15 bp, Homo sapiens
agagctgcctcccca

SEQ ID NO: 2944559 - DNA, 14 bp, Homo sapiens
agagctgcgggctg

SEQ ID NO: 2944560 - DNA, 15 bp, Homo sapiens
agagctgcgggctga

SEQ ID NO: 2944561 - DNA, 16 bp, Homo sapiens
agagctgcgggctgag

SEQ ID NO: 2944562 - DNA, 22 bp, Homo sapiens
agagctgcgggctgagggcatc

SEQ ID NO: 2944563 - DNA, 18 bp, Homo sapiens
agagctgggaaattcatg

SEQ ID NO: 2944564 - DNA, 22 bp, Homo sapiens
agagctgggaaattcatgtgga

SEQ ID NO: 2944565 - DNA, 22 bp, Homo sapiens
agagctgttcaacatcactgaa

SEQ ID NO: 2944566 - DNA, 12 bp, Homo sapiens
agagcttccctg

SEQ ID NO: 2944567 - DNA, 20 bp, Homo sapiens
agagcttccctgactcattc

SEQ ID NO: 2944568 - DNA, 19 bp, Homo sapiens
agagcttctgtattttcaa

SEQ ID NO: 2944569 - DNA, 15 bp, Homo sapiens
agagcttcttccagg

SEQ ID NO: 2944570 - DNA, 22 bp, Homo sapiens
agagctttcttcccgaacccca

SEQ ID NO: 2944571 - DNA, 23 bp, Homo sapiens
agagcttttcgaactgtgctccc

SEQ ID NO: 2944572 - DNA, 15 bp, Homo sapiens
agaggaacagtgtgg

SEQ ID NO: 2944573 - DNA, 13 bp, Homo sapiens
agaggaagagaca

SEQ ID NO: 2944574 - DNA, 16 bp, Homo sapiens
agaggaaggggccaga

SEQ ID NO: 2944575 - DNA, 22 bp, Homo sapiens
agaggaatcactcttgtggatg

SEQ ID NO: 2944576 - DNA, 23 bp, Homo sapiens
agaggaatcagacttcacactgc

SEQ ID NO: 2944577 - DNA, 13 bp, Homo sapiens
agaggaatgaaaa

SEQ ID NO: 2944578 - DNA, 14 bp, Homo sapiens
agaggaatttggct

SEQ ID NO: 2944579 - DNA, 18 bp, Homo sapiens
agaggaatttggctgctt

SEQ ID NO: 2944580 - DNA, 15 bp, Homo sapiens
agaggaccagggcct

SEQ ID NO: 2944581 - DNA, 23 bp, Homo sapiens
agaggagagccagagaagtgaca

SEQ ID NO: 2944582 - DNA, 22 bp, Homo sapiens
agaggagcccagtgggctgcac

SEQ ID NO: 2944583 - DNA, 19 bp, Homo sapiens
agaggaggaggtgggggct

SEQ ID NO: 2944584 - DNA, 21 bp, Homo sapiens
agaggagggcgtgactcaccc

SEQ ID NO: 2944585 - DNA, 20 bp, Homo sapiens
agaggaggggccgctgccac

SEQ ID NO: 2944586 - DNA, 22 bp, Homo sapiens
agaggaggggccgctgccaccc

SEQ ID NO: 2944587 - DNA, 13 bp, Homo sapiens
agaggagttcttt

SEQ ID NO: 2944588 - DNA, 20 bp, Homo sapiens
agaggatgagctctacccag

SEQ ID NO: 2944589 - DNA, 21 bp, Homo sapiens
agaggatgctctttcccagga

SEQ ID NO: 2944590 - DNA, 23 bp, Homo sapiens
agaggattttagctaggatttga

SEQ ID NO: 2944591 - DNA, 18 bp, Homo sapiens
agaggcagaaaattgcac

SEQ ID NO: 2944592 - DNA, 20 bp, Homo sapiens
agaggcagagttctgtgaag

SEQ ID NO: 2944593 - DNA, 14 bp, Homo sapiens
agaggccctctgga

SEQ ID NO: 2944594 - DNA, 14 bp, Homo sapiens
agaggcgtgtgcag

SEQ ID NO: 2944595 - DNA, 18 bp, Homo sapiens
agaggcgtgtgcaggccg

SEQ ID NO: 2944596 - DNA, 19 bp, Homo sapiens
agaggcgtgtgcaggccga

SEQ ID NO: 2944597 - DNA, 19 bp, Homo sapiens
agaggctaaattactcagg

SEQ ID NO: 2944598 - DNA, 12 bp, Homo sapiens
agaggctgagac

SEQ ID NO: 2944599 - DNA, 17 bp, Homo sapiens
agaggctggaggcaggg

SEQ ID NO: 2944600 - DNA, 20 bp, Homo sapiens
agaggctggaggcagggcct

SEQ ID NO: 2944601 - DNA, 22 bp, Homo sapiens
agaggctggaggcagggccttg

SEQ ID NO: 2944602 - DNA, 19 bp, Homo sapiens
agaggctggcctctacatc

SEQ ID NO: 2944603 - DNA, 21 bp, Homo sapiens
agagggaaggtgaccgcccag

SEQ ID NO: 2944604 - DNA, 20 bp, Homo sapiens
agagggaccaaattgcttct

SEQ ID NO: 2944605 - DNA, 15 bp, Homo sapiens
agagggacctctccc

SEQ ID NO: 2944606 - DNA, 14 bp, Homo sapiens
agagggagaagaag

SEQ ID NO: 2944607 - DNA, 16 bp, Homo sapiens
agagggaggcaagccc

SEQ ID NO: 2944608 - DNA, 18 bp, Homo sapiens
agagggaggcaagccctg

SEQ ID NO: 2944609 - DNA, 13 bp, Homo sapiens
agagggaggggcc

SEQ ID NO: 2944610 - DNA, 14 bp, Homo sapiens
agagggaggggcct

SEQ ID NO: 2944611 - DNA, 16 bp, Homo sapiens
agagggcactctgctt

SEQ ID NO: 2944612 - DNA, 14 bp, Homo sapiens
agagggcagaggct

SEQ ID NO: 2944613 - DNA, 15 bp, Homo sapiens
agagggcctctgcct

SEQ ID NO: 2944614 - DNA, 15 bp, Homo sapiens
agagggcgctcctgt

SEQ ID NO: 2944615 - DNA, 16 bp, Homo sapiens
agagggctacaaagga

SEQ ID NO: 2944616 - DNA, 17 bp, Homo sapiens
agagggctggaggccca

SEQ ID NO: 2944617 - DNA, 18 bp, Homo sapiens
agaggggaaaagagatga

SEQ ID NO: 2944618 - DNA, 22 bp, Homo sapiens
agagggtgacaagatagagagc

SEQ ID NO: 2944619 - DNA, 20 bp, Homo sapiens
agagggttcacacagcccag

SEQ ID NO: 2944620 - DNA, 14 bp, Homo sapiens
agaggtaccctggg

SEQ ID NO: 2944621 - DNA, 15 bp, Homo sapiens
agaggtgaaaatgaa

SEQ ID NO: 2944622 - DNA, 16 bp, Homo sapiens
agaggtgaaaatgaag

SEQ ID NO: 2944623 - DNA, 21 bp, Homo sapiens
agaggtgaaaatgaagaagga

SEQ ID NO: 2944624 - DNA, 13 bp, Homo sapiens
agaggtgcttcac

SEQ ID NO: 2944625 - DNA, 22 bp, Homo sapiens
agaggtgtgcaagagagggatg

SEQ ID NO: 2944626 - DNA, 21 bp, Homo sapiens
agaggttgctaatgcctttca

SEQ ID NO: 2944627 - DNA, 20 bp, Homo sapiens
agaggttgtagtgagccaag

SEQ ID NO: 2944628 - DNA, 21 bp, Homo sapiens
agaggttgtagtgagccaaga

SEQ ID NO: 2944629 - DNA, 16 bp, Homo sapiens
agagtaagaaatttca

SEQ ID NO: 2944630 - DNA, 13 bp, Homo sapiens
agagtaagacatt

SEQ ID NO: 2944631 - DNA, 17 bp, Homo sapiens
agagtaagtattatgcc

SEQ ID NO: 2944632 - DNA, 19 bp, Homo sapiens
agagtaatgccaccagatc

SEQ ID NO: 2944633 - DNA, 21 bp, Homo sapiens
agagtacaagctcttgtttct

SEQ ID NO: 2944634 - DNA, 14 bp, Homo sapiens
agagtacactgtgt

SEQ ID NO: 2944635 - DNA, 19 bp, Homo sapiens
agagtacactgtgtctcta

SEQ ID NO: 2944636 - DNA, 13 bp, Homo sapiens
agagtacatccat

SEQ ID NO: 2944637 - DNA, 16 bp, Homo sapiens
agagtagaattgcatt

SEQ ID NO: 2944638 - DNA, 17 bp, Homo sapiens
agagtagccgagagcct

SEQ ID NO: 2944639 - DNA, 18 bp, Homo sapiens
agagtagccgagagcctg

SEQ ID NO: 2944640 - DNA, 14 bp, Homo sapiens
agagtagttatata

SEQ ID NO: 2944641 - DNA, 18 bp, Homo sapiens
agagtatattatgtattt

SEQ ID NO: 2944642 - DNA, 15 bp, Homo sapiens
agagtatctaatcct

SEQ ID NO: 2944643 - DNA, 18 bp, Homo sapiens
agagtatctaatccttta

SEQ ID NO: 2944644 - DNA, 12 bp, Homo sapiens
agagtatcttta

SEQ ID NO: 2944645 - DNA, 13 bp, Homo sapiens
agagtatctttac

SEQ ID NO: 2944646 - DNA, 15 bp, Homo sapiens
agagtcacttctaat

SEQ ID NO: 2944647 - DNA, 19 bp, Homo sapiens
agagtccaaggtttaaaga

SEQ ID NO: 2944648 - DNA, 23 bp, Homo sapiens
agagtccatcagcctccatccta

SEQ ID NO: 2944649 - DNA, 22 bp, Homo sapiens
agagtccatttcccacatcttt

SEQ ID NO: 2944650 - DNA, 12 bp, Homo sapiens
agagtcctattt

SEQ ID NO: 2944651 - DNA, 12 bp, Homo sapiens
agagtctaaaga

SEQ ID NO: 2944652 - DNA, 13 bp, Homo sapiens
agagtctaaagat

SEQ ID NO: 2944653 - DNA, 21 bp, Homo sapiens
agagtctaatagtctttgcca

SEQ ID NO: 2944654 - DNA, 21 bp, Homo sapiens
agagtctagattcaaaggttc

SEQ ID NO: 2944655 - DNA, 22 bp, Homo sapiens
agagtctagattcaaaggttct

SEQ ID NO: 2944656 - DNA, 14 bp, Homo sapiens
agagtctagattct

SEQ ID NO: 2944657 - DNA, 15 bp, Homo sapiens
agagtctagattctc

SEQ ID NO: 2944658 - DNA, 15 bp, Homo sapiens
agagtctctccagcc

SEQ ID NO: 2944659 - DNA, 17 bp, Homo sapiens
agagtctctccagcctc

SEQ ID NO: 2944660 - DNA, 19 bp, Homo sapiens
agagtctctggctcagctg

SEQ ID NO: 2944661 - DNA, 23 bp, Homo sapiens
agagtctctggctcagctgtggt

SEQ ID NO: 2944662 - DNA, 18 bp, Homo sapiens
agagtgaaatattgtaaa

SEQ ID NO: 2944663 - DNA, 20 bp, Homo sapiens
agagtgaaatattgtaaatg

SEQ ID NO: 2944664 - DNA, 22 bp, Homo sapiens
agagtgacacccaagagggctg

SEQ ID NO: 2944665 - DNA, 18 bp, Homo sapiens
agagtgagactcagtctt

SEQ ID NO: 2944666 - DNA, 20 bp, Homo sapiens
agagtgcaagaagtctggcc

SEQ ID NO: 2944667 - DNA, 13 bp, Homo sapiens
agagtgcaatggt

SEQ ID NO: 2944668 - DNA, 17 bp, Homo sapiens
agagtgctctgaccctg

SEQ ID NO: 2944669 - DNA, 18 bp, Homo sapiens
agagtgctctgaccctgg

SEQ ID NO: 2944670 - DNA, 14 bp, Homo sapiens
agagtggccacggc

SEQ ID NO: 2944671 - DNA, 18 bp, Homo sapiens
agagtggcctagagcact

SEQ ID NO: 2944672 - DNA, 18 bp, Homo sapiens
agagtgtcaaccagacag

SEQ ID NO: 2944673 - DNA, 19 bp, Homo sapiens
agagtgtgaaatagacatt

SEQ ID NO: 2944674 - DNA, 11 bp, Homo sapiens
agagtgtgacc

SEQ ID NO: 2944675 - DNA, 17 bp, Homo sapiens
agagtgtggccttcgga

SEQ ID NO: 2944676 - DNA, 19 bp, Homo sapiens
agagtgtgggaagggagag

SEQ ID NO: 2944677 - DNA, 15 bp, Homo sapiens
agagttaaaagcagc

SEQ ID NO: 2944678 - DNA, 15 bp, Homo sapiens
agagttaaaatgttt

SEQ ID NO: 2944679 - DNA, 21 bp, Homo sapiens
agagttaaaatgtttactgta

SEQ ID NO: 2944680 - DNA, 22 bp, Homo sapiens
agagttagcctggatagccttg

SEQ ID NO: 2944681 - DNA, 18 bp, Homo sapiens
agagttattcaaatgaag

SEQ ID NO: 2944682 - DNA, 16 bp, Homo sapiens
agagttcgtgaagagg

SEQ ID NO: 2944683 - DNA, 19 bp, Homo sapiens
agagttctatactgtaaag

SEQ ID NO: 2944684 - DNA, 20 bp, Homo sapiens
agagttctatactgtaaagc

SEQ ID NO: 2944685 - DNA, 13 bp, Homo sapiens
agagttctttgca

SEQ ID NO: 2944686 - DNA, 23 bp, Homo sapiens
agagttgccccgtctctgttcca

SEQ ID NO: 2944687 - DNA, 17 bp, Homo sapiens
agagttggctgtattta

SEQ ID NO: 2944688 - DNA, 16 bp, Homo sapiens
agagttggggaaggca

SEQ ID NO: 2944689 - DNA, 16 bp, Homo sapiens
agagtttagttgtagc

SEQ ID NO: 2944690 - DNA, 16 bp, Homo sapiens
agagtttatacagtgt

SEQ ID NO: 2944691 - DNA, 20 bp, Homo sapiens
agagtttggttaatcagtgt

SEQ ID NO: 2944692 - DNA, 16 bp, Homo sapiens
agagttttgtcttgaa

SEQ ID NO: 2944693 - DNA, 13 bp, Homo sapiens
agataaactcaga

SEQ ID NO: 2944694 - DNA, 13 bp, Homo sapiens
agataaaggaaac

SEQ ID NO: 2944695 - DNA, 16 bp, Homo sapiens
agataaataaaagata

SEQ ID NO: 2944696 - DNA, 14 bp, Homo sapiens
agataaataatgta

SEQ ID NO: 2944697 - DNA, 15 bp, Homo sapiens
agataacatttgtgt

SEQ ID NO: 2944698 - DNA, 14 bp, Homo sapiens
agataactgctctt

SEQ ID NO: 2944699 - DNA, 15 bp, Homo sapiens
agataactgctcttt

SEQ ID NO: 2944700 - DNA, 18 bp, Homo sapiens
agataactgctcttttac

SEQ ID NO: 2944701 - DNA, 14 bp, Homo sapiens
agataacttccttc

SEQ ID NO: 2944702 - DNA, 22 bp, Homo sapiens
agataacttccttcacatctcc

SEQ ID NO: 2944703 - DNA, 16 bp, Homo sapiens
agataatacattccga

SEQ ID NO: 2944704 - DNA, 17 bp, Homo sapiens
agataatatgagaatca

SEQ ID NO: 2944705 - DNA, 19 bp, Homo sapiens
agataatcttttacattga

SEQ ID NO: 2944706 - DNA, 13 bp, Homo sapiens
agataatgtgaaa

SEQ ID NO: 2944707 - DNA, 15 bp, Homo sapiens
agatacatacagaat

SEQ ID NO: 2944708 - DNA, 14 bp, Homo sapiens
agatacctaaaaca

SEQ ID NO: 2944709 - DNA, 16 bp, Homo sapiens
agatacgggggctgtg

SEQ ID NO: 2944710 - DNA, 18 bp, Homo sapiens
agatactattttcatttt

SEQ ID NO: 2944711 - DNA, 16 bp, Homo sapiens
agatactcaagcaggt

SEQ ID NO: 2944712 - DNA, 14 bp, Homo sapiens
agatactgctgtgt

SEQ ID NO: 2944713 - DNA, 22 bp, Homo sapiens
agatactgctgtgtaatggtta

SEQ ID NO: 2944714 - DNA, 22 bp, Homo sapiens
agatactgtgagcttacattga

SEQ ID NO: 2944715 - DNA, 20 bp, Homo sapiens
agatacttcagctttgtgta

SEQ ID NO: 2944716 - DNA, 15 bp, Homo sapiens
agatagaaagcatta

SEQ ID NO: 2944717 - DNA, 12 bp, Homo sapiens
agatagaatgac

SEQ ID NO: 2944718 - DNA, 14 bp, Homo sapiens
agatagagagctat

SEQ ID NO: 2944719 - DNA, 20 bp, Homo sapiens
agatagataggtcagtgcaa

SEQ ID NO: 2944720 - DNA, 14 bp, Homo sapiens
agatagcattgtga

SEQ ID NO: 2944721 - DNA, 17 bp, Homo sapiens
agatagcattgtgaact

SEQ ID NO: 2944722 - DNA, 19 bp, Homo sapiens
agatagccccacaggaggt

SEQ ID NO: 2944723 - DNA, 14 bp, Homo sapiens
agatagcctgtggc

SEQ ID NO: 2944724 - DNA, 17 bp, Homo sapiens
agatagcctgtggccct

SEQ ID NO: 2944725 - DNA, 22 bp, Homo sapiens
agatagctcaatactctctgag

SEQ ID NO: 2944726 - DNA, 16 bp, Homo sapiens
agataggcacatgcat

SEQ ID NO: 2944727 - DNA, 14 bp, Homo sapiens
agatagtaactgta

SEQ ID NO: 2944728 - DNA, 20 bp, Homo sapiens
agatataaatactgacaatg

SEQ ID NO: 2944729 - DNA, 18 bp, Homo sapiens
agatatatctttatactt

SEQ ID NO: 2944730 - DNA, 13 bp, Homo sapiens
agatatccatctt

SEQ ID NO: 2944731 - DNA, 14 bp, Homo sapiens
agatatccatcttt

SEQ ID NO: 2944732 - DNA, 22 bp, Homo sapiens
agatatcccagctttaaaaaga

SEQ ID NO: 2944733 - DNA, 14 bp, Homo sapiens
agatatctttttca

SEQ ID NO: 2944734 - DNA, 14 bp, Homo sapiens
agatattaaattct

SEQ ID NO: 2944735 - DNA, 21 bp, Homo sapiens
agatattaaattctcaaagtt

SEQ ID NO: 2944736 - DNA, 14 bp, Homo sapiens
agatattggacaaa

SEQ ID NO: 2944737 - DNA, 17 bp, Homo sapiens
agatattggacaaagaa

SEQ ID NO: 2944738 - DNA, 19 bp, Homo sapiens
agatattttgggcatgtgg

SEQ ID NO: 2944739 - DNA, 22 bp, Homo sapiens
agatcaacaacactacttccct

SEQ ID NO: 2944740 - DNA, 12 bp, Homo sapiens
agatcaagctgt

SEQ ID NO: 2944741 - DNA, 22 bp, Homo sapiens
agatcacgccattgtactccag

SEQ ID NO: 2944742 - DNA, 23 bp, Homo sapiens
agatcacgccattgtactccagc

SEQ ID NO: 2944743 - DNA, 13 bp, Homo sapiens
agatcactcctgg

SEQ ID NO: 2944744 - DNA, 17 bp, Homo sapiens
agatcactcctggaggc

SEQ ID NO: 2944745 - DNA, 13 bp, Homo sapiens
agatcacttttta

SEQ ID NO: 2944746 - DNA, 22 bp, Homo sapiens
agatcagatgctccaagattct

SEQ ID NO: 2944747 - DNA, 21 bp, Homo sapiens
agatcatccagaagttcctca

SEQ ID NO: 2944748 - DNA, 14 bp, Homo sapiens
agatcatccgtctg

SEQ ID NO: 2944749 - DNA, 21 bp, Homo sapiens
agatcatccgtctgtgtgggg

SEQ ID NO: 2944750 - DNA, 16 bp, Homo sapiens
agatcattcagtgttt

SEQ ID NO: 2944751 - DNA, 16 bp, Homo sapiens
agatcatttgttctgg

SEQ ID NO: 2944752 - DNA, 20 bp, Homo sapiens
agatccaaggccgcggccca

SEQ ID NO: 2944753 - DNA, 14 bp, Homo sapiens
agatccagcctggg

SEQ ID NO: 2944754 - DNA, 13 bp, Homo sapiens
agatccaggacta

SEQ ID NO: 2944755 - DNA, 15 bp, Homo sapiens
agatccaggcttctc

SEQ ID NO: 2944756 - DNA, 20 bp, Homo sapiens
agatccaggcttctcccgga

SEQ ID NO: 2944757 - DNA, 12 bp, Homo sapiens
agatcctcttct

SEQ ID NO: 2944758 - DNA, 17 bp, Homo sapiens
agatcctcttctcaaag

SEQ ID NO: 2944759 - DNA, 21 bp, Homo sapiens
agatcctgatcttaagaggct

SEQ ID NO: 2944760 - DNA, 22 bp, Homo sapiens
agatcctgatcttaagaggctg

SEQ ID NO: 2944761 - DNA, 15 bp, Homo sapiens
agatccttccttttg

SEQ ID NO: 2944762 - DNA, 14 bp, Homo sapiens
agatccttgtttca

SEQ ID NO: 2944763 - DNA, 15 bp, Homo sapiens
agatccttgtttcaa

SEQ ID NO: 2944764 - DNA, 13 bp, Homo sapiens
agatcgcatggca

SEQ ID NO: 2944765 - DNA, 11 bp, Homo sapiens
agatctacatg

SEQ ID NO: 2944766 - DNA, 20 bp, Homo sapiens
agatctacctgcaacacaac

SEQ ID NO: 2944767 - DNA, 23 bp, Homo sapiens
agatctctttctctttaatggaa

SEQ ID NO: 2944768 - DNA, 20 bp, Homo sapiens
agatctgcctcccctgtgga

SEQ ID NO: 2944769 - DNA, 12 bp, Homo sapiens
agatctgctttc

SEQ ID NO: 2944770 - DNA, 15 bp, Homo sapiens
agatctggaacctca

SEQ ID NO: 2944771 - DNA, 20 bp, Homo sapiens
agatctggaacctcagcctg

SEQ ID NO: 2944772 - DNA, 15 bp, Homo sapiens
agatctggtgtccag

SEQ ID NO: 2944773 - DNA, 18 bp, Homo sapiens
agatctgtaatttttatt

SEQ ID NO: 2944774 - DNA, 19 bp, Homo sapiens
agatctgtcctcagccttg

SEQ ID NO: 2944775 - DNA, 14 bp, Homo sapiens
agatctgttttgaa

SEQ ID NO: 2944776 - DNA, 13 bp, Homo sapiens
agatctttatatt

SEQ ID NO: 2944777 - DNA, 22 bp, Homo sapiens
agatctttccaaagacaatgtg

SEQ ID NO: 2944778 - DNA, 18 bp, Homo sapiens
agatctttgcttccttgc

SEQ ID NO: 2944779 - DNA, 15 bp, Homo sapiens
agatgaaaggagaca

SEQ ID NO: 2944780 - DNA, 21 bp, Homo sapiens
agatgacattgctaagatgct

SEQ ID NO: 2944781 - DNA, 20 bp, Homo sapiens
agatgaccataaccactgaa

SEQ ID NO: 2944782 - DNA, 11 bp, Homo sapiens
agatgacccct

SEQ ID NO: 2944783 - DNA, 15 bp, Homo sapiens
agatgacccctaccc

SEQ ID NO: 2944784 - DNA, 19 bp, Homo sapiens
agatgacccctaccccctc

SEQ ID NO: 2944785 - DNA, 23 bp, Homo sapiens
agatgacccctaccccctcatcc

SEQ ID NO: 2944786 - DNA, 15 bp, Homo sapiens
agatgacctcattaa

SEQ ID NO: 2944787 - DNA, 20 bp, Homo sapiens
agatgactatgcagaggcct

SEQ ID NO: 2944788 - DNA, 17 bp, Homo sapiens
agatgactttgcagatg

SEQ ID NO: 2944789 - DNA, 20 bp, Homo sapiens
agatgagttatctaagaata

SEQ ID NO: 2944790 - DNA, 22 bp, Homo sapiens
agatgagttatctaagaataca

SEQ ID NO: 2944791 - DNA, 20 bp, Homo sapiens
agatgataaaaggaatctgg

SEQ ID NO: 2944792 - DNA, 14 bp, Homo sapiens
agatgatcaacata

SEQ ID NO: 2944793 - DNA, 22 bp, Homo sapiens
agatgatcagtggacagtctgc

SEQ ID NO: 2944794 - DNA, 18 bp, Homo sapiens
agatgatgaaaatattta

SEQ ID NO: 2944795 - DNA, 15 bp, Homo sapiens
agatgatgctcagtt

SEQ ID NO: 2944796 - DNA, 18 bp, Homo sapiens
agatgatgctcagtttta

SEQ ID NO: 2944797 - DNA, 21 bp, Homo sapiens
agatgatgctcagttttaaac

SEQ ID NO: 2944798 - DNA, 18 bp, Homo sapiens
agatgatgctttggaaga

SEQ ID NO: 2944799 - DNA, 16 bp, Homo sapiens
agatgatggatgccaa

SEQ ID NO: 2944800 - DNA, 12 bp, Homo sapiens
agatgatgtatt

SEQ ID NO: 2944801 - DNA, 14 bp, Homo sapiens
agatgattaaaatg

SEQ ID NO: 2944802 - DNA, 18 bp, Homo sapiens
agatgattaaataagatt

SEQ ID NO: 2944803 - DNA, 21 bp, Homo sapiens
agatgattaaataagattcta

SEQ ID NO: 2944804 - DNA, 14 bp, Homo sapiens
agatgatttgcaat

SEQ ID NO: 2944805 - DNA, 12 bp, Homo sapiens
agatgatttgta

SEQ ID NO: 2944806 - DNA, 18 bp, Homo sapiens
agatgatttgtacttgga

SEQ ID NO: 2944807 - DNA, 19 bp, Homo sapiens
agatgcaatgtgctactga

SEQ ID NO: 2944808 - DNA, 12 bp, Homo sapiens
agatgcagctgg

SEQ ID NO: 2944809 - DNA, 19 bp, Homo sapiens
agatgcaggtttgaccagg

SEQ ID NO: 2944810 - DNA, 21 bp, Homo sapiens
agatgcatgatccagctgtgt

SEQ ID NO: 2944811 - DNA, 15 bp, Homo sapiens
agatgcccaaatcct

SEQ ID NO: 2944812 - DNA, 16 bp, Homo sapiens
agatgcctccaccgct

SEQ ID NO: 2944813 - DNA, 17 bp, Homo sapiens
agatgcctccaccgctg

SEQ ID NO: 2944814 - DNA, 23 bp, Homo sapiens
agatgcgcagccccatctgtgca

SEQ ID NO: 2944815 - DNA, 15 bp, Homo sapiens
agatgcggggacagg

SEQ ID NO: 2944816 - DNA, 23 bp, Homo sapiens
agatgcgtcccaagatgttgatt

SEQ ID NO: 2944817 - DNA, 18 bp, Homo sapiens
agatgctccaagattcta

SEQ ID NO: 2944818 - DNA, 20 bp, Homo sapiens
agatgctccaagattctaga

SEQ ID NO: 2944819 - DNA, 21 bp, Homo sapiens
agatgctccaagattctagat

SEQ ID NO: 2944820 - DNA, 22 bp, Homo sapiens
agatgctccaagattctagatg

SEQ ID NO: 2944821 - DNA, 19 bp, Homo sapiens
agatgctccagcaacacag

SEQ ID NO: 2944822 - DNA, 15 bp, Homo sapiens
agatgctccttgggc

SEQ ID NO: 2944823 - DNA, 19 bp, Homo sapiens
agatgctgatgttcagtgt

SEQ ID NO: 2944824 - DNA, 21 bp, Homo sapiens
agatgctgatgttcagtgtaa

SEQ ID NO: 2944825 - DNA, 22 bp, Homo sapiens
agatgctggcccagggcccaga

SEQ ID NO: 2944826 - DNA, 15 bp, Homo sapiens
agatgcttggagcaa

SEQ ID NO: 2944827 - DNA, 19 bp, Homo sapiens
agatgctttcctaaatcag

SEQ ID NO: 2944828 - DNA, 11 bp, Homo sapiens
agatgctttta

SEQ ID NO: 2944829 - DNA, 20 bp, Homo sapiens
agatgcttttaacagagtct

SEQ ID NO: 2944830 - DNA, 13 bp, Homo sapiens
agatggaaagagg

SEQ ID NO: 2944831 - DNA, 22 bp, Homo sapiens
agatggaaagaggtgaaaatga

SEQ ID NO: 2944832 - DNA, 23 bp, Homo sapiens
agatggaaagaggtgaaaatgaa

SEQ ID NO: 2944833 - DNA, 18 bp, Homo sapiens
agatggaaccgcaggaag

SEQ ID NO: 2944834 - DNA, 17 bp, Homo sapiens
agatggacagtttgttt

SEQ ID NO: 2944835 - DNA, 18 bp, Homo sapiens
agatggacagtttgtttc

SEQ ID NO: 2944836 - DNA, 15 bp, Homo sapiens
agatggacgcaggcc

SEQ ID NO: 2944837 - DNA, 19 bp, Homo sapiens
agatggacgcaggccctgt

SEQ ID NO: 2944838 - DNA, 21 bp, Homo sapiens
agatggacgtcgaggaccggg

SEQ ID NO: 2944839 - DNA, 17 bp, Homo sapiens
agatggagttcttgtgc

SEQ ID NO: 2944840 - DNA, 17 bp, Homo sapiens
agatggagtttctaagg

SEQ ID NO: 2944841 - DNA, 19 bp, Homo sapiens
agatggataaactgagcct

SEQ ID NO: 2944842 - DNA, 18 bp, Homo sapiens
agatggattctccactca

SEQ ID NO: 2944843 - DNA, 23 bp, Homo sapiens
agatggattctccactcagttgc

SEQ ID NO: 2944844 - DNA, 21 bp, Homo sapiens
agatggcagggctgaggatgg

SEQ ID NO: 2944845 - DNA, 19 bp, Homo sapiens
agatggcatcctgtgaagt

SEQ ID NO: 2944846 - DNA, 22 bp, Homo sapiens
agatggctgactttgctctttc

SEQ ID NO: 2944847 - DNA, 17 bp, Homo sapiens
agatgggaatgaagctt

SEQ ID NO: 2944848 - DNA, 13 bp, Homo sapiens
agatgggaggaga

SEQ ID NO: 2944849 - DNA, 11 bp, Homo sapiens
agatggtttcc

SEQ ID NO: 2944850 - DNA, 17 bp, Homo sapiens
agatggtttccacattt

SEQ ID NO: 2944851 - DNA, 12 bp, Homo sapiens
agatgtaaatcg

SEQ ID NO: 2944852 - DNA, 13 bp, Homo sapiens
agatgtaatgtag

SEQ ID NO: 2944853 - DNA, 23 bp, Homo sapiens
agatgtcatttagttcagcatcc

SEQ ID NO: 2944854 - DNA, 14 bp, Homo sapiens
agatgtgaaaactc

SEQ ID NO: 2944855 - DNA, 18 bp, Homo sapiens
agatgtgatattctaaga

SEQ ID NO: 2944856 - DNA, 19 bp, Homo sapiens
agatgtgatattctaagac

SEQ ID NO: 2944857 - DNA, 22 bp, Homo sapiens
agatgtgcagcagattggaagg

SEQ ID NO: 2944858 - DNA, 17 bp, Homo sapiens
agatgtggaaaagccaa

SEQ ID NO: 2944859 - DNA, 13 bp, Homo sapiens
agatgtggagcca

SEQ ID NO: 2944860 - DNA, 15 bp, Homo sapiens
agatgtggagccagg

SEQ ID NO: 2944861 - DNA, 16 bp, Homo sapiens
agatgtggagccaggc

SEQ ID NO: 2944862 - DNA, 14 bp, Homo sapiens
agatgttatttttg

SEQ ID NO: 2944863 - DNA, 20 bp, Homo sapiens
agatgttctaagtctttcca

SEQ ID NO: 2944864 - DNA, 15 bp, Homo sapiens
agatgttgaattctt

SEQ ID NO: 2944865 - DNA, 23 bp, Homo sapiens
agatgttgaattcttttgccaag

SEQ ID NO: 2944866 - DNA, 23 bp, Homo sapiens
agatgttgatttttactgtgttt

SEQ ID NO: 2944867 - DNA, 15 bp, Homo sapiens
agatgtttatatcaa

SEQ ID NO: 2944868 - DNA, 19 bp, Homo sapiens
agatgtttatatcaaatga

SEQ ID NO: 2944869 - DNA, 17 bp, Homo sapiens
agatgtttattaataga

SEQ ID NO: 2944870 - DNA, 14 bp, Homo sapiens
agatgtttccagac

SEQ ID NO: 2944871 - DNA, 14 bp, Homo sapiens
agatgtttgacttt

SEQ ID NO: 2944872 - DNA, 15 bp, Homo sapiens
agattaaaaattata

SEQ ID NO: 2944873 - DNA, 16 bp, Homo sapiens
agattaagagccatat

SEQ ID NO: 2944874 - DNA, 20 bp, Homo sapiens
agattagcccttccttgcca

SEQ ID NO: 2944875 - DNA, 19 bp, Homo sapiens
agattaggaagtcacagat

SEQ ID NO: 2944876 - DNA, 13 bp, Homo sapiens
agattagtgattc

SEQ ID NO: 2944877 - DNA, 15 bp, Homo sapiens
agattatagattcta

SEQ ID NO: 2944878 - DNA, 21 bp, Homo sapiens
agattatagattctaaagatt

SEQ ID NO: 2944879 - DNA, 18 bp, Homo sapiens
agattatatcaaagtatt

SEQ ID NO: 2944880 - DNA, 16 bp, Homo sapiens
agattatttcattcgt

SEQ ID NO: 2944881 - DNA, 14 bp, Homo sapiens
agattcaaaggttc

SEQ ID NO: 2944882 - DNA, 16 bp, Homo sapiens
agattcaggggaaggg

SEQ ID NO: 2944883 - DNA, 17 bp, Homo sapiens
agattcaggggaagggc

SEQ ID NO: 2944884 - DNA, 21 bp, Homo sapiens
agattcaggggaagggcaggc

SEQ ID NO: 2944885 - DNA, 12 bp, Homo sapiens
agattcccagag

SEQ ID NO: 2944886 - DNA, 14 bp, Homo sapiens
agattcccaggcca

SEQ ID NO: 2944887 - DNA, 22 bp, Homo sapiens
agattcccaggccagggctggg

SEQ ID NO: 2944888 - DNA, 23 bp, Homo sapiens
agattcccaggccagggctgggt

SEQ ID NO: 2944889 - DNA, 24 bp, Homo sapiens
agattccggatcctaagcatctaa

SEQ ID NO: 2944890 - DNA, 18 bp, Homo sapiens
agattcctgtaaatgtga

SEQ ID NO: 2944891 - DNA, 18 bp, Homo sapiens
agattcgctgtcccctca

SEQ ID NO: 2944892 - DNA, 20 bp, Homo sapiens
agattcgctgtcccctcagc

SEQ ID NO: 2944893 - DNA, 12 bp, Homo sapiens
agattctaacgg

SEQ ID NO: 2944894 - DNA, 14 bp, Homo sapiens
agattctagatgat

SEQ ID NO: 2944895 - DNA, 23 bp, Homo sapiens
agattctctgtgtctaagattct

SEQ ID NO: 2944896 - DNA, 11 bp, Homo sapiens
agattctgaag

SEQ ID NO: 2944897 - DNA, 14 bp, Homo sapiens
agattctgattcag

SEQ ID NO: 2944898 - DNA, 24 bp, Homo sapiens
agattctgatttgccactgatatt

SEQ ID NO: 2944899 - DNA, 20 bp, Homo sapiens
agattgaaaacttttctcag

SEQ ID NO: 2944900 - DNA, 16 bp, Homo sapiens
agattgcagttctgat

SEQ ID NO: 2944901 - DNA, 22 bp, Homo sapiens
agattgcatgtgactctgaagc

SEQ ID NO: 2944902 - DNA, 13 bp, Homo sapiens
agattgctaattg

SEQ ID NO: 2944903 - DNA, 16 bp, Homo sapiens
agattgctaattgctg

SEQ ID NO: 2944904 - DNA, 22 bp, Homo sapiens
agattgctggaaaccaagtcag

SEQ ID NO: 2944905 - DNA, 23 bp, Homo sapiens
agattgctggaaaccaagtcagg

SEQ ID NO: 2944906 - DNA, 20 bp, Homo sapiens
agattggaaggagacacaga

SEQ ID NO: 2944907 - DNA, 11 bp, Homo sapiens
agattgtaaac

SEQ ID NO: 2944908 - DNA, 22 bp, Homo sapiens
agattgtaaaccgctttggcct

SEQ ID NO: 2944909 - DNA, 15 bp, Homo sapiens
agattgtatctctta

SEQ ID NO: 2944910 - DNA, 22 bp, Homo sapiens
agattgttgtttgccatacttt

SEQ ID NO: 2944911 - DNA, 23 bp, Homo sapiens
agattgttgtttgccatactttg

SEQ ID NO: 2944912 - DNA, 17 bp, Homo sapiens
agatttatcaaatcagt

SEQ ID NO: 2944913 - DNA, 20 bp, Homo sapiens
agatttatttgtttgatttt

SEQ ID NO: 2944914 - DNA, 16 bp, Homo sapiens
agatttatttttaata

SEQ ID NO: 2944915 - DNA, 18 bp, Homo sapiens
agatttatttttaatatg

SEQ ID NO: 2944916 - DNA, 20 bp, Homo sapiens
agatttcagtaatgtcttca

SEQ ID NO: 2944917 - DNA, 16 bp, Homo sapiens
agatttctaaataaaa

SEQ ID NO: 2944918 - DNA, 13 bp, Homo sapiens
agatttctagaaa

SEQ ID NO: 2944919 - DNA, 22 bp, Homo sapiens
agatttctagaaaagcttccta

SEQ ID NO: 2944920 - DNA, 15 bp, Homo sapiens
agatttcttaaatct

SEQ ID NO: 2944921 - DNA, 19 bp, Homo sapiens
agatttcttaaatctttct

SEQ ID NO: 2944922 - DNA, 20 bp, Homo sapiens
agatttcttaaatctttctt

SEQ ID NO: 2944923 - DNA, 13 bp, Homo sapiens
agatttgacctcc

SEQ ID NO: 2944924 - DNA, 19 bp, Homo sapiens
agatttgacctcctccctg

SEQ ID NO: 2944925 - DNA, 15 bp, Homo sapiens
agattttattgtata

SEQ ID NO: 2944926 - DNA, 16 bp, Homo sapiens
agattttctggttcta

SEQ ID NO: 2944927 - DNA, 17 bp, Homo sapiens
agattttctggttctaa

SEQ ID NO: 2944928 - DNA, 14 bp, Homo sapiens
agattttttaaaaa

SEQ ID NO: 2944929 - DNA, 16 bp, Homo sapiens
agattttttaaaaaaa

SEQ ID NO: 2944930 - DNA, 19 bp, Homo sapiens
agcaaaaaaaacccatgtg

SEQ ID NO: 2944931 - DNA, 15 bp, Homo sapiens
agcaaaaatgctaat

SEQ ID NO: 2944932 - DNA, 16 bp, Homo sapiens
agcaaaaatgctaata

SEQ ID NO: 2944933 - DNA, 21 bp, Homo sapiens
agcaaaaatgctaatattaaa

SEQ ID NO: 2944934 - DNA, 16 bp, Homo sapiens
agcaaaaatgtaaaaa

SEQ ID NO: 2944935 - DNA, 17 bp, Homo sapiens
agcaaaaatgtaaaaaa

SEQ ID NO: 2944936 - DNA, 13 bp, Homo sapiens
agcaaaactttta

SEQ ID NO: 2944937 - DNA, 15 bp, Homo sapiens
agcaaaatccaaact

SEQ ID NO: 2944938 - DNA, 21 bp, Homo sapiens
agcaaaatccaaactgctgtc

SEQ ID NO: 2944939 - DNA, 19 bp, Homo sapiens
agcaaaatccttacttcca

SEQ ID NO: 2944940 - DNA, 22 bp, Homo sapiens
agcaaaatccttacttccagca

SEQ ID NO: 2944941 - DNA, 15 bp, Homo sapiens
agcaaaatctttttt

SEQ ID NO: 2944942 - DNA, 16 bp, Homo sapiens
agcaaacacaataaga

SEQ ID NO: 2944943 - DNA, 23 bp, Homo sapiens
agcaaacagggtggcccaggtgg

SEQ ID NO: 2944944 - DNA, 17 bp, Homo sapiens
agcaaaccaagagattg

SEQ ID NO: 2944945 - DNA, 19 bp, Homo sapiens
agcaaaccaagagattgct

SEQ ID NO: 2944946 - DNA, 15 bp, Homo sapiens
agcaaacccagacgg

SEQ ID NO: 2944947 - DNA, 19 bp, Homo sapiens
agcaaactaacttgacttt

SEQ ID NO: 2944948 - DNA, 15 bp, Homo sapiens
agcaaactctgctgt

SEQ ID NO: 2944949 - DNA, 13 bp, Homo sapiens
agcaaagaagctt

SEQ ID NO: 2944950 - DNA, 17 bp, Homo sapiens
agcaaagatatatattc

SEQ ID NO: 2944951 - DNA, 11 bp, Homo sapiens
agcaaagcatc

SEQ ID NO: 2944952 - DNA, 21 bp, Homo sapiens
agcaaaggagacaaagcagga

SEQ ID NO: 2944953 - DNA, 22 bp, Homo sapiens
agcaaaggagacaaagcaggag

SEQ ID NO: 2944954 - DNA, 18 bp, Homo sapiens
agcaaagtcacttctcca

SEQ ID NO: 2944955 - DNA, 15 bp, Homo sapiens
agcaaatagcaaatg

SEQ ID NO: 2944956 - DNA, 18 bp, Homo sapiens
agcaaatcaccacaaact

SEQ ID NO: 2944957 - DNA, 21 bp, Homo sapiens
agcaaatgcattctatcgtta

SEQ ID NO: 2944958 - DNA, 17 bp, Homo sapiens
agcaaatgttatgcata

SEQ ID NO: 2944959 - DNA, 14 bp, Homo sapiens
agcaaattccagat

SEQ ID NO: 2944960 - DNA, 16 bp, Homo sapiens
agcaaattccagattt

SEQ ID NO: 2944961 - DNA, 15 bp, Homo sapiens
agcaacacagcctgg

SEQ ID NO: 2944962 - DNA, 21 bp, Homo sapiens
agcaacacagcctgggcccca

SEQ ID NO: 2944963 - DNA, 21 bp, Homo sapiens
agcaacatctagcaaatgtta

SEQ ID NO: 2944964 - DNA, 22 bp, Homo sapiens
agcaacattttacccacacaca

SEQ ID NO: 2944965 - DNA, 20 bp, Homo sapiens
agcaacgtagcttctaccat

SEQ ID NO: 2944966 - DNA, 15 bp, Homo sapiens
agcaacgtgttaatt

SEQ ID NO: 2944967 - DNA, 19 bp, Homo sapiens
agcaactcattggtggtag

SEQ ID NO: 2944968 - DNA, 14 bp, Homo sapiens
agcaactcttgatt

SEQ ID NO: 2944969 - DNA, 14 bp, Homo sapiens
agcaacttgcttct

SEQ ID NO: 2944970 - DNA, 18 bp, Homo sapiens
agcaagaaaaaaaaatgc

SEQ ID NO: 2944971 - DNA, 18 bp, Homo sapiens
agcaagaaggcaacttga

SEQ ID NO: 2944972 - DNA, 18 bp, Homo sapiens
agcaagaagggagttcca

SEQ ID NO: 2944973 - DNA, 15 bp, Homo sapiens
agcaagacagctctt

SEQ ID NO: 2944974 - DNA, 11 bp, Homo sapiens
agcaagctgtg

SEQ ID NO: 2944975 - DNA, 14 bp, Homo sapiens
agcaagctgtgtta

SEQ ID NO: 2944976 - DNA, 16 bp, Homo sapiens
agcaagggcgcctcac

SEQ ID NO: 2944977 - DNA, 20 bp, Homo sapiens
agcaagggttccctcaagag

SEQ ID NO: 2944978 - DNA, 18 bp, Homo sapiens
agcaaggtttcgtggcag

SEQ ID NO: 2944979 - DNA, 20 bp, Homo sapiens
agcaaggtttcgtggcagca

SEQ ID NO: 2944980 - DNA, 13 bp, Homo sapiens
agcaagtcccaga

SEQ ID NO: 2944981 - DNA, 14 bp, Homo sapiens
agcaagtgaatttt

SEQ ID NO: 2944982 - DNA, 23 bp, Homo sapiens
agcaagtgagtctggtggaggag

SEQ ID NO: 2944983 - DNA, 16 bp, Homo sapiens
agcaataaagaagagt

SEQ ID NO: 2944984 - DNA, 19 bp, Homo sapiens
agcaatacgtttgtgcaga

SEQ ID NO: 2944985 - DNA, 22 bp, Homo sapiens
agcaatacgtttgtgcagaatc

SEQ ID NO: 2944986 - DNA, 12 bp, Homo sapiens
agcaatagaaac

SEQ ID NO: 2944987 - DNA, 16 bp, Homo sapiens
agcaatcacaggaaaa

SEQ ID NO: 2944988 - DNA, 13 bp, Homo sapiens
agcaatcagcaaa

SEQ ID NO: 2944989 - DNA, 17 bp, Homo sapiens
agcaatcagcaaacaca

SEQ ID NO: 2944990 - DNA, 23 bp, Homo sapiens
agcaatcagcaaacacaataaga

SEQ ID NO: 2944991 - DNA, 13 bp, Homo sapiens
agcaatcctccta

SEQ ID NO: 2944992 - DNA, 22 bp, Homo sapiens
agcaatcctcctacctcagcct

SEQ ID NO: 2944993 - DNA, 22 bp, Homo sapiens
agcaatgctgatgaatcactgt

SEQ ID NO: 2944994 - DNA, 15 bp, Homo sapiens
agcaatgctgttgga

SEQ ID NO: 2944995 - DNA, 23 bp, Homo sapiens
agcaatgggtcttagctctttct

SEQ ID NO: 2944996 - DNA, 11 bp, Homo sapiens
agcaatgtgtt

SEQ ID NO: 2944997 - DNA, 22 bp, Homo sapiens
agcaattgcgaccttaatttaa

SEQ ID NO: 2944998 - DNA, 21 bp, Homo sapiens
agcacaaaatggattttagtc

SEQ ID NO: 2944999 - DNA, 14 bp, Homo sapiens
agcacaaacacaag

SEQ ID NO: 2945000 - DNA, 13 bp, Homo sapiens
agcacaatctgtt

SEQ ID NO: 2945001 - DNA, 17 bp, Homo sapiens
agcacaatttaaaacaa

SEQ ID NO: 2945002 - DNA, 14 bp, Homo sapiens
agcacacagggcag

SEQ ID NO: 2945003 - DNA, 20 bp, Homo sapiens
agcacactcatcccctcact

SEQ ID NO: 2945004 - DNA, 23 bp, Homo sapiens
agcacactgtgaaaatgtatttg

SEQ ID NO: 2945005 - DNA, 15 bp, Homo sapiens
agcacagcagcctgg

SEQ ID NO: 2945006 - DNA, 13 bp, Homo sapiens
agcacagccaaca

SEQ ID NO: 2945007 - DNA, 22 bp, Homo sapiens
agcacagcccctgctgtgtggg

SEQ ID NO: 2945008 - DNA, 17 bp, Homo sapiens
agcacagctcctcccct

SEQ ID NO: 2945009 - DNA, 18 bp, Homo sapiens
agcacagctcctcccctg

SEQ ID NO: 2945010 - DNA, 15 bp, Homo sapiens
agcacagtggtggca

SEQ ID NO: 2945011 - DNA, 18 bp, Homo sapiens
agcacagtggtggcaggg

SEQ ID NO: 2945012 - DNA, 19 bp, Homo sapiens
agcacagtggtggcagggc

SEQ ID NO: 2945013 - DNA, 20 bp, Homo sapiens
agcacagtggtggcagggcc

SEQ ID NO: 2945014 - DNA, 12 bp, Homo sapiens
agcacagtttgt

SEQ ID NO: 2945015 - DNA, 13 bp, Homo sapiens
agcacatactacc

SEQ ID NO: 2945016 - DNA, 18 bp, Homo sapiens
agcacatactacctagaa

SEQ ID NO: 2945017 - DNA, 19 bp, Homo sapiens
agcacatactacctagaag

SEQ ID NO: 2945018 - DNA, 22 bp, Homo sapiens
agcacatactacctagaagtaa

SEQ ID NO: 2945019 - DNA, 13 bp, Homo sapiens
agcacatcacctc

SEQ ID NO: 2945020 - DNA, 18 bp, Homo sapiens
agcacatcacctctttgc

SEQ ID NO: 2945021 - DNA, 16 bp, Homo sapiens
agcaccaccaggtctc

SEQ ID NO: 2945022 - DNA, 19 bp, Homo sapiens
agcaccatccgccagggcc

SEQ ID NO: 2945023 - DNA, 11 bp, Homo sapiens
agcacccactg

SEQ ID NO: 2945024 - DNA, 16 bp, Homo sapiens
agcaccgtgccaaccc

SEQ ID NO: 2945025 - DNA, 23 bp, Homo sapiens
agcaccgtgccaaccccacccag

SEQ ID NO: 2945026 - DNA, 15 bp, Homo sapiens
agcaccgttctgtgc

SEQ ID NO: 2945027 - DNA, 17 bp, Homo sapiens
agcaccgttctgtgcac

SEQ ID NO: 2945028 - DNA, 16 bp, Homo sapiens
agcacctcagcctgca

SEQ ID NO: 2945029 - DNA, 20 bp, Homo sapiens
agcacctgccagaggatgct

SEQ ID NO: 2945030 - DNA, 15 bp, Homo sapiens
agcacctgccgacct

SEQ ID NO: 2945031 - DNA, 21 bp, Homo sapiens
agcacctgccgacctcgtcct

SEQ ID NO: 2945032 - DNA, 18 bp, Homo sapiens
agcacctggaccccctgc

SEQ ID NO: 2945033 - DNA, 20 bp, Homo sapiens
agcacctggaccccctgccc

SEQ ID NO: 2945034 - DNA, 16 bp, Homo sapiens
agcaccttggcccagg

SEQ ID NO: 2945035 - DNA, 17 bp, Homo sapiens
agcaccttggcccagga

SEQ ID NO: 2945036 - DNA, 15 bp, Homo sapiens
agcaccttgtgcctg

SEQ ID NO: 2945037 - DNA, 16 bp, Homo sapiens
agcaccttgtgcctgg

SEQ ID NO: 2945038 - DNA, 17 bp, Homo sapiens
agcaccttgtgcctggg

SEQ ID NO: 2945039 - DNA, 16 bp, Homo sapiens
agcacggcccggcccc

SEQ ID NO: 2945040 - DNA, 22 bp, Homo sapiens
agcacggcccggcccctcaccc

SEQ ID NO: 2945041 - DNA, 23 bp, Homo sapiens
agcacggcccggcccctcaccct

SEQ ID NO: 2945042 - DNA, 18 bp, Homo sapiens
agcactcaggctctccat

SEQ ID NO: 2945043 - DNA, 19 bp, Homo sapiens
agcactcaggctctccatt

SEQ ID NO: 2945044 - DNA, 13 bp, Homo sapiens
agcactgccagga

SEQ ID NO: 2945045 - DNA, 17 bp, Homo sapiens
agcactgggaagctgga

SEQ ID NO: 2945046 - DNA, 20 bp, Homo sapiens
agcactgggatcacaggtgt

SEQ ID NO: 2945047 - DNA, 16 bp, Homo sapiens
agcacttaaacagaag

SEQ ID NO: 2945048 - DNA, 23 bp, Homo sapiens
agcacttcccaggatctgctcca

SEQ ID NO: 2945049 - DNA, 11 bp, Homo sapiens
agcactttgat

SEQ ID NO: 2945050 - DNA, 19 bp, Homo sapiens
agcactttgggaggcaggg

SEQ ID NO: 2945051 - DNA, 18 bp, Homo sapiens
agcactttgggaggccaa

SEQ ID NO: 2945052 - DNA, 13 bp, Homo sapiens
agcactttttcct

SEQ ID NO: 2945053 - DNA, 20 bp, Homo sapiens
agcactttttccttctgaaa

SEQ ID NO: 2945054 - DNA, 23 bp, Homo sapiens
agcagaaaaaggctgtgctgccc

SEQ ID NO: 2945055 - DNA, 22 bp, Homo sapiens
agcagaaagtgcctttatctca

SEQ ID NO: 2945056 - DNA, 16 bp, Homo sapiens
agcagaacagccattt

SEQ ID NO: 2945057 - DNA, 17 bp, Homo sapiens
agcagaacagccatttt

SEQ ID NO: 2945058 - DNA, 16 bp, Homo sapiens
agcagaaccttaaaca

SEQ ID NO: 2945059 - DNA, 20 bp, Homo sapiens
agcagaagactatttaccag

SEQ ID NO: 2945060 - DNA, 20 bp, Homo sapiens
agcagaagccagagggtggg

SEQ ID NO: 2945061 - DNA, 18 bp, Homo sapiens
agcagaattttaatgtga

SEQ ID NO: 2945062 - DNA, 14 bp, Homo sapiens
agcagacaggcctg

SEQ ID NO: 2945063 - DNA, 22 bp, Homo sapiens
agcagacgatagttatctgttc

SEQ ID NO: 2945064 - DNA, 16 bp, Homo sapiens
agcagactcagctctg

SEQ ID NO: 2945065 - DNA, 20 bp, Homo sapiens
agcagactcagctctgacat

SEQ ID NO: 2945066 - DNA, 18 bp, Homo sapiens
agcagactgatcaggacc

SEQ ID NO: 2945067 - DNA, 19 bp, Homo sapiens
agcagagaggtggccaccg

SEQ ID NO: 2945068 - DNA, 19 bp, Homo sapiens
agcagagcaaaatgctctt

SEQ ID NO: 2945069 - DNA, 15 bp, Homo sapiens
agcagaggaggggcc

SEQ ID NO: 2945070 - DNA, 16 bp, Homo sapiens
agcagagttctttgca

SEQ ID NO: 2945071 - DNA, 15 bp, Homo sapiens
agcagattggaagga

SEQ ID NO: 2945072 - DNA, 18 bp, Homo sapiens
agcagattggaaggagac

SEQ ID NO: 2945073 - DNA, 22 bp, Homo sapiens
agcagattggaaggagacacag

SEQ ID NO: 2945074 - DNA, 21 bp, Homo sapiens
agcagattttcctaaggccac

SEQ ID NO: 2945075 - DNA, 22 bp, Homo sapiens
agcagattttcctaaggccact

SEQ ID NO: 2945076 - DNA, 23 bp, Homo sapiens
agcagattttcctaaggccactg

SEQ ID NO: 2945077 - DNA, 12 bp, Homo sapiens
agcagcaaatag

SEQ ID NO: 2945078 - DNA, 20 bp, Homo sapiens
agcagcaaattttcagcatt

SEQ ID NO: 2945079 - DNA, 13 bp, Homo sapiens
agcagcaacagcc

SEQ ID NO: 2945080 - DNA, 21 bp, Homo sapiens
agcagcaagaaaaaaaaatgc

SEQ ID NO: 2945081 - DNA, 15 bp, Homo sapiens
agcagcagagagccc

SEQ ID NO: 2945082 - DNA, 11 bp, Homo sapiens
agcagcccagc

SEQ ID NO: 2945083 - DNA, 23 bp, Homo sapiens
agcagccctcctcaccccgtctg

SEQ ID NO: 2945084 - DNA, 17 bp, Homo sapiens
agcagcctcgcacaggc

SEQ ID NO: 2945085 - DNA, 13 bp, Homo sapiens
agcagcctgccag

SEQ ID NO: 2945086 - DNA, 15 bp, Homo sapiens
agcagcctgccagca

SEQ ID NO: 2945087 - DNA, 13 bp, Homo sapiens
agcagcctgtgag

SEQ ID NO: 2945088 - DNA, 16 bp, Homo sapiens
agcagcgcgcaggcct

SEQ ID NO: 2945089 - DNA, 23 bp, Homo sapiens
agcagcggctctggtcctcggag

SEQ ID NO: 2945090 - DNA, 16 bp, Homo sapiens
agcagctaactccgag

SEQ ID NO: 2945091 - DNA, 19 bp, Homo sapiens
agcagctaactccgagagc

SEQ ID NO: 2945092 - DNA, 15 bp, Homo sapiens
agcagctcaaaggca

SEQ ID NO: 2945093 - DNA, 23 bp, Homo sapiens
agcagctcacaccctaccttccc

SEQ ID NO: 2945094 - DNA, 14 bp, Homo sapiens
agcagctctcccct

SEQ ID NO: 2945095 - DNA, 12 bp, Homo sapiens
agcagctctgcc

SEQ ID NO: 2945096 - DNA, 14 bp, Homo sapiens
agcagctctgcctt

SEQ ID NO: 2945097 - DNA, 18 bp, Homo sapiens
agcagcttagactaaggc

SEQ ID NO: 2945098 - DNA, 18 bp, Homo sapiens
agcagcttcggtgtgcag

SEQ ID NO: 2945099 - DNA, 15 bp, Homo sapiens
agcaggaaatgaaaa

SEQ ID NO: 2945100 - DNA, 21 bp, Homo sapiens
agcaggaaatgaaaatgtctt

SEQ ID NO: 2945101 - DNA, 23 bp, Homo sapiens
agcaggactccaggcccaaggct

SEQ ID NO: 2945102 - DNA, 14 bp, Homo sapiens
agcaggaggccagg

SEQ ID NO: 2945103 - DNA, 20 bp, Homo sapiens
agcaggatgaccacgcacct

SEQ ID NO: 2945104 - DNA, 21 bp, Homo sapiens
agcaggcgctgtgctatcatg

SEQ ID NO: 2945105 - DNA, 18 bp, Homo sapiens
agccacagcccaggcctc

SEQ ID NO: 2945106 - DNA, 12 bp, Homo sapiens
agccacagcctg

SEQ ID NO: 2945107 - DNA, 16 bp, Homo sapiens
agccacagcctgtctt

SEQ ID NO: 2945108 - DNA, 19 bp, Homo sapiens
agccacaggaacggccctg

SEQ ID NO: 2945109 - DNA, 20 bp, Homo sapiens
agccacaggaacggccctgc

SEQ ID NO: 2945110 - DNA, 14 bp, Homo sapiens
agccacaggagccc

SEQ ID NO: 2945111 - DNA, 12 bp, Homo sapiens
agccacaggcca

SEQ ID NO: 2945112 - DNA, 22 bp, Homo sapiens
agccacagtgagggagatccca

SEQ ID NO: 2945113 - DNA, 15 bp, Homo sapiens
agccacatttacata

SEQ ID NO: 2945114 - DNA, 20 bp, Homo sapiens
agccacatttggaatacttt

SEQ ID NO: 2945115 - DNA, 21 bp, Homo sapiens
agccacatttggaatactttt

SEQ ID NO: 2945116 - DNA, 22 bp, Homo sapiens
agccacatttggaatacttttt

SEQ ID NO: 2945117 - DNA, 23 bp, Homo sapiens
agccacatttggaatactttttg

SEQ ID NO: 2945118 - DNA, 14 bp, Homo sapiens
agccacccctgcca

SEQ ID NO: 2945119 - DNA, 17 bp, Homo sapiens
agccacccctgccactc

SEQ ID NO: 2945120 - DNA, 17 bp, Homo sapiens
agccaccctcccagctc

SEQ ID NO: 2945121 - DNA, 18 bp, Homo sapiens
agccaccctcccagctct

SEQ ID NO: 2945122 - DNA, 13 bp, Homo sapiens
agccaccgcagct

SEQ ID NO: 2945123 - DNA, 14 bp, Homo sapiens
agccaccgcagctg

SEQ ID NO: 2945124 - DNA, 15 bp, Homo sapiens
agccaccgcagctgc

SEQ ID NO: 2945125 - DNA, 17 bp, Homo sapiens
agccaccgcagctgctg

SEQ ID NO: 2945126 - DNA, 20 bp, Homo sapiens
agccaccgcagctgctgcca

SEQ ID NO: 2945127 - DNA, 22 bp, Homo sapiens
agccaccgcagctgctgccact

SEQ ID NO: 2945128 - DNA, 16 bp, Homo sapiens
agccaccttcccaccc

SEQ ID NO: 2945129 - DNA, 18 bp, Homo sapiens
agccacgttccttactgc

SEQ ID NO: 2945130 - DNA, 20 bp, Homo sapiens
agccacgttccttactgcag

SEQ ID NO: 2945131 - DNA, 22 bp, Homo sapiens
agccacgttccttactgcagaa

SEQ ID NO: 2945132 - DNA, 14 bp, Homo sapiens
agccactccaagcc

SEQ ID NO: 2945133 - DNA, 22 bp, Homo sapiens
agccactccaagccccctggca

SEQ ID NO: 2945134 - DNA, 22 bp, Homo sapiens
agccactcctctgactcagggc

SEQ ID NO: 2945135 - DNA, 15 bp, Homo sapiens
agccactgagcaatg

SEQ ID NO: 2945136 - DNA, 16 bp, Homo sapiens
agccactggaaggagc

SEQ ID NO: 2945137 - DNA, 17 bp, Homo sapiens
agccactgtgcttggcc

SEQ ID NO: 2945138 - DNA, 18 bp, Homo sapiens
agccactgtgcttggcca

SEQ ID NO: 2945139 - DNA, 20 bp, Homo sapiens
agccagaacgtggctctgct

SEQ ID NO: 2945140 - DNA, 21 bp, Homo sapiens
agccagaacgtggctctgctg

SEQ ID NO: 2945141 - DNA, 14 bp, Homo sapiens
agccagaagctgag

SEQ ID NO: 2945142 - DNA, 23 bp, Homo sapiens
agccagacgccatttaaaagtct

SEQ ID NO: 2945143 - DNA, 18 bp, Homo sapiens
agccagagaagtgacagg

SEQ ID NO: 2945144 - DNA, 17 bp, Homo sapiens
agccagagggtgggagg

SEQ ID NO: 2945145 - DNA, 22 bp, Homo sapiens
agccagatggactccagcctgc

SEQ ID NO: 2945146 - DNA, 19 bp, Homo sapiens
agccagattggccaattaa

SEQ ID NO: 2945147 - DNA, 22 bp, Homo sapiens
agccagattttttaaaatttat

SEQ ID NO: 2945148 - DNA, 13 bp, Homo sapiens
agccagcacacag

SEQ ID NO: 2945149 - DNA, 21 bp, Homo sapiens
agccagcaccgccggctttca

SEQ ID NO: 2945150 - DNA, 15 bp, Homo sapiens
agccagcacttgtat

SEQ ID NO: 2945151 - DNA, 11 bp, Homo sapiens
agccagccacc

SEQ ID NO: 2945152 - DNA, 13 bp, Homo sapiens
agccagccacccc

SEQ ID NO: 2945153 - DNA, 16 bp, Homo sapiens
agccagccacccctgc

SEQ ID NO: 2945154 - DNA, 21 bp, Homo sapiens
agccagccacccctgccactc

SEQ ID NO: 2945155 - DNA, 14 bp, Homo sapiens
agccagcccagccc

SEQ ID NO: 2945156 - DNA, 16 bp, Homo sapiens
agccagcccagcccag

SEQ ID NO: 2945157 - DNA, 13 bp, Homo sapiens
agccagccctccc

SEQ ID NO: 2945158 - DNA, 15 bp, Homo sapiens
agccagccctccctg

SEQ ID NO: 2945159 - DNA, 18 bp, Homo sapiens
agccagccctccctgtcc

SEQ ID NO: 2945160 - DNA, 23 bp, Homo sapiens
agccagccctccctgtcctcctc

SEQ ID NO: 2945161 - DNA, 14 bp, Homo sapiens
agccagcggctcca

SEQ ID NO: 2945162 - DNA, 19 bp, Homo sapiens
agccagcgtcctcctctgt

SEQ ID NO: 2945163 - DNA, 21 bp, Homo sapiens
agccagcgtcctcctctgtga

SEQ ID NO: 2945164 - DNA, 23 bp, Homo sapiens
agccagcgtcctcctctgtgacc

SEQ ID NO: 2945165 - DNA, 11 bp, Homo sapiens
agccagctgcc

SEQ ID NO: 2945166 - DNA, 16 bp, Homo sapiens
agccagctgctcccca

SEQ ID NO: 2945167 - DNA, 19 bp, Homo sapiens
agccaggaatttcccagga

SEQ ID NO: 2945168 - DNA, 22 bp, Homo sapiens
agccaggaatttcccaggaccc

SEQ ID NO: 2945169 - DNA, 23 bp, Homo sapiens
agccaggaatttcccaggaccct

SEQ ID NO: 2945170 - DNA, 20 bp, Homo sapiens
agccaggagacctgctctcc

SEQ ID NO: 2945171 - DNA, 14 bp, Homo sapiens
agccaggagctgtc

SEQ ID NO: 2945172 - DNA, 17 bp, Homo sapiens
agccaggagctgtcacc

SEQ ID NO: 2945173 - DNA, 13 bp, Homo sapiens
agccaggagggac

SEQ ID NO: 2945174 - DNA, 14 bp, Homo sapiens
agccaggccccagg

SEQ ID NO: 2945175 - DNA, 20 bp, Homo sapiens
agccaggcctcgcctgccct

SEQ ID NO: 2945176 - DNA, 14 bp, Homo sapiens
agccaggctgggcc

SEQ ID NO: 2945177 - DNA, 23 bp, Homo sapiens
agccaggctgggccgcaagggcc

SEQ ID NO: 2945178 - DNA, 18 bp, Homo sapiens
agccaggcttggatggaa

SEQ ID NO: 2945179 - DNA, 16 bp, Homo sapiens
agccaggtccccctgc

SEQ ID NO: 2945180 - DNA, 19 bp, Homo sapiens
agccaggtccccctgcagc

SEQ ID NO: 2945181 - DNA, 23 bp, Homo sapiens
agccagtcattgtaacctcgtgt

SEQ ID NO: 2945182 - DNA, 14 bp, Homo sapiens
agccagtgaaacac

SEQ ID NO: 2945183 - DNA, 19 bp, Homo sapiens
agccagtgacctgaggaag

SEQ ID NO: 2945184 - DNA, 21 bp, Homo sapiens
agccagtgacctgaggaagcg

SEQ ID NO: 2945185 - DNA, 17 bp, Homo sapiens
agccagttaaggaaaga

SEQ ID NO: 2945186 - DNA, 18 bp, Homo sapiens
agccagttaaggaaagaa

SEQ ID NO: 2945187 - DNA, 23 bp, Homo sapiens
agccagttgcttcttcagctgac

SEQ ID NO: 2945188 - DNA, 14 bp, Homo sapiens
agccagttgtccta

SEQ ID NO: 2945189 - DNA, 16 bp, Homo sapiens
agccataggtgcagtt

SEQ ID NO: 2945190 - DNA, 22 bp, Homo sapiens
agccatatcatgctaaaattct

SEQ ID NO: 2945191 - DNA, 16 bp, Homo sapiens
agccatatggacactg

SEQ ID NO: 2945192 - DNA, 17 bp, Homo sapiens
agccatatggacactgt

SEQ ID NO: 2945193 - DNA, 14 bp, Homo sapiens
agccatcaaaatgc

SEQ ID NO: 2945194 - DNA, 16 bp, Homo sapiens
agccatcaagcacttc

SEQ ID NO: 2945195 - DNA, 21 bp, Homo sapiens
agccatcttcccgcctcagcc

SEQ ID NO: 2945196 - DNA, 14 bp, Homo sapiens
agccatcttggcag

SEQ ID NO: 2945197 - DNA, 16 bp, Homo sapiens
agccatcttggcaggg

SEQ ID NO: 2945198 - DNA, 15 bp, Homo sapiens
agccatcttggtaaa

SEQ ID NO: 2945199 - DNA, 21 bp, Homo sapiens
agccatgagatgatacatcca

SEQ ID NO: 2945200 - DNA, 15 bp, Homo sapiens
agccatgatttccca

SEQ ID NO: 2945201 - DNA, 21 bp, Homo sapiens
agccatgatttcccactgcac

SEQ ID NO: 2945202 - DNA, 21 bp, Homo sapiens
agccatgcgcgcgctctctct

SEQ ID NO: 2945203 - DNA, 22 bp, Homo sapiens
agccatgcgcgcgctctctctc

SEQ ID NO: 2945204 - DNA, 16 bp, Homo sapiens
agccatggaaggtgcc

SEQ ID NO: 2945205 - DNA, 19 bp, Homo sapiens
agccatggaaggtgccaga

SEQ ID NO: 2945206 - DNA, 20 bp, Homo sapiens
agccatggaaggtgccagaa

SEQ ID NO: 2945207 - DNA, 22 bp, Homo sapiens
agccatggaaggtgccagaagg

SEQ ID NO: 2945208 - DNA, 21 bp, Homo sapiens
agccatggagtgagacccagg

SEQ ID NO: 2945209 - DNA, 22 bp, Homo sapiens
agccatgggcacaaagggccca

SEQ ID NO: 2945210 - DNA, 13 bp, Homo sapiens
agccatgtacaga

SEQ ID NO: 2945211 - DNA, 16 bp, Homo sapiens
agccattgcacccagc

SEQ ID NO: 2945212 - DNA, 12 bp, Homo sapiens
agccattgtctt

SEQ ID NO: 2945213 - DNA, 13 bp, Homo sapiens
agccatttttaga

SEQ ID NO: 2945214 - DNA, 19 bp, Homo sapiens
agcccaaaccttgggccct

SEQ ID NO: 2945215 - DNA, 20 bp, Homo sapiens
agcccaaaccttgggccctg

SEQ ID NO: 2945216 - DNA, 15 bp, Homo sapiens
agcccaacagcactt

SEQ ID NO: 2945217 - DNA, 21 bp, Homo sapiens
agcccaccaggagcacctgga

SEQ ID NO: 2945218 - DNA, 18 bp, Homo sapiens
agcccacccccctcccca

SEQ ID NO: 2945219 - DNA, 22 bp, Homo sapiens
agcccacccccctccccaactc

SEQ ID NO: 2945220 - DNA, 14 bp, Homo sapiens
agcccaccctgctg

SEQ ID NO: 2945221 - DNA, 14 bp, Homo sapiens
agcccacctgaaag

SEQ ID NO: 2945222 - DNA, 16 bp, Homo sapiens
agcccacctgggctgg

SEQ ID NO: 2945223 - DNA, 17 bp, Homo sapiens
agcccacctgggctggg

SEQ ID NO: 2945224 - DNA, 13 bp, Homo sapiens
agcccactctgct

SEQ ID NO: 2945225 - DNA, 15 bp, Homo sapiens
agcccactctgctcg

SEQ ID NO: 2945226 - DNA, 14 bp, Homo sapiens
agcccactgcctcc

SEQ ID NO: 2945227 - DNA, 18 bp, Homo sapiens
agcccactgcctcctccc

SEQ ID NO: 2945228 - DNA, 22 bp, Homo sapiens
agcccactgcctcctccctggc

SEQ ID NO: 2945229 - DNA, 15 bp, Homo sapiens
agcccactgtcctgg

SEQ ID NO: 2945230 - DNA, 18 bp, Homo sapiens
agcccactgtcctgggcc

SEQ ID NO: 2945231 - DNA, 19 bp, Homo sapiens
agcccactgtcctgggcct

SEQ ID NO: 2945232 - DNA, 21 bp, Homo sapiens
agcccagatacgggggctgtg

SEQ ID NO: 2945233 - DNA, 15 bp, Homo sapiens
agcccagcccaggag

SEQ ID NO: 2945234 - DNA, 18 bp, Homo sapiens
agcccagcggcccaagag

SEQ ID NO: 2945235 - DNA, 11 bp, Homo sapiens
agcccagctct

SEQ ID NO: 2945236 - DNA, 13 bp, Homo sapiens
agcccagctctgg

SEQ ID NO: 2945237 - DNA, 22 bp, Homo sapiens
caatactcataatgtgaagtgt

SEQ ID NO: 2945238 - DNA, 13 bp, Homo sapiens
caatactctctga

SEQ ID NO: 2945239 - DNA, 23 bp, Homo sapiens
caatagaaggatgtacatttcca

SEQ ID NO: 2945240 - DNA, 19 bp, Homo sapiens
caatagatatttacctttt

SEQ ID NO: 2945241 - DNA, 21 bp, Homo sapiens
caatagctccaagctgttaaa

SEQ ID NO: 2945242 - DNA, 22 bp, Homo sapiens
caatagctccaagctgttaaag

SEQ ID NO: 2945243 - DNA, 16 bp, Homo sapiens
caatagtcattaaaaa

SEQ ID NO: 2945244 - DNA, 19 bp, Homo sapiens
caatagtcattaaaaacat

SEQ ID NO: 2945245 - DNA, 22 bp, Homo sapiens
caatagttcaaggaacttgaaa

SEQ ID NO: 2945246 - DNA, 18 bp, Homo sapiens
caatagttttagattatt

SEQ ID NO: 2945247 - DNA, 20 bp, Homo sapiens
caatagttttagattatttt

SEQ ID NO: 2945248 - DNA, 23 bp, Homo sapiens
caatataaaaggcaaatgtgtac

SEQ ID NO: 2945249 - DNA, 21 bp, Homo sapiens
caatataatctttgaatttct

SEQ ID NO: 2945250 - DNA, 20 bp, Homo sapiens
caatatagaaaaataaaaat

SEQ ID NO: 2945251 - DNA, 12 bp, Homo sapiens
caatatagcaag

SEQ ID NO: 2945252 - DNA, 22 bp, Homo sapiens
caatatagttttctaactcctg

SEQ ID NO: 2945253 - DNA, 22 bp, Homo sapiens
caatatatctaaattgaataat

SEQ ID NO: 2945254 - DNA, 19 bp, Homo sapiens
caatatcctcgctcccggg

SEQ ID NO: 2945255 - DNA, 13 bp, Homo sapiens
caatatcctttgc

SEQ ID NO: 2945256 - DNA, 15 bp, Homo sapiens
caatatcctttgcct

SEQ ID NO: 2945257 - DNA, 22 bp, Homo sapiens
caatatgaagttactttcttaa

SEQ ID NO: 2945258 - DNA, 23 bp, Homo sapiens
caatatgaagttactttcttaat

SEQ ID NO: 2945259 - DNA, 14 bp, Homo sapiens
caatatgtatatat

SEQ ID NO: 2945260 - DNA, 23 bp, Homo sapiens
caatatgtatatatgtatttcta

SEQ ID NO: 2945261 - DNA, 20 bp, Homo sapiens
caatatgtgagtgccttttg

SEQ ID NO: 2945262 - DNA, 14 bp, Homo sapiens
caatattaaatctg

SEQ ID NO: 2945263 - DNA, 19 bp, Homo sapiens
caatattaccttaagattt

SEQ ID NO: 2945264 - DNA, 17 bp, Homo sapiens
caatattgactttgtct

SEQ ID NO: 2945265 - DNA, 14 bp, Homo sapiens
caatattgtttcta

SEQ ID NO: 2945266 - DNA, 14 bp, Homo sapiens
caatcaacactacc

SEQ ID NO: 2945267 - DNA, 16 bp, Homo sapiens
caatcacagctcactg

SEQ ID NO: 2945268 - DNA, 22 bp, Homo sapiens
caatcacgggcggtcctgcaca

SEQ ID NO: 2945269 - DNA, 16 bp, Homo sapiens
caatcagctccttcct

SEQ ID NO: 2945270 - DNA, 16 bp, Homo sapiens
caatccaaatgcattc

SEQ ID NO: 2945271 - DNA, 22 bp, Homo sapiens
caatccaggtacgcacagacag

SEQ ID NO: 2945272 - DNA, 23 bp, Homo sapiens
caatccaggtacgcacagacagg

SEQ ID NO: 2945273 - DNA, 14 bp, Homo sapiens
caatccatcagcaa

SEQ ID NO: 2945274 - DNA, 19 bp, Homo sapiens
caatccatttggcagaact

SEQ ID NO: 2945275 - DNA, 21 bp, Homo sapiens
caatccatttggcagaactgc

SEQ ID NO: 2945276 - DNA, 12 bp, Homo sapiens
caatcccagcta

SEQ ID NO: 2945277 - DNA, 17 bp, Homo sapiens
caatcccagctacctca

SEQ ID NO: 2945278 - DNA, 21 bp, Homo sapiens
caatcccctcattcaggaaaa

SEQ ID NO: 2945279 - DNA, 20 bp, Homo sapiens
caatccctttattaccccct

SEQ ID NO: 2945280 - DNA, 14 bp, Homo sapiens
caatcctccccgct

SEQ ID NO: 2945281 - DNA, 19 bp, Homo sapiens
caatcctccccgctctgcc

SEQ ID NO: 2945282 - DNA, 24 bp, Homo sapiens
caatcctcctacctcagcctcctg

SEQ ID NO: 2945283 - DNA, 19 bp, Homo sapiens
caatctcgtttagtgccaa

SEQ ID NO: 2945284 - DNA, 17 bp, Homo sapiens
caatctgacattctcag

SEQ ID NO: 2945285 - DNA, 16 bp, Homo sapiens
caatctggacacttct

SEQ ID NO: 2945286 - DNA, 19 bp, Homo sapiens
caatctggacacttcttta

SEQ ID NO: 2945287 - DNA, 13 bp, Homo sapiens
caatctgttctac

SEQ ID NO: 2945288 - DNA, 23 bp, Homo sapiens
caatctgttctactcttaatgat

SEQ ID NO: 2945289 - DNA, 18 bp, Homo sapiens
caatcttaagcagagata

SEQ ID NO: 2945290 - DNA, 15 bp, Homo sapiens
caatgaaatgcttgt

SEQ ID NO: 2945291 - DNA, 14 bp, Homo sapiens
caatgacacagtct

SEQ ID NO: 2945292 - DNA, 19 bp, Homo sapiens
caatgacacagtcttggct

SEQ ID NO: 2945293 - DNA, 21 bp, Homo sapiens
caatgacacagtcttggctca

SEQ ID NO: 2945294 - DNA, 13 bp, Homo sapiens
caatgactaagcc

SEQ ID NO: 2945295 - DNA, 19 bp, Homo sapiens
caatgactgtggagttcca

SEQ ID NO: 2945296 - DNA, 20 bp, Homo sapiens
caatgatagtaagaaaagtg

SEQ ID NO: 2945297 - DNA, 19 bp, Homo sapiens
caatgatcctgtattcaga

SEQ ID NO: 2945298 - DNA, 13 bp, Homo sapiens
caatgattaatca

SEQ ID NO: 2945299 - DNA, 18 bp, Homo sapiens
caatgattaatcagctgt

SEQ ID NO: 2945300 - DNA, 14 bp, Homo sapiens
caatgattccagac

SEQ ID NO: 2945301 - DNA, 14 bp, Homo sapiens
caatgcattctgga

SEQ ID NO: 2945302 - DNA, 14 bp, Homo sapiens
caatgccatcatct

SEQ ID NO: 2945303 - DNA, 14 bp, Homo sapiens
caatgccattgtgc

SEQ ID NO: 2945304 - DNA, 16 bp, Homo sapiens
caatgccattgtgcag

SEQ ID NO: 2945305 - DNA, 12 bp, Homo sapiens
caatgcctcagt

SEQ ID NO: 2945306 - DNA, 22 bp, Homo sapiens
caatgcgtggcacatctaaatt

SEQ ID NO: 2945307 - DNA, 19 bp, Homo sapiens
caatggatcagccaaggcc

SEQ ID NO: 2945308 - DNA, 13 bp, Homo sapiens
caatggatttgat

SEQ ID NO: 2945309 - DNA, 23 bp, Homo sapiens
caatggccttttgctacgtgcct

SEQ ID NO: 2945310 - DNA, 20 bp, Homo sapiens
caatgggatgtatgaataca

SEQ ID NO: 2945311 - DNA, 21 bp, Homo sapiens
caatgggatgtatgaatacag

SEQ ID NO: 2945312 - DNA, 21 bp, Homo sapiens
caatggtgttatttgaaactt

SEQ ID NO: 2945313 - DNA, 15 bp, Homo sapiens
caatggtgtttttct

SEQ ID NO: 2945314 - DNA, 16 bp, Homo sapiens
caatggtttttaaatt

SEQ ID NO: 2945315 - DNA, 21 bp, Homo sapiens
caatggtttttaaattttgta

SEQ ID NO: 2945316 - DNA, 15 bp, Homo sapiens
caatgtatttattta

SEQ ID NO: 2945317 - DNA, 23 bp, Homo sapiens
caatgtatttatttaaaagattc

SEQ ID NO: 2945318 - DNA, 14 bp, Homo sapiens
caatgtcagcatca

SEQ ID NO: 2945319 - DNA, 21 bp, Homo sapiens
caatgtcttgatgcatgcact

SEQ ID NO: 2945320 - DNA, 23 bp, Homo sapiens
caatgtcttgatgcatgcactgt

SEQ ID NO: 2945321 - DNA, 19 bp, Homo sapiens
caatgtgaatcagacccta

SEQ ID NO: 2945322 - DNA, 13 bp, Homo sapiens
caatgtgattttg

SEQ ID NO: 2945323 - DNA, 19 bp, Homo sapiens
caatgttactatctgcttt

SEQ ID NO: 2945324 - DNA, 22 bp, Homo sapiens
caatgttagcctcaatttctga

SEQ ID NO: 2945325 - DNA, 22 bp, Homo sapiens
caatgttctttatatacaataa

SEQ ID NO: 2945326 - DNA, 14 bp, Homo sapiens
caatgttgtagtgt

SEQ ID NO: 2945327 - DNA, 13 bp, Homo sapiens
caatgttgtgtgt

SEQ ID NO: 2945328 - DNA, 19 bp, Homo sapiens
caatgttgtgtgttgcact

SEQ ID NO: 2945329 - DNA, 16 bp, Homo sapiens
caatgtttcttttatc

SEQ ID NO: 2945330 - DNA, 20 bp, Homo sapiens
caatgtttttgtgtagagtg

SEQ ID NO: 2945331 - DNA, 16 bp, Homo sapiens
caattaaaaacgaaaa

SEQ ID NO: 2945332 - DNA, 21 bp, Homo sapiens
caattaaaaacgaaaacctga

SEQ ID NO: 2945333 - DNA, 14 bp, Homo sapiens
caattaaaaataaa

SEQ ID NO: 2945334 - DNA, 17 bp, Homo sapiens
caattaagtgttgaaaa

SEQ ID NO: 2945335 - DNA, 19 bp, Homo sapiens
caattaattgctattgtgt

SEQ ID NO: 2945336 - DNA, 17 bp, Homo sapiens
caattacggtgtacagt

SEQ ID NO: 2945337 - DNA, 21 bp, Homo sapiens
caattacggtgtacagtttaa

SEQ ID NO: 2945338 - DNA, 15 bp, Homo sapiens
caattagacttgaaa

SEQ ID NO: 2945339 - DNA, 21 bp, Homo sapiens
caattataagaggatatgaac

SEQ ID NO: 2945340 - DNA, 23 bp, Homo sapiens
caattatatcagtcctctttcaa

SEQ ID NO: 2945341 - DNA, 13 bp, Homo sapiens
caattattgtata

SEQ ID NO: 2945342 - DNA, 20 bp, Homo sapiens
caattatttaaagaaagtga

SEQ ID NO: 2945343 - DNA, 15 bp, Homo sapiens
caattcaaaagttcc

SEQ ID NO: 2945344 - DNA, 14 bp, Homo sapiens
caattcagacaggc

SEQ ID NO: 2945345 - DNA, 23 bp, Homo sapiens
caattcagacaggcaaataaaag

SEQ ID NO: 2945346 - DNA, 14 bp, Homo sapiens
caattcagtctgct

SEQ ID NO: 2945347 - DNA, 16 bp, Homo sapiens
caattcagtctgctct

SEQ ID NO: 2945348 - DNA, 23 bp, Homo sapiens
caattcataactaatgaattgaa

SEQ ID NO: 2945349 - DNA, 14 bp, Homo sapiens
caattcatgaactt

SEQ ID NO: 2945350 - DNA, 13 bp, Homo sapiens
caattccactctg

SEQ ID NO: 2945351 - DNA, 21 bp, Homo sapiens
caattccactctgatagaatt

SEQ ID NO: 2945352 - DNA, 24 bp, Homo sapiens
caattcccgggcccttcagtccct

SEQ ID NO: 2945353 - DNA, 20 bp, Homo sapiens
caattccgtagccagctgct

SEQ ID NO: 2945354 - DNA, 21 bp, Homo sapiens
caattccgtagccagctgctc

SEQ ID NO: 2945355 - DNA, 15 bp, Homo sapiens
caattcctcatcctc

SEQ ID NO: 2945356 - DNA, 23 bp, Homo sapiens
caattcctcatcctcagatgctc

SEQ ID NO: 2945357 - DNA, 14 bp, Homo sapiens
caattcctggccct

SEQ ID NO: 2945358 - DNA, 15 bp, Homo sapiens
caattctcctgcctt

SEQ ID NO: 2945359 - DNA, 16 bp, Homo sapiens
caattctcctgccttt

SEQ ID NO: 2945360 - DNA, 17 bp, Homo sapiens
caattctcctgcctttg

SEQ ID NO: 2945361 - DNA, 20 bp, Homo sapiens
caattctcctgcctttgcct

SEQ ID NO: 2945362 - DNA, 15 bp, Homo sapiens
caattcttgccaaat

SEQ ID NO: 2945363 - DNA, 16 bp, Homo sapiens
caattctttatacaac

SEQ ID NO: 2945364 - DNA, 20 bp, Homo sapiens
caattgaaggatcatctgaa

SEQ ID NO: 2945365 - DNA, 18 bp, Homo sapiens
caattgcgaccttaattt

SEQ ID NO: 2945366 - DNA, 23 bp, Homo sapiens
caattgcgaccttaatttaactt

SEQ ID NO: 2945367 - DNA, 16 bp, Homo sapiens
caattgctcccatcag

SEQ ID NO: 2945368 - DNA, 15 bp, Homo sapiens
caattggttgtatat

SEQ ID NO: 2945369 - DNA, 16 bp, Homo sapiens
caattggttgtatata

SEQ ID NO: 2945370 - DNA, 11 bp, Homo sapiens
caattgtggat

SEQ ID NO: 2945371 - DNA, 14 bp, Homo sapiens
caattgttgacagt

SEQ ID NO: 2945372 - DNA, 22 bp, Homo sapiens
cacaatacctacaataaactgg

SEQ ID NO: 2945373 - DNA, 22 bp, Homo sapiens
cacaatgttctttatatacaat

SEQ ID NO: 2945374 - DNA, 21 bp, Homo sapiens
cacaattaaatgacttagaaa

SEQ ID NO: 2945375 - DNA, 15 bp, Homo sapiens
cacaatttctttaaa

SEQ ID NO: 2945376 - DNA, 21 bp, Homo sapiens
cacaatttctttaaaaaagaa

SEQ ID NO: 2945377 - DNA, 22 bp, Homo sapiens
cacaatttctttaaaaaagaaa

SEQ ID NO: 2945378 - DNA, 11 bp, Homo sapiens
cacacaaaaag

SEQ ID NO: 2945379 - DNA, 18 bp, Homo sapiens
cacacaaaaaggagcggg

SEQ ID NO: 2945380 - DNA, 16 bp, Homo sapiens
cacacaagggaaggac

SEQ ID NO: 2945381 - DNA, 21 bp, Homo sapiens
cacacaagtaagagactcagc

SEQ ID NO: 2945382 - DNA, 15 bp, Homo sapiens
cacacacaacagcca

SEQ ID NO: 2945383 - DNA, 10 bp, Homo sapiens
cacacacaca

SEQ ID NO: 2945384 - DNA, 11 bp, Homo sapiens
cacacacacaa

SEQ ID NO: 2945385 - DNA, 12 bp, Homo sapiens
cacacacacaca

SEQ ID NO: 2945386 - DNA, 15 bp, Homo sapiens
cacacacacacacac

SEQ ID NO: 2945387 - DNA, 13 bp, Homo sapiens
cacacacacacag

SEQ ID NO: 2945388 - DNA, 16 bp, Homo sapiens
cacacacacacagcca

SEQ ID NO: 2945389 - DNA, 14 bp, Homo sapiens
cacacacacacgca

SEQ ID NO: 2945390 - DNA, 13 bp, Homo sapiens
cacacacactcct

SEQ ID NO: 2945391 - DNA, 14 bp, Homo sapiens
cacacacactcctt

SEQ ID NO: 2945392 - DNA, 13 bp, Homo sapiens
cacacacagaaaa

SEQ ID NO: 2945393 - DNA, 15 bp, Homo sapiens
cacacacagaaaata

SEQ ID NO: 2945394 - DNA, 19 bp, Homo sapiens
cacacacagaaaatatact

SEQ ID NO: 2945395 - DNA, 13 bp, Homo sapiens
cacacacagccac

SEQ ID NO: 2945396 - DNA, 14 bp, Homo sapiens
cacacacagccaca

SEQ ID NO: 2945397 - DNA, 12 bp, Homo sapiens
cacacacaggtg

SEQ ID NO: 2945398 - DNA, 17 bp, Homo sapiens
cacacacatgcatacac

SEQ ID NO: 2945399 - DNA, 16 bp, Homo sapiens
cacacaccagtttaca

SEQ ID NO: 2945400 - DNA, 15 bp, Homo sapiens
cacacagaaaatata

SEQ ID NO: 2945401 - DNA, 19 bp, Homo sapiens
cacacagagctcacctgtt

SEQ ID NO: 2945402 - DNA, 20 bp, Homo sapiens
cacacagccacacacacaga

SEQ ID NO: 2945403 - DNA, 22 bp, Homo sapiens
cacacagccacacacacagaaa

SEQ ID NO: 2945404 - DNA, 18 bp, Homo sapiens
cacacagctactctcccc

SEQ ID NO: 2945405 - DNA, 20 bp, Homo sapiens
cacacagggtggtggcacat

SEQ ID NO: 2945406 - DNA, 17 bp, Homo sapiens
cacacatcaccaggtgc

SEQ ID NO: 2945407 - DNA, 13 bp, Homo sapiens
cacacatcccagc

SEQ ID NO: 2945408 - DNA, 18 bp, Homo sapiens
cacacatcgttgccgcag

SEQ ID NO: 2945409 - DNA, 20 bp, Homo sapiens
cacacatctgggtgccctga

SEQ ID NO: 2945410 - DNA, 17 bp, Homo sapiens
cacacatgcatacacac

SEQ ID NO: 2945411 - DNA, 19 bp, Homo sapiens
cacacatgcatacacacac

SEQ ID NO: 2945412 - DNA, 19 bp, Homo sapiens
cacacatgcttttcttcct

SEQ ID NO: 2945413 - DNA, 19 bp, Homo sapiens
cacacatgtcctatccaaa

SEQ ID NO: 2945414 - DNA, 16 bp, Homo sapiens
cacaccacatctaagc

SEQ ID NO: 2945415 - DNA, 16 bp, Homo sapiens
cacaccacgcccagct

SEQ ID NO: 2945416 - DNA, 15 bp, Homo sapiens
cacaccagcctcctg

SEQ ID NO: 2945417 - DNA, 14 bp, Homo sapiens
cacaccaggataga

SEQ ID NO: 2945418 - DNA, 14 bp, Homo sapiens
cacacccaaagctg

SEQ ID NO: 2945419 - DNA, 15 bp, Homo sapiens
cacacccaaagctga

SEQ ID NO: 2945420 - DNA, 19 bp, Homo sapiens
cacacccaaagctgagcct

SEQ ID NO: 2945421 - DNA, 14 bp, Homo sapiens
cacacccactcagc

SEQ ID NO: 2945422 - DNA, 18 bp, Homo sapiens
cacaccctaccttcccca

SEQ ID NO: 2945423 - DNA, 12 bp, Homo sapiens
cacaccctgcct

SEQ ID NO: 2945424 - DNA, 13 bp, Homo sapiens
cacaccctgcctg

SEQ ID NO: 2945425 - DNA, 20 bp, Homo sapiens
cacaccctgcctgctgtgga

SEQ ID NO: 2945426 - DNA, 16 bp, Homo sapiens
cacacctaagggacat

SEQ ID NO: 2945427 - DNA, 15 bp, Homo sapiens
cacacctctggctgt

SEQ ID NO: 2945428 - DNA, 12 bp, Homo sapiens
cacacctgcagt

SEQ ID NO: 2945429 - DNA, 12 bp, Homo sapiens
cacacctgcctg

SEQ ID NO: 2945430 - DNA, 13 bp, Homo sapiens
cacacctggccag

SEQ ID NO: 2945431 - DNA, 12 bp, Homo sapiens
cacacctggtct

SEQ ID NO: 2945432 - DNA, 17 bp, Homo sapiens
cacacctgtaatcccag

SEQ ID NO: 2945433 - DNA, 21 bp, Homo sapiens
cacacgcacatatacacacac

SEQ ID NO: 2945434 - DNA, 16 bp, Homo sapiens
cacacgcaggcggcca

SEQ ID NO: 2945435 - DNA, 17 bp, Homo sapiens
cacacgcaggcggccag

SEQ ID NO: 2945436 - DNA, 19 bp, Homo sapiens
cacacggctggtcactctg

SEQ ID NO: 2945437 - DNA, 21 bp, Homo sapiens
cacacggctggtcactctgcc

SEQ ID NO: 2945438 - DNA, 20 bp, Homo sapiens
cacacgtaatgaaacttgga

SEQ ID NO: 2945439 - DNA, 20 bp, Homo sapiens
cacacgtttaatcccagcac

SEQ ID NO: 2945440 - DNA, 19 bp, Homo sapiens
cacagcaccgtgccaaccc

SEQ ID NO: 2945441 - DNA, 13 bp, Homo sapiens
cacagcagaccta

SEQ ID NO: 2945442 - DNA, 11 bp, Homo sapiens
cacagccacac

SEQ ID NO: 2945443 - DNA, 13 bp, Homo sapiens
cacagccacacac

SEQ ID NO: 2945444 - DNA, 14 bp, Homo sapiens
cacagcccaggcct

SEQ ID NO: 2945445 - DNA, 17 bp, Homo sapiens
cacagcccccaccccag

SEQ ID NO: 2945446 - DNA, 19 bp, Homo sapiens
cacagcctgggccccagct

SEQ ID NO: 2945447 - DNA, 15 bp, Homo sapiens
cacagcctttctgaa

SEQ ID NO: 2945448 - DNA, 13 bp, Homo sapiens
cacagcgtgctgg

SEQ ID NO: 2945449 - DNA, 16 bp, Homo sapiens
cacagctactctcccc

SEQ ID NO: 2945450 - DNA, 15 bp, Homo sapiens
cacagctcccacccc

SEQ ID NO: 2945451 - DNA, 16 bp, Homo sapiens
cacagctcctcccctg

SEQ ID NO: 2945452 - DNA, 15 bp, Homo sapiens
cacagctgaagagca

SEQ ID NO: 2945453 - DNA, 23 bp, Homo sapiens
cacagcttcccctctctcctcct

SEQ ID NO: 2945454 - DNA, 22 bp, Homo sapiens
cacagcttcctgtccccatctg

SEQ ID NO: 2945455 - DNA, 23 bp, Homo sapiens
cacaggaaaatgtatccagagga

SEQ ID NO: 2945456 - DNA, 12 bp, Homo sapiens
cacaggaaacag

SEQ ID NO: 2945457 - DNA, 22 bp, Homo sapiens
cacaggaacggccctgcaggag

SEQ ID NO: 2945458 - DNA, 17 bp, Homo sapiens
cacaggacatttctcta

SEQ ID NO: 2945459 - DNA, 17 bp, Homo sapiens
cacaggacgaatgcata

SEQ ID NO: 2945460 - DNA, 21 bp, Homo sapiens
cacaggacgaatgcatattca

SEQ ID NO: 2945461 - DNA, 19 bp, Homo sapiens
cacaggagcaatcacagga

SEQ ID NO: 2945462 - DNA, 22 bp, Homo sapiens
cacaggaggcaggcatggccct

SEQ ID NO: 2945463 - DNA, 20 bp, Homo sapiens
cacaggagttgtgagccctc

SEQ ID NO: 2945464 - DNA, 13 bp, Homo sapiens
cacaggccctagc

SEQ ID NO: 2945465 - DNA, 19 bp, Homo sapiens
cacagggaagagctcccct

SEQ ID NO: 2945466 - DNA, 14 bp, Homo sapiens
cacagggtgggcct

SEQ ID NO: 2945467 - DNA, 16 bp, Homo sapiens
cacagggtgggcctcg

SEQ ID NO: 2945468 - DNA, 22 bp, Homo sapiens
cacagggtttggcccaagtttc

SEQ ID NO: 2945469 - DNA, 22 bp, Homo sapiens
cacaggtcaggggtgacacaga

SEQ ID NO: 2945470 - DNA, 23 bp, Homo sapiens
cacaggtcaggggtgacacagac

SEQ ID NO: 2945471 - DNA, 13 bp, Homo sapiens
cacaggtctctgt

SEQ ID NO: 2945472 - DNA, 14 bp, Homo sapiens
cacaggtctctgtt

SEQ ID NO: 2945473 - DNA, 20 bp, Homo sapiens
cacaggtctttcctaaggct

SEQ ID NO: 2945474 - DNA, 18 bp, Homo sapiens
cacaggtgcgggaccatc

SEQ ID NO: 2945475 - DNA, 16 bp, Homo sapiens
cacaggtggtgtcact

SEQ ID NO: 2945476 - DNA, 14 bp, Homo sapiens
cacaggtgtgagcc

SEQ ID NO: 2945477 - DNA, 20 bp, Homo sapiens
cacaggttcacgtgcagctc

SEQ ID NO: 2945478 - DNA, 13 bp, Homo sapiens
cacagtaaatatc

SEQ ID NO: 2945479 - DNA, 15 bp, Homo sapiens
cacagtagagtaggg

SEQ ID NO: 2945480 - DNA, 15 bp, Homo sapiens
cacagtgacactgga

SEQ ID NO: 2945481 - DNA, 16 bp, Homo sapiens
cacagtgttggaggtt

SEQ ID NO: 2945482 - DNA, 19 bp, Homo sapiens
cacagtgtttttgtaaagt

SEQ ID NO: 2945483 - DNA, 22 bp, Homo sapiens
cacagttcctcgccctgggtct

SEQ ID NO: 2945484 - DNA, 23 bp, Homo sapiens
cacagttcttaatacaggagacc

SEQ ID NO: 2945485 - DNA, 20 bp, Homo sapiens
cacagttctttgggccagac

SEQ ID NO: 2945486 - DNA, 15 bp, Homo sapiens
cacagttggccttca

SEQ ID NO: 2945487 - DNA, 13 bp, Homo sapiens
cacagtttagaac

SEQ ID NO: 2945488 - DNA, 12 bp, Homo sapiens
cacagtttcatt

SEQ ID NO: 2945489 - DNA, 20 bp, Homo sapiens
cacataaaaaagaagcactt

SEQ ID NO: 2945490 - DNA, 17 bp, Homo sapiens
cacataaatgcagccca

SEQ ID NO: 2945491 - DNA, 18 bp, Homo sapiens
cacatagcatgtaatggt

SEQ ID NO: 2945492 - DNA, 13 bp, Homo sapiens
cacatagctgtct

SEQ ID NO: 2945493 - DNA, 21 bp, Homo sapiens
cacatagtgggccttcattaa

SEQ ID NO: 2945494 - DNA, 15 bp, Homo sapiens
cacatatacacacac

SEQ ID NO: 2945495 - DNA, 18 bp, Homo sapiens
cacatatgcaccttgtgt

SEQ ID NO: 2945496 - DNA, 13 bp, Homo sapiens
cacatcaaagagg

SEQ ID NO: 2945497 - DNA, 15 bp, Homo sapiens
cacatcaagcatcat

SEQ ID NO: 2945498 - DNA, 16 bp, Homo sapiens
cacatcaagcatcatt

SEQ ID NO: 2945499 - DNA, 13 bp, Homo sapiens
cacatcacctctt

SEQ ID NO: 2945500 - DNA, 21 bp, Homo sapiens
cacatcacgaaggaaaactgc

SEQ ID NO: 2945501 - DNA, 13 bp, Homo sapiens
cacatcatttggg

SEQ ID NO: 2945502 - DNA, 12 bp, Homo sapiens
cacatcccagcc

SEQ ID NO: 2945503 - DNA, 14 bp, Homo sapiens
cacatccccagagc

SEQ ID NO: 2945504 - DNA, 23 bp, Homo sapiens
cacatccgcgtgtgcctgtgtgc

SEQ ID NO: 2945505 - DNA, 22 bp, Homo sapiens
cacatcctccacgttctgctca

SEQ ID NO: 2945506 - DNA, 19 bp, Homo sapiens
cacatcgttgccgcagcgg

SEQ ID NO: 2945507 - DNA, 17 bp, Homo sapiens
cacatctaaattgatca

SEQ ID NO: 2945508 - DNA, 22 bp, Homo sapiens
cacatctaaattgatcattcat

SEQ ID NO: 2945509 - DNA, 17 bp, Homo sapiens
cacatctaacctcatct

SEQ ID NO: 2945510 - DNA, 17 bp, Homo sapiens
cacatctaagcctgaag

SEQ ID NO: 2945511 - DNA, 22 bp, Homo sapiens
cacatctcccttccacctcaca

SEQ ID NO: 2945512 - DNA, 17 bp, Homo sapiens
cacatctgggtgccctg

SEQ ID NO: 2945513 - DNA, 14 bp, Homo sapiens
cacatctgtcctga

SEQ ID NO: 2945514 - DNA, 23 bp, Homo sapiens
cacatctgtgtctctggaaccca

SEQ ID NO: 2945515 - DNA, 18 bp, Homo sapiens
cacatctgtgtcttgttt

SEQ ID NO: 2945516 - DNA, 18 bp, Homo sapiens
caccaccttcccagctct

SEQ ID NO: 2945517 - DNA, 18 bp, Homo sapiens
caccacgatgtggccctg

SEQ ID NO: 2945518 - DNA, 20 bp, Homo sapiens
caccacgatgtggccctggc

SEQ ID NO: 2945519 - DNA, 19 bp, Homo sapiens
caccacgctggggtctggg

SEQ ID NO: 2945520 - DNA, 14 bp, Homo sapiens
caccactcctgcca

SEQ ID NO: 2945521 - DNA, 15 bp, Homo sapiens
caccactcctgccag

SEQ ID NO: 2945522 - DNA, 16 bp, Homo sapiens
caccactcctgccagc

SEQ ID NO: 2945523 - DNA, 18 bp, Homo sapiens
caccactgagctctgcct

SEQ ID NO: 2945524 - DNA, 15 bp, Homo sapiens
caccactgcactcca

SEQ ID NO: 2945525 - DNA, 20 bp, Homo sapiens
caccagaagctgttgggaga

SEQ ID NO: 2945526 - DNA, 17 bp, Homo sapiens
caccagacacccaggac

SEQ ID NO: 2945527 - DNA, 20 bp, Homo sapiens
caccagacacccaggactta

SEQ ID NO: 2945528 - DNA, 20 bp, Homo sapiens
caccagagcaggggctgctg

SEQ ID NO: 2945529 - DNA, 14 bp, Homo sapiens
caccagagctgcct

SEQ ID NO: 2945530 - DNA, 19 bp, Homo sapiens
caccagagctgcctcccca

SEQ ID NO: 2945531 - DNA, 23 bp, Homo sapiens
caccagagctgcctccccaatcc

SEQ ID NO: 2945532 - DNA, 14 bp, Homo sapiens
caccagcagcactg

SEQ ID NO: 2945533 - DNA, 15 bp, Homo sapiens
caccagcatcacctg

SEQ ID NO: 2945534 - DNA, 17 bp, Homo sapiens
caccagccctgctgctt

SEQ ID NO: 2945535 - DNA, 23 bp, Homo sapiens
caccagccctgctgcttcctaac

SEQ ID NO: 2945536 - DNA, 15 bp, Homo sapiens
caccagcctcctggg

SEQ ID NO: 2945537 - DNA, 15 bp, Homo sapiens
caccagctgcaaagt

SEQ ID NO: 2945538 - DNA, 23 bp, Homo sapiens
caccaggaatgttaaagtcagtg

SEQ ID NO: 2945539 - DNA, 20 bp, Homo sapiens
caccaggagcacctggaccc

SEQ ID NO: 2945540 - DNA, 22 bp, Homo sapiens
caccaggagcacctggaccccc

SEQ ID NO: 2945541 - DNA, 14 bp, Homo sapiens
caccaggatttata

SEQ ID NO: 2945542 - DNA, 18 bp, Homo sapiens
caccaggatttatacata

SEQ ID NO: 2945543 - DNA, 19 bp, Homo sapiens
caccaggcacgaacccacc

SEQ ID NO: 2945544 - DNA, 22 bp, Homo sapiens
caccagggttgaccccagagga

SEQ ID NO: 2945545 - DNA, 22 bp, Homo sapiens
caccaggtctcccgggaagcca

SEQ ID NO: 2945546 - DNA, 20 bp, Homo sapiens
caccagtccctgtccggaat

SEQ ID NO: 2945547 - DNA, 11 bp, Homo sapiens
caccagtttac

SEQ ID NO: 2945548 - DNA, 16 bp, Homo sapiens
caccatatttgaattg

SEQ ID NO: 2945549 - DNA, 21 bp, Homo sapiens
caccatccaacagacctggtg

SEQ ID NO: 2945550 - DNA, 18 bp, Homo sapiens
caccatccgccagggccc

SEQ ID NO: 2945551 - DNA, 17 bp, Homo sapiens
caccatcgctggcccct

SEQ ID NO: 2945552 - DNA, 18 bp, Homo sapiens
caccatgatggggcccta

SEQ ID NO: 2945553 - DNA, 11 bp, Homo sapiens
caccatgcaag

SEQ ID NO: 2945554 - DNA, 12 bp, Homo sapiens
caccatgcaagg

SEQ ID NO: 2945555 - DNA, 22 bp, Homo sapiens
caccatggcatgcgccaccatg

SEQ ID NO: 2945556 - DNA, 13 bp, Homo sapiens
caccattcaggtc

SEQ ID NO: 2945557 - DNA, 14 bp, Homo sapiens
caccattctttctt

SEQ ID NO: 2945558 - DNA, 17 bp, Homo sapiens
caccattgctgctcctt

SEQ ID NO: 2945559 - DNA, 13 bp, Homo sapiens
cacccaaaagcac

SEQ ID NO: 2945560 - DNA, 23 bp, Homo sapiens
cacccaaaagtcaaaaggtgcct

SEQ ID NO: 2945561 - DNA, 15 bp, Homo sapiens
cacccaaaccccttc

SEQ ID NO: 2945562 - DNA, 20 bp, Homo sapiens
cacccaaaccggcaggtgcg

SEQ ID NO: 2945563 - DNA, 16 bp, Homo sapiens
cacccaaagcctgtcc

SEQ ID NO: 2945564 - DNA, 21 bp, Homo sapiens
cacccaaagcctgtcccagga

SEQ ID NO: 2945565 - DNA, 19 bp, Homo sapiens
cacccaagagattgttgtt

SEQ ID NO: 2945566 - DNA, 21 bp, Homo sapiens
cacccaagagggctgcttccc

SEQ ID NO: 2945567 - DNA, 16 bp, Homo sapiens
cacccaattcaaaaca

SEQ ID NO: 2945568 - DNA, 17 bp, Homo sapiens
cacccaattcaaaacat

SEQ ID NO: 2945569 - DNA, 14 bp, Homo sapiens
cacccaattccact

SEQ ID NO: 2945570 - DNA, 12 bp, Homo sapiens
cacccacatgtg

SEQ ID NO: 2945571 - DNA, 14 bp, Homo sapiens
cacccaccctggga

SEQ ID NO: 2945572 - DNA, 13 bp, Homo sapiens
cacccacctccct

SEQ ID NO: 2945573 - DNA, 15 bp, Homo sapiens
cacccacctccctgc

SEQ ID NO: 2945574 - DNA, 18 bp, Homo sapiens
cacccacctccctgcctc

SEQ ID NO: 2945575 - DNA, 10 bp, Homo sapiens
cacccagccc

SEQ ID NO: 2945576 - DNA, 11 bp, Homo sapiens
cacccagccca

SEQ ID NO: 2945577 - DNA, 13 bp, Homo sapiens
cacccagcccaga

SEQ ID NO: 2945578 - DNA, 12 bp, Homo sapiens
cacccagcccat

SEQ ID NO: 2945579 - DNA, 22 bp, Homo sapiens
cacccagcccattctctctcct

SEQ ID NO: 2945580 - DNA, 17 bp, Homo sapiens
cacccagctccaggccc

SEQ ID NO: 2945581 - DNA, 21 bp, Homo sapiens
cacccaggcctatgttgatcc

SEQ ID NO: 2945582 - DNA, 22 bp, Homo sapiens
cacccaggggacgcgctggaaa

SEQ ID NO: 2945583 - DNA, 16 bp, Homo sapiens
caccccagagccacac

SEQ ID NO: 2945584 - DNA, 23 bp, Homo sapiens
caccccagcacagctcctcccct

SEQ ID NO: 2945585 - DNA, 16 bp, Homo sapiens
caccccatgctgttga

SEQ ID NO: 2945586 - DNA, 22 bp, Homo sapiens
cacccccaccactcttgactca

SEQ ID NO: 2945587 - DNA, 16 bp, Homo sapiens
cacccccactggtgag

SEQ ID NO: 2945588 - DNA, 15 bp, Homo sapiens
cacccccagccctgg

SEQ ID NO: 2945589 - DNA, 14 bp, Homo sapiens
cacccccgggatcc

SEQ ID NO: 2945590 - DNA, 21 bp, Homo sapiens
cacccccgggatcctgccccc

SEQ ID NO: 2945591 - DNA, 14 bp, Homo sapiens
caccccctccccag

SEQ ID NO: 2945592 - DNA, 15 bp, Homo sapiens
caccccctccccagg

SEQ ID NO: 2945593 - DNA, 19 bp, Homo sapiens
caccccctctcctggaggg

SEQ ID NO: 2945594 - DNA, 18 bp, Homo sapiens
caccccgaggccctgcat

SEQ ID NO: 2945595 - DNA, 16 bp, Homo sapiens
caccccgcctgcctcc

SEQ ID NO: 2945596 - DNA, 18 bp, Homo sapiens
cacccctgccactcaccc

SEQ ID NO: 2945597 - DNA, 18 bp, Homo sapiens
cacccctgggggctctca

SEQ ID NO: 2945598 - DNA, 23 bp, Homo sapiens
caccccttaccccaaagagaaag

SEQ ID NO: 2945599 - DNA, 21 bp, Homo sapiens
caccccttcataccgcctcgt

SEQ ID NO: 2945600 - DNA, 23 bp, Homo sapiens
caccccttcataccgcctcgtgc

SEQ ID NO: 2945601 - DNA, 17 bp, Homo sapiens
cactatctgggtgcatg

SEQ ID NO: 2945602 - DNA, 15 bp, Homo sapiens
cactatgtgtgttgt

SEQ ID NO: 2945603 - DNA, 20 bp, Homo sapiens
cactatgtgtgttgtttcca

SEQ ID NO: 2945604 - DNA, 22 bp, Homo sapiens
cactatgtgtgttgtttccata

SEQ ID NO: 2945605 - DNA, 16 bp, Homo sapiens
cactatgtttctcaga

SEQ ID NO: 2945606 - DNA, 20 bp, Homo sapiens
cactattcaaggatgactcc

SEQ ID NO: 2945607 - DNA, 14 bp, Homo sapiens
cactatttgtgact

SEQ ID NO: 2945608 - DNA, 22 bp, Homo sapiens
cactcaaaatgatgcaaccaaa

SEQ ID NO: 2945609 - DNA, 16 bp, Homo sapiens
cactcaagttgtttaa

SEQ ID NO: 2945610 - DNA, 17 bp, Homo sapiens
cactcaagttgtttaac

SEQ ID NO: 2945611 - DNA, 14 bp, Homo sapiens
cactcaatgggaga

SEQ ID NO: 2945612 - DNA, 18 bp, Homo sapiens
cactcaatgggagaatca

SEQ ID NO: 2945613 - DNA, 17 bp, Homo sapiens
cactcacctttctccac

SEQ ID NO: 2945614 - DNA, 22 bp, Homo sapiens
cactcacctttctccactgggt

SEQ ID NO: 2945615 - DNA, 13 bp, Homo sapiens
cactcagcacaag

SEQ ID NO: 2945616 - DNA, 15 bp, Homo sapiens
cactcagcacaaggc

SEQ ID NO: 2945617 - DNA, 16 bp, Homo sapiens
cactcagcccctaccc

SEQ ID NO: 2945618 - DNA, 22 bp, Homo sapiens
cactcagctcttggctccactg

SEQ ID NO: 2945619 - DNA, 12 bp, Homo sapiens
cactcaggctgg

SEQ ID NO: 2945620 - DNA, 13 bp, Homo sapiens
cactcaggctgga

SEQ ID NO: 2945621 - DNA, 14 bp, Homo sapiens
cactcaggctggag

SEQ ID NO: 2945622 - DNA, 16 bp, Homo sapiens
cactcagggcagctgc

SEQ ID NO: 2945623 - DNA, 21 bp, Homo sapiens
cactcagggcagctgcctggc

SEQ ID NO: 2945624 - DNA, 22 bp, Homo sapiens
cactcagggcagctgcctggcc

SEQ ID NO: 2945625 - DNA, 22 bp, Homo sapiens
cactcatacatatgtagaaaca

SEQ ID NO: 2945626 - DNA, 16 bp, Homo sapiens
cactcatgtgactctt

SEQ ID NO: 2945627 - DNA, 16 bp, Homo sapiens
cactcattgctgagcc

SEQ ID NO: 2945628 - DNA, 15 bp, Homo sapiens
cactgcctgggctga

SEQ ID NO: 2945629 - DNA, 17 bp, Homo sapiens
cactgccttattacata

SEQ ID NO: 2945630 - DNA, 20 bp, Homo sapiens
cactgccttattacataact

SEQ ID NO: 2945631 - DNA, 11 bp, Homo sapiens
cactgctacac

SEQ ID NO: 2945632 - DNA, 15 bp, Homo sapiens
cactgctgctactgc

SEQ ID NO: 2945633 - DNA, 19 bp, Homo sapiens
cactgcttctcggccagcc

SEQ ID NO: 2945634 - DNA, 20 bp, Homo sapiens
cactgcttctcggccagccc

SEQ ID NO: 2945635 - DNA, 15 bp, Homo sapiens
cactgcttgaggaaa

SEQ ID NO: 2945636 - DNA, 20 bp, Homo sapiens
cactgcttgaggaaaacaag

SEQ ID NO: 2945637 - DNA, 16 bp, Homo sapiens
cactggaaccacctgg

SEQ ID NO: 2945638 - DNA, 17 bp, Homo sapiens
cactggaaccacctgga

SEQ ID NO: 2945639 - DNA, 14 bp, Homo sapiens
cactggaaggagca

SEQ ID NO: 2945640 - DNA, 15 bp, Homo sapiens
cactggaaggagcac

SEQ ID NO: 2945641 - DNA, 18 bp, Homo sapiens
cactggaccaggtcctgc

SEQ ID NO: 2945642 - DNA, 16 bp, Homo sapiens
cactggagcaccaggc

SEQ ID NO: 2945643 - DNA, 21 bp, Homo sapiens
cactggagcaccaggcacgaa

SEQ ID NO: 2945644 - DNA, 18 bp, Homo sapiens
cactggagccacaggcag

SEQ ID NO: 2945645 - DNA, 16 bp, Homo sapiens
cactggagctgggagg

SEQ ID NO: 2945646 - DNA, 21 bp, Homo sapiens
cactggagtggctcgccaggc

SEQ ID NO: 2945647 - DNA, 19 bp, Homo sapiens
cactttgggtttttaactc

SEQ ID NO: 2945648 - DNA, 12 bp, Homo sapiens
cactttgtaaat

SEQ ID NO: 2945649 - DNA, 13 bp, Homo sapiens
cactttgtaaatt

SEQ ID NO: 2945650 - DNA, 19 bp, Homo sapiens
cactttgttggcccttcca

SEQ ID NO: 2945651 - DNA, 17 bp, Homo sapiens
cacttttaatgaacaaa

SEQ ID NO: 2945652 - DNA, 21 bp, Homo sapiens
cacttttcacttgtcttgctc

SEQ ID NO: 2945653 - DNA, 21 bp, Homo sapiens
cacttttttggggatatgctt

SEQ ID NO: 2945654 - DNA, 22 bp, Homo sapiens
cacttttttgggggtaaaaaat

SEQ ID NO: 2945655 - DNA, 22 bp, Homo sapiens
cagaaaaaaaaaatgcatttac

SEQ ID NO: 2945656 - DNA, 13 bp, Homo sapiens
cagaaaaagaaaa

SEQ ID NO: 2945657 - DNA, 21 bp, Homo sapiens
cagaaaaagcatgatgggaaa

SEQ ID NO: 2945658 - DNA, 18 bp, Homo sapiens
cagaaaaatatgtaccaa

SEQ ID NO: 2945659 - DNA, 20 bp, Homo sapiens
cagaaaaatggagcaaagtg

SEQ ID NO: 2945660 - DNA, 18 bp, Homo sapiens
cagaaaaattaaaaaaga

SEQ ID NO: 2945661 - DNA, 15 bp, Homo sapiens
cagaaaacaaaactg

SEQ ID NO: 2945662 - DNA, 15 bp, Homo sapiens
cagaaaagcacctgc

SEQ ID NO: 2945663 - DNA, 16 bp, Homo sapiens
cagaaaagcacctgcc

SEQ ID NO: 2945664 - DNA, 19 bp, Homo sapiens
cagaaaagcacctgccgac

SEQ ID NO: 2945665 - DNA, 22 bp, Homo sapiens
cagaaaataatctggtgttctt

SEQ ID NO: 2945666 - DNA, 16 bp, Homo sapiens
cagaaaatatactgta

SEQ ID NO: 2945667 - DNA, 21 bp, Homo sapiens
cagaaaatatactgtaaagaa

SEQ ID NO: 2945668 - DNA, 14 bp, Homo sapiens
cagaaaatgttgag

SEQ ID NO: 2945669 - DNA, 16 bp, Homo sapiens
cagaaaattagccggg

SEQ ID NO: 2945670 - DNA, 18 bp, Homo sapiens
cagaaacactgccttttt

SEQ ID NO: 2945671 - DNA, 21 bp, Homo sapiens
cagaaacactgcctttttatt

SEQ ID NO: 2945672 - DNA, 19 bp, Homo sapiens
cagaaacagggacaaagaa

SEQ ID NO: 2945673 - DNA, 21 bp, Homo sapiens
cagaaacagggacaaagaaat

SEQ ID NO: 2945674 - DNA, 17 bp, Homo sapiens
cagaaacatcagttact

SEQ ID NO: 2945675 - DNA, 22 bp, Homo sapiens
cagaaacatcagttactctgaa

SEQ ID NO: 2945676 - DNA, 20 bp, Homo sapiens
cagaaaccttgtttgtttta

SEQ ID NO: 2945677 - DNA, 12 bp, Homo sapiens
cagaaactgatg

SEQ ID NO: 2945678 - DNA, 21 bp, Homo sapiens
cagaaagagggacaagagggt

SEQ ID NO: 2945679 - DNA, 22 bp, Homo sapiens
cagaaaggaaaagattcctgtc

SEQ ID NO: 2945680 - DNA, 12 bp, Homo sapiens
cagaaaggagag

SEQ ID NO: 2945681 - DNA, 18 bp, Homo sapiens
cagaaagtaagcatttcc

SEQ ID NO: 2945682 - DNA, 15 bp, Homo sapiens
cagaaatataaacac

SEQ ID NO: 2945683 - DNA, 15 bp, Homo sapiens
cagaaatatataaaa

SEQ ID NO: 2945684 - DNA, 13 bp, Homo sapiens
cagaaatgctctg

SEQ ID NO: 2945685 - DNA, 14 bp, Homo sapiens
cagaaatgctctga

SEQ ID NO: 2945686 - DNA, 22 bp, Homo sapiens
cagaaatttaattcatgtttct

SEQ ID NO: 2945687 - DNA, 23 bp, Homo sapiens
cagaaatttaattcatgtttctt

SEQ ID NO: 2945688 - DNA, 17 bp, Homo sapiens
cagaacaggcagaaata

SEQ ID NO: 2945689 - DNA, 18 bp, Homo sapiens
cagaacaggcagaaatat

SEQ ID NO: 2945690 - DNA, 20 bp, Homo sapiens
cagaacagtgtttgattttt

SEQ ID NO: 2945691 - DNA, 17 bp, Homo sapiens
cagaacatcattagaac

SEQ ID NO: 2945692 - DNA, 17 bp, Homo sapiens
cagaacatgaagaagac

SEQ ID NO: 2945693 - DNA, 16 bp, Homo sapiens
cagaaccttgttattt

SEQ ID NO: 2945694 - DNA, 17 bp, Homo sapiens
cagaaccttgttatttc

SEQ ID NO: 2945695 - DNA, 21 bp, Homo sapiens
cagaaccttgttatttctcag

SEQ ID NO: 2945696 - DNA, 15 bp, Homo sapiens
cagaacgtggctctg

SEQ ID NO: 2945697 - DNA, 17 bp, Homo sapiens
cagaactaaactcattt

SEQ ID NO: 2945698 - DNA, 20 bp, Homo sapiens
cagaactaaactcatttata

SEQ ID NO: 2945699 - DNA, 15 bp, Homo sapiens
cagaactagaatttg

SEQ ID NO: 2945700 - DNA, 22 bp, Homo sapiens
cagaactcaaatggggccagat

SEQ ID NO: 2945701 - DNA, 15 bp, Homo sapiens
cagaactctttcaaa

SEQ ID NO: 2945702 - DNA, 15 bp, Homo sapiens
cagaactgaaataaa

SEQ ID NO: 2945703 - DNA, 16 bp, Homo sapiens
cagaagaaaggaacat

SEQ ID NO: 2945704 - DNA, 12 bp, Homo sapiens
cagaagaaaggc

SEQ ID NO: 2945705 - DNA, 17 bp, Homo sapiens
cagaagaatctttcttc

SEQ ID NO: 2945706 - DNA, 20 bp, Homo sapiens
cagaagatagcttcacccca

SEQ ID NO: 2945707 - DNA, 11 bp, Homo sapiens
cagaagcagag

SEQ ID NO: 2945708 - DNA, 17 bp, Homo sapiens
cagaagcagagagcaca

SEQ ID NO: 2945709 - DNA, 14 bp, Homo sapiens
cagaagcagaggct

SEQ ID NO: 2945710 - DNA, 21 bp, Homo sapiens
cagaagcctaggaggactggg

SEQ ID NO: 2945711 - DNA, 16 bp, Homo sapiens
cagaagcctctgggtc

SEQ ID NO: 2945712 - DNA, 19 bp, Homo sapiens
cagaagctgagcaccaggg

SEQ ID NO: 2945713 - DNA, 16 bp, Homo sapiens
cagaagctgtactttt

SEQ ID NO: 2945714 - DNA, 12 bp, Homo sapiens
cagaaggaaggt

SEQ ID NO: 2945715 - DNA, 14 bp, Homo sapiens
cagaaggagaagga

SEQ ID NO: 2945716 - DNA, 16 bp, Homo sapiens
cagaaggagaaggaaa

SEQ ID NO: 2945717 - DNA, 20 bp, Homo sapiens
cagaaggagaaggaaggaga

SEQ ID NO: 2945718 - DNA, 17 bp, Homo sapiens
cagaaggagacaggcag

SEQ ID NO: 2945719 - DNA, 22 bp, Homo sapiens
cagaaggagacaggcagagctg

SEQ ID NO: 2945720 - DNA, 19 bp, Homo sapiens
cagaaggagagtgagtgcc

SEQ ID NO: 2945721 - DNA, 18 bp, Homo sapiens
cagaaggatttcttgtat

SEQ ID NO: 2945722 - DNA, 19 bp, Homo sapiens
cagaaggatttcttgtatt

SEQ ID NO: 2945723 - DNA, 11 bp, Homo sapiens
cagaagggaat

SEQ ID NO: 2945724 - DNA, 18 bp, Homo sapiens
cagaagggaattgctcag

SEQ ID NO: 2945725 - DNA, 20 bp, Homo sapiens
cagaagggagctagccagag

SEQ ID NO: 2945726 - DNA, 15 bp, Homo sapiens
cagaaggtgaacttt

SEQ ID NO: 2945727 - DNA, 21 bp, Homo sapiens
cagaaggtgaactttgtgctt

SEQ ID NO: 2945728 - DNA, 17 bp, Homo sapiens
cagaagtaactcccact

SEQ ID NO: 2945729 - DNA, 23 bp, Homo sapiens
cagaagtaacttattttgtacta

SEQ ID NO: 2945730 - DNA, 17 bp, Homo sapiens
cagaagtattgtttaca

SEQ ID NO: 2945731 - DNA, 11 bp, Homo sapiens
cagaagtgtga

SEQ ID NO: 2945732 - DNA, 13 bp, Homo sapiens
cagaagtgtgatt

SEQ ID NO: 2945733 - DNA, 21 bp, Homo sapiens
cagaataagttattgcagttt

SEQ ID NO: 2945734 - DNA, 23 bp, Homo sapiens
cagaataagttattgcagtttat

SEQ ID NO: 2945735 - DNA, 21 bp, Homo sapiens
cagaatagccacatttggaat

SEQ ID NO: 2945736 - DNA, 22 bp, Homo sapiens
cagaatcaaacctttttatatt

SEQ ID NO: 2945737 - DNA, 17 bp, Homo sapiens
cagaatctaaagccagt

SEQ ID NO: 2945738 - DNA, 17 bp, Homo sapiens
cagaatctcgcagtgtt

SEQ ID NO: 2945739 - DNA, 19 bp, Homo sapiens
cagaatctctatgtatatt

SEQ ID NO: 2945740 - DNA, 21 bp, Homo sapiens
cagaatctctatgtatattct

SEQ ID NO: 2945741 - DNA, 13 bp, Homo sapiens
cagaatgaaaaat

SEQ ID NO: 2945742 - DNA, 16 bp, Homo sapiens
cagaatgaaaaatgaa

SEQ ID NO: 2945743 - DNA, 19 bp, Homo sapiens
cagaatgaaaaatgaaaga

SEQ ID NO: 2945744 - DNA, 21 bp, Homo sapiens
cagaatgaaaaatgaaagatg

SEQ ID NO: 2945745 - DNA, 22 bp, Homo sapiens
cagaatgaaaaatgaaagatga

SEQ ID NO: 2945746 - DNA, 14 bp, Homo sapiens
cagaatgaattcga

SEQ ID NO: 2945747 - DNA, 17 bp, Homo sapiens
cagaatgctgtacatct

SEQ ID NO: 2945748 - DNA, 15 bp, Homo sapiens
cagaatggaggcagg

SEQ ID NO: 2945749 - DNA, 16 bp, Homo sapiens
cagaatggaggcaggg

SEQ ID NO: 2945750 - DNA, 16 bp, Homo sapiens
cagaatgttgattaca

SEQ ID NO: 2945751 - DNA, 17 bp, Homo sapiens
cagaattacccttcctc

SEQ ID NO: 2945752 - DNA, 20 bp, Homo sapiens
cagaattatgatggaagaca

SEQ ID NO: 2945753 - DNA, 16 bp, Homo sapiens
cagaattgaaacactt

SEQ ID NO: 2945754 - DNA, 21 bp, Homo sapiens
cagaattgaaacacttttttg

SEQ ID NO: 2945755 - DNA, 13 bp, Homo sapiens
cagaattttaatg

SEQ ID NO: 2945756 - DNA, 18 bp, Homo sapiens
cagaattttaatgtgaag

SEQ ID NO: 2945757 - DNA, 23 bp, Homo sapiens
cagaattttaatgtgaagacatt

SEQ ID NO: 2945758 - DNA, 22 bp, Homo sapiens
cagacaaaaacagcctcacaga

SEQ ID NO: 2945759 - DNA, 14 bp, Homo sapiens
cagacaaaatgaaa

SEQ ID NO: 2945760 - DNA, 22 bp, Homo sapiens
cagacaaggagagcggaggagg

SEQ ID NO: 2945761 - DNA, 23 bp, Homo sapiens
cagacaaggagagcggaggagga

SEQ ID NO: 2945762 - DNA, 18 bp, Homo sapiens
cagacaaggcaggcctga

SEQ ID NO: 2945763 - DNA, 23 bp, Homo sapiens
cagacaaggcaggcctgaggcag

SEQ ID NO: 2945764 - DNA, 22 bp, Homo sapiens
cagacacattgtcatcagaggg

SEQ ID NO: 2945765 - DNA, 13 bp, Homo sapiens
cagacacccaccc

SEQ ID NO: 2945766 - DNA, 12 bp, Homo sapiens
cagacacccagg

SEQ ID NO: 2945767 - DNA, 15 bp, Homo sapiens
cagacacccaggact

SEQ ID NO: 2945768 - DNA, 14 bp, Homo sapiens
cagacaccctcaac

SEQ ID NO: 2945769 - DNA, 15 bp, Homo sapiens
cagacaccctcaacc

SEQ ID NO: 2945770 - DNA, 21 bp, Homo sapiens
cagacaccctcaacctcttct

SEQ ID NO: 2945771 - DNA, 15 bp, Homo sapiens
cagacagacatacat

SEQ ID NO: 2945772 - DNA, 16 bp, Homo sapiens
cagaggaccagggcct

SEQ ID NO: 2945773 - DNA, 21 bp, Homo sapiens
cagaggagagatagcctgtgg

SEQ ID NO: 2945774 - DNA, 22 bp, Homo sapiens
cagatgtaatgttttctttgca

SEQ ID NO: 2945775 - DNA, 23 bp, Homo sapiens
cagatgtaatgttttctttgcaa

SEQ ID NO: 2945776 - DNA, 17 bp, Homo sapiens
cagatgtgaaccattaa

SEQ ID NO: 2945777 - DNA, 14 bp, Homo sapiens
cagatgtggagcca

SEQ ID NO: 2945778 - DNA, 16 bp, Homo sapiens
cagatgtggagccagg

SEQ ID NO: 2945779 - DNA, 21 bp, Homo sapiens
cagatgtggggctgagctggg

SEQ ID NO: 2945780 - DNA, 23 bp, Homo sapiens
cagatgtggggctgagctgggga

SEQ ID NO: 2945781 - DNA, 20 bp, Homo sapiens
cagatgttatttttgtattt

SEQ ID NO: 2945782 - DNA, 17 bp, Homo sapiens
cagatgttcccccatct

SEQ ID NO: 2945783 - DNA, 22 bp, Homo sapiens
cagatgttttacgcaaggaagg

SEQ ID NO: 2945784 - DNA, 15 bp, Homo sapiens
cagctgctcagagcc

SEQ ID NO: 2945785 - DNA, 12 bp, Homo sapiens
cagctgctccca

SEQ ID NO: 2945786 - DNA, 14 bp, Homo sapiens
cagctgctcccaca

SEQ ID NO: 2945787 - DNA, 19 bp, Homo sapiens
cagctgctcctagagggag

SEQ ID NO: 2945788 - DNA, 23 bp, Homo sapiens
cagctgctcctagagggaggggc

SEQ ID NO: 2945789 - DNA, 18 bp, Homo sapiens
cagctgctgccactctgc

SEQ ID NO: 2945790 - DNA, 21 bp, Homo sapiens
cagctgctgccactctgctgc

SEQ ID NO: 2945791 - DNA, 22 bp, Homo sapiens
cagctgctgccactctgctgcc

SEQ ID NO: 2945792 - DNA, 19 bp, Homo sapiens
cagctgcttgttgtcaagt

SEQ ID NO: 2945793 - DNA, 17 bp, Homo sapiens
cagctggactgctgctg

SEQ ID NO: 2945794 - DNA, 18 bp, Homo sapiens
cagctggagaaatatggt

SEQ ID NO: 2945795 - DNA, 18 bp, Homo sapiens
cagctggccagatttcct

SEQ ID NO: 2945796 - DNA, 21 bp, Homo sapiens
cagctggcccactgctggctg

SEQ ID NO: 2945797 - DNA, 18 bp, Homo sapiens
cagctggcccgtgacaga

SEQ ID NO: 2945798 - DNA, 20 bp, Homo sapiens
cagctgggcagtgccagcca

SEQ ID NO: 2945799 - DNA, 16 bp, Homo sapiens
cagctgggcccacagc

SEQ ID NO: 2945800 - DNA, 19 bp, Homo sapiens
cagctgggcccacagcccc

SEQ ID NO: 2945801 - DNA, 21 bp, Homo sapiens
cagctgggcccacagccccca

SEQ ID NO: 2945802 - DNA, 20 bp, Homo sapiens
cagctgggtcaggcagggtg

SEQ ID NO: 2945803 - DNA, 15 bp, Homo sapiens
cagctggtgccccca

SEQ ID NO: 2945804 - DNA, 20 bp, Homo sapiens
cagctggtgggaagcgtctg

SEQ ID NO: 2945805 - DNA, 22 bp, Homo sapiens
cagctgtatataaacgtgtccc

SEQ ID NO: 2945806 - DNA, 23 bp, Homo sapiens
cagctgtatataaacgtgtcccg

SEQ ID NO: 2945807 - DNA, 21 bp, Homo sapiens
cagctgtccctgcccttcttc

SEQ ID NO: 2945808 - DNA, 22 bp, Homo sapiens
cagctgtccctgtcaccaagct

SEQ ID NO: 2945809 - DNA, 24 bp, Homo sapiens
cagctgtcccttgcttgcctgcag

SEQ ID NO: 2945810 - DNA, 15 bp, Homo sapiens
cagctgtctgtcatc

SEQ ID NO: 2945811 - DNA, 17 bp, Homo sapiens
cagctgtgccctcctgg

SEQ ID NO: 2945812 - DNA, 22 bp, Homo sapiens
cagctgtggtcccacccaggaa

SEQ ID NO: 2945813 - DNA, 13 bp, Homo sapiens
cagctgtgtgttt

SEQ ID NO: 2945814 - DNA, 18 bp, Homo sapiens
cagctgttgcaggcagtg

SEQ ID NO: 2945815 - DNA, 15 bp, Homo sapiens
cagcttatctctttt

SEQ ID NO: 2945816 - DNA, 16 bp, Homo sapiens
cagcttatctctttta

SEQ ID NO: 2945817 - DNA, 19 bp, Homo sapiens
cagcttatctcttttatat

SEQ ID NO: 2945818 - DNA, 22 bp, Homo sapiens
cagcttattgtgtgcgctgcct

SEQ ID NO: 2945819 - DNA, 23 bp, Homo sapiens
cagcttcccctctctcctcctgc

SEQ ID NO: 2945820 - DNA, 18 bp, Homo sapiens
cagcttcggtgtgcagat

SEQ ID NO: 2945821 - DNA, 21 bp, Homo sapiens
cagcttctaattttgtgctct

SEQ ID NO: 2945822 - DNA, 16 bp, Homo sapiens
cagcttctcctgtgtg

SEQ ID NO: 2945823 - DNA, 14 bp, Homo sapiens
cagcttctgttgga

SEQ ID NO: 2945824 - DNA, 15 bp, Homo sapiens
cagcttcttcatctt

SEQ ID NO: 2945825 - DNA, 23 bp, Homo sapiens
cagcttgatcaaaggcacacagc

SEQ ID NO: 2945826 - DNA, 17 bp, Homo sapiens
cagcttgccagatgctg

SEQ ID NO: 2945827 - DNA, 14 bp, Homo sapiens
cagcttgccaggga

SEQ ID NO: 2945828 - DNA, 14 bp, Homo sapiens
cagcttgtgcacaa

SEQ ID NO: 2945829 - DNA, 15 bp, Homo sapiens
cagcttgtgcacaat

SEQ ID NO: 2945830 - DNA, 19 bp, Homo sapiens
cagctttactgtggctgtc

SEQ ID NO: 2945831 - DNA, 16 bp, Homo sapiens
cagctttcaaagcatt

SEQ ID NO: 2945832 - DNA, 16 bp, Homo sapiens
cagctttcatgattag

SEQ ID NO: 2945833 - DNA, 23 bp, Homo sapiens
cagctttcctcaaaaagcagaag

SEQ ID NO: 2945834 - DNA, 12 bp, Homo sapiens
cagctttgagct

SEQ ID NO: 2945835 - DNA, 13 bp, Homo sapiens
cagctttgctgct

SEQ ID NO: 2945836 - DNA, 14 bp, Homo sapiens
cagctttgtttctg

SEQ ID NO: 2945837 - DNA, 13 bp, Homo sapiens
cagctttttgtct

SEQ ID NO: 2945838 - DNA, 16 bp, Homo sapiens
cagctttttgtctttt

SEQ ID NO: 2945839 - DNA, 19 bp, Homo sapiens
cagctttttgtcttttctg

SEQ ID NO: 2945840 - DNA, 20 bp, Homo sapiens
caggaaaactccttgttatc

SEQ ID NO: 2945841 - DNA, 19 bp, Homo sapiens
caggaaaactgacagagga

SEQ ID NO: 2945842 - DNA, 14 bp, Homo sapiens
caggaaaagcacaa

SEQ ID NO: 2945843 - DNA, 17 bp, Homo sapiens
caggaaaatcctctggc

SEQ ID NO: 2945844 - DNA, 22 bp, Homo sapiens
caggaaaatgtatccagaggaa

SEQ ID NO: 2945845 - DNA, 23 bp, Homo sapiens
caggaaaatgtatccagaggaat

SEQ ID NO: 2945846 - DNA, 18 bp, Homo sapiens
caggaaacaagggaaggg

SEQ ID NO: 2945847 - DNA, 21 bp, Homo sapiens
caggaaacaagggaaggggcc

SEQ ID NO: 2945848 - DNA, 20 bp, Homo sapiens
caggaaacccagtcgccctt

SEQ ID NO: 2945849 - DNA, 19 bp, Homo sapiens
caggaaccacaccacatct

SEQ ID NO: 2945850 - DNA, 19 bp, Homo sapiens
caggaacctcgagtactgt

SEQ ID NO: 2945851 - DNA, 23 bp, Homo sapiens
caggaacggccctgcaggagcag

SEQ ID NO: 2945852 - DNA, 20 bp, Homo sapiens
caggaagaccaaggcctcgg

SEQ ID NO: 2945853 - DNA, 14 bp, Homo sapiens
caggaagagagcat

SEQ ID NO: 2945854 - DNA, 12 bp, Homo sapiens
caggaagcaggg

SEQ ID NO: 2945855 - DNA, 15 bp, Homo sapiens
caggaagcagggaga

SEQ ID NO: 2945856 - DNA, 16 bp, Homo sapiens
caggaagcccaattgc

SEQ ID NO: 2945857 - DNA, 18 bp, Homo sapiens
caggaagcccaattgctg

SEQ ID NO: 2945858 - DNA, 15 bp, Homo sapiens
caggaagcccactgc

SEQ ID NO: 2945859 - DNA, 17 bp, Homo sapiens
caggaagcccactgcct

SEQ ID NO: 2945860 - DNA, 21 bp, Homo sapiens
caggaagccgtgccctgcccc

SEQ ID NO: 2945861 - DNA, 15 bp, Homo sapiens
caggaagcctgtggt

SEQ ID NO: 2945862 - DNA, 17 bp, Homo sapiens
caggaagctcagactgg

SEQ ID NO: 2945863 - DNA, 15 bp, Homo sapiens
caggaagctgctccg

SEQ ID NO: 2945864 - DNA, 15 bp, Homo sapiens
caggaaggaaaacta

SEQ ID NO: 2945865 - DNA, 19 bp, Homo sapiens
caggaaggaaaactatgta

SEQ ID NO: 2945866 - DNA, 21 bp, Homo sapiens
caggaaggcctaggctaggac

SEQ ID NO: 2945867 - DNA, 22 bp, Homo sapiens
caggaaggcttgttgtgctttt

SEQ ID NO: 2945868 - DNA, 22 bp, Homo sapiens
caggaagggagggagctgaggc

SEQ ID NO: 2945869 - DNA, 23 bp, Homo sapiens
caggaagggagggagctgaggcc

SEQ ID NO: 2945870 - DNA, 24 bp, Homo sapiens
caggaagggagggagctgaggcct

SEQ ID NO: 2945871 - DNA, 23 bp, Homo sapiens
caggaagttgccatgggaaacaa

SEQ ID NO: 2945872 - DNA, 15 bp, Homo sapiens
caggaatataaatat

SEQ ID NO: 2945873 - DNA, 17 bp, Homo sapiens
caggaatatttcctcca

SEQ ID NO: 2945874 - DNA, 13 bp, Homo sapiens
caggaatgtttca

SEQ ID NO: 2945875 - DNA, 19 bp, Homo sapiens
caggaattccaattaaatt

SEQ ID NO: 2945876 - DNA, 22 bp, Homo sapiens
caggaattgaagatgtaaggaa

SEQ ID NO: 2945877 - DNA, 19 bp, Homo sapiens
caggaatttcccaggaccc

SEQ ID NO: 2945878 - DNA, 19 bp, Homo sapiens
caggaatttgggaccctgc

SEQ ID NO: 2945879 - DNA, 14 bp, Homo sapiens
caggacagatgcca

SEQ ID NO: 2945880 - DNA, 12 bp, Homo sapiens
caggacagctct

SEQ ID NO: 2945881 - DNA, 12 bp, Homo sapiens
caggacaggacc

SEQ ID NO: 2945882 - DNA, 18 bp, Homo sapiens
caggacatttctctaaga

SEQ ID NO: 2945883 - DNA, 21 bp, Homo sapiens
caggaccaagggggcggggac

SEQ ID NO: 2945884 - DNA, 22 bp, Homo sapiens
caggaccaagggggcggggact

SEQ ID NO: 2945885 - DNA, 14 bp, Homo sapiens
caggaccagctcag

SEQ ID NO: 2945886 - DNA, 16 bp, Homo sapiens
caggaccagctcagga

SEQ ID NO: 2945887 - DNA, 17 bp, Homo sapiens
caggaccagctcaggac

SEQ ID NO: 2945888 - DNA, 20 bp, Homo sapiens
caggaccagctcaggacaga

SEQ ID NO: 2945889 - DNA, 19 bp, Homo sapiens
caggaccaggacccaggga

SEQ ID NO: 2945890 - DNA, 20 bp, Homo sapiens
caggacctctggacctcagg

SEQ ID NO: 2945891 - DNA, 16 bp, Homo sapiens
caggacctggctgcca

SEQ ID NO: 2945892 - DNA, 20 bp, Homo sapiens
caggacctggcttggcttta

SEQ ID NO: 2945893 - DNA, 22 bp, Homo sapiens
caggaccttcgggctgtgcccg

SEQ ID NO: 2945894 - DNA, 14 bp, Homo sapiens
caggacgaatgcat

SEQ ID NO: 2945895 - DNA, 16 bp, Homo sapiens
caggactcagaagcct

SEQ ID NO: 2945896 - DNA, 21 bp, Homo sapiens
caggactcagaagcctctggg

SEQ ID NO: 2945897 - DNA, 18 bp, Homo sapiens
caggactccaggcccaag

SEQ ID NO: 2945898 - DNA, 19 bp, Homo sapiens
caggactccaggcccaagg

SEQ ID NO: 2945899 - DNA, 21 bp, Homo sapiens
caggactccaggcccaaggct

SEQ ID NO: 2945900 - DNA, 16 bp, Homo sapiens
caggactcctccccac

SEQ ID NO: 2945901 - DNA, 13 bp, Homo sapiens
caggactggctgt

SEQ ID NO: 2945902 - DNA, 22 bp, Homo sapiens
caggactgggtctgacctggtg

SEQ ID NO: 2945903 - DNA, 16 bp, Homo sapiens
caggagaaggtcagcg

SEQ ID NO: 2945904 - DNA, 14 bp, Homo sapiens
caggagacccaaca

SEQ ID NO: 2945905 - DNA, 12 bp, Homo sapiens
caggagacctgc

SEQ ID NO: 2945906 - DNA, 17 bp, Homo sapiens
caggagacctgctctcc

SEQ ID NO: 2945907 - DNA, 15 bp, Homo sapiens
caggagactgggctc

SEQ ID NO: 2945908 - DNA, 19 bp, Homo sapiens
caggagactgggctctggc

SEQ ID NO: 2945909 - DNA, 15 bp, Homo sapiens
caggagagccagccc

SEQ ID NO: 2945910 - DNA, 21 bp, Homo sapiens
caggagagccagccctccctg

SEQ ID NO: 2945911 - DNA, 14 bp, Homo sapiens
caggagaggagagc

SEQ ID NO: 2945912 - DNA, 16 bp, Homo sapiens
caggagaggagagcca

SEQ ID NO: 2945913 - DNA, 22 bp, Homo sapiens
caggagaggagagccagagaag

SEQ ID NO: 2945914 - DNA, 15 bp, Homo sapiens
caggagcaacgccag

SEQ ID NO: 2945915 - DNA, 15 bp, Homo sapiens
caggagcacacccag

SEQ ID NO: 2945916 - DNA, 19 bp, Homo sapiens
caggagcacctggaccccc

SEQ ID NO: 2945917 - DNA, 22 bp, Homo sapiens
caggagcagggcggctgccgac

SEQ ID NO: 2945918 - DNA, 19 bp, Homo sapiens
caggagcgtgaaggactta

SEQ ID NO: 2945919 - DNA, 16 bp, Homo sapiens
caggagctctgcgcca

SEQ ID NO: 2945920 - DNA, 18 bp, Homo sapiens
caggagctctgcgccagg

SEQ ID NO: 2945921 - DNA, 19 bp, Homo sapiens
caggagctctgcgccaggc

SEQ ID NO: 2945922 - DNA, 21 bp, Homo sapiens
caggagctctgcgccaggcag

SEQ ID NO: 2945923 - DNA, 22 bp, Homo sapiens
caggagctctgcgccaggcaga

SEQ ID NO: 2945924 - DNA, 13 bp, Homo sapiens
caggaggaagggg

SEQ ID NO: 2945925 - DNA, 15 bp, Homo sapiens
caggaggacaattca

SEQ ID NO: 2945926 - DNA, 22 bp, Homo sapiens
caggaggacaattcatgaactt

SEQ ID NO: 2945927 - DNA, 15 bp, Homo sapiens
caggaggcaggcatg

SEQ ID NO: 2945928 - DNA, 18 bp, Homo sapiens
caggaggccaggccggcg

SEQ ID NO: 2945929 - DNA, 17 bp, Homo sapiens
caggaggctgagacagg

SEQ ID NO: 2945930 - DNA, 21 bp, Homo sapiens
caggaggctgagacaggagaa

SEQ ID NO: 2945931 - DNA, 17 bp, Homo sapiens
caggaggctgaggcaga

SEQ ID NO: 2945932 - DNA, 18 bp, Homo sapiens
caggaggctgaggcagaa

SEQ ID NO: 2945933 - DNA, 12 bp, Homo sapiens
caggagggacct

SEQ ID NO: 2945934 - DNA, 22 bp, Homo sapiens
caggagggagggtttctctccc

SEQ ID NO: 2945935 - DNA, 23 bp, Homo sapiens
caggagggagggtttctctccca

SEQ ID NO: 2945936 - DNA, 15 bp, Homo sapiens
caggaggtggaggtt

SEQ ID NO: 2945937 - DNA, 20 bp, Homo sapiens
caggaggtggaggttgcagt

SEQ ID NO: 2945938 - DNA, 15 bp, Homo sapiens
caggaggtggtctgg

SEQ ID NO: 2945939 - DNA, 19 bp, Homo sapiens
caggaggtttttttgtcaa

SEQ ID NO: 2945940 - DNA, 18 bp, Homo sapiens
caggagtgtcctggctgt

SEQ ID NO: 2945941 - DNA, 22 bp, Homo sapiens
caggagtgtcctggctgtgaat

SEQ ID NO: 2945942 - DNA, 20 bp, Homo sapiens
caggagttcaagaccagcct

SEQ ID NO: 2945943 - DNA, 21 bp, Homo sapiens
caggagttccagtgctgcatg

SEQ ID NO: 2945944 - DNA, 23 bp, Homo sapiens
caggagttcgagaccagcctggg

SEQ ID NO: 2945945 - DNA, 17 bp, Homo sapiens
caggagttgggggcagg

SEQ ID NO: 2945946 - DNA, 22 bp, Homo sapiens
caggagttgggggcaggtcagg

SEQ ID NO: 2945947 - DNA, 17 bp, Homo sapiens
caggagttgtgagccct

SEQ ID NO: 2945948 - DNA, 24 bp, Homo sapiens
caggagttgtgagccctctagggc

SEQ ID NO: 2945949 - DNA, 18 bp, Homo sapiens
caggagtttgagaccagg

SEQ ID NO: 2945950 - DNA, 20 bp, Homo sapiens
caggagtttgagaccaggct

SEQ ID NO: 2945951 - DNA, 17 bp, Homo sapiens
caggagtttgaggctgc

SEQ ID NO: 2945952 - DNA, 18 bp, Homo sapiens
caggagtttgaggctgca

SEQ ID NO: 2945953 - DNA, 14 bp, Homo sapiens
caggatagagactg

SEQ ID NO: 2945954 - DNA, 19 bp, Homo sapiens
caggccctctgcctgcact

SEQ ID NO: 2945955 - DNA, 12 bp, Homo sapiens
caggccctggag

SEQ ID NO: 2945956 - DNA, 19 bp, Homo sapiens
caggccctggagggcagag

SEQ ID NO: 2945957 - DNA, 20 bp, Homo sapiens
caggccctggctaagaccca

SEQ ID NO: 2945958 - DNA, 13 bp, Homo sapiens
caggccctgggtc

SEQ ID NO: 2945959 - DNA, 16 bp, Homo sapiens
caggccctgtccagcc

SEQ ID NO: 2945960 - DNA, 19 bp, Homo sapiens
caggccctgtccagccccc

SEQ ID NO: 2945961 - DNA, 15 bp, Homo sapiens
caggccgacagtcgg

SEQ ID NO: 2945962 - DNA, 18 bp, Homo sapiens
caggccgacagtcggtga

SEQ ID NO: 2945963 - DNA, 17 bp, Homo sapiens
caggccggagcccagat

SEQ ID NO: 2945964 - DNA, 19 bp, Homo sapiens
caggccggcgagccctgtg

SEQ ID NO: 2945965 - DNA, 13 bp, Homo sapiens
caggccgggcctg

SEQ ID NO: 2945966 - DNA, 18 bp, Homo sapiens
caggccgggcctgtacag

SEQ ID NO: 2945967 - DNA, 19 bp, Homo sapiens
caggccgggcctgtacagt

SEQ ID NO: 2945968 - DNA, 21 bp, Homo sapiens
caggccgggcctgtacagtct

SEQ ID NO: 2945969 - DNA, 20 bp, Homo sapiens
caggcctaggtgcagctcct

SEQ ID NO: 2945970 - DNA, 22 bp, Homo sapiens
caggcctcactggctcatgccc

SEQ ID NO: 2945971 - DNA, 15 bp, Homo sapiens
caggcctccagctca

SEQ ID NO: 2945972 - DNA, 16 bp, Homo sapiens
caggcctccagctcag

SEQ ID NO: 2945973 - DNA, 23 bp, Homo sapiens
caggcctcgcacttgcagaggag

SEQ ID NO: 2945974 - DNA, 15 bp, Homo sapiens
caggcctcgcctgcc

SEQ ID NO: 2945975 - DNA, 18 bp, Homo sapiens
caggcctcgcctgccctc

SEQ ID NO: 2945976 - DNA, 23 bp, Homo sapiens
caggcctctcggtgctccatctc

SEQ ID NO: 2945977 - DNA, 18 bp, Homo sapiens
caggcctgccctgctatt

SEQ ID NO: 2945978 - DNA, 13 bp, Homo sapiens
caggcctggagcg

SEQ ID NO: 2945979 - DNA, 19 bp, Homo sapiens
caggcctggctccccgagg

SEQ ID NO: 2945980 - DNA, 19 bp, Homo sapiens
caggcctgtgtgactccat

SEQ ID NO: 2945981 - DNA, 16 bp, Homo sapiens
caggccttatctccaa

SEQ ID NO: 2945982 - DNA, 17 bp, Homo sapiens
caggccttatctccaag

SEQ ID NO: 2945983 - DNA, 21 bp, Homo sapiens
caggccttgctgactctctga

SEQ ID NO: 2945984 - DNA, 13 bp, Homo sapiens
caggcgagcctga

SEQ ID NO: 2945985 - DNA, 14 bp, Homo sapiens
caggcgagcctgac

SEQ ID NO: 2945986 - DNA, 18 bp, Homo sapiens
caggcgagcctgactctg

SEQ ID NO: 2945987 - DNA, 24 bp, Homo sapiens
caggcgcctataatcccagctact

SEQ ID NO: 2945988 - DNA, 12 bp, Homo sapiens
caggcggccagg

SEQ ID NO: 2945989 - DNA, 15 bp, Homo sapiens
caggcggccctcagt

SEQ ID NO: 2945990 - DNA, 22 bp, Homo sapiens
caggcggggcccagcgctctcc

SEQ ID NO: 2945991 - DNA, 15 bp, Homo sapiens
caggcggggggggcg

SEQ ID NO: 2945992 - DNA, 21 bp, Homo sapiens
caggcggggggggcgcctgga

SEQ ID NO: 2945993 - DNA, 15 bp, Homo sapiens
caggcggtgggcacc

SEQ ID NO: 2945994 - DNA, 17 bp, Homo sapiens
caggcggtgggcaccca

SEQ ID NO: 2945995 - DNA, 19 bp, Homo sapiens
caggcgtgactcagcagcc

SEQ ID NO: 2945996 - DNA, 19 bp, Homo sapiens
caggcgtgtggcagccaca

SEQ ID NO: 2945997 - DNA, 17 bp, Homo sapiens
caggctagctggagcct

SEQ ID NO: 2945998 - DNA, 19 bp, Homo sapiens
caggctcccagggacacct

SEQ ID NO: 2945999 - DNA, 22 bp, Homo sapiens
caggctcccagggacacctggg

SEQ ID NO: 2946000 - DNA, 14 bp, Homo sapiens
caggctccgggctt

SEQ ID NO: 2946001 - DNA, 13 bp, Homo sapiens
caggctcctccct

SEQ ID NO: 2946002 - DNA, 14 bp, Homo sapiens
caggctctgttcct

SEQ ID NO: 2946003 - DNA, 18 bp, Homo sapiens
caggctgaagcaggttcc

SEQ ID NO: 2946004 - DNA, 14 bp, Homo sapiens
caggctgaccacag

SEQ ID NO: 2946005 - DNA, 15 bp, Homo sapiens
caggctgaccacagc

SEQ ID NO: 2946006 - DNA, 21 bp, Homo sapiens
caggctgagtccctccatgca

SEQ ID NO: 2946007 - DNA, 19 bp, Homo sapiens
caggtgcagaggaagtaca

SEQ ID NO: 2946008 - DNA, 13 bp, Homo sapiens
caggtgcagaggt

SEQ ID NO: 2946009 - DNA, 14 bp, Homo sapiens
caggtgcagccaga

SEQ ID NO: 2946010 - DNA, 23 bp, Homo sapiens
caggtgcccagctatacctgtgc

SEQ ID NO: 2946011 - DNA, 17 bp, Homo sapiens
caggtgcctttcaaatt

SEQ ID NO: 2946012 - DNA, 19 bp, Homo sapiens
caggtgcggcctgggggga

SEQ ID NO: 2946013 - DNA, 22 bp, Homo sapiens
caggtgcggcctggggggaacg

SEQ ID NO: 2946014 - DNA, 22 bp, Homo sapiens
caggtgctgacaatactgctgc

SEQ ID NO: 2946015 - DNA, 21 bp, Homo sapiens
caggtgctgacttcatctccc

SEQ ID NO: 2946016 - DNA, 21 bp, Homo sapiens
caggtgctgctgatgcgctgg

SEQ ID NO: 2946017 - DNA, 14 bp, Homo sapiens
caggtgctggccca

SEQ ID NO: 2946018 - DNA, 14 bp, Homo sapiens
caggtgctggtccc

SEQ ID NO: 2946019 - DNA, 17 bp, Homo sapiens
caggtggagagcactag

SEQ ID NO: 2946020 - DNA, 15 bp, Homo sapiens
caggtggccatgcct

SEQ ID NO: 2946021 - DNA, 19 bp, Homo sapiens
caggtggccatgcctcagc

SEQ ID NO: 2946022 - DNA, 21 bp, Homo sapiens
caggtggccgcccctgaggct

SEQ ID NO: 2946023 - DNA, 14 bp, Homo sapiens
caggtggcctctgc

SEQ ID NO: 2946024 - DNA, 17 bp, Homo sapiens
caggtggcctctgctgg

SEQ ID NO: 2946025 - DNA, 22 bp, Homo sapiens
caggtgggcggacaaaagggcc

SEQ ID NO: 2946026 - DNA, 23 bp, Homo sapiens
caggtggggagactgggctgagg

SEQ ID NO: 2946027 - DNA, 22 bp, Homo sapiens
caggtggggtgatggccagagg

SEQ ID NO: 2946028 - DNA, 23 bp, Homo sapiens
caggtggggtgatggccagagga

SEQ ID NO: 2946029 - DNA, 21 bp, Homo sapiens
caggtggggtggagtcccaga

SEQ ID NO: 2946030 - DNA, 19 bp, Homo sapiens
caggtgtagctgagctgtg

SEQ ID NO: 2946031 - DNA, 14 bp, Homo sapiens
caggtgtcagccat

SEQ ID NO: 2946032 - DNA, 19 bp, Homo sapiens
caggtgttaacattccaag

SEQ ID NO: 2946033 - DNA, 20 bp, Homo sapiens
caggtgttaacattccaaga

SEQ ID NO: 2946034 - DNA, 17 bp, Homo sapiens
caggttacaacagattt

SEQ ID NO: 2946035 - DNA, 17 bp, Homo sapiens
caggttagtgacattta

SEQ ID NO: 2946036 - DNA, 21 bp, Homo sapiens
caggttattttagtttctgtt

SEQ ID NO: 2946037 - DNA, 13 bp, Homo sapiens
caggttcacagca

SEQ ID NO: 2946038 - DNA, 21 bp, Homo sapiens
caggttctatttggaatttat

SEQ ID NO: 2946039 - DNA, 18 bp, Homo sapiens
caggttcttcttcctgaa

SEQ ID NO: 2946040 - DNA, 18 bp, Homo sapiens
caggttggaaaagaaatc

SEQ ID NO: 2946041 - DNA, 20 bp, Homo sapiens
caggttggcaaacgggcttg

SEQ ID NO: 2946042 - DNA, 19 bp, Homo sapiens
caggttggcggcagacaca

SEQ ID NO: 2946043 - DNA, 13 bp, Homo sapiens
caggttgttggtg

SEQ ID NO: 2946044 - DNA, 16 bp, Homo sapiens
caggttgttggtgact

SEQ ID NO: 2946045 - DNA, 14 bp, Homo sapiens
caggtttgaccagg

SEQ ID NO: 2946046 - DNA, 19 bp, Homo sapiens
caggtttgcacctaagtgt

SEQ ID NO: 2946047 - DNA, 20 bp, Homo sapiens
caggtttggtttttttgtac

SEQ ID NO: 2946048 - DNA, 17 bp, Homo sapiens
caggtttgtttcttgat

SEQ ID NO: 2946049 - DNA, 19 bp, Homo sapiens
caggttttcacataaatgc

SEQ ID NO: 2946050 - DNA, 20 bp, Homo sapiens
cagtaaatcttttacaactg

SEQ ID NO: 2946051 - DNA, 21 bp, Homo sapiens
cagtaaatgaactgattttta

SEQ ID NO: 2946052 - DNA, 12 bp, Homo sapiens
cagtaacacgct

SEQ ID NO: 2946053 - DNA, 16 bp, Homo sapiens
cagtaactttatgtgt

SEQ ID NO: 2946054 - DNA, 20 bp, Homo sapiens
cagtaactttatgtgtaaat

SEQ ID NO: 2946055 - DNA, 23 bp, Homo sapiens
cagtaataagaatggaaaagaga

SEQ ID NO: 2946056 - DNA, 18 bp, Homo sapiens
cagtaatgctaaatgtgt

SEQ ID NO: 2946057 - DNA, 19 bp, Homo sapiens
cagtaatgctaaatgtgta

SEQ ID NO: 2946058 - DNA, 23 bp, Homo sapiens
cagtaccttcaaactagggccaa

SEQ ID NO: 2946059 - DNA, 16 bp, Homo sapiens
cagtactaaggtgact

SEQ ID NO: 2946060 - DNA, 19 bp, Homo sapiens
cagtacttcagcaagagag

SEQ ID NO: 2946061 - DNA, 20 bp, Homo sapiens
cagtacttcagcaagagaga

SEQ ID NO: 2946062 - DNA, 24 bp, Homo sapiens
cagtacttcagcaagagagaacct

SEQ ID NO: 2946063 - DNA, 15 bp, Homo sapiens
cagtacttttttaaa

SEQ ID NO: 2946064 - DNA, 15 bp, Homo sapiens
cagtagacattttaa

SEQ ID NO: 2946065 - DNA, 19 bp, Homo sapiens
cagtagacattttaacaag

SEQ ID NO: 2946066 - DNA, 23 bp, Homo sapiens
cagtagattttctttaaaagaat

SEQ ID NO: 2946067 - DNA, 23 bp, Homo sapiens
cagtagcacaagttatttaaatc

SEQ ID NO: 2946068 - DNA, 15 bp, Homo sapiens
cagtagccatttttt

SEQ ID NO: 2946069 - DNA, 21 bp, Homo sapiens
cagtagcttaagggaatatgc

SEQ ID NO: 2946070 - DNA, 14 bp, Homo sapiens
cagtaggagcccag

SEQ ID NO: 2946071 - DNA, 22 bp, Homo sapiens
cagtaggagcccagctctgaaa

SEQ ID NO: 2946072 - DNA, 13 bp, Homo sapiens
cagtaggatattt

SEQ ID NO: 2946073 - DNA, 18 bp, Homo sapiens
cagtaggatatttctaca

SEQ ID NO: 2946074 - DNA, 13 bp, Homo sapiens
cagtaggccggtg

SEQ ID NO: 2946075 - DNA, 12 bp, Homo sapiens
cagtaggggagg

SEQ ID NO: 2946076 - DNA, 23 bp, Homo sapiens
catacatatgtagaaacatttag

SEQ ID NO: 2946077 - DNA, 19 bp, Homo sapiens
catacatgctgcgcatgtt

SEQ ID NO: 2946078 - DNA, 17 bp, Homo sapiens
catacatgttattgttt

SEQ ID NO: 2946079 - DNA, 16 bp, Homo sapiens
cataccgcctcgtgcc

SEQ ID NO: 2946080 - DNA, 21 bp, Homo sapiens
cataccgcctcgtgccagcag

SEQ ID NO: 2946081 - DNA, 22 bp, Homo sapiens
cataccgcctcgtgccagcagc

SEQ ID NO: 2946082 - DNA, 16 bp, Homo sapiens
catacctcatctcttg

SEQ ID NO: 2946083 - DNA, 22 bp, Homo sapiens
cataccttttattttttttaat

SEQ ID NO: 2946084 - DNA, 16 bp, Homo sapiens
catactaggtgccttt

SEQ ID NO: 2946085 - DNA, 20 bp, Homo sapiens
catactccgtgaggctgctg

SEQ ID NO: 2946086 - DNA, 22 bp, Homo sapiens
catactccgtgaggctgctgcc

SEQ ID NO: 2946087 - DNA, 13 bp, Homo sapiens
catactctgttgc

SEQ ID NO: 2946088 - DNA, 22 bp, Homo sapiens
catactctgttgcctcctctct

SEQ ID NO: 2946089 - DNA, 11 bp, Homo sapiens
catactgctgt

SEQ ID NO: 2946090 - DNA, 14 bp, Homo sapiens
catacttcaaaagt

SEQ ID NO: 2946091 - DNA, 17 bp, Homo sapiens
catacttcaaaagtatt

SEQ ID NO: 2946092 - DNA, 18 bp, Homo sapiens
catacttgaagggccaga

SEQ ID NO: 2946093 - DNA, 12 bp, Homo sapiens
catactttggat

SEQ ID NO: 2946094 - DNA, 14 bp, Homo sapiens
catactttggatga

SEQ ID NO: 2946095 - DNA, 14 bp, Homo sapiens
catactttgtaaat

SEQ ID NO: 2946096 - DNA, 22 bp, Homo sapiens
catagacatttcaaaattaata

SEQ ID NO: 2946097 - DNA, 23 bp, Homo sapiens
catagaccctctttcttgtttgt

SEQ ID NO: 2946098 - DNA, 16 bp, Homo sapiens
catagactgaagattt

SEQ ID NO: 2946099 - DNA, 17 bp, Homo sapiens
catagactgaagattta

SEQ ID NO: 2946100 - DNA, 13 bp, Homo sapiens
catagagaaacct

SEQ ID NO: 2946101 - DNA, 17 bp, Homo sapiens
catagagaacaaagtaa

SEQ ID NO: 2946102 - DNA, 22 bp, Homo sapiens
catagagatatttaaaagacaa

SEQ ID NO: 2946103 - DNA, 23 bp, Homo sapiens
catagatttgaagatctgattta

SEQ ID NO: 2946104 - DNA, 23 bp, Homo sapiens
catagcaccctgccctcatggga

SEQ ID NO: 2946105 - DNA, 12 bp, Homo sapiens
catagcagctgc

SEQ ID NO: 2946106 - DNA, 17 bp, Homo sapiens
catagcaggaaatgtag

SEQ ID NO: 2946107 - DNA, 11 bp, Homo sapiens
catagcattca

SEQ ID NO: 2946108 - DNA, 19 bp, Homo sapiens
catagccctggtgctcctg

SEQ ID NO: 2946109 - DNA, 22 bp, Homo sapiens
catagccctggtgctcctgccc

SEQ ID NO: 2946110 - DNA, 14 bp, Homo sapiens
catagcgtcctgcc

SEQ ID NO: 2946111 - DNA, 16 bp, Homo sapiens
catagcgtcctgccct

SEQ ID NO: 2946112 - DNA, 17 bp, Homo sapiens
catagctcttcacttcc

SEQ ID NO: 2946113 - DNA, 18 bp, Homo sapiens
catagctcttcacttcct

SEQ ID NO: 2946114 - DNA, 22 bp, Homo sapiens
catagctcttcacttcctccag

SEQ ID NO: 2946115 - DNA, 14 bp, Homo sapiens
catagctgtctaga

SEQ ID NO: 2946116 - DNA, 15 bp, Homo sapiens
cataggcccacacac

SEQ ID NO: 2946117 - DNA, 17 bp, Homo sapiens
cataggcccacacacag

SEQ ID NO: 2946118 - DNA, 20 bp, Homo sapiens
catagggacctttaaaaagc

SEQ ID NO: 2946119 - DNA, 13 bp, Homo sapiens
cataggggcaggt

SEQ ID NO: 2946120 - DNA, 23 bp, Homo sapiens
cataggtagaatgtaaagcttgt

SEQ ID NO: 2946121 - DNA, 23 bp, Homo sapiens
cataggtaggtatctttatagtt

SEQ ID NO: 2946122 - DNA, 15 bp, Homo sapiens
catagtaactgacat

SEQ ID NO: 2946123 - DNA, 13 bp, Homo sapiens
catagtcacatgg

SEQ ID NO: 2946124 - DNA, 22 bp, Homo sapiens
catagtgaacacagcagaccta

SEQ ID NO: 2946125 - DNA, 15 bp, Homo sapiens
catagtgcctttttc

SEQ ID NO: 2946126 - DNA, 18 bp, Homo sapiens
catagtgcctttttcctt

SEQ ID NO: 2946127 - DNA, 17 bp, Homo sapiens
catagtgggccttcatt

SEQ ID NO: 2946128 - DNA, 22 bp, Homo sapiens
catagttatttacttgaaagat

SEQ ID NO: 2946129 - DNA, 16 bp, Homo sapiens
catagttctttttagt

SEQ ID NO: 2946130 - DNA, 14 bp, Homo sapiens
catagtttggcatt

SEQ ID NO: 2946131 - DNA, 16 bp, Homo sapiens
catagtttggcatttg

SEQ ID NO: 2946132 - DNA, 17 bp, Homo sapiens
catagtttgggtatttt

SEQ ID NO: 2946133 - DNA, 21 bp, Homo sapiens
catagtttgggtatttttggt

SEQ ID NO: 2946134 - DNA, 12 bp, Homo sapiens
catagtttttcc

SEQ ID NO: 2946135 - DNA, 23 bp, Homo sapiens
catataaaataatgcaaagaatc

SEQ ID NO: 2946136 - DNA, 14 bp, Homo sapiens
catataaccaaaat

SEQ ID NO: 2946137 - DNA, 15 bp, Homo sapiens
catataagtttgaag

SEQ ID NO: 2946138 - DNA, 20 bp, Homo sapiens
catataagtttgaaggaaac

SEQ ID NO: 2946139 - DNA, 24 bp, Homo sapiens
catataagtttgaaggaaacagtt

SEQ ID NO: 2946140 - DNA, 18 bp, Homo sapiens
catatagcaaaactttta

SEQ ID NO: 2946141 - DNA, 18 bp, Homo sapiens
catatataactagctaga

SEQ ID NO: 2946142 - DNA, 14 bp, Homo sapiens
catatatatactat

SEQ ID NO: 2946143 - DNA, 16 bp, Homo sapiens
catatatatatataac

SEQ ID NO: 2946144 - DNA, 16 bp, Homo sapiens
catatattatatatag

SEQ ID NO: 2946145 - DNA, 19 bp, Homo sapiens
catatattatatatagaaa

SEQ ID NO: 2946146 - DNA, 23 bp, Homo sapiens
catatcaagaagtcagagaaaac

SEQ ID NO: 2946147 - DNA, 22 bp, Homo sapiens
catatcatcaatgtgacattta

SEQ ID NO: 2946148 - DNA, 23 bp, Homo sapiens
catatcatcaatgtgacatttac

SEQ ID NO: 2946149 - DNA, 15 bp, Homo sapiens
catatctaaagtcat

SEQ ID NO: 2946150 - DNA, 18 bp, Homo sapiens
catatctctagtccctgt

SEQ ID NO: 2946151 - DNA, 24 bp, Homo sapiens
catatctctagtccctgtgttctg

SEQ ID NO: 2946152 - DNA, 14 bp, Homo sapiens
catatctctccctt

SEQ ID NO: 2946153 - DNA, 18 bp, Homo sapiens
catatcttctgtttcata

SEQ ID NO: 2946154 - DNA, 13 bp, Homo sapiens
catatgaatgaaa

SEQ ID NO: 2946155 - DNA, 19 bp, Homo sapiens
catatgaattgctgtctag

SEQ ID NO: 2946156 - DNA, 16 bp, Homo sapiens
catatgcaccttgtgt

SEQ ID NO: 2946157 - DNA, 18 bp, Homo sapiens
catatgcaccttgtgtct

SEQ ID NO: 2946158 - DNA, 16 bp, Homo sapiens
catatgctgacagctc

SEQ ID NO: 2946159 - DNA, 17 bp, Homo sapiens
catatggacactgtgac

SEQ ID NO: 2946160 - DNA, 19 bp, Homo sapiens
catatggggtgtttgttcc

SEQ ID NO: 2946161 - DNA, 20 bp, Homo sapiens
catatggtctccattttaca

SEQ ID NO: 2946162 - DNA, 17 bp, Homo sapiens
catatgtattcctgatc

SEQ ID NO: 2946163 - DNA, 21 bp, Homo sapiens
catatgtgagtgaaagtactt

SEQ ID NO: 2946164 - DNA, 18 bp, Homo sapiens
catatgttaagcagctaa

SEQ ID NO: 2946165 - DNA, 14 bp, Homo sapiens
catattaaaaatat

SEQ ID NO: 2946166 - DNA, 20 bp, Homo sapiens
catattaagaatagtctctg

SEQ ID NO: 2946167 - DNA, 18 bp, Homo sapiens
catattacgttgtttctt

SEQ ID NO: 2946168 - DNA, 18 bp, Homo sapiens
catattgtaatctatgtt

SEQ ID NO: 2946169 - DNA, 22 bp, Homo sapiens
catattgtaatctatgtttata

SEQ ID NO: 2946170 - DNA, 12 bp, Homo sapiens
catcctgaacag

SEQ ID NO: 2946171 - DNA, 18 bp, Homo sapiens
catcctgcttctcttttc

SEQ ID NO: 2946172 - DNA, 10 bp, Homo sapiens
catcctgtgt

SEQ ID NO: 2946173 - DNA, 17 bp, Homo sapiens
catcctgtgtcccctga

SEQ ID NO: 2946174 - DNA, 21 bp, Homo sapiens
catcctgtgtcccctgacctg

SEQ ID NO: 2946175 - DNA, 21 bp, Homo sapiens
catcctgtgtttctagggaaa

SEQ ID NO: 2946176 - DNA, 22 bp, Homo sapiens
catcctgtgtttctagggaaat

SEQ ID NO: 2946177 - DNA, 23 bp, Homo sapiens
catcctgtttgtatgaaattata

SEQ ID NO: 2946178 - DNA, 19 bp, Homo sapiens
catccttcccaagaagaga

SEQ ID NO: 2946179 - DNA, 19 bp, Homo sapiens
catccttgagattctgaag

SEQ ID NO: 2946180 - DNA, 19 bp, Homo sapiens
catccttggtgctcttgct

SEQ ID NO: 2946181 - DNA, 21 bp, Homo sapiens
catccttggtgctcttgcttt

SEQ ID NO: 2946182 - DNA, 13 bp, Homo sapiens
catcctttttctg

SEQ ID NO: 2946183 - DNA, 11 bp, Homo sapiens
catcctttttt

SEQ ID NO: 2946184 - DNA, 23 bp, Homo sapiens
catccttttttctcttctgtcca

SEQ ID NO: 2946185 - DNA, 21 bp, Homo sapiens
catcgaatctactaattccac

SEQ ID NO: 2946186 - DNA, 17 bp, Homo sapiens
catcgacttagcctgag

SEQ ID NO: 2946187 - DNA, 14 bp, Homo sapiens
catcgatatgaaaa

SEQ ID NO: 2946188 - DNA, 15 bp, Homo sapiens
catcgccacaaactc

SEQ ID NO: 2946189 - DNA, 20 bp, Homo sapiens
catcgccagaggtgcttcac

SEQ ID NO: 2946190 - DNA, 15 bp, Homo sapiens
catcggccctgtccc

SEQ ID NO: 2946191 - DNA, 17 bp, Homo sapiens
catcgggcccagggaca

SEQ ID NO: 2946192 - DNA, 23 bp, Homo sapiens
catcgtattaaaaaacaattaac

SEQ ID NO: 2946193 - DNA, 16 bp, Homo sapiens
catcgtcatttgctgt

SEQ ID NO: 2946194 - DNA, 19 bp, Homo sapiens
catgaaggtcctagcttta

SEQ ID NO: 2946195 - DNA, 17 bp, Homo sapiens
catgaatcaaaagtgcc

SEQ ID NO: 2946196 - DNA, 21 bp, Homo sapiens
catgaatcccacccacatgtg

SEQ ID NO: 2946197 - DNA, 16 bp, Homo sapiens
catgaatcgcttctct

SEQ ID NO: 2946198 - DNA, 15 bp, Homo sapiens
catgaattcatactc

SEQ ID NO: 2946199 - DNA, 18 bp, Homo sapiens
catgaattcatactctgt

SEQ ID NO: 2946200 - DNA, 18 bp, Homo sapiens
catgaattcccttttaat

SEQ ID NO: 2946201 - DNA, 21 bp, Homo sapiens
catgaatttttttcatcttct

SEQ ID NO: 2946202 - DNA, 14 bp, Homo sapiens
catgacatcaaaat

SEQ ID NO: 2946203 - DNA, 13 bp, Homo sapiens
catgacatttctt

SEQ ID NO: 2946204 - DNA, 20 bp, Homo sapiens
catgaccctctgtccccagg

SEQ ID NO: 2946205 - DNA, 21 bp, Homo sapiens
catgaccctctgtccccaggc

SEQ ID NO: 2946206 - DNA, 22 bp, Homo sapiens
catgaccctctgtccccaggcc

SEQ ID NO: 2946207 - DNA, 20 bp, Homo sapiens
catgacgggttgtgagactt

SEQ ID NO: 2946208 - DNA, 13 bp, Homo sapiens
catgagaaaggga

SEQ ID NO: 2946209 - DNA, 13 bp, Homo sapiens
catgagaaataca

SEQ ID NO: 2946210 - DNA, 18 bp, Homo sapiens
catgagaaatacaaaaat

SEQ ID NO: 2946211 - DNA, 22 bp, Homo sapiens
catgagaaatacaaaaatactc

SEQ ID NO: 2946212 - DNA, 16 bp, Homo sapiens
catgagaacaaacaga

SEQ ID NO: 2946213 - DNA, 15 bp, Homo sapiens
catgagactcagtgc

SEQ ID NO: 2946214 - DNA, 12 bp, Homo sapiens
catgagatgtgt

SEQ ID NO: 2946215 - DNA, 17 bp, Homo sapiens
catgagcattggataca

SEQ ID NO: 2946216 - DNA, 21 bp, Homo sapiens
catgagccactgtgcttggcc

SEQ ID NO: 2946217 - DNA, 22 bp, Homo sapiens
catgagccactgtgcttggcca

SEQ ID NO: 2946218 - DNA, 14 bp, Homo sapiens
catgagcttttata

SEQ ID NO: 2946219 - DNA, 22 bp, Homo sapiens
catgaggaactgtagatgatgt

SEQ ID NO: 2946220 - DNA, 15 bp, Homo sapiens
catgaggaccagggt

SEQ ID NO: 2946221 - DNA, 16 bp, Homo sapiens
catgaggccactgctg

SEQ ID NO: 2946222 - DNA, 20 bp, Homo sapiens
catgaggtactggtcccttc

SEQ ID NO: 2946223 - DNA, 17 bp, Homo sapiens
catgagtccttgaaaat

SEQ ID NO: 2946224 - DNA, 18 bp, Homo sapiens
catgagtccttgaaaata

SEQ ID NO: 2946225 - DNA, 20 bp, Homo sapiens
catgagtccttgaaaatatt

SEQ ID NO: 2946226 - DNA, 20 bp, Homo sapiens
catgagtggccttaataaat

SEQ ID NO: 2946227 - DNA, 16 bp, Homo sapiens
catgataaacattcat

SEQ ID NO: 2946228 - DNA, 20 bp, Homo sapiens
catgatccaagcaagactga

SEQ ID NO: 2946229 - DNA, 20 bp, Homo sapiens
catgatctccctgccgcctc

SEQ ID NO: 2946230 - DNA, 15 bp, Homo sapiens
catgatcttgagcaa

SEQ ID NO: 2946231 - DNA, 15 bp, Homo sapiens
catgatgagctcctc

SEQ ID NO: 2946232 - DNA, 19 bp, Homo sapiens
catgatgagctcctcttcc

SEQ ID NO: 2946233 - DNA, 16 bp, Homo sapiens
catgatgcctctgtct

SEQ ID NO: 2946234 - DNA, 17 bp, Homo sapiens
catgatgcctctgtctt

SEQ ID NO: 2946235 - DNA, 21 bp, Homo sapiens
catgatggccaggctgatctc

SEQ ID NO: 2946236 - DNA, 17 bp, Homo sapiens
catgatgggaaaatatt

SEQ ID NO: 2946237 - DNA, 23 bp, Homo sapiens
catgatggttattttcttttctt

SEQ ID NO: 2946238 - DNA, 21 bp, Homo sapiens
catgattagcagaagaaagga

SEQ ID NO: 2946239 - DNA, 16 bp, Homo sapiens
catgatttcccactgc

SEQ ID NO: 2946240 - DNA, 19 bp, Homo sapiens
catgatttcccactgcact

SEQ ID NO: 2946241 - DNA, 22 bp, Homo sapiens
catgatttcccactgcactcca

SEQ ID NO: 2946242 - DNA, 12 bp, Homo sapiens
catgatttcctt

SEQ ID NO: 2946243 - DNA, 17 bp, Homo sapiens
catgatttccttgaatg

SEQ ID NO: 2946244 - DNA, 20 bp, Homo sapiens
catgcaaaagcaatcataga

SEQ ID NO: 2946245 - DNA, 15 bp, Homo sapiens
catgcaaaagtgggg

SEQ ID NO: 2946246 - DNA, 14 bp, Homo sapiens
catgcaagcagagg

SEQ ID NO: 2946247 - DNA, 14 bp, Homo sapiens
catgcaagtgctgt

SEQ ID NO: 2946248 - DNA, 12 bp, Homo sapiens
catgcacacggc

SEQ ID NO: 2946249 - DNA, 19 bp, Homo sapiens
catgcacacggctggtcac

SEQ ID NO: 2946250 - DNA, 21 bp, Homo sapiens
catgcacacggctggtcactc

SEQ ID NO: 2946251 - DNA, 20 bp, Homo sapiens
catgcaccaggactggctgt

SEQ ID NO: 2946252 - DNA, 19 bp, Homo sapiens
catgcacctgcaatcccag

SEQ ID NO: 2946253 - DNA, 10 bp, Homo sapiens
catgcactgt

SEQ ID NO: 2946254 - DNA, 22 bp, Homo sapiens
catgcactgtgaaggacccttg

SEQ ID NO: 2946255 - DNA, 19 bp, Homo sapiens
catgcactgttccccctgt

SEQ ID NO: 2946256 - DNA, 15 bp, Homo sapiens
catgcaggaaggaaa

SEQ ID NO: 2946257 - DNA, 16 bp, Homo sapiens
catgcaggaaggaaaa

SEQ ID NO: 2946258 - DNA, 18 bp, Homo sapiens
catgcaggaaggaaaact

SEQ ID NO: 2946259 - DNA, 12 bp, Homo sapiens
catgcagtttga

SEQ ID NO: 2946260 - DNA, 21 bp, Homo sapiens
catgcagtttgaaattctgaa

SEQ ID NO: 2946261 - DNA, 22 bp, Homo sapiens
catgcagtttgaaattctgaat

SEQ ID NO: 2946262 - DNA, 20 bp, Homo sapiens
catgcatacttcaaaagtat

SEQ ID NO: 2946263 - DNA, 14 bp, Homo sapiens
catgcatgacactt

SEQ ID NO: 2946264 - DNA, 18 bp, Homo sapiens
catgccaggacccgccag

SEQ ID NO: 2946265 - DNA, 14 bp, Homo sapiens
catgccccaggctc

SEQ ID NO: 2946266 - DNA, 15 bp, Homo sapiens
catgccccaggctct

SEQ ID NO: 2946267 - DNA, 23 bp, Homo sapiens
catgccctgccgtggtggcagct

SEQ ID NO: 2946268 - DNA, 19 bp, Homo sapiens
catgccctgtgcaacctct

SEQ ID NO: 2946269 - DNA, 13 bp, Homo sapiens
catgccctgtgtg

SEQ ID NO: 2946270 - DNA, 18 bp, Homo sapiens
catgcctcactaattttt

SEQ ID NO: 2946271 - DNA, 11 bp, Homo sapiens
catgcctcagc

SEQ ID NO: 2946272 - DNA, 19 bp, Homo sapiens
catgcctcagccctgaccc

SEQ ID NO: 2946273 - DNA, 20 bp, Homo sapiens
catgcctcagccctgaccct

SEQ ID NO: 2946274 - DNA, 12 bp, Homo sapiens
catgcctctgag

SEQ ID NO: 2946275 - DNA, 15 bp, Homo sapiens
catgcctgattttaa

SEQ ID NO: 2946276 - DNA, 21 bp, Homo sapiens
catgcctgtaatcccagaact

SEQ ID NO: 2946277 - DNA, 18 bp, Homo sapiens
catgcctgtagtctcagc

SEQ ID NO: 2946278 - DNA, 13 bp, Homo sapiens
catgcctgtggct

SEQ ID NO: 2946279 - DNA, 17 bp, Homo sapiens
catgcctgtggctgcgc

SEQ ID NO: 2946280 - DNA, 19 bp, Homo sapiens
catgcctgtggctgcgctt

SEQ ID NO: 2946281 - DNA, 17 bp, Homo sapiens
catgcgccaccatgccc

SEQ ID NO: 2946282 - DNA, 15 bp, Homo sapiens
catgcggtagccagc

SEQ ID NO: 2946283 - DNA, 12 bp, Homo sapiens
catgctccaggg

SEQ ID NO: 2946284 - DNA, 15 bp, Homo sapiens
catgctccagggtca

SEQ ID NO: 2946285 - DNA, 20 bp, Homo sapiens
catgctcccaactcccttct

SEQ ID NO: 2946286 - DNA, 14 bp, Homo sapiens
catgctctctgcag

SEQ ID NO: 2946287 - DNA, 19 bp, Homo sapiens
catgctcttgttctgttcc

SEQ ID NO: 2946288 - DNA, 22 bp, Homo sapiens
catgctgccaggaaacaaggga

SEQ ID NO: 2946289 - DNA, 22 bp, Homo sapiens
catgctgcgcatgttttcttca

SEQ ID NO: 2946290 - DNA, 16 bp, Homo sapiens
catgctgttgattgct

SEQ ID NO: 2946291 - DNA, 19 bp, Homo sapiens
catgctgttgattgctaaa

SEQ ID NO: 2946292 - DNA, 15 bp, Homo sapiens
catgctttcacctac

SEQ ID NO: 2946293 - DNA, 22 bp, Homo sapiens
catgctttcacctacacaagca

SEQ ID NO: 2946294 - DNA, 18 bp, Homo sapiens
catggaaagggtcttcct

SEQ ID NO: 2946295 - DNA, 20 bp, Homo sapiens
catggaaagggtcttccttc

SEQ ID NO: 2946296 - DNA, 22 bp, Homo sapiens
catggaaagggtcttccttctc

SEQ ID NO: 2946297 - DNA, 21 bp, Homo sapiens
catggaacacaaacacattgt

SEQ ID NO: 2946298 - DNA, 16 bp, Homo sapiens
catggaagttggggca

SEQ ID NO: 2946299 - DNA, 22 bp, Homo sapiens
catggaatggttataaaagtga

SEQ ID NO: 2946300 - DNA, 15 bp, Homo sapiens
catggagaaaccctg

SEQ ID NO: 2946301 - DNA, 20 bp, Homo sapiens
catggagaaaccctgtctct

SEQ ID NO: 2946302 - DNA, 16 bp, Homo sapiens
catggagacgcatttc

SEQ ID NO: 2946303 - DNA, 21 bp, Homo sapiens
catggagatagccccacagga

SEQ ID NO: 2946304 - DNA, 14 bp, Homo sapiens
catggagccagctc

SEQ ID NO: 2946305 - DNA, 19 bp, Homo sapiens
catggagctcttccatttc

SEQ ID NO: 2946306 - DNA, 19 bp, Homo sapiens
catggatgggggaactcag

SEQ ID NO: 2946307 - DNA, 12 bp, Homo sapiens
catggatgtttt

SEQ ID NO: 2946308 - DNA, 22 bp, Homo sapiens
catggatgttttagccattgtt

SEQ ID NO: 2946309 - DNA, 18 bp, Homo sapiens
catggattccaaagcatt

SEQ ID NO: 2946310 - DNA, 19 bp, Homo sapiens
catggcactccctccagca

SEQ ID NO: 2946311 - DNA, 21 bp, Homo sapiens
catggcactccctccagcaca

SEQ ID NO: 2946312 - DNA, 13 bp, Homo sapiens
catggcagaaggc

SEQ ID NO: 2946313 - DNA, 20 bp, Homo sapiens
catggcagctgggcccacag

SEQ ID NO: 2946314 - DNA, 23 bp, Homo sapiens
catggcagctgggcccacagccc

SEQ ID NO: 2946315 - DNA, 17 bp, Homo sapiens
aggggaacactgccctc

SEQ ID NO: 2946316 - DNA, 14 bp, Homo sapiens
aggggaagctgcta

SEQ ID NO: 2946317 - DNA, 15 bp, Homo sapiens
aggggaagggcaggc

SEQ ID NO: 2946318 - DNA, 21 bp, Homo sapiens
aggggaaggggccggggaggg

SEQ ID NO: 2946319 - DNA, 22 bp, Homo sapiens
aggggacactggccccacagga

SEQ ID NO: 2946320 - DNA, 16 bp, Homo sapiens
aggggacccatggggg

SEQ ID NO: 2946321 - DNA, 22 bp, Homo sapiens
aggggacgcaggcccctctcct

SEQ ID NO: 2946322 - DNA, 13 bp, Homo sapiens
aggggacgggaca

SEQ ID NO: 2946323 - DNA, 16 bp, Homo sapiens
aggggacgggacagac

SEQ ID NO: 2946324 - DNA, 16 bp, Homo sapiens
aggggacgggcaagtg

SEQ ID NO: 2946325 - DNA, 16 bp, Homo sapiens
aggggacgtgggccct

SEQ ID NO: 2946326 - DNA, 17 bp, Homo sapiens
aggggagaatgcagccc

SEQ ID NO: 2946327 - DNA, 18 bp, Homo sapiens
aggggagaatgcagccca

SEQ ID NO: 2946328 - DNA, 17 bp, Homo sapiens
aggggagagggtctgga

SEQ ID NO: 2946329 - DNA, 11 bp, Homo sapiens
aggggagccag

SEQ ID NO: 2946330 - DNA, 17 bp, Homo sapiens
aggggagcccactgtcc

SEQ ID NO: 2946331 - DNA, 14 bp, Homo sapiens
aggggatgggaggt

SEQ ID NO: 2946332 - DNA, 15 bp, Homo sapiens
aggggatggtgttgt

SEQ ID NO: 2946333 - DNA, 20 bp, Homo sapiens
aggggatgtttacctggtgc

SEQ ID NO: 2946334 - DNA, 16 bp, Homo sapiens
aggggcagccacacca

SEQ ID NO: 2946335 - DNA, 13 bp, Homo sapiens
aggggcaggaggg

SEQ ID NO: 2946336 - DNA, 20 bp, Homo sapiens
aggggcccccctgccctgtg

SEQ ID NO: 2946337 - DNA, 15 bp, Homo sapiens
aggggcccctggccc

SEQ ID NO: 2946338 - DNA, 18 bp, Homo sapiens
aggggcccctggcccagg

SEQ ID NO: 2946339 - DNA, 20 bp, Homo sapiens
aggggcccctggcccaggag

SEQ ID NO: 2946340 - DNA, 21 bp, Homo sapiens
aggggcccctggcccaggagg

SEQ ID NO: 2946341 - DNA, 13 bp, Homo sapiens
aggggcccggcca

SEQ ID NO: 2946342 - DNA, 19 bp, Homo sapiens
aggggcccggccagccatg

SEQ ID NO: 2946343 - DNA, 21 bp, Homo sapiens
aggggcccggtggcggcaggg

SEQ ID NO: 2946344 - DNA, 22 bp, Homo sapiens
aggggcccggtggcggcagggc

SEQ ID NO: 2946345 - DNA, 14 bp, Homo sapiens
aggggccctcactc

SEQ ID NO: 2946346 - DNA, 13 bp, Homo sapiens
aggggccggccct

SEQ ID NO: 2946347 - DNA, 17 bp, Homo sapiens
aggggccggccctgtgt

SEQ ID NO: 2946348 - DNA, 21 bp, Homo sapiens
aggggccggccctgtgtgcag

SEQ ID NO: 2946349 - DNA, 16 bp, Homo sapiens
aggggccggggagggg

SEQ ID NO: 2946350 - DNA, 18 bp, Homo sapiens
aggggccggggagggggc

SEQ ID NO: 2946351 - DNA, 19 bp, Homo sapiens
aggggccggggagggggca

SEQ ID NO: 2946352 - DNA, 20 bp, Homo sapiens
aggggcgctcgcttccgcat

SEQ ID NO: 2946353 - DNA, 17 bp, Homo sapiens
aggggcgggaatattgt

SEQ ID NO: 2946354 - DNA, 20 bp, Homo sapiens
aggggcgtgggagtggcctg

SEQ ID NO: 2946355 - DNA, 18 bp, Homo sapiens
aggggctagggaggacca

SEQ ID NO: 2946356 - DNA, 14 bp, Homo sapiens
aggggctgagtgag

SEQ ID NO: 2946357 - DNA, 14 bp, Homo sapiens
aggggctgctgggg

SEQ ID NO: 2946358 - DNA, 16 bp, Homo sapiens
aggggctgctgggggc

SEQ ID NO: 2946359 - DNA, 16 bp, Homo sapiens
aggggctggggagggg

SEQ ID NO: 2946360 - DNA, 19 bp, Homo sapiens
aggggcttggtcctagggt

SEQ ID NO: 2946361 - DNA, 23 bp, Homo sapiens
aggggcttggtgtttgtaagaaa

SEQ ID NO: 2946362 - DNA, 19 bp, Homo sapiens
agggggaaggctgcaaagt

SEQ ID NO: 2946363 - DNA, 16 bp, Homo sapiens
agggggagagggctgc

SEQ ID NO: 2946364 - DNA, 23 bp, Homo sapiens
agggggagtccctcgtctcttgt

SEQ ID NO: 2946365 - DNA, 23 bp, Homo sapiens
agggggatgccactcctccctcc

SEQ ID NO: 2946366 - DNA, 17 bp, Homo sapiens
agggggccctggggcct

SEQ ID NO: 2946367 - DNA, 12 bp, Homo sapiens
agggggcctgga

SEQ ID NO: 2946368 - DNA, 14 bp, Homo sapiens
agggggcggcaggg

SEQ ID NO: 2946369 - DNA, 22 bp, Homo sapiens
aggggggtcggaagcctgtcct

SEQ ID NO: 2946370 - DNA, 24 bp, Homo sapiens
aggggggtcggaagcctgtcctca

SEQ ID NO: 2946371 - DNA, 17 bp, Homo sapiens
aggggtcatccttgccc

SEQ ID NO: 2946372 - DNA, 23 bp, Homo sapiens
aggggtccctagcagcccaccct

SEQ ID NO: 2946373 - DNA, 19 bp, Homo sapiens
aggggtcgacttcgggctg

SEQ ID NO: 2946374 - DNA, 16 bp, Homo sapiens
aggggtgacacagact

SEQ ID NO: 2946375 - DNA, 23 bp, Homo sapiens
aggggtgacacagactcatcctg

SEQ ID NO: 2946376 - DNA, 16 bp, Homo sapiens
aggggtgtccgagagg

SEQ ID NO: 2946377 - DNA, 19 bp, Homo sapiens
aggggtgtccgagaggctg

SEQ ID NO: 2946378 - DNA, 19 bp, Homo sapiens
aggggttccttccacttct

SEQ ID NO: 2946379 - DNA, 22 bp, Homo sapiens
agggtaagctagagagaaaaag

SEQ ID NO: 2946380 - DNA, 15 bp, Homo sapiens
agggtaaggtgcctt

SEQ ID NO: 2946381 - DNA, 15 bp, Homo sapiens
agggtacctgaaaga

SEQ ID NO: 2946382 - DNA, 19 bp, Homo sapiens
agggtagaaaactccaggg

SEQ ID NO: 2946383 - DNA, 15 bp, Homo sapiens
agggtagaaggaaag

SEQ ID NO: 2946384 - DNA, 14 bp, Homo sapiens
agggtagagcaaag

SEQ ID NO: 2946385 - DNA, 12 bp, Homo sapiens
agggtccctggg

SEQ ID NO: 2946386 - DNA, 18 bp, Homo sapiens
agggtcctctacttcagg

SEQ ID NO: 2946387 - DNA, 22 bp, Homo sapiens
agggtcggaacccaagcttaga

SEQ ID NO: 2946388 - DNA, 22 bp, Homo sapiens
agggtctaccaatacaaaatgt

SEQ ID NO: 2946389 - DNA, 20 bp, Homo sapiens
agggtctagccgctgccctg

SEQ ID NO: 2946390 - DNA, 15 bp, Homo sapiens
agggtctagggagag

SEQ ID NO: 2946391 - DNA, 15 bp, Homo sapiens
agggtctggagaagc

SEQ ID NO: 2946392 - DNA, 18 bp, Homo sapiens
agggtcttttcatctggg

SEQ ID NO: 2946393 - DNA, 21 bp, Homo sapiens
agggtcttttcatctgggaaa

SEQ ID NO: 2946394 - DNA, 23 bp, Homo sapiens
agggtgattttatgatcagtgtt

SEQ ID NO: 2946395 - DNA, 23 bp, Homo sapiens
agggtgctaaagccaaccagcct

SEQ ID NO: 2946396 - DNA, 12 bp, Homo sapiens
agggtggcccag

SEQ ID NO: 2946397 - DNA, 21 bp, Homo sapiens
agggtggctgggtccagggga

SEQ ID NO: 2946398 - DNA, 17 bp, Homo sapiens
agggtgggatggaggag

SEQ ID NO: 2946399 - DNA, 19 bp, Homo sapiens
agggtggtggtattctgtc

SEQ ID NO: 2946400 - DNA, 20 bp, Homo sapiens
agggtgtgtttgaaatcatc

SEQ ID NO: 2946401 - DNA, 20 bp, Homo sapiens
agggttacagagacctatgt

SEQ ID NO: 2946402 - DNA, 16 bp, Homo sapiens
agggttcacacagccc

SEQ ID NO: 2946403 - DNA, 18 bp, Homo sapiens
agggttcacacagcccag

SEQ ID NO: 2946404 - DNA, 19 bp, Homo sapiens
agggttcatcatccctccc

SEQ ID NO: 2946405 - DNA, 15 bp, Homo sapiens
agggttgattaaggc

SEQ ID NO: 2946406 - DNA, 17 bp, Homo sapiens
agggttgcttctgagtg

SEQ ID NO: 2946407 - DNA, 17 bp, Homo sapiens
agggtttcttaaatata

SEQ ID NO: 2946408 - DNA, 16 bp, Homo sapiens
agggttttaatgtaga

SEQ ID NO: 2946409 - DNA, 17 bp, Homo sapiens
agggttttaatgtagat

SEQ ID NO: 2946410 - DNA, 17 bp, Homo sapiens
agggttttgcaataact

SEQ ID NO: 2946411 - DNA, 14 bp, Homo sapiens
agggttttggcctg

SEQ ID NO: 2946412 - DNA, 16 bp, Homo sapiens
agggttttggcctgcc

SEQ ID NO: 2946413 - DNA, 21 bp, Homo sapiens
aggtaaaaaaaagaagtgtgc

SEQ ID NO: 2946414 - DNA, 14 bp, Homo sapiens
aggtaaaatgccat

SEQ ID NO: 2946415 - DNA, 22 bp, Homo sapiens
aggtaaaatgccatgatgcctc

SEQ ID NO: 2946416 - DNA, 16 bp, Homo sapiens
aggtaaaggatgaggg

SEQ ID NO: 2946417 - DNA, 14 bp, Homo sapiens
aggtaaatacaagt

SEQ ID NO: 2946418 - DNA, 16 bp, Homo sapiens
aggtaaatcttagtga

SEQ ID NO: 2946419 - DNA, 20 bp, Homo sapiens
aggtaacatttatagaagaa

SEQ ID NO: 2946420 - DNA, 13 bp, Homo sapiens
aggtaactttgaa

SEQ ID NO: 2946421 - DNA, 21 bp, Homo sapiens
aggtaatccaagatattttaa

SEQ ID NO: 2946422 - DNA, 12 bp, Homo sapiens
aggtacactctt

SEQ ID NO: 2946423 - DNA, 18 bp, Homo sapiens
aggtacccaatagctgcc

SEQ ID NO: 2946424 - DNA, 20 bp, Homo sapiens
aggtaccctgggtgtccccg

SEQ ID NO: 2946425 - DNA, 15 bp, Homo sapiens
aggtacgcacagaca

SEQ ID NO: 2946426 - DNA, 17 bp, Homo sapiens
aggtacttggagggctc

SEQ ID NO: 2946427 - DNA, 19 bp, Homo sapiens
aggtagctgcccctggctc

SEQ ID NO: 2946428 - DNA, 23 bp, Homo sapiens
aggtagctttgaggtggaagagg

SEQ ID NO: 2946429 - DNA, 15 bp, Homo sapiens
aggtagggagatatt

SEQ ID NO: 2946430 - DNA, 23 bp, Homo sapiens
aggtataggggtcctgggggcag

SEQ ID NO: 2946431 - DNA, 19 bp, Homo sapiens
aggtatctttatagttgta

SEQ ID NO: 2946432 - DNA, 14 bp, Homo sapiens
aggtatgttgcctt

SEQ ID NO: 2946433 - DNA, 23 bp, Homo sapiens
aggtatttgggaaacttgtcact

SEQ ID NO: 2946434 - DNA, 14 bp, Homo sapiens
aggtcaataaactt

SEQ ID NO: 2946435 - DNA, 18 bp, Homo sapiens
aggtcaatacagtacagg

SEQ ID NO: 2946436 - DNA, 17 bp, Homo sapiens
aggtcactgtcactgcc

SEQ ID NO: 2946437 - DNA, 19 bp, Homo sapiens
aggtcactgtcactgccga

SEQ ID NO: 2946438 - DNA, 18 bp, Homo sapiens
atgacttttaaaatttgt

SEQ ID NO: 2946439 - DNA, 13 bp, Homo sapiens
atgactttttata

SEQ ID NO: 2946440 - DNA, 14 bp, Homo sapiens
atgagaaagccttc

SEQ ID NO: 2946441 - DNA, 15 bp, Homo sapiens
atgagaaagccttct

SEQ ID NO: 2946442 - DNA, 11 bp, Homo sapiens
atgagaaagga

SEQ ID NO: 2946443 - DNA, 20 bp, Homo sapiens
atgagaaagggagaggaaga

SEQ ID NO: 2946444 - DNA, 15 bp, Homo sapiens
atgagaaatacaaaa

SEQ ID NO: 2946445 - DNA, 12 bp, Homo sapiens
atgagaaatgta

SEQ ID NO: 2946446 - DNA, 16 bp, Homo sapiens
atgagaaatgtaatgc

SEQ ID NO: 2946447 - DNA, 13 bp, Homo sapiens
atgagaacatggt

SEQ ID NO: 2946448 - DNA, 23 bp, Homo sapiens
atgagaagaaaatggaaccaggc

SEQ ID NO: 2946449 - DNA, 19 bp, Homo sapiens
atgagaagatcctgtcaca

SEQ ID NO: 2946450 - DNA, 16 bp, Homo sapiens
atgagaaggaacttcc

SEQ ID NO: 2946451 - DNA, 16 bp, Homo sapiens
atgagaagtactttgt

SEQ ID NO: 2946452 - DNA, 21 bp, Homo sapiens
atgagacccattcctatttct

SEQ ID NO: 2946453 - DNA, 14 bp, Homo sapiens
atgagacttaattt

SEQ ID NO: 2946454 - DNA, 19 bp, Homo sapiens
atgagataggcacatgcat

SEQ ID NO: 2946455 - DNA, 21 bp, Homo sapiens
atgagatatatctttatactt

SEQ ID NO: 2946456 - DNA, 13 bp, Homo sapiens
atgagatccttta

SEQ ID NO: 2946457 - DNA, 23 bp, Homo sapiens
atgagatgatacatccaaagcag

SEQ ID NO: 2946458 - DNA, 14 bp, Homo sapiens
atgagatgtgtgga

SEQ ID NO: 2946459 - DNA, 22 bp, Homo sapiens
atgagatgtgtggactgtggca

SEQ ID NO: 2946460 - DNA, 16 bp, Homo sapiens
atgagatttttaaaaa

SEQ ID NO: 2946461 - DNA, 21 bp, Homo sapiens
atgagcattggatacagcagt

SEQ ID NO: 2946462 - DNA, 23 bp, Homo sapiens
atgagcattggatacagcagtag

SEQ ID NO: 2946463 - DNA, 23 bp, Homo sapiens
atgagcctacgctgaagatggca

SEQ ID NO: 2946464 - DNA, 20 bp, Homo sapiens
atgagcctgtttattgccat

SEQ ID NO: 2946465 - DNA, 22 bp, Homo sapiens
atgagcctgtttattgccatta

SEQ ID NO: 2946466 - DNA, 23 bp, Homo sapiens
atgagctaaataagtcaccattg

SEQ ID NO: 2946467 - DNA, 22 bp, Homo sapiens
atgagctcgcatttgtcaatga

SEQ ID NO: 2946468 - DNA, 16 bp, Homo sapiens
atgaggaactgtagat

SEQ ID NO: 2946469 - DNA, 21 bp, Homo sapiens
atgaggaactgtagatgatgt

SEQ ID NO: 2946470 - DNA, 21 bp, Homo sapiens
atgaggaggggcccccctgcc

SEQ ID NO: 2946471 - DNA, 22 bp, Homo sapiens
atgaggctgctttccaaagcca

SEQ ID NO: 2946472 - DNA, 13 bp, Homo sapiens
atgagggtcttgg

SEQ ID NO: 2946473 - DNA, 15 bp, Homo sapiens
atgagggttcatcat

SEQ ID NO: 2946474 - DNA, 18 bp, Homo sapiens
atgagtccttgaaaatat

SEQ ID NO: 2946475 - DNA, 20 bp, Homo sapiens
atgagtccttgaaaatattt

SEQ ID NO: 2946476 - DNA, 21 bp, Homo sapiens
atgagtctacctgagcattca

SEQ ID NO: 2946477 - DNA, 13 bp, Homo sapiens
atgagtctagatg

SEQ ID NO: 2946478 - DNA, 19 bp, Homo sapiens
atgagtctgttgtgtgtca

SEQ ID NO: 2946479 - DNA, 12 bp, Homo sapiens
atgagtggccag

SEQ ID NO: 2946480 - DNA, 19 bp, Homo sapiens
atgagtggccagcgccagg

SEQ ID NO: 2946481 - DNA, 17 bp, Homo sapiens
atgagtggctttaatga

SEQ ID NO: 2946482 - DNA, 20 bp, Homo sapiens
atgagttgttttcagactca

SEQ ID NO: 2946483 - DNA, 22 bp, Homo sapiens
atgagttgttttcagactcaga

SEQ ID NO: 2946484 - DNA, 12 bp, Homo sapiens
atgagtttttat

SEQ ID NO: 2946485 - DNA, 13 bp, Homo sapiens
atgagtttttccc

SEQ ID NO: 2946486 - DNA, 13 bp, Homo sapiens
atgataaaaggaa

SEQ ID NO: 2946487 - DNA, 17 bp, Homo sapiens
atgataaaaggaatctg

SEQ ID NO: 2946488 - DNA, 15 bp, Homo sapiens
atgataaacattcat

SEQ ID NO: 2946489 - DNA, 17 bp, Homo sapiens
atgataagattgaaatt

SEQ ID NO: 2946490 - DNA, 19 bp, Homo sapiens
atgataatagattctcttg

SEQ ID NO: 2946491 - DNA, 12 bp, Homo sapiens
atgatacagtgt

SEQ ID NO: 2946492 - DNA, 22 bp, Homo sapiens
atgatacagtgttttttaggaa

SEQ ID NO: 2946493 - DNA, 18 bp, Homo sapiens
atgatactcatttcttat

SEQ ID NO: 2946494 - DNA, 23 bp, Homo sapiens
atgatagaactgtactgttttct

SEQ ID NO: 2946495 - DNA, 16 bp, Homo sapiens
atgatagtgcaaggaa

SEQ ID NO: 2946496 - DNA, 13 bp, Homo sapiens
atgatagttttct

SEQ ID NO: 2946497 - DNA, 21 bp, Homo sapiens
atgatagttttctagatgaca

SEQ ID NO: 2946498 - DNA, 12 bp, Homo sapiens
atgatatttctt

SEQ ID NO: 2946499 - DNA, 20 bp, Homo sapiens
atgatcaattatagtttctg

SEQ ID NO: 2946500 - DNA, 13 bp, Homo sapiens
atgatcagggatc

SEQ ID NO: 2946501 - DNA, 16 bp, Homo sapiens
atgatcagggatccaa

SEQ ID NO: 2946502 - DNA, 13 bp, Homo sapiens
atgatcagtgttg

SEQ ID NO: 2946503 - DNA, 20 bp, Homo sapiens
atgatcagtgttgttgctct

SEQ ID NO: 2946504 - DNA, 15 bp, Homo sapiens
atgatccaagcaaga

SEQ ID NO: 2946505 - DNA, 12 bp, Homo sapiens
atgatcctcagt

SEQ ID NO: 2946506 - DNA, 13 bp, Homo sapiens
atgatcctcagtg

SEQ ID NO: 2946507 - DNA, 14 bp, Homo sapiens
atgatctccctgcc

SEQ ID NO: 2946508 - DNA, 15 bp, Homo sapiens
atgatcttggaccat

SEQ ID NO: 2946509 - DNA, 19 bp, Homo sapiens
atgatgaaaatatttaaag

SEQ ID NO: 2946510 - DNA, 17 bp, Homo sapiens
atgatgacaaaaaatgt

SEQ ID NO: 2946511 - DNA, 14 bp, Homo sapiens
atgatgacttgagc

SEQ ID NO: 2946512 - DNA, 18 bp, Homo sapiens
atgatgacttgagccctg

SEQ ID NO: 2946513 - DNA, 20 bp, Homo sapiens
atgatgatcaattatagttt

SEQ ID NO: 2946514 - DNA, 14 bp, Homo sapiens
atgatgatgataat

SEQ ID NO: 2946515 - DNA, 20 bp, Homo sapiens
atgatgatgtggaagaactt

SEQ ID NO: 2946516 - DNA, 21 bp, Homo sapiens
atgatgcaaccaaaagggaaa

SEQ ID NO: 2946517 - DNA, 15 bp, Homo sapiens
atgatgcatggagtg

SEQ ID NO: 2946518 - DNA, 21 bp, Homo sapiens
atgatgggaaaatatttcctg

SEQ ID NO: 2946519 - DNA, 16 bp, Homo sapiens
atgatggtcacttaaa

SEQ ID NO: 2946520 - DNA, 13 bp, Homo sapiens
atgatgttatctt

SEQ ID NO: 2946521 - DNA, 17 bp, Homo sapiens
atgatgttgataatttc

SEQ ID NO: 2946522 - DNA, 21 bp, Homo sapiens
atgatgtttcgtgaagtatac

SEQ ID NO: 2946523 - DNA, 18 bp, Homo sapiens
atgatgtttcttttgcaa

SEQ ID NO: 2946524 - DNA, 12 bp, Homo sapiens
atgattaatcag

SEQ ID NO: 2946525 - DNA, 15 bp, Homo sapiens
atgattccaggtggc

SEQ ID NO: 2946526 - DNA, 16 bp, Homo sapiens
atgattccaggtggca

SEQ ID NO: 2946527 - DNA, 18 bp, Homo sapiens
atgattctagtacataat

SEQ ID NO: 2946528 - DNA, 23 bp, Homo sapiens
atgattctatttatatgtacatg

SEQ ID NO: 2946529 - DNA, 15 bp, Homo sapiens
atgattctctgtggt

SEQ ID NO: 2946530 - DNA, 23 bp, Homo sapiens
atgattctgaagcttatgtttct

SEQ ID NO: 2946531 - DNA, 21 bp, Homo sapiens
atgattgttcttttgtttcat

SEQ ID NO: 2946532 - DNA, 17 bp, Homo sapiens
atgattgtttgcacaga

SEQ ID NO: 2946533 - DNA, 19 bp, Homo sapiens
atgattgtttgcacagagg

SEQ ID NO: 2946534 - DNA, 14 bp, Homo sapiens
atgatttaaaacat

SEQ ID NO: 2946535 - DNA, 18 bp, Homo sapiens
atgatttaaaacatgtaa

SEQ ID NO: 2946536 - DNA, 13 bp, Homo sapiens
atgatttcagaag

SEQ ID NO: 2946537 - DNA, 14 bp, Homo sapiens
atgatttcagtagc

SEQ ID NO: 2946538 - DNA, 19 bp, Homo sapiens
atgatttccctccagagaa

SEQ ID NO: 2946539 - DNA, 15 bp, Homo sapiens
atgatttccttgaat

SEQ ID NO: 2946540 - DNA, 12 bp, Homo sapiens
atgatttgcaat

SEQ ID NO: 2946541 - DNA, 11 bp, Homo sapiens
atgatttgtac

SEQ ID NO: 2946542 - DNA, 15 bp, Homo sapiens
atgcaaaaaagaaac

SEQ ID NO: 2946543 - DNA, 17 bp, Homo sapiens
atgcaaaagaaagcaaa

SEQ ID NO: 2946544 - DNA, 13 bp, Homo sapiens
atgcaaagaactc

SEQ ID NO: 2946545 - DNA, 12 bp, Homo sapiens
atgcaaccaaaa

SEQ ID NO: 2946546 - DNA, 22 bp, Homo sapiens
atgcaaccaaaagggaaaaaat

SEQ ID NO: 2946547 - DNA, 20 bp, Homo sapiens
atgcaactcgccctgtttgg

SEQ ID NO: 2946548 - DNA, 23 bp, Homo sapiens
atgcaagatagtttatctaactt

SEQ ID NO: 2946549 - DNA, 12 bp, Homo sapiens
atgcaaggatta

SEQ ID NO: 2946550 - DNA, 21 bp, Homo sapiens
atgcaaggattacagaaactg

SEQ ID NO: 2946551 - DNA, 15 bp, Homo sapiens
atgcaagggtgacat

SEQ ID NO: 2946552 - DNA, 14 bp, Homo sapiens
atgcaagtgctgtt

SEQ ID NO: 2946553 - DNA, 23 bp, Homo sapiens
atgcaatagaagtgctcccctct

SEQ ID NO: 2946554 - DNA, 19 bp, Homo sapiens
atgcaatatatctaaattg

SEQ ID NO: 2946555 - DNA, 20 bp, Homo sapiens
atgcaatatatctaaattga

SEQ ID NO: 2946556 - DNA, 21 bp, Homo sapiens
atgcaatatatctaaattgaa

SEQ ID NO: 2946557 - DNA, 22 bp, Homo sapiens
atgcaatatatctaaattgaat

SEQ ID NO: 2946558 - DNA, 15 bp, Homo sapiens
atgcaattcagtgtt

SEQ ID NO: 2946559 - DNA, 19 bp, Homo sapiens
atgcaattcagtgttccaa

SEQ ID NO: 2946560 - DNA, 19 bp, Homo sapiens
atgcaattgctcccatcag

SEQ ID NO: 2946561 - DNA, 20 bp, Homo sapiens
atgcacacagcggctgcctc

SEQ ID NO: 2946562 - DNA, 21 bp, Homo sapiens
atgcacacagcggctgcctcc

SEQ ID NO: 2946563 - DNA, 19 bp, Homo sapiens
atgcacatatggactctgc

SEQ ID NO: 2946564 - DNA, 13 bp, Homo sapiens
atgcaccaaatag

SEQ ID NO: 2946565 - DNA, 12 bp, Homo sapiens
atgcacccctgg

SEQ ID NO: 2946566 - DNA, 17 bp, Homo sapiens
atgcaggctcccctgag

SEQ ID NO: 2946567 - DNA, 18 bp, Homo sapiens
atgcagggattgctgcca

SEQ ID NO: 2946568 - DNA, 15 bp, Homo sapiens
atgcagggcagtcat

SEQ ID NO: 2946569 - DNA, 17 bp, Homo sapiens
atgcaggtgaaacccag

SEQ ID NO: 2946570 - DNA, 18 bp, Homo sapiens
atgcaggtgaaacccagt

SEQ ID NO: 2946571 - DNA, 21 bp, Homo sapiens
atgcaggtttgaccaggaaag

SEQ ID NO: 2946572 - DNA, 22 bp, Homo sapiens
atgcagtaacattctacttgct

SEQ ID NO: 2946573 - DNA, 15 bp, Homo sapiens
atgcagtatggtaca

SEQ ID NO: 2946574 - DNA, 18 bp, Homo sapiens
atgcagtctgtccaggct

SEQ ID NO: 2946575 - DNA, 14 bp, Homo sapiens
atgcagtttgaaat

SEQ ID NO: 2946576 - DNA, 16 bp, Homo sapiens
atgcagtttgaaattc

SEQ ID NO: 2946577 - DNA, 17 bp, Homo sapiens
atgcagtttgaaattct

SEQ ID NO: 2946578 - DNA, 22 bp, Homo sapiens
atgcagtttgaaattctgaatt

SEQ ID NO: 2946579 - DNA, 23 bp, Homo sapiens
atgcagtttgaaattctgaattt

SEQ ID NO: 2946580 - DNA, 21 bp, Homo sapiens
atgcataaaagggtcaaacct

SEQ ID NO: 2946581 - DNA, 15 bp, Homo sapiens
atgcataagcttttt

SEQ ID NO: 2946582 - DNA, 11 bp, Homo sapiens
atgcatacaca

SEQ ID NO: 2946583 - DNA, 17 bp, Homo sapiens
atgcatacacacacaca

SEQ ID NO: 2946584 - DNA, 17 bp, Homo sapiens
atgcatacttcaaaagt

SEQ ID NO: 2946585 - DNA, 20 bp, Homo sapiens
atgcatacttcaaaagtatt

SEQ ID NO: 2946586 - DNA, 21 bp, Homo sapiens
atgcatacttcaaaagtattt

SEQ ID NO: 2946587 - DNA, 22 bp, Homo sapiens
atgcatacttcaaaagtatttt

SEQ ID NO: 2946588 - DNA, 13 bp, Homo sapiens
atgcatattcaac

SEQ ID NO: 2946589 - DNA, 20 bp, Homo sapiens
atgcatattcaacacactgc

SEQ ID NO: 2946590 - DNA, 19 bp, Homo sapiens
atgcatcaagaactattgt

SEQ ID NO: 2946591 - DNA, 20 bp, Homo sapiens
atgcatctgtttattctata

SEQ ID NO: 2946592 - DNA, 12 bp, Homo sapiens
atgcatgctaaa

SEQ ID NO: 2946593 - DNA, 19 bp, Homo sapiens
atgcatggtgccccaggac

SEQ ID NO: 2946594 - DNA, 20 bp, Homo sapiens
atgcatggtgccccaggacc

SEQ ID NO: 2946595 - DNA, 21 bp, Homo sapiens
atgcatggtgccccaggacca

SEQ ID NO: 2946596 - DNA, 18 bp, Homo sapiens
atgcatgtcttttaaaat

SEQ ID NO: 2946597 - DNA, 14 bp, Homo sapiens
atgcatgtgaagaa

SEQ ID NO: 2946598 - DNA, 13 bp, Homo sapiens
atgcattcatgtt

SEQ ID NO: 2946599 - DNA, 14 bp, Homo sapiens
atgcattctatcgt

SEQ ID NO: 2946600 - DNA, 23 bp, Homo sapiens
atgcattctatcgttattataaa

SEQ ID NO: 2946601 - DNA, 13 bp, Homo sapiens
atgcattctgata

SEQ ID NO: 2946602 - DNA, 22 bp, Homo sapiens
atgcattctgataggagggggc

SEQ ID NO: 2946603 - DNA, 17 bp, Homo sapiens
atgcattgatattgtga

SEQ ID NO: 2946604 - DNA, 16 bp, Homo sapiens
atgcattgtctgcaat

SEQ ID NO: 2946605 - DNA, 15 bp, Homo sapiens
atgcatttctatcaa

SEQ ID NO: 2946606 - DNA, 20 bp, Homo sapiens
atgcattttgtgtacagtaa

SEQ ID NO: 2946607 - DNA, 16 bp, Homo sapiens
atgccaactgttggaa

SEQ ID NO: 2946608 - DNA, 20 bp, Homo sapiens
atgccaagagtgcacccatg

SEQ ID NO: 2946609 - DNA, 17 bp, Homo sapiens
atgccaatattaaatct

SEQ ID NO: 2946610 - DNA, 14 bp, Homo sapiens
atgccacacacctt

SEQ ID NO: 2946611 - DNA, 15 bp, Homo sapiens
atgccacacaccttt

SEQ ID NO: 2946612 - DNA, 17 bp, Homo sapiens
atgccactcctccctcc

SEQ ID NO: 2946613 - DNA, 21 bp, Homo sapiens
atgccagggccgaccagagga

SEQ ID NO: 2946614 - DNA, 21 bp, Homo sapiens
atgccaggttctatttggaat

SEQ ID NO: 2946615 - DNA, 20 bp, Homo sapiens
atgccagtgtgctgatgggc

SEQ ID NO: 2946616 - DNA, 13 bp, Homo sapiens
atgccataataca

SEQ ID NO: 2946617 - DNA, 16 bp, Homo sapiens
atgccatcatctcctg

SEQ ID NO: 2946618 - DNA, 19 bp, Homo sapiens
atgccatctaccggcgtcc

SEQ ID NO: 2946619 - DNA, 21 bp, Homo sapiens
atgccattttaaggaaaacta

SEQ ID NO: 2946620 - DNA, 16 bp, Homo sapiens
atgcccagccagccac

SEQ ID NO: 2946621 - DNA, 23 bp, Homo sapiens
atgcccaggatttgactcgggcc

SEQ ID NO: 2946622 - DNA, 14 bp, Homo sapiens
atgcccccagctgg

SEQ ID NO: 2946623 - DNA, 15 bp, Homo sapiens
atgcccccagctggc

SEQ ID NO: 2946624 - DNA, 23 bp, Homo sapiens
atgcccccgacccccgcagaggc

SEQ ID NO: 2946625 - DNA, 16 bp, Homo sapiens
atgcccctggctggga

SEQ ID NO: 2946626 - DNA, 15 bp, Homo sapiens
atgccctcctctccc

SEQ ID NO: 2946627 - DNA, 16 bp, Homo sapiens
atgccctggaggtggc

SEQ ID NO: 2946628 - DNA, 23 bp, Homo sapiens
atgccctgtgcaacctcttggcc

SEQ ID NO: 2946629 - DNA, 20 bp, Homo sapiens
atgccgtcttctgccctaac

SEQ ID NO: 2946630 - DNA, 12 bp, Homo sapiens
atgcctccaccg

SEQ ID NO: 2946631 - DNA, 16 bp, Homo sapiens
atgcctctcctttgta

SEQ ID NO: 2946632 - DNA, 17 bp, Homo sapiens
atgcctctcctttgtat

SEQ ID NO: 2946633 - DNA, 13 bp, Homo sapiens
atgcctctgtcta

SEQ ID NO: 2946634 - DNA, 18 bp, Homo sapiens
atgcctgcccgcaccctg

SEQ ID NO: 2946635 - DNA, 16 bp, Homo sapiens
atgcctggcctgccag

SEQ ID NO: 2946636 - DNA, 12 bp, Homo sapiens
atgcctgtggct

SEQ ID NO: 2946637 - DNA, 14 bp, Homo sapiens
atgcctgtggctgc

SEQ ID NO: 2946638 - DNA, 15 bp, Homo sapiens
atgccttagcatgtg

SEQ ID NO: 2946639 - DNA, 14 bp, Homo sapiens
atgcctttcatctt

SEQ ID NO: 2946640 - DNA, 17 bp, Homo sapiens
atgcctttcatcttgaa

SEQ ID NO: 2946641 - DNA, 20 bp, Homo sapiens
atgcgattttattactggcg

SEQ ID NO: 2946642 - DNA, 12 bp, Homo sapiens
atgcgcagcccc

SEQ ID NO: 2946643 - DNA, 18 bp, Homo sapiens
atgcggtagccagcacac

SEQ ID NO: 2946644 - DNA, 16 bp, Homo sapiens
atgcgtattctgtggc

SEQ ID NO: 2946645 - DNA, 18 bp, Homo sapiens
atgcgtatttgcatttgg

SEQ ID NO: 2946646 - DNA, 17 bp, Homo sapiens
atgctaaataactatat

SEQ ID NO: 2946647 - DNA, 15 bp, Homo sapiens
atgctaaatgtgtaa

SEQ ID NO: 2946648 - DNA, 21 bp, Homo sapiens
atgctaaattattatttagct

SEQ ID NO: 2946649 - DNA, 14 bp, Homo sapiens
atgctaccggggac

SEQ ID NO: 2946650 - DNA, 16 bp, Homo sapiens
atgctacgtgtgattt

SEQ ID NO: 2946651 - DNA, 12 bp, Homo sapiens
atgctactgaaa

SEQ ID NO: 2946652 - DNA, 12 bp, Homo sapiens
atgctactttta

SEQ ID NO: 2946653 - DNA, 17 bp, Homo sapiens
atgctagcgcgttgcct

SEQ ID NO: 2946654 - DNA, 18 bp, Homo sapiens
atgctagcgcgttgcctg

SEQ ID NO: 2946655 - DNA, 19 bp, Homo sapiens
atgctataaattttttgaa

SEQ ID NO: 2946656 - DNA, 18 bp, Homo sapiens
atgctatatatcttttgt

SEQ ID NO: 2946657 - DNA, 21 bp, Homo sapiens
atgctattatactgttatcca

SEQ ID NO: 2946658 - DNA, 15 bp, Homo sapiens
atgctcaatttcagc

SEQ ID NO: 2946659 - DNA, 19 bp, Homo sapiens
atgctccaagattctagat

SEQ ID NO: 2946660 - DNA, 22 bp, Homo sapiens
atgctccagcaacacagcctgg

SEQ ID NO: 2946661 - DNA, 21 bp, Homo sapiens
atgctctatcttgctctgtaa

SEQ ID NO: 2946662 - DNA, 23 bp, Homo sapiens
atgctctctgcagccagcccagc

SEQ ID NO: 2946663 - DNA, 15 bp, Homo sapiens
atgctcttgtccctg

SEQ ID NO: 2946664 - DNA, 11 bp, Homo sapiens
atgctctttca

SEQ ID NO: 2946665 - DNA, 17 bp, Homo sapiens
atgctctttcaatgcag

SEQ ID NO: 2946666 - DNA, 13 bp, Homo sapiens
atgctctttccca

SEQ ID NO: 2946667 - DNA, 17 bp, Homo sapiens
atgctctttcccaggac

SEQ ID NO: 2946668 - DNA, 16 bp, Homo sapiens
atgctcttttgtttgg

SEQ ID NO: 2946669 - DNA, 15 bp, Homo sapiens
atgctgacctcacct

SEQ ID NO: 2946670 - DNA, 24 bp, Homo sapiens
atgctgatcatcgccagaggtgct

SEQ ID NO: 2946671 - DNA, 17 bp, Homo sapiens
atgctgatgaatcactg

SEQ ID NO: 2946672 - DNA, 12 bp, Homo sapiens
atgctgatgttc

SEQ ID NO: 2946673 - DNA, 17 bp, Homo sapiens
atgctgatgttcagtgt

SEQ ID NO: 2946674 - DNA, 13 bp, Homo sapiens
atgtcctgccttt

SEQ ID NO: 2946675 - DNA, 14 bp, Homo sapiens
atgtcgagagctgg

SEQ ID NO: 2946676 - DNA, 18 bp, Homo sapiens
atgtcgtgttttcaagga

SEQ ID NO: 2946677 - DNA, 19 bp, Homo sapiens
atgtctactcagcatttga

SEQ ID NO: 2946678 - DNA, 15 bp, Homo sapiens
atgtctatgatagat

SEQ ID NO: 2946679 - DNA, 13 bp, Homo sapiens
atgtctattatta

SEQ ID NO: 2946680 - DNA, 19 bp, Homo sapiens
atgtctctgacaaagtgtg

SEQ ID NO: 2946681 - DNA, 22 bp, Homo sapiens
atgtctgagagaccatctccta

SEQ ID NO: 2946682 - DNA, 14 bp, Homo sapiens
atgtctgccaattt

SEQ ID NO: 2946683 - DNA, 14 bp, Homo sapiens
atgtctgcctggag

SEQ ID NO: 2946684 - DNA, 17 bp, Homo sapiens
atgtctgcctggagtgc

SEQ ID NO: 2946685 - DNA, 22 bp, Homo sapiens
atgtctgcctggagtgctgtgc

SEQ ID NO: 2946686 - DNA, 16 bp, Homo sapiens
atgtctgttgatgact

SEQ ID NO: 2946687 - DNA, 14 bp, Homo sapiens
atgtctgtttgctg

SEQ ID NO: 2946688 - DNA, 20 bp, Homo sapiens
atgtcttcaaggcttcagtc

SEQ ID NO: 2946689 - DNA, 15 bp, Homo sapiens
atgtcttcagtggaa

SEQ ID NO: 2946690 - DNA, 23 bp, Homo sapiens
atgtcttcattggctatataaaa

SEQ ID NO: 2946691 - DNA, 16 bp, Homo sapiens
atgtcttggacactgt

SEQ ID NO: 2946692 - DNA, 10 bp, Homo sapiens
atgtcttgtg

SEQ ID NO: 2946693 - DNA, 20 bp, Homo sapiens
atgtcttgtgtatttctctg

SEQ ID NO: 2946694 - DNA, 21 bp, Homo sapiens
atgtcttgtgtatttctctgt

SEQ ID NO: 2946695 - DNA, 13 bp, Homo sapiens
atgtcttttaaaa

SEQ ID NO: 2946696 - DNA, 15 bp, Homo sapiens
atgtcttttgaatat

SEQ ID NO: 2946697 - DNA, 21 bp, Homo sapiens
atgtcttttttcaaactttat

SEQ ID NO: 2946698 - DNA, 17 bp, Homo sapiens
atgtcttttttttaatg

SEQ ID NO: 2946699 - DNA, 18 bp, Homo sapiens
atgtcttttttttaatgt

SEQ ID NO: 2946700 - DNA, 22 bp, Homo sapiens
atgtcttttttttaatgtgctg

SEQ ID NO: 2946701 - DNA, 18 bp, Homo sapiens
atgtgaaaatcaaataca

SEQ ID NO: 2946702 - DNA, 21 bp, Homo sapiens
atgtgaaagattatttaaatg

SEQ ID NO: 2946703 - DNA, 16 bp, Homo sapiens
atgtgaaaggaacatt

SEQ ID NO: 2946704 - DNA, 18 bp, Homo sapiens
atgtgaaaggaacatttt

SEQ ID NO: 2946705 - DNA, 13 bp, Homo sapiens
atgtgaaattttt

SEQ ID NO: 2946706 - DNA, 12 bp, Homo sapiens
atgtgaaccatt

SEQ ID NO: 2946707 - DNA, 22 bp, Homo sapiens
atgtgaaccattaaccagatct

SEQ ID NO: 2946708 - DNA, 19 bp, Homo sapiens
atgtgaactctcccctccc

SEQ ID NO: 2946709 - DNA, 20 bp, Homo sapiens
atgtgaagacattttttgct

SEQ ID NO: 2946710 - DNA, 21 bp, Homo sapiens
atgtgaagacattttttgcta

SEQ ID NO: 2946711 - DNA, 21 bp, Homo sapiens
atgtgaagtcaccagtggcct

SEQ ID NO: 2946712 - DNA, 20 bp, Homo sapiens
atgtgaagtgttaatactag

SEQ ID NO: 2946713 - DNA, 17 bp, Homo sapiens
atgtgaatatggacagt

SEQ ID NO: 2946714 - DNA, 20 bp, Homo sapiens
atgtgaatatttgtaaaaat

SEQ ID NO: 2946715 - DNA, 21 bp, Homo sapiens
atgtgaatttgagtttgctgt

SEQ ID NO: 2946716 - DNA, 20 bp, Homo sapiens
atgtgacaattttgtacaaa

SEQ ID NO: 2946717 - DNA, 22 bp, Homo sapiens
atgtgacatgcccaaggccacg

SEQ ID NO: 2946718 - DNA, 16 bp, Homo sapiens
atgtgacatgttgctc

SEQ ID NO: 2946719 - DNA, 13 bp, Homo sapiens
atgtgacatttac

SEQ ID NO: 2946720 - DNA, 16 bp, Homo sapiens
atgtgacatttacacc

SEQ ID NO: 2946721 - DNA, 18 bp, Homo sapiens
atgtgaccatgtgaatct

SEQ ID NO: 2946722 - DNA, 12 bp, Homo sapiens
atgtgactctga

SEQ ID NO: 2946723 - DNA, 15 bp, Homo sapiens
atgtgagagaaagtg

SEQ ID NO: 2946724 - DNA, 17 bp, Homo sapiens
atgtgagaggtttgact

SEQ ID NO: 2946725 - DNA, 21 bp, Homo sapiens
atgtgagcagaagactattta

SEQ ID NO: 2946726 - DNA, 20 bp, Homo sapiens
atgtgagtgccttttgcaga

SEQ ID NO: 2946727 - DNA, 17 bp, Homo sapiens
atgtgagtgtgtgtgat

SEQ ID NO: 2946728 - DNA, 20 bp, Homo sapiens
atgtgataaggaaatcaact

SEQ ID NO: 2946729 - DNA, 21 bp, Homo sapiens
atgtgataagttcttatgcca

SEQ ID NO: 2946730 - DNA, 23 bp, Homo sapiens
atgtgatcagctttcaaagcatt

SEQ ID NO: 2946731 - DNA, 19 bp, Homo sapiens
atgtgatgaatactgtatt

SEQ ID NO: 2946732 - DNA, 17 bp, Homo sapiens
atgtgatgttctaaggc

SEQ ID NO: 2946733 - DNA, 16 bp, Homo sapiens
atgtgattaactctta

SEQ ID NO: 2946734 - DNA, 19 bp, Homo sapiens
atgtgattaactcttagaa

SEQ ID NO: 2946735 - DNA, 22 bp, Homo sapiens
atgtgattgtggaatggagatt

SEQ ID NO: 2946736 - DNA, 15 bp, Homo sapiens
atgtgatttaaacaa

SEQ ID NO: 2946737 - DNA, 17 bp, Homo sapiens
atgtgatttaatagtgt

SEQ ID NO: 2946738 - DNA, 18 bp, Homo sapiens
atgtgatttaatagtgtt

SEQ ID NO: 2946739 - DNA, 18 bp, Homo sapiens
atgtgattttaactctgt

SEQ ID NO: 2946740 - DNA, 22 bp, Homo sapiens
atgtgcagcagattggaaggag

SEQ ID NO: 2946741 - DNA, 20 bp, Homo sapiens
atgtgcatacgtatgagata

SEQ ID NO: 2946742 - DNA, 16 bp, Homo sapiens
atgtgccaattttgtc

SEQ ID NO: 2946743 - DNA, 17 bp, Homo sapiens
atgtgccaggcttgcct

SEQ ID NO: 2946744 - DNA, 22 bp, Homo sapiens
atgtgcctgtaatctttttctc

SEQ ID NO: 2946745 - DNA, 18 bp, Homo sapiens
atgtgcgtggaagtgttc

SEQ ID NO: 2946746 - DNA, 20 bp, Homo sapiens
atgtgcgtgtgcgtgttcct

SEQ ID NO: 2946747 - DNA, 23 bp, Homo sapiens
atgtgcgtgtgcgtgttcctttg

SEQ ID NO: 2946748 - DNA, 19 bp, Homo sapiens
atgtgctagtcactggcag

SEQ ID NO: 2946749 - DNA, 21 bp, Homo sapiens
atgtgctatagacattagaga

SEQ ID NO: 2946750 - DNA, 15 bp, Homo sapiens
atgtgctgtgtaaag

SEQ ID NO: 2946751 - DNA, 23 bp, Homo sapiens
atgtgcttgtgctcatgtgtgtg

SEQ ID NO: 2946752 - DNA, 12 bp, Homo sapiens
atgtggagccag

SEQ ID NO: 2946753 - DNA, 13 bp, Homo sapiens
atgtggagccagg

SEQ ID NO: 2946754 - DNA, 15 bp, Homo sapiens
atgtggagccaggcg

SEQ ID NO: 2946755 - DNA, 14 bp, Homo sapiens
atgtggatctgggg

SEQ ID NO: 2946756 - DNA, 14 bp, Homo sapiens
attcatttgaataa

SEQ ID NO: 2946757 - DNA, 14 bp, Homo sapiens
attcattttatatt

SEQ ID NO: 2946758 - DNA, 20 bp, Homo sapiens
attcattttatattgaaaaa

SEQ ID NO: 2946759 - DNA, 13 bp, Homo sapiens
attcatttttaat

SEQ ID NO: 2946760 - DNA, 18 bp, Homo sapiens
attccaacaaagggtttt

SEQ ID NO: 2946761 - DNA, 23 bp, Homo sapiens
attccaactcgtatagcatgcat

SEQ ID NO: 2946762 - DNA, 13 bp, Homo sapiens
attccaagacagt

SEQ ID NO: 2946763 - DNA, 16 bp, Homo sapiens
attccaagactctaga

SEQ ID NO: 2946764 - DNA, 17 bp, Homo sapiens
attccaagactctagag

SEQ ID NO: 2946765 - DNA, 20 bp, Homo sapiens
attccaagtgtattttaaaa

SEQ ID NO: 2946766 - DNA, 13 bp, Homo sapiens
attccaatctaca

SEQ ID NO: 2946767 - DNA, 18 bp, Homo sapiens
attccaattaaatttatt

SEQ ID NO: 2946768 - DNA, 22 bp, Homo sapiens
attccaattaaatttattttac

SEQ ID NO: 2946769 - DNA, 12 bp, Homo sapiens
attccacactgt

SEQ ID NO: 2946770 - DNA, 19 bp, Homo sapiens
attccacagatatcttttt

SEQ ID NO: 2946771 - DNA, 22 bp, Homo sapiens
attccacaggacgaatgcatat

SEQ ID NO: 2946772 - DNA, 23 bp, Homo sapiens
attccacaggacgaatgcatatt

SEQ ID NO: 2946773 - DNA, 15 bp, Homo sapiens
attccagaatgctgt

SEQ ID NO: 2946774 - DNA, 20 bp, Homo sapiens
attccagaatgctgtacatc

SEQ ID NO: 2946775 - DNA, 16 bp, Homo sapiens
attccagagttaaaat

SEQ ID NO: 2946776 - DNA, 13 bp, Homo sapiens
attccagctcatt

SEQ ID NO: 2946777 - DNA, 21 bp, Homo sapiens
attccagctcattcattttat

SEQ ID NO: 2946778 - DNA, 16 bp, Homo sapiens
attccatatatccttt

SEQ ID NO: 2946779 - DNA, 22 bp, Homo sapiens
attccatcacatcacatttaaa

SEQ ID NO: 2946780 - DNA, 13 bp, Homo sapiens
attccatcttgta

SEQ ID NO: 2946781 - DNA, 14 bp, Homo sapiens
attccatcttgtaa

SEQ ID NO: 2946782 - DNA, 12 bp, Homo sapiens
attccatgaatc

SEQ ID NO: 2946783 - DNA, 19 bp, Homo sapiens
attccatgaatcgcttctc

SEQ ID NO: 2946784 - DNA, 19 bp, Homo sapiens
attccatgttttaaaatta

SEQ ID NO: 2946785 - DNA, 12 bp, Homo sapiens
attccatttatg

SEQ ID NO: 2946786 - DNA, 21 bp, Homo sapiens
attccatttgaggatttagaa

SEQ ID NO: 2946787 - DNA, 14 bp, Homo sapiens
attccattttaagt

SEQ ID NO: 2946788 - DNA, 22 bp, Homo sapiens
attcccacccaattcaaaacat

SEQ ID NO: 2946789 - DNA, 17 bp, Homo sapiens
attcccactttcattca

SEQ ID NO: 2946790 - DNA, 23 bp, Homo sapiens
attcccaggccagggctgggtca

SEQ ID NO: 2946791 - DNA, 21 bp, Homo sapiens
attccccatatttgtgttcag

SEQ ID NO: 2946792 - DNA, 16 bp, Homo sapiens
attccccatctcaggc

SEQ ID NO: 2946793 - DNA, 17 bp, Homo sapiens
attccccctgccctgtg

SEQ ID NO: 2946794 - DNA, 19 bp, Homo sapiens
attccccctgccctgtgcc

SEQ ID NO: 2946795 - DNA, 20 bp, Homo sapiens
attccccctgccctgtgccg

SEQ ID NO: 2946796 - DNA, 17 bp, Homo sapiens
attccctagaaacttcc

SEQ ID NO: 2946797 - DNA, 21 bp, Homo sapiens
attccctcctgctactctgtt

SEQ ID NO: 2946798 - DNA, 13 bp, Homo sapiens
attccctcttgtc

SEQ ID NO: 2946799 - DNA, 22 bp, Homo sapiens
attccggaaactagtgtacatt

SEQ ID NO: 2946800 - DNA, 23 bp, Homo sapiens
attccggaaactagtgtacattt

SEQ ID NO: 2946801 - DNA, 13 bp, Homo sapiens
attccggatccta

SEQ ID NO: 2946802 - DNA, 15 bp, Homo sapiens
attccggatcctaag

SEQ ID NO: 2946803 - DNA, 16 bp, Homo sapiens
attccgtagccagctg

SEQ ID NO: 2946804 - DNA, 16 bp, Homo sapiens
attccgtattacattt

SEQ ID NO: 2946805 - DNA, 12 bp, Homo sapiens
attccgtcacca

SEQ ID NO: 2946806 - DNA, 21 bp, Homo sapiens
attcctaaatattttcaagaa

SEQ ID NO: 2946807 - DNA, 21 bp, Homo sapiens
attcctatacgcagcgtgctt

SEQ ID NO: 2946808 - DNA, 21 bp, Homo sapiens
attcctcatcctcagatgctc

SEQ ID NO: 2946809 - DNA, 14 bp, Homo sapiens
attcctctttgctt

SEQ ID NO: 2946810 - DNA, 16 bp, Homo sapiens
attcctgaagaaccag

SEQ ID NO: 2946811 - DNA, 16 bp, Homo sapiens
attcctgatatgattt

SEQ ID NO: 2946812 - DNA, 22 bp, Homo sapiens
attcctgatatgatttaaaaca

SEQ ID NO: 2946813 - DNA, 15 bp, Homo sapiens
attcctgctctccca

SEQ ID NO: 2946814 - DNA, 22 bp, Homo sapiens
attcctgggaaatattccctag

SEQ ID NO: 2946815 - DNA, 18 bp, Homo sapiens
attcctgtaaatgtgaca

SEQ ID NO: 2946816 - DNA, 16 bp, Homo sapiens
attcctgtaactttta

SEQ ID NO: 2946817 - DNA, 14 bp, Homo sapiens
attccttcagggtg

SEQ ID NO: 2946818 - DNA, 15 bp, Homo sapiens
attccttcagggtga

SEQ ID NO: 2946819 - DNA, 15 bp, Homo sapiens
attcctttaaagtga

SEQ ID NO: 2946820 - DNA, 23 bp, Homo sapiens
attcctttaaagtgagtactgtt

SEQ ID NO: 2946821 - DNA, 17 bp, Homo sapiens
attcctttttcttcact

SEQ ID NO: 2946822 - DNA, 16 bp, Homo sapiens
attcgagacagaacct

SEQ ID NO: 2946823 - DNA, 14 bp, Homo sapiens
attcgcatgtttaa

SEQ ID NO: 2946824 - DNA, 22 bp, Homo sapiens
attcgcatgtttaatgtgaact

SEQ ID NO: 2946825 - DNA, 21 bp, Homo sapiens
attcgctgtaccctttaagat

SEQ ID NO: 2946826 - DNA, 12 bp, Homo sapiens
attcgctgtccc

SEQ ID NO: 2946827 - DNA, 12 bp, Homo sapiens
attcgtcttttt

SEQ ID NO: 2946828 - DNA, 13 bp, Homo sapiens
attcgttctgtgg

SEQ ID NO: 2946829 - DNA, 22 bp, Homo sapiens
attctaaaatgtgatgttctaa

SEQ ID NO: 2946830 - DNA, 12 bp, Homo sapiens
attctaaacaga

SEQ ID NO: 2946831 - DNA, 20 bp, Homo sapiens
attctaaacagatgtccctg

SEQ ID NO: 2946832 - DNA, 14 bp, Homo sapiens
attctaaagattct

SEQ ID NO: 2946833 - DNA, 17 bp, Homo sapiens
attctaaagattctata

SEQ ID NO: 2946834 - DNA, 22 bp, Homo sapiens
attctaaagattctatagttct

SEQ ID NO: 2946835 - DNA, 19 bp, Homo sapiens
atgggtcttagctctttct

SEQ ID NO: 2946836 - DNA, 14 bp, Homo sapiens
atgggtgaaggctg

SEQ ID NO: 2946837 - DNA, 19 bp, Homo sapiens
atgggtttcttccagcaga

SEQ ID NO: 2946838 - DNA, 22 bp, Homo sapiens
atgggttttatgagatggatca

SEQ ID NO: 2946839 - DNA, 14 bp, Homo sapiens
atggtaatagcttt

SEQ ID NO: 2946840 - DNA, 22 bp, Homo sapiens
atggtacaacctttattctttt

SEQ ID NO: 2946841 - DNA, 16 bp, Homo sapiens
atggtacatttttcaa

SEQ ID NO: 2946842 - DNA, 17 bp, Homo sapiens
atggtaccaatcatgaa

SEQ ID NO: 2946843 - DNA, 17 bp, Homo sapiens
atggtaggcatttccta

SEQ ID NO: 2946844 - DNA, 18 bp, Homo sapiens
atggtaggcatttcctat

SEQ ID NO: 2946845 - DNA, 19 bp, Homo sapiens
atggtaggggcttaaaaga

SEQ ID NO: 2946846 - DNA, 19 bp, Homo sapiens
atggtatatatacatatat

SEQ ID NO: 2946847 - DNA, 17 bp, Homo sapiens
atggtatcatgtatctc

SEQ ID NO: 2946848 - DNA, 18 bp, Homo sapiens
atggtcacacactgatgc

SEQ ID NO: 2946849 - DNA, 13 bp, Homo sapiens
atggtccaggaga

SEQ ID NO: 2946850 - DNA, 18 bp, Homo sapiens
atggtccaggagaaggcc

SEQ ID NO: 2946851 - DNA, 17 bp, Homo sapiens
atggtcccaggaagcag

SEQ ID NO: 2946852 - DNA, 17 bp, Homo sapiens
atggtcttcagcctctt

SEQ ID NO: 2946853 - DNA, 17 bp, Homo sapiens
atggtcttgatctcctg

SEQ ID NO: 2946854 - DNA, 14 bp, Homo sapiens
atggtgacttttga

SEQ ID NO: 2946855 - DNA, 23 bp, Homo sapiens
atggtgacttttgaaaagaggtg

SEQ ID NO: 2946856 - DNA, 14 bp, Homo sapiens
atggtgccccagga

SEQ ID NO: 2946857 - DNA, 20 bp, Homo sapiens
atggtgccccaggaccagct

SEQ ID NO: 2946858 - DNA, 22 bp, Homo sapiens
atggtgccccaggaccagctca

SEQ ID NO: 2946859 - DNA, 18 bp, Homo sapiens
atggtgctaatattttat

SEQ ID NO: 2946860 - DNA, 20 bp, Homo sapiens
atggtgctacgcctgcatgt

SEQ ID NO: 2946861 - DNA, 18 bp, Homo sapiens
atggtggcttcagctcca

SEQ ID NO: 2946862 - DNA, 22 bp, Homo sapiens
atggtggcttcagctccagccc

SEQ ID NO: 2946863 - DNA, 16 bp, Homo sapiens
atggtgggcttcaggg

SEQ ID NO: 2946864 - DNA, 17 bp, Homo sapiens
atggtgggcttcagggc

SEQ ID NO: 2946865 - DNA, 22 bp, Homo sapiens
atggtgtagccctcccactttg

SEQ ID NO: 2946866 - DNA, 23 bp, Homo sapiens
atggtgtggactgaatgggatca

SEQ ID NO: 2946867 - DNA, 14 bp, Homo sapiens
atggtgtggccatc

SEQ ID NO: 2946868 - DNA, 16 bp, Homo sapiens
atggtgtgtgtctctg

SEQ ID NO: 2946869 - DNA, 17 bp, Homo sapiens
atggtgtgtgtctctga

SEQ ID NO: 2946870 - DNA, 18 bp, Homo sapiens
atggtgtgtgtctctgac

SEQ ID NO: 2946871 - DNA, 19 bp, Homo sapiens
atggtgttcaaaaaacttg

SEQ ID NO: 2946872 - DNA, 18 bp, Homo sapiens
atggttagaaccagcaga

SEQ ID NO: 2946873 - DNA, 14 bp, Homo sapiens
atggttataaaagt

SEQ ID NO: 2946874 - DNA, 12 bp, Homo sapiens
atggttctcaat

SEQ ID NO: 2946875 - DNA, 16 bp, Homo sapiens
atggttctcaatttat

SEQ ID NO: 2946876 - DNA, 15 bp, Homo sapiens
atggttctgcagtca

SEQ ID NO: 2946877 - DNA, 18 bp, Homo sapiens
atggtttagataaaggaa

SEQ ID NO: 2946878 - DNA, 16 bp, Homo sapiens
atggtttcctctggat

SEQ ID NO: 2946879 - DNA, 21 bp, Homo sapiens
atggtttttaaattttgtaat

SEQ ID NO: 2946880 - DNA, 16 bp, Homo sapiens
atgtaaaaaacaaaaa

SEQ ID NO: 2946881 - DNA, 18 bp, Homo sapiens
atgtaaaaaacaaaaaca

SEQ ID NO: 2946882 - DNA, 23 bp, Homo sapiens
atgtaaaacacatacaaaagaat

SEQ ID NO: 2946883 - DNA, 23 bp, Homo sapiens
atgtaaaagacactggtgtatct

SEQ ID NO: 2946884 - DNA, 15 bp, Homo sapiens
atgtaaaaggccaaa

SEQ ID NO: 2946885 - DNA, 18 bp, Homo sapiens
atgtaaaatcttcagctg

SEQ ID NO: 2946886 - DNA, 16 bp, Homo sapiens
atgtaaacagtgcctg

SEQ ID NO: 2946887 - DNA, 17 bp, Homo sapiens
atgtaaacagtgcctgc

SEQ ID NO: 2946888 - DNA, 20 bp, Homo sapiens
atgtaaacataccaacatgt

SEQ ID NO: 2946889 - DNA, 17 bp, Homo sapiens
atgtaaactcttcacct

SEQ ID NO: 2946890 - DNA, 18 bp, Homo sapiens
atgtaaactcttcacctt

SEQ ID NO: 2946891 - DNA, 14 bp, Homo sapiens
atgtaaactgtgca

SEQ ID NO: 2946892 - DNA, 16 bp, Homo sapiens
atgtaaagcttgtctg

SEQ ID NO: 2946893 - DNA, 20 bp, Homo sapiens
atgtaaaggagtcaaaacta

SEQ ID NO: 2946894 - DNA, 15 bp, Homo sapiens
atgtaaataactcta

SEQ ID NO: 2946895 - DNA, 14 bp, Homo sapiens
atgtaaatagattt

SEQ ID NO: 2946896 - DNA, 20 bp, Homo sapiens
atgtaaatagattttaagct

SEQ ID NO: 2946897 - DNA, 18 bp, Homo sapiens
atgtaaatcgggaaggat

SEQ ID NO: 2946898 - DNA, 14 bp, Homo sapiens
atgtaacagaaagg

SEQ ID NO: 2946899 - DNA, 20 bp, Homo sapiens
atgtaactgcattgagaact

SEQ ID NO: 2946900 - DNA, 17 bp, Homo sapiens
atgtaagattatagatt

SEQ ID NO: 2946901 - DNA, 15 bp, Homo sapiens
atgtaagcatacttt

SEQ ID NO: 2946902 - DNA, 15 bp, Homo sapiens
atgtaaggaattgaa

SEQ ID NO: 2946903 - DNA, 11 bp, Homo sapiens
atgtaagggtc

SEQ ID NO: 2946904 - DNA, 18 bp, Homo sapiens
atgtaagtttacctatgt

SEQ ID NO: 2946905 - DNA, 13 bp, Homo sapiens
atgtaataatcat

SEQ ID NO: 2946906 - DNA, 19 bp, Homo sapiens
atgtaataatcattttaga

SEQ ID NO: 2946907 - DNA, 23 bp, Homo sapiens
atgtaataatcattttagaatta

SEQ ID NO: 2946908 - DNA, 19 bp, Homo sapiens
atgtaatcggcttgaattt

SEQ ID NO: 2946909 - DNA, 16 bp, Homo sapiens
atgtaatgatcttgga

SEQ ID NO: 2946910 - DNA, 22 bp, Homo sapiens
atgtaatgcgattttattactg

SEQ ID NO: 2946911 - DNA, 21 bp, Homo sapiens
atgtaatgcttatgtgttgca

SEQ ID NO: 2946912 - DNA, 18 bp, Homo sapiens
atgtaatgttaatgttat

SEQ ID NO: 2946913 - DNA, 11 bp, Homo sapiens
atgtaattgtt

SEQ ID NO: 2946914 - DNA, 12 bp, Homo sapiens
atgtaatttcag

SEQ ID NO: 2946915 - DNA, 17 bp, Homo sapiens
atgtacaaggtatgtac

SEQ ID NO: 2946916 - DNA, 19 bp, Homo sapiens
atgtacaaggtatgtacag

SEQ ID NO: 2946917 - DNA, 23 bp, Homo sapiens
atgtacagacatatttaactggt

SEQ ID NO: 2946918 - DNA, 16 bp, Homo sapiens
atgtacagttgaaata

SEQ ID NO: 2946919 - DNA, 21 bp, Homo sapiens
atgtacatagtaaagtatttt

SEQ ID NO: 2946920 - DNA, 19 bp, Homo sapiens
atgtaccccctttcccttc

SEQ ID NO: 2946921 - DNA, 14 bp, Homo sapiens
atgtacgtttgtat

SEQ ID NO: 2946922 - DNA, 18 bp, Homo sapiens
atgtactgattgagaagt

SEQ ID NO: 2946923 - DNA, 21 bp, Homo sapiens
atgtactggtaattgtacaat

SEQ ID NO: 2946924 - DNA, 16 bp, Homo sapiens
atgtacttatattaag

SEQ ID NO: 2946925 - DNA, 18 bp, Homo sapiens
attctaacggtctgttct

SEQ ID NO: 2946926 - DNA, 22 bp, Homo sapiens
attctaataaatcaatgtgagt

SEQ ID NO: 2946927 - DNA, 15 bp, Homo sapiens
attctacacctggac

SEQ ID NO: 2946928 - DNA, 20 bp, Homo sapiens
attctaccaaccccagataa

SEQ ID NO: 2946929 - DNA, 21 bp, Homo sapiens
attctactaagttattttatg

SEQ ID NO: 2946930 - DNA, 21 bp, Homo sapiens
attctactgagtccctggcaa

SEQ ID NO: 2946931 - DNA, 13 bp, Homo sapiens
attctacttttaa

SEQ ID NO: 2946932 - DNA, 22 bp, Homo sapiens
attctagctgtatgatttgttt

SEQ ID NO: 2946933 - DNA, 17 bp, Homo sapiens
attctagcttttttcct

SEQ ID NO: 2946934 - DNA, 18 bp, Homo sapiens
attctagcttttttcctc

SEQ ID NO: 2946935 - DNA, 18 bp, Homo sapiens
attctaggcctcctggcc

SEQ ID NO: 2946936 - DNA, 16 bp, Homo sapiens
attctatagttctaga

SEQ ID NO: 2946937 - DNA, 15 bp, Homo sapiens
attctatcgttatta

SEQ ID NO: 2946938 - DNA, 19 bp, Homo sapiens
attctatcgttattataaa

SEQ ID NO: 2946939 - DNA, 21 bp, Homo sapiens
attctatcgttattataaatg

SEQ ID NO: 2946940 - DNA, 22 bp, Homo sapiens
attctatcgttattataaatgt

SEQ ID NO: 2946941 - DNA, 23 bp, Homo sapiens
attctatcgttattataaatgtt

SEQ ID NO: 2946942 - DNA, 22 bp, Homo sapiens
attctatttatatgtacatgag

SEQ ID NO: 2946943 - DNA, 19 bp, Homo sapiens
attctatttgtcttctcct

SEQ ID NO: 2946944 - DNA, 20 bp, Homo sapiens
attctatttgtcttctcctt

SEQ ID NO: 2946945 - DNA, 17 bp, Homo sapiens
attctcaaagttttatt

SEQ ID NO: 2946946 - DNA, 17 bp, Homo sapiens
attctcagccacaacca

SEQ ID NO: 2946947 - DNA, 14 bp, Homo sapiens
attctcagtgccaa

SEQ ID NO: 2946948 - DNA, 22 bp, Homo sapiens
attctcagtgccaactgtggct

SEQ ID NO: 2946949 - DNA, 24 bp, Homo sapiens
attctcagtgccaactgtggctgg

SEQ ID NO: 2946950 - DNA, 14 bp, Homo sapiens
attctccacagcaa

SEQ ID NO: 2946951 - DNA, 16 bp, Homo sapiens
attctccctgggcctc

SEQ ID NO: 2946952 - DNA, 11 bp, Homo sapiens
attctcctcct

SEQ ID NO: 2946953 - DNA, 16 bp, Homo sapiens
attctcctcctcctcc

SEQ ID NO: 2946954 - DNA, 22 bp, Homo sapiens
attctcctcctcctccctcctc

SEQ ID NO: 2946955 - DNA, 16 bp, Homo sapiens
attctcctgcctcagc

SEQ ID NO: 2946956 - DNA, 19 bp, Homo sapiens
attctcctgcctcagcctt

SEQ ID NO: 2946957 - DNA, 15 bp, Homo sapiens
attctctccaaaaat

SEQ ID NO: 2946958 - DNA, 19 bp, Homo sapiens
attctctccaaaaatgcac

SEQ ID NO: 2946959 - DNA, 17 bp, Homo sapiens
attctctggctgtaagg

SEQ ID NO: 2946960 - DNA, 12 bp, Homo sapiens
attctctgtctc

SEQ ID NO: 2946961 - DNA, 17 bp, Homo sapiens
attctctgtgtctaaga

SEQ ID NO: 2946962 - DNA, 23 bp, Homo sapiens
attctctgtgtctaagattctag

SEQ ID NO: 2946963 - DNA, 16 bp, Homo sapiens
attctctgtttgcttt

SEQ ID NO: 2946964 - DNA, 17 bp, Homo sapiens
attctctgtttgctttt

SEQ ID NO: 2946965 - DNA, 18 bp, Homo sapiens
attctctgtttgcttttg

SEQ ID NO: 2946966 - DNA, 15 bp, Homo sapiens
attctcttgtataag

SEQ ID NO: 2946967 - DNA, 20 bp, Homo sapiens
attctcttgtataagatcct

SEQ ID NO: 2946968 - DNA, 12 bp, Homo sapiens
attctcttttaa

SEQ ID NO: 2946969 - DNA, 18 bp, Homo sapiens
attctgaaaccacagttt

SEQ ID NO: 2946970 - DNA, 21 bp, Homo sapiens
attctgaagcttatgtttctt

SEQ ID NO: 2946971 - DNA, 15 bp, Homo sapiens
attctgaaggagccc

SEQ ID NO: 2946972 - DNA, 17 bp, Homo sapiens
attctgaattgtccttt

SEQ ID NO: 2946973 - DNA, 17 bp, Homo sapiens
attctgaatttgcaaag

SEQ ID NO: 2946974 - DNA, 13 bp, Homo sapiens
attgcttttatta

SEQ ID NO: 2946975 - DNA, 17 bp, Homo sapiens
attggaaagacaggaag

SEQ ID NO: 2946976 - DNA, 14 bp, Homo sapiens
attggaaggagaca

SEQ ID NO: 2946977 - DNA, 19 bp, Homo sapiens
attggaaggagacacagat

SEQ ID NO: 2946978 - DNA, 19 bp, Homo sapiens
attggacagatttcagtaa

SEQ ID NO: 2946979 - DNA, 14 bp, Homo sapiens
attggagtgcagct

SEQ ID NO: 2946980 - DNA, 17 bp, Homo sapiens
attggatgcatttctat

SEQ ID NO: 2946981 - DNA, 22 bp, Homo sapiens
attggattctgagagctgtgca

SEQ ID NO: 2946982 - DNA, 22 bp, Homo sapiens
attggatttgtccaaacaggtg

SEQ ID NO: 2946983 - DNA, 18 bp, Homo sapiens
attggcacagtgcttaca

SEQ ID NO: 2946984 - DNA, 20 bp, Homo sapiens
attggcacctaatccaggca

SEQ ID NO: 2946985 - DNA, 15 bp, Homo sapiens
attggccaattaaaa

SEQ ID NO: 2946986 - DNA, 15 bp, Homo sapiens
attggccctgcccct

SEQ ID NO: 2946987 - DNA, 19 bp, Homo sapiens
attggcctgaacagatgta

SEQ ID NO: 2946988 - DNA, 22 bp, Homo sapiens
attggccttcgattttaaatat

SEQ ID NO: 2946989 - DNA, 20 bp, Homo sapiens
attggctatataaaatgtgg

SEQ ID NO: 2946990 - DNA, 20 bp, Homo sapiens
attgggcagaatcctgggcc

SEQ ID NO: 2946991 - DNA, 22 bp, Homo sapiens
attgggcagaatcctgggcccc

SEQ ID NO: 2946992 - DNA, 18 bp, Homo sapiens
attgggcggctctgaagc

SEQ ID NO: 2946993 - DNA, 19 bp, Homo sapiens
attggggaattaaaagtca

SEQ ID NO: 2946994 - DNA, 21 bp, Homo sapiens
attgggtatcaagacatagca

SEQ ID NO: 2946995 - DNA, 15 bp, Homo sapiens
attgggtctattcca

SEQ ID NO: 2946996 - DNA, 20 bp, Homo sapiens
attgggtctattccagctca

SEQ ID NO: 2946997 - DNA, 12 bp, Homo sapiens
attggtgtatat

SEQ ID NO: 2946998 - DNA, 13 bp, Homo sapiens
attggtgtatatc

SEQ ID NO: 2946999 - DNA, 19 bp, Homo sapiens
attggttctgttttcgtac

SEQ ID NO: 2947000 - DNA, 14 bp, Homo sapiens
attgtaaatattgt

SEQ ID NO: 2947001 - DNA, 15 bp, Homo sapiens
attgtaactgttctt

SEQ ID NO: 2947002 - DNA, 13 bp, Homo sapiens
attgtaatcactg

SEQ ID NO: 2947003 - DNA, 14 bp, Homo sapiens
attgtacacttttt

SEQ ID NO: 2947004 - DNA, 15 bp, Homo sapiens
attgtaccttttaac

SEQ ID NO: 2947005 - DNA, 21 bp, Homo sapiens
attgtactaaagccaaacata

SEQ ID NO: 2947006 - DNA, 22 bp, Homo sapiens
attgtactaaagccaaacatat

SEQ ID NO: 2947007 - DNA, 18 bp, Homo sapiens
attgtactccagcctggg

SEQ ID NO: 2947008 - DNA, 18 bp, Homo sapiens
attgtagctttttattaa

SEQ ID NO: 2947009 - DNA, 17 bp, Homo sapiens
attgtagtatttagtat

SEQ ID NO: 2947010 - DNA, 19 bp, Homo sapiens
attgtagtggcctgtgctt

SEQ ID NO: 2947011 - DNA, 20 bp, Homo sapiens
attgtataaattactttgat

SEQ ID NO: 2947012 - DNA, 16 bp, Homo sapiens
attgtataacaggtta

SEQ ID NO: 2947013 - DNA, 24 bp, Homo sapiens
attgtatcgtatagctgtattgaa

SEQ ID NO: 2947014 - DNA, 13 bp, Homo sapiens
attgtatttatat

SEQ ID NO: 2947015 - DNA, 14 bp, Homo sapiens
attgtcaagctagc

SEQ ID NO: 2947016 - DNA, 14 bp, Homo sapiens
attgtcacatctat

SEQ ID NO: 2947017 - DNA, 14 bp, Homo sapiens
attgtcagccacct

SEQ ID NO: 2947018 - DNA, 16 bp, Homo sapiens
attgtccccatgcaac

SEQ ID NO: 2947019 - DNA, 12 bp, Homo sapiens
attgtccctctg

SEQ ID NO: 2947020 - DNA, 16 bp, Homo sapiens
attgtcctaagtgtca

SEQ ID NO: 2947021 - DNA, 18 bp, Homo sapiens
attgtctcctatatattt

SEQ ID NO: 2947022 - DNA, 22 bp, Homo sapiens
attgtctcctatatatttctat

SEQ ID NO: 2947023 - DNA, 19 bp, Homo sapiens
attgtctcgtttgtgattc

SEQ ID NO: 2947024 - DNA, 16 bp, Homo sapiens
attgtctgctgatgca

SEQ ID NO: 2947025 - DNA, 22 bp, Homo sapiens
attgtctttatgagctaaaaat

SEQ ID NO: 2947026 - DNA, 23 bp, Homo sapiens
attgtctttatgagctaaaaata

SEQ ID NO: 2947027 - DNA, 14 bp, Homo sapiens
attgtctttgttat

SEQ ID NO: 2947028 - DNA, 23 bp, Homo sapiens
attgtgaaataaaactggctttg

SEQ ID NO: 2947029 - DNA, 18 bp, Homo sapiens
attgtgaacatttgtgat

SEQ ID NO: 2947030 - DNA, 23 bp, Homo sapiens
attgtgaagtgatgttcagattt

SEQ ID NO: 2947031 - DNA, 22 bp, Homo sapiens
attgtgaccaatacatttgtat

SEQ ID NO: 2947032 - DNA, 21 bp, Homo sapiens
attgtgatatttgacagacat

SEQ ID NO: 2947033 - DNA, 22 bp, Homo sapiens
attgtgatatttgacagacatc

SEQ ID NO: 2947034 - DNA, 15 bp, Homo sapiens
attgtgcaatagtca

SEQ ID NO: 2947035 - DNA, 21 bp, Homo sapiens
attgtgccatgtcaaacaaat

SEQ ID NO: 2947036 - DNA, 21 bp, Homo sapiens
attgtggataacaaagatatc

SEQ ID NO: 2947037 - DNA, 15 bp, Homo sapiens
attgtgtaaaaaatg

SEQ ID NO: 2947038 - DNA, 19 bp, Homo sapiens
attgtgtaaaaaatggaaa

SEQ ID NO: 2947039 - DNA, 20 bp, Homo sapiens
attgtgtaaaaaatggaaaa

SEQ ID NO: 2947040 - DNA, 16 bp, Homo sapiens
attgtgtgcgctgcct

SEQ ID NO: 2947041 - DNA, 17 bp, Homo sapiens
attgtgtgcgctgcctg

SEQ ID NO: 2947042 - DNA, 20 bp, Homo sapiens
attgtgtgcgctgcctggcc

SEQ ID NO: 2947043 - DNA, 21 bp, Homo sapiens
attgtgtgcgctgcctggcca

SEQ ID NO: 2947044 - DNA, 19 bp, Homo sapiens
attgttaataataattatt

SEQ ID NO: 2947045 - DNA, 21 bp, Homo sapiens
attgttaatgcctataacttt

SEQ ID NO: 2947046 - DNA, 14 bp, Homo sapiens
attgttagatggca

SEQ ID NO: 2947047 - DNA, 23 bp, Homo sapiens
attgttagttaagtttttattca

SEQ ID NO: 2947048 - DNA, 12 bp, Homo sapiens
attgttagttta

SEQ ID NO: 2947049 - DNA, 19 bp, Homo sapiens
attgttccctatgaaagat

SEQ ID NO: 2947050 - DNA, 18 bp, Homo sapiens
attgttctgggtgatttc

SEQ ID NO: 2947051 - DNA, 20 bp, Homo sapiens
attgttctgggtgatttcta

SEQ ID NO: 2947052 - DNA, 13 bp, Homo sapiens
attgttcttttgt

SEQ ID NO: 2947053 - DNA, 18 bp, Homo sapiens
attgttcttttgtttcat

SEQ ID NO: 2947054 - DNA, 19 bp, Homo sapiens
attgttgtggtttaaatac

SEQ ID NO: 2947055 - DNA, 22 bp, Homo sapiens
attgtttcattgcgaatctttt

SEQ ID NO: 2947056 - DNA, 19 bp, Homo sapiens
attgtttctatacaaatat

SEQ ID NO: 2947057 - DNA, 13 bp, Homo sapiens
attgtttgaaaca

SEQ ID NO: 2947058 - DNA, 17 bp, Homo sapiens
attgtttgaaacaaaga

SEQ ID NO: 2947059 - DNA, 16 bp, Homo sapiens
attgtttgcacagagg

SEQ ID NO: 2947060 - DNA, 20 bp, Homo sapiens
attgtttggatttcctttat

SEQ ID NO: 2947061 - DNA, 21 bp, Homo sapiens
attgttttattttggaattgg

SEQ ID NO: 2947062 - DNA, 20 bp, Homo sapiens
attgttttcaacctagaaac

SEQ ID NO: 2947063 - DNA, 13 bp, Homo sapiens
attgttttgcaaa

SEQ ID NO: 2947064 - DNA, 23 bp, Homo sapiens
atttaaaaagtgagaaagaaagt

SEQ ID NO: 2947065 - DNA, 13 bp, Homo sapiens
atttaaaaatatt

SEQ ID NO: 2947066 - DNA, 15 bp, Homo sapiens
atttaaaaatatttc

SEQ ID NO: 2947067 - DNA, 19 bp, Homo sapiens
atttaaaaatatttcagat

SEQ ID NO: 2947068 - DNA, 20 bp, Homo sapiens
atttaaaacaatccttacta

SEQ ID NO: 2947069 - DNA, 19 bp, Homo sapiens
atttaatagtgttaatcaa

SEQ ID NO: 2947070 - DNA, 23 bp, Homo sapiens
atttaatagtgttaatcaattta

SEQ ID NO: 2947071 - DNA, 24 bp, Homo sapiens
atttaatgatttttgtgtatccag

SEQ ID NO: 2947072 - DNA, 13 bp, Homo sapiens
atttaattctctt

SEQ ID NO: 2947073 - DNA, 16 bp, Homo sapiens
atttaatttttaaaag

SEQ ID NO: 2947074 - DNA, 20 bp, Homo sapiens
atttaatttttaaaagactt

SEQ ID NO: 2947075 - DNA, 22 bp, Homo sapiens
atttaatttttaaaagactttg

SEQ ID NO: 2947076 - DNA, 14 bp, Homo sapiens
atttacaatgtgta

SEQ ID NO: 2947077 - DNA, 16 bp, Homo sapiens
atttacaccacacttt

SEQ ID NO: 2947078 - DNA, 22 bp, Homo sapiens
atttacagacacacccagtgcg

SEQ ID NO: 2947079 - DNA, 17 bp, Homo sapiens
atttacaggttcttagg

SEQ ID NO: 2947080 - DNA, 16 bp, Homo sapiens
atttacatgtattatt

SEQ ID NO: 2947081 - DNA, 14 bp, Homo sapiens
atttaccaacatgt

SEQ ID NO: 2947082 - DNA, 18 bp, Homo sapiens
atttaccaacatgtatct

SEQ ID NO: 2947083 - DNA, 19 bp, Homo sapiens
atttacccaactctgtaca

SEQ ID NO: 2947084 - DNA, 15 bp, Homo sapiens
atttacctgttgttg

SEQ ID NO: 2947085 - DNA, 19 bp, Homo sapiens
atttacgctttgattcata

SEQ ID NO: 2947086 - DNA, 19 bp, Homo sapiens
atttactgatcatctgctg

SEQ ID NO: 2947087 - DNA, 22 bp, Homo sapiens
atttactgatcatctgctgtga

SEQ ID NO: 2947088 - DNA, 23 bp, Homo sapiens
atttactggaaacctagccagct

SEQ ID NO: 2947089 - DNA, 20 bp, Homo sapiens
atttactgtcttaaatcagt

SEQ ID NO: 2947090 - DNA, 21 bp, Homo sapiens
atttactgtgagcttttgcct

SEQ ID NO: 2947091 - DNA, 13 bp, Homo sapiens
atttacttgaaag

SEQ ID NO: 2947092 - DNA, 22 bp, Homo sapiens
atttagaaaaagaacatgcagt

SEQ ID NO: 2947093 - DNA, 21 bp, Homo sapiens
atttagaaaatagagctttta

SEQ ID NO: 2947094 - DNA, 22 bp, Homo sapiens
atttagaaaatagagcttttaa

SEQ ID NO: 2947095 - DNA, 22 bp, Homo sapiens
atttagaaactaattgacttta

SEQ ID NO: 2947096 - DNA, 21 bp, Homo sapiens
atttagaacgagcctggaagc

SEQ ID NO: 2947097 - DNA, 19 bp, Homo sapiens
atttagaagtgtcatgttt

SEQ ID NO: 2947098 - DNA, 20 bp, Homo sapiens
atttagaatggttgagttac

SEQ ID NO: 2947099 - DNA, 19 bp, Homo sapiens
atttagaccccatacaagt

SEQ ID NO: 2947100 - DNA, 17 bp, Homo sapiens
atttagattgaaaactt

SEQ ID NO: 2947101 - DNA, 15 bp, Homo sapiens
atttagattgtaaac

SEQ ID NO: 2947102 - DNA, 18 bp, Homo sapiens
atttagcaaataatttcc

SEQ ID NO: 2947103 - DNA, 15 bp, Homo sapiens
atttagcaatgctgt

SEQ ID NO: 2947104 - DNA, 19 bp, Homo sapiens
atttagcaatgctgtgaat

SEQ ID NO: 2947105 - DNA, 14 bp, Homo sapiens
atttagcacatttt

SEQ ID NO: 2947106 - DNA, 18 bp, Homo sapiens
atttagcataaatttaat

SEQ ID NO: 2947107 - DNA, 19 bp, Homo sapiens
atttagcataaatttaatg

SEQ ID NO: 2947108 - DNA, 22 bp, Homo sapiens
atttagctaaacggattccaaa

SEQ ID NO: 2947109 - DNA, 14 bp, Homo sapiens
atttaggagaagcc

SEQ ID NO: 2947110 - DNA, 17 bp, Homo sapiens
atttagtcccttaaaaa

SEQ ID NO: 2947111 - DNA, 22 bp, Homo sapiens
atttagtctctttattcctagt

SEQ ID NO: 2947112 - DNA, 21 bp, Homo sapiens
atttagtgtttttacctctgt

SEQ ID NO: 2947113 - DNA, 21 bp, Homo sapiens
atttataaaaagatgatcgct

SEQ ID NO: 2947114 - DNA, 17 bp, Homo sapiens
atttataaagctaaaat

SEQ ID NO: 2947115 - DNA, 17 bp, Homo sapiens
atttataattcagtatg

SEQ ID NO: 2947116 - DNA, 20 bp, Homo sapiens
atttataattcagtatgttt

SEQ ID NO: 2947117 - DNA, 21 bp, Homo sapiens
atttataccattataccagca

SEQ ID NO: 2947118 - DNA, 19 bp, Homo sapiens
atttatatataaaaagaaa

SEQ ID NO: 2947119 - DNA, 15 bp, Homo sapiens
atttatatgaagcaa

SEQ ID NO: 2947120 - DNA, 21 bp, Homo sapiens
atttatatgaagcaagctgtg

SEQ ID NO: 2947121 - DNA, 15 bp, Homo sapiens
atttatatgtactgt

SEQ ID NO: 2947122 - DNA, 20 bp, Homo sapiens
atttatattaaataacatgt

SEQ ID NO: 2947123 - DNA, 13 bp, Homo sapiens
atttatcaaatca

SEQ ID NO: 2947124 - DNA, 13 bp, Homo sapiens
atttatgaccaga

SEQ ID NO: 2947125 - DNA, 18 bp, Homo sapiens
atttatgaccagagcaaa

SEQ ID NO: 2947126 - DNA, 19 bp, Homo sapiens
atttatgcacttataaggt

SEQ ID NO: 2947127 - DNA, 22 bp, Homo sapiens
atttatgctataaattttttga

SEQ ID NO: 2947128 - DNA, 13 bp, Homo sapiens
atttatgggcccc

SEQ ID NO: 2947129 - DNA, 15 bp, Homo sapiens
atttatgggcccctg

SEQ ID NO: 2947130 - DNA, 18 bp, Homo sapiens
atttatgggcccctggca

SEQ ID NO: 2947131 - DNA, 22 bp, Homo sapiens
atttatgtttgcacttgtgatt

SEQ ID NO: 2947132 - DNA, 12 bp, Homo sapiens
atttattaaata

SEQ ID NO: 2947133 - DNA, 15 bp, Homo sapiens
atttattaattgctt

SEQ ID NO: 2947134 - DNA, 23 bp, Homo sapiens
atttattatgctttattggaaaa

SEQ ID NO: 2947135 - DNA, 14 bp, Homo sapiens
atttattgaatatt

SEQ ID NO: 2947136 - DNA, 14 bp, Homo sapiens
atttattgagtttt

SEQ ID NO: 2947137 - DNA, 16 bp, Homo sapiens
atttattgcacattgt

SEQ ID NO: 2947138 - DNA, 19 bp, Homo sapiens
atttattgcacattgttca

SEQ ID NO: 2947139 - DNA, 20 bp, Homo sapiens
atttattgcacattgttcaa

SEQ ID NO: 2947140 - DNA, 23 bp, Homo sapiens
atttattggatgatacagtgttt

SEQ ID NO: 2947141 - DNA, 13 bp, Homo sapiens
atttatttaaaag

SEQ ID NO: 2947142 - DNA, 16 bp, Homo sapiens
atttatttaaaagatt

SEQ ID NO: 2947143 - DNA, 13 bp, Homo sapiens
atttatttaattt

SEQ ID NO: 2947144 - DNA, 13 bp, Homo sapiens
atttatttacaga

SEQ ID NO: 2947145 - DNA, 14 bp, Homo sapiens
atttatttgaaaat

SEQ ID NO: 2947146 - DNA, 15 bp, Homo sapiens
atttatttgtttgat

SEQ ID NO: 2947147 - DNA, 17 bp, Homo sapiens
atttatttgtttgattt

SEQ ID NO: 2947148 - DNA, 18 bp, Homo sapiens
atttatttttaatatgtt

SEQ ID NO: 2947149 - DNA, 15 bp, Homo sapiens
atttcaaaatgcttt

SEQ ID NO: 2947150 - DNA, 13 bp, Homo sapiens
atttcaaacattt

SEQ ID NO: 2947151 - DNA, 19 bp, Homo sapiens
atttcaaagccctgcctct

SEQ ID NO: 2947152 - DNA, 23 bp, Homo sapiens
atttcaaagccctgcctctgtgt

SEQ ID NO: 2947153 - DNA, 14 bp, Homo sapiens
atttcaaatctgta

SEQ ID NO: 2947154 - DNA, 19 bp, Homo sapiens
atttcaagatccaaatgct

SEQ ID NO: 2947155 - DNA, 22 bp, Homo sapiens
atttcaagggttgcttctgagt

SEQ ID NO: 2947156 - DNA, 14 bp, Homo sapiens
atttcacaaataat

SEQ ID NO: 2947157 - DNA, 19 bp, Homo sapiens
atttcacagagcacgcctg

SEQ ID NO: 2947158 - DNA, 20 bp, Homo sapiens
atttcacagagcacgcctgc

SEQ ID NO: 2947159 - DNA, 17 bp, Homo sapiens
atttcacagatgctgtg

SEQ ID NO: 2947160 - DNA, 18 bp, Homo sapiens
atttcacggagacagcaa

SEQ ID NO: 2947161 - DNA, 20 bp, Homo sapiens
atttcacgtcgtcttctgta

SEQ ID NO: 2947162 - DNA, 15 bp, Homo sapiens
atttcactgaatttc

SEQ ID NO: 2947163 - DNA, 14 bp, Homo sapiens
atttcactgtcttt

SEQ ID NO: 2947164 - DNA, 15 bp, Homo sapiens
atttcactgtctttt

SEQ ID NO: 2947165 - DNA, 19 bp, Homo sapiens
atttcagatatcaaaattc

SEQ ID NO: 2947166 - DNA, 16 bp, Homo sapiens
atttcagatgtaatgt

SEQ ID NO: 2947167 - DNA, 18 bp, Homo sapiens
atttcagatgtaatgttt

SEQ ID NO: 2947168 - DNA, 12 bp, Homo sapiens
atttcagccaaa

SEQ ID NO: 2947169 - DNA, 16 bp, Homo sapiens
atttcagccaaagtcc

SEQ ID NO: 2947170 - DNA, 14 bp, Homo sapiens
atttcagccaatct

SEQ ID NO: 2947171 - DNA, 16 bp, Homo sapiens
atttcagccaatctgg

SEQ ID NO: 2947172 - DNA, 19 bp, Homo sapiens
atttcaggaatcagaaatc

SEQ ID NO: 2947173 - DNA, 15 bp, Homo sapiens
attttggaagacata

SEQ ID NO: 2947174 - DNA, 18 bp, Homo sapiens
attttggactgagatttc

SEQ ID NO: 2947175 - DNA, 20 bp, Homo sapiens
attttggagagtttcctgaa

SEQ ID NO: 2947176 - DNA, 15 bp, Homo sapiens
attttggatttcttt

SEQ ID NO: 2947177 - DNA, 16 bp, Homo sapiens
attttggatttcttta

SEQ ID NO: 2947178 - DNA, 22 bp, Homo sapiens
attttggggggttttgtgtgtt

SEQ ID NO: 2947179 - DNA, 20 bp, Homo sapiens
attttggggttgtgttgtca

SEQ ID NO: 2947180 - DNA, 22 bp, Homo sapiens
attttggtgtgcatctgtgtgt

SEQ ID NO: 2947181 - DNA, 14 bp, Homo sapiens
attttggttgtatt

SEQ ID NO: 2947182 - DNA, 16 bp, Homo sapiens
attttggttgtattct

SEQ ID NO: 2947183 - DNA, 17 bp, Homo sapiens
attttggttgtattctt

SEQ ID NO: 2947184 - DNA, 19 bp, Homo sapiens
attttggttgtattctttg

SEQ ID NO: 2947185 - DNA, 15 bp, Homo sapiens
attttgtaggttatt

SEQ ID NO: 2947186 - DNA, 20 bp, Homo sapiens
attttgtaggttattttata

SEQ ID NO: 2947187 - DNA, 17 bp, Homo sapiens
attttgtataattgtat

SEQ ID NO: 2947188 - DNA, 10 bp, Homo sapiens
attttgtatt

SEQ ID NO: 2947189 - DNA, 19 bp, Homo sapiens
attttgtattgtttcaatt

SEQ ID NO: 2947190 - DNA, 22 bp, Homo sapiens
attttgtattttccaagtgtgc

SEQ ID NO: 2947191 - DNA, 13 bp, Homo sapiens
attttgtccaagt

SEQ ID NO: 2947192 - DNA, 19 bp, Homo sapiens
attttgtccaagttcacag

SEQ ID NO: 2947193 - DNA, 20 bp, Homo sapiens
attttgtccaagttcacagt

SEQ ID NO: 2947194 - DNA, 19 bp, Homo sapiens
attttgtctctgagatttt

SEQ ID NO: 2947195 - DNA, 18 bp, Homo sapiens
attttgtgaagccctgtt

SEQ ID NO: 2947196 - DNA, 13 bp, Homo sapiens
attttgtgatgaa

SEQ ID NO: 2947197 - DNA, 16 bp, Homo sapiens
attttgtgctctttcc

SEQ ID NO: 2947198 - DNA, 21 bp, Homo sapiens
attttgtggaggcagtgtcat

SEQ ID NO: 2947199 - DNA, 20 bp, Homo sapiens
attttgtgggaatttaagag

SEQ ID NO: 2947200 - DNA, 21 bp, Homo sapiens
attttgtgggaatttaagagc

SEQ ID NO: 2947201 - DNA, 20 bp, Homo sapiens
attttgtgtaaatttctcaa

SEQ ID NO: 2947202 - DNA, 14 bp, Homo sapiens
attttgtgtacagt

SEQ ID NO: 2947203 - DNA, 17 bp, Homo sapiens
attttgttcctgtttat

SEQ ID NO: 2947204 - DNA, 21 bp, Homo sapiens
attttgtttttattaaatgga

SEQ ID NO: 2947205 - DNA, 14 bp, Homo sapiens
atttttaaaaaaca

SEQ ID NO: 2947206 - DNA, 17 bp, Homo sapiens
atttttaaaaaacaatt

SEQ ID NO: 2947207 - DNA, 15 bp, Homo sapiens
atttttaaaaaatat

SEQ ID NO: 2947208 - DNA, 20 bp, Homo sapiens
atttttaaaaaatattttct

SEQ ID NO: 2947209 - DNA, 18 bp, Homo sapiens
atttttaaaagaaaaaaa

SEQ ID NO: 2947210 - DNA, 19 bp, Homo sapiens
atttttaaaagaaaaaaac

SEQ ID NO: 2947211 - DNA, 23 bp, Homo sapiens
atttttaaaagaaaaaaaccaaa

SEQ ID NO: 2947212 - DNA, 15 bp, Homo sapiens
atttttaaaagactt

SEQ ID NO: 2947213 - DNA, 16 bp, Homo sapiens
atttttaaaagacttt

SEQ ID NO: 2947214 - DNA, 14 bp, Homo sapiens
atttttaaaatgaa

SEQ ID NO: 2947215 - DNA, 19 bp, Homo sapiens
atttttaaaggacaaacag

SEQ ID NO: 2947216 - DNA, 20 bp, Homo sapiens
atttttaaaggacaaacagt

SEQ ID NO: 2947217 - DNA, 21 bp, Homo sapiens
atttttaaaggacaaacagtg

SEQ ID NO: 2947218 - DNA, 15 bp, Homo sapiens
atttttaaataattt

SEQ ID NO: 2947219 - DNA, 13 bp, Homo sapiens
atttttaaattct

SEQ ID NO: 2947220 - DNA, 19 bp, Homo sapiens
atttttaaattcttactct

SEQ ID NO: 2947221 - DNA, 18 bp, Homo sapiens
atttttaatatgttgact

SEQ ID NO: 2947222 - DNA, 14 bp, Homo sapiens
atttttaatttaaa

SEQ ID NO: 2947223 - DNA, 23 bp, Homo sapiens
atttttagagcattaaaataact

SEQ ID NO: 2947224 - DNA, 23 bp, Homo sapiens
atttttagaggcagggctgcatt

SEQ ID NO: 2947225 - DNA, 16 bp, Homo sapiens
atttttagtaaccttt

SEQ ID NO: 2947226 - DNA, 12 bp, Homo sapiens
atttttatctcc

SEQ ID NO: 2947227 - DNA, 15 bp, Homo sapiens
atttttatctccaag

SEQ ID NO: 2947228 - DNA, 16 bp, Homo sapiens
atttttatttcttttt

SEQ ID NO: 2947229 - DNA, 18 bp, Homo sapiens
atttttcaactttgaata

SEQ ID NO: 2947230 - DNA, 23 bp, Homo sapiens
atttttcaactttgaataaagaa

SEQ ID NO: 2947231 - DNA, 16 bp, Homo sapiens
atttttcaagagaaat

SEQ ID NO: 2947232 - DNA, 15 bp, Homo sapiens
atttttcagaaaaat

SEQ ID NO: 2947233 - DNA, 15 bp, Homo sapiens
atttttccttccttc

SEQ ID NO: 2947234 - DNA, 14 bp, Homo sapiens
atttttctctccct

SEQ ID NO: 2947235 - DNA, 15 bp, Homo sapiens
atttttctctccctc

SEQ ID NO: 2947236 - DNA, 15 bp, Homo sapiens
atttttcttccagga

SEQ ID NO: 2947237 - DNA, 14 bp, Homo sapiens
atttttctttaaag

SEQ ID NO: 2947238 - DNA, 20 bp, Homo sapiens
atttttgattaacaatgtat

SEQ ID NO: 2947239 - DNA, 12 bp, Homo sapiens
atttttgcaata

SEQ ID NO: 2947240 - DNA, 19 bp, Homo sapiens
atttttgcaataatgcagt

SEQ ID NO: 2947241 - DNA, 15 bp, Homo sapiens
atttttgccttcatt

SEQ ID NO: 2947242 - DNA, 16 bp, Homo sapiens
atttttgcttgacttc

SEQ ID NO: 2947243 - DNA, 13 bp, Homo sapiens
atttttgtgaaga

SEQ ID NO: 2947244 - DNA, 16 bp, Homo sapiens
atttttgtgaattata

SEQ ID NO: 2947245 - DNA, 20 bp, Homo sapiens
atttttgtgagcctctttgt

SEQ ID NO: 2947246 - DNA, 22 bp, Homo sapiens
atttttgttttccactgtgcta

SEQ ID NO: 2947247 - DNA, 22 bp, Homo sapiens
attttttaaaacaagccaagaa

SEQ ID NO: 2947248 - DNA, 23 bp, Homo sapiens
attttttaaaacaagccaagaaa

SEQ ID NO: 2947249 - DNA, 19 bp, Homo sapiens
attttttaaacagatattc

SEQ ID NO: 2947250 - DNA, 20 bp, Homo sapiens
attttttaaagttactttgt

SEQ ID NO: 2947251 - DNA, 21 bp, Homo sapiens
attttttatgatcaaggtgaa

SEQ ID NO: 2947252 - DNA, 20 bp, Homo sapiens
attttttcagacttgtcaag

SEQ ID NO: 2947253 - DNA, 14 bp, Homo sapiens
attttttcttgcat

SEQ ID NO: 2947254 - DNA, 14 bp, Homo sapiens
attttttcttttgt

SEQ ID NO: 2947255 - DNA, 22 bp, Homo sapiens
attttttgctataatcattagt

SEQ ID NO: 2947256 - DNA, 13 bp, Homo sapiens
attttttgttctt

SEQ ID NO: 2947257 - DNA, 16 bp, Homo sapiens
atttttttaattttgt

SEQ ID NO: 2947258 - DNA, 16 bp, Homo sapiens
atttttttagtttgtt

SEQ ID NO: 2947259 - DNA, 18 bp, Homo sapiens
atttttttctacataatt

SEQ ID NO: 2947260 - DNA, 20 bp, Homo sapiens
atttttttctacataattgt

SEQ ID NO: 2947261 - DNA, 13 bp, Homo sapiens
atttttttctccc

SEQ ID NO: 2947262 - DNA, 17 bp, Homo sapiens
atttttttgatggctaa

SEQ ID NO: 2947263 - DNA, 22 bp, Homo sapiens
atttttttggtacctatttgac

SEQ ID NO: 2947264 - DNA, 17 bp, Homo sapiens
atttttttgtcattaaa

SEQ ID NO: 2947265 - DNA, 13 bp, Homo sapiens
atttttttgttct

SEQ ID NO: 2947266 - DNA, 19 bp, Homo sapiens
attttttttaagttcactt

SEQ ID NO: 2947267 - DNA, 18 bp, Homo sapiens
attttttttagtatttat

SEQ ID NO: 2947268 - DNA, 19 bp, Homo sapiens
attttttttggttgtttgc

SEQ ID NO: 2947269 - DNA, 19 bp, Homo sapiens
caaaaaaaaaaaaaaatta

SEQ ID NO: 2947270 - DNA, 13 bp, Homo sapiens
caaaaaaaacaac

SEQ ID NO: 2947271 - DNA, 14 bp, Homo sapiens
caaaaaaaacaaca

SEQ ID NO: 2947272 - DNA, 15 bp, Homo sapiens
caaaaaaaagtctat

SEQ ID NO: 2947273 - DNA, 13 bp, Homo sapiens
caaaaaaaggaaa

SEQ ID NO: 2947274 - DNA, 20 bp, Homo sapiens
caaaaaaggacgtaaaattt

SEQ ID NO: 2947275 - DNA, 17 bp, Homo sapiens
caaaaaagtccaatttt

SEQ ID NO: 2947276 - DNA, 16 bp, Homo sapiens
caaaaaatgttttaaa

SEQ ID NO: 2947277 - DNA, 14 bp, Homo sapiens
caaaaacaaaaaag

SEQ ID NO: 2947278 - DNA, 16 bp, Homo sapiens
caaaaacaagactgcc

SEQ ID NO: 2947279 - DNA, 14 bp, Homo sapiens
caaaaacagcctca

SEQ ID NO: 2947280 - DNA, 18 bp, Homo sapiens
caaaaacatacttcaaaa

SEQ ID NO: 2947281 - DNA, 19 bp, Homo sapiens
caaaaacatacttcaaaaa

SEQ ID NO: 2947282 - DNA, 15 bp, Homo sapiens
caaaaacatgtatgt

SEQ ID NO: 2947283 - DNA, 23 bp, Homo sapiens
caaaaacatgtatgtgcatttca

SEQ ID NO: 2947284 - DNA, 16 bp, Homo sapiens
caaaaactacacatat

SEQ ID NO: 2947285 - DNA, 12 bp, Homo sapiens
caaaaagacaag

SEQ ID NO: 2947286 - DNA, 13 bp, Homo sapiens
caaaaagcagaag

SEQ ID NO: 2947287 - DNA, 21 bp, Homo sapiens
caaaaaggactggaaaaatga

SEQ ID NO: 2947288 - DNA, 20 bp, Homo sapiens
caaaaaggagcgggcagggc

SEQ ID NO: 2947289 - DNA, 16 bp, Homo sapiens
caaaaaggtataaata

SEQ ID NO: 2947290 - DNA, 13 bp, Homo sapiens
caaaaagtaaagt

SEQ ID NO: 2947291 - DNA, 16 bp, Homo sapiens
caaaaagttgagtttc

SEQ ID NO: 2947292 - DNA, 10 bp, Homo sapiens
caaaaataaa

SEQ ID NO: 2947293 - DNA, 19 bp, Homo sapiens
caaaaataatttattttgc

SEQ ID NO: 2947294 - DNA, 14 bp, Homo sapiens
caaaaatcagccag

SEQ ID NO: 2947295 - DNA, 14 bp, Homo sapiens
caaaaatgctaata

SEQ ID NO: 2947296 - DNA, 21 bp, Homo sapiens
caaaaatgctaatattaaaag

SEQ ID NO: 2947297 - DNA, 11 bp, Homo sapiens
caaaaatggga

SEQ ID NO: 2947298 - DNA, 19 bp, Homo sapiens
caaaaatgggaaaaataaa

SEQ ID NO: 2947299 - DNA, 15 bp, Homo sapiens
caaaaatgtaaaaaa

SEQ ID NO: 2947300 - DNA, 17 bp, Homo sapiens
caaaaattagccgggca

SEQ ID NO: 2947301 - DNA, 15 bp, Homo sapiens
caaaaattagctggg

SEQ ID NO: 2947302 - DNA, 15 bp, Homo sapiens
caaaacactatgtat

SEQ ID NO: 2947303 - DNA, 12 bp, Homo sapiens
caaaacatattt

SEQ ID NO: 2947304 - DNA, 20 bp, Homo sapiens
caaaacatattttacatctg

SEQ ID NO: 2947305 - DNA, 21 bp, Homo sapiens
caaaacattctcctttgcagt

SEQ ID NO: 2947306 - DNA, 17 bp, Homo sapiens
caaaaccaattcatgaa

SEQ ID NO: 2947307 - DNA, 21 bp, Homo sapiens
caaaactcatttcctatgtaa

SEQ ID NO: 2947308 - DNA, 14 bp, Homo sapiens
caaaactccgtctc

SEQ ID NO: 2947309 - DNA, 23 bp, Homo sapiens
caaaactttttgaccagtttctt

SEQ ID NO: 2947310 - DNA, 15 bp, Homo sapiens
caaaagaaagcaaat

SEQ ID NO: 2947311 - DNA, 20 bp, Homo sapiens
caaaagaaagcaaattattt

SEQ ID NO: 2947312 - DNA, 16 bp, Homo sapiens
caaaagaacttacccc

SEQ ID NO: 2947313 - DNA, 13 bp, Homo sapiens
caaaagaagcccc

SEQ ID NO: 2947314 - DNA, 12 bp, Homo sapiens
caaaagacaatt

SEQ ID NO: 2947315 - DNA, 21 bp, Homo sapiens
caaaagacaattctttataca

SEQ ID NO: 2947316 - DNA, 19 bp, Homo sapiens
caaaagatgctcttctgtg

SEQ ID NO: 2947317 - DNA, 20 bp, Homo sapiens
caaaagatgctcttctgtgg

SEQ ID NO: 2947318 - DNA, 20 bp, Homo sapiens
caaaagcagccctctgcctc

SEQ ID NO: 2947319 - DNA, 17 bp, Homo sapiens
caaaagctgtgtctctg

SEQ ID NO: 2947320 - DNA, 23 bp, Homo sapiens
caaaagctgtgtctctgtatata

SEQ ID NO: 2947321 - DNA, 14 bp, Homo sapiens
caaaaggaaagaaa

SEQ ID NO: 2947322 - DNA, 16 bp, Homo sapiens
caaaaggagagattat

SEQ ID NO: 2947323 - DNA, 17 bp, Homo sapiens
caaaaggagagattatt

SEQ ID NO: 2947324 - DNA, 19 bp, Homo sapiens
caaaaggatctttgtggcc

SEQ ID NO: 2947325 - DNA, 19 bp, Homo sapiens
caaaaggctccatatatat

SEQ ID NO: 2947326 - DNA, 15 bp, Homo sapiens
caaaagggaaaaaat

SEQ ID NO: 2947327 - DNA, 13 bp, Homo sapiens
caaaagggccagg

SEQ ID NO: 2947328 - DNA, 15 bp, Homo sapiens
caaaagggccaggtg

SEQ ID NO: 2947329 - DNA, 16 bp, Homo sapiens
caaaagggccaggtgc

SEQ ID NO: 2947330 - DNA, 21 bp, Homo sapiens
caaaagggccaggtgcggcct

SEQ ID NO: 2947331 - DNA, 18 bp, Homo sapiens
caaaaggtgcctgtgagg

SEQ ID NO: 2947332 - DNA, 11 bp, Homo sapiens
caaaaggttta

SEQ ID NO: 2947333 - DNA, 20 bp, Homo sapiens
caaaaggtttgagattcctg

SEQ ID NO: 2947334 - DNA, 14 bp, Homo sapiens
caaaagtaatgcct

SEQ ID NO: 2947335 - DNA, 15 bp, Homo sapiens
caaaagtaatgcctc

SEQ ID NO: 2947336 - DNA, 13 bp, Homo sapiens
caaaagtattttc

SEQ ID NO: 2947337 - DNA, 14 bp, Homo sapiens
caaaagtattttcc

SEQ ID NO: 2947338 - DNA, 15 bp, Homo sapiens
caaaagtctgaggca

SEQ ID NO: 2947339 - DNA, 18 bp, Homo sapiens
caaaagtgacagatgtta

SEQ ID NO: 2947340 - DNA, 22 bp, Homo sapiens
caaaagtgacagatgttatttt

SEQ ID NO: 2947341 - DNA, 22 bp, Homo sapiens
caaaagtgatcagcaatgaaga

SEQ ID NO: 2947342 - DNA, 21 bp, Homo sapiens
caaaagtgcctcaagaggaat

SEQ ID NO: 2947343 - DNA, 11 bp, Homo sapiens
caaaagtggag

SEQ ID NO: 2947344 - DNA, 18 bp, Homo sapiens
caaaagtggcctctttgt

SEQ ID NO: 2947345 - DNA, 22 bp, Homo sapiens
caaaagtggggctaaatgaagt

SEQ ID NO: 2947346 - DNA, 18 bp, Homo sapiens
caaaagttacatgtttgc

SEQ ID NO: 2947347 - DNA, 19 bp, Homo sapiens
caaaagttacatgtttgca

SEQ ID NO: 2947348 - DNA, 15 bp, Homo sapiens
caaaataaaacaaag

SEQ ID NO: 2947349 - DNA, 17 bp, Homo sapiens
caaaataaaacaaaggg

SEQ ID NO: 2947350 - DNA, 22 bp, Homo sapiens
caaaataaatcagtgggatttg

SEQ ID NO: 2947351 - DNA, 12 bp, Homo sapiens
caaaatatttaa

SEQ ID NO: 2947352 - DNA, 14 bp, Homo sapiens
caaaatatttaaaa

SEQ ID NO: 2947353 - DNA, 17 bp, Homo sapiens
caaaatatttaaaaatg

SEQ ID NO: 2947354 - DNA, 19 bp, Homo sapiens
caaaatatttaaaaatgtc

SEQ ID NO: 2947355 - DNA, 21 bp, Homo sapiens
caaaatatttaaaaatgtctt

SEQ ID NO: 2947356 - DNA, 13 bp, Homo sapiens
caaaatattttta

SEQ ID NO: 2947357 - DNA, 16 bp, Homo sapiens
caaaatattttttcct

SEQ ID NO: 2947358 - DNA, 17 bp, Homo sapiens
caaaatcacattctgca

SEQ ID NO: 2947359 - DNA, 18 bp, Homo sapiens
caaaatccaaactgctgt

SEQ ID NO: 2947360 - DNA, 21 bp, Homo sapiens
caaaatcctggaagattttgg

SEQ ID NO: 2947361 - DNA, 17 bp, Homo sapiens
caaaatgagtcaggcaa

SEQ ID NO: 2947362 - DNA, 22 bp, Homo sapiens
caaaatgagtcaggcaattgat

SEQ ID NO: 2947363 - DNA, 18 bp, Homo sapiens
caaaatgatagttttcta

SEQ ID NO: 2947364 - DNA, 19 bp, Homo sapiens
caaaatgatgcaaccaaaa

SEQ ID NO: 2947365 - DNA, 18 bp, Homo sapiens
caaaatgcgtatttgcat

SEQ ID NO: 2947366 - DNA, 23 bp, Homo sapiens
caaaatgctttttatttctgcat

SEQ ID NO: 2947367 - DNA, 15 bp, Homo sapiens
caaaatggcttcagt

SEQ ID NO: 2947368 - DNA, 23 bp, Homo sapiens
caaaatggtcctatttttgtgaa

SEQ ID NO: 2947369 - DNA, 14 bp, Homo sapiens
caaaatgtgtattt

SEQ ID NO: 2947370 - DNA, 20 bp, Homo sapiens
caaaatgttatcttctcaag

SEQ ID NO: 2947371 - DNA, 19 bp, Homo sapiens
caaaattatagcttttaag

SEQ ID NO: 2947372 - DNA, 15 bp, Homo sapiens
caaaattcatttcta

SEQ ID NO: 2947373 - DNA, 18 bp, Homo sapiens
caaaattcatttctaatt

SEQ ID NO: 2947374 - DNA, 17 bp, Homo sapiens
caaaattctagctgtat

SEQ ID NO: 2947375 - DNA, 17 bp, Homo sapiens
caaaattgcaaatcttg

SEQ ID NO: 2947376 - DNA, 15 bp, Homo sapiens
caaaattgctgcacc

SEQ ID NO: 2947377 - DNA, 24 bp, Homo sapiens
caaaatttaacgttgatgtaatga

SEQ ID NO: 2947378 - DNA, 16 bp, Homo sapiens
caaacaaagccagaag

SEQ ID NO: 2947379 - DNA, 16 bp, Homo sapiens
caaacaatttaaaaat

SEQ ID NO: 2947380 - DNA, 14 bp, Homo sapiens
caaacacaaggtca

SEQ ID NO: 2947381 - DNA, 14 bp, Homo sapiens
caaacacattgtta

SEQ ID NO: 2947382 - DNA, 16 bp, Homo sapiens
caaacacattgttatt

SEQ ID NO: 2947383 - DNA, 18 bp, Homo sapiens
caaacactgtgatgttgg

SEQ ID NO: 2947384 - DNA, 20 bp, Homo sapiens
caaacagccaactagcccct

SEQ ID NO: 2947385 - DNA, 15 bp, Homo sapiens
caaacaggctcagag

SEQ ID NO: 2947386 - DNA, 18 bp, Homo sapiens
caaacaggtgctggccca

SEQ ID NO: 2947387 - DNA, 19 bp, Homo sapiens
caaacaggtgctggcccag

SEQ ID NO: 2947388 - DNA, 23 bp, Homo sapiens
caaacaggtgctggcccagcatg

SEQ ID NO: 2947389 - DNA, 20 bp, Homo sapiens
caaacagtgaatttaagcat

SEQ ID NO: 2947390 - DNA, 20 bp, Homo sapiens
caaacataaggcacattgtg

SEQ ID NO: 2947391 - DNA, 21 bp, Homo sapiens
caaacatatatatactattaa

SEQ ID NO: 2947392 - DNA, 18 bp, Homo sapiens
caaacatgaaaacattga

SEQ ID NO: 2947393 - DNA, 21 bp, Homo sapiens
caaacatgaccctaaatcttg

SEQ ID NO: 2947394 - DNA, 21 bp, Homo sapiens
caaacatgtgcaactcttgta

SEQ ID NO: 2947395 - DNA, 19 bp, Homo sapiens
caaaccaacatctttgcga

SEQ ID NO: 2947396 - DNA, 22 bp, Homo sapiens
caaaccaacctttctgacatca

SEQ ID NO: 2947397 - DNA, 14 bp, Homo sapiens
caaaccacactgga

SEQ ID NO: 2947398 - DNA, 24 bp, Homo sapiens
caaacccagacggctccactagga

SEQ ID NO: 2947399 - DNA, 14 bp, Homo sapiens
caaaccccttccca

SEQ ID NO: 2947400 - DNA, 19 bp, Homo sapiens
caaaccctgttcaggctgg

SEQ ID NO: 2947401 - DNA, 13 bp, Homo sapiens
caaacctctgttc

SEQ ID NO: 2947402 - DNA, 14 bp, Homo sapiens
caaacctctgttca

SEQ ID NO: 2947403 - DNA, 20 bp, Homo sapiens
caaacctctgttcagtgtaa

SEQ ID NO: 2947404 - DNA, 14 bp, Homo sapiens
caaaccttgggccc

SEQ ID NO: 2947405 - DNA, 18 bp, Homo sapiens
caaacctttattttagaa

SEQ ID NO: 2947406 - DNA, 20 bp, Homo sapiens
caaacgccctttcctcctca

SEQ ID NO: 2947407 - DNA, 17 bp, Homo sapiens
caaacggagcccctgaa

SEQ ID NO: 2947408 - DNA, 22 bp, Homo sapiens
caaacggagcccctgaaagcct

SEQ ID NO: 2947409 - DNA, 19 bp, Homo sapiens
caaactacctatattcctt

SEQ ID NO: 2947410 - DNA, 19 bp, Homo sapiens
caaactagggccaagccca

SEQ ID NO: 2947411 - DNA, 14 bp, Homo sapiens
caaactatgtaatg

SEQ ID NO: 2947412 - DNA, 13 bp, Homo sapiens
caaactctgctgt

SEQ ID NO: 2947413 - DNA, 13 bp, Homo sapiens
caaactcttcagt

SEQ ID NO: 2947414 - DNA, 14 bp, Homo sapiens
caaactgtaaataa

SEQ ID NO: 2947415 - DNA, 16 bp, Homo sapiens
caaactgttaaatgtg

SEQ ID NO: 2947416 - DNA, 15 bp, Homo sapiens
caaactttaacaggt

SEQ ID NO: 2947417 - DNA, 16 bp, Homo sapiens
caaagaaacattttac

SEQ ID NO: 2947418 - DNA, 17 bp, Homo sapiens
caaagaaccatgcagga

SEQ ID NO: 2947419 - DNA, 18 bp, Homo sapiens
caaagaaccttctctatg

SEQ ID NO: 2947420 - DNA, 16 bp, Homo sapiens
caaagaagacatgttt

SEQ ID NO: 2947421 - DNA, 14 bp, Homo sapiens
caaagaagcttcat

SEQ ID NO: 2947422 - DNA, 19 bp, Homo sapiens
caaagaatccctagacttt

SEQ ID NO: 2947423 - DNA, 20 bp, Homo sapiens
caaagaatccctagacttta

SEQ ID NO: 2947424 - DNA, 22 bp, Homo sapiens
caaagaatgttagagcacagta

SEQ ID NO: 2947425 - DNA, 18 bp, Homo sapiens
caaagacaatcactgaaa

SEQ ID NO: 2947426 - DNA, 13 bp, Homo sapiens
caaagactgccac

SEQ ID NO: 2947427 - DNA, 16 bp, Homo sapiens
caaagagcctttccaa

SEQ ID NO: 2947428 - DNA, 22 bp, Homo sapiens
caaagagtctctggctcagctg

SEQ ID NO: 2947429 - DNA, 23 bp, Homo sapiens
caaagagtctctggctcagctgt

SEQ ID NO: 2947430 - DNA, 12 bp, Homo sapiens
caaagatatata

SEQ ID NO: 2947431 - DNA, 12 bp, Homo sapiens
caaagatatctt

SEQ ID NO: 2947432 - DNA, 23 bp, Homo sapiens
caaagatctgaattaaataaata

SEQ ID NO: 2947433 - DNA, 13 bp, Homo sapiens
caaagatgaccat

SEQ ID NO: 2947434 - DNA, 22 bp, Homo sapiens
caaagatgtgggttctttttct

SEQ ID NO: 2947435 - DNA, 16 bp, Homo sapiens
caaagattgaacactg

SEQ ID NO: 2947436 - DNA, 16 bp, Homo sapiens
caaagcacagtttgaa

SEQ ID NO: 2947437 - DNA, 12 bp, Homo sapiens
caaagcaggagt

SEQ ID NO: 2947438 - DNA, 13 bp, Homo sapiens
caaagcaggagtg

SEQ ID NO: 2947439 - DNA, 13 bp, Homo sapiens
caaagccactgga

SEQ ID NO: 2947440 - DNA, 16 bp, Homo sapiens
caaagccactggaagg

SEQ ID NO: 2947441 - DNA, 21 bp, Homo sapiens
caaagccactggaaggagcac

SEQ ID NO: 2947442 - DNA, 18 bp, Homo sapiens
caaagccagaagctgagc

SEQ ID NO: 2947443 - DNA, 21 bp, Homo sapiens
caaagccagagtggccacggc

SEQ ID NO: 2947444 - DNA, 22 bp, Homo sapiens
caaagccagcgtcctcctctgt

SEQ ID NO: 2947445 - DNA, 17 bp, Homo sapiens
caaagccatatggacac

SEQ ID NO: 2947446 - DNA, 19 bp, Homo sapiens
caaatttgaaaataattgt

SEQ ID NO: 2947447 - DNA, 14 bp, Homo sapiens
caaatttgattgat

SEQ ID NO: 2947448 - DNA, 17 bp, Homo sapiens
caaatttgattgatttg

SEQ ID NO: 2947449 - DNA, 17 bp, Homo sapiens
caaatttgtcttgcctt

SEQ ID NO: 2947450 - DNA, 22 bp, Homo sapiens
caaatttgtcttgccttattaa

SEQ ID NO: 2947451 - DNA, 21 bp, Homo sapiens
caaattttcactgctgctcct

SEQ ID NO: 2947452 - DNA, 13 bp, Homo sapiens
caacaaacactgt

SEQ ID NO: 2947453 - DNA, 15 bp, Homo sapiens
caacaaacactgtga

SEQ ID NO: 2947454 - DNA, 19 bp, Homo sapiens
caacaaagggttttaatgt

SEQ ID NO: 2947455 - DNA, 15 bp, Homo sapiens
caacaacaataataa

SEQ ID NO: 2947456 - DNA, 20 bp, Homo sapiens
caacaacctttccagctact

SEQ ID NO: 2947457 - DNA, 18 bp, Homo sapiens
caacaagaatgcattgat

SEQ ID NO: 2947458 - DNA, 17 bp, Homo sapiens
caactccctctctgtgc

SEQ ID NO: 2947459 - DNA, 19 bp, Homo sapiens
caactcctcgacatcactg

SEQ ID NO: 2947460 - DNA, 18 bp, Homo sapiens
caactcctttcagccaca

SEQ ID NO: 2947461 - DNA, 21 bp, Homo sapiens
caactctcccaaagggcacac

SEQ ID NO: 2947462 - DNA, 22 bp, Homo sapiens
caactctgaagagtatttgaaa

SEQ ID NO: 2947463 - DNA, 12 bp, Homo sapiens
caactcttgatt

SEQ ID NO: 2947464 - DNA, 22 bp, Homo sapiens
caactcttgtattgctccattt

SEQ ID NO: 2947465 - DNA, 13 bp, Homo sapiens
caactgacactcc

SEQ ID NO: 2947466 - DNA, 12 bp, Homo sapiens
caactgcaactc

SEQ ID NO: 2947467 - DNA, 17 bp, Homo sapiens
caactgcctccttgcca

SEQ ID NO: 2947468 - DNA, 20 bp, Homo sapiens
caactggatgcatcaagaac

SEQ ID NO: 2947469 - DNA, 23 bp, Homo sapiens
caactggatgcatcaagaactat

SEQ ID NO: 2947470 - DNA, 23 bp, Homo sapiens
caactggggggaccaaatagcca

SEQ ID NO: 2947471 - DNA, 15 bp, Homo sapiens
caactgtaaagcaaa

SEQ ID NO: 2947472 - DNA, 13 bp, Homo sapiens
caactgtatatat

SEQ ID NO: 2947473 - DNA, 15 bp, Homo sapiens
caactgtatatattc

SEQ ID NO: 2947474 - DNA, 13 bp, Homo sapiens
caactgtggctgg

SEQ ID NO: 2947475 - DNA, 18 bp, Homo sapiens
caactgtggtagctccag

SEQ ID NO: 2947476 - DNA, 19 bp, Homo sapiens
caactgtggtagctccagc

SEQ ID NO: 2947477 - DNA, 14 bp, Homo sapiens
caactgtgtagcat

SEQ ID NO: 2947478 - DNA, 14 bp, Homo sapiens
ctgaataaatggta

SEQ ID NO: 2947479 - DNA, 17 bp, Homo sapiens
ctgaataaatggtagta

SEQ ID NO: 2947480 - DNA, 16 bp, Homo sapiens
ctgaatacattctgct

SEQ ID NO: 2947481 - DNA, 18 bp, Homo sapiens
ctgaatacattctgcttt

SEQ ID NO: 2947482 - DNA, 15 bp, Homo sapiens
ctgaatattaagaaa

SEQ ID NO: 2947483 - DNA, 13 bp, Homo sapiens
ctgaatcaggaaa

SEQ ID NO: 2947484 - DNA, 23 bp, Homo sapiens
ctgaatcccggcggaaagcctct

SEQ ID NO: 2947485 - DNA, 20 bp, Homo sapiens
ctgaatctaacagtgacttc

SEQ ID NO: 2947486 - DNA, 15 bp, Homo sapiens
ctgaatgaaaataac

SEQ ID NO: 2947487 - DNA, 17 bp, Homo sapiens
ctgaatgaaacccccac

SEQ ID NO: 2947488 - DNA, 19 bp, Homo sapiens
ctgaatgaaacccccacac

SEQ ID NO: 2947489 - DNA, 22 bp, Homo sapiens
ctgaatgaaccttctggcctcc

SEQ ID NO: 2947490 - DNA, 23 bp, Homo sapiens
ctgaatgtcattatttgataaca

SEQ ID NO: 2947491 - DNA, 16 bp, Homo sapiens
ctgaatgtttgtgtct

SEQ ID NO: 2947492 - DNA, 17 bp, Homo sapiens
ctgaatgtttgtgtctg

SEQ ID NO: 2947493 - DNA, 14 bp, Homo sapiens
ctgaattaaataaa

SEQ ID NO: 2947494 - DNA, 18 bp, Homo sapiens
ctgaattgacatgaccct

SEQ ID NO: 2947495 - DNA, 19 bp, Homo sapiens
ctgaatttcaaacatttgt

SEQ ID NO: 2947496 - DNA, 21 bp, Homo sapiens
ctgaatttctttgatttaact

SEQ ID NO: 2947497 - DNA, 16 bp, Homo sapiens
ctgaatttgcaaagta

SEQ ID NO: 2947498 - DNA, 20 bp, Homo sapiens
ctgaatttgcaaagtactgt

SEQ ID NO: 2947499 - DNA, 21 bp, Homo sapiens
ctgaatttgcaaagtactgta

SEQ ID NO: 2947500 - DNA, 17 bp, Homo sapiens
ctgaatttgtatatgac

SEQ ID NO: 2947501 - DNA, 21 bp, Homo sapiens
ctgacaaattcaaaagagaga

SEQ ID NO: 2947502 - DNA, 13 bp, Homo sapiens
ctgacaagttatt

SEQ ID NO: 2947503 - DNA, 15 bp, Homo sapiens
ctgacaattgcaaat

SEQ ID NO: 2947504 - DNA, 15 bp, Homo sapiens
ctgacacatcagcat

SEQ ID NO: 2947505 - DNA, 23 bp, Homo sapiens
ctgacacatcagcatgttttctg

SEQ ID NO: 2947506 - DNA, 19 bp, Homo sapiens
ctgacacttcaaggtgaca

SEQ ID NO: 2947507 - DNA, 15 bp, Homo sapiens
ctgacagcagcctgt

SEQ ID NO: 2947508 - DNA, 19 bp, Homo sapiens
ctgacagcagcctgtgagg

SEQ ID NO: 2947509 - DNA, 20 bp, Homo sapiens
ctgacagcagcctgtgaggg

SEQ ID NO: 2947510 - DNA, 17 bp, Homo sapiens
ctgacagctcttcacag

SEQ ID NO: 2947511 - DNA, 15 bp, Homo sapiens
ctgacagctgctcct

SEQ ID NO: 2947512 - DNA, 16 bp, Homo sapiens
ctgacagctgctccta

SEQ ID NO: 2947513 - DNA, 19 bp, Homo sapiens
ctgacagctgctcctagag

SEQ ID NO: 2947514 - DNA, 22 bp, Homo sapiens
ctgacagctgctcctagaggga

SEQ ID NO: 2947515 - DNA, 23 bp, Homo sapiens
ctgacagctgctcctagagggag

SEQ ID NO: 2947516 - DNA, 20 bp, Homo sapiens
ctgacaggcagcctggacat

SEQ ID NO: 2947517 - DNA, 17 bp, Homo sapiens
ctgacattcacctgccc

SEQ ID NO: 2947518 - DNA, 19 bp, Homo sapiens
ctgacattgctccaagatg

SEQ ID NO: 2947519 - DNA, 21 bp, Homo sapiens
ctgacatttggagtgttcccc

SEQ ID NO: 2947520 - DNA, 15 bp, Homo sapiens
ctgaccacagcacag

SEQ ID NO: 2947521 - DNA, 18 bp, Homo sapiens
ctgaccacagcacagcca

SEQ ID NO: 2947522 - DNA, 16 bp, Homo sapiens
ctgaccatctgtgact

SEQ ID NO: 2947523 - DNA, 10 bp, Homo sapiens
ctgacccagt

SEQ ID NO: 2947524 - DNA, 13 bp, Homo sapiens
ctgacccagtgcc

SEQ ID NO: 2947525 - DNA, 20 bp, Homo sapiens
ctgacccagtgcccccactg

SEQ ID NO: 2947526 - DNA, 21 bp, Homo sapiens
ctgacccagtgcccccactga

SEQ ID NO: 2947527 - DNA, 15 bp, Homo sapiens
ctgaccccctccccc

SEQ ID NO: 2947528 - DNA, 19 bp, Homo sapiens
ctgacccggattggccctg

SEQ ID NO: 2947529 - DNA, 20 bp, Homo sapiens
ctgacccggattggccctgc

SEQ ID NO: 2947530 - DNA, 13 bp, Homo sapiens
ctgaccctgggcc

SEQ ID NO: 2947531 - DNA, 17 bp, Homo sapiens
ctgaccctgggcctgga

SEQ ID NO: 2947532 - DNA, 20 bp, Homo sapiens
ctgaccctggggctggcttt

SEQ ID NO: 2947533 - DNA, 19 bp, Homo sapiens
ctgaccctgtatatagccc

SEQ ID NO: 2947534 - DNA, 22 bp, Homo sapiens
ctgacccttacagcctctgact

SEQ ID NO: 2947535 - DNA, 19 bp, Homo sapiens
ctgacccttctccaaaggc

SEQ ID NO: 2947536 - DNA, 23 bp, Homo sapiens
ctgacccttctccaaaggctctg

SEQ ID NO: 2947537 - DNA, 18 bp, Homo sapiens
ctgaccgaaacagcgctg

SEQ ID NO: 2947538 - DNA, 14 bp, Homo sapiens
ctgaccgctgccca

SEQ ID NO: 2947539 - DNA, 17 bp, Homo sapiens
ctgaccgctgcccaggt

SEQ ID NO: 2947540 - DNA, 13 bp, Homo sapiens
ctgacctcacctg

SEQ ID NO: 2947541 - DNA, 17 bp, Homo sapiens
ctgacctcacctggtcc

SEQ ID NO: 2947542 - DNA, 12 bp, Homo sapiens
ctgacctccagt

SEQ ID NO: 2947543 - DNA, 24 bp, Homo sapiens
ctgacctccagtcctgctggcctg

SEQ ID NO: 2947544 - DNA, 16 bp, Homo sapiens
ctgacctcccaactct

SEQ ID NO: 2947545 - DNA, 14 bp, Homo sapiens
ctgacctgccagcc

SEQ ID NO: 2947546 - DNA, 13 bp, Homo sapiens
ctgacctggtggg

SEQ ID NO: 2947547 - DNA, 17 bp, Homo sapiens
ctgacctgtgagcccag

SEQ ID NO: 2947548 - DNA, 20 bp, Homo sapiens
ctgacctgtgagcccagctg

SEQ ID NO: 2947549 - DNA, 14 bp, Homo sapiens
ctgaccttcagctc

SEQ ID NO: 2947550 - DNA, 15 bp, Homo sapiens
ctgaccttcagctca

SEQ ID NO: 2947551 - DNA, 15 bp, Homo sapiens
ctgacggccagggag

SEQ ID NO: 2947552 - DNA, 21 bp, Homo sapiens
ctgacggccagggagaagctc

SEQ ID NO: 2947553 - DNA, 18 bp, Homo sapiens
ctgacggtgcagtctggg

SEQ ID NO: 2947554 - DNA, 13 bp, Homo sapiens
ctgactaaaatgt

SEQ ID NO: 2947555 - DNA, 14 bp, Homo sapiens
ctgactaaaatgtt

SEQ ID NO: 2947556 - DNA, 14 bp, Homo sapiens
ctgactaaccattg

SEQ ID NO: 2947557 - DNA, 21 bp, Homo sapiens
ctgactagggagccatgtttc

SEQ ID NO: 2947558 - DNA, 18 bp, Homo sapiens
ctgactcagggctcctgg

SEQ ID NO: 2947559 - DNA, 16 bp, Homo sapiens
ctgactcatcatttgt

SEQ ID NO: 2947560 - DNA, 12 bp, Homo sapiens
ctgactccctcc

SEQ ID NO: 2947561 - DNA, 17 bp, Homo sapiens
ctgactccctccccacc

SEQ ID NO: 2947562 - DNA, 19 bp, Homo sapiens
ctgagtgcagccgtttgag

SEQ ID NO: 2947563 - DNA, 14 bp, Homo sapiens
ctgagtggtgtttt

SEQ ID NO: 2947564 - DNA, 15 bp, Homo sapiens
ctgagtgtctctgcc

SEQ ID NO: 2947565 - DNA, 17 bp, Homo sapiens
ctgagtgtctctgcctg

SEQ ID NO: 2947566 - DNA, 18 bp, Homo sapiens
ctgagtgtctctgcctgg

SEQ ID NO: 2947567 - DNA, 12 bp, Homo sapiens
ctgagtgtggga

SEQ ID NO: 2947568 - DNA, 15 bp, Homo sapiens
ctgagttcctagcca

SEQ ID NO: 2947569 - DNA, 18 bp, Homo sapiens
ctgagttcctagccaccg

SEQ ID NO: 2947570 - DNA, 20 bp, Homo sapiens
ctgagttcctggaatggcac

SEQ ID NO: 2947571 - DNA, 22 bp, Homo sapiens
ctgagttgcaccattctttctt

SEQ ID NO: 2947572 - DNA, 22 bp, Homo sapiens
ctgagttggcgttgtgggcagg

SEQ ID NO: 2947573 - DNA, 23 bp, Homo sapiens
ctgagttggcgttgtgggcaggc

SEQ ID NO: 2947574 - DNA, 11 bp, Homo sapiens
ctgagtttcta

SEQ ID NO: 2947575 - DNA, 15 bp, Homo sapiens
ctgagttttgttttg

SEQ ID NO: 2947576 - DNA, 13 bp, Homo sapiens
ctgataaaaatga

SEQ ID NO: 2947577 - DNA, 19 bp, Homo sapiens
ctgataaagttgagagaca

SEQ ID NO: 2947578 - DNA, 19 bp, Homo sapiens
ctgataagagaatcaacat

SEQ ID NO: 2947579 - DNA, 19 bp, Homo sapiens
ctgataccatatgaatgaa

SEQ ID NO: 2947580 - DNA, 18 bp, Homo sapiens
ctgatagaattatttcac

SEQ ID NO: 2947581 - DNA, 20 bp, Homo sapiens
ctgataggagggggcggcag

SEQ ID NO: 2947582 - DNA, 18 bp, Homo sapiens
ctgatagttactgttgtg

SEQ ID NO: 2947583 - DNA, 21 bp, Homo sapiens
ctgatatatgtgtttttcaca

SEQ ID NO: 2947584 - DNA, 16 bp, Homo sapiens
ctgatatgatttaaaa

SEQ ID NO: 2947585 - DNA, 19 bp, Homo sapiens
ctgatatgatttaaaacat

SEQ ID NO: 2947586 - DNA, 20 bp, Homo sapiens
ctgatattcagaattatgat

SEQ ID NO: 2947587 - DNA, 12 bp, Homo sapiens
ctgatcaaggcc

SEQ ID NO: 2947588 - DNA, 19 bp, Homo sapiens
ctgatcacccccctgctta

SEQ ID NO: 2947589 - DNA, 14 bp, Homo sapiens
ctgatcagagccgt

SEQ ID NO: 2947590 - DNA, 18 bp, Homo sapiens
ctgatcaggacctccaag

SEQ ID NO: 2947591 - DNA, 16 bp, Homo sapiens
ctgatcatctgctgtg

SEQ ID NO: 2947592 - DNA, 15 bp, Homo sapiens
ctgatcccagacctg

SEQ ID NO: 2947593 - DNA, 22 bp, Homo sapiens
ctgatcccctttggttttacta

SEQ ID NO: 2947594 - DNA, 14 bp, Homo sapiens
ctgatccctggcca

SEQ ID NO: 2947595 - DNA, 15 bp, Homo sapiens
ctgatcctggaggcc

SEQ ID NO: 2947596 - DNA, 18 bp, Homo sapiens
ctgatcgacgtggtgacg

SEQ ID NO: 2947597 - DNA, 22 bp, Homo sapiens
ctgatcgtgacgctgaataaat

SEQ ID NO: 2947598 - DNA, 21 bp, Homo sapiens
ctgatctcaagtatatgtcat

SEQ ID NO: 2947599 - DNA, 20 bp, Homo sapiens
ctgatctggggcatgaaaaa

SEQ ID NO: 2947600 - DNA, 19 bp, Homo sapiens
ctgatcttacctttatgag

SEQ ID NO: 2947601 - DNA, 18 bp, Homo sapiens
ctgatctttgtatattac

SEQ ID NO: 2947602 - DNA, 20 bp, Homo sapiens
ctgatgaacttattctgtag

SEQ ID NO: 2947603 - DNA, 16 bp, Homo sapiens
ctgatgaatcactgtt

SEQ ID NO: 2947604 - DNA, 19 bp, Homo sapiens
ctgatgagactccactcag

SEQ ID NO: 2947605 - DNA, 16 bp, Homo sapiens
ctgatgcagccgtcca

SEQ ID NO: 2947606 - DNA, 13 bp, Homo sapiens
ctgatggaagcac

SEQ ID NO: 2947607 - DNA, 15 bp, Homo sapiens
ctgatggaagcacac

SEQ ID NO: 2947608 - DNA, 15 bp, Homo sapiens
ctgatggagagtgag

SEQ ID NO: 2947609 - DNA, 16 bp, Homo sapiens
ctgatgtagcttgaga

SEQ ID NO: 2947610 - DNA, 23 bp, Homo sapiens
ctgatgtcagctgctgttgaact

SEQ ID NO: 2947611 - DNA, 13 bp, Homo sapiens
ctgatgtggactg

SEQ ID NO: 2947612 - DNA, 17 bp, Homo sapiens
ctgatgtggactgtctt

SEQ ID NO: 2947613 - DNA, 21 bp, Homo sapiens
ctgattaaaaagggagaaaga

SEQ ID NO: 2947614 - DNA, 18 bp, Homo sapiens
ctgattagtattcaggca

SEQ ID NO: 2947615 - DNA, 22 bp, Homo sapiens
ctgattagtattcaggcactga

SEQ ID NO: 2947616 - DNA, 15 bp, Homo sapiens
ctgattcaactaaaa

SEQ ID NO: 2947617 - DNA, 18 bp, Homo sapiens
ctgattcaactaaaaaaa

SEQ ID NO: 2947618 - DNA, 17 bp, Homo sapiens
ctgattcacatctcatt

SEQ ID NO: 2947619 - DNA, 21 bp, Homo sapiens
ctgattcacatctcatttttc

SEQ ID NO: 2947620 - DNA, 13 bp, Homo sapiens
ctgattcactgca

SEQ ID NO: 2947621 - DNA, 22 bp, Homo sapiens
ctcttagacacttttatatttg

SEQ ID NO: 2947622 - DNA, 21 bp, Homo sapiens
ctcttagctactgtatgcaaa

SEQ ID NO: 2947623 - DNA, 19 bp, Homo sapiens
ctcttcaagcatcctcaga

SEQ ID NO: 2947624 - DNA, 14 bp, Homo sapiens
ctcttcaccttggt

SEQ ID NO: 2947625 - DNA, 17 bp, Homo sapiens
ctcttcaccttggttta

SEQ ID NO: 2947626 - DNA, 21 bp, Homo sapiens
ctcttcactgctacatgtgct

SEQ ID NO: 2947627 - DNA, 13 bp, Homo sapiens
ctcttcacttcct

SEQ ID NO: 2947628 - DNA, 23 bp, Homo sapiens
ctcttcacttcctccagaagcct

SEQ ID NO: 2947629 - DNA, 17 bp, Homo sapiens
ctcttcagaggccctcg

SEQ ID NO: 2947630 - DNA, 19 bp, Homo sapiens
ctcttcaggttgtaaaaaa

SEQ ID NO: 2947631 - DNA, 14 bp, Homo sapiens
ctcttcagttaatt

SEQ ID NO: 2947632 - DNA, 19 bp, Homo sapiens
ctcttccaccagagcaggg

SEQ ID NO: 2947633 - DNA, 22 bp, Homo sapiens
ctcttccaccagagcaggggct

SEQ ID NO: 2947634 - DNA, 19 bp, Homo sapiens
ctcttccaggactctctgc

SEQ ID NO: 2947635 - DNA, 12 bp, Homo sapiens
ctcttccattca

SEQ ID NO: 2947636 - DNA, 13 bp, Homo sapiens
ctcttcccttttt

SEQ ID NO: 2947637 - DNA, 19 bp, Homo sapiens
ctcttcccttttttttctg

SEQ ID NO: 2947638 - DNA, 19 bp, Homo sapiens
ctcttccgggagctggtga

SEQ ID NO: 2947639 - DNA, 21 bp, Homo sapiens
ctcttccgggagctggtgaca

SEQ ID NO: 2947640 - DNA, 17 bp, Homo sapiens
ctcttcctcatcctgct

SEQ ID NO: 2947641 - DNA, 23 bp, Homo sapiens
ctcttctagatggaccccagcat

SEQ ID NO: 2947642 - DNA, 13 bp, Homo sapiens
ctcttctccttga

SEQ ID NO: 2947643 - DNA, 17 bp, Homo sapiens
ctcttctgagcagaaat

SEQ ID NO: 2947644 - DNA, 20 bp, Homo sapiens
ctcttctgccggccctgggg

SEQ ID NO: 2947645 - DNA, 11 bp, Homo sapiens
ctcttctggct

SEQ ID NO: 2947646 - DNA, 22 bp, Homo sapiens
ctcttctgggagggcagcaggg

SEQ ID NO: 2947647 - DNA, 14 bp, Homo sapiens
ctcttctgggcaga

SEQ ID NO: 2947648 - DNA, 19 bp, Homo sapiens
ctgcacggtctgcggcagt

SEQ ID NO: 2947649 - DNA, 20 bp, Homo sapiens
ctgcactccagcctgagtga

SEQ ID NO: 2947650 - DNA, 21 bp, Homo sapiens
ctgcactccagcctgggtcac

SEQ ID NO: 2947651 - DNA, 15 bp, Homo sapiens
ctgcactccctggcc

SEQ ID NO: 2947652 - DNA, 12 bp, Homo sapiens
ctgcactcttga

SEQ ID NO: 2947653 - DNA, 18 bp, Homo sapiens
ctgcactgatgctgcccc

SEQ ID NO: 2947654 - DNA, 15 bp, Homo sapiens
ctgcactgtgccccg

SEQ ID NO: 2947655 - DNA, 23 bp, Homo sapiens
ctgcactgtgccccgcgggcttt

SEQ ID NO: 2947656 - DNA, 13 bp, Homo sapiens
ctgcacttacaat

SEQ ID NO: 2947657 - DNA, 19 bp, Homo sapiens
ctgcacttatacccatgaa

SEQ ID NO: 2947658 - DNA, 16 bp, Homo sapiens
ctgcacttcatatcta

SEQ ID NO: 2947659 - DNA, 18 bp, Homo sapiens
ctgcactttagtgtattt

SEQ ID NO: 2947660 - DNA, 23 bp, Homo sapiens
ctgcactttgggtttttaactca

SEQ ID NO: 2947661 - DNA, 13 bp, Homo sapiens
ctgcagaaaaaaa

SEQ ID NO: 2947662 - DNA, 20 bp, Homo sapiens
ctgcagaacgtattggtcca

SEQ ID NO: 2947663 - DNA, 18 bp, Homo sapiens
ctgcagacgtctggccct

SEQ ID NO: 2947664 - DNA, 19 bp, Homo sapiens
ctgcagacgtctggccctg

SEQ ID NO: 2947665 - DNA, 21 bp, Homo sapiens
ctgcagagcagtgggcctggc

SEQ ID NO: 2947666 - DNA, 12 bp, Homo sapiens
ctgcagagctgc

SEQ ID NO: 2947667 - DNA, 21 bp, Homo sapiens
ctgcagagctgcgggctgggt

SEQ ID NO: 2947668 - DNA, 15 bp, Homo sapiens
ctgcagagtttggat

SEQ ID NO: 2947669 - DNA, 17 bp, Homo sapiens
ctgcagccagcccagcc

SEQ ID NO: 2947670 - DNA, 18 bp, Homo sapiens
ctgcagccagcccagccc

SEQ ID NO: 2947671 - DNA, 13 bp, Homo sapiens
ctgcagccaggcc

SEQ ID NO: 2947672 - DNA, 15 bp, Homo sapiens
ctgcagccaggccac

SEQ ID NO: 2947673 - DNA, 23 bp, Homo sapiens
ctgcagccaggccactggcccct

SEQ ID NO: 2947674 - DNA, 17 bp, Homo sapiens
ctgcagccaggcctcgc

SEQ ID NO: 2947675 - DNA, 16 bp, Homo sapiens
ctgcagccctgccagt

SEQ ID NO: 2947676 - DNA, 17 bp, Homo sapiens
ctgcagccttgaactct

SEQ ID NO: 2947677 - DNA, 18 bp, Homo sapiens
ctgcagcggcaggaccgc

SEQ ID NO: 2947678 - DNA, 18 bp, Homo sapiens
ctgcaggacctgcctgta

SEQ ID NO: 2947679 - DNA, 13 bp, Homo sapiens
ctgcaggagcagg

SEQ ID NO: 2947680 - DNA, 15 bp, Homo sapiens
ctgcaggagggcact

SEQ ID NO: 2947681 - DNA, 11 bp, Homo sapiens
ctgcaggcagg

SEQ ID NO: 2947682 - DNA, 14 bp, Homo sapiens
ctgcaggccccgct

SEQ ID NO: 2947683 - DNA, 22 bp, Homo sapiens
ctgcaggccccgcttgtccagc

SEQ ID NO: 2947684 - DNA, 23 bp, Homo sapiens
ctgcaggcctaggtgcagctcct

SEQ ID NO: 2947685 - DNA, 15 bp, Homo sapiens
ctgcaggcttaataa

SEQ ID NO: 2947686 - DNA, 20 bp, Homo sapiens
ctgcagggagcaccacggcc

SEQ ID NO: 2947687 - DNA, 22 bp, Homo sapiens
ctgcagggagcaccacggccag

SEQ ID NO: 2947688 - DNA, 18 bp, Homo sapiens
ctgcagggccgccaggga

SEQ ID NO: 2947689 - DNA, 23 bp, Homo sapiens
ctgcaggttctctctcactgcca

SEQ ID NO: 2947690 - DNA, 14 bp, Homo sapiens
ctgcagtaaatctt

SEQ ID NO: 2947691 - DNA, 23 bp, Homo sapiens
ctgcagtcagccctgattgtgcc

SEQ ID NO: 2947692 - DNA, 20 bp, Homo sapiens
ctgcagtcgcttgccaaagc

SEQ ID NO: 2947693 - DNA, 21 bp, Homo sapiens
ctgcagtcgcttgccaaagca

SEQ ID NO: 2947694 - DNA, 16 bp, Homo sapiens
ctgcagtcggcatgcc

SEQ ID NO: 2947695 - DNA, 17 bp, Homo sapiens
ctgcagtcggcatgcca

SEQ ID NO: 2947696 - DNA, 19 bp, Homo sapiens
ctgcagtcggcatgccagg

SEQ ID NO: 2947697 - DNA, 20 bp, Homo sapiens
ctgcagtcggcatgccagga

SEQ ID NO: 2947698 - DNA, 23 bp, Homo sapiens
ctgcagtcggcatgccaggaccc

SEQ ID NO: 2947699 - DNA, 13 bp, Homo sapiens
ctgcagtctccgc

SEQ ID NO: 2947700 - DNA, 22 bp, Homo sapiens
ctgcagtctccgcctcctgagt

SEQ ID NO: 2947701 - DNA, 19 bp, Homo sapiens
ctgcagtgccagctccctc

SEQ ID NO: 2947702 - DNA, 13 bp, Homo sapiens
ctgcagttaatta

SEQ ID NO: 2947703 - DNA, 16 bp, Homo sapiens
ctgcagttaattagca

SEQ ID NO: 2947704 - DNA, 17 bp, Homo sapiens
ctgcagttgaagagcct

SEQ ID NO: 2947705 - DNA, 16 bp, Homo sapiens
ctgcataccaacctgg

SEQ ID NO: 2947706 - DNA, 21 bp, Homo sapiens
ctgcatatgttgaatactttt

SEQ ID NO: 2947707 - DNA, 21 bp, Homo sapiens
ctgcatcacccaggctggagt

SEQ ID NO: 2947708 - DNA, 22 bp, Homo sapiens
ctgcatctgaccagcagcgcct

SEQ ID NO: 2947709 - DNA, 14 bp, Homo sapiens
ctgcatctgataaa

SEQ ID NO: 2947710 - DNA, 13 bp, Homo sapiens
ctgcatcttgggg

SEQ ID NO: 2947711 - DNA, 19 bp, Homo sapiens
ctgcatcttggggacatct

SEQ ID NO: 2947712 - DNA, 13 bp, Homo sapiens
ctgcatggacagt

SEQ ID NO: 2947713 - DNA, 22 bp, Homo sapiens
ctgcatgtaaaatcttcagctg

SEQ ID NO: 2947714 - DNA, 15 bp, Homo sapiens
ctgcatgtggcttct

SEQ ID NO: 2947715 - DNA, 14 bp, Homo sapiens
ctgctatttgaagt

SEQ ID NO: 2947716 - DNA, 16 bp, Homo sapiens
ctgctcagagccaagg

SEQ ID NO: 2947717 - DNA, 14 bp, Homo sapiens
ctgctcagctctgg

SEQ ID NO: 2947718 - DNA, 17 bp, Homo sapiens
ctgctcagctctggtcc

SEQ ID NO: 2947719 - DNA, 18 bp, Homo sapiens
ctgctcagcttctcctgt

SEQ ID NO: 2947720 - DNA, 17 bp, Homo sapiens
ctgctcaggtaaatctt

SEQ ID NO: 2947721 - DNA, 18 bp, Homo sapiens
ctgctccacctttcagcc

SEQ ID NO: 2947722 - DNA, 24 bp, Homo sapiens
ctgctccacctttcagcccacgtc

SEQ ID NO: 2947723 - DNA, 14 bp, Homo sapiens
ctgctcccacactt

SEQ ID NO: 2947724 - DNA, 18 bp, Homo sapiens
ctgctcccacacttgtgc

SEQ ID NO: 2947725 - DNA, 21 bp, Homo sapiens
ctgctcccacacttgtgccag

SEQ ID NO: 2947726 - DNA, 12 bp, Homo sapiens
ctgctcccccac

SEQ ID NO: 2947727 - DNA, 12 bp, Homo sapiens
ctgctcccttcg

SEQ ID NO: 2947728 - DNA, 18 bp, Homo sapiens
ctgctccgctgcctggaa

SEQ ID NO: 2947729 - DNA, 19 bp, Homo sapiens
ctgctccgctgcctggaac

SEQ ID NO: 2947730 - DNA, 15 bp, Homo sapiens
ctgctcctagaggga

SEQ ID NO: 2947731 - DNA, 15 bp, Homo sapiens
ctgctcctctttccc

SEQ ID NO: 2947732 - DNA, 17 bp, Homo sapiens
ctgctccttagctgcca

SEQ ID NO: 2947733 - DNA, 13 bp, Homo sapiens
ctgctcctttccc

SEQ ID NO: 2947734 - DNA, 14 bp, Homo sapiens
ctgctcgcccagga

SEQ ID NO: 2947735 - DNA, 20 bp, Homo sapiens
ctgctctagatgagctgggc

SEQ ID NO: 2947736 - DNA, 11 bp, Homo sapiens
ctgctctccca

SEQ ID NO: 2947737 - DNA, 16 bp, Homo sapiens
ctgctctcccttgtgg

SEQ ID NO: 2947738 - DNA, 24 bp, Homo sapiens
ctgctctctttttctccagggtca

SEQ ID NO: 2947739 - DNA, 21 bp, Homo sapiens
ctgctctgcgtgtcacctgtg

SEQ ID NO: 2947740 - DNA, 14 bp, Homo sapiens
ctgctcttgtttct

SEQ ID NO: 2947741 - DNA, 12 bp, Homo sapiens
ctgctgaagctg

SEQ ID NO: 2947742 - DNA, 14 bp, Homo sapiens
ctgctgaagctgct

SEQ ID NO: 2947743 - DNA, 15 bp, Homo sapiens
ctgctgaagctgctg

SEQ ID NO: 2947744 - DNA, 16 bp, Homo sapiens
ctgctgaaggctcatt

SEQ ID NO: 2947745 - DNA, 13 bp, Homo sapiens
ctgctgacccacc

SEQ ID NO: 2947746 - DNA, 16 bp, Homo sapiens
ctgctgagagacccaa

SEQ ID NO: 2947747 - DNA, 13 bp, Homo sapiens
ctgctgagtgaca

SEQ ID NO: 2947748 - DNA, 14 bp, Homo sapiens
ctgctgagtgacag

SEQ ID NO: 2947749 - DNA, 17 bp, Homo sapiens
ctgctgccaccaaatct

SEQ ID NO: 2947750 - DNA, 18 bp, Homo sapiens
ctgctgccaccaaatctg

SEQ ID NO: 2947751 - DNA, 19 bp, Homo sapiens
ctgctgccaccaaatctgt

SEQ ID NO: 2947752 - DNA, 21 bp, Homo sapiens
ctgctgccactctgctgcctg

SEQ ID NO: 2947753 - DNA, 15 bp, Homo sapiens
ctgctgccagggctt

SEQ ID NO: 2947754 - DNA, 14 bp, Homo sapiens
ctgctgcccctccc

SEQ ID NO: 2947755 - DNA, 22 bp, Homo sapiens
ctgctgcccggggtggggtgca

SEQ ID NO: 2947756 - DNA, 14 bp, Homo sapiens
ctgctgcctcagct

SEQ ID NO: 2947757 - DNA, 16 bp, Homo sapiens
ctgctgcctcagctca

SEQ ID NO: 2947758 - DNA, 22 bp, Homo sapiens
ctggaaacttctgtaaggggca

SEQ ID NO: 2947759 - DNA, 12 bp, Homo sapiens
ctggaaagcaaa

SEQ ID NO: 2947760 - DNA, 19 bp, Homo sapiens
ctggaaagcccccccttat

SEQ ID NO: 2947761 - DNA, 21 bp, Homo sapiens
ctggaaaggaaagatgatgct

SEQ ID NO: 2947762 - DNA, 22 bp, Homo sapiens
ctggaaatactgatggaagcac

SEQ ID NO: 2947763 - DNA, 16 bp, Homo sapiens
ctggaacaaattattt

SEQ ID NO: 2947764 - DNA, 20 bp, Homo sapiens
ctggaacactagacaagcca

SEQ ID NO: 2947765 - DNA, 22 bp, Homo sapiens
ctggaacactagacaagccaga

SEQ ID NO: 2947766 - DNA, 17 bp, Homo sapiens
ctggaaccacctggacg

SEQ ID NO: 2947767 - DNA, 21 bp, Homo sapiens
ctggaaccagcaagtcccaga

SEQ ID NO: 2947768 - DNA, 14 bp, Homo sapiens
ctggaacccagact

SEQ ID NO: 2947769 - DNA, 22 bp, Homo sapiens
ctggaacccagactcagacatt

SEQ ID NO: 2947770 - DNA, 15 bp, Homo sapiens
ctggaacctcagcct

SEQ ID NO: 2947771 - DNA, 17 bp, Homo sapiens
ctggaacctcagcctgg

SEQ ID NO: 2947772 - DNA, 20 bp, Homo sapiens
ctggaacctcagcctggcca

SEQ ID NO: 2947773 - DNA, 23 bp, Homo sapiens
ctggaacctcagcctggccagac

SEQ ID NO: 2947774 - DNA, 19 bp, Homo sapiens
ctggaacttgaactgattc

SEQ ID NO: 2947775 - DNA, 14 bp, Homo sapiens
ctggaacttgggga

SEQ ID NO: 2947776 - DNA, 13 bp, Homo sapiens
ctggaagcagagc

SEQ ID NO: 2947777 - DNA, 19 bp, Homo sapiens
ctggaagctaatttgcatt

SEQ ID NO: 2947778 - DNA, 12 bp, Homo sapiens
ctggaagctgtg

SEQ ID NO: 2947779 - DNA, 18 bp, Homo sapiens
ctggaagctttgtcccct

SEQ ID NO: 2947780 - DNA, 14 bp, Homo sapiens
ctggaaggagcaca

SEQ ID NO: 2947781 - DNA, 19 bp, Homo sapiens
ctggaagtcaaataaatgt

SEQ ID NO: 2947782 - DNA, 17 bp, Homo sapiens
ctggaatctggagacca

SEQ ID NO: 2947783 - DNA, 22 bp, Homo sapiens
ctggaatggcacgttgctgcca

SEQ ID NO: 2947784 - DNA, 22 bp, Homo sapiens
ctggaattagcttggggccagg

SEQ ID NO: 2947785 - DNA, 14 bp, Homo sapiens
ctggacacaggcct

SEQ ID NO: 2947786 - DNA, 12 bp, Homo sapiens
ctggacacttct

SEQ ID NO: 2947787 - DNA, 23 bp, Homo sapiens
ctggacacttctttatactctct

SEQ ID NO: 2947788 - DNA, 12 bp, Homo sapiens
ctggacagatgg

SEQ ID NO: 2947789 - DNA, 22 bp, Homo sapiens
ctggacagatggacgcaggccc

SEQ ID NO: 2947790 - DNA, 12 bp, Homo sapiens
ctggacagcttg

SEQ ID NO: 2947791 - DNA, 17 bp, Homo sapiens
ctggcccctttgggccc

SEQ ID NO: 2947792 - DNA, 21 bp, Homo sapiens
ctggcccctttgggccctgca

SEQ ID NO: 2947793 - DNA, 23 bp, Homo sapiens
ctggcccctttgggccctgcatg

SEQ ID NO: 2947794 - DNA, 16 bp, Homo sapiens
ctggcccgtgacagac

SEQ ID NO: 2947795 - DNA, 19 bp, Homo sapiens
ctggcccgtgacagactcc

SEQ ID NO: 2947796 - DNA, 12 bp, Homo sapiens
ctggccctgcct

SEQ ID NO: 2947797 - DNA, 14 bp, Homo sapiens
ctggccctgccttc

SEQ ID NO: 2947798 - DNA, 22 bp, Homo sapiens
ctggccctggcgggtggctgca

SEQ ID NO: 2947799 - DNA, 20 bp, Homo sapiens
ctggccctggggtgtgtctc

SEQ ID NO: 2947800 - DNA, 16 bp, Homo sapiens
ctggccgagtccaagc

SEQ ID NO: 2947801 - DNA, 18 bp, Homo sapiens
ctggccgagtccaagctg

SEQ ID NO: 2947802 - DNA, 20 bp, Homo sapiens
ctggccgagtccaagctggg

SEQ ID NO: 2947803 - DNA, 21 bp, Homo sapiens
ctggccggagcaaactctgct

SEQ ID NO: 2947804 - DNA, 22 bp, Homo sapiens
ctggccggagcaaactctgctg

SEQ ID NO: 2947805 - DNA, 20 bp, Homo sapiens
ctggccgggtcaccctgtga

SEQ ID NO: 2947806 - DNA, 15 bp, Homo sapiens
ctggccgtggctcca

SEQ ID NO: 2947807 - DNA, 16 bp, Homo sapiens
ctggccgtggctccag

SEQ ID NO: 2947808 - DNA, 15 bp, Homo sapiens
ctggccgttcagcct

SEQ ID NO: 2947809 - DNA, 17 bp, Homo sapiens
ctggccgttcagcctgt

SEQ ID NO: 2947810 - DNA, 21 bp, Homo sapiens
ctggcctaggggccagggctt

SEQ ID NO: 2947811 - DNA, 22 bp, Homo sapiens
ctggcctcacccacccctgcac

SEQ ID NO: 2947812 - DNA, 13 bp, Homo sapiens
ctggcctcagact

SEQ ID NO: 2947813 - DNA, 21 bp, Homo sapiens
ctggcctcagactgcacccag

SEQ ID NO: 2947814 - DNA, 16 bp, Homo sapiens
ctggcctcccaaatga

SEQ ID NO: 2947815 - DNA, 19 bp, Homo sapiens
ctggcctcccacagactca

SEQ ID NO: 2947816 - DNA, 21 bp, Homo sapiens
ctggcctccctccgtccctct

SEQ ID NO: 2947817 - DNA, 18 bp, Homo sapiens
ctggcctccgatgcctgg

SEQ ID NO: 2947818 - DNA, 15 bp, Homo sapiens
ctggcctccttcccc

SEQ ID NO: 2947819 - DNA, 11 bp, Homo sapiens
ctggcctctgt

SEQ ID NO: 2947820 - DNA, 16 bp, Homo sapiens
ctggcctcttggcacc

SEQ ID NO: 2947821 - DNA, 20 bp, Homo sapiens
ctggcctcttggcacctgcc

SEQ ID NO: 2947822 - DNA, 24 bp, Homo sapiens
ctggcctcttggcacctgcctagc

SEQ ID NO: 2947823 - DNA, 12 bp, Homo sapiens
ctggcctgagag

SEQ ID NO: 2947824 - DNA, 13 bp, Homo sapiens
ctggcctgaggtc

SEQ ID NO: 2947825 - DNA, 19 bp, Homo sapiens
ctggcctgctgggctctcc

SEQ ID NO: 2947826 - DNA, 20 bp, Homo sapiens
ctggcctgctgggctctcca

SEQ ID NO: 2947827 - DNA, 18 bp, Homo sapiens
ctggcctggcacacatca

SEQ ID NO: 2947828 - DNA, 22 bp, Homo sapiens
ctggcctggcacacatcaggag

SEQ ID NO: 2947829 - DNA, 15 bp, Homo sapiens
ctggcctggtccctg

SEQ ID NO: 2947830 - DNA, 16 bp, Homo sapiens
ctggcctggtccctgg

SEQ ID NO: 2947831 - DNA, 17 bp, Homo sapiens
ctggcctggtccctggt

SEQ ID NO: 2947832 - DNA, 20 bp, Homo sapiens
ctggccttggtatgtgccag

SEQ ID NO: 2947833 - DNA, 15 bp, Homo sapiens
ctggccttgtcctca

SEQ ID NO: 2947834 - DNA, 22 bp, Homo sapiens
ctggcgacacgtagcagcttag

SEQ ID NO: 2947835 - DNA, 15 bp, Homo sapiens
ctggcgacactcagg

SEQ ID NO: 2947836 - DNA, 21 bp, Homo sapiens
ctggcgacactcagggcagct

SEQ ID NO: 2947837 - DNA, 24 bp, Homo sapiens
ctggcgacactcagggcagctgcc

SEQ ID NO: 2947838 - DNA, 13 bp, Homo sapiens
ctggcgagccctt

SEQ ID NO: 2947839 - DNA, 14 bp, Homo sapiens
ctggcgagccctta

SEQ ID NO: 2947840 - DNA, 22 bp, Homo sapiens
ctggcgaggtgcggccaccacc

SEQ ID NO: 2947841 - DNA, 20 bp, Homo sapiens
ctggcgccttctcggagctg

SEQ ID NO: 2947842 - DNA, 16 bp, Homo sapiens
ctggcggctactcagc

SEQ ID NO: 2947843 - DNA, 15 bp, Homo sapiens
ctggcggtggccaca

SEQ ID NO: 2947844 - DNA, 14 bp, Homo sapiens
ctggctaacaaggc

SEQ ID NO: 2947845 - DNA, 13 bp, Homo sapiens
ctggctacagtac

SEQ ID NO: 2947846 - DNA, 15 bp, Homo sapiens
ctggctagagggccc

SEQ ID NO: 2947847 - DNA, 17 bp, Homo sapiens
ctggctagagggcccaa

SEQ ID NO: 2947848 - DNA, 20 bp, Homo sapiens
ctggctagagggcccaaagc

SEQ ID NO: 2947849 - DNA, 19 bp, Homo sapiens
ctggctcacgccccgctgt

SEQ ID NO: 2947850 - DNA, 21 bp, Homo sapiens
ctggctcacgccccgctgtgt

SEQ ID NO: 2947851 - DNA, 22 bp, Homo sapiens
ctggctcacgccccgctgtgtc

SEQ ID NO: 2947852 - DNA, 13 bp, Homo sapiens
ctggctcagctgt

SEQ ID NO: 2947853 - DNA, 15 bp, Homo sapiens
ctggctcagctgtgg

SEQ ID NO: 2947854 - DNA, 16 bp, Homo sapiens
ctggctcagctgtggt

SEQ ID NO: 2947855 - DNA, 14 bp, Homo sapiens
ctggctcaggccca

SEQ ID NO: 2947856 - DNA, 14 bp, Homo sapiens
ctggctcatgcccc

SEQ ID NO: 2947857 - DNA, 16 bp, Homo sapiens
ctggctcatgcccctt

SEQ ID NO: 2947858 - DNA, 18 bp, Homo sapiens
ctggctcatgccccttgg

SEQ ID NO: 2947859 - DNA, 15 bp, Homo sapiens
ctggctccccgaggg

SEQ ID NO: 2947860 - DNA, 16 bp, Homo sapiens
ctggctcgtaggcctg

SEQ ID NO: 2947861 - DNA, 13 bp, Homo sapiens
ctggctctgattc

SEQ ID NO: 2947862 - DNA, 12 bp, Homo sapiens
ctggctctgggc

SEQ ID NO: 2947863 - DNA, 15 bp, Homo sapiens
ctggctctgtggagg

SEQ ID NO: 2947864 - DNA, 16 bp, Homo sapiens
ctggctgaacagtgct

SEQ ID NO: 2947865 - DNA, 19 bp, Homo sapiens
ctggctgaacagtgctctg

SEQ ID NO: 2947866 - DNA, 20 bp, Homo sapiens
ctggctgaacagtgctctgc

SEQ ID NO: 2947867 - DNA, 12 bp, Homo sapiens
ctggctgctgct

SEQ ID NO: 2947868 - DNA, 16 bp, Homo sapiens
ctggctggccagtctg

SEQ ID NO: 2947869 - DNA, 12 bp, Homo sapiens
ctggctgggacg

SEQ ID NO: 2947870 - DNA, 19 bp, Homo sapiens
ctggctgggacgtggctca

SEQ ID NO: 2947871 - DNA, 16 bp, Homo sapiens
ctggctggtgcctgag

SEQ ID NO: 2947872 - DNA, 19 bp, Homo sapiens
ctggctggtgcctgagccc

SEQ ID NO: 2947873 - DNA, 19 bp, Homo sapiens
ctggctgtaaggctctaga

SEQ ID NO: 2947874 - DNA, 18 bp, Homo sapiens
ctggctgtacctgttcct

SEQ ID NO: 2947875 - DNA, 21 bp, Homo sapiens
ctggctgtacctgttcctccc

SEQ ID NO: 2947876 - DNA, 23 bp, Homo sapiens
ctggctgttctgatcggccagtt

SEQ ID NO: 2947877 - DNA, 21 bp, Homo sapiens
ctggcttcaggcaattctcct

SEQ ID NO: 2947878 - DNA, 20 bp, Homo sapiens
ctggcttccctctctgaaat

SEQ ID NO: 2947879 - DNA, 13 bp, Homo sapiens
ctggcttctggcc

SEQ ID NO: 2947880 - DNA, 16 bp, Homo sapiens
ctggcttgagtgaatt

SEQ ID NO: 2947881 - DNA, 17 bp, Homo sapiens
ctggcttgtaactccac

SEQ ID NO: 2947882 - DNA, 15 bp, Homo sapiens
ctggcttgtacattt

SEQ ID NO: 2947883 - DNA, 14 bp, Homo sapiens
ctggcttgtttatt

SEQ ID NO: 2947884 - DNA, 19 bp, Homo sapiens
ctggctttcatccaactct

SEQ ID NO: 2947885 - DNA, 11 bp, Homo sapiens
ctggctttggc

SEQ ID NO: 2947886 - DNA, 19 bp, Homo sapiens
ctggctttttattgtattt

SEQ ID NO: 2947887 - DNA, 18 bp, Homo sapiens
ctgggaaacactccttgc

SEQ ID NO: 2947888 - DNA, 22 bp, Homo sapiens
ctgggaaacactccttgcatca

SEQ ID NO: 2947889 - DNA, 16 bp, Homo sapiens
ctgggaaacagaggct

SEQ ID NO: 2947890 - DNA, 16 bp, Homo sapiens
ctgggaaatattccct

SEQ ID NO: 2947891 - DNA, 21 bp, Homo sapiens
ctgggaagggagagggcctct

SEQ ID NO: 2947892 - DNA, 23 bp, Homo sapiens
ctgggacacttaacagatgcaat

SEQ ID NO: 2947893 - DNA, 19 bp, Homo sapiens
ctgggaccctttccttcct

SEQ ID NO: 2947894 - DNA, 20 bp, Homo sapiens
ctgggaccctttccttcctt

SEQ ID NO: 2947895 - DNA, 23 bp, Homo sapiens
ctgggaccctttccttccttccc

SEQ ID NO: 2947896 - DNA, 16 bp, Homo sapiens
ctgggacctgatttat

SEQ ID NO: 2947897 - DNA, 15 bp, Homo sapiens
ctgggacgtggctca

SEQ ID NO: 2947898 - DNA, 17 bp, Homo sapiens
ctgggacgtggctcagc

SEQ ID NO: 2947899 - DNA, 18 bp, Homo sapiens
ctgggacgtggctcagcc

SEQ ID NO: 2947900 - DNA, 21 bp, Homo sapiens
ctgggacgtggctcagccagc

SEQ ID NO: 2947901 - DNA, 14 bp, Homo sapiens
ctgggactgcaggc

SEQ ID NO: 2947902 - DNA, 22 bp, Homo sapiens
ctgggatcacaggtgtcagcca

SEQ ID NO: 2947903 - DNA, 14 bp, Homo sapiens
ctgggatcccacag

SEQ ID NO: 2947904 - DNA, 17 bp, Homo sapiens
ctgggatcccacagccc

SEQ ID NO: 2947905 - DNA, 20 bp, Homo sapiens
ctgggatcccacagccctag

SEQ ID NO: 2947906 - DNA, 17 bp, Homo sapiens
ctgggatcctaagggct

SEQ ID NO: 2947907 - DNA, 16 bp, Homo sapiens
ctgggatggtgggctt

SEQ ID NO: 2947908 - DNA, 17 bp, Homo sapiens
ctgggatggtgggcttc

SEQ ID NO: 2947909 - DNA, 18 bp, Homo sapiens
ctgggatggtgggcttca

SEQ ID NO: 2947910 - DNA, 20 bp, Homo sapiens
ctgggatggtgggcttcagg

SEQ ID NO: 2947911 - DNA, 21 bp, Homo sapiens
ctgggattacaggcgtgagcc

SEQ ID NO: 2947912 - DNA, 19 bp, Homo sapiens
ctgggattacaggtgtgca

SEQ ID NO: 2947913 - DNA, 17 bp, Homo sapiens
ctgggcacacgcctccc

SEQ ID NO: 2947914 - DNA, 22 bp, Homo sapiens
ctgggcacacgcctcccactgg

SEQ ID NO: 2947915 - DNA, 16 bp, Homo sapiens
ctgggcacctgcgcac

SEQ ID NO: 2947916 - DNA, 20 bp, Homo sapiens
ctgggcacctgcgcacaggt

SEQ ID NO: 2947917 - DNA, 22 bp, Homo sapiens
ctgggcacctgcgcacaggtgg

SEQ ID NO: 2947918 - DNA, 14 bp, Homo sapiens
ctgggcagagcctg

SEQ ID NO: 2947919 - DNA, 18 bp, Homo sapiens
ctgggcagagcctgtccc

SEQ ID NO: 2947920 - DNA, 16 bp, Homo sapiens
ctgggcagctgtccct

SEQ ID NO: 2947921 - DNA, 13 bp, Homo sapiens
ctgggcaggtggg

SEQ ID NO: 2947922 - DNA, 18 bp, Homo sapiens
ctgggcaggtgggagctg

SEQ ID NO: 2947923 - DNA, 12 bp, Homo sapiens
ctgggcagtgcc

SEQ ID NO: 2947924 - DNA, 19 bp, Homo sapiens
ctgggcagtgcccaccatg

SEQ ID NO: 2947925 - DNA, 12 bp, Homo sapiens
ctgggcattgct

SEQ ID NO: 2947926 - DNA, 14 bp, Homo sapiens
ctgggcattgcttt

SEQ ID NO: 2947927 - DNA, 19 bp, Homo sapiens
ctgggccattctccacagc

SEQ ID NO: 2947928 - DNA, 20 bp, Homo sapiens
ctgggccattctccacagca

SEQ ID NO: 2947929 - DNA, 16 bp, Homo sapiens
ctgggcccaggcaggt

SEQ ID NO: 2947930 - DNA, 19 bp, Homo sapiens
ctgggcccaggcaggtctg

SEQ ID NO: 2947931 - DNA, 14 bp, Homo sapiens
ctgggccccaccac

SEQ ID NO: 2947932 - DNA, 16 bp, Homo sapiens
ctgggccccaccacct

SEQ ID NO: 2947933 - DNA, 13 bp, Homo sapiens
ctgggcccccaga

SEQ ID NO: 2947934 - DNA, 16 bp, Homo sapiens
ctgggcccctcccctc

SEQ ID NO: 2947935 - DNA, 13 bp, Homo sapiens
ctgggccctctct

SEQ ID NO: 2947936 - DNA, 11 bp, Homo sapiens
ctgggccctga

SEQ ID NO: 2947937 - DNA, 22 bp, Homo sapiens
ctgggccctgagtctgggcagc

SEQ ID NO: 2947938 - DNA, 16 bp, Homo sapiens
ctgggccgcaagggcc

SEQ ID NO: 2947939 - DNA, 17 bp, Homo sapiens
ctgggccgcaagggcct

SEQ ID NO: 2947940 - DNA, 18 bp, Homo sapiens
ctgggccgcaagggcctg

SEQ ID NO: 2947941 - DNA, 22 bp, Homo sapiens
ctgggccgcgtgccgggccccc

SEQ ID NO: 2947942 - DNA, 23 bp, Homo sapiens
ctgggccgcgtgccgggccccca

SEQ ID NO: 2947943 - DNA, 23 bp, Homo sapiens
ctgggcctggagggggagcacca

SEQ ID NO: 2947944 - DNA, 16 bp, Homo sapiens
ctgggccttctcagct

SEQ ID NO: 2947945 - DNA, 20 bp, Homo sapiens
ctgggcgcggtggctcacgc

SEQ ID NO: 2947946 - DNA, 22 bp, Homo sapiens
ctgggcgcggtggctcacgcct

SEQ ID NO: 2947947 - DNA, 21 bp, Homo sapiens
ctgggcgtctgactccctccc

SEQ ID NO: 2947948 - DNA, 15 bp, Homo sapiens
ctgggctaccccacc

SEQ ID NO: 2947949 - DNA, 13 bp, Homo sapiens
ctgggctatattc

SEQ ID NO: 2947950 - DNA, 17 bp, Homo sapiens
ctgggctcctccagggt

SEQ ID NO: 2947951 - DNA, 20 bp, Homo sapiens
ctgggctctccacctcagcc

SEQ ID NO: 2947952 - DNA, 14 bp, Homo sapiens
ctgggctctggttt

SEQ ID NO: 2947953 - DNA, 17 bp, Homo sapiens
ctgggctgagccaaagc

SEQ ID NO: 2947954 - DNA, 17 bp, Homo sapiens
ctgggctgcagagtctg

SEQ ID NO: 2947955 - DNA, 15 bp, Homo sapiens
ctgggctgggcagcc

SEQ ID NO: 2947956 - DNA, 22 bp, Homo sapiens
ctgggctgggtggcccctgtct

SEQ ID NO: 2947957 - DNA, 22 bp, Homo sapiens
ctgggctgggtttgctgtcttg

SEQ ID NO: 2947958 - DNA, 22 bp, Homo sapiens
ctgggctgttttagtgccaggc

SEQ ID NO: 2947959 - DNA, 16 bp, Homo sapiens
ctggggaaagacactg

SEQ ID NO: 2947960 - DNA, 17 bp, Homo sapiens
ctggggagggggtacct

SEQ ID NO: 2947961 - DNA, 17 bp, Homo sapiens
ctggggaggtgggaggc

SEQ ID NO: 2947962 - DNA, 20 bp, Homo sapiens
ctggggaggtgggaggccag

SEQ ID NO: 2947963 - DNA, 23 bp, Homo sapiens
ctggggaggtgggaggccaggcg

SEQ ID NO: 2947964 - DNA, 12 bp, Homo sapiens
ctggggcactcc

SEQ ID NO: 2947965 - DNA, 19 bp, Homo sapiens
ctggggcactcccccagga

SEQ ID NO: 2947966 - DNA, 20 bp, Homo sapiens
ctggggcactcccccaggat

SEQ ID NO: 2947967 - DNA, 13 bp, Homo sapiens
ctggggccaggcc

SEQ ID NO: 2947968 - DNA, 15 bp, Homo sapiens
ctggggcctcagacg

SEQ ID NO: 2947969 - DNA, 12 bp, Homo sapiens
ctggggcctcca

SEQ ID NO: 2947970 - DNA, 17 bp, Homo sapiens
ctggggcgggcagccag

SEQ ID NO: 2947971 - DNA, 20 bp, Homo sapiens
ctggggctgagtctccaggg

SEQ ID NO: 2947972 - DNA, 15 bp, Homo sapiens
ctggggctggcctcc

SEQ ID NO: 2947973 - DNA, 13 bp, Homo sapiens
ctggggctggctt

SEQ ID NO: 2947974 - DNA, 23 bp, Homo sapiens
ctggggctggtggattgggcaga

SEQ ID NO: 2947975 - DNA, 16 bp, Homo sapiens
ctggggcttgaatttg

SEQ ID NO: 2947976 - DNA, 12 bp, Homo sapiens
ctgggggagaga

SEQ ID NO: 2947977 - DNA, 17 bp, Homo sapiens
ctgggggagggactgct

SEQ ID NO: 2947978 - DNA, 24 bp, Homo sapiens
ctgggggagggactgctgacccac

SEQ ID NO: 2947979 - DNA, 12 bp, Homo sapiens
ctgggggctccc

SEQ ID NO: 2947980 - DNA, 14 bp, Homo sapiens
ctgggggctcccct

SEQ ID NO: 2947981 - DNA, 15 bp, Homo sapiens
ctgggggctcccctt

SEQ ID NO: 2947982 - DNA, 14 bp, Homo sapiens
ctgggggctggttg

SEQ ID NO: 2947983 - DNA, 17 bp, Homo sapiens
ctggggggaacggatgc

SEQ ID NO: 2947984 - DNA, 19 bp, Homo sapiens
ctggggggacccagtgcag

SEQ ID NO: 2947985 - DNA, 21 bp, Homo sapiens
ctggggggacccagtgcagaa

SEQ ID NO: 2947986 - DNA, 14 bp, Homo sapiens
ctgggggtgggcca

SEQ ID NO: 2947987 - DNA, 15 bp, Homo sapiens
ctgggggtgggccag

SEQ ID NO: 2947988 - DNA, 17 bp, Homo sapiens
ctgggggtgggccaggc

SEQ ID NO: 2947989 - DNA, 19 bp, Homo sapiens
ctgggggtggggaggggcc

SEQ ID NO: 2947990 - DNA, 20 bp, Homo sapiens
ctgggggtggggaggggcct

SEQ ID NO: 2947991 - DNA, 18 bp, Homo sapiens
ctggggtaagcggaataa

SEQ ID NO: 2947992 - DNA, 19 bp, Homo sapiens
ctggggtacacagtgagag

SEQ ID NO: 2947993 - DNA, 16 bp, Homo sapiens
ctggggtccagggagc

SEQ ID NO: 2947994 - DNA, 12 bp, Homo sapiens
ctggggtcccca

SEQ ID NO: 2947995 - DNA, 19 bp, Homo sapiens
ctggggtctcaggtccagc

SEQ ID NO: 2947996 - DNA, 15 bp, Homo sapiens
ctggggtggccacca

SEQ ID NO: 2947997 - DNA, 13 bp, Homo sapiens
ctggggtggcctg

SEQ ID NO: 2947998 - DNA, 18 bp, Homo sapiens
ctggggtggcctgtgtgg

SEQ ID NO: 2947999 - DNA, 13 bp, Homo sapiens
ctggggttcagcc

SEQ ID NO: 2948000 - DNA, 19 bp, Homo sapiens
ctggggttcagcccctcct

SEQ ID NO: 2948001 - DNA, 21 bp, Homo sapiens
ctggggttcagcccctcctct

SEQ ID NO: 2948002 - DNA, 22 bp, Homo sapiens
ctggggttcagcccctcctctg

SEQ ID NO: 2948003 - DNA, 18 bp, Homo sapiens
ctggggttgtcagctctc

SEQ ID NO: 2948004 - DNA, 22 bp, Homo sapiens
ctgggtaataagcataagacca

SEQ ID NO: 2948005 - DNA, 15 bp, Homo sapiens
ctgggtacttcttga

SEQ ID NO: 2948006 - DNA, 23 bp, Homo sapiens
ctgggtacttcttgaaggtgctg

SEQ ID NO: 2948007 - DNA, 15 bp, Homo sapiens
ctgggtagaagccac

SEQ ID NO: 2948008 - DNA, 14 bp, Homo sapiens
ctgggtaggcccca

SEQ ID NO: 2948009 - DNA, 19 bp, Homo sapiens
ctgggtaggccccacaagg

SEQ ID NO: 2948010 - DNA, 21 bp, Homo sapiens
ctgggtaggccccacaaggcc

SEQ ID NO: 2948011 - DNA, 22 bp, Homo sapiens
ctgggtagtgctttaagaatga

SEQ ID NO: 2948012 - DNA, 17 bp, Homo sapiens
ctgggtcacaggaagga

SEQ ID NO: 2948013 - DNA, 14 bp, Homo sapiens
ctgggtcagaccca

SEQ ID NO: 2948014 - DNA, 12 bp, Homo sapiens
ctgggtcctgcc

SEQ ID NO: 2948015 - DNA, 19 bp, Homo sapiens
ctgggtccttgggcctggc

SEQ ID NO: 2948016 - DNA, 18 bp, Homo sapiens
ctgggtctgacctggtgg

SEQ ID NO: 2948017 - DNA, 21 bp, Homo sapiens
ctgggtctgacctggtgggag

SEQ ID NO: 2948018 - DNA, 13 bp, Homo sapiens
ctgggtgatttct

SEQ ID NO: 2948019 - DNA, 19 bp, Homo sapiens
ctgggtgccaagtcctagc

SEQ ID NO: 2948020 - DNA, 13 bp, Homo sapiens
ctgggtgccctga

SEQ ID NO: 2948021 - DNA, 12 bp, Homo sapiens
ctgtagctttct

SEQ ID NO: 2948022 - DNA, 21 bp, Homo sapiens
ctgtagggaaaaaaatgcttc

SEQ ID NO: 2948023 - DNA, 22 bp, Homo sapiens
ctgtagggaaaaaaatgcttct

SEQ ID NO: 2948024 - DNA, 19 bp, Homo sapiens
ctgtaggtatagaagatct

SEQ ID NO: 2948025 - DNA, 18 bp, Homo sapiens
ctgtaggttatttaaaat

SEQ ID NO: 2948026 - DNA, 20 bp, Homo sapiens
ctgtagtaaactatttatct

SEQ ID NO: 2948027 - DNA, 18 bp, Homo sapiens
ctgtagtaggcattttta

SEQ ID NO: 2948028 - DNA, 22 bp, Homo sapiens
ctgtagtaggcatttttaccat

SEQ ID NO: 2948029 - DNA, 14 bp, Homo sapiens
ctgtagtcagccga

SEQ ID NO: 2948030 - DNA, 14 bp, Homo sapiens
ctgtagtcccagct

SEQ ID NO: 2948031 - DNA, 18 bp, Homo sapiens
ctgtagtcccagctactt

SEQ ID NO: 2948032 - DNA, 18 bp, Homo sapiens
ctgtagtgagatagcatt

SEQ ID NO: 2948033 - DNA, 22 bp, Homo sapiens
ctgtagttacattaatgcccag

SEQ ID NO: 2948034 - DNA, 23 bp, Homo sapiens
ctgtagttacattaatgcccagc

SEQ ID NO: 2948035 - DNA, 14 bp, Homo sapiens
ctgtagttctaaga

SEQ ID NO: 2948036 - DNA, 19 bp, Homo sapiens
ctgtagttctaagactcaa

SEQ ID NO: 2948037 - DNA, 13 bp, Homo sapiens
ctgtagtttatgg

SEQ ID NO: 2948038 - DNA, 17 bp, Homo sapiens
ctgtataccgatcagga

SEQ ID NO: 2948039 - DNA, 22 bp, Homo sapiens
ctgtatataaatgggaacattt

SEQ ID NO: 2948040 - DNA, 15 bp, Homo sapiens
ctgtatataaatgtg

SEQ ID NO: 2948041 - DNA, 19 bp, Homo sapiens
ctgtatattgggctcagag

SEQ ID NO: 2948042 - DNA, 21 bp, Homo sapiens
ctgtatattgggctcagagag

SEQ ID NO: 2948043 - DNA, 14 bp, Homo sapiens
ctgtatatttatga

SEQ ID NO: 2948044 - DNA, 18 bp, Homo sapiens
ctgtatatttatgaccag

SEQ ID NO: 2948045 - DNA, 15 bp, Homo sapiens
ctgtatccatgtaat

SEQ ID NO: 2948046 - DNA, 15 bp, Homo sapiens
ctgtatctttctatg

SEQ ID NO: 2948047 - DNA, 18 bp, Homo sapiens
ctgtatgaatattttata

SEQ ID NO: 2948048 - DNA, 18 bp, Homo sapiens
ctgtatgatttgttttga

SEQ ID NO: 2948049 - DNA, 22 bp, Homo sapiens
ctgtatgggggagattgaactt

SEQ ID NO: 2948050 - DNA, 23 bp, Homo sapiens
ctgtatgggggagattgaacttt

SEQ ID NO: 2948051 - DNA, 17 bp, Homo sapiens
ctgtatgtattagtgat

SEQ ID NO: 2948052 - DNA, 15 bp, Homo sapiens
ctgtatgtctgtcat

SEQ ID NO: 2948053 - DNA, 18 bp, Homo sapiens
ctgtatgtgctgtaattt

SEQ ID NO: 2948054 - DNA, 19 bp, Homo sapiens
ctgtatgtgctgtaattta

SEQ ID NO: 2948055 - DNA, 16 bp, Homo sapiens
ctgtattcagacagat

SEQ ID NO: 2948056 - DNA, 14 bp, Homo sapiens
ctgtatttgtgact

SEQ ID NO: 2948057 - DNA, 19 bp, Homo sapiens
ctgtatttgtgactaattg

SEQ ID NO: 2948058 - DNA, 21 bp, Homo sapiens
ctgtatttgtgactaattgta

SEQ ID NO: 2948059 - DNA, 23 bp, Homo sapiens
ctgtattttgagtttcagctgga

SEQ ID NO: 2948060 - DNA, 15 bp, Homo sapiens
ctgtatttttctaaa

SEQ ID NO: 2948061 - DNA, 20 bp, Homo sapiens
ctgtattttttcttgcattg

SEQ ID NO: 2948062 - DNA, 22 bp, Homo sapiens
ctgtattttttcttgcattgac

SEQ ID NO: 2948063 - DNA, 23 bp, Homo sapiens
ctgtattttttcttgcattgaca

SEQ ID NO: 2948064 - DNA, 17 bp, Homo sapiens
ctgtattttttttttcc

SEQ ID NO: 2948065 - DNA, 20 bp, Homo sapiens
ctgtattttttttttccatt

SEQ ID NO: 2948066 - DNA, 17 bp, Homo sapiens
ctgtcaaacaaagccag

SEQ ID NO: 2948067 - DNA, 13 bp, Homo sapiens
ctgtcaagcatat

SEQ ID NO: 2948068 - DNA, 23 bp, Homo sapiens
ctgtcaccaagctcacagttcct

SEQ ID NO: 2948069 - DNA, 15 bp, Homo sapiens
ctgtcaccaaggaaa

SEQ ID NO: 2948070 - DNA, 16 bp, Homo sapiens
ctgtcaccaaggaaac

SEQ ID NO: 2948071 - DNA, 21 bp, Homo sapiens
ctgtcaccacatcttgtcttt

SEQ ID NO: 2948072 - DNA, 20 bp, Homo sapiens
ctgtcaccctggccaccacc

SEQ ID NO: 2948073 - DNA, 17 bp, Homo sapiens
ctgtcacctctcccacg

SEQ ID NO: 2948074 - DNA, 14 bp, Homo sapiens
ctgtcacggaggga

SEQ ID NO: 2948075 - DNA, 17 bp, Homo sapiens
ctgtcactcaggctgga

SEQ ID NO: 2948076 - DNA, 22 bp, Homo sapiens
ctgtcactcattgctgagcctc

SEQ ID NO: 2948077 - DNA, 23 bp, Homo sapiens
ctgtcactcattgctgagcctct

SEQ ID NO: 2948078 - DNA, 14 bp, Homo sapiens
ctgtcagatgtcac

SEQ ID NO: 2948079 - DNA, 12 bp, Homo sapiens
ctgtcagggagg

SEQ ID NO: 2948080 - DNA, 16 bp, Homo sapiens
ctgtcagtatgacatt

SEQ ID NO: 2948081 - DNA, 13 bp, Homo sapiens
ctgtcagtcacag

SEQ ID NO: 2948082 - DNA, 14 bp, Homo sapiens
ctgtcagtgtgaaa

SEQ ID NO: 2948083 - DNA, 15 bp, Homo sapiens
ctgtcataggactct

SEQ ID NO: 2948084 - DNA, 17 bp, Homo sapiens
ctgtccaacccctcccc

SEQ ID NO: 2948085 - DNA, 17 bp, Homo sapiens
ctgtccacatccccaga

SEQ ID NO: 2948086 - DNA, 18 bp, Homo sapiens
ctgtccacatccccagag

SEQ ID NO: 2948087 - DNA, 22 bp, Homo sapiens
ctgtccacatccccagagccca

SEQ ID NO: 2948088 - DNA, 15 bp, Homo sapiens
ctgtccacctcggcc

SEQ ID NO: 2948089 - DNA, 12 bp, Homo sapiens
ctgtccagcccc

SEQ ID NO: 2948090 - DNA, 13 bp, Homo sapiens
ctgtccagctcca

SEQ ID NO: 2948091 - DNA, 21 bp, Homo sapiens
ctgtccagctcccgctgtggc

SEQ ID NO: 2948092 - DNA, 12 bp, Homo sapiens
ctgtccaggctc

SEQ ID NO: 2948093 - DNA, 12 bp, Homo sapiens
ctgtccaggtga

SEQ ID NO: 2948094 - DNA, 14 bp, Homo sapiens
ctgtccagtgggta

SEQ ID NO: 2948095 - DNA, 14 bp, Homo sapiens
ctgtccatcctcct

SEQ ID NO: 2948096 - DNA, 15 bp, Homo sapiens
ctgtccatcctcctc

SEQ ID NO: 2948097 - DNA, 17 bp, Homo sapiens
ctgtccatcctcctctc

SEQ ID NO: 2948098 - DNA, 23 bp, Homo sapiens
ctgtccatcctcctctccatgca

SEQ ID NO: 2948099 - DNA, 12 bp, Homo sapiens
ctgtccatctgc

SEQ ID NO: 2948100 - DNA, 13 bp, Homo sapiens
ctgtcccaagctc

SEQ ID NO: 2948101 - DNA, 12 bp, Homo sapiens
ctgtcccagcta

SEQ ID NO: 2948102 - DNA, 14 bp, Homo sapiens
ctgtcccagctacc

SEQ ID NO: 2948103 - DNA, 22 bp, Homo sapiens
ctgtcccagctaccaagtcaga

SEQ ID NO: 2948104 - DNA, 12 bp, Homo sapiens
ctgtcccaggac

SEQ ID NO: 2948105 - DNA, 15 bp, Homo sapiens
ctgtcccaggactca

SEQ ID NO: 2948106 - DNA, 13 bp, Homo sapiens
ctgtcccagttgt

SEQ ID NO: 2948107 - DNA, 12 bp, Homo sapiens
ctgtccccaggc

SEQ ID NO: 2948108 - DNA, 17 bp, Homo sapiens
ctgtccccaggcctggc

SEQ ID NO: 2948109 - DNA, 18 bp, Homo sapiens
ctgtcccctcacagactc

SEQ ID NO: 2948110 - DNA, 12 bp, Homo sapiens
ctgtcccctcag

SEQ ID NO: 2948111 - DNA, 14 bp, Homo sapiens
ctgtcccctcagcg

SEQ ID NO: 2948112 - DNA, 21 bp, Homo sapiens
ctgtccctagtaaaaatacaa

SEQ ID NO: 2948113 - DNA, 16 bp, Homo sapiens
ctgtccctcacagcac

SEQ ID NO: 2948114 - DNA, 14 bp, Homo sapiens
ctgtccctcctggt

SEQ ID NO: 2948115 - DNA, 21 bp, Homo sapiens
ctgtccctctcagtgccttct

SEQ ID NO: 2948116 - DNA, 22 bp, Homo sapiens
ctgtccctctcagtgccttctc

SEQ ID NO: 2948117 - DNA, 14 bp, Homo sapiens
ctgtccctgcactg

SEQ ID NO: 2948118 - DNA, 13 bp, Homo sapiens
ctgtccctgcttt

SEQ ID NO: 2948119 - DNA, 12 bp, Homo sapiens
ctgtccctgtca

SEQ ID NO: 2948120 - DNA, 15 bp, Homo sapiens
ctgtccctgtcacca

SEQ ID NO: 2948121 - DNA, 19 bp, Homo sapiens
ctgtcccttctgtccctca

SEQ ID NO: 2948122 - DNA, 14 bp, Homo sapiens
ctgtcccttgctgt

SEQ ID NO: 2948123 - DNA, 18 bp, Homo sapiens
ctgtcccttgctgtatgc

SEQ ID NO: 2948124 - DNA, 17 bp, Homo sapiens
ctgtcccttgcttgcct

SEQ ID NO: 2948125 - DNA, 18 bp, Homo sapiens
ctgtcccttgcttgcctg

SEQ ID NO: 2948126 - DNA, 23 bp, Homo sapiens
ctgtcccttgcttgcctgcaggg

SEQ ID NO: 2948127 - DNA, 19 bp, Homo sapiens
ctgtcccttggaactcttg

SEQ ID NO: 2948128 - DNA, 18 bp, Homo sapiens
ctgtccgtttactccaag

SEQ ID NO: 2948129 - DNA, 20 bp, Homo sapiens
ctgtcctacctccactctct

SEQ ID NO: 2948130 - DNA, 20 bp, Homo sapiens
ctgtcctagtctcctttgaa

SEQ ID NO: 2948131 - DNA, 14 bp, Homo sapiens
ctgtcctcaccgtc

SEQ ID NO: 2948132 - DNA, 15 bp, Homo sapiens
ctgtcctcaccgtct

SEQ ID NO: 2948133 - DNA, 14 bp, Homo sapiens
ctgtcctcagcctt

SEQ ID NO: 2948134 - DNA, 22 bp, Homo sapiens
ctgtcctcagccttgccagaga

SEQ ID NO: 2948135 - DNA, 15 bp, Homo sapiens
ctgtcctccaagcca

SEQ ID NO: 2948136 - DNA, 17 bp, Homo sapiens
ctgtcctccaagccagc

SEQ ID NO: 2948137 - DNA, 21 bp, Homo sapiens
ctgtcctcgaattttatctgt

SEQ ID NO: 2948138 - DNA, 13 bp, Homo sapiens
ctgtcctctgtag

SEQ ID NO: 2948139 - DNA, 21 bp, Homo sapiens
ctgtcctgtggcatgcaaaag

SEQ ID NO: 2948140 - DNA, 22 bp, Homo sapiens
ctgtcctgtggcatgcaaaaga

SEQ ID NO: 2948141 - DNA, 16 bp, Homo sapiens
ctgtccttactcagag

SEQ ID NO: 2948142 - DNA, 19 bp, Homo sapiens
ctgtccttactcagagctg

SEQ ID NO: 2948143 - DNA, 22 bp, Homo sapiens
ctgtcctttctagagcactgcc

SEQ ID NO: 2948144 - DNA, 23 bp, Homo sapiens
ctgtcctttctagagcactgcca

SEQ ID NO: 2948145 - DNA, 17 bp, Homo sapiens
ctgtcgggggccactgt

SEQ ID NO: 2948146 - DNA, 20 bp, Homo sapiens
ctgtcgggggccactgtgtt

SEQ ID NO: 2948147 - DNA, 15 bp, Homo sapiens
ctgtcggtggctgcc

SEQ ID NO: 2948148 - DNA, 16 bp, Homo sapiens
ctgtcggtggctgcct

SEQ ID NO: 2948149 - DNA, 20 bp, Homo sapiens
ctgtcggtggctgcctttga

SEQ ID NO: 2948150 - DNA, 13 bp, Homo sapiens
ctgtctaaagcct

SEQ ID NO: 2948151 - DNA, 18 bp, Homo sapiens
ctgtctaaagccttaact

SEQ ID NO: 2948152 - DNA, 16 bp, Homo sapiens
ctgtctaacctgtgac

SEQ ID NO: 2948153 - DNA, 14 bp, Homo sapiens
ctgtctaagcagtt

SEQ ID NO: 2948154 - DNA, 19 bp, Homo sapiens
ctgtctagaatcctgcttt

SEQ ID NO: 2948155 - DNA, 19 bp, Homo sapiens
ctgtctagccttagtcaat

SEQ ID NO: 2948156 - DNA, 15 bp, Homo sapiens
ctgtctcaatagctc

SEQ ID NO: 2948157 - DNA, 13 bp, Homo sapiens
ctgtctcagggtg

SEQ ID NO: 2948158 - DNA, 17 bp, Homo sapiens
ctgtctcatccatcatc

SEQ ID NO: 2948159 - DNA, 14 bp, Homo sapiens
ctgtctcatttatt

SEQ ID NO: 2948160 - DNA, 15 bp, Homo sapiens
ctgtctcatttattt

SEQ ID NO: 2948161 - DNA, 21 bp, Homo sapiens
ctgtctccctcctctgcccgg

SEQ ID NO: 2948162 - DNA, 13 bp, Homo sapiens
ctgtctcctagga

SEQ ID NO: 2948163 - DNA, 22 bp, Homo sapiens
ctgtctcctttcaccccagggc

SEQ ID NO: 2948164 - DNA, 22 bp, Homo sapiens
ctgtctctccttgttgccccca

SEQ ID NO: 2948165 - DNA, 14 bp, Homo sapiens
ctgtctctctgggc

SEQ ID NO: 2948166 - DNA, 15 bp, Homo sapiens
ctgtctctctgggct

SEQ ID NO: 2948167 - DNA, 16 bp, Homo sapiens
ctgtctctctgggctg

SEQ ID NO: 2948168 - DNA, 22 bp, Homo sapiens
ctgtctctcttgtcacatggaa

SEQ ID NO: 2948169 - DNA, 14 bp, Homo sapiens
ctgtctctttccac

SEQ ID NO: 2948170 - DNA, 14 bp, Homo sapiens
ctgtctgccagggc

SEQ ID NO: 2948171 - DNA, 14 bp, Homo sapiens
ctgtctgctcaatg

SEQ ID NO: 2948172 - DNA, 20 bp, Homo sapiens
ctgtctggatccttcccaag

SEQ ID NO: 2948173 - DNA, 22 bp, Homo sapiens
ctgtctggatccttcccaaggt

SEQ ID NO: 2948174 - DNA, 13 bp, Homo sapiens
ctgtctgtcatct

SEQ ID NO: 2948175 - DNA, 14 bp, Homo sapiens
ctgtctgtcatctg

SEQ ID NO: 2948176 - DNA, 15 bp, Homo sapiens
ctgtctgtcatctgc

SEQ ID NO: 2948177 - DNA, 16 bp, Homo sapiens
ctgtctgtcttctcct

SEQ ID NO: 2948178 - DNA, 13 bp, Homo sapiens
ctgtctgtgacct

SEQ ID NO: 2948179 - DNA, 14 bp, Homo sapiens
ctgtctgtgacctg

SEQ ID NO: 2948180 - DNA, 14 bp, Homo sapiens
ctgtctgtgttttt

SEQ ID NO: 2948181 - DNA, 15 bp, Homo sapiens
ctgtctgttacactg

SEQ ID NO: 2948182 - DNA, 21 bp, Homo sapiens
ctgtcttatagggtaaaaaaa

SEQ ID NO: 2948183 - DNA, 18 bp, Homo sapiens
ctgtcttcaggctctgcc

SEQ ID NO: 2948184 - DNA, 22 bp, Homo sapiens
ctgtcttcggccgagctggttt

SEQ ID NO: 2948185 - DNA, 13 bp, Homo sapiens
ctgtcttctccta

SEQ ID NO: 2948186 - DNA, 15 bp, Homo sapiens
ctgtcttctcctaat

SEQ ID NO: 2948187 - DNA, 13 bp, Homo sapiens
ctgtcttctctcc

SEQ ID NO: 2948188 - DNA, 20 bp, Homo sapiens
ctgtcttctctccacttctg

SEQ ID NO: 2948189 - DNA, 21 bp, Homo sapiens
ctgtcttctctccacttctgg

SEQ ID NO: 2948190 - DNA, 13 bp, Homo sapiens
ctgtcttctgtat

SEQ ID NO: 2948191 - DNA, 16 bp, Homo sapiens
ctgtcttgctcctggg

SEQ ID NO: 2948192 - DNA, 22 bp, Homo sapiens
ctgtctttgcagggcacagatg

SEQ ID NO: 2948193 - DNA, 17 bp, Homo sapiens
ctgtctttgcggggcct

SEQ ID NO: 2948194 - DNA, 19 bp, Homo sapiens
ctgtctttgcggggcctgt

SEQ ID NO: 2948195 - DNA, 15 bp, Homo sapiens
ctgtctttgtggact

SEQ ID NO: 2948196 - DNA, 17 bp, Homo sapiens
ctgtctttgtggactgt

SEQ ID NO: 2948197 - DNA, 23 bp, Homo sapiens
ctgtctttttcatttttttctct

SEQ ID NO: 2948198 - DNA, 16 bp, Homo sapiens
ctgtgaagaagccctg

SEQ ID NO: 2948199 - DNA, 17 bp, Homo sapiens
ctgtgaagaagccctgt

SEQ ID NO: 2948200 - DNA, 19 bp, Homo sapiens
ctgtgaagaagccctgttc

SEQ ID NO: 2948201 - DNA, 21 bp, Homo sapiens
ctgtgaagaagccctgttctc

SEQ ID NO: 2948202 - DNA, 14 bp, Homo sapiens
ctgtgaagcccttt

SEQ ID NO: 2948203 - DNA, 18 bp, Homo sapiens
ctgtgaagccctttgcct

SEQ ID NO: 2948204 - DNA, 20 bp, Homo sapiens
ctgtgaagccctttgcctgt

SEQ ID NO: 2948205 - DNA, 16 bp, Homo sapiens
ctgtgaagtccttcac

SEQ ID NO: 2948206 - DNA, 18 bp, Homo sapiens
ctgtgaagtccttcacct

SEQ ID NO: 2948207 - DNA, 13 bp, Homo sapiens
ctgtgaagttaca

SEQ ID NO: 2948208 - DNA, 18 bp, Homo sapiens
ctgtgaagttacatgcat

SEQ ID NO: 2948209 - DNA, 21 bp, Homo sapiens
ctgtgaagttacatgcataaa

SEQ ID NO: 2948210 - DNA, 21 bp, Homo sapiens
ctgtgaataaaaagaaagatt

SEQ ID NO: 2948211 - DNA, 19 bp, Homo sapiens
ctgtgaatccatgggtctg

SEQ ID NO: 2948212 - DNA, 15 bp, Homo sapiens
ctgtgaatcctggca

SEQ ID NO: 2948213 - DNA, 17 bp, Homo sapiens
ctgtgaatcctggcaag

SEQ ID NO: 2948214 - DNA, 17 bp, Homo sapiens
ctgtgaatgttccccac

SEQ ID NO: 2948215 - DNA, 13 bp, Homo sapiens
ctgtgacacacta

SEQ ID NO: 2948216 - DNA, 22 bp, Homo sapiens
ctgtgacacactacaccacaca

SEQ ID NO: 2948217 - DNA, 16 bp, Homo sapiens
ctgtgacatcagaagt

SEQ ID NO: 2948218 - DNA, 17 bp, Homo sapiens
ctgtgacattgctggtc

SEQ ID NO: 2948219 - DNA, 21 bp, Homo sapiens
ctgtgacccacttctcatcac

SEQ ID NO: 2948220 - DNA, 13 bp, Homo sapiens
ctgtgacccccag

SEQ ID NO: 2948221 - DNA, 15 bp, Homo sapiens
ctgtgacctgcatct

SEQ ID NO: 2948222 - DNA, 14 bp, Homo sapiens
ctgtgaccttggga

SEQ ID NO: 2948223 - DNA, 18 bp, Homo sapiens
ctgtgactataaagctgt

SEQ ID NO: 2948224 - DNA, 15 bp, Homo sapiens
ctgtgactctgggca

SEQ ID NO: 2948225 - DNA, 17 bp, Homo sapiens
ctgtgagcccagctggg

SEQ ID NO: 2948226 - DNA, 13 bp, Homo sapiens
ctgtgagccttgc

SEQ ID NO: 2948227 - DNA, 17 bp, Homo sapiens
ctgtgagccttgcatga

SEQ ID NO: 2948228 - DNA, 17 bp, Homo sapiens
ctgtgagcttacattga

SEQ ID NO: 2948229 - DNA, 19 bp, Homo sapiens
ctgtgaggagccccatctg

SEQ ID NO: 2948230 - DNA, 19 bp, Homo sapiens
ctgtgaggggcccctggcc

SEQ ID NO: 2948231 - DNA, 20 bp, Homo sapiens
ctgtgagtctccccttgcag

SEQ ID NO: 2948232 - DNA, 22 bp, Homo sapiens
ctgtgagtctttggttctaagg

SEQ ID NO: 2948233 - DNA, 13 bp, Homo sapiens
ctgtgatcttatt

SEQ ID NO: 2948234 - DNA, 19 bp, Homo sapiens
ctgtgatgctcccaagcaa

SEQ ID NO: 2948235 - DNA, 23 bp, Homo sapiens
ctgtgattactgcaatcactgtg

SEQ ID NO: 2948236 - DNA, 14 bp, Homo sapiens
ctgtgattcatatg

SEQ ID NO: 2948237 - DNA, 16 bp, Homo sapiens
ctgtgcaaaaaaatta

SEQ ID NO: 2948238 - DNA, 18 bp, Homo sapiens
ctgtgcaaacagtgtaag

SEQ ID NO: 2948239 - DNA, 21 bp, Homo sapiens
ctgtgcaacctcttggcctga

SEQ ID NO: 2948240 - DNA, 21 bp, Homo sapiens
ctgtgcaacgccgtgggctgc

SEQ ID NO: 2948241 - DNA, 18 bp, Homo sapiens
ctgtgcaacggtctcctg

SEQ ID NO: 2948242 - DNA, 19 bp, Homo sapiens
ctgtgcaacggtctcctga

SEQ ID NO: 2948243 - DNA, 22 bp, Homo sapiens
ctgtgcaacggtctcctgactg

SEQ ID NO: 2948244 - DNA, 20 bp, Homo sapiens
ctgtgcaattactgcctgca

SEQ ID NO: 2948245 - DNA, 20 bp, Homo sapiens
ctgtgcacaaaacccagacc

SEQ ID NO: 2948246 - DNA, 21 bp, Homo sapiens
ctgtgcacatctgtgtcttgt

SEQ ID NO: 2948247 - DNA, 14 bp, Homo sapiens
ctgtgcaccaagca

SEQ ID NO: 2948248 - DNA, 12 bp, Homo sapiens
ctgtgcagacct

SEQ ID NO: 2948249 - DNA, 18 bp, Homo sapiens
ctgtgcagataaacagaa

SEQ ID NO: 2948250 - DNA, 16 bp, Homo sapiens
ctgtgcagccgctgag

SEQ ID NO: 2948251 - DNA, 17 bp, Homo sapiens
ctgtgcagccgctgagc

SEQ ID NO: 2948252 - DNA, 21 bp, Homo sapiens
ctgtgcagccgctgagcgagg

SEQ ID NO: 2948253 - DNA, 17 bp, Homo sapiens
ctgtgcatggtggcacc

SEQ ID NO: 2948254 - DNA, 15 bp, Homo sapiens
ctgtgcatgtatgtc

SEQ ID NO: 2948255 - DNA, 15 bp, Homo sapiens
ctgtgcattctcctg

SEQ ID NO: 2948256 - DNA, 20 bp, Homo sapiens
ctgtgcattctcctggatgc

SEQ ID NO: 2948257 - DNA, 14 bp, Homo sapiens
ctgtgccaggaggc

SEQ ID NO: 2948258 - DNA, 23 bp, Homo sapiens
ctgtgcccatcatctctgccttt

SEQ ID NO: 2948259 - DNA, 20 bp, Homo sapiens
ctgtgccccttctctttaat

SEQ ID NO: 2948260 - DNA, 17 bp, Homo sapiens
ctgtgccgcactctggc

SEQ ID NO: 2948261 - DNA, 20 bp, Homo sapiens
ctgtgccgcactctggcggt

SEQ ID NO: 2948262 - DNA, 16 bp, Homo sapiens
ctgtgcctccctctcc

SEQ ID NO: 2948263 - DNA, 18 bp, Homo sapiens
ctgtgcctgtctgtccaa

SEQ ID NO: 2948264 - DNA, 20 bp, Homo sapiens
ctgtgccttggtctctcctt

SEQ ID NO: 2948265 - DNA, 16 bp, Homo sapiens
ctgtgcctttcctatc

SEQ ID NO: 2948266 - DNA, 16 bp, Homo sapiens
ctgtgcgtggaaaaag

SEQ ID NO: 2948267 - DNA, 15 bp, Homo sapiens
ctgtgcgttcccttc

SEQ ID NO: 2948268 - DNA, 14 bp, Homo sapiens
ctgtgctacgtgtg

SEQ ID NO: 2948269 - DNA, 18 bp, Homo sapiens
ctgtgctacgtgtgaaat

SEQ ID NO: 2948270 - DNA, 19 bp, Homo sapiens
ctgtgctacgtgtgaaatc

SEQ ID NO: 2948271 - DNA, 21 bp, Homo sapiens
ctgtgctacgtgtgaaatctg

SEQ ID NO: 2948272 - DNA, 23 bp, Homo sapiens
ctgtgctatcggcagatgatgct

SEQ ID NO: 2948273 - DNA, 13 bp, Homo sapiens
ctgtgctatgaat

SEQ ID NO: 2948274 - DNA, 16 bp, Homo sapiens
ctgtgctatgaatttt

SEQ ID NO: 2948275 - DNA, 19 bp, Homo sapiens
ctgtgctatggtgctctgt

SEQ ID NO: 2948276 - DNA, 16 bp, Homo sapiens
ctgtgctcaggactca

SEQ ID NO: 2948277 - DNA, 17 bp, Homo sapiens
ctgtgctcaggactcag

SEQ ID NO: 2948278 - DNA, 16 bp, Homo sapiens
ctgtggagtccagctc

SEQ ID NO: 2948279 - DNA, 17 bp, Homo sapiens
ctgtggagtccagctct

SEQ ID NO: 2948280 - DNA, 14 bp, Homo sapiens
ctgtggagttcctg

SEQ ID NO: 2948281 - DNA, 15 bp, Homo sapiens
ctgtggagttcctgc

SEQ ID NO: 2948282 - DNA, 15 bp, Homo sapiens
ctgtggatgagccct

SEQ ID NO: 2948283 - DNA, 19 bp, Homo sapiens
ctgtggatgagccctcaga

SEQ ID NO: 2948284 - DNA, 16 bp, Homo sapiens
ctgtggatgccagggc

SEQ ID NO: 2948285 - DNA, 20 bp, Homo sapiens
ctgtggcacttgcctgggtc

SEQ ID NO: 2948286 - DNA, 15 bp, Homo sapiens
ctgtggcagctgccc

SEQ ID NO: 2948287 - DNA, 18 bp, Homo sapiens
ctgtggcaggaggagctg

SEQ ID NO: 2948288 - DNA, 22 bp, Homo sapiens
ctgtggccgcacgcctctccct

SEQ ID NO: 2948289 - DNA, 13 bp, Homo sapiens
ctgtggccgccat

SEQ ID NO: 2948290 - DNA, 18 bp, Homo sapiens
ctgtggcggtgcctgggt

SEQ ID NO: 2948291 - DNA, 23 bp, Homo sapiens
ctgtggctccctctctcctggac

SEQ ID NO: 2948292 - DNA, 14 bp, Homo sapiens
ctgtggctgcgctt

SEQ ID NO: 2948293 - DNA, 13 bp, Homo sapiens
ctgtggctgtgga

SEQ ID NO: 2948294 - DNA, 15 bp, Homo sapiens
ctgtgggaaggccag

SEQ ID NO: 2948295 - DNA, 12 bp, Homo sapiens
ctgtgggaccag

SEQ ID NO: 2948296 - DNA, 14 bp, Homo sapiens
ctgtgggaccccag

SEQ ID NO: 2948297 - DNA, 14 bp, Homo sapiens
ctgtgggcaattta

SEQ ID NO: 2948298 - DNA, 15 bp, Homo sapiens
ctgtgggcaatttag

SEQ ID NO: 2948299 - DNA, 13 bp, Homo sapiens
ctgtggggagccg

SEQ ID NO: 2948300 - DNA, 22 bp, Homo sapiens
ctgtgggggtcatcagggaggg

SEQ ID NO: 2948301 - DNA, 16 bp, Homo sapiens
ctgtgggtctgggagt

SEQ ID NO: 2948302 - DNA, 18 bp, Homo sapiens
ctgtggtaaatgccacac

SEQ ID NO: 2948303 - DNA, 17 bp, Homo sapiens
ctgtggtagctccagcg

SEQ ID NO: 2948304 - DNA, 14 bp, Homo sapiens
ctgtggtggctccc

SEQ ID NO: 2948305 - DNA, 19 bp, Homo sapiens
ctgtggtggctccccctct

SEQ ID NO: 2948306 - DNA, 23 bp, Homo sapiens
ctgtggtggctccccctctgctt

SEQ ID NO: 2948307 - DNA, 19 bp, Homo sapiens
ctgtggtggttcattccac

SEQ ID NO: 2948308 - DNA, 20 bp, Homo sapiens
ctgtggtggttcattccaca

SEQ ID NO: 2948309 - DNA, 22 bp, Homo sapiens
ctgtggtggttcattccacagg

SEQ ID NO: 2948310 - DNA, 14 bp, Homo sapiens
ctgtggtgtgtccc

SEQ ID NO: 2948311 - DNA, 15 bp, Homo sapiens
ctgtggtgtgtcccc

SEQ ID NO: 2948312 - DNA, 11 bp, Homo sapiens
ctgtgtaaagt

SEQ ID NO: 2948313 - DNA, 12 bp, Homo sapiens
ctgtgtaaagtt

SEQ ID NO: 2948314 - DNA, 18 bp, Homo sapiens
ctgtgtaaatatttttcc

SEQ ID NO: 2948315 - DNA, 21 bp, Homo sapiens
ctgtgtaaatatttttccctc

SEQ ID NO: 2948316 - DNA, 21 bp, Homo sapiens
ctgtgtaaccagctcagtgtt

SEQ ID NO: 2948317 - DNA, 16 bp, Homo sapiens
ctgtgtaaccatttta

SEQ ID NO: 2948318 - DNA, 22 bp, Homo sapiens
ctgtgtaaccattttataaagt

SEQ ID NO: 2948319 - DNA, 14 bp, Homo sapiens
ctgtgtacaaagaa

SEQ ID NO: 2948320 - DNA, 16 bp, Homo sapiens
ctgtgtacaaagaaat

SEQ ID NO: 2948321 - DNA, 18 bp, Homo sapiens
ctgtgtagccgccctgag

SEQ ID NO: 2948322 - DNA, 16 bp, Homo sapiens
ctgtgtattaaacctt

SEQ ID NO: 2948323 - DNA, 17 bp, Homo sapiens
ctgtgtattaaaccttt

SEQ ID NO: 2948324 - DNA, 13 bp, Homo sapiens
ctgtgtatttata

SEQ ID NO: 2948325 - DNA, 17 bp, Homo sapiens
ctgtgtcaatccagatg

SEQ ID NO: 2948326 - DNA, 19 bp, Homo sapiens
ctgtgtcaatccagatggt

SEQ ID NO: 2948327 - DNA, 14 bp, Homo sapiens
ctgtgtcactgtcc

SEQ ID NO: 2948328 - DNA, 23 bp, Homo sapiens
ctgtgtcaggaaacatatttaag

SEQ ID NO: 2948329 - DNA, 21 bp, Homo sapiens
ctgtgtccccttactgagcgc

SEQ ID NO: 2948330 - DNA, 17 bp, Homo sapiens
ctgtgtccgatgctgga

SEQ ID NO: 2948331 - DNA, 13 bp, Homo sapiens
ctgtgtcctccct

SEQ ID NO: 2948332 - DNA, 14 bp, Homo sapiens
ctgtgtccttgcac

SEQ ID NO: 2948333 - DNA, 18 bp, Homo sapiens
ctgtgtccttgcacctgc

SEQ ID NO: 2948334 - DNA, 22 bp, Homo sapiens
ctgtgtccttgcacctgcatcc

SEQ ID NO: 2948335 - DNA, 16 bp, Homo sapiens
ctgtgtctaaatttct

SEQ ID NO: 2948336 - DNA, 12 bp, Homo sapiens
ctgtgtctaaga

SEQ ID NO: 2948337 - DNA, 15 bp, Homo sapiens
ctgtgtctctatgtg

SEQ ID NO: 2948338 - DNA, 18 bp, Homo sapiens
ctgtgtctctatgtgaat

SEQ ID NO: 2948339 - DNA, 18 bp, Homo sapiens
ctgtgtctctgtatatag

SEQ ID NO: 2948340 - DNA, 18 bp, Homo sapiens
ctgtgtctgagagcaaag

SEQ ID NO: 2948341 - DNA, 14 bp, Homo sapiens
ctgtgtctgtcacc

SEQ ID NO: 2948342 - DNA, 20 bp, Homo sapiens
ctgtgtgattttcatacagg

SEQ ID NO: 2948343 - DNA, 9 bp, Homo sapiens
ctgtgtgca

SEQ ID NO: 2948344 - DNA, 13 bp, Homo sapiens
ctgtgtgcaggtt

SEQ ID NO: 2948345 - DNA, 19 bp, Homo sapiens
ctgtgtgcgtggtgtggcc

SEQ ID NO: 2948346 - DNA, 18 bp, Homo sapiens
ctgtgtgctcctccttgg

SEQ ID NO: 2948347 - DNA, 15 bp, Homo sapiens
ctgtgtggaaccacc

SEQ ID NO: 2948348 - DNA, 21 bp, Homo sapiens
ctgtgtggaggcctcagggag

SEQ ID NO: 2948349 - DNA, 15 bp, Homo sapiens
ctgtgtgtccaaaac

SEQ ID NO: 2948350 - DNA, 19 bp, Homo sapiens
ctgtgtgtccaaaactgcc

SEQ ID NO: 2948351 - DNA, 21 bp, Homo sapiens
ctgtgtgtccaaaactgcctc

SEQ ID NO: 2948352 - DNA, 16 bp, Homo sapiens
ctgtgtgtcccaggca

SEQ ID NO: 2948353 - DNA, 20 bp, Homo sapiens
ctgtgtgtcccaggcaggga

SEQ ID NO: 2948354 - DNA, 19 bp, Homo sapiens
ctgtgtgtgacccctcctg

SEQ ID NO: 2948355 - DNA, 12 bp, Homo sapiens
ctgtgtgtgtga

SEQ ID NO: 2948356 - DNA, 17 bp, Homo sapiens
ctgtgtgtgtgaatgaa

SEQ ID NO: 2948357 - DNA, 21 bp, Homo sapiens
ctgtgtgtgtggcgtggcccg

SEQ ID NO: 2948358 - DNA, 17 bp, Homo sapiens
ctgtgttcaaaaatata

SEQ ID NO: 2948359 - DNA, 14 bp, Homo sapiens
ctgtgttccagccc

SEQ ID NO: 2948360 - DNA, 14 bp, Homo sapiens
ctgtgttgactgct

SEQ ID NO: 2948361 - DNA, 19 bp, Homo sapiens
ctgtgtttagattgtatta

SEQ ID NO: 2948362 - DNA, 15 bp, Homo sapiens
ctgtgtttccatctc

SEQ ID NO: 2948363 - DNA, 23 bp, Homo sapiens
ctgtgtttccatctcaaagaagg

SEQ ID NO: 2948364 - DNA, 15 bp, Homo sapiens
ctgtgtttttgaaat

SEQ ID NO: 2948365 - DNA, 22 bp, Homo sapiens
ctgttaaagatatttttattca

SEQ ID NO: 2948366 - DNA, 13 bp, Homo sapiens
ctgttacactgga

SEQ ID NO: 2948367 - DNA, 17 bp, Homo sapiens
ctgttacctgtcttgct

SEQ ID NO: 2948368 - DNA, 17 bp, Homo sapiens
ctgttacgacaaagaaa

SEQ ID NO: 2948369 - DNA, 13 bp, Homo sapiens
ctgttagcagaca

SEQ ID NO: 2948370 - DNA, 15 bp, Homo sapiens
ctgttagcagacagg

SEQ ID NO: 2948371 - DNA, 22 bp, Homo sapiens
ctgttagctaaaagaggcctgt

SEQ ID NO: 2948372 - DNA, 17 bp, Homo sapiens
ctgttatcagtaatgct

SEQ ID NO: 2948373 - DNA, 19 bp, Homo sapiens
ctgttattatatttgacat

SEQ ID NO: 2948374 - DNA, 20 bp, Homo sapiens
ctgttattatatttgacatg

SEQ ID NO: 2948375 - DNA, 13 bp, Homo sapiens
ctgttattcttgt

SEQ ID NO: 2948376 - DNA, 13 bp, Homo sapiens
ctgttatttaatt

SEQ ID NO: 2948377 - DNA, 17 bp, Homo sapiens
ctgttcaaggcccctga

SEQ ID NO: 2948378 - DNA, 16 bp, Homo sapiens
ctgttcacagaaaaag

SEQ ID NO: 2948379 - DNA, 18 bp, Homo sapiens
ctgttcacccacagggct

SEQ ID NO: 2948380 - DNA, 16 bp, Homo sapiens
ctgttcagtaataaaa

SEQ ID NO: 2948381 - DNA, 18 bp, Homo sapiens
ctgttcagttacagaaag

SEQ ID NO: 2948382 - DNA, 18 bp, Homo sapiens
ctgttcatctctttgtcc

SEQ ID NO: 2948383 - DNA, 17 bp, Homo sapiens
ctgttccacaaagcagt

SEQ ID NO: 2948384 - DNA, 17 bp, Homo sapiens
ctgttcccacctgctgg

SEQ ID NO: 2948385 - DNA, 16 bp, Homo sapiens
ctgttccccagagaaa

SEQ ID NO: 2948386 - DNA, 15 bp, Homo sapiens
ctgttccccagcaac

SEQ ID NO: 2948387 - DNA, 15 bp, Homo sapiens
ctgttcctcccccat

SEQ ID NO: 2948388 - DNA, 20 bp, Homo sapiens
ctgttcctcccccataaaat

SEQ ID NO: 2948389 - DNA, 11 bp, Homo sapiens
ctgttcctgtg

SEQ ID NO: 2948390 - DNA, 15 bp, Homo sapiens
ctgttccttagacct

SEQ ID NO: 2948391 - DNA, 16 bp, Homo sapiens
ctgttccttagacctt

SEQ ID NO: 2948392 - DNA, 18 bp, Homo sapiens
ctgttccttcacatcctg

SEQ ID NO: 2948393 - DNA, 17 bp, Homo sapiens
ctgttctaaaactccaa

SEQ ID NO: 2948394 - DNA, 14 bp, Homo sapiens
ctgttgcaggcagt

SEQ ID NO: 2948395 - DNA, 19 bp, Homo sapiens
ctgttgcaggcagtgtctt

SEQ ID NO: 2948396 - DNA, 12 bp, Homo sapiens
ctgttgcagtgg

SEQ ID NO: 2948397 - DNA, 14 bp, Homo sapiens
ctgttgcccaggct

SEQ ID NO: 2948398 - DNA, 12 bp, Homo sapiens
ctgttgcctcct

SEQ ID NO: 2948399 - DNA, 15 bp, Homo sapiens
ctgttgcctcctctc

SEQ ID NO: 2948400 - DNA, 19 bp, Homo sapiens
ctgttgcctcctctctccc

SEQ ID NO: 2948401 - DNA, 18 bp, Homo sapiens
ctgttgcgtgacactctc

SEQ ID NO: 2948402 - DNA, 15 bp, Homo sapiens
ctgttgctatttgta

SEQ ID NO: 2948403 - DNA, 23 bp, Homo sapiens
ctgttgctatttgtatttctctt

SEQ ID NO: 2948404 - DNA, 15 bp, Homo sapiens
ctgttggctgctgcc

SEQ ID NO: 2948405 - DNA, 18 bp, Homo sapiens
ctgttgggaacagcatgg

SEQ ID NO: 2948406 - DNA, 19 bp, Homo sapiens
ctgttggtcctctctctgt

SEQ ID NO: 2948407 - DNA, 21 bp, Homo sapiens
ctgttggttatttgtgttatt

SEQ ID NO: 2948408 - DNA, 13 bp, Homo sapiens
ctgttgtgccaca

SEQ ID NO: 2948409 - DNA, 12 bp, Homo sapiens
ctgttgtttgaa

SEQ ID NO: 2948410 - DNA, 15 bp, Homo sapiens
ctgtttaatgttctg

SEQ ID NO: 2948411 - DNA, 14 bp, Homo sapiens
ctgtttacagacaa

SEQ ID NO: 2948412 - DNA, 13 bp, Homo sapiens
ctgtttacagtgt

SEQ ID NO: 2948413 - DNA, 15 bp, Homo sapiens
ctgtttactgcaagg

SEQ ID NO: 2948414 - DNA, 15 bp, Homo sapiens
ctgtttattgccatt

SEQ ID NO: 2948415 - DNA, 17 bp, Homo sapiens
ctgtttatttttaaatt

SEQ ID NO: 2948416 - DNA, 11 bp, Homo sapiens
ctgtttcaagg

SEQ ID NO: 2948417 - DNA, 15 bp, Homo sapiens
ctgtttccaaatccc

SEQ ID NO: 2948418 - DNA, 20 bp, Homo sapiens
ctgtttcctgacattgtctc

SEQ ID NO: 2948419 - DNA, 13 bp, Homo sapiens
ctgtttcctttta

SEQ ID NO: 2948420 - DNA, 21 bp, Homo sapiens
ctgtttctctgccgctacctc

SEQ ID NO: 2948421 - DNA, 12 bp, Homo sapiens
ctgtttctgaaa

SEQ ID NO: 2948422 - DNA, 17 bp, Homo sapiens
ctgtttctgaaaagaaa

SEQ ID NO: 2948423 - DNA, 19 bp, Homo sapiens
ctgtttctgaaaagaaata

SEQ ID NO: 2948424 - DNA, 17 bp, Homo sapiens
ctgtttgcttcaccgtg

SEQ ID NO: 2948425 - DNA, 18 bp, Homo sapiens
ctgtttgcttcaccgtgg

SEQ ID NO: 2948426 - DNA, 12 bp, Homo sapiens
ctgtttgctttt

SEQ ID NO: 2948427 - DNA, 16 bp, Homo sapiens
ctgtttgcttttgaac

SEQ ID NO: 2948428 - DNA, 12 bp, Homo sapiens
ctgtttggactg

SEQ ID NO: 2948429 - DNA, 23 bp, Homo sapiens
ctgtttggatttttaattaaaaa

SEQ ID NO: 2948430 - DNA, 20 bp, Homo sapiens
ctgtttgtagccacaagcct

SEQ ID NO: 2948431 - DNA, 12 bp, Homo sapiens
ctgtttgttatg

SEQ ID NO: 2948432 - DNA, 22 bp, Homo sapiens
ctgtttgtttttaaaaagcaaa

SEQ ID NO: 2948433 - DNA, 23 bp, Homo sapiens
ctgtttgtttttaaaaagcaaat

SEQ ID NO: 2948434 - DNA, 22 bp, Homo sapiens
ctgttttaaattgcatttctat

SEQ ID NO: 2948435 - DNA, 18 bp, Homo sapiens
ctgttttaggttaaaaaa

SEQ ID NO: 2948436 - DNA, 16 bp, Homo sapiens
ctgttttagtgccagg

SEQ ID NO: 2948437 - DNA, 14 bp, Homo sapiens
ctgttttatctcca

SEQ ID NO: 2948438 - DNA, 22 bp, Homo sapiens
ctgttttatctccatactttgg

SEQ ID NO: 2948439 - DNA, 16 bp, Homo sapiens
ctgttttcccacgagg

SEQ ID NO: 2948440 - DNA, 21 bp, Homo sapiens
ctgttttcctcccttctgcta

SEQ ID NO: 2948441 - DNA, 23 bp, Homo sapiens
ctgttttcctcccttctgctact

SEQ ID NO: 2948442 - DNA, 20 bp, Homo sapiens
ctgttttctaaaggagcaga

SEQ ID NO: 2948443 - DNA, 22 bp, Homo sapiens
ctgttttgtttggcaaggaaag

SEQ ID NO: 2948444 - DNA, 18 bp, Homo sapiens
ctgtttttagacaccttc

SEQ ID NO: 2948445 - DNA, 20 bp, Homo sapiens
ctgtttttcggacagtttat

SEQ ID NO: 2948446 - DNA, 20 bp, Homo sapiens
ctgtttttgtttatttcatt

SEQ ID NO: 2948447 - DNA, 22 bp, Homo sapiens
ctgtttttttcaggctcctaaa

SEQ ID NO: 2948448 - DNA, 16 bp, Homo sapiens
ctgtttttttttcatt

SEQ ID NO: 2948449 - DNA, 13 bp, Homo sapiens
cttaaaaaaatgg

SEQ ID NO: 2948450 - DNA, 15 bp, Homo sapiens
cttaaaaaattgaaa

SEQ ID NO: 2948451 - DNA, 13 bp, Homo sapiens
cttaaaaatcaca

SEQ ID NO: 2948452 - DNA, 18 bp, Homo sapiens
cttaaactctcttcttcc

SEQ ID NO: 2948453 - DNA, 16 bp, Homo sapiens
cttaaagatttatcaa

SEQ ID NO: 2948454 - DNA, 20 bp, Homo sapiens
cttaaagtggtcatattatt

SEQ ID NO: 2948455 - DNA, 15 bp, Homo sapiens
cttaaatcagaataa

SEQ ID NO: 2948456 - DNA, 18 bp, Homo sapiens
cttaaatcagaataaatt

SEQ ID NO: 2948457 - DNA, 19 bp, Homo sapiens
cttaaatctcttaaactct

SEQ ID NO: 2948458 - DNA, 19 bp, Homo sapiens
cttaacaaaccaacatctt

SEQ ID NO: 2948459 - DNA, 18 bp, Homo sapiens
cttaaccagttgtggtgt

SEQ ID NO: 2948460 - DNA, 11 bp, Homo sapiens
cttaacctttg

SEQ ID NO: 2948461 - DNA, 13 bp, Homo sapiens
cttaactaagact

SEQ ID NO: 2948462 - DNA, 17 bp, Homo sapiens
cttaagaaatgtataaa

SEQ ID NO: 2948463 - DNA, 20 bp, Homo sapiens
cttaagaaatgtataaactt

SEQ ID NO: 2948464 - DNA, 23 bp, Homo sapiens
cttaagacctactgttctaaagc

SEQ ID NO: 2948465 - DNA, 16 bp, Homo sapiens
cttaagattcagtttt

SEQ ID NO: 2948466 - DNA, 16 bp, Homo sapiens
cttaagccatcttggt

SEQ ID NO: 2948467 - DNA, 19 bp, Homo sapiens
cttaagccatcttggtaaa

SEQ ID NO: 2948468 - DNA, 22 bp, Homo sapiens
cttaagccatcttggtaaattt

SEQ ID NO: 2948469 - DNA, 23 bp, Homo sapiens
cttaaggacaaagtgccaaagaa

SEQ ID NO: 2948470 - DNA, 12 bp, Homo sapiens
cttaaggagact

SEQ ID NO: 2948471 - DNA, 21 bp, Homo sapiens
cttaaggagactggtaggagg

SEQ ID NO: 2948472 - DNA, 22 bp, Homo sapiens
cttaaggagactggtaggagga

SEQ ID NO: 2948473 - DNA, 19 bp, Homo sapiens
cttaagggaatatgcattg

SEQ ID NO: 2948474 - DNA, 15 bp, Homo sapiens
cttaaggtgaggcct

SEQ ID NO: 2948475 - DNA, 18 bp, Homo sapiens
cttaaggtgaggcctgtc

SEQ ID NO: 2948476 - DNA, 19 bp, Homo sapiens
cttaaggtgaggcctgtct

SEQ ID NO: 2948477 - DNA, 21 bp, Homo sapiens
cttaaggtgtagccacaccag

SEQ ID NO: 2948478 - DNA, 17 bp, Homo sapiens
cttaagtcctaaaagtt

SEQ ID NO: 2948479 - DNA, 20 bp, Homo sapiens
cttaataaaaacttacactc

SEQ ID NO: 2948480 - DNA, 20 bp, Homo sapiens
cttaataataattgaagaat

SEQ ID NO: 2948481 - DNA, 18 bp, Homo sapiens
cttaatactaccttgaaa

SEQ ID NO: 2948482 - DNA, 14 bp, Homo sapiens
cttaatcattttca

SEQ ID NO: 2948483 - DNA, 21 bp, Homo sapiens
cttaatcctttaactctgcgg

SEQ ID NO: 2948484 - DNA, 21 bp, Homo sapiens
cttaatgatgttatcttaaca

SEQ ID NO: 2948485 - DNA, 12 bp, Homo sapiens
cttaattctgat

SEQ ID NO: 2948486 - DNA, 23 bp, Homo sapiens
cttaatttatttcttaacctttg

SEQ ID NO: 2948487 - DNA, 19 bp, Homo sapiens
cttaatttcaaatctgtaa

SEQ ID NO: 2948488 - DNA, 22 bp, Homo sapiens
cttaatttggatctatttatta

SEQ ID NO: 2948489 - DNA, 20 bp, Homo sapiens
cttaattttaattggaggaa

SEQ ID NO: 2948490 - DNA, 19 bp, Homo sapiens
cttaattttggttgtattc

SEQ ID NO: 2948491 - DNA, 21 bp, Homo sapiens
cttaattttggttgtattctt

SEQ ID NO: 2948492 - DNA, 23 bp, Homo sapiens
cttaattttggttgtattctttg

SEQ ID NO: 2948493 - DNA, 17 bp, Homo sapiens
cttacaaccttgtcagt

SEQ ID NO: 2948494 - DNA, 17 bp, Homo sapiens
cttacaagccagctgga

SEQ ID NO: 2948495 - DNA, 18 bp, Homo sapiens
cttacaaggcaggccttt

SEQ ID NO: 2948496 - DNA, 18 bp, Homo sapiens
cttacaaggccctttcct

SEQ ID NO: 2948497 - DNA, 22 bp, Homo sapiens
cttacaaggccctttcctttgg

SEQ ID NO: 2948498 - DNA, 15 bp, Homo sapiens
cttacaatctttatt

SEQ ID NO: 2948499 - DNA, 22 bp, Homo sapiens
cttacaatttttttaattttgt

SEQ ID NO: 2948500 - DNA, 15 bp, Homo sapiens
cttactgtacctgtt

SEQ ID NO: 2948501 - DNA, 23 bp, Homo sapiens
cttactgtacctgttccttagac

SEQ ID NO: 2948502 - DNA, 22 bp, Homo sapiens
cttactgtctctcttgtcacat

SEQ ID NO: 2948503 - DNA, 11 bp, Homo sapiens
cttactgttga

SEQ ID NO: 2948504 - DNA, 21 bp, Homo sapiens
cttacttccagcaaaatccaa

SEQ ID NO: 2948505 - DNA, 22 bp, Homo sapiens
cttacttgccaagaaaatgaag

SEQ ID NO: 2948506 - DNA, 14 bp, Homo sapiens
cttactttcagttt

SEQ ID NO: 2948507 - DNA, 15 bp, Homo sapiens
cttactttcagtttt

SEQ ID NO: 2948508 - DNA, 23 bp, Homo sapiens
cttactttgtgcaaaagcaggct

SEQ ID NO: 2948509 - DNA, 22 bp, Homo sapiens
cttagaagtggaccaggacagg

SEQ ID NO: 2948510 - DNA, 18 bp, Homo sapiens
cttagaagtgttgtaaaa

SEQ ID NO: 2948511 - DNA, 23 bp, Homo sapiens
cttagacacttttatatttgaaa

SEQ ID NO: 2948512 - DNA, 20 bp, Homo sapiens
cttagacggtcttcactgtg

SEQ ID NO: 2948513 - DNA, 20 bp, Homo sapiens
cttagagggatttctttgct

SEQ ID NO: 2948514 - DNA, 14 bp, Homo sapiens
cttagatatttcat

SEQ ID NO: 2948515 - DNA, 18 bp, Homo sapiens
cttagatatttcatgtgc

SEQ ID NO: 2948516 - DNA, 15 bp, Homo sapiens
cttagatctggcatg

SEQ ID NO: 2948517 - DNA, 21 bp, Homo sapiens
cttagatctggcatgttagcc

SEQ ID NO: 2948518 - DNA, 14 bp, Homo sapiens
cttagatgttctaa

SEQ ID NO: 2948519 - DNA, 17 bp, Homo sapiens
cttagattcaggggaag

SEQ ID NO: 2948520 - DNA, 18 bp, Homo sapiens
cttagattcaggggaagg

SEQ ID NO: 2948521 - DNA, 24 bp, Homo sapiens
cttagattcaggggaagggcaggc

SEQ ID NO: 2948522 - DNA, 22 bp, Homo sapiens
cttagattctctgtgtctaaga

SEQ ID NO: 2948523 - DNA, 14 bp, Homo sapiens
cttagcagcccagc

SEQ ID NO: 2948524 - DNA, 22 bp, Homo sapiens
cttagcaggagaggagagccag

SEQ ID NO: 2948525 - DNA, 12 bp, Homo sapiens
cttagcatgtga

SEQ ID NO: 2948526 - DNA, 18 bp, Homo sapiens
cttagcctggatttcctt

SEQ ID NO: 2948527 - DNA, 19 bp, Homo sapiens
cttagccttgctgtagaga

SEQ ID NO: 2948528 - DNA, 23 bp, Homo sapiens
cttagccttgctgtagagacttc

SEQ ID NO: 2948529 - DNA, 15 bp, Homo sapiens
cttagcgctctggac

SEQ ID NO: 2948530 - DNA, 16 bp, Homo sapiens
cttagcgctctggaca

SEQ ID NO: 2948531 - DNA, 20 bp, Homo sapiens
cttagctacaatcctacctt

SEQ ID NO: 2948532 - DNA, 18 bp, Homo sapiens
cttagctgaggctgagaa

SEQ ID NO: 2948533 - DNA, 22 bp, Homo sapiens
cttagctgaggctgagaaagct

SEQ ID NO: 2948534 - DNA, 14 bp, Homo sapiens
cttagcttcaggaa

SEQ ID NO: 2948535 - DNA, 16 bp, Homo sapiens
cttagcttcaggaacc

SEQ ID NO: 2948536 - DNA, 18 bp, Homo sapiens
cttagcttcaggaacctc

SEQ ID NO: 2948537 - DNA, 16 bp, Homo sapiens
cttaggaatactgttt

SEQ ID NO: 2948538 - DNA, 19 bp, Homo sapiens
cttaggaatactgttttat

SEQ ID NO: 2948539 - DNA, 20 bp, Homo sapiens
cttaggactacattttgctc

SEQ ID NO: 2948540 - DNA, 23 bp, Homo sapiens
cttaggactacattttgctctgt

SEQ ID NO: 2948541 - DNA, 14 bp, Homo sapiens
cttaggcagggaag

SEQ ID NO: 2948542 - DNA, 15 bp, Homo sapiens
cttaggcagggaagt

SEQ ID NO: 2948543 - DNA, 12 bp, Homo sapiens
cttaggccttcc

SEQ ID NO: 2948544 - DNA, 15 bp, Homo sapiens
cttaggccttcctct

SEQ ID NO: 2948545 - DNA, 13 bp, Homo sapiens
cttaggccttttt

SEQ ID NO: 2948546 - DNA, 14 bp, Homo sapiens
cttagggaaagatg

SEQ ID NO: 2948547 - DNA, 22 bp, Homo sapiens
cttagggaaagatgtagaaaga

SEQ ID NO: 2948548 - DNA, 14 bp, Homo sapiens
cttaggtcttcctg

SEQ ID NO: 2948549 - DNA, 17 bp, Homo sapiens
cttaggtcttcctgtgg

SEQ ID NO: 2948550 - DNA, 18 bp, Homo sapiens
cttaggtcttcctgtggc

SEQ ID NO: 2948551 - DNA, 22 bp, Homo sapiens
cttaggtcttcctgtggctccc

SEQ ID NO: 2948552 - DNA, 21 bp, Homo sapiens
cttaggttgtagcagaaagga

SEQ ID NO: 2948553 - DNA, 20 bp, Homo sapiens
cttagtaatgctacgtgtga

SEQ ID NO: 2948554 - DNA, 22 bp, Homo sapiens
cttagtaatgctacgtgtgatt

SEQ ID NO: 2948555 - DNA, 14 bp, Homo sapiens
cttagtgttttagt

SEQ ID NO: 2948556 - DNA, 14 bp, Homo sapiens
cttagttctgtata

SEQ ID NO: 2948557 - DNA, 22 bp, Homo sapiens
cttataaagtggacttctgaaa

SEQ ID NO: 2948558 - DNA, 20 bp, Homo sapiens
cttataagagagagttaaaa

SEQ ID NO: 2948559 - DNA, 17 bp, Homo sapiens
cttataaggtgttttct

SEQ ID NO: 2948560 - DNA, 20 bp, Homo sapiens
cttataaggtgttttctgtg

SEQ ID NO: 2948561 - DNA, 21 bp, Homo sapiens
cttataaggtgttttctgtgt

SEQ ID NO: 2948562 - DNA, 23 bp, Homo sapiens
cttataaggtgttttctgtgtaa

SEQ ID NO: 2948563 - DNA, 16 bp, Homo sapiens
cttatacgagtaatat

SEQ ID NO: 2948564 - DNA, 15 bp, Homo sapiens
cttatactgtacaat

SEQ ID NO: 2948565 - DNA, 16 bp, Homo sapiens
cttatactgtacaata

SEQ ID NO: 2948566 - DNA, 12 bp, Homo sapiens
cttatagaataa

SEQ ID NO: 2948567 - DNA, 13 bp, Homo sapiens
cttatagaataaa

SEQ ID NO: 2948568 - DNA, 16 bp, Homo sapiens
cttatagaataaaagc

SEQ ID NO: 2948569 - DNA, 19 bp, Homo sapiens
cttatagaataaaagctgt

SEQ ID NO: 2948570 - DNA, 14 bp, Homo sapiens
cttataggtgttgg

SEQ ID NO: 2948571 - DNA, 14 bp, Homo sapiens
cttatagttctagg

SEQ ID NO: 2948572 - DNA, 15 bp, Homo sapiens
cttatagttctaggc

SEQ ID NO: 2948573 - DNA, 23 bp, Homo sapiens
cttatatatatattgattatttg

SEQ ID NO: 2948574 - DNA, 21 bp, Homo sapiens
cttatcatccacattgtttta

SEQ ID NO: 2948575 - DNA, 21 bp, Homo sapiens
cttatcctagcacatgcttca

SEQ ID NO: 2948576 - DNA, 18 bp, Homo sapiens
cttatccttcctctcctt

SEQ ID NO: 2948577 - DNA, 19 bp, Homo sapiens
cttatctatgatgtttctt

SEQ ID NO: 2948578 - DNA, 16 bp, Homo sapiens
cttatctccaagacca

SEQ ID NO: 2948579 - DNA, 17 bp, Homo sapiens
cttatctccctgcttca

SEQ ID NO: 2948580 - DNA, 17 bp, Homo sapiens
cttatctctaaaccatc

SEQ ID NO: 2948581 - DNA, 16 bp, Homo sapiens
cttatctgaaacttcc

SEQ ID NO: 2948582 - DNA, 16 bp, Homo sapiens
cttatctgctaactct

SEQ ID NO: 2948583 - DNA, 16 bp, Homo sapiens
cttatctgtgctcagg

SEQ ID NO: 2948584 - DNA, 15 bp, Homo sapiens
cttatgaatatattt

SEQ ID NO: 2948585 - DNA, 21 bp, Homo sapiens
cttatgagtataatgaacact

SEQ ID NO: 2948586 - DNA, 20 bp, Homo sapiens
cttatgatgggctccccagg

SEQ ID NO: 2948587 - DNA, 14 bp, Homo sapiens
cttatggaattgat

SEQ ID NO: 2948588 - DNA, 19 bp, Homo sapiens
cttatggaattgatttgca

SEQ ID NO: 2948589 - DNA, 19 bp, Homo sapiens
cttatggtaccagatgcag

SEQ ID NO: 2948590 - DNA, 19 bp, Homo sapiens
cttatgtagcaggaaataa

SEQ ID NO: 2948591 - DNA, 22 bp, Homo sapiens
cttattacataactgatctatt

SEQ ID NO: 2948592 - DNA, 15 bp, Homo sapiens
cttattacatttaaa

SEQ ID NO: 2948593 - DNA, 17 bp, Homo sapiens
cttattagagtgtcttt

SEQ ID NO: 2948594 - DNA, 17 bp, Homo sapiens
cttattctctgtttgct

SEQ ID NO: 2948595 - DNA, 13 bp, Homo sapiens
cttattctgtatc

SEQ ID NO: 2948596 - DNA, 18 bp, Homo sapiens
cttattgagcgtgattct

SEQ ID NO: 2948597 - DNA, 20 bp, Homo sapiens
cttattgtggataacaaaga

SEQ ID NO: 2948598 - DNA, 15 bp, Homo sapiens
cttcacctcactgaa

SEQ ID NO: 2948599 - DNA, 18 bp, Homo sapiens
cttcacctgattcaacta

SEQ ID NO: 2948600 - DNA, 19 bp, Homo sapiens
cttcacgaagtgttgcatg

SEQ ID NO: 2948601 - DNA, 17 bp, Homo sapiens
cttcactgctacatgtg

SEQ ID NO: 2948602 - DNA, 18 bp, Homo sapiens
cttcactgctacatgtgc

SEQ ID NO: 2948603 - DNA, 24 bp, Homo sapiens
cttcactggcgccttctcggagct

SEQ ID NO: 2948604 - DNA, 18 bp, Homo sapiens
cttcactgtcctccaagc

SEQ ID NO: 2948605 - DNA, 21 bp, Homo sapiens
cttcactgtcctccaagccag

SEQ ID NO: 2948606 - DNA, 21 bp, Homo sapiens
cttcactgtgctccaacctga

SEQ ID NO: 2948607 - DNA, 20 bp, Homo sapiens
cttcactgttgcttaattgt

SEQ ID NO: 2948608 - DNA, 21 bp, Homo sapiens
cttcacttcctccagaagcct

SEQ ID NO: 2948609 - DNA, 22 bp, Homo sapiens
cttcacttcctccagaagcctc

SEQ ID NO: 2948610 - DNA, 14 bp, Homo sapiens
cttcacttttgcaa

SEQ ID NO: 2948611 - DNA, 14 bp, Homo sapiens
cttcagaacagagg

SEQ ID NO: 2948612 - DNA, 15 bp, Homo sapiens
cttcagaacagaggc

SEQ ID NO: 2948613 - DNA, 17 bp, Homo sapiens
cttcagaacagaggcat

SEQ ID NO: 2948614 - DNA, 23 bp, Homo sapiens
cttcagaacagaggcatttaaaa

SEQ ID NO: 2948615 - DNA, 16 bp, Homo sapiens
cttcagagtttgtcat

SEQ ID NO: 2948616 - DNA, 15 bp, Homo sapiens
cttcagatcagtgct

SEQ ID NO: 2948617 - DNA, 17 bp, Homo sapiens
cttcagatgctcttggg

SEQ ID NO: 2948618 - DNA, 17 bp, Homo sapiens
cttcagatgtggagcca

SEQ ID NO: 2948619 - DNA, 19 bp, Homo sapiens
cttcagatgtggagccagg

SEQ ID NO: 2948620 - DNA, 22 bp, Homo sapiens
cttcagatgtggagccaggcgt

SEQ ID NO: 2948621 - DNA, 14 bp, Homo sapiens
cttcagattattaa

SEQ ID NO: 2948622 - DNA, 16 bp, Homo sapiens
cttcagattattaaaa

SEQ ID NO: 2948623 - DNA, 18 bp, Homo sapiens
cttcagatttgtgttata

SEQ ID NO: 2948624 - DNA, 16 bp, Homo sapiens
cttcagcctagtggct

SEQ ID NO: 2948625 - DNA, 17 bp, Homo sapiens
cttcagcctagtggctt

SEQ ID NO: 2948626 - DNA, 19 bp, Homo sapiens
cttcagcctagtggcttgt

SEQ ID NO: 2948627 - DNA, 20 bp, Homo sapiens
cttcagcctctttctgtccc

SEQ ID NO: 2948628 - DNA, 17 bp, Homo sapiens
cttcagctcacgcttca

SEQ ID NO: 2948629 - DNA, 14 bp, Homo sapiens
cttcagctttgtgt

SEQ ID NO: 2948630 - DNA, 22 bp, Homo sapiens
cttcaggaacctcgagtactgt

SEQ ID NO: 2948631 - DNA, 22 bp, Homo sapiens
cttcaggagtttcatgttggat

SEQ ID NO: 2948632 - DNA, 21 bp, Homo sapiens
cttcaggatgcacggtttctg

SEQ ID NO: 2948633 - DNA, 17 bp, Homo sapiens
cttcaggccaggtagca

SEQ ID NO: 2948634 - DNA, 16 bp, Homo sapiens
cttcaggctctgccca

SEQ ID NO: 2948635 - DNA, 18 bp, Homo sapiens
cttcaggctctgcccagg

SEQ ID NO: 2948636 - DNA, 16 bp, Homo sapiens
cttcagggcaggtggg

SEQ ID NO: 2948637 - DNA, 16 bp, Homo sapiens
cttcagggctgctggg

SEQ ID NO: 2948638 - DNA, 17 bp, Homo sapiens
cttcaggtccaggctgt

SEQ ID NO: 2948639 - DNA, 18 bp, Homo sapiens
cttcaggtccaggctgtg

SEQ ID NO: 2948640 - DNA, 16 bp, Homo sapiens
cttcaggtggaaaaac

SEQ ID NO: 2948641 - DNA, 22 bp, Homo sapiens
cttcagtaacccccactggact

SEQ ID NO: 2948642 - DNA, 22 bp, Homo sapiens
cttcagtcctggtctgctcagg

SEQ ID NO: 2948643 - DNA, 11 bp, Homo sapiens
cttcagtgccc

SEQ ID NO: 2948644 - DNA, 15 bp, Homo sapiens
cttcagtgggagaaa

SEQ ID NO: 2948645 - DNA, 18 bp, Homo sapiens
cttcagtgtaatgtgact

SEQ ID NO: 2948646 - DNA, 17 bp, Homo sapiens
cttcagttattggtgga

SEQ ID NO: 2948647 - DNA, 16 bp, Homo sapiens
cttcataaaactcatg

SEQ ID NO: 2948648 - DNA, 12 bp, Homo sapiens
cttcatacaggg

SEQ ID NO: 2948649 - DNA, 19 bp, Homo sapiens
cttcataccgcctcgtgcc

SEQ ID NO: 2948650 - DNA, 17 bp, Homo sapiens
cttcatagggaccttta

SEQ ID NO: 2948651 - DNA, 21 bp, Homo sapiens
cttcatagggacctttaaaaa

SEQ ID NO: 2948652 - DNA, 15 bp, Homo sapiens
cttcatattaatata

SEQ ID NO: 2948653 - DNA, 15 bp, Homo sapiens
cttcatcgaatctac

SEQ ID NO: 2948654 - DNA, 15 bp, Homo sapiens
cttcatctgcccaac

SEQ ID NO: 2948655 - DNA, 17 bp, Homo sapiens
cttcatcttcccaggta

SEQ ID NO: 2948656 - DNA, 12 bp, Homo sapiens
cttcatctttta

SEQ ID NO: 2948657 - DNA, 14 bp, Homo sapiens
cttcatgcctgatg

SEQ ID NO: 2948658 - DNA, 16 bp, Homo sapiens
cttcatgcctgatgaa

SEQ ID NO: 2948659 - DNA, 20 bp, Homo sapiens
cttcattaccttttttgata

SEQ ID NO: 2948660 - DNA, 18 bp, Homo sapiens
cttcattctgagaccaaa

SEQ ID NO: 2948661 - DNA, 21 bp, Homo sapiens
cttcattgagagttttgtctt

SEQ ID NO: 2948662 - DNA, 23 bp, Homo sapiens
cttcattgagagttttgtcttga

SEQ ID NO: 2948663 - DNA, 16 bp, Homo sapiens
cttcatttcatcctgt

SEQ ID NO: 2948664 - DNA, 15 bp, Homo sapiens
cttcattttcagagt

SEQ ID NO: 2948665 - DNA, 19 bp, Homo sapiens
cttccaaacaggctcagag

SEQ ID NO: 2948666 - DNA, 23 bp, Homo sapiens
cttccaaaccccactttctccct

SEQ ID NO: 2948667 - DNA, 19 bp, Homo sapiens
cttccaaatcccctaagca

SEQ ID NO: 2948668 - DNA, 20 bp, Homo sapiens
cttccaaatcccctaagcag

SEQ ID NO: 2948669 - DNA, 14 bp, Homo sapiens
cttccaagagcctg

SEQ ID NO: 2948670 - DNA, 23 bp, Homo sapiens
cttccaccaagttggaacatcct

SEQ ID NO: 2948671 - DNA, 18 bp, Homo sapiens
cttccaccagagcagggg

SEQ ID NO: 2948672 - DNA, 20 bp, Homo sapiens
cttccaccagagcaggggct

SEQ ID NO: 2948673 - DNA, 16 bp, Homo sapiens
cttccacctcacaact

SEQ ID NO: 2948674 - DNA, 18 bp, Homo sapiens
cttccacctcacaactcc

SEQ ID NO: 2948675 - DNA, 19 bp, Homo sapiens
cttccacctcacaactcct

SEQ ID NO: 2948676 - DNA, 13 bp, Homo sapiens
cttccacttctgg

SEQ ID NO: 2948677 - DNA, 23 bp, Homo sapiens
cttccagcaaaatccaaactgct

SEQ ID NO: 2948678 - DNA, 13 bp, Homo sapiens
cttccagcattta

SEQ ID NO: 2948679 - DNA, 21 bp, Homo sapiens
cttccagcatttagctggcca

SEQ ID NO: 2948680 - DNA, 18 bp, Homo sapiens
cttccagccacctagtcc

SEQ ID NO: 2948681 - DNA, 13 bp, Homo sapiens
cttccagcccaga

SEQ ID NO: 2948682 - DNA, 22 bp, Homo sapiens
cttccagcccagacccccagtg

SEQ ID NO: 2948683 - DNA, 20 bp, Homo sapiens
cttccagtctggagagctgt

SEQ ID NO: 2948684 - DNA, 22 bp, Homo sapiens
cttccatagcctaatccctggg

SEQ ID NO: 2948685 - DNA, 15 bp, Homo sapiens
cttccataggacaaa

SEQ ID NO: 2948686 - DNA, 14 bp, Homo sapiens
cttccatgatttta

SEQ ID NO: 2948687 - DNA, 17 bp, Homo sapiens
cttccatgctcccaact

SEQ ID NO: 2948688 - DNA, 21 bp, Homo sapiens
cttgagacaaatcctttctgc

SEQ ID NO: 2948689 - DNA, 22 bp, Homo sapiens
cttgagacacggagcccagccc

SEQ ID NO: 2948690 - DNA, 23 bp, Homo sapiens
cttgagattctgaagtatgaagt

SEQ ID NO: 2948691 - DNA, 20 bp, Homo sapiens
cttgagccctccccaggaat

SEQ ID NO: 2948692 - DNA, 21 bp, Homo sapiens
cttgagccctccccaggaatt

SEQ ID NO: 2948693 - DNA, 22 bp, Homo sapiens
cttgaggtggcctccttgcttg

SEQ ID NO: 2948694 - DNA, 19 bp, Homo sapiens
cttgagtaggccctgcttt

SEQ ID NO: 2948695 - DNA, 15 bp, Homo sapiens
cttgagtctattttt

SEQ ID NO: 2948696 - DNA, 19 bp, Homo sapiens
cttgagtttaaattgtaat

SEQ ID NO: 2948697 - DNA, 14 bp, Homo sapiens
cttgataaaggaga

SEQ ID NO: 2948698 - DNA, 14 bp, Homo sapiens
cttgataaatggaa

SEQ ID NO: 2948699 - DNA, 14 bp, Homo sapiens
cttgatatttcctt

SEQ ID NO: 2948700 - DNA, 23 bp, Homo sapiens
cttgatggaagaaaatggaatta

SEQ ID NO: 2948701 - DNA, 17 bp, Homo sapiens
cttgatgggattctgga

SEQ ID NO: 2948702 - DNA, 19 bp, Homo sapiens
cttgatgggattctggaca

SEQ ID NO: 2948703 - DNA, 20 bp, Homo sapiens
cttgatgttcagacatttat

SEQ ID NO: 2948704 - DNA, 15 bp, Homo sapiens
cttgatgtttcctgg

SEQ ID NO: 2948705 - DNA, 18 bp, Homo sapiens
cttgatgtttcctggaag

SEQ ID NO: 2948706 - DNA, 20 bp, Homo sapiens
cttgatgtttcctggaagca

SEQ ID NO: 2948707 - DNA, 21 bp, Homo sapiens
cttgatgtttcctggaagcag

SEQ ID NO: 2948708 - DNA, 20 bp, Homo sapiens
cttgattaagatctcagtgg

SEQ ID NO: 2948709 - DNA, 16 bp, Homo sapiens
cttgattataaatgtt

SEQ ID NO: 2948710 - DNA, 19 bp, Homo sapiens
cttgattccaacaggcgtg

SEQ ID NO: 2948711 - DNA, 17 bp, Homo sapiens
cttgattctgcagtaaa

SEQ ID NO: 2948712 - DNA, 21 bp, Homo sapiens
cttgatttcttctagaagata

SEQ ID NO: 2948713 - DNA, 20 bp, Homo sapiens
cttgattttaaaattccttc

SEQ ID NO: 2948714 - DNA, 18 bp, Homo sapiens
cttgcaagcatgcttgtg

SEQ ID NO: 2948715 - DNA, 14 bp, Homo sapiens
cttgcagaggagcc

SEQ ID NO: 2948716 - DNA, 23 bp, Homo sapiens
cttgcagaggagcccagtgggct

SEQ ID NO: 2948717 - DNA, 13 bp, Homo sapiens
cttgcagccagga

SEQ ID NO: 2948718 - DNA, 14 bp, Homo sapiens
cttgcagccaggag

SEQ ID NO: 2948719 - DNA, 15 bp, Homo sapiens
cttgcagccaggaga

SEQ ID NO: 2948720 - DNA, 21 bp, Homo sapiens
cttgcagtagattttctttaa

SEQ ID NO: 2948721 - DNA, 15 bp, Homo sapiens
cttgcagtgaagtgt

SEQ ID NO: 2948722 - DNA, 17 bp, Homo sapiens
cttgcatcaaggggtca

SEQ ID NO: 2948723 - DNA, 11 bp, Homo sapiens
cttgcattgac

SEQ ID NO: 2948724 - DNA, 14 bp, Homo sapiens
cttgcattgacatt

SEQ ID NO: 2948725 - DNA, 20 bp, Homo sapiens
cttgccaagggtccctgtgt

SEQ ID NO: 2948726 - DNA, 21 bp, Homo sapiens
cttgccacatctgtgtctctg

SEQ ID NO: 2948727 - DNA, 19 bp, Homo sapiens
cttgccagaaccaaattaa

SEQ ID NO: 2948728 - DNA, 11 bp, Homo sapiens
cttgccagaga

SEQ ID NO: 2948729 - DNA, 23 bp, Homo sapiens
cttgccagggatgggcagcccaa

SEQ ID NO: 2948730 - DNA, 12 bp, Homo sapiens
cttgccagggct

SEQ ID NO: 2948731 - DNA, 13 bp, Homo sapiens
cttgccagggctc

SEQ ID NO: 2948732 - DNA, 19 bp, Homo sapiens
cttgccatcccaagcccag

SEQ ID NO: 2948733 - DNA, 15 bp, Homo sapiens
cttgccatgtgctgg

SEQ ID NO: 2948734 - DNA, 21 bp, Homo sapiens
cttgcccagagatgcctccac

SEQ ID NO: 2948735 - DNA, 21 bp, Homo sapiens
cttgcccagggtgcagtgtga

SEQ ID NO: 2948736 - DNA, 17 bp, Homo sapiens
cttgccccactctgcct

SEQ ID NO: 2948737 - DNA, 22 bp, Homo sapiens
cttgccccactctgcctgcctg

SEQ ID NO: 2948738 - DNA, 16 bp, Homo sapiens
cttgcccgtcgtgtgc

SEQ ID NO: 2948739 - DNA, 22 bp, Homo sapiens
cttgcccgtcgtgtgctgaaga

SEQ ID NO: 2948740 - DNA, 23 bp, Homo sapiens
cttgccctcccaaagtgctggga

SEQ ID NO: 2948741 - DNA, 16 bp, Homo sapiens
cttgcccttcctgacc

SEQ ID NO: 2948742 - DNA, 21 bp, Homo sapiens
cttgccgcgtcgccctcccag

SEQ ID NO: 2948743 - DNA, 13 bp, Homo sapiens
cttgcctccaggt

SEQ ID NO: 2948744 - DNA, 16 bp, Homo sapiens
cttgcctccaggtgca

SEQ ID NO: 2948745 - DNA, 18 bp, Homo sapiens
cttgcctccaggtgcaga

SEQ ID NO: 2948746 - DNA, 23 bp, Homo sapiens
cttgcctccaggtgcagaggtac

SEQ ID NO: 2948747 - DNA, 15 bp, Homo sapiens
cttgcctccgtgtca

SEQ ID NO: 2948748 - DNA, 16 bp, Homo sapiens
cttgcctgcagggcca
